United States Patent 7,655,785 (BIOINFORMATICALLY DETECTABLE GROUP OF NOVEL REGULATORY OLIGONUCLEOTIDES AND USES THEREOF) - sequence listing, part 11

SEQ ID NO: 406362 - RNA, 14 nt, Homo sapiens
gcagcugugcugca

SEQ ID NO: 406363 - RNA, 15 nt, Homo sapiens
gcagcuucaccagag

SEQ ID NO: 406364 - RNA, 19 nt, Homo sapiens
gcagcuucgugugcagcua

SEQ ID NO: 406365 - RNA, 18 nt, Homo sapiens
gcaggaagucccugagaa

SEQ ID NO: 406366 - RNA, 18 nt, Homo sapiens
gcaggagaaucacuggaa

SEQ ID NO: 406367 - RNA, 19 nt, Homo sapiens
gcaggagaaucacuggaac

SEQ ID NO: 406368 - RNA, 17 nt, Homo sapiens
gcaggagacuggcaaga

SEQ ID NO: 406369 - RNA, 17 nt, Homo sapiens
gcaggaucaaagacaca

SEQ ID NO: 406370 - RNA, 19 nt, Homo sapiens
gcaggaugauuguacagaa

SEQ ID NO: 406371 - RNA, 14 nt, Homo sapiens
gcaggcagccccac

SEQ ID NO: 406372 - RNA, 20 nt, Homo sapiens
gcaggcagccccacacccgc

SEQ ID NO: 406373 - RNA, 15 nt, Homo sapiens
gcaggcccugcagug

SEQ ID NO: 406374 - RNA, 16 nt, Homo sapiens
gcaggcccuguccuaa

SEQ ID NO: 406375 - RNA, 15 nt, Homo sapiens
gcauuuuuugcaagu

SEQ ID NO: 406376 - RNA, 23 nt, Homo sapiens
gccaaagagaaugccauucucuu

SEQ ID NO: 406377 - RNA, 22 nt, Homo sapiens
gccaaagcuggcuuuuugucaa

SEQ ID NO: 406378 - RNA, 13 nt, Homo sapiens
gccaaauguaauu

SEQ ID NO: 406379 - RNA, 14 nt, Homo sapiens
gccaaauuuuggcc

SEQ ID NO: 406380 - RNA, 23 nt, Homo sapiens
gccaacagccccccccuugaauc

SEQ ID NO: 406381 - RNA, 21 nt, Homo sapiens
gccaaccagaauaaaauaacc

SEQ ID NO: 406382 - RNA, 18 nt, Homo sapiens
gccaaccggucacccagg

SEQ ID NO: 406383 - RNA, 20 nt, Homo sapiens
gccaacuccaugaccaggcc

SEQ ID NO: 406384 - RNA, 23 nt, Homo sapiens
gccaacuccaugaccaggccacc

SEQ ID NO: 406385 - RNA, 16 nt, Homo sapiens
gccaacugcccaagcc

SEQ ID NO: 406386 - RNA, 12 nt, Homo sapiens
gccaacuuuguu

SEQ ID NO: 406387 - RNA, 16 nt, Homo sapiens
gccaagacagugaagu

SEQ ID NO: 406388 - RNA, 23 nt, Homo sapiens
gccaagacaguggcagcaaagga

SEQ ID NO: 406389 - RNA, 22 nt, Homo sapiens
gccaagacccaacaggugcuga

SEQ ID NO: 406390 - RNA, 15 nt, Homo sapiens
gccaaggacacugau

SEQ ID NO: 406391 - RNA, 15 nt, Homo sapiens
gccaagggccucuug

SEQ ID NO: 406392 - RNA, 18 nt, Homo sapiens
gccaaguaacaaugcaug

SEQ ID NO: 406393 - RNA, 12 nt, Homo sapiens
gccaagugcagg

SEQ ID NO: 406394 - RNA, 17 nt, Homo sapiens
gccaaugaacagcuccu

SEQ ID NO: 406395 - RNA, 18 nt, Homo sapiens
gccaaugccacagccaag

SEQ ID NO: 406396 - RNA, 20 nt, Homo sapiens
gccaaugccacagccaagcc

SEQ ID NO: 406397 - RNA, 20 nt, Homo sapiens
gccacaaaacugacaguaaa

SEQ ID NO: 406398 - RNA, 20 nt, Homo sapiens
gccacacacaguuacagagu

SEQ ID NO: 406399 - RNA, 21 nt, Homo sapiens
gccacagaccuaggauuucau

SEQ ID NO: 406400 - RNA, 16 nt, Homo sapiens
gccacagcaggacuga

SEQ ID NO: 406401 - RNA, 19 nt, Homo sapiens
gccacauggagcuugacuu

SEQ ID NO: 406402 - RNA, 14 nt, Homo sapiens
gccaccaacauaaa

SEQ ID NO: 406403 - RNA, 21 nt, Homo sapiens
gccaccaccggggcacuggcu

SEQ ID NO: 406404 - RNA, 22 nt, Homo sapiens
gccacccucacacacacagcug

SEQ ID NO: 406405 - RNA, 18 nt, Homo sapiens
gccaccucucacacuggc

SEQ ID NO: 406406 - RNA, 23 nt, Homo sapiens
gccaccugcaggucacugaaacu

SEQ ID NO: 406407 - RNA, 14 nt, Homo sapiens
gccaccugcugcug

SEQ ID NO: 406408 - RNA, 20 nt, Homo sapiens
gccaccuggccuaaugcugu

SEQ ID NO: 406409 - RNA, 12 nt, Homo sapiens
gccacgaggugg

SEQ ID NO: 406410 - RNA, 17 nt, Homo sapiens
gccacggccuugugucu

SEQ ID NO: 406411 - RNA, 13 nt, Homo sapiens
gccacuaccuuug

SEQ ID NO: 406412 - RNA, 21 nt, Homo sapiens
gccacuagguuucaccuccca

SEQ ID NO: 406413 - RNA, 17 nt, Homo sapiens
gccacuaucacauaugc

SEQ ID NO: 406414 - RNA, 20 nt, Homo sapiens
gccacuccagaccccuggcu

SEQ ID NO: 406415 - RNA, 12 nt, Homo sapiens
gccacuccucaa

SEQ ID NO: 406416 - RNA, 23 nt, Homo sapiens
gccacugcccucuccacacccau

SEQ ID NO: 406417 - RNA, 14 nt, Homo sapiens
gccacuugacauuc

SEQ ID NO: 406418 - RNA, 16 nt, Homo sapiens
gccagaagggggccau

SEQ ID NO: 406419 - RNA, 12 nt, Homo sapiens
gccagaagugaa

SEQ ID NO: 406420 - RNA, 19 nt, Homo sapiens
gccagaguggccuggccag

SEQ ID NO: 406421 - RNA, 17 nt, Homo sapiens
gccagauggggccucug

SEQ ID NO: 406422 - RNA, 20 nt, Homo sapiens
gccagauguuguuccuggcu

SEQ ID NO: 406423 - RNA, 17 nt, Homo sapiens
gccagcaaugaugucca

SEQ ID NO: 406424 - RNA, 17 nt, Homo sapiens
gccagcagggcgggcca

SEQ ID NO: 406425 - RNA, 20 nt, Homo sapiens
gccagcccuucccaggccag

SEQ ID NO: 406426 - RNA, 11 nt, Homo sapiens
gccaggagcuc

SEQ ID NO: 406427 - RNA, 14 nt, Homo sapiens
gccaggccuguaug

SEQ ID NO: 406428 - RNA, 18 nt, Homo sapiens
gccaggcguuggugccac

SEQ ID NO: 406429 - RNA, 20 nt, Homo sapiens
gccaggcugccaaggccaga

SEQ ID NO: 406430 - RNA, 18 nt, Homo sapiens
gccagggcagugcuagug

SEQ ID NO: 406431 - RNA, 15 nt, Homo sapiens
gccaggugcacagac

SEQ ID NO: 406432 - RNA, 18 nt, Homo sapiens
gccagguugggggcagug

SEQ ID NO: 406433 - RNA, 12 nt, Homo sapiens
gccagugacaga

SEQ ID NO: 406434 - RNA, 11 nt, Homo sapiens
gccagugacuu

SEQ ID NO: 406435 - RNA, 17 nt, Homo sapiens
gccagugggcagugcau

SEQ ID NO: 406436 - RNA, 15 nt, Homo sapiens
gccagugugggaaug

SEQ ID NO: 406437 - RNA, 20 nt, Homo sapiens
gccaguuucuuuggccagaa

SEQ ID NO: 406438 - RNA, 19 nt, Homo sapiens
gccauaauucuaaguuauu

SEQ ID NO: 406439 - RNA, 16 nt, Homo sapiens
gccauaccaggugcua

SEQ ID NO: 406440 - RNA, 14 nt, Homo sapiens
gccauagccccaua

SEQ ID NO: 406441 - RNA, 19 nt, Homo sapiens
gccauagcuugauugcuca

SEQ ID NO: 406442 - RNA, 19 nt, Homo sapiens
gccauaugacaauuucaaa

SEQ ID NO: 406443 - RNA, 16 nt, Homo sapiens
gccaucaugccugacu

SEQ ID NO: 406444 - RNA, 17 nt, Homo sapiens
gccaucaugccugacua

SEQ ID NO: 406445 - RNA, 15 nt, Homo sapiens
gccauccucacccag

SEQ ID NO: 406446 - RNA, 15 nt, Homo sapiens
gccaucgccaaguaa

SEQ ID NO: 406447 - RNA, 23 nt, Homo sapiens
gccaugagaaaagggaagccgcc

SEQ ID NO: 406448 - RNA, 15 nt, Homo sapiens
gccaugcaacuccau

SEQ ID NO: 406449 - RNA, 15 nt, Homo sapiens
gccauggcuggaaug

SEQ ID NO: 406450 - RNA, 23 nt, Homo sapiens
gccauggcuggaaugaugaaggg

SEQ ID NO: 406451 - RNA, 22 nt, Homo sapiens
gccauguaccaguguacugcuu

SEQ ID NO: 406452 - RNA, 22 nt, Homo sapiens
gccauuccaagucaacacucuu

SEQ ID NO: 406453 - RNA, 17 nt, Homo sapiens
gccauucccacuaagcu

SEQ ID NO: 406454 - RNA, 13 nt, Homo sapiens
gccauuucuuccc

SEQ ID NO: 406455 - RNA, 13 nt, Homo sapiens
gccauuugugaua

SEQ ID NO: 406456 - RNA, 19 nt, Homo sapiens
gcccaaauguccgaucccc

SEQ ID NO: 406457 - RNA, 13 nt, Homo sapiens
gcccacacuugag

SEQ ID NO: 406458 - RNA, 12 nt, Homo sapiens
gcccacacuugg

SEQ ID NO: 406459 - RNA, 19 nt, Homo sapiens
gcccacccugggaugggcc

SEQ ID NO: 406460 - RNA, 23 nt, Homo sapiens
gcccacccuuguguccacuguga

SEQ ID NO: 406461 - RNA, 16 nt, Homo sapiens
gcccaccuaccuucaa

SEQ ID NO: 406462 - RNA, 22 nt, Homo sapiens
gcccaccucuuguuuuccccuu

SEQ ID NO: 406463 - RNA, 23 nt, Homo sapiens
gcccacugaggaaugaugaagcu

SEQ ID NO: 406464 - RNA, 21 nt, Homo sapiens
gcccacugcccaaugccugcu

SEQ ID NO: 406465 - RNA, 20 nt, Homo sapiens
gcccagacucaaggccucca

SEQ ID NO: 406466 - RNA, 16 nt, Homo sapiens
gcccagcagcggccca

SEQ ID NO: 406467 - RNA, 18 nt, Homo sapiens
gcccagccagcagguucu

SEQ ID NO: 406468 - RNA, 21 nt, Homo sapiens
gcccagccuccaagcuccauc

SEQ ID NO: 406469 - RNA, 16 nt, Homo sapiens
gcccagcuugggccca

SEQ ID NO: 406470 - RNA, 17 nt, Homo sapiens
gcccaggagcggcgaug

SEQ ID NO: 406471 - RNA, 20 nt, Homo sapiens
gcccaggcuggagugcagua

SEQ ID NO: 406472 - RNA, 21 nt, Homo sapiens
gcccaguguuguuuguaaaua

SEQ ID NO: 406473 - RNA, 17 nt, Homo sapiens
gcccaguuagcccggcc

SEQ ID NO: 406474 - RNA, 16 nt, Homo sapiens
gcccaguucaucccaa

SEQ ID NO: 406475 - RNA, 18 nt, Homo sapiens
gcccauaucugugaaaug

SEQ ID NO: 406476 - RNA, 14 nt, Homo sapiens
gcccauccagucuc

SEQ ID NO: 406477 - RNA, 23 nt, Homo sapiens
gcccauccucucgccaagccauc

SEQ ID NO: 406478 - RNA, 18 nt, Homo sapiens
gcccaucucaggugccac

SEQ ID NO: 406479 - RNA, 18 nt, Homo sapiens
gcccaugggauauguggu

SEQ ID NO: 406480 - RNA, 14 nt, Homo sapiens
gccccacucaggga

SEQ ID NO: 406481 - RNA, 15 nt, Homo sapiens
gccccagaccccagg

SEQ ID NO: 406482 - RNA, 14 nt, Homo sapiens
gcccccaccagcag

SEQ ID NO: 406483 - RNA, 17 nt, Homo sapiens
gcccccaggcugcugga

SEQ ID NO: 406484 - RNA, 13 nt, Homo sapiens
gccccccccaugu

SEQ ID NO: 406485 - RNA, 17 nt, Homo sapiens
gccccccucauuacugc

SEQ ID NO: 406486 - RNA, 20 nt, Homo sapiens
gcccccuucucccacacugc

SEQ ID NO: 406487 - RNA, 16 nt, Homo sapiens
gcccccuuucagaugu

SEQ ID NO: 406488 - RNA, 20 nt, Homo sapiens
gccccgcccccaccccuaca

SEQ ID NO: 406489 - RNA, 16 nt, Homo sapiens
gccccgugcagacugg

SEQ ID NO: 406490 - RNA, 23 nt, Homo sapiens
gccccguuucuugccccagugug

SEQ ID NO: 406491 - RNA, 11 nt, Homo sapiens
gccccuacccc

SEQ ID NO: 406492 - RNA, 17 nt, Homo sapiens
gccccuccucugugcuc

SEQ ID NO: 406493 - RNA, 18 nt, Homo sapiens
gccccucgcugcugcuac

SEQ ID NO: 406494 - RNA, 17 nt, Homo sapiens
gccccucugacucccaa

SEQ ID NO: 406495 - RNA, 16 nt, Homo sapiens
gccccugcacaaagcc

SEQ ID NO: 406496 - RNA, 19 nt, Homo sapiens
gccccugcccgagagcucu

SEQ ID NO: 406497 - RNA, 22 nt, Homo sapiens
gccccuggggccuagacucugu

SEQ ID NO: 406498 - RNA, 17 nt, Homo sapiens
gccccuucauggaagaa

SEQ ID NO: 406499 - RNA, 15 nt, Homo sapiens
gccccuuuuacuuuu

SEQ ID NO: 406500 - RNA, 16 nt, Homo sapiens
gcccgaccccaucuca

SEQ ID NO: 406501 - RNA, 16 nt, Homo sapiens
gcccgagagcucuuag

SEQ ID NO: 406502 - RNA, 15 nt, Homo sapiens
gcccgcugcaaugcc

SEQ ID NO: 406503 - RNA, 13 nt, Homo sapiens
gcccuaagccacu

SEQ ID NO: 406504 - RNA, 14 nt, Homo sapiens
gcccucaguuuuca

SEQ ID NO: 406505 - RNA, 17 nt, Homo sapiens
gcccucaucuugaaggg

SEQ ID NO: 406506 - RNA, 14 nt, Homo sapiens
gcccugagcuuucc

SEQ ID NO: 406507 - RNA, 12 nt, Homo sapiens
guacaucuggcc

SEQ ID NO: 406508 - RNA, 18 nt, Homo sapiens
guacauuuugcuugcgug

SEQ ID NO: 406509 - RNA, 22 nt, Homo sapiens
guaccacccuucagaccccagu

SEQ ID NO: 406510 - RNA, 17 nt, Homo sapiens
guaccaguguacugcuu

SEQ ID NO: 406511 - RNA, 21 nt, Homo sapiens
guaccauagcgcugcucuuau

SEQ ID NO: 406512 - RNA, 19 nt, Homo sapiens
guacccaccugagcuuugg

SEQ ID NO: 406513 - RNA, 15 nt, Homo sapiens
guacccugcuguaua

SEQ ID NO: 406514 - RNA, 18 nt, Homo sapiens
guaccucuucccaugacu

SEQ ID NO: 406515 - RNA, 18 nt, Homo sapiens
guaccuggucccuucuag

SEQ ID NO: 406516 - RNA, 20 nt, Homo sapiens
guaccuuucuaaaccucucu

SEQ ID NO: 406517 - RNA, 19 nt, Homo sapiens
guacgucugguguucucaa

SEQ ID NO: 406518 - RNA, 18 nt, Homo sapiens
guacuaguacuauugcua

SEQ ID NO: 406519 - RNA, 17 nt, Homo sapiens
guacuaguucagacacu

SEQ ID NO: 406520 - RNA, 23 nt, Homo sapiens
guacuauauguauaucuuugcac

SEQ ID NO: 406521 - RNA, 16 nt, Homo sapiens
guacucagcgaaugaa

SEQ ID NO: 406522 - RNA, 21 nt, Homo sapiens
guacugaguauugauaaacuu

SEQ ID NO: 406523 - RNA, 20 nt, Homo sapiens
guacuggagaaaauggacgu

SEQ ID NO: 406524 - RNA, 20 nt, Homo sapiens
guacuguuuuguuuguuaau

SEQ ID NO: 406525 - RNA, 17 nt, Homo sapiens
guacuuaagaguggcau

SEQ ID NO: 406526 - RNA, 14 nt, Homo sapiens
guacuuugugcuga

SEQ ID NO: 406527 - RNA, 17 nt, Homo sapiens
guagaaagauacacuga

SEQ ID NO: 406528 - RNA, 17 nt, Homo sapiens
guagaacaauguacaag

SEQ ID NO: 406529 - RNA, 15 nt, Homo sapiens
guagaagcaaaggca

SEQ ID NO: 406530 - RNA, 12 nt, Homo sapiens
guagaagccagu

SEQ ID NO: 406531 - RNA, 12 nt, Homo sapiens
guagaaucucag

SEQ ID NO: 406532 - RNA, 18 nt, Homo sapiens
guagaaucucagcacuuu

SEQ ID NO: 406533 - RNA, 18 nt, Homo sapiens
guagacacuaauucuguc

SEQ ID NO: 406534 - RNA, 23 nt, Homo sapiens
guagacaucccccuccuugccgc

SEQ ID NO: 406535 - RNA, 22 nt, Homo sapiens
guagagacaguguuuugccaug

SEQ ID NO: 406536 - RNA, 14 nt, Homo sapiens
guagagagugcccu

SEQ ID NO: 406537 - RNA, 17 nt, Homo sapiens
guagauacaaucagcug

SEQ ID NO: 406538 - RNA, 15 nt, Homo sapiens
guagauacuagcuau

SEQ ID NO: 406539 - RNA, 12 nt, Homo sapiens
guagcacacuga

SEQ ID NO: 406540 - RNA, 15 nt, Homo sapiens
guagcauacauuuau

SEQ ID NO: 406541 - RNA, 21 nt, Homo sapiens
guagcguuuccuuucuucccu

SEQ ID NO: 406542 - RNA, 15 nt, Homo sapiens
guagcuauucuuuga

SEQ ID NO: 406543 - RNA, 19 nt, Homo sapiens
guagcucucacaugcacag

SEQ ID NO: 406544 - RNA, 16 nt, Homo sapiens
guagcugaaaggggaa

SEQ ID NO: 406545 - RNA, 14 nt, Homo sapiens
guagcuucugaccu

SEQ ID NO: 406546 - RNA, 18 nt, Homo sapiens
guaggcacaaaaccagaa

SEQ ID NO: 406547 - RNA, 17 nt, Homo sapiens
guaggggcccacuucac

SEQ ID NO: 406548 - RNA, 19 nt, Homo sapiens
guaggugggauuacaggug

SEQ ID NO: 406549 - RNA, 16 nt, Homo sapiens
guaggugugacuugaa

SEQ ID NO: 406550 - RNA, 18 nt, Homo sapiens
guagucaaggugcucaau

SEQ ID NO: 406551 - RNA, 22 nt, Homo sapiens
guagucaggugccucaagagaa

SEQ ID NO: 406552 - RNA, 15 nt, Homo sapiens
guagucauuuugccc

SEQ ID NO: 406553 - RNA, 14 nt, Homo sapiens
guauaaauaaccaa

SEQ ID NO: 406554 - RNA, 21 nt, Homo sapiens
guauaacaagccaaacauucu

SEQ ID NO: 406555 - RNA, 23 nt, Homo sapiens
guauacuagaaaguaauacaaua

SEQ ID NO: 406556 - RNA, 11 nt, Homo sapiens
guauacuguac

SEQ ID NO: 406557 - RNA, 22 nt, Homo sapiens
guauagaauauuauaguuuaaa

SEQ ID NO: 406558 - RNA, 17 nt, Homo sapiens
guauauauacauaacag

SEQ ID NO: 406559 - RNA, 16 nt, Homo sapiens
guauaucuuugcacug

SEQ ID NO: 406560 - RNA, 18 nt, Homo sapiens
guauaucuuugcacugaa

SEQ ID NO: 406561 - RNA, 22 nt, Homo sapiens
guauaugaacuuaacaugcugu

SEQ ID NO: 406562 - RNA, 16 nt, Homo sapiens
guauccagaggugagg

SEQ ID NO: 406563 - RNA, 19 nt, Homo sapiens
guaucuaccucacuauuca

SEQ ID NO: 406564 - RNA, 18 nt, Homo sapiens
guaucuguaacccuugaa

SEQ ID NO: 406565 - RNA, 17 nt, Homo sapiens
guaucuucaaacuuuca

SEQ ID NO: 406566 - RNA, 22 nt, Homo sapiens
guaugaagacacugucaaugag

SEQ ID NO: 406567 - RNA, 14 nt, Homo sapiens
guaugaaugcagug

SEQ ID NO: 406568 - RNA, 15 nt, Homo sapiens
guaugagucaaugug

SEQ ID NO: 406569 - RNA, 17 nt, Homo sapiens
guaugcacgugugcaca

SEQ ID NO: 406570 - RNA, 12 nt, Homo sapiens
guaugccaagug

SEQ ID NO: 406571 - RNA, 14 nt, Homo sapiens
guaugccuauucag

SEQ ID NO: 406572 - RNA, 15 nt, Homo sapiens
guaugggaagccaua

SEQ ID NO: 406573 - RNA, 13 nt, Homo sapiens
guaugugccauuu

SEQ ID NO: 406574 - RNA, 12 nt, Homo sapiens
guauuaaacuug

SEQ ID NO: 406575 - RNA, 20 nt, Homo sapiens
guauuacaaaaacauggccu

SEQ ID NO: 406576 - RNA, 15 nt, Homo sapiens
guauuaccuauucaa

SEQ ID NO: 406577 - RNA, 13 nt, Homo sapiens
guauuacuuccuc

SEQ ID NO: 406578 - RNA, 18 nt, Homo sapiens
guauuagauaucaauguu

SEQ ID NO: 406579 - RNA, 19 nt, Homo sapiens
guauuaggugucauuucca

SEQ ID NO: 406580 - RNA, 19 nt, Homo sapiens
guauucaacuaauacaugg

SEQ ID NO: 406581 - RNA, 20 nt, Homo sapiens
guauuguugcuuuuuuucca

SEQ ID NO: 406582 - RNA, 21 nt, Homo sapiens
guauuuauauuagagugcccu

SEQ ID NO: 406583 - RNA, 19 nt, Homo sapiens
guauuuuaacucauaccuu

SEQ ID NO: 406584 - RNA, 21 nt, Homo sapiens
guauuuuacuuugugcaauau

SEQ ID NO: 406585 - RNA, 23 nt, Homo sapiens
guauuuuacuuugugcaauauga

SEQ ID NO: 406586 - RNA, 12 nt, Homo sapiens
guauuuugccag

SEQ ID NO: 406587 - RNA, 19 nt, Homo sapiens
guauuuuuaguaaagacag

SEQ ID NO: 406588 - RNA, 20 nt, Homo sapiens
gucaaacuuucaccucagau

SEQ ID NO: 406589 - RNA, 16 nt, Homo sapiens
gucaaagcaaguuuca

SEQ ID NO: 406590 - RNA, 17 nt, Homo sapiens
gucaaagugaugaauau

SEQ ID NO: 406591 - RNA, 18 nt, Homo sapiens
gucaaagugguacaggaa

SEQ ID NO: 406592 - RNA, 14 nt, Homo sapiens
gucaaccaggaaca

SEQ ID NO: 406593 - RNA, 18 nt, Homo sapiens
gucaaccuugugugagug

SEQ ID NO: 406594 - RNA, 17 nt, Homo sapiens
gucaacuuucauuugaa

SEQ ID NO: 406595 - RNA, 23 nt, Homo sapiens
gucacaggacgauuucacugaca

SEQ ID NO: 406596 - RNA, 19 nt, Homo sapiens
gucacagggaggaaggcag

SEQ ID NO: 406597 - RNA, 20 nt, Homo sapiens
gucacaucagauaagacaua

SEQ ID NO: 406598 - RNA, 18 nt, Homo sapiens
gucacauugaaggugcug

SEQ ID NO: 406599 - RNA, 23 nt, Homo sapiens
gucaccugaccucugaagagcug

SEQ ID NO: 406600 - RNA, 16 nt, Homo sapiens
gucagaccuucuucca

SEQ ID NO: 406601 - RNA, 17 nt, Homo sapiens
gucagagggacugucag

SEQ ID NO: 406602 - RNA, 20 nt, Homo sapiens
gucagauuugaacucuucaa

SEQ ID NO: 406603 - RNA, 20 nt, Homo sapiens
gucagcucccuucucuguag

SEQ ID NO: 406604 - RNA, 22 nt, Homo sapiens
gucagcuguaacccucacccac

SEQ ID NO: 406605 - RNA, 18 nt, Homo sapiens
gucaguagugccugugau

SEQ ID NO: 406606 - RNA, 14 nt, Homo sapiens
gucagucagggaca

SEQ ID NO: 406607 - RNA, 18 nt, Homo sapiens
gucagucuucacuugcac

SEQ ID NO: 406608 - RNA, 20 nt, Homo sapiens
gucagugcuucgugccucga

SEQ ID NO: 406609 - RNA, 21 nt, Homo sapiens
gucaguuucauggaggggaaa

SEQ ID NO: 406610 - RNA, 20 nt, Homo sapiens
gucauagaauagcauguugu

SEQ ID NO: 406611 - RNA, 15 nt, Homo sapiens
gucauagcuaugaca

SEQ ID NO: 406612 - RNA, 13 nt, Homo sapiens
gucauaugcugcu

SEQ ID NO: 406613 - RNA, 22 nt, Homo sapiens
gucaucaaccgaugguccucac

SEQ ID NO: 406614 - RNA, 19 nt, Homo sapiens
gucaucacuccucugucau

SEQ ID NO: 406615 - RNA, 20 nt, Homo sapiens
gucaucacuccucugucaua

SEQ ID NO: 406616 - RNA, 21 nt, Homo sapiens
gucaucauuugucuuugaacg

SEQ ID NO: 406617 - RNA, 15 nt, Homo sapiens
gucaucccggggcca

SEQ ID NO: 406618 - RNA, 19 nt, Homo sapiens
gucaucugggccaccagcu

SEQ ID NO: 406619 - RNA, 20 nt, Homo sapiens
gucaucugggccaccagcuc

SEQ ID NO: 406620 - RNA, 12 nt, Homo sapiens
gucaucugucag

SEQ ID NO: 406621 - RNA, 22 nt, Homo sapiens
gguagaggugugugccuaguga

SEQ ID NO: 406622 - RNA, 19 nt, Homo sapiens
gguagugaccuaaccacuu

SEQ ID NO: 406623 - RNA, 16 nt, Homo sapiens
gguauaaggaaauauc

SEQ ID NO: 406624 - RNA, 14 nt, Homo sapiens
gguauguuuuacca

SEQ ID NO: 406625 - RNA, 16 nt, Homo sapiens
gguauuacacuguauu

SEQ ID NO: 406626 - RNA, 18 nt, Homo sapiens
gguauuugagacauucca

SEQ ID NO: 406627 - RNA, 23 nt, Homo sapiens
ggucacaaggucuuuacuuaugc

SEQ ID NO: 406628 - RNA, 21 nt, Homo sapiens
ggucacaggggugucuugucu

SEQ ID NO: 406629 - RNA, 12 nt, Homo sapiens
ggucacccagga

SEQ ID NO: 406630 - RNA, 14 nt, Homo sapiens
ggucacccugugac

SEQ ID NO: 406631 - RNA, 21 nt, Homo sapiens
ggucaucucucacacauucca

SEQ ID NO: 406632 - RNA, 18 nt, Homo sapiens
ggucauuauuuuuuacaa

SEQ ID NO: 406633 - RNA, 20 nt, Homo sapiens
ggucauucuuuucuccuccu

SEQ ID NO: 406634 - RNA, 21 nt, Homo sapiens
ggucauuuuccuuucuguauu

SEQ ID NO: 406635 - RNA, 11 nt, Homo sapiens
ggucccagugc

SEQ ID NO: 406636 - RNA, 14 nt, Homo sapiens
ggucccccaugcca

SEQ ID NO: 406637 - RNA, 15 nt, Homo sapiens
ggucccccaugccac

SEQ ID NO: 406638 - RNA, 12 nt, Homo sapiens
ggucccggcuga

SEQ ID NO: 406639 - RNA, 23 nt, Homo sapiens
ggucccuaauucucuucgcugug

SEQ ID NO: 406640 - RNA, 17 nt, Homo sapiens
ggucccugcuaugcaga

SEQ ID NO: 406641 - RNA, 17 nt, Homo sapiens
gguccuaaagaugcuga

SEQ ID NO: 406642 - RNA, 23 nt, Homo sapiens
gguccucacaagccucuucugaa

SEQ ID NO: 406643 - RNA, 21 nt, Homo sapiens
gguccucuacuuaaugagaua

SEQ ID NO: 406644 - RNA, 17 nt, Homo sapiens
gguccugcccuuccuga

SEQ ID NO: 406645 - RNA, 19 nt, Homo sapiens
gguccuggccgucccuaag

SEQ ID NO: 406646 - RNA, 21 nt, Homo sapiens
ggucucuauacuacauuauua

SEQ ID NO: 406647 - RNA, 23 nt, Homo sapiens
ggucugcucuuucucugccagug

SEQ ID NO: 406648 - RNA, 21 nt, Homo sapiens
ggucugggacuuccuugcucu

SEQ ID NO: 406649 - RNA, 15 nt, Homo sapiens
ggucuucccuaccuc

SEQ ID NO: 406650 - RNA, 13 nt, Homo sapiens
ggucuucuuacau

SEQ ID NO: 406651 - RNA, 14 nt, Homo sapiens
ggucuugacucuaa

SEQ ID NO: 406652 - RNA, 16 nt, Homo sapiens
ggucuuugaaauaugc

SEQ ID NO: 406653 - RNA, 20 nt, Homo sapiens
ggucuuugcaagaaucauua

SEQ ID NO: 406654 - RNA, 16 nt, Homo sapiens
ggugaaagauggaacu

SEQ ID NO: 406655 - RNA, 18 nt, Homo sapiens
ggugacaggcccagugga

SEQ ID NO: 406656 - RNA, 18 nt, Homo sapiens
ggugacuuuccuaugaca

SEQ ID NO: 406657 - RNA, 18 nt, Homo sapiens
ggugaggcgugggaucca

SEQ ID NO: 406658 - RNA, 19 nt, Homo sapiens
ggugaucaauuaaauguag

SEQ ID NO: 406659 - RNA, 12 nt, Homo sapiens
ggugcacuggaa

SEQ ID NO: 406660 - RNA, 21 nt, Homo sapiens
ggugcaguuuuccaggaauag

SEQ ID NO: 406661 - RNA, 13 nt, Homo sapiens
ggugcaugccuuc

SEQ ID NO: 406662 - RNA, 19 nt, Homo sapiens
ggugccacucccugagcuu

SEQ ID NO: 406663 - RNA, 13 nt, Homo sapiens
ggugcccaccuaa

SEQ ID NO: 406664 - RNA, 15 nt, Homo sapiens
ggugccccacagcua

SEQ ID NO: 406665 - RNA, 12 nt, Homo sapiens
ggugcguggcug

SEQ ID NO: 406666 - RNA, 18 nt, Homo sapiens
gguggaaacuuuucuuaa

SEQ ID NO: 406667 - RNA, 16 nt, Homo sapiens
gguggaagaccuggac

SEQ ID NO: 406668 - RNA, 12 nt, Homo sapiens
gguggacaugca

SEQ ID NO: 406669 - RNA, 14 nt, Homo sapiens
gguggagugucaca

SEQ ID NO: 406670 - RNA, 13 nt, Homo sapiens
gguggcacgugcc

SEQ ID NO: 406671 - RNA, 19 nt, Homo sapiens
gguggcccuugcaguucag

SEQ ID NO: 406672 - RNA, 15 nt, Homo sapiens
gguggcgcgcaccug

SEQ ID NO: 406673 - RNA, 19 nt, Homo sapiens
gguggggagacauaaccac

SEQ ID NO: 406674 - RNA, 11 nt, Homo sapiens
gguggggcuua

SEQ ID NO: 406675 - RNA, 23 nt, Homo sapiens
gguggucaccagguccugugagc

SEQ ID NO: 406676 - RNA, 21 nt, Homo sapiens
ggugucauagaauagcauguu

SEQ ID NO: 406677 - RNA, 18 nt, Homo sapiens
gguguccuguuccugcca

SEQ ID NO: 406678 - RNA, 19 nt, Homo sapiens
ggugucuuggcacuguuag

SEQ ID NO: 406679 - RNA, 16 nt, Homo sapiens
ggugugccacaggcug

SEQ ID NO: 406680 - RNA, 14 nt, Homo sapiens
gguguggcuuggaa

SEQ ID NO: 406681 - RNA, 17 nt, Homo sapiens
gguguuaaaaaccauua

SEQ ID NO: 406682 - RNA, 20 nt, Homo sapiens
gguuaaacccacagccaaac

SEQ ID NO: 406683 - RNA, 17 nt, Homo sapiens
gguuaaagaaaggcaga

SEQ ID NO: 406684 - RNA, 22 nt, Homo sapiens
gguuaauggcuaguacuguauu

SEQ ID NO: 406685 - RNA, 20 nt, Homo sapiens
gguuacuaagaugaaauugc

SEQ ID NO: 406686 - RNA, 23 nt, Homo sapiens
gguuacuaagaugaaauugccaa

SEQ ID NO: 406687 - RNA, 15 nt, Homo sapiens
gguuccagacagggu

SEQ ID NO: 406688 - RNA, 19 nt, Homo sapiens
gguucucagguguugccaa

SEQ ID NO: 406689 - RNA, 20 nt, Homo sapiens
gguucuugguagagauucau

SEQ ID NO: 406690 - RNA, 16 nt, Homo sapiens
gguugacuuaugggcc

SEQ ID NO: 406691 - RNA, 19 nt, Homo sapiens
gguuggaugggagugggca

SEQ ID NO: 406692 - RNA, 16 nt, Homo sapiens
gguuuaacucagauca

SEQ ID NO: 406693 - RNA, 17 nt, Homo sapiens
gguuuaacucagaucac

SEQ ID NO: 406694 - RNA, 16 nt, Homo sapiens
gguuuacaacaaacac

SEQ ID NO: 406695 - RNA, 12 nt, Homo sapiens
gguuucaccucc

SEQ ID NO: 406696 - RNA, 16 nt, Homo sapiens
gguuucaccucccaaa

SEQ ID NO: 406697 - RNA, 14 nt, Homo sapiens
gguuucacuauucc

SEQ ID NO: 406698 - RNA, 21 nt, Homo sapiens
gguuugggagaacacauuucu

SEQ ID NO: 406699 - RNA, 18 nt, Homo sapiens
gguuuguuaggaggccac

SEQ ID NO: 406700 - RNA, 17 nt, Homo sapiens
gguuuuccuguugagau

SEQ ID NO: 406701 - RNA, 16 nt, Homo sapiens
gguuuuucuguucccu

SEQ ID NO: 406702 - RNA, 12 nt, Homo sapiens
guaaaacagagc

SEQ ID NO: 406703 - RNA, 14 nt, Homo sapiens
guaaaacugugaca

SEQ ID NO: 406704 - RNA, 21 nt, Homo sapiens
guaaaauagaauguuacuuug

SEQ ID NO: 406705 - RNA, 21 nt, Homo sapiens
guaaaauuagaggauugcacu

SEQ ID NO: 406706 - RNA, 21 nt, Homo sapiens
guaaacacccucuugcuuaau

SEQ ID NO: 406707 - RNA, 16 nt, Homo sapiens
guaaacauguguuuua

SEQ ID NO: 406708 - RNA, 15 nt, Homo sapiens
guaaacuguaucaaa

SEQ ID NO: 406709 - RNA, 13 nt, Homo sapiens
guaaagccucagc

SEQ ID NO: 406710 - RNA, 22 nt, Homo sapiens
guaaagccucagcaacagccag

SEQ ID NO: 406711 - RNA, 16 nt, Homo sapiens
guaaaggccaugugaa

SEQ ID NO: 406712 - RNA, 16 nt, Homo sapiens
guaaauaaaaguacaa

SEQ ID NO: 406713 - RNA, 17 nt, Homo sapiens
guaaauauucuugucca

SEQ ID NO: 406714 - RNA, 15 nt, Homo sapiens
guaaaugagccuuuc

SEQ ID NO: 406715 - RNA, 19 nt, Homo sapiens
guaaaugagccuuucugcc

SEQ ID NO: 406716 - RNA, 22 nt, Homo sapiens
guaaaugaucacuccaggauau

SEQ ID NO: 406717 - RNA, 13 nt, Homo sapiens
guaaaugcucaaa

SEQ ID NO: 406718 - RNA, 15 nt, Homo sapiens
guaaauguccauuua

SEQ ID NO: 406719 - RNA, 14 nt, Homo sapiens
guaacaauguuugu

SEQ ID NO: 406720 - RNA, 20 nt, Homo sapiens
guaacacuguauaacauuua

SEQ ID NO: 406721 - RNA, 14 nt, Homo sapiens
guaacagcuaugca

SEQ ID NO: 406722 - RNA, 19 nt, Homo sapiens
guaacaucacuauccaugc

SEQ ID NO: 406723 - RNA, 21 nt, Homo sapiens
guaaccaggucguccaagcaa

SEQ ID NO: 406724 - RNA, 21 nt, Homo sapiens
guaaccaguagucaccucugg

SEQ ID NO: 406725 - RNA, 21 nt, Homo sapiens
guaacccuuuucaugauuuca

SEQ ID NO: 406726 - RNA, 19 nt, Homo sapiens
guaacuauuacaccaaaua

SEQ ID NO: 406727 - RNA, 16 nt, Homo sapiens
guaacucaaagggugg

SEQ ID NO: 406728 - RNA, 15 nt, Homo sapiens
guaacucacuuuaaa

SEQ ID NO: 406729 - RNA, 21 nt, Homo sapiens
guaacucagacauuccaaggg

SEQ ID NO: 406730 - RNA, 22 nt, Homo sapiens
guaagaaauaacacugugaaug

SEQ ID NO: 406731 - RNA, 18 nt, Homo sapiens
guaaggacuugugccucu

SEQ ID NO: 406732 - RNA, 23 nt, Homo sapiens
guaaggauaugagccuuugcaca

SEQ ID NO: 406733 - RNA, 20 nt, Homo sapiens
guaagguacugaauacuuaa

SEQ ID NO: 406734 - RNA, 18 nt, Homo sapiens
guaaguaaggugcaauga

SEQ ID NO: 406735 - RNA, 20 nt, Homo sapiens
guaauaaaccuccuucggga

SEQ ID NO: 406736 - RNA, 15 nt, Homo sapiens
guaauaacugugaag

SEQ ID NO: 406737 - RNA, 23 nt, Homo sapiens
guaauagggcuucugccuaagcc

SEQ ID NO: 406738 - RNA, 19 nt, Homo sapiens
uaaaacagaauauugacaa

SEQ ID NO: 406739 - RNA, 16 nt, Homo sapiens
uaaaacaucuuuccag

SEQ ID NO: 406740 - RNA, 13 nt, Homo sapiens
uaaaacauuugaa

SEQ ID NO: 406741 - RNA, 19 nt, Homo sapiens
uaaaaccaguuuugcugcu

SEQ ID NO: 406742 - RNA, 17 nt, Homo sapiens
uaaaaccucucuuucca

SEQ ID NO: 406743 - RNA, 18 nt, Homo sapiens
uaaaaccugucaaugaua

SEQ ID NO: 406744 - RNA, 12 nt, Homo sapiens
uaaaacugcaca

SEQ ID NO: 406745 - RNA, 11 nt, Homo sapiens
uaaaacuguga

SEQ ID NO: 406746 - RNA, 14 nt, Homo sapiens
uaaaacuuccacua

SEQ ID NO: 406747 - RNA, 16 nt, Homo sapiens
uaaaagaaaucuucau

SEQ ID NO: 406748 - RNA, 16 nt, Homo sapiens
uaaaagacaagcacuu

SEQ ID NO: 406749 - RNA, 13 nt, Homo sapiens
uaaaagacuuuga

SEQ ID NO: 406750 - RNA, 14 nt, Homo sapiens
uaaaagacuuugau

SEQ ID NO: 406751 - RNA, 15 nt, Homo sapiens
uaaaagacuuugaug

SEQ ID NO: 406752 - RNA, 15 nt, Homo sapiens
uaaaagcaaaacugc

SEQ ID NO: 406753 - RNA, 14 nt, Homo sapiens
uaaaagcaacauca

SEQ ID NO: 406754 - RNA, 19 nt, Homo sapiens
uaaaagcagcaucugcuaa

SEQ ID NO: 406755 - RNA, 19 nt, Homo sapiens
uaaaagccuaugugccuuu

SEQ ID NO: 406756 - RNA, 16 nt, Homo sapiens
uaaaaggaaucuggca

SEQ ID NO: 406757 - RNA, 18 nt, Homo sapiens
uaaaaggauaggaaaaga

SEQ ID NO: 406758 - RNA, 21 nt, Homo sapiens
uaaaaguccugucaccaagga

SEQ ID NO: 406759 - RNA, 20 nt, Homo sapiens
uaaaaguuacuuaccacaga

SEQ ID NO: 406760 - RNA, 16 nt, Homo sapiens
uaaaauaagaauugaa

SEQ ID NO: 406761 - RNA, 16 nt, Homo sapiens
uaaaauaagugaaucu

SEQ ID NO: 406762 - RNA, 19 nt, Homo sapiens
uaaaauaauuuucauucau

SEQ ID NO: 406763 - RNA, 15 nt, Homo sapiens
uaaaauagcuuugca

SEQ ID NO: 406764 - RNA, 15 nt, Homo sapiens
uaaaaucaauaagag

SEQ ID NO: 406765 - RNA, 14 nt, Homo sapiens
uaaaaucuugucau

SEQ ID NO: 406766 - RNA, 19 nt, Homo sapiens
uaaaaucuuuccaucucau

SEQ ID NO: 406767 - RNA, 23 nt, Homo sapiens
uaacaucccaauaaaguccucuu

SEQ ID NO: 406768 - RNA, 22 nt, Homo sapiens
uaacaucucuuucaucuagcuc

SEQ ID NO: 406769 - RNA, 23 nt, Homo sapiens
uaacaucugaagugucuaaugca

SEQ ID NO: 406770 - RNA, 17 nt, Homo sapiens
uaacaugggcaaaggga

SEQ ID NO: 406771 - RNA, 13 nt, Homo sapiens
uaacauguuauca

SEQ ID NO: 406772 - RNA, 14 nt, Homo sapiens
uaacauugcacuuu

SEQ ID NO: 406773 - RNA, 12 nt, Homo sapiens
uaacauugcuga

SEQ ID NO: 406774 - RNA, 19 nt, Homo sapiens
uaaccaacuuuucuauuaa

SEQ ID NO: 406775 - RNA, 14 nt, Homo sapiens
uaaccacagugaaa

SEQ ID NO: 406776 - RNA, 23 nt, Homo sapiens
uaacccaauggagacuuucugau

SEQ ID NO: 406777 - RNA, 16 nt, Homo sapiens
uaacccucccauggca

SEQ ID NO: 406778 - RNA, 18 nt, Homo sapiens
uaaccgauaugcacuuga

SEQ ID NO: 406779 - RNA, 19 nt, Homo sapiens
uaaccucagugucauuuau

SEQ ID NO: 406780 - RNA, 20 nt, Homo sapiens
uaaccucuacaggcauuuaa

SEQ ID NO: 406781 - RNA, 14 nt, Homo sapiens
uaaccucugcacua

SEQ ID NO: 406782 - RNA, 20 nt, Homo sapiens
uaaccuggagacaguaacau

SEQ ID NO: 406783 - RNA, 14 nt, Homo sapiens
uaacggcacugugg

SEQ ID NO: 406784 - RNA, 12 nt, Homo sapiens
uaacuacauuua

SEQ ID NO: 406785 - RNA, 22 nt, Homo sapiens
uaacuaccaggaauaaugauac

SEQ ID NO: 406786 - RNA, 15 nt, Homo sapiens
uaacuauauuugcuu

SEQ ID NO: 406787 - RNA, 18 nt, Homo sapiens
uaacuauauuugcuuuuu

SEQ ID NO: 406788 - RNA, 18 nt, Homo sapiens
uaacuauuaguauuauua

SEQ ID NO: 406789 - RNA, 16 nt, Homo sapiens
uaacucagacauucca

SEQ ID NO: 406790 - RNA, 21 nt, Homo sapiens
uaacucagaucacuacugcag

SEQ ID NO: 406791 - RNA, 21 nt, Homo sapiens
uaacugcacacaugguuucca

SEQ ID NO: 406792 - RNA, 19 nt, Homo sapiens
uaacugcaccaacgagcug

SEQ ID NO: 406793 - RNA, 15 nt, Homo sapiens
uaacugguuacucag

SEQ ID NO: 406794 - RNA, 21 nt, Homo sapiens
uaacugugcagagacuuuauc

SEQ ID NO: 406795 - RNA, 21 nt, Homo sapiens
uaacuuggagagggacgaaga

SEQ ID NO: 406796 - RNA, 22 nt, Homo sapiens
uaacuuugcccuucacuguugc

SEQ ID NO: 406797 - RNA, 18 nt, Homo sapiens
uaacuuuugguaucuacu

SEQ ID NO: 406798 - RNA, 18 nt, Homo sapiens
uaagaaaaaaacuugucu

SEQ ID NO: 406799 - RNA, 22 nt, Homo sapiens
uaagaaaacaaaaucuaaaaca

SEQ ID NO: 406800 - RNA, 14 nt, Homo sapiens
uaagaaaacuaaga

SEQ ID NO: 406801 - RNA, 24 nt, Homo sapiens
uaagaaguuccacuuaacacauga

SEQ ID NO: 406802 - RNA, 18 nt, Homo sapiens
uaagaauuuagggagaaa

SEQ ID NO: 406803 - RNA, 14 nt, Homo sapiens
uaagacaacaggca

SEQ ID NO: 406804 - RNA, 22 nt, Homo sapiens
uaagacaggaggaucacaagag

SEQ ID NO: 406805 - RNA, 17 nt, Homo sapiens
uaagacauaaauuacuu

SEQ ID NO: 406806 - RNA, 18 nt, Homo sapiens
uaagacccacaaacugcc

SEQ ID NO: 406807 - RNA, 20 nt, Homo sapiens
uaagaccuuggcauccuucc

SEQ ID NO: 406808 - RNA, 21 nt, Homo sapiens
uaagacucuuaccuacaaaau

SEQ ID NO: 406809 - RNA, 13 nt, Homo sapiens
uaagagagccuug

SEQ ID NO: 406810 - RNA, 14 nt, Homo sapiens
uaagagaugggacu

SEQ ID NO: 406811 - RNA, 14 nt, Homo sapiens
uaagagucucuauu

SEQ ID NO: 406812 - RNA, 16 nt, Homo sapiens
uaagaugccagcauau

SEQ ID NO: 406813 - RNA, 17 nt, Homo sapiens
uaagcacuagaucuccc

SEQ ID NO: 406814 - RNA, 22 nt, Homo sapiens
uaagcacuagaucucccuuaau

SEQ ID NO: 406815 - RNA, 14 nt, Homo sapiens
uaagccaaaaacaa

SEQ ID NO: 406816 - RNA, 13 nt, Homo sapiens
uaagccugaugau

SEQ ID NO: 406817 - RNA, 22 nt, Homo sapiens
uaagcucuuugaaacaacuuuc

SEQ ID NO: 406818 - RNA, 13 nt, Homo sapiens
uaagcuguaaaaa

SEQ ID NO: 406819 - RNA, 16 nt, Homo sapiens
uaagcuguaaccgaua

SEQ ID NO: 406820 - RNA, 23 nt, Homo sapiens
uaagcuguaagauaauguugcuu

SEQ ID NO: 406821 - RNA, 19 nt, Homo sapiens
uaaggaagaauaaaaaaga

SEQ ID NO: 406822 - RNA, 21 nt, Homo sapiens
uaaggauaugagccuuugcac

SEQ ID NO: 406823 - RNA, 23 nt, Homo sapiens
uaagggaguggccucauuucacu

SEQ ID NO: 406824 - RNA, 22 nt, Homo sapiens
uaaggggggcagggagugauga

SEQ ID NO: 406825 - RNA, 20 nt, Homo sapiens
uaagguacuuaaagcuucua

SEQ ID NO: 406826 - RNA, 14 nt, Homo sapiens
uaaggucugacuga

SEQ ID NO: 406827 - RNA, 12 nt, Homo sapiens
uaaggugcaguu

SEQ ID NO: 406828 - RNA, 12 nt, Homo sapiens
uaaguaacauau

SEQ ID NO: 406829 - RNA, 23 nt, Homo sapiens
uaaguaaccucuacaggcauuua

SEQ ID NO: 406830 - RNA, 18 nt, Homo sapiens
uaaguaaguuugauuuca

SEQ ID NO: 406831 - RNA, 23 nt, Homo sapiens
uaaguacucacuaaaaguucuca

SEQ ID NO: 406832 - RNA, 13 nt, Homo sapiens
uaaguauaucuau

SEQ ID NO: 406833 - RNA, 17 nt, Homo sapiens
uaaguauaucuaucuau

SEQ ID NO: 406834 - RNA, 16 nt, Homo sapiens
uaaguccagcucuccc

SEQ ID NO: 406835 - RNA, 24 nt, Homo sapiens
uaagugaaaaucuuacaacaggcu

SEQ ID NO: 406836 - RNA, 19 nt, Homo sapiens
uaaguggaaaaugcaaugu

SEQ ID NO: 406837 - RNA, 20 nt, Homo sapiens
uaagugggguugcaaccacu

SEQ ID NO: 406838 - RNA, 18 nt, Homo sapiens
uaaguuaggcagucuucu

SEQ ID NO: 406839 - RNA, 19 nt, Homo sapiens
uaaguuauaccagcaaaag

SEQ ID NO: 406840 - RNA, 23 nt, Homo sapiens
uaaguucaccguaguaacacaua

SEQ ID NO: 406841 - RNA, 13 nt, Homo sapiens
uaaguugucuuac

SEQ ID NO: 406842 - RNA, 14 nt, Homo sapiens
uaaguuuaucuuuc

SEQ ID NO: 406843 - RNA, 20 nt, Homo sapiens
uaaguuuauuuauggcucuu

SEQ ID NO: 406844 - RNA, 19 nt, Homo sapiens
uaauaaaacaucuuuccag

SEQ ID NO: 406845 - RNA, 19 nt, Homo sapiens
uaauaaaacugcacagugc

SEQ ID NO: 406846 - RNA, 23 nt, Homo sapiens
uaauaaagguuucguugcauggu

SEQ ID NO: 406847 - RNA, 24 nt, Homo sapiens
uaauaaaucucuucuuugcugcag

SEQ ID NO: 406848 - RNA, 12 nt, Homo sapiens
uaauaaauggga

SEQ ID NO: 406849 - RNA, 16 nt, Homo sapiens
uaauaacuagaucucc

SEQ ID NO: 406850 - RNA, 13 nt, Homo sapiens
uaauaacuuugcu

SEQ ID NO: 406851 - RNA, 21 nt, Homo sapiens
uaauaauucuuuguguucagu

SEQ ID NO: 406852 - RNA, 20 nt, Homo sapiens
uaauacaauaaacaugucaa

SEQ ID NO: 406853 - RNA, 21 nt, Homo sapiens
uaauacaccgauaaccacagg

SEQ ID NO: 406854 - RNA, 17 nt, Homo sapiens
uaauacauaaguuaaua

SEQ ID NO: 406855 - RNA, 19 nt, Homo sapiens
uaauaccuuuaaauaucau

SEQ ID NO: 406856 - RNA, 14 nt, Homo sapiens
uaauacugaaggac

SEQ ID NO: 406857 - RNA, 20 nt, Homo sapiens
uaauacugaaggacacagca

SEQ ID NO: 406858 - RNA, 22 nt, Homo sapiens
uaauacugguuauccugugcua

SEQ ID NO: 406859 - RNA, 17 nt, Homo sapiens
uaauacuguauugcugu

SEQ ID NO: 406860 - RNA, 16 nt, Homo sapiens
uaauagaaaugcauac

SEQ ID NO: 406861 - RNA, 13 nt, Homo sapiens
uaauagagaacuu

SEQ ID NO: 406862 - RNA, 22 nt, Homo sapiens
uaauaggaagaacaguacauuu

SEQ ID NO: 406863 - RNA, 20 nt, Homo sapiens
gcauggacucuggguuucau

SEQ ID NO: 406864 - RNA, 23 nt, Homo sapiens
gcauggaggcugcgacugaugaa

SEQ ID NO: 406865 - RNA, 14 nt, Homo sapiens
gcaugguagcucau

SEQ ID NO: 406866 - RNA, 13 nt, Homo sapiens
gcauguauacuua

SEQ ID NO: 406867 - RNA, 23 nt, Homo sapiens
gcauguccucauccuuuccugcc

SEQ ID NO: 406868 - RNA, 13 nt, Homo sapiens
gcaugucucaggc

SEQ ID NO: 406869 - RNA, 11 nt, Homo sapiens
gcaugugccaa

SEQ ID NO: 406870 - RNA, 12 nt, Homo sapiens
gcaugugcugca

SEQ ID NO: 406871 - RNA, 21 nt, Homo sapiens
gcaugugcugugaccauuuau

SEQ ID NO: 406872 - RNA, 16 nt, Homo sapiens
gcauguguauuuccag

SEQ ID NO: 406873 - RNA, 14 nt, Homo sapiens
gcauuaaaugcuuu

SEQ ID NO: 406874 - RNA, 23 nt, Homo sapiens
gcauuacucugcacuauagccau

SEQ ID NO: 406875 - RNA, 13 nt, Homo sapiens
gcauucaagugua

SEQ ID NO: 406876 - RNA, 16 nt, Homo sapiens
gcauucacacacagcc

SEQ ID NO: 406877 - RNA, 12 nt, Homo sapiens
gcauuccagggu

SEQ ID NO: 406878 - RNA, 18 nt, Homo sapiens
gcauuccugagucuucca

SEQ ID NO: 406879 - RNA, 16 nt, Homo sapiens
gcauuguugaugcuca

SEQ ID NO: 406880 - RNA, 17 nt, Homo sapiens
gcauuuauuuaugugca

SEQ ID NO: 406881 - RNA, 16 nt, Homo sapiens
gcauuucuacauguuu

SEQ ID NO: 406882 - RNA, 23 nt, Homo sapiens
gcauuucuacauguuuuagacag

SEQ ID NO: 406883 - RNA, 16 nt, Homo sapiens
gcauuugcugcauuuc

SEQ ID NO: 406884 - RNA, 21 nt, Homo sapiens
gcauuugucaaugacaguuuc

SEQ ID NO: 406885 - RNA, 14 nt, Homo sapiens
gcauuuuucuggga

SEQ ID NO: 406886 - RNA, 17 nt, Homo sapiens
gccaaagcuggcuuuuu

SEQ ID NO: 406887 - RNA, 15 nt, Homo sapiens
gccaaauaaaaucua

SEQ ID NO: 406888 - RNA, 20 nt, Homo sapiens
gccaaauguuccauaugugg

SEQ ID NO: 406889 - RNA, 12 nt, Homo sapiens
gccaacccagcc

SEQ ID NO: 406890 - RNA, 19 nt, Homo sapiens
gccaaccgcaucugcucau

SEQ ID NO: 406891 - RNA, 17 nt, Homo sapiens
gccaaccggucacccag

SEQ ID NO: 406892 - RNA, 12 nt, Homo sapiens
gccaagaacucu

SEQ ID NO: 406893 - RNA, 23 nt, Homo sapiens
gccaagguuuggggaagaacgaa

SEQ ID NO: 406894 - RNA, 18 nt, Homo sapiens
gccaaguaagaaagugaa

SEQ ID NO: 406895 - RNA, 15 nt, Homo sapiens
gccaauaggcagcuu

SEQ ID NO: 406896 - RNA, 11 nt, Homo sapiens
gccaaucucaa

SEQ ID NO: 406897 - RNA, 22 nt, Homo sapiens
gccacaaaugugucccagugaa

SEQ ID NO: 406898 - RNA, 15 nt, Homo sapiens
gccacagccaagccc

SEQ ID NO: 406899 - RNA, 18 nt, Homo sapiens
gccacagccaagcccacc

SEQ ID NO: 406900 - RNA, 17 nt, Homo sapiens
gccacauccaacauuuc

SEQ ID NO: 406901 - RNA, 23 nt, Homo sapiens
gccacaugggaaacuuccaagac

SEQ ID NO: 406902 - RNA, 20 nt, Homo sapiens
gccaccaacauaaaacaaaa

SEQ ID NO: 406903 - RNA, 16 nt, Homo sapiens
gccaccacgucugcca

SEQ ID NO: 406904 - RNA, 19 nt, Homo sapiens
gccacccaggccacugacc

SEQ ID NO: 406905 - RNA, 19 nt, Homo sapiens
gccacccggaucuccaggc

SEQ ID NO: 406906 - RNA, 15 nt, Homo sapiens
gccaccucacccagc

SEQ ID NO: 406907 - RNA, 19 nt, Homo sapiens
gccaccuccccaggccgug

SEQ ID NO: 406908 - RNA, 16 nt, Homo sapiens
gccaccugcugcugcu

SEQ ID NO: 406909 - RNA, 13 nt, Homo sapiens
gccacggcagccu

SEQ ID NO: 406910 - RNA, 22 nt, Homo sapiens
gccacgugggcaaacaggcagu

SEQ ID NO: 406911 - RNA, 16 nt, Homo sapiens
gccacgugucuggaau

SEQ ID NO: 406912 - RNA, 20 nt, Homo sapiens
gccacuaccuucugaccucc

SEQ ID NO: 406913 - RNA, 13 nt, Homo sapiens
gccacugccagcu

SEQ ID NO: 406914 - RNA, 19 nt, Homo sapiens
gccacugggauucauggcu

SEQ ID NO: 406915 - RNA, 16 nt, Homo sapiens
gccacuugacauuccu

SEQ ID NO: 406916 - RNA, 23 nt, Homo sapiens
gccacuugacauuccuugucacc

SEQ ID NO: 406917 - RNA, 17 nt, Homo sapiens
gccacuugcacugugcu

SEQ ID NO: 406918 - RNA, 13 nt, Homo sapiens
gccacuugcucag

SEQ ID NO: 406919 - RNA, 19 nt, Homo sapiens
gccagaaggauaauauuga

SEQ ID NO: 406920 - RNA, 17 nt, Homo sapiens
gccagaagggggccaug

SEQ ID NO: 406921 - RNA, 12 nt, Homo sapiens
gccagaccucaa

SEQ ID NO: 406922 - RNA, 13 nt, Homo sapiens
gccagagaauaga

SEQ ID NO: 406923 - RNA, 22 nt, Homo sapiens
gccagcccucccuggcugugag

SEQ ID NO: 406924 - RNA, 17 nt, Homo sapiens
gccagccgugaugcuca

SEQ ID NO: 406925 - RNA, 16 nt, Homo sapiens
gccagccuccagcacc

SEQ ID NO: 406926 - RNA, 17 nt, Homo sapiens
gccagcucccccuugcc

SEQ ID NO: 406927 - RNA, 14 nt, Homo sapiens
gccagcugcagcug

SEQ ID NO: 406928 - RNA, 14 nt, Homo sapiens
gccaggacaucucu

SEQ ID NO: 406929 - RNA, 19 nt, Homo sapiens
gccaggagucugugcucuu

SEQ ID NO: 406930 - RNA, 17 nt, Homo sapiens
gccaggccugaccucaa

SEQ ID NO: 406931 - RNA, 21 nt, Homo sapiens
gccaggcuguaagcauucuga

SEQ ID NO: 406932 - RNA, 19 nt, Homo sapiens
gccagguaugcaaauaucg

SEQ ID NO: 406933 - RNA, 22 nt, Homo sapiens
gccaguacagagaaauucugug

SEQ ID NO: 406934 - RNA, 14 nt, Homo sapiens
gccaguagcugcca

SEQ ID NO: 406935 - RNA, 13 nt, Homo sapiens
gccagucccucag

SEQ ID NO: 406936 - RNA, 19 nt, Homo sapiens
gccaguccugccuggccag

SEQ ID NO: 406937 - RNA, 17 nt, Homo sapiens
gccagugacuccaggag

SEQ ID NO: 406938 - RNA, 15 nt, Homo sapiens
gccauaaaccaauaa

SEQ ID NO: 406939 - RNA, 22 nt, Homo sapiens
gccauaagcaggaguugauaca

SEQ ID NO: 406940 - RNA, 18 nt, Homo sapiens
gccauauucacaccucac

SEQ ID NO: 406941 - RNA, 15 nt, Homo sapiens
gccaucaucucugua

SEQ ID NO: 406942 - RNA, 14 nt, Homo sapiens
gccauccucaccca

SEQ ID NO: 406943 - RNA, 17 nt, Homo sapiens
gccauccucacccagca

SEQ ID NO: 406944 - RNA, 20 nt, Homo sapiens
gccaucggugaaacuaacag

SEQ ID NO: 406945 - RNA, 16 nt, Homo sapiens
gccaucugcuuaccac

SEQ ID NO: 406946 - RNA, 16 nt, Homo sapiens
gccaugauguggagug

SEQ ID NO: 406947 - RNA, 17 nt, Homo sapiens
gccaugauuuuggccac

SEQ ID NO: 406948 - RNA, 16 nt, Homo sapiens
gccauggaauaaacca

SEQ ID NO: 406949 - RNA, 16 nt, Homo sapiens
gccauggccugugcug

SEQ ID NO: 406950 - RNA, 16 nt, Homo sapiens
gccauggcuccccuuu

SEQ ID NO: 406951 - RNA, 13 nt, Homo sapiens
gccaugggggccc

SEQ ID NO: 406952 - RNA, 17 nt, Homo sapiens
gccauguuauuuauagu

SEQ ID NO: 406953 - RNA, 16 nt, Homo sapiens
gccauuaacaaugacc

SEQ ID NO: 406954 - RNA, 21 nt, Homo sapiens
gccauucacugauuggaagag

SEQ ID NO: 406955 - RNA, 14 nt, Homo sapiens
gccauucacugccc

SEQ ID NO: 406956 - RNA, 18 nt, Homo sapiens
gccauuguuuugccagug

SEQ ID NO: 406957 - RNA, 19 nt, Homo sapiens
gccauuguuuugccaguga

SEQ ID NO: 406958 - RNA, 14 nt, Homo sapiens
gccauuucuuccca

SEQ ID NO: 406959 - RNA, 22 nt, Homo sapiens
gccauuuuggguuuugggucuu

SEQ ID NO: 406960 - RNA, 14 nt, Homo sapiens
gcccaagaauagau

SEQ ID NO: 406961 - RNA, 17 nt, Homo sapiens
gcccaaggcaguguucc

SEQ ID NO: 406962 - RNA, 16 nt, Homo sapiens
gcccacacuugggagc

SEQ ID NO: 406963 - RNA, 13 nt, Homo sapiens
gcccacaucccag

SEQ ID NO: 406964 - RNA, 17 nt, Homo sapiens
gcccaccacaacuaaca

SEQ ID NO: 406965 - RNA, 14 nt, Homo sapiens
gcccaccaccuguc

SEQ ID NO: 406966 - RNA, 20 nt, Homo sapiens
gcccacccgucuucaaucuc

SEQ ID NO: 406967 - RNA, 20 nt, Homo sapiens
gcccagaaaacugucauuua

SEQ ID NO: 406968 - RNA, 12 nt, Homo sapiens
gcccagaacggg

SEQ ID NO: 406969 - RNA, 12 nt, Homo sapiens
gcccagacuaca

SEQ ID NO: 406970 - RNA, 19 nt, Homo sapiens
gcccagagcugggugagug

SEQ ID NO: 406971 - RNA, 20 nt, Homo sapiens
gcccagaggggcggggccag

SEQ ID NO: 406972 - RNA, 16 nt, Homo sapiens
gcccagccucaucucu

SEQ ID NO: 406973 - RNA, 23 nt, Homo sapiens
gcccagccuuguaaauaaccaca

SEQ ID NO: 406974 - RNA, 14 nt, Homo sapiens
gcccagcucugacu

SEQ ID NO: 406975 - RNA, 14 nt, Homo sapiens
gcccaggcagucuu

SEQ ID NO: 406976 - RNA, 20 nt, Homo sapiens
gcccaggcuggagcgcagug

SEQ ID NO: 406977 - RNA, 19 nt, Homo sapiens
gcccaggcuggagugcaac

SEQ ID NO: 406978 - RNA, 18 nt, Homo sapiens
gcccagggagaggccaug

SEQ ID NO: 406979 - RNA, 15 nt, Homo sapiens
gcccagggugcagug

SEQ ID NO: 406980 - RNA, 14 nt, Homo sapiens
gcccagugauggca

SEQ ID NO: 406981 - RNA, 12 nt, Homo sapiens
gcccaucugccg

SEQ ID NO: 406982 - RNA, 23 nt, Homo sapiens
gcccaugcccuccguccuggcag

SEQ ID NO: 406983 - RNA, 21 nt, Homo sapiens
gcccauggaagucucaaagau

SEQ ID NO: 406984 - RNA, 14 nt, Homo sapiens
caugugaucuauua

SEQ ID NO: 406985 - RNA, 15 nt, Homo sapiens
caugugauugugauu

SEQ ID NO: 406986 - RNA, 16 nt, Homo sapiens
caugugccgaaugugc

SEQ ID NO: 406987 - RNA, 14 nt, Homo sapiens
caugugccugucac

SEQ ID NO: 406988 - RNA, 11 nt, Homo sapiens
caugugcugca

SEQ ID NO: 406989 - RNA, 18 nt, Homo sapiens
caugugcugcuguggcau

SEQ ID NO: 406990 - RNA, 18 nt, Homo sapiens
cauguggcguauugggcc

SEQ ID NO: 406991 - RNA, 16 nt, Homo sapiens
caugugucuguauuca

SEQ ID NO: 406992 - RNA, 19 nt, Homo sapiens
caugugugagugugugcaa

SEQ ID NO: 406993 - RNA, 21 nt, Homo sapiens
caugugugcgagugugugcau

SEQ ID NO: 406994 - RNA, 15 nt, Homo sapiens
gccccaucagcagcu

SEQ ID NO: 406995 - RNA, 16 nt, Homo sapiens
gccccaucagcagcuu

SEQ ID NO: 406996 - RNA, 21 nt, Homo sapiens
gccccaugaguuugccauguu

SEQ ID NO: 406997 - RNA, 21 nt, Homo sapiens
gccccauucucccuccauggc

SEQ ID NO: 406998 - RNA, 12 nt, Homo sapiens
gcccccaccagc

SEQ ID NO: 406999 - RNA, 22 nt, Homo sapiens
gcccccacugucccccuaccca

SEQ ID NO: 407000 - RNA, 12 nt, Homo sapiens
gcccccagcugu

SEQ ID NO: 407001 - RNA, 21 nt, Homo sapiens
gccccccccuugaaucugcag

SEQ ID NO: 407002 - RNA, 16 nt, Homo sapiens
gcccccgccacaaccc

SEQ ID NO: 407003 - RNA, 17 nt, Homo sapiens
gcccccgcucaugggcc

SEQ ID NO: 407004 - RNA, 18 nt, Homo sapiens
gcccccuccacaccagug

SEQ ID NO: 407005 - RNA, 17 nt, Homo sapiens
gcccccucucuuacccc

SEQ ID NO: 407006 - RNA, 17 nt, Homo sapiens
gcccccugcacagggag

SEQ ID NO: 407007 - RNA, 13 nt, Homo sapiens
gcccccugcaucu

SEQ ID NO: 407008 - RNA, 16 nt, Homo sapiens
gcccccugccagugaa

SEQ ID NO: 407009 - RNA, 14 nt, Homo sapiens
gccccuaccagcca

SEQ ID NO: 407010 - RNA, 16 nt, Homo sapiens
gccccucaccucagga

SEQ ID NO: 407011 - RNA, 19 nt, Homo sapiens
gccccuccaggaacauucc

SEQ ID NO: 407012 - RNA, 22 nt, Homo sapiens
gccccuccccauggugcaguga

SEQ ID NO: 407013 - RNA, 15 nt, Homo sapiens
gccccuccuaguucu

SEQ ID NO: 407014 - RNA, 14 nt, Homo sapiens
gccccuccucgggc

SEQ ID NO: 407015 - RNA, 20 nt, Homo sapiens
gccccugcccgagagcucuu

SEQ ID NO: 407016 - RNA, 22 nt, Homo sapiens
gccccugccgccugugcccuug

SEQ ID NO: 407017 - RNA, 15 nt, Homo sapiens
gccccuguuaccuaa

SEQ ID NO: 407018 - RNA, 21 nt, Homo sapiens
gccccuuccuccuucaugccu

SEQ ID NO: 407019 - RNA, 17 nt, Homo sapiens
gcccgaccccaucucau

SEQ ID NO: 407020 - RNA, 18 nt, Homo sapiens
gcccgagaugugacccac

SEQ ID NO: 407021 - RNA, 16 nt, Homo sapiens
gcccgcugcgugccau

SEQ ID NO: 407022 - RNA, 19 nt, Homo sapiens
gcccggugguuugccaugu

SEQ ID NO: 407023 - RNA, 15 nt, Homo sapiens
gcccuccacaccucc

SEQ ID NO: 407024 - RNA, 15 nt, Homo sapiens
gcccuccacugcccu

SEQ ID NO: 407025 - RNA, 16 nt, Homo sapiens
gcccuccccagacucc

SEQ ID NO: 407026 - RNA, 19 nt, Homo sapiens
gcccucccccagcaguuga

SEQ ID NO: 407027 - RNA, 16 nt, Homo sapiens
gcccucccucccucca

SEQ ID NO: 407028 - RNA, 21 nt, Homo sapiens
gcccucccuggcugugagcag

SEQ ID NO: 407029 - RNA, 15 nt, Homo sapiens
gcccucccuuggaaa

SEQ ID NO: 407030 - RNA, 14 nt, Homo sapiens
gcccuccugagcac

SEQ ID NO: 407031 - RNA, 23 nt, Homo sapiens
gcccucgugguggaaacuuuucu

SEQ ID NO: 407032 - RNA, 14 nt, Homo sapiens
gcccucugcugcuu

SEQ ID NO: 407033 - RNA, 19 nt, Homo sapiens
gcccucugcugcuuuccaa

SEQ ID NO: 407034 - RNA, 14 nt, Homo sapiens
gcccucuguagcuc

SEQ ID NO: 407035 - RNA, 23 nt, Homo sapiens
gcccugaccuuggcugacugggg

SEQ ID NO: 407036 - RNA, 13 nt, Homo sapiens
gcccugauuugcu

SEQ ID NO: 407037 - RNA, 12 nt, Homo sapiens
gcccugcaccug

SEQ ID NO: 407038 - RNA, 21 nt, Homo sapiens
gcccugcaccuugggcacggg

SEQ ID NO: 407039 - RNA, 15 nt, Homo sapiens
gcccugcccugccac

SEQ ID NO: 407040 - RNA, 22 nt, Homo sapiens
gcccuggggucucugagcagug

SEQ ID NO: 407041 - RNA, 15 nt, Homo sapiens
gcccuggugcugcca

SEQ ID NO: 407042 - RNA, 15 nt, Homo sapiens
gcccuguguccugag

SEQ ID NO: 407043 - RNA, 18 nt, Homo sapiens
gcccuguucugggugcag

SEQ ID NO: 407044 - RNA, 10 nt, Homo sapiens
gcccuuccag

SEQ ID NO: 407045 - RNA, 14 nt, Homo sapiens
gcccuuuccagggc

SEQ ID NO: 407046 - RNA, 17 nt, Homo sapiens
gcccuuuggaaagccau

SEQ ID NO: 407047 - RNA, 22 nt, Homo sapiens
gcccuuuuaaauggcaugacaa

SEQ ID NO: 407048 - RNA, 14 nt, Homo sapiens
gccgaaugugcagg

SEQ ID NO: 407049 - RNA, 17 nt, Homo sapiens
gccgagcccagaccucc

SEQ ID NO: 407050 - RNA, 14 nt, Homo sapiens
gccggaaucucagc

SEQ ID NO: 407051 - RNA, 12 nt, Homo sapiens
gccggcucuuuc

SEQ ID NO: 407052 - RNA, 18 nt, Homo sapiens
gccggcucuuuccuugcu

SEQ ID NO: 407053 - RNA, 16 nt, Homo sapiens
gccgucacgcuuucau

SEQ ID NO: 407054 - RNA, 17 nt, Homo sapiens
gccgucuccucccucag

SEQ ID NO: 407055 - RNA, 17 nt, Homo sapiens
gccgugcagcugggauu

SEQ ID NO: 407056 - RNA, 19 nt, Homo sapiens
gccgugccuucagcucuac

SEQ ID NO: 407057 - RNA, 16 nt, Homo sapiens
gccguucagcugugac

SEQ ID NO: 407058 - RNA, 16 nt, Homo sapiens
gccguugcugcguucu

SEQ ID NO: 407059 - RNA, 15 nt, Homo sapiens
gccuaaaaguuacuu

SEQ ID NO: 407060 - RNA, 17 nt, Homo sapiens
gccuaaagaaacucagc

SEQ ID NO: 407061 - RNA, 19 nt, Homo sapiens
gccuacacccgucuugggg

SEQ ID NO: 407062 - RNA, 21 nt, Homo sapiens
gccuacuuucacacuaagaaa

SEQ ID NO: 407063 - RNA, 23 nt, Homo sapiens
gccuagacuucccaacagccuua

SEQ ID NO: 407064 - RNA, 22 nt, Homo sapiens
gccuagcugggaaggugaccac

SEQ ID NO: 407065 - RNA, 13 nt, Homo sapiens
gccuauggcaucu

SEQ ID NO: 407066 - RNA, 13 nt, Homo sapiens
gccucaaugccag

SEQ ID NO: 407067 - RNA, 15 nt, Homo sapiens
gccucagccuuccaa

SEQ ID NO: 407068 - RNA, 17 nt, Homo sapiens
gccucagugccacuuga

SEQ ID NO: 407069 - RNA, 12 nt, Homo sapiens
gccuccaagaaa

SEQ ID NO: 407070 - RNA, 10 nt, Homo sapiens
gccuccacuc

SEQ ID NO: 407071 - RNA, 23 nt, Homo sapiens
gccuccacuucuccccucaagaa

SEQ ID NO: 407072 - RNA, 16 nt, Homo sapiens
gccuccagcccucuca

SEQ ID NO: 407073 - RNA, 19 nt, Homo sapiens
gccucccacccccaucucu

SEQ ID NO: 407074 - RNA, 16 nt, Homo sapiens
gccuccccaacccugc

SEQ ID NO: 407075 - RNA, 21 nt, Homo sapiens
gccuccucacccaccucuuca

SEQ ID NO: 407076 - RNA, 18 nt, Homo sapiens
gccucgcagccuccggaa

SEQ ID NO: 407077 - RNA, 18 nt, Homo sapiens
gccucgggaccucaggug

SEQ ID NO: 407078 - RNA, 13 nt, Homo sapiens
gccucuacuuuau

SEQ ID NO: 407079 - RNA, 17 nt, Homo sapiens
gccucuagaacagccag

SEQ ID NO: 407080 - RNA, 20 nt, Homo sapiens
gccucucccaaguccagugu

SEQ ID NO: 407081 - RNA, 18 nt, Homo sapiens
gccucugcccucauccuc

SEQ ID NO: 407082 - RNA, 21 nt, Homo sapiens
gccucuggaaaacucaggauu

SEQ ID NO: 407083 - RNA, 14 nt, Homo sapiens
gccucugugcugca

SEQ ID NO: 407084 - RNA, 21 nt, Homo sapiens
gccucuugcuggugcacauga

SEQ ID NO: 407085 - RNA, 16 nt, Homo sapiens
gccugacaaccacugg

SEQ ID NO: 407086 - RNA, 14 nt, Homo sapiens
gccugacuuuuaca

SEQ ID NO: 407087 - RNA, 17 nt, Homo sapiens
gccugagggcgagggga

SEQ ID NO: 407088 - RNA, 14 nt, Homo sapiens
gccugaguccaguu

SEQ ID NO: 407089 - RNA, 15 nt, Homo sapiens
gccugaugauggaag

SEQ ID NO: 407090 - RNA, 23 nt, Homo sapiens
gccugaugauggaagggccuucu

SEQ ID NO: 407091 - RNA, 18 nt, Homo sapiens
gccugaugcucccucccc

SEQ ID NO: 407092 - RNA, 21 nt, Homo sapiens
gccugcaauuucauaugcugu

SEQ ID NO: 407093 - RNA, 20 nt, Homo sapiens
gccugcacucuuauuucacu

SEQ ID NO: 407094 - RNA, 15 nt, Homo sapiens
gccugcaucugugaa

SEQ ID NO: 407095 - RNA, 14 nt, Homo sapiens
gccugcgaaaccca

SEQ ID NO: 407096 - RNA, 17 nt, Homo sapiens
gccugcuuuuaggucau

SEQ ID NO: 407097 - RNA, 17 nt, Homo sapiens
gccuggacuuuccugca

SEQ ID NO: 407098 - RNA, 23 nt, Homo sapiens
gccuggaucuccccacucuaggg

SEQ ID NO: 407099 - RNA, 19 nt, Homo sapiens
gccuggcaagugggugaaa

SEQ ID NO: 407100 - RNA, 19 nt, Homo sapiens
gccuggccccaaauguucu

SEQ ID NO: 407101 - RNA, 14 nt, Homo sapiens
gccugggacccagc

SEQ ID NO: 407102 - RNA, 14 nt, Homo sapiens
gccugggagggcaa

SEQ ID NO: 407103 - RNA, 23 nt, Homo sapiens
gccugggucccacucaggugaaa

SEQ ID NO: 407104 - RNA, 21 nt, Homo sapiens
gccugggugacagagugagug

SEQ ID NO: 407105 - RNA, 22 nt, Homo sapiens
gccugguuuuuaaguacucacu

SEQ ID NO: 407106 - RNA, 20 nt, Homo sapiens
gccuguaaucccagcacuuu

SEQ ID NO: 407107 - RNA, 22 nt, Homo sapiens
gccuguaaucccagcacuuugg

SEQ ID NO: 407108 - RNA, 14 nt, Homo sapiens
gccuguccuggauc

SEQ ID NO: 407109 - RNA, 16 nt, Homo sapiens
gccugugcccuugcug

SEQ ID NO: 407110 - RNA, 15 nt, Homo sapiens
gccugugccuaucac

SEQ ID NO: 407111 - RNA, 18 nt, Homo sapiens
gccugugcuuuuggagcu

SEQ ID NO: 407112 - RNA, 17 nt, Homo sapiens
gccuguggcaugaagau

SEQ ID NO: 407113 - RNA, 21 nt, Homo sapiens
gccugugguuaacaucucaga

SEQ ID NO: 407114 - RNA, 18 nt, Homo sapiens
gccuguguuuguguggau

SEQ ID NO: 407115 - RNA, 14 nt, Homo sapiens
gccuguugcccuuu

SEQ ID NO: 407116 - RNA, 13 nt, Homo sapiens
gccuguugccucg

SEQ ID NO: 407117 - RNA, 22 nt, Homo sapiens
gccuguuugcuuagcauuccua

SEQ ID NO: 407118 - RNA, 14 nt, Homo sapiens
gccuguuugggagg

SEQ ID NO: 407119 - RNA, 11 nt, Homo sapiens
ccaaacccagc

SEQ ID NO: 407120 - RNA, 18 nt, Homo sapiens
ccaaacccagccucuaga

SEQ ID NO: 407121 - RNA, 18 nt, Homo sapiens
ccaaacuaaauacuguaa

SEQ ID NO: 407122 - RNA, 20 nt, Homo sapiens
ccaaacuaaauacuguaaca

SEQ ID NO: 407123 - RNA, 15 nt, Homo sapiens
ccaaacuacuuucuu

SEQ ID NO: 407124 - RNA, 18 nt, Homo sapiens
ccaaacuguacaguuucu

SEQ ID NO: 407125 - RNA, 15 nt, Homo sapiens
gccuucuaccugcag

SEQ ID NO: 407126 - RNA, 23 nt, Homo sapiens
gccuucuccacagggacacaguc

SEQ ID NO: 407127 - RNA, 22 nt, Homo sapiens
gccuucugacggcccugcaaug

SEQ ID NO: 407128 - RNA, 18 nt, Homo sapiens
gccuugccuccucaccca

SEQ ID NO: 407129 - RNA, 17 nt, Homo sapiens
gccuuggccugaccugg

SEQ ID NO: 407130 - RNA, 16 nt, Homo sapiens
gccuuggcucguucuc

SEQ ID NO: 407131 - RNA, 21 nt, Homo sapiens
gccuuguugaugaagcacauu

SEQ ID NO: 407132 - RNA, 19 nt, Homo sapiens
gccuuuaauaauguuauag

SEQ ID NO: 407133 - RNA, 14 nt, Homo sapiens
gccuuugaggcaaa

SEQ ID NO: 407134 - RNA, 16 nt, Homo sapiens
gccuuuguaagacaca

SEQ ID NO: 407135 - RNA, 15 nt, Homo sapiens
gccuuuuccuaugua

SEQ ID NO: 407136 - RNA, 15 nt, Homo sapiens
gccuuuugugugaug

SEQ ID NO: 407137 - RNA, 14 nt, Homo sapiens
gcgaacaucuucau

SEQ ID NO: 407138 - RNA, 22 nt, Homo sapiens
gcgaagccaucgcgcuccuugc

SEQ ID NO: 407139 - RNA, 17 nt, Homo sapiens
gcgacgugaggguccug

SEQ ID NO: 407140 - RNA, 17 nt, Homo sapiens
gcgagcugcucugcuau

SEQ ID NO: 407141 - RNA, 18 nt, Homo sapiens
gcgagggccugcguucaa

SEQ ID NO: 407142 - RNA, 23 nt, Homo sapiens
gcgauuuuaucuguuaaccaaau

SEQ ID NO: 407143 - RNA, 12 nt, Homo sapiens
gcgccacccgcc

SEQ ID NO: 407144 - RNA, 13 nt, Homo sapiens
gcgccugugcuga

SEQ ID NO: 407145 - RNA, 18 nt, Homo sapiens
gcgccuugcugauggcuu

SEQ ID NO: 407146 - RNA, 15 nt, Homo sapiens
gcggaggacuugggg

SEQ ID NO: 407147 - RNA, 13 nt, Homo sapiens
gcggaggggcuug

SEQ ID NO: 407148 - RNA, 13 nt, Homo sapiens
gcgggacugcugg

SEQ ID NO: 407149 - RNA, 16 nt, Homo sapiens
gcggggagcaugaaga

SEQ ID NO: 407150 - RNA, 22 nt, Homo sapiens
gcggguaaaaagagaaggcaag

SEQ ID NO: 407151 - RNA, 16 nt, Homo sapiens
gcgguauccaccugca

SEQ ID NO: 407152 - RNA, 20 nt, Homo sapiens
gcguaggagagaacagggau

SEQ ID NO: 407153 - RNA, 21 nt, Homo sapiens
gcgucagaccaguacugggaa

SEQ ID NO: 407154 - RNA, 13 nt, Homo sapiens
gcgucugcugcuc

SEQ ID NO: 407155 - RNA, 21 nt, Homo sapiens
gcguguccaggagaccuucca

SEQ ID NO: 407156 - RNA, 21 nt, Homo sapiens
gcgugugcgugcaugugcacu

SEQ ID NO: 407157 - RNA, 16 nt, Homo sapiens
gcuaaaauaaaccaga

SEQ ID NO: 407158 - RNA, 17 nt, Homo sapiens
gcuaaacugaugacuua

SEQ ID NO: 407159 - RNA, 17 nt, Homo sapiens
gcuaaaggacaguggau

SEQ ID NO: 407160 - RNA, 12 nt, Homo sapiens
gcuaaauuccac

SEQ ID NO: 407161 - RNA, 20 nt, Homo sapiens
gcuaacugcuugaacccaga

SEQ ID NO: 407162 - RNA, 12 nt, Homo sapiens
gcuaagagccag

SEQ ID NO: 407163 - RNA, 23 nt, Homo sapiens
gcuaccagguguucuacacucau

SEQ ID NO: 407164 - RNA, 16 nt, Homo sapiens
gcuaccucuccagccu

SEQ ID NO: 407165 - RNA, 12 nt, Homo sapiens
gcuaccugaugg

SEQ ID NO: 407166 - RNA, 20 nt, Homo sapiens
gcuagaauauccuauacugg

SEQ ID NO: 407167 - RNA, 18 nt, Homo sapiens
gcuagaauggaaaacugc

SEQ ID NO: 407168 - RNA, 19 nt, Homo sapiens
gcuagaauggaaaacugcc

SEQ ID NO: 407169 - RNA, 23 nt, Homo sapiens
gcuagagguagaguuugaucaua

SEQ ID NO: 407170 - RNA, 18 nt, Homo sapiens
gcuagaucuaguucucaa

SEQ ID NO: 407171 - RNA, 15 nt, Homo sapiens
gcuagggaauaucaa

SEQ ID NO: 407172 - RNA, 16 nt, Homo sapiens
gcuaggggacaucaga

SEQ ID NO: 407173 - RNA, 14 nt, Homo sapiens
gcuagguagugggg

SEQ ID NO: 407174 - RNA, 19 nt, Homo sapiens
gcuaguuaaacagugccau

SEQ ID NO: 407175 - RNA, 22 nt, Homo sapiens
gcuaguuuauuggaaguguuca

SEQ ID NO: 407176 - RNA, 18 nt, Homo sapiens
gcuauaauucuauacugu

SEQ ID NO: 407177 - RNA, 19 nt, Homo sapiens
gcuauacagaaaaaccaca

SEQ ID NO: 407178 - RNA, 17 nt, Homo sapiens
gcuauauccauguacug

SEQ ID NO: 407179 - RNA, 17 nt, Homo sapiens
gcuaucgcaccacugug

SEQ ID NO: 407180 - RNA, 17 nt, Homo sapiens
gcuaucucgcuagccau

SEQ ID NO: 407181 - RNA, 21 nt, Homo sapiens
gcuauggaggguccuccucca

SEQ ID NO: 407182 - RNA, 23 nt, Homo sapiens
gcuauggucagguuauacuccuc

SEQ ID NO: 407183 - RNA, 19 nt, Homo sapiens
gcuauuaagaaaaucacau

SEQ ID NO: 407184 - RNA, 20 nt, Homo sapiens
gcucaaagauguacugagag

SEQ ID NO: 407185 - RNA, 15 nt, Homo sapiens
gcucaagcagucuac

SEQ ID NO: 407186 - RNA, 15 nt, Homo sapiens
gcucaaggauucaau

SEQ ID NO: 407187 - RNA, 12 nt, Homo sapiens
gcucaaguauuu

SEQ ID NO: 407188 - RNA, 19 nt, Homo sapiens
gcucaauauuccugaauga

SEQ ID NO: 407189 - RNA, 21 nt, Homo sapiens
gcucagccccggccacucccu

SEQ ID NO: 407190 - RNA, 12 nt, Homo sapiens
gcucagugcaaa

SEQ ID NO: 407191 - RNA, 20 nt, Homo sapiens
gcucaguuggugcugcuuuc

SEQ ID NO: 407192 - RNA, 15 nt, Homo sapiens
gcucaucaacaauca

SEQ ID NO: 407193 - RNA, 13 nt, Homo sapiens
gcucaucacugga

SEQ ID NO: 407194 - RNA, 22 nt, Homo sapiens
gcuccaacacuuugagcauuuu

SEQ ID NO: 407195 - RNA, 23 nt, Homo sapiens
gcuccacgaagccuuaagccaua

SEQ ID NO: 407196 - RNA, 13 nt, Homo sapiens
gcuccaguuccag

SEQ ID NO: 407197 - RNA, 20 nt, Homo sapiens
gcuccauccuugcaucacug

SEQ ID NO: 407198 - RNA, 15 nt, Homo sapiens
gcucccagugccaaa

SEQ ID NO: 407199 - RNA, 12 nt, Homo sapiens
gcucccaugacc

SEQ ID NO: 407200 - RNA, 13 nt, Homo sapiens
gcuccccaaaggg

SEQ ID NO: 407201 - RNA, 14 nt, Homo sapiens
gcuccccaaagggu

SEQ ID NO: 407202 - RNA, 22 nt, Homo sapiens
gcuccccaauccaacccaugca

SEQ ID NO: 407203 - RNA, 23 nt, Homo sapiens
gcuccccaauccaacccaugcau

SEQ ID NO: 407204 - RNA, 16 nt, Homo sapiens
gcucccuagacugcau

SEQ ID NO: 407205 - RNA, 17 nt, Homo sapiens
gcucccuuccuccucaa

SEQ ID NO: 407206 - RNA, 21 nt, Homo sapiens
gcucccuuuuaaaaggagcac

SEQ ID NO: 407207 - RNA, 20 nt, Homo sapiens
gcuccuaaaggcagcaacca

SEQ ID NO: 407208 - RNA, 14 nt, Homo sapiens
gcuccuaagcaaaa

SEQ ID NO: 407209 - RNA, 23 nt, Homo sapiens
gcuccuccucuuggagcugagau

SEQ ID NO: 407210 - RNA, 20 nt, Homo sapiens
gcuccuccuugcccagacua

SEQ ID NO: 407211 - RNA, 18 nt, Homo sapiens
gcuccucugcagccugag

SEQ ID NO: 407212 - RNA, 15 nt, Homo sapiens
gcuccugaggggcau

SEQ ID NO: 407213 - RNA, 22 nt, Homo sapiens
gcucgagugccccugcagggga

SEQ ID NO: 407214 - RNA, 19 nt, Homo sapiens
gcucgcauuugucaaugac

SEQ ID NO: 407215 - RNA, 22 nt, Homo sapiens
gcucuacguggcaaauuaacuu

SEQ ID NO: 407216 - RNA, 12 nt, Homo sapiens
gcucuccaucau

SEQ ID NO: 407217 - RNA, 21 nt, Homo sapiens
gcucucccacaucccacugga

SEQ ID NO: 407218 - RNA, 23 nt, Homo sapiens
gcucuccccaaacuugcuuuaug

SEQ ID NO: 407219 - RNA, 20 nt, Homo sapiens
gcucucccucucugcaccug

SEQ ID NO: 407220 - RNA, 14 nt, Homo sapiens
gcucugaacacgaa

SEQ ID NO: 407221 - RNA, 19 nt, Homo sapiens
gcucugagaaaccucggga

SEQ ID NO: 407222 - RNA, 13 nt, Homo sapiens
gcucugagugcua

SEQ ID NO: 407223 - RNA, 19 nt, Homo sapiens
gcucuggcuggagaggaaa

SEQ ID NO: 407224 - RNA, 19 nt, Homo sapiens
gcucugggagacuuugaag

SEQ ID NO: 407225 - RNA, 16 nt, Homo sapiens
gcucuuagcagcuucc

SEQ ID NO: 407226 - RNA, 18 nt, Homo sapiens
gcucuuauaaaaucaaua

SEQ ID NO: 407227 - RNA, 13 nt, Homo sapiens
gcucuugcucaag

SEQ ID NO: 407228 - RNA, 18 nt, Homo sapiens
gcucuuggggccagccua

SEQ ID NO: 407229 - RNA, 23 nt, Homo sapiens
gcucuuucagagaggucucaggu

SEQ ID NO: 407230 - RNA, 22 nt, Homo sapiens
gcucuuucucugccagugacag

SEQ ID NO: 407231 - RNA, 22 nt, Homo sapiens
gcugaaaacccgaaucugagaa

SEQ ID NO: 407232 - RNA, 14 nt, Homo sapiens
gcugaaaagugcuu

SEQ ID NO: 407233 - RNA, 22 nt, Homo sapiens
gcugaaagaaggggugccaaaa

SEQ ID NO: 407234 - RNA, 15 nt, Homo sapiens
gcugaaagacaguaa

SEQ ID NO: 407235 - RNA, 20 nt, Homo sapiens
gcugaaaggggaagaccuga

SEQ ID NO: 407236 - RNA, 22 nt, Homo sapiens
gcugaccccaggaagugggaga

SEQ ID NO: 407237 - RNA, 18 nt, Homo sapiens
gcugacuguacuccuccc

SEQ ID NO: 407238 - RNA, 23 nt, Homo sapiens
gcugagauuacagacaugagccu

SEQ ID NO: 407239 - RNA, 16 nt, Homo sapiens
gcugaggcaagagaau

SEQ ID NO: 407240 - RNA, 13 nt, Homo sapiens
gcugagggcauua

SEQ ID NO: 407241 - RNA, 11 nt, Homo sapiens
gcugauucaau

SEQ ID NO: 407242 - RNA, 15 nt, Homo sapiens
gcugcauaguauucc

SEQ ID NO: 407243 - RNA, 10 nt, Homo sapiens
gcugcaucuc

SEQ ID NO: 407244 - RNA, 20 nt, Homo sapiens
gcugccagugcuggucacua

SEQ ID NO: 407245 - RNA, 20 nt, Homo sapiens
gcugccauccagggaugcca

SEQ ID NO: 407246 - RNA, 24 nt, Homo sapiens
gcugccauuucccuucuggacacu

SEQ ID NO: 407247 - RNA, 15 nt, Homo sapiens
gcugccucacuuccu

SEQ ID NO: 407248 - RNA, 15 nt, Homo sapiens
gcugccugacacuga

SEQ ID NO: 407249 - RNA, 19 nt, Homo sapiens
gcugccuuuucucauucug

SEQ ID NO: 407250 - RNA, 20 nt, Homo sapiens
gcugcggguggguaucccac

SEQ ID NO: 407251 - RNA, 13 nt, Homo sapiens
gcugcggugggca

SEQ ID NO: 407252 - RNA, 23 nt, Homo sapiens
gcugcgucagaccaguacuggga

SEQ ID NO: 407253 - RNA, 21 nt, Homo sapiens
ccacgugggcaaacaggcagu

SEQ ID NO: 407254 - RNA, 13 nt, Homo sapiens
ccauagcugguua

SEQ ID NO: 407255 - RNA, 22 nt, Homo sapiens
gcugcgucugacauccugaccu

SEQ ID NO: 407256 - RNA, 19 nt, Homo sapiens
gcugcugagaaucuagccu

SEQ ID NO: 407257 - RNA, 23 nt, Homo sapiens
gcugcuggaggaaaacugagacu

SEQ ID NO: 407258 - RNA, 22 nt, Homo sapiens
gcugcuggcacagacuucacac

SEQ ID NO: 407259 - RNA, 14 nt, Homo sapiens
gcuggaaugaugaa

SEQ ID NO: 407260 - RNA, 22 nt, Homo sapiens
gcuggagcuccuacauggugca

SEQ ID NO: 407261 - RNA, 18 nt, Homo sapiens
gcuggaguccuguucuca

SEQ ID NO: 407262 - RNA, 12 nt, Homo sapiens
gcuggagugcaa

SEQ ID NO: 407263 - RNA, 20 nt, Homo sapiens
gcuggagugcaguagcacga

SEQ ID NO: 407264 - RNA, 14 nt, Homo sapiens
gcuggagugcagug

SEQ ID NO: 407265 - RNA, 17 nt, Homo sapiens
gcuggauaaaaugaggu

SEQ ID NO: 407266 - RNA, 13 nt, Homo sapiens
gcuggauaccugu

SEQ ID NO: 407267 - RNA, 22 nt, Homo sapiens
gcuggauuacaggcaugugcca

SEQ ID NO: 407268 - RNA, 19 nt, Homo sapiens
gcuggcaugcagugcccuc

SEQ ID NO: 407269 - RNA, 16 nt, Homo sapiens
gcuggcggaaccuggc

SEQ ID NO: 407270 - RNA, 18 nt, Homo sapiens
gcuggcgucugucuucaa

SEQ ID NO: 407271 - RNA, 16 nt, Homo sapiens
gcuggcuccccaaagg

SEQ ID NO: 407272 - RNA, 20 nt, Homo sapiens
gcugggaaaaaaguuuugau

SEQ ID NO: 407273 - RNA, 14 nt, Homo sapiens
gcugggagagccaa

SEQ ID NO: 407274 - RNA, 20 nt, Homo sapiens
gcugggaguagcauggacuc

SEQ ID NO: 407275 - RNA, 16 nt, Homo sapiens
gcugggauuacaggug

SEQ ID NO: 407276 - RNA, 17 nt, Homo sapiens
gcugggauuacaggugu

SEQ ID NO: 407277 - RNA, 22 nt, Homo sapiens
gcuggggcccagcacaacugcu

SEQ ID NO: 407278 - RNA, 12 nt, Homo sapiens
gcugggugggcc

SEQ ID NO: 407279 - RNA, 12 nt, Homo sapiens
gcugggugguca

SEQ ID NO: 407280 - RNA, 21 nt, Homo sapiens
gcuggguuugggcaguggaga

SEQ ID NO: 407281 - RNA, 22 nt, Homo sapiens
gcugguauucucucuaugcaaa

SEQ ID NO: 407282 - RNA, 15 nt, Homo sapiens
gcuggugcacaugac

SEQ ID NO: 407283 - RNA, 21 nt, Homo sapiens
gcuggugucugagcuucagua

SEQ ID NO: 407284 - RNA, 20 nt, Homo sapiens
gcuguaccuggugcccugug

SEQ ID NO: 407285 - RNA, 22 nt, Homo sapiens
gcuguagcucccgagcuacucu

SEQ ID NO: 407286 - RNA, 17 nt, Homo sapiens
gcuguauacuguacuga

SEQ ID NO: 407287 - RNA, 23 nt, Homo sapiens
gcuguaucaaacuagugcaugaa

SEQ ID NO: 407288 - RNA, 15 nt, Homo sapiens
gcuguauugauauca

SEQ ID NO: 407289 - RNA, 17 nt, Homo sapiens
gcugucagcgccucaag

SEQ ID NO: 407290 - RNA, 14 nt, Homo sapiens
gcuguccuccagag

SEQ ID NO: 407291 - RNA, 19 nt, Homo sapiens
gcuguccucuuaagacacu

SEQ ID NO: 407292 - RNA, 18 nt, Homo sapiens
gcugucuggggccuuuau

SEQ ID NO: 407293 - RNA, 23 nt, Homo sapiens
gcugugaccauuuauaauguuag

SEQ ID NO: 407294 - RNA, 18 nt, Homo sapiens
gcugugagcuuucugaua

SEQ ID NO: 407295 - RNA, 20 nt, Homo sapiens
gcugugguuccuaagccugu

SEQ ID NO: 407296 - RNA, 22 nt, Homo sapiens
gcuguuggcugggggcaugggg

SEQ ID NO: 407297 - RNA, 13 nt, Homo sapiens
gcuuaaacaaagu

SEQ ID NO: 407298 - RNA, 13 nt, Homo sapiens
gcuuaaacauuuu

SEQ ID NO: 407299 - RNA, 14 nt, Homo sapiens
gcuuaauguuuauu

SEQ ID NO: 407300 - RNA, 19 nt, Homo sapiens
gcuuacaaugugcacugaa

SEQ ID NO: 407301 - RNA, 16 nt, Homo sapiens
gcuuagcugucucaga

SEQ ID NO: 407302 - RNA, 18 nt, Homo sapiens
gcuuaggugccaggcugu

SEQ ID NO: 407303 - RNA, 17 nt, Homo sapiens
gcuuauaaacacauuga

SEQ ID NO: 407304 - RNA, 23 nt, Homo sapiens
gcuuauaaauggcaccacaucuu

SEQ ID NO: 407305 - RNA, 21 nt, Homo sapiens
gcuuauacacuuacacuuuau

SEQ ID NO: 407306 - RNA, 19 nt, Homo sapiens
gcuuauaccagguuaccuc

SEQ ID NO: 407307 - RNA, 13 nt, Homo sapiens
gcuuaugaauaua

SEQ ID NO: 407308 - RNA, 15 nt, Homo sapiens
gcuucaaaacagaac

SEQ ID NO: 407309 - RNA, 12 nt, Homo sapiens
gcuucagaauug

SEQ ID NO: 407310 - RNA, 16 nt, Homo sapiens
gcuucauauaccagca

SEQ ID NO: 407311 - RNA, 20 nt, Homo sapiens
gcuucauauaccagcaauau

SEQ ID NO: 407312 - RNA, 22 nt, Homo sapiens
gcuucauuuccucugagcuguu

SEQ ID NO: 407313 - RNA, 18 nt, Homo sapiens
gcuucauuugugucaaug

SEQ ID NO: 407314 - RNA, 23 nt, Homo sapiens
gcuuccacucagcaucagcgugg

SEQ ID NO: 407315 - RNA, 23 nt, Homo sapiens
gcuuccauuugugugugugcaag

SEQ ID NO: 407316 - RNA, 23 nt, Homo sapiens
gcuucccggcgucccuaccuccu

SEQ ID NO: 407317 - RNA, 21 nt, Homo sapiens
gcuucccguucagcgucacau

SEQ ID NO: 407318 - RNA, 14 nt, Homo sapiens
gcuuccuaacugcu

SEQ ID NO: 407319 - RNA, 19 nt, Homo sapiens
gcuuccuccugguguggaa

SEQ ID NO: 407320 - RNA, 19 nt, Homo sapiens
gcuuccuugcucagugcaa

SEQ ID NO: 407321 - RNA, 15 nt, Homo sapiens
gcuucuccaugagac

SEQ ID NO: 407322 - RNA, 15 nt, Homo sapiens
gcuucucuugccuaa

SEQ ID NO: 407323 - RNA, 22 nt, Homo sapiens
gcuucucuugcuaccugugagc

SEQ ID NO: 407324 - RNA, 13 nt, Homo sapiens
gcuucugccuaag

SEQ ID NO: 407325 - RNA, 18 nt, Homo sapiens
gcuucuguaguacuccuu

SEQ ID NO: 407326 - RNA, 21 nt, Homo sapiens
gcuucuuaauauaacugccuu

SEQ ID NO: 407327 - RNA, 15 nt, Homo sapiens
gcuucuucaauggca

SEQ ID NO: 407328 - RNA, 20 nt, Homo sapiens
gcuucuugcuuguaaaaaua

SEQ ID NO: 407329 - RNA, 11 nt, Homo sapiens
gcuugaugcug

SEQ ID NO: 407330 - RNA, 16 nt, Homo sapiens
gcuugcaagggaccau

SEQ ID NO: 407331 - RNA, 16 nt, Homo sapiens
gcuugcauuucuuuau

SEQ ID NO: 407332 - RNA, 24 nt, Homo sapiens
gcuugcccagggugcagugugagu

SEQ ID NO: 407333 - RNA, 16 nt, Homo sapiens
gcuuggaaaggaaggu

SEQ ID NO: 407334 - RNA, 16 nt, Homo sapiens
gcuugggccacugccc

SEQ ID NO: 407335 - RNA, 13 nt, Homo sapiens
gcuugggcccagu

SEQ ID NO: 407336 - RNA, 16 nt, Homo sapiens
gcuugggcuuccauuu

SEQ ID NO: 407337 - RNA, 21 nt, Homo sapiens
gcuuggugguuaugucccaug

SEQ ID NO: 407338 - RNA, 17 nt, Homo sapiens
gcuugugggacuagccu

SEQ ID NO: 407339 - RNA, 21 nt, Homo sapiens
gcuuguucuuccucuuaccug

SEQ ID NO: 407340 - RNA, 20 nt, Homo sapiens
gcuuguuuacagcacuacuc

SEQ ID NO: 407341 - RNA, 17 nt, Homo sapiens
gcuuguuucuauacugu

SEQ ID NO: 407342 - RNA, 18 nt, Homo sapiens
gcuuuacauggguucaau

SEQ ID NO: 407343 - RNA, 13 nt, Homo sapiens
gcuuuaccuuuau

SEQ ID NO: 407344 - RNA, 17 nt, Homo sapiens
gcuuuacucugaauuuc

SEQ ID NO: 407345 - RNA, 20 nt, Homo sapiens
gcuuuaguccuagaggaccu

SEQ ID NO: 407346 - RNA, 12 nt, Homo sapiens
gcuuucaugacc

SEQ ID NO: 407347 - RNA, 12 nt, Homo sapiens
gcuuuccuccca

SEQ ID NO: 407348 - RNA, 17 nt, Homo sapiens
gcuuuccucccaaaggc

SEQ ID NO: 407349 - RNA, 23 nt, Homo sapiens
gcuuucguguaaauuauguaaug

SEQ ID NO: 407350 - RNA, 16 nt, Homo sapiens
gcuuucugaacucgcu

SEQ ID NO: 407351 - RNA, 17 nt, Homo sapiens
gcuuucuuuccaauccu

SEQ ID NO: 407352 - RNA, 23 nt, Homo sapiens
gcuuugaaggaaccaagugcauu

SEQ ID NO: 407353 - RNA, 23 nt, Homo sapiens
gcuuugcugaccaaaugccuggu

SEQ ID NO: 407354 - RNA, 19 nt, Homo sapiens
gcuuuggacgcacacagcu

SEQ ID NO: 407355 - RNA, 20 nt, Homo sapiens
gcuuuggacgcacacagcuu

SEQ ID NO: 407356 - RNA, 20 nt, Homo sapiens
gcuuuggagacgccucccca

SEQ ID NO: 407357 - RNA, 19 nt, Homo sapiens
gcuuugggaacacuggccu

SEQ ID NO: 407358 - RNA, 14 nt, Homo sapiens
gcuuuguugcccag

SEQ ID NO: 407359 - RNA, 18 nt, Homo sapiens
gcuuuuaagaaacacagg

SEQ ID NO: 407360 - RNA, 19 nt, Homo sapiens
gcuuuuaagaaacacaggg

SEQ ID NO: 407361 - RNA, 21 nt, Homo sapiens
gcuuuuaugauauauauaugc

SEQ ID NO: 407362 - RNA, 21 nt, Homo sapiens
gcuuuuccuauuuguuuucau

SEQ ID NO: 407363 - RNA, 20 nt, Homo sapiens
gcuuuugcuggucacugcca

SEQ ID NO: 407364 - RNA, 19 nt, Homo sapiens
gcuuuuggucucccuggga

SEQ ID NO: 407365 - RNA, 14 nt, Homo sapiens
gcuuuuuuacacaa

SEQ ID NO: 407366 - RNA, 19 nt, Homo sapiens
ggaaaaaugauccagugga

SEQ ID NO: 407367 - RNA, 14 nt, Homo sapiens
ggaaaaauguuucc

SEQ ID NO: 407368 - RNA, 15 nt, Homo sapiens
ggaaaccacacuucu

SEQ ID NO: 407369 - RNA, 13 nt, Homo sapiens
ggaaagccaguga

SEQ ID NO: 407370 - RNA, 18 nt, Homo sapiens
ggaaagcuuugaacaauu

SEQ ID NO: 407371 - RNA, 22 nt, Homo sapiens
ggaaaggcaucuaagacauuca

SEQ ID NO: 407372 - RNA, 13 nt, Homo sapiens
ggaaagguccugc

SEQ ID NO: 407373 - RNA, 14 nt, Homo sapiens
ggaaaggugcucaa

SEQ ID NO: 407374 - RNA, 17 nt, Homo sapiens
ggaaaggugcucaaaga

SEQ ID NO: 407375 - RNA, 19 nt, Homo sapiens
ggaaaguuugggaagggau

SEQ ID NO: 407376 - RNA, 16 nt, Homo sapiens
ggaaauaucauaaugu

SEQ ID NO: 407377 - RNA, 20 nt, Homo sapiens
ggaaauaucauaauguaaug

SEQ ID NO: 407378 - RNA, 13 nt, Homo sapiens
ggaaaugggagac

SEQ ID NO: 407379 - RNA, 20 nt, Homo sapiens
ggaaauucuucccugggggu

SEQ ID NO: 407380 - RNA, 19 nt, Homo sapiens
ggaaauuuggaagaugguu

SEQ ID NO: 407381 - RNA, 19 nt, Homo sapiens
ggaacauguaguuuuacuu

SEQ ID NO: 407382 - RNA, 18 nt, Homo sapiens
ggaacgugguucagagac

SEQ ID NO: 407383 - RNA, 20 nt, Homo sapiens
acuuugucacuucugcugua

SEQ ID NO: 407384 - RNA, 16 nt, Homo sapiens
acuuuguccgguggaa

SEQ ID NO: 407385 - RNA, 14 nt, Homo sapiens
acuuugugcaauau

SEQ ID NO: 407386 - RNA, 17 nt, Homo sapiens
acuuuuaaguugcugau

SEQ ID NO: 407387 - RNA, 22 nt, Homo sapiens
acuuuuaaguugcugaugaacu

SEQ ID NO: 407388 - RNA, 15 nt, Homo sapiens
acuuuucacaguaug

SEQ ID NO: 407389 - RNA, 17 nt, Homo sapiens
acuuuucuaacauaugu

SEQ ID NO: 407390 - RNA, 17 nt, Homo sapiens
acuuuugaaaagcuuuu

SEQ ID NO: 407391 - RNA, 17 nt, Homo sapiens
acuuuuuccuggcucau

SEQ ID NO: 407392 - RNA, 21 nt, Homo sapiens
acuuuuuccuggcucaucucu

SEQ ID NO: 407393 - RNA, 21 nt, Homo sapiens
acuuuuuguaaaaagcuucau

SEQ ID NO: 407394 - RNA, 15 nt, Homo sapiens
agaaaaaacaccacc

SEQ ID NO: 407395 - RNA, 19 nt, Homo sapiens
agaaaaagcacagcucuca

SEQ ID NO: 407396 - RNA, 14 nt, Homo sapiens
agaaaaauaaucuu

SEQ ID NO: 407397 - RNA, 13 nt, Homo sapiens
agaaaacacacaa

SEQ ID NO: 407398 - RNA, 21 nt, Homo sapiens
agaaaacccgacaacauuucu

SEQ ID NO: 407399 - RNA, 14 nt, Homo sapiens
agaaaacugucauu

SEQ ID NO: 407400 - RNA, 22 nt, Homo sapiens
agaaaagaugugcagauaucac

SEQ ID NO: 407401 - RNA, 12 nt, Homo sapiens
agaaaagccacg

SEQ ID NO: 407402 - RNA, 17 nt, Homo sapiens
agaaaauaauugcaaau

SEQ ID NO: 407403 - RNA, 13 nt, Homo sapiens
agaaaauaugaua

SEQ ID NO: 407404 - RNA, 22 nt, Homo sapiens
agaaaauauuauguguuuccau

SEQ ID NO: 407405 - RNA, 22 nt, Homo sapiens
agaaaaugaagcccuauuacuu

SEQ ID NO: 407406 - RNA, 20 nt, Homo sapiens
agaaaauggaugacaaagaa

SEQ ID NO: 407407 - RNA, 13 nt, Homo sapiens
agaaacaacagaa

SEQ ID NO: 407408 - RNA, 21 nt, Homo sapiens
agaaacaagguguacaacuuc

SEQ ID NO: 407409 - RNA, 21 nt, Homo sapiens
agaaaccuuauuguaccucuc

SEQ ID NO: 407410 - RNA, 17 nt, Homo sapiens
agaaacugaguccuguu

SEQ ID NO: 407411 - RNA, 22 nt, Homo sapiens
agaaacuuguaauggucucuga

SEQ ID NO: 407412 - RNA, 18 nt, Homo sapiens
agaaagaacgugaucucc

SEQ ID NO: 407413 - RNA, 19 nt, Homo sapiens
agaaagcagaggcuggccu

SEQ ID NO: 407414 - RNA, 15 nt, Homo sapiens
agaaagcauugccag

SEQ ID NO: 407415 - RNA, 18 nt, Homo sapiens
agaaaggguucuguaaaa

SEQ ID NO: 407416 - RNA, 15 nt, Homo sapiens
agaaagugugcuuua

SEQ ID NO: 407417 - RNA, 20 nt, Homo sapiens
agaaauaaaaucuaauuaau

SEQ ID NO: 407418 - RNA, 23 nt, Homo sapiens
agaaauaaauguaccugauguac

SEQ ID NO: 407419 - RNA, 23 nt, Homo sapiens
agaaauacaauucuacauuguca

SEQ ID NO: 407420 - RNA, 17 nt, Homo sapiens
agaaauaugaagcacuu

SEQ ID NO: 407421 - RNA, 14 nt, Homo sapiens
agaaauccauaucu

SEQ ID NO: 407422 - RNA, 14 nt, Homo sapiens
agaaaucccaguuc

SEQ ID NO: 407423 - RNA, 18 nt, Homo sapiens
agaaaugagcugcacucc

SEQ ID NO: 407424 - RNA, 20 nt, Homo sapiens
agaaaugcauaaaagacaag

SEQ ID NO: 407425 - RNA, 15 nt, Homo sapiens
agaaauguauccuga

SEQ ID NO: 407426 - RNA, 13 nt, Homo sapiens
agaaauucauuaa

SEQ ID NO: 407427 - RNA, 14 nt, Homo sapiens
agaaauugccucca

SEQ ID NO: 407428 - RNA, 16 nt, Homo sapiens
agaaauuuaaucagug

SEQ ID NO: 407429 - RNA, 16 nt, Homo sapiens
agaaauuuuaucucuu

SEQ ID NO: 407430 - RNA, 16 nt, Homo sapiens
agaacaaaaggcuuug

SEQ ID NO: 407431 - RNA, 17 nt, Homo sapiens
agaacaaauacaauuca

SEQ ID NO: 407432 - RNA, 23 nt, Homo sapiens
agaacaaugcuauaauauauaau

SEQ ID NO: 407433 - RNA, 18 nt, Homo sapiens
agaacacacugagacuug

SEQ ID NO: 407434 - RNA, 12 nt, Homo sapiens
agaacacauucu

SEQ ID NO: 407435 - RNA, 14 nt, Homo sapiens
agaacagccagacc

SEQ ID NO: 407436 - RNA, 22 nt, Homo sapiens
agaacauggugugugucucuga

SEQ ID NO: 407437 - RNA, 15 nt, Homo sapiens
agaaccaaaaagagg

SEQ ID NO: 407438 - RNA, 14 nt, Homo sapiens
agaaccacacuguu

SEQ ID NO: 407439 - RNA, 23 nt, Homo sapiens
agaaccugguggcuggaggcauu

SEQ ID NO: 407440 - RNA, 15 nt, Homo sapiens
agaacuaaaucauag

SEQ ID NO: 407441 - RNA, 20 nt, Homo sapiens
agaacucauuagcuguguga

SEQ ID NO: 407442 - RNA, 17 nt, Homo sapiens
agaacucgaugcacuga

SEQ ID NO: 407443 - RNA, 21 nt, Homo sapiens
agaacucgaugcacugaccug

SEQ ID NO: 407444 - RNA, 12 nt, Homo sapiens
agaacugaugac

SEQ ID NO: 407445 - RNA, 17 nt, Homo sapiens
agaacugccccaucucc

SEQ ID NO: 407446 - RNA, 14 nt, Homo sapiens
agaacugcuuagua

SEQ ID NO: 407447 - RNA, 17 nt, Homo sapiens
agaacugguucuugccu

SEQ ID NO: 407448 - RNA, 13 nt, Homo sapiens
agaacuguucauu

SEQ ID NO: 407449 - RNA, 15 nt, Homo sapiens
agaacuugauuugca

SEQ ID NO: 407450 - RNA, 15 nt, Homo sapiens
agaacuugucccuca

SEQ ID NO: 407451 - RNA, 14 nt, Homo sapiens
agaacuuuccagga

SEQ ID NO: 407452 - RNA, 22 nt, Homo sapiens
agaacuuuucauagaugaacuu

SEQ ID NO: 407453 - RNA, 22 nt, Homo sapiens
agaagaacagcuguuccugugu

SEQ ID NO: 407454 - RNA, 13 nt, Homo sapiens
agaagacacgugu

SEQ ID NO: 407455 - RNA, 19 nt, Homo sapiens
agaagaccucccugugaga

SEQ ID NO: 407456 - RNA, 14 nt, Homo sapiens
agaagagacuggga

SEQ ID NO: 407457 - RNA, 21 nt, Homo sapiens
agaagcagaagggcagaagau

SEQ ID NO: 407458 - RNA, 22 nt, Homo sapiens
agaagcccccaccuucccucca

SEQ ID NO: 407459 - RNA, 21 nt, Homo sapiens
agaagccuccaagccugccuc

SEQ ID NO: 407460 - RNA, 23 nt, Homo sapiens
agaagcuaaauccuuuacuguua

SEQ ID NO: 407461 - RNA, 20 nt, Homo sapiens
agaagcuaauguaggacugu

SEQ ID NO: 407462 - RNA, 11 nt, Homo sapiens
agaagcucucg

SEQ ID NO: 407463 - RNA, 14 nt, Homo sapiens
agaagcuucuugcu

SEQ ID NO: 407464 - RNA, 14 nt, Homo sapiens
agaaggaagacuuu

SEQ ID NO: 407465 - RNA, 15 nt, Homo sapiens
agaaggagaggcucu

SEQ ID NO: 407466 - RNA, 16 nt, Homo sapiens
agaagggagauucaaa

SEQ ID NO: 407467 - RNA, 17 nt, Homo sapiens
agaagggggccaugagg

SEQ ID NO: 407468 - RNA, 22 nt, Homo sapiens
agaagggggucucuucuuccag

SEQ ID NO: 407469 - RNA, 13 nt, Homo sapiens
agaaggugccgug

SEQ ID NO: 407470 - RNA, 18 nt, Homo sapiens
agaaguaauuccucugau

SEQ ID NO: 407471 - RNA, 23 nt, Homo sapiens
agaagucucuuaauucugaugcu

SEQ ID NO: 407472 - RNA, 21 nt, Homo sapiens
agaaguggaguuuucugugag

SEQ ID NO: 407473 - RNA, 16 nt, Homo sapiens
agaaguggcauaaaug

SEQ ID NO: 407474 - RNA, 13 nt, Homo sapiens
agaauaaagccuc

SEQ ID NO: 407475 - RNA, 22 nt, Homo sapiens
agaauaaagccucugugcugca

SEQ ID NO: 407476 - RNA, 23 nt, Homo sapiens
agaauaaagccucugugcugcac

SEQ ID NO: 407477 - RNA, 20 nt, Homo sapiens
agaauaagaaaacaaucaca

SEQ ID NO: 407478 - RNA, 17 nt, Homo sapiens
agaauacacugugacuu

SEQ ID NO: 407479 - RNA, 12 nt, Homo sapiens
agaaucaagucu

SEQ ID NO: 407480 - RNA, 13 nt, Homo sapiens
agaaucagccugg

SEQ ID NO: 407481 - RNA, 18 nt, Homo sapiens
agaaucauuaauacaaag

SEQ ID NO: 407482 - RNA, 18 nt, Homo sapiens
agaaucccuguucauugu

SEQ ID NO: 407483 - RNA, 22 nt, Homo sapiens
agaaucgcuugaaccugggaag

SEQ ID NO: 407484 - RNA, 21 nt, Homo sapiens
agaaucuguagaggagccugg

SEQ ID NO: 407485 - RNA, 21 nt, Homo sapiens
agaaugagaacauccaucuac

SEQ ID NO: 407486 - RNA, 18 nt, Homo sapiens
agaauggcuuuggucucu

SEQ ID NO: 407487 - RNA, 16 nt, Homo sapiens
agaauggugggcucca

SEQ ID NO: 407488 - RNA, 18 nt, Homo sapiens
agaaugucauuugcuaau

SEQ ID NO: 407489 - RNA, 18 nt, Homo sapiens
agaaugugcagugucuug

SEQ ID NO: 407490 - RNA, 21 nt, Homo sapiens
agaauguuauccaacuauuaa

SEQ ID NO: 407491 - RNA, 21 nt, Homo sapiens
agaauuaaugacaacaaaagg

SEQ ID NO: 407492 - RNA, 14 nt, Homo sapiens
agaauuaguggcac

SEQ ID NO: 407493 - RNA, 16 nt, Homo sapiens
agaauuauaagucaca

SEQ ID NO: 407494 - RNA, 21 nt, Homo sapiens
agaauuuauucaauuccucug

SEQ ID NO: 407495 - RNA, 22 nt, Homo sapiens
agaauuucauucauuugugcuu

SEQ ID NO: 407496 - RNA, 21 nt, Homo sapiens
agaauuuuauuuauaaaugag

SEQ ID NO: 407497 - RNA, 23 nt, Homo sapiens
guucucagagccaaguccucccu

SEQ ID NO: 407498 - RNA, 19 nt, Homo sapiens
guucuccuagacugacccu

SEQ ID NO: 407499 - RNA, 15 nt, Homo sapiens
guucugacccuggua

SEQ ID NO: 407500 - RNA, 19 nt, Homo sapiens
guucugauauuaauuuauc

SEQ ID NO: 407501 - RNA, 21 nt, Homo sapiens
guucugccacuugcacugugc

SEQ ID NO: 407502 - RNA, 16 nt, Homo sapiens
guucugguaugaacuu

SEQ ID NO: 407503 - RNA, 12 nt, Homo sapiens
guucugucauau

SEQ ID NO: 407504 - RNA, 19 nt, Homo sapiens
guucuuauugaaaacaaca

SEQ ID NO: 407505 - RNA, 19 nt, Homo sapiens
guucuuguaaaacugugac

SEQ ID NO: 407506 - RNA, 21 nt, Homo sapiens
guucuuuaauguuguccagga

SEQ ID NO: 407507 - RNA, 20 nt, Homo sapiens
guugacaccaagaaaccacu

SEQ ID NO: 407508 - RNA, 12 nt, Homo sapiens
guugaguuugcu

SEQ ID NO: 407509 - RNA, 16 nt, Homo sapiens
guugauuacuuuucag

SEQ ID NO: 407510 - RNA, 20 nt, Homo sapiens
guugcaaauacauggauaac

SEQ ID NO: 407511 - RNA, 19 nt, Homo sapiens
guugcaugccuauguacuc

SEQ ID NO: 407512 - RNA, 18 nt, Homo sapiens
guugcuaaugacagugga

SEQ ID NO: 407513 - RNA, 15 nt, Homo sapiens
guugcugcaucuccc

SEQ ID NO: 407514 - RNA, 21 nt, Homo sapiens
guuggacaaaccgagugcaau

SEQ ID NO: 407515 - RNA, 23 nt, Homo sapiens
guuggacaaaccgagugcaauga

SEQ ID NO: 407516 - RNA, 14 nt, Homo sapiens
guuggcaguguuug

SEQ ID NO: 407517 - RNA, 20 nt, Homo sapiens
guuggccauguucauucaca

SEQ ID NO: 407518 - RNA, 18 nt, Homo sapiens
guuggccugcacuggugu

SEQ ID NO: 407519 - RNA, 20 nt, Homo sapiens
guuggugacugaaacauuca

SEQ ID NO: 407520 - RNA, 16 nt, Homo sapiens
guugguuuacuguguu

SEQ ID NO: 407521 - RNA, 17 nt, Homo sapiens
guuguaauaaaacuuau

SEQ ID NO: 407522 - RNA, 16 nt, Homo sapiens
guuguaccacugcuaa

SEQ ID NO: 407523 - RNA, 17 nt, Homo sapiens
guugucauugacuucaa

SEQ ID NO: 407524 - RNA, 15 nt, Homo sapiens
guuguccugugucau

SEQ ID NO: 407525 - RNA, 17 nt, Homo sapiens
guuguucacaccacagg

SEQ ID NO: 407526 - RNA, 22 nt, Homo sapiens
guuuaaaagcaaaacugcaaau

SEQ ID NO: 407527 - RNA, 14 nt, Homo sapiens
guuuaaacagucaa

SEQ ID NO: 407528 - RNA, 16 nt, Homo sapiens
guuuaauuacaacagc

SEQ ID NO: 407529 - RNA, 22 nt, Homo sapiens
guuuacaacaaacacugugaug

SEQ ID NO: 407530 - RNA, 16 nt, Homo sapiens
guuuacagcacuacuc

SEQ ID NO: 407531 - RNA, 14 nt, Homo sapiens
cucgagauguaucc

SEQ ID NO: 407532 - RNA, 23 nt, Homo sapiens
cucgauaaaucuaacaguuacuc

SEQ ID NO: 407533 - RNA, 14 nt, Homo sapiens
cucgcccgcccacu

SEQ ID NO: 407534 - RNA, 12 nt, Homo sapiens
cucgccuaggcc

SEQ ID NO: 407535 - RNA, 23 nt, Homo sapiens
cucggaaauggaaugugccccug

SEQ ID NO: 407536 - RNA, 13 nt, Homo sapiens
cucggucuuaccc

SEQ ID NO: 407537 - RNA, 17 nt, Homo sapiens
cucgucugucaaugaca

SEQ ID NO: 407538 - RNA, 21 nt, Homo sapiens
cucgucuuccucucucucacc

SEQ ID NO: 407539 - RNA, 16 nt, Homo sapiens
cucgugaccuacaggg

SEQ ID NO: 407540 - RNA, 16 nt, Homo sapiens
cucgugccguccuccc

SEQ ID NO: 407541 - RNA, 20 nt, Homo sapiens
cucguggccccgugaacuca

SEQ ID NO: 407542 - RNA, 19 nt, Homo sapiens
cucuaaaaauaaaaugaug

SEQ ID NO: 407543 - RNA, 15 nt, Homo sapiens
cucuaaaagggggcu

SEQ ID NO: 407544 - RNA, 14 nt, Homo sapiens
cucuaaaugcaguu

SEQ ID NO: 407545 - RNA, 21 nt, Homo sapiens
cucuaacagcucaggaucucu

SEQ ID NO: 407546 - RNA, 21 nt, Homo sapiens
cucuaagaaauggcuuuccac

SEQ ID NO: 407547 - RNA, 17 nt, Homo sapiens
cucuaagccaacuuuaa

SEQ ID NO: 407548 - RNA, 13 nt, Homo sapiens
cucuagacaucua

SEQ ID NO: 407549 - RNA, 17 nt, Homo sapiens
cucuagacaucuagucu

SEQ ID NO: 407550 - RNA, 15 nt, Homo sapiens
cucuagacugacuca

SEQ ID NO: 407551 - RNA, 13 nt, Homo sapiens
cucuagccaaaug

SEQ ID NO: 407552 - RNA, 17 nt, Homo sapiens
cucuaggccuguugccu

SEQ ID NO: 407553 - RNA, 14 nt, Homo sapiens
cucuagucagcaca

SEQ ID NO: 407554 - RNA, 23 nt, Homo sapiens
cucuagucccuguguucugcaca

SEQ ID NO: 407555 - RNA, 13 nt, Homo sapiens
cucuagugccaua

SEQ ID NO: 407556 - RNA, 15 nt, Homo sapiens
cucuaguucuuaaca

SEQ ID NO: 407557 - RNA, 15 nt, Homo sapiens
cucuauaacagaucc

SEQ ID NO: 407558 - RNA, 15 nt, Homo sapiens
cucuauauauacaug

SEQ ID NO: 407559 - RNA, 21 nt, Homo sapiens
cucuaucauguugaagucaaa

SEQ ID NO: 407560 - RNA, 17 nt, Homo sapiens
cucuaucugaaccaccc

SEQ ID NO: 407561 - RNA, 13 nt, Homo sapiens
cucuaucugcaau

SEQ ID NO: 407562 - RNA, 20 nt, Homo sapiens
cucuaugagagauagcuuau

SEQ ID NO: 407563 - RNA, 15 nt, Homo sapiens
cucuauuuagcauga

SEQ ID NO: 407564 - RNA, 12 nt, Homo sapiens
cucucaacuuac

SEQ ID NO: 407565 - RNA, 19 nt, Homo sapiens
cucucaccuaaaaaaagag

SEQ ID NO: 407566 - RNA, 16 nt, Homo sapiens
cucucaccuacuuccu

SEQ ID NO: 407567 - RNA, 12 nt, Homo sapiens
cucucacuuugg

SEQ ID NO: 407568 - RNA, 14 nt, Homo sapiens
cucucagcuucuaa

SEQ ID NO: 407569 - RNA, 21 nt, Homo sapiens
cucucaggcaugccuguguga

SEQ ID NO: 407570 - RNA, 21 nt, Homo sapiens
cucucaucccccauuaaccag

SEQ ID NO: 407571 - RNA, 21 nt, Homo sapiens
cucuccaaggguggugaccaa

SEQ ID NO: 407572 - RNA, 13 nt, Homo sapiens
cucuccacaccca

SEQ ID NO: 407573 - RNA, 20 nt, Homo sapiens
cucucccaaguccaguguga

SEQ ID NO: 407574 - RNA, 20 nt, Homo sapiens
cucucccaugcacacaaaca

SEQ ID NO: 407575 - RNA, 18 nt, Homo sapiens
cucucccgccagacuguu

SEQ ID NO: 407576 - RNA, 20 nt, Homo sapiens
cucuccuccccccaagcuca

SEQ ID NO: 407577 - RNA, 20 nt, Homo sapiens
cucuccuggcacccagagaa

SEQ ID NO: 407578 - RNA, 15 nt, Homo sapiens
cucucgacaguaucc

SEQ ID NO: 407579 - RNA, 18 nt, Homo sapiens
cucucgacaguauccaca

SEQ ID NO: 407580 - RNA, 18 nt, Homo sapiens
cucucuaaaaauaaaaug

SEQ ID NO: 407581 - RNA, 17 nt, Homo sapiens
cucucugagaugccccu

SEQ ID NO: 407582 - RNA, 17 nt, Homo sapiens
cucucugggacucuccu

SEQ ID NO: 407583 - RNA, 14 nt, Homo sapiens
cucucuucaaucuc

SEQ ID NO: 407584 - RNA, 12 nt, Homo sapiens
cucucuuuacau

SEQ ID NO: 407585 - RNA, 14 nt, Homo sapiens
cucucuuuacauuu

SEQ ID NO: 407586 - RNA, 21 nt, Homo sapiens
cucugacaguauuaacaucaa

SEQ ID NO: 407587 - RNA, 16 nt, Homo sapiens
cucugacccuagcucu

SEQ ID NO: 407588 - RNA, 19 nt, Homo sapiens
cucugacccugaugcuuaa

SEQ ID NO: 407589 - RNA, 20 nt, Homo sapiens
cucugagacagcaguaucac

SEQ ID NO: 407590 - RNA, 21 nt, Homo sapiens
cucugagaguagagucacugg

SEQ ID NO: 407591 - RNA, 20 nt, Homo sapiens
cucugagcaaauguggcucc

SEQ ID NO: 407592 - RNA, 23 nt, Homo sapiens
cucugcaagcccacuggccagcu

SEQ ID NO: 407593 - RNA, 20 nt, Homo sapiens
cucugcagacucguucucgu

SEQ ID NO: 407594 - RNA, 20 nt, Homo sapiens
cucugcagcccucagauuau

SEQ ID NO: 407595 - RNA, 12 nt, Homo sapiens
cucugcauagac

SEQ ID NO: 407596 - RNA, 11 nt, Homo sapiens
cucugccagug

SEQ ID NO: 407597 - RNA, 22 nt, Homo sapiens
cucugccggucccccaugccac

SEQ ID NO: 407598 - RNA, 22 nt, Homo sapiens
cucugccuccaggagggcauca

SEQ ID NO: 407599 - RNA, 19 nt, Homo sapiens
cucugcgagcaacagugcc

SEQ ID NO: 407600 - RNA, 16 nt, Homo sapiens
cucugcuaaaacaaca

SEQ ID NO: 407601 - RNA, 18 nt, Homo sapiens
cucugcuaccaucucauu

SEQ ID NO: 407602 - RNA, 19 nt, Homo sapiens
cucugcuaugucugugaug

SEQ ID NO: 407603 - RNA, 16 nt, Homo sapiens
cucugcugacuucuga

SEQ ID NO: 407604 - RNA, 17 nt, Homo sapiens
cucugcuguagagccau

SEQ ID NO: 407605 - RNA, 16 nt, Homo sapiens
cucugcuucaguccac

SEQ ID NO: 407606 - RNA, 20 nt, Homo sapiens
cucugcuucaguccacagua

SEQ ID NO: 407607 - RNA, 21 nt, Homo sapiens
cucugcuugagucagguuuga

SEQ ID NO: 407608 - RNA, 22 nt, Homo sapiens
cucuggaaaacucaggauucuc

SEQ ID NO: 407609 - RNA, 14 nt, Homo sapiens
cucuggaagaccug

SEQ ID NO: 407610 - RNA, 16 nt, Homo sapiens
cucuggacaugauuua

SEQ ID NO: 407611 - RNA, 13 nt, Homo sapiens
cucuggcuggaga

SEQ ID NO: 407612 - RNA, 17 nt, Homo sapiens
cucuggcuucugugaug

SEQ ID NO: 407613 - RNA, 21 nt, Homo sapiens
cucugguggcaggugccuugu

SEQ ID NO: 407614 - RNA, 19 nt, Homo sapiens
cucuguaggucauuggcca

SEQ ID NO: 407615 - RNA, 13 nt, Homo sapiens
cucuguauguacu

SEQ ID NO: 407616 - RNA, 14 nt, Homo sapiens
cucugucauaugca

SEQ ID NO: 407617 - RNA, 13 nt, Homo sapiens
cucugucucaaaa

SEQ ID NO: 407618 - RNA, 18 nt, Homo sapiens
cucugucuucacuauuca

SEQ ID NO: 407619 - RNA, 21 nt, Homo sapiens
cucugugaacgauuuagaaag

SEQ ID NO: 407620 - RNA, 18 nt, Homo sapiens
cucugugcaggugcugcc

SEQ ID NO: 407621 - RNA, 15 nt, Homo sapiens
cucugugcucugaau

SEQ ID NO: 407622 - RNA, 12 nt, Homo sapiens
cucugugcugca

SEQ ID NO: 407623 - RNA, 20 nt, Homo sapiens
cucuuaaguacugaaauaca

SEQ ID NO: 407624 - RNA, 15 nt, Homo sapiens
cucuuagcacacuca

SEQ ID NO: 407625 - RNA, 19 nt, Homo sapiens
cucuuagcuuucucagggg

SEQ ID NO: 407626 - RNA, 14 nt, Homo sapiens
cucuuaguccuccc

SEQ ID NO: 407627 - RNA, 15 nt, Homo sapiens
cugauaauaauugau

SEQ ID NO: 407628 - RNA, 17 nt, Homo sapiens
cugauaauaauugauca

SEQ ID NO: 407629 - RNA, 21 nt, Homo sapiens
cugauaauguauaugaacuua

SEQ ID NO: 407630 - RNA, 16 nt, Homo sapiens
cugauaauguauugca

SEQ ID NO: 407631 - RNA, 21 nt, Homo sapiens
cugauagauauccuuggcaca

SEQ ID NO: 407632 - RNA, 15 nt, Homo sapiens
cugauauacaauuag

SEQ ID NO: 407633 - RNA, 21 nt, Homo sapiens
cugauauugccgcacuagggg

SEQ ID NO: 407634 - RNA, 13 nt, Homo sapiens
cugauauuggugu

SEQ ID NO: 407635 - RNA, 18 nt, Homo sapiens
cugaucauuaaagccuga

SEQ ID NO: 407636 - RNA, 16 nt, Homo sapiens
cugaucauuacauggc

SEQ ID NO: 407637 - RNA, 18 nt, Homo sapiens
cugauccagagcacagau

SEQ ID NO: 407638 - RNA, 21 nt, Homo sapiens
cugaucccauaaagaaaguga

SEQ ID NO: 407639 - RNA, 11 nt, Homo sapiens
cugaucugcag

SEQ ID NO: 407640 - RNA, 19 nt, Homo sapiens
cugaucuuauucuguggug

SEQ ID NO: 407641 - RNA, 22 nt, Homo sapiens
cugaugaaaaauaugugcuuga

SEQ ID NO: 407642 - RNA, 15 nt, Homo sapiens
cugaugacacugaga

SEQ ID NO: 407643 - RNA, 22 nt, Homo sapiens
cugaugaugucucuuguagaag

SEQ ID NO: 407644 - RNA, 13 nt, Homo sapiens
cugaugcacuguu

SEQ ID NO: 407645 - RNA, 19 nt, Homo sapiens
cugaugcagaaagaccgug

SEQ ID NO: 407646 - RNA, 21 nt, Homo sapiens
cugauggaccgggugggccug

SEQ ID NO: 407647 - RNA, 19 nt, Homo sapiens
cugauggagcucagaauuc

SEQ ID NO: 407648 - RNA, 12 nt, Homo sapiens
cugaugugccag

SEQ ID NO: 407649 - RNA, 22 nt, Homo sapiens
cugauuaauccauuuuaacaaa

SEQ ID NO: 407650 - RNA, 19 nt, Homo sapiens
cugauuagaaaugaccaau

SEQ ID NO: 407651 - RNA, 23 nt, Homo sapiens
cugauucaauaaaaugcacugac

SEQ ID NO: 407652 - RNA, 15 nt, Homo sapiens
cugauuggggccuca

SEQ ID NO: 407653 - RNA, 14 nt, Homo sapiens
cugauuugcaaaug

SEQ ID NO: 407654 - RNA, 19 nt, Homo sapiens
cugauuugcaaaugcacau

SEQ ID NO: 407655 - RNA, 14 nt, Homo sapiens
cugcaacucaagga

SEQ ID NO: 407656 - RNA, 12 nt, Homo sapiens
cugcaagcucca

SEQ ID NO: 407657 - RNA, 14 nt, Homo sapiens
cugcaauacauuaa

SEQ ID NO: 407658 - RNA, 18 nt, Homo sapiens
cugcacaggaaaugcaag

SEQ ID NO: 407659 - RNA, 24 nt, Homo sapiens
cugcacauaugcaagccauuugca

SEQ ID NO: 407660 - RNA, 16 nt, Homo sapiens
cugcacccacccagga

SEQ ID NO: 407661 - RNA, 19 nt, Homo sapiens
cugcaccccugcaguuuga

SEQ ID NO: 407662 - RNA, 14 nt, Homo sapiens
cugcacuaauauaa

SEQ ID NO: 407663 - RNA, 14 nt, Homo sapiens
cugcacuacugaca

SEQ ID NO: 407664 - RNA, 15 nt, Homo sapiens
cugcacuucauaucu

SEQ ID NO: 407665 - RNA, 15 nt, Homo sapiens
cugcagaacuccuuu

SEQ ID NO: 407666 - RNA, 14 nt, Homo sapiens
cugcagaggauuua

SEQ ID NO: 407667 - RNA, 16 nt, Homo sapiens
uaaaccucaaaauguc

SEQ ID NO: 407668 - RNA, 16 nt, Homo sapiens
uaaaccuccuucggga

SEQ ID NO: 407669 - RNA, 10 nt, Homo sapiens
uaaaccugga

SEQ ID NO: 407670 - RNA, 22 nt, Homo sapiens
uaaacgaggcaaugacugugag

SEQ ID NO: 407671 - RNA, 17 nt, Homo sapiens
uaaacgugaugugcuca

SEQ ID NO: 407672 - RNA, 11 nt, Homo sapiens
uaaacuacuga

SEQ ID NO: 407673 - RNA, 20 nt, Homo sapiens
uaaacucacaacucucuggu

SEQ ID NO: 407674 - RNA, 16 nt, Homo sapiens
uaaacucuccuuugau

SEQ ID NO: 407675 - RNA, 15 nt, Homo sapiens
uaaacucugcacuua

SEQ ID NO: 407676 - RNA, 17 nt, Homo sapiens
uaaacugacuuuuuccc

SEQ ID NO: 407677 - RNA, 13 nt, Homo sapiens
uaaacugugagau

SEQ ID NO: 407678 - RNA, 17 nt, Homo sapiens
uaaacugugucuguccc

SEQ ID NO: 407679 - RNA, 13 nt, Homo sapiens
uaaagaacauacc

SEQ ID NO: 407680 - RNA, 16 nt, Homo sapiens
uaaagaugaucuacuc

SEQ ID NO: 407681 - RNA, 17 nt, Homo sapiens
uaaagaugaucuacuca

SEQ ID NO: 407682 - RNA, 11 nt, Homo sapiens
uaaagcaaagu

SEQ ID NO: 407683 - RNA, 18 nt, Homo sapiens
uaaagcauuccccaaaga

SEQ ID NO: 407684 - RNA, 21 nt, Homo sapiens
uaaagccaacacccugucuaa

SEQ ID NO: 407685 - RNA, 21 nt, Homo sapiens
uaaagccucagcaacagccag

SEQ ID NO: 407686 - RNA, 17 nt, Homo sapiens
uaaagccucugugcugc

SEQ ID NO: 407687 - RNA, 22 nt, Homo sapiens
uaaagcugccggcacagaacuu

SEQ ID NO: 407688 - RNA, 13 nt, Homo sapiens
uaaaggcaucuac

SEQ ID NO: 407689 - RNA, 15 nt, Homo sapiens
uaaaggccaugugaa

SEQ ID NO: 407690 - RNA, 13 nt, Homo sapiens
uaaaggucccuua

SEQ ID NO: 407691 - RNA, 17 nt, Homo sapiens
uaaaggucccuuagccc

SEQ ID NO: 407692 - RNA, 17 nt, Homo sapiens
uaaagguuuauguggaa

SEQ ID NO: 407693 - RNA, 15 nt, Homo sapiens
uaaagucaggauuua

SEQ ID NO: 407694 - RNA, 20 nt, Homo sapiens
uaaagugagcaugcuuucug

SEQ ID NO: 407695 - RNA, 14 nt, Homo sapiens
uaaaguuacuugaa

SEQ ID NO: 407696 - RNA, 22 nt, Homo sapiens
uaaaguuuaaauaccaguacuu

SEQ ID NO: 407697 - RNA, 18 nt, Homo sapiens
uaaauaaaaaguauacuu

SEQ ID NO: 407698 - RNA, 21 nt, Homo sapiens
uaaauaaaauucauuucuaca

SEQ ID NO: 407699 - RNA, 15 nt, Homo sapiens
uaaauaaaucauuaa

SEQ ID NO: 407700 - RNA, 18 nt, Homo sapiens
uaaauaagagauuuggag

SEQ ID NO: 407701 - RNA, 17 nt, Homo sapiens
uaaauaauuuuacaugu

SEQ ID NO: 407702 - RNA, 18 nt, Homo sapiens
uaaauaccaguacuugag

SEQ ID NO: 407703 - RNA, 16 nt, Homo sapiens
uaaauacugcuugacc

SEQ ID NO: 407704 - RNA, 17 nt, Homo sapiens
uaaauacuguaacacug

SEQ ID NO: 407705 - RNA, 18 nt, Homo sapiens
uaaauacuguaacacugu

SEQ ID NO: 407706 - RNA, 20 nt, Homo sapiens
uaaauacuguaacacuguau

SEQ ID NO: 407707 - RNA, 21 nt, Homo sapiens
uaaauacuguaacacuguaua

SEQ ID NO: 407708 - RNA, 15 nt, Homo sapiens
uaaauacuuuaacuu

SEQ ID NO: 407709 - RNA, 21 nt, Homo sapiens
uaaauagcuaaauggcaacaa

SEQ ID NO: 407710 - RNA, 14 nt, Homo sapiens
uaaauagugcagaa

SEQ ID NO: 407711 - RNA, 16 nt, Homo sapiens
uaaauauacuaugaaa

SEQ ID NO: 407712 - RNA, 16 nt, Homo sapiens
uaaauauagagaugug

SEQ ID NO: 407713 - RNA, 20 nt, Homo sapiens
uaaauauauauauauuucuc

SEQ ID NO: 407714 - RNA, 17 nt, Homo sapiens
uaaauauugaaacacug

SEQ ID NO: 407715 - RNA, 18 nt, Homo sapiens
uaaauauuuauguagaug

SEQ ID NO: 407716 - RNA, 19 nt, Homo sapiens
uaaaucaaugucacuuaaa

SEQ ID NO: 407717 - RNA, 12 nt, Homo sapiens
uaaaucaauucu

SEQ ID NO: 407718 - RNA, 18 nt, Homo sapiens
uaaaucaguuaauggcuc

SEQ ID NO: 407719 - RNA, 19 nt, Homo sapiens
uaaaucauggcuaagcuua

SEQ ID NO: 407720 - RNA, 12 nt, Homo sapiens
uaaaucauuuca

SEQ ID NO: 407721 - RNA, 15 nt, Homo sapiens
uaaauccaacucuga

SEQ ID NO: 407722 - RNA, 21 nt, Homo sapiens
uaaauccucagguaguacugg

SEQ ID NO: 407723 - RNA, 21 nt, Homo sapiens
uaaaucugucugauucuaugc

SEQ ID NO: 407724 - RNA, 13 nt, Homo sapiens
uaaaucugugaug

SEQ ID NO: 407725 - RNA, 14 nt, Homo sapiens
uaaaucugugauga

SEQ ID NO: 407726 - RNA, 20 nt, Homo sapiens
uaaaucugugaugauccuca

SEQ ID NO: 407727 - RNA, 15 nt, Homo sapiens
uaaaucuuccaaagu

SEQ ID NO: 407728 - RNA, 20 nt, Homo sapiens
uaaaugaaaaaaaugaucua

SEQ ID NO: 407729 - RNA, 21 nt, Homo sapiens
uaaaugaagugcccacuaaga

SEQ ID NO: 407730 - RNA, 11 nt, Homo sapiens
uaaaugcccug

SEQ ID NO: 407731 - RNA, 11 nt, Homo sapiens
uaaaugcuuug

SEQ ID NO: 407732 - RNA, 19 nt, Homo sapiens
uaaauggaacaaacaauga

SEQ ID NO: 407733 - RNA, 18 nt, Homo sapiens
uaaauguacuacauuugc

SEQ ID NO: 407734 - RNA, 15 nt, Homo sapiens
uaaaugucccaaaua

SEQ ID NO: 407735 - RNA, 22 nt, Homo sapiens
uaaaugugagaacuguucucau

SEQ ID NO: 407736 - RNA, 16 nt, Homo sapiens
uaaauguuaugacucc

SEQ ID NO: 407737 - RNA, 22 nt, Homo sapiens
uaaauguuauuuaagaaugaca

SEQ ID NO: 407738 - RNA, 15 nt, Homo sapiens
uaaauguucuaacag

SEQ ID NO: 407739 - RNA, 14 nt, Homo sapiens
uaaauuaacauuau

SEQ ID NO: 407740 - RNA, 16 nt, Homo sapiens
uaaauuauggcauuuu

SEQ ID NO: 407741 - RNA, 15 nt, Homo sapiens
uaaauucaugcugcu

SEQ ID NO: 407742 - RNA, 22 nt, Homo sapiens
uaaauuccacacuaccacauua

SEQ ID NO: 407743 - RNA, 12 nt, Homo sapiens
uaaauucugcuc

SEQ ID NO: 407744 - RNA, 16 nt, Homo sapiens
uaaauuuaacugcaua

SEQ ID NO: 407745 - RNA, 15 nt, Homo sapiens
uaacaaaacaagaaa

SEQ ID NO: 407746 - RNA, 21 nt, Homo sapiens
uaacaacuaauuauaaugcaa

SEQ ID NO: 407747 - RNA, 15 nt, Homo sapiens
uaacaagccaaacau

SEQ ID NO: 407748 - RNA, 14 nt, Homo sapiens
uaacaaguggguga

SEQ ID NO: 407749 - RNA, 21 nt, Homo sapiens
uaacaauaacuacuguguucc

SEQ ID NO: 407750 - RNA, 15 nt, Homo sapiens
uaacaaugaccuuua

SEQ ID NO: 407751 - RNA, 13 nt, Homo sapiens
uaacaaugcaugc

SEQ ID NO: 407752 - RNA, 17 nt, Homo sapiens
uaacaaugcaugcuuug

SEQ ID NO: 407753 - RNA, 19 nt, Homo sapiens
uaacacaaguccugugaau

SEQ ID NO: 407754 - RNA, 14 nt, Homo sapiens
uaacacuaauaaua

SEQ ID NO: 407755 - RNA, 17 nt, Homo sapiens
uaacacuggagugguaa

SEQ ID NO: 407756 - RNA, 20 nt, Homo sapiens
uaacagaggcaggaguggca

SEQ ID NO: 407757 - RNA, 19 nt, Homo sapiens
uaacagaucagaacaugaa

SEQ ID NO: 407758 - RNA, 19 nt, Homo sapiens
uaacagcuaauaagagaua

SEQ ID NO: 407759 - RNA, 17 nt, Homo sapiens
uaacaguuuuccaugaa

SEQ ID NO: 407760 - RNA, 14 nt, Homo sapiens
uaacaucaaagacu

SEQ ID NO: 407761 - RNA, 17 nt, Homo sapiens
uaacauggaaguacuau

SEQ ID NO: 407762 - RNA, 19 nt, Homo sapiens
uaacauggacugcuucauc

SEQ ID NO: 407763 - RNA, 17 nt, Homo sapiens
uaacauguuaucaaauc

SEQ ID NO: 407764 - RNA, 15 nt, Homo sapiens
uaacauucaguacuu

SEQ ID NO: 407765 - RNA, 17 nt, Homo sapiens
uaacauuggugcaaaga

SEQ ID NO: 407766 - RNA, 22 nt, Homo sapiens
uaacauuucauuaaccaaagaa

SEQ ID NO: 407767 - RNA, 23 nt, Homo sapiens
uaacauuucauuaaccaaagaaa

SEQ ID NO: 407768 - RNA, 20 nt, Homo sapiens
uaaccaaauaaaacauaaua

SEQ ID NO: 407769 - RNA, 19 nt, Homo sapiens
uaaccauccccaacuccau

SEQ ID NO: 407770 - RNA, 17 nt, Homo sapiens
uaacccaggaaugaaga

SEQ ID NO: 407771 - RNA, 15 nt, Homo sapiens
uaaccccaccuugcc

SEQ ID NO: 407772 - RNA, 18 nt, Homo sapiens
uaaccccugccuggauuu

SEQ ID NO: 407773 - RNA, 15 nt, Homo sapiens
uaacccucacccaca

SEQ ID NO: 407774 - RNA, 14 nt, Homo sapiens
uaacccuccaccuc

SEQ ID NO: 407775 - RNA, 21 nt, Homo sapiens
uaaccgagccagcagcugaag

SEQ ID NO: 407776 - RNA, 14 nt, Homo sapiens
uaaccuacuagaca

SEQ ID NO: 407777 - RNA, 20 nt, Homo sapiens
uaaccugggcuuaaguuuua

SEQ ID NO: 407778 - RNA, 13 nt, Homo sapiens
uaacggcacugug

SEQ ID NO: 407779 - RNA, 14 nt, Homo sapiens
uaacuauauuugcu

SEQ ID NO: 407780 - RNA, 19 nt, Homo sapiens
uaacucaaaggguggaaua

SEQ ID NO: 407781 - RNA, 15 nt, Homo sapiens
uaacucagacauucc

SEQ ID NO: 407782 - RNA, 17 nt, Homo sapiens
uaacucugcacuacucc

SEQ ID NO: 407783 - RNA, 13 nt, Homo sapiens
uaacucugcauag

SEQ ID NO: 407784 - RNA, 13 nt, Homo sapiens
uaacucuugcuca

SEQ ID NO: 407785 - RNA, 22 nt, Homo sapiens
uaacugacuuaguucuucccuu

SEQ ID NO: 407786 - RNA, 17 nt, Homo sapiens
uaacugccuuguguaca

SEQ ID NO: 407787 - RNA, 15 nt, Homo sapiens
uaacugucaagucau

SEQ ID NO: 407788 - RNA, 16 nt, Homo sapiens
uaacuguuaguauuaa

SEQ ID NO: 407789 - RNA, 16 nt, Homo sapiens
uaacuuaacauugcau

SEQ ID NO: 407790 - RNA, 20 nt, Homo sapiens
uaacuuacaagaauggaauu

SEQ ID NO: 407791 - RNA, 13 nt, Homo sapiens
uaacuuauuuucc

SEQ ID NO: 407792 - RNA, 20 nt, Homo sapiens
uaacuucaaggcccauaucu

SEQ ID NO: 407793 - RNA, 16 nt, Homo sapiens
uaacuuuaaguuucag

SEQ ID NO: 407794 - RNA, 13 nt, Homo sapiens
uaacuuucuugcu

SEQ ID NO: 407795 - RNA, 16 nt, Homo sapiens
uaacuuugacuuucuu

SEQ ID NO: 407796 - RNA, 22 nt, Homo sapiens
uaagaaauagacagucaggcua

SEQ ID NO: 407797 - RNA, 20 nt, Homo sapiens
uaagaaauauauuugauaaa

SEQ ID NO: 407798 - RNA, 14 nt, Homo sapiens
uaagaacugcccag

SEQ ID NO: 407799 - RNA, 23 nt, Homo sapiens
uaagaaugacaggcuuuuacuuc

SEQ ID NO: 407800 - RNA, 18 nt, Homo sapiens
cugcagccaggacugggg

SEQ ID NO: 407801 - RNA, 14 nt, Homo sapiens
cugcagcccacaga

SEQ ID NO: 407802 - RNA, 22 nt, Homo sapiens
cugcagcccacagaggacagug

SEQ ID NO: 407803 - RNA, 18 nt, Homo sapiens
cugcagcucccagaagcu

SEQ ID NO: 407804 - RNA, 22 nt, Homo sapiens
cugcaggaacgagcacuggcca

SEQ ID NO: 407805 - RNA, 18 nt, Homo sapiens
cugcaggguccccaagga

SEQ ID NO: 407806 - RNA, 15 nt, Homo sapiens
cugcaggucacugaa

SEQ ID NO: 407807 - RNA, 16 nt, Homo sapiens
cugcagugucugugau

SEQ ID NO: 407808 - RNA, 14 nt, Homo sapiens
cugcauauugugau

SEQ ID NO: 407809 - RNA, 16 nt, Homo sapiens
cugcaucaagauguga

SEQ ID NO: 407810 - RNA, 20 nt, Homo sapiens
cugcaucaagaugugacaug

SEQ ID NO: 407811 - RNA, 16 nt, Homo sapiens
cugcaucugucugucc

SEQ ID NO: 407812 - RNA, 16 nt, Homo sapiens
cugcauguaaaaucuu

SEQ ID NO: 407813 - RNA, 15 nt, Homo sapiens
cugcaugucucaggc

SEQ ID NO: 407814 - RNA, 22 nt, Homo sapiens
cugcauucuuuuaaaguuuuau

SEQ ID NO: 407815 - RNA, 19 nt, Homo sapiens
cugcauuuauaaaugugug

SEQ ID NO: 407816 - RNA, 20 nt, Homo sapiens
cugcauuucaaguuaauucu

SEQ ID NO: 407817 - RNA, 15 nt, Homo sapiens
cugcauuuuacugua

SEQ ID NO: 407818 - RNA, 18 nt, Homo sapiens
cugcauuuuacuguacag

SEQ ID NO: 407819 - RNA, 22 nt, Homo sapiens
cugccaagcccucaauaagcca

SEQ ID NO: 407820 - RNA, 13 nt, Homo sapiens
cugccacauucua

SEQ ID NO: 407821 - RNA, 19 nt, Homo sapiens
cugccaccacgucugccag

SEQ ID NO: 407822 - RNA, 16 nt, Homo sapiens
cugccacgguccuuug

SEQ ID NO: 407823 - RNA, 16 nt, Homo sapiens
cugccacuugcacugu

SEQ ID NO: 407824 - RNA, 21 nt, Homo sapiens
cugccaggcaugguagcucau

SEQ ID NO: 407825 - RNA, 16 nt, Homo sapiens
cugccaugauagcugg

SEQ ID NO: 407826 - RNA, 11 nt, Homo sapiens
cugccauuucc

SEQ ID NO: 407827 - RNA, 12 nt, Homo sapiens
cugccauuuccc

SEQ ID NO: 407828 - RNA, 21 nt, Homo sapiens
cugcccaaagcagcacuuaua

SEQ ID NO: 407829 - RNA, 13 nt, Homo sapiens
cugcccacggcca

SEQ ID NO: 407830 - RNA, 20 nt, Homo sapiens
cugccccaaacaaauaugca

SEQ ID NO: 407831 - RNA, 16 nt, Homo sapiens
cugcccgacucagguc

SEQ ID NO: 407832 - RNA, 16 nt, Homo sapiens
cugcccgagagcucuu

SEQ ID NO: 407833 - RNA, 15 nt, Homo sapiens
cugcccgcacacccu

SEQ ID NO: 407834 - RNA, 18 nt, Homo sapiens
cugcccugccaccugucu

SEQ ID NO: 407835 - RNA, 16 nt, Homo sapiens
cugcccuucagcaucc

SEQ ID NO: 407836 - RNA, 17 nt, Homo sapiens
cugccucagccuuccaa

SEQ ID NO: 407837 - RNA, 17 nt, Homo sapiens
cugccucaugcucucua

SEQ ID NO: 407838 - RNA, 19 nt, Homo sapiens
cugccuccccaacccugcc

SEQ ID NO: 407839 - RNA, 23 nt, Homo sapiens
cugccucccgaguucaagcgauu

SEQ ID NO: 407840 - RNA, 23 nt, Homo sapiens
cugccugaaacagccauguccaa

SEQ ID NO: 407841 - RNA, 14 nt, Homo sapiens
cugccugcagagca

SEQ ID NO: 407842 - RNA, 19 nt, Homo sapiens
cugccuguuauaacucugc

SEQ ID NO: 407843 - RNA, 16 nt, Homo sapiens
cugccuuggacaccau

SEQ ID NO: 407844 - RNA, 21 nt, Homo sapiens
cugcgcuccucugcagccuga

SEQ ID NO: 407845 - RNA, 19 nt, Homo sapiens
cugcggggggcaccagagg

SEQ ID NO: 407846 - RNA, 22 nt, Homo sapiens
cugcguaggagagaacagggau

SEQ ID NO: 407847 - RNA, 20 nt, Homo sapiens
cugcgucugacauccugacc

SEQ ID NO: 407848 - RNA, 20 nt, Homo sapiens
cugcuaaggcuccuccuugc

SEQ ID NO: 407849 - RNA, 15 nt, Homo sapiens
cugcuaauaauaaau

SEQ ID NO: 407850 - RNA, 19 nt, Homo sapiens
cugcuacccagaaccuuuu

SEQ ID NO: 407851 - RNA, 15 nt, Homo sapiens
cugcuacuuaauucc

SEQ ID NO: 407852 - RNA, 19 nt, Homo sapiens
cugcuagguagaggcauuu

SEQ ID NO: 407853 - RNA, 19 nt, Homo sapiens
cugcuaugucugugauguc

SEQ ID NO: 407854 - RNA, 17 nt, Homo sapiens
cugcucacgucugugag

SEQ ID NO: 407855 - RNA, 14 nt, Homo sapiens
cugcucaugacaca

SEQ ID NO: 407856 - RNA, 13 nt, Homo sapiens
cugcuccacccuu

SEQ ID NO: 407857 - RNA, 14 nt, Homo sapiens
cugcuccagugcag

SEQ ID NO: 407858 - RNA, 15 nt, Homo sapiens
cugcuccagugcagg

SEQ ID NO: 407859 - RNA, 12 nt, Homo sapiens
cugcuccaugca

SEQ ID NO: 407860 - RNA, 19 nt, Homo sapiens
cugcuccuggagccuuuga

SEQ ID NO: 407861 - RNA, 15 nt, Homo sapiens
cugcucuaagcacac

SEQ ID NO: 407862 - RNA, 16 nt, Homo sapiens
cugcucuacccaugag

SEQ ID NO: 407863 - RNA, 17 nt, Homo sapiens
cugcucugugccuggga

SEQ ID NO: 407864 - RNA, 22 nt, Homo sapiens
cugcucuuucucugccagugac

SEQ ID NO: 407865 - RNA, 23 nt, Homo sapiens
cugcucuuucucugccagugaca

SEQ ID NO: 407866 - RNA, 20 nt, Homo sapiens
cugcugaaaaccaucuggcc

SEQ ID NO: 407867 - RNA, 16 nt, Homo sapiens
cugcugaaugcauuca

SEQ ID NO: 407868 - RNA, 13 nt, Homo sapiens
cugcugagugaau

SEQ ID NO: 407869 - RNA, 19 nt, Homo sapiens
cugcugagugcaccacuuc

SEQ ID NO: 407870 - RNA, 17 nt, Homo sapiens
cugcugcaaacauugua

SEQ ID NO: 407871 - RNA, 17 nt, Homo sapiens
cugcugcauagcucuau

SEQ ID NO: 407872 - RNA, 17 nt, Homo sapiens
cugcugcuugaaacuuc

SEQ ID NO: 407873 - RNA, 14 nt, Homo sapiens
cugcuggccaaagu

SEQ ID NO: 407874 - RNA, 12 nt, Homo sapiens
cugcuguauacu

SEQ ID NO: 407875 - RNA, 15 nt, Homo sapiens
cugcuguauacugua

SEQ ID NO: 407876 - RNA, 15 nt, Homo sapiens
cugcuguaugauauu

SEQ ID NO: 407877 - RNA, 21 nt, Homo sapiens
cugcuguccaggaacuuucca

SEQ ID NO: 407878 - RNA, 17 nt, Homo sapiens
cugcuguggcaucagga

SEQ ID NO: 407879 - RNA, 13 nt, Homo sapiens
cugcuuacuaaug

SEQ ID NO: 407880 - RNA, 22 nt, Homo sapiens
cugcuuagugucccuuaccugg

SEQ ID NO: 407881 - RNA, 23 nt, Homo sapiens
cugcuucaaacucaaacacagag

SEQ ID NO: 407882 - RNA, 15 nt, Homo sapiens
cugcuucugugcauu

SEQ ID NO: 407883 - RNA, 14 nt, Homo sapiens
cugcuugaacccag

SEQ ID NO: 407884 - RNA, 19 nt, Homo sapiens
cugcuugaccguacucuca

SEQ ID NO: 407885 - RNA, 16 nt, Homo sapiens
cugcuuguacuaagcc

SEQ ID NO: 407886 - RNA, 19 nt, Homo sapiens
cugcuuuucugaggacuca

SEQ ID NO: 407887 - RNA, 20 nt, Homo sapiens
cuggaaaccuguuaugccaa

SEQ ID NO: 407888 - RNA, 17 nt, Homo sapiens
gagagccuggugcugcu

SEQ ID NO: 407889 - RNA, 11 nt, Homo sapiens
gagagcucacu

SEQ ID NO: 407890 - RNA, 23 nt, Homo sapiens
gagaggaaaaguaaggugcaguu

SEQ ID NO: 407891 - RNA, 19 nt, Homo sapiens
gagaggagagaaugagaga

SEQ ID NO: 407892 - RNA, 16 nt, Homo sapiens
gagagggggauguuuc

SEQ ID NO: 407893 - RNA, 13 nt, Homo sapiens
gagagggggccac

SEQ ID NO: 407894 - RNA, 20 nt, Homo sapiens
gagagggggcucuccaaagg

SEQ ID NO: 407895 - RNA, 13 nt, Homo sapiens
gagaggggggcca

SEQ ID NO: 407896 - RNA, 23 nt, Homo sapiens
gagaggucucagguucuuuccau

SEQ ID NO: 407897 - RNA, 14 nt, Homo sapiens
gagagugaaaccau

SEQ ID NO: 407898 - RNA, 17 nt, Homo sapiens
gagagugcagaucugug

SEQ ID NO: 407899 - RNA, 21 nt, Homo sapiens
gagagugcagaucugugcuca

SEQ ID NO: 407900 - RNA, 21 nt, Homo sapiens
gagaguguggaaaaaaaaaga

SEQ ID NO: 407901 - RNA, 21 nt, Homo sapiens
gagaguuacauguuaacugag

SEQ ID NO: 407902 - RNA, 22 nt, Homo sapiens
gagaguuacauguuaacugagg

SEQ ID NO: 407903 - RNA, 22 nt, Homo sapiens
gagauagcuuauuacucugaua

SEQ ID NO: 407904 - RNA, 17 nt, Homo sapiens
gagaucuuaagauucca

SEQ ID NO: 407905 - RNA, 21 nt, Homo sapiens
gagaucuuaagauuccauuuu

SEQ ID NO: 407906 - RNA, 17 nt, Homo sapiens
gagaugaauaugagcuc

SEQ ID NO: 407907 - RNA, 20 nt, Homo sapiens
gagaugagccccacguggag

SEQ ID NO: 407908 - RNA, 17 nt, Homo sapiens
gagauggaauaaagccc

SEQ ID NO: 407909 - RNA, 19 nt, Homo sapiens
gagaugggaugcuugccua

SEQ ID NO: 407910 - RNA, 17 nt, Homo sapiens
gagaugggguuucacca

SEQ ID NO: 407911 - RNA, 22 nt, Homo sapiens
gagauggguugaguuugcugua

SEQ ID NO: 407912 - RNA, 15 nt, Homo sapiens
gagauguaugaaggc

SEQ ID NO: 407913 - RNA, 19 nt, Homo sapiens
gagauguaugcccaaagac

SEQ ID NO: 407914 - RNA, 12 nt, Homo sapiens
gagaugucuucg

SEQ ID NO: 407915 - RNA, 19 nt, Homo sapiens
gagauucagugaacuaauu

SEQ ID NO: 407916 - RNA, 23 nt, Homo sapiens
gagauugcucuggggcuugcuau

SEQ ID NO: 407917 - RNA, 11 nt, Homo sapiens
gagauuugcca

SEQ ID NO: 407918 - RNA, 16 nt, Homo sapiens
gagauuugccaaaaac

SEQ ID NO: 407919 - RNA, 15 nt, Homo sapiens
gagcaaaaugcugcu

SEQ ID NO: 407920 - RNA, 23 nt, Homo sapiens
gagcaaacuaacuugacuuuuaa

SEQ ID NO: 407921 - RNA, 18 nt, Homo sapiens
gagcaaagugcagguuau

SEQ ID NO: 407922 - RNA, 14 nt, Homo sapiens
gagcaagacccugu

SEQ ID NO: 407923 - RNA, 20 nt, Homo sapiens
gagcaccuacuacaugcaag

SEQ ID NO: 407924 - RNA, 22 nt, Homo sapiens
gagcacugagggucuggugcca

SEQ ID NO: 407925 - RNA, 22 nt, Homo sapiens
gagcacuguccaguauucuacc

SEQ ID NO: 407926 - RNA, 16 nt, Homo sapiens
gagcagaccacauaua

SEQ ID NO: 407927 - RNA, 15 nt, Homo sapiens
gagcagagaaggcca

SEQ ID NO: 407928 - RNA, 22 nt, Homo sapiens
gagcagcuccccaggagcucag

SEQ ID NO: 407929 - RNA, 18 nt, Homo sapiens
gagcagggcccucagagg

SEQ ID NO: 407930 - RNA, 18 nt, Homo sapiens
gagcaggugagcaaaaug

SEQ ID NO: 407931 - RNA, 17 nt, Homo sapiens
gagcaguagaagccugc

SEQ ID NO: 407932 - RNA, 17 nt, Homo sapiens
gagcaguccugccucag

SEQ ID NO: 407933 - RNA, 17 nt, Homo sapiens
gagcaguggcuggucca

SEQ ID NO: 407934 - RNA, 14 nt, Homo sapiens
gagcaucugucuca

SEQ ID NO: 407935 - RNA, 23 nt, Homo sapiens
gagcaugcucaguuggugcugcu

SEQ ID NO: 407936 - RNA, 21 nt, Homo sapiens
gagcaugggacugugccuuug

SEQ ID NO: 407937 - RNA, 12 nt, Homo sapiens
gagcauuuccaa

SEQ ID NO: 407938 - RNA, 12 nt, Homo sapiens
gagccaaccucg

SEQ ID NO: 407939 - RNA, 21 nt, Homo sapiens
gagccaaguucacaccacugc

SEQ ID NO: 407940 - RNA, 13 nt, Homo sapiens
gagccaggguaga

SEQ ID NO: 407941 - RNA, 20 nt, Homo sapiens
gagcccaagaaaguaauuag

SEQ ID NO: 407942 - RNA, 15 nt, Homo sapiens
gagcccccacccggg

SEQ ID NO: 407943 - RNA, 20 nt, Homo sapiens
gagcccccuguccuucccac

SEQ ID NO: 407944 - RNA, 23 nt, Homo sapiens
gagccccuuggggguucagggaa

SEQ ID NO: 407945 - RNA, 21 nt, Homo sapiens
gagcccgcuuuuguucuuccc

SEQ ID NO: 407946 - RNA, 20 nt, Homo sapiens
gagcccuccuggaauggagc

SEQ ID NO: 407947 - RNA, 12 nt, Homo sapiens
gagcccuugcac

SEQ ID NO: 407948 - RNA, 19 nt, Homo sapiens
gagccgcaccuugucaugu

SEQ ID NO: 407949 - RNA, 17 nt, Homo sapiens
gagccgugcagcuggga

SEQ ID NO: 407950 - RNA, 22 nt, Homo sapiens
gagccuacugucuccuucccac

SEQ ID NO: 407951 - RNA, 17 nt, Homo sapiens
gagccuccacugccucu

SEQ ID NO: 407952 - RNA, 17 nt, Homo sapiens
gagccucgggacaucaa

SEQ ID NO: 407953 - RNA, 17 nt, Homo sapiens
gagccucuccuugcccc

SEQ ID NO: 407954 - RNA, 12 nt, Homo sapiens
gagccucuuagu

SEQ ID NO: 407955 - RNA, 12 nt, Homo sapiens
gagccugaggca

SEQ ID NO: 407956 - RNA, 15 nt, Homo sapiens
gagccuggaagacac

SEQ ID NO: 407957 - RNA, 15 nt, Homo sapiens
gagccuggcaggugc

SEQ ID NO: 407958 - RNA, 21 nt, Homo sapiens
gagccuuugaucuucaggaug

SEQ ID NO: 407959 - RNA, 13 nt, Homo sapiens
gagccuuugcaca

SEQ ID NO: 407960 - RNA, 19 nt, Homo sapiens
gagcgccccucccuaguga

SEQ ID NO: 407961 - RNA, 13 nt, Homo sapiens
gagcgggggcuaa

SEQ ID NO: 407962 - RNA, 17 nt, Homo sapiens
gagcguuaacacaguaa

SEQ ID NO: 407963 - RNA, 22 nt, Homo sapiens
gagcuaagcagaauaauggaau

SEQ ID NO: 407964 - RNA, 14 nt, Homo sapiens
gagcuagcccaguc

SEQ ID NO: 407965 - RNA, 22 nt, Homo sapiens
gagcuaguuaaacagugccauu

SEQ ID NO: 407966 - RNA, 16 nt, Homo sapiens
gagcuaugggaaggcc

SEQ ID NO: 407967 - RNA, 17 nt, Homo sapiens
gagcuauggugaggugu

SEQ ID NO: 407968 - RNA, 23 nt, Homo sapiens
gagcucacaguacaauguuucag

SEQ ID NO: 407969 - RNA, 16 nt, Homo sapiens
gagcuccgaugcccgc

SEQ ID NO: 407970 - RNA, 19 nt, Homo sapiens
gagcucgcauuugucaaug

SEQ ID NO: 407971 - RNA, 19 nt, Homo sapiens
ucccuggucccucguccac

SEQ ID NO: 407972 - RNA, 22 nt, Homo sapiens
ucccugguggggugugcaugcc

SEQ ID NO: 407973 - RNA, 15 nt, Homo sapiens
ucccuuaauaaacuc

SEQ ID NO: 407974 - RNA, 16 nt, Homo sapiens
ucccuuaauaaacuca

SEQ ID NO: 407975 - RNA, 17 nt, Homo sapiens
ucccuuaauaaacucac

SEQ ID NO: 407976 - RNA, 19 nt, Homo sapiens
ucccuuaauaaacucacaa

SEQ ID NO: 407977 - RNA, 20 nt, Homo sapiens
ucccuuagccccgaguuuaa

SEQ ID NO: 407978 - RNA, 16 nt, Homo sapiens
ucccuuggguucugau

SEQ ID NO: 407979 - RNA, 18 nt, Homo sapiens
ucccuugugucuguugcu

SEQ ID NO: 407980 - RNA, 22 nt, Homo sapiens
ucccuuuccagauauucaaguc

SEQ ID NO: 407981 - RNA, 19 nt, Homo sapiens
ucccuuuguugcacacuca

SEQ ID NO: 407982 - RNA, 20 nt, Homo sapiens
uccgacuucucuagacaucu

SEQ ID NO: 407983 - RNA, 22 nt, Homo sapiens
uccgaggcaaagagaaaagcca

SEQ ID NO: 407984 - RNA, 15 nt, Homo sapiens
uccgcaccagcugcu

SEQ ID NO: 407985 - RNA, 20 nt, Homo sapiens
uccgcaguuccugucccuuc

SEQ ID NO: 407986 - RNA, 19 nt, Homo sapiens
uccgccaauggcuuccagc

SEQ ID NO: 407987 - RNA, 13 nt, Homo sapiens
uccgccauuccaa

SEQ ID NO: 407988 - RNA, 22 nt, Homo sapiens
uccgcugccaccacgucugcca

SEQ ID NO: 407989 - RNA, 15 nt, Homo sapiens
uccgcugucacccag

SEQ ID NO: 407990 - RNA, 21 nt, Homo sapiens
uccgcugucacccagcaaggc

SEQ ID NO: 407991 - RNA, 17 nt, Homo sapiens
uccgcuuucucuugcug

SEQ ID NO: 407992 - RNA, 20 nt, Homo sapiens
uccgggcaggggagccaggg

SEQ ID NO: 407993 - RNA, 15 nt, Homo sapiens
uccguuaugccaccu

SEQ ID NO: 407994 - RNA, 19 nt, Homo sapiens
uccguucccaccucugagg

SEQ ID NO: 407995 - RNA, 19 nt, Homo sapiens
uccuaaaaaucuguggcaa

SEQ ID NO: 407996 - RNA, 19 nt, Homo sapiens
uccuaaaguagacuucauu

SEQ ID NO: 407997 - RNA, 22 nt, Homo sapiens
uccuaaauauccaaagacugua

SEQ ID NO: 407998 - RNA, 14 nt, Homo sapiens
uccuaaauuuccag

SEQ ID NO: 407999 - RNA, 20 nt, Homo sapiens
uccuaacaaguagcacccug

SEQ ID NO: 408000 - RNA, 23 nt, Homo sapiens
uccuaacaggaugaaaguucccc

SEQ ID NO: 408001 - RNA, 16 nt, Homo sapiens
uccuaaggacacacua

SEQ ID NO: 408002 - RNA, 22 nt, Homo sapiens
uccuaauaugcuuuacaaucug

SEQ ID NO: 408003 - RNA, 11 nt, Homo sapiens
uccuacaaggg

SEQ ID NO: 408004 - RNA, 16 nt, Homo sapiens
uccuaccaaccucuga

SEQ ID NO: 408005 - RNA, 16 nt, Homo sapiens
uccuacuccuaccugg

SEQ ID NO: 408006 - RNA, 21 nt, Homo sapiens
uccuacuuuacauaugcuuua

SEQ ID NO: 408007 - RNA, 14 nt, Homo sapiens
uccuagacuugaaa

SEQ ID NO: 408008 - RNA, 16 nt, Homo sapiens
uccuagcuuaucuccc

SEQ ID NO: 408009 - RNA, 19 nt, Homo sapiens
uccuaggagagccaaccuc

SEQ ID NO: 408010 - RNA, 19 nt, Homo sapiens
uccuaggggccgagggaaa

SEQ ID NO: 408011 - RNA, 17 nt, Homo sapiens
uccuauaauucuauuga

SEQ ID NO: 408012 - RNA, 21 nt, Homo sapiens
uccuauccuuggagagcagcu

SEQ ID NO: 408013 - RNA, 21 nt, Homo sapiens
uccuaugcgcucaugagcguc

SEQ ID NO: 408014 - RNA, 21 nt, Homo sapiens
uccuauuaaucuucagcugaa

SEQ ID NO: 408015 - RNA, 13 nt, Homo sapiens
uccucaaccuuga

SEQ ID NO: 408016 - RNA, 13 nt, Homo sapiens
uccucacaugccc

SEQ ID NO: 408017 - RNA, 22 nt, Homo sapiens
ucgucccguucuccauucugcu

SEQ ID NO: 408018 - RNA, 19 nt, Homo sapiens
ucguccuuagaauacugua

SEQ ID NO: 408019 - RNA, 16 nt, Homo sapiens
ucgucugucaaugaca

SEQ ID NO: 408020 - RNA, 17 nt, Homo sapiens
ucgucugucaaugacau

SEQ ID NO: 408021 - RNA, 15 nt, Homo sapiens
ucguggguaaauaua

SEQ ID NO: 408022 - RNA, 15 nt, Homo sapiens
ucguucucugccuca

SEQ ID NO: 408023 - RNA, 22 nt, Homo sapiens
ucuaaaaacaguuaagacaaca

SEQ ID NO: 408024 - RNA, 13 nt, Homo sapiens
ucuaaaacauucu

SEQ ID NO: 408025 - RNA, 16 nt, Homo sapiens
ucuaaaacucauacaa

SEQ ID NO: 408026 - RNA, 20 nt, Homo sapiens
ucuaaagauggaaaaaccac

SEQ ID NO: 408027 - RNA, 13 nt, Homo sapiens
ucuaaaggggaca

SEQ ID NO: 408028 - RNA, 19 nt, Homo sapiens
ucuaaaugauuaucuugaa

SEQ ID NO: 408029 - RNA, 23 nt, Homo sapiens
ucuaaaugcauauccugagccau

SEQ ID NO: 408030 - RNA, 18 nt, Homo sapiens
ucuaaauugaucauucau

SEQ ID NO: 408031 - RNA, 21 nt, Homo sapiens
ucuaacagaucagaacaugaa

SEQ ID NO: 408032 - RNA, 18 nt, Homo sapiens
ucuaaccaaagguuuugc

SEQ ID NO: 408033 - RNA, 14 nt, Homo sapiens
ucuaaccauguauc

SEQ ID NO: 408034 - RNA, 15 nt, Homo sapiens
ucuaacccacccuca

SEQ ID NO: 408035 - RNA, 19 nt, Homo sapiens
ucuaacuuuugugugaaau

SEQ ID NO: 408036 - RNA, 20 nt, Homo sapiens
ucuaagauaguaacaaugaa

SEQ ID NO: 408037 - RNA, 21 nt, Homo sapiens
ucuaaggccaaggccucagga

SEQ ID NO: 408038 - RNA, 12 nt, Homo sapiens
ucuaaguauuua

SEQ ID NO: 408039 - RNA, 11 nt, Homo sapiens
ucuaauaaccu

SEQ ID NO: 408040 - RNA, 14 nt, Homo sapiens
ucuaauccaugugc

SEQ ID NO: 408041 - RNA, 21 nt, Homo sapiens
ucuaauccaugugcugcugug

SEQ ID NO: 408042 - RNA, 18 nt, Homo sapiens
ucuaauggcuguggcauu

SEQ ID NO: 408043 - RNA, 21 nt, Homo sapiens
ucuaauuuugugcucuuuccu

SEQ ID NO: 408044 - RNA, 13 nt, Homo sapiens
ucuacaaccagag

SEQ ID NO: 408045 - RNA, 19 nt, Homo sapiens
ucuacaacugaucauuugc

SEQ ID NO: 408046 - RNA, 14 nt, Homo sapiens
ucuacaggcauuua

SEQ ID NO: 408047 - RNA, 21 nt, Homo sapiens
ucuacaguuaggguugaguua

SEQ ID NO: 408048 - RNA, 21 nt, Homo sapiens
ucuacauuucaccuacuuugu

SEQ ID NO: 408049 - RNA, 16 nt, Homo sapiens
ucuaccccugcuccca

SEQ ID NO: 408050 - RNA, 14 nt, Homo sapiens
ucuaccucuuccag

SEQ ID NO: 408051 - RNA, 19 nt, Homo sapiens
ucuaccugccucagccucc

SEQ ID NO: 408052 - RNA, 16 nt, Homo sapiens
ucuacuaccacaagga

SEQ ID NO: 408053 - RNA, 17 nt, Homo sapiens
ucuacuaccacaaggaa

SEQ ID NO: 408054 - RNA, 17 nt, Homo sapiens
ucuacucuugucauuuu

SEQ ID NO: 408055 - RNA, 17 nt, Homo sapiens
ucuacugaacaguccau

SEQ ID NO: 408056 - RNA, 17 nt, Homo sapiens
ucuacugaucaacagac

SEQ ID NO: 408057 - RNA, 21 nt, Homo sapiens
ucuacugcuuggauccauaca

SEQ ID NO: 408058 - RNA, 21 nt, Homo sapiens
ucuacugucuggaagacaugu

SEQ ID NO: 408059 - RNA, 18 nt, Homo sapiens
ucuacuucauagcuccuu

SEQ ID NO: 408060 - RNA, 21 nt, Homo sapiens
ucuacuuuccaggcuaguccg

SEQ ID NO: 408061 - RNA, 12 nt, Homo sapiens
ucuagaacagcc

SEQ ID NO: 408062 - RNA, 17 nt, Homo sapiens
ucuagaacagccagacc

SEQ ID NO: 408063 - RNA, 17 nt, Homo sapiens
ucuagacugacucacau

SEQ ID NO: 408064 - RNA, 16 nt, Homo sapiens
ucuagacuugugcuga

SEQ ID NO: 408065 - RNA, 21 nt, Homo sapiens
ucuagaguaauuaucugugau

SEQ ID NO: 408066 - RNA, 15 nt, Homo sapiens
ucuagauaacauuca

SEQ ID NO: 408067 - RNA, 16 nt, Homo sapiens
ucuagauaacauucau

SEQ ID NO: 408068 - RNA, 16 nt, Homo sapiens
ucuagcaccaggacuc

SEQ ID NO: 408069 - RNA, 21 nt, Homo sapiens
ucuagccugaauucuuuucaa

SEQ ID NO: 408070 - RNA, 18 nt, Homo sapiens
ucuagcuaccuguauuau

SEQ ID NO: 408071 - RNA, 13 nt, Homo sapiens
ucuaggaaagugc

SEQ ID NO: 408072 - RNA, 21 nt, Homo sapiens
ucuaggacuagaaaaacuugg

SEQ ID NO: 408073 - RNA, 15 nt, Homo sapiens
ucuaggguuuuccaa

SEQ ID NO: 408074 - RNA, 22 nt, Homo sapiens
ucuagguaggggcccacuucac

SEQ ID NO: 408075 - RNA, 16 nt, Homo sapiens
ucuagguuuaacucag

SEQ ID NO: 408076 - RNA, 22 nt, Homo sapiens
ucuaguccuauucuauugcagu

SEQ ID NO: 408077 - RNA, 13 nt, Homo sapiens
ucuagugaaugaa

SEQ ID NO: 408078 - RNA, 18 nt, Homo sapiens
ucuagugucuuuugccuu

SEQ ID NO: 408079 - RNA, 20 nt, Homo sapiens
ucuaguuaaccuagaaguau

SEQ ID NO: 408080 - RNA, 15 nt, Homo sapiens
ucuaguuuugucaaa

SEQ ID NO: 408081 - RNA, 15 nt, Homo sapiens
ucuauaaacauaugc

SEQ ID NO: 408082 - RNA, 13 nt, Homo sapiens
ucuauaaauucaa

SEQ ID NO: 408083 - RNA, 20 nt, Homo sapiens
ucuauacaaauuuucagaag

SEQ ID NO: 408084 - RNA, 13 nt, Homo sapiens
ucuauagcagauu

SEQ ID NO: 408085 - RNA, 23 nt, Homo sapiens
ucuauagguuuuuaaauggaauu

SEQ ID NO: 408086 - RNA, 18 nt, Homo sapiens
ucuaucauguugaaguca

SEQ ID NO: 408087 - RNA, 12 nt, Homo sapiens
ucuaucugcaau

SEQ ID NO: 408088 - RNA, 16 nt, Homo sapiens
ucuauggauucacuuc

SEQ ID NO: 408089 - RNA, 18 nt, Homo sapiens
ucuauguagaacuguuca

SEQ ID NO: 408090 - RNA, 18 nt, Homo sapiens
ucuauuaaaucuugcaac

SEQ ID NO: 408091 - RNA, 19 nt, Homo sapiens
ucuauuggccaacaauccu

SEQ ID NO: 408092 - RNA, 16 nt, Homo sapiens
ucuauuucaacuucag

SEQ ID NO: 408093 - RNA, 15 nt, Homo sapiens
ucuauuuuacuuugu

SEQ ID NO: 408094 - RNA, 15 nt, Homo sapiens
ucuauuuugugauga

SEQ ID NO: 408095 - RNA, 22 nt, Homo sapiens
ucucaaaaugugccgucuuugg

SEQ ID NO: 408096 - RNA, 19 nt, Homo sapiens
ucucaaaugauacagucag

SEQ ID NO: 408097 - RNA, 14 nt, Homo sapiens
ucucaacaaaugga

SEQ ID NO: 408098 - RNA, 12 nt, Homo sapiens
ucucaagugaua

SEQ ID NO: 408099 - RNA, 14 nt, Homo sapiens
ucucaaugugcaau

SEQ ID NO: 408100 - RNA, 14 nt, Homo sapiens
ucucaauguuccau

SEQ ID NO: 408101 - RNA, 18 nt, Homo sapiens
ucucaccuggacuccagu

SEQ ID NO: 408102 - RNA, 16 nt, Homo sapiens
ucucacgauaugcaag

SEQ ID NO: 408103 - RNA, 21 nt, Homo sapiens
ucucacuuauaccaaagggaa

SEQ ID NO: 408104 - RNA, 18 nt, Homo sapiens
ucucacuugugcaguguu

SEQ ID NO: 408105 - RNA, 22 nt, Homo sapiens
ucucacuuugguuggaacuuua

SEQ ID NO: 408106 - RNA, 14 nt, Homo sapiens
ucucagaacuccug

SEQ ID NO: 408107 - RNA, 19 nt, Homo sapiens
gauacagauccgcaugugu

SEQ ID NO: 408108 - RNA, 20 nt, Homo sapiens
gauacagccuuacaauacaa

SEQ ID NO: 408109 - RNA, 21 nt, Homo sapiens
gauaccucaacccccauuucu

SEQ ID NO: 408110 - RNA, 15 nt, Homo sapiens
gauacgcuccaguac

SEQ ID NO: 408111 - RNA, 19 nt, Homo sapiens
gauacuaauagaguacuua

SEQ ID NO: 408112 - RNA, 18 nt, Homo sapiens
gauagaacaaugcuauaa

SEQ ID NO: 408113 - RNA, 14 nt, Homo sapiens
gauagcauugcuuu

SEQ ID NO: 408114 - RNA, 22 nt, Homo sapiens
gauagcuucaucuugagccuga

SEQ ID NO: 408115 - RNA, 15 nt, Homo sapiens
gauaggaaaaaucca

SEQ ID NO: 408116 - RNA, 20 nt, Homo sapiens
gauagucagcuguaccaagc

SEQ ID NO: 408117 - RNA, 21 nt, Homo sapiens
gauauaggucagugaggccca

SEQ ID NO: 408118 - RNA, 18 nt, Homo sapiens
gauaucuaugacuguguu

SEQ ID NO: 408119 - RNA, 22 nt, Homo sapiens
gauaucugaacacauacuagaa

SEQ ID NO: 408120 - RNA, 18 nt, Homo sapiens
gauaucuuggcuuugcca

SEQ ID NO: 408121 - RNA, 14 nt, Homo sapiens
gauaugcacuugaa

SEQ ID NO: 408122 - RNA, 19 nt, Homo sapiens
gauaugcacuugaaaugau

SEQ ID NO: 408123 - RNA, 15 nt, Homo sapiens
gauauuaaaauaagc

SEQ ID NO: 408124 - RNA, 17 nt, Homo sapiens
gauauuacugaaaggga

SEQ ID NO: 408125 - RNA, 20 nt, Homo sapiens
gauauuguauguaccuggga

SEQ ID NO: 408126 - RNA, 15 nt, Homo sapiens
gauauuuuccauuuu

SEQ ID NO: 408127 - RNA, 13 nt, Homo sapiens
gaucacuacugca

SEQ ID NO: 408128 - RNA, 15 nt, Homo sapiens
gaucacuaugcauuu

SEQ ID NO: 408129 - RNA, 19 nt, Homo sapiens
gaucacuugaggccaguga

SEQ ID NO: 408130 - RNA, 17 nt, Homo sapiens
gaucacuuuaugucuca

SEQ ID NO: 408131 - RNA, 15 nt, Homo sapiens
gaucagaacugggaa

SEQ ID NO: 408132 - RNA, 19 nt, Homo sapiens
gaucagcaaaccggggccu

SEQ ID NO: 408133 - RNA, 18 nt, Homo sapiens
gaucaguuuuccuagucu

SEQ ID NO: 408134 - RNA, 18 nt, Homo sapiens
gaucauagcugacucaga

SEQ ID NO: 408135 - RNA, 13 nt, Homo sapiens
gaucauauuucac

SEQ ID NO: 408136 - RNA, 12 nt, Homo sapiens
gaucauucucag

SEQ ID NO: 408137 - RNA, 18 nt, Homo sapiens
gaucauugguaucugaua

SEQ ID NO: 408138 - RNA, 20 nt, Homo sapiens
gaucauuucccaaaauucua

SEQ ID NO: 408139 - RNA, 21 nt, Homo sapiens
gauccaccugucucagccucc

SEQ ID NO: 408140 - RNA, 15 nt, Homo sapiens
gauccagacuguaag

SEQ ID NO: 408141 - RNA, 17 nt, Homo sapiens
gaucccacuccuaggac

SEQ ID NO: 408142 - RNA, 15 nt, Homo sapiens
gaucccguguugcca

SEQ ID NO: 408143 - RNA, 21 nt, Homo sapiens
gauccugcaccccagcauucc

SEQ ID NO: 408144 - RNA, 17 nt, Homo sapiens
gauccuguugggaaaga

SEQ ID NO: 408145 - RNA, 18 nt, Homo sapiens
gaucguucucugccucac

SEQ ID NO: 408146 - RNA, 21 nt, Homo sapiens
gaucuaaaaggaggacaggga

SEQ ID NO: 408147 - RNA, 23 nt, Homo sapiens
gcaaaaucuguucuaacauguaa

SEQ ID NO: 408148 - RNA, 18 nt, Homo sapiens
gcaaaauugauguguuua

SEQ ID NO: 408149 - RNA, 13 nt, Homo sapiens
gcaaacaggcagu

SEQ ID NO: 408150 - RNA, 15 nt, Homo sapiens
gcaaacaugugcaac

SEQ ID NO: 408151 - RNA, 20 nt, Homo sapiens
gcaaagcgcuauuucaggca

SEQ ID NO: 408152 - RNA, 20 nt, Homo sapiens
gcaaagcugaugacaacuuc

SEQ ID NO: 408153 - RNA, 13 nt, Homo sapiens
gcaaaggacagau

SEQ ID NO: 408154 - RNA, 12 nt, Homo sapiens
gcaaaguaauag

SEQ ID NO: 408155 - RNA, 14 nt, Homo sapiens
gcaaaucagacaca

SEQ ID NO: 408156 - RNA, 13 nt, Homo sapiens
gcaaauggaacaa

SEQ ID NO: 408157 - RNA, 22 nt, Homo sapiens
gcaacaguacuucaaacagaac

SEQ ID NO: 408158 - RNA, 12 nt, Homo sapiens
gcaacaguuuuu

SEQ ID NO: 408159 - RNA, 13 nt, Homo sapiens
gcaacaucagcuu

SEQ ID NO: 408160 - RNA, 14 nt, Homo sapiens
gcaacccuuuccaa

SEQ ID NO: 408161 - RNA, 18 nt, Homo sapiens
gcaacuccagaaguggag

SEQ ID NO: 408162 - RNA, 20 nt, Homo sapiens
gcaacuuauggacucgcuag

SEQ ID NO: 408163 - RNA, 20 nt, Homo sapiens
gcaagacucugucucaaaaa

SEQ ID NO: 408164 - RNA, 12 nt, Homo sapiens
gcaagagacugg

SEQ ID NO: 408165 - RNA, 16 nt, Homo sapiens
gcaagcaaagaaccca

SEQ ID NO: 408166 - RNA, 21 nt, Homo sapiens
gcaaggacauugccccaagau

SEQ ID NO: 408167 - RNA, 22 nt, Homo sapiens
gcaaggcugccggcugcacccu

SEQ ID NO: 408168 - RNA, 21 nt, Homo sapiens
gcaagguuggcgacugucaug

SEQ ID NO: 408169 - RNA, 19 nt, Homo sapiens
gcaaguguguaugugcgug

SEQ ID NO: 408170 - RNA, 17 nt, Homo sapiens
gcaagugugugcacaug

SEQ ID NO: 408171 - RNA, 15 nt, Homo sapiens
gcaagugugugcaug

SEQ ID NO: 408172 - RNA, 18 nt, Homo sapiens
gcaauaaaaaucauagua

SEQ ID NO: 408173 - RNA, 18 nt, Homo sapiens
gcaauaaggaucuuccca

SEQ ID NO: 408174 - RNA, 14 nt, Homo sapiens
gcaauaggacaaaa

SEQ ID NO: 408175 - RNA, 21 nt, Homo sapiens
gcaauagggugcaguuuucca

SEQ ID NO: 408176 - RNA, 20 nt, Homo sapiens
gcaauaugggaggaacaaag

SEQ ID NO: 408177 - RNA, 11 nt, Homo sapiens
gcaauauuugg

SEQ ID NO: 408178 - RNA, 23 nt, Homo sapiens
gcaaucuuugccuuuaucucuga

SEQ ID NO: 408179 - RNA, 22 nt, Homo sapiens
gcaaugaaaagaaaaugugcca

SEQ ID NO: 408180 - RNA, 23 nt, Homo sapiens
gcaaugugcccccagacgcacgu

SEQ ID NO: 408181 - RNA, 22 nt, Homo sapiens
gcaauuucauaugcuguauauc

SEQ ID NO: 408182 - RNA, 14 nt, Homo sapiens
gcacaaaagggacu

SEQ ID NO: 408183 - RNA, 23 nt, Homo sapiens
gcacaaaagucucaauguuccau

SEQ ID NO: 408184 - RNA, 19 nt, Homo sapiens
gcacaaaguguauucacgu

SEQ ID NO: 408185 - RNA, 13 nt, Homo sapiens
gcacaaucucaca

SEQ ID NO: 408186 - RNA, 14 nt, Homo sapiens
gcacacaacugugg

SEQ ID NO: 408187 - RNA, 23 nt, Homo sapiens
gcacacacaccacacauacacac

SEQ ID NO: 408188 - RNA, 20 nt, Homo sapiens
gcacacaugguuuccaaggg

SEQ ID NO: 408189 - RNA, 17 nt, Homo sapiens
gcacacugccagugucu

SEQ ID NO: 408190 - RNA, 22 nt, Homo sapiens
gcacacugcuugugaaaggaaa

SEQ ID NO: 408191 - RNA, 16 nt, Homo sapiens
gcacagaccaguuuca

SEQ ID NO: 408192 - RNA, 12 nt, Homo sapiens
gcacagccagaa

SEQ ID NO: 408193 - RNA, 13 nt, Homo sapiens
gcacagccauggc

SEQ ID NO: 408194 - RNA, 23 nt, Homo sapiens
gcacagcccugggagggggcuau

SEQ ID NO: 408195 - RNA, 19 nt, Homo sapiens
gcacaggaugggggcaaug

SEQ ID NO: 408196 - RNA, 17 nt, Homo sapiens
gcacaggcaacauuaca

SEQ ID NO: 408197 - RNA, 19 nt, Homo sapiens
gcacaggccauggugcaca

SEQ ID NO: 408198 - RNA, 22 nt, Homo sapiens
gcacaucugcauuuucacccca

SEQ ID NO: 408199 - RNA, 19 nt, Homo sapiens
gcacaugcgaccccgagga

SEQ ID NO: 408200 - RNA, 12 nt, Homo sapiens
gcacaugugugc

SEQ ID NO: 408201 - RNA, 19 nt, Homo sapiens
gcacauguugcuaaugaca

SEQ ID NO: 408202 - RNA, 23 nt, Homo sapiens
gcacauuagagggacagccaaaa

SEQ ID NO: 408203 - RNA, 18 nt, Homo sapiens
gcacauuugucacugaau

SEQ ID NO: 408204 - RNA, 17 nt, Homo sapiens
gcacauuuuccacggaa

SEQ ID NO: 408205 - RNA, 18 nt, Homo sapiens
gcaccaagaccccaaagg

SEQ ID NO: 408206 - RNA, 15 nt, Homo sapiens
gcaccacuguguauu

SEQ ID NO: 408207 - RNA, 22 nt, Homo sapiens
gcaccaggcaggagaugcugca

SEQ ID NO: 408208 - RNA, 23 nt, Homo sapiens
gcaccagguguuaaaaaccauua

SEQ ID NO: 408209 - RNA, 14 nt, Homo sapiens
gcaccagugugaca

SEQ ID NO: 408210 - RNA, 22 nt, Homo sapiens
gcacccaccaccaugcccagcu

SEQ ID NO: 408211 - RNA, 14 nt, Homo sapiens
gcacccacccagca

SEQ ID NO: 408212 - RNA, 22 nt, Homo sapiens
gcacccaggacuuccauuugcu

SEQ ID NO: 408213 - RNA, 22 nt, Homo sapiens
gcacccgcccuuuccuugccuu

SEQ ID NO: 408214 - RNA, 17 nt, Homo sapiens
gcacccugauccucacc

SEQ ID NO: 408215 - RNA, 16 nt, Homo sapiens
gcaccuaaaugaugcc

SEQ ID NO: 408216 - RNA, 13 nt, Homo sapiens
gcaccuacuuuau

SEQ ID NO: 408217 - RNA, 21 nt, Homo sapiens
gcaccucauggacuccaggau

SEQ ID NO: 408218 - RNA, 12 nt, Homo sapiens
gcaccugugcag

SEQ ID NO: 408219 - RNA, 14 nt, Homo sapiens
gcaccuucagacuu

SEQ ID NO: 408220 - RNA, 22 nt, Homo sapiens
gcaccuugucauguaccaucaa

SEQ ID NO: 408221 - RNA, 12 nt, Homo sapiens
gcacgcacacac

SEQ ID NO: 408222 - RNA, 15 nt, Homo sapiens
gcacgcccaugugug

SEQ ID NO: 408223 - RNA, 18 nt, Homo sapiens
gcacgcuggcuugugauc

SEQ ID NO: 408224 - RNA, 13 nt, Homo sapiens
gcacggcuuccca

SEQ ID NO: 408225 - RNA, 13 nt, Homo sapiens
gcacguccuccac

SEQ ID NO: 408226 - RNA, 18 nt, Homo sapiens
gcacguccuccaccggug

SEQ ID NO: 408227 - RNA, 19 nt, Homo sapiens
gcacguggagauagugcca

SEQ ID NO: 408228 - RNA, 19 nt, Homo sapiens
gcacuacauaaacugacuu

SEQ ID NO: 408229 - RNA, 20 nt, Homo sapiens
gcacuaccacgccaagcuaa

SEQ ID NO: 408230 - RNA, 13 nt, Homo sapiens
gcacuacucugug

SEQ ID NO: 408231 - RNA, 12 nt, Homo sapiens
gcacuagcauuu

SEQ ID NO: 408232 - RNA, 18 nt, Homo sapiens
gcacucaaagcuuguuaa

SEQ ID NO: 408233 - RNA, 14 nt, Homo sapiens
gcacucacaggcua

SEQ ID NO: 408234 - RNA, 13 nt, Homo sapiens
gcacucacgcccu

SEQ ID NO: 408235 - RNA, 20 nt, Homo sapiens
gcacucacgcccuaagcgca

SEQ ID NO: 408236 - RNA, 16 nt, Homo sapiens
gcacuccauggccacc

SEQ ID NO: 408237 - RNA, 22 nt, Homo sapiens
gcacugcaaauacuuccaaaga

SEQ ID NO: 408238 - RNA, 13 nt, Homo sapiens
gcacugcugcugc

SEQ ID NO: 408239 - RNA, 16 nt, Homo sapiens
gcacuggcucucucca

SEQ ID NO: 408240 - RNA, 13 nt, Homo sapiens
gcacuggucacau

SEQ ID NO: 408241 - RNA, 21 nt, Homo sapiens
gcacuggugguuuuugcucuc

SEQ ID NO: 408242 - RNA, 18 nt, Homo sapiens
gcacugguguugagcaau

SEQ ID NO: 408243 - RNA, 20 nt, Homo sapiens
gcacugugaccgagaacuuu

SEQ ID NO: 408244 - RNA, 19 nt, Homo sapiens
ucugcuuuagcuuuccaau

SEQ ID NO: 408245 - RNA, 15 nt, Homo sapiens
ucuggaaggacaucu

SEQ ID NO: 408246 - RNA, 18 nt, Homo sapiens
ucuggaauccaaaccaca

SEQ ID NO: 408247 - RNA, 16 nt, Homo sapiens
ucuggaccccaggcca

SEQ ID NO: 408248 - RNA, 21 nt, Homo sapiens
ucuggcacuugcaagucccau

SEQ ID NO: 408249 - RNA, 23 nt, Homo sapiens
ucuggcacuugcaagucccauga

SEQ ID NO: 408250 - RNA, 20 nt, Homo sapiens
ucuggcccuguugugggggu

SEQ ID NO: 408251 - RNA, 21 nt, Homo sapiens
ucuggcccuguugugggggug

SEQ ID NO: 408252 - RNA, 18 nt, Homo sapiens
ucuggcuacgacuuggga

SEQ ID NO: 408253 - RNA, 16 nt, Homo sapiens
ucuggcuggagaggaa

SEQ ID NO: 408254 - RNA, 16 nt, Homo sapiens
ucuggcuucugcauua

SEQ ID NO: 408255 - RNA, 15 nt, Homo sapiens
ucuggcuucugugau

SEQ ID NO: 408256 - RNA, 18 nt, Homo sapiens
ucuggcuucuuucacuuu

SEQ ID NO: 408257 - RNA, 20 nt, Homo sapiens
ucugggaaaggugcucaaag

SEQ ID NO: 408258 - RNA, 15 nt, Homo sapiens
ucugggcacaaucau

SEQ ID NO: 408259 - RNA, 20 nt, Homo sapiens
ucugggcacuuuugaacuca

SEQ ID NO: 408260 - RNA, 16 nt, Homo sapiens
ucugggcagcuaaaag

SEQ ID NO: 408261 - RNA, 14 nt, Homo sapiens
ucugggcccagaac

SEQ ID NO: 408262 - RNA, 18 nt, Homo sapiens
ucugggcugccaugugaa

SEQ ID NO: 408263 - RNA, 20 nt, Homo sapiens
ucugggcuuggggcuuccua

SEQ ID NO: 408264 - RNA, 14 nt, Homo sapiens
ucuggggaagggaa

SEQ ID NO: 408265 - RNA, 14 nt, Homo sapiens
ucugggugcagcug

SEQ ID NO: 408266 - RNA, 17 nt, Homo sapiens
ucugggugcagcugaga

SEQ ID NO: 408267 - RNA, 19 nt, Homo sapiens
ucugguaggaauagcaugu

SEQ ID NO: 408268 - RNA, 16 nt, Homo sapiens
ucuggucguuugacca

SEQ ID NO: 408269 - RNA, 14 nt, Homo sapiens
ucugguuccacuca

SEQ ID NO: 408270 - RNA, 23 nt, Homo sapiens
ucuguaaaccacuugucacuaca

SEQ ID NO: 408271 - RNA, 13 nt, Homo sapiens
ucuguaaauaucc

SEQ ID NO: 408272 - RNA, 21 nt, Homo sapiens
ucuguaaauuuaacugcauau

SEQ ID NO: 408273 - RNA, 14 nt, Homo sapiens
ucuguaaccaccuc

SEQ ID NO: 408274 - RNA, 19 nt, Homo sapiens
ucuguacauauuacuguug

SEQ ID NO: 408275 - RNA, 21 nt, Homo sapiens
ucuguagcuauucuuugacca

SEQ ID NO: 408276 - RNA, 13 nt, Homo sapiens
ucuguagggauuu

SEQ ID NO: 408277 - RNA, 15 nt, Homo sapiens
ucugucauaugcaga

SEQ ID NO: 408278 - RNA, 16 nt, Homo sapiens
ucugucauaugcagaa

SEQ ID NO: 408279 - RNA, 21 nt, Homo sapiens
ucuguccagaggcugcaagga

SEQ ID NO: 408280 - RNA, 16 nt, Homo sapiens
ucugucccacugggac

SEQ ID NO: 408281 - RNA, 20 nt, Homo sapiens
ucugucgcccuuagucauau

SEQ ID NO: 408282 - RNA, 20 nt, Homo sapiens
ucugucuacuguggugaucu

SEQ ID NO: 408283 - RNA, 13 nt, Homo sapiens
ucugucucuauga

SEQ ID NO: 408284 - RNA, 11 nt, Homo sapiens
ucugucuucaa

SEQ ID NO: 408285 - RNA, 22 nt, Homo sapiens
ucugugaaaagggaucugcucc

SEQ ID NO: 408286 - RNA, 18 nt, Homo sapiens
ucugugaagcccuuugcc

SEQ ID NO: 408287 - RNA, 19 nt, Homo sapiens
ucugugacuccuggucuga

SEQ ID NO: 408288 - RNA, 16 nt, Homo sapiens
ucugugauugccauuu

SEQ ID NO: 408289 - RNA, 20 nt, Homo sapiens
ucuguggucuaaacaaaaaa

SEQ ID NO: 408290 - RNA, 14 nt, Homo sapiens
ucuguguaucucag

SEQ ID NO: 408291 - RNA, 14 nt, Homo sapiens
ucuguuaaaaucag

SEQ ID NO: 408292 - RNA, 14 nt, Homo sapiens
ucuguuaaccaaau

SEQ ID NO: 408293 - RNA, 16 nt, Homo sapiens
ucuguuaagugguuuc

SEQ ID NO: 408294 - RNA, 17 nt, Homo sapiens
ucuguuagaugcuacua

SEQ ID NO: 408295 - RNA, 14 nt, Homo sapiens
ucuguuccaagugu

SEQ ID NO: 408296 - RNA, 22 nt, Homo sapiens
ucuguuccaagugugugugcaa

SEQ ID NO: 408297 - RNA, 17 nt, Homo sapiens
ucuguugaggcaucaaa

SEQ ID NO: 408298 - RNA, 18 nt, Homo sapiens
ucuguugcuuauugggag

SEQ ID NO: 408299 - RNA, 19 nt, Homo sapiens
ucuguuuaggagugucuaa

SEQ ID NO: 408300 - RNA, 19 nt, Homo sapiens
ucuguuuccaggucagaaa

SEQ ID NO: 408301 - RNA, 22 nt, Homo sapiens
ucuguuucuaauuugcugcuga

SEQ ID NO: 408302 - RNA, 18 nt, Homo sapiens
ucuguuugauacaguauu

SEQ ID NO: 408303 - RNA, 19 nt, Homo sapiens
ucuguuugauacaguauua

SEQ ID NO: 408304 - RNA, 16 nt, Homo sapiens
ucuuaagcacuuugaa

SEQ ID NO: 408305 - RNA, 18 nt, Homo sapiens
ucuuaauauaacugccuu

SEQ ID NO: 408306 - RNA, 21 nt, Homo sapiens
ucuuacagccacaggcacugu

SEQ ID NO: 408307 - RNA, 13 nt, Homo sapiens
ucuuacaguauuu

SEQ ID NO: 408308 - RNA, 22 nt, Homo sapiens
ucuuacauaauuuuuuauucaa

SEQ ID NO: 408309 - RNA, 23 nt, Homo sapiens
ucuuaccagaucuaauauugacu

SEQ ID NO: 408310 - RNA, 13 nt, Homo sapiens
ucuuaccagaugc

SEQ ID NO: 408311 - RNA, 21 nt, Homo sapiens
ucuuacugcuugguccuugau

SEQ ID NO: 408312 - RNA, 21 nt, Homo sapiens
ucuuagauggugaucugggau

SEQ ID NO: 408313 - RNA, 16 nt, Homo sapiens
ucuuagcuuacaggaa

SEQ ID NO: 408314 - RNA, 17 nt, Homo sapiens
ucuuagcuuacaggaag

SEQ ID NO: 408315 - RNA, 21 nt, Homo sapiens
ucuuagugaaaggucaucuca

SEQ ID NO: 408316 - RNA, 13 nt, Homo sapiens
ucuuagugucacu

SEQ ID NO: 408317 - RNA, 20 nt, Homo sapiens
ucuuauaagaaaacauguaa

SEQ ID NO: 408318 - RNA, 16 nt, Homo sapiens
ucuuaucccagugauc

SEQ ID NO: 408319 - RNA, 18 nt, Homo sapiens
ucuuaucccagugaucac

SEQ ID NO: 408320 - RNA, 20 nt, Homo sapiens
ucuuaugaaaugggcuuuaa

SEQ ID NO: 408321 - RNA, 16 nt, Homo sapiens
ucuuauuguuccucuu

SEQ ID NO: 408322 - RNA, 14 nt, Homo sapiens
ucuuauuuccucaa

SEQ ID NO: 408323 - RNA, 19 nt, Homo sapiens
ucuuauuuguaaagcucac

SEQ ID NO: 408324 - RNA, 13 nt, Homo sapiens
ucuucaacuaauu

SEQ ID NO: 408325 - RNA, 19 nt, Homo sapiens
ucuucacaccuacccuccu

SEQ ID NO: 408326 - RNA, 20 nt, Homo sapiens
ucuucaccucuauccaaaga

SEQ ID NO: 408327 - RNA, 15 nt, Homo sapiens
ucuucacucucugaa

SEQ ID NO: 408328 - RNA, 16 nt, Homo sapiens
ucuucacucucugaag

SEQ ID NO: 408329 - RNA, 20 nt, Homo sapiens
ucuucacugcagauuucuca

SEQ ID NO: 408330 - RNA, 21 nt, Homo sapiens
ucuucacuucuaaaugcauau

SEQ ID NO: 408331 - RNA, 22 nt, Homo sapiens
ucuucacuucuaaaugcauauc

SEQ ID NO: 408332 - RNA, 21 nt, Homo sapiens
ucuucagccucauucacuguc

SEQ ID NO: 408333 - RNA, 17 nt, Homo sapiens
ucuucagcugguggaug

SEQ ID NO: 408334 - RNA, 17 nt, Homo sapiens
ucuucagggcacugcug

SEQ ID NO: 408335 - RNA, 18 nt, Homo sapiens
ucuucagggcacugcugc

SEQ ID NO: 408336 - RNA, 20 nt, Homo sapiens
ucuucagggcacugcugcug

SEQ ID NO: 408337 - RNA, 23 nt, Homo sapiens
ucuucagggggccaggugcacag

SEQ ID NO: 408338 - RNA, 22 nt, Homo sapiens
ucuucauuuauuuugacuguga

SEQ ID NO: 408339 - RNA, 18 nt, Homo sapiens
ucuuccaaagcacauuga

SEQ ID NO: 408340 - RNA, 22 nt, Homo sapiens
ucuuccaaucuccaucaccuuu

SEQ ID NO: 408341 - RNA, 22 nt, Homo sapiens
ucuuccacccauucccccaugu

SEQ ID NO: 408342 - RNA, 22 nt, Homo sapiens
ucuucccacacagaauauacau

SEQ ID NO: 408343 - RNA, 14 nt, Homo sapiens
ucuucccaugacug

SEQ ID NO: 408344 - RNA, 20 nt, Homo sapiens
ucuuccccuccccgcuccua

SEQ ID NO: 408345 - RNA, 19 nt, Homo sapiens
ucuucccgccucagccucu

SEQ ID NO: 408346 - RNA, 13 nt, Homo sapiens
ucuucccuaccuc

SEQ ID NO: 408347 - RNA, 20 nt, Homo sapiens
ucuuccgggagcuggugaca

SEQ ID NO: 408348 - RNA, 19 nt, Homo sapiens
ucuuccuauuuuaaugaau

SEQ ID NO: 408349 - RNA, 18 nt, Homo sapiens
ucuuccucaagucuugac

SEQ ID NO: 408350 - RNA, 14 nt, Homo sapiens
ucuuccucuuaccu

SEQ ID NO: 408351 - RNA, 19 nt, Homo sapiens
ucuuccugaguggugccaa

SEQ ID NO: 408352 - RNA, 13 nt, Homo sapiens
ucuuccugcaaag

SEQ ID NO: 408353 - RNA, 22 nt, Homo sapiens
ucuuccuggcuccaacacugcu

SEQ ID NO: 408354 - RNA, 20 nt, Homo sapiens
ucuucgagccggcaacggca

SEQ ID NO: 408355 - RNA, 23 nt, Homo sapiens
ucuucgcugugaugcaugagcuc

SEQ ID NO: 408356 - RNA, 16 nt, Homo sapiens
ucuucuacaaccagag

SEQ ID NO: 408357 - RNA, 14 nt, Homo sapiens
ucuucuacuuuaag

SEQ ID NO: 408358 - RNA, 19 nt, Homo sapiens
ucuucuaucaaagcacaua

SEQ ID NO: 408359 - RNA, 12 nt, Homo sapiens
ucuucucaagca

SEQ ID NO: 408360 - RNA, 17 nt, Homo sapiens
ucuucucaggauuuaaa

SEQ ID NO: 408361 - RNA, 14 nt, Homo sapiens
ucuucucucuugau

SEQ ID NO: 408362 - RNA, 18 nt, Homo sapiens
ucuucugauuugucccua

SEQ ID NO: 408363 - RNA, 14 nt, Homo sapiens
ucuucuuacuguau

SEQ ID NO: 408364 - RNA, 17 nt, Homo sapiens
ucuucuuauucaugcuu

SEQ ID NO: 408365 - RNA, 22 nt, Homo sapiens
ucuucuuauucaugcuuucucc

SEQ ID NO: 408366 - RNA, 14 nt, Homo sapiens
ucuucuugugaaau

SEQ ID NO: 408367 - RNA, 19 nt, Homo sapiens
ucuucuuguguccugauga

SEQ ID NO: 408368 - RNA, 23 nt, Homo sapiens
ucuucuuugacuauaacaaaauc

SEQ ID NO: 408369 - RNA, 20 nt, Homo sapiens
ucuucuuuuauguaaaucau

SEQ ID NO: 408370 - RNA, 13 nt, Homo sapiens
ucuugaaagcugu

SEQ ID NO: 408371 - RNA, 14 nt, Homo sapiens
ucuugaagaauauu

SEQ ID NO: 408372 - RNA, 15 nt, Homo sapiens
ucuugaaguucaugg

SEQ ID NO: 408373 - RNA, 13 nt, Homo sapiens
ucuugaauguuga

SEQ ID NO: 408374 - RNA, 17 nt, Homo sapiens
ucuugacauucaaggca

SEQ ID NO: 408375 - RNA, 15 nt, Homo sapiens
gcacuuuagaucacu

SEQ ID NO: 408376 - RNA, 14 nt, Homo sapiens
gcagaaauugaccu

SEQ ID NO: 408377 - RNA, 20 nt, Homo sapiens
gcagaaauuuuaagccaaaa

SEQ ID NO: 408378 - RNA, 19 nt, Homo sapiens
gcagaacaugagugcugau

SEQ ID NO: 408379 - RNA, 14 nt, Homo sapiens
gcagaaccuggugg

SEQ ID NO: 408380 - RNA, 18 nt, Homo sapiens
gcagaccugggacuuuag

SEQ ID NO: 408381 - RNA, 21 nt, Homo sapiens
gcagacuggugagcagacugg

SEQ ID NO: 408382 - RNA, 12 nt, Homo sapiens
gcagagccuguc

SEQ ID NO: 408383 - RNA, 15 nt, Homo sapiens
gcagagcucagagga

SEQ ID NO: 408384 - RNA, 14 nt, Homo sapiens
gcagaggagccaug

SEQ ID NO: 408385 - RNA, 13 nt, Homo sapiens
gcagaggcaccuc

SEQ ID NO: 408386 - RNA, 13 nt, Homo sapiens
gcagagguugcag

SEQ ID NO: 408387 - RNA, 16 nt, Homo sapiens
gcagagguugcaguga

SEQ ID NO: 408388 - RNA, 18 nt, Homo sapiens
gcagagucucauucuguu

SEQ ID NO: 408389 - RNA, 17 nt, Homo sapiens
gcagaucugugccccau

SEQ ID NO: 408390 - RNA, 17 nt, Homo sapiens
gcagaugccaaaaaaga

SEQ ID NO: 408391 - RNA, 16 nt, Homo sapiens
gcagcaacacccaagu

SEQ ID NO: 408392 - RNA, 15 nt, Homo sapiens
gcagcauacacagau

SEQ ID NO: 408393 - RNA, 17 nt, Homo sapiens
gcagcauacacagauga

SEQ ID NO: 408394 - RNA, 17 nt, Homo sapiens
gcagcaucuacuacucu

SEQ ID NO: 408395 - RNA, 21 nt, Homo sapiens
gcagcaucuucaaacauguac

SEQ ID NO: 408396 - RNA, 17 nt, Homo sapiens
gcagccccacacccgcc

SEQ ID NO: 408397 - RNA, 21 nt, Homo sapiens
gcagcccuugggcaguucuca

SEQ ID NO: 408398 - RNA, 16 nt, Homo sapiens
gcagccuccuccugac

SEQ ID NO: 408399 - RNA, 14 nt, Homo sapiens
gcagccucugccag

SEQ ID NO: 408400 - RNA, 21 nt, Homo sapiens
gcagccuggcucccaggacac

SEQ ID NO: 408401 - RNA, 23 nt, Homo sapiens
gcagcggggcaagcaaaaacaau

SEQ ID NO: 408402 - RNA, 22 nt, Homo sapiens
gcagcuaccagguguucuacac

SEQ ID NO: 408403 - RNA, 19 nt, Homo sapiens
gcagcucaaguuagcauuu

SEQ ID NO: 408404 - RNA, 17 nt, Homo sapiens
gcagcuccgccuggcac

SEQ ID NO: 408405 - RNA, 19 nt, Homo sapiens
gcagcugguggaagaccug

SEQ ID NO: 408406 - RNA, 23 nt, Homo sapiens
gcagcuguuuuaguuaaauuucu

SEQ ID NO: 408407 - RNA, 17 nt, Homo sapiens
ggcagagaggacuguug

SEQ ID NO: 408408 - RNA, 20 nt, Homo sapiens
ggcagagaggacuguugaca

SEQ ID NO: 408409 - RNA, 12 nt, Homo sapiens
ggcagagccaug

SEQ ID NO: 408410 - RNA, 15 nt, Homo sapiens
ggcagagccaugggc

SEQ ID NO: 408411 - RNA, 15 nt, Homo sapiens
ggcagagcucagagg

SEQ ID NO: 408412 - RNA, 16 nt, Homo sapiens
ggcagcccaguggaau

SEQ ID NO: 408413 - RNA, 19 nt, Homo sapiens
ggcagcggggcaagcaaaa

SEQ ID NO: 408414 - RNA, 19 nt, Homo sapiens
uguguguauguuugcacac

SEQ ID NO: 408415 - RNA, 17 nt, Homo sapiens
uguguuggcuguggcag

SEQ ID NO: 408416 - RNA, 15 nt, Homo sapiens
uguguuucaggugga

SEQ ID NO: 408417 - RNA, 18 nt, Homo sapiens
uguguuuugcuaaaggaa

SEQ ID NO: 408418 - RNA, 20 nt, Homo sapiens
uguguuuuuaauaaagacag

SEQ ID NO: 408419 - RNA, 21 nt, Homo sapiens
uguguuuuuaauaaagacagg

SEQ ID NO: 408420 - RNA, 15 nt, Homo sapiens
uguuaaaaucaggau

SEQ ID NO: 408421 - RNA, 18 nt, Homo sapiens
uguuaaagcaucagagau

SEQ ID NO: 408422 - RNA, 20 nt, Homo sapiens
uguuaaauaaggccucaucc

SEQ ID NO: 408423 - RNA, 23 nt, Homo sapiens
uguuaacaccuaccucacagggu

SEQ ID NO: 408424 - RNA, 18 nt, Homo sapiens
uguuaacauggacaugau

SEQ ID NO: 408425 - RNA, 13 nt, Homo sapiens
uguuaagugcagg

SEQ ID NO: 408426 - RNA, 13 nt, Homo sapiens
uguuaagugcuuu

SEQ ID NO: 408427 - RNA, 13 nt, Homo sapiens
uguuaauaaaggu

SEQ ID NO: 408428 - RNA, 15 nt, Homo sapiens
uguuaccuccuauaa

SEQ ID NO: 408429 - RNA, 14 nt, Homo sapiens
uguuaccuucacau

SEQ ID NO: 408430 - RNA, 20 nt, Homo sapiens
uguuacucauuuuauucacu

SEQ ID NO: 408431 - RNA, 20 nt, Homo sapiens
uguuacugaauuugcuaaua

SEQ ID NO: 408432 - RNA, 12 nt, Homo sapiens
uguuagagccau

SEQ ID NO: 408433 - RNA, 16 nt, Homo sapiens
uguuagcauaauguga

SEQ ID NO: 408434 - RNA, 19 nt, Homo sapiens
uguuagccgggauggucuu

SEQ ID NO: 408435 - RNA, 20 nt, Homo sapiens
uguuagccgggauggucuug

SEQ ID NO: 408436 - RNA, 16 nt, Homo sapiens
uguuagugucugucca

SEQ ID NO: 408437 - RNA, 12 nt, Homo sapiens
uguuaugacucc

SEQ ID NO: 408438 - RNA, 22 nt, Homo sapiens
uguuauuuucuguugaaguuua

SEQ ID NO: 408439 - RNA, 22 nt, Homo sapiens
uguuauuuuguauaaaugggaa

SEQ ID NO: 408440 - RNA, 17 nt, Homo sapiens
uguucaaaauuccauuu

SEQ ID NO: 408441 - RNA, 13 nt, Homo sapiens
uguucaacauuuu

SEQ ID NO: 408442 - RNA, 15 nt, Homo sapiens
uguucagaugugcau

SEQ ID NO: 408443 - RNA, 15 nt, Homo sapiens
uguucauuucugucu

SEQ ID NO: 408444 - RNA, 20 nt, Homo sapiens
uguucauuuuagugacugua

SEQ ID NO: 408445 - RNA, 14 nt, Homo sapiens
uguuccagacucag

SEQ ID NO: 408446 - RNA, 22 nt, Homo sapiens
uguuccagauccuucaaagagu

SEQ ID NO: 408447 - RNA, 22 nt, Homo sapiens
uguuccaugaaggcagagccau

SEQ ID NO: 408448 - RNA, 14 nt, Homo sapiens
uguucccacucccu

SEQ ID NO: 408449 - RNA, 20 nt, Homo sapiens
uguuccuguucgugcuugua

SEQ ID NO: 408450 - RNA, 15 nt, Homo sapiens
uguuccuuuugacaa

SEQ ID NO: 408451 - RNA, 20 nt, Homo sapiens
uguucucauggagaagacuu

SEQ ID NO: 408452 - RNA, 15 nt, Homo sapiens
uguucugaacugugg

SEQ ID NO: 408453 - RNA, 23 nt, Homo sapiens
uguucugaauaauuucuuacuaa

SEQ ID NO: 408454 - RNA, 20 nt, Homo sapiens
uguucuugcugagcacccuc

SEQ ID NO: 408455 - RNA, 19 nt, Homo sapiens
uguucuuguaaaacuguga

SEQ ID NO: 408456 - RNA, 19 nt, Homo sapiens
uguugaagaacucauguga

SEQ ID NO: 408457 - RNA, 14 nt, Homo sapiens
uguugaaguuuaca

SEQ ID NO: 408458 - RNA, 15 nt, Homo sapiens
uguugacacggccau

SEQ ID NO: 408459 - RNA, 17 nt, Homo sapiens
uguugacauccaagcuu

SEQ ID NO: 408460 - RNA, 15 nt, Homo sapiens
uguugacugcugcuc

SEQ ID NO: 408461 - RNA, 15 nt, Homo sapiens
uguugacuucuaucc

SEQ ID NO: 408462 - RNA, 21 nt, Homo sapiens
uguugagacugauucagagga

SEQ ID NO: 408463 - RNA, 22 nt, Homo sapiens
uguugaguucuguagagccuuc

SEQ ID NO: 408464 - RNA, 14 nt, Homo sapiens
uguugcaaucuggu

SEQ ID NO: 408465 - RNA, 16 nt, Homo sapiens
uguugcccauugcacu

SEQ ID NO: 408466 - RNA, 13 nt, Homo sapiens
uguugcugcaucu

SEQ ID NO: 408467 - RNA, 15 nt, Homo sapiens
uguugcugcaucucc

SEQ ID NO: 408468 - RNA, 19 nt, Homo sapiens
uguugcuuaauugugaaca

SEQ ID NO: 408469 - RNA, 12 nt, Homo sapiens
uguugguugaga

SEQ ID NO: 408470 - RNA, 14 nt, Homo sapiens
uguuguccaggaaa

SEQ ID NO: 408471 - RNA, 16 nt, Homo sapiens
uguugugucuugcuau

SEQ ID NO: 408472 - RNA, 15 nt, Homo sapiens
uguuguuauucagaa

SEQ ID NO: 408473 - RNA, 22 nt, Homo sapiens
uguuuaaaagcaaaacugcaaa

SEQ ID NO: 408474 - RNA, 13 nt, Homo sapiens
uguuuaaaagcau

SEQ ID NO: 408475 - RNA, 20 nt, Homo sapiens
uguuuaaauauaaaucugau

SEQ ID NO: 408476 - RNA, 19 nt, Homo sapiens
uguuuaagaaaaaauaaca

SEQ ID NO: 408477 - RNA, 19 nt, Homo sapiens
uguuuacaugaguucaaau

SEQ ID NO: 408478 - RNA, 19 nt, Homo sapiens
uguuuagaaugucaguuga

SEQ ID NO: 408479 - RNA, 13 nt, Homo sapiens
uguuuagcauuaa

SEQ ID NO: 408480 - RNA, 17 nt, Homo sapiens
uguuuauauacuggguu

SEQ ID NO: 408481 - RNA, 21 nt, Homo sapiens
uguuuaugaagaaagauacua

SEQ ID NO: 408482 - RNA, 22 nt, Homo sapiens
uguuuccuuuaauuuuuuacua

SEQ ID NO: 408483 - RNA, 19 nt, Homo sapiens
uguuucguaagacaaaaau

SEQ ID NO: 408484 - RNA, 17 nt, Homo sapiens
uguuucguagccauauu

SEQ ID NO: 408485 - RNA, 21 nt, Homo sapiens
uguuucuaaaacuaugguucc

SEQ ID NO: 408486 - RNA, 23 nt, Homo sapiens
uguuucuaauuugcugcugauaa

SEQ ID NO: 408487 - RNA, 16 nt, Homo sapiens
uguuucugaaccauua

SEQ ID NO: 408488 - RNA, 12 nt, Homo sapiens
uguuucuuccaa

SEQ ID NO: 408489 - RNA, 14 nt, Homo sapiens
uguuugagguuaaa

SEQ ID NO: 408490 - RNA, 17 nt, Homo sapiens
uguuugauacaguauua

SEQ ID NO: 408491 - RNA, 18 nt, Homo sapiens
uguuugccuuuaggcagg

SEQ ID NO: 408492 - RNA, 18 nt, Homo sapiens
uguuugcuggggccgaaa

SEQ ID NO: 408493 - RNA, 20 nt, Homo sapiens
uguuugcuuaaacaaaguga

SEQ ID NO: 408494 - RNA, 18 nt, Homo sapiens
uguuuggguauccugccc

SEQ ID NO: 408495 - RNA, 22 nt, Homo sapiens
uguuuuccccaauuauccuccu

SEQ ID NO: 408496 - RNA, 19 nt, Homo sapiens
uguuuuccuuugucaucau

SEQ ID NO: 408497 - RNA, 11 nt, Homo sapiens
uguuuugccau

SEQ ID NO: 408498 - RNA, 12 nt, Homo sapiens
uguuuuguacaa

SEQ ID NO: 408499 - RNA, 19 nt, Homo sapiens
uguuuuuaauaaagacagg

SEQ ID NO: 408500 - RNA, 20 nt, Homo sapiens
uguuuuuagcugguggcaau

SEQ ID NO: 408501 - RNA, 12 nt, Homo sapiens
uguuuuuugcca

SEQ ID NO: 408502 - RNA, 17 nt, Homo sapiens
uuaaaaaaaaacauuca

SEQ ID NO: 408503 - RNA, 18 nt, Homo sapiens
uuaaaaaaaaacauucaa

SEQ ID NO: 408504 - RNA, 15 nt, Homo sapiens
uuaaaaaaauaacau

SEQ ID NO: 408505 - RNA, 18 nt, Homo sapiens
uuaaaaaaauacaguauu

SEQ ID NO: 408506 - RNA, 23 nt, Homo sapiens
uuaaaaaagugguggcaaaagac

SEQ ID NO: 408507 - RNA, 13 nt, Homo sapiens
uuaaaaaaucuca

SEQ ID NO: 408508 - RNA, 22 nt, Homo sapiens
uuaaaaaaucucaaauuuggau

SEQ ID NO: 408509 - RNA, 17 nt, Homo sapiens
uuaaaaacccauaacua

SEQ ID NO: 408510 - RNA, 12 nt, Homo sapiens
uuaaaaagucaa

SEQ ID NO: 408511 - RNA, 14 nt, Homo sapiens
uuaaaaaguuucac

SEQ ID NO: 408512 - RNA, 22 nt, Homo sapiens
uuaaaaauaaacucugcacuua

SEQ ID NO: 408513 - RNA, 21 nt, Homo sapiens
uuaaaaaucuuucagaauaca

SEQ ID NO: 408514 - RNA, 13 nt, Homo sapiens
uuaaaacaaugaa

SEQ ID NO: 408515 - RNA, 15 nt, Homo sapiens
uuaaaagauucacua

SEQ ID NO: 408516 - RNA, 21 nt, Homo sapiens
uuaaaagggucguuaccagag

SEQ ID NO: 408517 - RNA, 18 nt, Homo sapiens
uuaaaauagcuuugcagu

SEQ ID NO: 408518 - RNA, 21 nt, Homo sapiens
uuaaaaucauucaauaucuga

SEQ ID NO: 408519 - RNA, 13 nt, Homo sapiens
uuaaacaccugac

SEQ ID NO: 408520 - RNA, 17 nt, Homo sapiens
uuaaacaccugacacau

SEQ ID NO: 408521 - RNA, 20 nt, Homo sapiens
uuaaacacggggcuugcaac

SEQ ID NO: 408522 - RNA, 13 nt, Homo sapiens
uuaaacaguuaca

SEQ ID NO: 408523 - RNA, 22 nt, Homo sapiens
uuaaacaugaauuuaaugucua

SEQ ID NO: 408524 - RNA, 16 nt, Homo sapiens
uuaaaccaaacggaac

SEQ ID NO: 408525 - RNA, 17 nt, Homo sapiens
uuaaacucuccuuugau

SEQ ID NO: 408526 - RNA, 21 nt, Homo sapiens
uuaaacugugguccaucucca

SEQ ID NO: 408527 - RNA, 19 nt, Homo sapiens
uuaaacuucuuaacuggca

SEQ ID NO: 408528 - RNA, 22 nt, Homo sapiens
uuaaagaaaaugugucugcaac

SEQ ID NO: 408529 - RNA, 13 nt, Homo sapiens
uuaaagaacugcu

SEQ ID NO: 408530 - RNA, 15 nt, Homo sapiens
uuaaagaacugcuua

SEQ ID NO: 408531 - RNA, 16 nt, Homo sapiens
uuaaagaugcuauucu

SEQ ID NO: 408532 - RNA, 17 nt, Homo sapiens
uuaaagcagucacuuca

SEQ ID NO: 408533 - RNA, 23 nt, Homo sapiens
uuaaagcuuggugcuaaaccaca

SEQ ID NO: 408534 - RNA, 20 nt, Homo sapiens
uuaaaggaauuaaacuaaaa

SEQ ID NO: 408535 - RNA, 20 nt, Homo sapiens
uuaaaguaaaaacaauucaa

SEQ ID NO: 408536 - RNA, 18 nt, Homo sapiens
uuaaaguuuuauaugcau

SEQ ID NO: 408537 - RNA, 15 nt, Homo sapiens
uuagauagugauauu

SEQ ID NO: 408538 - RNA, 18 nt, Homo sapiens
uuagaucaaggcaaaaau

SEQ ID NO: 408539 - RNA, 16 nt, Homo sapiens
uuagauuauauauucc

SEQ ID NO: 408540 - RNA, 19 nt, Homo sapiens
uuagauuuuucucaucucc

SEQ ID NO: 408541 - RNA, 16 nt, Homo sapiens
uuagcaaggggcucag

SEQ ID NO: 408542 - RNA, 22 nt, Homo sapiens
uuagcacccuucugcuguauac

SEQ ID NO: 408543 - RNA, 16 nt, Homo sapiens
uuagcaguucugcaaa

SEQ ID NO: 408544 - RNA, 13 nt, Homo sapiens
uuagcaugcacaa

SEQ ID NO: 408545 - RNA, 21 nt, Homo sapiens
uuagcccuguguccugaguua

SEQ ID NO: 408546 - RNA, 22 nt, Homo sapiens
uuagcuccuugaagacauauca

SEQ ID NO: 408547 - RNA, 23 nt, Homo sapiens
uuagcuguaaauacaugugugga

SEQ ID NO: 408548 - RNA, 18 nt, Homo sapiens
uuagcugucucagagaua

SEQ ID NO: 408549 - RNA, 16 nt, Homo sapiens
uuagcuucucugccaa

SEQ ID NO: 408550 - RNA, 18 nt, Homo sapiens
uuaggauuuaccaaauag

SEQ ID NO: 408551 - RNA, 13 nt, Homo sapiens
gggaagaccagcu

SEQ ID NO: 408552 - RNA, 18 nt, Homo sapiens
gggaagaggccagcguga

SEQ ID NO: 408553 - RNA, 14 nt, Homo sapiens
gggaagagggcagu

SEQ ID NO: 408554 - RNA, 20 nt, Homo sapiens
gggaagcaucugucuuguca

SEQ ID NO: 408555 - RNA, 22 nt, Homo sapiens
gggaagcugcagcuugggagag

SEQ ID NO: 408556 - RNA, 19 nt, Homo sapiens
gggaaggcgauguggugac

SEQ ID NO: 408557 - RNA, 22 nt, Homo sapiens
gggaaggugaccacauccaccu

SEQ ID NO: 408558 - RNA, 22 nt, Homo sapiens
gggaaugauuaagggagcugcu

SEQ ID NO: 408559 - RNA, 21 nt, Homo sapiens
gggacaucaaaaacagcagaa

SEQ ID NO: 408560 - RNA, 22 nt, Homo sapiens
gggaccaacugggcccaagaca

SEQ ID NO: 408561 - RNA, 15 nt, Homo sapiens
gggacuaggaccuga

SEQ ID NO: 408562 - RNA, 20 nt, Homo sapiens
gggacugcaugcaagcucag

SEQ ID NO: 408563 - RNA, 15 nt, Homo sapiens
gggacuggagucaga

SEQ ID NO: 408564 - RNA, 13 nt, Homo sapiens
gggacuuccuugc

SEQ ID NO: 408565 - RNA, 15 nt, Homo sapiens
gggagaaaagccaga

SEQ ID NO: 408566 - RNA, 14 nt, Homo sapiens
gggagacaaucuaa

SEQ ID NO: 408567 - RNA, 21 nt, Homo sapiens
gggagauccgcccugggcucu

SEQ ID NO: 408568 - RNA, 17 nt, Homo sapiens
gggagauugaaccacua

SEQ ID NO: 408569 - RNA, 14 nt, Homo sapiens
gggagcauguucau

SEQ ID NO: 408570 - RNA, 17 nt, Homo sapiens
gggagcucugcuugccg

SEQ ID NO: 408571 - RNA, 16 nt, Homo sapiens
gggagcugagccaguc

SEQ ID NO: 408572 - RNA, 14 nt, Homo sapiens
gggaggaacaaaga

SEQ ID NO: 408573 - RNA, 22 nt, Homo sapiens
gggaggacccacacugcuacac

SEQ ID NO: 408574 - RNA, 16 nt, Homo sapiens
gggaggucagugcuuc

SEQ ID NO: 408575 - RNA, 18 nt, Homo sapiens
gggaguccacgauucuca

SEQ ID NO: 408576 - RNA, 18 nt, Homo sapiens
gggagugcucaccgccuc

SEQ ID NO: 408577 - RNA, 13 nt, Homo sapiens
gggagugggagag

SEQ ID NO: 408578 - RNA, 19 nt, Homo sapiens
gggaugucugagaucagug

SEQ ID NO: 408579 - RNA, 10 nt, Homo sapiens
gggauguuuu

SEQ ID NO: 408580 - RNA, 23 nt, Homo sapiens
gggauuucuucgcugcucuagcu

SEQ ID NO: 408581 - RNA, 11 nt, Homo sapiens
gggauuugccg

SEQ ID NO: 408582 - RNA, 13 nt, Homo sapiens
gggcaacugauga

SEQ ID NO: 408583 - RNA, 17 nt, Homo sapiens
gggcaagccugaguggu

SEQ ID NO: 408584 - RNA, 15 nt, Homo sapiens
gggcaagucauuguc

SEQ ID NO: 408585 - RNA, 14 nt, Homo sapiens
gggcacagccagaa

SEQ ID NO: 408586 - RNA, 11 nt, Homo sapiens
gggcacagcug

SEQ ID NO: 408587 - RNA, 22 nt, Homo sapiens
gggcacuggccuagagccucac

SEQ ID NO: 408588 - RNA, 13 nt, Homo sapiens
gggcacugguggc

SEQ ID NO: 408589 - RNA, 21 nt, Homo sapiens
gggcagagguccccugagguc

SEQ ID NO: 408590 - RNA, 17 nt, Homo sapiens
gggcagcagcaucucag

SEQ ID NO: 408591 - RNA, 13 nt, Homo sapiens
gggcaggguucua

SEQ ID NO: 408592 - RNA, 19 nt, Homo sapiens
gggcagugcccaccaugca

SEQ ID NO: 408593 - RNA, 14 nt, Homo sapiens
gggcaguggcacga

SEQ ID NO: 408594 - RNA, 11 nt, Homo sapiens
gggcaucuccu

SEQ ID NO: 408595 - RNA, 12 nt, Homo sapiens
gggcaugccacc

SEQ ID NO: 408596 - RNA, 12 nt, Homo sapiens
gggcauguuucu

SEQ ID NO: 408597 - RNA, 13 nt, Homo sapiens
gggccacagccag

SEQ ID NO: 408598 - RNA, 17 nt, Homo sapiens
gggccaccaugcacuca

SEQ ID NO: 408599 - RNA, 18 nt, Homo sapiens
gggccaccaugcacucaa

SEQ ID NO: 408600 - RNA, 20 nt, Homo sapiens
gggccagcugccccucauuu

SEQ ID NO: 408601 - RNA, 16 nt, Homo sapiens
gggccaggagaaagaa

SEQ ID NO: 408602 - RNA, 14 nt, Homo sapiens
gggcccagccagcc

SEQ ID NO: 408603 - RNA, 21 nt, Homo sapiens
gggcccagcugggcucugcca

SEQ ID NO: 408604 - RNA, 14 nt, Homo sapiens
gggcccucagagga

SEQ ID NO: 408605 - RNA, 21 nt, Homo sapiens
gggcccugggguccccacucc

SEQ ID NO: 408606 - RNA, 15 nt, Homo sapiens
gggccgaauccccuc

SEQ ID NO: 408607 - RNA, 17 nt, Homo sapiens
gggccucaaggacuuga

SEQ ID NO: 408608 - RNA, 19 nt, Homo sapiens
gggccucugcucccaugcu

SEQ ID NO: 408609 - RNA, 14 nt, Homo sapiens
gggccuggaccugc

SEQ ID NO: 408610 - RNA, 23 nt, Homo sapiens
gggcucccggagagggagucagu

SEQ ID NO: 408611 - RNA, 14 nt, Homo sapiens
gggcucuguauaua

SEQ ID NO: 408612 - RNA, 11 nt, Homo sapiens
gggcuguagac

SEQ ID NO: 408613 - RNA, 15 nt, Homo sapiens
gggcuuacacgugga

SEQ ID NO: 408614 - RNA, 20 nt, Homo sapiens
gggcuucucgccccucagug

SEQ ID NO: 408615 - RNA, 21 nt, Homo sapiens
gggcuugugauuuccauuucu

SEQ ID NO: 408616 - RNA, 18 nt, Homo sapiens
ggggaagaguggucuuga

SEQ ID NO: 408617 - RNA, 23 nt, Homo sapiens
ggggaagggccccacucagggau

SEQ ID NO: 408618 - RNA, 22 nt, Homo sapiens
ggggaccugggcucauucuucu

SEQ ID NO: 408619 - RNA, 15 nt, Homo sapiens
ggggagaauggcucu

SEQ ID NO: 408620 - RNA, 15 nt, Homo sapiens
ggggagcaugggacu

SEQ ID NO: 408621 - RNA, 21 nt, Homo sapiens
ggggaugucuugagauguauu

SEQ ID NO: 408622 - RNA, 19 nt, Homo sapiens
ggggauguuugugcugcag

SEQ ID NO: 408623 - RNA, 14 nt, Homo sapiens
ggggcacagccaga

SEQ ID NO: 408624 - RNA, 13 nt, Homo sapiens
ggggcagggcagc

SEQ ID NO: 408625 - RNA, 14 nt, Homo sapiens
ggggcaugggugga

SEQ ID NO: 408626 - RNA, 23 nt, Homo sapiens
ggggccaggucacccuuugcugu

SEQ ID NO: 408627 - RNA, 21 nt, Homo sapiens
ggggccuuccuguguggccug

SEQ ID NO: 408628 - RNA, 18 nt, Homo sapiens
ggggccuugggugagugg

SEQ ID NO: 408629 - RNA, 19 nt, Homo sapiens
ggggcgggaaagccaguga

SEQ ID NO: 408630 - RNA, 13 nt, Homo sapiens
ggggcucccugug

SEQ ID NO: 408631 - RNA, 21 nt, Homo sapiens
ggggcugacuucaauccaugu

SEQ ID NO: 408632 - RNA, 15 nt, Homo sapiens
ggggcugaggggcaa

SEQ ID NO: 408633 - RNA, 13 nt, Homo sapiens
ggggcuguccaau

SEQ ID NO: 408634 - RNA, 14 nt, Homo sapiens
gggggcagcagggg

SEQ ID NO: 408635 - RNA, 20 nt, Homo sapiens
gggggcaucaggagcagggg

SEQ ID NO: 408636 - RNA, 10 nt, Homo sapiens
ggggggcccg

SEQ ID NO: 408637 - RNA, 20 nt, Homo sapiens
gggggucucaccauguugcc

SEQ ID NO: 408638 - RNA, 20 nt, Homo sapiens
gggggucuugcuauguugcc

SEQ ID NO: 408639 - RNA, 18 nt, Homo sapiens
ggggucucccugagccug

SEQ ID NO: 408640 - RNA, 20 nt, Homo sapiens
ggggucuguauauacauuuc

SEQ ID NO: 408641 - RNA, 15 nt, Homo sapiens
gggguggggagcaug

SEQ ID NO: 408642 - RNA, 14 nt, Homo sapiens
gggguuagaccacu

SEQ ID NO: 408643 - RNA, 18 nt, Homo sapiens
gggguuggguuccagaca

SEQ ID NO: 408644 - RNA, 12 nt, Homo sapiens
ggguaagugcuu

SEQ ID NO: 408645 - RNA, 19 nt, Homo sapiens
ggguaauagaaaugcauac

SEQ ID NO: 408646 - RNA, 21 nt, Homo sapiens
ggguaucccagaccccucuca

SEQ ID NO: 408647 - RNA, 18 nt, Homo sapiens
ggguaugggaagccauau

SEQ ID NO: 408648 - RNA, 20 nt, Homo sapiens
gggucaaagugguacaggaa

SEQ ID NO: 408649 - RNA, 19 nt, Homo sapiens
gggucucacaguguugccc

SEQ ID NO: 408650 - RNA, 16 nt, Homo sapiens
gggugacagugccuuc

SEQ ID NO: 408651 - RNA, 14 nt, Homo sapiens
gggugacaucccag

SEQ ID NO: 408652 - RNA, 19 nt, Homo sapiens
gggugagcagggcccucag

SEQ ID NO: 408653 - RNA, 11 nt, Homo sapiens
gggugagccag

SEQ ID NO: 408654 - RNA, 15 nt, Homo sapiens
gggugcaaugauaau

SEQ ID NO: 408655 - RNA, 22 nt, Homo sapiens
gggugcuaauccaggacagcau

SEQ ID NO: 408656 - RNA, 11 nt, Homo sapiens
gggugcuccug

SEQ ID NO: 408657 - RNA, 14 nt, Homo sapiens
gggugucugcuaaa

SEQ ID NO: 408658 - RNA, 17 nt, Homo sapiens
ggguguggcaguguaug

SEQ ID NO: 408659 - RNA, 23 nt, Homo sapiens
ggguguguuucaggacagcugcu

SEQ ID NO: 408660 - RNA, 16 nt, Homo sapiens
ggguuacaaacugcaa

SEQ ID NO: 408661 - RNA, 14 nt, Homo sapiens
ggguucaagugauu

SEQ ID NO: 408662 - RNA, 14 nt, Homo sapiens
ggguuccagacagg

SEQ ID NO: 408663 - RNA, 16 nt, Homo sapiens
ggguugcuugggccac

SEQ ID NO: 408664 - RNA, 23 nt, Homo sapiens
gguaaagccucagcaacagccag

SEQ ID NO: 408665 - RNA, 15 nt, Homo sapiens
gguaaugugaauaaa

SEQ ID NO: 408666 - RNA, 21 nt, Homo sapiens
gguaauugccuaaaucuccag

SEQ ID NO: 408667 - RNA, 14 nt, Homo sapiens
gguacaauuguaaa

SEQ ID NO: 408668 - RNA, 15 nt, Homo sapiens
gguacuacaaccaau

SEQ ID NO: 408669 - RNA, 20 nt, Homo sapiens
gguacugugaggaagagcag

SEQ ID NO: 408670 - RNA, 13 nt, Homo sapiens
gguacuugguaag

SEQ ID NO: 408671 - RNA, 19 nt, Homo sapiens
gguagagaugggguuucac

SEQ ID NO: 408672 - RNA, 18 nt, Homo sapiens
gguaguuagccaucuaau

SEQ ID NO: 408673 - RNA, 16 nt, Homo sapiens
gguauccugcccagug

SEQ ID NO: 408674 - RNA, 19 nt, Homo sapiens
gguaucugcugccucugaa

SEQ ID NO: 408675 - RNA, 16 nt, Homo sapiens
gguaugaguugcccau

SEQ ID NO: 408676 - RNA, 11 nt, Homo sapiens
gguaugucuuu

SEQ ID NO: 408677 - RNA, 14 nt, Homo sapiens
gguauuagcaccuc

SEQ ID NO: 408678 - RNA, 19 nt, Homo sapiens
gguauuggccgaugagcug

SEQ ID NO: 408679 - RNA, 21 nt, Homo sapiens
ggucagcucccaucucauuuc

SEQ ID NO: 408680 - RNA, 18 nt, Homo sapiens
ggucagcucuggccacaa

SEQ ID NO: 408681 - RNA, 21 nt, Homo sapiens
ggucagcuugaauguccccau

SEQ ID NO: 408682 - RNA, 20 nt, Homo sapiens
ggucagcuuuuguuguuuau

SEQ ID NO: 408683 - RNA, 22 nt, Homo sapiens
ggucaggaacaguggcugggug

SEQ ID NO: 408684 - RNA, 14 nt, Homo sapiens
uuaggcagucuucu

SEQ ID NO: 408685 - RNA, 15 nt, Homo sapiens
uuagggacagaauua

SEQ ID NO: 408686 - RNA, 17 nt, Homo sapiens
uuagguugcacauucac

SEQ ID NO: 408687 - RNA, 16 nt, Homo sapiens
uuaguagagacagggu

SEQ ID NO: 408688 - RNA, 16 nt, Homo sapiens
uuaguuuuauauugcu

SEQ ID NO: 408689 - RNA, 21 nt, Homo sapiens
uuauaaaaucuuuccaucuca

SEQ ID NO: 408690 - RNA, 16 nt, Homo sapiens
uuauaaaauuaagcaa

SEQ ID NO: 408691 - RNA, 16 nt, Homo sapiens
uuauaaacuagaucuc

SEQ ID NO: 408692 - RNA, 12 nt, Homo sapiens
uuauaaauauca

SEQ ID NO: 408693 - RNA, 17 nt, Homo sapiens
uuauaaccaacuuuucu

SEQ ID NO: 408694 - RNA, 22 nt, Homo sapiens
uuauaauuuugguccaaauucu

SEQ ID NO: 408695 - RNA, 17 nt, Homo sapiens
uuauacuagguuaacau

SEQ ID NO: 408696 - RNA, 14 nt, Homo sapiens
uuauacugcacuuu

SEQ ID NO: 408697 - RNA, 21 nt, Homo sapiens
uuauagaauauuuauuaccuc

SEQ ID NO: 408698 - RNA, 19 nt, Homo sapiens
uuauagcuuccagauuaca

SEQ ID NO: 408699 - RNA, 23 nt, Homo sapiens
uuauaggaaaaguuauugugaua

SEQ ID NO: 408700 - RNA, 18 nt, Homo sapiens
uuauauagguugugcaaa

SEQ ID NO: 408701 - RNA, 19 nt, Homo sapiens
uuauauaugaaaacuaagu

SEQ ID NO: 408702 - RNA, 19 nt, Homo sapiens
uuauauauuuauaacucau

SEQ ID NO: 408703 - RNA, 18 nt, Homo sapiens
uuauauauuugaaagaag

SEQ ID NO: 408704 - RNA, 14 nt, Homo sapiens
uuauaucagccuga

SEQ ID NO: 408705 - RNA, 16 nt, Homo sapiens
uuauauuaaaauaugg

SEQ ID NO: 408706 - RNA, 14 nt, Homo sapiens
uuauauugccuuau

SEQ ID NO: 408707 - RNA, 17 nt, Homo sapiens
uuaucaguacaauucuu

SEQ ID NO: 408708 - RNA, 16 nt, Homo sapiens
uuaucagugauggucu

SEQ ID NO: 408709 - RNA, 22 nt, Homo sapiens
uuauccaagaccugaaagaugg

SEQ ID NO: 408710 - RNA, 15 nt, Homo sapiens
uuauccagaugaacu

SEQ ID NO: 408711 - RNA, 18 nt, Homo sapiens
uuaucccagugaucaccu

SEQ ID NO: 408712 - RNA, 17 nt, Homo sapiens
uuauccuccuucacucc

SEQ ID NO: 408713 - RNA, 16 nt, Homo sapiens
uuauccuuuuaucuca

SEQ ID NO: 408714 - RNA, 11 nt, Homo sapiens
uuaucugcuag

SEQ ID NO: 408715 - RNA, 20 nt, Homo sapiens
uuaucuugcaccccaaagcu

SEQ ID NO: 408716 - RNA, 15 nt, Homo sapiens
uuaucuuggacugac

SEQ ID NO: 408717 - RNA, 21 nt, Homo sapiens
uuaugaaccgcaauaugggag

SEQ ID NO: 408718 - RNA, 18 nt, Homo sapiens
uuaugaccucaacaaaga

SEQ ID NO: 408719 - RNA, 13 nt, Homo sapiens
uuaugacuccaga

SEQ ID NO: 408720 - RNA, 16 nt, Homo sapiens
uuaugcagugcugcuu

SEQ ID NO: 408721 - RNA, 16 nt, Homo sapiens
uuaugcugaaacagaa

SEQ ID NO: 408722 - RNA, 11 nt, Homo sapiens
uuaugcugcug

SEQ ID NO: 408723 - RNA, 21 nt, Homo sapiens
uuaugcuguggucacaggggu

SEQ ID NO: 408724 - RNA, 19 nt, Homo sapiens
uuaugggaacaaguguaca

SEQ ID NO: 408725 - RNA, 10 nt, Homo sapiens
uuauguacug

SEQ ID NO: 408726 - RNA, 14 nt, Homo sapiens
uuaugucuauaacu

SEQ ID NO: 408727 - RNA, 12 nt, Homo sapiens
uuaugugacaac

SEQ ID NO: 408728 - RNA, 14 nt, Homo sapiens
uuauguugcuccag

SEQ ID NO: 408729 - RNA, 20 nt, Homo sapiens
uuauuaaugaacugugacag

SEQ ID NO: 408730 - RNA, 16 nt, Homo sapiens
uuauuacaucuuuauu

SEQ ID NO: 408731 - RNA, 12 nt, Homo sapiens
uuauuaccucug

SEQ ID NO: 408732 - RNA, 18 nt, Homo sapiens
uuauuauggguauguguu

SEQ ID NO: 408733 - RNA, 23 nt, Homo sapiens
uuauucaauaacuauugcugcuu

SEQ ID NO: 408734 - RNA, 23 nt, Homo sapiens
uuauucuaauaaauauacuauga

SEQ ID NO: 408735 - RNA, 23 nt, Homo sapiens
uuauugaauaacgcacaguauuu

SEQ ID NO: 408736 - RNA, 13 nt, Homo sapiens
uuauuguauauau

SEQ ID NO: 408737 - RNA, 20 nt, Homo sapiens
uuauuuaaaaagaacucuga

SEQ ID NO: 408738 - RNA, 23 nt, Homo sapiens
uuauuuaaagaaaaaaaaggcag

SEQ ID NO: 408739 - RNA, 13 nt, Homo sapiens
uuauuuccaugga

SEQ ID NO: 408740 - RNA, 14 nt, Homo sapiens
uuauuucugaucua

SEQ ID NO: 408741 - RNA, 19 nt, Homo sapiens
uuauuuuuauaucagccug

SEQ ID NO: 408742 - RNA, 22 nt, Homo sapiens
uuauuuuucauauugugccaau

SEQ ID NO: 408743 - RNA, 13 nt, Homo sapiens
uucaaaacuucag

SEQ ID NO: 408744 - RNA, 12 nt, Homo sapiens
uucaaaagugga

SEQ ID NO: 408745 - RNA, 16 nt, Homo sapiens
uucaaaauguuaacaa

SEQ ID NO: 408746 - RNA, 21 nt, Homo sapiens
uucaaaauuccauuuacuuga

SEQ ID NO: 408747 - RNA, 17 nt, Homo sapiens
uucaaacgaaauggcuc

SEQ ID NO: 408748 - RNA, 15 nt, Homo sapiens
uucaaaugcuguaac

SEQ ID NO: 408749 - RNA, 16 nt, Homo sapiens
uucaacagcucaccaa

SEQ ID NO: 408750 - RNA, 11 nt, Homo sapiens
uucaaccacug

SEQ ID NO: 408751 - RNA, 15 nt, Homo sapiens
uucaaccacuguaaa

SEQ ID NO: 408752 - RNA, 22 nt, Homo sapiens
uucaaccaguuugaaccaagaa

SEQ ID NO: 408753 - RNA, 21 nt, Homo sapiens
uucaacuaauacaugguuuaa

SEQ ID NO: 408754 - RNA, 16 nt, Homo sapiens
uucaagauuaaacuga

SEQ ID NO: 408755 - RNA, 21 nt, Homo sapiens
uucaaggcauuucuaucacau

SEQ ID NO: 408756 - RNA, 12 nt, Homo sapiens
uucaaguguaca

SEQ ID NO: 408757 - RNA, 13 nt, Homo sapiens
uucaaguguacag

SEQ ID NO: 408758 - RNA, 22 nt, Homo sapiens
uucaaguuaaagugaauaacca

SEQ ID NO: 408759 - RNA, 12 nt, Homo sapiens
uucaaucucuug

SEQ ID NO: 408760 - RNA, 13 nt, Homo sapiens
uucaaugaacugu

SEQ ID NO: 408761 - RNA, 15 nt, Homo sapiens
uucaaugaauacugg

SEQ ID NO: 408762 - RNA, 20 nt, Homo sapiens
uucaaugaaucaaauccaau

SEQ ID NO: 408763 - RNA, 18 nt, Homo sapiens
uucaaugaucuagguuua

SEQ ID NO: 408764 - RNA, 19 nt, Homo sapiens
uucaaugcuuucuacucau

SEQ ID NO: 408765 - RNA, 21 nt, Homo sapiens
uucaauggcaccuucauucuc

SEQ ID NO: 408766 - RNA, 22 nt, Homo sapiens
uucaaugguugggacaauggca

SEQ ID NO: 408767 - RNA, 12 nt, Homo sapiens
uucaaugugacu

SEQ ID NO: 408768 - RNA, 15 nt, Homo sapiens
uucaauuaccaagaa

SEQ ID NO: 408769 - RNA, 20 nt, Homo sapiens
uucacacccuuuugugagac

SEQ ID NO: 408770 - RNA, 22 nt, Homo sapiens
uucacacuuugcccuaugacau

SEQ ID NO: 408771 - RNA, 20 nt, Homo sapiens
uucacagggacagaucugau

SEQ ID NO: 408772 - RNA, 14 nt, Homo sapiens
uucaccaacaacag

SEQ ID NO: 408773 - RNA, 14 nt, Homo sapiens
uucaccagagcauu

SEQ ID NO: 408774 - RNA, 15 nt, Homo sapiens
uucaccagagcauuu

SEQ ID NO: 408775 - RNA, 22 nt, Homo sapiens
uucaccagucugucuacugugg

SEQ ID NO: 408776 - RNA, 17 nt, Homo sapiens
uucacccacgcauauac

SEQ ID NO: 408777 - RNA, 17 nt, Homo sapiens
uucaccccugcacuuca

SEQ ID NO: 408778 - RNA, 17 nt, Homo sapiens
uucaccugugacaaagg

SEQ ID NO: 408779 - RNA, 17 nt, Homo sapiens
uucaccuguuaaggugg

SEQ ID NO: 408780 - RNA, 17 nt, Homo sapiens
uucacgugcagcagcaa

SEQ ID NO: 408781 - RNA, 18 nt, Homo sapiens
uucacuauaaaugguguu

SEQ ID NO: 408782 - RNA, 17 nt, Homo sapiens
uucacucccugucauag

SEQ ID NO: 408783 - RNA, 16 nt, Homo sapiens
uucacugcagauuucu

SEQ ID NO: 408784 - RNA, 11 nt, Homo sapiens
uucacugcugc

SEQ ID NO: 408785 - RNA, 20 nt, Homo sapiens
uucagaaaagaugugcagau

SEQ ID NO: 408786 - RNA, 17 nt, Homo sapiens
uucagaagagaugggcu

SEQ ID NO: 408787 - RNA, 21 nt, Homo sapiens
uucagaagccccauuugcaca

SEQ ID NO: 408788 - RNA, 14 nt, Homo sapiens
uucagacucucucc

SEQ ID NO: 408789 - RNA, 22 nt, Homo sapiens
uucagagugguuucauugccuu

SEQ ID NO: 408790 - RNA, 23 nt, Homo sapiens
uucagaguugcuuuaaaguaccu

SEQ ID NO: 408791 - RNA, 19 nt, Homo sapiens
uucagaucauauuucacaa

SEQ ID NO: 408792 - RNA, 19 nt, Homo sapiens
uucagaugauucuaugucu

SEQ ID NO: 408793 - RNA, 13 nt, Homo sapiens
uucagcaagguga

SEQ ID NO: 408794 - RNA, 16 nt, Homo sapiens
uucagcccuaacauag

SEQ ID NO: 408795 - RNA, 15 nt, Homo sapiens
uucagcuccuuccac

SEQ ID NO: 408796 - RNA, 15 nt, Homo sapiens
uucagcugcaguuga

SEQ ID NO: 408797 - RNA, 17 nt, Homo sapiens
uucaggaagguaucaca

SEQ ID NO: 408798 - RNA, 19 nt, Homo sapiens
uucaggagaaugugcagug

SEQ ID NO: 408799 - RNA, 17 nt, Homo sapiens
uuauuaauuucuucaca

SEQ ID NO: 408800 - RNA, 18 nt, Homo sapiens
uuauuaccccacacaucc

SEQ ID NO: 408801 - RNA, 15 nt, Homo sapiens
uuauuaccucugaua

SEQ ID NO: 408802 - RNA, 22 nt, Homo sapiens
uuauucagaaaagaugugcaga

SEQ ID NO: 408803 - RNA, 15 nt, Homo sapiens
uuauucccccaaagc

SEQ ID NO: 408804 - RNA, 12 nt, Homo sapiens
uuauucuaguca

SEQ ID NO: 408805 - RNA, 15 nt, Homo sapiens
uuauugaaugugauu

SEQ ID NO: 408806 - RNA, 20 nt, Homo sapiens
uuauugaauguuauaucauc

SEQ ID NO: 408807 - RNA, 23 nt, Homo sapiens
uuauugccuggagugugaacugu

SEQ ID NO: 408808 - RNA, 19 nt, Homo sapiens
uuauugggcaagugauuga

SEQ ID NO: 408809 - RNA, 15 nt, Homo sapiens
uuauuguaaaugagu

SEQ ID NO: 408810 - RNA, 14 nt, Homo sapiens
uuauuguaccucuc

SEQ ID NO: 408811 - RNA, 12 nt, Homo sapiens
uuauuguuccaa

SEQ ID NO: 408812 - RNA, 12 nt, Homo sapiens
uuauuucauuca

SEQ ID NO: 408813 - RNA, 15 nt, Homo sapiens
uuauuuccauggauu

SEQ ID NO: 408814 - RNA, 13 nt, Homo sapiens
uuauuucuagcaa

SEQ ID NO: 408815 - RNA, 21 nt, Homo sapiens
uuauuucucuuucaucaaaac

SEQ ID NO: 408816 - RNA, 19 nt, Homo sapiens
uuauuucugaucuauacaa

SEQ ID NO: 408817 - RNA, 20 nt, Homo sapiens
uuauuucugaucuauacaaa

SEQ ID NO: 408818 - RNA, 14 nt, Homo sapiens
uuauuugacuaaag

SEQ ID NO: 408819 - RNA, 13 nt, Homo sapiens
uuauuugaucugg

SEQ ID NO: 408820 - RNA, 22 nt, Homo sapiens
uuauuuggaguuagguccucac

SEQ ID NO: 408821 - RNA, 14 nt, Homo sapiens
uucaaaacuuucag

SEQ ID NO: 408822 - RNA, 18 nt, Homo sapiens
uucaaaauauacauucaa

SEQ ID NO: 408823 - RNA, 14 nt, Homo sapiens
uucaaaaugcaugu

SEQ ID NO: 408824 - RNA, 17 nt, Homo sapiens
uucaaaaugcaugugau

SEQ ID NO: 408825 - RNA, 22 nt, Homo sapiens
uucaaaauuccauuuacuugau

SEQ ID NO: 408826 - RNA, 18 nt, Homo sapiens
uucaaacauuauucucaa

SEQ ID NO: 408827 - RNA, 12 nt, Homo sapiens
uucaaacuuaaa

SEQ ID NO: 408828 - RNA, 15 nt, Homo sapiens
uucaaagagucauau

SEQ ID NO: 408829 - RNA, 22 nt, Homo sapiens
uucaaagagucauauugcccag

SEQ ID NO: 408830 - RNA, 13 nt, Homo sapiens
uucaaagucucac

SEQ ID NO: 408831 - RNA, 14 nt, Homo sapiens
uucaaauacuuuug

SEQ ID NO: 408832 - RNA, 19 nt, Homo sapiens
uucaaaucagagcagugau

SEQ ID NO: 408833 - RNA, 21 nt, Homo sapiens
uucaaauccucccuacuucca

SEQ ID NO: 408834 - RNA, 23 nt, Homo sapiens
uucaacagcucaccaacuacaga

SEQ ID NO: 408835 - RNA, 18 nt, Homo sapiens
uucaaccacauuugcuag

SEQ ID NO: 408836 - RNA, 17 nt, Homo sapiens
uuccccaagaaggugag

SEQ ID NO: 408837 - RNA, 13 nt, Homo sapiens
uuccccacucccg

SEQ ID NO: 408838 - RNA, 17 nt, Homo sapiens
uuccccccaaaacugau

SEQ ID NO: 408839 - RNA, 16 nt, Homo sapiens
uucccccgcuaauuca

SEQ ID NO: 408840 - RNA, 19 nt, Homo sapiens
uuccccggaguaccuauug

SEQ ID NO: 408841 - RNA, 19 nt, Homo sapiens
uuccccgugggccauggca

SEQ ID NO: 408842 - RNA, 18 nt, Homo sapiens
uuccccucauugcauuua

SEQ ID NO: 408843 - RNA, 19 nt, Homo sapiens
uuccccucccuggguucag

SEQ ID NO: 408844 - RNA, 19 nt, Homo sapiens
uucccggcgucccuaccuc

SEQ ID NO: 408845 - RNA, 23 nt, Homo sapiens
uucccggcuggacuuuugcagcu

SEQ ID NO: 408846 - RNA, 17 nt, Homo sapiens
uucccuagacucuguaa

SEQ ID NO: 408847 - RNA, 16 nt, Homo sapiens
uucccuccaccagugu

SEQ ID NO: 408848 - RNA, 18 nt, Homo sapiens
uucccugucuuccccacc

SEQ ID NO: 408849 - RNA, 19 nt, Homo sapiens
uucccuuagccucucccac

SEQ ID NO: 408850 - RNA, 15 nt, Homo sapiens
uucccuucaaugcaa

SEQ ID NO: 408851 - RNA, 17 nt, Homo sapiens
uucccuuccacugccuc

SEQ ID NO: 408852 - RNA, 19 nt, Homo sapiens
uucccuuccaguuccggga

SEQ ID NO: 408853 - RNA, 21 nt, Homo sapiens
uucccuucuccuuccaacugc

SEQ ID NO: 408854 - RNA, 14 nt, Homo sapiens
uucccuugcuggaa

SEQ ID NO: 408855 - RNA, 15 nt, Homo sapiens
uuccuaggccucagg

SEQ ID NO: 408856 - RNA, 18 nt, Homo sapiens
uuccuagucauaauguca

SEQ ID NO: 408857 - RNA, 16 nt, Homo sapiens
uuccuaugcaguguca

SEQ ID NO: 408858 - RNA, 17 nt, Homo sapiens
uuccuauuaaucuucag

SEQ ID NO: 408859 - RNA, 19 nt, Homo sapiens
uuccuauuuguuuucaugg

SEQ ID NO: 408860 - RNA, 19 nt, Homo sapiens
uuccuccauggcccaucac

SEQ ID NO: 408861 - RNA, 18 nt, Homo sapiens
uuccucgccugacaacca

SEQ ID NO: 408862 - RNA, 16 nt, Homo sapiens
uuccucuuaccuguaa

SEQ ID NO: 408863 - RNA, 21 nt, Homo sapiens
uuccucuuacgcucugcucaa

SEQ ID NO: 408864 - RNA, 17 nt, Homo sapiens
uuccucuuccacuuuga

SEQ ID NO: 408865 - RNA, 14 nt, Homo sapiens
uuccucuugccucu

SEQ ID NO: 408866 - RNA, 18 nt, Homo sapiens
uuccucuuucacuucuua

SEQ ID NO: 408867 - RNA, 13 nt, Homo sapiens
uuccucuuugcau

SEQ ID NO: 408868 - RNA, 14 nt, Homo sapiens
uuccugagauucug

SEQ ID NO: 408869 - RNA, 17 nt, Homo sapiens
uuccugagauucuggga

SEQ ID NO: 408870 - RNA, 18 nt, Homo sapiens
uuccugagauucugggaa

SEQ ID NO: 408871 - RNA, 16 nt, Homo sapiens
uuccugaucacuaugc

SEQ ID NO: 408872 - RNA, 18 nt, Homo sapiens
uuccugaucacuaugcau

SEQ ID NO: 408873 - RNA, 21 nt, Homo sapiens
uuccugcaacucaaggacuuu

SEQ ID NO: 408874 - RNA, 19 nt, Homo sapiens
uuccugccaccugcugcug

SEQ ID NO: 408875 - RNA, 23 nt, Homo sapiens
uuccugccuuugauguggaugaa

SEQ ID NO: 408876 - RNA, 15 nt, Homo sapiens
uuccuguagucccau

SEQ ID NO: 408877 - RNA, 22 nt, Homo sapiens
uuccuguguccacaucuaacaa

SEQ ID NO: 408878 - RNA, 17 nt, Homo sapiens
uuccuguucccaugaga

SEQ ID NO: 408879 - RNA, 18 nt, Homo sapiens
uuccuucagacagauucc

SEQ ID NO: 408880 - RNA, 20 nt, Homo sapiens
uuccuucagacagauuccag

SEQ ID NO: 408881 - RNA, 16 nt, Homo sapiens
uuccuucccugggaag

SEQ ID NO: 408882 - RNA, 21 nt, Homo sapiens
uuccuugauggagauauuuac

SEQ ID NO: 408883 - RNA, 15 nt, Homo sapiens
uuccuugguucccuc

SEQ ID NO: 408884 - RNA, 15 nt, Homo sapiens
uucgaauccagagag

SEQ ID NO: 408885 - RNA, 21 nt, Homo sapiens
uucgaauccagagagcagugu

SEQ ID NO: 408886 - RNA, 23 nt, Homo sapiens
uucgaauccagagagcagugugg

SEQ ID NO: 408887 - RNA, 15 nt, Homo sapiens
uucgaccacuacagc

SEQ ID NO: 408888 - RNA, 17 nt, Homo sapiens
uucgauguacagucuca

SEQ ID NO: 408889 - RNA, 18 nt, Homo sapiens
uucgcagugcccagugau

SEQ ID NO: 408890 - RNA, 18 nt, Homo sapiens
uucgcgcuggaauccaga

SEQ ID NO: 408891 - RNA, 15 nt, Homo sapiens
uucgcugagucccag

SEQ ID NO: 408892 - RNA, 13 nt, Homo sapiens
uucguaguuuuca

SEQ ID NO: 408893 - RNA, 17 nt, Homo sapiens
uucuaaaggcuugauau

SEQ ID NO: 408894 - RNA, 14 nt, Homo sapiens
uucuaaaugcauau

SEQ ID NO: 408895 - RNA, 20 nt, Homo sapiens
uucuaaccuuucuaacccac

SEQ ID NO: 408896 - RNA, 19 nt, Homo sapiens
uucuaagagcagcagcaua

SEQ ID NO: 408897 - RNA, 21 nt, Homo sapiens
uucuaaggauagccuuuguag

SEQ ID NO: 408898 - RNA, 16 nt, Homo sapiens
uucuaauccaugugcu

SEQ ID NO: 408899 - RNA, 22 nt, Homo sapiens
uucuacaccuguugcaccucag

SEQ ID NO: 408900 - RNA, 19 nt, Homo sapiens
uucuacacuguauuacaua

SEQ ID NO: 408901 - RNA, 14 nt, Homo sapiens
uucuacaugacugg

SEQ ID NO: 408902 - RNA, 15 nt, Homo sapiens
uucuaccaaaugugu

SEQ ID NO: 408903 - RNA, 23 nt, Homo sapiens
uucuaccuuccugcaacaccuug

SEQ ID NO: 408904 - RNA, 20 nt, Homo sapiens
uucuacucgaguuacagaca

SEQ ID NO: 408905 - RNA, 14 nt, Homo sapiens
uucuacuuugccac

SEQ ID NO: 408906 - RNA, 18 nt, Homo sapiens
uucuagaaaagcuuccua

SEQ ID NO: 408907 - RNA, 23 nt, Homo sapiens
uucuagaaagccccucaccucag

SEQ ID NO: 408908 - RNA, 14 nt, Homo sapiens
uucuagauucacug

SEQ ID NO: 408909 - RNA, 19 nt, Homo sapiens
uucuagcuaccuguauuau

SEQ ID NO: 408910 - RNA, 22 nt, Homo sapiens
uucuaggauaagcacuagaucu

SEQ ID NO: 408911 - RNA, 17 nt, Homo sapiens
uucuaggccaagcauuu

SEQ ID NO: 408912 - RNA, 17 nt, Homo sapiens
uucuaguccuggaugac

SEQ ID NO: 408913 - RNA, 17 nt, Homo sapiens
uucuaguuguaaugugu

SEQ ID NO: 408914 - RNA, 11 nt, Homo sapiens
uucuauacugu

SEQ ID NO: 408915 - RNA, 12 nt, Homo sapiens
uucuauggauuc

SEQ ID NO: 408916 - RNA, 18 nt, Homo sapiens
uucuauggauucacuucu

SEQ ID NO: 408917 - RNA, 14 nt, Homo sapiens
uucuauuaacuuua

SEQ ID NO: 408918 - RNA, 21 nt, Homo sapiens
uucuauuagcuuacugauuaa

SEQ ID NO: 408919 - RNA, 22 nt, Homo sapiens
uucuauuucaacuucaggaaag

SEQ ID NO: 408920 - RNA, 14 nt, Homo sapiens
uucucaaccagaga

SEQ ID NO: 408921 - RNA, 20 nt, Homo sapiens
uucucaggaggugucuccua

SEQ ID NO: 408922 - RNA, 21 nt, Homo sapiens
uucucagguguugccaaauau

SEQ ID NO: 408923 - RNA, 14 nt, Homo sapiens
uucucaucccacgc

SEQ ID NO: 408924 - RNA, 11 nt, Homo sapiens
uucucaucucc

SEQ ID NO: 408925 - RNA, 21 nt, Homo sapiens
uucucauuuagcauugaaaua

SEQ ID NO: 408926 - RNA, 16 nt, Homo sapiens
uucuccaccuccccca

SEQ ID NO: 408927 - RNA, 21 nt, Homo sapiens
uucuccaccugaagugaugau

SEQ ID NO: 408928 - RNA, 19 nt, Homo sapiens
uucucccucacuccugcca

SEQ ID NO: 408929 - RNA, 19 nt, Homo sapiens
uucuccguugucauugacu

SEQ ID NO: 408930 - RNA, 23 nt, Homo sapiens
uucuccucccuguuaucugcuag

SEQ ID NO: 408931 - RNA, 12 nt, Homo sapiens
uucucuagacau

SEQ ID NO: 408932 - RNA, 22 nt, Homo sapiens
uucucuagggaaggccaccugc

SEQ ID NO: 408933 - RNA, 23 nt, Homo sapiens
uucucuaguucaaguucaccaga

SEQ ID NO: 408934 - RNA, 22 nt, Homo sapiens
uucucucccuuccucucuccuu

SEQ ID NO: 408935 - RNA, 19 nt, Homo sapiens
ugaucuacuucauagcucc

SEQ ID NO: 408936 - RNA, 13 nt, Homo sapiens
ugaucuauacaaa

SEQ ID NO: 408937 - RNA, 18 nt, Homo sapiens
ugaucuauuacucugaca

SEQ ID NO: 408938 - RNA, 17 nt, Homo sapiens
ugaucuccugaccucau

SEQ ID NO: 408939 - RNA, 12 nt, Homo sapiens
ugaucucuuagg

SEQ ID NO: 408940 - RNA, 19 nt, Homo sapiens
ugaugaaaaauaugugcuu

SEQ ID NO: 408941 - RNA, 18 nt, Homo sapiens
ugaugaaugaggaacaau

SEQ ID NO: 408942 - RNA, 19 nt, Homo sapiens
ugaugagacaacacacaca

SEQ ID NO: 408943 - RNA, 13 nt, Homo sapiens
ugaugaugucucu

SEQ ID NO: 408944 - RNA, 22 nt, Homo sapiens
ugaugcauauugcccuggagaa

SEQ ID NO: 408945 - RNA, 19 nt, Homo sapiens
ugaugccuggcgcuuccag

SEQ ID NO: 408946 - RNA, 23 nt, Homo sapiens
ugaugcucccuccccugcccugg

SEQ ID NO: 408947 - RNA, 13 nt, Homo sapiens
ugauggaaauauu

SEQ ID NO: 408948 - RNA, 22 nt, Homo sapiens
ugauggaccuccuucgcuggaa

SEQ ID NO: 408949 - RNA, 21 nt, Homo sapiens
ugauggagauauuuacaugaa

SEQ ID NO: 408950 - RNA, 17 nt, Homo sapiens
ugauggauggacacaaa

SEQ ID NO: 408951 - RNA, 17 nt, Homo sapiens
ugauggcuugacaugug

SEQ ID NO: 408952 - RNA, 19 nt, Homo sapiens
ugaugguaacugcacacau

SEQ ID NO: 408953 - RNA, 18 nt, Homo sapiens
ugauggugagcugggaag

SEQ ID NO: 408954 - RNA, 11 nt, Homo sapiens
ugauguaaaac

SEQ ID NO: 408955 - RNA, 20 nt, Homo sapiens
ugauguccuguaaacacuca

SEQ ID NO: 408956 - RNA, 16 nt, Homo sapiens
ugaugucgaugcucac

SEQ ID NO: 408957 - RNA, 20 nt, Homo sapiens
ugaugugauacaaauugaua

SEQ ID NO: 408958 - RNA, 22 nt, Homo sapiens
ugaugugcgugcugucuguccu

SEQ ID NO: 408959 - RNA, 20 nt, Homo sapiens
ugauguuuguggccucagaa

SEQ ID NO: 408960 - RNA, 14 nt, Homo sapiens
ugauuaaacuguau

SEQ ID NO: 408961 - RNA, 15 nt, Homo sapiens
ugauuaacucagucc

SEQ ID NO: 408962 - RNA, 15 nt, Homo sapiens
ugauuccacuugugu

SEQ ID NO: 408963 - RNA, 17 nt, Homo sapiens
ugauucuaugccuguau

SEQ ID NO: 408964 - RNA, 13 nt, Homo sapiens
ugauucuaugucu

SEQ ID NO: 408965 - RNA, 16 nt, Homo sapiens
ugauucuccucuccca

SEQ ID NO: 408966 - RNA, 21 nt, Homo sapiens
ugauucuuuugcccacacuug

SEQ ID NO: 408967 - RNA, 16 nt, Homo sapiens
ugauugaaucauugcc

SEQ ID NO: 408968 - RNA, 20 nt, Homo sapiens
ugauugaaucugauuggaca

SEQ ID NO: 408969 - RNA, 17 nt, Homo sapiens
ugauugcaggaagggaa

SEQ ID NO: 408970 - RNA, 11 nt, Homo sapiens
ugauugcuaag

SEQ ID NO: 408971 - RNA, 18 nt, Homo sapiens
ugauuucacaacagauca

SEQ ID NO: 408972 - RNA, 14 nt, Homo sapiens
ugauuucauuucaa

SEQ ID NO: 408973 - RNA, 20 nt, Homo sapiens
ugauuucuccaaccacucau

SEQ ID NO: 408974 - RNA, 20 nt, Homo sapiens
ugauuucuugcuaagcucca

SEQ ID NO: 408975 - RNA, 17 nt, Homo sapiens
ugcaaaacauaucuuga

SEQ ID NO: 408976 - RNA, 21 nt, Homo sapiens
ugcaaaaucuccaauccacac

SEQ ID NO: 408977 - RNA, 13 nt, Homo sapiens
ugcaaacuuuuau

SEQ ID NO: 408978 - RNA, 21 nt, Homo sapiens
ugcaaagacugaguguucaaa

SEQ ID NO: 408979 - RNA, 14 nt, Homo sapiens
ugcaaagcauuuga

SEQ ID NO: 408980 - RNA, 15 nt, Homo sapiens
ugcaaaggacagauc

SEQ ID NO: 408981 - RNA, 12 nt, Homo sapiens
ugcaaaguaaua

SEQ ID NO: 408982 - RNA, 17 nt, Homo sapiens
ugcaaauaagacucuua

SEQ ID NO: 408983 - RNA, 17 nt, Homo sapiens
ugcaaaugcuauauugc

SEQ ID NO: 408984 - RNA, 23 nt, Homo sapiens
ugcaaauuagggcuacauuguaa

SEQ ID NO: 408985 - RNA, 14 nt, Homo sapiens
ugcaacagcacugg

SEQ ID NO: 408986 - RNA, 16 nt, Homo sapiens
ugcaacagcacuggcu

SEQ ID NO: 408987 - RNA, 16 nt, Homo sapiens
ugcaacccuuaccccu

SEQ ID NO: 408988 - RNA, 14 nt, Homo sapiens
ugcaaccucugccu

SEQ ID NO: 408989 - RNA, 16 nt, Homo sapiens
ugcaagagaaacugca

SEQ ID NO: 408990 - RNA, 15 nt, Homo sapiens
ugcaagagugacagu

SEQ ID NO: 408991 - RNA, 15 nt, Homo sapiens
ugcaagcacaucugc

SEQ ID NO: 408992 - RNA, 11 nt, Homo sapiens
ugcaagggaau

SEQ ID NO: 408993 - RNA, 16 nt, Homo sapiens
ugcaagugugugcaug

SEQ ID NO: 408994 - RNA, 19 nt, Homo sapiens
ugcaagugugugcaugugu

SEQ ID NO: 408995 - RNA, 18 nt, Homo sapiens
ugcaauaaaauaguagca

SEQ ID NO: 408996 - RNA, 16 nt, Homo sapiens
ugcaauagagacugua

SEQ ID NO: 408997 - RNA, 16 nt, Homo sapiens
ugcauaauuuugccaa

SEQ ID NO: 408998 - RNA, 13 nt, Homo sapiens
ugcauagcucuau

SEQ ID NO: 408999 - RNA, 18 nt, Homo sapiens
ugcaucaagaugugacau

SEQ ID NO: 409000 - RNA, 15 nt, Homo sapiens
ugcauccuacuccua

SEQ ID NO: 409001 - RNA, 22 nt, Homo sapiens
ugcaucuccccucagauuccac

SEQ ID NO: 409002 - RNA, 23 nt, Homo sapiens
ugcaucuccccucagauuccacc

SEQ ID NO: 409003 - RNA, 14 nt, Homo sapiens
ugcaucugucuguc

SEQ ID NO: 409004 - RNA, 15 nt, Homo sapiens
ugcaugaccugauca

SEQ ID NO: 409005 - RNA, 16 nt, Homo sapiens
ugcaugagaacuaaau

SEQ ID NO: 409006 - RNA, 14 nt, Homo sapiens
ugcaugcagaaagg

SEQ ID NO: 409007 - RNA, 16 nt, Homo sapiens
ugcauggaguguuuga

SEQ ID NO: 409008 - RNA, 17 nt, Homo sapiens
ugcauggccucuaagag

SEQ ID NO: 409009 - RNA, 13 nt, Homo sapiens
ugcaugugcugca

SEQ ID NO: 409010 - RNA, 18 nt, Homo sapiens
ugcauuagaaacugaaaa

SEQ ID NO: 409011 - RNA, 12 nt, Homo sapiens
ugcauucagggg

SEQ ID NO: 409012 - RNA, 16 nt, Homo sapiens
ugcauucuucuucacu

SEQ ID NO: 409013 - RNA, 19 nt, Homo sapiens
ugcauugaaagaauuagau

SEQ ID NO: 409014 - RNA, 18 nt, Homo sapiens
ugcauugcuaaaauauua

SEQ ID NO: 409015 - RNA, 21 nt, Homo sapiens
ugcauuggaagaccccaccca

SEQ ID NO: 409016 - RNA, 23 nt, Homo sapiens
ugcauugucuccuuccacaauga

SEQ ID NO: 409017 - RNA, 16 nt, Homo sapiens
ugcauuucaccuguga

SEQ ID NO: 409018 - RNA, 21 nt, Homo sapiens
ugcauuucuucacgcaccucg

SEQ ID NO: 409019 - RNA, 16 nt, Homo sapiens
ugcauuuuuagaccau

SEQ ID NO: 409020 - RNA, 15 nt, Homo sapiens
ugccaaaaacaacaa

SEQ ID NO: 409021 - RNA, 17 nt, Homo sapiens
ugccaaauaaaugcuca

SEQ ID NO: 409022 - RNA, 20 nt, Homo sapiens
ugccaaaugcuauacugugu

SEQ ID NO: 409023 - RNA, 15 nt, Homo sapiens
ugccaaauguuccau

SEQ ID NO: 409024 - RNA, 15 nt, Homo sapiens
ugccaaccggucacc

SEQ ID NO: 409025 - RNA, 18 nt, Homo sapiens
ugccaacuccaugaccag

SEQ ID NO: 409026 - RNA, 13 nt, Homo sapiens
ugccaacuuucca

SEQ ID NO: 409027 - RNA, 13 nt, Homo sapiens
ugccaagaacucu

SEQ ID NO: 409028 - RNA, 23 nt, Homo sapiens
ugccaagcccucaauaagccagc

SEQ ID NO: 409029 - RNA, 18 nt, Homo sapiens
ugccaaguaacaaugcau

SEQ ID NO: 409030 - RNA, 13 nt, Homo sapiens
ugccacacucuga

SEQ ID NO: 409031 - RNA, 13 nt, Homo sapiens
ugccacagccaag

SEQ ID NO: 409032 - RNA, 23 nt, Homo sapiens
ugccacauggagcuugacuucau

SEQ ID NO: 409033 - RNA, 11 nt, Homo sapiens
ugccacccaca

SEQ ID NO: 409034 - RNA, 23 nt, Homo sapiens
ugccacccucacacacacagcug

SEQ ID NO: 409035 - RNA, 17 nt, Homo sapiens
ugccaccggaaauacca

SEQ ID NO: 409036 - RNA, 18 nt, Homo sapiens
ugccaccuccugccucag

SEQ ID NO: 409037 - RNA, 14 nt, Homo sapiens
ugccaccugcugcu

SEQ ID NO: 409038 - RNA, 15 nt, Homo sapiens
ugccaccugcugcug

SEQ ID NO: 409039 - RNA, 15 nt, Homo sapiens
ugccaccugucuguc

SEQ ID NO: 409040 - RNA, 22 nt, Homo sapiens
ugccacuagguuucaccuccca

SEQ ID NO: 409041 - RNA, 17 nt, Homo sapiens
ugccacucccugagcuu

SEQ ID NO: 409042 - RNA, 17 nt, Homo sapiens
ugccacuugcacugugc

SEQ ID NO: 409043 - RNA, 21 nt, Homo sapiens
ugccagaaggauaauauugau

SEQ ID NO: 409044 - RNA, 18 nt, Homo sapiens
ugccagcccguguuucuc

SEQ ID NO: 409045 - RNA, 19 nt, Homo sapiens
ugccagcuccacagggugg

SEQ ID NO: 409046 - RNA, 19 nt, Homo sapiens
ugccagcuguuucaucacc

SEQ ID NO: 409047 - RNA, 22 nt, Homo sapiens
ugccaggacucucuuucuucca

SEQ ID NO: 409048 - RNA, 19 nt, Homo sapiens
ugccaggacugugacucau

SEQ ID NO: 409049 - RNA, 15 nt, Homo sapiens
ugccaggccuggcaa

SEQ ID NO: 409050 - RNA, 15 nt, Homo sapiens
ugccaggcugcuaaa

SEQ ID NO: 409051 - RNA, 20 nt, Homo sapiens
ugccaggcuguaagcauucu

SEQ ID NO: 409052 - RNA, 21 nt, Homo sapiens
ugccagguggcucagugccac

SEQ ID NO: 409053 - RNA, 22 nt, Homo sapiens
ugccaguauauaagcuguuuag

SEQ ID NO: 409054 - RNA, 15 nt, Homo sapiens
ugccagugacagaca

SEQ ID NO: 409055 - RNA, 18 nt, Homo sapiens
ugccagugggcagugcau

SEQ ID NO: 409056 - RNA, 16 nt, Homo sapiens
ugccagugucuuagca

SEQ ID NO: 409057 - RNA, 14 nt, Homo sapiens
ugccauaacauaaa

SEQ ID NO: 409058 - RNA, 20 nt, Homo sapiens
ugccaucaugccugacuaau

SEQ ID NO: 409059 - RNA, 16 nt, Homo sapiens
ugcgagugugugcaug

SEQ ID NO: 409060 - RNA, 19 nt, Homo sapiens
ugcgcaaaacugccugaaa

SEQ ID NO: 409061 - RNA, 18 nt, Homo sapiens
ugcgcaaugagacuacaa

SEQ ID NO: 409062 - RNA, 13 nt, Homo sapiens
ugcgcugugccaa

SEQ ID NO: 409063 - RNA, 17 nt, Homo sapiens
ugcgcuuuauugcccau

SEQ ID NO: 409064 - RNA, 13 nt, Homo sapiens
ugcggcaucagau

SEQ ID NO: 409065 - RNA, 15 nt, Homo sapiens
ugcggugugucucca

SEQ ID NO: 409066 - RNA, 22 nt, Homo sapiens
ugcguaggagagaacagggaug

SEQ ID NO: 409067 - RNA, 13 nt, Homo sapiens
ugcgugcaugugc

SEQ ID NO: 409068 - RNA, 15 nt, Homo sapiens
ugcgugcaugugcac

SEQ ID NO: 409069 - RNA, 17 nt, Homo sapiens
ugcgugguccauuccau

SEQ ID NO: 409070 - RNA, 14 nt, Homo sapiens
ugcgugugugcaag

SEQ ID NO: 409071 - RNA, 15 nt, Homo sapiens
ugcgugugugcaagu

SEQ ID NO: 409072 - RNA, 19 nt, Homo sapiens
ugcguuccucauccaugca

SEQ ID NO: 409073 - RNA, 13 nt, Homo sapiens
ugcguucuuucaa

SEQ ID NO: 409074 - RNA, 21 nt, Homo sapiens
ugcguugaggccgcaucuuuc

SEQ ID NO: 409075 - RNA, 13 nt, Homo sapiens
ugcuaacuuugcc

SEQ ID NO: 409076 - RNA, 22 nt, Homo sapiens
ugcuaagggaaauaacaguauu

SEQ ID NO: 409077 - RNA, 16 nt, Homo sapiens
ugcuaauuucugucca

SEQ ID NO: 409078 - RNA, 20 nt, Homo sapiens
ugcuacacuuacaaguaaug

SEQ ID NO: 409079 - RNA, 13 nt, Homo sapiens
ugcuaccugugag

SEQ ID NO: 409080 - RNA, 18 nt, Homo sapiens
ugcuacgaagaaagacuc

SEQ ID NO: 409081 - RNA, 15 nt, Homo sapiens
ugcuagcaacaacuu

SEQ ID NO: 409082 - RNA, 13 nt, Homo sapiens
ugcuagcuguaga

SEQ ID NO: 409083 - RNA, 15 nt, Homo sapiens
ugcuaguacuaguac

SEQ ID NO: 409084 - RNA, 16 nt, Homo sapiens
ugcuauugacaaguca

SEQ ID NO: 409085 - RNA, 22 nt, Homo sapiens
ugcucaaagauguaauguaguu

SEQ ID NO: 409086 - RNA, 17 nt, Homo sapiens
ugcucaaagauguacug

SEQ ID NO: 409087 - RNA, 22 nt, Homo sapiens
ugcucaaccccccucccagaca

SEQ ID NO: 409088 - RNA, 19 nt, Homo sapiens
ugcucaaugaaaccuuccu

SEQ ID NO: 409089 - RNA, 22 nt, Homo sapiens
ugcucaaugaaaccuuccucuu

SEQ ID NO: 409090 - RNA, 19 nt, Homo sapiens
ugcucacccauugucucau

SEQ ID NO: 409091 - RNA, 20 nt, Homo sapiens
ugcucacccauugucucauu

SEQ ID NO: 409092 - RNA, 20 nt, Homo sapiens
ugcucagaaauguugguuac

SEQ ID NO: 409093 - RNA, 20 nt, Homo sapiens
ugcucagagaaggaaaagac

SEQ ID NO: 409094 - RNA, 24 nt, Homo sapiens
ugcucaguggaucacacacaugga

SEQ ID NO: 409095 - RNA, 17 nt, Homo sapiens
ugcucaguuggugcugc

SEQ ID NO: 409096 - RNA, 15 nt, Homo sapiens
ugcucauucauauuc

SEQ ID NO: 409097 - RNA, 17 nt, Homo sapiens
ugcucauucauauuccu

SEQ ID NO: 409098 - RNA, 20 nt, Homo sapiens
ugcuccaguaaaaucuugcc

SEQ ID NO: 409099 - RNA, 14 nt, Homo sapiens
ugcuccagugcagg

SEQ ID NO: 409100 - RNA, 18 nt, Homo sapiens
ugcuccagugcaggagac

SEQ ID NO: 409101 - RNA, 21 nt, Homo sapiens
ugcuccauuuuucaucaucua

SEQ ID NO: 409102 - RNA, 21 nt, Homo sapiens
ugcucccagcagcccuaagga

SEQ ID NO: 409103 - RNA, 23 nt, Homo sapiens
ugcucccagccccuaccuugaga

SEQ ID NO: 409104 - RNA, 22 nt, Homo sapiens
ugcuccuaccccuguccugggg

SEQ ID NO: 409105 - RNA, 12 nt, Homo sapiens
ugcuccucaggg

SEQ ID NO: 409106 - RNA, 16 nt, Homo sapiens
ugcucuacccaugagc

SEQ ID NO: 409107 - RNA, 17 nt, Homo sapiens
ugcucucaauauauaau

SEQ ID NO: 409108 - RNA, 21 nt, Homo sapiens
ugcucuccccuccucggagga

SEQ ID NO: 409109 - RNA, 14 nt, Homo sapiens
ugcucucugcucac

SEQ ID NO: 409110 - RNA, 18 nt, Homo sapiens
ugcucugagugcuagcua

SEQ ID NO: 409111 - RNA, 11 nt, Homo sapiens
ugcucugcuau

SEQ ID NO: 409112 - RNA, 18 nt, Homo sapiens
ugcucugcuggucuucaa

SEQ ID NO: 409113 - RNA, 16 nt, Homo sapiens
ugcucuggaagaccug

SEQ ID NO: 409114 - RNA, 19 nt, Homo sapiens
ugcucuggaagaccugaaa

SEQ ID NO: 409115 - RNA, 21 nt, Homo sapiens
ugcucugguuagaaaaaggac

SEQ ID NO: 409116 - RNA, 20 nt, Homo sapiens
ugcucuugggaagaccagcu

SEQ ID NO: 409117 - RNA, 16 nt, Homo sapiens
ugcugaaacagaauac

SEQ ID NO: 409118 - RNA, 14 nt, Homo sapiens
ugcugaauaugcaa

SEQ ID NO: 409119 - RNA, 15 nt, Homo sapiens
ugcugaaugcauuca

SEQ ID NO: 409120 - RNA, 20 nt, Homo sapiens
ugcugaaugcauucagggga

SEQ ID NO: 409121 - RNA, 19 nt, Homo sapiens
uuaagcugaaggcauuuga

SEQ ID NO: 409122 - RNA, 14 nt, Homo sapiens
uuaaggucauaaaa

SEQ ID NO: 409123 - RNA, 17 nt, Homo sapiens
uuaaggugaguucucac

SEQ ID NO: 409124 - RNA, 13 nt, Homo sapiens
uuaagugugcuua

SEQ ID NO: 409125 - RNA, 14 nt, Homo sapiens
uuaaguuaggcagu

SEQ ID NO: 409126 - RNA, 13 nt, Homo sapiens
uuaaguugcugua

SEQ ID NO: 409127 - RNA, 16 nt, Homo sapiens
uuaaguuuuacuugag

SEQ ID NO: 409128 - RNA, 21 nt, Homo sapiens
uuaauaaacucacaacucucu

SEQ ID NO: 409129 - RNA, 22 nt, Homo sapiens
uuaauacaccgauaaccacagg

SEQ ID NO: 409130 - RNA, 12 nt, Homo sapiens
uuaauacuguau

SEQ ID NO: 409131 - RNA, 12 nt, Homo sapiens
uuaauauacugc

SEQ ID NO: 409132 - RNA, 14 nt, Homo sapiens
uuaauauaucccag

SEQ ID NO: 409133 - RNA, 16 nt, Homo sapiens
uuaauauauccuaaau

SEQ ID NO: 409134 - RNA, 20 nt, Homo sapiens
uuaauaugguuguacuacag

SEQ ID NO: 409135 - RNA, 14 nt, Homo sapiens
uuaaucauuuccag

SEQ ID NO: 409136 - RNA, 22 nt, Homo sapiens
uuaaugaaaaugauaaaacaga

SEQ ID NO: 409137 - RNA, 21 nt, Homo sapiens
uuaaugguagcaacugaaaga

SEQ ID NO: 409138 - RNA, 22 nt, Homo sapiens
uuaauggucaaugcuagcacaa

SEQ ID NO: 409139 - RNA, 18 nt, Homo sapiens
uuaauuacccuacuuuca

SEQ ID NO: 409140 - RNA, 11 nt, Homo sapiens
uuaauuacuuu

SEQ ID NO: 409141 - RNA, 19 nt, Homo sapiens
uuaauucucuuucaaagcu

SEQ ID NO: 409142 - RNA, 15 nt, Homo sapiens
uuaauuucagugccu

SEQ ID NO: 409143 - RNA, 14 nt, Homo sapiens
uuaauuuugauuca

SEQ ID NO: 409144 - RNA, 22 nt, Homo sapiens
uuaauuuuuaaaagacuuugau

SEQ ID NO: 409145 - RNA, 19 nt, Homo sapiens
uuacaacaaacacugugau

SEQ ID NO: 409146 - RNA, 20 nt, Homo sapiens
uuacaaucagccacauucua

SEQ ID NO: 409147 - RNA, 17 nt, Homo sapiens
uuacaaugugcacugaa

SEQ ID NO: 409148 - RNA, 13 nt, Homo sapiens
uuacacaucugcc

SEQ ID NO: 409149 - RNA, 21 nt, Homo sapiens
uuacagacaugaaccaccacg

SEQ ID NO: 409150 - RNA, 21 nt, Homo sapiens
uuacagagaggagaaacacau

SEQ ID NO: 409151 - RNA, 16 nt, Homo sapiens
uuacagcaagagccac

SEQ ID NO: 409152 - RNA, 13 nt, Homo sapiens
uuacagcuuuucu

SEQ ID NO: 409153 - RNA, 12 nt, Homo sapiens
uuacagugcaga

SEQ ID NO: 409154 - RNA, 17 nt, Homo sapiens
uuacaucuguguucuau

SEQ ID NO: 409155 - RNA, 14 nt, Homo sapiens
uuacaugcauuuga

SEQ ID NO: 409156 - RNA, 12 nt, Homo sapiens
uuacaugugauu

SEQ ID NO: 409157 - RNA, 17 nt, Homo sapiens
uuacaugugauugugau

SEQ ID NO: 409158 - RNA, 17 nt, Homo sapiens
uuacauuauuacuccuu

SEQ ID NO: 409159 - RNA, 14 nt, Homo sapiens
uuacauuuauacau

SEQ ID NO: 409160 - RNA, 13 nt, Homo sapiens
uuaccaaaggaua

SEQ ID NO: 409161 - RNA, 14 nt, Homo sapiens
uuaccagcaagaau

SEQ ID NO: 409162 - RNA, 18 nt, Homo sapiens
uuaccaucuuacuugagc

SEQ ID NO: 409163 - RNA, 13 nt, Homo sapiens
uuaccccagcucc

SEQ ID NO: 409164 - RNA, 13 nt, Homo sapiens
uagaguguuauca

SEQ ID NO: 409165 - RNA, 23 nt, Homo sapiens
uagauacaaucagcugcuuuguu

SEQ ID NO: 409166 - RNA, 15 nt, Homo sapiens
uagauaucaauguua

SEQ ID NO: 409167 - RNA, 14 nt, Homo sapiens
uagauccucugaua

SEQ ID NO: 409168 - RNA, 14 nt, Homo sapiens
uagaucuaguucuc

SEQ ID NO: 409169 - RNA, 16 nt, Homo sapiens
uagaucucccuuaaua

SEQ ID NO: 409170 - RNA, 22 nt, Homo sapiens
uagaucucccuuaauaaacuca

SEQ ID NO: 409171 - RNA, 18 nt, Homo sapiens
uagaucugauggugagcu

SEQ ID NO: 409172 - RNA, 17 nt, Homo sapiens
uagaugaacucuucuca

SEQ ID NO: 409173 - RNA, 16 nt, Homo sapiens
uagaugguuugagccu

SEQ ID NO: 409174 - RNA, 19 nt, Homo sapiens
uagauguauuuucaauaaa

SEQ ID NO: 409175 - RNA, 14 nt, Homo sapiens
uagauuaacccuau

SEQ ID NO: 409176 - RNA, 13 nt, Homo sapiens
uagauucaccugu

SEQ ID NO: 409177 - RNA, 16 nt, Homo sapiens
uagauuccucuugccu

SEQ ID NO: 409178 - RNA, 23 nt, Homo sapiens
uagauuccucuugccucucucag

SEQ ID NO: 409179 - RNA, 18 nt, Homo sapiens
uagauugccuuuggcaau

SEQ ID NO: 409180 - RNA, 21 nt, Homo sapiens
uagcaaauggcagaaccaaag

SEQ ID NO: 409181 - RNA, 13 nt, Homo sapiens
uagcaacuuugau

SEQ ID NO: 409182 - RNA, 17 nt, Homo sapiens
uagcaccaggacucaga

SEQ ID NO: 409183 - RNA, 13 nt, Homo sapiens
uagcacugggaac

SEQ ID NO: 409184 - RNA, 12 nt, Homo sapiens
uagcacuuuaua

SEQ ID NO: 409185 - RNA, 20 nt, Homo sapiens
uagcagaggagccauguccu

SEQ ID NO: 409186 - RNA, 22 nt, Homo sapiens
uagcaggugaacucgaagccca

SEQ ID NO: 409187 - RNA, 17 nt, Homo sapiens
uagcauuauaccaagag

SEQ ID NO: 409188 - RNA, 22 nt, Homo sapiens
uagcauuguuccacacauuuaa

SEQ ID NO: 409189 - RNA, 21 nt, Homo sapiens
uagcauuuucuugaaccaaua

SEQ ID NO: 409190 - RNA, 22 nt, Homo sapiens
uagccaccuggccuaaugcugu

SEQ ID NO: 409191 - RNA, 10 nt, Homo sapiens
uagccagucc

SEQ ID NO: 409192 - RNA, 20 nt, Homo sapiens
uagccauuuuguaacugccu

SEQ ID NO: 409193 - RNA, 20 nt, Homo sapiens
uagcccccgagggauguccu

SEQ ID NO: 409194 - RNA, 21 nt, Homo sapiens
uagcccucccccucaaccuca

SEQ ID NO: 409195 - RNA, 15 nt, Homo sapiens
uagccggguguggca

SEQ ID NO: 409196 - RNA, 14 nt, Homo sapiens
uagccucaccuucc

SEQ ID NO: 409197 - RNA, 17 nt, Homo sapiens
uagccucgcucuuggca

SEQ ID NO: 409198 - RNA, 18 nt, Homo sapiens
uagccugcauaucauuca

SEQ ID NO: 409199 - RNA, 21 nt, Homo sapiens
uagcgauaauuuuuagacuaa

SEQ ID NO: 409200 - RNA, 15 nt, Homo sapiens
uagcgccucuuuuau

SEQ ID NO: 409201 - RNA, 16 nt, Homo sapiens
uagcgcucucuuccag

SEQ ID NO: 409202 - RNA, 15 nt, Homo sapiens
uagcuagcuauuucu

SEQ ID NO: 409203 - RNA, 13 nt, Homo sapiens
uagcuaugugacc

SEQ ID NO: 409204 - RNA, 20 nt, Homo sapiens
uagcuauuaaaaaaaaucag

SEQ ID NO: 409205 - RNA, 17 nt, Homo sapiens
uagcugcaaaggacaga

SEQ ID NO: 409206 - RNA, 18 nt, Homo sapiens
uagcugggauuacaggug

SEQ ID NO: 409207 - RNA, 19 nt, Homo sapiens
uagcugggauuacaggugu

SEQ ID NO: 409208 - RNA, 15 nt, Homo sapiens
uagcugggauuugaa

SEQ ID NO: 409209 - RNA, 21 nt, Homo sapiens
uagcugggauuugaacugagc

SEQ ID NO: 409210 - RNA, 15 nt, Homo sapiens
uagcugggcuuacag

SEQ ID NO: 409211 - RNA, 19 nt, Homo sapiens
uagcuguaaauacaugugu

SEQ ID NO: 409212 - RNA, 17 nt, Homo sapiens
uagcuuuuacuuuuuau

SEQ ID NO: 409213 - RNA, 17 nt, Homo sapiens
uaggaaaaguacauuua

SEQ ID NO: 409214 - RNA, 21 nt, Homo sapiens
uaggaaaaguuauugugauaa

SEQ ID NO: 409215 - RNA, 21 nt, Homo sapiens
uaggaaaauauggguugcauu

SEQ ID NO: 409216 - RNA, 20 nt, Homo sapiens
uaggaaagugccugcuuuua

SEQ ID NO: 409217 - RNA, 12 nt, Homo sapiens
uaggaacagacu

SEQ ID NO: 409218 - RNA, 14 nt, Homo sapiens
uaggaaugcucaau

SEQ ID NO: 409219 - RNA, 12 nt, Homo sapiens
uaggacacagug

SEQ ID NO: 409220 - RNA, 17 nt, Homo sapiens
uaggagagaacagggau

SEQ ID NO: 409221 - RNA, 16 nt, Homo sapiens
uaggagagacuggcca

SEQ ID NO: 409222 - RNA, 13 nt, Homo sapiens
uaggagagccaac

SEQ ID NO: 409223 - RNA, 12 nt, Homo sapiens
uaggagauguca

SEQ ID NO: 409224 - RNA, 13 nt, Homo sapiens
uaggagugagaag

SEQ ID NO: 409225 - RNA, 17 nt, Homo sapiens
uaggauuuaccaaauag

SEQ ID NO: 409226 - RNA, 22 nt, Homo sapiens
uaggcaaaaccuugugacucag

SEQ ID NO: 409227 - RNA, 17 nt, Homo sapiens
uaggcagccucucugcu

SEQ ID NO: 409228 - RNA, 15 nt, Homo sapiens
uaggcagggauuuga

SEQ ID NO: 409229 - RNA, 16 nt, Homo sapiens
uaggccucaguguccu

SEQ ID NO: 409230 - RNA, 18 nt, Homo sapiens
uaggcuccgucaguauca

SEQ ID NO: 409231 - RNA, 14 nt, Homo sapiens
uaggcugacaccaa

SEQ ID NO: 409232 - RNA, 22 nt, Homo sapiens
uaggcugagaugcaccaaguac

SEQ ID NO: 409233 - RNA, 12 nt, Homo sapiens
uaggcuggccag

SEQ ID NO: 409234 - RNA, 11 nt, Homo sapiens
uaggcuucuau

SEQ ID NO: 409235 - RNA, 18 nt, Homo sapiens
uaggcuuuuaaaagcauu

SEQ ID NO: 409236 - RNA, 22 nt, Homo sapiens
uagggaagaguucugaucugua

SEQ ID NO: 409237 - RNA, 22 nt, Homo sapiens
uagggaugccuuucuaguccua

SEQ ID NO: 409238 - RNA, 24 nt, Homo sapiens
uagggauuuuuggcuacacacaaa

SEQ ID NO: 409239 - RNA, 16 nt, Homo sapiens
uagggcucuaauuucc

SEQ ID NO: 409240 - RNA, 21 nt, Homo sapiens
uagggcuguagacuuacuuuc

SEQ ID NO: 409241 - RNA, 16 nt, Homo sapiens
uaggggucaggcucca

SEQ ID NO: 409242 - RNA, 20 nt, Homo sapiens
uaggguuuuccaaugugacu

SEQ ID NO: 409243 - RNA, 16 nt, Homo sapiens
uagguagaugagaaaa

SEQ ID NO: 409244 - RNA, 20 nt, Homo sapiens
uagguaggggcccacuucac

SEQ ID NO: 409245 - RNA, 22 nt, Homo sapiens
uauuuuuucgugcacucugcua

SEQ ID NO: 409246 - RNA, 21 nt, Homo sapiens
uauuuuuuuuaacugcauucu

SEQ ID NO: 409247 - RNA, 15 nt, Homo sapiens
ucaaaaacauucuua

SEQ ID NO: 409248 - RNA, 14 nt, Homo sapiens
ucaaaaaguguuua

SEQ ID NO: 409249 - RNA, 16 nt, Homo sapiens
ucaaaaccugugccag

SEQ ID NO: 409250 - RNA, 13 nt, Homo sapiens
ucaaaacuucaga

SEQ ID NO: 409251 - RNA, 19 nt, Homo sapiens
ucaaaacuucagaugacaa

SEQ ID NO: 409252 - RNA, 12 nt, Homo sapiens
ucaaaagcacaa

SEQ ID NO: 409253 - RNA, 17 nt, Homo sapiens
ucaaaauauacauucaa

SEQ ID NO: 409254 - RNA, 21 nt, Homo sapiens
ucaaaauccuuccaaagaauu

SEQ ID NO: 409255 - RNA, 21 nt, Homo sapiens
ucaaaauguuaacaacuugaa

SEQ ID NO: 409256 - RNA, 20 nt, Homo sapiens
ucaaaauguuguccuuuccc

SEQ ID NO: 409257 - RNA, 22 nt, Homo sapiens
ucaaaauuauaggagacuugua

SEQ ID NO: 409258 - RNA, 16 nt, Homo sapiens
ucaaacacacaguauu

SEQ ID NO: 409259 - RNA, 21 nt, Homo sapiens
ucaaacagcaucaaaauacaa

SEQ ID NO: 409260 - RNA, 19 nt, Homo sapiens
ucaaacagggacacuacaa

SEQ ID NO: 409261 - RNA, 14 nt, Homo sapiens
ucaaacauuucaaa

SEQ ID NO: 409262 - RNA, 19 nt, Homo sapiens
ucaaaccugcauauuguga

SEQ ID NO: 409263 - RNA, 20 nt, Homo sapiens
ucaaacgccgcugacugcca

SEQ ID NO: 409264 - RNA, 22 nt, Homo sapiens
ucaaacuucuggcuucaugcaa

SEQ ID NO: 409265 - RNA, 15 nt, Homo sapiens
ucaaacuuuacucua

SEQ ID NO: 409266 - RNA, 12 nt, Homo sapiens
ucaaagaaagaa

SEQ ID NO: 409267 - RNA, 20 nt, Homo sapiens
ucaaagaacccuagcacaaa

SEQ ID NO: 409268 - RNA, 14 nt, Homo sapiens
ucaaagaucuuucg

SEQ ID NO: 409269 - RNA, 13 nt, Homo sapiens
ucaaagauguacu

SEQ ID NO: 409270 - RNA, 18 nt, Homo sapiens
ucaaagauguacugagag

SEQ ID NO: 409271 - RNA, 23 nt, Homo sapiens
ucaaagauguguugcuauccuga

SEQ ID NO: 409272 - RNA, 12 nt, Homo sapiens
ucaaagcacuug

SEQ ID NO: 409273 - RNA, 21 nt, Homo sapiens
ucaaagcuaaauuccacacua

SEQ ID NO: 409274 - RNA, 14 nt, Homo sapiens
ucaaagcuccuuaa

SEQ ID NO: 409275 - RNA, 22 nt, Homo sapiens
ucaaaggagagucacagaacaa

SEQ ID NO: 409276 - RNA, 17 nt, Homo sapiens
ucaaaguacuacagcaa

SEQ ID NO: 409277 - RNA, 14 nt, Homo sapiens
ucaaauagcauaag

SEQ ID NO: 409278 - RNA, 22 nt, Homo sapiens
ucaaauauguagauugccuuug

SEQ ID NO: 409279 - RNA, 17 nt, Homo sapiens
ucaaaucuauucagaca

SEQ ID NO: 409280 - RNA, 14 nt, Homo sapiens
ucaaaugaguuuaa

SEQ ID NO: 409281 - RNA, 18 nt, Homo sapiens
ucaaaugauacagucagg

SEQ ID NO: 409282 - RNA, 13 nt, Homo sapiens
ucaaauggaugua

SEQ ID NO: 409283 - RNA, 19 nt, Homo sapiens
ucaacaaagcacaguguua

SEQ ID NO: 409284 - RNA, 23 nt, Homo sapiens
ucaacaagaguaaauauugucac

SEQ ID NO: 409285 - RNA, 21 nt, Homo sapiens
ucaacacauauuuuuauauua

SEQ ID NO: 409286 - RNA, 16 nt, Homo sapiens
ucaacacucuucuuga

SEQ ID NO: 409287 - RNA, 12 nt, Homo sapiens
ucaacagaauug

SEQ ID NO: 409288 - RNA, 21 nt, Homo sapiens
ucaacauaggccugcucagcc

SEQ ID NO: 409289 - RNA, 19 nt, Homo sapiens
ucaacaucuuuuacauucu

SEQ ID NO: 409290 - RNA, 18 nt, Homo sapiens
ucaacaugguuaccucug

SEQ ID NO: 409291 - RNA, 16 nt, Homo sapiens
ucaaccugcacuucau

SEQ ID NO: 409292 - RNA, 23 nt, Homo sapiens
ucaacucuccaauguucuauuaa

SEQ ID NO: 409293 - RNA, 14 nt, Homo sapiens
ucaacuguugauac

SEQ ID NO: 409294 - RNA, 18 nt, Homo sapiens
ucaagaaagcauugccag

SEQ ID NO: 409295 - RNA, 17 nt, Homo sapiens
ucaagagugagugaaca

SEQ ID NO: 409296 - RNA, 14 nt, Homo sapiens
ucaagaugugacau

SEQ ID NO: 409297 - RNA, 19 nt, Homo sapiens
ucaagauuaaacugaguga

SEQ ID NO: 409298 - RNA, 18 nt, Homo sapiens
ucaagauucuacuuggug

SEQ ID NO: 409299 - RNA, 21 nt, Homo sapiens
ucaagauuuucauacuuuuac

SEQ ID NO: 409300 - RNA, 18 nt, Homo sapiens
ucaagcaauugucugccu

SEQ ID NO: 409301 - RNA, 18 nt, Homo sapiens
ucaaggagugaaguaauu

SEQ ID NO: 409302 - RNA, 17 nt, Homo sapiens
ucaaggcuuaccuguga

SEQ ID NO: 409303 - RNA, 20 nt, Homo sapiens
ucaaguauuagggguaauau

SEQ ID NO: 409304 - RNA, 19 nt, Homo sapiens
acuuauuucauaaacaacu

SEQ ID NO: 409305 - RNA, 17 nt, Homo sapiens
acuucaaauguuauuca

SEQ ID NO: 409306 - RNA, 12 nt, Homo sapiens
acuucacacagc

SEQ ID NO: 409307 - RNA, 14 nt, Homo sapiens
acuucagacucucu

SEQ ID NO: 409308 - RNA, 22 nt, Homo sapiens
acuucaguggugagacuguauc

SEQ ID NO: 409309 - RNA, 17 nt, Homo sapiens
acuucaugccagcuaua

SEQ ID NO: 409310 - RNA, 19 nt, Homo sapiens
acuucauuugaugcuaaau

SEQ ID NO: 409311 - RNA, 13 nt, Homo sapiens
acuuccacuaccu

SEQ ID NO: 409312 - RNA, 11 nt, Homo sapiens
acuuccagugg

SEQ ID NO: 409313 - RNA, 23 nt, Homo sapiens
acuuccauagcuucauccacuga

SEQ ID NO: 409314 - RNA, 23 nt, Homo sapiens
acuuccucagucuggugcuccag

SEQ ID NO: 409315 - RNA, 19 nt, Homo sapiens
acuuccugugacuucagcu

SEQ ID NO: 409316 - RNA, 13 nt, Homo sapiens
acuuccuuugaaa

SEQ ID NO: 409317 - RNA, 20 nt, Homo sapiens
acuuccuuugaaagcuguau

SEQ ID NO: 409318 - RNA, 13 nt, Homo sapiens
acuucgacuguga

SEQ ID NO: 409319 - RNA, 14 nt, Homo sapiens
acuucuaccaggac

SEQ ID NO: 409320 - RNA, 15 nt, Homo sapiens
acuucuaccaggacg

SEQ ID NO: 409321 - RNA, 17 nt, Homo sapiens
acuucuccccucaagaa

SEQ ID NO: 409322 - RNA, 18 nt, Homo sapiens
acuucuccccucaagaaa

SEQ ID NO: 409323 - RNA, 15 nt, Homo sapiens
acuucuggaagucau

SEQ ID NO: 409324 - RNA, 20 nt, Homo sapiens
acuucuguguugugauuccc

SEQ ID NO: 409325 - RNA, 15 nt, Homo sapiens
acuucuuguucaaaa

SEQ ID NO: 409326 - RNA, 18 nt, Homo sapiens
acuucuuuuccaaaaaua

SEQ ID NO: 409327 - RNA, 13 nt, Homo sapiens
acuugaauuucaa

SEQ ID NO: 409328 - RNA, 14 nt, Homo sapiens
acuugagauguaug

SEQ ID NO: 409329 - RNA, 23 nt, Homo sapiens
acuugaggacacauguccagugg

SEQ ID NO: 409330 - RNA, 15 nt, Homo sapiens
acuugaggccaguga

SEQ ID NO: 409331 - RNA, 16 nt, Homo sapiens
acuugagggaccaaua

SEQ ID NO: 409332 - RNA, 15 nt, Homo sapiens
acuugaucauucuca

SEQ ID NO: 409333 - RNA, 20 nt, Homo sapiens
acuugaugacccccaaccaa

SEQ ID NO: 409334 - RNA, 19 nt, Homo sapiens
acuugauguguuaucucuu

SEQ ID NO: 409335 - RNA, 18 nt, Homo sapiens
agagccagugaaggagcc

SEQ ID NO: 409336 - RNA, 22 nt, Homo sapiens
agagccauggacucuacacugu

SEQ ID NO: 409337 - RNA, 23 nt, Homo sapiens
agagcccccaccuugaucccaau

SEQ ID NO: 409338 - RNA, 21 nt, Homo sapiens
agagcccugaguuucuuggcu

SEQ ID NO: 409339 - RNA, 21 nt, Homo sapiens
agagcccuucacugccaugau

SEQ ID NO: 409340 - RNA, 17 nt, Homo sapiens
agagccuagaggcucac

SEQ ID NO: 409341 - RNA, 21 nt, Homo sapiens
agagccugcaucugucugucc

SEQ ID NO: 409342 - RNA, 17 nt, Homo sapiens
agagccuggugcugcug

SEQ ID NO: 409343 - RNA, 15 nt, Homo sapiens
agagccuuugaucuu

SEQ ID NO: 409344 - RNA, 19 nt, Homo sapiens
agagcgagauuccgucuca

SEQ ID NO: 409345 - RNA, 19 nt, Homo sapiens
agagcggcugcccgacuca

SEQ ID NO: 409346 - RNA, 15 nt, Homo sapiens
agagcgucauguccu

SEQ ID NO: 409347 - RNA, 21 nt, Homo sapiens
agagcuagaugugucuuacca

SEQ ID NO: 409348 - RNA, 18 nt, Homo sapiens
agaggaacccagaugcuc

SEQ ID NO: 409349 - RNA, 15 nt, Homo sapiens
agaggaagugcacug

SEQ ID NO: 409350 - RNA, 13 nt, Homo sapiens
agaggaauuccuc

SEQ ID NO: 409351 - RNA, 21 nt, Homo sapiens
agaggacagaucaauggcgca

SEQ ID NO: 409352 - RNA, 19 nt, Homo sapiens
agaggaccugagucugcua

SEQ ID NO: 409353 - RNA, 20 nt, Homo sapiens
agaggacuucuggcagggaa

SEQ ID NO: 409354 - RNA, 16 nt, Homo sapiens
agaggagaguaccccc

SEQ ID NO: 409355 - RNA, 22 nt, Homo sapiens
agaggagaguaccccccugaga

SEQ ID NO: 409356 - RNA, 22 nt, Homo sapiens
agaggagugauugaaccagcuc

SEQ ID NO: 409357 - RNA, 21 nt, Homo sapiens
agaggaugaauguaugugcac

SEQ ID NO: 409358 - RNA, 11 nt, Homo sapiens
agaggcccaag

SEQ ID NO: 409359 - RNA, 15 nt, Homo sapiens
agaggcucugagaaa

SEQ ID NO: 409360 - RNA, 13 nt, Homo sapiens
agaggcugagaca

SEQ ID NO: 409361 - RNA, 16 nt, Homo sapiens
agaggcugcaaggauu

SEQ ID NO: 409362 - RNA, 13 nt, Homo sapiens
agaggcugcugca

SEQ ID NO: 409363 - RNA, 18 nt, Homo sapiens
agagggggcgaagggauc

SEQ ID NO: 409364 - RNA, 22 nt, Homo sapiens
agagggguggaguuuuaacugu

SEQ ID NO: 409365 - RNA, 13 nt, Homo sapiens
agagguaccacag

SEQ ID NO: 409366 - RNA, 22 nt, Homo sapiens
agagguagguaggaucauccca

SEQ ID NO: 409367 - RNA, 20 nt, Homo sapiens
agaggucaaggcugcaguga

SEQ ID NO: 409368 - RNA, 22 nt, Homo sapiens
agagguccuaaagaugcugacu

SEQ ID NO: 409369 - RNA, 19 nt, Homo sapiens
agagguggccccaccugag

SEQ ID NO: 409370 - RNA, 14 nt, Homo sapiens
agagguuaucugcc

SEQ ID NO: 409371 - RNA, 22 nt, Homo sapiens
agaguacucacuuuucacuugu

SEQ ID NO: 409372 - RNA, 22 nt, Homo sapiens
agaguagaacagauaaucagug

SEQ ID NO: 409373 - RNA, 14 nt, Homo sapiens
agagucgcaucuca

SEQ ID NO: 409374 - RNA, 14 nt, Homo sapiens
agagugaacauauc

SEQ ID NO: 409375 - RNA, 18 nt, Homo sapiens
agagugccccaccugcca

SEQ ID NO: 409376 - RNA, 16 nt, Homo sapiens
agaguucuauccccaa

SEQ ID NO: 409377 - RNA, 14 nt, Homo sapiens
agaguuuuaucaac

SEQ ID NO: 409378 - RNA, 23 nt, Homo sapiens
agauaaaaaaauuuuaauuccuu

SEQ ID NO: 409379 - RNA, 20 nt, Homo sapiens
agauaaaccaauaaauccac

SEQ ID NO: 409380 - RNA, 12 nt, Homo sapiens
agauaaauccaa

SEQ ID NO: 409381 - RNA, 12 nt, Homo sapiens
agauaacuuccu

SEQ ID NO: 409382 - RNA, 14 nt, Homo sapiens
agauaagacauauc

SEQ ID NO: 409383 - RNA, 23 nt, Homo sapiens
agauaagacuuguuucuuucugu

SEQ ID NO: 409384 - RNA, 20 nt, Homo sapiens
agauaaucuuagcugccaag

SEQ ID NO: 409385 - RNA, 17 nt, Homo sapiens
agauacaaucagcugcu

SEQ ID NO: 409386 - RNA, 14 nt, Homo sapiens
agauacacugacuu

SEQ ID NO: 409387 - RNA, 20 nt, Homo sapiens
agauacacugacuuggugca

SEQ ID NO: 409388 - RNA, 19 nt, Homo sapiens
agauaccagagacucugaa

SEQ ID NO: 409389 - RNA, 18 nt, Homo sapiens
agauagcaccauugcacu

SEQ ID NO: 409390 - RNA, 13 nt, Homo sapiens
agauagugauauu

SEQ ID NO: 409391 - RNA, 14 nt, Homo sapiens
agaucaaacuucca

SEQ ID NO: 409392 - RNA, 14 nt, Homo sapiens
agaucaacugaguu

SEQ ID NO: 409393 - RNA, 19 nt, Homo sapiens
agaucacaaauaguguuga

SEQ ID NO: 409394 - RNA, 15 nt, Homo sapiens
agaucagaacaugaa

SEQ ID NO: 409395 - RNA, 24 nt, Homo sapiens
agaucagcauucaaaauaguucua

SEQ ID NO: 409396 - RNA, 15 nt, Homo sapiens
agaucaucagucacc

SEQ ID NO: 409397 - RNA, 23 nt, Homo sapiens
agaucaugucauugaugaacugc

SEQ ID NO: 409398 - RNA, 14 nt, Homo sapiens
agaucauuucccaa

SEQ ID NO: 409399 - RNA, 23 nt, Homo sapiens
agaucccauccaucagcucccuu

SEQ ID NO: 409400 - RNA, 13 nt, Homo sapiens
agauccuccauuu

SEQ ID NO: 409401 - RNA, 18 nt, Homo sapiens
agauccucugauauacaa

SEQ ID NO: 409402 - RNA, 20 nt, Homo sapiens
agaucuaagccuuuccauaa

SEQ ID NO: 409403 - RNA, 22 nt, Homo sapiens
agaucucccuuaauaaacucac

SEQ ID NO: 409404 - RNA, 22 nt, Homo sapiens
agaucuggucccuugcagcuag

SEQ ID NO: 409405 - RNA, 12 nt, Homo sapiens
agaucuuuacau

SEQ ID NO: 409406 - RNA, 20 nt, Homo sapiens
agaugaaaccaggucacugg

SEQ ID NO: 409407 - RNA, 18 nt, Homo sapiens
agaugaaaccgucccuga

SEQ ID NO: 409408 - RNA, 15 nt, Homo sapiens
agaugaaauugccaa

SEQ ID NO: 409409 - RNA, 14 nt, Homo sapiens
agaugaacucuucu

SEQ ID NO: 409410 - RNA, 13 nt, Homo sapiens
agaugaacugaga

SEQ ID NO: 409411 - RNA, 16 nt, Homo sapiens
agaugaauaugagcuc

SEQ ID NO: 409412 - RNA, 23 nt, Homo sapiens
agaugaaucaguaugaagacacu

SEQ ID NO: 409413 - RNA, 22 nt, Homo sapiens
agaugagaaaacaggcucacag

SEQ ID NO: 409414 - RNA, 15 nt, Homo sapiens
acaguuuggaagugu

SEQ ID NO: 409415 - RNA, 17 nt, Homo sapiens
acauaaagaaacacuuu

SEQ ID NO: 409416 - RNA, 18 nt, Homo sapiens
acauaacaggcauugcac

SEQ ID NO: 409417 - RNA, 17 nt, Homo sapiens
acauaauagaauuuccu

SEQ ID NO: 409418 - RNA, 13 nt, Homo sapiens
acauaaugcacug

SEQ ID NO: 409419 - RNA, 20 nt, Homo sapiens
acauacacaaaugggcauac

SEQ ID NO: 409420 - RNA, 22 nt, Homo sapiens
acauaccucucucuauauauac

SEQ ID NO: 409421 - RNA, 16 nt, Homo sapiens
acauacuccuuccauc

SEQ ID NO: 409422 - RNA, 20 nt, Homo sapiens
acauaggccugcucagccuc

SEQ ID NO: 409423 - RNA, 16 nt, Homo sapiens
acauauacaucuagca

SEQ ID NO: 409424 - RNA, 12 nt, Homo sapiens
acauaucaugug

SEQ ID NO: 409425 - RNA, 20 nt, Homo sapiens
acauauuacuguugcauuua

SEQ ID NO: 409426 - RNA, 17 nt, Homo sapiens
acauauuaggaaaauau

SEQ ID NO: 409427 - RNA, 19 nt, Homo sapiens
acaucaaauaaacugacuu

SEQ ID NO: 409428 - RNA, 19 nt, Homo sapiens
acaucaagauacacuugua

SEQ ID NO: 409429 - RNA, 16 nt, Homo sapiens
acaucaauaaauacuu

SEQ ID NO: 409430 - RNA, 13 nt, Homo sapiens
acaucaauguuca

SEQ ID NO: 409431 - RNA, 19 nt, Homo sapiens
acaucaccuuuuugacuuu

SEQ ID NO: 409432 - RNA, 23 nt, Homo sapiens
acaucaccuuuuugacuuuucca

SEQ ID NO: 409433 - RNA, 18 nt, Homo sapiens
acaucagaccugucuucc

SEQ ID NO: 409434 - RNA, 16 nt, Homo sapiens
acauccaagcuuccuu

SEQ ID NO: 409435 - RNA, 19 nt, Homo sapiens
acauccucugcuaccaucu

SEQ ID NO: 409436 - RNA, 20 nt, Homo sapiens
acauccucugcuaccaucuc

SEQ ID NO: 409437 - RNA, 19 nt, Homo sapiens
acaucuagucucagugcua

SEQ ID NO: 409438 - RNA, 15 nt, Homo sapiens
acaucugcauuucua

SEQ ID NO: 409439 - RNA, 15 nt, Homo sapiens
acaucugcauuuuca

SEQ ID NO: 409440 - RNA, 12 nt, Homo sapiens
acaucuuguuaa

SEQ ID NO: 409441 - RNA, 22 nt, Homo sapiens
acaucuuuccaguccuugguca

SEQ ID NO: 409442 - RNA, 14 nt, Homo sapiens
acaugaaaacagaa

SEQ ID NO: 409443 - RNA, 13 nt, Homo sapiens
acaugaacccauc

SEQ ID NO: 409444 - RNA, 15 nt, Homo sapiens
acaugaaucauagcc

SEQ ID NO: 409445 - RNA, 15 nt, Homo sapiens
acaugacaacuuugc

SEQ ID NO: 409446 - RNA, 23 nt, Homo sapiens
acaugaccuccguguagugucug

SEQ ID NO: 409447 - RNA, 16 nt, Homo sapiens
acaugauacuuauuca

SEQ ID NO: 409448 - RNA, 18 nt, Homo sapiens
acaugaucuucuuuauaa

SEQ ID NO: 409449 - RNA, 14 nt, Homo sapiens
acaugaugugagau

SEQ ID NO: 409450 - RNA, 22 nt, Homo sapiens
acaugcacaguuugcaaucuua

SEQ ID NO: 409451 - RNA, 21 nt, Homo sapiens
acaugcagcaaggggacaucu

SEQ ID NO: 409452 - RNA, 17 nt, Homo sapiens
acaugcugugcucuuug

SEQ ID NO: 409453 - RNA, 18 nt, Homo sapiens
acauggcccgcaguggcu

SEQ ID NO: 409454 - RNA, 22 nt, Homo sapiens
acauguaauugcagauaacuuu

SEQ ID NO: 409455 - RNA, 19 nt, Homo sapiens
acauguagaaaaauacuga

SEQ ID NO: 409456 - RNA, 22 nt, Homo sapiens
acauguauguggauacagucau

SEQ ID NO: 409457 - RNA, 14 nt, Homo sapiens
acauguccuauuac

SEQ ID NO: 409458 - RNA, 23 nt, Homo sapiens
acaugucuuuggcuucagaauug

SEQ ID NO: 409459 - RNA, 15 nt, Homo sapiens
acaugugacuggcag

SEQ ID NO: 409460 - RNA, 14 nt, Homo sapiens
acaugugauuguga

SEQ ID NO: 409461 - RNA, 15 nt, Homo sapiens
acaugugauugugau

SEQ ID NO: 409462 - RNA, 19 nt, Homo sapiens
acaugugccgaaugugcag

SEQ ID NO: 409463 - RNA, 11 nt, Homo sapiens
acauguuccug

SEQ ID NO: 409464 - RNA, 13 nt, Homo sapiens
acauguugucaca

SEQ ID NO: 409465 - RNA, 18 nt, Homo sapiens
acauuaacaaaagcaauu

SEQ ID NO: 409466 - RNA, 23 nt, Homo sapiens
acauuaggggguuuguugcacag

SEQ ID NO: 409467 - RNA, 19 nt, Homo sapiens
acauuauuacuccuugcca

SEQ ID NO: 409468 - RNA, 23 nt, Homo sapiens
acauucaagauuaaacugaguga

SEQ ID NO: 409469 - RNA, 21 nt, Homo sapiens
acauucaaggcauuucuauca

SEQ ID NO: 409470 - RNA, 14 nt, Homo sapiens
acauucacacaggg

SEQ ID NO: 409471 - RNA, 13 nt, Homo sapiens
acauucacaccau

SEQ ID NO: 409472 - RNA, 19 nt, Homo sapiens
acauucaccaacaacaguc

SEQ ID NO: 409473 - RNA, 15 nt, Homo sapiens
acauucagauuuacc

SEQ ID NO: 409474 - RNA, 19 nt, Homo sapiens
acauucagauuuaccauaa

SEQ ID NO: 409475 - RNA, 14 nt, Homo sapiens
acauucaucaagcu

SEQ ID NO: 409476 - RNA, 19 nt, Homo sapiens
acauucaucaagcuguaca

SEQ ID NO: 409477 - RNA, 20 nt, Homo sapiens
acauuccaaugcauugcuaa

SEQ ID NO: 409478 - RNA, 17 nt, Homo sapiens
acauuccaggaaaccau

SEQ ID NO: 409479 - RNA, 18 nt, Homo sapiens
acauuccaucacagccag

SEQ ID NO: 409480 - RNA, 23 nt, Homo sapiens
acauucccuuggauguagucuga

SEQ ID NO: 409481 - RNA, 12 nt, Homo sapiens
acauuccuggcc

SEQ ID NO: 409482 - RNA, 22 nt, Homo sapiens
acauucucccuugauuccacuu

SEQ ID NO: 409483 - RNA, 15 nt, Homo sapiens
acauucuucacuguc

SEQ ID NO: 409484 - RNA, 19 nt, Homo sapiens
acauugaaagagaaccagu

SEQ ID NO: 409485 - RNA, 14 nt, Homo sapiens
acauugccuugcau

SEQ ID NO: 409486 - RNA, 16 nt, Homo sapiens
acauugguauucuggg

SEQ ID NO: 409487 - RNA, 14 nt, Homo sapiens
acauuguaaaugau

SEQ ID NO: 409488 - RNA, 19 nt, Homo sapiens
acauuucauuaaccaaaga

SEQ ID NO: 409489 - RNA, 20 nt, Homo sapiens
acauuucauuaaccaaagaa

SEQ ID NO: 409490 - RNA, 18 nt, Homo sapiens
acauuucuaacuaaggac

SEQ ID NO: 409491 - RNA, 20 nt, Homo sapiens
acauuucuaacuaaggacag

SEQ ID NO: 409492 - RNA, 21 nt, Homo sapiens
acauuuguggucugacuccuu

SEQ ID NO: 409493 - RNA, 23 nt, Homo sapiens
acauuuuacuuuuuccuggcuca

SEQ ID NO: 409494 - RNA, 19 nt, Homo sapiens
acauuuucaguaccaaaga

SEQ ID NO: 409495 - RNA, 20 nt, Homo sapiens
acauuuuucauagauaccau

SEQ ID NO: 409496 - RNA, 20 nt, Homo sapiens
acauuuuugaauacauuaaa

SEQ ID NO: 409497 - RNA, 15 nt, Homo sapiens
accaaaauccgacug

SEQ ID NO: 409498 - RNA, 18 nt, Homo sapiens
accaaacggaacucuuca

SEQ ID NO: 409499 - RNA, 18 nt, Homo sapiens
accaaagauacauguaaa

SEQ ID NO: 409500 - RNA, 18 nt, Homo sapiens
accaaaggauagugcgau

SEQ ID NO: 409501 - RNA, 14 nt, Homo sapiens
accaacaacaguca

SEQ ID NO: 409502 - RNA, 12 nt, Homo sapiens
accaaccacugc

SEQ ID NO: 409503 - RNA, 15 nt, Homo sapiens
accaacccauguaua

SEQ ID NO: 409504 - RNA, 22 nt, Homo sapiens
accaaccuagccaacaugguga

SEQ ID NO: 409505 - RNA, 12 nt, Homo sapiens
accaacugagcc

SEQ ID NO: 409506 - RNA, 12 nt, Homo sapiens
accaacuuucug

SEQ ID NO: 409507 - RNA, 17 nt, Homo sapiens
accaagagccaauggag

SEQ ID NO: 409508 - RNA, 22 nt, Homo sapiens
accaaggccagccacaccacag

SEQ ID NO: 409509 - RNA, 13 nt, Homo sapiens
accaaguucucau

SEQ ID NO: 409510 - RNA, 13 nt, Homo sapiens
accaauaauguau

SEQ ID NO: 409511 - RNA, 14 nt, Homo sapiens
accaauauuaccau

SEQ ID NO: 409512 - RNA, 13 nt, Homo sapiens
accaaugcuguug

SEQ ID NO: 409513 - RNA, 13 nt, Homo sapiens
accacaagagcuc

SEQ ID NO: 409514 - RNA, 12 nt, Homo sapiens
accacaaggaaa

SEQ ID NO: 409515 - RNA, 17 nt, Homo sapiens
accacagguucaugcca

SEQ ID NO: 409516 - RNA, 13 nt, Homo sapiens
accacagugucug

SEQ ID NO: 409517 - RNA, 20 nt, Homo sapiens
accacauuugcuagagggag

SEQ ID NO: 409518 - RNA, 18 nt, Homo sapiens
accaccaaccacugcgac

SEQ ID NO: 409519 - RNA, 10 nt, Homo sapiens
accacccacc

SEQ ID NO: 409520 - RNA, 14 nt, Homo sapiens
accacccacuugau

SEQ ID NO: 409521 - RNA, 19 nt, Homo sapiens
accaccgaaucccuagucc

SEQ ID NO: 409522 - RNA, 21 nt, Homo sapiens
accaccgcauaugcaugccag

SEQ ID NO: 409523 - RNA, 21 nt, Homo sapiens
accaccuggauggaucugcuc

SEQ ID NO: 409524 - RNA, 20 nt, Homo sapiens
accacguccucgaauucuca

SEQ ID NO: 409525 - RNA, 21 nt, Homo sapiens
accacuaagagaauacaggaa

SEQ ID NO: 409526 - RNA, 21 nt, Homo sapiens
accacuacaugcagcccaugc

SEQ ID NO: 409527 - RNA, 13 nt, Homo sapiens
accacucuugacu

SEQ ID NO: 409528 - RNA, 20 nt, Homo sapiens
accacugagcccuugcacag

SEQ ID NO: 409529 - RNA, 17 nt, Homo sapiens
accacuuuuugcagcuu

SEQ ID NO: 409530 - RNA, 15 nt, Homo sapiens
accagaagugccaug

SEQ ID NO: 409531 - RNA, 15 nt, Homo sapiens
accagagcucuggag

SEQ ID NO: 409532 - RNA, 13 nt, Homo sapiens
accagagcugucu

SEQ ID NO: 409533 - RNA, 22 nt, Homo sapiens
accagccuggucaacaugguga

SEQ ID NO: 409534 - RNA, 17 nt, Homo sapiens
accagcuccacuggccu

SEQ ID NO: 409535 - RNA, 14 nt, Homo sapiens
accagcugcucugc

SEQ ID NO: 409536 - RNA, 21 nt, Homo sapiens
accagcuuguccaacaacucc

SEQ ID NO: 409537 - RNA, 21 nt, Homo sapiens
accaggacucugccccuucug

SEQ ID NO: 409538 - RNA, 19 nt, Homo sapiens
accaggccgccccagccuc

SEQ ID NO: 409539 - RNA, 19 nt, Homo sapiens
accaggcugugggccucaa

SEQ ID NO: 409540 - RNA, 19 nt, Homo sapiens
accagggacugcagcugca

SEQ ID NO: 409541 - RNA, 19 nt, Homo sapiens
accaggugucuagaggcaa

SEQ ID NO: 409542 - RNA, 14 nt, Homo sapiens
accagguuaccuca

SEQ ID NO: 409543 - RNA, 14 nt, Homo sapiens
aagcaagggcucca

SEQ ID NO: 409544 - RNA, 21 nt, Homo sapiens
aagcaaguuucaucagucaau

SEQ ID NO: 409545 - RNA, 15 nt, Homo sapiens
aagcaauaaguucau

SEQ ID NO: 409546 - RNA, 18 nt, Homo sapiens
aagcaauuucuugcucua

SEQ ID NO: 409547 - RNA, 18 nt, Homo sapiens
aagcacaaacuucuguaa

SEQ ID NO: 409548 - RNA, 13 nt, Homo sapiens
aagcacacuugac

SEQ ID NO: 409549 - RNA, 15 nt, Homo sapiens
aagcaccccaugcca

SEQ ID NO: 409550 - RNA, 23 nt, Homo sapiens
aagcaccuagccucgcucuuggc

SEQ ID NO: 409551 - RNA, 15 nt, Homo sapiens
aagcaccugcucaac

SEQ ID NO: 409552 - RNA, 23 nt, Homo sapiens
aagcacgauggagagagccuuau

SEQ ID NO: 409553 - RNA, 14 nt, Homo sapiens
aagcacuagaucuc

SEQ ID NO: 409554 - RNA, 19 nt, Homo sapiens
aagcacuagaucucccuua

SEQ ID NO: 409555 - RNA, 20 nt, Homo sapiens
aagcacuagaucucccuuaa

SEQ ID NO: 409556 - RNA, 22 nt, Homo sapiens
aagcacucuuaaagcaaaaaau

SEQ ID NO: 409557 - RNA, 15 nt, Homo sapiens
aagcagaagcacaua

SEQ ID NO: 409558 - RNA, 21 nt, Homo sapiens
aagcagaagcauuaacuucuc

SEQ ID NO: 409559 - RNA, 20 nt, Homo sapiens
aagcagaucauuucccaaaa

SEQ ID NO: 409560 - RNA, 20 nt, Homo sapiens
aagcagugaauaguaacaau

SEQ ID NO: 409561 - RNA, 19 nt, Homo sapiens
aagcaguguguacuucuuc

SEQ ID NO: 409562 - RNA, 16 nt, Homo sapiens
aagcaguuacuaauau

SEQ ID NO: 409563 - RNA, 23 nt, Homo sapiens
aagcaguuguuauuuagugauau

SEQ ID NO: 409564 - RNA, 23 nt, Homo sapiens
aagcaugcucaguauugagacac

SEQ ID NO: 409565 - RNA, 17 nt, Homo sapiens
aagcauuaacuucucug

SEQ ID NO: 409566 - RNA, 17 nt, Homo sapiens
aagcauuauccuuuuau

SEQ ID NO: 409567 - RNA, 11 nt, Homo sapiens
aagcauuguuu

SEQ ID NO: 409568 - RNA, 15 nt, Homo sapiens
aagcauuucaccuuu

SEQ ID NO: 409569 - RNA, 18 nt, Homo sapiens
aagcauuucuagcaguga

SEQ ID NO: 409570 - RNA, 20 nt, Homo sapiens
aagcauuugacuuucugucu

SEQ ID NO: 409571 - RNA, 14 nt, Homo sapiens
aagccaagcaaacc

SEQ ID NO: 409572 - RNA, 21 nt, Homo sapiens
aagccaagucagcuuugccuu

SEQ ID NO: 409573 - RNA, 21 nt, Homo sapiens
aagccagcugcagcugggcug

SEQ ID NO: 409574 - RNA, 17 nt, Homo sapiens
aagccaggaaagcguuu

SEQ ID NO: 409575 - RNA, 18 nt, Homo sapiens
aagccaggguuccagaca

SEQ ID NO: 409576 - RNA, 14 nt, Homo sapiens
aagccauauuccag

SEQ ID NO: 409577 - RNA, 15 nt, Homo sapiens
aagcccaccugggcu

SEQ ID NO: 409578 - RNA, 15 nt, Homo sapiens
aagccccacuugaag

SEQ ID NO: 409579 - RNA, 14 nt, Homo sapiens
aagccccgcucagg

SEQ ID NO: 409580 - RNA, 20 nt, Homo sapiens
aagcccgauccacauugcau

SEQ ID NO: 409581 - RNA, 13 nt, Homo sapiens
aagcccucugagc

SEQ ID NO: 409582 - RNA, 13 nt, Homo sapiens
aagcccuugaacc

SEQ ID NO: 409583 - RNA, 15 nt, Homo sapiens
aagcccuuuacuuga

SEQ ID NO: 409584 - RNA, 15 nt, Homo sapiens
aagccuaacauuggu

SEQ ID NO: 409585 - RNA, 18 nt, Homo sapiens
aagccucagccauucacu

SEQ ID NO: 409586 - RNA, 20 nt, Homo sapiens
aagccucauuuguguggaaa

SEQ ID NO: 409587 - RNA, 15 nt, Homo sapiens
aagccuccugcugag

SEQ ID NO: 409588 - RNA, 20 nt, Homo sapiens
aagccucgggccacaugggu

SEQ ID NO: 409589 - RNA, 12 nt, Homo sapiens
aagccugaugau

SEQ ID NO: 409590 - RNA, 17 nt, Homo sapiens
aagccugguggcaauaa

SEQ ID NO: 409591 - RNA, 21 nt, Homo sapiens
aagccuguccucaccgucucg

SEQ ID NO: 409592 - RNA, 20 nt, Homo sapiens
aagccuguguauaaaaaaga

SEQ ID NO: 409593 - RNA, 15 nt, Homo sapiens
aagccuugcccagca

SEQ ID NO: 409594 - RNA, 19 nt, Homo sapiens
aagccuuggaccaaaugga

SEQ ID NO: 409595 - RNA, 15 nt, Homo sapiens
aagcgaacaucuuca

SEQ ID NO: 409596 - RNA, 12 nt, Homo sapiens
aagcgauucuca

SEQ ID NO: 409597 - RNA, 19 nt, Homo sapiens
aagcgauucuugugccuca

SEQ ID NO: 409598 - RNA, 23 nt, Homo sapiens
aagcgauucuugugccucagcuu

SEQ ID NO: 409599 - RNA, 14 nt, Homo sapiens
aagcgggaguggcu

SEQ ID NO: 409600 - RNA, 15 nt, Homo sapiens
aagcguaauuuugcc

SEQ ID NO: 409601 - RNA, 21 nt, Homo sapiens
aagcguaauuuugccaaauaa

SEQ ID NO: 409602 - RNA, 15 nt, Homo sapiens
aagcuaaaaugauuu

SEQ ID NO: 409603 - RNA, 14 nt, Homo sapiens
aagcuaaauuccac

SEQ ID NO: 409604 - RNA, 21 nt, Homo sapiens
aagcuaggguggcccuugcag

SEQ ID NO: 409605 - RNA, 20 nt, Homo sapiens
aagcuauauguuauggcuua

SEQ ID NO: 409606 - RNA, 21 nt, Homo sapiens
aagcuccaucuuauuugucag

SEQ ID NO: 409607 - RNA, 13 nt, Homo sapiens
aagcucuucuaaa

SEQ ID NO: 409608 - RNA, 14 nt, Homo sapiens
aagcucuuguggua

SEQ ID NO: 409609 - RNA, 23 nt, Homo sapiens
aagcugaagaaaaugaagcccua

SEQ ID NO: 409610 - RNA, 20 nt, Homo sapiens
aagcugaugacaacuuccca

SEQ ID NO: 409611 - RNA, 20 nt, Homo sapiens
aagcugcucuccuucacucu

SEQ ID NO: 409612 - RNA, 20 nt, Homo sapiens
aagcugcugaaugcauucag

SEQ ID NO: 409613 - RNA, 23 nt, Homo sapiens
aagcugcugaaugcauucagggg

SEQ ID NO: 409614 - RNA, 21 nt, Homo sapiens
aagcugcugagaaucuagccu

SEQ ID NO: 409615 - RNA, 20 nt, Homo sapiens
aagcugggagaaccaaaaag

SEQ ID NO: 409616 - RNA, 17 nt, Homo sapiens
aagcuggggauguuuag

SEQ ID NO: 409617 - RNA, 19 nt, Homo sapiens
aagcuguuuccauagggug

SEQ ID NO: 409618 - RNA, 22 nt, Homo sapiens
aagcuucucagacuucucuuau

SEQ ID NO: 409619 - RNA, 16 nt, Homo sapiens
aagcuucuugcuccug

SEQ ID NO: 409620 - RNA, 20 nt, Homo sapiens
aagcuuuaggaugacuguau

SEQ ID NO: 409621 - RNA, 18 nt, Homo sapiens
aaggaaaccaagugguca

SEQ ID NO: 409622 - RNA, 17 nt, Homo sapiens
aaggaaauaacauugca

SEQ ID NO: 409623 - RNA, 19 nt, Homo sapiens
aaggaaauaacauugcacu

SEQ ID NO: 409624 - RNA, 21 nt, Homo sapiens
aaggaacauuccuuagucuca

SEQ ID NO: 409625 - RNA, 14 nt, Homo sapiens
aaggaaggcauuug

SEQ ID NO: 409626 - RNA, 16 nt, Homo sapiens
aaggacaaacagugaa

SEQ ID NO: 409627 - RNA, 21 nt, Homo sapiens
aaggaccuaaauucguagcaa

SEQ ID NO: 409628 - RNA, 19 nt, Homo sapiens
aaggacucugcuucagucc

SEQ ID NO: 409629 - RNA, 17 nt, Homo sapiens
aaggagaacugugcucu

SEQ ID NO: 409630 - RNA, 21 nt, Homo sapiens
aaggagaacugugcucuccca

SEQ ID NO: 409631 - RNA, 17 nt, Homo sapiens
aaggaggggaagcugca

SEQ ID NO: 409632 - RNA, 13 nt, Homo sapiens
aaggaucacuuga

SEQ ID NO: 409633 - RNA, 16 nt, Homo sapiens
aaggaugaaagacaaa

SEQ ID NO: 409634 - RNA, 18 nt, Homo sapiens
aaggauggaaagggaaug

SEQ ID NO: 409635 - RNA, 14 nt, Homo sapiens
aaggauugugaacu

SEQ ID NO: 409636 - RNA, 16 nt, Homo sapiens
aaggcaaauauaagcu

SEQ ID NO: 409637 - RNA, 14 nt, Homo sapiens
aaggcaaaugaugc

SEQ ID NO: 409638 - RNA, 15 nt, Homo sapiens
aaggcaaaugaugcc

SEQ ID NO: 409639 - RNA, 17 nt, Homo sapiens
aaggcaccugaaugugu

SEQ ID NO: 409640 - RNA, 15 nt, Homo sapiens
aaggcagcucugucg

SEQ ID NO: 409641 - RNA, 15 nt, Homo sapiens
aaggcaguauucccu

SEQ ID NO: 409642 - RNA, 21 nt, Homo sapiens
aaggcaguguuccucaccaau

SEQ ID NO: 409643 - RNA, 16 nt, Homo sapiens
aaggcaucauuuucac

SEQ ID NO: 409644 - RNA, 23 nt, Homo sapiens
aaggcaucauuuucaccuccauu

SEQ ID NO: 409645 - RNA, 14 nt, Homo sapiens
aaggcaucuaagac

SEQ ID NO: 409646 - RNA, 20 nt, Homo sapiens
aaggccacggccuugugucu

SEQ ID NO: 409647 - RNA, 20 nt, Homo sapiens
aaggccagucugaaccugag

SEQ ID NO: 409648 - RNA, 17 nt, Homo sapiens
uccccuuccauucccaa

SEQ ID NO: 409649 - RNA, 19 nt, Homo sapiens
uccccuuugguuuuacuac

SEQ ID NO: 409650 - RNA, 16 nt, Homo sapiens
uccccuuuuucuuccu

SEQ ID NO: 409651 - RNA, 13 nt, Homo sapiens
ucccgaauccuga

SEQ ID NO: 409652 - RNA, 19 nt, Homo sapiens
ucccgccuuccuccuccac

SEQ ID NO: 409653 - RNA, 18 nt, Homo sapiens
ucccggggcuccacugaa

SEQ ID NO: 409654 - RNA, 21 nt, Homo sapiens
ucccgguguaugcagugguga

SEQ ID NO: 409655 - RNA, 16 nt, Homo sapiens
ucccgguucaccuugc

SEQ ID NO: 409656 - RNA, 17 nt, Homo sapiens
ucccuaaagaacauacc

SEQ ID NO: 409657 - RNA, 20 nt, Homo sapiens
ucccuaacuuaacauugcau

SEQ ID NO: 409658 - RNA, 22 nt, Homo sapiens
ucccuaauccuccaagucuuca

SEQ ID NO: 409659 - RNA, 20 nt, Homo sapiens
ucccuaaugagaagucaaca

SEQ ID NO: 409660 - RNA, 21 nt, Homo sapiens
ucccuacgaggaguguuccca

SEQ ID NO: 409661 - RNA, 22 nt, Homo sapiens
ucccuagauagcuauuaagaua

SEQ ID NO: 409662 - RNA, 13 nt, Homo sapiens
ucccuauguccca

SEQ ID NO: 409663 - RNA, 22 nt, Homo sapiens
ucccucauguucucauguuugu

SEQ ID NO: 409664 - RNA, 22 nt, Homo sapiens
ucccuccagggccacugcuuga

SEQ ID NO: 409665 - RNA, 12 nt, Homo sapiens
ucccuccauccu

SEQ ID NO: 409666 - RNA, 16 nt, Homo sapiens
ucccuccccugccauu

SEQ ID NO: 409667 - RNA, 19 nt, Homo sapiens
ucccucgaacccacacugc

SEQ ID NO: 409668 - RNA, 20 nt, Homo sapiens
ucccucgcccccacacccca

SEQ ID NO: 409669 - RNA, 17 nt, Homo sapiens
ucccucucucuggaaag

SEQ ID NO: 409670 - RNA, 13 nt, Homo sapiens
ucccucucugcac

SEQ ID NO: 409671 - RNA, 23 nt, Homo sapiens
ucccucucugcaccugucucaua

SEQ ID NO: 409672 - RNA, 17 nt, Homo sapiens
ucccucucuuccgggag

SEQ ID NO: 409673 - RNA, 17 nt, Homo sapiens
ucccugaaacauugcau

SEQ ID NO: 409674 - RNA, 18 nt, Homo sapiens
ucccuggccauccaugug

SEQ ID NO: 409675 - RNA, 13 nt, Homo sapiens
ucccuggcuguga

SEQ ID NO: 409676 - RNA, 13 nt, Homo sapiens
ucccugggggccu

SEQ ID NO: 409677 - RNA, 16 nt, Homo sapiens
ucccugucuccagggc

SEQ ID NO: 409678 - RNA, 21 nt, Homo sapiens
ucccuguguauucuagugaau

SEQ ID NO: 409679 - RNA, 13 nt, Homo sapiens
ucccugugucagg

SEQ ID NO: 409680 - RNA, 16 nt, Homo sapiens
ucccuguguggaccau

SEQ ID NO: 409681 - RNA, 18 nt, Homo sapiens
ucccuguguugucucuag

SEQ ID NO: 409682 - RNA, 17 nt, Homo sapiens
ucccuguuaucugcuag

SEQ ID NO: 409683 - RNA, 19 nt, Homo sapiens
ucccuguuaucugcuagau

SEQ ID NO: 409684 - RNA, 23 nt, Homo sapiens
ucccuuaauaaacucacaacucu

SEQ ID NO: 409685 - RNA, 16 nt, Homo sapiens
ucccuuccacugccuc

SEQ ID NO: 409686 - RNA, 20 nt, Homo sapiens
ucccuucucacagcacaugc

SEQ ID NO: 409687 - RNA, 18 nt, Homo sapiens
ucccuucuuggugcuuac

SEQ ID NO: 409688 - RNA, 19 nt, Homo sapiens
ucccuucuuugcuucuuuu

SEQ ID NO: 409689 - RNA, 21 nt, Homo sapiens
ucccuucuuugcuucuuuuuc

SEQ ID NO: 409690 - RNA, 15 nt, Homo sapiens
ucccuugcagggguc

SEQ ID NO: 409691 - RNA, 13 nt, Homo sapiens
ucccuuucuggga

SEQ ID NO: 409692 - RNA, 17 nt, Homo sapiens
ucccuuuguaugggagc

SEQ ID NO: 409693 - RNA, 21 nt, Homo sapiens
ucccuuuguugcacacucacu

SEQ ID NO: 409694 - RNA, 13 nt, Homo sapiens
ucccuuuguugcu

SEQ ID NO: 409695 - RNA, 23 nt, Homo sapiens
ucccuuuuuauaucccauuuuua

SEQ ID NO: 409696 - RNA, 15 nt, Homo sapiens
uccgaggcaaagaga

SEQ ID NO: 409697 - RNA, 18 nt, Homo sapiens
uccgaguagcugggauua

SEQ ID NO: 409698 - RNA, 16 nt, Homo sapiens
uccgaucgacugccaa

SEQ ID NO: 409699 - RNA, 14 nt, Homo sapiens
uccgccagaccuca

SEQ ID NO: 409700 - RNA, 20 nt, Homo sapiens
uccgccauuccaagucaaca

SEQ ID NO: 409701 - RNA, 14 nt, Homo sapiens
uccgcgcaggugcc

SEQ ID NO: 409702 - RNA, 15 nt, Homo sapiens
uccgcucucucaugu

SEQ ID NO: 409703 - RNA, 15 nt, Homo sapiens
uccggaauccugucc

SEQ ID NO: 409704 - RNA, 18 nt, Homo sapiens
uccggaauccuguccuca

SEQ ID NO: 409705 - RNA, 21 nt, Homo sapiens
uccggagaugaauaugagcuc

SEQ ID NO: 409706 - RNA, 15 nt, Homo sapiens
uccgguggaaggccu

SEQ ID NO: 409707 - RNA, 20 nt, Homo sapiens
uccgucaguccaagucuucu

SEQ ID NO: 409708 - RNA, 11 nt, Homo sapiens
uccgugcuuuu

SEQ ID NO: 409709 - RNA, 22 nt, Homo sapiens
uccguggccccgcccucaggcu

SEQ ID NO: 409710 - RNA, 12 nt, Homo sapiens
uccguguaaaau

SEQ ID NO: 409711 - RNA, 12 nt, Homo sapiens
uccuaacuuauu

SEQ ID NO: 409712 - RNA, 23 nt, Homo sapiens
uccuaagccuguugcugaaguca

SEQ ID NO: 409713 - RNA, 21 nt, Homo sapiens
uccuaaguuaccuuucuaggu

SEQ ID NO: 409714 - RNA, 15 nt, Homo sapiens
uccuaauaugcuuua

SEQ ID NO: 409715 - RNA, 14 nt, Homo sapiens
uccuacaagcuaaa

SEQ ID NO: 409716 - RNA, 14 nt, Homo sapiens
uccuacaauaucau

SEQ ID NO: 409717 - RNA, 21 nt, Homo sapiens
uccuacacccuuggacuugag

SEQ ID NO: 409718 - RNA, 12 nt, Homo sapiens
uccuaucugugu

SEQ ID NO: 409719 - RNA, 21 nt, Homo sapiens
uccuaugcccagguaccaccc

SEQ ID NO: 409720 - RNA, 17 nt, Homo sapiens
uccuaugcugcaauaca

SEQ ID NO: 409721 - RNA, 18 nt, Homo sapiens
uccuauuacugaugugug

SEQ ID NO: 409722 - RNA, 13 nt, Homo sapiens
uccucaaaccuac

SEQ ID NO: 409723 - RNA, 15 nt, Homo sapiens
uccucaacagcugua

SEQ ID NO: 409724 - RNA, 17 nt, Homo sapiens
uccucaagaaguaauaa

SEQ ID NO: 409725 - RNA, 21 nt, Homo sapiens
uccucaauggaaccaaauaua

SEQ ID NO: 409726 - RNA, 18 nt, Homo sapiens
uccucacaguugccaugu

SEQ ID NO: 409727 - RNA, 14 nt, Homo sapiens
uccucaccgucucg

SEQ ID NO: 409728 - RNA, 18 nt, Homo sapiens
uccucaccuuaauuuauu

SEQ ID NO: 409729 - RNA, 21 nt, Homo sapiens
uccucagaagucaguugcaaa

SEQ ID NO: 409730 - RNA, 19 nt, Homo sapiens
uccucagguaguacuggga

SEQ ID NO: 409731 - RNA, 17 nt, Homo sapiens
uccucaggugaccaaaa

SEQ ID NO: 409732 - RNA, 15 nt, Homo sapiens
uccucaguuccugca

SEQ ID NO: 409733 - RNA, 13 nt, Homo sapiens
uccucauuccuga

SEQ ID NO: 409734 - RNA, 16 nt, Homo sapiens
uccuccacagugcugc

SEQ ID NO: 409735 - RNA, 18 nt, Homo sapiens
uccuccacagugcugcuu

SEQ ID NO: 409736 - RNA, 22 nt, Homo sapiens
uccuccccuuugacccuauuca

SEQ ID NO: 409737 - RNA, 15 nt, Homo sapiens
uccucccucauucca

SEQ ID NO: 409738 - RNA, 14 nt, Homo sapiens
uccuccuucacucc

SEQ ID NO: 409739 - RNA, 19 nt, Homo sapiens
uccuccuuugcucuuggga

SEQ ID NO: 409740 - RNA, 15 nt, Homo sapiens
uccucgggcacagac

SEQ ID NO: 409741 - RNA, 16 nt, Homo sapiens
uccucuccacugccuu

SEQ ID NO: 409742 - RNA, 16 nt, Homo sapiens
uccucucccaagucca

SEQ ID NO: 409743 - RNA, 14 nt, Homo sapiens
uccucucucccugc

SEQ ID NO: 409744 - RNA, 21 nt, Homo sapiens
uccucucuggacuuucuccaa

SEQ ID NO: 409745 - RNA, 18 nt, Homo sapiens
uccucuggggaagggaac

SEQ ID NO: 409746 - RNA, 14 nt, Homo sapiens
uccucuucagagga

SEQ ID NO: 409747 - RNA, 16 nt, Homo sapiens
uccucuucuguaaaau

SEQ ID NO: 409748 - RNA, 15 nt, Homo sapiens
uccucuugaaccaca

SEQ ID NO: 409749 - RNA, 14 nt, Homo sapiens
uccucuuggagcug

SEQ ID NO: 409750 - RNA, 14 nt, Homo sapiens
uccucuuuaccugu

SEQ ID NO: 409751 - RNA, 23 nt, Homo sapiens
uccugaccucaaguaauccaccu

SEQ ID NO: 409752 - RNA, 19 nt, Homo sapiens
uccugacuuuuaaugucau

SEQ ID NO: 409753 - RNA, 18 nt, Homo sapiens
uccugagauucugggaaa

SEQ ID NO: 409754 - RNA, 19 nt, Homo sapiens
uccugaggcagaaccuggu

SEQ ID NO: 409755 - RNA, 19 nt, Homo sapiens
uccugagggccccgacuuu

SEQ ID NO: 409756 - RNA, 19 nt, Homo sapiens
uccugaguagcuggauuac

SEQ ID NO: 409757 - RNA, 21 nt, Homo sapiens
uccugaguagcugggaugaca

SEQ ID NO: 409758 - RNA, 20 nt, Homo sapiens
uccugauggaauuguuauac

SEQ ID NO: 409759 - RNA, 16 nt, Homo sapiens
uccugcaacucaagga

SEQ ID NO: 409760 - RNA, 12 nt, Homo sapiens
uccugcacucua

SEQ ID NO: 409761 - RNA, 10 nt, Homo sapiens
uccugccacc

SEQ ID NO: 409762 - RNA, 22 nt, Homo sapiens
uccugccacuagguuucaccuc

SEQ ID NO: 409763 - RNA, 13 nt, Homo sapiens
uccuggaaccaau

SEQ ID NO: 409764 - RNA, 16 nt, Homo sapiens
uccuggaauaaaccac

SEQ ID NO: 409765 - RNA, 23 nt, Homo sapiens
uccuggagaaggcauuccagggu

SEQ ID NO: 409766 - RNA, 15 nt, Homo sapiens
uccuggcaagugacc

SEQ ID NO: 409767 - RNA, 16 nt, Homo sapiens
uccuggcaugacacuc

SEQ ID NO: 409768 - RNA, 19 nt, Homo sapiens
uccuggcuuugacaugaaa

SEQ ID NO: 409769 - RNA, 17 nt, Homo sapiens
uccugggccuccugaca

SEQ ID NO: 409770 - RNA, 19 nt, Homo sapiens
uccuguacauugugggaug

SEQ ID NO: 409771 - RNA, 16 nt, Homo sapiens
uccugucccuggccau

SEQ ID NO: 409772 - RNA, 14 nt, Homo sapiens
uccugugaauuucu

SEQ ID NO: 409773 - RNA, 11 nt, Homo sapiens
uccugugacug

SEQ ID NO: 409774 - RNA, 16 nt, Homo sapiens
uccugugccaaccuga

SEQ ID NO: 409775 - RNA, 20 nt, Homo sapiens
uccugugcggugucaccaug

SEQ ID NO: 409776 - RNA, 20 nt, Homo sapiens
ucucacuuuucuccaugagu

SEQ ID NO: 409777 - RNA, 16 nt, Homo sapiens
ucucagacgacaccug

SEQ ID NO: 409778 - RNA, 19 nt, Homo sapiens
ucucagauuguaccauuga

SEQ ID NO: 409779 - RNA, 12 nt, Homo sapiens
ucucagcacuug

SEQ ID NO: 409780 - RNA, 12 nt, Homo sapiens
ucucagcacuuu

SEQ ID NO: 409781 - RNA, 17 nt, Homo sapiens
ucucagccuccugagua

SEQ ID NO: 409782 - RNA, 22 nt, Homo sapiens
ucucagcucacugcaagcucca

SEQ ID NO: 409783 - RNA, 14 nt, Homo sapiens
ucucaguccucaaa

SEQ ID NO: 409784 - RNA, 16 nt, Homo sapiens
ucucaguccucaaagc

SEQ ID NO: 409785 - RNA, 16 nt, Homo sapiens
ucucagugcucuccua

SEQ ID NO: 409786 - RNA, 14 nt, Homo sapiens
ucucauccacagag

SEQ ID NO: 409787 - RNA, 22 nt, Homo sapiens
ucucaucucccugcaaccuccg

SEQ ID NO: 409788 - RNA, 21 nt, Homo sapiens
ucucaugguauuaucuaguag

SEQ ID NO: 409789 - RNA, 18 nt, Homo sapiens
ucucauguuugugcaugu

SEQ ID NO: 409790 - RNA, 21 nt, Homo sapiens
ucucauuauuucaucaugacu

SEQ ID NO: 409791 - RNA, 14 nt, Homo sapiens
ucucauugaucaca

SEQ ID NO: 409792 - RNA, 13 nt, Homo sapiens
ucuccaaaggcac

SEQ ID NO: 409793 - RNA, 18 nt, Homo sapiens
ucuccaaaggcacugacc

SEQ ID NO: 409794 - RNA, 14 nt, Homo sapiens
ucuccaaaugagau

SEQ ID NO: 409795 - RNA, 15 nt, Homo sapiens
ucuccaagauagcau

SEQ ID NO: 409796 - RNA, 13 nt, Homo sapiens
ucuccacagggac

SEQ ID NO: 409797 - RNA, 23 nt, Homo sapiens
ucuccagcccuauggaagucuca

SEQ ID NO: 409798 - RNA, 21 nt, Homo sapiens
ucuccagguccucuacuuaau

SEQ ID NO: 409799 - RNA, 14 nt, Homo sapiens
ucucccaaagccau

SEQ ID NO: 409800 - RNA, 22 nt, Homo sapiens
ucucccaccugguuaccacagu

SEQ ID NO: 409801 - RNA, 13 nt, Homo sapiens
ucuccccaugugc

SEQ ID NO: 409802 - RNA, 16 nt, Homo sapiens
ucuccccuccaaguga

SEQ ID NO: 409803 - RNA, 19 nt, Homo sapiens
ucucccucucugcaccugu

SEQ ID NO: 409804 - RNA, 23 nt, Homo sapiens
ucucccuguuggucgguggguug

SEQ ID NO: 409805 - RNA, 22 nt, Homo sapiens
ucucccuucuuuaccuucauuu

SEQ ID NO: 409806 - RNA, 18 nt, Homo sapiens
ucuccguugucauugacu

SEQ ID NO: 409807 - RNA, 11 nt, Homo sapiens
ucuccuacuuu

SEQ ID NO: 409808 - RNA, 15 nt, Homo sapiens
ucuccuauguggcag

SEQ ID NO: 409809 - RNA, 12 nt, Homo sapiens
ucuccucagggu

SEQ ID NO: 409810 - RNA, 16 nt, Homo sapiens
ucuccucccauggccu

SEQ ID NO: 409811 - RNA, 13 nt, Homo sapiens
ucuccucugucag

SEQ ID NO: 409812 - RNA, 14 nt, Homo sapiens
ucuccugcccagau

SEQ ID NO: 409813 - RNA, 13 nt, Homo sapiens
ucuccugcuugua

SEQ ID NO: 409814 - RNA, 15 nt, Homo sapiens
ucuccuggucccugg

SEQ ID NO: 409815 - RNA, 23 nt, Homo sapiens
ucuccuucacucugacaguauua

SEQ ID NO: 409816 - RNA, 13 nt, Homo sapiens
ucuccuuugaggg

SEQ ID NO: 409817 - RNA, 17 nt, Homo sapiens
ucucgaaugcugagaag

SEQ ID NO: 409818 - RNA, 15 nt, Homo sapiens
ucucgacaguaucca

SEQ ID NO: 409819 - RNA, 15 nt, Homo sapiens
ucucgccaagccauc

SEQ ID NO: 409820 - RNA, 18 nt, Homo sapiens
ucucgcuuuguugcccag

SEQ ID NO: 409821 - RNA, 21 nt, Homo sapiens
ucucggaccuuucagcuguga

SEQ ID NO: 409822 - RNA, 18 nt, Homo sapiens
ucucgguagcugugcgug

SEQ ID NO: 409823 - RNA, 20 nt, Homo sapiens
ucucgucaggaggugccuga

SEQ ID NO: 409824 - RNA, 22 nt, Homo sapiens
ucucgugauugauaagaaccuu

SEQ ID NO: 409825 - RNA, 17 nt, Homo sapiens
ucucuacuaaaaauaca

SEQ ID NO: 409826 - RNA, 11 nt, Homo sapiens
ucucuacuguc

SEQ ID NO: 409827 - RNA, 20 nt, Homo sapiens
ucucuagacaucuagucuca

SEQ ID NO: 409828 - RNA, 15 nt, Homo sapiens
ucucuagagugagaa

SEQ ID NO: 409829 - RNA, 17 nt, Homo sapiens
ucucuagugucuuuugc

SEQ ID NO: 409830 - RNA, 23 nt, Homo sapiens
ucucuauaacagauccuuucaaa

SEQ ID NO: 409831 - RNA, 13 nt, Homo sapiens
ucucucacaugga

SEQ ID NO: 409832 - RNA, 20 nt, Homo sapiens
ucucuccugauagucuuuca

SEQ ID NO: 409833 - RNA, 14 nt, Homo sapiens
ucucucgugauuga

SEQ ID NO: 409834 - RNA, 23 nt, Homo sapiens
ucucucuaaaaauaaaaugaugu

SEQ ID NO: 409835 - RNA, 11 nt, Homo sapiens
ucucugcaaaa

SEQ ID NO: 409836 - RNA, 12 nt, Homo sapiens
ucucugcaccug

SEQ ID NO: 409837 - RNA, 14 nt, Homo sapiens
ucucugccaugugg

SEQ ID NO: 409838 - RNA, 18 nt, Homo sapiens
ucucugcccucuucucau

SEQ ID NO: 409839 - RNA, 13 nt, Homo sapiens
ucucugccuuuga

SEQ ID NO: 409840 - RNA, 20 nt, Homo sapiens
ucucuggaaaggggggagcu

SEQ ID NO: 409841 - RNA, 18 nt, Homo sapiens
ucucuggacuuucuccaa

SEQ ID NO: 409842 - RNA, 16 nt, Homo sapiens
ucucugggacucuccu

SEQ ID NO: 409843 - RNA, 14 nt, Homo sapiens
ucucugguggugcu

SEQ ID NO: 409844 - RNA, 16 nt, Homo sapiens
ucucuuauagaauauu

SEQ ID NO: 409845 - RNA, 17 nt, Homo sapiens
ucucuugcuaccuguga

SEQ ID NO: 409846 - RNA, 12 nt, Homo sapiens
ucucuuuccaaa

SEQ ID NO: 409847 - RNA, 20 nt, Homo sapiens
ucugaaaaacauuccaggaa

SEQ ID NO: 409848 - RNA, 17 nt, Homo sapiens
ucugaaaucagugccua

SEQ ID NO: 409849 - RNA, 18 nt, Homo sapiens
ucugaaccauuacuguaa

SEQ ID NO: 409850 - RNA, 16 nt, Homo sapiens
ucugaauaacuugaag

SEQ ID NO: 409851 - RNA, 19 nt, Homo sapiens
ucugaauccucaugaggcu

SEQ ID NO: 409852 - RNA, 20 nt, Homo sapiens
ucugaaucgagugagacaaa

SEQ ID NO: 409853 - RNA, 21 nt, Homo sapiens
ucugagagugaaaccaugacu

SEQ ID NO: 409854 - RNA, 23 nt, Homo sapiens
ucugagcccugcccucacuccac

SEQ ID NO: 409855 - RNA, 21 nt, Homo sapiens
ucugagcuaacgugcugucag

SEQ ID NO: 409856 - RNA, 14 nt, Homo sapiens
ucugagggcacucu

SEQ ID NO: 409857 - RNA, 17 nt, Homo sapiens
ucugaguagcauauaua

SEQ ID NO: 409858 - RNA, 15 nt, Homo sapiens
ucugauucuucaaag

SEQ ID NO: 409859 - RNA, 14 nt, Homo sapiens
ucugcaacagccug

SEQ ID NO: 409860 - RNA, 21 nt, Homo sapiens
ucugcaagcacaucugcauuu

SEQ ID NO: 409861 - RNA, 14 nt, Homo sapiens
ucugcaagcccacu

SEQ ID NO: 409862 - RNA, 16 nt, Homo sapiens
ucugcacacauaacac

SEQ ID NO: 409863 - RNA, 19 nt, Homo sapiens
ucugcaccugucucauagc

SEQ ID NO: 409864 - RNA, 20 nt, Homo sapiens
ucugcagcacucuuaucuac

SEQ ID NO: 409865 - RNA, 23 nt, Homo sapiens
ucugcagcccggcgccaccaucc

SEQ ID NO: 409866 - RNA, 13 nt, Homo sapiens
ucugcagccugag

SEQ ID NO: 409867 - RNA, 21 nt, Homo sapiens
ucugcagcgagccccccaugu

SEQ ID NO: 409868 - RNA, 18 nt, Homo sapiens
ucugcagggagcaacucu

SEQ ID NO: 409869 - RNA, 20 nt, Homo sapiens
ucugcagggagcaacucucc

SEQ ID NO: 409870 - RNA, 15 nt, Homo sapiens
ucugcauguguguug

SEQ ID NO: 409871 - RNA, 18 nt, Homo sapiens
ucugcauuucuacauguu

SEQ ID NO: 409872 - RNA, 17 nt, Homo sapiens
ucugccacccuaccugu

SEQ ID NO: 409873 - RNA, 19 nt, Homo sapiens
ucugccagcuccacagggu

SEQ ID NO: 409874 - RNA, 13 nt, Homo sapiens
ucugccccagaua

SEQ ID NO: 409875 - RNA, 21 nt, Homo sapiens
ucugcccccgcggguucuaga

SEQ ID NO: 409876 - RNA, 13 nt, Homo sapiens
ucugccuguggaa

SEQ ID NO: 409877 - RNA, 22 nt, Homo sapiens
ucugccuguuauaacucugcac

SEQ ID NO: 409878 - RNA, 23 nt, Homo sapiens
ucugccuugcacaaaaagcacaa

SEQ ID NO: 409879 - RNA, 16 nt, Homo sapiens
ucugcuauaugccuua

SEQ ID NO: 409880 - RNA, 16 nt, Homo sapiens
ucugcuauauuuucau

SEQ ID NO: 409881 - RNA, 17 nt, Homo sapiens
ucugcuaugucugugau

SEQ ID NO: 409882 - RNA, 21 nt, Homo sapiens
ucugcucaggaguucugugag

SEQ ID NO: 409883 - RNA, 22 nt, Homo sapiens
ucugcucugugccugggaucag

SEQ ID NO: 409884 - RNA, 23 nt, Homo sapiens
ucugcucuuucucugccagugac

SEQ ID NO: 409885 - RNA, 23 nt, Homo sapiens
ucugcugccaugagaaaagggaa

SEQ ID NO: 409886 - RNA, 15 nt, Homo sapiens
ucugcugcuuuccaa

SEQ ID NO: 409887 - RNA, 23 nt, Homo sapiens
ucugcuggggauggccacuguga

SEQ ID NO: 409888 - RNA, 15 nt, Homo sapiens
ucugcuggucuucaa

SEQ ID NO: 409889 - RNA, 16 nt, Homo sapiens
ucugcuguagagccau

SEQ ID NO: 409890 - RNA, 21 nt, Homo sapiens
ucugcuguauacuguacugag

SEQ ID NO: 409891 - RNA, 16 nt, Homo sapiens
ucugcuuugacugagc

SEQ ID NO: 409892 - RNA, 23 nt, Homo sapiens
ucuggaaaaauaaguacauauag

SEQ ID NO: 409893 - RNA, 13 nt, Homo sapiens
ucuggaagaccug

SEQ ID NO: 409894 - RNA, 16 nt, Homo sapiens
ucuggaagucaucuca

SEQ ID NO: 409895 - RNA, 13 nt, Homo sapiens
ucuggacuuucuc

SEQ ID NO: 409896 - RNA, 16 nt, Homo sapiens
ucuggagucugaagga

SEQ ID NO: 409897 - RNA, 22 nt, Homo sapiens
ucuggcaucucuuucugcaaag

SEQ ID NO: 409898 - RNA, 20 nt, Homo sapiens
ucuggccaaauaugcacuuu

SEQ ID NO: 409899 - RNA, 18 nt, Homo sapiens
ucugggaaaggugcucaa

SEQ ID NO: 409900 - RNA, 14 nt, Homo sapiens
ucugggccagguug

SEQ ID NO: 409901 - RNA, 21 nt, Homo sapiens
ucugggccucugacucugagu

SEQ ID NO: 409902 - RNA, 21 nt, Homo sapiens
ucugggccuucucaccacaga

SEQ ID NO: 409903 - RNA, 18 nt, Homo sapiens
ucugggucaucucucaca

SEQ ID NO: 409904 - RNA, 19 nt, Homo sapiens
ucuggucuaguuaaccuag

SEQ ID NO: 409905 - RNA, 20 nt, Homo sapiens
ucugguuagaaaaaggacuc

SEQ ID NO: 409906 - RNA, 15 nt, Homo sapiens
ucuguaaaugaacac

SEQ ID NO: 409907 - RNA, 14 nt, Homo sapiens
ucuguaagagaauu

SEQ ID NO: 409908 - RNA, 16 nt, Homo sapiens
ggaugaugguugcaaa

SEQ ID NO: 409909 - RNA, 22 nt, Homo sapiens
ggaugcaggguuugagaauguu

SEQ ID NO: 409910 - RNA, 14 nt, Homo sapiens
ggaugcugugccuc

SEQ ID NO: 409911 - RNA, 13 nt, Homo sapiens
ggauggaaaggga

SEQ ID NO: 409912 - RNA, 16 nt, Homo sapiens
ggaugggaacacuggu

SEQ ID NO: 409913 - RNA, 12 nt, Homo sapiens
ggaugucuuccu

SEQ ID NO: 409914 - RNA, 19 nt, Homo sapiens
ggaugugcauuucugugau

SEQ ID NO: 409915 - RNA, 18 nt, Homo sapiens
ggaugugccuguggcaug

SEQ ID NO: 409916 - RNA, 19 nt, Homo sapiens
ggauguugcuuuugcaccu

SEQ ID NO: 409917 - RNA, 17 nt, Homo sapiens
ggauuaaccucugcacu

SEQ ID NO: 409918 - RNA, 12 nt, Homo sapiens
ggauuaaucucu

SEQ ID NO: 409919 - RNA, 21 nt, Homo sapiens
ggauuaauguuuuguacaauu

SEQ ID NO: 409920 - RNA, 17 nt, Homo sapiens
ggauuacagacaugaac

SEQ ID NO: 409921 - RNA, 13 nt, Homo sapiens
ggauuacaggcau

SEQ ID NO: 409922 - RNA, 19 nt, Homo sapiens
ggauucacuucuauuuauu

SEQ ID NO: 409923 - RNA, 16 nt, Homo sapiens
ggauugaagcccucca

SEQ ID NO: 409924 - RNA, 19 nt, Homo sapiens
ggauugagcagaacccaga

SEQ ID NO: 409925 - RNA, 19 nt, Homo sapiens
ggauuggcuauaacauguc

SEQ ID NO: 409926 - RNA, 17 nt, Homo sapiens
ggauuugccugugccac

SEQ ID NO: 409927 - RNA, 18 nt, Homo sapiens
ggauuuuccaccaaauuc

SEQ ID NO: 409928 - RNA, 22 nt, Homo sapiens
ggcaaagaacugccccaucucc

SEQ ID NO: 409929 - RNA, 18 nt, Homo sapiens
ggcaaaucagaugcagcu

SEQ ID NO: 409930 - RNA, 15 nt, Homo sapiens
ggcaaccuguugaau

SEQ ID NO: 409931 - RNA, 20 nt, Homo sapiens
ggcaacucacgggugcauga

SEQ ID NO: 409932 - RNA, 14 nt, Homo sapiens
ggcaacuccagaag

SEQ ID NO: 409933 - RNA, 13 nt, Homo sapiens
ggcaagagcucuu

SEQ ID NO: 409934 - RNA, 14 nt, Homo sapiens
ggcaagauagcucc

SEQ ID NO: 409935 - RNA, 16 nt, Homo sapiens
ggcaaggaugauccag

SEQ ID NO: 409936 - RNA, 23 nt, Homo sapiens
ggcaauaaauauuagaagccugc

SEQ ID NO: 409937 - RNA, 13 nt, Homo sapiens
ggcaaucuuugcc

SEQ ID NO: 409938 - RNA, 17 nt, Homo sapiens
ggcaaucuuugccuuua

SEQ ID NO: 409939 - RNA, 13 nt, Homo sapiens
ggcaauucacaag

SEQ ID NO: 409940 - RNA, 21 nt, Homo sapiens
ggcaauuuuuuuauacuacca

SEQ ID NO: 409941 - RNA, 15 nt, Homo sapiens
ggcacaucauuggaa

SEQ ID NO: 409942 - RNA, 15 nt, Homo sapiens
ggcacauguguucag

SEQ ID NO: 409943 - RNA, 21 nt, Homo sapiens
ggcacccagcccaaccgggaa

SEQ ID NO: 409944 - RNA, 15 nt, Homo sapiens
ggcaccuucauucuc

SEQ ID NO: 409945 - RNA, 14 nt, Homo sapiens
ggcacguccuccac

SEQ ID NO: 409946 - RNA, 22 nt, Homo sapiens
ggcacuccucucgcauggugug

SEQ ID NO: 409947 - RNA, 16 nt, Homo sapiens
ggcacuccuuucuugc

SEQ ID NO: 409948 - RNA, 20 nt, Homo sapiens
ggcacugauaauauguuuga

SEQ ID NO: 409949 - RNA, 11 nt, Homo sapiens
ggcacugccug

SEQ ID NO: 409950 - RNA, 22 nt, Homo sapiens
ggcagagacaauaaaacauucc

SEQ ID NO: 409951 - RNA, 21 nt, Homo sapiens
ggcagaugaaauuuauuucca

SEQ ID NO: 409952 - RNA, 20 nt, Homo sapiens
ggcagcagaauugcuugaac

SEQ ID NO: 409953 - RNA, 17 nt, Homo sapiens
ggcagccaggacaucuc

SEQ ID NO: 409954 - RNA, 22 nt, Homo sapiens
ggcagcuggggggcuguccuga

SEQ ID NO: 409955 - RNA, 21 nt, Homo sapiens
ggcagcugucucaaaccucca

SEQ ID NO: 409956 - RNA, 20 nt, Homo sapiens
ggcagcuucgugugcagcua

SEQ ID NO: 409957 - RNA, 12 nt, Homo sapiens
ggcagcuuucuu

SEQ ID NO: 409958 - RNA, 14 nt, Homo sapiens
ggcaggaagucccu

SEQ ID NO: 409959 - RNA, 20 nt, Homo sapiens
ggcaggagaaucgcuugaac

SEQ ID NO: 409960 - RNA, 14 nt, Homo sapiens
ggcaggaucaaaga

SEQ ID NO: 409961 - RNA, 15 nt, Homo sapiens
ggcagggagugauga

SEQ ID NO: 409962 - RNA, 19 nt, Homo sapiens
ggcagggagugggagccaa

SEQ ID NO: 409963 - RNA, 12 nt, Homo sapiens
ggcaggugcaga

SEQ ID NO: 409964 - RNA, 19 nt, Homo sapiens
ggcagguguugggaccugc

SEQ ID NO: 409965 - RNA, 15 nt, Homo sapiens
ggcagucuucuuagc

SEQ ID NO: 409966 - RNA, 14 nt, Homo sapiens
ggcagugggaccaa

SEQ ID NO: 409967 - RNA, 15 nt, Homo sapiens
ggcaguucucacucc

SEQ ID NO: 409968 - RNA, 16 nt, Homo sapiens
ggcauaauagucaauu

SEQ ID NO: 409969 - RNA, 17 nt, Homo sapiens
ggcauacucuccaggau

SEQ ID NO: 409970 - RNA, 17 nt, Homo sapiens
ggcauccaaggcaaaca

SEQ ID NO: 409971 - RNA, 16 nt, Homo sapiens
ggcauccacccagugc

SEQ ID NO: 409972 - RNA, 22 nt, Homo sapiens
ggcaucuuugccuugggcugcu

SEQ ID NO: 409973 - RNA, 20 nt, Homo sapiens
ggcauuugcaccuaccucac

SEQ ID NO: 409974 - RNA, 12 nt, Homo sapiens
ggcauuuggacc

SEQ ID NO: 409975 - RNA, 15 nt, Homo sapiens
ggccaaaguguacaa

SEQ ID NO: 409976 - RNA, 12 nt, Homo sapiens
ggccaaauaugc

SEQ ID NO: 409977 - RNA, 22 nt, Homo sapiens
ggccaaauaugcacuuucccua

SEQ ID NO: 409978 - RNA, 15 nt, Homo sapiens
ggccaaccuccccaa

SEQ ID NO: 409979 - RNA, 17 nt, Homo sapiens
ggccaacguggaccugc

SEQ ID NO: 409980 - RNA, 18 nt, Homo sapiens
ggccaagcaccuagccuc

SEQ ID NO: 409981 - RNA, 22 nt, Homo sapiens
ggccacccccuauccucugagu

SEQ ID NO: 409982 - RNA, 15 nt, Homo sapiens
ggccacgcagccagg

SEQ ID NO: 409983 - RNA, 19 nt, Homo sapiens
ggccacgcuccucuguuca

SEQ ID NO: 409984 - RNA, 18 nt, Homo sapiens
ggccacucuugaccugga

SEQ ID NO: 409985 - RNA, 22 nt, Homo sapiens
ggccacugggucucacuccuga

SEQ ID NO: 409986 - RNA, 16 nt, Homo sapiens
ggccacuugcucagac

SEQ ID NO: 409987 - RNA, 18 nt, Homo sapiens
ggccagagcucccaggac

SEQ ID NO: 409988 - RNA, 16 nt, Homo sapiens
ggccagcagcagauaa

SEQ ID NO: 409989 - RNA, 21 nt, Homo sapiens
ggccagcguggcgcaguggcc

SEQ ID NO: 409990 - RNA, 20 nt, Homo sapiens
ggccagcugccccucauuua

SEQ ID NO: 409991 - RNA, 17 nt, Homo sapiens
ggccaggccauggccaa

SEQ ID NO: 409992 - RNA, 13 nt, Homo sapiens
ggccauggcaauu

SEQ ID NO: 409993 - RNA, 19 nt, Homo sapiens
ggccauuugugauacuucc

SEQ ID NO: 409994 - RNA, 18 nt, Homo sapiens
ggcccaagcaugccccac

SEQ ID NO: 409995 - RNA, 20 nt, Homo sapiens
ggcccagcuguagccauggc

SEQ ID NO: 409996 - RNA, 16 nt, Homo sapiens
ggcccauaucugugaa

SEQ ID NO: 409997 - RNA, 22 nt, Homo sapiens
ggcccaucacucggcuguggag

SEQ ID NO: 409998 - RNA, 15 nt, Homo sapiens
ggccccagaacacag

SEQ ID NO: 409999 - RNA, 16 nt, Homo sapiens
ggccccagaucugccu

SEQ ID NO: 410000 - RNA, 22 nt, Homo sapiens
ggccccauucagaacucucaga

SEQ ID NO: 410001 - RNA, 19 nt, Homo sapiens
ggcccccacccaccuggau

SEQ ID NO: 410002 - RNA, 14 nt, Homo sapiens
ggcccugccaugcu

SEQ ID NO: 410003 - RNA, 20 nt, Homo sapiens
ggcccuguccuaagcacuuu

SEQ ID NO: 410004 - RNA, 20 nt, Homo sapiens
ggcccuuccugcagcgccug

SEQ ID NO: 410005 - RNA, 12 nt, Homo sapiens
ggcccuugccca

SEQ ID NO: 410006 - RNA, 21 nt, Homo sapiens
ggccgcaugucugcauggcag

SEQ ID NO: 410007 - RNA, 16 nt, Homo sapiens
ggccgcuucccuaccc

SEQ ID NO: 410008 - RNA, 18 nt, Homo sapiens
ggccgggcugcugcugau

SEQ ID NO: 410009 - RNA, 13 nt, Homo sapiens
ggccgucuucacu

SEQ ID NO: 410010 - RNA, 23 nt, Homo sapiens
ggccucaccuggcuucccaggac

SEQ ID NO: 410011 - RNA, 13 nt, Homo sapiens
ggccucaccuuuc

SEQ ID NO: 410012 - RNA, 10 nt, Homo sapiens
ggccucagaa

SEQ ID NO: 410013 - RNA, 19 nt, Homo sapiens
ggccucagagacagcgcga

SEQ ID NO: 410014 - RNA, 13 nt, Homo sapiens
ggccucagguuug

SEQ ID NO: 410015 - RNA, 12 nt, Homo sapiens
ggccuccacucc

SEQ ID NO: 410016 - RNA, 22 nt, Homo sapiens
ggccucccaccagagacuggga

SEQ ID NO: 410017 - RNA, 16 nt, Homo sapiens
ggccuccccugcugaa

SEQ ID NO: 410018 - RNA, 22 nt, Homo sapiens
ggccucuuccuugcugugucau

SEQ ID NO: 410019 - RNA, 15 nt, Homo sapiens
ggccugcacucuuau

SEQ ID NO: 410020 - RNA, 21 nt, Homo sapiens
ggccugcccucacgcucucca

SEQ ID NO: 410021 - RNA, 20 nt, Homo sapiens
ggccuguccaccugugcugc

SEQ ID NO: 410022 - RNA, 19 nt, Homo sapiens
ggccuucagaaaagacacu

SEQ ID NO: 410023 - RNA, 15 nt, Homo sapiens
ggccuucucagcucu

SEQ ID NO: 410024 - RNA, 17 nt, Homo sapiens
ggccuucugaacuccau

SEQ ID NO: 410025 - RNA, 13 nt, Homo sapiens
ggccuuucaggaa

SEQ ID NO: 410026 - RNA, 14 nt, Homo sapiens
ggccuuucaggaag

SEQ ID NO: 410027 - RNA, 22 nt, Homo sapiens
ggccuuuugcccguugagguag

SEQ ID NO: 410028 - RNA, 17 nt, Homo sapiens
ggcgaaucuacagaaca

SEQ ID NO: 410029 - RNA, 23 nt, Homo sapiens
ggcgauaugagagggaugcagug

SEQ ID NO: 410030 - RNA, 20 nt, Homo sapiens
ggcgaugugcaaguguaugc

SEQ ID NO: 410031 - RNA, 17 nt, Homo sapiens
ggcgccaucgccaagua

SEQ ID NO: 410032 - RNA, 19 nt, Homo sapiens
gcugccucccuggggacca

SEQ ID NO: 410033 - RNA, 14 nt, Homo sapiens
gcugcgacugauga

SEQ ID NO: 410034 - RNA, 13 nt, Homo sapiens
gcugcgugccauc

SEQ ID NO: 410035 - RNA, 19 nt, Homo sapiens
gcugcgugccaucacucaa

SEQ ID NO: 410036 - RNA, 22 nt, Homo sapiens
gcugcguucuuucaaugcugac

SEQ ID NO: 410037 - RNA, 15 nt, Homo sapiens
gcugcuaaaggacag

SEQ ID NO: 410038 - RNA, 12 nt, Homo sapiens
gcugcucauggg

SEQ ID NO: 410039 - RNA, 14 nt, Homo sapiens
gcugcucuauauua

SEQ ID NO: 410040 - RNA, 23 nt, Homo sapiens
gcugcucuuagugcccgccuagg

SEQ ID NO: 410041 - RNA, 20 nt, Homo sapiens
gcugcugacguuugacacca

SEQ ID NO: 410042 - RNA, 18 nt, Homo sapiens
gcugcugagaaucuagcc

SEQ ID NO: 410043 - RNA, 10 nt, Homo sapiens
gcugcugaua

SEQ ID NO: 410044 - RNA, 11 nt, Homo sapiens
gcugcugcuac

SEQ ID NO: 410045 - RNA, 21 nt, Homo sapiens
gcugcuucuguguguggugag

SEQ ID NO: 410046 - RNA, 16 nt, Homo sapiens
gcuggaggcagacucg

SEQ ID NO: 410047 - RNA, 22 nt, Homo sapiens
gcuggaguccuguucucagagc

SEQ ID NO: 410048 - RNA, 14 nt, Homo sapiens
gcuggagugcagua

SEQ ID NO: 410049 - RNA, 19 nt, Homo sapiens
gcuggagugcaguggugcg

SEQ ID NO: 410050 - RNA, 17 nt, Homo sapiens
gcuggcaaacugugaau

SEQ ID NO: 410051 - RNA, 12 nt, Homo sapiens
gcuggcagaguu

SEQ ID NO: 410052 - RNA, 21 nt, Homo sapiens
gcuggcauuugcugcauuuca

SEQ ID NO: 410053 - RNA, 21 nt, Homo sapiens
gcuggccugcgccugcaccug

SEQ ID NO: 410054 - RNA, 13 nt, Homo sapiens
gcuggcuugcagu

SEQ ID NO: 410055 - RNA, 14 nt, Homo sapiens
gcugggcacugggc

SEQ ID NO: 410056 - RNA, 18 nt, Homo sapiens
gcuggguuugggcagugg

SEQ ID NO: 410057 - RNA, 18 nt, Homo sapiens
gcuggucucaaacuccug

SEQ ID NO: 410058 - RNA, 20 nt, Homo sapiens
gcuggucucaaacuccugac

SEQ ID NO: 410059 - RNA, 22 nt, Homo sapiens
gcuggucuuggugaacacacau

SEQ ID NO: 410060 - RNA, 23 nt, Homo sapiens
gcuggugccccacagcuaccuga

SEQ ID NO: 410061 - RNA, 14 nt, Homo sapiens
gcugguggcaauaa

SEQ ID NO: 410062 - RNA, 15 nt, Homo sapiens
gcuggugggcaccaa

SEQ ID NO: 410063 - RNA, 15 nt, Homo sapiens
gcugguggugcugca

SEQ ID NO: 410064 - RNA, 19 nt, Homo sapiens
gcugguugaaaaauggcaa

SEQ ID NO: 410065 - RNA, 20 nt, Homo sapiens
gcugguuuuccuaaaugcag

SEQ ID NO: 410066 - RNA, 22 nt, Homo sapiens
gcuguaaacuaccauguggcca

SEQ ID NO: 410067 - RNA, 20 nt, Homo sapiens
gcuguacccuuccaccuccu

SEQ ID NO: 410068 - RNA, 15 nt, Homo sapiens
gcuguacccuugaga

SEQ ID NO: 410069 - RNA, 13 nt, Homo sapiens
gcuguagagccau

SEQ ID NO: 410070 - RNA, 13 nt, Homo sapiens
gcuguauauuuga

SEQ ID NO: 410071 - RNA, 17 nt, Homo sapiens
gcuguauuuaauggcau

SEQ ID NO: 410072 - RNA, 20 nt, Homo sapiens
gcugucaguaugacauuuca

SEQ ID NO: 410073 - RNA, 20 nt, Homo sapiens
gcuguccccuccaucugggg

SEQ ID NO: 410074 - RNA, 24 nt, Homo sapiens
gcuguccugagcccccugcaccca

SEQ ID NO: 410075 - RNA, 16 nt, Homo sapiens
gcugugaacauggacu

SEQ ID NO: 410076 - RNA, 18 nt, Homo sapiens
gcugugccaggacuguga

SEQ ID NO: 410077 - RNA, 17 nt, Homo sapiens
gcugugcuccuguggau

SEQ ID NO: 410078 - RNA, 14 nt, Homo sapiens
gcuguggagcaaaa

SEQ ID NO: 410079 - RNA, 20 nt, Homo sapiens
gcuguuuuggaugaaugcag

SEQ ID NO: 410080 - RNA, 12 nt, Homo sapiens
gcuuacaggaag

SEQ ID NO: 410081 - RNA, 21 nt, Homo sapiens
gcuuacaguaggagugagaaa

SEQ ID NO: 410082 - RNA, 20 nt, Homo sapiens
gcuuagacuucgacucagga

SEQ ID NO: 410083 - RNA, 22 nt, Homo sapiens
gcuuagaugagggugacuguca

SEQ ID NO: 410084 - RNA, 23 nt, Homo sapiens
gcuuaucucccugcuucauaucu

SEQ ID NO: 410085 - RNA, 21 nt, Homo sapiens
gcuucaaaaauuaaaauccag

SEQ ID NO: 410086 - RNA, 18 nt, Homo sapiens
gcuucaccagagcauuuc

SEQ ID NO: 410087 - RNA, 16 nt, Homo sapiens
gcuucauccacugaau

SEQ ID NO: 410088 - RNA, 13 nt, Homo sapiens
gcuucaugcaauc

SEQ ID NO: 410089 - RNA, 20 nt, Homo sapiens
gcuucaugcaauccuuccaa

SEQ ID NO: 410090 - RNA, 22 nt, Homo sapiens
gcuuccagggggcagcccagug

SEQ ID NO: 410091 - RNA, 16 nt, Homo sapiens
gcuuccuucugugaaa

SEQ ID NO: 410092 - RNA, 18 nt, Homo sapiens
gcuuccuugcucagugca

SEQ ID NO: 410093 - RNA, 19 nt, Homo sapiens
gcuucuauuuccuuuccac

SEQ ID NO: 410094 - RNA, 18 nt, Homo sapiens
gcuucucauggauggcac

SEQ ID NO: 410095 - RNA, 13 nt, Homo sapiens
gcuucuccugacc

SEQ ID NO: 410096 - RNA, 12 nt, Homo sapiens
gcuucuccuucu

SEQ ID NO: 410097 - RNA, 20 nt, Homo sapiens
gcuucucuaaaacagcacua

SEQ ID NO: 410098 - RNA, 16 nt, Homo sapiens
gcuucucuccacugaa

SEQ ID NO: 410099 - RNA, 19 nt, Homo sapiens
gcuucugcucacauucccu

SEQ ID NO: 410100 - RNA, 22 nt, Homo sapiens
gcuucugcugcccugaugcguc

SEQ ID NO: 410101 - RNA, 21 nt, Homo sapiens
gcuucuggggguagaucucaa

SEQ ID NO: 410102 - RNA, 19 nt, Homo sapiens
gcuucuguaguacuccuua

SEQ ID NO: 410103 - RNA, 14 nt, Homo sapiens
gcuucuuucucuca

SEQ ID NO: 410104 - RNA, 15 nt, Homo sapiens
gcuugaaguaaccuu

SEQ ID NO: 410105 - RNA, 19 nt, Homo sapiens
gcuugaccuuuaagagaaa

SEQ ID NO: 410106 - RNA, 22 nt, Homo sapiens
gcuugauauuuuccaaauggau

SEQ ID NO: 410107 - RNA, 20 nt, Homo sapiens
gcuugaugagaagaacacau

SEQ ID NO: 410108 - RNA, 22 nt, Homo sapiens
gcuugcaacuuagcucacaccu

SEQ ID NO: 410109 - RNA, 15 nt, Homo sapiens
gcuugcaugugcugc

SEQ ID NO: 410110 - RNA, 20 nt, Homo sapiens
gcuugcccagggugcagugu

SEQ ID NO: 410111 - RNA, 21 nt, Homo sapiens
gcuuggauggagacuccauga

SEQ ID NO: 410112 - RNA, 21 nt, Homo sapiens
gcuugggcccaguagccccaa

SEQ ID NO: 410113 - RNA, 18 nt, Homo sapiens
gcuugggcuccauuccca

SEQ ID NO: 410114 - RNA, 17 nt, Homo sapiens
gcuuggggaacccauga

SEQ ID NO: 410115 - RNA, 22 nt, Homo sapiens
gcuuggugguuaugucccauga

SEQ ID NO: 410116 - RNA, 19 nt, Homo sapiens
gcuuguaaugcucacuuau

SEQ ID NO: 410117 - RNA, 14 nt, Homo sapiens
gcuuguacuaagcc

SEQ ID NO: 410118 - RNA, 18 nt, Homo sapiens
gcuugugggacuagccug

SEQ ID NO: 410119 - RNA, 22 nt, Homo sapiens
gcuuguuguuuuuaaguccugu

SEQ ID NO: 410120 - RNA, 20 nt, Homo sapiens
gcuuguuuaagguucuugcu

SEQ ID NO: 410121 - RNA, 23 nt, Homo sapiens
gcuuguuuacagcacuacucugu

SEQ ID NO: 410122 - RNA, 14 nt, Homo sapiens
gcuuguuuguucua

SEQ ID NO: 410123 - RNA, 21 nt, Homo sapiens
gcuuuaauaagcgagaccuaa

SEQ ID NO: 410124 - RNA, 14 nt, Homo sapiens
gcuuuacauuuuau

SEQ ID NO: 410125 - RNA, 16 nt, Homo sapiens
gcuuuaucccacggaa

SEQ ID NO: 410126 - RNA, 21 nt, Homo sapiens
gcuuuauuuuuuaaguauuua

SEQ ID NO: 410127 - RNA, 21 nt, Homo sapiens
gcuuucaagugccuuucugca

SEQ ID NO: 410128 - RNA, 15 nt, Homo sapiens
gcuuucauccugugu

SEQ ID NO: 410129 - RNA, 20 nt, Homo sapiens
gcuuucauuuugcauuuugu

SEQ ID NO: 410130 - RNA, 16 nt, Homo sapiens
gcuuuccacaucccca

SEQ ID NO: 410131 - RNA, 12 nt, Homo sapiens
gcuuuccagggu

SEQ ID NO: 410132 - RNA, 16 nt, Homo sapiens
gcuuuccucccaaagg

SEQ ID NO: 410133 - RNA, 16 nt, Homo sapiens
gcuuucugucugugaa

SEQ ID NO: 410134 - RNA, 18 nt, Homo sapiens
gcuuucuuaucccaguga

SEQ ID NO: 410135 - RNA, 15 nt, Homo sapiens
gcuuucuuguugcug

SEQ ID NO: 410136 - RNA, 14 nt, Homo sapiens
gcuuugaggacaaa

SEQ ID NO: 410137 - RNA, 15 nt, Homo sapiens
gcuuugaggacaaag

SEQ ID NO: 410138 - RNA, 13 nt, Homo sapiens
gcuuugcaggcuc

SEQ ID NO: 410139 - RNA, 13 nt, Homo sapiens
gcuuugcagugaa

SEQ ID NO: 410140 - RNA, 15 nt, Homo sapiens
gcuuugcagugacag

SEQ ID NO: 410141 - RNA, 14 nt, Homo sapiens
gcuuugccacugaa

SEQ ID NO: 410142 - RNA, 17 nt, Homo sapiens
gcuuugcugcuaugaaa

SEQ ID NO: 410143 - RNA, 21 nt, Homo sapiens
gcuuugggauaauguuuauaa

SEQ ID NO: 410144 - RNA, 13 nt, Homo sapiens
gcuuugguuuaaa

SEQ ID NO: 410145 - RNA, 17 nt, Homo sapiens
gcuuugucccacagcuu

SEQ ID NO: 410146 - RNA, 13 nt, Homo sapiens
gcuuuguuuggau

SEQ ID NO: 410147 - RNA, 22 nt, Homo sapiens
gcuuuuauuuuuuaaguucaau

SEQ ID NO: 410148 - RNA, 24 nt, Homo sapiens
gcuuuucaugcguguguguugucu

SEQ ID NO: 410149 - RNA, 14 nt, Homo sapiens
gcuuuuccucccuu

SEQ ID NO: 410150 - RNA, 12 nt, Homo sapiens
gcuuuucuugcc

SEQ ID NO: 410151 - RNA, 21 nt, Homo sapiens
gcuuuuuuuuguagccagucc

SEQ ID NO: 410152 - RNA, 22 nt, Homo sapiens
ggaaaaaaaaaaauaugagauu

SEQ ID NO: 410153 - RNA, 18 nt, Homo sapiens
ggaaaaacaaaugccaua

SEQ ID NO: 410154 - RNA, 14 nt, Homo sapiens
ggaaaacucaggau

SEQ ID NO: 410155 - RNA, 15 nt, Homo sapiens
ggaaaaugucuuaaa

SEQ ID NO: 410156 - RNA, 15 nt, Homo sapiens
ggaaacugcacuguu

SEQ ID NO: 410157 - RNA, 12 nt, Homo sapiens
ggaaagccucau

SEQ ID NO: 410158 - RNA, 17 nt, Homo sapiens
ggaaauaacauugcacu

SEQ ID NO: 410159 - RNA, 12 nt, Homo sapiens
ggaaaucuccuc

SEQ ID NO: 410160 - RNA, 19 nt, Homo sapiens
ggaaauggcuugaagccaa

SEQ ID NO: 410161 - RNA, 22 nt, Homo sapiens
ggaacaaagacaaccacuggga

SEQ ID NO: 410162 - RNA, 15 nt, Homo sapiens
cuuucagaauacaau

SEQ ID NO: 410163 - RNA, 19 nt, Homo sapiens
cuuucagcauuaggcuuuu

SEQ ID NO: 410164 - RNA, 20 nt, Homo sapiens
cuuuccacccacucuucaca

SEQ ID NO: 410165 - RNA, 23 nt, Homo sapiens
cuuuccagacuucgcuauuccca

SEQ ID NO: 410166 - RNA, 23 nt, Homo sapiens
cuuuccaggaaggcuaaagggaa

SEQ ID NO: 410167 - RNA, 18 nt, Homo sapiens
cuuuccagggucuuuacu

SEQ ID NO: 410168 - RNA, 17 nt, Homo sapiens
cuuuccccgugggccau

SEQ ID NO: 410169 - RNA, 13 nt, Homo sapiens
cuuucccuaccuu

SEQ ID NO: 410170 - RNA, 18 nt, Homo sapiens
cuuuccucagcaccuggg

SEQ ID NO: 410171 - RNA, 20 nt, Homo sapiens
cuuuccugaucacuaugcau

SEQ ID NO: 410172 - RNA, 17 nt, Homo sapiens
cuuuccuguagucccau

SEQ ID NO: 410173 - RNA, 12 nt, Homo sapiens
cuuuccuugccu

SEQ ID NO: 410174 - RNA, 13 nt, Homo sapiens
cuuucuaacaaaa

SEQ ID NO: 410175 - RNA, 18 nt, Homo sapiens
cuuucuauuaccccucau

SEQ ID NO: 410176 - RNA, 16 nt, Homo sapiens
cuuucuccaaaggcac

SEQ ID NO: 410177 - RNA, 17 nt, Homo sapiens
cuuucucucagccuuac

SEQ ID NO: 410178 - RNA, 18 nt, Homo sapiens
cuuucucugccagugaca

SEQ ID NO: 410179 - RNA, 12 nt, Homo sapiens
cuuucugccuug

SEQ ID NO: 410180 - RNA, 22 nt, Homo sapiens
cuuucuggaauccaaaccacag

SEQ ID NO: 410181 - RNA, 18 nt, Homo sapiens
cuuucuuaucccagugau

SEQ ID NO: 410182 - RNA, 13 nt, Homo sapiens
cuuucuuccacua

SEQ ID NO: 410183 - RNA, 16 nt, Homo sapiens
cuuucuugaauugcau

SEQ ID NO: 410184 - RNA, 14 nt, Homo sapiens
cuuucuugcacuau

SEQ ID NO: 410185 - RNA, 19 nt, Homo sapiens
cuuucuugcacuauuccac

SEQ ID NO: 410186 - RNA, 15 nt, Homo sapiens
cuuucuugcuucaaa

SEQ ID NO: 410187 - RNA, 14 nt, Homo sapiens
cuuucuuguugcug

SEQ ID NO: 410188 - RNA, 18 nt, Homo sapiens
cuuucuuuuuauuuuaaa

SEQ ID NO: 410189 - RNA, 16 nt, Homo sapiens
cuuugaaagcuguaua

SEQ ID NO: 410190 - RNA, 20 nt, Homo sapiens
cuuugaaauaugcauguacu

SEQ ID NO: 410191 - RNA, 20 nt, Homo sapiens
cuuugaaguggcaccuaaua

SEQ ID NO: 410192 - RNA, 15 nt, Homo sapiens
cuuugagucaaguca

SEQ ID NO: 410193 - RNA, 17 nt, Homo sapiens
cuuugauuuacagugcc

SEQ ID NO: 410194 - RNA, 16 nt, Homo sapiens
cuuugcaggcccagca

SEQ ID NO: 410195 - RNA, 18 nt, Homo sapiens
cuuugcagggagaccagg

SEQ ID NO: 410196 - RNA, 20 nt, Homo sapiens
cuuugcagugaaagcuuuca

SEQ ID NO: 410197 - RNA, 11 nt, Homo sapiens
cuuugccaaau

SEQ ID NO: 410198 - RNA, 14 nt, Homo sapiens
cuuugccacacaca

SEQ ID NO: 410199 - RNA, 19 nt, Homo sapiens
cuuugccacacacaguuac

SEQ ID NO: 410200 - RNA, 20 nt, Homo sapiens
cuuugccuucucuguucccu

SEQ ID NO: 410201 - RNA, 15 nt, Homo sapiens
cuuugcucaguggau

SEQ ID NO: 410202 - RNA, 23 nt, Homo sapiens
cuuugcucaguggaucacacaca

SEQ ID NO: 410203 - RNA, 21 nt, Homo sapiens
cuuugcugccagccacuucau

SEQ ID NO: 410204 - RNA, 18 nt, Homo sapiens
cuuugcugcuggugcuaa

SEQ ID NO: 410205 - RNA, 21 nt, Homo sapiens
cuuugcuggaguccuguucuc

SEQ ID NO: 410206 - RNA, 11 nt, Homo sapiens
cuuugcugguu

SEQ ID NO: 410207 - RNA, 15 nt, Homo sapiens
cuuugcuucccauug

SEQ ID NO: 410208 - RNA, 21 nt, Homo sapiens
cuuuggaauguugaauugcau

SEQ ID NO: 410209 - RNA, 20 nt, Homo sapiens
cuuuggacacacacagcuuc

SEQ ID NO: 410210 - RNA, 13 nt, Homo sapiens
cuuuggcaacaga

SEQ ID NO: 410211 - RNA, 15 nt, Homo sapiens
cuuuggcaauucuuc

SEQ ID NO: 410212 - RNA, 15 nt, Homo sapiens
cuuugggaucagccu

SEQ ID NO: 410213 - RNA, 15 nt, Homo sapiens
cuuuguaugcacuuu

SEQ ID NO: 410214 - RNA, 15 nt, Homo sapiens
cuuugucacagggug

SEQ ID NO: 410215 - RNA, 13 nt, Homo sapiens
cuuugugccuuug

SEQ ID NO: 410216 - RNA, 18 nt, Homo sapiens
cuuuguggcaguggccag

SEQ ID NO: 410217 - RNA, 13 nt, Homo sapiens
cuuuguguagaaa

SEQ ID NO: 410218 - RNA, 20 nt, Homo sapiens
cuuuguguagaaagccaaau

SEQ ID NO: 410219 - RNA, 14 nt, Homo sapiens
cuuuguucuuguca

SEQ ID NO: 410220 - RNA, 19 nt, Homo sapiens
cuuuguuuacaugaguuca

SEQ ID NO: 410221 - RNA, 18 nt, Homo sapiens
cuuuuaaaacacuuccau

SEQ ID NO: 410222 - RNA, 15 nt, Homo sapiens
cuuuuaagaaacaca

SEQ ID NO: 410223 - RNA, 18 nt, Homo sapiens
cuuuuaagaaacacaggg

SEQ ID NO: 410224 - RNA, 20 nt, Homo sapiens
cuuuuaagaugugucuucaa

SEQ ID NO: 410225 - RNA, 12 nt, Homo sapiens
cuuuuacauucu

SEQ ID NO: 410226 - RNA, 13 nt, Homo sapiens
cuuuuacauucug

SEQ ID NO: 410227 - RNA, 22 nt, Homo sapiens
cuuuuacuuuuugccccuucca

SEQ ID NO: 410228 - RNA, 19 nt, Homo sapiens
cuuuuaucuuggacugaca

SEQ ID NO: 410229 - RNA, 18 nt, Homo sapiens
cuuuuauggaccaauuag

SEQ ID NO: 410230 - RNA, 12 nt, Homo sapiens
cuuuuauuacau

SEQ ID NO: 410231 - RNA, 17 nt, Homo sapiens
cuuuucccaaacugauc

SEQ ID NO: 410232 - RNA, 16 nt, Homo sapiens
cuuuucccaccagcuc

SEQ ID NO: 410233 - RNA, 18 nt, Homo sapiens
cuuuucuauggagcaaaa

SEQ ID NO: 410234 - RNA, 15 nt, Homo sapiens
cuuuucuccaugagu

SEQ ID NO: 410235 - RNA, 17 nt, Homo sapiens
cuuuucugaggacucaa

SEQ ID NO: 410236 - RNA, 15 nt, Homo sapiens
cuuuucugcaauuca

SEQ ID NO: 410237 - RNA, 16 nt, Homo sapiens
cuuuucugugucauac

SEQ ID NO: 410238 - RNA, 16 nt, Homo sapiens
cuuuugaaaagcuuuu

SEQ ID NO: 410239 - RNA, 16 nt, Homo sapiens
cuuuugaaguaauccc

SEQ ID NO: 410240 - RNA, 12 nt, Homo sapiens
cuuuugaagucc

SEQ ID NO: 410241 - RNA, 23 nt, Homo sapiens
cuuuugacagcugugcuguaaca

SEQ ID NO: 410242 - RNA, 13 nt, Homo sapiens
cuuuugaggggcu

SEQ ID NO: 410243 - RNA, 21 nt, Homo sapiens
cuuuugaggggcugacuucaa

SEQ ID NO: 410244 - RNA, 16 nt, Homo sapiens
cuuuugagugccuuac

SEQ ID NO: 410245 - RNA, 12 nt, Homo sapiens
cuuuugcacaua

SEQ ID NO: 410246 - RNA, 13 nt, Homo sapiens
cuuuugcauuaaa

SEQ ID NO: 410247 - RNA, 20 nt, Homo sapiens
cuuuugcuggucacugccau

SEQ ID NO: 410248 - RNA, 22 nt, Homo sapiens
cuuuugggauguuaccuucaca

SEQ ID NO: 410249 - RNA, 19 nt, Homo sapiens
cuuuugguaucuacuucua

SEQ ID NO: 410250 - RNA, 15 nt, Homo sapiens
cuuuuguaagguacu

SEQ ID NO: 410251 - RNA, 22 nt, Homo sapiens
cuuuugugccaggagugggugg

SEQ ID NO: 410252 - RNA, 16 nt, Homo sapiens
cuuuugugugaugcgc

SEQ ID NO: 410253 - RNA, 18 nt, Homo sapiens
cuuuuguuuugaguuacu

SEQ ID NO: 410254 - RNA, 15 nt, Homo sapiens
cuuuuuaaacagugu

SEQ ID NO: 410255 - RNA, 17 nt, Homo sapiens
cuuuuuaaccugcaaaa

SEQ ID NO: 410256 - RNA, 14 nt, Homo sapiens
cuuuuuaaugucag

SEQ ID NO: 410257 - RNA, 20 nt, Homo sapiens
cuuuuuccuggcucaucucu

SEQ ID NO: 410258 - RNA, 16 nt, Homo sapiens
cuuuuuccuuccugcc

SEQ ID NO: 410259 - RNA, 13 nt, Homo sapiens
cuuuuucuuugag

SEQ ID NO: 410260 - RNA, 22 nt, Homo sapiens
cuuuuugaagacuucuagcaga

SEQ ID NO: 410261 - RNA, 13 nt, Homo sapiens
cuuuuugccauuu

SEQ ID NO: 410262 - RNA, 12 nt, Homo sapiens
cuuuuuucuucc

SEQ ID NO: 410263 - RNA, 15 nt, Homo sapiens
cuuuuuuuccaauuu

SEQ ID NO: 410264 - RNA, 16 nt, Homo sapiens
gaaaaaaaaauuauuu

SEQ ID NO: 410265 - RNA, 23 nt, Homo sapiens
gaaaaaaaaggcaguauucccuu

SEQ ID NO: 410266 - RNA, 20 nt, Homo sapiens
gaaaaaaagguuaacaguaa

SEQ ID NO: 410267 - RNA, 16 nt, Homo sapiens
gaaaaaaauaguuuua

SEQ ID NO: 410268 - RNA, 15 nt, Homo sapiens
gaaaaaaaugaucua

SEQ ID NO: 410269 - RNA, 14 nt, Homo sapiens
gaaaaaagcaacuu

SEQ ID NO: 410270 - RNA, 21 nt, Homo sapiens
gaaaaacaaguuugcuaguga

SEQ ID NO: 410271 - RNA, 19 nt, Homo sapiens
gaaaaacaccgcuucugcc

SEQ ID NO: 410272 - RNA, 14 nt, Homo sapiens
gaaaaacaugucau

SEQ ID NO: 410273 - RNA, 15 nt, Homo sapiens
gaaaaaccaaugauu

SEQ ID NO: 410274 - RNA, 22 nt, Homo sapiens
gaaaaaggacucugcuucaguc

SEQ ID NO: 410275 - RNA, 20 nt, Homo sapiens
gaaaaaggcuggcugaaaau

SEQ ID NO: 410276 - RNA, 13 nt, Homo sapiens
gaaaaaggcuucu

SEQ ID NO: 410277 - RNA, 19 nt, Homo sapiens
gaaaaaguuaaacauugaa

SEQ ID NO: 410278 - RNA, 21 nt, Homo sapiens
gaaaaauacuuuaauaguaaa

SEQ ID NO: 410279 - RNA, 18 nt, Homo sapiens
gaaaacaaauauuucacu

SEQ ID NO: 410280 - RNA, 14 nt, Homo sapiens
gaaaacaacauugg

SEQ ID NO: 410281 - RNA, 14 nt, Homo sapiens
gaaaacagaccuaa

SEQ ID NO: 410282 - RNA, 20 nt, Homo sapiens
gaaaacagcagcaaugcaau

SEQ ID NO: 410283 - RNA, 21 nt, Homo sapiens
gaaaacauuccagaugcauga

SEQ ID NO: 410284 - RNA, 18 nt, Homo sapiens
gaaaaccaacaccaucac

SEQ ID NO: 410285 - RNA, 13 nt, Homo sapiens
gaaaacguaucac

SEQ ID NO: 410286 - RNA, 17 nt, Homo sapiens
gaaaacuaaguucucua

SEQ ID NO: 410287 - RNA, 15 nt, Homo sapiens
gaaaacugagacuca

SEQ ID NO: 410288 - RNA, 19 nt, Homo sapiens
gaaaacuuagagagguaca

SEQ ID NO: 410289 - RNA, 15 nt, Homo sapiens
gaaaagacugaccuu

SEQ ID NO: 410290 - RNA, 12 nt, Homo sapiens
gaaaagcacugg

SEQ ID NO: 410291 - RNA, 12 nt, Homo sapiens
gaaaagccaguu

SEQ ID NO: 410292 - RNA, 15 nt, Homo sapiens
gaaaagcuguuccca

SEQ ID NO: 410293 - RNA, 16 nt, Homo sapiens
gaaaaggguguugcua

SEQ ID NO: 410294 - RNA, 15 nt, Homo sapiens
gaaaagguugccuga

SEQ ID NO: 410295 - RNA, 15 nt, Homo sapiens
gaaaaguagagcaau

SEQ ID NO: 410296 - RNA, 19 nt, Homo sapiens
cuucuuguaguagucucau

SEQ ID NO: 410297 - RNA, 19 nt, Homo sapiens
cuucuuuaccuucauuuca

SEQ ID NO: 410298 - RNA, 20 nt, Homo sapiens
cuucuuuauacaaugaccac

SEQ ID NO: 410299 - RNA, 15 nt, Homo sapiens
cuucuuuugaacugu

SEQ ID NO: 410300 - RNA, 17 nt, Homo sapiens
cuucuuuuugcuucaaa

SEQ ID NO: 410301 - RNA, 19 nt, Homo sapiens
cuugaaaaugaaaugacug

SEQ ID NO: 410302 - RNA, 22 nt, Homo sapiens
cuugaaagaaaauaccaaggaa

SEQ ID NO: 410303 - RNA, 23 nt, Homo sapiens
cuugaaagaaaggggcaggagcu

SEQ ID NO: 410304 - RNA, 21 nt, Homo sapiens
cuugaaaggaagagcuaauaa

SEQ ID NO: 410305 - RNA, 13 nt, Homo sapiens
cuugaaaguuuuc

SEQ ID NO: 410306 - RNA, 17 nt, Homo sapiens
cuugaaccacaguucua

SEQ ID NO: 410307 - RNA, 17 nt, Homo sapiens
cuugaacucuguucccc

SEQ ID NO: 410308 - RNA, 16 nt, Homo sapiens
cuugaaguaaccuuau

SEQ ID NO: 410309 - RNA, 17 nt, Homo sapiens
cuugaaugaugccauga

SEQ ID NO: 410310 - RNA, 15 nt, Homo sapiens
cuugaauguacaaag

SEQ ID NO: 410311 - RNA, 21 nt, Homo sapiens
cuugaauguccccauucuaua

SEQ ID NO: 410312 - RNA, 12 nt, Homo sapiens
cuugacaugugc

SEQ ID NO: 410313 - RNA, 20 nt, Homo sapiens
cuugaccacggcuguucccc

SEQ ID NO: 410314 - RNA, 22 nt, Homo sapiens
cuugaccaguauaaaauuacag

SEQ ID NO: 410315 - RNA, 23 nt, Homo sapiens
cuugacugaagcgaacaucuuca

SEQ ID NO: 410316 - RNA, 16 nt, Homo sapiens
cuugagagcugcugag

SEQ ID NO: 410317 - RNA, 19 nt, Homo sapiens
cuugagauguauuaugcaa

SEQ ID NO: 410318 - RNA, 16 nt, Homo sapiens
cuugagcaaggcaaga

SEQ ID NO: 410319 - RNA, 15 nt, Homo sapiens
cuugagccaguaauu

SEQ ID NO: 410320 - RNA, 15 nt, Homo sapiens
cuugagcuaagcaga

SEQ ID NO: 410321 - RNA, 20 nt, Homo sapiens
cuugagggugcuuguucccu

SEQ ID NO: 410322 - RNA, 17 nt, Homo sapiens
cuugagguggugccuuc

SEQ ID NO: 410323 - RNA, 14 nt, Homo sapiens
cuugagucugaggc

SEQ ID NO: 410324 - RNA, 20 nt, Homo sapiens
cuugaguuggaguacuauau

SEQ ID NO: 410325 - RNA, 16 nt, Homo sapiens
cuugaguuuuccugcu

SEQ ID NO: 410326 - RNA, 19 nt, Homo sapiens
cuugauaggaauucaucuu

SEQ ID NO: 410327 - RNA, 15 nt, Homo sapiens
cuugauaugaccugu

SEQ ID NO: 410328 - RNA, 18 nt, Homo sapiens
cuugaucaugaaucacug

SEQ ID NO: 410329 - RNA, 21 nt, Homo sapiens
cuugaugagaagaacacauca

SEQ ID NO: 410330 - RNA, 13 nt, Homo sapiens
cuugaugccagug

SEQ ID NO: 410331 - RNA, 12 nt, Homo sapiens
cuugaugguuua

SEQ ID NO: 410332 - RNA, 19 nt, Homo sapiens
cuugauuacauaauguuag

SEQ ID NO: 410333 - RNA, 19 nt, Homo sapiens
cuugauucauaaugacuua

SEQ ID NO: 410334 - RNA, 16 nt, Homo sapiens
cuugauuccacuugug

SEQ ID NO: 410335 - RNA, 16 nt, Homo sapiens
cuugauucuaaagggg

SEQ ID NO: 410336 - RNA, 23 nt, Homo sapiens
cuugauuuuuuucauuuugccaa

SEQ ID NO: 410337 - RNA, 15 nt, Homo sapiens
cuugcaaagccuuua

SEQ ID NO: 410338 - RNA, 18 nt, Homo sapiens
cuugcacaaaaagcacaa

SEQ ID NO: 410339 - RNA, 14 nt, Homo sapiens
cuugcacugugcuu

SEQ ID NO: 410340 - RNA, 17 nt, Homo sapiens
cuugcaguuaaggguua

SEQ ID NO: 410341 - RNA, 18 nt, Homo sapiens
cuugcaguuaaggguuag

SEQ ID NO: 410342 - RNA, 10 nt, Homo sapiens
cuugcauaau

SEQ ID NO: 410343 - RNA, 13 nt, Homo sapiens
cuugccagcauuu

SEQ ID NO: 410344 - RNA, 14 nt, Homo sapiens
cuugccauuuucaa

SEQ ID NO: 410345 - RNA, 16 nt, Homo sapiens
cuugccucucucagga

SEQ ID NO: 410346 - RNA, 22 nt, Homo sapiens
cuugccuggaaagaggcagucu

SEQ ID NO: 410347 - RNA, 18 nt, Homo sapiens
cuugcuagcuaugugacc

SEQ ID NO: 410348 - RNA, 23 nt, Homo sapiens
cuugcucagacgagacacccuaa

SEQ ID NO: 410349 - RNA, 14 nt, Homo sapiens
cuugcucagugcaa

SEQ ID NO: 410350 - RNA, 15 nt, Homo sapiens
cuugcucagugcaaa

SEQ ID NO: 410351 - RNA, 10 nt, Homo sapiens
cuugcugaug

SEQ ID NO: 410352 - RNA, 16 nt, Homo sapiens
cuugcugauggcuuga

SEQ ID NO: 410353 - RNA, 16 nt, Homo sapiens
cuugcuugcaauaggu

SEQ ID NO: 410354 - RNA, 15 nt, Homo sapiens
cuugcuuguaaaaau

SEQ ID NO: 410355 - RNA, 12 nt, Homo sapiens
cuugcuuucaca

SEQ ID NO: 410356 - RNA, 21 nt, Homo sapiens
cuugcuuuggucuucuuccaa

SEQ ID NO: 410357 - RNA, 14 nt, Homo sapiens
cuuggaaggugaca

SEQ ID NO: 410358 - RNA, 23 nt, Homo sapiens
cuuggaauuggaauuacuguaaa

SEQ ID NO: 410359 - RNA, 12 nt, Homo sapiens
cuuggacaccau

SEQ ID NO: 410360 - RNA, 18 nt, Homo sapiens
cuuggaccucgugcuuua

SEQ ID NO: 410361 - RNA, 16 nt, Homo sapiens
cuuggaggaaugacaa

SEQ ID NO: 410362 - RNA, 19 nt, Homo sapiens
cuuggagggcccacuugua

SEQ ID NO: 410363 - RNA, 20 nt, Homo sapiens
cuuggccagaagggggccau

SEQ ID NO: 410364 - RNA, 22 nt, Homo sapiens
cuuggccagaagggggccauga

SEQ ID NO: 410365 - RNA, 20 nt, Homo sapiens
cuuggccuccccugcugaag

SEQ ID NO: 410366 - RNA, 15 nt, Homo sapiens
cuuggcguuccugcc

SEQ ID NO: 410367 - RNA, 18 nt, Homo sapiens
cuuggcuagucacauauc

SEQ ID NO: 410368 - RNA, 22 nt, Homo sapiens
cuuggcugccccacaggccaca

SEQ ID NO: 410369 - RNA, 15 nt, Homo sapiens
cuugggaacuccacu

SEQ ID NO: 410370 - RNA, 18 nt, Homo sapiens
cuugggagaccuguaauc

SEQ ID NO: 410371 - RNA, 13 nt, Homo sapiens
cuugggagcaaaa

SEQ ID NO: 410372 - RNA, 16 nt, Homo sapiens
cuugggcuacuggcag

SEQ ID NO: 410373 - RNA, 17 nt, Homo sapiens
cuuggggaacccaugag

SEQ ID NO: 410374 - RNA, 20 nt, Homo sapiens
cuugggggucugcucugugc

SEQ ID NO: 410375 - RNA, 16 nt, Homo sapiens
cuugguucccauuugc

SEQ ID NO: 410376 - RNA, 13 nt, Homo sapiens
cuugguugauuua

SEQ ID NO: 410377 - RNA, 13 nt, Homo sapiens
cuuguaaauuaca

SEQ ID NO: 410378 - RNA, 18 nt, Homo sapiens
cuuguaauucuaaaugaa

SEQ ID NO: 410379 - RNA, 19 nt, Homo sapiens
cuuguacaguuaacucucc

SEQ ID NO: 410380 - RNA, 16 nt, Homo sapiens
cuuguauaguguaaaa

SEQ ID NO: 410381 - RNA, 13 nt, Homo sapiens
cuuguauggauau

SEQ ID NO: 410382 - RNA, 15 nt, Homo sapiens
cuugucauguacuga

SEQ ID NO: 410383 - RNA, 14 nt, Homo sapiens
cuugucauguguau

SEQ ID NO: 410384 - RNA, 20 nt, Homo sapiens
cuugucccuuucccuaccuu

SEQ ID NO: 410385 - RNA, 13 nt, Homo sapiens
cuuguccugaugc

SEQ ID NO: 410386 - RNA, 15 nt, Homo sapiens
cuugugacauucacu

SEQ ID NO: 410387 - RNA, 18 nt, Homo sapiens
cuugugacuagugcugaa

SEQ ID NO: 410388 - RNA, 21 nt, Homo sapiens
cuugugauuuuugaacaauac

SEQ ID NO: 410389 - RNA, 20 nt, Homo sapiens
cuuguggagaacaugcauac

SEQ ID NO: 410390 - RNA, 12 nt, Homo sapiens
cuuguguacaaa

SEQ ID NO: 410391 - RNA, 16 nt, Homo sapiens
cuuguguccacuguga

SEQ ID NO: 410392 - RNA, 15 nt, Homo sapiens
cuugugucccaugau

SEQ ID NO: 410393 - RNA, 21 nt, Homo sapiens
cuugugugugggcugugagug

SEQ ID NO: 410394 - RNA, 18 nt, Homo sapiens
cuuguucuuuucugguag

SEQ ID NO: 410395 - RNA, 18 nt, Homo sapiens
cuuguugaugaagcacau

SEQ ID NO: 410396 - RNA, 15 nt, Homo sapiens
cuuguugaugacauu

SEQ ID NO: 410397 - RNA, 13 nt, Homo sapiens
cuuguugcucaaa

SEQ ID NO: 410398 - RNA, 16 nt, Homo sapiens
cuuguuuacagcacua

SEQ ID NO: 410399 - RNA, 24 nt, Homo sapiens
cuuguuuacagcacuacucugugc

SEQ ID NO: 410400 - RNA, 23 nt, Homo sapiens
cuuguuuguuuuauucaccauca

SEQ ID NO: 410401 - RNA, 23 nt, Homo sapiens
cuuuaaacuacugaacuguuacc

SEQ ID NO: 410402 - RNA, 13 nt, Homo sapiens
cuuuaaauaucau

SEQ ID NO: 410403 - RNA, 14 nt, Homo sapiens
cuuuaaauaucauu

SEQ ID NO: 410404 - RNA, 14 nt, Homo sapiens
cuuuaaaucuguga

SEQ ID NO: 410405 - RNA, 13 nt, Homo sapiens
cuuuaacaaaaca

SEQ ID NO: 410406 - RNA, 22 nt, Homo sapiens
cuuuaacucugcggauagcauu

SEQ ID NO: 410407 - RNA, 14 nt, Homo sapiens
cuuuaacugacuua

SEQ ID NO: 410408 - RNA, 20 nt, Homo sapiens
cuuuaacuuaguauuuuacc

SEQ ID NO: 410409 - RNA, 18 nt, Homo sapiens
cuuuaauagaaguuuuau

SEQ ID NO: 410410 - RNA, 18 nt, Homo sapiens
cuuuacaaacugaagaua

SEQ ID NO: 410411 - RNA, 17 nt, Homo sapiens
cuuuacuacugcaaguu

SEQ ID NO: 410412 - RNA, 13 nt, Homo sapiens
cuuuacuggcuua

SEQ ID NO: 410413 - RNA, 18 nt, Homo sapiens
cuuuacuguuagucauuu

SEQ ID NO: 410414 - RNA, 19 nt, Homo sapiens
cuuuacuguuagucauuug

SEQ ID NO: 410415 - RNA, 11 nt, Homo sapiens
cuuuacuugac

SEQ ID NO: 410416 - RNA, 16 nt, Homo sapiens
cuuuaggaugacugua

SEQ ID NO: 410417 - RNA, 18 nt, Homo sapiens
cuuuaggcagcagcuuuu

SEQ ID NO: 410418 - RNA, 23 nt, Homo sapiens
cuuuauaccccauuugauuucga

SEQ ID NO: 410419 - RNA, 14 nt, Homo sapiens
cuuuauagcuuugg

SEQ ID NO: 410420 - RNA, 12 nt, Homo sapiens
cuuuaucacaac

SEQ ID NO: 410421 - RNA, 18 nt, Homo sapiens
cuuuaugaaaaaaauaua

SEQ ID NO: 410422 - RNA, 18 nt, Homo sapiens
cuuuaugcugaaacagaa

SEQ ID NO: 410423 - RNA, 17 nt, Homo sapiens
cuuuaugguuucuccag

SEQ ID NO: 410424 - RNA, 19 nt, Homo sapiens
cuuuauuccuucauuucau

SEQ ID NO: 410425 - RNA, 18 nt, Homo sapiens
cuuucaauauuuauuucc

SEQ ID NO: 410426 - RNA, 17 nt, Homo sapiens
cuuucacaguaccaucu

SEQ ID NO: 410427 - RNA, 12 nt, Homo sapiens
cuuucaccucag

SEQ ID NO: 410428 - RNA, 13 nt, Homo sapiens
cuuucacuuugaa

SEQ ID NO: 410429 - RNA, 18 nt, Homo sapiens
cgauggggcccacauuag

SEQ ID NO: 410430 - RNA, 13 nt, Homo sapiens
cgauucccugugu

SEQ ID NO: 410431 - RNA, 16 nt, Homo sapiens
cgauugaaagaaccag

SEQ ID NO: 410432 - RNA, 14 nt, Homo sapiens
cgauugaaggugac

SEQ ID NO: 410433 - RNA, 14 nt, Homo sapiens
cgauuucacugaca

SEQ ID NO: 410434 - RNA, 16 nt, Homo sapiens
cgauuucagcacaugc

SEQ ID NO: 410435 - RNA, 17 nt, Homo sapiens
cgcaaacuuuaacaggu

SEQ ID NO: 410436 - RNA, 11 nt, Homo sapiens
cgcagacacac

SEQ ID NO: 410437 - RNA, 16 nt, Homo sapiens
cgcagggguugcagug

SEQ ID NO: 410438 - RNA, 22 nt, Homo sapiens
cgcauaauaaggggaagacuuu

SEQ ID NO: 410439 - RNA, 23 nt, Homo sapiens
cgcauauacauaaaguauccaug

SEQ ID NO: 410440 - RNA, 22 nt, Homo sapiens
cgcauaugcaugccaggcuggg

SEQ ID NO: 410441 - RNA, 23 nt, Homo sapiens
cgcaucguggccuugaccuccaa

SEQ ID NO: 410442 - RNA, 12 nt, Homo sapiens
cgccaacacuug

SEQ ID NO: 410443 - RNA, 13 nt, Homo sapiens
cgccagacuguua

SEQ ID NO: 410444 - RNA, 13 nt, Homo sapiens
cgccagaucugca

SEQ ID NO: 410445 - RNA, 14 nt, Homo sapiens
cgccagauggggcc

SEQ ID NO: 410446 - RNA, 15 nt, Homo sapiens
cgccagcccuaggcu

SEQ ID NO: 410447 - RNA, 18 nt, Homo sapiens
cgcccagcucucccacau

SEQ ID NO: 410448 - RNA, 23 nt, Homo sapiens
cgcccagugcagucggugguacc

SEQ ID NO: 410449 - RNA, 16 nt, Homo sapiens
cgccugacaaccacug

SEQ ID NO: 410450 - RNA, 16 nt, Homo sapiens
cgccuggcagaacuga

SEQ ID NO: 410451 - RNA, 23 nt, Homo sapiens
cgccugguucuguacauguggaa

SEQ ID NO: 410452 - RNA, 13 nt, Homo sapiens
cgcgagacugaga

SEQ ID NO: 410453 - RNA, 12 nt, Homo sapiens
cgcggggaccau

SEQ ID NO: 410454 - RNA, 13 nt, Homo sapiens
cgcuaucuagcaa

SEQ ID NO: 410455 - RNA, 13 nt, Homo sapiens
cgcucucuuccag

SEQ ID NO: 410456 - RNA, 18 nt, Homo sapiens
cgcugggagaaaagccag

SEQ ID NO: 410457 - RNA, 23 nt, Homo sapiens
cgcuugaaccugggaaguggagg

SEQ ID NO: 410458 - RNA, 17 nt, Homo sapiens
cgcuuucccaucuuaaa

SEQ ID NO: 410459 - RNA, 15 nt, Homo sapiens
cgcuuuguugcccag

SEQ ID NO: 410460 - RNA, 17 nt, Homo sapiens
cggaacuuacuguguaa

SEQ ID NO: 410461 - RNA, 19 nt, Homo sapiens
cggaagaggcugcugagaa

SEQ ID NO: 410462 - RNA, 21 nt, Homo sapiens
cggaaguacuucccucaggcc

SEQ ID NO: 410463 - RNA, 12 nt, Homo sapiens
cggaaucucagc

SEQ ID NO: 410464 - RNA, 12 nt, Homo sapiens
cggacugugaau

SEQ ID NO: 410465 - RNA, 17 nt, Homo sapiens
cggagccuccucucuca

SEQ ID NO: 410466 - RNA, 13 nt, Homo sapiens
cggauagcauuug

SEQ ID NO: 410467 - RNA, 21 nt, Homo sapiens
cggauguuucuggaauugaua

SEQ ID NO: 410468 - RNA, 17 nt, Homo sapiens
cggcaagcgagcacagu

SEQ ID NO: 410469 - RNA, 19 nt, Homo sapiens
cggcacccugauccucacc

SEQ ID NO: 410470 - RNA, 17 nt, Homo sapiens
cggcaggcccugcagug

SEQ ID NO: 410471 - RNA, 18 nt, Homo sapiens
cggccacucccugccaac

SEQ ID NO: 410472 - RNA, 15 nt, Homo sapiens
cggccagaagaucua

SEQ ID NO: 410473 - RNA, 14 nt, Homo sapiens
cggcgccaccaucc

SEQ ID NO: 410474 - RNA, 19 nt, Homo sapiens
cggcuaagaggcugcugaa

SEQ ID NO: 410475 - RNA, 15 nt, Homo sapiens
cggcuccuucaagcu

SEQ ID NO: 410476 - RNA, 18 nt, Homo sapiens
cggcuccuucaagcugcu

SEQ ID NO: 410477 - RNA, 22 nt, Homo sapiens
cggcuggaaagaggagaaggag

SEQ ID NO: 410478 - RNA, 13 nt, Homo sapiens
cggcuguggagca

SEQ ID NO: 410479 - RNA, 19 nt, Homo sapiens
cgggaaugacuugggccaa

SEQ ID NO: 410480 - RNA, 23 nt, Homo sapiens
cgggaugggacacccaacacuuu

SEQ ID NO: 410481 - RNA, 15 nt, Homo sapiens
cgggcugcugcugau

SEQ ID NO: 410482 - RNA, 12 nt, Homo sapiens
cggggugcuccu

SEQ ID NO: 410483 - RNA, 15 nt, Homo sapiens
cggguuacuuucaca

SEQ ID NO: 410484 - RNA, 12 nt, Homo sapiens
cggucccggcug

SEQ ID NO: 410485 - RNA, 23 nt, Homo sapiens
cggucugagaagauucaauuuaa

SEQ ID NO: 410486 - RNA, 23 nt, Homo sapiens
cggugcauacacccccaccuccu

SEQ ID NO: 410487 - RNA, 14 nt, Homo sapiens
cggugcucuggaag

SEQ ID NO: 410488 - RNA, 22 nt, Homo sapiens
cggugcucuggaagaccugaaa

SEQ ID NO: 410489 - RNA, 16 nt, Homo sapiens
cgguuugggagaacac

SEQ ID NO: 410490 - RNA, 19 nt, Homo sapiens
cgguuuuauaaaagccuug

SEQ ID NO: 410491 - RNA, 16 nt, Homo sapiens
cguacaucugcaauau

SEQ ID NO: 410492 - RNA, 18 nt, Homo sapiens
cguaccucuucccaugac

SEQ ID NO: 410493 - RNA, 21 nt, Homo sapiens
cguagcuauccggacagagca

SEQ ID NO: 410494 - RNA, 19 nt, Homo sapiens
cguagcuccauauuggaca

SEQ ID NO: 410495 - RNA, 18 nt, Homo sapiens
cguagcuuucccaaauaa

SEQ ID NO: 410496 - RNA, 16 nt, Homo sapiens
cguaguccgcuuucuc

SEQ ID NO: 410497 - RNA, 21 nt, Homo sapiens
cguauuuuggggaacuguugu

SEQ ID NO: 410498 - RNA, 20 nt, Homo sapiens
cgucagaccaguacugggaa

SEQ ID NO: 410499 - RNA, 20 nt, Homo sapiens
cgucaguccaagucuucuca

SEQ ID NO: 410500 - RNA, 14 nt, Homo sapiens
cguccauggcacca

SEQ ID NO: 410501 - RNA, 17 nt, Homo sapiens
cgucccuccacguucac

SEQ ID NO: 410502 - RNA, 21 nt, Homo sapiens
cguccgcgcgccagcacagaa

SEQ ID NO: 410503 - RNA, 14 nt, Homo sapiens
cguccguccgcccg

SEQ ID NO: 410504 - RNA, 17 nt, Homo sapiens
cgucuccgaagauuugg

SEQ ID NO: 410505 - RNA, 17 nt, Homo sapiens
cgucugucaaugacauc

SEQ ID NO: 410506 - RNA, 22 nt, Homo sapiens
cgugauagaagaaaagcacugg

SEQ ID NO: 410507 - RNA, 12 nt, Homo sapiens
cgugcacucugc

SEQ ID NO: 410508 - RNA, 21 nt, Homo sapiens
cgugcagcagcaacacaaugu

SEQ ID NO: 410509 - RNA, 16 nt, Homo sapiens
cguggaaagggugcug

SEQ ID NO: 410510 - RNA, 18 nt, Homo sapiens
cguggcaaauuaacuuga

SEQ ID NO: 410511 - RNA, 14 nt, Homo sapiens
cguggcaacugugg

SEQ ID NO: 410512 - RNA, 20 nt, Homo sapiens
cguggccgagggcuucccua

SEQ ID NO: 410513 - RNA, 15 nt, Homo sapiens
cgugggauccagaga

SEQ ID NO: 410514 - RNA, 13 nt, Homo sapiens
cgugggcaaguca

SEQ ID NO: 410515 - RNA, 21 nt, Homo sapiens
cgugggcaagucauuguccuc

SEQ ID NO: 410516 - RNA, 15 nt, Homo sapiens
cgugguagaagccag

SEQ ID NO: 410517 - RNA, 14 nt, Homo sapiens
cgugguaugugaau

SEQ ID NO: 410518 - RNA, 20 nt, Homo sapiens
cguggucagggcagggcuca

SEQ ID NO: 410519 - RNA, 15 nt, Homo sapiens
cgugguccauuccau

SEQ ID NO: 410520 - RNA, 13 nt, Homo sapiens
cguguagugucug

SEQ ID NO: 410521 - RNA, 15 nt, Homo sapiens
cguguauuuucauua

SEQ ID NO: 410522 - RNA, 21 nt, Homo sapiens
cguguccaggagaccuuccac

SEQ ID NO: 410523 - RNA, 14 nt, Homo sapiens
cgugugaggaugug

SEQ ID NO: 410524 - RNA, 13 nt, Homo sapiens
cgugugagucagg

SEQ ID NO: 410525 - RNA, 22 nt, Homo sapiens
cgugugcgugcaugugcacuug

SEQ ID NO: 410526 - RNA, 21 nt, Homo sapiens
cguguguauuagaaugcaugu

SEQ ID NO: 410527 - RNA, 21 nt, Homo sapiens
cguguguguugucugaacaug

SEQ ID NO: 410528 - RNA, 14 nt, Homo sapiens
cguguuaugacucc

SEQ ID NO: 410529 - RNA, 21 nt, Homo sapiens
cguguuuaauuaaauuucaca

SEQ ID NO: 410530 - RNA, 12 nt, Homo sapiens
cguuaaaggcau

SEQ ID NO: 410531 - RNA, 18 nt, Homo sapiens
cguuaugauaguguccca

SEQ ID NO: 410532 - RNA, 20 nt, Homo sapiens
cguucacuuccccuuccaac

SEQ ID NO: 410533 - RNA, 13 nt, Homo sapiens
cguucagcuguga

SEQ ID NO: 410534 - RNA, 19 nt, Homo sapiens
cguucagcugugacgaagg

SEQ ID NO: 410535 - RNA, 20 nt, Homo sapiens
cguucucuucucucuucaau

SEQ ID NO: 410536 - RNA, 14 nt, Homo sapiens
cguucuuucaaugc

SEQ ID NO: 410537 - RNA, 15 nt, Homo sapiens
cguucuuucaaugcu

SEQ ID NO: 410538 - RNA, 19 nt, Homo sapiens
cguugcugcguucuuucaa

SEQ ID NO: 410539 - RNA, 17 nt, Homo sapiens
cguugguucugcacuaa

SEQ ID NO: 410540 - RNA, 21 nt, Homo sapiens
cguuugaauauauuuuaucuu

SEQ ID NO: 410541 - RNA, 14 nt, Homo sapiens
cguuuuuuucauuc

SEQ ID NO: 410542 - RNA, 19 nt, Homo sapiens
cuaaaaccacaugugcaac

SEQ ID NO: 410543 - RNA, 14 nt, Homo sapiens
cuaaaauaugaugu

SEQ ID NO: 410544 - RNA, 23 nt, Homo sapiens
cuaaaaugauuuuaucugugaau

SEQ ID NO: 410545 - RNA, 19 nt, Homo sapiens
cuaaaccaguccuuagcaa

SEQ ID NO: 410546 - RNA, 23 nt, Homo sapiens
cuaaagaaacucagcagccucag

SEQ ID NO: 410547 - RNA, 17 nt, Homo sapiens
cuaaagaauagugccuc

SEQ ID NO: 410548 - RNA, 15 nt, Homo sapiens
cuaaagagcuuuagu

SEQ ID NO: 410549 - RNA, 22 nt, Homo sapiens
cuaaagcuuuaggaugacugua

SEQ ID NO: 410550 - RNA, 14 nt, Homo sapiens
cuaaaggacuaaca

SEQ ID NO: 410551 - RNA, 23 nt, Homo sapiens
cuaaaggacugguuaaaucaauu

SEQ ID NO: 410552 - RNA, 21 nt, Homo sapiens
cuaaagguggugaggcaauaa

SEQ ID NO: 410553 - RNA, 12 nt, Homo sapiens
cuaaaguagacu

SEQ ID NO: 410554 - RNA, 22 nt, Homo sapiens
cuaaauaguucuaucaggaaaa

SEQ ID NO: 410555 - RNA, 15 nt, Homo sapiens
cuaaaucucuaauau

SEQ ID NO: 410556 - RNA, 15 nt, Homo sapiens
cuaaaucuucagcau

SEQ ID NO: 410557 - RNA, 17 nt, Homo sapiens
cuaaaugauuaucuuga

SEQ ID NO: 410558 - RNA, 18 nt, Homo sapiens
cuuacaaugugcacugaa

SEQ ID NO: 410559 - RNA, 14 nt, Homo sapiens
cuuacaauucccug

SEQ ID NO: 410560 - RNA, 18 nt, Homo sapiens
cuuacaauugcacugcug

SEQ ID NO: 410561 - RNA, 13 nt, Homo sapiens
cuuacacaucuca

SEQ ID NO: 410562 - RNA, 19 nt, Homo sapiens
cuuacaucugcagcucuuu

SEQ ID NO: 410563 - RNA, 13 nt, Homo sapiens
cuuacauggcgcu

SEQ ID NO: 410564 - RNA, 19 nt, Homo sapiens
cuuacccccaccacuaaga

SEQ ID NO: 410565 - RNA, 18 nt, Homo sapiens
cuuacccuucugugccca

SEQ ID NO: 410566 - RNA, 15 nt, Homo sapiens
cuuaccucauuugca

SEQ ID NO: 410567 - RNA, 23 nt, Homo sapiens
cuuacggucaugaugucugcaaa

SEQ ID NO: 410568 - RNA, 22 nt, Homo sapiens
cuuagaacagauggcugugaaa

SEQ ID NO: 410569 - RNA, 18 nt, Homo sapiens
cuuagaauaaaauuguaa

SEQ ID NO: 410570 - RNA, 14 nt, Homo sapiens
cuuagaauacugua

SEQ ID NO: 410571 - RNA, 19 nt, Homo sapiens
cuuagaauuugggggaaaa

SEQ ID NO: 410572 - RNA, 21 nt, Homo sapiens
cuuagagcacuagaagcacag

SEQ ID NO: 410573 - RNA, 22 nt, Homo sapiens
cuuagaugagggugacugucaa

SEQ ID NO: 410574 - RNA, 12 nt, Homo sapiens
cuuagcaacagc

SEQ ID NO: 410575 - RNA, 18 nt, Homo sapiens
cuuagcacacucacagau

SEQ ID NO: 410576 - RNA, 17 nt, Homo sapiens
cuuagcaugcacaaagu

SEQ ID NO: 410577 - RNA, 21 nt, Homo sapiens
cuuagccccagggcacucaga

SEQ ID NO: 410578 - RNA, 16 nt, Homo sapiens
cuuagggacagaauua

SEQ ID NO: 410579 - RNA, 15 nt, Homo sapiens
cuuagugugugcaau

SEQ ID NO: 410580 - RNA, 12 nt, Homo sapiens
cuuaguucucac

SEQ ID NO: 410581 - RNA, 15 nt, Homo sapiens
cuuaucuagccaaag

SEQ ID NO: 410582 - RNA, 21 nt, Homo sapiens
cuuaucucccugcuucauauc

SEQ ID NO: 410583 - RNA, 13 nt, Homo sapiens
cuuaugauucaga

SEQ ID NO: 410584 - RNA, 21 nt, Homo sapiens
cuuauuacaauuuguucaucc

SEQ ID NO: 410585 - RNA, 22 nt, Homo sapiens
cuuauucuugagcacaaaauga

SEQ ID NO: 410586 - RNA, 14 nt, Homo sapiens
cuuauuguaccucu

SEQ ID NO: 410587 - RNA, 17 nt, Homo sapiens
cuuauuguuccaagaca

SEQ ID NO: 410588 - RNA, 15 nt, Homo sapiens
cuuauuucauaaaca

SEQ ID NO: 410589 - RNA, 17 nt, Homo sapiens
cuuauuucuaacuauua

SEQ ID NO: 410590 - RNA, 17 nt, Homo sapiens
cuucaaaaucagugaug

SEQ ID NO: 410591 - RNA, 17 nt, Homo sapiens
cuucaaaccccuacuga

SEQ ID NO: 410592 - RNA, 20 nt, Homo sapiens
cuucaacaugguuaccucug

SEQ ID NO: 410593 - RNA, 12 nt, Homo sapiens
cuucaacuaauu

SEQ ID NO: 410594 - RNA, 13 nt, Homo sapiens
cuucaagagccag

SEQ ID NO: 410595 - RNA, 19 nt, Homo sapiens
cuucaaggaagugauaaca

SEQ ID NO: 410596 - RNA, 22 nt, Homo sapiens
cuucaaggcccauaucugugaa

SEQ ID NO: 410597 - RNA, 23 nt, Homo sapiens
cuucaaucucuguucugcuccca

SEQ ID NO: 410598 - RNA, 20 nt, Homo sapiens
cuucacaccuacccuccuuu

SEQ ID NO: 410599 - RNA, 22 nt, Homo sapiens
cuucacaggcagugcaugugaa

SEQ ID NO: 410600 - RNA, 21 nt, Homo sapiens
cuucacaggcuauucuacuuu

SEQ ID NO: 410601 - RNA, 17 nt, Homo sapiens
cuucacccuggagccca

SEQ ID NO: 410602 - RNA, 21 nt, Homo sapiens
cuucacgccuccccuuuguga

SEQ ID NO: 410603 - RNA, 15 nt, Homo sapiens
cuucacggacaggaa

SEQ ID NO: 410604 - RNA, 21 nt, Homo sapiens
cuucacuauucagaacuugua

SEQ ID NO: 410605 - RNA, 15 nt, Homo sapiens
cuucacugcagauuu

SEQ ID NO: 410606 - RNA, 17 nt, Homo sapiens
cuucacugcagauuucu

SEQ ID NO: 410607 - RNA, 13 nt, Homo sapiens
cuucacuugcacu

SEQ ID NO: 410608 - RNA, 23 nt, Homo sapiens
cuucagacaggagccacagggag

SEQ ID NO: 410609 - RNA, 18 nt, Homo sapiens
cuucagagcaagcacugg

SEQ ID NO: 410610 - RNA, 17 nt, Homo sapiens
cuucagaggagaaagaa

SEQ ID NO: 410611 - RNA, 20 nt, Homo sapiens
cuucagagggaaacucagau

SEQ ID NO: 410612 - RNA, 19 nt, Homo sapiens
cuucagaugacaaggauua

SEQ ID NO: 410613 - RNA, 17 nt, Homo sapiens
cuucagcagcgugcaau

SEQ ID NO: 410614 - RNA, 18 nt, Homo sapiens
cuucagcaugauguguug

SEQ ID NO: 410615 - RNA, 12 nt, Homo sapiens
cuucagcccuaa

SEQ ID NO: 410616 - RNA, 13 nt, Homo sapiens
cuucagcccugaa

SEQ ID NO: 410617 - RNA, 13 nt, Homo sapiens
cuucagggccaga

SEQ ID NO: 410618 - RNA, 23 nt, Homo sapiens
cuucagggggccaggugcacaga

SEQ ID NO: 410619 - RNA, 22 nt, Homo sapiens
cuucagguucuuagugucacuu

SEQ ID NO: 410620 - RNA, 21 nt, Homo sapiens
cuucagugccaaaaacaacaa

SEQ ID NO: 410621 - RNA, 16 nt, Homo sapiens
cuucaguuguuuuccc

SEQ ID NO: 410622 - RNA, 21 nt, Homo sapiens
cuucaucgcaguggacugugu

SEQ ID NO: 410623 - RNA, 23 nt, Homo sapiens
cuucaucuugagccugagccuua

SEQ ID NO: 410624 - RNA, 19 nt, Homo sapiens
cuucaugcaauccuuccaa

SEQ ID NO: 410625 - RNA, 20 nt, Homo sapiens
cuucauuaguugaaagggau

SEQ ID NO: 410626 - RNA, 19 nt, Homo sapiens
cuucauucuccguugucau

SEQ ID NO: 410627 - RNA, 11 nt, Homo sapiens
cuucauuucau

SEQ ID NO: 410628 - RNA, 24 nt, Homo sapiens
cuucauuugaugcuaaauaggaga

SEQ ID NO: 410629 - RNA, 14 nt, Homo sapiens
cuucauuuguguca

SEQ ID NO: 410630 - RNA, 20 nt, Homo sapiens
cuuccaaagugcugggauua

SEQ ID NO: 410631 - RNA, 15 nt, Homo sapiens
cuuccaaaugagcca

SEQ ID NO: 410632 - RNA, 16 nt, Homo sapiens
cuuccaaggaaaagca

SEQ ID NO: 410633 - RNA, 14 nt, Homo sapiens
cuuccaauguggug

SEQ ID NO: 410634 - RNA, 12 nt, Homo sapiens
cuuccaccacuc

SEQ ID NO: 410635 - RNA, 12 nt, Homo sapiens
cuuccaccucac

SEQ ID NO: 410636 - RNA, 13 nt, Homo sapiens
cuuccacuaccuu

SEQ ID NO: 410637 - RNA, 18 nt, Homo sapiens
cuuccagauugacgacaa

SEQ ID NO: 410638 - RNA, 23 nt, Homo sapiens
cuuccauaggacauacugcaugu

SEQ ID NO: 410639 - RNA, 12 nt, Homo sapiens
cuuccauuugcu

SEQ ID NO: 410640 - RNA, 21 nt, Homo sapiens
cuuccauuugugugugugcaa

SEQ ID NO: 410641 - RNA, 19 nt, Homo sapiens
cuucccaacguacuccuca

SEQ ID NO: 410642 - RNA, 12 nt, Homo sapiens
cuucccagcaca

SEQ ID NO: 410643 - RNA, 18 nt, Homo sapiens
cuucccaguagcucuugc

SEQ ID NO: 410644 - RNA, 23 nt, Homo sapiens
cuucccauuguggcuccuaucug

SEQ ID NO: 410645 - RNA, 16 nt, Homo sapiens
cuuccccaacgaaaag

SEQ ID NO: 410646 - RNA, 20 nt, Homo sapiens
cuuccccuccccgcuccuaa

SEQ ID NO: 410647 - RNA, 20 nt, Homo sapiens
cuucccggcgucccuaccuc

SEQ ID NO: 410648 - RNA, 22 nt, Homo sapiens
cuucccggcgucccuaccuccu

SEQ ID NO: 410649 - RNA, 14 nt, Homo sapiens
cuucccuaguucuu

SEQ ID NO: 410650 - RNA, 19 nt, Homo sapiens
cuuccgaguagcugggauu

SEQ ID NO: 410651 - RNA, 18 nt, Homo sapiens
cuuccucaagucuugaca

SEQ ID NO: 410652 - RNA, 14 nt, Homo sapiens
cuuccucaugaauc

SEQ ID NO: 410653 - RNA, 15 nt, Homo sapiens
cuuccuccagaggag

SEQ ID NO: 410654 - RNA, 22 nt, Homo sapiens
cuuccugcagaggcccagccac

SEQ ID NO: 410655 - RNA, 12 nt, Homo sapiens
cuuccugcagua

SEQ ID NO: 410656 - RNA, 16 nt, Homo sapiens
cuuccuggacuggccc

SEQ ID NO: 410657 - RNA, 14 nt, Homo sapiens
cuuccuggcuguaa

SEQ ID NO: 410658 - RNA, 15 nt, Homo sapiens
cuuccuguccacucu

SEQ ID NO: 410659 - RNA, 23 nt, Homo sapiens
cuuccuguguggccugccuucac

SEQ ID NO: 410660 - RNA, 20 nt, Homo sapiens
cuuccuuggaggggggagcc

SEQ ID NO: 410661 - RNA, 13 nt, Homo sapiens
cuucgacugugac

SEQ ID NO: 410662 - RNA, 15 nt, Homo sapiens
cuucuagacacugaa

SEQ ID NO: 410663 - RNA, 17 nt, Homo sapiens
cuucuaucaaagcacau

SEQ ID NO: 410664 - RNA, 17 nt, Homo sapiens
cuucuauguccaacaga

SEQ ID NO: 410665 - RNA, 16 nt, Homo sapiens
cuucucaagugccuua

SEQ ID NO: 410666 - RNA, 15 nt, Homo sapiens
cuucuccaaaugaga

SEQ ID NO: 410667 - RNA, 23 nt, Homo sapiens
cuucuccacagggacacagucug

SEQ ID NO: 410668 - RNA, 13 nt, Homo sapiens
cuucucugcucca

SEQ ID NO: 410669 - RNA, 15 nt, Homo sapiens
cuucugaagauggaa

SEQ ID NO: 410670 - RNA, 19 nt, Homo sapiens
cuucugagagcaaagggaa

SEQ ID NO: 410671 - RNA, 18 nt, Homo sapiens
cuucugagcaguuuucca

SEQ ID NO: 410672 - RNA, 19 nt, Homo sapiens
cuucugagcaguuuuccag

SEQ ID NO: 410673 - RNA, 18 nt, Homo sapiens
cuucugagccucuuuaac

SEQ ID NO: 410674 - RNA, 19 nt, Homo sapiens
cuucugcaucuuacaguca

SEQ ID NO: 410675 - RNA, 19 nt, Homo sapiens
cuucugcucacauucccuc

SEQ ID NO: 410676 - RNA, 19 nt, Homo sapiens
cuucugcuguauacuguac

SEQ ID NO: 410677 - RNA, 21 nt, Homo sapiens
cuucugcuguauacuguacug

SEQ ID NO: 410678 - RNA, 22 nt, Homo sapiens
cuucugcuguauacuguacuga

SEQ ID NO: 410679 - RNA, 21 nt, Homo sapiens
cuucuggcagggaagugggga

SEQ ID NO: 410680 - RNA, 19 nt, Homo sapiens
cuucuggggguagaucuca

SEQ ID NO: 410681 - RNA, 20 nt, Homo sapiens
cuucuggggguagaucucaa

SEQ ID NO: 410682 - RNA, 21 nt, Homo sapiens
cuucugguuguauuucuauau

SEQ ID NO: 410683 - RNA, 13 nt, Homo sapiens
cuucuguuuccau

SEQ ID NO: 410684 - RNA, 19 nt, Homo sapiens
cuucuuacaugcauuugag

SEQ ID NO: 410685 - RNA, 15 nt, Homo sapiens
cuucuucaauacuga

SEQ ID NO: 410686 - RNA, 18 nt, Homo sapiens
cuucuuccacacaugcaa

SEQ ID NO: 410687 - RNA, 14 nt, Homo sapiens
cuucuuccacagca

SEQ ID NO: 410688 - RNA, 19 nt, Homo sapiens
cuucuuccccccgcuguca

SEQ ID NO: 410689 - RNA, 22 nt, Homo sapiens
cuucuuccucaagucuugacaa

SEQ ID NO: 410690 - RNA, 14 nt, Homo sapiens
cuacccugcugacc

SEQ ID NO: 410691 - RNA, 10 nt, Homo sapiens
cuaccucagc

SEQ ID NO: 410692 - RNA, 19 nt, Homo sapiens
cuaccucccgaccuaccac

SEQ ID NO: 410693 - RNA, 15 nt, Homo sapiens
cuaccuucaaagcug

SEQ ID NO: 410694 - RNA, 20 nt, Homo sapiens
cuaccuugaaagaagaaaag

SEQ ID NO: 410695 - RNA, 17 nt, Homo sapiens
cuacgcuccugucucca

SEQ ID NO: 410696 - RNA, 13 nt, Homo sapiens
cuacuaacauccc

SEQ ID NO: 410697 - RNA, 15 nt, Homo sapiens
cuacuaacaucccaa

SEQ ID NO: 410698 - RNA, 22 nt, Homo sapiens
cuacuagucaagagaaguacag

SEQ ID NO: 410699 - RNA, 15 nt, Homo sapiens
cuacuccucugcagu

SEQ ID NO: 410700 - RNA, 15 nt, Homo sapiens
cuacucgaguuacag

SEQ ID NO: 410701 - RNA, 18 nt, Homo sapiens
cuacucgaguuacagaca

SEQ ID NO: 410702 - RNA, 16 nt, Homo sapiens
cuacucucaugcugca

SEQ ID NO: 410703 - RNA, 15 nt, Homo sapiens
cuacugaaaaugcau

SEQ ID NO: 410704 - RNA, 20 nt, Homo sapiens
cuacuggucuguacuccuug

SEQ ID NO: 410705 - RNA, 22 nt, Homo sapiens
cuacugucagcgagcugugcaa

SEQ ID NO: 410706 - RNA, 13 nt, Homo sapiens
cuacuguguuccu

SEQ ID NO: 410707 - RNA, 15 nt, Homo sapiens
cuacuucauagcucc

SEQ ID NO: 410708 - RNA, 14 nt, Homo sapiens
cuacuugcuguaga

SEQ ID NO: 410709 - RNA, 19 nt, Homo sapiens
cuacuugggaggcugaggc

SEQ ID NO: 410710 - RNA, 15 nt, Homo sapiens
cuacuuuaagcacua

SEQ ID NO: 410711 - RNA, 16 nt, Homo sapiens
cuacuuuaucaauuaa

SEQ ID NO: 410712 - RNA, 22 nt, Homo sapiens
cuacuuuauuuugaaacauuug

SEQ ID NO: 410713 - RNA, 19 nt, Homo sapiens
cuacuuugccacagauuau

SEQ ID NO: 410714 - RNA, 17 nt, Homo sapiens
cuagaaaguaauacaau

SEQ ID NO: 410715 - RNA, 14 nt, Homo sapiens
cuagaacaaacuaa

SEQ ID NO: 410716 - RNA, 12 nt, Homo sapiens
cuagaacagcca

SEQ ID NO: 410717 - RNA, 14 nt, Homo sapiens
cuagaacagccaga

SEQ ID NO: 410718 - RNA, 23 nt, Homo sapiens
cuagaaccuucuaauccaugugc

SEQ ID NO: 410719 - RNA, 18 nt, Homo sapiens
cuagaauggaaaacugcc

SEQ ID NO: 410720 - RNA, 14 nt, Homo sapiens
cuagaccuugccuc

SEQ ID NO: 410721 - RNA, 19 nt, Homo sapiens
cuagacuacucaauauuaa

SEQ ID NO: 410722 - RNA, 21 nt, Homo sapiens
cuagacuucccaacagccuua

SEQ ID NO: 410723 - RNA, 21 nt, Homo sapiens
cuagagcuagaugugucuuac

SEQ ID NO: 410724 - RNA, 22 nt, Homo sapiens
cuagagcuagaugugucuuacc

SEQ ID NO: 410725 - RNA, 22 nt, Homo sapiens
cuagaggcuugcauaauaagcu

SEQ ID NO: 410726 - RNA, 21 nt, Homo sapiens
cuagagguagaguuugaucau

SEQ ID NO: 410727 - RNA, 21 nt, Homo sapiens
cuagaguaauuaucugugaug

SEQ ID NO: 410728 - RNA, 14 nt, Homo sapiens
cuagaguccucacu

SEQ ID NO: 410729 - RNA, 14 nt, Homo sapiens
cuagauccacacuu

SEQ ID NO: 410730 - RNA, 15 nt, Homo sapiens
cuagaucucccuuaa

SEQ ID NO: 410731 - RNA, 18 nt, Homo sapiens
cuagaucuuacaucugca

SEQ ID NO: 410732 - RNA, 20 nt, Homo sapiens
cuagaugugcaaaugcaagc

SEQ ID NO: 410733 - RNA, 15 nt, Homo sapiens
cuagaugugucuuac

SEQ ID NO: 410734 - RNA, 23 nt, Homo sapiens
cuagauuucuagaaaagcuuccu

SEQ ID NO: 410735 - RNA, 10 nt, Homo sapiens
cuagcacaaa

SEQ ID NO: 410736 - RNA, 16 nt, Homo sapiens
cuagcaccaggacuca

SEQ ID NO: 410737 - RNA, 14 nt, Homo sapiens
cuagcaucccugag

SEQ ID NO: 410738 - RNA, 22 nt, Homo sapiens
cuagcauuuucuugaaccaaua

SEQ ID NO: 410739 - RNA, 15 nt, Homo sapiens
cuagccaaagagcuc

SEQ ID NO: 410740 - RNA, 23 nt, Homo sapiens
cuagccugcauaucauucaccca

SEQ ID NO: 410741 - RNA, 14 nt, Homo sapiens
cuagcuuagcuguc

SEQ ID NO: 410742 - RNA, 20 nt, Homo sapiens
cuaggaaagaguugagcaca

SEQ ID NO: 410743 - RNA, 21 nt, Homo sapiens
cuaggaaaggcagaaacacaa

SEQ ID NO: 410744 - RNA, 19 nt, Homo sapiens
cuaggaaucaugugccaag

SEQ ID NO: 410745 - RNA, 23 nt, Homo sapiens
cuaggacuuuagggaucugggga

SEQ ID NO: 410746 - RNA, 23 nt, Homo sapiens
cuaggagaacugcuguguucuca

SEQ ID NO: 410747 - RNA, 19 nt, Homo sapiens
cuaggaguugaguacagug

SEQ ID NO: 410748 - RNA, 17 nt, Homo sapiens
cuagggaggaccuuauc

SEQ ID NO: 410749 - RNA, 16 nt, Homo sapiens
cuagggucuugggggu

SEQ ID NO: 410750 - RNA, 14 nt, Homo sapiens
cuagguaacaguuu

SEQ ID NO: 410751 - RNA, 17 nt, Homo sapiens
cuagguaggggcccacu

SEQ ID NO: 410752 - RNA, 22 nt, Homo sapiens
cuagguagugaccuaaccacuu

SEQ ID NO: 410753 - RNA, 16 nt, Homo sapiens
cuaggugcacauauac

SEQ ID NO: 410754 - RNA, 22 nt, Homo sapiens
cuaggugggucaacuccaaggc

SEQ ID NO: 410755 - RNA, 13 nt, Homo sapiens
cuagguucaggaa

SEQ ID NO: 410756 - RNA, 20 nt, Homo sapiens
cuagguucuaaaaauuguga

SEQ ID NO: 410757 - RNA, 19 nt, Homo sapiens
cuagguuucaccucccaaa

SEQ ID NO: 410758 - RNA, 10 nt, Homo sapiens
caggacaucu

SEQ ID NO: 410759 - RNA, 12 nt, Homo sapiens
cagugcacucga

SEQ ID NO: 410760 - RNA, 19 nt, Homo sapiens
cauccuuuuuaaaugagac

SEQ ID NO: 410761 - RNA, 20 nt, Homo sapiens
caucgaggcucuugcucaag

SEQ ID NO: 410762 - RNA, 22 nt, Homo sapiens
caucgcuucuuuuucaaaacua

SEQ ID NO: 410763 - RNA, 23 nt, Homo sapiens
caucgguucauauuaagacauaa

SEQ ID NO: 410764 - RNA, 21 nt, Homo sapiens
caucguggccuugaccuccaa

SEQ ID NO: 410765 - RNA, 17 nt, Homo sapiens
caucuaaaacucauaca

SEQ ID NO: 410766 - RNA, 19 nt, Homo sapiens
caucuaaaacucauacaau

SEQ ID NO: 410767 - RNA, 17 nt, Homo sapiens
caucuaaauugaucauu

SEQ ID NO: 410768 - RNA, 16 nt, Homo sapiens
caucuaagacauucac

SEQ ID NO: 410769 - RNA, 20 nt, Homo sapiens
caucuacccugcugaccucc

SEQ ID NO: 410770 - RNA, 13 nt, Homo sapiens
caucuacuggaua

SEQ ID NO: 410771 - RNA, 22 nt, Homo sapiens
caucuacuuuuuuuuuaauuaa

SEQ ID NO: 410772 - RNA, 21 nt, Homo sapiens
caucuauugccugagagcaca

SEQ ID NO: 410773 - RNA, 21 nt, Homo sapiens
caucucagaaaacucugguaa

SEQ ID NO: 410774 - RNA, 20 nt, Homo sapiens
caucucagacaucaagucaa

SEQ ID NO: 410775 - RNA, 12 nt, Homo sapiens
caucucagccua

SEQ ID NO: 410776 - RNA, 19 nt, Homo sapiens
caucuccccucagauucca

SEQ ID NO: 410777 - RNA, 21 nt, Homo sapiens
caucuccccucagauuccacc

SEQ ID NO: 410778 - RNA, 19 nt, Homo sapiens
caucucuaaaaaaauacaa

SEQ ID NO: 410779 - RNA, 18 nt, Homo sapiens
caucucuccccauauaua

SEQ ID NO: 410780 - RNA, 23 nt, Homo sapiens
caucucucccuccccugccauuu

SEQ ID NO: 410781 - RNA, 13 nt, Homo sapiens
caucucugcaaaa

SEQ ID NO: 410782 - RNA, 13 nt, Homo sapiens
caucucuguaaaa

SEQ ID NO: 410783 - RNA, 15 nt, Homo sapiens
caucugacacugaca

SEQ ID NO: 410784 - RNA, 17 nt, Homo sapiens
caucugaggaguccaaa

SEQ ID NO: 410785 - RNA, 10 nt, Homo sapiens
caucugaguu

SEQ ID NO: 410786 - RNA, 19 nt, Homo sapiens
caucugaguugagcacugg

SEQ ID NO: 410787 - RNA, 22 nt, Homo sapiens
caucugaguugagcacugguca

SEQ ID NO: 410788 - RNA, 19 nt, Homo sapiens
caucugcaguggagccuga

SEQ ID NO: 410789 - RNA, 16 nt, Homo sapiens
caucugcauuucuaca

SEQ ID NO: 410790 - RNA, 13 nt, Homo sapiens
caucugcucugag

SEQ ID NO: 410791 - RNA, 12 nt, Homo sapiens
caucugcuuaca

SEQ ID NO: 410792 - RNA, 16 nt, Homo sapiens
caucuguauaaacaca

SEQ ID NO: 410793 - RNA, 22 nt, Homo sapiens
caucuguauuuuuaaauucugc

SEQ ID NO: 410794 - RNA, 17 nt, Homo sapiens
caucugucccacuggga

SEQ ID NO: 410795 - RNA, 11 nt, Homo sapiens
caucuuccuag

SEQ ID NO: 410796 - RNA, 13 nt, Homo sapiens
caucuucuuuuaa

SEQ ID NO: 410797 - RNA, 16 nt, Homo sapiens
caucuugaauuguaag

SEQ ID NO: 410798 - RNA, 14 nt, Homo sapiens
caucuuucauaguu

SEQ ID NO: 410799 - RNA, 16 nt, Homo sapiens
caucuuuuugugugca

SEQ ID NO: 410800 - RNA, 15 nt, Homo sapiens
caugaaccaagugga

SEQ ID NO: 410801 - RNA, 12 nt, Homo sapiens
caugaagccuug

SEQ ID NO: 410802 - RNA, 14 nt, Homo sapiens
caugaauccagucc

SEQ ID NO: 410803 - RNA, 17 nt, Homo sapiens
caugaauccaguccaga

SEQ ID NO: 410804 - RNA, 14 nt, Homo sapiens
caugaaucucucaa

SEQ ID NO: 410805 - RNA, 14 nt, Homo sapiens
caugaaugaaugaa

SEQ ID NO: 410806 - RNA, 13 nt, Homo sapiens
caugaauguauca

SEQ ID NO: 410807 - RNA, 16 nt, Homo sapiens
caugacaaaguuacaa

SEQ ID NO: 410808 - RNA, 22 nt, Homo sapiens
caugacagcuacuaaccuggag

SEQ ID NO: 410809 - RNA, 18 nt, Homo sapiens
caugacgguguccaugcc

SEQ ID NO: 410810 - RNA, 20 nt, Homo sapiens
caugacuauuguaacuagau

SEQ ID NO: 410811 - RNA, 21 nt, Homo sapiens
caugacuucagaguacaucca

SEQ ID NO: 410812 - RNA, 14 nt, Homo sapiens
caugagaaugucau

SEQ ID NO: 410813 - RNA, 19 nt, Homo sapiens
caugagauucauucaguua

SEQ ID NO: 410814 - RNA, 16 nt, Homo sapiens
caugagguaaaagagc

SEQ ID NO: 410815 - RNA, 16 nt, Homo sapiens
caugauauuguaugua

SEQ ID NO: 410816 - RNA, 22 nt, Homo sapiens
caugaucccuguguugucucua

SEQ ID NO: 410817 - RNA, 19 nt, Homo sapiens
caugauggagucagguuug

SEQ ID NO: 410818 - RNA, 22 nt, Homo sapiens
caugauugauugaaucauugcc

SEQ ID NO: 410819 - RNA, 17 nt, Homo sapiens
caugauugugaccucca

SEQ ID NO: 410820 - RNA, 22 nt, Homo sapiens
caugauuucauuucaacuguuu

SEQ ID NO: 410821 - RNA, 16 nt, Homo sapiens
caugcaaggcacugua

SEQ ID NO: 410822 - RNA, 21 nt, Homo sapiens
caugcaagggaugaauuguaa

SEQ ID NO: 410823 - RNA, 14 nt, Homo sapiens
caugcacacaaaca

SEQ ID NO: 410824 - RNA, 21 nt, Homo sapiens
caugcacacacacacaucuca

SEQ ID NO: 410825 - RNA, 18 nt, Homo sapiens
caugcacacccauucaca

SEQ ID NO: 410826 - RNA, 20 nt, Homo sapiens
caugcacucuuuugagcagu

SEQ ID NO: 410827 - RNA, 22 nt, Homo sapiens
caugcagaaagggagcagagaa

SEQ ID NO: 410828 - RNA, 22 nt, Homo sapiens
caugcagcaaggggacaucuua

SEQ ID NO: 410829 - RNA, 17 nt, Homo sapiens
caugcaggucuccauga

SEQ ID NO: 410830 - RNA, 18 nt, Homo sapiens
caugcaguugugggaccg

SEQ ID NO: 410831 - RNA, 20 nt, Homo sapiens
caugcauggccucccagcca

SEQ ID NO: 410832 - RNA, 16 nt, Homo sapiens
caugcauguuugguua

SEQ ID NO: 410833 - RNA, 18 nt, Homo sapiens
caugcauuuuaucagaca

SEQ ID NO: 410834 - RNA, 16 nt, Homo sapiens
caugccaaauguucca

SEQ ID NO: 410835 - RNA, 23 nt, Homo sapiens
caugcccuggauccaucaggcca

SEQ ID NO: 410836 - RNA, 19 nt, Homo sapiens
caugccuauuuacuggaaa

SEQ ID NO: 410837 - RNA, 12 nt, Homo sapiens
caugcucuccaa

SEQ ID NO: 410838 - RNA, 15 nt, Homo sapiens
caugcugcuaugaag

SEQ ID NO: 410839 - RNA, 20 nt, Homo sapiens
caugcugcuuuaauugugaa

SEQ ID NO: 410840 - RNA, 13 nt, Homo sapiens
cauggaaguacua

SEQ ID NO: 410841 - RNA, 17 nt, Homo sapiens
cauggaggaauugggac

SEQ ID NO: 410842 - RNA, 16 nt, Homo sapiens
cauggaggcaugccaa

SEQ ID NO: 410843 - RNA, 18 nt, Homo sapiens
cauggaugauucuuuucc

SEQ ID NO: 410844 - RNA, 19 nt, Homo sapiens
cauggcaccuuuugcacau

SEQ ID NO: 410845 - RNA, 22 nt, Homo sapiens
cauggcuggcagagguuucuag

SEQ ID NO: 410846 - RNA, 23 nt, Homo sapiens
caugggcaccucugcuguauuga

SEQ ID NO: 410847 - RNA, 18 nt, Homo sapiens
caugggggaggcucugaa

SEQ ID NO: 410848 - RNA, 19 nt, Homo sapiens
cauggggugggccucuggu

SEQ ID NO: 410849 - RNA, 17 nt, Homo sapiens
cauggguucaauuggac

SEQ ID NO: 410850 - RNA, 16 nt, Homo sapiens
caugguacuaguguuu

SEQ ID NO: 410851 - RNA, 22 nt, Homo sapiens
caugguagacugugacacagcu

SEQ ID NO: 410852 - RNA, 17 nt, Homo sapiens
caugguauuaucuagua

SEQ ID NO: 410853 - RNA, 21 nt, Homo sapiens
caugguccuggaggaugacca

SEQ ID NO: 410854 - RNA, 15 nt, Homo sapiens
cauggugaugcaagu

SEQ ID NO: 410855 - RNA, 12 nt, Homo sapiens
cauggugcagug

SEQ ID NO: 410856 - RNA, 18 nt, Homo sapiens
caugguuuagggugauca

SEQ ID NO: 410857 - RNA, 11 nt, Homo sapiens
cauguaaaaua

SEQ ID NO: 410858 - RNA, 14 nt, Homo sapiens
cauguaaaaucuuc

SEQ ID NO: 410859 - RNA, 15 nt, Homo sapiens
cauguaccaucaaua

SEQ ID NO: 410860 - RNA, 13 nt, Homo sapiens
cauguaccugaaa

SEQ ID NO: 410861 - RNA, 19 nt, Homo sapiens
cauguaguuuuacuuggug

SEQ ID NO: 410862 - RNA, 12 nt, Homo sapiens
cauguauacuua

SEQ ID NO: 410863 - RNA, 22 nt, Homo sapiens
cauguauuagccagucauugua

SEQ ID NO: 410864 - RNA, 15 nt, Homo sapiens
cauguccaaguccaa

SEQ ID NO: 410865 - RNA, 16 nt, Homo sapiens
cauguccuauuacuga

SEQ ID NO: 410866 - RNA, 20 nt, Homo sapiens
caugucuaacaggacuugaa

SEQ ID NO: 410867 - RNA, 17 nt, Homo sapiens
caugugaauucuggcau

SEQ ID NO: 410868 - RNA, 21 nt, Homo sapiens
caugugccaagauucuacucu

SEQ ID NO: 410869 - RNA, 19 nt, Homo sapiens
cauguggaaaacucacaga

SEQ ID NO: 410870 - RNA, 19 nt, Homo sapiens
cauguggccauuaacaaug

SEQ ID NO: 410871 - RNA, 18 nt, Homo sapiens
caugugugagugugugca

SEQ ID NO: 410872 - RNA, 22 nt, Homo sapiens
caugugugcgagugugugcaug

SEQ ID NO: 410873 - RNA, 12 nt, Homo sapiens
caugugugugca

SEQ ID NO: 410874 - RNA, 23 nt, Homo sapiens
caugugugugcaagugugugcau

SEQ ID NO: 410875 - RNA, 16 nt, Homo sapiens
cauguguguucaugca

SEQ ID NO: 410876 - RNA, 18 nt, Homo sapiens
cauguguguucaugcaca

SEQ ID NO: 410877 - RNA, 18 nt, Homo sapiens
cauguuacugaccagcaa

SEQ ID NO: 410878 - RNA, 14 nt, Homo sapiens
cauguucauucaca

SEQ ID NO: 410879 - RNA, 17 nt, Homo sapiens
cauguugcuaaugacag

SEQ ID NO: 410880 - RNA, 23 nt, Homo sapiens
cauguuguagauacaaucagcug

SEQ ID NO: 410881 - RNA, 16 nt, Homo sapiens
cauguuuccaucauuu

SEQ ID NO: 410882 - RNA, 13 nt, Homo sapiens
cauuaaacacugu

SEQ ID NO: 410883 - RNA, 19 nt, Homo sapiens
cauuaaacaugaauuuaau

SEQ ID NO: 410884 - RNA, 15 nt, Homo sapiens
cauuaaacuuaccug

SEQ ID NO: 410885 - RNA, 14 nt, Homo sapiens
cauuaaaugcuuug

SEQ ID NO: 410886 - RNA, 13 nt, Homo sapiens
cauuaacaaugac

SEQ ID NO: 410887 - RNA, 17 nt, Homo sapiens
cauuaaccagggcacca

SEQ ID NO: 410888 - RNA, 17 nt, Homo sapiens
cauuaagagauuuucaa

SEQ ID NO: 410889 - RNA, 20 nt, Homo sapiens
ccccucccgccucgcugggc

SEQ ID NO: 410890 - RNA, 16 nt, Homo sapiens
ccccuccucugugcuc

SEQ ID NO: 410891 - RNA, 19 nt, Homo sapiens
ccccucgcuucauaggcag

SEQ ID NO: 410892 - RNA, 14 nt, Homo sapiens
ccccucucuuugag

SEQ ID NO: 410893 - RNA, 20 nt, Homo sapiens
ccccucuuagcuuacaggaa

SEQ ID NO: 410894 - RNA, 21 nt, Homo sapiens
ccccugccccguccccugggc

SEQ ID NO: 410895 - RNA, 21 nt, Homo sapiens
ccccugccucaagaaauugcc

SEQ ID NO: 410896 - RNA, 17 nt, Homo sapiens
ccccuggacauauuccc

SEQ ID NO: 410897 - RNA, 19 nt, Homo sapiens
ccccuggaucuaccagcau

SEQ ID NO: 410898 - RNA, 20 nt, Homo sapiens
ccccuggcccagcggccccu

SEQ ID NO: 410899 - RNA, 15 nt, Homo sapiens
ccccuggccuuugag

SEQ ID NO: 410900 - RNA, 21 nt, Homo sapiens
ccccuggccuuugaggcaaag

SEQ ID NO: 410901 - RNA, 21 nt, Homo sapiens
ccccuucuuuuuugucucaag

SEQ ID NO: 410902 - RNA, 22 nt, Homo sapiens
cccgacugugaaaguaugugau

SEQ ID NO: 410903 - RNA, 15 nt, Homo sapiens
cccgcggugcucugg

SEQ ID NO: 410904 - RNA, 23 nt, Homo sapiens
cccgcugggauuucuucgcugcu

SEQ ID NO: 410905 - RNA, 21 nt, Homo sapiens
cccgggguggccacaccacag

SEQ ID NO: 410906 - RNA, 18 nt, Homo sapiens
cccggugguuugccaugu

SEQ ID NO: 410907 - RNA, 16 nt, Homo sapiens
cccgguguaugcagug

SEQ ID NO: 410908 - RNA, 22 nt, Homo sapiens
cccguaggcagccucucugcua

SEQ ID NO: 410909 - RNA, 12 nt, Homo sapiens
cccgugccaaau

SEQ ID NO: 410910 - RNA, 14 nt, Homo sapiens
cccguuucuugccc

SEQ ID NO: 410911 - RNA, 18 nt, Homo sapiens
cccuaaugagaagucaac

SEQ ID NO: 410912 - RNA, 16 nt, Homo sapiens
cccuacacaaaauaca

SEQ ID NO: 410913 - RNA, 23 nt, Homo sapiens
cccuacacaaaauacagcacuuu

SEQ ID NO: 410914 - RNA, 15 nt, Homo sapiens
cccuacaccucuggg

SEQ ID NO: 410915 - RNA, 14 nt, Homo sapiens
cccuacccaccgau

SEQ ID NO: 410916 - RNA, 16 nt, Homo sapiens
cccuacgaaagcacag

SEQ ID NO: 410917 - RNA, 15 nt, Homo sapiens
cccuacuaacauccc

SEQ ID NO: 410918 - RNA, 23 nt, Homo sapiens
cccuacuuccagguucugguuag

SEQ ID NO: 410919 - RNA, 23 nt, Homo sapiens
cccuagccagagaauagaucagu

SEQ ID NO: 410920 - RNA, 19 nt, Homo sapiens
cccuagcgcucucuuccag

SEQ ID NO: 410921 - RNA, 22 nt, Homo sapiens
cccuagugggagcccagcacac

SEQ ID NO: 410922 - RNA, 17 nt, Homo sapiens
cccuauccuuggcacca

SEQ ID NO: 410923 - RNA, 17 nt, Homo sapiens
cccucacacacacagcu

SEQ ID NO: 410924 - RNA, 20 nt, Homo sapiens
cccucaccugggcaccuggg

SEQ ID NO: 410925 - RNA, 22 nt, Homo sapiens
cccucacuccugccaguugaaa

SEQ ID NO: 410926 - RNA, 14 nt, Homo sapiens
cccucacucugcca

SEQ ID NO: 410927 - RNA, 16 nt, Homo sapiens
cccucagauuccaccu

SEQ ID NO: 410928 - RNA, 14 nt, Homo sapiens
cccuccacguucac

SEQ ID NO: 410929 - RNA, 19 nt, Homo sapiens
cccuccagccaauaggcag

SEQ ID NO: 410930 - RNA, 13 nt, Homo sapiens
cccuccagugcuu

SEQ ID NO: 410931 - RNA, 15 nt, Homo sapiens
cccuccgacuucucu

SEQ ID NO: 410932 - RNA, 20 nt, Homo sapiens
cccuccucgcugugccacca

SEQ ID NO: 410933 - RNA, 18 nt, Homo sapiens
cccuccugaggucuggau

SEQ ID NO: 410934 - RNA, 23 nt, Homo sapiens
cccucucccuggggauaugcaac

SEQ ID NO: 410935 - RNA, 20 nt, Homo sapiens
cccucugcuaugucugugau

SEQ ID NO: 410936 - RNA, 18 nt, Homo sapiens
cccucuuaguagggacuu

SEQ ID NO: 410937 - RNA, 22 nt, Homo sapiens
cccucuugaagggggauaugaa

SEQ ID NO: 410938 - RNA, 22 nt, Homo sapiens
cccucuuuucugaucugcaguu

SEQ ID NO: 410939 - RNA, 18 nt, Homo sapiens
cccugaaacuacacacca

SEQ ID NO: 410940 - RNA, 16 nt, Homo sapiens
cccugaagucuugcau

SEQ ID NO: 410941 - RNA, 19 nt, Homo sapiens
cccugaccucacugugacc

SEQ ID NO: 410942 - RNA, 20 nt, Homo sapiens
cccugaccucacugugaccu

SEQ ID NO: 410943 - RNA, 17 nt, Homo sapiens
cccugacuucccagcug

SEQ ID NO: 410944 - RNA, 16 nt, Homo sapiens
cccugaggguuuccac

SEQ ID NO: 410945 - RNA, 12 nt, Homo sapiens
cccugauuuggg

SEQ ID NO: 410946 - RNA, 21 nt, Homo sapiens
cccugccaugcucuccaaacc

SEQ ID NO: 410947 - RNA, 18 nt, Homo sapiens
cccugcccccgcuccggc

SEQ ID NO: 410948 - RNA, 17 nt, Homo sapiens
cccugccucacaucucc

SEQ ID NO: 410949 - RNA, 18 nt, Homo sapiens
cccugcucacucuuccac

SEQ ID NO: 410950 - RNA, 11 nt, Homo sapiens
cccugcugcuu

SEQ ID NO: 410951 - RNA, 12 nt, Homo sapiens
cccugcuuagaa

SEQ ID NO: 410952 - RNA, 15 nt, Homo sapiens
cccuggaccagccuc

SEQ ID NO: 410953 - RNA, 14 nt, Homo sapiens
cccuggagcaagac

SEQ ID NO: 410954 - RNA, 20 nt, Homo sapiens
cccuggagcccauccagucu

SEQ ID NO: 410955 - RNA, 14 nt, Homo sapiens
cccuggcuguaaua

SEQ ID NO: 410956 - RNA, 16 nt, Homo sapiens
cccugggcuggacugg

SEQ ID NO: 410957 - RNA, 22 nt, Homo sapiens
cccuggggccuagacucuguaa

SEQ ID NO: 410958 - RNA, 20 nt, Homo sapiens
cccugggggcugugauauua

SEQ ID NO: 410959 - RNA, 13 nt, Homo sapiens
cccuggugucaca

SEQ ID NO: 410960 - RNA, 17 nt, Homo sapiens
cccuguccuaagcacuu

SEQ ID NO: 410961 - RNA, 12 nt, Homo sapiens
cccugucugcuu

SEQ ID NO: 410962 - RNA, 14 nt, Homo sapiens
cccuguucuuugaa

SEQ ID NO: 410963 - RNA, 21 nt, Homo sapiens
cccuguucuuugaaguggcac

SEQ ID NO: 410964 - RNA, 17 nt, Homo sapiens
cccuuaaaacuuccacu

SEQ ID NO: 410965 - RNA, 13 nt, Homo sapiens
cccuuaaggacaa

SEQ ID NO: 410966 - RNA, 22 nt, Homo sapiens
cccuuacuuagcaugcacaaag

SEQ ID NO: 410967 - RNA, 17 nt, Homo sapiens
cccuuagccuugcugua

SEQ ID NO: 410968 - RNA, 17 nt, Homo sapiens
cccuucacauacccucc

SEQ ID NO: 410969 - RNA, 15 nt, Homo sapiens
cccuucagcauccuc

SEQ ID NO: 410970 - RNA, 21 nt, Homo sapiens
cccuucauccuucuggaauaa

SEQ ID NO: 410971 - RNA, 21 nt, Homo sapiens
cccuuccacugccucugccuu

SEQ ID NO: 410972 - RNA, 23 nt, Homo sapiens
cccuuccaggggucaccuugaga

SEQ ID NO: 410973 - RNA, 12 nt, Homo sapiens
cccuuccagugg

SEQ ID NO: 410974 - RNA, 21 nt, Homo sapiens
cccuuccaugucgccucugca

SEQ ID NO: 410975 - RNA, 19 nt, Homo sapiens
cccuuccugaagaagaucc

SEQ ID NO: 410976 - RNA, 21 nt, Homo sapiens
cccuucgacacggaccugcuu

SEQ ID NO: 410977 - RNA, 17 nt, Homo sapiens
cccuugaaccucauuaa

SEQ ID NO: 410978 - RNA, 23 nt, Homo sapiens
cccuugaauuucuagacaguauu

SEQ ID NO: 410979 - RNA, 21 nt, Homo sapiens
cccuugcaaucuucuacuuua

SEQ ID NO: 410980 - RNA, 22 nt, Homo sapiens
cccuugcccaaccaaugcacac

SEQ ID NO: 410981 - RNA, 20 nt, Homo sapiens
cccuuggggcucccuguguc

SEQ ID NO: 410982 - RNA, 14 nt, Homo sapiens
cccuugugucuguu

SEQ ID NO: 410983 - RNA, 17 nt, Homo sapiens
cccuuucagaugucuuc

SEQ ID NO: 410984 - RNA, 12 nt, Homo sapiens
cccuuuuacuuu

SEQ ID NO: 410985 - RNA, 21 nt, Homo sapiens
cccuuuuguaucuuaagccaa

SEQ ID NO: 410986 - RNA, 19 nt, Homo sapiens
ccgaaaaggauaugcagua

SEQ ID NO: 410987 - RNA, 22 nt, Homo sapiens
ccgaaacauacaagacaaaaaa

SEQ ID NO: 410988 - RNA, 20 nt, Homo sapiens
cagaacaagaccccgucuca

SEQ ID NO: 410989 - RNA, 15 nt, Homo sapiens
cagaacacacugaga

SEQ ID NO: 410990 - RNA, 14 nt, Homo sapiens
cagaacacagugcc

SEQ ID NO: 410991 - RNA, 17 nt, Homo sapiens
cagaacauuucucaugu

SEQ ID NO: 410992 - RNA, 18 nt, Homo sapiens
cagaacauuucucaugug

SEQ ID NO: 410993 - RNA, 15 nt, Homo sapiens
cagaacccuggugag

SEQ ID NO: 410994 - RNA, 16 nt, Homo sapiens
cagaacgucucucacc

SEQ ID NO: 410995 - RNA, 15 nt, Homo sapiens
cagaacucagccuua

SEQ ID NO: 410996 - RNA, 19 nt, Homo sapiens
cagaacugcuuuaucccac

SEQ ID NO: 410997 - RNA, 13 nt, Homo sapiens
cagaacuucugaa

SEQ ID NO: 410998 - RNA, 12 nt, Homo sapiens
cagaacuuguaa

SEQ ID NO: 410999 - RNA, 15 nt, Homo sapiens
cagaagcacauauga

SEQ ID NO: 411000 - RNA, 14 nt, Homo sapiens
cagaagcauuucac

SEQ ID NO: 411001 - RNA, 16 nt, Homo sapiens
cagaagggaauugcuc

SEQ ID NO: 411002 - RNA, 23 nt, Homo sapiens
cagaagugcucuuuguggcagug

SEQ ID NO: 411003 - RNA, 13 nt, Homo sapiens
cagaauacaauuc

SEQ ID NO: 411004 - RNA, 17 nt, Homo sapiens
cagaauacaauucaguu

SEQ ID NO: 411005 - RNA, 19 nt, Homo sapiens
cagaauauugcuuugguca

SEQ ID NO: 411006 - RNA, 21 nt, Homo sapiens
cagaauggugggcuccagagu

SEQ ID NO: 411007 - RNA, 20 nt, Homo sapiens
cagaauguauggagaguuac

SEQ ID NO: 411008 - RNA, 15 nt, Homo sapiens
cagacaaaaagaaca

SEQ ID NO: 411009 - RNA, 21 nt, Homo sapiens
cagacaaaguaauuccucuca

SEQ ID NO: 411010 - RNA, 12 nt, Homo sapiens
cagacaaaugga

SEQ ID NO: 411011 - RNA, 22 nt, Homo sapiens
cagacacccagaauguagcauc

SEQ ID NO: 411012 - RNA, 16 nt, Homo sapiens
cagacacuaaguuaua

SEQ ID NO: 411013 - RNA, 23 nt, Homo sapiens
cagacacugaccauccacucuac

SEQ ID NO: 411014 - RNA, 14 nt, Homo sapiens
cagacaugauaugc

SEQ ID NO: 411015 - RNA, 20 nt, Homo sapiens
cagacauucauugucccuga

SEQ ID NO: 411016 - RNA, 13 nt, Homo sapiens
cagaccacauaua

SEQ ID NO: 411017 - RNA, 14 nt, Homo sapiens
cagaccagagcucu

SEQ ID NO: 411018 - RNA, 14 nt, Homo sapiens
cagacccccagugu

SEQ ID NO: 411019 - RNA, 16 nt, Homo sapiens
cagaccuaaugcuccu

SEQ ID NO: 411020 - RNA, 19 nt, Homo sapiens
cagaccuagugcucccuuc

SEQ ID NO: 411021 - RNA, 16 nt, Homo sapiens
cagacucaguuuguca

SEQ ID NO: 411022 - RNA, 19 nt, Homo sapiens
cagacuggcugcacagccc

SEQ ID NO: 411023 - RNA, 21 nt, Homo sapiens
cagacuguuagaaaauggaca

SEQ ID NO: 411024 - RNA, 17 nt, Homo sapiens
cagacuuucuacaccug

SEQ ID NO: 411025 - RNA, 13 nt, Homo sapiens
cagagaaaacaca

SEQ ID NO: 411026 - RNA, 16 nt, Homo sapiens
cagagaaauacuuuca

SEQ ID NO: 411027 - RNA, 15 nt, Homo sapiens
cagagaaauucugug

SEQ ID NO: 411028 - RNA, 13 nt, Homo sapiens
cagagaagucagu

SEQ ID NO: 411029 - RNA, 21 nt, Homo sapiens
cagagaaucucuagugaauuu

SEQ ID NO: 411030 - RNA, 20 nt, Homo sapiens
cagagacaauaaaacauucc

SEQ ID NO: 411031 - RNA, 15 nt, Homo sapiens
cagagacccccgugc

SEQ ID NO: 411032 - RNA, 14 nt, Homo sapiens
cagagacucugaaa

SEQ ID NO: 411033 - RNA, 20 nt, Homo sapiens
cagagacugggaugggaaca

SEQ ID NO: 411034 - RNA, 20 nt, Homo sapiens
cagagagaagcccagacuuc

SEQ ID NO: 411035 - RNA, 16 nt, Homo sapiens
cagagaggacuguuga

SEQ ID NO: 411036 - RNA, 11 nt, Homo sapiens
cagagcacugg

SEQ ID NO: 411037 - RNA, 15 nt, Homo sapiens
cagagcacuguguaa

SEQ ID NO: 411038 - RNA, 21 nt, Homo sapiens
cagagcacuguguaaccagca

SEQ ID NO: 411039 - RNA, 17 nt, Homo sapiens
cagagcagaucagucuu

SEQ ID NO: 411040 - RNA, 11 nt, Homo sapiens
cagagccacag

SEQ ID NO: 411041 - RNA, 22 nt, Homo sapiens
cagagccacccaggccacugac

SEQ ID NO: 411042 - RNA, 22 nt, Homo sapiens
cagagcccugaguuucuuggcu

SEQ ID NO: 411043 - RNA, 21 nt, Homo sapiens
cagagcccuucacugccauga

SEQ ID NO: 411044 - RNA, 21 nt, Homo sapiens
cagagcucagcacagccucac

SEQ ID NO: 411045 - RNA, 20 nt, Homo sapiens
cagagcuccacagaagacac

SEQ ID NO: 411046 - RNA, 21 nt, Homo sapiens
cagagcuggaccaguggugcc

SEQ ID NO: 411047 - RNA, 13 nt, Homo sapiens
cagagcuuuucag

SEQ ID NO: 411048 - RNA, 15 nt, Homo sapiens
cagaggaugcugaag

SEQ ID NO: 411049 - RNA, 17 nt, Homo sapiens
cagaggauguucuggac

SEQ ID NO: 411050 - RNA, 14 nt, Homo sapiens
cagaggcacagccg

SEQ ID NO: 411051 - RNA, 22 nt, Homo sapiens
cagaggccuauaacuuuuggua

SEQ ID NO: 411052 - RNA, 16 nt, Homo sapiens
cagagggaaacacagc

SEQ ID NO: 411053 - RNA, 14 nt, Homo sapiens
cagagggacuguca

SEQ ID NO: 411054 - RNA, 19 nt, Homo sapiens
cagaggggcccuggcugua

SEQ ID NO: 411055 - RNA, 20 nt, Homo sapiens
cagaggggugcgcagagcug

SEQ ID NO: 411056 - RNA, 18 nt, Homo sapiens
cagagguccccugagguc

SEQ ID NO: 411057 - RNA, 20 nt, Homo sapiens
cagagguuguggugagccga

SEQ ID NO: 411058 - RNA, 16 nt, Homo sapiens
cagagucgaugcucaa

SEQ ID NO: 411059 - RNA, 20 nt, Homo sapiens
cagagucucauucuguugcc

SEQ ID NO: 411060 - RNA, 19 nt, Homo sapiens
cagagucugggccucugac

SEQ ID NO: 411061 - RNA, 14 nt, Homo sapiens
cagagugaacacuc

SEQ ID NO: 411062 - RNA, 16 nt, Homo sapiens
cagagugaagcaucaa

SEQ ID NO: 411063 - RNA, 13 nt, Homo sapiens
cagagugccccac

SEQ ID NO: 411064 - RNA, 14 nt, Homo sapiens
cagaguucagggag

SEQ ID NO: 411065 - RNA, 21 nt, Homo sapiens
cagaguucagggaggggcuga

SEQ ID NO: 411066 - RNA, 23 nt, Homo sapiens
cagaguuugauaugggcuuucuc

SEQ ID NO: 411067 - RNA, 16 nt, Homo sapiens
cagauaacaccaaacc

SEQ ID NO: 411068 - RNA, 13 nt, Homo sapiens
cagauacuccucc

SEQ ID NO: 411069 - RNA, 12 nt, Homo sapiens
aacauaaaucag

SEQ ID NO: 411070 - RNA, 18 nt, Homo sapiens
aacauaagauauuguaca

SEQ ID NO: 411071 - RNA, 16 nt, Homo sapiens
aacauacccaucugca

SEQ ID NO: 411072 - RNA, 12 nt, Homo sapiens
aacauagugucu

SEQ ID NO: 411073 - RNA, 14 nt, Homo sapiens
aacaucagcuugac

SEQ ID NO: 411074 - RNA, 17 nt, Homo sapiens
aacaucaguucaugccu

SEQ ID NO: 411075 - RNA, 18 nt, Homo sapiens
aacaucaguucaugccug

SEQ ID NO: 411076 - RNA, 22 nt, Homo sapiens
aacaucaucaggcuuggaauga

SEQ ID NO: 411077 - RNA, 17 nt, Homo sapiens
aacaucuuuuacauucu

SEQ ID NO: 411078 - RNA, 20 nt, Homo sapiens
aacaugaaaaacacggcagc

SEQ ID NO: 411079 - RNA, 17 nt, Homo sapiens
aacaugaaaacauugau

SEQ ID NO: 411080 - RNA, 15 nt, Homo sapiens
aacaugaaaugcccu

SEQ ID NO: 411081 - RNA, 18 nt, Homo sapiens
aacaugaagaaugcauuc

SEQ ID NO: 411082 - RNA, 19 nt, Homo sapiens
aacaugauuguuuacagcu

SEQ ID NO: 411083 - RNA, 16 nt, Homo sapiens
aacauggagaacuugc

SEQ ID NO: 411084 - RNA, 12 nt, Homo sapiens
aacauggccuuu

SEQ ID NO: 411085 - RNA, 11 nt, Homo sapiens
aacauguaauu

SEQ ID NO: 411086 - RNA, 21 nt, Homo sapiens
aacauguuuuugauauuugau

SEQ ID NO: 411087 - RNA, 21 nt, Homo sapiens
aacauuagaagaaaacauaua

SEQ ID NO: 411088 - RNA, 14 nt, Homo sapiens
aacauuaugccuua

SEQ ID NO: 411089 - RNA, 13 nt, Homo sapiens
aacauuauucuca

SEQ ID NO: 411090 - RNA, 14 nt, Homo sapiens
aacauuauucucaa

SEQ ID NO: 411091 - RNA, 21 nt, Homo sapiens
aacauuccguuuacauuuuag

SEQ ID NO: 411092 - RNA, 13 nt, Homo sapiens
aacauugcugauu

SEQ ID NO: 411093 - RNA, 20 nt, Homo sapiens
aacauuucauuaaccaaaga

SEQ ID NO: 411094 - RNA, 20 nt, Homo sapiens
aacauuucucuucagugugu

SEQ ID NO: 411095 - RNA, 13 nt, Homo sapiens
aacauuucugcca

SEQ ID NO: 411096 - RNA, 20 nt, Homo sapiens
aacauuuuguuauugggcaa

SEQ ID NO: 411097 - RNA, 19 nt, Homo sapiens
aaccaaagaaaguggguca

SEQ ID NO: 411098 - RNA, 14 nt, Homo sapiens
aaccaacacuaaca

SEQ ID NO: 411099 - RNA, 17 nt, Homo sapiens
aaccaagaguauuccau

SEQ ID NO: 411100 - RNA, 17 nt, Homo sapiens
aaccaagcuguacccuu

SEQ ID NO: 411101 - RNA, 14 nt, Homo sapiens
aaccaagcuugucu

SEQ ID NO: 411102 - RNA, 15 nt, Homo sapiens
aaccacaauauguau

SEQ ID NO: 411103 - RNA, 17 nt, Homo sapiens
aaccaccaccaaccacu

SEQ ID NO: 411104 - RNA, 14 nt, Homo sapiens
aaccacuaaugcuu

SEQ ID NO: 411105 - RNA, 13 nt, Homo sapiens
aaccacucaaauu

SEQ ID NO: 411106 - RNA, 17 nt, Homo sapiens
aaccagagccacaggcc

SEQ ID NO: 411107 - RNA, 21 nt, Homo sapiens
aaccagcucuuuggugccagc

SEQ ID NO: 411108 - RNA, 15 nt, Homo sapiens
aaccaggaacaugua

SEQ ID NO: 411109 - RNA, 16 nt, Homo sapiens
aaccaggaaccuccuc

SEQ ID NO: 411110 - RNA, 16 nt, Homo sapiens
aaccaggacucugccc

SEQ ID NO: 411111 - RNA, 19 nt, Homo sapiens
aaccagguuuagacaguau

SEQ ID NO: 411112 - RNA, 13 nt, Homo sapiens
aaccagucugaag

SEQ ID NO: 411113 - RNA, 20 nt, Homo sapiens
aaccagugucugaaccaccc

SEQ ID NO: 411114 - RNA, 14 nt, Homo sapiens
aaccauaacacuug

SEQ ID NO: 411115 - RNA, 16 nt, Homo sapiens
aaccauaacacuugau

SEQ ID NO: 411116 - RNA, 13 nt, Homo sapiens
aaccauccaucug

SEQ ID NO: 411117 - RNA, 13 nt, Homo sapiens
acugagauuacag

SEQ ID NO: 411118 - RNA, 14 nt, Homo sapiens
acugaggaccagcc

SEQ ID NO: 411119 - RNA, 18 nt, Homo sapiens
acugagggccuggucacc

SEQ ID NO: 411120 - RNA, 23 nt, Homo sapiens
acugaguguucaaacuacuguac

SEQ ID NO: 411121 - RNA, 18 nt, Homo sapiens
acugaguuugaacacaga

SEQ ID NO: 411122 - RNA, 14 nt, Homo sapiens
acugauccuguuuc

SEQ ID NO: 411123 - RNA, 16 nt, Homo sapiens
acugauuaacucaguc

SEQ ID NO: 411124 - RNA, 20 nt, Homo sapiens
acugcaaauacuuccaaaga

SEQ ID NO: 411125 - RNA, 12 nt, Homo sapiens
acugcacaaaag

SEQ ID NO: 411126 - RNA, 16 nt, Homo sapiens
acugcacaguagagca

SEQ ID NO: 411127 - RNA, 16 nt, Homo sapiens
acugcagccucugccu

SEQ ID NO: 411128 - RNA, 18 nt, Homo sapiens
acugcagguuggacccca

SEQ ID NO: 411129 - RNA, 14 nt, Homo sapiens
acugcagucagcau

SEQ ID NO: 411130 - RNA, 16 nt, Homo sapiens
acugcccaauaugcag

SEQ ID NO: 411131 - RNA, 13 nt, Homo sapiens
acugccucugcca

SEQ ID NO: 411132 - RNA, 22 nt, Homo sapiens
acugccuggguuccaauccugg

SEQ ID NO: 411133 - RNA, 20 nt, Homo sapiens
acugccugugaaguggaugg

SEQ ID NO: 411134 - RNA, 17 nt, Homo sapiens
acugccuucaguaucaa

SEQ ID NO: 411135 - RNA, 19 nt, Homo sapiens
acugcgccgaccccgccac

SEQ ID NO: 411136 - RNA, 23 nt, Homo sapiens
acugcguaggagagaacagggau

SEQ ID NO: 411137 - RNA, 21 nt, Homo sapiens
acugcuuugagaaaucucauc

SEQ ID NO: 411138 - RNA, 15 nt, Homo sapiens
acuggaaaacauaga

SEQ ID NO: 411139 - RNA, 23 nt, Homo sapiens
acuggaccaaaaaaauaaagcau

SEQ ID NO: 411140 - RNA, 22 nt, Homo sapiens
acuggauuggccaaacaucaga

SEQ ID NO: 411141 - RNA, 13 nt, Homo sapiens
acuggcagcaucu

SEQ ID NO: 411142 - RNA, 16 nt, Homo sapiens
acuggcagcaucuuca

SEQ ID NO: 411143 - RNA, 14 nt, Homo sapiens
acuggcagcuccuc

SEQ ID NO: 411144 - RNA, 18 nt, Homo sapiens
acuggcaucugacacaaa

SEQ ID NO: 411145 - RNA, 20 nt, Homo sapiens
acuggcauuuuuagcuccuu

SEQ ID NO: 411146 - RNA, 23 nt, Homo sapiens
acuggccagagagggcccagcug

SEQ ID NO: 411147 - RNA, 17 nt, Homo sapiens
acuggcuucucuugagu

SEQ ID NO: 411148 - RNA, 19 nt, Homo sapiens
acuggcuucucuugaguca

SEQ ID NO: 411149 - RNA, 20 nt, Homo sapiens
acuggcuuugucccacagcu

SEQ ID NO: 411150 - RNA, 21 nt, Homo sapiens
acugggagagcugguggugca

SEQ ID NO: 411151 - RNA, 22 nt, Homo sapiens
acugguauguguggaugaugcu

SEQ ID NO: 411152 - RNA, 23 nt, Homo sapiens
acugguauguguggaugaugcug

SEQ ID NO: 411153 - RNA, 13 nt, Homo sapiens
acuguaaacauuc

SEQ ID NO: 411154 - RNA, 15 nt, Homo sapiens
acuguaaacauucau

SEQ ID NO: 411155 - RNA, 21 nt, Homo sapiens
acuguaauaucuuuaaaugau

SEQ ID NO: 411156 - RNA, 16 nt, Homo sapiens
acuguagcugaugaaa

SEQ ID NO: 411157 - RNA, 21 nt, Homo sapiens
acuguauuggcucugugaaaa

SEQ ID NO: 411158 - RNA, 23 nt, Homo sapiens
acugucaaaaaguuugguucugu

SEQ ID NO: 411159 - RNA, 20 nt, Homo sapiens
acugucaagucaugauggag

SEQ ID NO: 411160 - RNA, 18 nt, Homo sapiens
acugucacuguuucucug

SEQ ID NO: 411161 - RNA, 13 nt, Homo sapiens
acugucacuuugc

SEQ ID NO: 411162 - RNA, 18 nt, Homo sapiens
acugucagcugagcuuga

SEQ ID NO: 411163 - RNA, 13 nt, Homo sapiens
acugucauguggc

SEQ ID NO: 411164 - RNA, 14 nt, Homo sapiens
acugucccacaaaa

SEQ ID NO: 411165 - RNA, 16 nt, Homo sapiens
acugucccuugccuca

SEQ ID NO: 411166 - RNA, 17 nt, Homo sapiens
acugucucguacuagaa

SEQ ID NO: 411167 - RNA, 17 nt, Homo sapiens
acugugacauuccacag

SEQ ID NO: 411168 - RNA, 14 nt, Homo sapiens
acugugcauuugag

SEQ ID NO: 411169 - RNA, 15 nt, Homo sapiens
acugugcauuugaga

SEQ ID NO: 411170 - RNA, 15 nt, Homo sapiens
acugugccuuugagu

SEQ ID NO: 411171 - RNA, 13 nt, Homo sapiens
acugugcuccuaa

SEQ ID NO: 411172 - RNA, 14 nt, Homo sapiens
acugugcugauuca

SEQ ID NO: 411173 - RNA, 17 nt, Homo sapiens
acugugguccaucucca

SEQ ID NO: 411174 - RNA, 13 nt, Homo sapiens
acugugucugucc

SEQ ID NO: 411175 - RNA, 14 nt, Homo sapiens
acugugucuguccc

SEQ ID NO: 411176 - RNA, 19 nt, Homo sapiens
acuguguggacugugaugc

SEQ ID NO: 411177 - RNA, 20 nt, Homo sapiens
acuguguuaguaaacugugc

SEQ ID NO: 411178 - RNA, 20 nt, Homo sapiens
acuguuaauaguacuauuaa

SEQ ID NO: 411179 - RNA, 20 nt, Homo sapiens
acuguuagucauuugcugag

SEQ ID NO: 411180 - RNA, 15 nt, Homo sapiens
acuuaacaacugacu

SEQ ID NO: 411181 - RNA, 13 nt, Homo sapiens
acuuaacauugca

SEQ ID NO: 411182 - RNA, 17 nt, Homo sapiens
acuuaacugugugaaga

SEQ ID NO: 411183 - RNA, 19 nt, Homo sapiens
acuuaagcacacuugacau

SEQ ID NO: 411184 - RNA, 17 nt, Homo sapiens
acuuaauacagauguau

SEQ ID NO: 411185 - RNA, 21 nt, Homo sapiens
acuuaauuaccuaagagccac

SEQ ID NO: 411186 - RNA, 22 nt, Homo sapiens
acuuacuguguaaauaaacuuu

SEQ ID NO: 411187 - RNA, 22 nt, Homo sapiens
acuuacuuagagaugcuacugu

SEQ ID NO: 411188 - RNA, 17 nt, Homo sapiens
acuuagagaugcuacug

SEQ ID NO: 411189 - RNA, 22 nt, Homo sapiens
acuuagagcacuagaagcacag

SEQ ID NO: 411190 - RNA, 17 nt, Homo sapiens
acuuagaucaucaguca

SEQ ID NO: 411191 - RNA, 15 nt, Homo sapiens
acuuagcaugcacaa

SEQ ID NO: 411192 - RNA, 23 nt, Homo sapiens
acuuaguccugauguacuuuaaa

SEQ ID NO: 411193 - RNA, 16 nt, Homo sapiens
acuuaguugcguuaca

SEQ ID NO: 411194 - RNA, 15 nt, Homo sapiens
acuuaucaaaucauu

SEQ ID NO: 411195 - RNA, 20 nt, Homo sapiens
acuuaucaaaucauucaaaa

SEQ ID NO: 411196 - RNA, 16 nt, Homo sapiens
acuuaugcacauuugu

SEQ ID NO: 411197 - RNA, 20 nt, Homo sapiens
acuuaugggcccagccagcc

SEQ ID NO: 411198 - RNA, 15 nt, Homo sapiens
acuuauuucauaaac

SEQ ID NO: 411199 - RNA, 13 nt, Homo sapiens
acuuauuuuacac

SEQ ID NO: 411200 - RNA, 22 nt, Homo sapiens
acuucaaaagccauaacuugaa

SEQ ID NO: 411201 - RNA, 15 nt, Homo sapiens
acuucaaagcugaau

SEQ ID NO: 411202 - RNA, 15 nt, Homo sapiens
acuucacacagacaa

SEQ ID NO: 411203 - RNA, 13 nt, Homo sapiens
acuucacacagca

SEQ ID NO: 411204 - RNA, 19 nt, Homo sapiens
acuucagcaguaccuauaa

SEQ ID NO: 411205 - RNA, 16 nt, Homo sapiens
acuucagcugccugaa

SEQ ID NO: 411206 - RNA, 12 nt, Homo sapiens
acuucagggauc

SEQ ID NO: 411207 - RNA, 15 nt, Homo sapiens
acuucagucuuggag

SEQ ID NO: 411208 - RNA, 13 nt, Homo sapiens
acuuccauuugcu

SEQ ID NO: 411209 - RNA, 14 nt, Homo sapiens
acuucccagugaau

SEQ ID NO: 411210 - RNA, 20 nt, Homo sapiens
acuucccucaggccuaugca

SEQ ID NO: 411211 - RNA, 20 nt, Homo sapiens
acuuccuagagcaucugucc

SEQ ID NO: 411212 - RNA, 18 nt, Homo sapiens
acuucgacucaggaucca

SEQ ID NO: 411213 - RNA, 17 nt, Homo sapiens
acuucuaauaucauuca

SEQ ID NO: 411214 - RNA, 14 nt, Homo sapiens
acuucuacauccaa

SEQ ID NO: 411215 - RNA, 18 nt, Homo sapiens
acuucuacauccaaugua

SEQ ID NO: 411216 - RNA, 13 nt, Homo sapiens
acuucuaguguau

SEQ ID NO: 411217 - RNA, 16 nt, Homo sapiens
acuucuggcagggaag

SEQ ID NO: 411218 - RNA, 19 nt, Homo sapiens
acuucuggcuucaugcaau

SEQ ID NO: 411219 - RNA, 22 nt, Homo sapiens
acuucugucuguugaggcauca

SEQ ID NO: 411220 - RNA, 23 nt, Homo sapiens
acuucuuaaaaguugugauucca

SEQ ID NO: 411221 - RNA, 19 nt, Homo sapiens
acuucuuuauucacaguau

SEQ ID NO: 411222 - RNA, 18 nt, Homo sapiens
acuugaauucaaagcaug

SEQ ID NO: 411223 - RNA, 17 nt, Homo sapiens
acuugacaucaacugca

SEQ ID NO: 411224 - RNA, 13 nt, Homo sapiens
acuugacauuccu

SEQ ID NO: 411225 - RNA, 13 nt, Homo sapiens
acuugagcaccgu

SEQ ID NO: 411226 - RNA, 18 nt, Homo sapiens
acuugaggaucauaugaa

SEQ ID NO: 411227 - RNA, 23 nt, Homo sapiens
acuugaggccagugagcugugau

SEQ ID NO: 411228 - RNA, 15 nt, Homo sapiens
acuugaugccagugg

SEQ ID NO: 411229 - RNA, 18 nt, Homo sapiens
acuugcaagucccaugau

SEQ ID NO: 411230 - RNA, 15 nt, Homo sapiens
acuugcacugugcuu

SEQ ID NO: 411231 - RNA, 16 nt, Homo sapiens
acuugcuuuaugccuu

SEQ ID NO: 411232 - RNA, 21 nt, Homo sapiens
acuuggaauuuguaaccucag

SEQ ID NO: 411233 - RNA, 20 nt, Homo sapiens
acuuggauaggagcuuccag

SEQ ID NO: 411234 - RNA, 20 nt, Homo sapiens
acuuggcaguagaaauccag

SEQ ID NO: 411235 - RNA, 22 nt, Homo sapiens
acuugggggaggaggaacaaau

SEQ ID NO: 411236 - RNA, 12 nt, Homo sapiens
acuuggugcugc

SEQ ID NO: 411237 - RNA, 16 nt, Homo sapiens
acuugguguacugggu

SEQ ID NO: 411238 - RNA, 22 nt, Homo sapiens
acuugguuuguuauaucaggga

SEQ ID NO: 411239 - RNA, 18 nt, Homo sapiens
acuugguuuuuggcucuu

SEQ ID NO: 411240 - RNA, 17 nt, Homo sapiens
acuuguagggaugccuu

SEQ ID NO: 411241 - RNA, 23 nt, Homo sapiens
acuugucauuuuuguuucugaaa

SEQ ID NO: 411242 - RNA, 22 nt, Homo sapiens
acuugugauuuuuauaauacaa

SEQ ID NO: 411243 - RNA, 20 nt, Homo sapiens
acuugugccucuugggagac

SEQ ID NO: 411244 - RNA, 16 nt, Homo sapiens
acuugugucccaugau

SEQ ID NO: 411245 - RNA, 20 nt, Homo sapiens
acuuguguucaaucugugaa

SEQ ID NO: 411246 - RNA, 18 nt, Homo sapiens
acuuguucuguacuugua

SEQ ID NO: 411247 - RNA, 19 nt, Homo sapiens
acuuuaaucccacuugccc

SEQ ID NO: 411248 - RNA, 21 nt, Homo sapiens
acuuuaguguauuuucuguca

SEQ ID NO: 411249 - RNA, 18 nt, Homo sapiens
aaguaccuguagugagaa

SEQ ID NO: 411250 - RNA, 15 nt, Homo sapiens
aaguacuacagcaaa

SEQ ID NO: 411251 - RNA, 22 nt, Homo sapiens
aaguagacuucauuuuuccuaa

SEQ ID NO: 411252 - RNA, 23 nt, Homo sapiens
aaguagacuucauuuuuccuaac

SEQ ID NO: 411253 - RNA, 22 nt, Homo sapiens
aaguagggguugugggugacca

SEQ ID NO: 411254 - RNA, 21 nt, Homo sapiens
aaguauacauuuuugcauugc

SEQ ID NO: 411255 - RNA, 18 nt, Homo sapiens
aaguauguaaacaggaga

SEQ ID NO: 411256 - RNA, 14 nt, Homo sapiens
aaguauuuugccac

SEQ ID NO: 411257 - RNA, 22 nt, Homo sapiens
aagucaaauauguagauugccu

SEQ ID NO: 411258 - RNA, 15 nt, Homo sapiens
aagucaccuccuuaa

SEQ ID NO: 411259 - RNA, 22 nt, Homo sapiens
aagucagaucuggucuaguuaa

SEQ ID NO: 411260 - RNA, 19 nt, Homo sapiens
aagucaggccucucuggga

SEQ ID NO: 411261 - RNA, 22 nt, Homo sapiens
aagucaucucauuccacuguug

SEQ ID NO: 411262 - RNA, 17 nt, Homo sapiens
aagucaugugcauuucc

SEQ ID NO: 411263 - RNA, 19 nt, Homo sapiens
aagucauuguccucugagc

SEQ ID NO: 411264 - RNA, 21 nt, Homo sapiens
aaguccagugugacuuuaucu

SEQ ID NO: 411265 - RNA, 13 nt, Homo sapiens
aagucuaugcuua

SEQ ID NO: 411266 - RNA, 19 nt, Homo sapiens
aagucucauggcaguccca

SEQ ID NO: 411267 - RNA, 15 nt, Homo sapiens
aagucuccuguauca

SEQ ID NO: 411268 - RNA, 19 nt, Homo sapiens
aagucugauauugcaguaa

SEQ ID NO: 411269 - RNA, 18 nt, Homo sapiens
aagucugggauguagaac

SEQ ID NO: 411270 - RNA, 17 nt, Homo sapiens
aagucuuauuuccucaa

SEQ ID NO: 411271 - RNA, 15 nt, Homo sapiens
aagucuucaagggcu

SEQ ID NO: 411272 - RNA, 23 nt, Homo sapiens
aagugaaaaugccacauuuugcu

SEQ ID NO: 411273 - RNA, 23 nt, Homo sapiens
aagugacaggacuuucauuguuc

SEQ ID NO: 411274 - RNA, 19 nt, Homo sapiens
aagugacccagcucuucuc

SEQ ID NO: 411275 - RNA, 14 nt, Homo sapiens
aagugacucucaca

SEQ ID NO: 411276 - RNA, 16 nt, Homo sapiens
aagugagagaggggga

SEQ ID NO: 411277 - RNA, 14 nt, Homo sapiens
aagugaugugauuu

SEQ ID NO: 411278 - RNA, 14 nt, Homo sapiens
aagugauguuauag

SEQ ID NO: 411279 - RNA, 22 nt, Homo sapiens
aagugcauuuuuaucugugagu

SEQ ID NO: 411280 - RNA, 23 nt, Homo sapiens
aagugcauuuuuaucugugaguu

SEQ ID NO: 411281 - RNA, 15 nt, Homo sapiens
aagugccaugcucag

SEQ ID NO: 411282 - RNA, 13 nt, Homo sapiens
aaguggaguccac

SEQ ID NO: 411283 - RNA, 19 nt, Homo sapiens
aaguggaguccacccucau

SEQ ID NO: 411284 - RNA, 13 nt, Homo sapiens
aaguggcaccuaa

SEQ ID NO: 411285 - RNA, 19 nt, Homo sapiens
aaguggggaaguguuccag

SEQ ID NO: 411286 - RNA, 13 nt, Homo sapiens
aagugggugaaug

SEQ ID NO: 411287 - RNA, 12 nt, Homo sapiens
aaguguacagaa

SEQ ID NO: 411288 - RNA, 12 nt, Homo sapiens
aaguguacagua

SEQ ID NO: 411289 - RNA, 11 nt, Homo sapiens
aagugugagua

SEQ ID NO: 411290 - RNA, 12 nt, Homo sapiens
aagugugcacag

SEQ ID NO: 411291 - RNA, 13 nt, Homo sapiens
aagugugugcaug

SEQ ID NO: 411292 - RNA, 11 nt, Homo sapiens
aaguguuccag

SEQ ID NO: 411293 - RNA, 20 nt, Homo sapiens
aaguguuuucucagaacagc

SEQ ID NO: 411294 - RNA, 15 nt, Homo sapiens
aaguuaaagugaaua

SEQ ID NO: 411295 - RNA, 15 nt, Homo sapiens
aaguuaacuuccaau

SEQ ID NO: 411296 - RNA, 20 nt, Homo sapiens
aaguuacuauccuggcuuug

SEQ ID NO: 411297 - RNA, 13 nt, Homo sapiens
aaguuagcauuuc

SEQ ID NO: 411298 - RNA, 20 nt, Homo sapiens
aaguuauaaccaacuuuucu

SEQ ID NO: 411299 - RNA, 16 nt, Homo sapiens
aaguuauuuacuuuua

SEQ ID NO: 411300 - RNA, 22 nt, Homo sapiens
aaguucccuacuuccugugacu

SEQ ID NO: 411301 - RNA, 22 nt, Homo sapiens
aaguucgaagcuccgugaguga

SEQ ID NO: 411302 - RNA, 15 nt, Homo sapiens
aaguucuaaguucau

SEQ ID NO: 411303 - RNA, 20 nt, Homo sapiens
aaguucuggcaagauugaag

SEQ ID NO: 411304 - RNA, 23 nt, Homo sapiens
aaguucuggcaagauugaagucu

SEQ ID NO: 411305 - RNA, 16 nt, Homo sapiens
aaguucuuaggcacca

SEQ ID NO: 411306 - RNA, 14 nt, Homo sapiens
aaguucuucaccuc

SEQ ID NO: 411307 - RNA, 15 nt, Homo sapiens
aaguugauucugucc

SEQ ID NO: 411308 - RNA, 16 nt, Homo sapiens
aaguugauucuguccc

SEQ ID NO: 411309 - RNA, 21 nt, Homo sapiens
aaguugugcaugcaaccagau

SEQ ID NO: 411310 - RNA, 22 nt, Homo sapiens
aaguuuaaauaccaguacuuga

SEQ ID NO: 411311 - RNA, 15 nt, Homo sapiens
aaguuucaaugugau

SEQ ID NO: 411312 - RNA, 18 nt, Homo sapiens
aaguuucaggauacaugu

SEQ ID NO: 411313 - RNA, 17 nt, Homo sapiens
aaguuucaucagucaau

SEQ ID NO: 411314 - RNA, 21 nt, Homo sapiens
aaguuuuauaaaagacaugaa

SEQ ID NO: 411315 - RNA, 23 nt, Homo sapiens
aaguuuuaugagaaaugccagug

SEQ ID NO: 411316 - RNA, 22 nt, Homo sapiens
aaguuuucaccuaucuggaaaa

SEQ ID NO: 411317 - RNA, 18 nt, Homo sapiens
aaguuuuccaguauugaa

SEQ ID NO: 411318 - RNA, 15 nt, Homo sapiens
aauaaaaaacaagaa

SEQ ID NO: 411319 - RNA, 14 nt, Homo sapiens
aagaguaguaauag

SEQ ID NO: 411320 - RNA, 18 nt, Homo sapiens
aagagucauauugcccag

SEQ ID NO: 411321 - RNA, 14 nt, Homo sapiens
aagagucucuauua

SEQ ID NO: 411322 - RNA, 17 nt, Homo sapiens
aagagugggcuuuccag

SEQ ID NO: 411323 - RNA, 18 nt, Homo sapiens
aagagugguggcagcuca

SEQ ID NO: 411324 - RNA, 16 nt, Homo sapiens
aagaguuaauagcuau

SEQ ID NO: 411325 - RNA, 14 nt, Homo sapiens
aagaguucuggaaa

SEQ ID NO: 411326 - RNA, 14 nt, Homo sapiens
aagaguuuucuucc

SEQ ID NO: 411327 - RNA, 15 nt, Homo sapiens
aagauaaaacuaauu

SEQ ID NO: 411328 - RNA, 13 nt, Homo sapiens
aagauaaauccaa

SEQ ID NO: 411329 - RNA, 13 nt, Homo sapiens
aagauacacuccu

SEQ ID NO: 411330 - RNA, 19 nt, Homo sapiens
aagauagcaucccaucuca

SEQ ID NO: 411331 - RNA, 14 nt, Homo sapiens
aagauaguaacaau

SEQ ID NO: 411332 - RNA, 17 nt, Homo sapiens
aagauaucagagcucuu

SEQ ID NO: 411333 - RNA, 17 nt, Homo sapiens
aagauaucuaugacugu

SEQ ID NO: 411334 - RNA, 18 nt, Homo sapiens
aagauaucuaugacugug

SEQ ID NO: 411335 - RNA, 18 nt, Homo sapiens
aagauauuauucaccaug

SEQ ID NO: 411336 - RNA, 22 nt, Homo sapiens
aagaucaaaauaaaaagugaca

SEQ ID NO: 411337 - RNA, 16 nt, Homo sapiens
aagaucaaacuuccau

SEQ ID NO: 411338 - RNA, 13 nt, Homo sapiens
aagaucaagcucc

SEQ ID NO: 411339 - RNA, 20 nt, Homo sapiens
aagaucaagcuccaucuuau

SEQ ID NO: 411340 - RNA, 13 nt, Homo sapiens
aagaucacaaaua

SEQ ID NO: 411341 - RNA, 18 nt, Homo sapiens
aagaugaaauugccaaaa

SEQ ID NO: 411342 - RNA, 12 nt, Homo sapiens
aagaugcuccug

SEQ ID NO: 411343 - RNA, 15 nt, Homo sapiens
aagaugucaaauauc

SEQ ID NO: 411344 - RNA, 21 nt, Homo sapiens
aagaugucccccaggggccca

SEQ ID NO: 411345 - RNA, 15 nt, Homo sapiens
aagaugugucuucaa

SEQ ID NO: 411346 - RNA, 16 nt, Homo sapiens
aagauguuguuuuagg

SEQ ID NO: 411347 - RNA, 21 nt, Homo sapiens
aagauuauccuguuacugaau

SEQ ID NO: 411348 - RNA, 22 nt, Homo sapiens
aagauucacuaaagcagcacau

SEQ ID NO: 411349 - RNA, 20 nt, Homo sapiens
aagauucauauuuacuucuu

SEQ ID NO: 411350 - RNA, 23 nt, Homo sapiens
aagauucuuuaaacuacugaacu

SEQ ID NO: 411351 - RNA, 13 nt, Homo sapiens
aagauugauacuu

SEQ ID NO: 411352 - RNA, 18 nt, Homo sapiens
aagauuguccagugcaac

SEQ ID NO: 411353 - RNA, 22 nt, Homo sapiens
aagauuguccagugcaaccaca

SEQ ID NO: 411354 - RNA, 22 nt, Homo sapiens
aagauuuagaaaaaaguuuaca

SEQ ID NO: 411355 - RNA, 21 nt, Homo sapiens
aagauuuagcacccuucugcu

SEQ ID NO: 411356 - RNA, 21 nt, Homo sapiens
aagcaaaaaaugaaugucuaa

SEQ ID NO: 411357 - RNA, 13 nt, Homo sapiens
aagcaaaacugca

SEQ ID NO: 411358 - RNA, 15 nt, Homo sapiens
aagcaaaccuucuca

SEQ ID NO: 411359 - RNA, 19 nt, Homo sapiens
aagcaaauauguuugcauu

SEQ ID NO: 411360 - RNA, 18 nt, Homo sapiens
aagcaagacguccuggaa

SEQ ID NO: 411361 - RNA, 13 nt, Homo sapiens
aagcaaggccagc

SEQ ID NO: 411362 - RNA, 18 nt, Homo sapiens
aagcaaggcuuuaaauga

SEQ ID NO: 411363 - RNA, 20 nt, Homo sapiens
aagcaaguagcuuuccacau

SEQ ID NO: 411364 - RNA, 21 nt, Homo sapiens
aagcaauuacaauacaucuaa

SEQ ID NO: 411365 - RNA, 18 nt, Homo sapiens
aagcaccuaaaugaugcc

SEQ ID NO: 411366 - RNA, 15 nt, Homo sapiens
aagcacuagaucucc

SEQ ID NO: 411367 - RNA, 23 nt, Homo sapiens
aagcacuguuggagcuacugcaa

SEQ ID NO: 411368 - RNA, 16 nt, Homo sapiens
aagcagaaucuuugca

SEQ ID NO: 411369 - RNA, 17 nt, Homo sapiens
aagcagaucauuuccca

SEQ ID NO: 411370 - RNA, 23 nt, Homo sapiens
aagcagcacauagcacugggaac

SEQ ID NO: 411371 - RNA, 11 nt, Homo sapiens
aagcagggaaa

SEQ ID NO: 411372 - RNA, 19 nt, Homo sapiens
aagcagucuugcucuguua

SEQ ID NO: 411373 - RNA, 13 nt, Homo sapiens
aagcaucagagau

SEQ ID NO: 411374 - RNA, 14 nt, Homo sapiens
aagcaucccuguga

SEQ ID NO: 411375 - RNA, 16 nt, Homo sapiens
aagcaucccugugagc

SEQ ID NO: 411376 - RNA, 24 nt, Homo sapiens
aagcaucucagccuaccaugagaa

SEQ ID NO: 411377 - RNA, 19 nt, Homo sapiens
aagcaugucucugcuucca

SEQ ID NO: 411378 - RNA, 19 nt, Homo sapiens
aagcauucugagcugggcu

SEQ ID NO: 411379 - RNA, 16 nt, Homo sapiens
aagcauucugugcaua

SEQ ID NO: 411380 - RNA, 17 nt, Homo sapiens
aagccaaaaacaaacga

SEQ ID NO: 411381 - RNA, 19 nt, Homo sapiens
aagccagguccgaggccaa

SEQ ID NO: 411382 - RNA, 17 nt, Homo sapiens
aagccauaaaccaauaa

SEQ ID NO: 411383 - RNA, 21 nt, Homo sapiens
aagccauuugcacucuggaac

SEQ ID NO: 411384 - RNA, 14 nt, Homo sapiens
aagcccacccuggg

SEQ ID NO: 411385 - RNA, 21 nt, Homo sapiens
aagccccgcauaugugaguga

SEQ ID NO: 411386 - RNA, 13 nt, Homo sapiens
aagcccuggcaac

SEQ ID NO: 411387 - RNA, 22 nt, Homo sapiens
aagccucccuccucguccccug

SEQ ID NO: 411388 - RNA, 18 nt, Homo sapiens
aagccugggcagaaaugu

SEQ ID NO: 411389 - RNA, 17 nt, Homo sapiens
aagccuuuuccauaaag

SEQ ID NO: 411390 - RNA, 14 nt, Homo sapiens
aagcgaacaucuuc

SEQ ID NO: 411391 - RNA, 23 nt, Homo sapiens
aagcgcuauuucaggcacaucau

SEQ ID NO: 411392 - RNA, 20 nt, Homo sapiens
aagcuaaaauuagaugaacu

SEQ ID NO: 411393 - RNA, 22 nt, Homo sapiens
aagcuaaauccuuuacuguuag

SEQ ID NO: 411394 - RNA, 17 nt, Homo sapiens
aagcucagggugcuccc

SEQ ID NO: 411395 - RNA, 17 nt, Homo sapiens
aagcuccuucaguuuga

SEQ ID NO: 411396 - RNA, 12 nt, Homo sapiens
aagcucuaguuc

SEQ ID NO: 411397 - RNA, 19 nt, Homo sapiens
aagcucuaguucuuaacaa

SEQ ID NO: 411398 - RNA, 15 nt, Homo sapiens
aagcucuaucugcaa

SEQ ID NO: 411399 - RNA, 16 nt, Homo sapiens
aagcucuuguguauac

SEQ ID NO: 411400 - RNA, 14 nt, Homo sapiens
aagcugauuucccu

SEQ ID NO: 411401 - RNA, 19 nt, Homo sapiens
aagcugcagggaauuuuca

SEQ ID NO: 411402 - RNA, 18 nt, Homo sapiens
aagcugcugaaugcauuc

SEQ ID NO: 411403 - RNA, 19 nt, Homo sapiens
aagcugcugaaugcauuca

SEQ ID NO: 411404 - RNA, 14 nt, Homo sapiens
aagcugcuuuagaa

SEQ ID NO: 411405 - RNA, 17 nt, Homo sapiens
aagcuggagugcugcuu

SEQ ID NO: 411406 - RNA, 17 nt, Homo sapiens
aagcuggcaggagacac

SEQ ID NO: 411407 - RNA, 22 nt, Homo sapiens
aagcugggacucauucacauuu

SEQ ID NO: 411408 - RNA, 16 nt, Homo sapiens
aagcugggagaaccaa

SEQ ID NO: 411409 - RNA, 19 nt, Homo sapiens
aagcugguuaaaguggaug

SEQ ID NO: 411410 - RNA, 21 nt, Homo sapiens
aagcuguacucagagcagagc

SEQ ID NO: 411411 - RNA, 21 nt, Homo sapiens
aagcugucccucacuguugaa

SEQ ID NO: 411412 - RNA, 15 nt, Homo sapiens
aagcuuauuaaugcu

SEQ ID NO: 411413 - RNA, 19 nt, Homo sapiens
aagcuuauuuagcacauuu

SEQ ID NO: 411414 - RNA, 22 nt, Homo sapiens
aagcuuccauuccaagccugac

SEQ ID NO: 411415 - RNA, 21 nt, Homo sapiens
aagcuuggugcuaaaccacaa

SEQ ID NO: 411416 - RNA, 22 nt, Homo sapiens
aagcuuguauuaucagugaaua

SEQ ID NO: 411417 - RNA, 14 nt, Homo sapiens
aagcuuguguacuu

SEQ ID NO: 411418 - RNA, 20 nt, Homo sapiens
aaggaaaacucaccauuuca

SEQ ID NO: 411419 - RNA, 13 nt, Homo sapiens
aaggaaaucuccu

SEQ ID NO: 411420 - RNA, 16 nt, Homo sapiens
aaggaaaucuccucuu

SEQ ID NO: 411421 - RNA, 19 nt, Homo sapiens
aaggaaaucuccucuuuug

SEQ ID NO: 411422 - RNA, 22 nt, Homo sapiens
aaggaacauuccuuagucucaa

SEQ ID NO: 411423 - RNA, 18 nt, Homo sapiens
aaggaaucuggcauucua

SEQ ID NO: 411424 - RNA, 17 nt, Homo sapiens
aaggacagcucuucccc

SEQ ID NO: 411425 - RNA, 14 nt, Homo sapiens
aaggaccagugaga

SEQ ID NO: 411426 - RNA, 19 nt, Homo sapiens
aaggacgagggaugggauu

SEQ ID NO: 411427 - RNA, 17 nt, Homo sapiens
aaggacucagauuguau

SEQ ID NO: 411428 - RNA, 23 nt, Homo sapiens
aaggagcaaaacgccucuuuucc

SEQ ID NO: 411429 - RNA, 15 nt, Homo sapiens
aaggagccuauggca

SEQ ID NO: 411430 - RNA, 15 nt, Homo sapiens
aaggagggagcugcu

SEQ ID NO: 411431 - RNA, 17 nt, Homo sapiens
aaggaguucagauguuu

SEQ ID NO: 411432 - RNA, 14 nt, Homo sapiens
aaggauacuuuaca

SEQ ID NO: 411433 - RNA, 15 nt, Homo sapiens
aaggauagugcgaug

SEQ ID NO: 411434 - RNA, 12 nt, Homo sapiens
aaggaucacuug

SEQ ID NO: 411435 - RNA, 17 nt, Homo sapiens
aaggauccucuccacuc

SEQ ID NO: 411436 - RNA, 18 nt, Homo sapiens
aaggaugaaagacaaaga

SEQ ID NO: 411437 - RNA, 18 nt, Homo sapiens
aaggauggagccagcucu

SEQ ID NO: 411438 - RNA, 13 nt, Homo sapiens
aaggauguuuaua

SEQ ID NO: 411439 - RNA, 20 nt, Homo sapiens
aaggauuaagauacacuccu

SEQ ID NO: 411440 - RNA, 20 nt, Homo sapiens
aaggcaacauuuccgaagac

SEQ ID NO: 411441 - RNA, 22 nt, Homo sapiens
aaggcaaggggugccugggaac

SEQ ID NO: 411442 - RNA, 19 nt, Homo sapiens
aaggcaucauuuucaccuc

SEQ ID NO: 411443 - RNA, 12 nt, Homo sapiens
aaggcauccacu

SEQ ID NO: 411444 - RNA, 24 nt, Homo sapiens
aaggcauccacuucacaguucuga

SEQ ID NO: 411445 - RNA, 13 nt, Homo sapiens
aaggcauuccagg

SEQ ID NO: 411446 - RNA, 15 nt, Homo sapiens
aaggcauuccagggu

SEQ ID NO: 411447 - RNA, 21 nt, Homo sapiens
aaggccuugcugucaugugaa

SEQ ID NO: 411448 - RNA, 21 nt, Homo sapiens
aaggccuuguuaaaauccaag

SEQ ID NO: 411449 - RNA, 14 nt, Homo sapiens
cgaggcgaugccac

SEQ ID NO: 411450 - RNA, 15 nt, Homo sapiens
cgaggcgggggagcc

SEQ ID NO: 411451 - RNA, 17 nt, Homo sapiens
cgaggcucuugcucaag

SEQ ID NO: 411452 - RNA, 20 nt, Homo sapiens
cgaggugguagcucugagcc

SEQ ID NO: 411453 - RNA, 19 nt, Homo sapiens
cgaguagcugggauuacag

SEQ ID NO: 411454 - RNA, 13 nt, Homo sapiens
cgaguaucuguaa

SEQ ID NO: 411455 - RNA, 19 nt, Homo sapiens
cgagucucuucuccacugg

SEQ ID NO: 411456 - RNA, 16 nt, Homo sapiens
cgaguuuuaaacuggu

SEQ ID NO: 411457 - RNA, 14 nt, Homo sapiens
cgauaauuuuuaga

SEQ ID NO: 411458 - RNA, 22 nt, Homo sapiens
cgauccauguaaucugacguca

SEQ ID NO: 411459 - RNA, 15 nt, Homo sapiens
cgaucgacugccaag

SEQ ID NO: 411460 - RNA, 15 nt, Homo sapiens
cgauguggaccucua

SEQ ID NO: 411461 - RNA, 11 nt, Homo sapiens
cgauguuaaac

SEQ ID NO: 411462 - RNA, 20 nt, Homo sapiens
cgauucaucuacccugcuga

SEQ ID NO: 411463 - RNA, 16 nt, Homo sapiens
cgauucucaugccuca

SEQ ID NO: 411464 - RNA, 13 nt, Homo sapiens
cgcaaaaccugca

SEQ ID NO: 411465 - RNA, 14 nt, Homo sapiens
cgcaaaugaguauu

SEQ ID NO: 411466 - RNA, 13 nt, Homo sapiens
cgcaacaguuuuu

SEQ ID NO: 411467 - RNA, 21 nt, Homo sapiens
cgcaaggaucacuugagccca

SEQ ID NO: 411468 - RNA, 15 nt, Homo sapiens
cgcaaggccugugcu

SEQ ID NO: 411469 - RNA, 11 nt, Homo sapiens
cgcacaguauu

SEQ ID NO: 411470 - RNA, 16 nt, Homo sapiens
cgcaccuugucaugua

SEQ ID NO: 411471 - RNA, 14 nt, Homo sapiens
cgcagccuccaguu

SEQ ID NO: 411472 - RNA, 18 nt, Homo sapiens
cgcaguggggugaucuca

SEQ ID NO: 411473 - RNA, 16 nt, Homo sapiens
cgcaucucagugcagg

SEQ ID NO: 411474 - RNA, 19 nt, Homo sapiens
cgcaugagaacauuaacaa

SEQ ID NO: 411475 - RNA, 14 nt, Homo sapiens
cgccauuccaaguc

SEQ ID NO: 411476 - RNA, 17 nt, Homo sapiens
cgccauuccaagucaac

SEQ ID NO: 411477 - RNA, 20 nt, Homo sapiens
cgcccaggcuggagugcaau

SEQ ID NO: 411478 - RNA, 20 nt, Homo sapiens
cgcccaggcuggagugcagu

SEQ ID NO: 411479 - RNA, 21 nt, Homo sapiens
cgcccaugugugagugugugc

SEQ ID NO: 411480 - RNA, 10 nt, Homo sapiens
cgccccagag

SEQ ID NO: 411481 - RNA, 14 nt, Homo sapiens
cgcccccucccuau

SEQ ID NO: 411482 - RNA, 19 nt, Homo sapiens
cgccccucgcugcugcuac

SEQ ID NO: 411483 - RNA, 16 nt, Homo sapiens
cgcccgaccaggauca

SEQ ID NO: 411484 - RNA, 14 nt, Homo sapiens
cgccgucagggugg

SEQ ID NO: 411485 - RNA, 20 nt, Homo sapiens
cgccuccccuuugugacuuc

SEQ ID NO: 411486 - RNA, 15 nt, Homo sapiens
cgccugacaaccacu

SEQ ID NO: 411487 - RNA, 18 nt, Homo sapiens
cgccuuaugagaacaugg

SEQ ID NO: 411488 - RNA, 17 nt, Homo sapiens
cgccuugccuccucacc

SEQ ID NO: 411489 - RNA, 21 nt, Homo sapiens
cgcgagccaugauguggagug

SEQ ID NO: 411490 - RNA, 11 nt, Homo sapiens
cgcgcacacac

SEQ ID NO: 411491 - RNA, 14 nt, Homo sapiens
cgcggaagugacca

SEQ ID NO: 411492 - RNA, 14 nt, Homo sapiens
cgcguacagaucuc

SEQ ID NO: 411493 - RNA, 22 nt, Homo sapiens
cgcuauuccucacucagaggaa

SEQ ID NO: 411494 - RNA, 15 nt, Homo sapiens
cgcucaucuugcaaa

SEQ ID NO: 411495 - RNA, 19 nt, Homo sapiens
cgcuggaauccagaaggaa

SEQ ID NO: 411496 - RNA, 21 nt, Homo sapiens
cgcuggagcuccuacauggug

SEQ ID NO: 411497 - RNA, 20 nt, Homo sapiens
cgcugggagaaaagccagau

SEQ ID NO: 411498 - RNA, 17 nt, Homo sapiens
cgcugugccaaagccag

SEQ ID NO: 411499 - RNA, 14 nt, Homo sapiens
cgcuucauaggcag

SEQ ID NO: 411500 - RNA, 22 nt, Homo sapiens
cgcuuuugcuggucacugccau

SEQ ID NO: 411501 - RNA, 11 nt, Homo sapiens
cggacaaauca

SEQ ID NO: 411502 - RNA, 14 nt, Homo sapiens
cggacagagcacgu

SEQ ID NO: 411503 - RNA, 15 nt, Homo sapiens
cggaccucaguuucu

SEQ ID NO: 411504 - RNA, 12 nt, Homo sapiens
cggacuccaugg

SEQ ID NO: 411505 - RNA, 17 nt, Homo sapiens
cggacucuuugcuguug

SEQ ID NO: 411506 - RNA, 15 nt, Homo sapiens
cggagggaacccuga

SEQ ID NO: 411507 - RNA, 17 nt, Homo sapiens
cggagucuugcucuguu

SEQ ID NO: 411508 - RNA, 18 nt, Homo sapiens
cggagugagcaauggagu

SEQ ID NO: 411509 - RNA, 22 nt, Homo sapiens
cggaugugugucucaccccuca

SEQ ID NO: 411510 - RNA, 13 nt, Homo sapiens
cggcaagaaggaa

SEQ ID NO: 411511 - RNA, 23 nt, Homo sapiens
cggcagggaagaggccagcguga

SEQ ID NO: 411512 - RNA, 16 nt, Homo sapiens
cggccacucccugcca

SEQ ID NO: 411513 - RNA, 16 nt, Homo sapiens
cggccacucuaccuga

SEQ ID NO: 411514 - RNA, 15 nt, Homo sapiens
cggccggccuggggc

SEQ ID NO: 411515 - RNA, 21 nt, Homo sapiens
cggccuccucuccuacuuugg

SEQ ID NO: 411516 - RNA, 15 nt, Homo sapiens
cggccuuuguugcuc

SEQ ID NO: 411517 - RNA, 17 nt, Homo sapiens
cggccuuuguugcucag

SEQ ID NO: 411518 - RNA, 19 nt, Homo sapiens
cggcuaugggacugcagug

SEQ ID NO: 411519 - RNA, 13 nt, Homo sapiens
cggcucccggggc

SEQ ID NO: 411520 - RNA, 17 nt, Homo sapiens
cggcugcauacccgggc

SEQ ID NO: 411521 - RNA, 22 nt, Homo sapiens
cggcuguuccccucacccaaaa

SEQ ID NO: 411522 - RNA, 19 nt, Homo sapiens
cggcuugugggcuggugcc

SEQ ID NO: 411523 - RNA, 16 nt, Homo sapiens
cgggaaagccagugac

SEQ ID NO: 411524 - RNA, 14 nt, Homo sapiens
cgggacccccaugu

SEQ ID NO: 411525 - RNA, 21 nt, Homo sapiens
cgggagaagaaguuugaccau

SEQ ID NO: 411526 - RNA, 13 nt, Homo sapiens
cgggagauugaac

SEQ ID NO: 411527 - RNA, 22 nt, Homo sapiens
cgggcccaggcccuagacccuc

SEQ ID NO: 411528 - RNA, 18 nt, Homo sapiens
cgggcugggagcucugca

SEQ ID NO: 411529 - RNA, 15 nt, Homo sapiens
cggggaagacuugaa

SEQ ID NO: 411530 - RNA, 17 nt, Homo sapiens
cggggcacccagcccaa

SEQ ID NO: 411531 - RNA, 13 nt, Homo sapiens
cggggugcuccug

SEQ ID NO: 411532 - RNA, 16 nt, Homo sapiens
cggguggguaucccac

SEQ ID NO: 411533 - RNA, 15 nt, Homo sapiens
cggucaccugugcua

SEQ ID NO: 411534 - RNA, 15 nt, Homo sapiens
cggucccccaugcca

SEQ ID NO: 411535 - RNA, 19 nt, Homo sapiens
cggugauauugugcaugca

SEQ ID NO: 411536 - RNA, 23 nt, Homo sapiens
cgguuugggagagaccauugcau

SEQ ID NO: 411537 - RNA, 12 nt, Homo sapiens
cgguuuuagcuu

SEQ ID NO: 411538 - RNA, 14 nt, Homo sapiens
cguaauuuugccaa

SEQ ID NO: 411539 - RNA, 14 nt, Homo sapiens
cguacaguucuucg

SEQ ID NO: 411540 - RNA, 14 nt, Homo sapiens
cguacucucacaug

SEQ ID NO: 411541 - RNA, 18 nt, Homo sapiens
cguauagaaaaagcacag

SEQ ID NO: 411542 - RNA, 19 nt, Homo sapiens
cguaucuccuugauuacau

SEQ ID NO: 411543 - RNA, 17 nt, Homo sapiens
cguauguaaacauucau

SEQ ID NO: 411544 - RNA, 23 nt, Homo sapiens
cgucacccuugguagaguuuauu

SEQ ID NO: 411545 - RNA, 17 nt, Homo sapiens
cgucagaccaguacugg

SEQ ID NO: 411546 - RNA, 11 nt, Homo sapiens
cgucauguccu

SEQ ID NO: 411547 - RNA, 20 nt, Homo sapiens
cguccgcgcgccagcacaga

SEQ ID NO: 411548 - RNA, 12 nt, Homo sapiens
cguccugcagug

SEQ ID NO: 411549 - RNA, 15 nt, Homo sapiens
cgucuccucccucag

SEQ ID NO: 411550 - RNA, 14 nt, Homo sapiens
cgucuccucuccag

SEQ ID NO: 411551 - RNA, 20 nt, Homo sapiens
cgucucuacuaaaaauacaa

SEQ ID NO: 411552 - RNA, 17 nt, Homo sapiens
cgucugugauugccauu

SEQ ID NO: 411553 - RNA, 19 nt, Homo sapiens
cgugcaccuggcagcuuuu

SEQ ID NO: 411554 - RNA, 15 nt, Homo sapiens
cgugcacggggccag

SEQ ID NO: 411555 - RNA, 18 nt, Homo sapiens
cgugcacuuggugcugcg

SEQ ID NO: 411556 - RNA, 13 nt, Homo sapiens
cgugcccccagcg

SEQ ID NO: 411557 - RNA, 20 nt, Homo sapiens
cgugccccgccuccccgaaa

SEQ ID NO: 411558 - RNA, 13 nt, Homo sapiens
cgugccccugaag

SEQ ID NO: 411559 - RNA, 14 nt, Homo sapiens
cguggcagucacca

SEQ ID NO: 411560 - RNA, 21 nt, Homo sapiens
cgugggucuucagggggccag

SEQ ID NO: 411561 - RNA, 14 nt, Homo sapiens
cguguaaauuaugu

SEQ ID NO: 411562 - RNA, 17 nt, Homo sapiens
cguguaauauucucuga

SEQ ID NO: 411563 - RNA, 18 nt, Homo sapiens
cguguagugucuguaaua

SEQ ID NO: 411564 - RNA, 23 nt, Homo sapiens
cguguggcucacgugugugacuc

SEQ ID NO: 411565 - RNA, 22 nt, Homo sapiens
cguguguauuagaaugcaugua

SEQ ID NO: 411566 - RNA, 15 nt, Homo sapiens
cguguguccaugugu

SEQ ID NO: 411567 - RNA, 13 nt, Homo sapiens
cgugugucucaug

SEQ ID NO: 411568 - RNA, 16 nt, Homo sapiens
cguguuuuuguaucuu

SEQ ID NO: 411569 - RNA, 21 nt, Homo sapiens
cguuaaggagaugggccuuuu

SEQ ID NO: 411570 - RNA, 20 nt, Homo sapiens
cguuccaaguauuuugccac

SEQ ID NO: 411571 - RNA, 17 nt, Homo sapiens
cguucccaccucugagg

SEQ ID NO: 411572 - RNA, 14 nt, Homo sapiens
cguuuagaacucau

SEQ ID NO: 411573 - RNA, 13 nt, Homo sapiens
cguuuuaugauuu

SEQ ID NO: 411574 - RNA, 15 nt, Homo sapiens
cguuuucaccagcaa

SEQ ID NO: 411575 - RNA, 17 nt, Homo sapiens
cuaaaaccacaugugca

SEQ ID NO: 411576 - RNA, 12 nt, Homo sapiens
cuaaaacuuaac

SEQ ID NO: 411577 - RNA, 14 nt, Homo sapiens
cuaaaacuuaacau

SEQ ID NO: 411578 - RNA, 14 nt, Homo sapiens
cuaaaagauucuuu

SEQ ID NO: 411579 - RNA, 21 nt, Homo sapiens
cuaaaagggggcuauucccug

SEQ ID NO: 411580 - RNA, 15 nt, Homo sapiens
cuaaaauucuagucu

SEQ ID NO: 411581 - RNA, 13 nt, Homo sapiens
cuagcuauaacaa

SEQ ID NO: 411582 - RNA, 15 nt, Homo sapiens
cuagcuggauuuccu

SEQ ID NO: 411583 - RNA, 21 nt, Homo sapiens
cuaggacucaggccugccaau

SEQ ID NO: 411584 - RNA, 18 nt, Homo sapiens
cuaggaguugaguacagu

SEQ ID NO: 411585 - RNA, 15 nt, Homo sapiens
cuagguaggggccca

SEQ ID NO: 411586 - RNA, 17 nt, Homo sapiens
cuaggucuccucagggu

SEQ ID NO: 411587 - RNA, 16 nt, Homo sapiens
cuagguucgaauccag

SEQ ID NO: 411588 - RNA, 23 nt, Homo sapiens
cuagguucuaaaaauugugauca

SEQ ID NO: 411589 - RNA, 23 nt, Homo sapiens
cuagguuguuuuuaaaaccacua

SEQ ID NO: 411590 - RNA, 14 nt, Homo sapiens
cuagguuuaacuca

SEQ ID NO: 411591 - RNA, 17 nt, Homo sapiens
cuaguagaacaauguac

SEQ ID NO: 411592 - RNA, 18 nt, Homo sapiens
cuaguauuguccauauca

SEQ ID NO: 411593 - RNA, 14 nt, Homo sapiens
cuagucacauauca

SEQ ID NO: 411594 - RNA, 16 nt, Homo sapiens
cuagucugucagggcc

SEQ ID NO: 411595 - RNA, 16 nt, Homo sapiens
cuagugacaagcuccu

SEQ ID NO: 411596 - RNA, 23 nt, Homo sapiens
cuagugagcaaaauaugccccuu

SEQ ID NO: 411597 - RNA, 16 nt, Homo sapiens
cuaguuaaaagccuuu

SEQ ID NO: 411598 - RNA, 22 nt, Homo sapiens
cuauaaccaucaguuacugguu

SEQ ID NO: 411599 - RNA, 15 nt, Homo sapiens
cuauaauguuucccu

SEQ ID NO: 411600 - RNA, 16 nt, Homo sapiens
cuauaauucuauugaa

SEQ ID NO: 411601 - RNA, 23 nt, Homo sapiens
cuauacaaacuacagaguuuaug

SEQ ID NO: 411602 - RNA, 13 nt, Homo sapiens
cuauauccaugua

SEQ ID NO: 411603 - RNA, 19 nt, Homo sapiens
cuauauccauguacuguag

SEQ ID NO: 411604 - RNA, 15 nt, Homo sapiens
cuaucaaagcacaua

SEQ ID NO: 411605 - RNA, 15 nt, Homo sapiens
cuaucaguucuagca

SEQ ID NO: 411606 - RNA, 13 nt, Homo sapiens
cuaucauauauua

SEQ ID NO: 411607 - RNA, 16 nt, Homo sapiens
cuaucauggcauauaa

SEQ ID NO: 411608 - RNA, 14 nt, Homo sapiens
cuaucgcaccacug

SEQ ID NO: 411609 - RNA, 15 nt, Homo sapiens
cuaucgcaccacugu

SEQ ID NO: 411610 - RNA, 15 nt, Homo sapiens
cuaugcacaccaaau

SEQ ID NO: 411611 - RNA, 19 nt, Homo sapiens
cuaugcacagauuaaacuu

SEQ ID NO: 411612 - RNA, 18 nt, Homo sapiens
cuaugccugccucaaagg

SEQ ID NO: 411613 - RNA, 17 nt, Homo sapiens
cuaugcugcaauacauu

SEQ ID NO: 411614 - RNA, 16 nt, Homo sapiens
cuauggauucacuucu

SEQ ID NO: 411615 - RNA, 15 nt, Homo sapiens
cuauggcaucuuccc

SEQ ID NO: 411616 - RNA, 16 nt, Homo sapiens
cuaugggaagcucugu

SEQ ID NO: 411617 - RNA, 18 nt, Homo sapiens
cuaugggacugcagugcc

SEQ ID NO: 411618 - RNA, 23 nt, Homo sapiens
cuauggguugucaauaguauuaa

SEQ ID NO: 411619 - RNA, 14 nt, Homo sapiens
cuaugugagcacaa

SEQ ID NO: 411620 - RNA, 21 nt, Homo sapiens
cuauuaaaagaauccaaauuc

SEQ ID NO: 411621 - RNA, 18 nt, Homo sapiens
cuauuaagaaaaucacau

SEQ ID NO: 411622 - RNA, 15 nt, Homo sapiens
cuauuacuaguacua

SEQ ID NO: 411623 - RNA, 18 nt, Homo sapiens
cuauuacuaguacuauua

SEQ ID NO: 411624 - RNA, 12 nt, Homo sapiens
cuauucaugucu

SEQ ID NO: 411625 - RNA, 18 nt, Homo sapiens
cuauucccaggcagggag

SEQ ID NO: 411626 - RNA, 16 nt, Homo sapiens
cuauuccuucuggccu

SEQ ID NO: 411627 - RNA, 16 nt, Homo sapiens
cuauucuugauguaaa

SEQ ID NO: 411628 - RNA, 19 nt, Homo sapiens
cuauugacaagucauuuua

SEQ ID NO: 411629 - RNA, 14 nt, Homo sapiens
cuauugccugagag

SEQ ID NO: 411630 - RNA, 15 nt, Homo sapiens
cuauuuaaguuauca

SEQ ID NO: 411631 - RNA, 14 nt, Homo sapiens
cuauuuacuggaaa

SEQ ID NO: 411632 - RNA, 17 nt, Homo sapiens
cuauuuccauuccagaa

SEQ ID NO: 411633 - RNA, 14 nt, Homo sapiens
cuauuucuauccug

SEQ ID NO: 411634 - RNA, 17 nt, Homo sapiens
cuauuuggaaagcacug

SEQ ID NO: 411635 - RNA, 21 nt, Homo sapiens
cuauuuggaaagcacuggaau

SEQ ID NO: 411636 - RNA, 18 nt, Homo sapiens
cuauuuguuguuuuuaac

SEQ ID NO: 411637 - RNA, 14 nt, Homo sapiens
cuauuuguuuucau

SEQ ID NO: 411638 - RNA, 16 nt, Homo sapiens
cuauuuuaaugaauga

SEQ ID NO: 411639 - RNA, 17 nt, Homo sapiens
cuauuuucuuuuccauu

SEQ ID NO: 411640 - RNA, 22 nt, Homo sapiens
cucaaaaggagaacugugcucu

SEQ ID NO: 411641 - RNA, 13 nt, Homo sapiens
cucaaaauuugau

SEQ ID NO: 411642 - RNA, 12 nt, Homo sapiens
cucaaacauguu

SEQ ID NO: 411643 - RNA, 20 nt, Homo sapiens
cucaaaccuccaaaagcccu

SEQ ID NO: 411644 - RNA, 19 nt, Homo sapiens
cucaaagauguacugagag

SEQ ID NO: 411645 - RNA, 16 nt, Homo sapiens
cucaaaguuaaccuac

SEQ ID NO: 411646 - RNA, 13 nt, Homo sapiens
cucaaaucuccag

SEQ ID NO: 411647 - RNA, 19 nt, Homo sapiens
cucaacaaagaagaaccau

SEQ ID NO: 411648 - RNA, 22 nt, Homo sapiens
cucaacaaagaagaaccaucuu

SEQ ID NO: 411649 - RNA, 20 nt, Homo sapiens
cucaacaaagcacaguguua

SEQ ID NO: 411650 - RNA, 23 nt, Homo sapiens
cucaacauguuacugaccagcaa

SEQ ID NO: 411651 - RNA, 20 nt, Homo sapiens
cucaacauugcauggugcua

SEQ ID NO: 411652 - RNA, 20 nt, Homo sapiens
cucaaccugggucaaagugg

SEQ ID NO: 411653 - RNA, 23 nt, Homo sapiens
cucaaccuugacuucugcccaaa

SEQ ID NO: 411654 - RNA, 15 nt, Homo sapiens
cucaagauucaguag

SEQ ID NO: 411655 - RNA, 15 nt, Homo sapiens
cucaagcacugacac

SEQ ID NO: 411656 - RNA, 21 nt, Homo sapiens
cucaagcacugacacucauua

SEQ ID NO: 411657 - RNA, 14 nt, Homo sapiens
cucaagcagucuac

SEQ ID NO: 411658 - RNA, 18 nt, Homo sapiens
cucaagugucucagucca

SEQ ID NO: 411659 - RNA, 16 nt, Homo sapiens
cucaauauuaaagggu

SEQ ID NO: 411660 - RNA, 17 nt, Homo sapiens
cucaaucacugcucccc

SEQ ID NO: 411661 - RNA, 16 nt, Homo sapiens
cucaauggaaccaaau

SEQ ID NO: 411662 - RNA, 17 nt, Homo sapiens
cucacaacuguuuuuga

SEQ ID NO: 411663 - RNA, 20 nt, Homo sapiens
cucacaauagcgugagcuaa

SEQ ID NO: 411664 - RNA, 15 nt, Homo sapiens
cucacacuucauccu

SEQ ID NO: 411665 - RNA, 20 nt, Homo sapiens
cucacagagugcauugugag

SEQ ID NO: 411666 - RNA, 14 nt, Homo sapiens
cucacaguguugcc

SEQ ID NO: 411667 - RNA, 22 nt, Homo sapiens
cucacaucacuguccaccacca

SEQ ID NO: 411668 - RNA, 16 nt, Homo sapiens
cucacaucuguccaga

SEQ ID NO: 411669 - RNA, 21 nt, Homo sapiens
cucacaugcacaggggcccau

SEQ ID NO: 411670 - RNA, 15 nt, Homo sapiens
cucaccaacccugca

SEQ ID NO: 411671 - RNA, 12 nt, Homo sapiens
cucaccgucucg

SEQ ID NO: 411672 - RNA, 13 nt, Homo sapiens
cucaccucaggac

SEQ ID NO: 411673 - RNA, 13 nt, Homo sapiens
cucaccuccuaaa

SEQ ID NO: 411674 - RNA, 18 nt, Homo sapiens
cucaccuggacuccagua

SEQ ID NO: 411675 - RNA, 20 nt, Homo sapiens
cucaccuucccuaguucuuu

SEQ ID NO: 411676 - RNA, 13 nt, Homo sapiens
cucacgccuguaa

SEQ ID NO: 411677 - RNA, 17 nt, Homo sapiens
cucacgccuguaauccc

SEQ ID NO: 411678 - RNA, 15 nt, Homo sapiens
cucacucaccaucug

SEQ ID NO: 411679 - RNA, 15 nt, Homo sapiens
cucacucccagucca

SEQ ID NO: 411680 - RNA, 21 nt, Homo sapiens
cucacucuuaugaaaugggcu

SEQ ID NO: 411681 - RNA, 20 nt, Homo sapiens
cucacugaggaugcuucugu

SEQ ID NO: 411682 - RNA, 17 nt, Homo sapiens
cucacuguugaauuuuc

SEQ ID NO: 411683 - RNA, 19 nt, Homo sapiens
cucagaacagucugaaaua

SEQ ID NO: 411684 - RNA, 23 nt, Homo sapiens
cucagaauauacccauccaugca

SEQ ID NO: 411685 - RNA, 16 nt, Homo sapiens
cucagacucauuguaa

SEQ ID NO: 411686 - RNA, 15 nt, Homo sapiens
cucagagaagaccac

SEQ ID NO: 411687 - RNA, 19 nt, Homo sapiens
cucagagaccgugagcgcc

SEQ ID NO: 411688 - RNA, 15 nt, Homo sapiens
cucagagcagccucu

SEQ ID NO: 411689 - RNA, 18 nt, Homo sapiens
cucagaggaugaggucaa

SEQ ID NO: 411690 - RNA, 23 nt, Homo sapiens
cucagauuccaccuagagcuaga

SEQ ID NO: 411691 - RNA, 17 nt, Homo sapiens
cucagcaacagccagug

SEQ ID NO: 411692 - RNA, 16 nt, Homo sapiens
cucagcaaguguacag

SEQ ID NO: 411693 - RNA, 22 nt, Homo sapiens
cucagcgcugcccacaccaccg

SEQ ID NO: 411694 - RNA, 16 nt, Homo sapiens
cucagcugcacauucc

SEQ ID NO: 411695 - RNA, 15 nt, Homo sapiens
cucaggaucucuuag

SEQ ID NO: 411696 - RNA, 22 nt, Homo sapiens
cucagggaucucagaccuagug

SEQ ID NO: 411697 - RNA, 15 nt, Homo sapiens
cucagguaguacugg

SEQ ID NO: 411698 - RNA, 22 nt, Homo sapiens
cucagguccgcccgaccaggau

SEQ ID NO: 411699 - RNA, 17 nt, Homo sapiens
cucagguguugccaaau

SEQ ID NO: 411700 - RNA, 15 nt, Homo sapiens
cucagucaugcacuc

SEQ ID NO: 411701 - RNA, 23 nt, Homo sapiens
cucaguccaguccucacaugccc

SEQ ID NO: 411702 - RNA, 23 nt, Homo sapiens
cucagugcagcaauauauuacca

SEQ ID NO: 411703 - RNA, 11 nt, Homo sapiens
cucagugcagg

SEQ ID NO: 411704 - RNA, 20 nt, Homo sapiens
cucaguggacuuuccacccc

SEQ ID NO: 411705 - RNA, 17 nt, Homo sapiens
cucaguuggugcugcuu

SEQ ID NO: 411706 - RNA, 18 nt, Homo sapiens
cucaguuggugcugcuuu

SEQ ID NO: 411707 - RNA, 16 nt, Homo sapiens
cucaguuucuguuguu

SEQ ID NO: 411708 - RNA, 13 nt, Homo sapiens
cucauacaaugau

SEQ ID NO: 411709 - RNA, 18 nt, Homo sapiens
cucauaccuggcuugcag

SEQ ID NO: 411710 - RNA, 13 nt, Homo sapiens
cucaucacuggau

SEQ ID NO: 411711 - RNA, 19 nt, Homo sapiens
cugcucugcagcccacaga

SEQ ID NO: 411712 - RNA, 13 nt, Homo sapiens
cugcucugcuaua

SEQ ID NO: 411713 - RNA, 15 nt, Homo sapiens
cugcucuuucucugc

SEQ ID NO: 411714 - RNA, 22 nt, Homo sapiens
cugcugaccucccagugacccc

SEQ ID NO: 411715 - RNA, 20 nt, Homo sapiens
cugcugacguuugacaccag

SEQ ID NO: 411716 - RNA, 17 nt, Homo sapiens
cugcugauguaggagcu

SEQ ID NO: 411717 - RNA, 16 nt, Homo sapiens
cugcugccauccucac

SEQ ID NO: 411718 - RNA, 21 nt, Homo sapiens
cugcugccucccuggggacca

SEQ ID NO: 411719 - RNA, 14 nt, Homo sapiens
cugcugcuggucac

SEQ ID NO: 411720 - RNA, 20 nt, Homo sapiens
cugcuggaugucaccaagaa

SEQ ID NO: 411721 - RNA, 15 nt, Homo sapiens
cugcuggugcuaaaa

SEQ ID NO: 411722 - RNA, 20 nt, Homo sapiens
cugcugguuuugguuuccac

SEQ ID NO: 411723 - RNA, 16 nt, Homo sapiens
cugcuguauacuguac

SEQ ID NO: 411724 - RNA, 22 nt, Homo sapiens
cugcuguccaggaacuuuccag

SEQ ID NO: 411725 - RNA, 11 nt, Homo sapiens
cugcugugaau

SEQ ID NO: 411726 - RNA, 21 nt, Homo sapiens
cugcugugccaggacugugac

SEQ ID NO: 411727 - RNA, 11 nt, Homo sapiens
cugcuguggaa

SEQ ID NO: 411728 - RNA, 15 nt, Homo sapiens
cugcuguguucucac

SEQ ID NO: 411729 - RNA, 20 nt, Homo sapiens
cugcuguuccugcuccauga

SEQ ID NO: 411730 - RNA, 21 nt, Homo sapiens
cugcuuagugucccuuaccug

SEQ ID NO: 411731 - RNA, 19 nt, Homo sapiens
cugcuucaaacucaaacac

SEQ ID NO: 411732 - RNA, 20 nt, Homo sapiens
cugcuucacgauucuuaccc

SEQ ID NO: 411733 - RNA, 15 nt, Homo sapiens
cugcuuccucugaau

SEQ ID NO: 411734 - RNA, 18 nt, Homo sapiens
cugcuucugugcauuugu

SEQ ID NO: 411735 - RNA, 22 nt, Homo sapiens
cugcuucuguguguggugagca

SEQ ID NO: 411736 - RNA, 15 nt, Homo sapiens
cugcuuucuaauuaa

SEQ ID NO: 411737 - RNA, 20 nt, Homo sapiens
cugcuuuggcugacugggaa

SEQ ID NO: 411738 - RNA, 21 nt, Homo sapiens
cuggaaaaaaaaaaauaugag

SEQ ID NO: 411739 - RNA, 16 nt, Homo sapiens
cuggaaaacagcugcu

SEQ ID NO: 411740 - RNA, 16 nt, Homo sapiens
cuggaaaacccaaagu

SEQ ID NO: 411741 - RNA, 18 nt, Homo sapiens
cuggaaaacucaggauuc

SEQ ID NO: 411742 - RNA, 22 nt, Homo sapiens
cuggaaaacucaggauucucac

SEQ ID NO: 411743 - RNA, 16 nt, Homo sapiens
cuggaaaccagaauga

SEQ ID NO: 411744 - RNA, 14 nt, Homo sapiens
cuggaaaugcugac

SEQ ID NO: 411745 - RNA, 18 nt, Homo sapiens
cuggaaauucuuauuucc

SEQ ID NO: 411746 - RNA, 15 nt, Homo sapiens
cuggaagaacaucaa

SEQ ID NO: 411747 - RNA, 17 nt, Homo sapiens
cuggaagaccugaaaga

SEQ ID NO: 411748 - RNA, 16 nt, Homo sapiens
cuggaagccugcugau

SEQ ID NO: 411749 - RNA, 23 nt, Homo sapiens
cuggaaggagugagaggggacaa

SEQ ID NO: 411750 - RNA, 15 nt, Homo sapiens
cuggaaucccagcuc

SEQ ID NO: 411751 - RNA, 19 nt, Homo sapiens
cuggaaugcauucacucag

SEQ ID NO: 411752 - RNA, 12 nt, Homo sapiens
cuggacaccucu

SEQ ID NO: 411753 - RNA, 20 nt, Homo sapiens
cuggaccugccuccugccug

SEQ ID NO: 411754 - RNA, 13 nt, Homo sapiens
cuggacuugaaug

SEQ ID NO: 411755 - RNA, 19 nt, Homo sapiens
cuggagaaaauggacgugu

SEQ ID NO: 411756 - RNA, 20 nt, Homo sapiens
cuggagaacuagagaaggac

SEQ ID NO: 411757 - RNA, 21 nt, Homo sapiens
cuggagagguuaaggugcaau

SEQ ID NO: 411758 - RNA, 15 nt, Homo sapiens
cuggagccccugugu

SEQ ID NO: 411759 - RNA, 17 nt, Homo sapiens
cuggagccuccacugcc

SEQ ID NO: 411760 - RNA, 14 nt, Homo sapiens
cuggagccuuugaa

SEQ ID NO: 411761 - RNA, 23 nt, Homo sapiens
cuggagcuggcgucugucuucaa

SEQ ID NO: 411762 - RNA, 12 nt, Homo sapiens
cuggaggaacuu

SEQ ID NO: 411763 - RNA, 15 nt, Homo sapiens
cuggagggggcagaa

SEQ ID NO: 411764 - RNA, 21 nt, Homo sapiens
cuggagugcaguggugugauc

SEQ ID NO: 411765 - RNA, 20 nt, Homo sapiens
cuggaguggaguggcgugau

SEQ ID NO: 411766 - RNA, 19 nt, Homo sapiens
cuggaguugcccugccauc

SEQ ID NO: 411767 - RNA, 21 nt, Homo sapiens
cuggauccccucugucuacaa

SEQ ID NO: 411768 - RNA, 15 nt, Homo sapiens
cuggaucuaccagca

SEQ ID NO: 411769 - RNA, 20 nt, Homo sapiens
cuggauuacaggcaugugcc

SEQ ID NO: 411770 - RNA, 21 nt, Homo sapiens
cuggcacaccagaagugccau

SEQ ID NO: 411771 - RNA, 15 nt, Homo sapiens
cuggcagaggggaca

SEQ ID NO: 411772 - RNA, 21 nt, Homo sapiens
cuggcagagguuucuagggug

SEQ ID NO: 411773 - RNA, 20 nt, Homo sapiens
cuggcagcaucuucacuucu

SEQ ID NO: 411774 - RNA, 21 nt, Homo sapiens
cuggcaggagccggcugccua

SEQ ID NO: 411775 - RNA, 19 nt, Homo sapiens
cuggcaucugacacugaca

SEQ ID NO: 411776 - RNA, 21 nt, Homo sapiens
cuggcaugggaaugaauguca

SEQ ID NO: 411777 - RNA, 15 nt, Homo sapiens
cuggcauuugcugca

SEQ ID NO: 411778 - RNA, 19 nt, Homo sapiens
cuggccaaauaugcacuuu

SEQ ID NO: 411779 - RNA, 17 nt, Homo sapiens
cuggccauccaugugau

SEQ ID NO: 411780 - RNA, 21 nt, Homo sapiens
cuggccauuuaacuagcacuu

SEQ ID NO: 411781 - RNA, 13 nt, Homo sapiens
cuggccccaaaag

SEQ ID NO: 411782 - RNA, 13 nt, Homo sapiens
cuggccccaggcg

SEQ ID NO: 411783 - RNA, 16 nt, Homo sapiens
cuggccccuagaauca

SEQ ID NO: 411784 - RNA, 13 nt, Homo sapiens
cuggccgcuggga

SEQ ID NO: 411785 - RNA, 23 nt, Homo sapiens
cuggccuauuuuggacgugugag

SEQ ID NO: 411786 - RNA, 14 nt, Homo sapiens
cuggcucagccuca

SEQ ID NO: 411787 - RNA, 13 nt, Homo sapiens
cuggcucaucucu

SEQ ID NO: 411788 - RNA, 18 nt, Homo sapiens
cuggcucccagggccaug

SEQ ID NO: 411789 - RNA, 13 nt, Homo sapiens
cuggcucugucac

SEQ ID NO: 411790 - RNA, 12 nt, Homo sapiens
cuggcugccagg

SEQ ID NO: 411791 - RNA, 19 nt, Homo sapiens
cuggcuggugacagaacau

SEQ ID NO: 411792 - RNA, 14 nt, Homo sapiens
cuggcuuccagggg

SEQ ID NO: 411793 - RNA, 16 nt, Homo sapiens
cuggcuucuuucacuu

SEQ ID NO: 411794 - RNA, 14 nt, Homo sapiens
cuggcuugugaucu

SEQ ID NO: 411795 - RNA, 18 nt, Homo sapiens
cuggcuuuguucuuguca

SEQ ID NO: 411796 - RNA, 22 nt, Homo sapiens
cugggaagcuugagccuccccc

SEQ ID NO: 411797 - RNA, 17 nt, Homo sapiens
cugggaaggagggagcu

SEQ ID NO: 411798 - RNA, 15 nt, Homo sapiens
cugggacugcugcuu

SEQ ID NO: 411799 - RNA, 18 nt, Homo sapiens
cugggagaaccaaaaaga

SEQ ID NO: 411800 - RNA, 22 nt, Homo sapiens
cugggagccggaggcugcagug

SEQ ID NO: 411801 - RNA, 17 nt, Homo sapiens
cugggaucagcuggugu

SEQ ID NO: 411802 - RNA, 22 nt, Homo sapiens
cugggauggggcauguggccaa

SEQ ID NO: 411803 - RNA, 22 nt, Homo sapiens
cugggauuacaggcgugagcca

SEQ ID NO: 411804 - RNA, 18 nt, Homo sapiens
cugggcaagggaccugcu

SEQ ID NO: 411805 - RNA, 18 nt, Homo sapiens
cugggcagaaaugugcug

SEQ ID NO: 411806 - RNA, 18 nt, Homo sapiens
cugggccugcuuuuccag

SEQ ID NO: 411807 - RNA, 15 nt, Homo sapiens
cugggccuucucacc

SEQ ID NO: 411808 - RNA, 13 nt, Homo sapiens
cugggcucugggu

SEQ ID NO: 411809 - RNA, 12 nt, Homo sapiens
cugggcuuucug

SEQ ID NO: 411810 - RNA, 17 nt, Homo sapiens
cuggggccgaaagaaca

SEQ ID NO: 411811 - RNA, 19 nt, Homo sapiens
cuggggcuuuugugccagg

SEQ ID NO: 411812 - RNA, 19 nt, Homo sapiens
cugggggaggaacagggcu

SEQ ID NO: 411813 - RNA, 12 nt, Homo sapiens
cugggggccaug

SEQ ID NO: 411814 - RNA, 14 nt, Homo sapiens
cugggggccaugag

SEQ ID NO: 411815 - RNA, 22 nt, Homo sapiens
cugggguacuacucuccagcuu

SEQ ID NO: 411816 - RNA, 19 nt, Homo sapiens
cuggguaacugucaaguca

SEQ ID NO: 411817 - RNA, 20 nt, Homo sapiens
cugggucaccuuccugggca

SEQ ID NO: 411818 - RNA, 22 nt, Homo sapiens
cuggguccgccuuaaucuggaa

SEQ ID NO: 411819 - RNA, 15 nt, Homo sapiens
cuggguucaaaaaga

SEQ ID NO: 411820 - RNA, 17 nt, Homo sapiens
cuggguucucuucauuc

SEQ ID NO: 411821 - RNA, 19 nt, Homo sapiens
cuggguuugggcaguggag

SEQ ID NO: 411822 - RNA, 22 nt, Homo sapiens
cugguaaauauauuucaaaacu

SEQ ID NO: 411823 - RNA, 16 nt, Homo sapiens
cugguagaaaggcagu

SEQ ID NO: 411824 - RNA, 16 nt, Homo sapiens
cugguagaaauaccca

SEQ ID NO: 411825 - RNA, 15 nt, Homo sapiens
cugguaggaauagca

SEQ ID NO: 411826 - RNA, 20 nt, Homo sapiens
cugguagguucugucugugc

SEQ ID NO: 411827 - RNA, 16 nt, Homo sapiens
cugguaucugcaugua

SEQ ID NO: 411828 - RNA, 13 nt, Homo sapiens
cuggucauacauu

SEQ ID NO: 411829 - RNA, 12 nt, Homo sapiens
cugguccaugau

SEQ ID NO: 411830 - RNA, 18 nt, Homo sapiens
cuggucucaaacuccuga

SEQ ID NO: 411831 - RNA, 23 nt, Homo sapiens
cuggucucaaacuccugggcuca

SEQ ID NO: 411832 - RNA, 19 nt, Homo sapiens
cuggugaccagcaccaucu

SEQ ID NO: 411833 - RNA, 13 nt, Homo sapiens
cuggugcacauga

SEQ ID NO: 411834 - RNA, 18 nt, Homo sapiens
cuggugcagucauuauga

SEQ ID NO: 411835 - RNA, 12 nt, Homo sapiens
cuggugccccac

SEQ ID NO: 411836 - RNA, 14 nt, Homo sapiens
cuggugcuccaguu

SEQ ID NO: 411837 - RNA, 13 nt, Homo sapiens
cugguggggcuga

SEQ ID NO: 411838 - RNA, 18 nt, Homo sapiens
cugguggucaugaauuca

SEQ ID NO: 411839 - RNA, 17 nt, Homo sapiens
cugguguggaagagcuc

SEQ ID NO: 411840 - RNA, 16 nt, Homo sapiens
cugguguuacacauac

SEQ ID NO: 411841 - RNA, 23 nt, Homo sapiens
ggaaauaguaccuucaauacuua

SEQ ID NO: 411842 - RNA, 23 nt, Homo sapiens
ggaaauucaaaacaauuggcaaa

SEQ ID NO: 411843 - RNA, 13 nt, Homo sapiens
ggaacacacuugg

SEQ ID NO: 411844 - RNA, 13 nt, Homo sapiens
ggaacacuggugg

SEQ ID NO: 411845 - RNA, 21 nt, Homo sapiens
ggaaccucccugggccugucu

SEQ ID NO: 411846 - RNA, 16 nt, Homo sapiens
ggaacucuagccaaau

SEQ ID NO: 411847 - RNA, 20 nt, Homo sapiens
ggaagacauguccccauggc

SEQ ID NO: 411848 - RNA, 13 nt, Homo sapiens
ggaagacuuuaaa

SEQ ID NO: 411849 - RNA, 19 nt, Homo sapiens
ggaagaucagcacccuaag

SEQ ID NO: 411850 - RNA, 20 nt, Homo sapiens
ggaagaucuugagagcugcu

SEQ ID NO: 411851 - RNA, 18 nt, Homo sapiens
ggaagcagagcacugugu

SEQ ID NO: 411852 - RNA, 16 nt, Homo sapiens
ggaagccccacuugaa

SEQ ID NO: 411853 - RNA, 20 nt, Homo sapiens
ggaagccggaggguguuuau

SEQ ID NO: 411854 - RNA, 17 nt, Homo sapiens
ggaagccuccugcugag

SEQ ID NO: 411855 - RNA, 22 nt, Homo sapiens
ggaagcuccaguccugcucucu

SEQ ID NO: 411856 - RNA, 17 nt, Homo sapiens
ggaaggagggagcugcu

SEQ ID NO: 411857 - RNA, 12 nt, Homo sapiens
ggaaggcaaaug

SEQ ID NO: 411858 - RNA, 18 nt, Homo sapiens
ggaaggggugggagccaa

SEQ ID NO: 411859 - RNA, 22 nt, Homo sapiens
ggaaggugaccgcccagcucuc

SEQ ID NO: 411860 - RNA, 23 nt, Homo sapiens
ggaagguuaugcuccuggcacag

SEQ ID NO: 411861 - RNA, 23 nt, Homo sapiens
ggaagucaucucauuccacuguu

SEQ ID NO: 411862 - RNA, 14 nt, Homo sapiens
ggaauaaagcccuu

SEQ ID NO: 411863 - RNA, 18 nt, Homo sapiens
ggaauaaagcccuugaac

SEQ ID NO: 411864 - RNA, 22 nt, Homo sapiens
ggaauaaauugcuccuugacau

SEQ ID NO: 411865 - RNA, 23 nt, Homo sapiens
ggaauaagcucuaguucuuaaca

SEQ ID NO: 411866 - RNA, 23 nt, Homo sapiens
ggaauaauuagcuuguuacaauu

SEQ ID NO: 411867 - RNA, 14 nt, Homo sapiens
ggaaucgacuguau

SEQ ID NO: 411868 - RNA, 16 nt, Homo sapiens
ggaaugaaugucagug

SEQ ID NO: 411869 - RNA, 19 nt, Homo sapiens
ggaauggaaagaauguggg

SEQ ID NO: 411870 - RNA, 19 nt, Homo sapiens
ggaauggggaccuggggug

SEQ ID NO: 411871 - RNA, 22 nt, Homo sapiens
ggaauuagaaaugaauuuggag

SEQ ID NO: 411872 - RNA, 13 nt, Homo sapiens
ggaauugcucaga

SEQ ID NO: 411873 - RNA, 18 nt, Homo sapiens
ggacaaaccgagugcaau

SEQ ID NO: 411874 - RNA, 17 nt, Homo sapiens
ggacaagauacauauga

SEQ ID NO: 411875 - RNA, 22 nt, Homo sapiens
ggacacccaacacuuuuuccau

SEQ ID NO: 411876 - RNA, 11 nt, Homo sapiens
ggacacugaga

SEQ ID NO: 411877 - RNA, 22 nt, Homo sapiens
ggacagaucaauggcgcagugc

SEQ ID NO: 411878 - RNA, 14 nt, Homo sapiens
ggacagcucuuccc

SEQ ID NO: 411879 - RNA, 21 nt, Homo sapiens
ggacagggcccccggccacgc

SEQ ID NO: 411880 - RNA, 18 nt, Homo sapiens
ggacaugcuuuggcaauu

SEQ ID NO: 411881 - RNA, 20 nt, Homo sapiens
ggacccaccccaacucuccc

SEQ ID NO: 411882 - RNA, 17 nt, Homo sapiens
ggaccccaucugcugag

SEQ ID NO: 411883 - RNA, 19 nt, Homo sapiens
ggacgaggaguaauggcau

SEQ ID NO: 411884 - RNA, 21 nt, Homo sapiens
ggacgaggaguaauggcauuu

SEQ ID NO: 411885 - RNA, 18 nt, Homo sapiens
ggacuaggagcacuguag

SEQ ID NO: 411886 - RNA, 14 nt, Homo sapiens
ggacucugugcuca

SEQ ID NO: 411887 - RNA, 13 nt, Homo sapiens
ggacugaugucau

SEQ ID NO: 411888 - RNA, 20 nt, Homo sapiens
ggacugguccaggcaugggu

SEQ ID NO: 411889 - RNA, 19 nt, Homo sapiens
ggacuguguuuuuccuaug

SEQ ID NO: 411890 - RNA, 15 nt, Homo sapiens
ggacuuccauuugcu

SEQ ID NO: 411891 - RNA, 17 nt, Homo sapiens
ggacuucuggcagggaa

SEQ ID NO: 411892 - RNA, 13 nt, Homo sapiens
ggagaacuagaga

SEQ ID NO: 411893 - RNA, 22 nt, Homo sapiens
ggagaagaggcagauucaauuu

SEQ ID NO: 411894 - RNA, 17 nt, Homo sapiens
ggagaagcaugaaaaag

SEQ ID NO: 411895 - RNA, 14 nt, Homo sapiens
ggagaauugaaaag

SEQ ID NO: 411896 - RNA, 23 nt, Homo sapiens
ggagacacaacuauuuuuccaaa

SEQ ID NO: 411897 - RNA, 22 nt, Homo sapiens
ggagacccauguaaauaccaga

SEQ ID NO: 411898 - RNA, 15 nt, Homo sapiens
ggagaccugugcuag

SEQ ID NO: 411899 - RNA, 14 nt, Homo sapiens
ggagagaaaaaaga

SEQ ID NO: 411900 - RNA, 14 nt, Homo sapiens
ggagagacugugag

SEQ ID NO: 411901 - RNA, 19 nt, Homo sapiens
ggagagagccuuggccuga

SEQ ID NO: 411902 - RNA, 16 nt, Homo sapiens
ggagaggagcgggacc

SEQ ID NO: 411903 - RNA, 14 nt, Homo sapiens
ggagaggggggcca

SEQ ID NO: 411904 - RNA, 19 nt, Homo sapiens
ggagcaaaaggcagcucac

SEQ ID NO: 411905 - RNA, 22 nt, Homo sapiens
ggagcacauuaaaauucucaga

SEQ ID NO: 411906 - RNA, 20 nt, Homo sapiens
ggagcacgaggccuucagaa

SEQ ID NO: 411907 - RNA, 23 nt, Homo sapiens
ggagcacuguuucuuuccagcaa

SEQ ID NO: 411908 - RNA, 14 nt, Homo sapiens
ggagcagcugagau

SEQ ID NO: 411909 - RNA, 13 nt, Homo sapiens
ggagcaggaccua

SEQ ID NO: 411910 - RNA, 21 nt, Homo sapiens
ggagcaggaccuacuaggaga

SEQ ID NO: 411911 - RNA, 10 nt, Homo sapiens
ggagccacuc

SEQ ID NO: 411912 - RNA, 14 nt, Homo sapiens
ggagccaugcucuu

SEQ ID NO: 411913 - RNA, 15 nt, Homo sapiens
ggagcuaacacuggc

SEQ ID NO: 411914 - RNA, 23 nt, Homo sapiens
ggaggaacuuuucaagcugcuga

SEQ ID NO: 411915 - RNA, 23 nt, Homo sapiens
ggaggcaccagcucuguggccug

SEQ ID NO: 411916 - RNA, 14 nt, Homo sapiens
ggaggcaccauuca

SEQ ID NO: 411917 - RNA, 21 nt, Homo sapiens
ggaggcaguuuuuguuccuuc

SEQ ID NO: 411918 - RNA, 19 nt, Homo sapiens
ggaggccccugguggcaug

SEQ ID NO: 411919 - RNA, 14 nt, Homo sapiens
ggagggagggacaa

SEQ ID NO: 411920 - RNA, 17 nt, Homo sapiens
ggagggcaguggcacga

SEQ ID NO: 411921 - RNA, 17 nt, Homo sapiens
ggagggucagugccaag

SEQ ID NO: 411922 - RNA, 13 nt, Homo sapiens
ggagguacuguga

SEQ ID NO: 411923 - RNA, 21 nt, Homo sapiens
ggaggugggcaugccacccuc

SEQ ID NO: 411924 - RNA, 15 nt, Homo sapiens
ggagguugagugagc

SEQ ID NO: 411925 - RNA, 20 nt, Homo sapiens
ggaguagcauggacucuggg

SEQ ID NO: 411926 - RNA, 16 nt, Homo sapiens
ggaguaggacauacca

SEQ ID NO: 411927 - RNA, 14 nt, Homo sapiens
ggaguaggcuguau

SEQ ID NO: 411928 - RNA, 16 nt, Homo sapiens
ggagucagucuucacu

SEQ ID NO: 411929 - RNA, 17 nt, Homo sapiens
ggaguccuguucucaga

SEQ ID NO: 411930 - RNA, 13 nt, Homo sapiens
ggagucuuuguaa

SEQ ID NO: 411931 - RNA, 22 nt, Homo sapiens
ggagugcucaccgccucacuca

SEQ ID NO: 411932 - RNA, 16 nt, Homo sapiens
ggagugggcaccucag

SEQ ID NO: 411933 - RNA, 18 nt, Homo sapiens
ggaguguggccacguggg

SEQ ID NO: 411934 - RNA, 19 nt, Homo sapiens
ggauaauaacuagaucucc

SEQ ID NO: 411935 - RNA, 19 nt, Homo sapiens
ggauagaucaaagucaaaa

SEQ ID NO: 411936 - RNA, 17 nt, Homo sapiens
ggauaggaacugggccu

SEQ ID NO: 411937 - RNA, 19 nt, Homo sapiens
ggauaguagaucuguggcg

SEQ ID NO: 411938 - RNA, 23 nt, Homo sapiens
ggauauguguaaauguuaugacu

SEQ ID NO: 411939 - RNA, 19 nt, Homo sapiens
ggaucacuuaagcccagga

SEQ ID NO: 411940 - RNA, 19 nt, Homo sapiens
ggaucacuugagcccagga

SEQ ID NO: 411941 - RNA, 23 nt, Homo sapiens
ggaucauguaaaugcucaaagau

SEQ ID NO: 411942 - RNA, 19 nt, Homo sapiens
ggauccucuccacuccaug

SEQ ID NO: 411943 - RNA, 21 nt, Homo sapiens
ggauccuguguggagagggaa

SEQ ID NO: 411944 - RNA, 17 nt, Homo sapiens
ggaucuaccagcauaaa

SEQ ID NO: 411945 - RNA, 19 nt, Homo sapiens
ggaucucggucacagggag

SEQ ID NO: 411946 - RNA, 11 nt, Homo sapiens
ggaucuucaau

SEQ ID NO: 411947 - RNA, 20 nt, Homo sapiens
ggaugaaaaaauaacacugu

SEQ ID NO: 411948 - RNA, 22 nt, Homo sapiens
ggaugaaaaaauaacacuguac

SEQ ID NO: 411949 - RNA, 22 nt, Homo sapiens
ggaugaagaacacagcaugugc

SEQ ID NO: 411950 - RNA, 17 nt, Homo sapiens
ggaugaauugccugucc

SEQ ID NO: 411951 - RNA, 18 nt, Homo sapiens
ggauggcuuaagccugug

SEQ ID NO: 411952 - RNA, 16 nt, Homo sapiens
ggaugggaaacugcuc

SEQ ID NO: 411953 - RNA, 15 nt, Homo sapiens
ggauggggacaaaga

SEQ ID NO: 411954 - RNA, 12 nt, Homo sapiens
ggauguacuuaa

SEQ ID NO: 411955 - RNA, 16 nt, Homo sapiens
ggauguguggggcaug

SEQ ID NO: 411956 - RNA, 13 nt, Homo sapiens
ggauuacagggau

SEQ ID NO: 411957 - RNA, 13 nt, Homo sapiens
ggauuacaggugc

SEQ ID NO: 411958 - RNA, 13 nt, Homo sapiens
ggauuaugaagug

SEQ ID NO: 411959 - RNA, 13 nt, Homo sapiens
ggauuauuaacua

SEQ ID NO: 411960 - RNA, 21 nt, Homo sapiens
ggauucauguccagagcucau

SEQ ID NO: 411961 - RNA, 16 nt, Homo sapiens
ggauucucaccguggg

SEQ ID NO: 411962 - RNA, 17 nt, Homo sapiens
ggauugaagcccuccaa

SEQ ID NO: 411963 - RNA, 19 nt, Homo sapiens
ggauugcuaaucaccaaag

SEQ ID NO: 411964 - RNA, 18 nt, Homo sapiens
ggauuggccaaacaucag

SEQ ID NO: 411965 - RNA, 12 nt, Homo sapiens
ggcaaaauaugg

SEQ ID NO: 411966 - RNA, 14 nt, Homo sapiens
ggcaacaugaugaa

SEQ ID NO: 411967 - RNA, 12 nt, Homo sapiens
ggcaaccagauu

SEQ ID NO: 411968 - RNA, 17 nt, Homo sapiens
ggcaacgacgguuucaa

SEQ ID NO: 411969 - RNA, 18 nt, Homo sapiens
ggcaacgugcgugucucu

SEQ ID NO: 411970 - RNA, 22 nt, Homo sapiens
ggcaacuucaguccugggagac

SEQ ID NO: 411971 - RNA, 13 nt, Homo sapiens
ggucuucuuccaa

SEQ ID NO: 411972 - RNA, 17 nt, Homo sapiens
ggugaaaauccaucuca

SEQ ID NO: 411973 - RNA, 23 nt, Homo sapiens
ggugaaacccuacgaaagcacag

SEQ ID NO: 411974 - RNA, 20 nt, Homo sapiens
ggugaaccuuaguaccuaaa

SEQ ID NO: 411975 - RNA, 18 nt, Homo sapiens
ggugaaggcccagccugu

SEQ ID NO: 411976 - RNA, 19 nt, Homo sapiens
ggugaagggagagccagcu

SEQ ID NO: 411977 - RNA, 14 nt, Homo sapiens
ggugacagagcaag

SEQ ID NO: 411978 - RNA, 15 nt, Homo sapiens
ggugaucucaucucc

SEQ ID NO: 411979 - RNA, 18 nt, Homo sapiens
ggugaugcaagucacuaa

SEQ ID NO: 411980 - RNA, 19 nt, Homo sapiens
ggugauuucuagaaugguu

SEQ ID NO: 411981 - RNA, 19 nt, Homo sapiens
ggugcacuuuucuguguca

SEQ ID NO: 411982 - RNA, 16 nt, Homo sapiens
ggugcaguaaccauuu

SEQ ID NO: 411983 - RNA, 21 nt, Homo sapiens
ggugcaugauaagagcaucuc

SEQ ID NO: 411984 - RNA, 15 nt, Homo sapiens
ggugccaaguuccac

SEQ ID NO: 411985 - RNA, 18 nt, Homo sapiens
ggugcccuuugggguccc

SEQ ID NO: 411986 - RNA, 22 nt, Homo sapiens
ggugccuucucacaucugucca

SEQ ID NO: 411987 - RNA, 20 nt, Homo sapiens
ggugccuuuugugugaugcg

SEQ ID NO: 411988 - RNA, 17 nt, Homo sapiens
ggugcguuuggccaaaa

SEQ ID NO: 411989 - RNA, 16 nt, Homo sapiens
ggugcucacgacucuu

SEQ ID NO: 411990 - RNA, 12 nt, Homo sapiens
ggugcugagcuu

SEQ ID NO: 411991 - RNA, 17 nt, Homo sapiens
ggugcugcuuucuuguu

SEQ ID NO: 411992 - RNA, 12 nt, Homo sapiens
gguggcaauaaa

SEQ ID NO: 411993 - RNA, 17 nt, Homo sapiens
gguggccccagcuguga

SEQ ID NO: 411994 - RNA, 20 nt, Homo sapiens
gguggccccuccccaacucc

SEQ ID NO: 411995 - RNA, 19 nt, Homo sapiens
gguggccgucacgcuuuca

SEQ ID NO: 411996 - RNA, 23 nt, Homo sapiens
ggugggaggccccugguggcaug

SEQ ID NO: 411997 - RNA, 17 nt, Homo sapiens
ggugggggaugcugagg

SEQ ID NO: 411998 - RNA, 23 nt, Homo sapiens
gguggguaagacuaaaucuguaa

SEQ ID NO: 411999 - RNA, 13 nt, Homo sapiens
ggugguaccugag

SEQ ID NO: 412000 - RNA, 14 nt, Homo sapiens
gguggucuuggaga

SEQ ID NO: 412001 - RNA, 22 nt, Homo sapiens
gguggugcagccccaggaccaa

SEQ ID NO: 412002 - RNA, 22 nt, Homo sapiens
ggugguuuuugagccaugcgug

SEQ ID NO: 412003 - RNA, 18 nt, Homo sapiens
gguguaauuccucccuaa

SEQ ID NO: 412004 - RNA, 21 nt, Homo sapiens
gguguccuguuccugccacau

SEQ ID NO: 412005 - RNA, 21 nt, Homo sapiens
gguguccuuucccuccacucc

SEQ ID NO: 412006 - RNA, 17 nt, Homo sapiens
gguguuguaugccuuua

SEQ ID NO: 412007 - RNA, 12 nt, Homo sapiens
gguuacaaagac

SEQ ID NO: 412008 - RNA, 14 nt, Homo sapiens
gguuagccugguga

SEQ ID NO: 412009 - RNA, 19 nt, Homo sapiens
gguucagggaacugcuugc

SEQ ID NO: 412010 - RNA, 12 nt, Homo sapiens
gguuccauccac

SEQ ID NO: 412011 - RNA, 22 nt, Homo sapiens
gguucuaggagaacugucauga

SEQ ID NO: 412012 - RNA, 15 nt, Homo sapiens
gguucuccaggugau

SEQ ID NO: 412013 - RNA, 22 nt, Homo sapiens
gguucuuuccaugcagacuccu

SEQ ID NO: 412014 - RNA, 22 nt, Homo sapiens
gguugaaaaauggcaaagaauu

SEQ ID NO: 412015 - RNA, 23 nt, Homo sapiens
gguugauauauucuuuccaugca

SEQ ID NO: 412016 - RNA, 15 nt, Homo sapiens
gguugcacguuaaaa

SEQ ID NO: 412017 - RNA, 21 nt, Homo sapiens
gguugcuguugugcagugugc

SEQ ID NO: 412018 - RNA, 21 nt, Homo sapiens
gguuggaaagaguugccauaa

SEQ ID NO: 412019 - RNA, 17 nt, Homo sapiens
gguuggagcgagcaucc

SEQ ID NO: 412020 - RNA, 13 nt, Homo sapiens
gguuuagaaucaa

SEQ ID NO: 412021 - RNA, 18 nt, Homo sapiens
gguuuauugaaugugauu

SEQ ID NO: 412022 - RNA, 19 nt, Homo sapiens
gguuucccuguguggacca

SEQ ID NO: 412023 - RNA, 20 nt, Homo sapiens
gguuucugagagagugccau

SEQ ID NO: 412024 - RNA, 18 nt, Homo sapiens
gguuuuuguuaccuuuau

SEQ ID NO: 412025 - RNA, 16 nt, Homo sapiens
gguuuuuuagugcaau

SEQ ID NO: 412026 - RNA, 20 nt, Homo sapiens
guaaaacagaauauucugua

SEQ ID NO: 412027 - RNA, 17 nt, Homo sapiens
guaaaagcaacaucagc

SEQ ID NO: 412028 - RNA, 17 nt, Homo sapiens
guaaaagccuaugugcc

SEQ ID NO: 412029 - RNA, 13 nt, Homo sapiens
guaaaauacuucu

SEQ ID NO: 412030 - RNA, 18 nt, Homo sapiens
guaaaauagggcuuugua

SEQ ID NO: 412031 - RNA, 22 nt, Homo sapiens
guaaacaguuugaaaagacaaa

SEQ ID NO: 412032 - RNA, 18 nt, Homo sapiens
guaaacuaguacuauuau

SEQ ID NO: 412033 - RNA, 17 nt, Homo sapiens
guaaagauaaaaggaua

SEQ ID NO: 412034 - RNA, 15 nt, Homo sapiens
guaaauaaauacauu

SEQ ID NO: 412035 - RNA, 16 nt, Homo sapiens
guaaauaguauuugag

SEQ ID NO: 412036 - RNA, 22 nt, Homo sapiens
guaaauauauuucaaaacuuca

SEQ ID NO: 412037 - RNA, 16 nt, Homo sapiens
guaaauggaacaaaca

SEQ ID NO: 412038 - RNA, 20 nt, Homo sapiens
guaaauggaacaaacaauga

SEQ ID NO: 412039 - RNA, 21 nt, Homo sapiens
guaaauuuuggaaacaguaca

SEQ ID NO: 412040 - RNA, 19 nt, Homo sapiens
guaacaagaaaacauaaga

SEQ ID NO: 412041 - RNA, 16 nt, Homo sapiens
guaaccucuacaggca

SEQ ID NO: 412042 - RNA, 19 nt, Homo sapiens
guaacgaaugguacuacaa

SEQ ID NO: 412043 - RNA, 18 nt, Homo sapiens
guaagacuaaaucuguaa

SEQ ID NO: 412044 - RNA, 18 nt, Homo sapiens
guaagagcuggugucuga

SEQ ID NO: 412045 - RNA, 13 nt, Homo sapiens
guaagcauuuuag

SEQ ID NO: 412046 - RNA, 20 nt, Homo sapiens
guaaggauaugagccuuugc

SEQ ID NO: 412047 - RNA, 17 nt, Homo sapiens
guaaggcagcucugucg

SEQ ID NO: 412048 - RNA, 12 nt, Homo sapiens
guaaggcugugg

SEQ ID NO: 412049 - RNA, 22 nt, Homo sapiens
guaaggucuucuuguguccuga

SEQ ID NO: 412050 - RNA, 22 nt, Homo sapiens
guaauagcugaaccuguucaaa

SEQ ID NO: 412051 - RNA, 15 nt, Homo sapiens
guaaucaucauagaa

SEQ ID NO: 412052 - RNA, 18 nt, Homo sapiens
guaaucccagcuacucag

SEQ ID NO: 412053 - RNA, 16 nt, Homo sapiens
guaaucccagcuacuu

SEQ ID NO: 412054 - RNA, 19 nt, Homo sapiens
guaaucccaguacuuggga

SEQ ID NO: 412055 - RNA, 16 nt, Homo sapiens
guaauccuagcacuuu

SEQ ID NO: 412056 - RNA, 16 nt, Homo sapiens
guaaucucagcacuuu

SEQ ID NO: 412057 - RNA, 12 nt, Homo sapiens
guaaucucugau

SEQ ID NO: 412058 - RNA, 17 nt, Homo sapiens
guaaugcagacauuuac

SEQ ID NO: 412059 - RNA, 13 nt, Homo sapiens
guaauuaucugug

SEQ ID NO: 412060 - RNA, 20 nt, Homo sapiens
guaauugcagauaacuuuga

SEQ ID NO: 412061 - RNA, 22 nt, Homo sapiens
guaauuguaaacuaguacuauu

SEQ ID NO: 412062 - RNA, 15 nt, Homo sapiens
guaauuguuacaauu

SEQ ID NO: 412063 - RNA, 18 nt, Homo sapiens
guaauuuuguaucuugau

SEQ ID NO: 412064 - RNA, 18 nt, Homo sapiens
guacaaagacagggaaua

SEQ ID NO: 412065 - RNA, 13 nt, Homo sapiens
guacaagcugaug

SEQ ID NO: 412066 - RNA, 18 nt, Homo sapiens
guacaaguuuuguauaaa

SEQ ID NO: 412067 - RNA, 17 nt, Homo sapiens
guacaauuuucauccca

SEQ ID NO: 412068 - RNA, 18 nt, Homo sapiens
guacaauuuucaucccac

SEQ ID NO: 412069 - RNA, 13 nt, Homo sapiens
guacacaguuuaa

SEQ ID NO: 412070 - RNA, 17 nt, Homo sapiens
guacaguuauacauacc

SEQ ID NO: 412071 - RNA, 19 nt, Homo sapiens
guacauucacagcacgggc

SEQ ID NO: 412072 - RNA, 20 nt, Homo sapiens
guacauugggcacauaucuc

SEQ ID NO: 412073 - RNA, 22 nt, Homo sapiens
guacccaccugagcuuuggaca

SEQ ID NO: 412074 - RNA, 13 nt, Homo sapiens
guaccucuaagua

SEQ ID NO: 412075 - RNA, 14 nt, Homo sapiens
guaccucucuuaua

SEQ ID NO: 412076 - RNA, 21 nt, Homo sapiens
guaccuguaggaaacagaaaa

SEQ ID NO: 412077 - RNA, 16 nt, Homo sapiens
guaccuuauugaucuu

SEQ ID NO: 412078 - RNA, 15 nt, Homo sapiens
guaccuuucugacaa

SEQ ID NO: 412079 - RNA, 20 nt, Homo sapiens
guaccuuucuucacugcaga

SEQ ID NO: 412080 - RNA, 18 nt, Homo sapiens
guacguggagagggauga

SEQ ID NO: 412081 - RNA, 19 nt, Homo sapiens
guacuaugacacuguuaau

SEQ ID NO: 412082 - RNA, 15 nt, Homo sapiens
guacuauuacuauua

SEQ ID NO: 412083 - RNA, 16 nt, Homo sapiens
guacuccuuaagaaca

SEQ ID NO: 412084 - RNA, 21 nt, Homo sapiens
guacuucaaguuaaagugaau

SEQ ID NO: 412085 - RNA, 22 nt, Homo sapiens
guacuuuguuuuuccauguguu

SEQ ID NO: 412086 - RNA, 14 nt, Homo sapiens
guagaaugcuguag

SEQ ID NO: 412087 - RNA, 20 nt, Homo sapiens
guagaauuguuuggcaaugc

SEQ ID NO: 412088 - RNA, 20 nt, Homo sapiens
guagagacaguguuuugcca

SEQ ID NO: 412089 - RNA, 17 nt, Homo sapiens
guagagagcaagggaag

SEQ ID NO: 412090 - RNA, 20 nt, Homo sapiens
guagaggcuuagagacaguu

SEQ ID NO: 412091 - RNA, 18 nt, Homo sapiens
guagagguuuuguuguuu

SEQ ID NO: 412092 - RNA, 23 nt, Homo sapiens
guagagguuuuuuuccuccuugu

SEQ ID NO: 412093 - RNA, 15 nt, Homo sapiens
guagagucacuggaa

SEQ ID NO: 412094 - RNA, 15 nt, Homo sapiens
guagagucaucucca

SEQ ID NO: 412095 - RNA, 21 nt, Homo sapiens
guagauacaaucagcugcuuu

SEQ ID NO: 412096 - RNA, 15 nt, Homo sapiens
guagauauuaauuaa

SEQ ID NO: 412097 - RNA, 20 nt, Homo sapiens
guagauauuguuuucuguaa

SEQ ID NO: 412098 - RNA, 23 nt, Homo sapiens
guagauccagauccagacuguaa

SEQ ID NO: 412099 - RNA, 15 nt, Homo sapiens
guagauguagcauug

SEQ ID NO: 412100 - RNA, 18 nt, Homo sapiens
gugccacuugacauuccu

SEQ ID NO: 412101 - RNA, 22 nt, Homo sapiens
gugccagaaagagagaaccaag

SEQ ID NO: 412102 - RNA, 17 nt, Homo sapiens
gugccagaauccucuca

SEQ ID NO: 412103 - RNA, 15 nt, Homo sapiens
gugccagcuguuuca

SEQ ID NO: 412104 - RNA, 22 nt, Homo sapiens
gugccagguggcucagugccac

SEQ ID NO: 412105 - RNA, 17 nt, Homo sapiens
gugccaguggcuuauua

SEQ ID NO: 412106 - RNA, 12 nt, Homo sapiens
gugcccagugau

SEQ ID NO: 412107 - RNA, 22 nt, Homo sapiens
gugccccacagcuaccugagac

SEQ ID NO: 412108 - RNA, 20 nt, Homo sapiens
gugcccccagacgcacgugg

SEQ ID NO: 412109 - RNA, 17 nt, Homo sapiens
gugccccccuccuccag

SEQ ID NO: 412110 - RNA, 18 nt, Homo sapiens
gugccccccuccuccagu

SEQ ID NO: 412111 - RNA, 16 nt, Homo sapiens
gugcccgccaccacgc

SEQ ID NO: 412112 - RNA, 17 nt, Homo sapiens
gugcccuuugggguccc

SEQ ID NO: 412113 - RNA, 14 nt, Homo sapiens
gugccuaacaccag

SEQ ID NO: 412114 - RNA, 16 nt, Homo sapiens
gugccuaauguuccau

SEQ ID NO: 412115 - RNA, 19 nt, Homo sapiens
gugccuauggguugucaau

SEQ ID NO: 412116 - RNA, 19 nt, Homo sapiens
gugccuauggguuguuaau

SEQ ID NO: 412117 - RNA, 19 nt, Homo sapiens
gugccucagcuucccaagc

SEQ ID NO: 412118 - RNA, 18 nt, Homo sapiens
gugccuccccccagaccc

SEQ ID NO: 412119 - RNA, 23 nt, Homo sapiens
gugccucuuuuaaugucaucucu

SEQ ID NO: 412120 - RNA, 21 nt, Homo sapiens
gugccuguacaagcugauguu

SEQ ID NO: 412121 - RNA, 17 nt, Homo sapiens
gugccuugagcugccug

SEQ ID NO: 412122 - RNA, 18 nt, Homo sapiens
gugccuuugaccaucucu

SEQ ID NO: 412123 - RNA, 17 nt, Homo sapiens
gugcgugugcgugcaug

SEQ ID NO: 412124 - RNA, 22 nt, Homo sapiens
gugcuaauccaggacagcauua

SEQ ID NO: 412125 - RNA, 20 nt, Homo sapiens
gugcuaucgcaccacugugu

SEQ ID NO: 412126 - RNA, 14 nt, Homo sapiens
gugcuccaguucca

SEQ ID NO: 412127 - RNA, 23 nt, Homo sapiens
gugcuccugugggagaucuucac

SEQ ID NO: 412128 - RNA, 20 nt, Homo sapiens
gugcugagaauaaaaccagc

SEQ ID NO: 412129 - RNA, 12 nt, Homo sapiens
gugcugggacag

SEQ ID NO: 412130 - RNA, 16 nt, Homo sapiens
gugcugggacagcuag

SEQ ID NO: 412131 - RNA, 19 nt, Homo sapiens
gugcugggauuacagggau

SEQ ID NO: 412132 - RNA, 14 nt, Homo sapiens
gugcugguauacua

SEQ ID NO: 412133 - RNA, 18 nt, Homo sapiens
gugcuuaaaaaucauuga

SEQ ID NO: 412134 - RNA, 15 nt, Homo sapiens
gugcuuguucuuccu

SEQ ID NO: 412135 - RNA, 23 nt, Homo sapiens
gugcuuguucuuccucuuaccug

SEQ ID NO: 412136 - RNA, 20 nt, Homo sapiens
gugcuuuauaccccauuuga

SEQ ID NO: 412137 - RNA, 16 nt, Homo sapiens
gugcuuuugcaaaaga

SEQ ID NO: 412138 - RNA, 18 nt, Homo sapiens
guggaaaccuugcugcua

SEQ ID NO: 412139 - RNA, 18 nt, Homo sapiens
guggaaccaacacuaaca

SEQ ID NO: 412140 - RNA, 16 nt, Homo sapiens
guggaaugcagggaag

SEQ ID NO: 412141 - RNA, 17 nt, Homo sapiens
guggacacgcgugauug

SEQ ID NO: 412142 - RNA, 12 nt, Homo sapiens
guggacgaggga

SEQ ID NO: 412143 - RNA, 13 nt, Homo sapiens
guggagagaccag

SEQ ID NO: 412144 - RNA, 16 nt, Homo sapiens
guggagauagugccag

SEQ ID NO: 412145 - RNA, 22 nt, Homo sapiens
guggagcacaaaagccucucau

SEQ ID NO: 412146 - RNA, 12 nt, Homo sapiens
guggagggguca

SEQ ID NO: 412147 - RNA, 17 nt, Homo sapiens
guggauacagucauuau

SEQ ID NO: 412148 - RNA, 15 nt, Homo sapiens
guggaugaugcugcc

SEQ ID NO: 412149 - RNA, 17 nt, Homo sapiens
guggauugcucaucuca

SEQ ID NO: 412150 - RNA, 14 nt, Homo sapiens
guggcaaaugccag

SEQ ID NO: 412151 - RNA, 21 nt, Homo sapiens
guggcagauaaucagccucuu

SEQ ID NO: 412152 - RNA, 20 nt, Homo sapiens
guggcagcggggcaagcaaa

SEQ ID NO: 412153 - RNA, 23 nt, Homo sapiens
guggcagcugucucaaaccucca

SEQ ID NO: 412154 - RNA, 16 nt, Homo sapiens
guggcaguggccaggc

SEQ ID NO: 412155 - RNA, 14 nt, Homo sapiens
guggcaucaggaaa

SEQ ID NO: 412156 - RNA, 23 nt, Homo sapiens
guggcaugaagauuuucuuucuc

SEQ ID NO: 412157 - RNA, 18 nt, Homo sapiens
guggccgaggacuuugau

SEQ ID NO: 412158 - RNA, 19 nt, Homo sapiens
guggccuaauuuacaagca

SEQ ID NO: 412159 - RNA, 17 nt, Homo sapiens
guggccucucagucaaa

SEQ ID NO: 412160 - RNA, 14 nt, Homo sapiens
guggcgacucuaua

SEQ ID NO: 412161 - RNA, 15 nt, Homo sapiens
guggcggggcagcag

SEQ ID NO: 412162 - RNA, 22 nt, Homo sapiens
guggcuucuuuugaacuguuag

SEQ ID NO: 412163 - RNA, 21 nt, Homo sapiens
gugggagcuugauucucagca

SEQ ID NO: 412164 - RNA, 17 nt, Homo sapiens
gugggauccucccucau

SEQ ID NO: 412165 - RNA, 15 nt, Homo sapiens
gugggcaccucagaa

SEQ ID NO: 412166 - RNA, 12 nt, Homo sapiens
gugggcugugag

SEQ ID NO: 412167 - RNA, 20 nt, Homo sapiens
guggggggugacagugccuu

SEQ ID NO: 412168 - RNA, 20 nt, Homo sapiens
guggggugugcacaucucug

SEQ ID NO: 412169 - RNA, 13 nt, Homo sapiens
gugguagcucuga

SEQ ID NO: 412170 - RNA, 14 nt, Homo sapiens
gugguagcucugag

SEQ ID NO: 412171 - RNA, 15 nt, Homo sapiens
guggucuaaacaaaa

SEQ ID NO: 412172 - RNA, 17 nt, Homo sapiens
guggugaacagaacaaa

SEQ ID NO: 412173 - RNA, 21 nt, Homo sapiens
guggugaccaaugcauuaccu

SEQ ID NO: 412174 - RNA, 23 nt, Homo sapiens
guggugcagccccaggaccaagc

SEQ ID NO: 412175 - RNA, 17 nt, Homo sapiens
guguaaccagcagucac

SEQ ID NO: 412176 - RNA, 16 nt, Homo sapiens
guguaccugccauaac

SEQ ID NO: 412177 - RNA, 20 nt, Homo sapiens
guguacguggagagggauga

SEQ ID NO: 412178 - RNA, 23 nt, Homo sapiens
guguauauaguaugaaugcagug

SEQ ID NO: 412179 - RNA, 22 nt, Homo sapiens
guguaugugcgugugugcaagu

SEQ ID NO: 412180 - RNA, 23 nt, Homo sapiens
guguauuuuuauuuuccugugac

SEQ ID NO: 412181 - RNA, 18 nt, Homo sapiens
gugucaacuuucauuuga

SEQ ID NO: 412182 - RNA, 19 nt, Homo sapiens
gugucacuugacucuugaa

SEQ ID NO: 412183 - RNA, 22 nt, Homo sapiens
gugucagagcugggaguagcau

SEQ ID NO: 412184 - RNA, 20 nt, Homo sapiens
gugucauauauggggggcca

SEQ ID NO: 412185 - RNA, 13 nt, Homo sapiens
gugucaucuguca

SEQ ID NO: 412186 - RNA, 15 nt, Homo sapiens
gugucaucugucagc

SEQ ID NO: 412187 - RNA, 16 nt, Homo sapiens
gugucauuucuuuuag

SEQ ID NO: 412188 - RNA, 14 nt, Homo sapiens
guguccacauaauc

SEQ ID NO: 412189 - RNA, 11 nt, Homo sapiens
guguccaugcc

SEQ ID NO: 412190 - RNA, 20 nt, Homo sapiens
guguccccugaccuguccag

SEQ ID NO: 412191 - RNA, 15 nt, Homo sapiens
gugucuaaugcauua

SEQ ID NO: 412192 - RNA, 17 nt, Homo sapiens
gugucuaguuugcauac

SEQ ID NO: 412193 - RNA, 15 nt, Homo sapiens
gugucuauuuggcaa

SEQ ID NO: 412194 - RNA, 23 nt, Homo sapiens
gugucuccuuaugguacacucca

SEQ ID NO: 412195 - RNA, 13 nt, Homo sapiens
gugucucugccau

SEQ ID NO: 412196 - RNA, 16 nt, Homo sapiens
gugucuuggcacuguu

SEQ ID NO: 412197 - RNA, 17 nt, Homo sapiens
gugugaagaaauggaau

SEQ ID NO: 412198 - RNA, 15 nt, Homo sapiens
gugugagugugugca

SEQ ID NO: 412199 - RNA, 18 nt, Homo sapiens
gugugcaagugugugcau

SEQ ID NO: 412200 - RNA, 18 nt, Homo sapiens
gugugcauaauuuugcca

SEQ ID NO: 412201 - RNA, 14 nt, Homo sapiens
gugugcgugcaugu

SEQ ID NO: 412202 - RNA, 23 nt, Homo sapiens
gugugcuuauuuuaaauguuacu

SEQ ID NO: 412203 - RNA, 14 nt, Homo sapiens
guguggaguggagg

SEQ ID NO: 412204 - RNA, 17 nt, Homo sapiens
guguggcuuaaacauuu

SEQ ID NO: 412205 - RNA, 20 nt, Homo sapiens
gugugguauucaacuaauac

SEQ ID NO: 412206 - RNA, 17 nt, Homo sapiens
guguguagaaacacagc

SEQ ID NO: 412207 - RNA, 23 nt, Homo sapiens
guguguaugugcgugugugcaag

SEQ ID NO: 412208 - RNA, 23 nt, Homo sapiens
guguguccaugugugugcaagug

SEQ ID NO: 412209 - RNA, 23 nt, Homo sapiens
gugugucgcuuaugucuauaacu

SEQ ID NO: 412210 - RNA, 20 nt, Homo sapiens
gugugugcaaguaugugagu

SEQ ID NO: 412211 - RNA, 15 nt, Homo sapiens
guguguguugucuga

SEQ ID NO: 412212 - RNA, 21 nt, Homo sapiens
guguuaucagucauaacuaaa

SEQ ID NO: 412213 - RNA, 16 nt, Homo sapiens
guguucacacuguaaa

SEQ ID NO: 412214 - RNA, 22 nt, Homo sapiens
guguucacacuguaaacauuca

SEQ ID NO: 412215 - RNA, 21 nt, Homo sapiens
guguucgcuuggcuccaugcu

SEQ ID NO: 412216 - RNA, 19 nt, Homo sapiens
guguucuacacucaucuua

SEQ ID NO: 412217 - RNA, 12 nt, Homo sapiens
guguugacugcu

SEQ ID NO: 412218 - RNA, 13 nt, Homo sapiens
guguugcauaaac

SEQ ID NO: 412219 - RNA, 14 nt, Homo sapiens
guguugcaugcagc

SEQ ID NO: 412220 - RNA, 20 nt, Homo sapiens
guguuuauauauaagccaaa

SEQ ID NO: 412221 - RNA, 15 nt, Homo sapiens
guguuuauugucaaa

SEQ ID NO: 412222 - RNA, 21 nt, Homo sapiens
guguuucuuguuaagugcuuu

SEQ ID NO: 412223 - RNA, 19 nt, Homo sapiens
guguuugucaaaaagucau

SEQ ID NO: 412224 - RNA, 13 nt, Homo sapiens
guguuugugcuga

SEQ ID NO: 412225 - RNA, 19 nt, Homo sapiens
guuaaacccacagccaaac

SEQ ID NO: 412226 - RNA, 14 nt, Homo sapiens
guuaaagugaauaa

SEQ ID NO: 412227 - RNA, 18 nt, Homo sapiens
guuaaaugaaauuguaaa

SEQ ID NO: 412228 - RNA, 14 nt, Homo sapiens
guuaaaugaacuug

SEQ ID NO: 412229 - RNA, 11 nt, Homo sapiens
ugaaucuuccc

SEQ ID NO: 412230 - RNA, 12 nt, Homo sapiens
ugaaucuugucc

SEQ ID NO: 412231 - RNA, 22 nt, Homo sapiens
ugaaugaaagucuugugacuag

SEQ ID NO: 412232 - RNA, 15 nt, Homo sapiens
ugaaugacauugaac

SEQ ID NO: 412233 - RNA, 15 nt, Homo sapiens
ugaaugaugccauga

SEQ ID NO: 412234 - RNA, 18 nt, Homo sapiens
ugaaugaugccaugagga

SEQ ID NO: 412235 - RNA, 21 nt, Homo sapiens
ugaaugccaguccagaugugc

SEQ ID NO: 412236 - RNA, 23 nt, Homo sapiens
ugaaugcuccauuaauccaggga

SEQ ID NO: 412237 - RNA, 11 nt, Homo sapiens
ugaaugugauu

SEQ ID NO: 412238 - RNA, 18 nt, Homo sapiens
ugaauguugugauguauu

SEQ ID NO: 412239 - RNA, 21 nt, Homo sapiens
ugaauguuuuauggaauugaa

SEQ ID NO: 412240 - RNA, 13 nt, Homo sapiens
ugaauucaagaaa

SEQ ID NO: 412241 - RNA, 21 nt, Homo sapiens
ugaauuguaaaagcaacauca

SEQ ID NO: 412242 - RNA, 17 nt, Homo sapiens
ugaauuguaaggaauga

SEQ ID NO: 412243 - RNA, 17 nt, Homo sapiens
ugaauuuucaaguaauu

SEQ ID NO: 412244 - RNA, 16 nt, Homo sapiens
ugaauuuugaaccaug

SEQ ID NO: 412245 - RNA, 16 nt, Homo sapiens
ugaauuuuggcugugu

SEQ ID NO: 412246 - RNA, 22 nt, Homo sapiens
ugacaaauauuuuagaagcuaa

SEQ ID NO: 412247 - RNA, 15 nt, Homo sapiens
ugacaacuuugccag

SEQ ID NO: 412248 - RNA, 16 nt, Homo sapiens
ugacaaucaacucuaa

SEQ ID NO: 412249 - RNA, 23 nt, Homo sapiens
ugacaaucaacucuaauagugcu

SEQ ID NO: 412250 - RNA, 15 nt, Homo sapiens
ugacaauggcagcua

SEQ ID NO: 412251 - RNA, 18 nt, Homo sapiens
ugacacacucaccauuua

SEQ ID NO: 412252 - RNA, 12 nt, Homo sapiens
ugacacagcagc

SEQ ID NO: 412253 - RNA, 14 nt, Homo sapiens
ugacacggccauga

SEQ ID NO: 412254 - RNA, 20 nt, Homo sapiens
ugacacggccaugaccacuu

SEQ ID NO: 412255 - RNA, 19 nt, Homo sapiens
ugacagacaggcucuuagc

SEQ ID NO: 412256 - RNA, 18 nt, Homo sapiens
ugacagaguucacuauaa

SEQ ID NO: 412257 - RNA, 12 nt, Homo sapiens
ugacagccuccc

SEQ ID NO: 412258 - RNA, 21 nt, Homo sapiens
ugacaggaagcccaaggcagu

SEQ ID NO: 412259 - RNA, 16 nt, Homo sapiens
ugacagggaugccaac

SEQ ID NO: 412260 - RNA, 17 nt, Homo sapiens
ugacaguaaaucucaca

SEQ ID NO: 412261 - RNA, 20 nt, Homo sapiens
ugacaguaaaucucacaaau

SEQ ID NO: 412262 - RNA, 16 nt, Homo sapiens
ugacagucuugugcuu

SEQ ID NO: 412263 - RNA, 17 nt, Homo sapiens
ugacagugccugggaau

SEQ ID NO: 412264 - RNA, 19 nt, Homo sapiens
ugacauaaacccaucugua

SEQ ID NO: 412265 - RNA, 20 nt, Homo sapiens
ugacauaaacccaucuguaa

SEQ ID NO: 412266 - RNA, 15 nt, Homo sapiens
ugacaucaguggcau

SEQ ID NO: 412267 - RNA, 16 nt, Homo sapiens
ugacaucaguggcaug

SEQ ID NO: 412268 - RNA, 14 nt, Homo sapiens
ugacauccaagcuu

SEQ ID NO: 412269 - RNA, 17 nt, Homo sapiens
ugacaucgguucaggag

SEQ ID NO: 412270 - RNA, 21 nt, Homo sapiens
ugacaugugacaucuaccucc

SEQ ID NO: 412271 - RNA, 17 nt, Homo sapiens
ugacauucuucacuguc

SEQ ID NO: 412272 - RNA, 20 nt, Homo sapiens
ugacauuuaauaacuuugcu

SEQ ID NO: 412273 - RNA, 21 nt, Homo sapiens
ugacauuuaauaacuuugcug

SEQ ID NO: 412274 - RNA, 15 nt, Homo sapiens
ugacauuugguggua

SEQ ID NO: 412275 - RNA, 22 nt, Homo sapiens
ugaccaacggugguaugcugca

SEQ ID NO: 412276 - RNA, 18 nt, Homo sapiens
ugaccaggacuaaugcau

SEQ ID NO: 412277 - RNA, 17 nt, Homo sapiens
ugaccaguugcacuugg

SEQ ID NO: 412278 - RNA, 16 nt, Homo sapiens
ugaccaguuguugaua

SEQ ID NO: 412279 - RNA, 20 nt, Homo sapiens
ugaccauaaaauuagacaua

SEQ ID NO: 412280 - RNA, 23 nt, Homo sapiens
ugaccaucucuuaggucuaauga

SEQ ID NO: 412281 - RNA, 19 nt, Homo sapiens
ugacccccugcugccaucu

SEQ ID NO: 412282 - RNA, 21 nt, Homo sapiens
ugaccccuuccugucuggccc

SEQ ID NO: 412283 - RNA, 16 nt, Homo sapiens
ugacccucucacuuug

SEQ ID NO: 412284 - RNA, 14 nt, Homo sapiens
ugaccggcugcuuu

SEQ ID NO: 412285 - RNA, 14 nt, Homo sapiens
ugaccuaaccacuu

SEQ ID NO: 412286 - RNA, 16 nt, Homo sapiens
ugaccucacugugacc

SEQ ID NO: 412287 - RNA, 12 nt, Homo sapiens
ugaccucagcug

SEQ ID NO: 412288 - RNA, 21 nt, Homo sapiens
ugaccucagcugcacauuccu

SEQ ID NO: 412289 - RNA, 16 nt, Homo sapiens
ugaccucugccccaga

SEQ ID NO: 412290 - RNA, 19 nt, Homo sapiens
ugaccugauuuccauuugc

SEQ ID NO: 412291 - RNA, 19 nt, Homo sapiens
ugaccuugaaugaugccau

SEQ ID NO: 412292 - RNA, 20 nt, Homo sapiens
ugacgagcaugagcuggaug

SEQ ID NO: 412293 - RNA, 14 nt, Homo sapiens
ugacgcguggucac

SEQ ID NO: 412294 - RNA, 12 nt, Homo sapiens
ugacggugucca

SEQ ID NO: 412295 - RNA, 15 nt, Homo sapiens
ugacgucaucuuguc

SEQ ID NO: 412296 - RNA, 17 nt, Homo sapiens
ugacuaaccauugauga

SEQ ID NO: 412297 - RNA, 21 nt, Homo sapiens
ugacuauucuugauguaaaau

SEQ ID NO: 412298 - RNA, 20 nt, Homo sapiens
ugacucaccuugcucugcca

SEQ ID NO: 412299 - RNA, 22 nt, Homo sapiens
ugacucagcauagauuguauaa

SEQ ID NO: 412300 - RNA, 14 nt, Homo sapiens
ugacugaaacauuc

SEQ ID NO: 412301 - RNA, 19 nt, Homo sapiens
ugacugaagugaacuauga

SEQ ID NO: 412302 - RNA, 12 nt, Homo sapiens
ugacugagggcc

SEQ ID NO: 412303 - RNA, 16 nt, Homo sapiens
ugacugccacccacac

SEQ ID NO: 412304 - RNA, 17 nt, Homo sapiens
ugacugcugcuccccac

SEQ ID NO: 412305 - RNA, 14 nt, Homo sapiens
ugacuggcacccaa

SEQ ID NO: 412306 - RNA, 21 nt, Homo sapiens
ugacuggcacccaauguuuga

SEQ ID NO: 412307 - RNA, 16 nt, Homo sapiens
ugacugucccuucgac

SEQ ID NO: 412308 - RNA, 15 nt, Homo sapiens
ugacuuaaguggcau

SEQ ID NO: 412309 - RNA, 18 nt, Homo sapiens
ugacuuaguugcguuaca

SEQ ID NO: 412310 - RNA, 17 nt, Homo sapiens
ugacuucacccacgcau

SEQ ID NO: 412311 - RNA, 19 nt, Homo sapiens
ugacuucagaguacaucca

SEQ ID NO: 412312 - RNA, 18 nt, Homo sapiens
ugacuucagcugccugaa

SEQ ID NO: 412313 - RNA, 13 nt, Homo sapiens
ugacuucaugcca

SEQ ID NO: 412314 - RNA, 18 nt, Homo sapiens
ugacuuuugaagaacaaa

SEQ ID NO: 412315 - RNA, 13 nt, Homo sapiens
ugagaaaacagau

SEQ ID NO: 412316 - RNA, 16 nt, Homo sapiens
ugagaaaacaggcuca

SEQ ID NO: 412317 - RNA, 22 nt, Homo sapiens
ugagaaaacaggcucacagaga

SEQ ID NO: 412318 - RNA, 15 nt, Homo sapiens
ugagaaacugauuua

SEQ ID NO: 412319 - RNA, 22 nt, Homo sapiens
ugagaaacuuugaucucugcuu

SEQ ID NO: 412320 - RNA, 17 nt, Homo sapiens
ugagaaagaaacuaaua

SEQ ID NO: 412321 - RNA, 18 nt, Homo sapiens
ugagaaaugccagugugc

SEQ ID NO: 412322 - RNA, 23 nt, Homo sapiens
ugagaaaugggguggaauaggga

SEQ ID NO: 412323 - RNA, 21 nt, Homo sapiens
ugagaacagaucuccaaagcu

SEQ ID NO: 412324 - RNA, 22 nt, Homo sapiens
ugagaacauuaacaaaagcaau

SEQ ID NO: 412325 - RNA, 18 nt, Homo sapiens
ugagaacugguucuugcc

SEQ ID NO: 412326 - RNA, 19 nt, Homo sapiens
ugagaacugguucuugccu

SEQ ID NO: 412327 - RNA, 14 nt, Homo sapiens
ugagaacuugacaa

SEQ ID NO: 412328 - RNA, 14 nt, Homo sapiens
ugagaacuuuccau

SEQ ID NO: 412329 - RNA, 15 nt, Homo sapiens
ugagaagaacacauc

SEQ ID NO: 412330 - RNA, 18 nt, Homo sapiens
ugagaaguaauuccucug

SEQ ID NO: 412331 - RNA, 14 nt, Homo sapiens
ugagaauaguuuuc

SEQ ID NO: 412332 - RNA, 22 nt, Homo sapiens
ugagaaucugugcagucaucaa

SEQ ID NO: 412333 - RNA, 22 nt, Homo sapiens
ugagacaaaauuuuaguccaaa

SEQ ID NO: 412334 - RNA, 13 nt, Homo sapiens
ugagacacaagau

SEQ ID NO: 412335 - RNA, 14 nt, Homo sapiens
ugagacacugucaa

SEQ ID NO: 412336 - RNA, 22 nt, Homo sapiens
ugagacagcuucgguuucuaac

SEQ ID NO: 412337 - RNA, 21 nt, Homo sapiens
ugagacgcaaggaucacuuga

SEQ ID NO: 412338 - RNA, 22 nt, Homo sapiens
ugagacuauaaagcaguagaca

SEQ ID NO: 412339 - RNA, 12 nt, Homo sapiens
ugagagcacaaa

SEQ ID NO: 412340 - RNA, 13 nt, Homo sapiens
ugagaggaugaau

SEQ ID NO: 412341 - RNA, 18 nt, Homo sapiens
ugagaggcaugacagcug

SEQ ID NO: 412342 - RNA, 19 nt, Homo sapiens
ugagagggaaucgacugua

SEQ ID NO: 412343 - RNA, 17 nt, Homo sapiens
ugagaggguuugaguca

SEQ ID NO: 412344 - RNA, 21 nt, Homo sapiens
ugagaugggaggaucacuuga

SEQ ID NO: 412345 - RNA, 21 nt, Homo sapiens
ugagcaaaaugcugcuuucug

SEQ ID NO: 412346 - RNA, 17 nt, Homo sapiens
ugagcaaggacaaccug

SEQ ID NO: 412347 - RNA, 17 nt, Homo sapiens
ugagcaaggacauugcc

SEQ ID NO: 412348 - RNA, 18 nt, Homo sapiens
ugagcaagucccaucuca

SEQ ID NO: 412349 - RNA, 20 nt, Homo sapiens
ugagcacagccccagacaga

SEQ ID NO: 412350 - RNA, 18 nt, Homo sapiens
ugagcagaaguggagcug

SEQ ID NO: 412351 - RNA, 17 nt, Homo sapiens
ugagcagcaacuguguc

SEQ ID NO: 412352 - RNA, 20 nt, Homo sapiens
ugagcagggcccucagagga

SEQ ID NO: 412353 - RNA, 23 nt, Homo sapiens
ugagcauccucucucacauggaa

SEQ ID NO: 412354 - RNA, 19 nt, Homo sapiens
ugagccaaagagaaugcca

SEQ ID NO: 412355 - RNA, 20 nt, Homo sapiens
ugagccaaagagaaugccau

SEQ ID NO: 412356 - RNA, 21 nt, Homo sapiens
ugagccaaagagaaugccauu

SEQ ID NO: 412357 - RNA, 17 nt, Homo sapiens
ugagcccacaaagccuu

SEQ ID NO: 412358 - RNA, 19 nt, Homo sapiens
ugagcccccugcacccacc

SEQ ID NO: 412359 - RNA, 19 nt, Homo sapiens
ugcaauuuucuaagcaauu

SEQ ID NO: 412360 - RNA, 17 nt, Homo sapiens
ugcacaaagcccuucca

SEQ ID NO: 412361 - RNA, 23 nt, Homo sapiens
ugcacaacucuccaaaacacuua

SEQ ID NO: 412362 - RNA, 15 nt, Homo sapiens
ugcacacauuaggca

SEQ ID NO: 412363 - RNA, 19 nt, Homo sapiens
ugcacacccaucgucuuua

SEQ ID NO: 412364 - RNA, 21 nt, Homo sapiens
ugcacacucacuuguaagaaa

SEQ ID NO: 412365 - RNA, 19 nt, Homo sapiens
ugcacacuucaaaucagag

SEQ ID NO: 412366 - RNA, 19 nt, Homo sapiens
ugcacagauacacauacac

SEQ ID NO: 412367 - RNA, 18 nt, Homo sapiens
ugcacagauuaaacuuca

SEQ ID NO: 412368 - RNA, 18 nt, Homo sapiens
ugcacagcccaaccagga

SEQ ID NO: 412369 - RNA, 23 nt, Homo sapiens
ugcacagcuaacauggaaguacu

SEQ ID NO: 412370 - RNA, 22 nt, Homo sapiens
ugcacaguuugcaaucuuaugu

SEQ ID NO: 412371 - RNA, 22 nt, Homo sapiens
ugcacauuagagggacagccaa

SEQ ID NO: 412372 - RNA, 22 nt, Homo sapiens
ugcacauuugugcauaaauuuc

SEQ ID NO: 412373 - RNA, 21 nt, Homo sapiens
ugcaccaacgagcuguacaug

SEQ ID NO: 412374 - RNA, 17 nt, Homo sapiens
ugcaccacuucaaguga

SEQ ID NO: 412375 - RNA, 20 nt, Homo sapiens
ugcaccccaaagcuuuccug

SEQ ID NO: 412376 - RNA, 19 nt, Homo sapiens
ugcaccccaccagcaauac

SEQ ID NO: 412377 - RNA, 18 nt, Homo sapiens
ugcaccucuuugucacag

SEQ ID NO: 412378 - RNA, 13 nt, Homo sapiens
ugcacggggccag

SEQ ID NO: 412379 - RNA, 19 nt, Homo sapiens
ugcacuagagaaacuugaa

SEQ ID NO: 412380 - RNA, 16 nt, Homo sapiens
ugcacuauagccauuu

SEQ ID NO: 412381 - RNA, 20 nt, Homo sapiens
ugcacuccagccugggcaac

SEQ ID NO: 412382 - RNA, 15 nt, Homo sapiens
ugcacugagggccac

SEQ ID NO: 412383 - RNA, 17 nt, Homo sapiens
ugcacugggguaccaca

SEQ ID NO: 412384 - RNA, 21 nt, Homo sapiens
ugcacuugcacgcccaugugu

SEQ ID NO: 412385 - RNA, 15 nt, Homo sapiens
ugcacuuggugcugc

SEQ ID NO: 412386 - RNA, 16 nt, Homo sapiens
ugcacuuggugcugcg

SEQ ID NO: 412387 - RNA, 22 nt, Homo sapiens
ugcacuuucccuagaaagccau

SEQ ID NO: 412388 - RNA, 21 nt, Homo sapiens
ugcagaaacuaccagauuuga

SEQ ID NO: 412389 - RNA, 20 nt, Homo sapiens
ugcagaauuguuuuuugcuc

SEQ ID NO: 412390 - RNA, 14 nt, Homo sapiens
ugcagacaggccau

SEQ ID NO: 412391 - RNA, 13 nt, Homo sapiens
ugcagagacagag

SEQ ID NO: 412392 - RNA, 21 nt, Homo sapiens
ugcagaggaggagaaaaguga

SEQ ID NO: 412393 - RNA, 16 nt, Homo sapiens
ugcagaggcaccucaa

SEQ ID NO: 412394 - RNA, 22 nt, Homo sapiens
ugcagaggcccagccacguguc

SEQ ID NO: 412395 - RNA, 21 nt, Homo sapiens
ugcagauauuugauguaguuu

SEQ ID NO: 412396 - RNA, 19 nt, Homo sapiens
ugcagauuucucaccugua

SEQ ID NO: 412397 - RNA, 11 nt, Homo sapiens
ugcagcaauau

SEQ ID NO: 412398 - RNA, 19 nt, Homo sapiens
ugcagcacucuuaucuaca

SEQ ID NO: 412399 - RNA, 12 nt, Homo sapiens
ugcagcaguacc

SEQ ID NO: 412400 - RNA, 14 nt, Homo sapiens
ugcagcaguaccau

SEQ ID NO: 412401 - RNA, 15 nt, Homo sapiens
ugcagcccaugccca

SEQ ID NO: 412402 - RNA, 17 nt, Homo sapiens
ugcagcccuugggcagu

SEQ ID NO: 412403 - RNA, 21 nt, Homo sapiens
ugcagcggcacaaaugcaccu

SEQ ID NO: 412404 - RNA, 14 nt, Homo sapiens
ugcaggacacagau

SEQ ID NO: 412405 - RNA, 20 nt, Homo sapiens
ugcaggauccuugccuccaa

SEQ ID NO: 412406 - RNA, 15 nt, Homo sapiens
ugcaggccaccagcu

SEQ ID NO: 412407 - RNA, 18 nt, Homo sapiens
ugcagggaagagggcagu

SEQ ID NO: 412408 - RNA, 19 nt, Homo sapiens
ugcagggguccccccucaa

SEQ ID NO: 412409 - RNA, 15 nt, Homo sapiens
ugcaggguccccaag

SEQ ID NO: 412410 - RNA, 18 nt, Homo sapiens
ugcagguuuguuacauag

SEQ ID NO: 412411 - RNA, 22 nt, Homo sapiens
ugcaguagagucaucuccauca

SEQ ID NO: 412412 - RNA, 17 nt, Homo sapiens
ugcaguagcacgaucuc

SEQ ID NO: 412413 - RNA, 20 nt, Homo sapiens
ugcagucggugguaccugag

SEQ ID NO: 412414 - RNA, 22 nt, Homo sapiens
ugcagucggugguaccugagau

SEQ ID NO: 412415 - RNA, 17 nt, Homo sapiens
ugcagugacagcuugag

SEQ ID NO: 412416 - RNA, 17 nt, Homo sapiens
ugcaguggcgugaucuc

SEQ ID NO: 412417 - RNA, 16 nt, Homo sapiens
ugcaguuggacucuca

SEQ ID NO: 412418 - RNA, 18 nt, Homo sapiens
ugcaguuggacucucagg

SEQ ID NO: 412419 - RNA, 20 nt, Homo sapiens
ugcaguuuccucaucuguca

SEQ ID NO: 412420 - RNA, 22 nt, Homo sapiens
ugcaguuuuugccuggguccca

SEQ ID NO: 412421 - RNA, 14 nt, Homo sapiens
ugcauauauuuuag

SEQ ID NO: 412422 - RNA, 14 nt, Homo sapiens
ugcaucauguugaa

SEQ ID NO: 412423 - RNA, 19 nt, Homo sapiens
ugcauccagccuccugcua

SEQ ID NO: 412424 - RNA, 20 nt, Homo sapiens
ugcauccauguaaucuauuc

SEQ ID NO: 412425 - RNA, 16 nt, Homo sapiens
ugcaucuccccucaga

SEQ ID NO: 412426 - RNA, 16 nt, Homo sapiens
ugcaucugucuguccu

SEQ ID NO: 412427 - RNA, 15 nt, Homo sapiens
ugcaugaaagacaga

SEQ ID NO: 412428 - RNA, 21 nt, Homo sapiens
ugcaugaccugaucauuacau

SEQ ID NO: 412429 - RNA, 15 nt, Homo sapiens
ugcaugagaauguca

SEQ ID NO: 412430 - RNA, 22 nt, Homo sapiens
ugcaugagcucccucgcuguau

SEQ ID NO: 412431 - RNA, 15 nt, Homo sapiens
ugcaugauaaugagu

SEQ ID NO: 412432 - RNA, 15 nt, Homo sapiens
ugcaugaucugucaa

SEQ ID NO: 412433 - RNA, 21 nt, Homo sapiens
ugcaugcuuuucucuugcuaa

SEQ ID NO: 412434 - RNA, 11 nt, Homo sapiens
ugcauggauuu

SEQ ID NO: 412435 - RNA, 15 nt, Homo sapiens
ugcauguaagccaag

SEQ ID NO: 412436 - RNA, 21 nt, Homo sapiens
ugcaugucaucuucuaggcca

SEQ ID NO: 412437 - RNA, 22 nt, Homo sapiens
ugcaugugugcgagugugugca

SEQ ID NO: 412438 - RNA, 20 nt, Homo sapiens
ugcaugugugugcucagggg

SEQ ID NO: 412439 - RNA, 16 nt, Homo sapiens
ugcauugaaagaauua

SEQ ID NO: 412440 - RNA, 11 nt, Homo sapiens
ugcauuuacuu

SEQ ID NO: 412441 - RNA, 22 nt, Homo sapiens
ugcauuuauggucaacacuuaa

SEQ ID NO: 412442 - RNA, 18 nt, Homo sapiens
ugcauuucaccugugaca

SEQ ID NO: 412443 - RNA, 20 nt, Homo sapiens
ugcauuuucuacauguauua

SEQ ID NO: 412444 - RNA, 14 nt, Homo sapiens
ugccaaaaacaaca

SEQ ID NO: 412445 - RNA, 23 nt, Homo sapiens
ugccaaacaugagagcccagaaa

SEQ ID NO: 412446 - RNA, 21 nt, Homo sapiens
ugccaaagugucuacaugugc

SEQ ID NO: 412447 - RNA, 16 nt, Homo sapiens
ugccaaauauguccug

SEQ ID NO: 412448 - RNA, 22 nt, Homo sapiens
ugccaaaugaauaagacaacaa

SEQ ID NO: 412449 - RNA, 18 nt, Homo sapiens
ugccaacaccuucuuggc

SEQ ID NO: 412450 - RNA, 21 nt, Homo sapiens
ugccaaccggucacccaggag

SEQ ID NO: 412451 - RNA, 18 nt, Homo sapiens
ugccaagaauaaagaagu

SEQ ID NO: 412452 - RNA, 22 nt, Homo sapiens
ugccaaggccgcccaccugcau

SEQ ID NO: 412453 - RNA, 16 nt, Homo sapiens
ugccaaguaaauagca

SEQ ID NO: 412454 - RNA, 19 nt, Homo sapiens
ugccaauggcggacucaaa

SEQ ID NO: 412455 - RNA, 19 nt, Homo sapiens
ugccacauuagccuuugca

SEQ ID NO: 412456 - RNA, 20 nt, Homo sapiens
ugccaccacccaccccaaac

SEQ ID NO: 412457 - RNA, 20 nt, Homo sapiens
ugccaccauggccagccaac

SEQ ID NO: 412458 - RNA, 15 nt, Homo sapiens
ugccacccuaccugu

SEQ ID NO: 412459 - RNA, 16 nt, Homo sapiens
ugccacgguccuuuga

SEQ ID NO: 412460 - RNA, 20 nt, Homo sapiens
ugccacguucuggacugucu

SEQ ID NO: 412461 - RNA, 17 nt, Homo sapiens
ugccacuagguuucacc

SEQ ID NO: 412462 - RNA, 14 nt, Homo sapiens
ugccacugccucuu

SEQ ID NO: 412463 - RNA, 17 nt, Homo sapiens
ugccacuugacauuccu

SEQ ID NO: 412464 - RNA, 18 nt, Homo sapiens
ugccagacuuaaaucaca

SEQ ID NO: 412465 - RNA, 17 nt, Homo sapiens
ugccagauuuugggauu

SEQ ID NO: 412466 - RNA, 15 nt, Homo sapiens
ugccagcaacgcuca

SEQ ID NO: 412467 - RNA, 15 nt, Homo sapiens
ugccagcgcaugugu

SEQ ID NO: 412468 - RNA, 18 nt, Homo sapiens
ugccagcuauaaucuccc

SEQ ID NO: 412469 - RNA, 14 nt, Homo sapiens
ugccaggacuguga

SEQ ID NO: 412470 - RNA, 18 nt, Homo sapiens
ugccaggcagaaaacugg

SEQ ID NO: 412471 - RNA, 18 nt, Homo sapiens
ugccaggcuguaagcauu

SEQ ID NO: 412472 - RNA, 19 nt, Homo sapiens
ugccagggcccgaccuggg

SEQ ID NO: 412473 - RNA, 18 nt, Homo sapiens
ugccagugagcucgccau

SEQ ID NO: 412474 - RNA, 13 nt, Homo sapiens
ugccaguggcuua

SEQ ID NO: 412475 - RNA, 13 nt, Homo sapiens
ugccaucaugccu

SEQ ID NO: 412476 - RNA, 22 nt, Homo sapiens
ugccauccacauuuuaacagua

SEQ ID NO: 412477 - RNA, 20 nt, Homo sapiens
ugccauccucacccagcacc

SEQ ID NO: 412478 - RNA, 18 nt, Homo sapiens
ugccaugacaacuucuaa

SEQ ID NO: 412479 - RNA, 12 nt, Homo sapiens
ugccaugcucag

SEQ ID NO: 412480 - RNA, 15 nt, Homo sapiens
ugccaugcucagaaa

SEQ ID NO: 412481 - RNA, 17 nt, Homo sapiens
ugccauggccugugcug

SEQ ID NO: 412482 - RNA, 15 nt, Homo sapiens
ugccauuucuuccca

SEQ ID NO: 412483 - RNA, 14 nt, Homo sapiens
ugccauuuuugcaa

SEQ ID NO: 412484 - RNA, 22 nt, Homo sapiens
ugcccacacuugggagcaaaag

SEQ ID NO: 412485 - RNA, 18 nt, Homo sapiens
ugcccacccgucuucaau

SEQ ID NO: 412486 - RNA, 21 nt, Homo sapiens
ugcccacuuccccuuccccaa

SEQ ID NO: 412487 - RNA, 17 nt, Homo sapiens
ugcccagacuacagggc

SEQ ID NO: 412488 - RNA, 18 nt, Homo sapiens
uggcaugggaaugaaugu

SEQ ID NO: 412489 - RNA, 20 nt, Homo sapiens
uggcauguggguugugauau

SEQ ID NO: 412490 - RNA, 15 nt, Homo sapiens
uggcauuagcacuac

SEQ ID NO: 412491 - RNA, 14 nt, Homo sapiens
uggcauucgcagug

SEQ ID NO: 412492 - RNA, 22 nt, Homo sapiens
uggcauuuuccucgccuaggcc

SEQ ID NO: 412493 - RNA, 20 nt, Homo sapiens
uggccaaggggccagcugcc

SEQ ID NO: 412494 - RNA, 12 nt, Homo sapiens
uggccacagcca

SEQ ID NO: 412495 - RNA, 21 nt, Homo sapiens
uggccacugucuccacucaca

SEQ ID NO: 412496 - RNA, 16 nt, Homo sapiens
uggccaggcacugccu

SEQ ID NO: 412497 - RNA, 14 nt, Homo sapiens
uggccccaaauguu

SEQ ID NO: 412498 - RNA, 17 nt, Homo sapiens
uggcccgccccucgcug

SEQ ID NO: 412499 - RNA, 14 nt, Homo sapiens
uggcccucuguguu

SEQ ID NO: 412500 - RNA, 18 nt, Homo sapiens
uggcccugcccugaggaa

SEQ ID NO: 412501 - RNA, 23 nt, Homo sapiens
uggccgaggacuuugauugcaca

SEQ ID NO: 412502 - RNA, 23 nt, Homo sapiens
uggccgucccuaagcaugugucc

SEQ ID NO: 412503 - RNA, 14 nt, Homo sapiens
uggccgucgcugug

SEQ ID NO: 412504 - RNA, 19 nt, Homo sapiens
uggccuagucagauggaug

SEQ ID NO: 412505 - RNA, 16 nt, Homo sapiens
uggccucaaacagcca

SEQ ID NO: 412506 - RNA, 17 nt, Homo sapiens
uggccuccccugcugaa

SEQ ID NO: 412507 - RNA, 21 nt, Homo sapiens
uggccucucagucaaacaagu

SEQ ID NO: 412508 - RNA, 20 nt, Homo sapiens
uggccuuccccuuuugccug

SEQ ID NO: 412509 - RNA, 22 nt, Homo sapiens
uggccuugggagagaugccuuc

SEQ ID NO: 412510 - RNA, 16 nt, Homo sapiens
uggccuuugcuugaaa

SEQ ID NO: 412511 - RNA, 16 nt, Homo sapiens
uggcgaagauggucuc

SEQ ID NO: 412512 - RNA, 13 nt, Homo sapiens
uggcgcuuccagc

SEQ ID NO: 412513 - RNA, 14 nt, Homo sapiens
uggcggaaccuggc

SEQ ID NO: 412514 - RNA, 17 nt, Homo sapiens
uggcggcgcagagggaa

SEQ ID NO: 412515 - RNA, 16 nt, Homo sapiens
uggcgucugucuucaa

SEQ ID NO: 412516 - RNA, 22 nt, Homo sapiens
uggcuaacuauauuugcuuuuu

SEQ ID NO: 412517 - RNA, 17 nt, Homo sapiens
uggcuagucacauauca

SEQ ID NO: 412518 - RNA, 12 nt, Homo sapiens
uggcucagggau

SEQ ID NO: 412519 - RNA, 23 nt, Homo sapiens
uggcucagggcccaccuccucca

SEQ ID NO: 412520 - RNA, 17 nt, Homo sapiens
uggcucaucaacaauca

SEQ ID NO: 412521 - RNA, 12 nt, Homo sapiens
uggcucaucucu

SEQ ID NO: 412522 - RNA, 19 nt, Homo sapiens
uggcuccaacacugcugcu

SEQ ID NO: 412523 - RNA, 20 nt, Homo sapiens
uggcuccaacacugcugcuc

SEQ ID NO: 412524 - RNA, 18 nt, Homo sapiens
uggcucccaggacacgac

SEQ ID NO: 412525 - RNA, 15 nt, Homo sapiens
uggcucccaugacca

SEQ ID NO: 412526 - RNA, 19 nt, Homo sapiens
uggcucugagauacuaaua

SEQ ID NO: 412527 - RNA, 14 nt, Homo sapiens
uggcugaaaaucac

SEQ ID NO: 412528 - RNA, 16 nt, Homo sapiens
uggcugccucugggag

SEQ ID NO: 412529 - RNA, 14 nt, Homo sapiens
uggcugccuuagaa

SEQ ID NO: 412530 - RNA, 17 nt, Homo sapiens
uggcuggaucagggaau

SEQ ID NO: 412531 - RNA, 11 nt, Homo sapiens
uggcugugagc

SEQ ID NO: 412532 - RNA, 22 nt, Homo sapiens
uggcuguggcaggccagcugug

SEQ ID NO: 412533 - RNA, 22 nt, Homo sapiens
uggcuguuggccccucugcugu

SEQ ID NO: 412534 - RNA, 21 nt, Homo sapiens
uggcuuaauguuuauuccuga

SEQ ID NO: 412535 - RNA, 23 nt, Homo sapiens
uggcuuacuacaugugggagcuu

SEQ ID NO: 412536 - RNA, 14 nt, Homo sapiens
uggcuucuccguca

SEQ ID NO: 412537 - RNA, 18 nt, Homo sapiens
uggcuucugcuugucauc

SEQ ID NO: 412538 - RNA, 14 nt, Homo sapiens
uggcuugacucagg

SEQ ID NO: 412539 - RNA, 21 nt, Homo sapiens
uggcuuggccacaaccugaaa

SEQ ID NO: 412540 - RNA, 13 nt, Homo sapiens
uggcuuuccucuc

SEQ ID NO: 412541 - RNA, 15 nt, Homo sapiens
uggcuuuuugucaaa

SEQ ID NO: 412542 - RNA, 14 nt, Homo sapiens
ugggaaacugcucc

SEQ ID NO: 412543 - RNA, 15 nt, Homo sapiens
ugggaaagcagagug

SEQ ID NO: 412544 - RNA, 16 nt, Homo sapiens
ugggaaaggugcucaa

SEQ ID NO: 412545 - RNA, 13 nt, Homo sapiens
ugggaacucccaa

SEQ ID NO: 412546 - RNA, 18 nt, Homo sapiens
ugggaacucgaacuugaa

SEQ ID NO: 412547 - RNA, 20 nt, Homo sapiens
ugggaacugugccuuugagu

SEQ ID NO: 412548 - RNA, 19 nt, Homo sapiens
ugggaagaaagauucaauu

SEQ ID NO: 412549 - RNA, 18 nt, Homo sapiens
ugggaagaccagcuuugc

SEQ ID NO: 412550 - RNA, 21 nt, Homo sapiens
ugggaagaccagcuuugcagu

SEQ ID NO: 412551 - RNA, 21 nt, Homo sapiens
ugggaagauaggcucugcaca

SEQ ID NO: 412552 - RNA, 12 nt, Homo sapiens
ugggaagccaua

SEQ ID NO: 412553 - RNA, 23 nt, Homo sapiens
ugggaagccauauucacaccuca

SEQ ID NO: 412554 - RNA, 15 nt, Homo sapiens
ugggaagcuauuucc

SEQ ID NO: 412555 - RNA, 19 nt, Homo sapiens
ugggaaggggcgugucccu

SEQ ID NO: 412556 - RNA, 16 nt, Homo sapiens
ugggaagggguuucua

SEQ ID NO: 412557 - RNA, 15 nt, Homo sapiens
ugggaaggugaccac

SEQ ID NO: 412558 - RNA, 20 nt, Homo sapiens
ugggaauguauuauucugca

SEQ ID NO: 412559 - RNA, 16 nt, Homo sapiens
ugggacaaaggacauu

SEQ ID NO: 412560 - RNA, 16 nt, Homo sapiens
ugggacaguggaugcc

SEQ ID NO: 412561 - RNA, 19 nt, Homo sapiens
ugggaccuguguucuugcu

SEQ ID NO: 412562 - RNA, 21 nt, Homo sapiens
ugggacucauucacauuucaa

SEQ ID NO: 412563 - RNA, 17 nt, Homo sapiens
ugggacugaugucaucu

SEQ ID NO: 412564 - RNA, 20 nt, Homo sapiens
ugggacuggagucagaugag

SEQ ID NO: 412565 - RNA, 15 nt, Homo sapiens
ugggacuuccuugcu

SEQ ID NO: 412566 - RNA, 15 nt, Homo sapiens
ugggagaaccaaaaa

SEQ ID NO: 412567 - RNA, 23 nt, Homo sapiens
ugggagaaccucguugacaugca

SEQ ID NO: 412568 - RNA, 18 nt, Homo sapiens
ugggagaacuaacagagg

SEQ ID NO: 412569 - RNA, 18 nt, Homo sapiens
ugggagacacagcaagac

SEQ ID NO: 412570 - RNA, 17 nt, Homo sapiens
ugggagagcaacuggac

SEQ ID NO: 412571 - RNA, 18 nt, Homo sapiens
ugggagaugcugggaccc

SEQ ID NO: 412572 - RNA, 15 nt, Homo sapiens
ugggaggccauuugu

SEQ ID NO: 412573 - RNA, 17 nt, Homo sapiens
ugggaggcuguggagcc

SEQ ID NO: 412574 - RNA, 16 nt, Homo sapiens
ugggaguagcauggac

SEQ ID NO: 412575 - RNA, 18 nt, Homo sapiens
ugggagugaacauuucua

SEQ ID NO: 412576 - RNA, 23 nt, Homo sapiens
ugggaucaaagcuaggaaaggca

SEQ ID NO: 412577 - RNA, 20 nt, Homo sapiens
ugggaugcgggcauuuugaa

SEQ ID NO: 412578 - RNA, 13 nt, Homo sapiens
ugggauuacaggg

SEQ ID NO: 412579 - RNA, 14 nt, Homo sapiens
ugggauuacaggga

SEQ ID NO: 412580 - RNA, 15 nt, Homo sapiens
ugggauuacagggau

SEQ ID NO: 412581 - RNA, 16 nt, Homo sapiens
ugggauuaggcccuca

SEQ ID NO: 412582 - RNA, 21 nt, Homo sapiens
ugggauugggggcuggugcca

SEQ ID NO: 412583 - RNA, 15 nt, Homo sapiens
ugggauuuggaguca

SEQ ID NO: 412584 - RNA, 22 nt, Homo sapiens
ugggcaacagagugagacccua

SEQ ID NO: 412585 - RNA, 15 nt, Homo sapiens
ugggcaaggccuuug

SEQ ID NO: 412586 - RNA, 22 nt, Homo sapiens
ugggcaagggaccugcuucuau

SEQ ID NO: 412587 - RNA, 22 nt, Homo sapiens
ugggcagcggcuucaagagcca

SEQ ID NO: 412588 - RNA, 23 nt, Homo sapiens
ugggcagcggcuucaagagccag

SEQ ID NO: 412589 - RNA, 21 nt, Homo sapiens
ugggcagcuguuagaguccaa

SEQ ID NO: 412590 - RNA, 16 nt, Homo sapiens
ugggcaggaccucaga

SEQ ID NO: 412591 - RNA, 17 nt, Homo sapiens
ugggcauagccauggaa

SEQ ID NO: 412592 - RNA, 20 nt, Homo sapiens
ugggcccagaggcacagccg

SEQ ID NO: 412593 - RNA, 20 nt, Homo sapiens
ugggccuccugacagcaaua

SEQ ID NO: 412594 - RNA, 20 nt, Homo sapiens
ugggccucugcuucucucac

SEQ ID NO: 412595 - RNA, 15 nt, Homo sapiens
ugggccuucucagcu

SEQ ID NO: 412596 - RNA, 17 nt, Homo sapiens
ugggcggaaguacuucc

SEQ ID NO: 412597 - RNA, 17 nt, Homo sapiens
ugggcuagauaggauau

SEQ ID NO: 412598 - RNA, 23 nt, Homo sapiens
ugggcuagguaguggggaccaag

SEQ ID NO: 412599 - RNA, 20 nt, Homo sapiens
ugggcuuaaguuuuacuuga

SEQ ID NO: 412600 - RNA, 20 nt, Homo sapiens
uggggaaacagaugccucag

SEQ ID NO: 412601 - RNA, 15 nt, Homo sapiens
uggggaaguguucca

SEQ ID NO: 412602 - RNA, 14 nt, Homo sapiens
uggggaguccaggg

SEQ ID NO: 412603 - RNA, 19 nt, Homo sapiens
uggggcccaagcaugcccc

SEQ ID NO: 412604 - RNA, 21 nt, Homo sapiens
uggggcccgcugcgugccauc

SEQ ID NO: 412605 - RNA, 19 nt, Homo sapiens
uggggcuggguguguuuca

SEQ ID NO: 412606 - RNA, 23 nt, Homo sapiens
ugggggaaggccuugcugucaug

SEQ ID NO: 412607 - RNA, 18 nt, Homo sapiens
ugggggacgugggcauuu

SEQ ID NO: 412608 - RNA, 15 nt, Homo sapiens
ugggggaucuguugu

SEQ ID NO: 412609 - RNA, 12 nt, Homo sapiens
ugggggauuuca

SEQ ID NO: 412610 - RNA, 22 nt, Homo sapiens
ugggggcaccaagaccccaaag

SEQ ID NO: 412611 - RNA, 22 nt, Homo sapiens
ugggggcagggcaugacuuugu

SEQ ID NO: 412612 - RNA, 17 nt, Homo sapiens
ugggggccaugagcucc

SEQ ID NO: 412613 - RNA, 18 nt, Homo sapiens
uggggggcacagccagaa

SEQ ID NO: 412614 - RNA, 14 nt, Homo sapiens
ugggggucccagga

SEQ ID NO: 412615 - RNA, 19 nt, Homo sapiens
ugggguugcaaccacugca

SEQ ID NO: 412616 - RNA, 16 nt, Homo sapiens
ugggguuucaccaucu

SEQ ID NO: 412617 - RNA, 23 nt, Homo sapiens
ugcuuccuccuuugcucuuggga

SEQ ID NO: 412618 - RNA, 13 nt, Homo sapiens
ugcuucuccauga

SEQ ID NO: 412619 - RNA, 17 nt, Homo sapiens
ugcuucugcucacauuc

SEQ ID NO: 412620 - RNA, 17 nt, Homo sapiens
ugcuucuuaauucaguu

SEQ ID NO: 412621 - RNA, 23 nt, Homo sapiens
ugcuugaaaugagaaacuuugau

SEQ ID NO: 412622 - RNA, 18 nt, Homo sapiens
ugcuugaacccaagaggu

SEQ ID NO: 412623 - RNA, 21 nt, Homo sapiens
ugcuugcaagggaccaugccg

SEQ ID NO: 412624 - RNA, 23 nt, Homo sapiens
ugcuugggaucuucaaugaacug

SEQ ID NO: 412625 - RNA, 17 nt, Homo sapiens
ugcuuuaaaaaaauaca

SEQ ID NO: 412626 - RNA, 19 nt, Homo sapiens
ugcuuuaaaguaccuguag

SEQ ID NO: 412627 - RNA, 16 nt, Homo sapiens
ugcuuuagaaguaaca

SEQ ID NO: 412628 - RNA, 18 nt, Homo sapiens
ugcuuuagcacaggacaa

SEQ ID NO: 412629 - RNA, 20 nt, Homo sapiens
ugcuuucaacuuaaaucacu

SEQ ID NO: 412630 - RNA, 20 nt, Homo sapiens
ugcuuucucuucuacuucuu

SEQ ID NO: 412631 - RNA, 19 nt, Homo sapiens
ugcuuucuuguugcugcau

SEQ ID NO: 412632 - RNA, 14 nt, Homo sapiens
ugcuuugaagcagu

SEQ ID NO: 412633 - RNA, 10 nt, Homo sapiens
ugcuuugcau

SEQ ID NO: 412634 - RNA, 14 nt, Homo sapiens
ugcuuuucauguag

SEQ ID NO: 412635 - RNA, 19 nt, Homo sapiens
uggaaaaccuccuuuacca

SEQ ID NO: 412636 - RNA, 14 nt, Homo sapiens
uggaaaaggaagac

SEQ ID NO: 412637 - RNA, 20 nt, Homo sapiens
uggaaaagucuucaagggcu

SEQ ID NO: 412638 - RNA, 13 nt, Homo sapiens
uggaaaaugcaau

SEQ ID NO: 412639 - RNA, 20 nt, Homo sapiens
uggaaaccuguuaugccaaa

SEQ ID NO: 412640 - RNA, 20 nt, Homo sapiens
uggaaacgcaaaugaguauu

SEQ ID NO: 412641 - RNA, 18 nt, Homo sapiens
uggaaacuguugccagag

SEQ ID NO: 412642 - RNA, 21 nt, Homo sapiens
uggaaacuguugguugagaua

SEQ ID NO: 412643 - RNA, 21 nt, Homo sapiens
uggaaagaaaagaauguacau

SEQ ID NO: 412644 - RNA, 23 nt, Homo sapiens
uggaaagaggagaaggagaggga

SEQ ID NO: 412645 - RNA, 23 nt, Homo sapiens
uggaaagugauuuguaauaugau

SEQ ID NO: 412646 - RNA, 19 nt, Homo sapiens
uggaaauaaaauacuucua

SEQ ID NO: 412647 - RNA, 19 nt, Homo sapiens
uggaaaugcugacuuuuaa

SEQ ID NO: 412648 - RNA, 13 nt, Homo sapiens
uggaacaacagcu

SEQ ID NO: 412649 - RNA, 18 nt, Homo sapiens
uggaacacucucugagau

SEQ ID NO: 412650 - RNA, 15 nt, Homo sapiens
uggaacauaugcaca

SEQ ID NO: 412651 - RNA, 23 nt, Homo sapiens
uggaaccaacacuaacauauaau

SEQ ID NO: 412652 - RNA, 20 nt, Homo sapiens
uggaaccugacguagcugca

SEQ ID NO: 412653 - RNA, 15 nt, Homo sapiens
uggaacuucuaauau

SEQ ID NO: 412654 - RNA, 18 nt, Homo sapiens
uggaagacuuagaucuga

SEQ ID NO: 412655 - RNA, 19 nt, Homo sapiens
uggaagagcuccuugauau

SEQ ID NO: 412656 - RNA, 14 nt, Homo sapiens
uggaagaguaguaa

SEQ ID NO: 412657 - RNA, 12 nt, Homo sapiens
uggaagcacugc

SEQ ID NO: 412658 - RNA, 20 nt, Homo sapiens
uggaagcuagaaugguggga

SEQ ID NO: 412659 - RNA, 18 nt, Homo sapiens
uggaaggccuucuuucua

SEQ ID NO: 412660 - RNA, 12 nt, Homo sapiens
uggaagggucaa

SEQ ID NO: 412661 - RNA, 20 nt, Homo sapiens
uggaagucaucucauuccac

SEQ ID NO: 412662 - RNA, 13 nt, Homo sapiens
uggaagucucaaa

SEQ ID NO: 412663 - RNA, 19 nt, Homo sapiens
uggaaguggauucuggaug

SEQ ID NO: 412664 - RNA, 20 nt, Homo sapiens
uggaauaacucuguggcauu

SEQ ID NO: 412665 - RNA, 17 nt, Homo sapiens
uggaauaaggagaauga

SEQ ID NO: 412666 - RNA, 18 nt, Homo sapiens
uggaauacuuacucuugu

SEQ ID NO: 412667 - RNA, 20 nt, Homo sapiens
uggaauacuuacucuugucg

SEQ ID NO: 412668 - RNA, 17 nt, Homo sapiens
uggaaucccacuuauca

SEQ ID NO: 412669 - RNA, 19 nt, Homo sapiens
uggaaucuucucuuugaca

SEQ ID NO: 412670 - RNA, 17 nt, Homo sapiens
uggaauuuguaaguuua

SEQ ID NO: 412671 - RNA, 17 nt, Homo sapiens
uggacacgucggacagc

SEQ ID NO: 412672 - RNA, 11 nt, Homo sapiens
uggacacugag

SEQ ID NO: 412673 - RNA, 19 nt, Homo sapiens
uggacagagggagaaggga

SEQ ID NO: 412674 - RNA, 17 nt, Homo sapiens
uggacaguucacacccu

SEQ ID NO: 412675 - RNA, 20 nt, Homo sapiens
uggacaguucacacccugca

SEQ ID NO: 412676 - RNA, 13 nt, Homo sapiens
uggacaugauuua

SEQ ID NO: 412677 - RNA, 16 nt, Homo sapiens
uggacaugcacagcua

SEQ ID NO: 412678 - RNA, 13 nt, Homo sapiens
uggaccaaaugga

SEQ ID NO: 412679 - RNA, 19 nt, Homo sapiens
uggaccaauuagcauucca

SEQ ID NO: 412680 - RNA, 22 nt, Homo sapiens
uggaccaggaagcccugaaucc

SEQ ID NO: 412681 - RNA, 17 nt, Homo sapiens
uggaccaguggugccuu

SEQ ID NO: 412682 - RNA, 15 nt, Homo sapiens
uggaccuaacauucg

SEQ ID NO: 412683 - RNA, 15 nt, Homo sapiens
uggaccuguucaaaa

SEQ ID NO: 412684 - RNA, 18 nt, Homo sapiens
uggacucuacacugugaa

SEQ ID NO: 412685 - RNA, 18 nt, Homo sapiens
uggacuugaggauuuuga

SEQ ID NO: 412686 - RNA, 18 nt, Homo sapiens
uggacuuuccacccccuc

SEQ ID NO: 412687 - RNA, 14 nt, Homo sapiens
uggagacacaacua

SEQ ID NO: 412688 - RNA, 19 nt, Homo sapiens
uggagagagcaaucuugcu

SEQ ID NO: 412689 - RNA, 20 nt, Homo sapiens
uggagagcucaggauggcuc

SEQ ID NO: 412690 - RNA, 14 nt, Homo sapiens
uggagaggaaccca

SEQ ID NO: 412691 - RNA, 19 nt, Homo sapiens
uggagauaccagagacucu

SEQ ID NO: 412692 - RNA, 22 nt, Homo sapiens
uggagauaccagagacucugaa

SEQ ID NO: 412693 - RNA, 21 nt, Homo sapiens
uggagaugucuucguacaguu

SEQ ID NO: 412694 - RNA, 22 nt, Homo sapiens
uggagccaccaugcccagcuca

SEQ ID NO: 412695 - RNA, 15 nt, Homo sapiens
uggagccauccuccu

SEQ ID NO: 412696 - RNA, 16 nt, Homo sapiens
uggagccccuguguug

SEQ ID NO: 412697 - RNA, 12 nt, Homo sapiens
uggagccuuuga

SEQ ID NO: 412698 - RNA, 23 nt, Homo sapiens
uggagcgcaguggggugaucuca

SEQ ID NO: 412699 - RNA, 18 nt, Homo sapiens
uggagcuccugcuggaug

SEQ ID NO: 412700 - RNA, 18 nt, Homo sapiens
uggaggaaagugauaucc

SEQ ID NO: 412701 - RNA, 12 nt, Homo sapiens
uggaggccaagc

SEQ ID NO: 412702 - RNA, 19 nt, Homo sapiens
uggaggccggaaucucagc

SEQ ID NO: 412703 - RNA, 20 nt, Homo sapiens
uggaggccggaaucucagcc

SEQ ID NO: 412704 - RNA, 18 nt, Homo sapiens
uggaggccgggugcucag

SEQ ID NO: 412705 - RNA, 15 nt, Homo sapiens
uggagggauaagcca

SEQ ID NO: 412706 - RNA, 22 nt, Homo sapiens
uggagggauugaacacaggcaa

SEQ ID NO: 412707 - RNA, 13 nt, Homo sapiens
uggaggugagaaa

SEQ ID NO: 412708 - RNA, 19 nt, Homo sapiens
uggaguacuauauuuacaa

SEQ ID NO: 412709 - RNA, 18 nt, Homo sapiens
uggaguagauauuaauua

SEQ ID NO: 412710 - RNA, 18 nt, Homo sapiens
uggagugcaguggcguga

SEQ ID NO: 412711 - RNA, 22 nt, Homo sapiens
uggaguguaauuaccugucauc

SEQ ID NO: 412712 - RNA, 15 nt, Homo sapiens
uggauaaaaugaggu

SEQ ID NO: 412713 - RNA, 19 nt, Homo sapiens
uggauaacaccaccauuca

SEQ ID NO: 412714 - RNA, 19 nt, Homo sapiens
uggauauuacugaaaggga

SEQ ID NO: 412715 - RNA, 15 nt, Homo sapiens
uggaucacacacaug

SEQ ID NO: 412716 - RNA, 12 nt, Homo sapiens
uggaucaccugu

SEQ ID NO: 412717 - RNA, 13 nt, Homo sapiens
uggauccugugug

SEQ ID NO: 412718 - RNA, 15 nt, Homo sapiens
uggaucuaccagcau

SEQ ID NO: 412719 - RNA, 22 nt, Homo sapiens
uggaucuaccagcauaaauauc

SEQ ID NO: 412720 - RNA, 20 nt, Homo sapiens
ugggcucuggguucgggaag

SEQ ID NO: 412721 - RNA, 23 nt, Homo sapiens
uggggaacucaaaggacugaccu

SEQ ID NO: 412722 - RNA, 20 nt, Homo sapiens
uggggaaguguuccagauag

SEQ ID NO: 412723 - RNA, 14 nt, Homo sapiens
uggggacuaaggga

SEQ ID NO: 412724 - RNA, 17 nt, Homo sapiens
uggggagaucggggcca

SEQ ID NO: 412725 - RNA, 18 nt, Homo sapiens
uggggagggagguguuua

SEQ ID NO: 412726 - RNA, 19 nt, Homo sapiens
uggggaugguccacuguca

SEQ ID NO: 412727 - RNA, 20 nt, Homo sapiens
uggggauugcccauccaucu

SEQ ID NO: 412728 - RNA, 23 nt, Homo sapiens
uggggcaugguauuugagacauu

SEQ ID NO: 412729 - RNA, 14 nt, Homo sapiens
uggggccacagcca

SEQ ID NO: 412730 - RNA, 21 nt, Homo sapiens
uggggcccaagcaugccccac

SEQ ID NO: 412731 - RNA, 15 nt, Homo sapiens
uggggcccacauuag

SEQ ID NO: 412732 - RNA, 20 nt, Homo sapiens
uggggccgaaagaacagucc

SEQ ID NO: 412733 - RNA, 22 nt, Homo sapiens
uggggcgggggucuauacauuc

SEQ ID NO: 412734 - RNA, 12 nt, Homo sapiens
uggggcucagac

SEQ ID NO: 412735 - RNA, 15 nt, Homo sapiens
uggggcuggccugca

SEQ ID NO: 412736 - RNA, 22 nt, Homo sapiens
uggggcuuccauggugguuuca

SEQ ID NO: 412737 - RNA, 19 nt, Homo sapiens
ugggggacgugggcauuuu

SEQ ID NO: 412738 - RNA, 15 nt, Homo sapiens
ugggggaggcucuga

SEQ ID NO: 412739 - RNA, 19 nt, Homo sapiens
ugggggauucaaaugcaug

SEQ ID NO: 412740 - RNA, 15 nt, Homo sapiens
ugggggcaaugggag

SEQ ID NO: 412741 - RNA, 21 nt, Homo sapiens
ugggggcauccuugaggaccu

SEQ ID NO: 412742 - RNA, 15 nt, Homo sapiens
ugggggccucugccu

SEQ ID NO: 412743 - RNA, 21 nt, Homo sapiens
ugggggccucugccuccagga

SEQ ID NO: 412744 - RNA, 13 nt, Homo sapiens
ugggggucagggg

SEQ ID NO: 412745 - RNA, 17 nt, Homo sapiens
ugggguagagaggacag

SEQ ID NO: 412746 - RNA, 13 nt, Homo sapiens
uggggucaggaac

SEQ ID NO: 412747 - RNA, 17 nt, Homo sapiens
ugggguccccacucccu

SEQ ID NO: 412748 - RNA, 15 nt, Homo sapiens
uggggucuuuuuaug

SEQ ID NO: 412749 - RNA, 21 nt, Homo sapiens
uggggucuuuuuaugcauuug

SEQ ID NO: 412750 - RNA, 18 nt, Homo sapiens
uggggugcaccuguccaa

SEQ ID NO: 412751 - RNA, 12 nt, Homo sapiens
uggggugccuga

SEQ ID NO: 412752 - RNA, 24 nt, Homo sapiens
uucccacucccucucuugccgaca

SEQ ID NO: 412753 - RNA, 16 nt, Homo sapiens
uucccacuuucauuca

SEQ ID NO: 412754 - RNA, 13 nt, Homo sapiens
uucccaugacugc

SEQ ID NO: 412755 - RNA, 19 nt, Homo sapiens
uucccauuggucugcaugu

SEQ ID NO: 412756 - RNA, 22 nt, Homo sapiens
uuccccaccccagcucaugccc

SEQ ID NO: 412757 - RNA, 18 nt, Homo sapiens
uuccccacgggaacauua

SEQ ID NO: 412758 - RNA, 23 nt, Homo sapiens
uuccccagcgucccagucucugg

SEQ ID NO: 412759 - RNA, 21 nt, Homo sapiens
uucccccagcccaauaaaggu

SEQ ID NO: 412760 - RNA, 17 nt, Homo sapiens
uucccccagcccugugg

SEQ ID NO: 412761 - RNA, 16 nt, Homo sapiens
uuccccggaguaccua

SEQ ID NO: 412762 - RNA, 16 nt, Homo sapiens
uuccccgugggccaug

SEQ ID NO: 412763 - RNA, 20 nt, Homo sapiens
uuccccuaacccuacaugca

SEQ ID NO: 412764 - RNA, 22 nt, Homo sapiens
uucccgacacccggagcucuac

SEQ ID NO: 412765 - RNA, 21 nt, Homo sapiens
uucccgcagcaccagccugag

SEQ ID NO: 412766 - RNA, 19 nt, Homo sapiens
uucccuaaaagaaaaccaa

SEQ ID NO: 412767 - RNA, 16 nt, Homo sapiens
uucccuagugcuggua

SEQ ID NO: 412768 - RNA, 18 nt, Homo sapiens
uucccuccaccagugugc

SEQ ID NO: 412769 - RNA, 16 nt, Homo sapiens
uucccucccuaucuaa

SEQ ID NO: 412770 - RNA, 19 nt, Homo sapiens
uucccugaaaccguuaaaa

SEQ ID NO: 412771 - RNA, 13 nt, Homo sapiens
uucccuggcucag

SEQ ID NO: 412772 - RNA, 20 nt, Homo sapiens
uucccuguaugauuccuuga

SEQ ID NO: 412773 - RNA, 18 nt, Homo sapiens
uucccuguguagcucuca

SEQ ID NO: 412774 - RNA, 15 nt, Homo sapiens
uucccuguuugccua

SEQ ID NO: 412775 - RNA, 15 nt, Homo sapiens
uucccuuccacugcc

SEQ ID NO: 412776 - RNA, 16 nt, Homo sapiens
uucccuuccacugccu

SEQ ID NO: 412777 - RNA, 21 nt, Homo sapiens
uucccuuguauggauauacca

SEQ ID NO: 412778 - RNA, 14 nt, Homo sapiens
uuccgaaacauaca

SEQ ID NO: 412779 - RNA, 13 nt, Homo sapiens
uuccguuccagag

SEQ ID NO: 412780 - RNA, 22 nt, Homo sapiens
uuccuaacaggauuagacaguc

SEQ ID NO: 412781 - RNA, 21 nt, Homo sapiens
uuccuacacccuuggacuuga

SEQ ID NO: 412782 - RNA, 23 nt, Homo sapiens
uuccuacacccuuggacuugagg

SEQ ID NO: 412783 - RNA, 15 nt, Homo sapiens
uuccuaccauacaau

SEQ ID NO: 412784 - RNA, 17 nt, Homo sapiens
uuccuacccaaccacuc

SEQ ID NO: 412785 - RNA, 12 nt, Homo sapiens
uuccuacuggag

SEQ ID NO: 412786 - RNA, 18 nt, Homo sapiens
uuccuaugcugcaauaca

SEQ ID NO: 412787 - RNA, 12 nt, Homo sapiens
uuccucaccaau

SEQ ID NO: 412788 - RNA, 13 nt, Homo sapiens
uuccuccauaaau

SEQ ID NO: 412789 - RNA, 13 nt, Homo sapiens
uuccucuuaccug

SEQ ID NO: 412790 - RNA, 13 nt, Homo sapiens
uuccucuugccuc

SEQ ID NO: 412791 - RNA, 19 nt, Homo sapiens
uuccucuugggcuuuugaa

SEQ ID NO: 412792 - RNA, 19 nt, Homo sapiens
uuccugaguggugccaaac

SEQ ID NO: 412793 - RNA, 13 nt, Homo sapiens
uugaaagaauuag

SEQ ID NO: 412794 - RNA, 16 nt, Homo sapiens
uugaaauagucugugu

SEQ ID NO: 412795 - RNA, 11 nt, Homo sapiens
uugaaauccaa

SEQ ID NO: 412796 - RNA, 21 nt, Homo sapiens
uugaaaugaugguaaguuaau

SEQ ID NO: 412797 - RNA, 18 nt, Homo sapiens
uugaaaugccacgugcca

SEQ ID NO: 412798 - RNA, 16 nt, Homo sapiens
uugaacagaacugccg

SEQ ID NO: 412799 - RNA, 23 nt, Homo sapiens
uugaacaguuuaugcagugcugc

SEQ ID NO: 412800 - RNA, 16 nt, Homo sapiens
uugaacauacuucauc

SEQ ID NO: 412801 - RNA, 13 nt, Homo sapiens
uugaaccugggaa

SEQ ID NO: 412802 - RNA, 22 nt, Homo sapiens
uugaacuguuagaugcugaaua

SEQ ID NO: 412803 - RNA, 21 nt, Homo sapiens
uugaagaaaaagacacagaca

SEQ ID NO: 412804 - RNA, 19 nt, Homo sapiens
uugaagacacguucuugcc

SEQ ID NO: 412805 - RNA, 11 nt, Homo sapiens
uugaagaccag

SEQ ID NO: 412806 - RNA, 22 nt, Homo sapiens
uugaagacuucuagcagaaaaa

SEQ ID NO: 412807 - RNA, 23 nt, Homo sapiens
uugaagcuaaaauaaaccagacu

SEQ ID NO: 412808 - RNA, 19 nt, Homo sapiens
uugaaggguguucacccau

SEQ ID NO: 412809 - RNA, 14 nt, Homo sapiens
uugaaggucugcaa

SEQ ID NO: 412810 - RNA, 21 nt, Homo sapiens
uugaaguaggaaguaggaaau

SEQ ID NO: 412811 - RNA, 13 nt, Homo sapiens
uugaagucugaua

SEQ ID NO: 412812 - RNA, 18 nt, Homo sapiens
uugaauaaaagugcacac

SEQ ID NO: 412813 - RNA, 22 nt, Homo sapiens
uugaaugaaaaauuuaagcauu

SEQ ID NO: 412814 - RNA, 20 nt, Homo sapiens
uugaaugaugugauacaaau

SEQ ID NO: 412815 - RNA, 18 nt, Homo sapiens
uugaaugcggaaccauag

SEQ ID NO: 412816 - RNA, 13 nt, Homo sapiens
uugaauguacaaa

SEQ ID NO: 412817 - RNA, 13 nt, Homo sapiens
uugaauguaucua

SEQ ID NO: 412818 - RNA, 14 nt, Homo sapiens
uugacacaguuguu

SEQ ID NO: 412819 - RNA, 15 nt, Homo sapiens
uugacacggccauga

SEQ ID NO: 412820 - RNA, 11 nt, Homo sapiens
uugacauuccu

SEQ ID NO: 412821 - RNA, 17 nt, Homo sapiens
uugacauucuucacugu

SEQ ID NO: 412822 - RNA, 19 nt, Homo sapiens
uugacucuaaaugcaguuu

SEQ ID NO: 412823 - RNA, 14 nt, Homo sapiens
uugacucuugaaua

SEQ ID NO: 412824 - RNA, 18 nt, Homo sapiens
uugagacuauaaagcagu

SEQ ID NO: 412825 - RNA, 21 nt, Homo sapiens
uugagaggugggggaugcuga

SEQ ID NO: 412826 - RNA, 18 nt, Homo sapiens
uugagauguaugaaggcu

SEQ ID NO: 412827 - RNA, 18 nt, Homo sapiens
uugagcaccgucauggcu

SEQ ID NO: 412828 - RNA, 16 nt, Homo sapiens
uugagccccagaggca

SEQ ID NO: 412829 - RNA, 21 nt, Homo sapiens
uugagcuucauauaccagcaa

SEQ ID NO: 412830 - RNA, 17 nt, Homo sapiens
uugaggacacaugucca

SEQ ID NO: 412831 - RNA, 17 nt, Homo sapiens
uugaggcagcagaauug

SEQ ID NO: 412832 - RNA, 12 nt, Homo sapiens
uugaggcuuuca

SEQ ID NO: 412833 - RNA, 13 nt, Homo sapiens
uugagggaccaau

SEQ ID NO: 412834 - RNA, 16 nt, Homo sapiens
uugagucucugaacau

SEQ ID NO: 412835 - RNA, 22 nt, Homo sapiens
uugauaaaaaauuuauuauguc

SEQ ID NO: 412836 - RNA, 12 nt, Homo sapiens
uugauagucaau

SEQ ID NO: 412837 - RNA, 22 nt, Homo sapiens
uugauauacuauuuucauucuc

SEQ ID NO: 412838 - RNA, 17 nt, Homo sapiens
uugauaugggcuuucuc

SEQ ID NO: 412839 - RNA, 22 nt, Homo sapiens
uugaucauucucaguauccacu

SEQ ID NO: 412840 - RNA, 16 nt, Homo sapiens
uugaugaaaagauuua

SEQ ID NO: 412841 - RNA, 17 nt, Homo sapiens
uugaugacccucugacc

SEQ ID NO: 412842 - RNA, 19 nt, Homo sapiens
uugaugauuaauucaccuu

SEQ ID NO: 412843 - RNA, 11 nt, Homo sapiens
uugauggaccc

SEQ ID NO: 412844 - RNA, 14 nt, Homo sapiens
uugauguacuuuac

SEQ ID NO: 412845 - RNA, 13 nt, Homo sapiens
uugauucuugauu

SEQ ID NO: 412846 - RNA, 15 nt, Homo sapiens
uugauuuacagugcc

SEQ ID NO: 412847 - RNA, 15 nt, Homo sapiens
uugcaaagcauuuga

SEQ ID NO: 412848 - RNA, 16 nt, Homo sapiens
uugcaaauacauggau

SEQ ID NO: 412849 - RNA, 20 nt, Homo sapiens
uugcaaauuauucuagucaa

SEQ ID NO: 412850 - RNA, 16 nt, Homo sapiens
uugcaaucuucuacuu

SEQ ID NO: 412851 - RNA, 13 nt, Homo sapiens
uugcacaaaaagg

SEQ ID NO: 412852 - RNA, 12 nt, Homo sapiens
uugcacauucua

SEQ ID NO: 412853 - RNA, 21 nt, Homo sapiens
uugcacuaaaagugaugugau

SEQ ID NO: 412854 - RNA, 15 nt, Homo sapiens
uugcagaugccaaaa

SEQ ID NO: 412855 - RNA, 15 nt, Homo sapiens
uugcagcuaagcuca

SEQ ID NO: 412856 - RNA, 23 nt, Homo sapiens
uugcaggggauugaagcccucca

SEQ ID NO: 412857 - RNA, 18 nt, Homo sapiens
uugcagugagcugagauc

SEQ ID NO: 412858 - RNA, 20 nt, Homo sapiens
uugcagugagcugagaucac

SEQ ID NO: 412859 - RNA, 20 nt, Homo sapiens
uugcauaguaccaaucauuu

SEQ ID NO: 412860 - RNA, 21 nt, Homo sapiens
uugcaugaucugucaaaguga

SEQ ID NO: 412861 - RNA, 14 nt, Homo sapiens
uugcaugugcugca

SEQ ID NO: 412862 - RNA, 15 nt, Homo sapiens
uugcaugugcugcag

SEQ ID NO: 412863 - RNA, 23 nt, Homo sapiens
uugcauugaauuuagucauuauu

SEQ ID NO: 412864 - RNA, 10 nt, Homo sapiens
uugcauuugg

SEQ ID NO: 412865 - RNA, 19 nt, Homo sapiens
uugccaaacuaaauacugu

SEQ ID NO: 412866 - RNA, 23 nt, Homo sapiens
uugccacguucuggacugucuuc

SEQ ID NO: 412867 - RNA, 16 nt, Homo sapiens
uugccagcucuuccaa

SEQ ID NO: 412868 - RNA, 14 nt, Homo sapiens
uugccgcauauuau

SEQ ID NO: 412869 - RNA, 14 nt, Homo sapiens
uugccuaaguauuc

SEQ ID NO: 412870 - RNA, 19 nt, Homo sapiens
uugccucaaugccaguaac

SEQ ID NO: 412871 - RNA, 13 nt, Homo sapiens
uugccuccucacc

SEQ ID NO: 412872 - RNA, 18 nt, Homo sapiens
uugccuccuuauuuauca

SEQ ID NO: 412873 - RNA, 17 nt, Homo sapiens
uugccuggagugugaac

SEQ ID NO: 412874 - RNA, 22 nt, Homo sapiens
uugccuucaucuucacugcaau

SEQ ID NO: 412875 - RNA, 15 nt, Homo sapiens
uugccuugggcugcu

SEQ ID NO: 412876 - RNA, 20 nt, Homo sapiens
uugcgagccucgcagccucc

SEQ ID NO: 412877 - RNA, 12 nt, Homo sapiens
uugcgucaugua

SEQ ID NO: 412878 - RNA, 15 nt, Homo sapiens
uugcuaaaauauuau

SEQ ID NO: 412879 - RNA, 13 nt, Homo sapiens
uuuauggccucag

SEQ ID NO: 412880 - RNA, 16 nt, Homo sapiens
uuuauguggugguuuc

SEQ ID NO: 412881 - RNA, 18 nt, Homo sapiens
uuuauuaaugaacuguga

SEQ ID NO: 412882 - RNA, 16 nt, Homo sapiens
uuuauuaauucauuaa

SEQ ID NO: 412883 - RNA, 15 nt, Homo sapiens
uuuauucaccaucau

SEQ ID NO: 412884 - RNA, 15 nt, Homo sapiens
uuuauucccccaaag

SEQ ID NO: 412885 - RNA, 12 nt, Homo sapiens
uuuauugagaua

SEQ ID NO: 412886 - RNA, 17 nt, Homo sapiens
uuuauuuaaacuauuca

SEQ ID NO: 412887 - RNA, 23 nt, Homo sapiens
uuuauuuaaggggaauuaacaau

SEQ ID NO: 412888 - RNA, 15 nt, Homo sapiens
uuuauuucugaucua

SEQ ID NO: 412889 - RNA, 16 nt, Homo sapiens
uuuauuucugaucuau

SEQ ID NO: 412890 - RNA, 20 nt, Homo sapiens
uuuauuuugacugugauuua

SEQ ID NO: 412891 - RNA, 20 nt, Homo sapiens
uuuauuuuucauauugugcc

SEQ ID NO: 412892 - RNA, 17 nt, Homo sapiens
uuucaaaacuaguucuu

SEQ ID NO: 412893 - RNA, 13 nt, Homo sapiens
uuucaaagcuaaa

SEQ ID NO: 412894 - RNA, 18 nt, Homo sapiens
uuucaaaguguugauggu

SEQ ID NO: 412895 - RNA, 19 nt, Homo sapiens
uuucaaugcugacuggacu

SEQ ID NO: 412896 - RNA, 19 nt, Homo sapiens
uuucacaaauauaguugaa

SEQ ID NO: 412897 - RNA, 21 nt, Homo sapiens
uuucacacccuuuugugagac

SEQ ID NO: 412898 - RNA, 20 nt, Homo sapiens
uuucaccccacagacacuua

SEQ ID NO: 412899 - RNA, 13 nt, Homo sapiens
uuucaccucagau

SEQ ID NO: 412900 - RNA, 20 nt, Homo sapiens
uuucaccucccaaacccagc

SEQ ID NO: 412901 - RNA, 11 nt, Homo sapiens
uuucacugaca

SEQ ID NO: 412902 - RNA, 15 nt, Homo sapiens
uuucacuguucauga

SEQ ID NO: 412903 - RNA, 22 nt, Homo sapiens
uuucacuuaaacuuugucacuu

SEQ ID NO: 412904 - RNA, 15 nt, Homo sapiens
uuucagaaaauauua

SEQ ID NO: 412905 - RNA, 23 nt, Homo sapiens
uuucagaagccccauuugcacag

SEQ ID NO: 412906 - RNA, 17 nt, Homo sapiens
uuucagagccagugaag

SEQ ID NO: 412907 - RNA, 19 nt, Homo sapiens
uuucagaugauucuauguc

SEQ ID NO: 412908 - RNA, 21 nt, Homo sapiens
uuucagggcugggcuauaaca

SEQ ID NO: 412909 - RNA, 16 nt, Homo sapiens
uuucaguauacugugu

SEQ ID NO: 412910 - RNA, 17 nt, Homo sapiens
uuucagucaucaucuca

SEQ ID NO: 412911 - RNA, 19 nt, Homo sapiens
uuucauaaacuucagggau

SEQ ID NO: 412912 - RNA, 22 nt, Homo sapiens
uuucauggaaguggcagugaaa

SEQ ID NO: 412913 - RNA, 17 nt, Homo sapiens
uuucauuauagcacgaa

SEQ ID NO: 412914 - RNA, 14 nt, Homo sapiens
uuucauuuugccaa

SEQ ID NO: 412915 - RNA, 21 nt, Homo sapiens
uuuccaacaaacuuacuguca

SEQ ID NO: 412916 - RNA, 14 nt, Homo sapiens
uuuccaacacacaa

SEQ ID NO: 412917 - RNA, 21 nt, Homo sapiens
uuuccaagaaucggcauguau

SEQ ID NO: 412918 - RNA, 22 nt, Homo sapiens
uuuccaagggucuuccuccuaa

SEQ ID NO: 412919 - RNA, 15 nt, Homo sapiens
uuuccaauuccaaaa

SEQ ID NO: 412920 - RNA, 12 nt, Homo sapiens
uuuccacacagc

SEQ ID NO: 412921 - RNA, 18 nt, Homo sapiens
uuuccaggggccucccaa

SEQ ID NO: 412922 - RNA, 16 nt, Homo sapiens
uuuccaguguuuacaa

SEQ ID NO: 412923 - RNA, 12 nt, Homo sapiens
uuuccaucuccc

SEQ ID NO: 412924 - RNA, 11 nt, Homo sapiens
uuuccauuugc

SEQ ID NO: 412925 - RNA, 17 nt, Homo sapiens
uuucccauuacuuuaau

SEQ ID NO: 412926 - RNA, 17 nt, Homo sapiens
uuuccccaccagugaau

SEQ ID NO: 412927 - RNA, 22 nt, Homo sapiens
uuuccccugugguuuguuauca

SEQ ID NO: 412928 - RNA, 22 nt, Homo sapiens
uuuccccuuuuaaaaacucaga

SEQ ID NO: 412929 - RNA, 22 nt, Homo sapiens
uuucccugggguacuacucucc

SEQ ID NO: 412930 - RNA, 23 nt, Homo sapiens
uuucccugggguacuacucucca

SEQ ID NO: 412931 - RNA, 11 nt, Homo sapiens
uuucccugugu

SEQ ID NO: 412932 - RNA, 13 nt, Homo sapiens
uuucccuuccagu

SEQ ID NO: 412933 - RNA, 18 nt, Homo sapiens
uuuccuaaaugcagugaa

SEQ ID NO: 412934 - RNA, 16 nt, Homo sapiens
uuuccuccaaacuccu

SEQ ID NO: 412935 - RNA, 19 nt, Homo sapiens
uuuccucccuuucccugag

SEQ ID NO: 412936 - RNA, 12 nt, Homo sapiens
uuuccuccuugu

SEQ ID NO: 412937 - RNA, 13 nt, Homo sapiens
uuuccugacaggg

SEQ ID NO: 412938 - RNA, 21 nt, Homo sapiens
uuuccugcugccauccucacc

SEQ ID NO: 412939 - RNA, 16 nt, Homo sapiens
uuuccugugccuaaca

SEQ ID NO: 412940 - RNA, 21 nt, Homo sapiens
uuuccuucggaauccagugcu

SEQ ID NO: 412941 - RNA, 12 nt, Homo sapiens
uuuccuugcuca

SEQ ID NO: 412942 - RNA, 16 nt, Homo sapiens
uuucgggauucuuuga

SEQ ID NO: 412943 - RNA, 21 nt, Homo sapiens
uuucuacaccuguugcaccuc

SEQ ID NO: 412944 - RNA, 21 nt, Homo sapiens
uuucuaccuuucugagucucu

SEQ ID NO: 412945 - RNA, 20 nt, Homo sapiens
uuucuaguuguaauguguau

SEQ ID NO: 412946 - RNA, 14 nt, Homo sapiens
uuucucagacuuua

SEQ ID NO: 412947 - RNA, 21 nt, Homo sapiens
uuucucagcucccaaggcucu

SEQ ID NO: 412948 - RNA, 15 nt, Homo sapiens
uuucuccuuagucuu

SEQ ID NO: 412949 - RNA, 22 nt, Homo sapiens
uuucuccuuuuuuaugaugaca

SEQ ID NO: 412950 - RNA, 15 nt, Homo sapiens
uuucucgaguccaaa

SEQ ID NO: 412951 - RNA, 14 nt, Homo sapiens
uuucucuuaugcuu

SEQ ID NO: 412952 - RNA, 19 nt, Homo sapiens
uuucugaaaaagaacugua

SEQ ID NO: 412953 - RNA, 19 nt, Homo sapiens
uuucugagagagugccaug

SEQ ID NO: 412954 - RNA, 12 nt, Homo sapiens
uuucugagcuuu

SEQ ID NO: 412955 - RNA, 22 nt, Homo sapiens
uuucugaugggaggaaaguagc

SEQ ID NO: 412956 - RNA, 19 nt, Homo sapiens
uuucugcaugacuauugua

SEQ ID NO: 412957 - RNA, 17 nt, Homo sapiens
uuucuggccugccuucg

SEQ ID NO: 412958 - RNA, 12 nt, Homo sapiens
uuucuguguuua

SEQ ID NO: 412959 - RNA, 21 nt, Homo sapiens
uuuuuggcuacacacaaacca

SEQ ID NO: 412960 - RNA, 14 nt, Homo sapiens
uuuuuuacacaaau

SEQ ID NO: 412961 - RNA, 14 nt, Homo sapiens
uuuuuuguagccag

SEQ ID NO: 412962 - RNA, 17 nt, Homo sapiens
aacacguuggcucaguc

SEQ ID NO: 412963 - RNA, 23 nt, Homo sapiens
aacacuaaugaggaaacugcacu

SEQ ID NO: 412964 - RNA, 13 nt, Homo sapiens
aacacuaccucuu

SEQ ID NO: 412965 - RNA, 16 nt, Homo sapiens
aacacuagacaugcca

SEQ ID NO: 412966 - RNA, 15 nt, Homo sapiens
aacacucuucuugag

SEQ ID NO: 412967 - RNA, 16 nt, Homo sapiens
aacacugcagcccucu

SEQ ID NO: 412968 - RNA, 14 nt, Homo sapiens
aacacugcccucuu

SEQ ID NO: 412969 - RNA, 21 nt, Homo sapiens
aacacuggugggcagcugagg

SEQ ID NO: 412970 - RNA, 13 nt, Homo sapiens
aacacuuauuuuc

SEQ ID NO: 412971 - RNA, 23 nt, Homo sapiens
aacacuugaugccguuucuuuca

SEQ ID NO: 412972 - RNA, 21 nt, Homo sapiens
aacacuuuuuccauuucuuca

SEQ ID NO: 412973 - RNA, 14 nt, Homo sapiens
aacagaaaacaauu

SEQ ID NO: 412974 - RNA, 23 nt, Homo sapiens
aacagaaacgagauuugccaaaa

SEQ ID NO: 412975 - RNA, 16 nt, Homo sapiens
aacagaagcuuccauu

SEQ ID NO: 412976 - RNA, 13 nt, Homo sapiens
aacagaauauucu

SEQ ID NO: 412977 - RNA, 22 nt, Homo sapiens
aacagaggggcagccaggacau

SEQ ID NO: 412978 - RNA, 20 nt, Homo sapiens
aacagaguuugauaugggcu

SEQ ID NO: 412979 - RNA, 15 nt, Homo sapiens
aacagauaagcaaga

SEQ ID NO: 412980 - RNA, 14 nt, Homo sapiens
aacagccuacugaa

SEQ ID NO: 412981 - RNA, 23 nt, Homo sapiens
aacagcugaggucucuugaggga

SEQ ID NO: 412982 - RNA, 19 nt, Homo sapiens
aacaggauuagacagucaa

SEQ ID NO: 412983 - RNA, 12 nt, Homo sapiens
aacaggcaguug

SEQ ID NO: 412984 - RNA, 18 nt, Homo sapiens
aacaggcucacagagauu

SEQ ID NO: 412985 - RNA, 17 nt, Homo sapiens
aacaggcuuggcaaaga

SEQ ID NO: 412986 - RNA, 18 nt, Homo sapiens
aacagucugaaauaccuu

SEQ ID NO: 412987 - RNA, 20 nt, Homo sapiens
aacagugccauuguuuugcc

SEQ ID NO: 412988 - RNA, 13 nt, Homo sapiens
aacaguucuugga

SEQ ID NO: 412989 - RNA, 23 nt, Homo sapiens
aacaguuuaugcagugcugcuuu

SEQ ID NO: 412990 - RNA, 22 nt, Homo sapiens
aacaguuuuuuaugcuaaucag

SEQ ID NO: 412991 - RNA, 18 nt, Homo sapiens
aacauaaaaugaggcagu

SEQ ID NO: 412992 - RNA, 22 nt, Homo sapiens
aacauaaaaugaggcaguuaaa

SEQ ID NO: 412993 - RNA, 17 nt, Homo sapiens
aacauaacuguaacaua

SEQ ID NO: 412994 - RNA, 23 nt, Homo sapiens
aacauaagagagccuugguucau

SEQ ID NO: 412995 - RNA, 18 nt, Homo sapiens
aacauaaucuaguuuaca

SEQ ID NO: 412996 - RNA, 13 nt, Homo sapiens
aacauacccaucu

SEQ ID NO: 412997 - RNA, 17 nt, Homo sapiens
aacauaggccugcucag

SEQ ID NO: 412998 - RNA, 13 nt, Homo sapiens
aacauaucuugag

SEQ ID NO: 412999 - RNA, 17 nt, Homo sapiens
aacauauucuugcuuuc

SEQ ID NO: 413000 - RNA, 14 nt, Homo sapiens
aacauccuuguaca

SEQ ID NO: 413001 - RNA, 21 nt, Homo sapiens
aacaucugccuugcugcaccu

SEQ ID NO: 413002 - RNA, 21 nt, Homo sapiens
aacaucuuuuuaaccugcaaa

SEQ ID NO: 413003 - RNA, 17 nt, Homo sapiens
aacaugcagcucugcag

SEQ ID NO: 413004 - RNA, 18 nt, Homo sapiens
aacaugcaguucauuauu

SEQ ID NO: 413005 - RNA, 17 nt, Homo sapiens
aacauggccacauccaa

SEQ ID NO: 413006 - RNA, 14 nt, Homo sapiens
aacauggccuuugc

SEQ ID NO: 413007 - RNA, 19 nt, Homo sapiens
aacauggccuuugcuugaa

SEQ ID NO: 413008 - RNA, 19 nt, Homo sapiens
aacaugguuaccucugcau

SEQ ID NO: 413009 - RNA, 16 nt, Homo sapiens
aacauguaauugcaga

SEQ ID NO: 413010 - RNA, 21 nt, Homo sapiens
aacauguuagaagcaaugaau

SEQ ID NO: 413011 - RNA, 14 nt, Homo sapiens
aacauuacugccuu

SEQ ID NO: 413012 - RNA, 13 nt, Homo sapiens
aacauuaugccuu

SEQ ID NO: 413013 - RNA, 17 nt, Homo sapiens
aacauucaaaagcacaa

SEQ ID NO: 413014 - RNA, 19 nt, Homo sapiens
aacauucauucaacagcug

SEQ ID NO: 413015 - RNA, 16 nt, Homo sapiens
aacauuccaaugcauu

SEQ ID NO: 413016 - RNA, 23 nt, Homo sapiens
aacauuccauuugaagcagugau

SEQ ID NO: 413017 - RNA, 15 nt, Homo sapiens
aacauuccugugaaa

SEQ ID NO: 413018 - RNA, 18 nt, Homo sapiens
aacauuccuuagucucaa

SEQ ID NO: 413019 - RNA, 21 nt, Homo sapiens
aacauucuauuucaacuucag

SEQ ID NO: 413020 - RNA, 14 nt, Homo sapiens
aacauugcugccua

SEQ ID NO: 413021 - RNA, 16 nt, Homo sapiens
aacauuggugcaaaga

SEQ ID NO: 413022 - RNA, 18 nt, Homo sapiens
aacauuuggaagccccau

SEQ ID NO: 413023 - RNA, 16 nt, Homo sapiens
aacauuuuguuuaugu

SEQ ID NO: 413024 - RNA, 13 nt, Homo sapiens
aaccaacugccuu

SEQ ID NO: 413025 - RNA, 22 nt, Homo sapiens
aaccaagcuguacccuugagac

SEQ ID NO: 413026 - RNA, 17 nt, Homo sapiens
aaccacaaccaacacca

SEQ ID NO: 413027 - RNA, 15 nt, Homo sapiens
aaccacaugugcaac

SEQ ID NO: 413028 - RNA, 19 nt, Homo sapiens
aaccacccuaucaucaguu

SEQ ID NO: 413029 - RNA, 16 nt, Homo sapiens
aaccaccucucugucu

SEQ ID NO: 413030 - RNA, 18 nt, Homo sapiens
aaccacuaaaauguuaga

SEQ ID NO: 413031 - RNA, 19 nt, Homo sapiens
aaccacuaagagucucuau

SEQ ID NO: 413032 - RNA, 16 nt, Homo sapiens
aaccacuaauguuaga

SEQ ID NO: 413033 - RNA, 24 nt, Homo sapiens
aaccagaauuaggucaaguucaua

SEQ ID NO: 413034 - RNA, 17 nt, Homo sapiens
aaccagagccauggacu

SEQ ID NO: 413035 - RNA, 23 nt, Homo sapiens
aaccagcucuuuggugccagcug

SEQ ID NO: 413036 - RNA, 13 nt, Homo sapiens
aaccagucuucuc

SEQ ID NO: 413037 - RNA, 16 nt, Homo sapiens
aaccaguuaugugaau

SEQ ID NO: 413038 - RNA, 17 nt, Homo sapiens
aaccaugaacucagcua

SEQ ID NO: 413039 - RNA, 12 nt, Homo sapiens
aaccauucugcu

SEQ ID NO: 413040 - RNA, 23 nt, Homo sapiens
aaccauucugcuugguuccacaa

SEQ ID NO: 413041 - RNA, 19 nt, Homo sapiens
aacccagaagauguauuca

SEQ ID NO: 413042 - RNA, 23 nt, Homo sapiens
aacccagccucuagaacagccag

SEQ ID NO: 413043 - RNA, 12 nt, Homo sapiens
aaccccaguguu

SEQ ID NO: 413044 - RNA, 17 nt, Homo sapiens
aaccccgcggugcucug

SEQ ID NO: 413045 - RNA, 13 nt, Homo sapiens
aaccccucugagc

SEQ ID NO: 413046 - RNA, 20 nt, Homo sapiens
aacccggcuaugggacugca

SEQ ID NO: 413047 - RNA, 17 nt, Homo sapiens
aacccugccccugcccc

SEQ ID NO: 413048 - RNA, 17 nt, Homo sapiens
aacccugcccugcaccu

SEQ ID NO: 413049 - RNA, 12 nt, Homo sapiens
aacccugucuga

SEQ ID NO: 413050 - RNA, 19 nt, Homo sapiens
aacccuguuuuauugaguu

SEQ ID NO: 413051 - RNA, 23 nt, Homo sapiens
aacccuguuuuauugaguucuga

SEQ ID NO: 413052 - RNA, 15 nt, Homo sapiens
aacccuuccacacgu

SEQ ID NO: 413053 - RNA, 21 nt, Homo sapiens
aaccgaugguccucacaagcc

SEQ ID NO: 413054 - RNA, 17 nt, Homo sapiens
aaccggggccuacuaga

SEQ ID NO: 413055 - RNA, 16 nt, Homo sapiens
aaccggucacccagga

SEQ ID NO: 413056 - RNA, 21 nt, Homo sapiens
aaccguccuucaucaccgaag

SEQ ID NO: 413057 - RNA, 20 nt, Homo sapiens
aaccuacuagacaaugaugu

SEQ ID NO: 413058 - RNA, 13 nt, Homo sapiens
aaccucaaaaugu

SEQ ID NO: 413059 - RNA, 22 nt, Homo sapiens
aaccucucugaucuugugcuca

SEQ ID NO: 413060 - RNA, 13 nt, Homo sapiens
aaccucuuuccaa

SEQ ID NO: 413061 - RNA, 14 nt, Homo sapiens
aaccugcugaaggg

SEQ ID NO: 413062 - RNA, 22 nt, Homo sapiens
aaccugggagccggaggcugca

SEQ ID NO: 413063 - RNA, 17 nt, Homo sapiens
aaccuggugcuggauau

SEQ ID NO: 413064 - RNA, 12 nt, Homo sapiens
aaccugugauga

SEQ ID NO: 413065 - RNA, 18 nt, Homo sapiens
aaccuugugagcaaggug

SEQ ID NO: 413066 - RNA, 18 nt, Homo sapiens
aaccuugugugaguguga

SEQ ID NO: 413067 - RNA, 14 nt, Homo sapiens
aacgaaacauuuag

SEQ ID NO: 413068 - RNA, 16 nt, Homo sapiens
aacgaaugguacuaca

SEQ ID NO: 413069 - RNA, 18 nt, Homo sapiens
aacgacaaagcaugguau

SEQ ID NO: 413070 - RNA, 19 nt, Homo sapiens
aacgaggcaaugacuguga

SEQ ID NO: 413071 - RNA, 22 nt, Homo sapiens
aacgccacguguaguggcucau

SEQ ID NO: 413072 - RNA, 14 nt, Homo sapiens
aacggcccucuuga

SEQ ID NO: 413073 - RNA, 18 nt, Homo sapiens
aacggcuccaggauuuua

SEQ ID NO: 413074 - RNA, 18 nt, Homo sapiens
aacguccuuccacuucag

SEQ ID NO: 413075 - RNA, 13 nt, Homo sapiens
aacgugcugucag

SEQ ID NO: 413076 - RNA, 22 nt, Homo sapiens
aacgugggaguucagcugcuuc

SEQ ID NO: 413077 - RNA, 15 nt, Homo sapiens
aacgugguucagaga

SEQ ID NO: 413078 - RNA, 23 nt, Homo sapiens
aacguuaucucauugcaaaaaua

SEQ ID NO: 413079 - RNA, 15 nt, Homo sapiens
aacguucaugcauuu

SEQ ID NO: 413080 - RNA, 23 nt, Homo sapiens
aacuaaauacuguaacacuguau

SEQ ID NO: 413081 - RNA, 17 nt, Homo sapiens
aacuaagaaauaugcac

SEQ ID NO: 413082 - RNA, 23 nt, Homo sapiens
aacuaagcaaguauauuuauuuc

SEQ ID NO: 413083 - RNA, 17 nt, Homo sapiens
aacuaaguucucuaucu

SEQ ID NO: 413084 - RNA, 17 nt, Homo sapiens
aacuacugaacuguuac

SEQ ID NO: 413085 - RNA, 22 nt, Homo sapiens
aacuacugaacuguuaccuagg

SEQ ID NO: 413086 - RNA, 17 nt, Homo sapiens
aacuagaauuuauucaa

SEQ ID NO: 413087 - RNA, 21 nt, Homo sapiens
aacuagcacuuuauaagccaa

SEQ ID NO: 413088 - RNA, 17 nt, Homo sapiens
aacuaguguuucugcag

SEQ ID NO: 413089 - RNA, 23 nt, Homo sapiens
aacuaguucuuaggaacagacuc

SEQ ID NO: 413090 - RNA, 17 nt, Homo sapiens
aacuauuacaccaaaua

SEQ ID NO: 413091 - RNA, 15 nt, Homo sapiens
aaggcaucuaagaca

SEQ ID NO: 413092 - RNA, 19 nt, Homo sapiens
aaggcaucuaagacauuca

SEQ ID NO: 413093 - RNA, 18 nt, Homo sapiens
aaggcccauaucugugaa

SEQ ID NO: 413094 - RNA, 22 nt, Homo sapiens
aaggccguguccccuuguucua

SEQ ID NO: 413095 - RNA, 18 nt, Homo sapiens
aaggccucauccuccacu

SEQ ID NO: 413096 - RNA, 17 nt, Homo sapiens
aaggccuugaagaauuu

SEQ ID NO: 413097 - RNA, 18 nt, Homo sapiens
aaggcggcuacaugccuc

SEQ ID NO: 413098 - RNA, 15 nt, Homo sapiens
aaggcggugagcaau

SEQ ID NO: 413099 - RNA, 22 nt, Homo sapiens
aaggcucauaccuggcuugcag

SEQ ID NO: 413100 - RNA, 14 nt, Homo sapiens
aaggcuugguccca

SEQ ID NO: 413101 - RNA, 19 nt, Homo sapiens
aagggaaauaacaguauuu

SEQ ID NO: 413102 - RNA, 17 nt, Homo sapiens
aagggaagagcauguaa

SEQ ID NO: 413103 - RNA, 17 nt, Homo sapiens
aagggaagcuucuugcu

SEQ ID NO: 413104 - RNA, 18 nt, Homo sapiens
aagggacugguccaggca

SEQ ID NO: 413105 - RNA, 19 nt, Homo sapiens
aagggauggaaaaggaaga

SEQ ID NO: 413106 - RNA, 18 nt, Homo sapiens
aagggcagcuucagucuc

SEQ ID NO: 413107 - RNA, 19 nt, Homo sapiens
aagggcagcuucagucucu

SEQ ID NO: 413108 - RNA, 15 nt, Homo sapiens
aagggcaggcccaaa

SEQ ID NO: 413109 - RNA, 9 nt, Homo sapiens
aagggccag

SEQ ID NO: 413110 - RNA, 18 nt, Homo sapiens
aagggccccacucaggga

SEQ ID NO: 413111 - RNA, 16 nt, Homo sapiens
aaggggcugucuccca

SEQ ID NO: 413112 - RNA, 17 nt, Homo sapiens
aagggggguugcagugg

SEQ ID NO: 413113 - RNA, 18 nt, Homo sapiens
aagggguaauugcauucu

SEQ ID NO: 413114 - RNA, 18 nt, Homo sapiens
aagggguagaaguggcau

SEQ ID NO: 413115 - RNA, 17 nt, Homo sapiens
aaggggugccugggaac

SEQ ID NO: 413116 - RNA, 16 nt, Homo sapiens
aagggugcccaccucu

SEQ ID NO: 413117 - RNA, 15 nt, Homo sapiens
aagguaaacaguuug

SEQ ID NO: 413118 - RNA, 17 nt, Homo sapiens
aagguaccaagaucaca

SEQ ID NO: 413119 - RNA, 13 nt, Homo sapiens
aagguaugguggg

SEQ ID NO: 413120 - RNA, 17 nt, Homo sapiens
aagguaugugucagcca

SEQ ID NO: 413121 - RNA, 22 nt, Homo sapiens
aaggucguuuuuuucauuccau

SEQ ID NO: 413122 - RNA, 21 nt, Homo sapiens
aaggucuaccugaaaauucaa

SEQ ID NO: 413123 - RNA, 15 nt, Homo sapiens
aaggucuccacuuca

SEQ ID NO: 413124 - RNA, 15 nt, Homo sapiens
aaggucucugaacuc

SEQ ID NO: 413125 - RNA, 12 nt, Homo sapiens
aaggugaccucu

SEQ ID NO: 413126 - RNA, 15 nt, Homo sapiens
aaggugaccuugcaa

SEQ ID NO: 413127 - RNA, 14 nt, Homo sapiens
aaggugagugcuug

SEQ ID NO: 413128 - RNA, 15 nt, Homo sapiens
aaggugaguucucac

SEQ ID NO: 413129 - RNA, 16 nt, Homo sapiens
aaggugaguucucacu

SEQ ID NO: 413130 - RNA, 20 nt, Homo sapiens
aaggugauuuuccugugucc

SEQ ID NO: 413131 - RNA, 14 nt, Homo sapiens
aaggugugcuacag

SEQ ID NO: 413132 - RNA, 20 nt, Homo sapiens
aagguucucagguguugcca

SEQ ID NO: 413133 - RNA, 17 nt, Homo sapiens
aagguucuuacugcuug

SEQ ID NO: 413134 - RNA, 22 nt, Homo sapiens
aagguugcugaggcucugaccc

SEQ ID NO: 413135 - RNA, 23 nt, Homo sapiens
aagguugcuguugugcagugugc

SEQ ID NO: 413136 - RNA, 16 nt, Homo sapiens
aagguuucacuguuca

SEQ ID NO: 413137 - RNA, 17 nt, Homo sapiens
aagguuuuuacugugag

SEQ ID NO: 413138 - RNA, 23 nt, Homo sapiens
aaguaaaaacacuaccucuuuug

SEQ ID NO: 413139 - RNA, 20 nt, Homo sapiens
aaguaaacugcccugucuag

SEQ ID NO: 413140 - RNA, 21 nt, Homo sapiens
aaguaaauugccuucuagaca

SEQ ID NO: 413141 - RNA, 20 nt, Homo sapiens
aaguaagcagaguucuuugc

SEQ ID NO: 413142 - RNA, 14 nt, Homo sapiens
aaguaauaucuuuc

SEQ ID NO: 413143 - RNA, 22 nt, Homo sapiens
aaguaauuccucucacuaaacu

SEQ ID NO: 413144 - RNA, 14 nt, Homo sapiens
aaguaauugugaaa

SEQ ID NO: 413145 - RNA, 13 nt, Homo sapiens
aaguacaaagcau

SEQ ID NO: 413146 - RNA, 17 nt, Homo sapiens
aaguacaaauauuccug

SEQ ID NO: 413147 - RNA, 18 nt, Homo sapiens
aaguacagucccagcaca

SEQ ID NO: 413148 - RNA, 16 nt, Homo sapiens
aaguaccaaugcuguu

SEQ ID NO: 413149 - RNA, 16 nt, Homo sapiens
aaguacccugugcuca

SEQ ID NO: 413150 - RNA, 19 nt, Homo sapiens
aaguacugaaauacauaug

SEQ ID NO: 413151 - RNA, 17 nt, Homo sapiens
aaguagcacccuggauu

SEQ ID NO: 413152 - RNA, 16 nt, Homo sapiens
aaguauaacuuauuca

SEQ ID NO: 413153 - RNA, 15 nt, Homo sapiens
aaguaucaugcauuc

SEQ ID NO: 413154 - RNA, 20 nt, Homo sapiens
aaguauccaauuaugugaca

SEQ ID NO: 413155 - RNA, 19 nt, Homo sapiens
aaguauggcagugggagac

SEQ ID NO: 413156 - RNA, 11 nt, Homo sapiens
aaguauuccac

SEQ ID NO: 413157 - RNA, 18 nt, Homo sapiens
aaguauucccuucuuucc

SEQ ID NO: 413158 - RNA, 15 nt, Homo sapiens
aaguauuccuuuccu

SEQ ID NO: 413159 - RNA, 15 nt, Homo sapiens
aagucaaacuuucac

SEQ ID NO: 413160 - RNA, 21 nt, Homo sapiens
aagucaaauuuggauuuucca

SEQ ID NO: 413161 - RNA, 17 nt, Homo sapiens
aagucaaucauuucuca

SEQ ID NO: 413162 - RNA, 13 nt, Homo sapiens
aagucagcaacag

SEQ ID NO: 413163 - RNA, 17 nt, Homo sapiens
aagucauuaaaauggaa

SEQ ID NO: 413164 - RNA, 18 nt, Homo sapiens
aaguccaaccugccugug

SEQ ID NO: 413165 - RNA, 23 nt, Homo sapiens
aaguccaaccugccugugcauga

SEQ ID NO: 413166 - RNA, 14 nt, Homo sapiens
aaguccagcuccuu

SEQ ID NO: 413167 - RNA, 19 nt, Homo sapiens
aaguccagugugacuuuau

SEQ ID NO: 413168 - RNA, 13 nt, Homo sapiens
aagucccaucuca

SEQ ID NO: 413169 - RNA, 14 nt, Homo sapiens
aagucccaucucac

SEQ ID NO: 413170 - RNA, 16 nt, Homo sapiens
aagucccgaggcagca

SEQ ID NO: 413171 - RNA, 18 nt, Homo sapiens
aaguccuuagaaugaggg

SEQ ID NO: 413172 - RNA, 23 nt, Homo sapiens
aagucuaaaguuuacaguaaaua

SEQ ID NO: 413173 - RNA, 11 nt, Homo sapiens
aagucuugaca

SEQ ID NO: 413174 - RNA, 19 nt, Homo sapiens
aagucuugugacuagugcu

SEQ ID NO: 413175 - RNA, 15 nt, Homo sapiens
aagugagagagacaa

SEQ ID NO: 413176 - RNA, 15 nt, Homo sapiens
aagugagcacugagg

SEQ ID NO: 413177 - RNA, 17 nt, Homo sapiens
aagugcauuuuuaucug

SEQ ID NO: 413178 - RNA, 11 nt, Homo sapiens
aagugccccug

SEQ ID NO: 413179 - RNA, 10 nt, Homo sapiens
aagugccuua

SEQ ID NO: 413180 - RNA, 16 nt, Homo sapiens
aaguggaaaaugcaau

SEQ ID NO: 413181 - RNA, 17 nt, Homo sapiens
aaguggaagccacugga

SEQ ID NO: 413182 - RNA, 17 nt, Homo sapiens
aaguggcaccuaauaaa

SEQ ID NO: 413183 - RNA, 17 nt, Homo sapiens
aaguggcuaauucaauu

SEQ ID NO: 413184 - RNA, 20 nt, Homo sapiens
aaguggucgcuuacuuugag

SEQ ID NO: 413185 - RNA, 17 nt, Homo sapiens
aaguguacaauuuucau

SEQ ID NO: 413186 - RNA, 21 nt, Homo sapiens
aaguguacaauuuucauccca

SEQ ID NO: 413187 - RNA, 13 nt, Homo sapiens
aaguguacuggau

SEQ ID NO: 413188 - RNA, 15 nt, Homo sapiens
aaguguagcacccug

SEQ ID NO: 413189 - RNA, 21 nt, Homo sapiens
aaguguccccuauggggaugg

SEQ ID NO: 413190 - RNA, 18 nt, Homo sapiens
aagugugcuuuaugcuga

SEQ ID NO: 413191 - RNA, 18 nt, Homo sapiens
aaguguugcucuuggaaa

SEQ ID NO: 413192 - RNA, 19 nt, Homo sapiens
aaguguuucguaagacaaa

SEQ ID NO: 413193 - RNA, 20 nt, Homo sapiens
aaguuaaaaagucaaacuuu

SEQ ID NO: 413194 - RNA, 21 nt, Homo sapiens
aaguuaacauucaguacuuua

SEQ ID NO: 413195 - RNA, 14 nt, Homo sapiens
aaguuacuugaauu

SEQ ID NO: 413196 - RNA, 16 nt, Homo sapiens
aaguuauugauguuuu

SEQ ID NO: 413197 - RNA, 13 nt, Homo sapiens
aaguucaugucua

SEQ ID NO: 413198 - RNA, 22 nt, Homo sapiens
aaguuccaguguucucucuuau

SEQ ID NO: 413199 - RNA, 18 nt, Homo sapiens
aaguucuacaguuaauua

SEQ ID NO: 413200 - RNA, 19 nt, Homo sapiens
aaguucugguaugaacuug

SEQ ID NO: 413201 - RNA, 14 nt, Homo sapiens
aaguugcugagaaa

SEQ ID NO: 413202 - RNA, 22 nt, Homo sapiens
aaguugcugugccccaucagca

SEQ ID NO: 413203 - RNA, 17 nt, Homo sapiens
aaguugcuucucaugga

SEQ ID NO: 413204 - RNA, 22 nt, Homo sapiens
aaguuggucuuacuuugugcaa

SEQ ID NO: 413205 - RNA, 19 nt, Homo sapiens
aaguugucuuacacuucuc

SEQ ID NO: 413206 - RNA, 20 nt, Homo sapiens
aaguuguuuaccucuuuguc

SEQ ID NO: 413207 - RNA, 14 nt, Homo sapiens
aaguuuaucuuuca

SEQ ID NO: 413208 - RNA, 11 nt, Homo sapiens
aaguuucacau

SEQ ID NO: 413209 - RNA, 18 nt, Homo sapiens
aaguuucugcagcagaug

SEQ ID NO: 413210 - RNA, 15 nt, Homo sapiens
aaguuugcuagugac

SEQ ID NO: 413211 - RNA, 18 nt, Homo sapiens
aaguuugggaagggaugg

SEQ ID NO: 413212 - RNA, 13 nt, Homo sapiens
aaguuuuacuuga

SEQ ID NO: 413213 - RNA, 23 nt, Homo sapiens
aaguuuucagaaccucuucccca

SEQ ID NO: 413214 - RNA, 14 nt, Homo sapiens
aaguuuugaugaaa

SEQ ID NO: 413215 - RNA, 20 nt, Homo sapiens
aauaaaaagugacacagcag

SEQ ID NO: 413216 - RNA, 14 nt, Homo sapiens
aauaaaaaugcacg

SEQ ID NO: 413217 - RNA, 20 nt, Homo sapiens
aauaaaacagcugucucuaa

SEQ ID NO: 413218 - RNA, 14 nt, Homo sapiens
aauaaaacauuccu

SEQ ID NO: 413219 - RNA, 16 nt, Homo sapiens
aauaaaaugcauuuaa

SEQ ID NO: 413220 - RNA, 17 nt, Homo sapiens
aauaaacaacauugucu

SEQ ID NO: 413221 - RNA, 12 nt, Homo sapiens
aauaaacugugc

SEQ ID NO: 413222 - RNA, 20 nt, Homo sapiens
aauaaacuguguuuacucag

SEQ ID NO: 413223 - RNA, 14 nt, Homo sapiens
aauaaacuguuaug

SEQ ID NO: 413224 - RNA, 12 nt, Homo sapiens
aauaaagacagg

SEQ ID NO: 413225 - RNA, 22 nt, Homo sapiens
aauaaagaccuauguacuuaau

SEQ ID NO: 413226 - RNA, 20 nt, Homo sapiens
aauaaagcaaauauauuuag

SEQ ID NO: 413227 - RNA, 15 nt, Homo sapiens
aauaaagcaucucau

SEQ ID NO: 413228 - RNA, 14 nt, Homo sapiens
aauaaagcauuaua

SEQ ID NO: 413229 - RNA, 22 nt, Homo sapiens
aauaaagccuugugaucacuuu

SEQ ID NO: 413230 - RNA, 22 nt, Homo sapiens
aauaaagguuagauaaguccuu

SEQ ID NO: 413231 - RNA, 19 nt, Homo sapiens
aauaaaguuauuacucuga

SEQ ID NO: 413232 - RNA, 17 nt, Homo sapiens
aauaaauaaaaauauuc

SEQ ID NO: 413233 - RNA, 23 nt, Homo sapiens
aauaaaugagagggaaucgacug

SEQ ID NO: 413234 - RNA, 19 nt, Homo sapiens
aauaaauggguaacacuga

SEQ ID NO: 413235 - RNA, 22 nt, Homo sapiens
aauaaauuggaacaccuccuca

SEQ ID NO: 413236 - RNA, 12 nt, Homo sapiens
aauaacacuguc

SEQ ID NO: 413237 - RNA, 13 nt, Homo sapiens
aauaaccaaaaaa

SEQ ID NO: 413238 - RNA, 13 nt, Homo sapiens
aauaaccaguuaa

SEQ ID NO: 413239 - RNA, 11 nt, Homo sapiens
aauaacuaaua

SEQ ID NO: 413240 - RNA, 14 nt, Homo sapiens
aauaacuacugcaa

SEQ ID NO: 413241 - RNA, 16 nt, Homo sapiens
aauaagaaacaugaug

SEQ ID NO: 413242 - RNA, 21 nt, Homo sapiens
aauaaguaacauauaaauuaa

SEQ ID NO: 413243 - RNA, 13 nt, Homo sapiens
aauaaguaauauc

SEQ ID NO: 413244 - RNA, 19 nt, Homo sapiens
aauaaguucauuaaacaga

SEQ ID NO: 413245 - RNA, 22 nt, Homo sapiens
aauaauacaucuuuaucauuaa

SEQ ID NO: 413246 - RNA, 22 nt, Homo sapiens
aauaaucugguguucuugcuaa

SEQ ID NO: 413247 - RNA, 13 nt, Homo sapiens
aauaaugauaccu

SEQ ID NO: 413248 - RNA, 13 nt, Homo sapiens
aauaaugauuuaa

SEQ ID NO: 413249 - RNA, 14 nt, Homo sapiens
aauaauguacaucu

SEQ ID NO: 413250 - RNA, 16 nt, Homo sapiens
aauaauguacaucugg

SEQ ID NO: 413251 - RNA, 15 nt, Homo sapiens
aauaauguccuuucc

SEQ ID NO: 413252 - RNA, 14 nt, Homo sapiens
aauaauuguggaga

SEQ ID NO: 413253 - RNA, 13 nt, Homo sapiens
aauaauuguguac

SEQ ID NO: 413254 - RNA, 17 nt, Homo sapiens
aauaauuuggaaucagc

SEQ ID NO: 413255 - RNA, 11 nt, Homo sapiens
aauacaaggag

SEQ ID NO: 413256 - RNA, 23 nt, Homo sapiens
aauacaauaguaugcagcuaaaa

SEQ ID NO: 413257 - RNA, 20 nt, Homo sapiens
aauacaccgauaaccacagg

SEQ ID NO: 413258 - RNA, 15 nt, Homo sapiens
aauacaugcaucuca

SEQ ID NO: 413259 - RNA, 12 nt, Homo sapiens
aauacauggcua

SEQ ID NO: 413260 - RNA, 19 nt, Homo sapiens
aauacauuucuacuuuauu

SEQ ID NO: 413261 - RNA, 17 nt, Homo sapiens
aauacccuuggcacuga

SEQ ID NO: 413262 - RNA, 20 nt, Homo sapiens
aauaccuuaguuuuuuccac

SEQ ID NO: 413263 - RNA, 18 nt, Homo sapiens
aauaccuuuaaauaucau

SEQ ID NO: 413264 - RNA, 22 nt, Homo sapiens
aauacgugaaagaugcaagcac

SEQ ID NO: 413265 - RNA, 23 nt, Homo sapiens
aauacugcuugaccguacucuca

SEQ ID NO: 413266 - RNA, 21 nt, Homo sapiens
aauacugcuuuugcaaacaga

SEQ ID NO: 413267 - RNA, 23 nt, Homo sapiens
aauacugguuauccugugcuaca

SEQ ID NO: 413268 - RNA, 17 nt, Homo sapiens
aauacuuacucuugucg

SEQ ID NO: 413269 - RNA, 21 nt, Homo sapiens
aauacuugaacucuguucccc

SEQ ID NO: 413270 - RNA, 24 nt, Homo sapiens
aauacuugaauauggaacauaugc

SEQ ID NO: 413271 - RNA, 11 nt, Homo sapiens
aauacuuucag

SEQ ID NO: 413272 - RNA, 17 nt, Homo sapiens
aauacuuuuuaaaaggu

SEQ ID NO: 413273 - RNA, 21 nt, Homo sapiens
aauacuuuuuucuaguuucag

SEQ ID NO: 413274 - RNA, 16 nt, Homo sapiens
aauagaaccacuauga

SEQ ID NO: 413275 - RNA, 20 nt, Homo sapiens
aauagaaccacuaugaagcu

SEQ ID NO: 413276 - RNA, 21 nt, Homo sapiens
aauagaauuucuuucccuaaa

SEQ ID NO: 413277 - RNA, 15 nt, Homo sapiens
aauagagacuguaga

SEQ ID NO: 413278 - RNA, 22 nt, Homo sapiens
aauagagucacagcuuucccag

SEQ ID NO: 413279 - RNA, 15 nt, Homo sapiens
aauagcaaaagugau

SEQ ID NO: 413280 - RNA, 22 nt, Homo sapiens
aauagcacauccuccaacguua

SEQ ID NO: 413281 - RNA, 23 nt, Homo sapiens
aauagcauacaucaauggugugu

SEQ ID NO: 413282 - RNA, 14 nt, Homo sapiens
aauagcaugucacu

SEQ ID NO: 413283 - RNA, 13 nt, Homo sapiens
aauagccaaucau

SEQ ID NO: 413284 - RNA, 20 nt, Homo sapiens
aauagcuauauccauguacu

SEQ ID NO: 413285 - RNA, 17 nt, Homo sapiens
aauaggugcuuauucuc

SEQ ID NO: 413286 - RNA, 19 nt, Homo sapiens
aauaggugcuuauucucaa

SEQ ID NO: 413287 - RNA, 18 nt, Homo sapiens
aauaguaauaucaauaaa

SEQ ID NO: 413288 - RNA, 20 nt, Homo sapiens
aauaguaccuucaauacuua

SEQ ID NO: 413289 - RNA, 14 nt, Homo sapiens
aauaguacuauuaa

SEQ ID NO: 413290 - RNA, 12 nt, Homo sapiens
aauagucauucc

SEQ ID NO: 413291 - RNA, 14 nt, Homo sapiens
aauagucauuccaa

SEQ ID NO: 413292 - RNA, 18 nt, Homo sapiens
aauagucauuccaaauau

SEQ ID NO: 413293 - RNA, 20 nt, Homo sapiens
aauagugggaucaaagcuag

SEQ ID NO: 413294 - RNA, 17 nt, Homo sapiens
aauaguguguccaugca

SEQ ID NO: 413295 - RNA, 14 nt, Homo sapiens
aauauaacugccuu

SEQ ID NO: 413296 - RNA, 23 nt, Homo sapiens
aauauaagcuuaaaauaagugaa

SEQ ID NO: 413297 - RNA, 18 nt, Homo sapiens
aauauacauucaaacuua

SEQ ID NO: 413298 - RNA, 14 nt, Homo sapiens
aauauacuaugaaa

SEQ ID NO: 413299 - RNA, 13 nt, Homo sapiens
aauauaguuugag

SEQ ID NO: 413300 - RNA, 16 nt, Homo sapiens
aauauauauaauacuu

SEQ ID NO: 413301 - RNA, 22 nt, Homo sapiens
aauauauuuuucccuguuugcc

SEQ ID NO: 413302 - RNA, 17 nt, Homo sapiens
aauaucaaaaaggagcu

SEQ ID NO: 413303 - RNA, 13 nt, Homo sapiens
aauaucauuucau

SEQ ID NO: 413304 - RNA, 23 nt, Homo sapiens
aauauccaccucuccuuuuugcc

SEQ ID NO: 413305 - RNA, 14 nt, Homo sapiens
aauauccagucaaa

SEQ ID NO: 413306 - RNA, 14 nt, Homo sapiens
aauaucccagagaa

SEQ ID NO: 413307 - RNA, 21 nt, Homo sapiens
aauaugagaugcguuguuaca

SEQ ID NO: 413308 - RNA, 17 nt, Homo sapiens
aauaugcaguucugcag

SEQ ID NO: 413309 - RNA, 22 nt, Homo sapiens
aauaugccuagcacaaguacca

SEQ ID NO: 413310 - RNA, 14 nt, Homo sapiens
aauauggaacauau

SEQ ID NO: 413311 - RNA, 22 nt, Homo sapiens
aauauguauuguaaacaugugu

SEQ ID NO: 413312 - RNA, 13 nt, Homo sapiens
aauauuacauugc

SEQ ID NO: 413313 - RNA, 18 nt, Homo sapiens
aauauuagaagccugcag

SEQ ID NO: 413314 - RNA, 17 nt, Homo sapiens
aauauuagauugcugaa

SEQ ID NO: 413315 - RNA, 15 nt, Homo sapiens
aauauuauaaaucca

SEQ ID NO: 413316 - RNA, 14 nt, Homo sapiens
aauauuauacuucu

SEQ ID NO: 413317 - RNA, 18 nt, Homo sapiens
aauauuccuaugcugcaa

SEQ ID NO: 413318 - RNA, 12 nt, Homo sapiens
aauauuccugaa

SEQ ID NO: 413319 - RNA, 15 nt, Homo sapiens
aauauugauuccuca

SEQ ID NO: 413320 - RNA, 19 nt, Homo sapiens
aauauuuauauugucacuc

SEQ ID NO: 413321 - RNA, 21 nt, Homo sapiens
aauauuuauauugucacucau

SEQ ID NO: 413322 - RNA, 20 nt, Homo sapiens
aauauuuccuuaaacugugu

SEQ ID NO: 413323 - RNA, 18 nt, Homo sapiens
aauauuucuuucaugucu

SEQ ID NO: 413324 - RNA, 15 nt, Homo sapiens
aauauuuuaccacug

SEQ ID NO: 413325 - RNA, 14 nt, Homo sapiens
aauauuuuuguaca

SEQ ID NO: 413326 - RNA, 15 nt, Homo sapiens
aaucaaacagggaca

SEQ ID NO: 413327 - RNA, 13 nt, Homo sapiens
aaucaaagcacuu

SEQ ID NO: 413328 - RNA, 22 nt, Homo sapiens
aaucaaaggaaaauaguaaugu

SEQ ID NO: 413329 - RNA, 12 nt, Homo sapiens
aaucaacaguga

SEQ ID NO: 413330 - RNA, 22 nt, Homo sapiens
aaucaaccugcacuucauaucu

SEQ ID NO: 413331 - RNA, 23 nt, Homo sapiens
aaucaagaaauaugaagcacuuu

SEQ ID NO: 413332 - RNA, 14 nt, Homo sapiens
aaucaagagugagu

SEQ ID NO: 413333 - RNA, 24 nt, Homo sapiens
aaucaaggcauaaaauacaauuaa

SEQ ID NO: 413334 - RNA, 18 nt, Homo sapiens
aaucaagucagcaacaga

SEQ ID NO: 413335 - RNA, 15 nt, Homo sapiens
aaucaagucugugaa

SEQ ID NO: 413336 - RNA, 14 nt, Homo sapiens
aaucacaacucagc

SEQ ID NO: 413337 - RNA, 14 nt, Homo sapiens
aaucaccucucugu

SEQ ID NO: 413338 - RNA, 20 nt, Homo sapiens
aaucagaauuguagccaguu

SEQ ID NO: 413339 - RNA, 14 nt, Homo sapiens
aaucagaugcagcu

SEQ ID NO: 413340 - RNA, 18 nt, Homo sapiens
aaucagcucaaucuucaa

SEQ ID NO: 413341 - RNA, 22 nt, Homo sapiens
aaucagugagaagaauagcuua

SEQ ID NO: 413342 - RNA, 19 nt, Homo sapiens
aaucauagccaaaaacuuu

SEQ ID NO: 413343 - RNA, 16 nt, Homo sapiens
aaucauauugaugaaa

SEQ ID NO: 413344 - RNA, 21 nt, Homo sapiens
aaucaugaaauaugcaucuca

SEQ ID NO: 413345 - RNA, 21 nt, Homo sapiens
aaucaugugggugagccagug

SEQ ID NO: 413346 - RNA, 21 nt, Homo sapiens
aaucauguuuuuaaaugcaua

SEQ ID NO: 413347 - RNA, 17 nt, Homo sapiens
aaucauugugugucuuc

SEQ ID NO: 413348 - RNA, 22 nt, Homo sapiens
aaucauugugugucuucaggag

SEQ ID NO: 413349 - RNA, 20 nt, Homo sapiens
aauccaagcugcucauuuca

SEQ ID NO: 413350 - RNA, 19 nt, Homo sapiens
aauccacaaauaugcuaaa

SEQ ID NO: 413351 - RNA, 14 nt, Homo sapiens
aauccacaguauug

SEQ ID NO: 413352 - RNA, 20 nt, Homo sapiens
auaaaacuaggggguguaua

SEQ ID NO: 413353 - RNA, 21 nt, Homo sapiens
auaaaagcuaugacacgagaa

SEQ ID NO: 413354 - RNA, 21 nt, Homo sapiens
auaaaaggaaguagaugugaa

SEQ ID NO: 413355 - RNA, 18 nt, Homo sapiens
auaaaagguuuaauguca

SEQ ID NO: 413356 - RNA, 20 nt, Homo sapiens
auaaaaucuaauuaauucuu

SEQ ID NO: 413357 - RNA, 15 nt, Homo sapiens
auaaaaucuuuccau

SEQ ID NO: 413358 - RNA, 15 nt, Homo sapiens
auaaaaugauguaug

SEQ ID NO: 413359 - RNA, 16 nt, Homo sapiens
auaaaauuagcuugag

SEQ ID NO: 413360 - RNA, 22 nt, Homo sapiens
auaaacaaucuuagacauuuau

SEQ ID NO: 413361 - RNA, 18 nt, Homo sapiens
auaaacacuguauuguaa

SEQ ID NO: 413362 - RNA, 13 nt, Homo sapiens
auaaacauaugca

SEQ ID NO: 413363 - RNA, 19 nt, Homo sapiens
auaaacauuaaacacugua

SEQ ID NO: 413364 - RNA, 15 nt, Homo sapiens
auaaaccauaaaaua

SEQ ID NO: 413365 - RNA, 15 nt, Homo sapiens
auaaacccaucugua

SEQ ID NO: 413366 - RNA, 22 nt, Homo sapiens
auaaaccccaccuuuauuccuu

SEQ ID NO: 413367 - RNA, 17 nt, Homo sapiens
auaaacgaaacauuuag

SEQ ID NO: 413368 - RNA, 14 nt, Homo sapiens
auaaacuagaucuc

SEQ ID NO: 413369 - RNA, 16 nt, Homo sapiens
auaaacucacaacucu

SEQ ID NO: 413370 - RNA, 12 nt, Homo sapiens
auaaacugugag

SEQ ID NO: 413371 - RNA, 16 nt, Homo sapiens
auaaacugugucuguc

SEQ ID NO: 413372 - RNA, 15 nt, Homo sapiens
auaaacuucagggau

SEQ ID NO: 413373 - RNA, 12 nt, Homo sapiens
auaaacuuugaa

SEQ ID NO: 413374 - RNA, 17 nt, Homo sapiens
auaaagaggacuugaac

SEQ ID NO: 413375 - RNA, 14 nt, Homo sapiens
auaaagaugaucua

SEQ ID NO: 413376 - RNA, 21 nt, Homo sapiens
auaaagaugucaaauaucuca

SEQ ID NO: 413377 - RNA, 22 nt, Homo sapiens
auaaagcacccuguaucacaga

SEQ ID NO: 413378 - RNA, 18 nt, Homo sapiens
auaaagcccuugaaccag

SEQ ID NO: 413379 - RNA, 15 nt, Homo sapiens
auaaaggcauuucaa

SEQ ID NO: 413380 - RNA, 23 nt, Homo sapiens
auaaaggcauuucaaagucucac

SEQ ID NO: 413381 - RNA, 19 nt, Homo sapiens
auaaagguuagauaagucc

SEQ ID NO: 413382 - RNA, 23 nt, Homo sapiens
auaaaguauccaugcaugugcau

SEQ ID NO: 413383 - RNA, 15 nt, Homo sapiens
auaaaguuugcuaag

SEQ ID NO: 413384 - RNA, 21 nt, Homo sapiens
auaaauaaagaagaaaauaac

SEQ ID NO: 413385 - RNA, 18 nt, Homo sapiens
auaaauauuuuugccaua

SEQ ID NO: 413386 - RNA, 19 nt, Homo sapiens
auaaaucaaugucacuuaa

SEQ ID NO: 413387 - RNA, 22 nt, Homo sapiens
auaaauccucagguaguacugg

SEQ ID NO: 413388 - RNA, 16 nt, Homo sapiens
auaaaucuaaagucua

SEQ ID NO: 413389 - RNA, 11 nt, Homo sapiens
auaaaugggcc

SEQ ID NO: 413390 - RNA, 14 nt, Homo sapiens
auaaaugugaacuu

SEQ ID NO: 413391 - RNA, 12 nt, Homo sapiens
auaaauguggau

SEQ ID NO: 413392 - RNA, 13 nt, Homo sapiens
auaaauguuuaaa

SEQ ID NO: 413393 - RNA, 21 nt, Homo sapiens
auaaauuacuuuuucauucuu

SEQ ID NO: 413394 - RNA, 18 nt, Homo sapiens
auaaauugcuccuugaca

SEQ ID NO: 413395 - RNA, 21 nt, Homo sapiens
auaaauuggugauaaguggaa

SEQ ID NO: 413396 - RNA, 22 nt, Homo sapiens
auaaauuggugauaaguggaaa

SEQ ID NO: 413397 - RNA, 18 nt, Homo sapiens
auaacaauauaugauaua

SEQ ID NO: 413398 - RNA, 17 nt, Homo sapiens
auaacagauccuuucaa

SEQ ID NO: 413399 - RNA, 16 nt, Homo sapiens
auaacaguuacuccag

SEQ ID NO: 413400 - RNA, 20 nt, Homo sapiens
auaacauaaaagugcuacuu

SEQ ID NO: 413401 - RNA, 19 nt, Homo sapiens
auaacaucucuuucaucua

SEQ ID NO: 413402 - RNA, 12 nt, Homo sapiens
auaacauuugcu

SEQ ID NO: 413403 - RNA, 18 nt, Homo sapiens
auaacauuugcugaauau

SEQ ID NO: 413404 - RNA, 17 nt, Homo sapiens
auaaccacugcuuccau

SEQ ID NO: 413405 - RNA, 16 nt, Homo sapiens
auaaccccaccuugcc

SEQ ID NO: 413406 - RNA, 18 nt, Homo sapiens
auaaccugugaauccaau

SEQ ID NO: 413407 - RNA, 22 nt, Homo sapiens
auaacuggcuucugcuugucau

SEQ ID NO: 413408 - RNA, 16 nt, Homo sapiens
auaacuguaacauaua

SEQ ID NO: 413409 - RNA, 21 nt, Homo sapiens
auaacuuuugguaucuacuuc

SEQ ID NO: 413410 - RNA, 22 nt, Homo sapiens
auaagaaaacauguaaaggggg

SEQ ID NO: 413411 - RNA, 17 nt, Homo sapiens
auaagaaguagcaagau

SEQ ID NO: 413412 - RNA, 15 nt, Homo sapiens
auaagcacgcauuuu

SEQ ID NO: 413413 - RNA, 13 nt, Homo sapiens
auaagccagcugc

SEQ ID NO: 413414 - RNA, 13 nt, Homo sapiens
auaagcugaauaa

SEQ ID NO: 413415 - RNA, 20 nt, Homo sapiens
auaagguuggguuagcaaua

SEQ ID NO: 413416 - RNA, 13 nt, Homo sapiens
auaaguuuucaca

SEQ ID NO: 413417 - RNA, 19 nt, Homo sapiens
auaauaaacaacauugucu

SEQ ID NO: 413418 - RNA, 14 nt, Homo sapiens
auaauaaaugggaa

SEQ ID NO: 413419 - RNA, 16 nt, Homo sapiens
auaauaagcuaaagag

SEQ ID NO: 413420 - RNA, 18 nt, Homo sapiens
auaauacauggcuaucau

SEQ ID NO: 413421 - RNA, 17 nt, Homo sapiens
auaauauugauuccuca

SEQ ID NO: 413422 - RNA, 14 nt, Homo sapiens
auaaucacauugac

SEQ ID NO: 413423 - RNA, 13 nt, Homo sapiens
auaaucagugugu

SEQ ID NO: 413424 - RNA, 23 nt, Homo sapiens
auaauccacgcucaucuugcaaa

SEQ ID NO: 413425 - RNA, 17 nt, Homo sapiens
auaaucuucaggugaaa

SEQ ID NO: 413426 - RNA, 16 nt, Homo sapiens
auaaugaaauaguuau

SEQ ID NO: 413427 - RNA, 18 nt, Homo sapiens
auaaugaagaauggccau

SEQ ID NO: 413428 - RNA, 17 nt, Homo sapiens
auaaugacuuaagcaca

SEQ ID NO: 413429 - RNA, 20 nt, Homo sapiens
auaaugacuuaagcacacuu

SEQ ID NO: 413430 - RNA, 20 nt, Homo sapiens
auaaugaguuuuacauuaca

SEQ ID NO: 413431 - RNA, 12 nt, Homo sapiens
auaaugaugaug

SEQ ID NO: 413432 - RNA, 15 nt, Homo sapiens
auaaugcuuccccac

SEQ ID NO: 413433 - RNA, 14 nt, Homo sapiens
auaaugguuuacug

SEQ ID NO: 413434 - RNA, 19 nt, Homo sapiens
auaauguuaacauggacau

SEQ ID NO: 413435 - RNA, 15 nt, Homo sapiens
auaauucccuaucuu

SEQ ID NO: 413436 - RNA, 16 nt, Homo sapiens
auaauucuacuuugag

SEQ ID NO: 413437 - RNA, 16 nt, Homo sapiens
auaauugcaagggaag

SEQ ID NO: 413438 - RNA, 15 nt, Homo sapiens
auaauuggaguagau

SEQ ID NO: 413439 - RNA, 20 nt, Homo sapiens
auaauugucaaaaaccagaa

SEQ ID NO: 413440 - RNA, 12 nt, Homo sapiens
auaauuguguac

SEQ ID NO: 413441 - RNA, 16 nt, Homo sapiens
auaauuguguacaaag

SEQ ID NO: 413442 - RNA, 20 nt, Homo sapiens
auaauuuucauucauucacu

SEQ ID NO: 413443 - RNA, 19 nt, Homo sapiens
auacaaacaggugcuaaca

SEQ ID NO: 413444 - RNA, 19 nt, Homo sapiens
auacaagccacuaccuucu

SEQ ID NO: 413445 - RNA, 22 nt, Homo sapiens
auacaaguuugccccauucucu

SEQ ID NO: 413446 - RNA, 17 nt, Homo sapiens
auacacauacacgguau

SEQ ID NO: 413447 - RNA, 23 nt, Homo sapiens
auacacccccaccuccugcaaua

SEQ ID NO: 413448 - RNA, 23 nt, Homo sapiens
auacacguuacugaucuuacuca

SEQ ID NO: 413449 - RNA, 13 nt, Homo sapiens
auacacuuacacu

SEQ ID NO: 413450 - RNA, 15 nt, Homo sapiens
auacacuuacacuuu

SEQ ID NO: 413451 - RNA, 15 nt, Homo sapiens
auacagcacuuugac

SEQ ID NO: 413452 - RNA, 14 nt, Homo sapiens
auacaguuauuaaa

SEQ ID NO: 413453 - RNA, 24 nt, Homo sapiens
auacauggguagcuucugaccuca

SEQ ID NO: 413454 - RNA, 15 nt, Homo sapiens
auacaugugccgaau

SEQ ID NO: 413455 - RNA, 18 nt, Homo sapiens
auacauuguauaggccau

SEQ ID NO: 413456 - RNA, 23 nt, Homo sapiens
auaccacaauaaaaaaaaaccua

SEQ ID NO: 413457 - RNA, 19 nt, Homo sapiens
auaccagagaccugaggca

SEQ ID NO: 413458 - RNA, 14 nt, Homo sapiens
auaccccauuugau

SEQ ID NO: 413459 - RNA, 20 nt, Homo sapiens
auaccccuuacuuagcaugc

SEQ ID NO: 413460 - RNA, 21 nt, Homo sapiens
auaccccuuacuuagcaugca

SEQ ID NO: 413461 - RNA, 20 nt, Homo sapiens
auacccuggagcaagaccug

SEQ ID NO: 413462 - RNA, 21 nt, Homo sapiens
auaccucaacccccauuucua

SEQ ID NO: 413463 - RNA, 18 nt, Homo sapiens
auaccugugugucuccau

SEQ ID NO: 413464 - RNA, 16 nt, Homo sapiens
auacuccacugcucau

SEQ ID NO: 413465 - RNA, 16 nt, Homo sapiens
auacucuaugugauuu

SEQ ID NO: 413466 - RNA, 15 nt, Homo sapiens
auacugaaacauuug

SEQ ID NO: 413467 - RNA, 14 nt, Homo sapiens
auacugaaggacac

SEQ ID NO: 413468 - RNA, 17 nt, Homo sapiens
auacugaauuucuuuga

SEQ ID NO: 413469 - RNA, 22 nt, Homo sapiens
auacugagugccugcagcaucu

SEQ ID NO: 413470 - RNA, 15 nt, Homo sapiens
auacugccuuugcag

SEQ ID NO: 413471 - RNA, 19 nt, Homo sapiens
auacugguuauccugugcu

SEQ ID NO: 413472 - RNA, 22 nt, Homo sapiens
auacuguacugagacauuacag

SEQ ID NO: 413473 - RNA, 13 nt, Homo sapiens
auacuuagauuag

SEQ ID NO: 413474 - RNA, 21 nt, Homo sapiens
auacuuauauuucccuaaaau

SEQ ID NO: 413475 - RNA, 18 nt, Homo sapiens
auacuuccaaagagucau

SEQ ID NO: 413476 - RNA, 21 nt, Homo sapiens
auacuucuuuauucacaguau

SEQ ID NO: 413477 - RNA, 22 nt, Homo sapiens
auacuucuuuauucacaguauc

SEQ ID NO: 413478 - RNA, 17 nt, Homo sapiens
auacuugagugugcaag

SEQ ID NO: 413479 - RNA, 19 nt, Homo sapiens
auacuuuauuucugaucua

SEQ ID NO: 413480 - RNA, 14 nt, Homo sapiens
auacuuucagucaa

SEQ ID NO: 413481 - RNA, 19 nt, Homo sapiens
auacuuuuuucuaguuuca

SEQ ID NO: 413482 - RNA, 15 nt, Homo sapiens
auagaaacuugcuua

SEQ ID NO: 413483 - RNA, 19 nt, Homo sapiens
auagaaaugcauaccagua

SEQ ID NO: 413484 - RNA, 19 nt, Homo sapiens
auagaaauguauuuugaaa

SEQ ID NO: 413485 - RNA, 12 nt, Homo sapiens
auagaacugucc

SEQ ID NO: 413486 - RNA, 17 nt, Homo sapiens
auagacuuagccccaug

SEQ ID NO: 413487 - RNA, 15 nt, Homo sapiens
auagacuuauaugca

SEQ ID NO: 413488 - RNA, 14 nt, Homo sapiens
auagagccuuugau

SEQ ID NO: 413489 - RNA, 17 nt, Homo sapiens
auagagccuuugaucuu

SEQ ID NO: 413490 - RNA, 15 nt, Homo sapiens
auagaguagaccuga

SEQ ID NO: 413491 - RNA, 15 nt, Homo sapiens
auagaguauaugcac

SEQ ID NO: 413492 - RNA, 18 nt, Homo sapiens
auagagucacagcuuucc

SEQ ID NO: 413493 - RNA, 21 nt, Homo sapiens
auagagugguacagcacuguu

SEQ ID NO: 413494 - RNA, 17 nt, Homo sapiens
auagauacuuuugauaa

SEQ ID NO: 413495 - RNA, 22 nt, Homo sapiens
auagauccucugauauacaauu

SEQ ID NO: 413496 - RNA, 22 nt, Homo sapiens
auagaugccgcggaaggucccu

SEQ ID NO: 413497 - RNA, 16 nt, Homo sapiens
auagaugugaucacug

SEQ ID NO: 413498 - RNA, 21 nt, Homo sapiens
auagcacugguuuguuucuca

SEQ ID NO: 413499 - RNA, 13 nt, Homo sapiens
auagcauguaaua

SEQ ID NO: 413500 - RNA, 18 nt, Homo sapiens
auagccucaccuucccua

SEQ ID NO: 413501 - RNA, 19 nt, Homo sapiens
auagccuuugucauuuuau

SEQ ID NO: 413502 - RNA, 22 nt, Homo sapiens
auagcgugagcuaacugagaga

SEQ ID NO: 413503 - RNA, 18 nt, Homo sapiens
auagcuaguuaugugaga

SEQ ID NO: 413504 - RNA, 18 nt, Homo sapiens
auagcuauauccauguac

SEQ ID NO: 413505 - RNA, 19 nt, Homo sapiens
auagcuauuaagauacuua

SEQ ID NO: 413506 - RNA, 23 nt, Homo sapiens
auagcugggaacccgacugugaa

SEQ ID NO: 413507 - RNA, 16 nt, Homo sapiens
auagcuucaucuugag

SEQ ID NO: 413508 - RNA, 14 nt, Homo sapiens
auagcuuccaugag

SEQ ID NO: 413509 - RNA, 12 nt, Homo sapiens
auaggaggacag

SEQ ID NO: 413510 - RNA, 14 nt, Homo sapiens
auaggucacuccug

SEQ ID NO: 413511 - RNA, 13 nt, Homo sapiens
auaguaaacuacg

SEQ ID NO: 413512 - RNA, 13 nt, Homo sapiens
auaguacuauuaa

SEQ ID NO: 413513 - RNA, 14 nt, Homo sapiens
auagucaaucaaac

SEQ ID NO: 413514 - RNA, 18 nt, Homo sapiens
auaguccuccaaaacaca

SEQ ID NO: 413515 - RNA, 23 nt, Homo sapiens
auagugauugauagaguguuauc

SEQ ID NO: 413516 - RNA, 22 nt, Homo sapiens
auagugccagguggcucagugc

SEQ ID NO: 413517 - RNA, 14 nt, Homo sapiens
auagugccuaaaau

SEQ ID NO: 413518 - RNA, 18 nt, Homo sapiens
auagugcuucuuguaaua

SEQ ID NO: 413519 - RNA, 17 nt, Homo sapiens
auaguuuuacauuaaca

SEQ ID NO: 413520 - RNA, 17 nt, Homo sapiens
auaguuuucccuauucu

SEQ ID NO: 413521 - RNA, 14 nt, Homo sapiens
auauaaaguuacac

SEQ ID NO: 413522 - RNA, 20 nt, Homo sapiens
auauaacaagugggugaaug

SEQ ID NO: 413523 - RNA, 17 nt, Homo sapiens
auauaacaauauaugau

SEQ ID NO: 413524 - RNA, 12 nt, Homo sapiens
auauaacugccu

SEQ ID NO: 413525 - RNA, 13 nt, Homo sapiens
auauaacugccuu

SEQ ID NO: 413526 - RNA, 16 nt, Homo sapiens
auauaaggaaagcaau

SEQ ID NO: 413527 - RNA, 22 nt, Homo sapiens
auauacaacuuuggaauuugaa

SEQ ID NO: 413528 - RNA, 13 nt, Homo sapiens
auauacauauaca

SEQ ID NO: 413529 - RNA, 15 nt, Homo sapiens
auauacauuucauaa

SEQ ID NO: 413530 - RNA, 19 nt, Homo sapiens
auauaccuggcuuuuacuu

SEQ ID NO: 413531 - RNA, 21 nt, Homo sapiens
auauaccuggcuuuuacuuua

SEQ ID NO: 413532 - RNA, 15 nt, Homo sapiens
auauacuaaccauuu

SEQ ID NO: 413533 - RNA, 18 nt, Homo sapiens
auauacuaaccauuucuu

SEQ ID NO: 413534 - RNA, 17 nt, Homo sapiens
auauacuaauauguaau

SEQ ID NO: 413535 - RNA, 18 nt, Homo sapiens
auauacuauuuucauucu

SEQ ID NO: 413536 - RNA, 24 nt, Homo sapiens
auauagggaagaguucugaucugu

SEQ ID NO: 413537 - RNA, 14 nt, Homo sapiens
auauauaagccaaa

SEQ ID NO: 413538 - RNA, 18 nt, Homo sapiens
auauauacauauacacaa

SEQ ID NO: 413539 - RNA, 21 nt, Homo sapiens
auauauauguauaauuucaca

SEQ ID NO: 413540 - RNA, 13 nt, Homo sapiens
auauauauuuauc

SEQ ID NO: 413541 - RNA, 16 nt, Homo sapiens
auauauuuauaacuca

SEQ ID NO: 413542 - RNA, 19 nt, Homo sapiens
auauauuuuuaagacuuuu

SEQ ID NO: 413543 - RNA, 21 nt, Homo sapiens
auauauuuuugguugucaaua

SEQ ID NO: 413544 - RNA, 12 nt, Homo sapiens
auaucaaaaagg

SEQ ID NO: 413545 - RNA, 18 nt, Homo sapiens
auaucagaguaugucagu

SEQ ID NO: 413546 - RNA, 16 nt, Homo sapiens
auaucauaauguaaug

SEQ ID NO: 413547 - RNA, 21 nt, Homo sapiens
auaucauucuuuguaucuuaa

SEQ ID NO: 413548 - RNA, 17 nt, Homo sapiens
auaucauuuuauucaca

SEQ ID NO: 413549 - RNA, 16 nt, Homo sapiens
auauccaaagacugua

SEQ ID NO: 413550 - RNA, 20 nt, Homo sapiens
auauccaccuaccuauucau

SEQ ID NO: 413551 - RNA, 16 nt, Homo sapiens
auaucccuaugcugcc

SEQ ID NO: 413552 - RNA, 17 nt, Homo sapiens
auauccuuggcacaucc

SEQ ID NO: 413553 - RNA, 18 nt, Homo sapiens
auaucucaaugugcaaua

SEQ ID NO: 413554 - RNA, 12 nt, Homo sapiens
auaucugggcug

SEQ ID NO: 413555 - RNA, 18 nt, Homo sapiens
auaugaacuggaccugca

SEQ ID NO: 413556 - RNA, 13 nt, Homo sapiens
auaugaagcacuu

SEQ ID NO: 413557 - RNA, 14 nt, Homo sapiens
auaugaagcacuuu

SEQ ID NO: 413558 - RNA, 19 nt, Homo sapiens
auaugagccuuugcacagg

SEQ ID NO: 413559 - RNA, 19 nt, Homo sapiens
auaugaggggacugcaugc

SEQ ID NO: 413560 - RNA, 20 nt, Homo sapiens
auaugauauauauguauaau

SEQ ID NO: 413561 - RNA, 19 nt, Homo sapiens
auaugcaccccuggaacca

SEQ ID NO: 413562 - RNA, 20 nt, Homo sapiens
auaugcauaaacaacaguac

SEQ ID NO: 413563 - RNA, 14 nt, Homo sapiens
auaugcugccaaau

SEQ ID NO: 413564 - RNA, 20 nt, Homo sapiens
auaugcuuauacacuuacac

SEQ ID NO: 413565 - RNA, 20 nt, Homo sapiens
auaugcuuggcuaacuauau

SEQ ID NO: 413566 - RNA, 18 nt, Homo sapiens
auaugggaggaacaaaga

SEQ ID NO: 413567 - RNA, 17 nt, Homo sapiens
auauguagauugccuuu

SEQ ID NO: 413568 - RNA, 16 nt, Homo sapiens
auauguauaauuucac

SEQ ID NO: 413569 - RNA, 17 nt, Homo sapiens
auaugucuuacuacuuu

SEQ ID NO: 413570 - RNA, 11 nt, Homo sapiens
auaugucuuca

SEQ ID NO: 413571 - RNA, 23 nt, Homo sapiens
auaugugggugucagucagggac

SEQ ID NO: 413572 - RNA, 23 nt, Homo sapiens
auauguguaaauguuaugacucc

SEQ ID NO: 413573 - RNA, 19 nt, Homo sapiens
auauuaacaacaauaacac

SEQ ID NO: 413574 - RNA, 17 nt, Homo sapiens
auauuacugauuuacaa

SEQ ID NO: 413575 - RNA, 22 nt, Homo sapiens
auauuauacaaauacuaucucu

SEQ ID NO: 413576 - RNA, 18 nt, Homo sapiens
auauuccugcauuuguga

SEQ ID NO: 413577 - RNA, 23 nt, Homo sapiens
auauucuuguccacauucuacuu

SEQ ID NO: 413578 - RNA, 16 nt, Homo sapiens
auauugaggcauucaa

SEQ ID NO: 413579 - RNA, 19 nt, Homo sapiens
auauugaggcauucaagga

SEQ ID NO: 413580 - RNA, 14 nt, Homo sapiens
auauugaggggcaa

SEQ ID NO: 413581 - RNA, 15 nt, Homo sapiens
auauugauuccucac

SEQ ID NO: 413582 - RNA, 20 nt, Homo sapiens
auauugcuuggacuaccuau

SEQ ID NO: 413583 - RNA, 21 nt, Homo sapiens
auauuguggguaacgugagaa

SEQ ID NO: 413584 - RNA, 18 nt, Homo sapiens
auauuuaaagucuugaau

SEQ ID NO: 413585 - RNA, 22 nt, Homo sapiens
auauuuaaauguaaagacaaaa

SEQ ID NO: 413586 - RNA, 20 nt, Homo sapiens
auauuuaggcaugagcucuu

SEQ ID NO: 413587 - RNA, 21 nt, Homo sapiens
auauuuaggcaugagcucuug

SEQ ID NO: 413588 - RNA, 22 nt, Homo sapiens
auauuuaugaccucaacaaaga

SEQ ID NO: 413589 - RNA, 14 nt, Homo sapiens
auauuuauguagau

SEQ ID NO: 413590 - RNA, 21 nt, Homo sapiens
auauuuauguuuaagugcuug

SEQ ID NO: 413591 - RNA, 20 nt, Homo sapiens
auauuucucauuuagcauug

SEQ ID NO: 413592 - RNA, 16 nt, Homo sapiens
auauuucuucaaguga

SEQ ID NO: 413593 - RNA, 22 nt, Homo sapiens
auauuuggauugucauucuuac

SEQ ID NO: 413594 - RNA, 13 nt, Homo sapiens
auauuugugaaaa

SEQ ID NO: 413595 - RNA, 16 nt, Homo sapiens
auauuuugcauaguac

SEQ ID NO: 413596 - RNA, 13 nt, Homo sapiens
auauuuuuguaca

SEQ ID NO: 413597 - RNA, 18 nt, Homo sapiens
aucaaaaaugccacuuaa

SEQ ID NO: 413598 - RNA, 17 nt, Homo sapiens
aucaaacuagugcauga

SEQ ID NO: 413599 - RNA, 15 nt, Homo sapiens
aucaaagcaccuuga

SEQ ID NO: 413600 - RNA, 21 nt, Homo sapiens
aucaaagcuaggaaaggcaga

SEQ ID NO: 413601 - RNA, 14 nt, Homo sapiens
aucaacucuaauag

SEQ ID NO: 413602 - RNA, 20 nt, Homo sapiens
aucaacuuguguacugauaa

SEQ ID NO: 413603 - RNA, 21 nt, Homo sapiens
aucaagucccgaggcagcaac

SEQ ID NO: 413604 - RNA, 14 nt, Homo sapiens
aucaagugucuucc

SEQ ID NO: 413605 - RNA, 15 nt, Homo sapiens
aucaagugucuucca

SEQ ID NO: 413606 - RNA, 18 nt, Homo sapiens
aucaagugucuuccauca

SEQ ID NO: 413607 - RNA, 18 nt, Homo sapiens
aucaauggcgcagugccu

SEQ ID NO: 413608 - RNA, 18 nt, Homo sapiens
aucaauuauuacauuuau

SEQ ID NO: 413609 - RNA, 16 nt, Homo sapiens
aucacaccucugggcu

SEQ ID NO: 413610 - RNA, 22 nt, Homo sapiens
aucacacucauaacucauuguc

SEQ ID NO: 413611 - RNA, 23 nt, Homo sapiens
aucacagaugugcccagaguagc

SEQ ID NO: 413612 - RNA, 22 nt, Homo sapiens
augauuuccuggggcacagugg

SEQ ID NO: 413613 - RNA, 17 nt, Homo sapiens
augauuuugaugcacaa

SEQ ID NO: 413614 - RNA, 14 nt, Homo sapiens
augcaaauaucgcu

SEQ ID NO: 413615 - RNA, 16 nt, Homo sapiens
augcaacuccaugccu

SEQ ID NO: 413616 - RNA, 14 nt, Homo sapiens
augcacacaaacac

SEQ ID NO: 413617 - RNA, 21 nt, Homo sapiens
augcacacaaacaccuccuag

SEQ ID NO: 413618 - RNA, 21 nt, Homo sapiens
augcacaccaaauugcugaga

SEQ ID NO: 413619 - RNA, 18 nt, Homo sapiens
augcacagauuaaacuuc

SEQ ID NO: 413620 - RNA, 19 nt, Homo sapiens
augcacuugaaaugauggu

SEQ ID NO: 413621 - RNA, 14 nt, Homo sapiens
augcagacauuuac

SEQ ID NO: 413622 - RNA, 14 nt, Homo sapiens
augcagcucugcag

SEQ ID NO: 413623 - RNA, 14 nt, Homo sapiens
augcagugcccuca

SEQ ID NO: 413624 - RNA, 22 nt, Homo sapiens
augcagugccggcugccaagac

SEQ ID NO: 413625 - RNA, 23 nt, Homo sapiens
augcaugauaaugaguuuuacau

SEQ ID NO: 413626 - RNA, 19 nt, Homo sapiens
augcaugcagccacugugc

SEQ ID NO: 413627 - RNA, 17 nt, Homo sapiens
augcauguagcauauaa

SEQ ID NO: 413628 - RNA, 12 nt, Homo sapiens
augcaugugauu

SEQ ID NO: 413629 - RNA, 21 nt, Homo sapiens
augccaaccggucacccagga

SEQ ID NO: 413630 - RNA, 19 nt, Homo sapiens
augccacauuuugcuuuau

SEQ ID NO: 413631 - RNA, 13 nt, Homo sapiens
augccacccucac

SEQ ID NO: 413632 - RNA, 16 nt, Homo sapiens
augccagcuguacuga

SEQ ID NO: 413633 - RNA, 20 nt, Homo sapiens
augccagcuguacugaguuc

SEQ ID NO: 413634 - RNA, 20 nt, Homo sapiens
augccaugaggaacaaggca

SEQ ID NO: 413635 - RNA, 21 nt, Homo sapiens
augccaugggcccucucagca

SEQ ID NO: 413636 - RNA, 18 nt, Homo sapiens
augccccacccaccccuc

SEQ ID NO: 413637 - RNA, 15 nt, Homo sapiens
augcccgcccgggga

SEQ ID NO: 413638 - RNA, 21 nt, Homo sapiens
augcccuccaauccuuuccac

SEQ ID NO: 413639 - RNA, 15 nt, Homo sapiens
augccuacagauaau

SEQ ID NO: 413640 - RNA, 23 nt, Homo sapiens
augccuauguacucuacgccaaa

SEQ ID NO: 413641 - RNA, 16 nt, Homo sapiens
augccuauuuacugga

SEQ ID NO: 413642 - RNA, 17 nt, Homo sapiens
augccuauuuacuggaa

SEQ ID NO: 413643 - RNA, 20 nt, Homo sapiens
augccuguggugaagugugg

SEQ ID NO: 413644 - RNA, 18 nt, Homo sapiens
augccuuuccagcaccuu

SEQ ID NO: 413645 - RNA, 14 nt, Homo sapiens
augcgcaaaacugc

SEQ ID NO: 413646 - RNA, 18 nt, Homo sapiens
augcgggcugggcagcug

SEQ ID NO: 413647 - RNA, 17 nt, Homo sapiens
augcuaagggcagcccu

SEQ ID NO: 413648 - RNA, 18 nt, Homo sapiens
augcuauggacugcacaa

SEQ ID NO: 413649 - RNA, 14 nt, Homo sapiens
augcucagggucaa

SEQ ID NO: 413650 - RNA, 22 nt, Homo sapiens
augcucaguuggugcugcuuuc

SEQ ID NO: 413651 - RNA, 14 nt, Homo sapiens
augcucauaccucu

SEQ ID NO: 413652 - RNA, 23 nt, Homo sapiens
augcucccuccccugcccugguc

SEQ ID NO: 413653 - RNA, 11 nt, Homo sapiens
augcucuccaa

SEQ ID NO: 413654 - RNA, 10 nt, Homo sapiens
augcucuccu

SEQ ID NO: 413655 - RNA, 20 nt, Homo sapiens
augcugauuuaaacuucuua

SEQ ID NO: 413656 - RNA, 15 nt, Homo sapiens
augcugccaaccagc

SEQ ID NO: 413657 - RNA, 12 nt, Homo sapiens
augcugcuuuaa

SEQ ID NO: 413658 - RNA, 15 nt, Homo sapiens
augcuggcauuugca

SEQ ID NO: 413659 - RNA, 23 nt, Homo sapiens
augcuggcauuugcaccuaccuc

SEQ ID NO: 413660 - RNA, 19 nt, Homo sapiens
augcugggacccucggggc

SEQ ID NO: 413661 - RNA, 16 nt, Homo sapiens
augcuucugagagcaa

SEQ ID NO: 413662 - RNA, 13 nt, Homo sapiens
augcuugugauuu

SEQ ID NO: 413663 - RNA, 22 nt, Homo sapiens
augcuugugauuuuugaacaau

SEQ ID NO: 413664 - RNA, 21 nt, Homo sapiens
augcuuugauuguucauauca

SEQ ID NO: 413665 - RNA, 16 nt, Homo sapiens
augcuuuguccaugau

SEQ ID NO: 413666 - RNA, 18 nt, Homo sapiens
augcuuuuacuaagcacu

SEQ ID NO: 413667 - RNA, 23 nt, Homo sapiens
augcuuuugugucccugauuugg

SEQ ID NO: 413668 - RNA, 16 nt, Homo sapiens
auggaaaaaucuugga

SEQ ID NO: 413669 - RNA, 13 nt, Homo sapiens
auggaaaacugcc

SEQ ID NO: 413670 - RNA, 20 nt, Homo sapiens
auggaaagaaucuaauagag

SEQ ID NO: 413671 - RNA, 21 nt, Homo sapiens
auggaaaucacauuuacaaaa

SEQ ID NO: 413672 - RNA, 20 nt, Homo sapiens
auggaaauccuguuacuuaa

SEQ ID NO: 413673 - RNA, 22 nt, Homo sapiens
auggaagcaccuaaaugaugcc

SEQ ID NO: 413674 - RNA, 21 nt, Homo sapiens
auggaaggaagaaaagcugcc

SEQ ID NO: 413675 - RNA, 17 nt, Homo sapiens
auggaaguggcagugaa

SEQ ID NO: 413676 - RNA, 15 nt, Homo sapiens
auggaagugucugga

SEQ ID NO: 413677 - RNA, 15 nt, Homo sapiens
auggaauaaagcccu

SEQ ID NO: 413678 - RNA, 20 nt, Homo sapiens
auggaauauuccccuaucuc

SEQ ID NO: 413679 - RNA, 17 nt, Homo sapiens
auggaaugcuguguuaa

SEQ ID NO: 413680 - RNA, 20 nt, Homo sapiens
auggacucugaaaaacauuc

SEQ ID NO: 413681 - RNA, 17 nt, Homo sapiens
auggagaacuugcucaa

SEQ ID NO: 413682 - RNA, 21 nt, Homo sapiens
auggagacaagggcaucaucu

SEQ ID NO: 413683 - RNA, 18 nt, Homo sapiens
auggagccagcucugcau

SEQ ID NO: 413684 - RNA, 14 nt, Homo sapiens
auggagcucuaacc

SEQ ID NO: 413685 - RNA, 19 nt, Homo sapiens
auggaguguuuuaguucuu

SEQ ID NO: 413686 - RNA, 20 nt, Homo sapiens
auggaguuaaacuugaugcc

SEQ ID NO: 413687 - RNA, 16 nt, Homo sapiens
auggauccccagugaa

SEQ ID NO: 413688 - RNA, 14 nt, Homo sapiens
auggauccuuguca

SEQ ID NO: 413689 - RNA, 15 nt, Homo sapiens
auggaucugcuccau

SEQ ID NO: 413690 - RNA, 18 nt, Homo sapiens
auggaucuuaaagcauuc

SEQ ID NO: 413691 - RNA, 14 nt, Homo sapiens
auggauggggccca

SEQ ID NO: 413692 - RNA, 17 nt, Homo sapiens
auggcaaagaauucaaa

SEQ ID NO: 413693 - RNA, 18 nt, Homo sapiens
auggcaccuucauucucc

SEQ ID NO: 413694 - RNA, 20 nt, Homo sapiens
auggcaccuuuugcacauaa

SEQ ID NO: 413695 - RNA, 21 nt, Homo sapiens
auggcacugcuuuucugagga

SEQ ID NO: 413696 - RNA, 21 nt, Homo sapiens
auggcagaagggaauugcuca

SEQ ID NO: 413697 - RNA, 20 nt, Homo sapiens
auggcagucacugaauucca

SEQ ID NO: 413698 - RNA, 22 nt, Homo sapiens
auggcauaggcugacuuuugca

SEQ ID NO: 413699 - RNA, 20 nt, Homo sapiens
auggccacauccaacauuuc

SEQ ID NO: 413700 - RNA, 15 nt, Homo sapiens
auggccacugaagca

SEQ ID NO: 413701 - RNA, 15 nt, Homo sapiens
auggcccagcagcuu

SEQ ID NO: 413702 - RNA, 23 nt, Homo sapiens
auggccgaaaaggauaugcagua

SEQ ID NO: 413703 - RNA, 17 nt, Homo sapiens
auggccuuggagggcau

SEQ ID NO: 413704 - RNA, 16 nt, Homo sapiens
auggccuuugcuuaug

SEQ ID NO: 413705 - RNA, 16 nt, Homo sapiens
auggcuaguacuguau

SEQ ID NO: 413706 - RNA, 16 nt, Homo sapiens
auggcuaucaucaaaa

SEQ ID NO: 413707 - RNA, 19 nt, Homo sapiens
auggcuguggcauuguuga

SEQ ID NO: 413708 - RNA, 19 nt, Homo sapiens
augggacacccaacacuuu

SEQ ID NO: 413709 - RNA, 18 nt, Homo sapiens
augggagugggcaccuca

SEQ ID NO: 413710 - RNA, 22 nt, Homo sapiens
augggauuucauguaaccaaga

SEQ ID NO: 413711 - RNA, 20 nt, Homo sapiens
augggcaaauuaaggcauaa

SEQ ID NO: 413712 - RNA, 21 nt, Homo sapiens
augggcacuggaaaacauaga

SEQ ID NO: 413713 - RNA, 13 nt, Homo sapiens
augggcagaagau

SEQ ID NO: 413714 - RNA, 16 nt, Homo sapiens
augggccggucgggga

SEQ ID NO: 413715 - RNA, 15 nt, Homo sapiens
augggccuucagauu

SEQ ID NO: 413716 - RNA, 15 nt, Homo sapiens
auggggugcaccugu

SEQ ID NO: 413717 - RNA, 14 nt, Homo sapiens
auggggugggccca

SEQ ID NO: 413718 - RNA, 18 nt, Homo sapiens
augguagcauacuuuaua

SEQ ID NO: 413719 - RNA, 20 nt, Homo sapiens
augguaggauaucuuggcuu

SEQ ID NO: 413720 - RNA, 21 nt, Homo sapiens
auggucauaaauguuugcugc

SEQ ID NO: 413721 - RNA, 18 nt, Homo sapiens
augguccuggaggaugac

SEQ ID NO: 413722 - RNA, 16 nt, Homo sapiens
auggugauuucuugcu

SEQ ID NO: 413723 - RNA, 20 nt, Homo sapiens
auggugcucacgacucuucc

SEQ ID NO: 413724 - RNA, 21 nt, Homo sapiens
auggugggagagacugugagg

SEQ ID NO: 413725 - RNA, 20 nt, Homo sapiens
augguggggcaugccuguag

SEQ ID NO: 413726 - RNA, 23 nt, Homo sapiens
auguaaaaucuucagcuggugga

SEQ ID NO: 413727 - RNA, 15 nt, Homo sapiens
auguaaaugcucaaa

SEQ ID NO: 413728 - RNA, 17 nt, Homo sapiens
auguaagccaagucaug

SEQ ID NO: 413729 - RNA, 19 nt, Homo sapiens
auguacaucuggccuugaa

SEQ ID NO: 413730 - RNA, 19 nt, Homo sapiens
auguaccaguguacugcuu

SEQ ID NO: 413731 - RNA, 17 nt, Homo sapiens
auguaccuccaugagcu

SEQ ID NO: 413732 - RNA, 15 nt, Homo sapiens
auguaccugauguac

SEQ ID NO: 413733 - RNA, 17 nt, Homo sapiens
auguaccuuucuucacu

SEQ ID NO: 413734 - RNA, 16 nt, Homo sapiens
auguacuacauuugca

SEQ ID NO: 413735 - RNA, 17 nt, Homo sapiens
auguacuacauuugcau

SEQ ID NO: 413736 - RNA, 22 nt, Homo sapiens
auguacuuugauuuacagugcc

SEQ ID NO: 413737 - RNA, 16 nt, Homo sapiens
auguagaccugugaga

SEQ ID NO: 413738 - RNA, 21 nt, Homo sapiens
auguagcaaaacgcauggagu

SEQ ID NO: 413739 - RNA, 14 nt, Homo sapiens
auguagcuuccaaa

SEQ ID NO: 413740 - RNA, 15 nt, Homo sapiens
auguauaauuucaca

SEQ ID NO: 413741 - RNA, 23 nt, Homo sapiens
auugcaugcagugccggcugcca

SEQ ID NO: 413742 - RNA, 16 nt, Homo sapiens
auugcaugcugcuuua

SEQ ID NO: 413743 - RNA, 21 nt, Homo sapiens
auugccaaauugacauguugu

SEQ ID NO: 413744 - RNA, 12 nt, Homo sapiens
auugcuauuacu

SEQ ID NO: 413745 - RNA, 13 nt, Homo sapiens
auugcucauaauc

SEQ ID NO: 413746 - RNA, 17 nt, Homo sapiens
auugcuuggacuaccua

SEQ ID NO: 413747 - RNA, 13 nt, Homo sapiens
auugcuuugguca

SEQ ID NO: 413748 - RNA, 21 nt, Homo sapiens
auuggaaguguucaagaaaua

SEQ ID NO: 413749 - RNA, 20 nt, Homo sapiens
auuggaccuguucaaaaagg

SEQ ID NO: 413750 - RNA, 23 nt, Homo sapiens
auuggccacugggucucacuccu

SEQ ID NO: 413751 - RNA, 20 nt, Homo sapiens
auuggcuuuugaaucaaaga

SEQ ID NO: 413752 - RNA, 20 nt, Homo sapiens
auugggcuugugauuuccau

SEQ ID NO: 413753 - RNA, 15 nt, Homo sapiens
auugggggacguggg

SEQ ID NO: 413754 - RNA, 21 nt, Homo sapiens
auugguccgaucuuugacucu

SEQ ID NO: 413755 - RNA, 20 nt, Homo sapiens
auugguggcagauuuuacaa

SEQ ID NO: 413756 - RNA, 13 nt, Homo sapiens
auugguuucuuaa

SEQ ID NO: 413757 - RNA, 14 nt, Homo sapiens
auuguaaacaugug

SEQ ID NO: 413758 - RNA, 19 nt, Homo sapiens
auuguaaacuaguacuauu

SEQ ID NO: 413759 - RNA, 20 nt, Homo sapiens
auuguaaacuaguacuauua

SEQ ID NO: 413760 - RNA, 18 nt, Homo sapiens
auuguaaggaaugauuaa

SEQ ID NO: 413761 - RNA, 17 nt, Homo sapiens
auuguaauugucucaaa

SEQ ID NO: 413762 - RNA, 18 nt, Homo sapiens
auuguacaugguacgaau

SEQ ID NO: 413763 - RNA, 18 nt, Homo sapiens
auuguauugucugacaca

SEQ ID NO: 413764 - RNA, 17 nt, Homo sapiens
auugucaccuagcagau

SEQ ID NO: 413765 - RNA, 15 nt, Homo sapiens
auuguccagugcaac

SEQ ID NO: 413766 - RNA, 23 nt, Homo sapiens
auuguccagugcaaccacacacc

SEQ ID NO: 413767 - RNA, 17 nt, Homo sapiens
auuguccucuuugacua

SEQ ID NO: 413768 - RNA, 16 nt, Homo sapiens
auugugaaguacauau

SEQ ID NO: 413769 - RNA, 23 nt, Homo sapiens
auugugccgagaaaagcauuuua

SEQ ID NO: 413770 - RNA, 23 nt, Homo sapiens
auugugguuuauugaaugugauu

SEQ ID NO: 413771 - RNA, 22 nt, Homo sapiens
auugugucuggucguuugacca

SEQ ID NO: 413772 - RNA, 20 nt, Homo sapiens
auuguuaaaaccuuacuuaa

SEQ ID NO: 413773 - RNA, 18 nt, Homo sapiens
auuguuacagguguacua

SEQ ID NO: 413774 - RNA, 21 nt, Homo sapiens
auuguuagucucuugauucau

SEQ ID NO: 413775 - RNA, 15 nt, Homo sapiens
auuguuccaagacau

SEQ ID NO: 413776 - RNA, 16 nt, Homo sapiens
auuguugaugcucaca

SEQ ID NO: 413777 - RNA, 23 nt, Homo sapiens
auuguuucuccucugaagcauuu

SEQ ID NO: 413778 - RNA, 14 nt, Homo sapiens
auuguuucuuucaa

SEQ ID NO: 413779 - RNA, 14 nt, Homo sapiens
auuuaaaaaugcau

SEQ ID NO: 413780 - RNA, 23 nt, Homo sapiens
auuuaaaaaugcaugauaaugag

SEQ ID NO: 413781 - RNA, 13 nt, Homo sapiens
auuuaaagcacau

SEQ ID NO: 413782 - RNA, 17 nt, Homo sapiens
auuuaacagucauuuaa

SEQ ID NO: 413783 - RNA, 15 nt, Homo sapiens
auuuaacugacuuaa

SEQ ID NO: 413784 - RNA, 15 nt, Homo sapiens
auuuaagguacuuaa

SEQ ID NO: 413785 - RNA, 15 nt, Homo sapiens
auuuaagguuucaca

SEQ ID NO: 413786 - RNA, 18 nt, Homo sapiens
auuuaauaggacuuccuu

SEQ ID NO: 413787 - RNA, 19 nt, Homo sapiens
auuuacaugugauugugau

SEQ ID NO: 413788 - RNA, 21 nt, Homo sapiens
auuuagauuuuucucaucucc

SEQ ID NO: 413789 - RNA, 13 nt, Homo sapiens
auuuagcacaaaa

SEQ ID NO: 413790 - RNA, 12 nt, Homo sapiens
auuuagugucuu

SEQ ID NO: 413791 - RNA, 13 nt, Homo sapiens
auuuagugucuug

SEQ ID NO: 413792 - RNA, 17 nt, Homo sapiens
auuuaguuggaauauca

SEQ ID NO: 413793 - RNA, 13 nt, Homo sapiens
auuuauaacaauu

SEQ ID NO: 413794 - RNA, 15 nt, Homo sapiens
auuuauaacucauca

SEQ ID NO: 413795 - RNA, 12 nt, Homo sapiens
auuuauauaugu

SEQ ID NO: 413796 - RNA, 18 nt, Homo sapiens
auuuaucaacuguugaua

SEQ ID NO: 413797 - RNA, 23 nt, Homo sapiens
auuuaugaguuuuugauagcuuu

SEQ ID NO: 413798 - RNA, 20 nt, Homo sapiens
auuuauggucaacacuuaag

SEQ ID NO: 413799 - RNA, 14 nt, Homo sapiens
auuuauuaccucug

SEQ ID NO: 413800 - RNA, 13 nt, Homo sapiens
auuuauucaggaa

SEQ ID NO: 413801 - RNA, 18 nt, Homo sapiens
auuuauuuacaugugauu

SEQ ID NO: 413802 - RNA, 19 nt, Homo sapiens
auuucaaaauauacauuca

SEQ ID NO: 413803 - RNA, 16 nt, Homo sapiens
auuucaccuacuuugu

SEQ ID NO: 413804 - RNA, 13 nt, Homo sapiens
auuucacugaugu

SEQ ID NO: 413805 - RNA, 19 nt, Homo sapiens
auuucagaucauauuucac

SEQ ID NO: 413806 - RNA, 17 nt, Homo sapiens
auuucagggcugggcua

SEQ ID NO: 413807 - RNA, 20 nt, Homo sapiens
auuucaugauuucauuucaa

SEQ ID NO: 413808 - RNA, 15 nt, Homo sapiens
auuucauguaaccaa

SEQ ID NO: 413809 - RNA, 17 nt, Homo sapiens
auuucauguaaccaaga

SEQ ID NO: 413810 - RNA, 15 nt, Homo sapiens
auuucaugugaucua

SEQ ID NO: 413811 - RNA, 17 nt, Homo sapiens
auuucauuaaccaaaga

SEQ ID NO: 413812 - RNA, 18 nt, Homo sapiens
auuuccaacaccacagac

SEQ ID NO: 413813 - RNA, 13 nt, Homo sapiens
auuuccacaaaau

SEQ ID NO: 413814 - RNA, 21 nt, Homo sapiens
auuuccagucuccaccaggaa

SEQ ID NO: 413815 - RNA, 15 nt, Homo sapiens
auuucccacacccca

SEQ ID NO: 413816 - RNA, 15 nt, Homo sapiens
auuuccccuuuccaa

SEQ ID NO: 413817 - RNA, 21 nt, Homo sapiens
auuuccccuuuccaauuccaa

SEQ ID NO: 413818 - RNA, 15 nt, Homo sapiens
auuuccuccugggca

SEQ ID NO: 413819 - RNA, 21 nt, Homo sapiens
auuuccucugagcuguuaucu

SEQ ID NO: 413820 - RNA, 21 nt, Homo sapiens
auuuccuuugcgcaaacuuua

SEQ ID NO: 413821 - RNA, 14 nt, Homo sapiens
auuucuaaucaaaa

SEQ ID NO: 413822 - RNA, 16 nt, Homo sapiens
auuucuacuuugacua

SEQ ID NO: 413823 - RNA, 20 nt, Homo sapiens
auuucuagcagugaugaaaa

SEQ ID NO: 413824 - RNA, 20 nt, Homo sapiens
auuucuauguaugugccaau

SEQ ID NO: 413825 - RNA, 14 nt, Homo sapiens
auuucucacugaga

SEQ ID NO: 413826 - RNA, 16 nt, Homo sapiens
auuucuccaaccacuc

SEQ ID NO: 413827 - RNA, 20 nt, Homo sapiens
auuucucccagcucuagaca

SEQ ID NO: 413828 - RNA, 22 nt, Homo sapiens
auuucucccuucaauccuguca

SEQ ID NO: 413829 - RNA, 12 nt, Homo sapiens
auuucugaaaaa

SEQ ID NO: 413830 - RNA, 21 nt, Homo sapiens
auuucugaaaaagaacuguau

SEQ ID NO: 413831 - RNA, 16 nt, Homo sapiens
auuucuucacgcaccu

SEQ ID NO: 413832 - RNA, 20 nt, Homo sapiens
auuucuuugauugugaaaca

SEQ ID NO: 413833 - RNA, 15 nt, Homo sapiens
auuucuuugauuuaa

SEQ ID NO: 413834 - RNA, 22 nt, Homo sapiens
auuucuuugauuuaacugacuu

SEQ ID NO: 413835 - RNA, 15 nt, Homo sapiens
auuucuuuguuauca

SEQ ID NO: 413836 - RNA, 24 nt, Homo sapiens
auuugaagaauuaaugacaacaaa

SEQ ID NO: 413837 - RNA, 21 nt, Homo sapiens
auuugaaugugguuacuuccu

SEQ ID NO: 413838 - RNA, 21 nt, Homo sapiens
auuugagagaaucuacuaagu

SEQ ID NO: 413839 - RNA, 19 nt, Homo sapiens
auuugaggucaaguaagaa

SEQ ID NO: 413840 - RNA, 23 nt, Homo sapiens
auuugauaguugguguucaaaaa

SEQ ID NO: 413841 - RNA, 23 nt, Homo sapiens
auuugcauuugcucuuucaucuc

SEQ ID NO: 413842 - RNA, 18 nt, Homo sapiens
auuugccaggggcaucca

SEQ ID NO: 413843 - RNA, 22 nt, Homo sapiens
auuugcgguuagaaucccaugg

SEQ ID NO: 413844 - RNA, 15 nt, Homo sapiens
auuugcuuuuugcua

SEQ ID NO: 413845 - RNA, 16 nt, Homo sapiens
auuuggauuuuccacc

SEQ ID NO: 413846 - RNA, 17 nt, Homo sapiens
auuugguuaugauggaa

SEQ ID NO: 413847 - RNA, 20 nt, Homo sapiens
auuuguaccuuauugaucuu

SEQ ID NO: 413848 - RNA, 16 nt, Homo sapiens
auuugugauacuuccu

SEQ ID NO: 413849 - RNA, 16 nt, Homo sapiens
auuuguuauacuucaa

SEQ ID NO: 413850 - RNA, 13 nt, Homo sapiens
auuuguucagaga

SEQ ID NO: 413851 - RNA, 14 nt, Homo sapiens
auuuguucagagag

SEQ ID NO: 413852 - RNA, 15 nt, Homo sapiens
auuuuaaacuacuga

SEQ ID NO: 413853 - RNA, 13 nt, Homo sapiens
auuuuaaaguauc

SEQ ID NO: 413854 - RNA, 20 nt, Homo sapiens
auuuuaaguaucccaucuaa

SEQ ID NO: 413855 - RNA, 16 nt, Homo sapiens
auuuuaauccuucuaa

SEQ ID NO: 413856 - RNA, 18 nt, Homo sapiens
auuuuaauguaaaauuca

SEQ ID NO: 413857 - RNA, 15 nt, Homo sapiens
auuuuagugcuugcc

SEQ ID NO: 413858 - RNA, 12 nt, Homo sapiens
auuuuaucucag

SEQ ID NO: 413859 - RNA, 15 nt, Homo sapiens
auuuuaucugugaau

SEQ ID NO: 413860 - RNA, 20 nt, Homo sapiens
auuuuaucuugguaguacau

SEQ ID NO: 413861 - RNA, 19 nt, Homo sapiens
auuuuauuuuuaucccauc

SEQ ID NO: 413862 - RNA, 23 nt, Homo sapiens
auuuuauuuuuucccuccugaca

SEQ ID NO: 413863 - RNA, 20 nt, Homo sapiens
auuuuauuuuuuucuaccuu

SEQ ID NO: 413864 - RNA, 22 nt, Homo sapiens
auuuucaagaaagcauugccag

SEQ ID NO: 413865 - RNA, 14 nt, Homo sapiens
auuuucaagcaaau

SEQ ID NO: 413866 - RNA, 16 nt, Homo sapiens
auuuucaagcaaauau

SEQ ID NO: 413867 - RNA, 20 nt, Homo sapiens
auuuucaaguggaaaccuug

SEQ ID NO: 413868 - RNA, 20 nt, Homo sapiens
auuuucagaaaauauuaugu

SEQ ID NO: 413869 - RNA, 16 nt, Homo sapiens
auuuucaguaccaaag

SEQ ID NO: 413870 - RNA, 18 nt, Homo sapiens
auuuucaguauacugugu

SEQ ID NO: 413871 - RNA, 16 nt, Homo sapiens
aaacuaaaucucuaau

SEQ ID NO: 413872 - RNA, 14 nt, Homo sapiens
aaacuaaugugaua

SEQ ID NO: 413873 - RNA, 18 nt, Homo sapiens
aaacuaauuuuaacaaac

SEQ ID NO: 413874 - RNA, 16 nt, Homo sapiens
aaacuacaaagcugaa

SEQ ID NO: 413875 - RNA, 18 nt, Homo sapiens
aaacuacacaucccuaau

SEQ ID NO: 413876 - RNA, 16 nt, Homo sapiens
aaacuacugaacuguu

SEQ ID NO: 413877 - RNA, 17 nt, Homo sapiens
aaacuacugaacuguua

SEQ ID NO: 413878 - RNA, 17 nt, Homo sapiens
aaacuaugguucccaau

SEQ ID NO: 413879 - RNA, 17 nt, Homo sapiens
aaacuauguaaugcuua

SEQ ID NO: 413880 - RNA, 19 nt, Homo sapiens
aaacuauuggaaaguacuc

SEQ ID NO: 413881 - RNA, 17 nt, Homo sapiens
aaacuauuucuauccug

SEQ ID NO: 413882 - RNA, 17 nt, Homo sapiens
aaacuccuuuugguuua

SEQ ID NO: 413883 - RNA, 17 nt, Homo sapiens
aaacugaaaaucuaaua

SEQ ID NO: 413884 - RNA, 13 nt, Homo sapiens
aaacugaagccca

SEQ ID NO: 413885 - RNA, 23 nt, Homo sapiens
aaacugcaauagagacuguagau

SEQ ID NO: 413886 - RNA, 14 nt, Homo sapiens
aaacugcugugaau

SEQ ID NO: 413887 - RNA, 23 nt, Homo sapiens
aaacuguacaguuucuuccccaa

SEQ ID NO: 413888 - RNA, 17 nt, Homo sapiens
aaacuguccucuuucag

SEQ ID NO: 413889 - RNA, 12 nt, Homo sapiens
aaacugugaacc

SEQ ID NO: 413890 - RNA, 18 nt, Homo sapiens
aaacuuaaaaguauucau

SEQ ID NO: 413891 - RNA, 13 nt, Homo sapiens
aaacuuaacuuua

SEQ ID NO: 413892 - RNA, 13 nt, Homo sapiens
aaacuuagaucau

SEQ ID NO: 413893 - RNA, 20 nt, Homo sapiens
aaacuuccacuaccuuuaaa

SEQ ID NO: 413894 - RNA, 24 nt, Homo sapiens
aaacuuccauagcuucauccacug

SEQ ID NO: 413895 - RNA, 17 nt, Homo sapiens
aaacuucccaacuuccc

SEQ ID NO: 413896 - RNA, 16 nt, Homo sapiens
aaacuugaaugcucca

SEQ ID NO: 413897 - RNA, 19 nt, Homo sapiens
aaacuugggccgcugcacc

SEQ ID NO: 413898 - RNA, 17 nt, Homo sapiens
aaacuuuauguacugcu

SEQ ID NO: 413899 - RNA, 21 nt, Homo sapiens
aaacuuuguuugcuaaugcac

SEQ ID NO: 413900 - RNA, 17 nt, Homo sapiens
aaagaaaauaccaagga

SEQ ID NO: 413901 - RNA, 12 nt, Homo sapiens
aaagaaauccau

SEQ ID NO: 413902 - RNA, 18 nt, Homo sapiens
aaagaacccuagcacaaa

SEQ ID NO: 413903 - RNA, 22 nt, Homo sapiens
aaagaacuguauuuagugauua

SEQ ID NO: 413904 - RNA, 23 nt, Homo sapiens
aaagaagagaugagaaaugauga

SEQ ID NO: 413905 - RNA, 14 nt, Homo sapiens
aaagaagaguuuac

SEQ ID NO: 413906 - RNA, 12 nt, Homo sapiens
aaagaagucaaa

SEQ ID NO: 413907 - RNA, 22 nt, Homo sapiens
aaagaauaauaugcugccaaau

SEQ ID NO: 413908 - RNA, 19 nt, Homo sapiens
aaagaaucaacagugaaca

SEQ ID NO: 413909 - RNA, 22 nt, Homo sapiens
aaagaaucccuguucauuguaa

SEQ ID NO: 413910 - RNA, 16 nt, Homo sapiens
aaagaauguacauuac

SEQ ID NO: 413911 - RNA, 20 nt, Homo sapiens
aaagaauugugccucuccca

SEQ ID NO: 413912 - RNA, 20 nt, Homo sapiens
aaagacaaaacuuccuguuu

SEQ ID NO: 413913 - RNA, 17 nt, Homo sapiens
aaagacaguaaagacca

SEQ ID NO: 413914 - RNA, 22 nt, Homo sapiens
aaagacauaggaacauguaguu

SEQ ID NO: 413915 - RNA, 14 nt, Homo sapiens
aaagaccuaugagc

SEQ ID NO: 413916 - RNA, 14 nt, Homo sapiens
aaagaccuugcuua

SEQ ID NO: 413917 - RNA, 17 nt, Homo sapiens
aaagagaaaaaccaaug

SEQ ID NO: 413918 - RNA, 20 nt, Homo sapiens
aaagagaauaaagacuucau

SEQ ID NO: 413919 - RNA, 15 nt, Homo sapiens
aaagaggcuauguga

SEQ ID NO: 413920 - RNA, 19 nt, Homo sapiens
aaagaugaaaaaugguccc

SEQ ID NO: 413921 - RNA, 20 nt, Homo sapiens
aaagaugaucuacucagaaa

SEQ ID NO: 413922 - RNA, 22 nt, Homo sapiens
aaagaugcaaggaccaggacuc

SEQ ID NO: 413923 - RNA, 14 nt, Homo sapiens
aaagauguacugag

SEQ ID NO: 413924 - RNA, 20 nt, Homo sapiens
aaagauugauuaaugaacua

SEQ ID NO: 413925 - RNA, 17 nt, Homo sapiens
aaagauuuaagcacaaa

SEQ ID NO: 413926 - RNA, 17 nt, Homo sapiens
aaagcaaaacugcaaau

SEQ ID NO: 413927 - RNA, 14 nt, Homo sapiens
aaagcaaccaccug

SEQ ID NO: 413928 - RNA, 18 nt, Homo sapiens
aaagcaacuacagaauuu

SEQ ID NO: 413929 - RNA, 20 nt, Homo sapiens
aaagcaaguuucaucaguca

SEQ ID NO: 413930 - RNA, 16 nt, Homo sapiens
aaagcacagcucucac

SEQ ID NO: 413931 - RNA, 20 nt, Homo sapiens
aaagcacagggacacaaaga

SEQ ID NO: 413932 - RNA, 17 nt, Homo sapiens
aaagcacuggaauucag

SEQ ID NO: 413933 - RNA, 23 nt, Homo sapiens
aaagcagcacauagcacugggaa

SEQ ID NO: 413934 - RNA, 12 nt, Homo sapiens
aaagcagcaucu

SEQ ID NO: 413935 - RNA, 20 nt, Homo sapiens
aaagcaggucagaagaggga

SEQ ID NO: 413936 - RNA, 12 nt, Homo sapiens
aaagcagugcau

SEQ ID NO: 413937 - RNA, 15 nt, Homo sapiens
aaagcaguguuuuca

SEQ ID NO: 413938 - RNA, 18 nt, Homo sapiens
aaagcaucuaugugagac

SEQ ID NO: 413939 - RNA, 18 nt, Homo sapiens
aaagcaugcucaguauug

SEQ ID NO: 413940 - RNA, 19 nt, Homo sapiens
aaagccaccucucccucaa

SEQ ID NO: 413941 - RNA, 16 nt, Homo sapiens
aaagccauuauucucu

SEQ ID NO: 413942 - RNA, 13 nt, Homo sapiens
aaagcccuuccau

SEQ ID NO: 413943 - RNA, 15 nt, Homo sapiens
aaagcccuuccaugu

SEQ ID NO: 413944 - RNA, 15 nt, Homo sapiens
aaagcccuugaacca

SEQ ID NO: 413945 - RNA, 22 nt, Homo sapiens
aaagccgguugcagagaaucug

SEQ ID NO: 413946 - RNA, 17 nt, Homo sapiens
aaagccucagccauuca

SEQ ID NO: 413947 - RNA, 14 nt, Homo sapiens
aaagccucuggaaa

SEQ ID NO: 413948 - RNA, 16 nt, Homo sapiens
aaagccugcaauuuca

SEQ ID NO: 413949 - RNA, 23 nt, Homo sapiens
aaagccugggcagaaaugugcug

SEQ ID NO: 413950 - RNA, 17 nt, Homo sapiens
aaagcugauuacuguca

SEQ ID NO: 413951 - RNA, 22 nt, Homo sapiens
aaagcugcugagaaucuagccu

SEQ ID NO: 413952 - RNA, 21 nt, Homo sapiens
aaagcugugucucuguauaua

SEQ ID NO: 413953 - RNA, 15 nt, Homo sapiens
aaagcuucauucuca

SEQ ID NO: 413954 - RNA, 22 nt, Homo sapiens
aaagcuuggugcuaaaccacaa

SEQ ID NO: 413955 - RNA, 19 nt, Homo sapiens
aaagcuuggugucuuggca

SEQ ID NO: 413956 - RNA, 20 nt, Homo sapiens
aaagcuuuggugccuggaaa

SEQ ID NO: 413957 - RNA, 14 nt, Homo sapiens
aaaggaagacuaga

SEQ ID NO: 413958 - RNA, 15 nt, Homo sapiens
aaaggaauauaccac

SEQ ID NO: 413959 - RNA, 19 nt, Homo sapiens
aaaggacucugcuucaguc

SEQ ID NO: 413960 - RNA, 19 nt, Homo sapiens
aaaggagcauccuuaccuc

SEQ ID NO: 413961 - RNA, 22 nt, Homo sapiens
aaagggagcagagaaggccagg

SEQ ID NO: 413962 - RNA, 19 nt, Homo sapiens
aaaggggcaggagcucaga

SEQ ID NO: 413963 - RNA, 18 nt, Homo sapiens
aaagggggcuauucccug

SEQ ID NO: 413964 - RNA, 19 nt, Homo sapiens
aaagguaaucugaaacaca

SEQ ID NO: 413965 - RNA, 21 nt, Homo sapiens
aaagguagcuuuucccaaacu

SEQ ID NO: 413966 - RNA, 20 nt, Homo sapiens
aaagguauuuugaauaccau

SEQ ID NO: 413967 - RNA, 14 nt, Homo sapiens
aaagguuaagccau

SEQ ID NO: 413968 - RNA, 14 nt, Homo sapiens
aaagguugccugaa

SEQ ID NO: 413969 - RNA, 19 nt, Homo sapiens
aaagguuuaaugucagggu

SEQ ID NO: 413970 - RNA, 20 nt, Homo sapiens
aaagguuucguugcauggua

SEQ ID NO: 413971 - RNA, 17 nt, Homo sapiens
aaaguaaaugcuaccuc

SEQ ID NO: 413972 - RNA, 23 nt, Homo sapiens
aaaguaauagggcuucugccuaa

SEQ ID NO: 413973 - RNA, 20 nt, Homo sapiens
aaaguaauuguaaacuagua

SEQ ID NO: 413974 - RNA, 14 nt, Homo sapiens
aaaguacaaagcau

SEQ ID NO: 413975 - RNA, 16 nt, Homo sapiens
aaaguagguauacaaa

SEQ ID NO: 413976 - RNA, 14 nt, Homo sapiens
aaaguauggcagug

SEQ ID NO: 413977 - RNA, 20 nt, Homo sapiens
aaaguauggcagugggagac

SEQ ID NO: 413978 - RNA, 11 nt, Homo sapiens
aaaguauucca

SEQ ID NO: 413979 - RNA, 15 nt, Homo sapiens
aaaguauuccaccuu

SEQ ID NO: 413980 - RNA, 13 nt, Homo sapiens
aaagucaaaaaua

SEQ ID NO: 413981 - RNA, 14 nt, Homo sapiens
aaaguccugucacc

SEQ ID NO: 413982 - RNA, 19 nt, Homo sapiens
aaaguccugucaccaagga

SEQ ID NO: 413983 - RNA, 22 nt, Homo sapiens
aaagucuuaacaacagcuucuu

SEQ ID NO: 413984 - RNA, 15 nt, Homo sapiens
aaagucuugugacua

SEQ ID NO: 413985 - RNA, 14 nt, Homo sapiens
aaagugcugagauu

SEQ ID NO: 413986 - RNA, 18 nt, Homo sapiens
aaaguguacuauuugaua

SEQ ID NO: 413987 - RNA, 19 nt, Homo sapiens
aaaguguguuucuauguga

SEQ ID NO: 413988 - RNA, 23 nt, Homo sapiens
aaaguuaugguacuauguuagcc

SEQ ID NO: 413989 - RNA, 14 nt, Homo sapiens
aaaguuauugugau

SEQ ID NO: 413990 - RNA, 14 nt, Homo sapiens
aaaguucaaagcaa

SEQ ID NO: 413991 - RNA, 14 nt, Homo sapiens
aaaguugaggggag

SEQ ID NO: 413992 - RNA, 16 nt, Homo sapiens
aaaguuuaaauaccag

SEQ ID NO: 413993 - RNA, 17 nt, Homo sapiens
aaauaaaaauagcuaua

SEQ ID NO: 413994 - RNA, 21 nt, Homo sapiens
aaauaaacucuucaaggccaa

SEQ ID NO: 413995 - RNA, 18 nt, Homo sapiens
aaauaaacugaacauauu

SEQ ID NO: 413996 - RNA, 19 nt, Homo sapiens
aaauaaauaugaauggagu

SEQ ID NO: 413997 - RNA, 15 nt, Homo sapiens
aaauaaaugugagaa

SEQ ID NO: 413998 - RNA, 15 nt, Homo sapiens
aaauaacacuguacu

SEQ ID NO: 413999 - RNA, 15 nt, Homo sapiens
aaauaacacugugaa

SEQ ID NO: 414000 - RNA, 20 nt, Homo sapiens
aaauaaccccaaaaugaaga

SEQ ID NO: 414001 - RNA, 17 nt, Homo sapiens
acccuuucucugagaga

SEQ ID NO: 414002 - RNA, 18 nt, Homo sapiens
accgagagagauggaaua

SEQ ID NO: 414003 - RNA, 16 nt, Homo sapiens
accgaggcgaugccac

SEQ ID NO: 414004 - RNA, 16 nt, Homo sapiens
accgagucucuucucc

SEQ ID NO: 414005 - RNA, 14 nt, Homo sapiens
accgauaugcacuu

SEQ ID NO: 414006 - RNA, 14 nt, Homo sapiens
accgaugguccuca

SEQ ID NO: 414007 - RNA, 17 nt, Homo sapiens
accgcugccagcacaga

SEQ ID NO: 414008 - RNA, 14 nt, Homo sapiens
accgcuggagcucc

SEQ ID NO: 414009 - RNA, 20 nt, Homo sapiens
accggaggcaaaaggcagug

SEQ ID NO: 414010 - RNA, 18 nt, Homo sapiens
accgucugugauugccau

SEQ ID NO: 414011 - RNA, 14 nt, Homo sapiens
accgugaccaucuu

SEQ ID NO: 414012 - RNA, 15 nt, Homo sapiens
accguugcacaaaaa

SEQ ID NO: 414013 - RNA, 19 nt, Homo sapiens
accguuuggugucugaugu

SEQ ID NO: 414014 - RNA, 16 nt, Homo sapiens
accuaaacguauuuca

SEQ ID NO: 414015 - RNA, 16 nt, Homo sapiens
accuaaccacuuagca

SEQ ID NO: 414016 - RNA, 18 nt, Homo sapiens
accuacagggaacuggga

SEQ ID NO: 414017 - RNA, 14 nt, Homo sapiens
accuaccugugaau

SEQ ID NO: 414018 - RNA, 16 nt, Homo sapiens
accuagaccuugccuc

SEQ ID NO: 414019 - RNA, 13 nt, Homo sapiens
accuagcauuuca

SEQ ID NO: 414020 - RNA, 19 nt, Homo sapiens
accuagguuaacaacccug

SEQ ID NO: 414021 - RNA, 15 nt, Homo sapiens
accuaugccuguggu

SEQ ID NO: 414022 - RNA, 16 nt, Homo sapiens
accuaugcuucuagaa

SEQ ID NO: 414023 - RNA, 15 nt, Homo sapiens
accuauguacuuaau

SEQ ID NO: 414024 - RNA, 22 nt, Homo sapiens
accuauugccaggaauguuuca

SEQ ID NO: 414025 - RNA, 12 nt, Homo sapiens
accuauugcugu

SEQ ID NO: 414026 - RNA, 18 nt, Homo sapiens
accucaaacuuccaguca

SEQ ID NO: 414027 - RNA, 22 nt, Homo sapiens
accucaacauugcauggugcua

SEQ ID NO: 414028 - RNA, 21 nt, Homo sapiens
accucaagcaaccaugaacuc

SEQ ID NO: 414029 - RNA, 17 nt, Homo sapiens
accucagaggaguuuaa

SEQ ID NO: 414030 - RNA, 19 nt, Homo sapiens
accucagcugcacauuccu

SEQ ID NO: 414031 - RNA, 22 nt, Homo sapiens
accucagguugaaauaccaggg

SEQ ID NO: 414032 - RNA, 22 nt, Homo sapiens
accucagugucauuuaugaaaa

SEQ ID NO: 414033 - RNA, 22 nt, Homo sapiens
accucaguuuuaucauuuucaa

SEQ ID NO: 414034 - RNA, 20 nt, Homo sapiens
accuccacccccuccuguca

SEQ ID NO: 414035 - RNA, 15 nt, Homo sapiens
accucccaguuugcu

SEQ ID NO: 414036 - RNA, 21 nt, Homo sapiens
accucccucccuccccagugu

SEQ ID NO: 414037 - RNA, 19 nt, Homo sapiens
accuccuccaagaagcccu

SEQ ID NO: 414038 - RNA, 16 nt, Homo sapiens
accuccuccucuggac

SEQ ID NO: 414039 - RNA, 22 nt, Homo sapiens
accucgggaaacuuagaucauc

SEQ ID NO: 414040 - RNA, 17 nt, Homo sapiens
accucuacaggcauuua

SEQ ID NO: 414041 - RNA, 19 nt, Homo sapiens
accucugaucaaagcaccu

SEQ ID NO: 414042 - RNA, 17 nt, Homo sapiens
accucuggacuggcuag

SEQ ID NO: 414043 - RNA, 20 nt, Homo sapiens
accucuggauaauuuugcau

SEQ ID NO: 414044 - RNA, 15 nt, Homo sapiens
accucuggccaaaua

SEQ ID NO: 414045 - RNA, 22 nt, Homo sapiens
accucuggccaaauaugcacuu

SEQ ID NO: 414046 - RNA, 20 nt, Homo sapiens
accucuggcuagaggacaua

SEQ ID NO: 414047 - RNA, 12 nt, Homo sapiens
accucuucacuc

SEQ ID NO: 414048 - RNA, 20 nt, Homo sapiens
accucuucccaugacugcac

SEQ ID NO: 414049 - RNA, 20 nt, Homo sapiens
accucuuugucccagaguua

SEQ ID NO: 414050 - RNA, 20 nt, Homo sapiens
accugaagggugacauccca

SEQ ID NO: 414051 - RNA, 11 nt, Homo sapiens
accugaagucu

SEQ ID NO: 414052 - RNA, 21 nt, Homo sapiens
accugacaggggucacucauu

SEQ ID NO: 414053 - RNA, 19 nt, Homo sapiens
accugacguacucugguua

SEQ ID NO: 414054 - RNA, 19 nt, Homo sapiens
accugagcagcaacugugu

SEQ ID NO: 414055 - RNA, 16 nt, Homo sapiens
accugagguugcuuua

SEQ ID NO: 414056 - RNA, 21 nt, Homo sapiens
accugauguaccugaugcuau

SEQ ID NO: 414057 - RNA, 15 nt, Homo sapiens
accugcacaccuacg

SEQ ID NO: 414058 - RNA, 12 nt, Homo sapiens
accugcacuuca

SEQ ID NO: 414059 - RNA, 19 nt, Homo sapiens
accugccucagccuuccaa

SEQ ID NO: 414060 - RNA, 23 nt, Homo sapiens
accugcuccuuggccuagucaga

SEQ ID NO: 414061 - RNA, 19 nt, Homo sapiens
accugcucuccucuugcca

SEQ ID NO: 414062 - RNA, 18 nt, Homo sapiens
accugcuuugagauuucc

SEQ ID NO: 414063 - RNA, 14 nt, Homo sapiens
accuggagacuguc

SEQ ID NO: 414064 - RNA, 21 nt, Homo sapiens
accuggagauugugcucugca

SEQ ID NO: 414065 - RNA, 19 nt, Homo sapiens
accuggagccaucuuccua

SEQ ID NO: 414066 - RNA, 23 nt, Homo sapiens
accuggcuugcagggaagcaucu

SEQ ID NO: 414067 - RNA, 18 nt, Homo sapiens
accugggccaccaugcac

SEQ ID NO: 414068 - RNA, 23 nt, Homo sapiens
accugggcucauucuucuuggcu

SEQ ID NO: 414069 - RNA, 22 nt, Homo sapiens
accugggcugggagaaggugcu

SEQ ID NO: 414070 - RNA, 17 nt, Homo sapiens
accugguuauguuguua

SEQ ID NO: 414071 - RNA, 16 nt, Homo sapiens
accuguauuuugccag

SEQ ID NO: 414072 - RNA, 20 nt, Homo sapiens
accuguccaggugaguguga

SEQ ID NO: 414073 - RNA, 12 nt, Homo sapiens
accugugaauca

SEQ ID NO: 414074 - RNA, 19 nt, Homo sapiens
accugugacaaaggaugaa

SEQ ID NO: 414075 - RNA, 11 nt, Homo sapiens
accugugauga

SEQ ID NO: 414076 - RNA, 17 nt, Homo sapiens
accuguggguugugcua

SEQ ID NO: 414077 - RNA, 17 nt, Homo sapiens
accuguucaaaauucca

SEQ ID NO: 414078 - RNA, 20 nt, Homo sapiens
accuguucagugucccgggc

SEQ ID NO: 414079 - RNA, 13 nt, Homo sapiens
accuguuccuguu

SEQ ID NO: 414080 - RNA, 20 nt, Homo sapiens
accuguugagacugauucag

SEQ ID NO: 414081 - RNA, 13 nt, Homo sapiens
accuguuucugca

SEQ ID NO: 414082 - RNA, 21 nt, Homo sapiens
accuuacccuacuggcuguaa

SEQ ID NO: 414083 - RNA, 19 nt, Homo sapiens
accuuacuuaaagcuuguu

SEQ ID NO: 414084 - RNA, 13 nt, Homo sapiens
accuucaauacuu

SEQ ID NO: 414085 - RNA, 15 nt, Homo sapiens
accuuccagucuuuu

SEQ ID NO: 414086 - RNA, 15 nt, Homo sapiens
accuuccccugagga

SEQ ID NO: 414087 - RNA, 18 nt, Homo sapiens
accuuccugggcagccca

SEQ ID NO: 414088 - RNA, 13 nt, Homo sapiens
accuucuaaucca

SEQ ID NO: 414089 - RNA, 16 nt, Homo sapiens
accuucuuccacagca

SEQ ID NO: 414090 - RNA, 17 nt, Homo sapiens
accuugacuucugccca

SEQ ID NO: 414091 - RNA, 15 nt, Homo sapiens
accuugagacagcuu

SEQ ID NO: 414092 - RNA, 22 nt, Homo sapiens
accuuguuccuguaaaauccau

SEQ ID NO: 414093 - RNA, 19 nt, Homo sapiens
accuuguuggagccugcag

SEQ ID NO: 414094 - RNA, 15 nt, Homo sapiens
accuuuaaauaucau

SEQ ID NO: 414095 - RNA, 21 nt, Homo sapiens
accuuuaaauaucauucuuug

SEQ ID NO: 414096 - RNA, 19 nt, Homo sapiens
accuuucugaggaguaaaa

SEQ ID NO: 414097 - RNA, 12 nt, Homo sapiens
accuuugucaac

SEQ ID NO: 414098 - RNA, 22 nt, Homo sapiens
accuuuuauguguugaugacuc

SEQ ID NO: 414099 - RNA, 19 nt, Homo sapiens
accuuuuuauauuuuauac

SEQ ID NO: 414100 - RNA, 13 nt, Homo sapiens
acgaaagcacagu

SEQ ID NO: 414101 - RNA, 21 nt, Homo sapiens
acgaacagcugacauggaguu

SEQ ID NO: 414102 - RNA, 22 nt, Homo sapiens
acgaacgcucuuagcuuucuca

SEQ ID NO: 414103 - RNA, 16 nt, Homo sapiens
acgaagaaagacuccu

SEQ ID NO: 414104 - RNA, 17 nt, Homo sapiens
acgacaacgaugaugcu

SEQ ID NO: 414105 - RNA, 16 nt, Homo sapiens
acgacgauuucagcua

SEQ ID NO: 414106 - RNA, 15 nt, Homo sapiens
acgagcgaaugauuu

SEQ ID NO: 414107 - RNA, 19 nt, Homo sapiens
acgaggcaggggcucugcu

SEQ ID NO: 414108 - RNA, 21 nt, Homo sapiens
acgagggauguggagcacaaa

SEQ ID NO: 414109 - RNA, 15 nt, Homo sapiens
acgaucuuccuggcu

SEQ ID NO: 414110 - RNA, 15 nt, Homo sapiens
acgauuucacugaca

SEQ ID NO: 414111 - RNA, 12 nt, Homo sapiens
acgcacacagcu

SEQ ID NO: 414112 - RNA, 15 nt, Homo sapiens
acgcagccaggacac

SEQ ID NO: 414113 - RNA, 15 nt, Homo sapiens
acgccagaacugcuu

SEQ ID NO: 414114 - RNA, 18 nt, Homo sapiens
acgccagaacugcuuuau

SEQ ID NO: 414115 - RNA, 20 nt, Homo sapiens
acgccuccccuuugugacuu

SEQ ID NO: 414116 - RNA, 17 nt, Homo sapiens
acgccucuuuucccucu

SEQ ID NO: 414117 - RNA, 13 nt, Homo sapiens
acgcucucugucu

SEQ ID NO: 414118 - RNA, 18 nt, Homo sapiens
acgcuuaggccaugaugu

SEQ ID NO: 414119 - RNA, 19 nt, Homo sapiens
acgcuugcuuuagcacagg

SEQ ID NO: 414120 - RNA, 16 nt, Homo sapiens
acggaagaggcugcug

SEQ ID NO: 414121 - RNA, 20 nt, Homo sapiens
acggcugccugacacugagc

SEQ ID NO: 414122 - RNA, 22 nt, Homo sapiens
acggggcuugcaacuuagcuca

SEQ ID NO: 414123 - RNA, 19 nt, Homo sapiens
acgguccuuugagugucag

SEQ ID NO: 414124 - RNA, 19 nt, Homo sapiens
acgguggccagagaugcca

SEQ ID NO: 414125 - RNA, 20 nt, Homo sapiens
acgguggccagagaugccag

SEQ ID NO: 414126 - RNA, 20 nt, Homo sapiens
acgguguccaugccuuccau

SEQ ID NO: 414127 - RNA, 20 nt, Homo sapiens
acgguuuuaaauguguugcu

SEQ ID NO: 414128 - RNA, 20 nt, Homo sapiens
acgguuuuauaaaagccuug

SEQ ID NO: 414129 - RNA, 17 nt, Homo sapiens
acguaaucucacuuaau

SEQ ID NO: 414130 - RNA, 17 nt, Homo sapiens
acguauauuucauugaa

SEQ ID NO: 414131 - RNA, 16 nt, Homo sapiens
agaagagaaucaaggc

SEQ ID NO: 414132 - RNA, 21 nt, Homo sapiens
agaagauaauguucuuuaaug

SEQ ID NO: 414133 - RNA, 16 nt, Homo sapiens
agaagcacauaugaac

SEQ ID NO: 414134 - RNA, 18 nt, Homo sapiens
agaagccaagacaguggc

SEQ ID NO: 414135 - RNA, 18 nt, Homo sapiens
agaagcccagacuuccuu

SEQ ID NO: 414136 - RNA, 22 nt, Homo sapiens
agaaggauggcauuuuuugcaa

SEQ ID NO: 414137 - RNA, 22 nt, Homo sapiens
agaaggcagcaggcggccuuug

SEQ ID NO: 414138 - RNA, 17 nt, Homo sapiens
agaaggcauuccagggu

SEQ ID NO: 414139 - RNA, 24 nt, Homo sapiens
agaaguaagcagaguucuuugcaa

SEQ ID NO: 414140 - RNA, 17 nt, Homo sapiens
agaaguaauuccucuga

SEQ ID NO: 414141 - RNA, 13 nt, Homo sapiens
agaaguacuuugu

SEQ ID NO: 414142 - RNA, 17 nt, Homo sapiens
agaaguagcaagaucuu

SEQ ID NO: 414143 - RNA, 16 nt, Homo sapiens
agaaguaggcucugau

SEQ ID NO: 414144 - RNA, 16 nt, Homo sapiens
agaagucaguugcaaa

SEQ ID NO: 414145 - RNA, 12 nt, Homo sapiens
agaagucucuua

SEQ ID NO: 414146 - RNA, 21 nt, Homo sapiens
agaauaaaaaagaaauccaua

SEQ ID NO: 414147 - RNA, 17 nt, Homo sapiens
agaauaauuguguacaa

SEQ ID NO: 414148 - RNA, 13 nt, Homo sapiens
agaauaucuggga

SEQ ID NO: 414149 - RNA, 14 nt, Homo sapiens
agaaucaacaguga

SEQ ID NO: 414150 - RNA, 17 nt, Homo sapiens
agaaucaacagugaaca

SEQ ID NO: 414151 - RNA, 16 nt, Homo sapiens
agaaucacuggaaccu

SEQ ID NO: 414152 - RNA, 23 nt, Homo sapiens
agaaucacuugacuuugccacau

SEQ ID NO: 414153 - RNA, 18 nt, Homo sapiens
agaaucaugugaacccgg

SEQ ID NO: 414154 - RNA, 21 nt, Homo sapiens
agaauccagcuacgaauauag

SEQ ID NO: 414155 - RNA, 18 nt, Homo sapiens
agaaucgaccucacuguc

SEQ ID NO: 414156 - RNA, 14 nt, Homo sapiens
agaaucuacuaagu

SEQ ID NO: 414157 - RNA, 13 nt, Homo sapiens
agaaucugagggc

SEQ ID NO: 414158 - RNA, 14 nt, Homo sapiens
agaaucugcagcua

SEQ ID NO: 414159 - RNA, 21 nt, Homo sapiens
agaaucugcagcuaacuuauu

SEQ ID NO: 414160 - RNA, 15 nt, Homo sapiens
agaaucugcugcaua

SEQ ID NO: 414161 - RNA, 23 nt, Homo sapiens
agaaucugcugcauagcucuauu

SEQ ID NO: 414162 - RNA, 11 nt, Homo sapiens
agaaucugugc

SEQ ID NO: 414163 - RNA, 18 nt, Homo sapiens
agaaucugugcagucauc

SEQ ID NO: 414164 - RNA, 19 nt, Homo sapiens
agaauggcuuuggucucuu

SEQ ID NO: 414165 - RNA, 22 nt, Homo sapiens
agaauggcuuuggucucuugcu

SEQ ID NO: 414166 - RNA, 22 nt, Homo sapiens
agaauggggguggggaggcaag

SEQ ID NO: 414167 - RNA, 18 nt, Homo sapiens
agaauguacacaguuuaa

SEQ ID NO: 414168 - RNA, 15 nt, Homo sapiens
agaaugucaguugau

SEQ ID NO: 414169 - RNA, 15 nt, Homo sapiens
agaaugucauuugcu

SEQ ID NO: 414170 - RNA, 21 nt, Homo sapiens
agaaugugcagugucuuguaa

SEQ ID NO: 414171 - RNA, 23 nt, Homo sapiens
agaauuagauuuuaaaacuucau

SEQ ID NO: 414172 - RNA, 19 nt, Homo sapiens
agaauuaguggcacuugcu

SEQ ID NO: 414173 - RNA, 23 nt, Homo sapiens
agaauuauacagaccuaauauca

SEQ ID NO: 414174 - RNA, 17 nt, Homo sapiens
agaauuaucaucccaac

SEQ ID NO: 414175 - RNA, 23 nt, Homo sapiens
agaauucacuaggaggucaucaa

SEQ ID NO: 414176 - RNA, 19 nt, Homo sapiens
agaauucacuuuaccuuca

SEQ ID NO: 414177 - RNA, 16 nt, Homo sapiens
agaauugugccucucc

SEQ ID NO: 414178 - RNA, 20 nt, Homo sapiens
agaauuucuuugucauucaa

SEQ ID NO: 414179 - RNA, 18 nt, Homo sapiens
agacaaaauaaacauuuu

SEQ ID NO: 414180 - RNA, 18 nt, Homo sapiens
agacaaagugacauuccu

SEQ ID NO: 414181 - RNA, 14 nt, Homo sapiens
agacaaaugcugcg

SEQ ID NO: 414182 - RNA, 13 nt, Homo sapiens
agacaaauugauc

SEQ ID NO: 414183 - RNA, 22 nt, Homo sapiens
agacaacccugcaaaggacugu

SEQ ID NO: 414184 - RNA, 17 nt, Homo sapiens
agacaaugguuguguag

SEQ ID NO: 414185 - RNA, 20 nt, Homo sapiens
agacacaacuauuuuuccaa

SEQ ID NO: 414186 - RNA, 14 nt, Homo sapiens
agacacagcaagac

SEQ ID NO: 414187 - RNA, 22 nt, Homo sapiens
agacacaucuccuccauacuca

SEQ ID NO: 414188 - RNA, 13 nt, Homo sapiens
agacaccacagac

SEQ ID NO: 414189 - RNA, 22 nt, Homo sapiens
agacacccuaacucuugcucac

SEQ ID NO: 414190 - RNA, 23 nt, Homo sapiens
agacacccuaacucuugcucacu

SEQ ID NO: 414191 - RNA, 14 nt, Homo sapiens
agacacgaaauugg

SEQ ID NO: 414192 - RNA, 18 nt, Homo sapiens
agacacugugguugcaaa

SEQ ID NO: 414193 - RNA, 22 nt, Homo sapiens
agacacuguucccagcuaccag

SEQ ID NO: 414194 - RNA, 18 nt, Homo sapiens
agacagaagucacucaau

SEQ ID NO: 414195 - RNA, 20 nt, Homo sapiens
agacaggccaugugagccac

SEQ ID NO: 414196 - RNA, 17 nt, Homo sapiens
agacagugggggugccu

SEQ ID NO: 414197 - RNA, 21 nt, Homo sapiens
agacaguugguuuugcauguc

SEQ ID NO: 414198 - RNA, 18 nt, Homo sapiens
agacauaaccacugcuuc

SEQ ID NO: 414199 - RNA, 21 nt, Homo sapiens
agacauaaccacugcuuccau

SEQ ID NO: 414200 - RNA, 21 nt, Homo sapiens
agacauaaguaaaugagccuu

SEQ ID NO: 414201 - RNA, 13 nt, Homo sapiens
agacauacuugua

SEQ ID NO: 414202 - RNA, 14 nt, Homo sapiens
agacauccauguuu

SEQ ID NO: 414203 - RNA, 20 nt, Homo sapiens
agacaugcacuaugaggaau

SEQ ID NO: 414204 - RNA, 19 nt, Homo sapiens
agacauucuuccaaaaaga

SEQ ID NO: 414205 - RNA, 22 nt, Homo sapiens
agacauugggaggggcuucuga

SEQ ID NO: 414206 - RNA, 21 nt, Homo sapiens
agacauuuaucaacuguugau

SEQ ID NO: 414207 - RNA, 20 nt, Homo sapiens
agaccaacucucuccuguau

SEQ ID NO: 414208 - RNA, 16 nt, Homo sapiens
agaccagaagugaaug

SEQ ID NO: 414209 - RNA, 21 nt, Homo sapiens
agaccagucacagccauuuca

SEQ ID NO: 414210 - RNA, 23 nt, Homo sapiens
agaccaguccuguuugcagggaa

SEQ ID NO: 414211 - RNA, 18 nt, Homo sapiens
agaccaguugggagcacu

SEQ ID NO: 414212 - RNA, 19 nt, Homo sapiens
agaccaguugggagcacug

SEQ ID NO: 414213 - RNA, 16 nt, Homo sapiens
agacccacaaacugcc

SEQ ID NO: 414214 - RNA, 20 nt, Homo sapiens
agacccccaugguaauguaa

SEQ ID NO: 414215 - RNA, 18 nt, Homo sapiens
agaccccuggcugguaag

SEQ ID NO: 414216 - RNA, 15 nt, Homo sapiens
agacccgcucuccau

SEQ ID NO: 414217 - RNA, 15 nt, Homo sapiens
agacccucaaugcca

SEQ ID NO: 414218 - RNA, 12 nt, Homo sapiens
agacccucagac

SEQ ID NO: 414219 - RNA, 13 nt, Homo sapiens
agacccucagacc

SEQ ID NO: 414220 - RNA, 18 nt, Homo sapiens
agacccucuucucugggc

SEQ ID NO: 414221 - RNA, 23 nt, Homo sapiens
agaccucccucccuccccagugu

SEQ ID NO: 414222 - RNA, 22 nt, Homo sapiens
agaccucucaacagaucugugg

SEQ ID NO: 414223 - RNA, 15 nt, Homo sapiens
agaccuggaaccaga

SEQ ID NO: 414224 - RNA, 15 nt, Homo sapiens
agaccuggcacugga

SEQ ID NO: 414225 - RNA, 23 nt, Homo sapiens
agaccuguugguuagcuggacau

SEQ ID NO: 414226 - RNA, 19 nt, Homo sapiens
agaccuucugaagaucuca

SEQ ID NO: 414227 - RNA, 22 nt, Homo sapiens
agacgaacagcugacauggagu

SEQ ID NO: 414228 - RNA, 15 nt, Homo sapiens
agacgcagauuucag

SEQ ID NO: 414229 - RNA, 16 nt, Homo sapiens
agacggagaugcaugg

SEQ ID NO: 414230 - RNA, 11 nt, Homo sapiens
agacgggaccg

SEQ ID NO: 414231 - RNA, 20 nt, Homo sapiens
agacgugcacuuggugcugc

SEQ ID NO: 414232 - RNA, 24 nt, Homo sapiens
agacuaagcccugucgagacacuu

SEQ ID NO: 414233 - RNA, 14 nt, Homo sapiens
agacuacuuuuaga

SEQ ID NO: 414234 - RNA, 14 nt, Homo sapiens
agacuagugccgua

SEQ ID NO: 414235 - RNA, 17 nt, Homo sapiens
agacucacgcugacugc

SEQ ID NO: 414236 - RNA, 18 nt, Homo sapiens
agacuccgucucaaaaga

SEQ ID NO: 414237 - RNA, 15 nt, Homo sapiens
agacucuaccacuua

SEQ ID NO: 414238 - RNA, 16 nt, Homo sapiens
agacucuuaccuacaa

SEQ ID NO: 414239 - RNA, 17 nt, Homo sapiens
agacugaaucuaccugc

SEQ ID NO: 414240 - RNA, 16 nt, Homo sapiens
agacuggauacugccc

SEQ ID NO: 414241 - RNA, 20 nt, Homo sapiens
agacugggucucgcuuuguu

SEQ ID NO: 414242 - RNA, 20 nt, Homo sapiens
agacugggugaaagugacua

SEQ ID NO: 414243 - RNA, 22 nt, Homo sapiens
agacuguacuggccagugucau

SEQ ID NO: 414244 - RNA, 14 nt, Homo sapiens
agacuguugcucaa

SEQ ID NO: 414245 - RNA, 15 nt, Homo sapiens
agacuguugcucaaa

SEQ ID NO: 414246 - RNA, 12 nt, Homo sapiens
agacuuccccau

SEQ ID NO: 414247 - RNA, 22 nt, Homo sapiens
agacuuccucaugaaucucuca

SEQ ID NO: 414248 - RNA, 16 nt, Homo sapiens
agacuucgacucagga

SEQ ID NO: 414249 - RNA, 22 nt, Homo sapiens
agacuugaugaauaaacacuuu

SEQ ID NO: 414250 - RNA, 13 nt, Homo sapiens
agacuuggagcug

SEQ ID NO: 414251 - RNA, 20 nt, Homo sapiens
agacuuuacauggaugccaa

SEQ ID NO: 414252 - RNA, 23 nt, Homo sapiens
agacuuuguguuuacaucugcau

SEQ ID NO: 414253 - RNA, 19 nt, Homo sapiens
agacuuuuaacuucaccuu

SEQ ID NO: 414254 - RNA, 14 nt, Homo sapiens
agacuuuucuuucc

SEQ ID NO: 414255 - RNA, 13 nt, Homo sapiens
agagaaaacagac

SEQ ID NO: 414256 - RNA, 21 nt, Homo sapiens
agagaaacuugaaugcuccau

SEQ ID NO: 414257 - RNA, 14 nt, Homo sapiens
agagaaauacuuuc

SEQ ID NO: 414258 - RNA, 14 nt, Homo sapiens
agagaaaugagcuu

SEQ ID NO: 414259 - RNA, 18 nt, Homo sapiens
agagaacaaucacuauuc

SEQ ID NO: 414260 - RNA, 19 nt, Homo sapiens
agaugucuucguacaguuc

SEQ ID NO: 414261 - RNA, 21 nt, Homo sapiens
agaugucuucugccuguuaua

SEQ ID NO: 414262 - RNA, 15 nt, Homo sapiens
agaugugcauuucac

SEQ ID NO: 414263 - RNA, 12 nt, Homo sapiens
agauguuugcaa

SEQ ID NO: 414264 - RNA, 19 nt, Homo sapiens
agauguuuuggggacucau

SEQ ID NO: 414265 - RNA, 17 nt, Homo sapiens
agauuaaacugagugaa

SEQ ID NO: 414266 - RNA, 22 nt, Homo sapiens
agauucauuauuuuuccacuuu

SEQ ID NO: 414267 - RNA, 15 nt, Homo sapiens
agauucccaagccaa

SEQ ID NO: 414268 - RNA, 12 nt, Homo sapiens
agauucuagcac

SEQ ID NO: 414269 - RNA, 20 nt, Homo sapiens
agauucuaguagaacucuag

SEQ ID NO: 414270 - RNA, 16 nt, Homo sapiens
agauucuccugugcua

SEQ ID NO: 414271 - RNA, 12 nt, Homo sapiens
agauucugggaa

SEQ ID NO: 414272 - RNA, 21 nt, Homo sapiens
agauucuucaggcuuccugca

SEQ ID NO: 414273 - RNA, 19 nt, Homo sapiens
agauucuuuaaacuacuga

SEQ ID NO: 414274 - RNA, 18 nt, Homo sapiens
agauugauuaaugaacua

SEQ ID NO: 414275 - RNA, 17 nt, Homo sapiens
agauugcuuuugugcau

SEQ ID NO: 414276 - RNA, 16 nt, Homo sapiens
agauuggaaagacagg

SEQ ID NO: 414277 - RNA, 15 nt, Homo sapiens
agauuguaaagguag

SEQ ID NO: 414278 - RNA, 17 nt, Homo sapiens
agauuguccagugcaac

SEQ ID NO: 414279 - RNA, 14 nt, Homo sapiens
agauuuaagcacaa

SEQ ID NO: 414280 - RNA, 14 nt, Homo sapiens
agauuucagaucau

SEQ ID NO: 414281 - RNA, 13 nt, Homo sapiens
agcaaaaggcagc

SEQ ID NO: 414282 - RNA, 14 nt, Homo sapiens
agcaaagaacccau

SEQ ID NO: 414283 - RNA, 21 nt, Homo sapiens
agcaaagcugaugacaacuuc

SEQ ID NO: 414284 - RNA, 20 nt, Homo sapiens
agcaaauggcagaaccaaag

SEQ ID NO: 414285 - RNA, 16 nt, Homo sapiens
agcaaauguggcuccu

SEQ ID NO: 414286 - RNA, 12 nt, Homo sapiens
agcaacaacuua

SEQ ID NO: 414287 - RNA, 17 nt, Homo sapiens
agcaacaacuuacuaaa

SEQ ID NO: 414288 - RNA, 16 nt, Homo sapiens
agcaacacaauguuau

SEQ ID NO: 414289 - RNA, 13 nt, Homo sapiens
agcaacaucagcu

SEQ ID NO: 414290 - RNA, 15 nt, Homo sapiens
agcaaccaugaacuc

SEQ ID NO: 414291 - RNA, 20 nt, Homo sapiens
agcaacucagaaugcucuac

SEQ ID NO: 414292 - RNA, 22 nt, Homo sapiens
agcaacuggugacugucccuuc

SEQ ID NO: 414293 - RNA, 19 nt, Homo sapiens
agcaagacccugucuuaaa

SEQ ID NO: 414294 - RNA, 18 nt, Homo sapiens
agcaagacucugucucaa

SEQ ID NO: 414295 - RNA, 17 nt, Homo sapiens
agcaagagccacugagg

SEQ ID NO: 414296 - RNA, 19 nt, Homo sapiens
agcaagaugugaaagaaga

SEQ ID NO: 414297 - RNA, 18 nt, Homo sapiens
agcaaggacaaccugccc

SEQ ID NO: 414298 - RNA, 17 nt, Homo sapiens
agcaaggccuugguguu

SEQ ID NO: 414299 - RNA, 20 nt, Homo sapiens
agcaaguauauuuauuucua

SEQ ID NO: 414300 - RNA, 14 nt, Homo sapiens
agcaauacaaagac

SEQ ID NO: 414301 - RNA, 15 nt, Homo sapiens
agcaaugcaaugugg

SEQ ID NO: 414302 - RNA, 19 nt, Homo sapiens
agcaaugggacuggaguca

SEQ ID NO: 414303 - RNA, 16 nt, Homo sapiens
agcaaugugcacuuca

SEQ ID NO: 414304 - RNA, 18 nt, Homo sapiens
agcacaaagguagcuuuu

SEQ ID NO: 414305 - RNA, 18 nt, Homo sapiens
agcacaagucucagggga

SEQ ID NO: 414306 - RNA, 18 nt, Homo sapiens
agcacacugcuugugaaa

SEQ ID NO: 414307 - RNA, 21 nt, Homo sapiens
agcacagcagguuuauccaga

SEQ ID NO: 414308 - RNA, 23 nt, Homo sapiens
agcacaggccauggugcacaaaa

SEQ ID NO: 414309 - RNA, 20 nt, Homo sapiens
agcacauaguguuuaaagac

SEQ ID NO: 414310 - RNA, 23 nt, Homo sapiens
agcacauguugcuaaugacagug

SEQ ID NO: 414311 - RNA, 15 nt, Homo sapiens
agcacauuuugacac

SEQ ID NO: 414312 - RNA, 23 nt, Homo sapiens
agcaccucuuuuugaacagggaa

SEQ ID NO: 414313 - RNA, 16 nt, Homo sapiens
agcaccuugaauggaa

SEQ ID NO: 414314 - RNA, 17 nt, Homo sapiens
agcacuagaucucccuu

SEQ ID NO: 414315 - RNA, 19 nt, Homo sapiens
agcacuauguggagcucag

SEQ ID NO: 414316 - RNA, 13 nt, Homo sapiens
agcacuggucaca

SEQ ID NO: 414317 - RNA, 17 nt, Homo sapiens
agcacugucucaguuuc

SEQ ID NO: 414318 - RNA, 22 nt, Homo sapiens
agcacuguguaaccagcaguca

SEQ ID NO: 414319 - RNA, 18 nt, Homo sapiens
agcacuuugggaggccaa

SEQ ID NO: 414320 - RNA, 15 nt, Homo sapiens
agcagaacuucugaa

SEQ ID NO: 414321 - RNA, 14 nt, Homo sapiens
agcagaauaaugga

SEQ ID NO: 414322 - RNA, 21 nt, Homo sapiens
agcagagagauugaacuuuga

SEQ ID NO: 414323 - RNA, 12 nt, Homo sapiens
agcagagcacug

SEQ ID NO: 414324 - RNA, 17 nt, Homo sapiens
agcagaguucuuugcaa

SEQ ID NO: 414325 - RNA, 12 nt, Homo sapiens
agcagcacuuau

SEQ ID NO: 414326 - RNA, 21 nt, Homo sapiens
agcagcccuaaggaucucuca

SEQ ID NO: 414327 - RNA, 11 nt, Homo sapiens
agcagcugugc

SEQ ID NO: 414328 - RNA, 21 nt, Homo sapiens
agcagcuucaguuguuuuccc

SEQ ID NO: 414329 - RNA, 18 nt, Homo sapiens
agcaggaaccccaggaga

SEQ ID NO: 414330 - RNA, 19 nt, Homo sapiens
agcaggagcagcugugcug

SEQ ID NO: 414331 - RNA, 21 nt, Homo sapiens
agcaggaugugccuguggcau

SEQ ID NO: 414332 - RNA, 21 nt, Homo sapiens
agcaggcccagcuggggcccc

SEQ ID NO: 414333 - RNA, 20 nt, Homo sapiens
agcaggcuggcagcucucca

SEQ ID NO: 414334 - RNA, 17 nt, Homo sapiens
agcaggcuugugcuuua

SEQ ID NO: 414335 - RNA, 13 nt, Homo sapiens
agcagggacaaga

SEQ ID NO: 414336 - RNA, 19 nt, Homo sapiens
agcagggauuaaccucugc

SEQ ID NO: 414337 - RNA, 20 nt, Homo sapiens
agcaggggcagggccugagg

SEQ ID NO: 414338 - RNA, 23 nt, Homo sapiens
agcaggggcauuaguuucaggca

SEQ ID NO: 414339 - RNA, 14 nt, Homo sapiens
agcaguaguggcau

SEQ ID NO: 414340 - RNA, 10 nt, Homo sapiens
agcagucauc

SEQ ID NO: 414341 - RNA, 21 nt, Homo sapiens
agcagucccaguauucucaga

SEQ ID NO: 414342 - RNA, 13 nt, Homo sapiens
agcagugaugaaa

SEQ ID NO: 414343 - RNA, 13 nt, Homo sapiens
agcagugccagcu

SEQ ID NO: 414344 - RNA, 11 nt, Homo sapiens
agcaguguccu

SEQ ID NO: 414345 - RNA, 20 nt, Homo sapiens
agcaguguccugugcuuucu

SEQ ID NO: 414346 - RNA, 21 nt, Homo sapiens
agcaguguccugugcuuucug

SEQ ID NO: 414347 - RNA, 13 nt, Homo sapiens
agcagugugauug

SEQ ID NO: 414348 - RNA, 20 nt, Homo sapiens
agcaguucagcuccuuccac

SEQ ID NO: 414349 - RNA, 20 nt, Homo sapiens
agcauacucuaugugauuua

SEQ ID NO: 414350 - RNA, 15 nt, Homo sapiens
agcaucccccaaagu

SEQ ID NO: 414351 - RNA, 20 nt, Homo sapiens
agcauccucucucacaugga

SEQ ID NO: 414352 - RNA, 16 nt, Homo sapiens
agcaucuaugugagac

SEQ ID NO: 414353 - RNA, 17 nt, Homo sapiens
agcaugaagauaaaucc

SEQ ID NO: 414354 - RNA, 14 nt, Homo sapiens
agcaugauugugac

SEQ ID NO: 414355 - RNA, 13 nt, Homo sapiens
agcaugcacaaag

SEQ ID NO: 414356 - RNA, 22 nt, Homo sapiens
agcaugcucaguuggugcugcu

SEQ ID NO: 414357 - RNA, 22 nt, Homo sapiens
agcaugcuuugcugcuaugaaa

SEQ ID NO: 414358 - RNA, 20 nt, Homo sapiens
agcaugggacugugccuuug

SEQ ID NO: 414359 - RNA, 15 nt, Homo sapiens
agcaugguauuugaa

SEQ ID NO: 414360 - RNA, 20 nt, Homo sapiens
agcaugugccaagauucuac

SEQ ID NO: 414361 - RNA, 15 nt, Homo sapiens
agcaugugggggaag

SEQ ID NO: 414362 - RNA, 15 nt, Homo sapiens
agcauguguauuucc

SEQ ID NO: 414363 - RNA, 10 nt, Homo sapiens
agcaugugug

SEQ ID NO: 414364 - RNA, 20 nt, Homo sapiens
agcaugugugugucucuauc

SEQ ID NO: 414365 - RNA, 22 nt, Homo sapiens
agcaugugugugucucuaucuu

SEQ ID NO: 414366 - RNA, 18 nt, Homo sapiens
agcauucucauuuugcuu

SEQ ID NO: 414367 - RNA, 18 nt, Homo sapiens
agcauugagucauuguca

SEQ ID NO: 414368 - RNA, 18 nt, Homo sapiens
agcauuuccaacaccaca

SEQ ID NO: 414369 - RNA, 22 nt, Homo sapiens
agcauuuccaacaccacagaca

SEQ ID NO: 414370 - RNA, 23 nt, Homo sapiens
agcauuuccaacaccacagacac

SEQ ID NO: 414371 - RNA, 20 nt, Homo sapiens
agccaaagagaaugccauuc

SEQ ID NO: 414372 - RNA, 20 nt, Homo sapiens
agccaaaguuaugcaaggga

SEQ ID NO: 414373 - RNA, 23 nt, Homo sapiens
agccaaauaaaaucuauacauac

SEQ ID NO: 414374 - RNA, 16 nt, Homo sapiens
agccaacauggugaaa

SEQ ID NO: 414375 - RNA, 23 nt, Homo sapiens
agccaacccaacugacuucugcu

SEQ ID NO: 414376 - RNA, 16 nt, Homo sapiens
agccaaccccugugga

SEQ ID NO: 414377 - RNA, 21 nt, Homo sapiens
agccaacucacucuuaugaaa

SEQ ID NO: 414378 - RNA, 20 nt, Homo sapiens
agccaagaauucuuaaauau

SEQ ID NO: 414379 - RNA, 23 nt, Homo sapiens
agccaagggguagaaguggcaua

SEQ ID NO: 414380 - RNA, 17 nt, Homo sapiens
agccaagucagcuuugc

SEQ ID NO: 414381 - RNA, 23 nt, Homo sapiens
agccaagugccuuccguggguca

SEQ ID NO: 414382 - RNA, 20 nt, Homo sapiens
agccaaguucacaccacugc

SEQ ID NO: 414383 - RNA, 16 nt, Homo sapiens
agccaauaggcagcuu

SEQ ID NO: 414384 - RNA, 19 nt, Homo sapiens
agccaauauuuacucauca

SEQ ID NO: 414385 - RNA, 16 nt, Homo sapiens
agccacaacacccagc

SEQ ID NO: 414386 - RNA, 22 nt, Homo sapiens
agccaccaugcccagcucagag

SEQ ID NO: 414387 - RNA, 23 nt, Homo sapiens
agccaccaugcccagcucagagg

SEQ ID NO: 414388 - RNA, 22 nt, Homo sapiens
agccacggaccguugcacaaaa

SEQ ID NO: 414389 - RNA, 18 nt, Homo sapiens
agguucuuagugucacuu

SEQ ID NO: 414390 - RNA, 14 nt, Homo sapiens
agguugaauuaauu

SEQ ID NO: 414391 - RNA, 15 nt, Homo sapiens
agguugcacauucac

SEQ ID NO: 414392 - RNA, 18 nt, Homo sapiens
agguugcacauucacuga

SEQ ID NO: 414393 - RNA, 16 nt, Homo sapiens
agguugcagcugcucu

SEQ ID NO: 414394 - RNA, 16 nt, Homo sapiens
agguugggagccaaau

SEQ ID NO: 414395 - RNA, 23 nt, Homo sapiens
agguugucugaagucacugcaca

SEQ ID NO: 414396 - RNA, 18 nt, Homo sapiens
agguuuaacucagaucac

SEQ ID NO: 414397 - RNA, 21 nt, Homo sapiens
agguuucaccucccaaaccca

SEQ ID NO: 414398 - RNA, 17 nt, Homo sapiens
aguaaaaacacuaccuc

SEQ ID NO: 414399 - RNA, 12 nt, Homo sapiens
aguaaagacagg

SEQ ID NO: 414400 - RNA, 12 nt, Homo sapiens
aguaaagaccau

SEQ ID NO: 414401 - RNA, 18 nt, Homo sapiens
aguaaaggccaugugaag

SEQ ID NO: 414402 - RNA, 23 nt, Homo sapiens
aguaaaugcuagguuaauuccaa

SEQ ID NO: 414403 - RNA, 23 nt, Homo sapiens
aguaacaaugcaugcuuuggaaa

SEQ ID NO: 414404 - RNA, 17 nt, Homo sapiens
aguaacgcgucuuccug

SEQ ID NO: 414405 - RNA, 14 nt, Homo sapiens
aguaaggugcaguu

SEQ ID NO: 414406 - RNA, 19 nt, Homo sapiens
aguaauaaacgucuugcca

SEQ ID NO: 414407 - RNA, 21 nt, Homo sapiens
aguaauagggcuucugccuaa

SEQ ID NO: 414408 - RNA, 18 nt, Homo sapiens
aguaaucucacacuucau

SEQ ID NO: 414409 - RNA, 16 nt, Homo sapiens
aguaauguuaauucuu

SEQ ID NO: 414410 - RNA, 15 nt, Homo sapiens
aguaccaacugagcc

SEQ ID NO: 414411 - RNA, 17 nt, Homo sapiens
aguaccuucaauacuua

SEQ ID NO: 414412 - RNA, 22 nt, Homo sapiens
aguacuaaauucuuaguaaaau

SEQ ID NO: 414413 - RNA, 14 nt, Homo sapiens
aguacuauugcuau

SEQ ID NO: 414414 - RNA, 20 nt, Homo sapiens
aguacucacuaaaaguucuc

SEQ ID NO: 414415 - RNA, 19 nt, Homo sapiens
aguacucacuuuucacuug

SEQ ID NO: 414416 - RNA, 19 nt, Homo sapiens
aguacucucugcucuagcc

SEQ ID NO: 414417 - RNA, 21 nt, Homo sapiens
aguacuuccugcaguacaaga

SEQ ID NO: 414418 - RNA, 17 nt, Homo sapiens
aguacuugagggaccaa

SEQ ID NO: 414419 - RNA, 23 nt, Homo sapiens
aguacuugggaggccaaggcagg

SEQ ID NO: 414420 - RNA, 14 nt, Homo sapiens
aguagagucacugg

SEQ ID NO: 414421 - RNA, 14 nt, Homo sapiens
aguagcacccccag

SEQ ID NO: 414422 - RNA, 21 nt, Homo sapiens
aguagcuggauuacaggcaug

SEQ ID NO: 414423 - RNA, 19 nt, Homo sapiens
aguagcuguggggagcugg

SEQ ID NO: 414424 - RNA, 16 nt, Homo sapiens
aguagcuuuccuccca

SEQ ID NO: 414425 - RNA, 20 nt, Homo sapiens
aguaggucugcacacauaac

SEQ ID NO: 414426 - RNA, 18 nt, Homo sapiens
aguaggugugacuugaac

SEQ ID NO: 414427 - RNA, 19 nt, Homo sapiens
aguagucaaggugcucaau

SEQ ID NO: 414428 - RNA, 19 nt, Homo sapiens
aguaguugguuuccuucac

SEQ ID NO: 414429 - RNA, 17 nt, Homo sapiens
aguauaaauuuguguaa

SEQ ID NO: 414430 - RNA, 14 nt, Homo sapiens
aguauauagccuua

SEQ ID NO: 414431 - RNA, 20 nt, Homo sapiens
aguauauagccuuaagucuu

SEQ ID NO: 414432 - RNA, 17 nt, Homo sapiens
aguaucacugucuuucc

SEQ ID NO: 414433 - RNA, 19 nt, Homo sapiens
aguaucugggaacugugcc

SEQ ID NO: 414434 - RNA, 17 nt, Homo sapiens
aguaucuguaacccuug

SEQ ID NO: 414435 - RNA, 12 nt, Homo sapiens
aguaucuuaccu

SEQ ID NO: 414436 - RNA, 18 nt, Homo sapiens
aguaugaagacacuguca

SEQ ID NO: 414437 - RNA, 15 nt, Homo sapiens
aguauuaacuauuag

SEQ ID NO: 414438 - RNA, 13 nt, Homo sapiens
aguauugagacac

SEQ ID NO: 414439 - RNA, 20 nt, Homo sapiens
aguauugccaccucuggcca

SEQ ID NO: 414440 - RNA, 17 nt, Homo sapiens
aguauuucagaugcuuu

SEQ ID NO: 414441 - RNA, 14 nt, Homo sapiens
aguauuugcuguuu

SEQ ID NO: 414442 - RNA, 21 nt, Homo sapiens
agucaaauauguagauugccu

SEQ ID NO: 414443 - RNA, 20 nt, Homo sapiens
agucaaauuuggauuuucca

SEQ ID NO: 414444 - RNA, 16 nt, Homo sapiens
agucaauucaucuagu

SEQ ID NO: 414445 - RNA, 13 nt, Homo sapiens
agucaauuucuac

SEQ ID NO: 414446 - RNA, 15 nt, Homo sapiens
agucaauuucuacuu

SEQ ID NO: 414447 - RNA, 16 nt, Homo sapiens
agucacccuucugggc

SEQ ID NO: 414448 - RNA, 16 nt, Homo sapiens
agucacguagcacaga

SEQ ID NO: 414449 - RNA, 14 nt, Homo sapiens
agucacugcacagu

SEQ ID NO: 414450 - RNA, 17 nt, Homo sapiens
agucagcuguaccaagc

SEQ ID NO: 414451 - RNA, 21 nt, Homo sapiens
agucaggcuacuaaaauauua

SEQ ID NO: 414452 - RNA, 19 nt, Homo sapiens
agucagggacagcagccuc

SEQ ID NO: 414453 - RNA, 12 nt, Homo sapiens
agucaguugcaa

SEQ ID NO: 414454 - RNA, 18 nt, Homo sapiens
agucaucuccaucagcug

SEQ ID NO: 414455 - RNA, 11 nt, Homo sapiens
agucaucuuug

SEQ ID NO: 414456 - RNA, 21 nt, Homo sapiens
agucauugaaggguguucacc

SEQ ID NO: 414457 - RNA, 15 nt, Homo sapiens
aguccaaccugccug

SEQ ID NO: 414458 - RNA, 17 nt, Homo sapiens
aguccacccccauugug

SEQ ID NO: 414459 - RNA, 18 nt, Homo sapiens
aguccaccugagcugcca

SEQ ID NO: 414460 - RNA, 20 nt, Homo sapiens
aguccacuuuccucucucuc

SEQ ID NO: 414461 - RNA, 22 nt, Homo sapiens
aguccaggagccccagccagcc

SEQ ID NO: 414462 - RNA, 15 nt, Homo sapiens
aguccucugcuaaaa

SEQ ID NO: 414463 - RNA, 19 nt, Homo sapiens
aguccuguuugcagggaag

SEQ ID NO: 414464 - RNA, 20 nt, Homo sapiens
agucgaauguuagauuccuc

SEQ ID NO: 414465 - RNA, 19 nt, Homo sapiens
agucgcaucucagugcagg

SEQ ID NO: 414466 - RNA, 14 nt, Homo sapiens
agucuaaaguuuac

SEQ ID NO: 414467 - RNA, 22 nt, Homo sapiens
agucuacaggccuuucaggaag

SEQ ID NO: 414468 - RNA, 13 nt, Homo sapiens
agucucaaaaaua

SEQ ID NO: 414469 - RNA, 20 nt, Homo sapiens
agucucacccacuaggauag

SEQ ID NO: 414470 - RNA, 17 nt, Homo sapiens
agucucugccacccacu

SEQ ID NO: 414471 - RNA, 14 nt, Homo sapiens
agucugaaauaccu

SEQ ID NO: 414472 - RNA, 14 nt, Homo sapiens
agucugauauugca

SEQ ID NO: 414473 - RNA, 15 nt, Homo sapiens
agucuggugcuccag

SEQ ID NO: 414474 - RNA, 14 nt, Homo sapiens
agucugucuacugu

SEQ ID NO: 414475 - RNA, 16 nt, Homo sapiens
agucuguggacacugu

SEQ ID NO: 414476 - RNA, 17 nt, Homo sapiens
agucuguguguagccag

SEQ ID NO: 414477 - RNA, 11 nt, Homo sapiens
agucuuaacaa

SEQ ID NO: 414478 - RNA, 17 nt, Homo sapiens
agucuuauuuccucaac

SEQ ID NO: 414479 - RNA, 21 nt, Homo sapiens
agucuucuaccaaauguguaa

SEQ ID NO: 414480 - RNA, 20 nt, Homo sapiens
agucuucucauagcauuaac

SEQ ID NO: 414481 - RNA, 18 nt, Homo sapiens
agucuugcucuguugccc

SEQ ID NO: 414482 - RNA, 17 nt, Homo sapiens
agucuuuguuuacauga

SEQ ID NO: 414483 - RNA, 16 nt, Homo sapiens
agugaaaacaucugca

SEQ ID NO: 414484 - RNA, 17 nt, Homo sapiens
agugaaaacaucugcac

SEQ ID NO: 414485 - RNA, 20 nt, Homo sapiens
agugaaaaugccacauuuug

SEQ ID NO: 414486 - RNA, 20 nt, Homo sapiens
agugaaaauuuuauugaaua

SEQ ID NO: 414487 - RNA, 22 nt, Homo sapiens
agugaaagcuuucaugaccaua

SEQ ID NO: 414488 - RNA, 17 nt, Homo sapiens
agugaaaggucaucuca

SEQ ID NO: 414489 - RNA, 14 nt, Homo sapiens
agugaacacacuca

SEQ ID NO: 414490 - RNA, 17 nt, Homo sapiens
agugaacacacucagca

SEQ ID NO: 414491 - RNA, 14 nt, Homo sapiens
agugaacuaugaag

SEQ ID NO: 414492 - RNA, 23 nt, Homo sapiens
agugaagcagccuuacuauucau

SEQ ID NO: 414493 - RNA, 16 nt, Homo sapiens
agugaagcugggagaa

SEQ ID NO: 414494 - RNA, 12 nt, Homo sapiens
agugaaguaauu

SEQ ID NO: 414495 - RNA, 18 nt, Homo sapiens
agugaauaaccacuuaaa

SEQ ID NO: 414496 - RNA, 19 nt, Homo sapiens
agugaaugaaacacucagu

SEQ ID NO: 414497 - RNA, 21 nt, Homo sapiens
agugaaugaguaaauaaacuc

SEQ ID NO: 414498 - RNA, 14 nt, Homo sapiens
agugacacagcagc

SEQ ID NO: 414499 - RNA, 15 nt, Homo sapiens
agugacaugcggcug

SEQ ID NO: 414500 - RNA, 16 nt, Homo sapiens
agugaccccugaccuc

SEQ ID NO: 414501 - RNA, 22 nt, Homo sapiens
agugaccccugaccucacugug

SEQ ID NO: 414502 - RNA, 23 nt, Homo sapiens
agugaccccugaccucacuguga

SEQ ID NO: 414503 - RNA, 16 nt, Homo sapiens
agugacuaguacaaau

SEQ ID NO: 414504 - RNA, 17 nt, Homo sapiens
agugacuguuuggcuua

SEQ ID NO: 414505 - RNA, 19 nt, Homo sapiens
agugacuugaauguacaaa

SEQ ID NO: 414506 - RNA, 21 nt, Homo sapiens
agugaggcugcacccacccag

SEQ ID NO: 414507 - RNA, 21 nt, Homo sapiens
agugauaucccccagccucaa

SEQ ID NO: 414508 - RNA, 12 nt, Homo sapiens
agugauggcauu

SEQ ID NO: 414509 - RNA, 19 nt, Homo sapiens
agugauucuccugccucag

SEQ ID NO: 414510 - RNA, 22 nt, Homo sapiens
agugauugaaccagcucaucuc

SEQ ID NO: 414511 - RNA, 18 nt, Homo sapiens
agugauuugggggugcaa

SEQ ID NO: 414512 - RNA, 18 nt, Homo sapiens
agugcaacagcacuggcu

SEQ ID NO: 414513 - RNA, 16 nt, Homo sapiens
agugcaauugcacaaa

SEQ ID NO: 414514 - RNA, 17 nt, Homo sapiens
agugcacccacucugcu

SEQ ID NO: 414515 - RNA, 18 nt, Homo sapiens
agugcaggagagacagug

SEQ ID NO: 414516 - RNA, 20 nt, Homo sapiens
agugcaguggcgugaucucg

SEQ ID NO: 414517 - RNA, 16 nt, Homo sapiens
agugcaguggugcgau

SEQ ID NO: 414518 - RNA, 20 nt, Homo sapiens
agugcaguggugugaucucg

SEQ ID NO: 414519 - RNA, 16 nt, Homo sapiens
caaggugacugggaug

SEQ ID NO: 414520 - RNA, 23 nt, Homo sapiens
caaggugggccuugcuaccucaa

SEQ ID NO: 414521 - RNA, 21 nt, Homo sapiens
caaguaacaaugcaugcuuug

SEQ ID NO: 414522 - RNA, 21 nt, Homo sapiens
caaguaagaaagugaagcaaa

SEQ ID NO: 414523 - RNA, 17 nt, Homo sapiens
caaguaagaagacauga

SEQ ID NO: 414524 - RNA, 13 nt, Homo sapiens
caaguagcuuucc

SEQ ID NO: 414525 - RNA, 22 nt, Homo sapiens
caaguauauuuauuucuagcaa

SEQ ID NO: 414526 - RNA, 18 nt, Homo sapiens
caagucaugugcauuucc

SEQ ID NO: 414527 - RNA, 15 nt, Homo sapiens
caagucccaucucac

SEQ ID NO: 414528 - RNA, 19 nt, Homo sapiens
caagucccuugaccuuucc

SEQ ID NO: 414529 - RNA, 22 nt, Homo sapiens
caagugagcaaaccugccccau

SEQ ID NO: 414530 - RNA, 19 nt, Homo sapiens
caagugauuugggggugca

SEQ ID NO: 414531 - RNA, 21 nt, Homo sapiens
caagugauuugggggugcaau

SEQ ID NO: 414532 - RNA, 12 nt, Homo sapiens
caaguggcaugu

SEQ ID NO: 414533 - RNA, 21 nt, Homo sapiens
caaguguaugcacgugugcac

SEQ ID NO: 414534 - RNA, 13 nt, Homo sapiens
caagugugugcac

SEQ ID NO: 414535 - RNA, 14 nt, Homo sapiens
caagugugugcaca

SEQ ID NO: 414536 - RNA, 18 nt, Homo sapiens
caagugugugcaugugug

SEQ ID NO: 414537 - RNA, 15 nt, Homo sapiens
caagugugugugcgu

SEQ ID NO: 414538 - RNA, 23 nt, Homo sapiens
caaguuaaagugaauaaccacuu

SEQ ID NO: 414539 - RNA, 13 nt, Homo sapiens
caaguuacaguga

SEQ ID NO: 414540 - RNA, 17 nt, Homo sapiens
caaguuacagugaugcu

SEQ ID NO: 414541 - RNA, 23 nt, Homo sapiens
caaguuauaaaucaaugucacuu

SEQ ID NO: 414542 - RNA, 21 nt, Homo sapiens
caaguuauuaauuucuucaca

SEQ ID NO: 414543 - RNA, 10 nt, Homo sapiens
caaguucaau

SEQ ID NO: 414544 - RNA, 23 nt, Homo sapiens
caaguucacaccacugccauuuc

SEQ ID NO: 414545 - RNA, 17 nt, Homo sapiens
caaguuccgucagucca

SEQ ID NO: 414546 - RNA, 21 nt, Homo sapiens
caaguucuucaccucuaucca

SEQ ID NO: 414547 - RNA, 15 nt, Homo sapiens
caaguugagaacaaa

SEQ ID NO: 414548 - RNA, 16 nt, Homo sapiens
caauaaaacauuccug

SEQ ID NO: 414549 - RNA, 19 nt, Homo sapiens
caauaaaagugacucucag

SEQ ID NO: 414550 - RNA, 14 nt, Homo sapiens
caauaaacauccuu

SEQ ID NO: 414551 - RNA, 17 nt, Homo sapiens
caauaaacgaaacacag

SEQ ID NO: 414552 - RNA, 17 nt, Homo sapiens
caauaaauaaucuguac

SEQ ID NO: 414553 - RNA, 13 nt, Homo sapiens
caauaaauuggaa

SEQ ID NO: 414554 - RNA, 17 nt, Homo sapiens
caauaaauuggaacacc

SEQ ID NO: 414555 - RNA, 19 nt, Homo sapiens
caauaacacugcuuauaaa

SEQ ID NO: 414556 - RNA, 16 nt, Homo sapiens
caauaauucuguauua

SEQ ID NO: 414557 - RNA, 16 nt, Homo sapiens
caauaccguaacaaug

SEQ ID NO: 414558 - RNA, 14 nt, Homo sapiens
caauaggacaaaac

SEQ ID NO: 414559 - RNA, 20 nt, Homo sapiens
caauaggcagcuuucuuaac

SEQ ID NO: 414560 - RNA, 20 nt, Homo sapiens
caauagggugcaguuuucca

SEQ ID NO: 414561 - RNA, 22 nt, Homo sapiens
caauauguauagcauauggagu

SEQ ID NO: 414562 - RNA, 15 nt, Homo sapiens
caauauuaccaucuu

SEQ ID NO: 414563 - RNA, 17 nt, Homo sapiens
caauauuccuaugcugc

SEQ ID NO: 414564 - RNA, 16 nt, Homo sapiens
caauauuuacucauca

SEQ ID NO: 414565 - RNA, 15 nt, Homo sapiens
caauauuuauuucca

SEQ ID NO: 414566 - RNA, 22 nt, Homo sapiens
caaucaauucauaucuauuuau

SEQ ID NO: 414567 - RNA, 22 nt, Homo sapiens
caaucaugaaauaugcaucuca

SEQ ID NO: 414568 - RNA, 16 nt, Homo sapiens
caauccuggcucugug

SEQ ID NO: 414569 - RNA, 12 nt, Homo sapiens
caauccugugga

SEQ ID NO: 414570 - RNA, 18 nt, Homo sapiens
caauccuuuauagcuuug

SEQ ID NO: 414571 - RNA, 18 nt, Homo sapiens
caaucuaagggagucauu

SEQ ID NO: 414572 - RNA, 18 nt, Homo sapiens
caaucuccccuugcacua

SEQ ID NO: 414573 - RNA, 12 nt, Homo sapiens
caaugaaaccuu

SEQ ID NO: 414574 - RNA, 13 nt, Homo sapiens
caaugaaaccuuc

SEQ ID NO: 414575 - RNA, 15 nt, Homo sapiens
caaugacacagucuu

SEQ ID NO: 414576 - RNA, 13 nt, Homo sapiens
caaugacaucucc

SEQ ID NO: 414577 - RNA, 12 nt, Homo sapiens
caaugacuguga

SEQ ID NO: 414578 - RNA, 11 nt, Homo sapiens
caaugaucuag

SEQ ID NO: 414579 - RNA, 12 nt, Homo sapiens
caaugauucaua

SEQ ID NO: 414580 - RNA, 16 nt, Homo sapiens
caaugcaaacaucuuc

SEQ ID NO: 414581 - RNA, 15 nt, Homo sapiens
caaugcaauguggaa

SEQ ID NO: 414582 - RNA, 17 nt, Homo sapiens
caaugcaugcuuuggaa

SEQ ID NO: 414583 - RNA, 15 nt, Homo sapiens
caaugcuauggacug

SEQ ID NO: 414584 - RNA, 16 nt, Homo sapiens
caaugcuuugaucccu

SEQ ID NO: 414585 - RNA, 17 nt, Homo sapiens
caaugcuuuguccauga

SEQ ID NO: 414586 - RNA, 18 nt, Homo sapiens
caaugugaaaaauguguc

SEQ ID NO: 414587 - RNA, 14 nt, Homo sapiens
caaugugaguccca

SEQ ID NO: 414588 - RNA, 23 nt, Homo sapiens
caaugugauauguguaauaucau

SEQ ID NO: 414589 - RNA, 21 nt, Homo sapiens
caaugugauucuaaugucuuc

SEQ ID NO: 414590 - RNA, 14 nt, Homo sapiens
caaugugcacugaa

SEQ ID NO: 414591 - RNA, 15 nt, Homo sapiens
caaugugcacugaau

SEQ ID NO: 414592 - RNA, 15 nt, Homo sapiens
caaugugcacuucac

SEQ ID NO: 414593 - RNA, 23 nt, Homo sapiens
caaugugcuguugauucuuucaa

SEQ ID NO: 414594 - RNA, 13 nt, Homo sapiens
caauguucuauua

SEQ ID NO: 414595 - RNA, 18 nt, Homo sapiens
caauuaaguccuacuuua

SEQ ID NO: 414596 - RNA, 19 nt, Homo sapiens
caauuacaggaaguacugg

SEQ ID NO: 414597 - RNA, 22 nt, Homo sapiens
caauuacuccaccaucaccucu

SEQ ID NO: 414598 - RNA, 16 nt, Homo sapiens
caauuauuacauuuau

SEQ ID NO: 414599 - RNA, 23 nt, Homo sapiens
caauucagagaauagcaguuuca

SEQ ID NO: 414600 - RNA, 20 nt, Homo sapiens
caauucaguuuuaguuucaa

SEQ ID NO: 414601 - RNA, 16 nt, Homo sapiens
caauucuuuguugcuu

SEQ ID NO: 414602 - RNA, 19 nt, Homo sapiens
caauugaccuucucccuca

SEQ ID NO: 414603 - RNA, 15 nt, Homo sapiens
caauugcacugcugu

SEQ ID NO: 414604 - RNA, 15 nt, Homo sapiens
caauugggagagaaa

SEQ ID NO: 414605 - RNA, 23 nt, Homo sapiens
caauuuagauuuuucucaucucc

SEQ ID NO: 414606 - RNA, 19 nt, Homo sapiens
caauuuauccaacccauuu

SEQ ID NO: 414607 - RNA, 19 nt, Homo sapiens
caauuuguucagucuuuca

SEQ ID NO: 414608 - RNA, 23 nt, Homo sapiens
caauuuuaaaaaauaacauauuc

SEQ ID NO: 414609 - RNA, 20 nt, Homo sapiens
caauuuuuuuauacuaccaa

SEQ ID NO: 414610 - RNA, 22 nt, Homo sapiens
caauuuuuuuucuguaaaugga

SEQ ID NO: 414611 - RNA, 20 nt, Homo sapiens
cacaaaauacagcacuuuga

SEQ ID NO: 414612 - RNA, 18 nt, Homo sapiens
cacaaaaugauaaucaau

SEQ ID NO: 414613 - RNA, 17 nt, Homo sapiens
cacaaaauguacccagu

SEQ ID NO: 414614 - RNA, 18 nt, Homo sapiens
cacaaagcccuuccaugu

SEQ ID NO: 414615 - RNA, 12 nt, Homo sapiens
cacaaauaugcu

SEQ ID NO: 414616 - RNA, 15 nt, Homo sapiens
cacaaaugaccgcac

SEQ ID NO: 414617 - RNA, 15 nt, Homo sapiens
cacaaaugcagacac

SEQ ID NO: 414618 - RNA, 12 nt, Homo sapiens
cacaaccacuca

SEQ ID NO: 414619 - RNA, 21 nt, Homo sapiens
cacaagaccccugcuccugac

SEQ ID NO: 414620 - RNA, 22 nt, Homo sapiens
cacaagcgaaucucugccuuuc

SEQ ID NO: 414621 - RNA, 12 nt, Homo sapiens
cacaagcucaga

SEQ ID NO: 414622 - RNA, 14 nt, Homo sapiens
cacaaguccuguga

SEQ ID NO: 414623 - RNA, 17 nt, Homo sapiens
cacaauauuccuaugcu

SEQ ID NO: 414624 - RNA, 16 nt, Homo sapiens
cacaauucauuuaccc

SEQ ID NO: 414625 - RNA, 15 nt, Homo sapiens
cacacaaacaccucc

SEQ ID NO: 414626 - RNA, 16 nt, Homo sapiens
cacacaaaugcagaca

SEQ ID NO: 414627 - RNA, 11 nt, Homo sapiens
cacacacagcu

SEQ ID NO: 414628 - RNA, 21 nt, Homo sapiens
cacacacccagcuugugccug

SEQ ID NO: 414629 - RNA, 13 nt, Homo sapiens
cacacaccugccu

SEQ ID NO: 414630 - RNA, 14 nt, Homo sapiens
cacacaguggcacu

SEQ ID NO: 414631 - RNA, 12 nt, Homo sapiens
cacacaucucau

SEQ ID NO: 414632 - RNA, 16 nt, Homo sapiens
cacaccaguuacuguu

SEQ ID NO: 414633 - RNA, 20 nt, Homo sapiens
cacacccgccgccuccugca

SEQ ID NO: 414634 - RNA, 21 nt, Homo sapiens
cacaccucccacccccuguau

SEQ ID NO: 414635 - RNA, 20 nt, Homo sapiens
cacaccuugcccaugcacaa

SEQ ID NO: 414636 - RNA, 15 nt, Homo sapiens
cacacgccuguaauc

SEQ ID NO: 414637 - RNA, 18 nt, Homo sapiens
cacacggggcacccagcc

SEQ ID NO: 414638 - RNA, 15 nt, Homo sapiens
cacacucacagaugu

SEQ ID NO: 414639 - RNA, 20 nt, Homo sapiens
cacacuccuccaaggcacaa

SEQ ID NO: 414640 - RNA, 20 nt, Homo sapiens
cacacucucuucuuacugua

SEQ ID NO: 414641 - RNA, 13 nt, Homo sapiens
cacacugaccaca

SEQ ID NO: 414642 - RNA, 17 nt, Homo sapiens
cacacugaguuugaaca

SEQ ID NO: 414643 - RNA, 12 nt, Homo sapiens
cacacugggacu

SEQ ID NO: 414644 - RNA, 12 nt, Homo sapiens
cacacuguggaa

SEQ ID NO: 414645 - RNA, 20 nt, Homo sapiens
cacacuucuugaaacagccu

SEQ ID NO: 414646 - RNA, 20 nt, Homo sapiens
cacacuuggaugcaggguuu

SEQ ID NO: 414647 - RNA, 14 nt, Homo sapiens
cacacuuguccaca

SEQ ID NO: 414648 - RNA, 15 nt, Homo sapiens
cacacuuucugacug

SEQ ID NO: 414649 - RNA, 19 nt, Homo sapiens
cacacuuucugacugcaac

SEQ ID NO: 414650 - RNA, 15 nt, Homo sapiens
cagcgagcugugcaa

SEQ ID NO: 414651 - RNA, 19 nt, Homo sapiens
cagcggcuucaagagccag

SEQ ID NO: 414652 - RNA, 17 nt, Homo sapiens
cagcgucacaucugcag

SEQ ID NO: 414653 - RNA, 16 nt, Homo sapiens
cagcgucccagucucu

SEQ ID NO: 414654 - RNA, 21 nt, Homo sapiens
cagcguccggggugguggaca

SEQ ID NO: 414655 - RNA, 21 nt, Homo sapiens
cagcguggccuccgugaccca

SEQ ID NO: 414656 - RNA, 21 nt, Homo sapiens
cagcuaacauggaaguacuau

SEQ ID NO: 414657 - RNA, 15 nt, Homo sapiens
cagcuacauuccuca

SEQ ID NO: 414658 - RNA, 17 nt, Homo sapiens
cagcuaggcugagaugc

SEQ ID NO: 414659 - RNA, 20 nt, Homo sapiens
cagcuaugcaaaucagucuc

SEQ ID NO: 414660 - RNA, 22 nt, Homo sapiens
cagcucaaagaguaaaacauuu

SEQ ID NO: 414661 - RNA, 17 nt, Homo sapiens
cagcucaccaacuacag

SEQ ID NO: 414662 - RNA, 15 nt, Homo sapiens
cagcuccacaguguu

SEQ ID NO: 414663 - RNA, 18 nt, Homo sapiens
cagcuccauccuugcauc

SEQ ID NO: 414664 - RNA, 15 nt, Homo sapiens
cagcucccaucucau

SEQ ID NO: 414665 - RNA, 16 nt, Homo sapiens
cagcucccuucucugu

SEQ ID NO: 414666 - RNA, 12 nt, Homo sapiens
cagcuccuagua

SEQ ID NO: 414667 - RNA, 18 nt, Homo sapiens
cagcucuguguugccaug

SEQ ID NO: 414668 - RNA, 22 nt, Homo sapiens
cagcugaaaaguaaauugccuu

SEQ ID NO: 414669 - RNA, 22 nt, Homo sapiens
cagcugaaagauugauuaauga

SEQ ID NO: 414670 - RNA, 17 nt, Homo sapiens
cagcugccaagugcucu

SEQ ID NO: 414671 - RNA, 14 nt, Homo sapiens
cagcugccagagaa

SEQ ID NO: 414672 - RNA, 19 nt, Homo sapiens
cagcugccucugccacuga

SEQ ID NO: 414673 - RNA, 20 nt, Homo sapiens
cagcugccucugccacugac

SEQ ID NO: 414674 - RNA, 19 nt, Homo sapiens
cagcugcuuccugcacaua

SEQ ID NO: 414675 - RNA, 15 nt, Homo sapiens
cagcugggauuugaa

SEQ ID NO: 414676 - RNA, 17 nt, Homo sapiens
cagcuggggagcagcug

SEQ ID NO: 414677 - RNA, 17 nt, Homo sapiens
cagcuggggcugaguga

SEQ ID NO: 414678 - RNA, 17 nt, Homo sapiens
cagcuggugucaguccc

SEQ ID NO: 414679 - RNA, 22 nt, Homo sapiens
cagcuguaagaagagacuggga

SEQ ID NO: 414680 - RNA, 23 nt, Homo sapiens
cagcugugaacauggacucuucc

SEQ ID NO: 414681 - RNA, 13 nt, Homo sapiens
cagcugugcugca

SEQ ID NO: 414682 - RNA, 13 nt, Homo sapiens
cagcugugcugua

SEQ ID NO: 414683 - RNA, 17 nt, Homo sapiens
cagcugugcuguaacac

SEQ ID NO: 414684 - RNA, 13 nt, Homo sapiens
cagcuguggugag

SEQ ID NO: 414685 - RNA, 22 nt, Homo sapiens
cagcugugguuuucuuuugcca

SEQ ID NO: 414686 - RNA, 15 nt, Homo sapiens
cagcuguguucacac

SEQ ID NO: 414687 - RNA, 23 nt, Homo sapiens
cagcuguguucacacuguaaaca

SEQ ID NO: 414688 - RNA, 19 nt, Homo sapiens
cagcuguuacuuucuuuca

SEQ ID NO: 414689 - RNA, 16 nt, Homo sapiens
cagcuguuagagucca

SEQ ID NO: 414690 - RNA, 20 nt, Homo sapiens
cagcuucuuuacuacugcaa

SEQ ID NO: 414691 - RNA, 22 nt, Homo sapiens
caggaagaccaaggccucggca

SEQ ID NO: 414692 - RNA, 18 nt, Homo sapiens
caggaagaguucuauccc

SEQ ID NO: 414693 - RNA, 21 nt, Homo sapiens
caggaagggcaggaaggagag

SEQ ID NO: 414694 - RNA, 14 nt, Homo sapiens
caggaauacauuug

SEQ ID NO: 414695 - RNA, 21 nt, Homo sapiens
caggaauaggcauuugccuaa

SEQ ID NO: 414696 - RNA, 21 nt, Homo sapiens
caggacacgacuuguaaugaa

SEQ ID NO: 414697 - RNA, 22 nt, Homo sapiens
caggacagcugcaggugcccau

SEQ ID NO: 414698 - RNA, 12 nt, Homo sapiens
caggacaucucu

SEQ ID NO: 414699 - RNA, 19 nt, Homo sapiens
caggacgauuucacugaca

SEQ ID NO: 414700 - RNA, 18 nt, Homo sapiens
caggacugugacucauuc

SEQ ID NO: 414701 - RNA, 20 nt, Homo sapiens
caggacuuccauuugcuuug

SEQ ID NO: 414702 - RNA, 17 nt, Homo sapiens
caggagaaccacuacau

SEQ ID NO: 414703 - RNA, 18 nt, Homo sapiens
caggagaaucacuggaac

SEQ ID NO: 414704 - RNA, 15 nt, Homo sapiens
caggagaaugugcag

SEQ ID NO: 414705 - RNA, 14 nt, Homo sapiens
caggagacugaguu

SEQ ID NO: 414706 - RNA, 13 nt, Homo sapiens
caggagacuggca

SEQ ID NO: 414707 - RNA, 18 nt, Homo sapiens
caggagagagagagagaa

SEQ ID NO: 414708 - RNA, 15 nt, Homo sapiens
caggagagcugcagu

SEQ ID NO: 414709 - RNA, 23 nt, Homo sapiens
caggagagugcagaucugugcuc

SEQ ID NO: 414710 - RNA, 15 nt, Homo sapiens
caggagaugcugcag

SEQ ID NO: 414711 - RNA, 12 nt, Homo sapiens
caggagcucaga

SEQ ID NO: 414712 - RNA, 17 nt, Homo sapiens
caggaggaacuggucca

SEQ ID NO: 414713 - RNA, 15 nt, Homo sapiens
caggaggcugaggca

SEQ ID NO: 414714 - RNA, 21 nt, Homo sapiens
caggagggguuaaagcugccg

SEQ ID NO: 414715 - RNA, 14 nt, Homo sapiens
caggagguggguga

SEQ ID NO: 414716 - RNA, 21 nt, Homo sapiens
caggagucucugccacccacu

SEQ ID NO: 414717 - RNA, 20 nt, Homo sapiens
caggaguguggccacguggg

SEQ ID NO: 414718 - RNA, 17 nt, Homo sapiens
caggaguuguugaacua

SEQ ID NO: 414719 - RNA, 16 nt, Homo sapiens
caggauauugacaaga

SEQ ID NO: 414720 - RNA, 18 nt, Homo sapiens
caggauccagaagggguu

SEQ ID NO: 414721 - RNA, 14 nt, Homo sapiens
caggaucugaguua

SEQ ID NO: 414722 - RNA, 16 nt, Homo sapiens
caggauuucuaaucaa

SEQ ID NO: 414723 - RNA, 17 nt, Homo sapiens
caggauuuuaaauuaca

SEQ ID NO: 414724 - RNA, 22 nt, Homo sapiens
caggauuuuagugcuugccacc

SEQ ID NO: 414725 - RNA, 24 nt, Homo sapiens
caggcaacgugcgugucucugcca

SEQ ID NO: 414726 - RNA, 16 nt, Homo sapiens
caggcagacacaugcu

SEQ ID NO: 414727 - RNA, 20 nt, Homo sapiens
caggcagaucugugccccau

SEQ ID NO: 414728 - RNA, 19 nt, Homo sapiens
caggcaggcccugccuuca

SEQ ID NO: 414729 - RNA, 20 nt, Homo sapiens
caggcagucuuugcucagug

SEQ ID NO: 414730 - RNA, 16 nt, Homo sapiens
caggcaugcaagugag

SEQ ID NO: 414731 - RNA, 22 nt, Homo sapiens
caggccacugcaaacccugcug

SEQ ID NO: 414732 - RNA, 19 nt, Homo sapiens
caggccaggagacuguuaa

SEQ ID NO: 414733 - RNA, 17 nt, Homo sapiens
caggccccuuaccugca

SEQ ID NO: 414734 - RNA, 22 nt, Homo sapiens
caggcccggcccagccuaggcc

SEQ ID NO: 414735 - RNA, 23 nt, Homo sapiens
caggcccucccugucuccagggc

SEQ ID NO: 414736 - RNA, 18 nt, Homo sapiens
caggcccuuccucuccac

SEQ ID NO: 414737 - RNA, 18 nt, Homo sapiens
caggccggccagccucac

SEQ ID NO: 414738 - RNA, 14 nt, Homo sapiens
caggccugaccuca

SEQ ID NO: 414739 - RNA, 19 nt, Homo sapiens
caggcgauucuccugccuc

SEQ ID NO: 414740 - RNA, 13 nt, Homo sapiens
caggcgugaucca

SEQ ID NO: 414741 - RNA, 18 nt, Homo sapiens
caggcugaucgggcaaug

SEQ ID NO: 414742 - RNA, 20 nt, Homo sapiens
caggcugcagucccuggaaa

SEQ ID NO: 414743 - RNA, 16 nt, Homo sapiens
caggcuggagugcaau

SEQ ID NO: 414744 - RNA, 20 nt, Homo sapiens
caggcuggagugcaguggca

SEQ ID NO: 414745 - RNA, 19 nt, Homo sapiens
caggcuguaagcauucuga

SEQ ID NO: 414746 - RNA, 15 nt, Homo sapiens
caggcuuuuuuccag

SEQ ID NO: 414747 - RNA, 14 nt, Homo sapiens
cagggaacugggaa

SEQ ID NO: 414748 - RNA, 16 nt, Homo sapiens
cagggaagagggcagu

SEQ ID NO: 414749 - RNA, 17 nt, Homo sapiens
cagggaagagggcagua

SEQ ID NO: 414750 - RNA, 19 nt, Homo sapiens
cagggaagcugucccucac

SEQ ID NO: 414751 - RNA, 18 nt, Homo sapiens
cagggaagugacaggacu

SEQ ID NO: 414752 - RNA, 22 nt, Homo sapiens
cagggaagugacaggacuuuca

SEQ ID NO: 414753 - RNA, 23 nt, Homo sapiens
cagggaaguggggaaguguucca

SEQ ID NO: 414754 - RNA, 18 nt, Homo sapiens
cagggagugaugauuugg

SEQ ID NO: 414755 - RNA, 17 nt, Homo sapiens
cagggagugggagccaa

SEQ ID NO: 414756 - RNA, 20 nt, Homo sapiens
cagggaugccaacaccuucu

SEQ ID NO: 414757 - RNA, 13 nt, Homo sapiens
cagggaugccauc

SEQ ID NO: 414758 - RNA, 20 nt, Homo sapiens
cagggauggggccacagcca

SEQ ID NO: 414759 - RNA, 15 nt, Homo sapiens
cagggcaaucaucua

SEQ ID NO: 414760 - RNA, 18 nt, Homo sapiens
cagggcauuuugguccaa

SEQ ID NO: 414761 - RNA, 13 nt, Homo sapiens
cagggccuugaca

SEQ ID NO: 414762 - RNA, 20 nt, Homo sapiens
cagggcgagacuccgucuca

SEQ ID NO: 414763 - RNA, 13 nt, Homo sapiens
cagggcuagugac

SEQ ID NO: 414764 - RNA, 20 nt, Homo sapiens
cagggcuggagucaaaacac

SEQ ID NO: 414765 - RNA, 11 nt, Homo sapiens
cagggcuguga

SEQ ID NO: 414766 - RNA, 15 nt, Homo sapiens
cagggcuuaccugua

SEQ ID NO: 414767 - RNA, 18 nt, Homo sapiens
caggggaaaaugaagguu

SEQ ID NO: 414768 - RNA, 21 nt, Homo sapiens
caggggagaaacgaaaaccac

SEQ ID NO: 414769 - RNA, 13 nt, Homo sapiens
caggggcucugcu

SEQ ID NO: 414770 - RNA, 18 nt, Homo sapiens
caggguagacuuggagcu

SEQ ID NO: 414771 - RNA, 12 nt, Homo sapiens
cagggucugcuc

SEQ ID NO: 414772 - RNA, 20 nt, Homo sapiens
cagggucugcucuuucucug

SEQ ID NO: 414773 - RNA, 18 nt, Homo sapiens
cagggucuuuacugggaa

SEQ ID NO: 414774 - RNA, 17 nt, Homo sapiens
caggguugaaucuuguc

SEQ ID NO: 414775 - RNA, 20 nt, Homo sapiens
caggguuucaccauguuggc

SEQ ID NO: 414776 - RNA, 14 nt, Homo sapiens
cagguaaugugaau

SEQ ID NO: 414777 - RNA, 15 nt, Homo sapiens
caggugaaaauccau

SEQ ID NO: 414778 - RNA, 19 nt, Homo sapiens
caggugaaaauccaucuca

SEQ ID NO: 414779 - RNA, 21 nt, Homo sapiens
cauuuccccugugguuuguua

SEQ ID NO: 414780 - RNA, 17 nt, Homo sapiens
cauuuccgaagaccuuc

SEQ ID NO: 414781 - RNA, 14 nt, Homo sapiens
cauuucuaucacau

SEQ ID NO: 414782 - RNA, 20 nt, Homo sapiens
cauuucucuacacuaagggg

SEQ ID NO: 414783 - RNA, 17 nt, Homo sapiens
cauuucugaugucucca

SEQ ID NO: 414784 - RNA, 17 nt, Homo sapiens
cauuugacuuucugucu

SEQ ID NO: 414785 - RNA, 15 nt, Homo sapiens
cauuugccuaauucc

SEQ ID NO: 414786 - RNA, 14 nt, Homo sapiens
cauuugcucuuuca

SEQ ID NO: 414787 - RNA, 21 nt, Homo sapiens
cauuugcugaauaacaacaau

SEQ ID NO: 414788 - RNA, 18 nt, Homo sapiens
cauuugcugaauaugcaa

SEQ ID NO: 414789 - RNA, 21 nt, Homo sapiens
cauuuggugguacuuuauucu

SEQ ID NO: 414790 - RNA, 12 nt, Homo sapiens
cauuugugucaa

SEQ ID NO: 414791 - RNA, 16 nt, Homo sapiens
cauuugugugcucaug

SEQ ID NO: 414792 - RNA, 23 nt, Homo sapiens
cauuugugugugugcaagugugu

SEQ ID NO: 414793 - RNA, 15 nt, Homo sapiens
cauuuuagugacugu

SEQ ID NO: 414794 - RNA, 12 nt, Homo sapiens
cauuuucaccuc

SEQ ID NO: 414795 - RNA, 12 nt, Homo sapiens
cauuuucuacau

SEQ ID NO: 414796 - RNA, 18 nt, Homo sapiens
cauuuucuugucaaugga

SEQ ID NO: 414797 - RNA, 19 nt, Homo sapiens
cauuuugaaugugaucauc

SEQ ID NO: 414798 - RNA, 20 nt, Homo sapiens
cauuuugacacaauguugca

SEQ ID NO: 414799 - RNA, 13 nt, Homo sapiens
cauuuugcaaaau

SEQ ID NO: 414800 - RNA, 19 nt, Homo sapiens
cauuuuggcgcuauuacaa

SEQ ID NO: 414801 - RNA, 18 nt, Homo sapiens
cauuuuguaacugccuac

SEQ ID NO: 414802 - RNA, 14 nt, Homo sapiens
cauuuuuagcuccu

SEQ ID NO: 414803 - RNA, 18 nt, Homo sapiens
cauuuuuaucccauugag

SEQ ID NO: 414804 - RNA, 15 nt, Homo sapiens
cauuuuucuacugcu

SEQ ID NO: 414805 - RNA, 15 nt, Homo sapiens
cauuuuuuguucugu

SEQ ID NO: 414806 - RNA, 19 nt, Homo sapiens
ccaaaaaaauaaagcauua

SEQ ID NO: 414807 - RNA, 18 nt, Homo sapiens
ccaaaaaagaugccaaca

SEQ ID NO: 414808 - RNA, 20 nt, Homo sapiens
ccaaaaaaugcuugcuucaa

SEQ ID NO: 414809 - RNA, 18 nt, Homo sapiens
ccaaaaacuaaaauucaa

SEQ ID NO: 414810 - RNA, 18 nt, Homo sapiens
ccaaaaccacagcccugu

SEQ ID NO: 414811 - RNA, 13 nt, Homo sapiens
ccaaaauccgacu

SEQ ID NO: 414812 - RNA, 16 nt, Homo sapiens
ccaaaaucuuaucaug

SEQ ID NO: 414813 - RNA, 16 nt, Homo sapiens
ccaaacauguaucucu

SEQ ID NO: 414814 - RNA, 16 nt, Homo sapiens
ccaaacccagccucua

SEQ ID NO: 414815 - RNA, 22 nt, Homo sapiens
ccaaacccagccucuagaacag

SEQ ID NO: 414816 - RNA, 12 nt, Homo sapiens
ccaaacuccugc

SEQ ID NO: 414817 - RNA, 18 nt, Homo sapiens
ccaaacugggggcucugu

SEQ ID NO: 414818 - RNA, 21 nt, Homo sapiens
ccaaagaccugccugugugcu

SEQ ID NO: 414819 - RNA, 16 nt, Homo sapiens
ccaaagacuguacugg

SEQ ID NO: 414820 - RNA, 17 nt, Homo sapiens
ccaaagagaaugccauu

SEQ ID NO: 414821 - RNA, 19 nt, Homo sapiens
ccaaagagaaugccauucu

SEQ ID NO: 414822 - RNA, 14 nt, Homo sapiens
ccaaagcagcacuu

SEQ ID NO: 414823 - RNA, 23 nt, Homo sapiens
ccaaaggauagugcgauguuuca

SEQ ID NO: 414824 - RNA, 18 nt, Homo sapiens
ccaaaguuugcucaagga

SEQ ID NO: 414825 - RNA, 14 nt, Homo sapiens
ccaaauacauucca

SEQ ID NO: 414826 - RNA, 23 nt, Homo sapiens
ccaaaugacaagucacacccucc

SEQ ID NO: 414827 - RNA, 18 nt, Homo sapiens
ccaaaugacuucauuucu

SEQ ID NO: 414828 - RNA, 15 nt, Homo sapiens
ccaaaugcagggagg

SEQ ID NO: 414829 - RNA, 15 nt, Homo sapiens
ccaaauuacagcaua

SEQ ID NO: 414830 - RNA, 16 nt, Homo sapiens
ccaaauuaucaagcua

SEQ ID NO: 414831 - RNA, 11 nt, Homo sapiens
ccaaauucuga

SEQ ID NO: 414832 - RNA, 15 nt, Homo sapiens
ccaacaauacuuugu

SEQ ID NO: 414833 - RNA, 13 nt, Homo sapiens
ccaacaccacaga

SEQ ID NO: 414834 - RNA, 21 nt, Homo sapiens
ccaacacugcugcuccagugc

SEQ ID NO: 414835 - RNA, 11 nt, Homo sapiens
ccaacacuuca

SEQ ID NO: 414836 - RNA, 12 nt, Homo sapiens
ccaacacuuugg

SEQ ID NO: 414837 - RNA, 23 nt, Homo sapiens
ccaacgaaaagcacauccaggca

SEQ ID NO: 414838 - RNA, 15 nt, Homo sapiens
ccaacgggaagcaac

SEQ ID NO: 414839 - RNA, 23 nt, Homo sapiens
ccaacguggggcagcacagagag

SEQ ID NO: 414840 - RNA, 16 nt, Homo sapiens
ccaacucacugugcuc

SEQ ID NO: 414841 - RNA, 15 nt, Homo sapiens
ccaacucugcacucc

SEQ ID NO: 414842 - RNA, 16 nt, Homo sapiens
ccaacucugcacucca

SEQ ID NO: 414843 - RNA, 21 nt, Homo sapiens
ccaacugagccaaaaacaaua

SEQ ID NO: 414844 - RNA, 22 nt, Homo sapiens
ccaacuuuguggaugucuuccu

SEQ ID NO: 414845 - RNA, 15 nt, Homo sapiens
ccaagacaguggcag

SEQ ID NO: 414846 - RNA, 11 nt, Homo sapiens
ccaagcagcuu

SEQ ID NO: 414847 - RNA, 23 nt, Homo sapiens
ccaagcuggagugcaguggugcg

SEQ ID NO: 414848 - RNA, 18 nt, Homo sapiens
ccaagcuggccacuauca

SEQ ID NO: 414849 - RNA, 12 nt, Homo sapiens
ccaagcuuucuu

SEQ ID NO: 414850 - RNA, 16 nt, Homo sapiens
ccaaggcaguguuccu

SEQ ID NO: 414851 - RNA, 21 nt, Homo sapiens
ccaaggccuucuccuccccac

SEQ ID NO: 414852 - RNA, 19 nt, Homo sapiens
ccaagggacaguggucuaa

SEQ ID NO: 414853 - RNA, 20 nt, Homo sapiens
ccaagggcuccagggccagg

SEQ ID NO: 414854 - RNA, 20 nt, Homo sapiens
ccaaggguaugggaagccau

SEQ ID NO: 414855 - RNA, 21 nt, Homo sapiens
ccaaggguaugggaagccaua

SEQ ID NO: 414856 - RNA, 16 nt, Homo sapiens
ccaagguaaacaguuu

SEQ ID NO: 414857 - RNA, 18 nt, Homo sapiens
ccaagguaaacaguuuga

SEQ ID NO: 414858 - RNA, 22 nt, Homo sapiens
ccaaggucagcucccaucucau

SEQ ID NO: 414859 - RNA, 23 nt, Homo sapiens
ccaaguccaggucgggcucagcu

SEQ ID NO: 414860 - RNA, 12 nt, Homo sapiens
ccaagucuuccu

SEQ ID NO: 414861 - RNA, 21 nt, Homo sapiens
ccaagugaccauaaaggcaug

SEQ ID NO: 414862 - RNA, 17 nt, Homo sapiens
ccaagugugugugcgug

SEQ ID NO: 414863 - RNA, 24 nt, Homo sapiens
ccaaguuccacuuuucugcaggua

SEQ ID NO: 414864 - RNA, 17 nt, Homo sapiens
ccaaguucuucaccucu

SEQ ID NO: 414865 - RNA, 18 nt, Homo sapiens
ccaaguugaagacuuugu

SEQ ID NO: 414866 - RNA, 22 nt, Homo sapiens
ccaaguuuugaaaggcuuuccu

SEQ ID NO: 414867 - RNA, 19 nt, Homo sapiens
ccaauauuucucagacauc

SEQ ID NO: 414868 - RNA, 14 nt, Homo sapiens
ccaaucccgugaaa

SEQ ID NO: 414869 - RNA, 15 nt, Homo sapiens
ccaauccuuuccacc

SEQ ID NO: 414870 - RNA, 20 nt, Homo sapiens
ccaaugaagcaaacacacag

SEQ ID NO: 414871 - RNA, 13 nt, Homo sapiens
ccaaugauucaua

SEQ ID NO: 414872 - RNA, 16 nt, Homo sapiens
ccaaugccacagccaa

SEQ ID NO: 414873 - RNA, 16 nt, Homo sapiens
ccaauggcggacucaa

SEQ ID NO: 414874 - RNA, 15 nt, Homo sapiens
ccaauuaaacccaga

SEQ ID NO: 414875 - RNA, 18 nt, Homo sapiens
ccaauuagcauuccauca

SEQ ID NO: 414876 - RNA, 18 nt, Homo sapiens
ccaauugcccugccaggc

SEQ ID NO: 414877 - RNA, 14 nt, Homo sapiens
ccaauuuacauacu

SEQ ID NO: 414878 - RNA, 12 nt, Homo sapiens
ccacaacuccag

SEQ ID NO: 414879 - RNA, 10 nt, Homo sapiens
ccacacauau

SEQ ID NO: 414880 - RNA, 23 nt, Homo sapiens
ccacacauuuaaaacauuugaag

SEQ ID NO: 414881 - RNA, 17 nt, Homo sapiens
ccacacuaccaguuuca

SEQ ID NO: 414882 - RNA, 13 nt, Homo sapiens
ccacacugggacu

SEQ ID NO: 414883 - RNA, 11 nt, Homo sapiens
ccacacuuuca

SEQ ID NO: 414884 - RNA, 14 nt, Homo sapiens
ccacagaggccagg

SEQ ID NO: 414885 - RNA, 10 nt, Homo sapiens
ccacagcagg

SEQ ID NO: 414886 - RNA, 20 nt, Homo sapiens
ccacagccaaacuaggacac

SEQ ID NO: 414887 - RNA, 16 nt, Homo sapiens
ccacagccaccuccac

SEQ ID NO: 414888 - RNA, 14 nt, Homo sapiens
ccacagcccuguca

SEQ ID NO: 414889 - RNA, 17 nt, Homo sapiens
ccacaggccacugcaaa

SEQ ID NO: 414890 - RNA, 15 nt, Homo sapiens
ccacauucuacuuca

SEQ ID NO: 414891 - RNA, 13 nt, Homo sapiens
ccaccaccugucc

SEQ ID NO: 414892 - RNA, 12 nt, Homo sapiens
ccacccacccuu

SEQ ID NO: 414893 - RNA, 14 nt, Homo sapiens
ccacccauaccagc

SEQ ID NO: 414894 - RNA, 15 nt, Homo sapiens
ccacccccuccuguc

SEQ ID NO: 414895 - RNA, 16 nt, Homo sapiens
ccacccuccucaagaa

SEQ ID NO: 414896 - RNA, 21 nt, Homo sapiens
ccacccugggcaacaugauga

SEQ ID NO: 414897 - RNA, 17 nt, Homo sapiens
ccacccuucucagggac

SEQ ID NO: 414898 - RNA, 21 nt, Homo sapiens
ccaccgauggagcccccagau

SEQ ID NO: 414899 - RNA, 23 nt, Homo sapiens
ccaccgguguccuguuccugcca

SEQ ID NO: 414900 - RNA, 19 nt, Homo sapiens
ccaccuagagcuagaugug

SEQ ID NO: 414901 - RNA, 24 nt, Homo sapiens
ccaccuagagguagguaggaucau

SEQ ID NO: 414902 - RNA, 20 nt, Homo sapiens
ccaccuaugccuguggugaa

SEQ ID NO: 414903 - RNA, 22 nt, Homo sapiens
ccaccucccugacccgucuaau

SEQ ID NO: 414904 - RNA, 18 nt, Homo sapiens
ccaccuccucucuuggac

SEQ ID NO: 414905 - RNA, 21 nt, Homo sapiens
ccaccucuggccaaauaugca

SEQ ID NO: 414906 - RNA, 16 nt, Homo sapiens
ccaccugaaagccugu

SEQ ID NO: 414907 - RNA, 19 nt, Homo sapiens
ccaccuggauggaucugcu

SEQ ID NO: 414908 - RNA, 18 nt, Homo sapiens
ccaccugggcccuaggca

SEQ ID NO: 414909 - RNA, 13 nt, Homo sapiens
ccaccugucucag

SEQ ID NO: 414910 - RNA, 21 nt, Homo sapiens
ccccaagguuuuggagucagu

SEQ ID NO: 414911 - RNA, 14 nt, Homo sapiens
ccccaccaccccag

SEQ ID NO: 414912 - RNA, 12 nt, Homo sapiens
ccccaccaguga

SEQ ID NO: 414913 - RNA, 21 nt, Homo sapiens
ccccacccaccccuccugggc

SEQ ID NO: 414914 - RNA, 20 nt, Homo sapiens
ccccaccuugccaagcuuuc

SEQ ID NO: 414915 - RNA, 15 nt, Homo sapiens
ccccacgggaacauu

SEQ ID NO: 414916 - RNA, 23 nt, Homo sapiens
ccccacguugccucuacuuuauc

SEQ ID NO: 414917 - RNA, 14 nt, Homo sapiens
ccccacucagcugu

SEQ ID NO: 414918 - RNA, 12 nt, Homo sapiens
ccccacucccug

SEQ ID NO: 414919 - RNA, 18 nt, Homo sapiens
ccccagaacacagugccu

SEQ ID NO: 414920 - RNA, 10 nt, Homo sapiens
ccccagagac

SEQ ID NO: 414921 - RNA, 15 nt, Homo sapiens
ccccagagcuccgau

SEQ ID NO: 414922 - RNA, 15 nt, Homo sapiens
ccccagcaguugaau

SEQ ID NO: 414923 - RNA, 18 nt, Homo sapiens
ccccagccaucuacugga

SEQ ID NO: 414924 - RNA, 21 nt, Homo sapiens
ccccagcuguggguacagaga

SEQ ID NO: 414925 - RNA, 18 nt, Homo sapiens
ccccaucauccacgccaa

SEQ ID NO: 414926 - RNA, 15 nt, Homo sapiens
ccccaugccugucca

SEQ ID NO: 414927 - RNA, 14 nt, Homo sapiens
cccccaagcucagu

SEQ ID NO: 414928 - RNA, 23 nt, Homo sapiens
cccccacccgggagcaguguccu

SEQ ID NO: 414929 - RNA, 16 nt, Homo sapiens
cccccauccacaguug

SEQ ID NO: 414930 - RNA, 18 nt, Homo sapiens
cccccucccagacaggcc

SEQ ID NO: 414931 - RNA, 20 nt, Homo sapiens
cccccucuugagagggguga

SEQ ID NO: 414932 - RNA, 14 nt, Homo sapiens
cccccugcugccau

SEQ ID NO: 414933 - RNA, 21 nt, Homo sapiens
cccccugucccauucuagauc

SEQ ID NO: 414934 - RNA, 18 nt, Homo sapiens
cccccuuuccucuugggc

SEQ ID NO: 414935 - RNA, 19 nt, Homo sapiens
ccccuaacccuacaugcau

SEQ ID NO: 414936 - RNA, 16 nt, Homo sapiens
ccccucagauuccacc

SEQ ID NO: 414937 - RNA, 17 nt, Homo sapiens
ccccucagugguuuccu

SEQ ID NO: 414938 - RNA, 13 nt, Homo sapiens
ccccucaucucau

SEQ ID NO: 414939 - RNA, 15 nt, Homo sapiens
ccccucauugcauuu

SEQ ID NO: 414940 - RNA, 12 nt, Homo sapiens
ccccuccagugc

SEQ ID NO: 414941 - RNA, 19 nt, Homo sapiens
ccccuccuugccgcuggga

SEQ ID NO: 414942 - RNA, 18 nt, Homo sapiens
ccccugaccucacuguga

SEQ ID NO: 414943 - RNA, 16 nt, Homo sapiens
ccccugccccagagaa

SEQ ID NO: 414944 - RNA, 13 nt, Homo sapiens
ccccugcuccuga

SEQ ID NO: 414945 - RNA, 21 nt, Homo sapiens
ccccuggcugguaagggccaa

SEQ ID NO: 414946 - RNA, 22 nt, Homo sapiens
ccccuggcugguaagggccaag

SEQ ID NO: 414947 - RNA, 21 nt, Homo sapiens
ccccuggggggcacagccaga

SEQ ID NO: 414948 - RNA, 17 nt, Homo sapiens
ccccugucccauucuag

SEQ ID NO: 414949 - RNA, 22 nt, Homo sapiens
ccccuuaaggguugaaggcagu

SEQ ID NO: 414950 - RNA, 13 nt, Homo sapiens
cccgacagccugg

SEQ ID NO: 414951 - RNA, 14 nt, Homo sapiens
cccgagagcucuua

SEQ ID NO: 414952 - RNA, 19 nt, Homo sapiens
cccgagcugggggccauga

SEQ ID NO: 414953 - RNA, 17 nt, Homo sapiens
cccgaguaacugagauu

SEQ ID NO: 414954 - RNA, 13 nt, Homo sapiens
cccgcaaugugcc

SEQ ID NO: 414955 - RNA, 20 nt, Homo sapiens
cccgccugauuggggccuca

SEQ ID NO: 414956 - RNA, 18 nt, Homo sapiens
cccggagagggagucagu

SEQ ID NO: 414957 - RNA, 23 nt, Homo sapiens
cccggagagggagucagucuuca

SEQ ID NO: 414958 - RNA, 15 nt, Homo sapiens
cccggccacucccug

SEQ ID NO: 414959 - RNA, 20 nt, Homo sapiens
cccggggcauggacagggcc

SEQ ID NO: 414960 - RNA, 17 nt, Homo sapiens
cccggggcuccacugaa

SEQ ID NO: 414961 - RNA, 12 nt, Homo sapiens
cccuaauucuua

SEQ ID NO: 414962 - RNA, 16 nt, Homo sapiens
cccuacaacuccagcc

SEQ ID NO: 414963 - RNA, 17 nt, Homo sapiens
cccuacagccugcacac

SEQ ID NO: 414964 - RNA, 21 nt, Homo sapiens
cccuacauuaguaaaaauaaa

SEQ ID NO: 414965 - RNA, 13 nt, Homo sapiens
cccuaccuugaaa

SEQ ID NO: 414966 - RNA, 16 nt, Homo sapiens
cccuacuggcuguaaa

SEQ ID NO: 414967 - RNA, 15 nt, Homo sapiens
cccuagcuguauaua

SEQ ID NO: 414968 - RNA, 14 nt, Homo sapiens
cccuagugcuggua

SEQ ID NO: 414969 - RNA, 12 nt, Homo sapiens
cccuaugcugcc

SEQ ID NO: 414970 - RNA, 15 nt, Homo sapiens
cccuaugucccagcc

SEQ ID NO: 414971 - RNA, 14 nt, Homo sapiens
cccuauuacuuguu

SEQ ID NO: 414972 - RNA, 21 nt, Homo sapiens
cccucaaagugucacaaugcu

SEQ ID NO: 414973 - RNA, 22 nt, Homo sapiens
cccucacagagacccaccuuca

SEQ ID NO: 414974 - RNA, 15 nt, Homo sapiens
cccucacuguugaau

SEQ ID NO: 414975 - RNA, 13 nt, Homo sapiens
cccucagacuggg

SEQ ID NO: 414976 - RNA, 15 nt, Homo sapiens
cccucaggaccaaag

SEQ ID NO: 414977 - RNA, 10 nt, Homo sapiens
cccucaggcu

SEQ ID NO: 414978 - RNA, 14 nt, Homo sapiens
cccuccaaaagcac

SEQ ID NO: 414979 - RNA, 15 nt, Homo sapiens
cccuccaaaagcacu

SEQ ID NO: 414980 - RNA, 16 nt, Homo sapiens
cccuccaaaagcacuu

SEQ ID NO: 414981 - RNA, 13 nt, Homo sapiens
cccuccaauccca

SEQ ID NO: 414982 - RNA, 16 nt, Homo sapiens
cccuccacaccagugg

SEQ ID NO: 414983 - RNA, 16 nt, Homo sapiens
cccuccaccagugugc

SEQ ID NO: 414984 - RNA, 22 nt, Homo sapiens
cccuccaccgccacuaugggcc

SEQ ID NO: 414985 - RNA, 19 nt, Homo sapiens
cccuccagggccacugcuu

SEQ ID NO: 414986 - RNA, 15 nt, Homo sapiens
cccuccccagagcac

SEQ ID NO: 414987 - RNA, 18 nt, Homo sapiens
cccucccuggcugugagc

SEQ ID NO: 414988 - RNA, 21 nt, Homo sapiens
cccucccuguauaagacacuu

SEQ ID NO: 414989 - RNA, 18 nt, Homo sapiens
cccuccuggagcauccca

SEQ ID NO: 414990 - RNA, 19 nt, Homo sapiens
cccucgcaaaaugauguga

SEQ ID NO: 414991 - RNA, 16 nt, Homo sapiens
cccucggcauucacac

SEQ ID NO: 414992 - RNA, 21 nt, Homo sapiens
cccucuccugcccagaugccc

SEQ ID NO: 414993 - RNA, 23 nt, Homo sapiens
cccucuccuguagccacuggcau

SEQ ID NO: 414994 - RNA, 12 nt, Homo sapiens
cccucucugcac

SEQ ID NO: 414995 - RNA, 13 nt, Homo sapiens
cccucugcucuca

SEQ ID NO: 414996 - RNA, 23 nt, Homo sapiens
cccucuuuucugaucugcaguuu

SEQ ID NO: 414997 - RNA, 15 nt, Homo sapiens
cccugaggacagggg

SEQ ID NO: 414998 - RNA, 20 nt, Homo sapiens
cccugcagcuaugcuggaaa

SEQ ID NO: 414999 - RNA, 18 nt, Homo sapiens
cccugcagggccaagcac

SEQ ID NO: 415000 - RNA, 17 nt, Homo sapiens
cccugcaguuugagaca

SEQ ID NO: 415001 - RNA, 14 nt, Homo sapiens
cccugccagacuga

SEQ ID NO: 415002 - RNA, 19 nt, Homo sapiens
cccugccagcaacgcucac

SEQ ID NO: 415003 - RNA, 15 nt, Homo sapiens
cccugccagccugaa

SEQ ID NO: 415004 - RNA, 15 nt, Homo sapiens
cccugccucaagaaa

SEQ ID NO: 415005 - RNA, 21 nt, Homo sapiens
cccugccugccccgacaccca

SEQ ID NO: 415006 - RNA, 19 nt, Homo sapiens
cccugcucacucuuccaca

SEQ ID NO: 415007 - RNA, 14 nt, Homo sapiens
cccugcugaccucc

SEQ ID NO: 415008 - RNA, 13 nt, Homo sapiens
cccugcuggacca

SEQ ID NO: 415009 - RNA, 15 nt, Homo sapiens
cccuggcccaucuca

SEQ ID NO: 415010 - RNA, 20 nt, Homo sapiens
cccuggcugugagcagccuc

SEQ ID NO: 415011 - RNA, 19 nt, Homo sapiens
cccuguagacuagugccgu

SEQ ID NO: 415012 - RNA, 15 nt, Homo sapiens
cccugugggagucca

SEQ ID NO: 415013 - RNA, 15 nt, Homo sapiens
cccuguguagcucuc

SEQ ID NO: 415014 - RNA, 20 nt, Homo sapiens
cccuguguauucuagugaau

SEQ ID NO: 415015 - RNA, 14 nt, Homo sapiens
cccuguuaccuaau

SEQ ID NO: 415016 - RNA, 22 nt, Homo sapiens
cccuguuuacgguacuugguaa

SEQ ID NO: 415017 - RNA, 12 nt, Homo sapiens
cccuuaauaaac

SEQ ID NO: 415018 - RNA, 16 nt, Homo sapiens
cccuuaauaaacucac

SEQ ID NO: 415019 - RNA, 18 nt, Homo sapiens
cccuuaggaauauacaua

SEQ ID NO: 415020 - RNA, 20 nt, Homo sapiens
cccuucaaugcaaaauacau

SEQ ID NO: 415021 - RNA, 14 nt, Homo sapiens
cccuucccaguggg

SEQ ID NO: 415022 - RNA, 16 nt, Homo sapiens
cccuucuaggcaucuc

SEQ ID NO: 415023 - RNA, 13 nt, Homo sapiens
cccuucucagaaa

SEQ ID NO: 415024 - RNA, 12 nt, Homo sapiens
cccuucugcuuu

SEQ ID NO: 415025 - RNA, 20 nt, Homo sapiens
cccuugcacaggccacuugc

SEQ ID NO: 415026 - RNA, 13 nt, Homo sapiens
cccuugcagcuag

SEQ ID NO: 415027 - RNA, 21 nt, Homo sapiens
cccuugugagagcccauuccc

SEQ ID NO: 415028 - RNA, 13 nt, Homo sapiens
cccuuuuacuuuu

SEQ ID NO: 415029 - RNA, 19 nt, Homo sapiens
cccuuuugcgugguccuua

SEQ ID NO: 415030 - RNA, 15 nt, Homo sapiens
cccuuuuguacauuu

SEQ ID NO: 415031 - RNA, 18 nt, Homo sapiens
ccgaaaaggauaugcagu

SEQ ID NO: 415032 - RNA, 12 nt, Homo sapiens
ccgaaacauaca

SEQ ID NO: 415033 - RNA, 22 nt, Homo sapiens
ccgacggugggcauuugugagg

SEQ ID NO: 415034 - RNA, 16 nt, Homo sapiens
ccgacuggcugugaga

SEQ ID NO: 415035 - RNA, 16 nt, Homo sapiens
ccgagagagauggaau

SEQ ID NO: 415036 - RNA, 12 nt, Homo sapiens
ccgagagcucuu

SEQ ID NO: 415037 - RNA, 15 nt, Homo sapiens
ccgagccgagcucuc

SEQ ID NO: 415038 - RNA, 17 nt, Homo sapiens
ccgagccgagcucuccu

SEQ ID NO: 415039 - RNA, 23 nt, Homo sapiens
ccgagcugggggccaugagcucc

SEQ ID NO: 415040 - RNA, 23 nt, Homo sapiens
ccgaggaguccaguuugugcaag

SEQ ID NO: 415041 - RNA, 22 nt, Homo sapiens
cuuaaggagaggagagcaucug

SEQ ID NO: 415042 - RNA, 18 nt, Homo sapiens
cuuaaggucauaaaaaua

SEQ ID NO: 415043 - RNA, 16 nt, Homo sapiens
cuuaaguuuaccaaau

SEQ ID NO: 415044 - RNA, 13 nt, Homo sapiens
cuuaaguuuagaa

SEQ ID NO: 415045 - RNA, 17 nt, Homo sapiens
cuuaaguuuuacuugag

SEQ ID NO: 415046 - RNA, 18 nt, Homo sapiens
cuuaaguuuuacuugagg

SEQ ID NO: 415047 - RNA, 13 nt, Homo sapiens
cuuaauaaacuca

SEQ ID NO: 415048 - RNA, 22 nt, Homo sapiens
cuuaauaguaggguaaguuguu

SEQ ID NO: 415049 - RNA, 20 nt, Homo sapiens
cuuaaucuagagcuaugcac

SEQ ID NO: 415050 - RNA, 15 nt, Homo sapiens
cuuaaugacauuccc

SEQ ID NO: 415051 - RNA, 20 nt, Homo sapiens
cuuaauuauaagcuauguca

SEQ ID NO: 415052 - RNA, 17 nt, Homo sapiens
cuuaauucuguuacaca

SEQ ID NO: 415053 - RNA, 20 nt, Homo sapiens
cuuaauucuguuacacaaua

SEQ ID NO: 415054 - RNA, 23 nt, Homo sapiens
cuuaauucuuaccucauuugcau

SEQ ID NO: 415055 - RNA, 16 nt, Homo sapiens
cuuacaaugugcacug

SEQ ID NO: 415056 - RNA, 17 nt, Homo sapiens
cuuacagucagcacaga

SEQ ID NO: 415057 - RNA, 15 nt, Homo sapiens
cuuacgcuauuucug

SEQ ID NO: 415058 - RNA, 19 nt, Homo sapiens
cuuacuuagcaugcacaaa

SEQ ID NO: 415059 - RNA, 15 nt, Homo sapiens
cuuagaaauacuugu

SEQ ID NO: 415060 - RNA, 18 nt, Homo sapiens
cuuagaaauugcauuucc

SEQ ID NO: 415061 - RNA, 15 nt, Homo sapiens
cuuagaauacuguau

SEQ ID NO: 415062 - RNA, 12 nt, Homo sapiens
cuuagaaugagg

SEQ ID NO: 415063 - RNA, 16 nt, Homo sapiens
cuuagacuucgacuca

SEQ ID NO: 415064 - RNA, 22 nt, Homo sapiens
cuuagagcacuagaagcacagg

SEQ ID NO: 415065 - RNA, 16 nt, Homo sapiens
cuuagagcagauucua

SEQ ID NO: 415066 - RNA, 21 nt, Homo sapiens
cuuagagugggaccaacuucc

SEQ ID NO: 415067 - RNA, 14 nt, Homo sapiens
cuuagcaacagccg

SEQ ID NO: 415068 - RNA, 16 nt, Homo sapiens
cuuagcaaggggcuca

SEQ ID NO: 415069 - RNA, 13 nt, Homo sapiens
cuuagcauguccc

SEQ ID NO: 415070 - RNA, 15 nt, Homo sapiens
cuuagcgggacaaag

SEQ ID NO: 415071 - RNA, 20 nt, Homo sapiens
cuuagcguucuguuucacca

SEQ ID NO: 415072 - RNA, 18 nt, Homo sapiens
cuuagcugucucagagau

SEQ ID NO: 415073 - RNA, 17 nt, Homo sapiens
cuuagcuuagcuuucug

SEQ ID NO: 415074 - RNA, 22 nt, Homo sapiens
cuuaguccugauguacuuuaaa

SEQ ID NO: 415075 - RNA, 15 nt, Homo sapiens
cuuagugucacuuac

SEQ ID NO: 415076 - RNA, 14 nt, Homo sapiens
cuuauacauuugau

SEQ ID NO: 415077 - RNA, 15 nt, Homo sapiens
cuuauacauuugaua

SEQ ID NO: 415078 - RNA, 13 nt, Homo sapiens
cuuauaccaaagg

SEQ ID NO: 415079 - RNA, 22 nt, Homo sapiens
cuuauauuugacauucuucacu

SEQ ID NO: 415080 - RNA, 13 nt, Homo sapiens
cuuaucauggucu

SEQ ID NO: 415081 - RNA, 14 nt, Homo sapiens
cuuauccagcauua

SEQ ID NO: 415082 - RNA, 14 nt, Homo sapiens
cuuaucuagccaaa

SEQ ID NO: 415083 - RNA, 19 nt, Homo sapiens
cuuaucuagccaaagagcu

SEQ ID NO: 415084 - RNA, 18 nt, Homo sapiens
cuuaucuauauccauaac

SEQ ID NO: 415085 - RNA, 23 nt, Homo sapiens
cuuaucuauauccauaaccucua

SEQ ID NO: 415086 - RNA, 22 nt, Homo sapiens
cuuaucugugcgugaaacacac

SEQ ID NO: 415087 - RNA, 12 nt, Homo sapiens
cuuaucuugcac

SEQ ID NO: 415088 - RNA, 22 nt, Homo sapiens
cuuaugauacuugagguaccag

SEQ ID NO: 415089 - RNA, 21 nt, Homo sapiens
cuuauuccuaggcaacuauua

SEQ ID NO: 415090 - RNA, 18 nt, Homo sapiens
cuuauuggccaaaugccu

SEQ ID NO: 415091 - RNA, 21 nt, Homo sapiens
cuuauuggccacugggucuca

SEQ ID NO: 415092 - RNA, 16 nt, Homo sapiens
cuuauugugugaaggu

SEQ ID NO: 415093 - RNA, 23 nt, Homo sapiens
cuuauuugagugauuauuuguua

SEQ ID NO: 415094 - RNA, 18 nt, Homo sapiens
cuuauuuuaccuucucau

SEQ ID NO: 415095 - RNA, 20 nt, Homo sapiens
cuucaaaucagagcagugau

SEQ ID NO: 415096 - RNA, 16 nt, Homo sapiens
cuucaaccccaugaga

SEQ ID NO: 415097 - RNA, 19 nt, Homo sapiens
cuucaaguuaaagugaaua

SEQ ID NO: 415098 - RNA, 13 nt, Homo sapiens
cuucaauacuuaa

SEQ ID NO: 415099 - RNA, 12 nt, Homo sapiens
cuucacauccac

SEQ ID NO: 415100 - RNA, 20 nt, Homo sapiens
cuucacauuuagaauuugaa

SEQ ID NO: 415101 - RNA, 22 nt, Homo sapiens
cuucacauuuuacgacaaggau

SEQ ID NO: 415102 - RNA, 15 nt, Homo sapiens
cuucacccugaaugg

SEQ ID NO: 415103 - RNA, 14 nt, Homo sapiens
cuucacugccauga

SEQ ID NO: 415104 - RNA, 17 nt, Homo sapiens
cuucacuuaaaaucaaa

SEQ ID NO: 415105 - RNA, 15 nt, Homo sapiens
cuucacuugcacugg

SEQ ID NO: 415106 - RNA, 18 nt, Homo sapiens
cuucagaugacaaggauu

SEQ ID NO: 415107 - RNA, 18 nt, Homo sapiens
cuucagcugccugaaaca

SEQ ID NO: 415108 - RNA, 17 nt, Homo sapiens
cuucagcuuugaaaagg

SEQ ID NO: 415109 - RNA, 22 nt, Homo sapiens
cuucagggcugggcagguccug

SEQ ID NO: 415110 - RNA, 23 nt, Homo sapiens
cuucaguacacuugguguacugg

SEQ ID NO: 415111 - RNA, 20 nt, Homo sapiens
cuucaguccacuucugcucu

SEQ ID NO: 415112 - RNA, 13 nt, Homo sapiens
cuucaguuuuagg

SEQ ID NO: 415113 - RNA, 11 nt, Homo sapiens
cuucauaauau

SEQ ID NO: 415114 - RNA, 15 nt, Homo sapiens
cuucauauaccagca

SEQ ID NO: 415115 - RNA, 16 nt, Homo sapiens
cuucauccauagacac

SEQ ID NO: 415116 - RNA, 23 nt, Homo sapiens
cuucauccccuuuggcuaccuga

SEQ ID NO: 415117 - RNA, 12 nt, Homo sapiens
cuucaucuguga

SEQ ID NO: 415118 - RNA, 19 nt, Homo sapiens
cuucaucuucacugcaauu

SEQ ID NO: 415119 - RNA, 17 nt, Homo sapiens
cuucauggaggggguca

SEQ ID NO: 415120 - RNA, 10 nt, Homo sapiens
cuucauucua

SEQ ID NO: 415121 - RNA, 14 nt, Homo sapiens
cuuccaaaccugac

SEQ ID NO: 415122 - RNA, 13 nt, Homo sapiens
cuuccaacugcug

SEQ ID NO: 415123 - RNA, 16 nt, Homo sapiens
cuuccaaucuccauca

SEQ ID NO: 415124 - RNA, 20 nt, Homo sapiens
cuuccacagaauacaagcca

SEQ ID NO: 415125 - RNA, 15 nt, Homo sapiens
cuuccaccaaauacu

SEQ ID NO: 415126 - RNA, 12 nt, Homo sapiens
cuuccaccugua

SEQ ID NO: 415127 - RNA, 13 nt, Homo sapiens
cuuccaccugucc

SEQ ID NO: 415128 - RNA, 19 nt, Homo sapiens
cuuccacuuugaguaccaa

SEQ ID NO: 415129 - RNA, 14 nt, Homo sapiens
cuuccagguacuga

SEQ ID NO: 415130 - RNA, 22 nt, Homo sapiens
cuuccauaauuaugacaguuau

SEQ ID NO: 415131 - RNA, 18 nt, Homo sapiens
cuuccaucagcagugauu

SEQ ID NO: 415132 - RNA, 13 nt, Homo sapiens
cuuccaucaugga

SEQ ID NO: 415133 - RNA, 12 nt, Homo sapiens
cuuccauggugg

SEQ ID NO: 415134 - RNA, 13 nt, Homo sapiens
cuuccaugguggu

SEQ ID NO: 415135 - RNA, 17 nt, Homo sapiens
cuuccauucuuucuucc

SEQ ID NO: 415136 - RNA, 15 nt, Homo sapiens
cuucccaaacuccca

SEQ ID NO: 415137 - RNA, 19 nt, Homo sapiens
cuucccacuuugccacugg

SEQ ID NO: 415138 - RNA, 14 nt, Homo sapiens
cuucccagugaauu

SEQ ID NO: 415139 - RNA, 12 nt, Homo sapiens
cuucccauuucu

SEQ ID NO: 415140 - RNA, 18 nt, Homo sapiens
cuuccccugugacuccuc

SEQ ID NO: 415141 - RNA, 18 nt, Homo sapiens
cuucccgaguaacugaga

SEQ ID NO: 415142 - RNA, 21 nt, Homo sapiens
cuucccugggggucccaggau

SEQ ID NO: 415143 - RNA, 22 nt, Homo sapiens
cuucccuugcuggaaaacccaa

SEQ ID NO: 415144 - RNA, 20 nt, Homo sapiens
cuucccuuucugcuuguguu

SEQ ID NO: 415145 - RNA, 13 nt, Homo sapiens
cuucccuuugauu

SEQ ID NO: 415146 - RNA, 18 nt, Homo sapiens
cuuccgcucccaccagcc

SEQ ID NO: 415147 - RNA, 13 nt, Homo sapiens
cuuccgugagaca

SEQ ID NO: 415148 - RNA, 23 nt, Homo sapiens
cuuccgugggucaucccagcacc

SEQ ID NO: 415149 - RNA, 13 nt, Homo sapiens
cuuccuacuguag

SEQ ID NO: 415150 - RNA, 12 nt, Homo sapiens
cuuccucugcag

SEQ ID NO: 415151 - RNA, 15 nt, Homo sapiens
cuuccugacugggaa

SEQ ID NO: 415152 - RNA, 22 nt, Homo sapiens
cuuccuggaaugcauucacuca

SEQ ID NO: 415153 - RNA, 15 nt, Homo sapiens
cuuccuggcuguaaa

SEQ ID NO: 415154 - RNA, 20 nt, Homo sapiens
cuuccugggcagcccagaga

SEQ ID NO: 415155 - RNA, 14 nt, Homo sapiens
cuuccuguccagag

SEQ ID NO: 415156 - RNA, 15 nt, Homo sapiens
cuuccuguccagaga

SEQ ID NO: 415157 - RNA, 15 nt, Homo sapiens
cuuccugucuggccc

SEQ ID NO: 415158 - RNA, 19 nt, Homo sapiens
cuuccuuaaacuccuguga

SEQ ID NO: 415159 - RNA, 23 nt, Homo sapiens
cuuccuuaccgugggcacugaag

SEQ ID NO: 415160 - RNA, 12 nt, Homo sapiens
cuuccuucacau

SEQ ID NO: 415161 - RNA, 21 nt, Homo sapiens
cuuccuuggaggggggagcca

SEQ ID NO: 415162 - RNA, 18 nt, Homo sapiens
cuucgacccuuucucuga

SEQ ID NO: 415163 - RNA, 14 nt, Homo sapiens
cuucgacucaggau

SEQ ID NO: 415164 - RNA, 23 nt, Homo sapiens
cuucgauacaccgggccuggaga

SEQ ID NO: 415165 - RNA, 14 nt, Homo sapiens
cuucguacaguucu

SEQ ID NO: 415166 - RNA, 12 nt, Homo sapiens
cuucgugccugu

SEQ ID NO: 415167 - RNA, 15 nt, Homo sapiens
cuucuaauguucccc

SEQ ID NO: 415168 - RNA, 22 nt, Homo sapiens
cuucuagaguaauuaucuguga

SEQ ID NO: 415169 - RNA, 19 nt, Homo sapiens
cuucuaucaaagcacauaa

SEQ ID NO: 415170 - RNA, 15 nt, Homo sapiens
cuucucaagcacuga

SEQ ID NO: 415171 - RNA, 16 nt, Homo sapiens
cuucuccaaaugagau

SEQ ID NO: 415172 - RNA, 18 nt, Homo sapiens
gaaccgcaauaugggagg

SEQ ID NO: 415173 - RNA, 16 nt, Homo sapiens
gaaccuaauagcacca

SEQ ID NO: 415174 - RNA, 12 nt, Homo sapiens
gaaccucuccau

SEQ ID NO: 415175 - RNA, 15 nt, Homo sapiens
gaacgaagccaccuu

SEQ ID NO: 415176 - RNA, 20 nt, Homo sapiens
gaacguacccaaggucacau

SEQ ID NO: 415177 - RNA, 22 nt, Homo sapiens
gaacgucucucaccuagaccuu

SEQ ID NO: 415178 - RNA, 15 nt, Homo sapiens
gaacucuagccaaau

SEQ ID NO: 415179 - RNA, 18 nt, Homo sapiens
gaacucugggcacuuuug

SEQ ID NO: 415180 - RNA, 13 nt, Homo sapiens
gaacucuucaucu

SEQ ID NO: 415181 - RNA, 22 nt, Homo sapiens
gaacucuucaucuuaaacuaca

SEQ ID NO: 415182 - RNA, 22 nt, Homo sapiens
gaacucuuccuggaaugcauuc

SEQ ID NO: 415183 - RNA, 16 nt, Homo sapiens
gaacugaagaccucca

SEQ ID NO: 415184 - RNA, 18 nt, Homo sapiens
gaacugaugacacugaga

SEQ ID NO: 415185 - RNA, 16 nt, Homo sapiens
gaacugcagucagcau

SEQ ID NO: 415186 - RNA, 21 nt, Homo sapiens
gaacugcuaccaugaagugaa

SEQ ID NO: 415187 - RNA, 18 nt, Homo sapiens
gaacugggaagaugcugg

SEQ ID NO: 415188 - RNA, 15 nt, Homo sapiens
gaacugguucuugcc

SEQ ID NO: 415189 - RNA, 17 nt, Homo sapiens
gaacugugcaucaacca

SEQ ID NO: 415190 - RNA, 13 nt, Homo sapiens
gaacugugcuuuu

SEQ ID NO: 415191 - RNA, 18 nt, Homo sapiens
gaacuguuggcugcuccc

SEQ ID NO: 415192 - RNA, 22 nt, Homo sapiens
gaacuguuggcugcuccccacc

SEQ ID NO: 415193 - RNA, 22 nt, Homo sapiens
gaacuuuagcaugguauugaag

SEQ ID NO: 415194 - RNA, 17 nt, Homo sapiens
gaacuuugcacacuuca

SEQ ID NO: 415195 - RNA, 13 nt, Homo sapiens
gaagaaaacauau

SEQ ID NO: 415196 - RNA, 16 nt, Homo sapiens
gaagaaagacuccuuu

SEQ ID NO: 415197 - RNA, 15 nt, Homo sapiens
gaagaacgaagccac

SEQ ID NO: 415198 - RNA, 17 nt, Homo sapiens
gaagaagaaaacacuag

SEQ ID NO: 415199 - RNA, 22 nt, Homo sapiens
gaagaaguguugauugccaaau

SEQ ID NO: 415200 - RNA, 19 nt, Homo sapiens
gaagaauauucaggacuua

SEQ ID NO: 415201 - RNA, 15 nt, Homo sapiens
gaagacagagggaaa

SEQ ID NO: 415202 - RNA, 18 nt, Homo sapiens
gaagacagauacuccucc

SEQ ID NO: 415203 - RNA, 16 nt, Homo sapiens
gaagacauccugagca

SEQ ID NO: 415204 - RNA, 20 nt, Homo sapiens
gaagaccagcuuugcaguga

SEQ ID NO: 415205 - RNA, 19 nt, Homo sapiens
gaagacuggagacugucca

SEQ ID NO: 415206 - RNA, 16 nt, Homo sapiens
gaagacuucuuugcaa

SEQ ID NO: 415207 - RNA, 18 nt, Homo sapiens
gaagagauacccacagag

SEQ ID NO: 415208 - RNA, 16 nt, Homo sapiens
gaagagcuccuugaua

SEQ ID NO: 415209 - RNA, 18 nt, Homo sapiens
gaagagcuggguaccagg

SEQ ID NO: 415210 - RNA, 22 nt, Homo sapiens
gaagagugauguuucagucaag

SEQ ID NO: 415211 - RNA, 14 nt, Homo sapiens
gaagauaccauaag

SEQ ID NO: 415212 - RNA, 17 nt, Homo sapiens
gaagaugagacugccca

SEQ ID NO: 415213 - RNA, 18 nt, Homo sapiens
gaagaugaucauuugccc

SEQ ID NO: 415214 - RNA, 18 nt, Homo sapiens
gaagauguaagaagcuaa

SEQ ID NO: 415215 - RNA, 18 nt, Homo sapiens
gaagauucuccugugcua

SEQ ID NO: 415216 - RNA, 17 nt, Homo sapiens
gaagcacagcagcaucu

SEQ ID NO: 415217 - RNA, 16 nt, Homo sapiens
gaagcaccccaugcca

SEQ ID NO: 415218 - RNA, 23 nt, Homo sapiens
gaagcacuuucucuuaacuuaau

SEQ ID NO: 415219 - RNA, 19 nt, Homo sapiens
gaagcagugccuuccauaa

SEQ ID NO: 415220 - RNA, 14 nt, Homo sapiens
gaagcaucugucuu

SEQ ID NO: 415221 - RNA, 16 nt, Homo sapiens
gaagccacugccagcu

SEQ ID NO: 415222 - RNA, 17 nt, Homo sapiens
gaagccagugggguccc

SEQ ID NO: 415223 - RNA, 18 nt, Homo sapiens
gaagccccauuugcacag

SEQ ID NO: 415224 - RNA, 16 nt, Homo sapiens
gaagcccuccuugcca

SEQ ID NO: 415225 - RNA, 17 nt, Homo sapiens
gaagccucggcaggacc

SEQ ID NO: 415226 - RNA, 21 nt, Homo sapiens
gaagcuaaaauaaaccagacu

SEQ ID NO: 415227 - RNA, 17 nt, Homo sapiens
gaagcugcagcuggucu

SEQ ID NO: 415228 - RNA, 18 nt, Homo sapiens
gaaggacagcucuucccc

SEQ ID NO: 415229 - RNA, 23 nt, Homo sapiens
gaaggauuguuucuggugacugc

SEQ ID NO: 415230 - RNA, 16 nt, Homo sapiens
gaaggcaaaugaugcc

SEQ ID NO: 415231 - RNA, 15 nt, Homo sapiens
gaaggcaaccuggaa

SEQ ID NO: 415232 - RNA, 14 nt, Homo sapiens
gaaggcagagccau

SEQ ID NO: 415233 - RNA, 20 nt, Homo sapiens
gaaggcagagguugcaguga

SEQ ID NO: 415234 - RNA, 16 nt, Homo sapiens
gaaggcauuccagggu

SEQ ID NO: 415235 - RNA, 16 nt, Homo sapiens
gaaggccaucaucucu

SEQ ID NO: 415236 - RNA, 18 nt, Homo sapiens
gaaggccgggcgcagugg

SEQ ID NO: 415237 - RNA, 17 nt, Homo sapiens
gaaggccuucuuucuag

SEQ ID NO: 415238 - RNA, 18 nt, Homo sapiens
gaaggcuuugccaugggc

SEQ ID NO: 415239 - RNA, 17 nt, Homo sapiens
gaagggaauugcucaga

SEQ ID NO: 415240 - RNA, 14 nt, Homo sapiens
gaagggaugggaga

SEQ ID NO: 415241 - RNA, 12 nt, Homo sapiens
gaagggccaguc

SEQ ID NO: 415242 - RNA, 19 nt, Homo sapiens
gaagggccccacucaggga

SEQ ID NO: 415243 - RNA, 17 nt, Homo sapiens
gaaggggacgcuuugaa

SEQ ID NO: 415244 - RNA, 16 nt, Homo sapiens
gaagggugacauccca

SEQ ID NO: 415245 - RNA, 22 nt, Homo sapiens
gaagguuaugcuccuggcacag

SEQ ID NO: 415246 - RNA, 15 nt, Homo sapiens
gaagguugugaugaa

SEQ ID NO: 415247 - RNA, 14 nt, Homo sapiens
gaaguaauugacag

SEQ ID NO: 415248 - RNA, 17 nt, Homo sapiens
gaaguaggugugacuug

SEQ ID NO: 415249 - RNA, 22 nt, Homo sapiens
gaaguauccaauuaugugacaa

SEQ ID NO: 415250 - RNA, 15 nt, Homo sapiens
gaaguauugcuaaua

SEQ ID NO: 415251 - RNA, 16 nt, Homo sapiens
gaagucacugcacagu

SEQ ID NO: 415252 - RNA, 13 nt, Homo sapiens
gaagucaucucau

SEQ ID NO: 415253 - RNA, 20 nt, Homo sapiens
gaagucaucucauuccacug

SEQ ID NO: 415254 - RNA, 11 nt, Homo sapiens
gaagucucuuu

SEQ ID NO: 415255 - RNA, 20 nt, Homo sapiens
gaagugaaugaaacacucag

SEQ ID NO: 415256 - RNA, 17 nt, Homo sapiens
gaagugggagugggaga

SEQ ID NO: 415257 - RNA, 18 nt, Homo sapiens
gaagugugaguagagcau

SEQ ID NO: 415258 - RNA, 16 nt, Homo sapiens
gaaguuccaguguucu

SEQ ID NO: 415259 - RNA, 15 nt, Homo sapiens
gaaguuuacaaucaa

SEQ ID NO: 415260 - RNA, 18 nt, Homo sapiens
gaaguuuauacaguacag

SEQ ID NO: 415261 - RNA, 17 nt, Homo sapiens
gaaguuugaccaucacc

SEQ ID NO: 415262 - RNA, 13 nt, Homo sapiens
gaaguuuggcaau

SEQ ID NO: 415263 - RNA, 14 nt, Homo sapiens
gaaguuuguguucu

SEQ ID NO: 415264 - RNA, 18 nt, Homo sapiens
gaauaaaauuagcuugag

SEQ ID NO: 415265 - RNA, 19 nt, Homo sapiens
gaauaaacuagacucugaa

SEQ ID NO: 415266 - RNA, 19 nt, Homo sapiens
gaauaaagcccuugaacca

SEQ ID NO: 415267 - RNA, 18 nt, Homo sapiens
gaauaaauaaauguaucu

SEQ ID NO: 415268 - RNA, 20 nt, Homo sapiens
gaauaacuguguuuccuacc

SEQ ID NO: 415269 - RNA, 12 nt, Homo sapiens
gaauaaggccuu

SEQ ID NO: 415270 - RNA, 22 nt, Homo sapiens
gaauaauaagcuacuugccuug

SEQ ID NO: 415271 - RNA, 19 nt, Homo sapiens
gaauaaugacguauuguga

SEQ ID NO: 415272 - RNA, 16 nt, Homo sapiens
gaauaaugauaccucc

SEQ ID NO: 415273 - RNA, 18 nt, Homo sapiens
gaauaaugcuguuuuaua

SEQ ID NO: 415274 - RNA, 20 nt, Homo sapiens
gaauaauuauguuuaccuca

SEQ ID NO: 415275 - RNA, 14 nt, Homo sapiens
gaauacucuugguc

SEQ ID NO: 415276 - RNA, 21 nt, Homo sapiens
gaauacucuuggucaccucaa

SEQ ID NO: 415277 - RNA, 11 nt, Homo sapiens
gaauacuguau

SEQ ID NO: 415278 - RNA, 18 nt, Homo sapiens
gaauacuuacucuugucg

SEQ ID NO: 415279 - RNA, 15 nt, Homo sapiens
gaauagaugcugacu

SEQ ID NO: 415280 - RNA, 12 nt, Homo sapiens
gaauagcaguuu

SEQ ID NO: 415281 - RNA, 23 nt, Homo sapiens
gaauagugccucagcgcugccca

SEQ ID NO: 415282 - RNA, 16 nt, Homo sapiens
gaauauaaacacauaa

SEQ ID NO: 415283 - RNA, 15 nt, Homo sapiens
gaauauaaauguacu

SEQ ID NO: 415284 - RNA, 13 nt, Homo sapiens
gaauauagagggu

SEQ ID NO: 415285 - RNA, 15 nt, Homo sapiens
gaauauccuauacug

SEQ ID NO: 415286 - RNA, 18 nt, Homo sapiens
gaauaucugggauucuac

SEQ ID NO: 415287 - RNA, 17 nt, Homo sapiens
gaauaucuuaauuccuu

SEQ ID NO: 415288 - RNA, 15 nt, Homo sapiens
gaauauuacauugca

SEQ ID NO: 415289 - RNA, 17 nt, Homo sapiens
gaauauucaacagcuca

SEQ ID NO: 415290 - RNA, 19 nt, Homo sapiens
gaauauucuguaaaccuaa

SEQ ID NO: 415291 - RNA, 21 nt, Homo sapiens
gaaucauagccaaaaacuuuu

SEQ ID NO: 415292 - RNA, 19 nt, Homo sapiens
gaaucauccagacuccuca

SEQ ID NO: 415293 - RNA, 17 nt, Homo sapiens
gaaucaugaaguaaauu

SEQ ID NO: 415294 - RNA, 13 nt, Homo sapiens
gaaucccuagucc

SEQ ID NO: 415295 - RNA, 18 nt, Homo sapiens
gaauccucucagagucau

SEQ ID NO: 415296 - RNA, 19 nt, Homo sapiens
gaaucuauuguuucuccuc

SEQ ID NO: 415297 - RNA, 17 nt, Homo sapiens
gaaucugcuguugccau

SEQ ID NO: 415298 - RNA, 20 nt, Homo sapiens
gaaucuugucccagccucag

SEQ ID NO: 415299 - RNA, 22 nt, Homo sapiens
gaaugaaauauaaacugugaga

SEQ ID NO: 415300 - RNA, 16 nt, Homo sapiens
gaaugaacaaagucca

SEQ ID NO: 415301 - RNA, 21 nt, Homo sapiens
gaaugaaguggaggaaguaac

SEQ ID NO: 415302 - RNA, 15 nt, Homo sapiens
gagugucacaucucu

SEQ ID NO: 415303 - RNA, 14 nt, Homo sapiens
gagugucacugagc

SEQ ID NO: 415304 - RNA, 13 nt, Homo sapiens
gagugugugcaag

SEQ ID NO: 415305 - RNA, 15 nt, Homo sapiens
gagugugugucuuuc

SEQ ID NO: 415306 - RNA, 19 nt, Homo sapiens
gaguguuuuaaaacauuca

SEQ ID NO: 415307 - RNA, 12 nt, Homo sapiens
gaguucagaggg

SEQ ID NO: 415308 - RNA, 14 nt, Homo sapiens
gaguucuuugcaag

SEQ ID NO: 415309 - RNA, 20 nt, Homo sapiens
gaguuguuuaaacagucaaa

SEQ ID NO: 415310 - RNA, 20 nt, Homo sapiens
gaguuguuucugacccacug

SEQ ID NO: 415311 - RNA, 15 nt, Homo sapiens
gaguuuaguuuuaua

SEQ ID NO: 415312 - RNA, 16 nt, Homo sapiens
gaguuugacauuuaau

SEQ ID NO: 415313 - RNA, 21 nt, Homo sapiens
gauaaaaaagaaaacauucca

SEQ ID NO: 415314 - RNA, 15 nt, Homo sapiens
gauaaagcacccugu

SEQ ID NO: 415315 - RNA, 16 nt, Homo sapiens
gauaaaguuugcuaag

SEQ ID NO: 415316 - RNA, 12 nt, Homo sapiens
gauaacuuugac

SEQ ID NO: 415317 - RNA, 23 nt, Homo sapiens
gauaagcacuagaucucccuuaa

SEQ ID NO: 415318 - RNA, 15 nt, Homo sapiens
gauaaguguccccua

SEQ ID NO: 415319 - RNA, 16 nt, Homo sapiens
gauaaugauaguguuu

SEQ ID NO: 415320 - RNA, 19 nt, Homo sapiens
gauacaaauguuagucccu

SEQ ID NO: 415321 - RNA, 17 nt, Homo sapiens
gauacaaucagcugcuu

SEQ ID NO: 415322 - RNA, 13 nt, Homo sapiens
gauacaguauuau

SEQ ID NO: 415323 - RNA, 20 nt, Homo sapiens
gauacaugguugugaccuga

SEQ ID NO: 415324 - RNA, 21 nt, Homo sapiens
gauacccauagcuuccaugag

SEQ ID NO: 415325 - RNA, 17 nt, Homo sapiens
gauaccugugugucucc

SEQ ID NO: 415326 - RNA, 11 nt, Homo sapiens
gauacgcugga

SEQ ID NO: 415327 - RNA, 20 nt, Homo sapiens
gauacuaauaggugugugag

SEQ ID NO: 415328 - RNA, 19 nt, Homo sapiens
gauagaggaugggcagcug

SEQ ID NO: 415329 - RNA, 14 nt, Homo sapiens
gauagauaaugccu

SEQ ID NO: 415330 - RNA, 20 nt, Homo sapiens
gauagaucuuggcccuguua

SEQ ID NO: 415331 - RNA, 11 nt, Homo sapiens
gauagccuuug

SEQ ID NO: 415332 - RNA, 15 nt, Homo sapiens
gauaggcagcacuga

SEQ ID NO: 415333 - RNA, 16 nt, Homo sapiens
gauagguggugccagu

SEQ ID NO: 415334 - RNA, 19 nt, Homo sapiens
gauaguguuuuguacuugu

SEQ ID NO: 415335 - RNA, 16 nt, Homo sapiens
gauauaauuaacauaa

SEQ ID NO: 415336 - RNA, 13 nt, Homo sapiens
gauauacuggccc

SEQ ID NO: 415337 - RNA, 20 nt, Homo sapiens
gauauacuugagugugcaag

SEQ ID NO: 415338 - RNA, 20 nt, Homo sapiens
gauauauucuuuccaugcag

SEQ ID NO: 415339 - RNA, 21 nt, Homo sapiens
gauaucaugccccuguacucc

SEQ ID NO: 415340 - RNA, 17 nt, Homo sapiens
gauaucugaacacauac

SEQ ID NO: 415341 - RNA, 18 nt, Homo sapiens
gauaugagccuuugcaca

SEQ ID NO: 415342 - RNA, 18 nt, Homo sapiens
gauaugauuguaacauau

SEQ ID NO: 415343 - RNA, 14 nt, Homo sapiens
gauaugcaguaugc

SEQ ID NO: 415344 - RNA, 22 nt, Homo sapiens
gauaugcggcuaugccugccuc

SEQ ID NO: 415345 - RNA, 16 nt, Homo sapiens
gauauggagcccugua

SEQ ID NO: 415346 - RNA, 13 nt, Homo sapiens
gauauguggugua

SEQ ID NO: 415347 - RNA, 18 nt, Homo sapiens
gauauuaacaacaauaac

SEQ ID NO: 415348 - RNA, 20 nt, Homo sapiens
gauauuuaaaagacaaacac

SEQ ID NO: 415349 - RNA, 20 nt, Homo sapiens
gauauuuccuucaccaccuc

SEQ ID NO: 415350 - RNA, 22 nt, Homo sapiens
gaucaaaauaaaaagugacaca

SEQ ID NO: 415351 - RNA, 13 nt, Homo sapiens
gaucaacugaguu

SEQ ID NO: 415352 - RNA, 15 nt, Homo sapiens
gaucaagaagaucau

SEQ ID NO: 415353 - RNA, 11 nt, Homo sapiens
gaucacuugag

SEQ ID NO: 415354 - RNA, 15 nt, Homo sapiens
gaucagaauguuuca

SEQ ID NO: 415355 - RNA, 21 nt, Homo sapiens
gaucagccuccgccauuccaa

SEQ ID NO: 415356 - RNA, 17 nt, Homo sapiens
gaucaguggggccccaa

SEQ ID NO: 415357 - RNA, 21 nt, Homo sapiens
gaucaguuuuccuagucuuug

SEQ ID NO: 415358 - RNA, 16 nt, Homo sapiens
gaucauagcugacuca

SEQ ID NO: 415359 - RNA, 21 nt, Homo sapiens
gaucauauuucacaauccugu

SEQ ID NO: 415360 - RNA, 13 nt, Homo sapiens
gaucaucagucac

SEQ ID NO: 415361 - RNA, 14 nt, Homo sapiens
gaucaugcauuguu

SEQ ID NO: 415362 - RNA, 22 nt, Homo sapiens
gaucaugguuuagggugaucag

SEQ ID NO: 415363 - RNA, 21 nt, Homo sapiens
gaucauguaaaugcucaaaga

SEQ ID NO: 415364 - RNA, 15 nt, Homo sapiens
gaucauuugcagcug

SEQ ID NO: 415365 - RNA, 21 nt, Homo sapiens
gaucauuuuuaacugauucuu

SEQ ID NO: 415366 - RNA, 13 nt, Homo sapiens
gauccagacugua

SEQ ID NO: 415367 - RNA, 15 nt, Homo sapiens
gauccaggugccaag

SEQ ID NO: 415368 - RNA, 19 nt, Homo sapiens
gauccccgacaguggcucu

SEQ ID NO: 415369 - RNA, 19 nt, Homo sapiens
gauccucacccgaaucucc

SEQ ID NO: 415370 - RNA, 23 nt, Homo sapiens
gauccucauauggcccaguguca

SEQ ID NO: 415371 - RNA, 20 nt, Homo sapiens
gaucgcaccauugcacucca

SEQ ID NO: 415372 - RNA, 18 nt, Homo sapiens
gaucuaaaaggaggacag

SEQ ID NO: 415373 - RNA, 16 nt, Homo sapiens
gaucuaccugccucag

SEQ ID NO: 415374 - RNA, 23 nt, Homo sapiens
gaucuagguuuaacucagaucac

SEQ ID NO: 415375 - RNA, 15 nt, Homo sapiens
gaucuccccacucua

SEQ ID NO: 415376 - RNA, 22 nt, Homo sapiens
gaucucccuuaauaaacucaca

SEQ ID NO: 415377 - RNA, 18 nt, Homo sapiens
gaucucggcucacugcaa

SEQ ID NO: 415378 - RNA, 14 nt, Homo sapiens
gaucugaacacagu

SEQ ID NO: 415379 - RNA, 17 nt, Homo sapiens
gaucuggucccuugcag

SEQ ID NO: 415380 - RNA, 17 nt, Homo sapiens
gaucuguguuuacuuaa

SEQ ID NO: 415381 - RNA, 22 nt, Homo sapiens
gaugaaaaauaugugcuugaaa

SEQ ID NO: 415382 - RNA, 14 nt, Homo sapiens
gaugaaaaccugca

SEQ ID NO: 415383 - RNA, 19 nt, Homo sapiens
gaugaaaaugaaucuucac

SEQ ID NO: 415384 - RNA, 14 nt, Homo sapiens
gaugaaacuccuga

SEQ ID NO: 415385 - RNA, 12 nt, Homo sapiens
gaugaagcuucc

SEQ ID NO: 415386 - RNA, 16 nt, Homo sapiens
gaugagaaaacaggcu

SEQ ID NO: 415387 - RNA, 16 nt, Homo sapiens
gaugagugaggacuug

SEQ ID NO: 415388 - RNA, 14 nt, Homo sapiens
gaugauaaacacug

SEQ ID NO: 415389 - RNA, 21 nt, Homo sapiens
gaugaucaaaaccugugccag

SEQ ID NO: 415390 - RNA, 13 nt, Homo sapiens
gaugaucuacuca

SEQ ID NO: 415391 - RNA, 12 nt, Homo sapiens
gaugaugugaug

SEQ ID NO: 415392 - RNA, 22 nt, Homo sapiens
gaugcaccaaguacagccuuca

SEQ ID NO: 415393 - RNA, 13 nt, Homo sapiens
gaugcacuggccu

SEQ ID NO: 415394 - RNA, 23 nt, Homo sapiens
gaugcagaaauguggaugcucuu

SEQ ID NO: 415395 - RNA, 21 nt, Homo sapiens
gaugcauuccugagucuucca

SEQ ID NO: 415396 - RNA, 18 nt, Homo sapiens
gaugccguucccugaaca

SEQ ID NO: 415397 - RNA, 22 nt, Homo sapiens
gaugcuaucucgcuagccauau

SEQ ID NO: 415398 - RNA, 17 nt, Homo sapiens
gaugcucacauaugaua

SEQ ID NO: 415399 - RNA, 20 nt, Homo sapiens
gaugcugccuaggguugcuu

SEQ ID NO: 415400 - RNA, 14 nt, Homo sapiens
gauggaagcaccua

SEQ ID NO: 415401 - RNA, 18 nt, Homo sapiens
gauggaaguugcagugag

SEQ ID NO: 415402 - RNA, 16 nt, Homo sapiens
gauggaauaaagcccu

SEQ ID NO: 415403 - RNA, 17 nt, Homo sapiens
gauggaauaaagcccuu

SEQ ID NO: 415404 - RNA, 20 nt, Homo sapiens
gauggaauaaagcccuugaa

SEQ ID NO: 415405 - RNA, 17 nt, Homo sapiens
gauggaauaacucugug

SEQ ID NO: 415406 - RNA, 17 nt, Homo sapiens
gauggaggggugguccu

SEQ ID NO: 415407 - RNA, 19 nt, Homo sapiens
gauggaggggugguccuga

SEQ ID NO: 415408 - RNA, 23 nt, Homo sapiens
gauggaggggugguccugacuca

SEQ ID NO: 415409 - RNA, 17 nt, Homo sapiens
gauggagucagguuugg

SEQ ID NO: 415410 - RNA, 15 nt, Homo sapiens
gauggauggacacaa

SEQ ID NO: 415411 - RNA, 21 nt, Homo sapiens
gauggcauuuuuugcaaguua

SEQ ID NO: 415412 - RNA, 12 nt, Homo sapiens
gauggcugugaa

SEQ ID NO: 415413 - RNA, 18 nt, Homo sapiens
gaugggaguaagagcaaa

SEQ ID NO: 415414 - RNA, 13 nt, Homo sapiens
gaugggauuucau

SEQ ID NO: 415415 - RNA, 19 nt, Homo sapiens
gaugggguugggcucugcg

SEQ ID NO: 415416 - RNA, 22 nt, Homo sapiens
gauggguauuaaacuugucaga

SEQ ID NO: 415417 - RNA, 22 nt, Homo sapiens
gaugggucacuuguccucaguu

SEQ ID NO: 415418 - RNA, 13 nt, Homo sapiens
gaugguccacugu

SEQ ID NO: 415419 - RNA, 19 nt, Homo sapiens
gauggucccaggaagcagg

SEQ ID NO: 415420 - RNA, 16 nt, Homo sapiens
gauguaccauguuaaa

SEQ ID NO: 415421 - RNA, 23 nt, Homo sapiens
gauguacuuuaccugaaacaacc

SEQ ID NO: 415422 - RNA, 17 nt, Homo sapiens
gauguagaacuucaaga

SEQ ID NO: 415423 - RNA, 15 nt, Homo sapiens
gauguagucaguuag

SEQ ID NO: 415424 - RNA, 20 nt, Homo sapiens
gauguaucccugccccgugg

SEQ ID NO: 415425 - RNA, 17 nt, Homo sapiens
gauguaugaaggcuuuu

SEQ ID NO: 415426 - RNA, 19 nt, Homo sapiens
gauguauucagagccaccc

SEQ ID NO: 415427 - RNA, 17 nt, Homo sapiens
gaugugcauuucuguga

SEQ ID NO: 415428 - RNA, 21 nt, Homo sapiens
gauguguaaauggagcuugua

SEQ ID NO: 415429 - RNA, 13 nt, Homo sapiens
gaugugucuucaa

SEQ ID NO: 415430 - RNA, 18 nt, Homo sapiens
gauguuugaggcuuucag

SEQ ID NO: 415431 - RNA, 22 nt, Homo sapiens
gauguuuuaaguuuaucuuuca

SEQ ID NO: 415432 - RNA, 13 nt, Homo sapiens
gcccuauucugcc

SEQ ID NO: 415433 - RNA, 20 nt, Homo sapiens
gcccucaccacccacuugau

SEQ ID NO: 415434 - RNA, 15 nt, Homo sapiens
gcccucacuccacuc

SEQ ID NO: 415435 - RNA, 19 nt, Homo sapiens
gcccuccuucuugcccuga

SEQ ID NO: 415436 - RNA, 15 nt, Homo sapiens
gcccucucucugggc

SEQ ID NO: 415437 - RNA, 19 nt, Homo sapiens
gcccugaugcgucuaccca

SEQ ID NO: 415438 - RNA, 16 nt, Homo sapiens
gcccugcaccugugca

SEQ ID NO: 415439 - RNA, 13 nt, Homo sapiens
gcccugcaccuug

SEQ ID NO: 415440 - RNA, 14 nt, Homo sapiens
gcccugccaugcuc

SEQ ID NO: 415441 - RNA, 20 nt, Homo sapiens
gcccugcucugaacacgaag

SEQ ID NO: 415442 - RNA, 16 nt, Homo sapiens
gcccugggguuuccac

SEQ ID NO: 415443 - RNA, 14 nt, Homo sapiens
gcccugucagugca

SEQ ID NO: 415444 - RNA, 19 nt, Homo sapiens
gcccuguccuaagcacuuu

SEQ ID NO: 415445 - RNA, 14 nt, Homo sapiens
gcccuuguccugcc

SEQ ID NO: 415446 - RNA, 18 nt, Homo sapiens
gcccuuuggaaagccauu

SEQ ID NO: 415447 - RNA, 19 nt, Homo sapiens
gccgaaaaggauaugcagu

SEQ ID NO: 415448 - RNA, 12 nt, Homo sapiens
gccgacugccug

SEQ ID NO: 415449 - RNA, 17 nt, Homo sapiens
gccgacuggcugugaga

SEQ ID NO: 415450 - RNA, 16 nt, Homo sapiens
gccgcaugcauaaagu

SEQ ID NO: 415451 - RNA, 13 nt, Homo sapiens
gccgcccaaagag

SEQ ID NO: 415452 - RNA, 13 nt, Homo sapiens
gccgcgugacgga

SEQ ID NO: 415453 - RNA, 22 nt, Homo sapiens
gccgcugggagaaaagccagau

SEQ ID NO: 415454 - RNA, 13 nt, Homo sapiens
gccgcugggagag

SEQ ID NO: 415455 - RNA, 20 nt, Homo sapiens
gccgggcacagcugugguga

SEQ ID NO: 415456 - RNA, 17 nt, Homo sapiens
gccgucacgcuuucaug

SEQ ID NO: 415457 - RNA, 18 nt, Homo sapiens
gccguguuguagcuaauu

SEQ ID NO: 415458 - RNA, 21 nt, Homo sapiens
gccuagacucuguaacaucac

SEQ ID NO: 415459 - RNA, 17 nt, Homo sapiens
gccuaugccaccugcag

SEQ ID NO: 415460 - RNA, 22 nt, Homo sapiens
gccucaaagggacugccgccau

SEQ ID NO: 415461 - RNA, 18 nt, Homo sapiens
gccucagcugaaaacccg

SEQ ID NO: 415462 - RNA, 14 nt, Homo sapiens
gccucagugccacu

SEQ ID NO: 415463 - RNA, 13 nt, Homo sapiens
gccucauuucacu

SEQ ID NO: 415464 - RNA, 17 nt, Homo sapiens
gccuccaccgagccagc

SEQ ID NO: 415465 - RNA, 17 nt, Homo sapiens
gccuccagcuucaggca

SEQ ID NO: 415466 - RNA, 23 nt, Homo sapiens
gccuccaggcaggacgagacucc

SEQ ID NO: 415467 - RNA, 17 nt, Homo sapiens
gccucccaaagugcugg

SEQ ID NO: 415468 - RNA, 13 nt, Homo sapiens
gccucccaccaga

SEQ ID NO: 415469 - RNA, 21 nt, Homo sapiens
gccucccacccuucucaggga

SEQ ID NO: 415470 - RNA, 15 nt, Homo sapiens
gccucccagccaccc

SEQ ID NO: 415471 - RNA, 22 nt, Homo sapiens
gccuccccuggggcuggcagcu

SEQ ID NO: 415472 - RNA, 16 nt, Homo sapiens
gccucccuggggacca

SEQ ID NO: 415473 - RNA, 22 nt, Homo sapiens
gccucccuggggaccaggagcu

SEQ ID NO: 415474 - RNA, 16 nt, Homo sapiens
gccucccuuucuggga

SEQ ID NO: 415475 - RNA, 19 nt, Homo sapiens
gccuccucuaacaggggcu

SEQ ID NO: 415476 - RNA, 17 nt, Homo sapiens
gccucgcagccuccgga

SEQ ID NO: 415477 - RNA, 21 nt, Homo sapiens
gccucgcuucacggacaggaa

SEQ ID NO: 415478 - RNA, 19 nt, Homo sapiens
gccucggcaggaccccugg

SEQ ID NO: 415479 - RNA, 14 nt, Homo sapiens
gccucuagaacagc

SEQ ID NO: 415480 - RNA, 15 nt, Homo sapiens
gccucuagaacagcc

SEQ ID NO: 415481 - RNA, 16 nt, Homo sapiens
gccucuagaacagcca

SEQ ID NO: 415482 - RNA, 21 nt, Homo sapiens
gccucuagaacagccagaccc

SEQ ID NO: 415483 - RNA, 19 nt, Homo sapiens
gccucucauagaaauugcc

SEQ ID NO: 415484 - RNA, 21 nt, Homo sapiens
gccucucccaaguccagugug

SEQ ID NO: 415485 - RNA, 12 nt, Homo sapiens
gccucuccccaa

SEQ ID NO: 415486 - RNA, 19 nt, Homo sapiens
gccucuccccaaacauuaa

SEQ ID NO: 415487 - RNA, 22 nt, Homo sapiens
gccucugacagcagccugugag

SEQ ID NO: 415488 - RNA, 20 nt, Homo sapiens
gccucugcucccaugcucau

SEQ ID NO: 415489 - RNA, 18 nt, Homo sapiens
gccucuggaauugcucaa

SEQ ID NO: 415490 - RNA, 13 nt, Homo sapiens
gccucuggccaga

SEQ ID NO: 415491 - RNA, 19 nt, Homo sapiens
gccucuuccucccucauuc

SEQ ID NO: 415492 - RNA, 18 nt, Homo sapiens
gccugaaggcuauccacu

SEQ ID NO: 415493 - RNA, 14 nt, Homo sapiens
gccugacauugggg

SEQ ID NO: 415494 - RNA, 17 nt, Homo sapiens
gccugaccaaaagugag

SEQ ID NO: 415495 - RNA, 20 nt, Homo sapiens
gccugaggaugagcuggaag

SEQ ID NO: 415496 - RNA, 21 nt, Homo sapiens
gccugaggcaugagugacugu

SEQ ID NO: 415497 - RNA, 18 nt, Homo sapiens
gccugagucuccugugcc

SEQ ID NO: 415498 - RNA, 13 nt, Homo sapiens
gccugagugguga

SEQ ID NO: 415499 - RNA, 11 nt, Homo sapiens
gccugccaaac

SEQ ID NO: 415500 - RNA, 22 nt, Homo sapiens
gccugccccccucaucucauuc

SEQ ID NO: 415501 - RNA, 17 nt, Homo sapiens
gccugccccgacaccca

SEQ ID NO: 415502 - RNA, 23 nt, Homo sapiens
gccugcccuccccagagcacugg

SEQ ID NO: 415503 - RNA, 24 nt, Homo sapiens
gccugcgcagcuuggauggagacu

SEQ ID NO: 415504 - RNA, 13 nt, Homo sapiens
gccugcggacucc

SEQ ID NO: 415505 - RNA, 16 nt, Homo sapiens
gccuggacaacauagu

SEQ ID NO: 415506 - RNA, 17 nt, Homo sapiens
gccuggaugggggugca

SEQ ID NO: 415507 - RNA, 16 nt, Homo sapiens
gccuggcuccccacga

SEQ ID NO: 415508 - RNA, 17 nt, Homo sapiens
gccugucgcaugagaac

SEQ ID NO: 415509 - RNA, 21 nt, Homo sapiens
gccuguggaggaacuuuucaa

SEQ ID NO: 415510 - RNA, 11 nt, Homo sapiens
gccuguggcau

SEQ ID NO: 415511 - RNA, 18 nt, Homo sapiens
gccugugguuaacaucuc

SEQ ID NO: 415512 - RNA, 20 nt, Homo sapiens
gccugugguuacagugcaga

SEQ ID NO: 415513 - RNA, 14 nt, Homo sapiens
gccuguuccaugaa

SEQ ID NO: 415514 - RNA, 13 nt, Homo sapiens
gccuguugcugaa

SEQ ID NO: 415515 - RNA, 17 nt, Homo sapiens
gccuuaagaaagcuaua

SEQ ID NO: 415516 - RNA, 19 nt, Homo sapiens
gccuuaaguaauguuaauu

SEQ ID NO: 415517 - RNA, 18 nt, Homo sapiens
gccuuaaugacauucccc

SEQ ID NO: 415518 - RNA, 12 nt, Homo sapiens
gccuucacccau

SEQ ID NO: 415519 - RNA, 14 nt, Homo sapiens
gccuucaucuucac

SEQ ID NO: 415520 - RNA, 20 nt, Homo sapiens
gccuuccauaauuaugacag

SEQ ID NO: 415521 - RNA, 16 nt, Homo sapiens
gccuucccaugaaucu

SEQ ID NO: 415522 - RNA, 16 nt, Homo sapiens
gccuucuccacaggga

SEQ ID NO: 415523 - RNA, 22 nt, Homo sapiens
gccuucuccacagggacacagu

SEQ ID NO: 415524 - RNA, 15 nt, Homo sapiens
gccuucuucacccag

SEQ ID NO: 415525 - RNA, 16 nt, Homo sapiens
gccuugaaaccaccuu

SEQ ID NO: 415526 - RNA, 23 nt, Homo sapiens
gccuugcacaaaaagcacaagca

SEQ ID NO: 415527 - RNA, 15 nt, Homo sapiens
gccuugcaguaggca

SEQ ID NO: 415528 - RNA, 15 nt, Homo sapiens
gccuugcugcaccug

SEQ ID NO: 415529 - RNA, 14 nt, Homo sapiens
gccuugggcugcuc

SEQ ID NO: 415530 - RNA, 16 nt, Homo sapiens
gccuugguuuuaccug

SEQ ID NO: 415531 - RNA, 13 nt, Homo sapiens
gccuuguggcacu

SEQ ID NO: 415532 - RNA, 18 nt, Homo sapiens
gccuuuaaaucugugaug

SEQ ID NO: 415533 - RNA, 15 nt, Homo sapiens
gccuuuaucucugag

SEQ ID NO: 415534 - RNA, 21 nt, Homo sapiens
gccuuuauuuggcaaauaacu

SEQ ID NO: 415535 - RNA, 19 nt, Homo sapiens
gccuuuccccccagagggc

SEQ ID NO: 415536 - RNA, 13 nt, Homo sapiens
gccuuucuuccau

SEQ ID NO: 415537 - RNA, 21 nt, Homo sapiens
gccuuuguaagacacacagcc

SEQ ID NO: 415538 - RNA, 16 nt, Homo sapiens
gccuuuuauggaccaa

SEQ ID NO: 415539 - RNA, 15 nt, Homo sapiens
gccuuuucacugugu

SEQ ID NO: 415540 - RNA, 16 nt, Homo sapiens
gccuuuucucauucug

SEQ ID NO: 415541 - RNA, 22 nt, Homo sapiens
gcgaaaguaaaaacacuaccuc

SEQ ID NO: 415542 - RNA, 24 nt, Homo sapiens
gcgaaugauuuaaauagaacuuga

SEQ ID NO: 415543 - RNA, 13 nt, Homo sapiens
gcgagacauuggg

SEQ ID NO: 415544 - RNA, 16 nt, Homo sapiens
gcgagucuggagacca

SEQ ID NO: 415545 - RNA, 22 nt, Homo sapiens
gcgauccaccugucucagccuc

SEQ ID NO: 415546 - RNA, 23 nt, Homo sapiens
gcgcacuucccauuuguguuuca

SEQ ID NO: 415547 - RNA, 17 nt, Homo sapiens
gcgcaggcccuggugga

SEQ ID NO: 415548 - RNA, 19 nt, Homo sapiens
gcgcaguggggugaucuca

SEQ ID NO: 415549 - RNA, 18 nt, Homo sapiens
gcgcccagccucaucucu

SEQ ID NO: 415550 - RNA, 23 nt, Homo sapiens
gcgccccugccaccucccugacc

SEQ ID NO: 415551 - RNA, 15 nt, Homo sapiens
gcgccugugcugagg

SEQ ID NO: 415552 - RNA, 18 nt, Homo sapiens
gcgccuugccuccucacc

SEQ ID NO: 415553 - RNA, 13 nt, Homo sapiens
gcgcuauuacaaa

SEQ ID NO: 415554 - RNA, 14 nt, Homo sapiens
gcggaguugugcac

SEQ ID NO: 415555 - RNA, 20 nt, Homo sapiens
gcggcucaaaaggaaaccaa

SEQ ID NO: 415556 - RNA, 16 nt, Homo sapiens
gcgggaggcaccagcu

SEQ ID NO: 415557 - RNA, 17 nt, Homo sapiens
gcgggccaaggacugcc

SEQ ID NO: 415558 - RNA, 11 nt, Homo sapiens
gcggggaccau

SEQ ID NO: 415559 - RNA, 13 nt, Homo sapiens
gcgguauccagag

SEQ ID NO: 415560 - RNA, 22 nt, Homo sapiens
gcgguccugggauggggcaugu

SEQ ID NO: 415561 - RNA, 14 nt, Homo sapiens
gcguacagaucucu

SEQ ID NO: 415562 - RNA, 22 nt, Homo sapiens
uaaagaaugcaauccaugccau

SEQ ID NO: 415563 - RNA, 15 nt, Homo sapiens
uaaagacagaaggcc

SEQ ID NO: 415564 - RNA, 21 nt, Homo sapiens
uaaagacauaggaacauguag

SEQ ID NO: 415565 - RNA, 19 nt, Homo sapiens
uaaagagcagccuggcuaa

SEQ ID NO: 415566 - RNA, 17 nt, Homo sapiens
uaaagaugcuauucuuc

SEQ ID NO: 415567 - RNA, 19 nt, Homo sapiens
uaaagcacuauuguuuaga

SEQ ID NO: 415568 - RNA, 21 nt, Homo sapiens
uaaagcaguguuuucaccuca

SEQ ID NO: 415569 - RNA, 22 nt, Homo sapiens
uaaagcaguguuuucaccucau

SEQ ID NO: 415570 - RNA, 19 nt, Homo sapiens
uaaagccuagcgauaauuu

SEQ ID NO: 415571 - RNA, 16 nt, Homo sapiens
uaaagccuugugauca

SEQ ID NO: 415572 - RNA, 17 nt, Homo sapiens
uaaagcgaauggaccau

SEQ ID NO: 415573 - RNA, 23 nt, Homo sapiens
uaaagcuuguuuguucuaguuag

SEQ ID NO: 415574 - RNA, 16 nt, Homo sapiens
uaaaggaauuccccaa

SEQ ID NO: 415575 - RNA, 14 nt, Homo sapiens
uaaaggccuggaac

SEQ ID NO: 415576 - RNA, 14 nt, Homo sapiens
uaaaggcuguguca

SEQ ID NO: 415577 - RNA, 23 nt, Homo sapiens
uaaaggcuugauauuuuccaaau

SEQ ID NO: 415578 - RNA, 15 nt, Homo sapiens
uaaaguacguguuua

SEQ ID NO: 415579 - RNA, 18 nt, Homo sapiens
uaaaguauauuauuguga

SEQ ID NO: 415580 - RNA, 15 nt, Homo sapiens
uaaagucacagaauu

SEQ ID NO: 415581 - RNA, 16 nt, Homo sapiens
uaaagucaggauuuau

SEQ ID NO: 415582 - RNA, 16 nt, Homo sapiens
uaaaguccguauuucu

SEQ ID NO: 415583 - RNA, 16 nt, Homo sapiens
uaaaguuaauucauua

SEQ ID NO: 415584 - RNA, 17 nt, Homo sapiens
uaaaguuuaaauaccag

SEQ ID NO: 415585 - RNA, 21 nt, Homo sapiens
uaaaguuuuaggguacaguuu

SEQ ID NO: 415586 - RNA, 17 nt, Homo sapiens
uaaauaaacacauagau

SEQ ID NO: 415587 - RNA, 22 nt, Homo sapiens
uaaauaaagaagaaaauaaccu

SEQ ID NO: 415588 - RNA, 18 nt, Homo sapiens
uaaauaaaguuacuugaa

SEQ ID NO: 415589 - RNA, 21 nt, Homo sapiens
uaaauaaauguaucuuauuca

SEQ ID NO: 415590 - RNA, 14 nt, Homo sapiens
uaaauaaaugugag

SEQ ID NO: 415591 - RNA, 15 nt, Homo sapiens
uaaauaauaccauaa

SEQ ID NO: 415592 - RNA, 12 nt, Homo sapiens
uaaauacagaca

SEQ ID NO: 415593 - RNA, 21 nt, Homo sapiens
uaaauagaguauaugcacuuu

SEQ ID NO: 415594 - RNA, 14 nt, Homo sapiens
uaaauagaugaguc

SEQ ID NO: 415595 - RNA, 16 nt, Homo sapiens
uaaauagcaacaugcu

SEQ ID NO: 415596 - RNA, 22 nt, Homo sapiens
uaaauaucccagagaacaauca

SEQ ID NO: 415597 - RNA, 14 nt, Homo sapiens
uaaauaugaaauga

SEQ ID NO: 415598 - RNA, 21 nt, Homo sapiens
uaaauauuagaagccugcaga

SEQ ID NO: 415599 - RNA, 22 nt, Homo sapiens
uaaauauuagcaaagcaugcca

SEQ ID NO: 415600 - RNA, 18 nt, Homo sapiens
uaaaucaaauauauguca

SEQ ID NO: 415601 - RNA, 13 nt, Homo sapiens
uaaaucauuucau

SEQ ID NO: 415602 - RNA, 15 nt, Homo sapiens
uaaauccauuuucua

SEQ ID NO: 415603 - RNA, 22 nt, Homo sapiens
uaaaucugaguauauauuuaca

SEQ ID NO: 415604 - RNA, 15 nt, Homo sapiens
uaaaucuugcaacug

SEQ ID NO: 415605 - RNA, 23 nt, Homo sapiens
uaaaugaaauuguaaaaccuguc

SEQ ID NO: 415606 - RNA, 19 nt, Homo sapiens
uaaaugagugccacaaaag

SEQ ID NO: 415607 - RNA, 15 nt, Homo sapiens
uaaaugaucacucca

SEQ ID NO: 415608 - RNA, 14 nt, Homo sapiens
uaaauggaacaaac

SEQ ID NO: 415609 - RNA, 15 nt, Homo sapiens
uaaauggaacaaaca

SEQ ID NO: 415610 - RNA, 15 nt, Homo sapiens
uaaauggcaccugua

SEQ ID NO: 415611 - RNA, 18 nt, Homo sapiens
uaaauggcauaccaaaau

SEQ ID NO: 415612 - RNA, 18 nt, Homo sapiens
uaaaugggaaaugucgau

SEQ ID NO: 415613 - RNA, 16 nt, Homo sapiens
uaaauggugagaauua

SEQ ID NO: 415614 - RNA, 14 nt, Homo sapiens
uaaauguacauuaa

SEQ ID NO: 415615 - RNA, 20 nt, Homo sapiens
uaaauguacuacauuugcau

SEQ ID NO: 415616 - RNA, 11 nt, Homo sapiens
uaaaugugcag

SEQ ID NO: 415617 - RNA, 18 nt, Homo sapiens
uaaauguucuaacagauc

SEQ ID NO: 415618 - RNA, 17 nt, Homo sapiens
uaaauguuuaauaucug

SEQ ID NO: 415619 - RNA, 19 nt, Homo sapiens
uaaauuacuuuuucauucu

SEQ ID NO: 415620 - RNA, 20 nt, Homo sapiens
uaaauuacuuuuucauucuu

SEQ ID NO: 415621 - RNA, 23 nt, Homo sapiens
uaaauucuauaggaacauaugaa

SEQ ID NO: 415622 - RNA, 14 nt, Homo sapiens
uaaauucucaguca

SEQ ID NO: 415623 - RNA, 17 nt, Homo sapiens
uaaauuguuugaccaug

SEQ ID NO: 415624 - RNA, 17 nt, Homo sapiens
uaaauuuaauauacugc

SEQ ID NO: 415625 - RNA, 14 nt, Homo sapiens
uaaauuuguacuau

SEQ ID NO: 415626 - RNA, 15 nt, Homo sapiens
uaacaaacgcauuaa

SEQ ID NO: 415627 - RNA, 21 nt, Homo sapiens
uaacaaauguuuucauuuaca

SEQ ID NO: 415628 - RNA, 19 nt, Homo sapiens
uaacaacaauaacacuguc

SEQ ID NO: 415629 - RNA, 20 nt, Homo sapiens
uaacaacaauaacacugucu

SEQ ID NO: 415630 - RNA, 17 nt, Homo sapiens
uaacaacacuaauacac

SEQ ID NO: 415631 - RNA, 17 nt, Homo sapiens
uaacaaccccggacaaa

SEQ ID NO: 415632 - RNA, 16 nt, Homo sapiens
uaacaaguaccaaagu

SEQ ID NO: 415633 - RNA, 17 nt, Homo sapiens
uaacaauauaugauaua

SEQ ID NO: 415634 - RNA, 18 nt, Homo sapiens
uaacacuguaauaucuuu

SEQ ID NO: 415635 - RNA, 12 nt, Homo sapiens
uaacacuguaua

SEQ ID NO: 415636 - RNA, 18 nt, Homo sapiens
uaacagacauagacugca

SEQ ID NO: 415637 - RNA, 17 nt, Homo sapiens
uaacagauccuuucaaa

SEQ ID NO: 415638 - RNA, 19 nt, Homo sapiens
uaacagcauaauugccuuu

SEQ ID NO: 415639 - RNA, 16 nt, Homo sapiens
uaacaggauuagacag

SEQ ID NO: 415640 - RNA, 18 nt, Homo sapiens
uaacaggcauugcacuaa

SEQ ID NO: 415641 - RNA, 22 nt, Homo sapiens
uaacaggcucaauauuccugaa

SEQ ID NO: 415642 - RNA, 15 nt, Homo sapiens
uaacagucauuuaaa

SEQ ID NO: 415643 - RNA, 21 nt, Homo sapiens
uaacauaaaagugcuacuuga

SEQ ID NO: 415644 - RNA, 19 nt, Homo sapiens
uaacaucucuuucaucuag

SEQ ID NO: 415645 - RNA, 22 nt, Homo sapiens
uaacaugaaaaacacggcagcu

SEQ ID NO: 415646 - RNA, 12 nt, Homo sapiens
uaacaugcuuua

SEQ ID NO: 415647 - RNA, 16 nt, Homo sapiens
uaacauggaaguacua

SEQ ID NO: 415648 - RNA, 19 nt, Homo sapiens
uaacauucaguacuuuaug

SEQ ID NO: 415649 - RNA, 15 nt, Homo sapiens
uaacauugcacuuua

SEQ ID NO: 415650 - RNA, 20 nt, Homo sapiens
uaaccaaagguuuugcagcc

SEQ ID NO: 415651 - RNA, 16 nt, Homo sapiens
uaaccauguaucuaau

SEQ ID NO: 415652 - RNA, 16 nt, Homo sapiens
uaacccucacccacag

SEQ ID NO: 415653 - RNA, 17 nt, Homo sapiens
uaacccuccaccuccuc

SEQ ID NO: 415654 - RNA, 21 nt, Homo sapiens
uaacccuuuucaugauuucaa

SEQ ID NO: 415655 - RNA, 14 nt, Homo sapiens
uaaccucuacaggc

SEQ ID NO: 415656 - RNA, 12 nt, Homo sapiens
uaacggcacugu

SEQ ID NO: 415657 - RNA, 17 nt, Homo sapiens
uaacuacugcaaaaagu

SEQ ID NO: 415658 - RNA, 17 nt, Homo sapiens
uaacuagaauuuauuca

SEQ ID NO: 415659 - RNA, 13 nt, Homo sapiens
uaacuagaucucc

SEQ ID NO: 415660 - RNA, 12 nt, Homo sapiens
uaacuagauggu

SEQ ID NO: 415661 - RNA, 15 nt, Homo sapiens
uaacuauugcugcuu

SEQ ID NO: 415662 - RNA, 17 nt, Homo sapiens
uaacucagacauuccaa

SEQ ID NO: 415663 - RNA, 15 nt, Homo sapiens
uaacuccguuuccaa

SEQ ID NO: 415664 - RNA, 14 nt, Homo sapiens
uaacucuugcucac

SEQ ID NO: 415665 - RNA, 21 nt, Homo sapiens
uaacucuugcucacucccuaa

SEQ ID NO: 415666 - RNA, 15 nt, Homo sapiens
uaacugaauucugaa

SEQ ID NO: 415667 - RNA, 22 nt, Homo sapiens
uaacugcacacaugguuuccaa

SEQ ID NO: 415668 - RNA, 14 nt, Homo sapiens
uaacugugaaguuu

SEQ ID NO: 415669 - RNA, 13 nt, Homo sapiens
uaacugugaauaa

SEQ ID NO: 415670 - RNA, 15 nt, Homo sapiens
uaacuguuaguauua

SEQ ID NO: 415671 - RNA, 13 nt, Homo sapiens
uaacuuaauucaa

SEQ ID NO: 415672 - RNA, 23 nt, Homo sapiens
uaacuugugauuccagggcuguu

SEQ ID NO: 415673 - RNA, 22 nt, Homo sapiens
uaacuuugcuggaaaaucugua

SEQ ID NO: 415674 - RNA, 20 nt, Homo sapiens
uaagaaaauacaauaaacua

SEQ ID NO: 415675 - RNA, 15 nt, Homo sapiens
uaagaacuuugcaca

SEQ ID NO: 415676 - RNA, 18 nt, Homo sapiens
uaagaagagacugggaag

SEQ ID NO: 415677 - RNA, 21 nt, Homo sapiens
uaagaagccuuaccacgcagu

SEQ ID NO: 415678 - RNA, 17 nt, Homo sapiens
uaagaauaguucuaaaa

SEQ ID NO: 415679 - RNA, 17 nt, Homo sapiens
uaagaaugcagauuccu

SEQ ID NO: 415680 - RNA, 22 nt, Homo sapiens
uaagacaacaaagagaagcaga

SEQ ID NO: 415681 - RNA, 18 nt, Homo sapiens
uaagacaacaggcauuuu

SEQ ID NO: 415682 - RNA, 16 nt, Homo sapiens
uaagacauaucucuaa

SEQ ID NO: 415683 - RNA, 20 nt, Homo sapiens
uaagacccacaaacugccug

SEQ ID NO: 415684 - RNA, 15 nt, Homo sapiens
uaagagaaaugagcu

SEQ ID NO: 415685 - RNA, 16 nt, Homo sapiens
uaagagaaaugagcug

SEQ ID NO: 415686 - RNA, 18 nt, Homo sapiens
uaagagaaaugagcugca

SEQ ID NO: 415687 - RNA, 16 nt, Homo sapiens
uaagagauuaagaaua

SEQ ID NO: 415688 - RNA, 18 nt, Homo sapiens
uaagagguuuauuugggu

SEQ ID NO: 415689 - RNA, 15 nt, Homo sapiens
uaagauaauguugcu

SEQ ID NO: 415690 - RNA, 21 nt, Homo sapiens
uaagaucguucucugccucac

SEQ ID NO: 415691 - RNA, 14 nt, Homo sapiens
uaagauuuugccug

SEQ ID NO: 415692 - RNA, 21 nt, Homo sapiens
uaugacuguuuuuguaguggu

SEQ ID NO: 415693 - RNA, 20 nt, Homo sapiens
uaugaggggacugcaugcaa

SEQ ID NO: 415694 - RNA, 17 nt, Homo sapiens
uaugagucaaugugcag

SEQ ID NO: 415695 - RNA, 21 nt, Homo sapiens
uaugagucggauacccuggag

SEQ ID NO: 415696 - RNA, 17 nt, Homo sapiens
uaugauaaaacacugcc

SEQ ID NO: 415697 - RNA, 20 nt, Homo sapiens
uaugauaaauuugacuguua

SEQ ID NO: 415698 - RNA, 22 nt, Homo sapiens
uaugauaugcauguagcauaua

SEQ ID NO: 415699 - RNA, 20 nt, Homo sapiens
uaugaugguggaucaagaca

SEQ ID NO: 415700 - RNA, 20 nt, Homo sapiens
uaugauuuaagguacuuaaa

SEQ ID NO: 415701 - RNA, 19 nt, Homo sapiens
uaugcaaacaguucuugga

SEQ ID NO: 415702 - RNA, 17 nt, Homo sapiens
uaugcaguaugcuuaau

SEQ ID NO: 415703 - RNA, 18 nt, Homo sapiens
uaugcauguagcauauaa

SEQ ID NO: 415704 - RNA, 11 nt, Homo sapiens
uaugcauuuau

SEQ ID NO: 415705 - RNA, 18 nt, Homo sapiens
uaugcauuugcauuugcu

SEQ ID NO: 415706 - RNA, 20 nt, Homo sapiens
uaugcauuugcauuugcucu

SEQ ID NO: 415707 - RNA, 21 nt, Homo sapiens
uaugccaaaccuuggcauuuu

SEQ ID NO: 415708 - RNA, 20 nt, Homo sapiens
uaugccucuguguaucucag

SEQ ID NO: 415709 - RNA, 16 nt, Homo sapiens
uaugccuuaagccaau

SEQ ID NO: 415710 - RNA, 17 nt, Homo sapiens
uaugcgcaaaacugccu

SEQ ID NO: 415711 - RNA, 18 nt, Homo sapiens
uaugcucagggucaauuu

SEQ ID NO: 415712 - RNA, 22 nt, Homo sapiens
uaugcucagggucaauuucuuu

SEQ ID NO: 415713 - RNA, 18 nt, Homo sapiens
uaugcuguucauugauga

SEQ ID NO: 415714 - RNA, 17 nt, Homo sapiens
uaugcuuacucuugcuu

SEQ ID NO: 415715 - RNA, 19 nt, Homo sapiens
uaugcuuggcuaacuauau

SEQ ID NO: 415716 - RNA, 21 nt, Homo sapiens
uaugggcuuuguuaucuucca

SEQ ID NO: 415717 - RNA, 15 nt, Homo sapiens
uaugguaacugauga

SEQ ID NO: 415718 - RNA, 23 nt, Homo sapiens
uaugguguggaugggaaacugcu

SEQ ID NO: 415719 - RNA, 10 nt, Homo sapiens
uauguaaaaa

SEQ ID NO: 415720 - RNA, 16 nt, Homo sapiens
uauguaaaguauguaa

SEQ ID NO: 415721 - RNA, 19 nt, Homo sapiens
uauguaccauguacaugaa

SEQ ID NO: 415722 - RNA, 16 nt, Homo sapiens
uauguagaacuguuca

SEQ ID NO: 415723 - RNA, 16 nt, Homo sapiens
uauguagaugugcauu

SEQ ID NO: 415724 - RNA, 15 nt, Homo sapiens
uauguauaacaagcc

SEQ ID NO: 415725 - RNA, 19 nt, Homo sapiens
uaugucccaugaccuugac

SEQ ID NO: 415726 - RNA, 18 nt, Homo sapiens
uaugucuuacuacuuuaa

SEQ ID NO: 415727 - RNA, 21 nt, Homo sapiens
uaugugaauugaagucaucau

SEQ ID NO: 415728 - RNA, 21 nt, Homo sapiens
uaugugaccagacugcacagg

SEQ ID NO: 415729 - RNA, 14 nt, Homo sapiens
uaugugagcacaaa

SEQ ID NO: 415730 - RNA, 20 nt, Homo sapiens
uaugugagugaaaguacuuc

SEQ ID NO: 415731 - RNA, 13 nt, Homo sapiens
uaugugcacucau

SEQ ID NO: 415732 - RNA, 19 nt, Homo sapiens
uaugugcgugugugcaagu

SEQ ID NO: 415733 - RNA, 20 nt, Homo sapiens
uauguggacguaaucuccac

SEQ ID NO: 415734 - RNA, 20 nt, Homo sapiens
uauguggugguuucuauaca

SEQ ID NO: 415735 - RNA, 20 nt, Homo sapiens
uauguguggaugaugcugcc

SEQ ID NO: 415736 - RNA, 13 nt, Homo sapiens
uauguguguauau

SEQ ID NO: 415737 - RNA, 16 nt, Homo sapiens
uauguucccucuuguc

SEQ ID NO: 415738 - RNA, 18 nt, Homo sapiens
uauuaaaaacccauaacu

SEQ ID NO: 415739 - RNA, 20 nt, Homo sapiens
uauuaaauaaaugugcaugc

SEQ ID NO: 415740 - RNA, 17 nt, Homo sapiens
uauuaacuuuaauucuc

SEQ ID NO: 415741 - RNA, 20 nt, Homo sapiens
uauuaagauacuuagauuag

SEQ ID NO: 415742 - RNA, 22 nt, Homo sapiens
uauuaaguaugauugacacagc

SEQ ID NO: 415743 - RNA, 18 nt, Homo sapiens
uauuaaugaacugugaca

SEQ ID NO: 415744 - RNA, 19 nt, Homo sapiens
uauuaaugaacugugacag

SEQ ID NO: 415745 - RNA, 22 nt, Homo sapiens
uauuaauugccuuugagguuau

SEQ ID NO: 415746 - RNA, 12 nt, Homo sapiens
uauuaccagcaa

SEQ ID NO: 415747 - RNA, 13 nt, Homo sapiens
uauuaccaugaga

SEQ ID NO: 415748 - RNA, 19 nt, Homo sapiens
uauuaccuggucauuucaa

SEQ ID NO: 415749 - RNA, 17 nt, Homo sapiens
uauuacuccuugccauu

SEQ ID NO: 415750 - RNA, 12 nt, Homo sapiens
uauuacugaugu

SEQ ID NO: 415751 - RNA, 14 nt, Homo sapiens
uauuagaaugcaug

SEQ ID NO: 415752 - RNA, 22 nt, Homo sapiens
uauuaggcuauaaauguccuaa

SEQ ID NO: 415753 - RNA, 13 nt, Homo sapiens
uauuaguguuauu

SEQ ID NO: 415754 - RNA, 22 nt, Homo sapiens
uauuauaaaaauaucaaaaagg

SEQ ID NO: 415755 - RNA, 13 nt, Homo sapiens
uauuauaagcauu

SEQ ID NO: 415756 - RNA, 16 nt, Homo sapiens
uauuauacaaauacua

SEQ ID NO: 415757 - RNA, 15 nt, Homo sapiens
uauuauacuaagaaa

SEQ ID NO: 415758 - RNA, 17 nt, Homo sapiens
uauuauuggcuugcacu

SEQ ID NO: 415759 - RNA, 13 nt, Homo sapiens
uauuauuguggaa

SEQ ID NO: 415760 - RNA, 18 nt, Homo sapiens
uauucaagaaagauaucu

SEQ ID NO: 415761 - RNA, 14 nt, Homo sapiens
uauucacauauguc

SEQ ID NO: 415762 - RNA, 15 nt, Homo sapiens
uauucaccaucaugu

SEQ ID NO: 415763 - RNA, 14 nt, Homo sapiens
uauucauagcugua

SEQ ID NO: 415764 - RNA, 16 nt, Homo sapiens
uauuccauugugugag

SEQ ID NO: 415765 - RNA, 23 nt, Homo sapiens
uauuccccccacuuaagacugug

SEQ ID NO: 415766 - RNA, 14 nt, Homo sapiens
uauuccuaugcugc

SEQ ID NO: 415767 - RNA, 13 nt, Homo sapiens
uauuccugcauuu

SEQ ID NO: 415768 - RNA, 19 nt, Homo sapiens
uauuccugccuuucuucca

SEQ ID NO: 415769 - RNA, 12 nt, Homo sapiens
uauuccugguca

SEQ ID NO: 415770 - RNA, 21 nt, Homo sapiens
uauucuauaaacauaugcaaa

SEQ ID NO: 415771 - RNA, 19 nt, Homo sapiens
uauucucauuauuucauca

SEQ ID NO: 415772 - RNA, 21 nt, Homo sapiens
uauucucucuaugcaaaaugu

SEQ ID NO: 415773 - RNA, 15 nt, Homo sapiens
uauucucugcaauuu

SEQ ID NO: 415774 - RNA, 15 nt, Homo sapiens
uauucuucauaacaa

SEQ ID NO: 415775 - RNA, 16 nt, Homo sapiens
uauucuuuccaugcag

SEQ ID NO: 415776 - RNA, 23 nt, Homo sapiens
uauucuuuuuggaaauaaaauac

SEQ ID NO: 415777 - RNA, 21 nt, Homo sapiens
uauugagauaauuuauuuaau

SEQ ID NO: 415778 - RNA, 20 nt, Homo sapiens
uauuggaaaggucauugugg

SEQ ID NO: 415779 - RNA, 14 nt, Homo sapiens
uauuggaacauguc

SEQ ID NO: 415780 - RNA, 22 nt, Homo sapiens
uauugguuuuaaaaaagcauua

SEQ ID NO: 415781 - RNA, 14 nt, Homo sapiens
uauuguauguaccu

SEQ ID NO: 415782 - RNA, 14 nt, Homo sapiens
uauuguccauauca

SEQ ID NO: 415783 - RNA, 12 nt, Homo sapiens
uauugugagauu

SEQ ID NO: 415784 - RNA, 18 nt, Homo sapiens
uauuuaaaagacaaacac

SEQ ID NO: 415785 - RNA, 19 nt, Homo sapiens
uauuuaauaugcaucuuug

SEQ ID NO: 415786 - RNA, 20 nt, Homo sapiens
uauuuacuguacuaauuaga

SEQ ID NO: 415787 - RNA, 19 nt, Homo sapiens
uauuuacuuuuaccacuau

SEQ ID NO: 415788 - RNA, 21 nt, Homo sapiens
uauuuauauauuuauaacuca

SEQ ID NO: 415789 - RNA, 15 nt, Homo sapiens
uauuuaugugugagg

SEQ ID NO: 415790 - RNA, 13 nt, Homo sapiens
uauuuauuuacug

SEQ ID NO: 415791 - RNA, 11 nt, Homo sapiens
uauuucacuua

SEQ ID NO: 415792 - RNA, 19 nt, Homo sapiens
uauuucagucaucaucuca

SEQ ID NO: 415793 - RNA, 12 nt, Homo sapiens
uauuuccuugcc

SEQ ID NO: 415794 - RNA, 21 nt, Homo sapiens
uauuucuaucugcaaauaguu

SEQ ID NO: 415795 - RNA, 17 nt, Homo sapiens
uauuucucaacaaagca

SEQ ID NO: 415796 - RNA, 21 nt, Homo sapiens
uauuugaaaauuuuacuucca

SEQ ID NO: 415797 - RNA, 21 nt, Homo sapiens
uauuugacauucuucacuguc

SEQ ID NO: 415798 - RNA, 19 nt, Homo sapiens
uauuugagagaaucuacua

SEQ ID NO: 415799 - RNA, 16 nt, Homo sapiens
uauuugauaacaguua

SEQ ID NO: 415800 - RNA, 21 nt, Homo sapiens
uauuugauaacaguuacucca

SEQ ID NO: 415801 - RNA, 19 nt, Homo sapiens
uauuugauaaguuuucaca

SEQ ID NO: 415802 - RNA, 13 nt, Homo sapiens
uauuugcaauauu

SEQ ID NO: 415803 - RNA, 23 nt, Homo sapiens
uauuuggaaagcacuggaauuca

SEQ ID NO: 415804 - RNA, 16 nt, Homo sapiens
uauuuggauaucuguu

SEQ ID NO: 415805 - RNA, 13 nt, Homo sapiens
uauuugguacugu

SEQ ID NO: 415806 - RNA, 20 nt, Homo sapiens
uauuuuaaacuacugauuga

SEQ ID NO: 415807 - RNA, 16 nt, Homo sapiens
uauuuuaagcacucuu

SEQ ID NO: 415808 - RNA, 18 nt, Homo sapiens
uauuuuaagcacucuuaa

SEQ ID NO: 415809 - RNA, 17 nt, Homo sapiens
uauuuuaauaccuuuaa

SEQ ID NO: 415810 - RNA, 14 nt, Homo sapiens
uauuuuauacugca

SEQ ID NO: 415811 - RNA, 18 nt, Homo sapiens
uauuuuauacugcacuuu

SEQ ID NO: 415812 - RNA, 23 nt, Homo sapiens
uauuuuauauaauaaaguauucc

SEQ ID NO: 415813 - RNA, 17 nt, Homo sapiens
uauuuuauuauucagaa

SEQ ID NO: 415814 - RNA, 13 nt, Homo sapiens
uauuuucuguuga

SEQ ID NO: 415815 - RNA, 12 nt, Homo sapiens
uauuuugcccag

SEQ ID NO: 415816 - RNA, 16 nt, Homo sapiens
uauuuuguugccuuca

SEQ ID NO: 415817 - RNA, 22 nt, Homo sapiens
uauuuuguugccuucaucuuca

SEQ ID NO: 415818 - RNA, 15 nt, Homo sapiens
uauuuuuaccugccu

SEQ ID NO: 415819 - RNA, 18 nt, Homo sapiens
uauuuuuuacaauggcca

SEQ ID NO: 415820 - RNA, 17 nt, Homo sapiens
uauuuuuuuaagcugua

SEQ ID NO: 415821 - RNA, 18 nt, Homo sapiens
uauuuuuuuaagcuguaa

SEQ ID NO: 415822 - RNA, 20 nt, Homo sapiens
uccagccguguuguagcuaa

SEQ ID NO: 415823 - RNA, 20 nt, Homo sapiens
uccagccugggcaacagagc

SEQ ID NO: 415824 - RNA, 20 nt, Homo sapiens
uccagcuguacuagugccau

SEQ ID NO: 415825 - RNA, 16 nt, Homo sapiens
uccaggaaggcagcug

SEQ ID NO: 415826 - RNA, 19 nt, Homo sapiens
uccaggaauaggcauuugc

SEQ ID NO: 415827 - RNA, 22 nt, Homo sapiens
uccaggaauaggcauuugccua

SEQ ID NO: 415828 - RNA, 16 nt, Homo sapiens
uccaggagaccuucca

SEQ ID NO: 415829 - RNA, 19 nt, Homo sapiens
uccaggagaccuuccacaa

SEQ ID NO: 415830 - RNA, 15 nt, Homo sapiens
uccaggcgaugugca

SEQ ID NO: 415831 - RNA, 17 nt, Homo sapiens
uccagggccccccaaau

SEQ ID NO: 415832 - RNA, 22 nt, Homo sapiens
uccagggggcagcccaguggaa

SEQ ID NO: 415833 - RNA, 18 nt, Homo sapiens
uccaggguuaaagaaagg

SEQ ID NO: 415834 - RNA, 17 nt, Homo sapiens
uccaguauucuugucaa

SEQ ID NO: 415835 - RNA, 21 nt, Homo sapiens
uccaguauugaaaacuucaaa

SEQ ID NO: 415836 - RNA, 17 nt, Homo sapiens
uccaguccugcucucua

SEQ ID NO: 415837 - RNA, 13 nt, Homo sapiens
uccagucucaaaa

SEQ ID NO: 415838 - RNA, 14 nt, Homo sapiens
uccagugcaauugu

SEQ ID NO: 415839 - RNA, 15 nt, Homo sapiens
uccagugccuggauc

SEQ ID NO: 415840 - RNA, 10 nt, Homo sapiens
uccaguggac

SEQ ID NO: 415841 - RNA, 14 nt, Homo sapiens
uccaguggacacuu

SEQ ID NO: 415842 - RNA, 16 nt, Homo sapiens
uccagugugacuuuau

SEQ ID NO: 415843 - RNA, 18 nt, Homo sapiens
uccauaaaaguccuguca

SEQ ID NO: 415844 - RNA, 23 nt, Homo sapiens
uccauacccccugccccagagaa

SEQ ID NO: 415845 - RNA, 17 nt, Homo sapiens
uccauagacacaguauu

SEQ ID NO: 415846 - RNA, 18 nt, Homo sapiens
uccauagacacaguauug

SEQ ID NO: 415847 - RNA, 19 nt, Homo sapiens
uccauagcuucauccacug

SEQ ID NO: 415848 - RNA, 14 nt, Homo sapiens
uccauagugcacua

SEQ ID NO: 415849 - RNA, 14 nt, Homo sapiens
uccaucagccagac

SEQ ID NO: 415850 - RNA, 18 nt, Homo sapiens
uccaucagcucucugcaa

SEQ ID NO: 415851 - RNA, 15 nt, Homo sapiens
uccaucccgaaaauc

SEQ ID NO: 415852 - RNA, 15 nt, Homo sapiens
uccaucuccacucca

SEQ ID NO: 415853 - RNA, 14 nt, Homo sapiens
uccaucugucuguc

SEQ ID NO: 415854 - RNA, 19 nt, Homo sapiens
uccaucuguggaaaugaca

SEQ ID NO: 415855 - RNA, 22 nt, Homo sapiens
uccaucuuccacgaaaugggcc

SEQ ID NO: 415856 - RNA, 14 nt, Homo sapiens
uccaugaauguauc

SEQ ID NO: 415857 - RNA, 12 nt, Homo sapiens
uccaugauucca

SEQ ID NO: 415858 - RNA, 13 nt, Homo sapiens
uccaugcaugugc

SEQ ID NO: 415859 - RNA, 14 nt, Homo sapiens
uccaugccuuccau

SEQ ID NO: 415860 - RNA, 18 nt, Homo sapiens
uccaugcuccucacugcc

SEQ ID NO: 415861 - RNA, 16 nt, Homo sapiens
uccauggaugcaugcc

SEQ ID NO: 415862 - RNA, 12 nt, Homo sapiens
uccauguaucua

SEQ ID NO: 415863 - RNA, 15 nt, Homo sapiens
uccaugucugaaguu

SEQ ID NO: 415864 - RNA, 16 nt, Homo sapiens
uccaugugcccaguua

SEQ ID NO: 415865 - RNA, 15 nt, Homo sapiens
uccauguguaucugg

SEQ ID NO: 415866 - RNA, 14 nt, Homo sapiens
uccauuauuuauau

SEQ ID NO: 415867 - RNA, 19 nt, Homo sapiens
uccauuauuugaguuugac

SEQ ID NO: 415868 - RNA, 17 nt, Homo sapiens
uccauucccaacucucu

SEQ ID NO: 415869 - RNA, 17 nt, Homo sapiens
uccauucccaucacugc

SEQ ID NO: 415870 - RNA, 17 nt, Homo sapiens
uccauuuacuugaucau

SEQ ID NO: 415871 - RNA, 18 nt, Homo sapiens
uccauuuauaaccccagc

SEQ ID NO: 415872 - RNA, 16 nt, Homo sapiens
uccauuucaugugauc

SEQ ID NO: 415873 - RNA, 18 nt, Homo sapiens
uccauuugugugugugca

SEQ ID NO: 415874 - RNA, 22 nt, Homo sapiens
uccauuugugugugugcaagug

SEQ ID NO: 415875 - RNA, 22 nt, Homo sapiens
uccauuuuucccaggacaggaa

SEQ ID NO: 415876 - RNA, 17 nt, Homo sapiens
ucccaaacccagccucu

SEQ ID NO: 415877 - RNA, 19 nt, Homo sapiens
ucccaaacccagccucuag

SEQ ID NO: 415878 - RNA, 16 nt, Homo sapiens
ucccaaagcagugcau

SEQ ID NO: 415879 - RNA, 19 nt, Homo sapiens
ucccaaagugcugagauua

SEQ ID NO: 415880 - RNA, 16 nt, Homo sapiens
ucccaacucacugugc

SEQ ID NO: 415881 - RNA, 21 nt, Homo sapiens
ucccaacuuguauuaaagaca

SEQ ID NO: 415882 - RNA, 18 nt, Homo sapiens
ucccaagggaggcccaug

SEQ ID NO: 415883 - RNA, 21 nt, Homo sapiens
ucccaauaaaagugacucuca

SEQ ID NO: 415884 - RNA, 13 nt, Homo sapiens
ucccaauaaaguc

SEQ ID NO: 415885 - RNA, 15 nt, Homo sapiens
ucccaaucuuucuau

SEQ ID NO: 415886 - RNA, 22 nt, Homo sapiens
ucccaccaacucugcacuccau

SEQ ID NO: 415887 - RNA, 20 nt, Homo sapiens
ucccaccacagcagguguca

SEQ ID NO: 415888 - RNA, 13 nt, Homo sapiens
ucccaccagagac

SEQ ID NO: 415889 - RNA, 17 nt, Homo sapiens
ucccacccggcugcaua

SEQ ID NO: 415890 - RNA, 19 nt, Homo sapiens
ucccacccuucucagggac

SEQ ID NO: 415891 - RNA, 16 nt, Homo sapiens
ucccaccucaaauggg

SEQ ID NO: 415892 - RNA, 23 nt, Homo sapiens
ucccaccucuccuuuugaggcuu

SEQ ID NO: 415893 - RNA, 14 nt, Homo sapiens
ucccaccucugagg

SEQ ID NO: 415894 - RNA, 23 nt, Homo sapiens
ucccaccugcagagccagugucc

SEQ ID NO: 415895 - RNA, 20 nt, Homo sapiens
ucccacgucuggccaggcac

SEQ ID NO: 415896 - RNA, 15 nt, Homo sapiens
ucccacugggacaca

SEQ ID NO: 415897 - RNA, 23 nt, Homo sapiens
ucccacugggacacaaccacuaa

SEQ ID NO: 415898 - RNA, 16 nt, Homo sapiens
ucccacuuaucaaauc

SEQ ID NO: 415899 - RNA, 14 nt, Homo sapiens
ucccagaaccacac

SEQ ID NO: 415900 - RNA, 20 nt, Homo sapiens
ucccagcagcgguaccccag

SEQ ID NO: 415901 - RNA, 16 nt, Homo sapiens
ucccagcauguugaga

SEQ ID NO: 415902 - RNA, 13 nt, Homo sapiens
ucccagcauuugu

SEQ ID NO: 415903 - RNA, 14 nt, Homo sapiens
ucccagcuacaggg

SEQ ID NO: 415904 - RNA, 19 nt, Homo sapiens
ucccaggcccgagauguga

SEQ ID NO: 415905 - RNA, 17 nt, Homo sapiens
ucccaguucauguugcu

SEQ ID NO: 415906 - RNA, 23 nt, Homo sapiens
ucccauaacauaaaagugcuacu

SEQ ID NO: 415907 - RNA, 16 nt, Homo sapiens
ucccauagccaggaaa

SEQ ID NO: 415908 - RNA, 13 nt, Homo sapiens
ucccaugauuucu

SEQ ID NO: 415909 - RNA, 14 nt, Homo sapiens
ucccauggcccagc

SEQ ID NO: 415910 - RNA, 17 nt, Homo sapiens
ucccauguugcaugccu

SEQ ID NO: 415911 - RNA, 16 nt, Homo sapiens
ucccauuggucugcau

SEQ ID NO: 415912 - RNA, 22 nt, Homo sapiens
ucccauuguggcuccuaucugu

SEQ ID NO: 415913 - RNA, 18 nt, Homo sapiens
ucccauuugggcaguaua

SEQ ID NO: 415914 - RNA, 13 nt, Homo sapiens
uccccaacgaaaa

SEQ ID NO: 415915 - RNA, 16 nt, Homo sapiens
uccccaacgaaaagca

SEQ ID NO: 415916 - RNA, 21 nt, Homo sapiens
uccccaagcuggccacuauca

SEQ ID NO: 415917 - RNA, 14 nt, Homo sapiens
uccccacauaccau

SEQ ID NO: 415918 - RNA, 13 nt, Homo sapiens
uccccacucccug

SEQ ID NO: 415919 - RNA, 21 nt, Homo sapiens
uccccagaagcagccauaaaa

SEQ ID NO: 415920 - RNA, 15 nt, Homo sapiens
uccccagacuccacc

SEQ ID NO: 415921 - RNA, 16 nt, Homo sapiens
uccccauccuccagcu

SEQ ID NO: 415922 - RNA, 21 nt, Homo sapiens
ucccccaaacuucuuguucaa

SEQ ID NO: 415923 - RNA, 17 nt, Homo sapiens
ucccccagccucaaguc

SEQ ID NO: 415924 - RNA, 20 nt, Homo sapiens
ucccccagcuuucccgacac

SEQ ID NO: 415925 - RNA, 17 nt, Homo sapiens
ucccccucucccaguug

SEQ ID NO: 415926 - RNA, 16 nt, Homo sapiens
uccccguagccacucu

SEQ ID NO: 415927 - RNA, 15 nt, Homo sapiens
uccccgugggccaug

SEQ ID NO: 415928 - RNA, 19 nt, Homo sapiens
uccccgugggccauggcaa

SEQ ID NO: 415929 - RNA, 19 nt, Homo sapiens
uccccuaacccuacaugca

SEQ ID NO: 415930 - RNA, 20 nt, Homo sapiens
uccccuaacccuacaugcau

SEQ ID NO: 415931 - RNA, 22 nt, Homo sapiens
uccccucacuucucccaccugc

SEQ ID NO: 415932 - RNA, 15 nt, Homo sapiens
uccccucagauucca

SEQ ID NO: 415933 - RNA, 16 nt, Homo sapiens
uccccucagauuccac

SEQ ID NO: 415934 - RNA, 21 nt, Homo sapiens
uccccucauccacuaggugcc

SEQ ID NO: 415935 - RNA, 14 nt, Homo sapiens
uccccuccaaguga

SEQ ID NO: 415936 - RNA, 18 nt, Homo sapiens
uccccuccccucacuucu

SEQ ID NO: 415937 - RNA, 17 nt, Homo sapiens
uccccucccuguauaag

SEQ ID NO: 415938 - RNA, 14 nt, Homo sapiens
uccccuccuuccag

SEQ ID NO: 415939 - RNA, 15 nt, Homo sapiens
uccccucucuuugag

SEQ ID NO: 415940 - RNA, 22 nt, Homo sapiens
uccccugcugaagguggggauu

SEQ ID NO: 415941 - RNA, 22 nt, Homo sapiens
uccccuggggacgccaaggagg

SEQ ID NO: 415942 - RNA, 19 nt, Homo sapiens
uccccuuccuaaauaucca

SEQ ID NO: 415943 - RNA, 21 nt, Homo sapiens
uccccuuuggcuaccugaugg

SEQ ID NO: 415944 - RNA, 18 nt, Homo sapiens
uccccuuuguguagaaag

SEQ ID NO: 415945 - RNA, 19 nt, Homo sapiens
ucccgagcuacucucuugc

SEQ ID NO: 415946 - RNA, 21 nt, Homo sapiens
ucccgagcuacucucuugcca

SEQ ID NO: 415947 - RNA, 18 nt, Homo sapiens
ucccgaguaacugagauu

SEQ ID NO: 415948 - RNA, 20 nt, Homo sapiens
ucccgaguagcugggauuac

SEQ ID NO: 415949 - RNA, 14 nt, Homo sapiens
ucccgcaugcugcc

SEQ ID NO: 415950 - RNA, 19 nt, Homo sapiens
ucccggcgucccuaccucc

SEQ ID NO: 415951 - RNA, 23 nt, Homo sapiens
ucccguguuguaccugacuucca

SEQ ID NO: 415952 - RNA, 13 nt, Homo sapiens
ucugcugagcucu

SEQ ID NO: 415953 - RNA, 14 nt, Homo sapiens
ucugcugcuugaaa

SEQ ID NO: 415954 - RNA, 19 nt, Homo sapiens
ucugcuggccuggaucucc

SEQ ID NO: 415955 - RNA, 14 nt, Homo sapiens
ucugcuuaccacau

SEQ ID NO: 415956 - RNA, 20 nt, Homo sapiens
ucugcuuucuauuaccccuc

SEQ ID NO: 415957 - RNA, 19 nt, Homo sapiens
ucuggaaaacucaggauuc

SEQ ID NO: 415958 - RNA, 19 nt, Homo sapiens
ucuggaaagggcacgagag

SEQ ID NO: 415959 - RNA, 17 nt, Homo sapiens
ucuggaagaccugaaag

SEQ ID NO: 415960 - RNA, 14 nt, Homo sapiens
ucuggaagucaucu

SEQ ID NO: 415961 - RNA, 19 nt, Homo sapiens
ucuggaauugauauugaau

SEQ ID NO: 415962 - RNA, 11 nt, Homo sapiens
ucuggacaaag

SEQ ID NO: 415963 - RNA, 13 nt, Homo sapiens
ucuggacacugag

SEQ ID NO: 415964 - RNA, 17 nt, Homo sapiens
ucuggacauucagaaca

SEQ ID NO: 415965 - RNA, 18 nt, Homo sapiens
ucuggagguacgaaaaga

SEQ ID NO: 415966 - RNA, 19 nt, Homo sapiens
ucuggcaaacaugugcaac

SEQ ID NO: 415967 - RNA, 16 nt, Homo sapiens
ucuggccaaauaugca

SEQ ID NO: 415968 - RNA, 20 nt, Homo sapiens
ucuggccuugaaaccaccuu

SEQ ID NO: 415969 - RNA, 23 nt, Homo sapiens
ucuggcugccccaaccugcugaa

SEQ ID NO: 415970 - RNA, 17 nt, Homo sapiens
ucuggcuuuacauuuua

SEQ ID NO: 415971 - RNA, 18 nt, Homo sapiens
ucuggcuuuacauuuuau

SEQ ID NO: 415972 - RNA, 21 nt, Homo sapiens
ucugggaaaggugcucaaaga

SEQ ID NO: 415973 - RNA, 21 nt, Homo sapiens
ucugggagacuuugaagacca

SEQ ID NO: 415974 - RNA, 17 nt, Homo sapiens
ucugggaggggugcugc

SEQ ID NO: 415975 - RNA, 18 nt, Homo sapiens
ucugggccagaaguccuc

SEQ ID NO: 415976 - RNA, 14 nt, Homo sapiens
ucugggguggggcu

SEQ ID NO: 415977 - RNA, 18 nt, Homo sapiens
ucugguaucugcauguaa

SEQ ID NO: 415978 - RNA, 15 nt, Homo sapiens
ucuggugggaaaaug

SEQ ID NO: 415979 - RNA, 18 nt, Homo sapiens
ucugguguuacacauaca

SEQ ID NO: 415980 - RNA, 20 nt, Homo sapiens
ucugguugguaaagccucag

SEQ ID NO: 415981 - RNA, 23 nt, Homo sapiens
ucuguaaaauuagaggauugcac

SEQ ID NO: 415982 - RNA, 14 nt, Homo sapiens
ucuguaaacucaaa

SEQ ID NO: 415983 - RNA, 17 nt, Homo sapiens
ucuguaaaugaacacau

SEQ ID NO: 415984 - RNA, 13 nt, Homo sapiens
ucuguaaauggaa

SEQ ID NO: 415985 - RNA, 20 nt, Homo sapiens
ucuguaaauggaacaaacaa

SEQ ID NO: 415986 - RNA, 19 nt, Homo sapiens
ucuguaacaucacuaucca

SEQ ID NO: 415987 - RNA, 15 nt, Homo sapiens
ucuguaccuuucuaa

SEQ ID NO: 415988 - RNA, 16 nt, Homo sapiens
ucuguauucauacagc

SEQ ID NO: 415989 - RNA, 18 nt, Homo sapiens
ucugucaccgccaugcaa

SEQ ID NO: 415990 - RNA, 23 nt, Homo sapiens
ucugucaguaggggcaugguaua

SEQ ID NO: 415991 - RNA, 12 nt, Homo sapiens
ucugucaugaac

SEQ ID NO: 415992 - RNA, 14 nt, Homo sapiens
ucugucccaaagaa

SEQ ID NO: 415993 - RNA, 20 nt, Homo sapiens
ucuguccuggcugugcacau

SEQ ID NO: 415994 - RNA, 18 nt, Homo sapiens
ucugucuucacuauucag

SEQ ID NO: 415995 - RNA, 14 nt, Homo sapiens
ucugugaaaguaca

SEQ ID NO: 415996 - RNA, 21 nt, Homo sapiens
ucugugagacccccacaccuc

SEQ ID NO: 415997 - RNA, 14 nt, Homo sapiens
ucugugaugauccu

SEQ ID NO: 415998 - RNA, 14 nt, Homo sapiens
ucugugccccaugc

SEQ ID NO: 415999 - RNA, 16 nt, Homo sapiens
ucugugccgccaccuc

SEQ ID NO: 416000 - RNA, 19 nt, Homo sapiens
ucugugcucugaaugggag

SEQ ID NO: 416001 - RNA, 13 nt, Homo sapiens
ucugugucuguca

SEQ ID NO: 416002 - RNA, 20 nt, Homo sapiens
ucugugucugucaccacauc

SEQ ID NO: 416003 - RNA, 22 nt, Homo sapiens
ucuguuaaccaaauaaaacaua

SEQ ID NO: 416004 - RNA, 16 nt, Homo sapiens
ucuguucagaugugca

SEQ ID NO: 416005 - RNA, 21 nt, Homo sapiens
ucuguuguguuugucaaaaag

SEQ ID NO: 416006 - RNA, 22 nt, Homo sapiens
ucuguuguguuugucaaaaagu

SEQ ID NO: 416007 - RNA, 20 nt, Homo sapiens
ucuguuuccaggucagaaac

SEQ ID NO: 416008 - RNA, 23 nt, Homo sapiens
ucuguuucuaauuugcugcugau

SEQ ID NO: 416009 - RNA, 14 nt, Homo sapiens
ucuguuugagauuu

SEQ ID NO: 416010 - RNA, 14 nt, Homo sapiens
ucuuaacuauccua

SEQ ID NO: 416011 - RNA, 14 nt, Homo sapiens
ucuuaagcacuuug

SEQ ID NO: 416012 - RNA, 23 nt, Homo sapiens
ucuuaaguacugaaauacauaug

SEQ ID NO: 416013 - RNA, 15 nt, Homo sapiens
ucuuaauucugaugc

SEQ ID NO: 416014 - RNA, 23 nt, Homo sapiens
ucuuacaacaggcuuaugaauau

SEQ ID NO: 416015 - RNA, 17 nt, Homo sapiens
ucuuacaauugcacugc

SEQ ID NO: 416016 - RNA, 12 nt, Homo sapiens
ucuuacaguauu

SEQ ID NO: 416017 - RNA, 18 nt, Homo sapiens
ucuuacagucagcacaga

SEQ ID NO: 416018 - RNA, 21 nt, Homo sapiens
ucuuacgcucugcucaaugaa

SEQ ID NO: 416019 - RNA, 20 nt, Homo sapiens
ucuuacuacuuuaaauccua

SEQ ID NO: 416020 - RNA, 11 nt, Homo sapiens
ucuuacuuugu

SEQ ID NO: 416021 - RNA, 16 nt, Homo sapiens
ucuuagaaauacuugu

SEQ ID NO: 416022 - RNA, 14 nt, Homo sapiens
ucuuagacauuuau

SEQ ID NO: 416023 - RNA, 18 nt, Homo sapiens
ucuuagcacacucacaga

SEQ ID NO: 416024 - RNA, 21 nt, Homo sapiens
ucuuagcagcuuccagauuga

SEQ ID NO: 416025 - RNA, 18 nt, Homo sapiens
ucuuaguuuuuaaaaagg

SEQ ID NO: 416026 - RNA, 14 nt, Homo sapiens
ucuuaucauggucu

SEQ ID NO: 416027 - RNA, 21 nt, Homo sapiens
ucuuauccaacaucaacaucu

SEQ ID NO: 416028 - RNA, 22 nt, Homo sapiens
ucuuauggaggagaguguuuaa

SEQ ID NO: 416029 - RNA, 20 nt, Homo sapiens
ucuuaugggauuacauguua

SEQ ID NO: 416030 - RNA, 18 nt, Homo sapiens
ucuuauucaugcuuucuc

SEQ ID NO: 416031 - RNA, 19 nt, Homo sapiens
ucuuauucccaaacuacag

SEQ ID NO: 416032 - RNA, 19 nt, Homo sapiens
ucuuauugaaaacaacauu

SEQ ID NO: 416033 - RNA, 13 nt, Homo sapiens
ucuuauuugcuca

SEQ ID NO: 416034 - RNA, 14 nt, Homo sapiens
ucuuauuuuagaca

SEQ ID NO: 416035 - RNA, 20 nt, Homo sapiens
ucuuauuuuagacaaccaua

SEQ ID NO: 416036 - RNA, 20 nt, Homo sapiens
ucuucaccaggaagaaggcc

SEQ ID NO: 416037 - RNA, 13 nt, Homo sapiens
ucuucacuugcac

SEQ ID NO: 416038 - RNA, 15 nt, Homo sapiens
ucuucacuugcacug

SEQ ID NO: 416039 - RNA, 17 nt, Homo sapiens
ucuucagagcaagcacu

SEQ ID NO: 416040 - RNA, 13 nt, Homo sapiens
ucuucagcuuuga

SEQ ID NO: 416041 - RNA, 21 nt, Homo sapiens
ucuucaggagaaugugcagug

SEQ ID NO: 416042 - RNA, 16 nt, Homo sapiens
ucuucaggccucccuc

SEQ ID NO: 416043 - RNA, 15 nt, Homo sapiens
ucuucagggggccag

SEQ ID NO: 416044 - RNA, 19 nt, Homo sapiens
ucuuccacaaaaaauacuu

SEQ ID NO: 416045 - RNA, 16 nt, Homo sapiens
ucuuccagguacugau

SEQ ID NO: 416046 - RNA, 20 nt, Homo sapiens
ucuuccaucagcucucugca

SEQ ID NO: 416047 - RNA, 17 nt, Homo sapiens
ucuucccacuuugccac

SEQ ID NO: 416048 - RNA, 19 nt, Homo sapiens
ucuucccacuuugccacug

SEQ ID NO: 416049 - RNA, 20 nt, Homo sapiens
ucuucccuuaggcaauggug

SEQ ID NO: 416050 - RNA, 15 nt, Homo sapiens
ucuuccucuuaccug

SEQ ID NO: 416051 - RNA, 21 nt, Homo sapiens
ucuuccuuggaggggggagcc

SEQ ID NO: 416052 - RNA, 18 nt, Homo sapiens
ucuuccuuuucuuucucc

SEQ ID NO: 416053 - RNA, 14 nt, Homo sapiens
ucuucgcugugaug

SEQ ID NO: 416054 - RNA, 16 nt, Homo sapiens
ucuucuaccucuucca

SEQ ID NO: 416055 - RNA, 14 nt, Homo sapiens
ucuucucaagaucc

SEQ ID NO: 416056 - RNA, 16 nt, Homo sapiens
ucuucucaagcacuga

SEQ ID NO: 416057 - RNA, 23 nt, Homo sapiens
ucuucucaagcacugacacucau

SEQ ID NO: 416058 - RNA, 14 nt, Homo sapiens
ucuucucaaggaca

SEQ ID NO: 416059 - RNA, 15 nt, Homo sapiens
ucuucucuccacuuc

SEQ ID NO: 416060 - RNA, 22 nt, Homo sapiens
ucuucugaauauuuuaucuuuc

SEQ ID NO: 416061 - RNA, 14 nt, Homo sapiens
ucuucuuacaugca

SEQ ID NO: 416062 - RNA, 13 nt, Homo sapiens
ucuucuuacugua

SEQ ID NO: 416063 - RNA, 21 nt, Homo sapiens
ucuucuucucaagcacugaca

SEQ ID NO: 416064 - RNA, 20 nt, Homo sapiens
ucuucuugugauugcugcca

SEQ ID NO: 416065 - RNA, 14 nt, Homo sapiens
ucuucuuugcugca

SEQ ID NO: 416066 - RNA, 16 nt, Homo sapiens
ucuucuuuuauguaaa

SEQ ID NO: 416067 - RNA, 23 nt, Homo sapiens
ucuugaaauagguguuaccuucu

SEQ ID NO: 416068 - RNA, 13 nt, Homo sapiens
ucuugaagacuuu

SEQ ID NO: 416069 - RNA, 22 nt, Homo sapiens
ucuugaauguugaagaacucau

SEQ ID NO: 416070 - RNA, 13 nt, Homo sapiens
ucuugaccuggag

SEQ ID NO: 416071 - RNA, 18 nt, Homo sapiens
ucuugauaugaccuguua

SEQ ID NO: 416072 - RNA, 11 nt, Homo sapiens
ucuugaucucc

SEQ ID NO: 416073 - RNA, 17 nt, Homo sapiens
ucuugcacuauuccaca

SEQ ID NO: 416074 - RNA, 15 nt, Homo sapiens
ucuugccaccguccc

SEQ ID NO: 416075 - RNA, 18 nt, Homo sapiens
ucuugcggcaccgcccac

SEQ ID NO: 416076 - RNA, 14 nt, Homo sapiens
ucuugcucacuccc

SEQ ID NO: 416077 - RNA, 24 nt, Homo sapiens
ucuugcuguaacucagacauucca

SEQ ID NO: 416078 - RNA, 16 nt, Homo sapiens
ucuugcuuauucacug

SEQ ID NO: 416079 - RNA, 14 nt, Homo sapiens
ucuuggaccccuga

SEQ ID NO: 416080 - RNA, 13 nt, Homo sapiens
ucuuggauuggua

SEQ ID NO: 416081 - RNA, 15 nt, Homo sapiens
ucuuggcucacuaca

SEQ ID NO: 416082 - RNA, 18 nt, Homo sapiens
uuacuuugugcaauauga

SEQ ID NO: 416083 - RNA, 16 nt, Homo sapiens
uuacuuuuaccacuau

SEQ ID NO: 416084 - RNA, 23 nt, Homo sapiens
uuacuuuuuccuggcucaucucu

SEQ ID NO: 416085 - RNA, 23 nt, Homo sapiens
uuagaaaagacugaccuugaugu

SEQ ID NO: 416086 - RNA, 16 nt, Homo sapiens
uuagaagaaaauggau

SEQ ID NO: 416087 - RNA, 19 nt, Homo sapiens
uuagaagaaaauggaugac

SEQ ID NO: 416088 - RNA, 20 nt, Homo sapiens
uuagaagcagaucauuuccc

SEQ ID NO: 416089 - RNA, 19 nt, Homo sapiens
uuagaagcugagacacaaa

SEQ ID NO: 416090 - RNA, 15 nt, Homo sapiens
uuagacaauguggaa

SEQ ID NO: 416091 - RNA, 15 nt, Homo sapiens
uuagacauaccucuc

SEQ ID NO: 416092 - RNA, 23 nt, Homo sapiens
uuagacuuuuaacuucaccuuaa

SEQ ID NO: 416093 - RNA, 19 nt, Homo sapiens
uuagagagggugguuuucc

SEQ ID NO: 416094 - RNA, 23 nt, Homo sapiens
uuagaguggauagaaaauuaugc

SEQ ID NO: 416095 - RNA, 22 nt, Homo sapiens
uuagauacagagacuuggggaa

SEQ ID NO: 416096 - RNA, 19 nt, Homo sapiens
uuagauuuuaaaacuucau

SEQ ID NO: 416097 - RNA, 12 nt, Homo sapiens
uuagcaaagcau

SEQ ID NO: 416098 - RNA, 14 nt, Homo sapiens
uuagcacacucaca

SEQ ID NO: 416099 - RNA, 16 nt, Homo sapiens
uuagcacuaccauugu

SEQ ID NO: 416100 - RNA, 15 nt, Homo sapiens
uuagcaugcacaaag

SEQ ID NO: 416101 - RNA, 12 nt, Homo sapiens
uuagccccauga

SEQ ID NO: 416102 - RNA, 21 nt, Homo sapiens
uuagccccaugaguuugccau

SEQ ID NO: 416103 - RNA, 20 nt, Homo sapiens
uuagcugguggcaauaaaua

SEQ ID NO: 416104 - RNA, 21 nt, Homo sapiens
uuagcuucucugccaagcccu

SEQ ID NO: 416105 - RNA, 14 nt, Homo sapiens
uuaggcagggauuu

SEQ ID NO: 416106 - RNA, 19 nt, Homo sapiens
uuaggcuucuauuuccuuu

SEQ ID NO: 416107 - RNA, 14 nt, Homo sapiens
uuagggcuguagac

SEQ ID NO: 416108 - RNA, 23 nt, Homo sapiens
uuaguagagacaguguuuugcca

SEQ ID NO: 416109 - RNA, 14 nt, Homo sapiens
uuaguaugugucaa

SEQ ID NO: 416110 - RNA, 13 nt, Homo sapiens
uuaguccaaauaa

SEQ ID NO: 416111 - RNA, 21 nt, Homo sapiens
uuagugguaaaugucacauug

SEQ ID NO: 416112 - RNA, 19 nt, Homo sapiens
uuaguuuagguguuuggga

SEQ ID NO: 416113 - RNA, 13 nt, Homo sapiens
uuauaacucaugg

SEQ ID NO: 416114 - RNA, 17 nt, Homo sapiens
uuauaagacuacuauac

SEQ ID NO: 416115 - RNA, 19 nt, Homo sapiens
uuauaauaauguucucugg

SEQ ID NO: 416116 - RNA, 12 nt, Homo sapiens
uuauaccaagag

SEQ ID NO: 416117 - RNA, 19 nt, Homo sapiens
uuauaccagguuaccucac

SEQ ID NO: 416118 - RNA, 16 nt, Homo sapiens
uuauaccccauuugau

SEQ ID NO: 416119 - RNA, 20 nt, Homo sapiens
uuauacuagguuaacauuug

SEQ ID NO: 416120 - RNA, 16 nt, Homo sapiens
uuauacugcacuuuag

SEQ ID NO: 416121 - RNA, 19 nt, Homo sapiens
uuauacuguagcugaugaa

SEQ ID NO: 416122 - RNA, 12 nt, Homo sapiens
uuauacuuucag

SEQ ID NO: 416123 - RNA, 23 nt, Homo sapiens
uuauagaguguacuuaacuauuc

SEQ ID NO: 416124 - RNA, 18 nt, Homo sapiens
uuauaggacgaaugccaa

SEQ ID NO: 416125 - RNA, 22 nt, Homo sapiens
uuauauaaguuaaagagacaaa

SEQ ID NO: 416126 - RNA, 12 nt, Homo sapiens
uuauauaauuca

SEQ ID NO: 416127 - RNA, 20 nt, Homo sapiens
uuauauacuggaaauaaccu

SEQ ID NO: 416128 - RNA, 18 nt, Homo sapiens
uuauauauaugcuacuuu

SEQ ID NO: 416129 - RNA, 17 nt, Homo sapiens
uuauaucagacugcuuu

SEQ ID NO: 416130 - RNA, 21 nt, Homo sapiens
uuauaucagcagacacuccag

SEQ ID NO: 416131 - RNA, 15 nt, Homo sapiens
uuauaucagccugag

SEQ ID NO: 416132 - RNA, 18 nt, Homo sapiens
uuaucaauaaagcacuau

SEQ ID NO: 416133 - RNA, 14 nt, Homo sapiens
uuaucagucauaac

SEQ ID NO: 416134 - RNA, 21 nt, Homo sapiens
uuaucaucccaacagccaaga

SEQ ID NO: 416135 - RNA, 20 nt, Homo sapiens
uuaucauggguaucacauug

SEQ ID NO: 416136 - RNA, 17 nt, Homo sapiens
uuauccacaacuuuuca

SEQ ID NO: 416137 - RNA, 17 nt, Homo sapiens
uuauccugcuagcugua

SEQ ID NO: 416138 - RNA, 13 nt, Homo sapiens
uuauccugugcua

SEQ ID NO: 416139 - RNA, 15 nt, Homo sapiens
uuauccugugcuaca

SEQ ID NO: 416140 - RNA, 16 nt, Homo sapiens
uuauccuguuacugaa

SEQ ID NO: 416141 - RNA, 20 nt, Homo sapiens
uuaucugugcgugaaacaca

SEQ ID NO: 416142 - RNA, 18 nt, Homo sapiens
uuaucuguuaaccaaaua

SEQ ID NO: 416143 - RNA, 12 nt, Homo sapiens
uuaugacaugau

SEQ ID NO: 416144 - RNA, 22 nt, Homo sapiens
uuaugacuguuuuuguaguggu

SEQ ID NO: 416145 - RNA, 21 nt, Homo sapiens
uuaugagaaaugccagugugc

SEQ ID NO: 416146 - RNA, 15 nt, Homo sapiens
uuaugaggcuauuaa

SEQ ID NO: 416147 - RNA, 16 nt, Homo sapiens
uuaugaguucuguaua

SEQ ID NO: 416148 - RNA, 15 nt, Homo sapiens
uuaugauauucucau

SEQ ID NO: 416149 - RNA, 23 nt, Homo sapiens
uuaugauauucucauuauuucau

SEQ ID NO: 416150 - RNA, 13 nt, Homo sapiens
uuaugaucuuggc

SEQ ID NO: 416151 - RNA, 15 nt, Homo sapiens
uuaugcagugcugcu

SEQ ID NO: 416152 - RNA, 14 nt, Homo sapiens
uuaugcugugguca

SEQ ID NO: 416153 - RNA, 23 nt, Homo sapiens
uuauggaccaauuagcauuccau

SEQ ID NO: 416154 - RNA, 23 nt, Homo sapiens
uuauggcagaagggaauugcuca

SEQ ID NO: 416155 - RNA, 20 nt, Homo sapiens
uuaugggaacaaguguacag

SEQ ID NO: 416156 - RNA, 13 nt, Homo sapiens
uuauguacuuuga

SEQ ID NO: 416157 - RNA, 14 nt, Homo sapiens
uuauguacuuugau

SEQ ID NO: 416158 - RNA, 20 nt, Homo sapiens
uuaugugagagaaaguguga

SEQ ID NO: 416159 - RNA, 19 nt, Homo sapiens
uuaugugugaggagcugcu

SEQ ID NO: 416160 - RNA, 18 nt, Homo sapiens
uuauguguugaugacuca

SEQ ID NO: 416161 - RNA, 13 nt, Homo sapiens
uuauuaaaucagu

SEQ ID NO: 416162 - RNA, 23 nt, Homo sapiens
uuauuaauccacaaauaugcuaa

SEQ ID NO: 416163 - RNA, 17 nt, Homo sapiens
uuauuacauggggucua

SEQ ID NO: 416164 - RNA, 17 nt, Homo sapiens
uuauuacuccuugccau

SEQ ID NO: 416165 - RNA, 20 nt, Homo sapiens
uuauuauguccauuauucaa

SEQ ID NO: 416166 - RNA, 16 nt, Homo sapiens
uuauuauuagauucuc

SEQ ID NO: 416167 - RNA, 21 nt, Homo sapiens
uuauucaauaacuauugcugc

SEQ ID NO: 416168 - RNA, 15 nt, Homo sapiens
uuauuccuccaggaa

SEQ ID NO: 416169 - RNA, 17 nt, Homo sapiens
uuauuccuuauuucucu

SEQ ID NO: 416170 - RNA, 18 nt, Homo sapiens
uuauucuagggucuuacu

SEQ ID NO: 416171 - RNA, 19 nt, Homo sapiens
uuauugcuggaaucuacua

SEQ ID NO: 416172 - RNA, 17 nt, Homo sapiens
uuauuggccaaaugccu

SEQ ID NO: 416173 - RNA, 23 nt, Homo sapiens
uuauuguuuauuuaucagugaca

SEQ ID NO: 416174 - RNA, 16 nt, Homo sapiens
uuauuuacaugugauu

SEQ ID NO: 416175 - RNA, 14 nt, Homo sapiens
uuauuuauauauga

SEQ ID NO: 416176 - RNA, 14 nt, Homo sapiens
uuauuuauguaugu

SEQ ID NO: 416177 - RNA, 17 nt, Homo sapiens
uuauuucauucauaucc

SEQ ID NO: 416178 - RNA, 14 nt, Homo sapiens
uuauuuccauggau

SEQ ID NO: 416179 - RNA, 17 nt, Homo sapiens
uuauuuguacaguucag

SEQ ID NO: 416180 - RNA, 21 nt, Homo sapiens
uuauuuuuucgugcacucugc

SEQ ID NO: 416181 - RNA, 24 nt, Homo sapiens
uucaaaaauauuuauauugucacu

SEQ ID NO: 416182 - RNA, 19 nt, Homo sapiens
uucaaaacagaacggguuc

SEQ ID NO: 416183 - RNA, 23 nt, Homo sapiens
uucaaaauaaacaauaaaugggc

SEQ ID NO: 416184 - RNA, 12 nt, Homo sapiens
uucaaaauacuu

SEQ ID NO: 416185 - RNA, 15 nt, Homo sapiens
uucaaaauguuaaca

SEQ ID NO: 416186 - RNA, 12 nt, Homo sapiens
uucaaacagaac

SEQ ID NO: 416187 - RNA, 24 nt, Homo sapiens
uucaaacagaacugcagucagcau

SEQ ID NO: 416188 - RNA, 19 nt, Homo sapiens
uucaaaccugaccacagaa

SEQ ID NO: 416189 - RNA, 21 nt, Homo sapiens
uucaaaccugcauauugugau

SEQ ID NO: 416190 - RNA, 16 nt, Homo sapiens
uucaaagcaaccaccu

SEQ ID NO: 416191 - RNA, 19 nt, Homo sapiens
uucaacaugguuaccucug

SEQ ID NO: 416192 - RNA, 15 nt, Homo sapiens
uucaaccccaugaga

SEQ ID NO: 416193 - RNA, 21 nt, Homo sapiens
uucaagaaagauaucuaugac

SEQ ID NO: 416194 - RNA, 15 nt, Homo sapiens
uucaagacucaaugu

SEQ ID NO: 416195 - RNA, 18 nt, Homo sapiens
uucaagcuuucaaauccu

SEQ ID NO: 416196 - RNA, 23 nt, Homo sapiens
uucaaggcauuucuaucacauau

SEQ ID NO: 416197 - RNA, 16 nt, Homo sapiens
uucaaguaauugugaa

SEQ ID NO: 416198 - RNA, 18 nt, Homo sapiens
uucaaguauuagggguaa

SEQ ID NO: 416199 - RNA, 12 nt, Homo sapiens
uucaagugcuaa

SEQ ID NO: 416200 - RNA, 20 nt, Homo sapiens
uucaauaaaaugcacugacc

SEQ ID NO: 416201 - RNA, 22 nt, Homo sapiens
uucaauggcaccuucauucucc

SEQ ID NO: 416202 - RNA, 18 nt, Homo sapiens
uucacacaguaaagcagg

SEQ ID NO: 416203 - RNA, 14 nt, Homo sapiens
uucacacccugcaa

SEQ ID NO: 416204 - RNA, 19 nt, Homo sapiens
uucacaccgcugcacucaa

SEQ ID NO: 416205 - RNA, 13 nt, Homo sapiens
uucacaccuaccc

SEQ ID NO: 416206 - RNA, 17 nt, Homo sapiens
uucacagauaauuuacu

SEQ ID NO: 416207 - RNA, 16 nt, Homo sapiens
uucacaugagcuauuu

SEQ ID NO: 416208 - RNA, 19 nt, Homo sapiens
uucacauucccaucuguca

SEQ ID NO: 416209 - RNA, 23 nt, Homo sapiens
uucaccaauauuucucagacauc

SEQ ID NO: 416210 - RNA, 18 nt, Homo sapiens
uucaccagagcauuucca

SEQ ID NO: 416211 - RNA, 18 nt, Homo sapiens
ugucacccugcagagcua

SEQ ID NO: 416212 - RNA, 15 nt, Homo sapiens
ugucacuaaagcagg

SEQ ID NO: 416213 - RNA, 13 nt, Homo sapiens
ugucacucugccu

SEQ ID NO: 416214 - RNA, 15 nt, Homo sapiens
ugucagccaugacca

SEQ ID NO: 416215 - RNA, 16 nt, Homo sapiens
ugucagcuacuaauga

SEQ ID NO: 416216 - RNA, 18 nt, Homo sapiens
ugucagucuacaggccuu

SEQ ID NO: 416217 - RNA, 12 nt, Homo sapiens
ugucauaugcag

SEQ ID NO: 416218 - RNA, 23 nt, Homo sapiens
ugucaugucucugguggugcugg

SEQ ID NO: 416219 - RNA, 19 nt, Homo sapiens
ugucauuaauauauccuaa

SEQ ID NO: 416220 - RNA, 14 nt, Homo sapiens
ugucauuugcuaau

SEQ ID NO: 416221 - RNA, 16 nt, Homo sapiens
uguccaaguguuucuu

SEQ ID NO: 416222 - RNA, 15 nt, Homo sapiens
uguccaaucacauuc

SEQ ID NO: 416223 - RNA, 14 nt, Homo sapiens
uguccacaaauguc

SEQ ID NO: 416224 - RNA, 15 nt, Homo sapiens
uguccacauaaucca

SEQ ID NO: 416225 - RNA, 13 nt, Homo sapiens
uguccacaucuaa

SEQ ID NO: 416226 - RNA, 16 nt, Homo sapiens
uguccaccaccaccug

SEQ ID NO: 416227 - RNA, 17 nt, Homo sapiens
uguccaugccuacagau

SEQ ID NO: 416228 - RNA, 21 nt, Homo sapiens
uguccaugugugugcaagugu

SEQ ID NO: 416229 - RNA, 14 nt, Homo sapiens
ugucccacugggac

SEQ ID NO: 416230 - RNA, 17 nt, Homo sapiens
ugucccccaacuugaga

SEQ ID NO: 416231 - RNA, 18 nt, Homo sapiens
ugucccccaacuugagau

SEQ ID NO: 416232 - RNA, 18 nt, Homo sapiens
ugucccccuacccaccga

SEQ ID NO: 416233 - RNA, 19 nt, Homo sapiens
uguccccgccuucccucac

SEQ ID NO: 416234 - RNA, 15 nt, Homo sapiens
ugucccuaagagaug

SEQ ID NO: 416235 - RNA, 16 nt, Homo sapiens
ugucccucacuguuga

SEQ ID NO: 416236 - RNA, 21 nt, Homo sapiens
ugucccucuccuauguggcag

SEQ ID NO: 416237 - RNA, 23 nt, Homo sapiens
ugucccuuucuuggccaguuauc

SEQ ID NO: 416238 - RNA, 15 nt, Homo sapiens
uguccuaugcgcuca

SEQ ID NO: 416239 - RNA, 20 nt, Homo sapiens
uguccucagggcuacagcag

SEQ ID NO: 416240 - RNA, 16 nt, Homo sapiens
uguccuguuccugcca

SEQ ID NO: 416241 - RNA, 17 nt, Homo sapiens
uguccuguuccugccac

SEQ ID NO: 416242 - RNA, 21 nt, Homo sapiens
uguccuucccacggccacugc

SEQ ID NO: 416243 - RNA, 19 nt, Homo sapiens
ugucgcaugagaacauuaa

SEQ ID NO: 416244 - RNA, 22 nt, Homo sapiens
ugucuaauuaaaacacuuucaa

SEQ ID NO: 416245 - RNA, 12 nt, Homo sapiens
ugucuacugugg

SEQ ID NO: 416246 - RNA, 16 nt, Homo sapiens
ugucucaaaccuccaa

SEQ ID NO: 416247 - RNA, 20 nt, Homo sapiens
ugucucuacuaaaaaugcaa

SEQ ID NO: 416248 - RNA, 17 nt, Homo sapiens
ugucucuauccaucaga

SEQ ID NO: 416249 - RNA, 17 nt, Homo sapiens
ugucucuuuccacuuug

SEQ ID NO: 416250 - RNA, 16 nt, Homo sapiens
ugucugacaaccucuu

SEQ ID NO: 416251 - RNA, 16 nt, Homo sapiens
ugucuggaagacaugu

SEQ ID NO: 416252 - RNA, 19 nt, Homo sapiens
ugucugggaaagcagagug

SEQ ID NO: 416253 - RNA, 22 nt, Homo sapiens
ugucuguaucggagacagugau

SEQ ID NO: 416254 - RNA, 15 nt, Homo sapiens
ugucuguauucauac

SEQ ID NO: 416255 - RNA, 23 nt, Homo sapiens
ugucugucccaguuaacuguuaa

SEQ ID NO: 416256 - RNA, 18 nt, Homo sapiens
ugucuuuaacucauaaaa

SEQ ID NO: 416257 - RNA, 15 nt, Homo sapiens
ugucuuuaacuguca

SEQ ID NO: 416258 - RNA, 17 nt, Homo sapiens
ugucuuuauucuuauua

SEQ ID NO: 416259 - RNA, 15 nt, Homo sapiens
ugucuuuggcuucag

SEQ ID NO: 416260 - RNA, 19 nt, Homo sapiens
ugucuuuuuuuacuuaugc

SEQ ID NO: 416261 - RNA, 22 nt, Homo sapiens
ugugaaauaaauaugaauggag

SEQ ID NO: 416262 - RNA, 17 nt, Homo sapiens
ugugaaauucucuuucc

SEQ ID NO: 416263 - RNA, 19 nt, Homo sapiens
ugugaacaagugaacacau

SEQ ID NO: 416264 - RNA, 18 nt, Homo sapiens
ugugaacuuaucaaaaau

SEQ ID NO: 416265 - RNA, 18 nt, Homo sapiens
ugugaagcaccuacuaug

SEQ ID NO: 416266 - RNA, 21 nt, Homo sapiens
ugugaagugaaugaaacacuc

SEQ ID NO: 416267 - RNA, 17 nt, Homo sapiens
ugugaauguggauucuu

SEQ ID NO: 416268 - RNA, 19 nt, Homo sapiens
ugugacaucuacaacucca

SEQ ID NO: 416269 - RNA, 15 nt, Homo sapiens
ugugacauucacuca

SEQ ID NO: 416270 - RNA, 15 nt, Homo sapiens
ugugaccauuuauaa

SEQ ID NO: 416271 - RNA, 12 nt, Homo sapiens
ugugaccuugac

SEQ ID NO: 416272 - RNA, 22 nt, Homo sapiens
ugugacuugaacuagauugcau

SEQ ID NO: 416273 - RNA, 22 nt, Homo sapiens
ugugacuuuuuagccagugacu

SEQ ID NO: 416274 - RNA, 14 nt, Homo sapiens
ugugagccuugcug

SEQ ID NO: 416275 - RNA, 18 nt, Homo sapiens
ugugagccuugcugccaa

SEQ ID NO: 416276 - RNA, 20 nt, Homo sapiens
ugugagcuuucugauacuua

SEQ ID NO: 416277 - RNA, 18 nt, Homo sapiens
ugugagugugugcaagua

SEQ ID NO: 416278 - RNA, 17 nt, Homo sapiens
ugugauauguguaauau

SEQ ID NO: 416279 - RNA, 15 nt, Homo sapiens
ugugaugcaugagcu

SEQ ID NO: 416280 - RNA, 17 nt, Homo sapiens
ugugauggauggacaca

SEQ ID NO: 416281 - RNA, 22 nt, Homo sapiens
ugugauuggcagcuucaaaaca

SEQ ID NO: 416282 - RNA, 20 nt, Homo sapiens
ugugauuuauuuauuucuac

SEQ ID NO: 416283 - RNA, 21 nt, Homo sapiens
ugugcaaauccccuccccaaa

SEQ ID NO: 416284 - RNA, 22 nt, Homo sapiens
ugugcaagugugugcaugugug

SEQ ID NO: 416285 - RNA, 21 nt, Homo sapiens
ugugcaguggccccauccagc

SEQ ID NO: 416286 - RNA, 20 nt, Homo sapiens
ugugcauuucaccugugaca

SEQ ID NO: 416287 - RNA, 16 nt, Homo sapiens
ugugccaggacuguga

SEQ ID NO: 416288 - RNA, 20 nt, Homo sapiens
ugugcccagagaugggacug

SEQ ID NO: 416289 - RNA, 15 nt, Homo sapiens
ugugccccaugucca

SEQ ID NO: 416290 - RNA, 22 nt, Homo sapiens
ugugccccauguccaaguccaa

SEQ ID NO: 416291 - RNA, 16 nt, Homo sapiens
ugugccgaaugugcag

SEQ ID NO: 416292 - RNA, 16 nt, Homo sapiens
ugugccuguggcauga

SEQ ID NO: 416293 - RNA, 19 nt, Homo sapiens
ugugcuaaguugucuuaca

SEQ ID NO: 416294 - RNA, 9 nt, Homo sapiens
ugugcucca

SEQ ID NO: 416295 - RNA, 19 nt, Homo sapiens
ugugcugcaccccaugugg

SEQ ID NO: 416296 - RNA, 15 nt, Homo sapiens
uguggaaaacucaca

SEQ ID NO: 416297 - RNA, 18 nt, Homo sapiens
uguggaauuacauaacag

SEQ ID NO: 416298 - RNA, 15 nt, Homo sapiens
uguggaauuaccuga

SEQ ID NO: 416299 - RNA, 20 nt, Homo sapiens
uguggacaaugaguggaaua

SEQ ID NO: 416300 - RNA, 13 nt, Homo sapiens
uguggacugugau

SEQ ID NO: 416301 - RNA, 17 nt, Homo sapiens
uguggagagugagaaua

SEQ ID NO: 416302 - RNA, 16 nt, Homo sapiens
uguggagcacguggag

SEQ ID NO: 416303 - RNA, 22 nt, Homo sapiens
uguggagggauugaacacaggc

SEQ ID NO: 416304 - RNA, 15 nt, Homo sapiens
uguggaugucuuccu

SEQ ID NO: 416305 - RNA, 18 nt, Homo sapiens
uguggcacacaacugugg

SEQ ID NO: 416306 - RNA, 13 nt, Homo sapiens
uguggcacuccaa

SEQ ID NO: 416307 - RNA, 14 nt, Homo sapiens
uguggcagcugucu

SEQ ID NO: 416308 - RNA, 15 nt, Homo sapiens
uguggccccuuuuac

SEQ ID NO: 416309 - RNA, 17 nt, Homo sapiens
uguggcucacgugugug

SEQ ID NO: 416310 - RNA, 14 nt, Homo sapiens
ugugggaaggcaaa

SEQ ID NO: 416311 - RNA, 19 nt, Homo sapiens
ugugggaaugcggcaagaa

SEQ ID NO: 416312 - RNA, 17 nt, Homo sapiens
ugugggagccugcaaac

SEQ ID NO: 416313 - RNA, 14 nt, Homo sapiens
ugugggcugugagu

SEQ ID NO: 416314 - RNA, 15 nt, Homo sapiens
uguggguauucacca

SEQ ID NO: 416315 - RNA, 19 nt, Homo sapiens
ugugggugucagucaggga

SEQ ID NO: 416316 - RNA, 20 nt, Homo sapiens
uguggguuucucugugcucu

SEQ ID NO: 416317 - RNA, 15 nt, Homo sapiens
uguggucacacugug

SEQ ID NO: 416318 - RNA, 18 nt, Homo sapiens
uguggugcaguaaccauu

SEQ ID NO: 416319 - RNA, 19 nt, Homo sapiens
uguguaaauguuaugacuc

SEQ ID NO: 416320 - RNA, 20 nt, Homo sapiens
uguguaaccagcagucacag

SEQ ID NO: 416321 - RNA, 20 nt, Homo sapiens
uguguaagucaacucuucag

SEQ ID NO: 416322 - RNA, 17 nt, Homo sapiens
uguguacaaacccagau

SEQ ID NO: 416323 - RNA, 20 nt, Homo sapiens
uguguagcaaauuucgagca

SEQ ID NO: 416324 - RNA, 23 nt, Homo sapiens
uguguauauaguaugaaugcagu

SEQ ID NO: 416325 - RNA, 22 nt, Homo sapiens
uguguauauauaguagcauuuc

SEQ ID NO: 416326 - RNA, 9 nt, Homo sapiens
uguguauga

SEQ ID NO: 416327 - RNA, 13 nt, Homo sapiens
uguguaugugcgu

SEQ ID NO: 416328 - RNA, 16 nt, Homo sapiens
uguguauguuugcaca

SEQ ID NO: 416329 - RNA, 19 nt, Homo sapiens
uguguauuuccagugcaau

SEQ ID NO: 416330 - RNA, 24 nt, Homo sapiens
uguguauuuccagugcaauuguag

SEQ ID NO: 416331 - RNA, 15 nt, Homo sapiens
ugugucagcuacugc

SEQ ID NO: 416332 - RNA, 13 nt, Homo sapiens
uguguccaugugu

SEQ ID NO: 416333 - RNA, 17 nt, Homo sapiens
uguguccccugaccugu

SEQ ID NO: 416334 - RNA, 19 nt, Homo sapiens
ugugugaaauucucuuucc

SEQ ID NO: 416335 - RNA, 13 nt, Homo sapiens
ugugugaagauca

SEQ ID NO: 416336 - RNA, 15 nt, Homo sapiens
ugugugaguguacca

SEQ ID NO: 416337 - RNA, 22 nt, Homo sapiens
ugugugauuuuuauuuucuucu

SEQ ID NO: 416338 - RNA, 15 nt, Homo sapiens
uuaaauaaaccucaa

SEQ ID NO: 416339 - RNA, 19 nt, Homo sapiens
uuaaauaaaguuacuugaa

SEQ ID NO: 416340 - RNA, 19 nt, Homo sapiens
uuaaauaaaucauuaauac

SEQ ID NO: 416341 - RNA, 19 nt, Homo sapiens
uuaaauaccaguacuugag

SEQ ID NO: 416342 - RNA, 22 nt, Homo sapiens
uuaaaucacagauggguauuaa

SEQ ID NO: 416343 - RNA, 13 nt, Homo sapiens
uuaaaucugugaa

SEQ ID NO: 416344 - RNA, 20 nt, Homo sapiens
uuaaauggugauuucuugcu

SEQ ID NO: 416345 - RNA, 18 nt, Homo sapiens
uuaaauguccguguaaaa

SEQ ID NO: 416346 - RNA, 23 nt, Homo sapiens
uuaaauuugcaaaucucaggaua

SEQ ID NO: 416347 - RNA, 17 nt, Homo sapiens
ggcaggcgguccccauc

SEQ ID NO: 416348 - RNA, 22 nt, Homo sapiens
ggcagggaagaggccagcguga

SEQ ID NO: 416349 - RNA, 14 nt, Homo sapiens
ggcagggagugucu

SEQ ID NO: 416350 - RNA, 22 nt, Homo sapiens
ggcagucugaacccuugugcuu

SEQ ID NO: 416351 - RNA, 14 nt, Homo sapiens
ggcagugcauguga

SEQ ID NO: 416352 - RNA, 23 nt, Homo sapiens
ggcaguuuuuguuccuuccugcg

SEQ ID NO: 416353 - RNA, 23 nt, Homo sapiens
ggcauagaacuccggaaugacca

SEQ ID NO: 416354 - RNA, 16 nt, Homo sapiens
ggcauaggccugggug

SEQ ID NO: 416355 - RNA, 20 nt, Homo sapiens
ggcauaucuuguuguucagu

SEQ ID NO: 416356 - RNA, 22 nt, Homo sapiens
ggcauccacccagugcugccau

SEQ ID NO: 416357 - RNA, 13 nt, Homo sapiens
ggcauccaguauc

SEQ ID NO: 416358 - RNA, 14 nt, Homo sapiens
ggcaucuccaggaa

SEQ ID NO: 416359 - RNA, 16 nt, Homo sapiens
ggcaucuccugugcau

SEQ ID NO: 416360 - RNA, 21 nt, Homo sapiens
ggcaucuccugugcaugggug

SEQ ID NO: 416361 - RNA, 14 nt, Homo sapiens
ggcaugaagcacau

SEQ ID NO: 416362 - RNA, 14 nt, Homo sapiens
ggcaugacacucua

SEQ ID NO: 416363 - RNA, 18 nt, Homo sapiens
ggcaugggaaugaauguc

SEQ ID NO: 416364 - RNA, 17 nt, Homo sapiens
ggcaugguggcacgugc

SEQ ID NO: 416365 - RNA, 13 nt, Homo sapiens
ggcaugugugccu

SEQ ID NO: 416366 - RNA, 21 nt, Homo sapiens
ggcauucgcagugcccaguga

SEQ ID NO: 416367 - RNA, 18 nt, Homo sapiens
ggccaaauaugcacuuuc

SEQ ID NO: 416368 - RNA, 15 nt, Homo sapiens
ggccacacccaggaa

SEQ ID NO: 416369 - RNA, 16 nt, Homo sapiens
ggccaccaugcacuca

SEQ ID NO: 416370 - RNA, 19 nt, Homo sapiens
ggccacucccugccaacuc

SEQ ID NO: 416371 - RNA, 17 nt, Homo sapiens
ggccacuggcaucucug

SEQ ID NO: 416372 - RNA, 17 nt, Homo sapiens
ggccacuguggccagag

SEQ ID NO: 416373 - RNA, 15 nt, Homo sapiens
ggccagaagaucuac

SEQ ID NO: 416374 - RNA, 22 nt, Homo sapiens
ggccagccccucccaccacagc

SEQ ID NO: 416375 - RNA, 23 nt, Homo sapiens
ggccaggcaacgugcgugucucu

SEQ ID NO: 416376 - RNA, 20 nt, Homo sapiens
ggccaggcuggucuugaacu

SEQ ID NO: 416377 - RNA, 15 nt, Homo sapiens
ggccaguagcugcca

SEQ ID NO: 416378 - RNA, 23 nt, Homo sapiens
ggccagucaggcugcagaggcac

SEQ ID NO: 416379 - RNA, 17 nt, Homo sapiens
ggccaugagcuccagac

SEQ ID NO: 416380 - RNA, 15 nt, Homo sapiens
ggccauggcaugugu

SEQ ID NO: 416381 - RNA, 18 nt, Homo sapiens
ggcccaauucugccacuu

SEQ ID NO: 416382 - RNA, 17 nt, Homo sapiens
ggcccaccuaccuucaa

SEQ ID NO: 416383 - RNA, 13 nt, Homo sapiens
ggcccagccuugu

SEQ ID NO: 416384 - RNA, 18 nt, Homo sapiens
ggcccaucugccgccugg

SEQ ID NO: 416385 - RNA, 14 nt, Homo sapiens
ggccccaaaagccu

SEQ ID NO: 416386 - RNA, 17 nt, Homo sapiens
ggccccaguucaaucuc

SEQ ID NO: 416387 - RNA, 19 nt, Homo sapiens
ggccccauccagcaugugu

SEQ ID NO: 416388 - RNA, 19 nt, Homo sapiens
ggccccugcgugggggcca

SEQ ID NO: 416389 - RNA, 12 nt, Homo sapiens
ggcccucagagg

SEQ ID NO: 416390 - RNA, 14 nt, Homo sapiens
ggcccuccugcugg

SEQ ID NO: 416391 - RNA, 19 nt, Homo sapiens
ggcccucuguccacaugug

SEQ ID NO: 416392 - RNA, 15 nt, Homo sapiens
ggcccucuucuuauu

SEQ ID NO: 416393 - RNA, 20 nt, Homo sapiens
ggcccugccaugcucuccaa

SEQ ID NO: 416394 - RNA, 16 nt, Homo sapiens
ggcccuggcuguaaua

SEQ ID NO: 416395 - RNA, 14 nt, Homo sapiens
ggcccugggguccc

SEQ ID NO: 416396 - RNA, 19 nt, Homo sapiens
ggcccuguccuaagcacuu

SEQ ID NO: 416397 - RNA, 22 nt, Homo sapiens
ggccggggcccugcaccugugc

SEQ ID NO: 416398 - RNA, 19 nt, Homo sapiens
ggccucccaaagugcuagu

SEQ ID NO: 416399 - RNA, 24 nt, Homo sapiens
ggccuccccuggggcuggcagcuu

SEQ ID NO: 416400 - RNA, 20 nt, Homo sapiens
ggccuccugacagcaauaaa

SEQ ID NO: 416401 - RNA, 20 nt, Homo sapiens
ggccucggcagaacucucug

SEQ ID NO: 416402 - RNA, 18 nt, Homo sapiens
ggccucugccuccaggag

SEQ ID NO: 416403 - RNA, 19 nt, Homo sapiens
ggccugauggagaggagaa

SEQ ID NO: 416404 - RNA, 15 nt, Homo sapiens
ggccugccaaugcca

SEQ ID NO: 416405 - RNA, 17 nt, Homo sapiens
ggccuggcaagugggug

SEQ ID NO: 416406 - RNA, 15 nt, Homo sapiens
ggccugguccaugau

SEQ ID NO: 416407 - RNA, 22 nt, Homo sapiens
ggccuucagaaaagacacuuca

SEQ ID NO: 416408 - RNA, 17 nt, Homo sapiens
ggccuucuccacaggga

SEQ ID NO: 416409 - RNA, 16 nt, Homo sapiens
ggccuugcuaccucaa

SEQ ID NO: 416410 - RNA, 14 nt, Homo sapiens
ggccuuucccauug

SEQ ID NO: 416411 - RNA, 22 nt, Homo sapiens
ggccuuuccugugccaaccuga

SEQ ID NO: 416412 - RNA, 19 nt, Homo sapiens
ggccuuuggcuuggcgaga

SEQ ID NO: 416413 - RNA, 21 nt, Homo sapiens
ggcgagagguggagugucaca

SEQ ID NO: 416414 - RNA, 13 nt, Homo sapiens
ggcgcugacucug

SEQ ID NO: 416415 - RNA, 17 nt, Homo sapiens
ggcggagcgccagugga

SEQ ID NO: 416416 - RNA, 17 nt, Homo sapiens
ggcggcuucgcgcugga

SEQ ID NO: 416417 - RNA, 17 nt, Homo sapiens
ggcgggaaagccaguga

SEQ ID NO: 416418 - RNA, 13 nt, Homo sapiens
ggcggugagcaau

SEQ ID NO: 416419 - RNA, 16 nt, Homo sapiens
ggcgucccuaccuccu

SEQ ID NO: 416420 - RNA, 23 nt, Homo sapiens
ggcuaaguguccauuauuuaccu

SEQ ID NO: 416421 - RNA, 17 nt, Homo sapiens
ggcuacacacaaaccag

SEQ ID NO: 416422 - RNA, 21 nt, Homo sapiens
ggcuagaagaaaguaaaaaga

SEQ ID NO: 416423 - RNA, 15 nt, Homo sapiens
ggcuaggccggccag

SEQ ID NO: 416424 - RNA, 20 nt, Homo sapiens
ggcuauggaggguccuccuc

SEQ ID NO: 416425 - RNA, 15 nt, Homo sapiens
ggcuaugugagcaca

SEQ ID NO: 416426 - RNA, 21 nt, Homo sapiens
ggcucacucuuucccccaaau

SEQ ID NO: 416427 - RNA, 21 nt, Homo sapiens
ggcucagccucaaaugcagua

SEQ ID NO: 416428 - RNA, 21 nt, Homo sapiens
ggcucauauuccugcagccug

SEQ ID NO: 416429 - RNA, 17 nt, Homo sapiens
ggcuccacgcccugggg

SEQ ID NO: 416430 - RNA, 21 nt, Homo sapiens
ggcuccauucccaucacugcu

SEQ ID NO: 416431 - RNA, 13 nt, Homo sapiens
ggcucccaggaca

SEQ ID NO: 416432 - RNA, 17 nt, Homo sapiens
ggcucccagggccauga

SEQ ID NO: 416433 - RNA, 14 nt, Homo sapiens
ggcuccccaaaggg

SEQ ID NO: 416434 - RNA, 14 nt, Homo sapiens
ggcuccccugugua

SEQ ID NO: 416435 - RNA, 21 nt, Homo sapiens
ggcucccuccuggagcauccc

SEQ ID NO: 416436 - RNA, 16 nt, Homo sapiens
ggcuccuggcugccag

SEQ ID NO: 416437 - RNA, 21 nt, Homo sapiens
ggcuccuuggauguagucagu

SEQ ID NO: 416438 - RNA, 15 nt, Homo sapiens
ggcucgggacuucaa

SEQ ID NO: 416439 - RNA, 16 nt, Homo sapiens
ggcucuaccaagacau

SEQ ID NO: 416440 - RNA, 17 nt, Homo sapiens
ggcucuaccaagacaua

SEQ ID NO: 416441 - RNA, 23 nt, Homo sapiens
ggcucuauuucggaaauacacua

SEQ ID NO: 416442 - RNA, 16 nt, Homo sapiens
ggcucuguauucugca

SEQ ID NO: 416443 - RNA, 13 nt, Homo sapiens
ggcucuguccuaa

SEQ ID NO: 416444 - RNA, 19 nt, Homo sapiens
ggcucuuagcagcuuccag

SEQ ID NO: 416445 - RNA, 13 nt, Homo sapiens
ggcucuuuccuug

SEQ ID NO: 416446 - RNA, 19 nt, Homo sapiens
ggcugaaggaaaccagugc

SEQ ID NO: 416447 - RNA, 15 nt, Homo sapiens
ggcugacaccaagaa

SEQ ID NO: 416448 - RNA, 14 nt, Homo sapiens
ggcugaggugggca

SEQ ID NO: 416449 - RNA, 21 nt, Homo sapiens
ggcugagugaaaacaucugca

SEQ ID NO: 416450 - RNA, 16 nt, Homo sapiens
ggcugcacagcucaac

SEQ ID NO: 416451 - RNA, 21 nt, Homo sapiens
ggcugccuaccaggggccuuc

SEQ ID NO: 416452 - RNA, 14 nt, Homo sapiens
ggcugcggugggca

SEQ ID NO: 416453 - RNA, 19 nt, Homo sapiens
ggcugcugaaaaccaucug

SEQ ID NO: 416454 - RNA, 22 nt, Homo sapiens
ggcugcuucuccaccuccccca

SEQ ID NO: 416455 - RNA, 14 nt, Homo sapiens
ggcuggagugcagu

SEQ ID NO: 416456 - RNA, 19 nt, Homo sapiens
ggcuggaguggaguggcgu

SEQ ID NO: 416457 - RNA, 19 nt, Homo sapiens
ggcuggccugcaggcugca

SEQ ID NO: 416458 - RNA, 18 nt, Homo sapiens
ggcugggagaaggugcuu

SEQ ID NO: 416459 - RNA, 13 nt, Homo sapiens
ggcuggugacaga

SEQ ID NO: 416460 - RNA, 23 nt, Homo sapiens
ggcuggugacagaacaugcagca

SEQ ID NO: 416461 - RNA, 14 nt, Homo sapiens
ggcuguggagcaaa

SEQ ID NO: 416462 - RNA, 17 nt, Homo sapiens
ggcuuaggacuucaaaa

SEQ ID NO: 416463 - RNA, 15 nt, Homo sapiens
ggcuuaucuagccaa

SEQ ID NO: 416464 - RNA, 19 nt, Homo sapiens
ggcuuaugaauauauuuaa

SEQ ID NO: 416465 - RNA, 21 nt, Homo sapiens
ggcuucaugcaauccuuccaa

SEQ ID NO: 416466 - RNA, 15 nt, Homo sapiens
ggcuucccaggggaa

SEQ ID NO: 416467 - RNA, 18 nt, Homo sapiens
uucaggagcgcaagauag

SEQ ID NO: 416468 - RNA, 14 nt, Homo sapiens
uucaggaggcugga

SEQ ID NO: 416469 - RNA, 19 nt, Homo sapiens
uucaggcacaucauuggaa

SEQ ID NO: 416470 - RNA, 23 nt, Homo sapiens
uucaggcgauucuccugccucag

SEQ ID NO: 416471 - RNA, 19 nt, Homo sapiens
uucagguggaacaggagga

SEQ ID NO: 416472 - RNA, 21 nt, Homo sapiens
uucauaaaaauaaccaaaaaa

SEQ ID NO: 416473 - RNA, 17 nt, Homo sapiens
uucauaaggccugcccu

SEQ ID NO: 416474 - RNA, 15 nt, Homo sapiens
uucauacgguuguau

SEQ ID NO: 416475 - RNA, 23 nt, Homo sapiens
uucauauagggaagaguucugau

SEQ ID NO: 416476 - RNA, 20 nt, Homo sapiens
uucauaucucucccuucuuu

SEQ ID NO: 416477 - RNA, 15 nt, Homo sapiens
uucauaugcuguaua

SEQ ID NO: 416478 - RNA, 18 nt, Homo sapiens
uucauaugcuguauaucc

SEQ ID NO: 416479 - RNA, 22 nt, Homo sapiens
uucaucaaguagcguuggagac

SEQ ID NO: 416480 - RNA, 12 nt, Homo sapiens
uucaucaugacu

SEQ ID NO: 416481 - RNA, 14 nt, Homo sapiens
uucauccacugaau

SEQ ID NO: 416482 - RNA, 14 nt, Homo sapiens
uucaugaaaauccu

SEQ ID NO: 416483 - RNA, 15 nt, Homo sapiens
uucaugaccauacaa

SEQ ID NO: 416484 - RNA, 18 nt, Homo sapiens
uucaugcaauccuuccaa

SEQ ID NO: 416485 - RNA, 14 nt, Homo sapiens
ggucagugugccac

SEQ ID NO: 416486 - RNA, 10 nt, Homo sapiens
ggucaucuca

SEQ ID NO: 416487 - RNA, 22 nt, Homo sapiens
ggucaugcauuguaaucaucau

SEQ ID NO: 416488 - RNA, 21 nt, Homo sapiens
ggucaugcccgucgauguuuu

SEQ ID NO: 416489 - RNA, 17 nt, Homo sapiens
gguccaaauucuuuauu

SEQ ID NO: 416490 - RNA, 24 nt, Homo sapiens
gguccagauuguagcucuuagucc

SEQ ID NO: 416491 - RNA, 18 nt, Homo sapiens
gguccauuucaugugauc

SEQ ID NO: 416492 - RNA, 21 nt, Homo sapiens
ggucccgaauggaguccagac

SEQ ID NO: 416493 - RNA, 21 nt, Homo sapiens
ggucccgagcccccuguccuu

SEQ ID NO: 416494 - RNA, 20 nt, Homo sapiens
gguccugcaaucuccagggc

SEQ ID NO: 416495 - RNA, 15 nt, Homo sapiens
gguccuucccucucc

SEQ ID NO: 416496 - RNA, 15 nt, Homo sapiens
gguccuucugacccc

SEQ ID NO: 416497 - RNA, 17 nt, Homo sapiens
gguccuuugagugucag

SEQ ID NO: 416498 - RNA, 18 nt, Homo sapiens
ggucgucaaugaugaguc

SEQ ID NO: 416499 - RNA, 20 nt, Homo sapiens
ggucucacaguguugcccag

SEQ ID NO: 416500 - RNA, 22 nt, Homo sapiens
ggugaaacuaacagauaagcaa

SEQ ID NO: 416501 - RNA, 14 nt, Homo sapiens
ggugaaagugcagu

SEQ ID NO: 416502 - RNA, 13 nt, Homo sapiens
ggugaacagaaca

SEQ ID NO: 416503 - RNA, 15 nt, Homo sapiens
ggugaagacccagag

SEQ ID NO: 416504 - RNA, 15 nt, Homo sapiens
ggugaccagcaccau

SEQ ID NO: 416505 - RNA, 23 nt, Homo sapiens
ggugagauggacacgcugcgcaa

SEQ ID NO: 416506 - RNA, 19 nt, Homo sapiens
ggugagcagaaguggagcu

SEQ ID NO: 416507 - RNA, 13 nt, Homo sapiens
ggugaggaccacu

SEQ ID NO: 416508 - RNA, 14 nt, Homo sapiens
ggugaggcaauaaa

SEQ ID NO: 416509 - RNA, 17 nt, Homo sapiens
ggugaggggcuggcacu

SEQ ID NO: 416510 - RNA, 13 nt, Homo sapiens
ggugauaggcaag

SEQ ID NO: 416511 - RNA, 18 nt, Homo sapiens
ggugauuuuccugugucc

SEQ ID NO: 416512 - RNA, 16 nt, Homo sapiens
ggugccaaguuccacu

SEQ ID NO: 416513 - RNA, 19 nt, Homo sapiens
ggugccaucacgcuuguga

SEQ ID NO: 416514 - RNA, 15 nt, Homo sapiens
ggugcccagucuuga

SEQ ID NO: 416515 - RNA, 19 nt, Homo sapiens
ggugcccuuuggggucccg

SEQ ID NO: 416516 - RNA, 13 nt, Homo sapiens
ggugccuugggga

SEQ ID NO: 416517 - RNA, 20 nt, Homo sapiens
ggugcugcuuucuuguugcu

SEQ ID NO: 416518 - RNA, 21 nt, Homo sapiens
ggugcugcuuucuuguugcug

SEQ ID NO: 416519 - RNA, 21 nt, Homo sapiens
gguggauuuuguggaggugag

SEQ ID NO: 416520 - RNA, 16 nt, Homo sapiens
gguggcaggugccuug

SEQ ID NO: 416521 - RNA, 17 nt, Homo sapiens
gguggcucacgccugua

SEQ ID NO: 416522 - RNA, 21 nt, Homo sapiens
ggugggcacuggauuaguuaa

SEQ ID NO: 416523 - RNA, 15 nt, Homo sapiens
gguggggcuuggaag

SEQ ID NO: 416524 - RNA, 17 nt, Homo sapiens
ggugguuccuguucuca

SEQ ID NO: 416525 - RNA, 24 nt, Homo sapiens
gguguagaugggggaacugugaau

SEQ ID NO: 416526 - RNA, 20 nt, Homo sapiens
ggugucaccaugagcaccuc

SEQ ID NO: 416527 - RNA, 20 nt, Homo sapiens
ggugucguccugcaguguga

SEQ ID NO: 416528 - RNA, 20 nt, Homo sapiens
gguguguucguggagccaca

SEQ ID NO: 416529 - RNA, 15 nt, Homo sapiens
gguuaacacgagcua

SEQ ID NO: 416530 - RNA, 18 nt, Homo sapiens
gguuacagcaagagccac

SEQ ID NO: 416531 - RNA, 23 nt, Homo sapiens
gguuagaaucccauggauguuuc

SEQ ID NO: 416532 - RNA, 20 nt, Homo sapiens
gguuagaauuucuguguuua

SEQ ID NO: 416533 - RNA, 22 nt, Homo sapiens
gguuaugucccaugaccuugac

SEQ ID NO: 416534 - RNA, 13 nt, Homo sapiens
gguucaagugauu

SEQ ID NO: 416535 - RNA, 16 nt, Homo sapiens
gguucagacugagcuc

SEQ ID NO: 416536 - RNA, 21 nt, Homo sapiens
gguucauuagcgauccaugua

SEQ ID NO: 416537 - RNA, 22 nt, Homo sapiens
gguucccaauaaaagugacucu

SEQ ID NO: 416538 - RNA, 14 nt, Homo sapiens
gguucccccaggac

SEQ ID NO: 416539 - RNA, 21 nt, Homo sapiens
gguuccucaggugaccaaaac

SEQ ID NO: 416540 - RNA, 12 nt, Homo sapiens
gguugaaggcag

SEQ ID NO: 416541 - RNA, 18 nt, Homo sapiens
gguuggcugggcccagaa

SEQ ID NO: 416542 - RNA, 21 nt, Homo sapiens
gguuggcugggcccagaaggu

SEQ ID NO: 416543 - RNA, 19 nt, Homo sapiens
gguuguucacaccacaggc

SEQ ID NO: 416544 - RNA, 13 nt, Homo sapiens
gguuuacugcugu

SEQ ID NO: 416545 - RNA, 14 nt, Homo sapiens
gguuucaccuccca

SEQ ID NO: 416546 - RNA, 22 nt, Homo sapiens
gguuucaccucccaaacccagc

SEQ ID NO: 416547 - RNA, 19 nt, Homo sapiens
gguuucucugugcucugaa

SEQ ID NO: 416548 - RNA, 20 nt, Homo sapiens
gguuucuuguuuaccaaaga

SEQ ID NO: 416549 - RNA, 12 nt, Homo sapiens
gguuugcuccag

SEQ ID NO: 416550 - RNA, 16 nt, Homo sapiens
gguuuuaacaauuucc

SEQ ID NO: 416551 - RNA, 13 nt, Homo sapiens
gguuuuccgccca

SEQ ID NO: 416552 - RNA, 22 nt, Homo sapiens
guaaaacagauuuguucauucc

SEQ ID NO: 416553 - RNA, 15 nt, Homo sapiens
guaaaacugugacau

SEQ ID NO: 416554 - RNA, 13 nt, Homo sapiens
guaaaauguuuca

SEQ ID NO: 416555 - RNA, 19 nt, Homo sapiens
guaaagaauuuagcuguau

SEQ ID NO: 416556 - RNA, 23 nt, Homo sapiens
guaaagccucagcaacagccagu

SEQ ID NO: 416557 - RNA, 16 nt, Homo sapiens
guaaagcucacuuuac

SEQ ID NO: 416558 - RNA, 13 nt, Homo sapiens
guaaauacugcuu

SEQ ID NO: 416559 - RNA, 20 nt, Homo sapiens
guaaauagcaacaugcuuca

SEQ ID NO: 416560 - RNA, 16 nt, Homo sapiens
guaaauagguauuaua

SEQ ID NO: 416561 - RNA, 15 nt, Homo sapiens
guaaauauucuuguc

SEQ ID NO: 416562 - RNA, 11 nt, Homo sapiens
guaaaucucac

SEQ ID NO: 416563 - RNA, 17 nt, Homo sapiens
guaaauguuuaauaucu

SEQ ID NO: 416564 - RNA, 12 nt, Homo sapiens
guaaauuuugga

SEQ ID NO: 416565 - RNA, 18 nt, Homo sapiens
guaacacuguauaacauu

SEQ ID NO: 416566 - RNA, 21 nt, Homo sapiens
guaacacuguauaacauuuaa

SEQ ID NO: 416567 - RNA, 20 nt, Homo sapiens
guaacccgcucaucacugga

SEQ ID NO: 416568 - RNA, 15 nt, Homo sapiens
guaacccucacccac

SEQ ID NO: 416569 - RNA, 17 nt, Homo sapiens
guaacccuggcacuuaa

SEQ ID NO: 416570 - RNA, 21 nt, Homo sapiens
guaacugggaucgcaccuuuu

SEQ ID NO: 416571 - RNA, 15 nt, Homo sapiens
guaacuuugcauguu

SEQ ID NO: 416572 - RNA, 17 nt, Homo sapiens
guaacuuuuacaaaaca

SEQ ID NO: 416573 - RNA, 19 nt, Homo sapiens
guaagacacacagccuuuc

SEQ ID NO: 416574 - RNA, 22 nt, Homo sapiens
guaagaucguucucugccucac

SEQ ID NO: 416575 - RNA, 20 nt, Homo sapiens
guaagaugcuccugguggcu

SEQ ID NO: 416576 - RNA, 19 nt, Homo sapiens
guaagcagaguucuuugca

SEQ ID NO: 416577 - RNA, 14 nt, Homo sapiens
guaagcauucugag

SEQ ID NO: 416578 - RNA, 19 nt, Homo sapiens
guaagcugcucuauuguag

SEQ ID NO: 416579 - RNA, 23 nt, Homo sapiens
guaaggacuugugccucuuggga

SEQ ID NO: 416580 - RNA, 13 nt, Homo sapiens
guaauaucauuuc

SEQ ID NO: 416581 - RNA, 15 nt, Homo sapiens
guaaucccagcacuu

SEQ ID NO: 416582 - RNA, 16 nt, Homo sapiens
guaaucccagcacuuu

SEQ ID NO: 416583 - RNA, 18 nt, Homo sapiens
guaaucuuuuucuccacc

SEQ ID NO: 416584 - RNA, 17 nt, Homo sapiens
guaauuccucccuaaga

SEQ ID NO: 416585 - RNA, 23 nt, Homo sapiens
guaauucuaaaugaauguuuaca

SEQ ID NO: 416586 - RNA, 18 nt, Homo sapiens
guaauuguaaacuaguac

SEQ ID NO: 416587 - RNA, 15 nt, Homo sapiens
guaauuuugcaaaac

SEQ ID NO: 416588 - RNA, 15 nt, Homo sapiens
guacaaauauuccug

SEQ ID NO: 416589 - RNA, 22 nt, Homo sapiens
guacaagguauguacaguucau

SEQ ID NO: 416590 - RNA, 22 nt, Homo sapiens
guacacacccuccagcacagac

SEQ ID NO: 416591 - RNA, 16 nt, Homo sapiens
guacagauugcugcuu

SEQ ID NO: 416592 - RNA, 13 nt, Homo sapiens
guacaucuuugga

SEQ ID NO: 416593 - RNA, 19 nt, Homo sapiens
guacauguggaaaacucac

SEQ ID NO: 416594 - RNA, 14 nt, Homo sapiens
guacauuuggugca

SEQ ID NO: 416595 - RNA, 22 nt, Homo sapiens
guaccaaagaaacaccacuuaa

SEQ ID NO: 416596 - RNA, 21 nt, Homo sapiens
guaccaaauccacaagccauu

SEQ ID NO: 416597 - RNA, 16 nt, Homo sapiens
uaggucauuggccacu

SEQ ID NO: 416598 - RNA, 12 nt, Homo sapiens
uaggucugcauu

SEQ ID NO: 416599 - RNA, 19 nt, Homo sapiens
uagguggagagaguggucu

SEQ ID NO: 416600 - RNA, 16 nt, Homo sapiens
uagguggugccagugg

SEQ ID NO: 416601 - RNA, 20 nt, Homo sapiens
uagguuaauaggaggacaga

SEQ ID NO: 416602 - RNA, 19 nt, Homo sapiens
uagguucaggaagaccaca

SEQ ID NO: 416603 - RNA, 17 nt, Homo sapiens
uaguaaagcuugcacau

SEQ ID NO: 416604 - RNA, 19 nt, Homo sapiens
uaguaacacauaaaguaaa

SEQ ID NO: 416605 - RNA, 17 nt, Homo sapiens
uaguaagccucccuccu

SEQ ID NO: 416606 - RNA, 21 nt, Homo sapiens
uaguaauguuuuauacuguuu

SEQ ID NO: 416607 - RNA, 18 nt, Homo sapiens
uaguacuaguacuaugac

SEQ ID NO: 416608 - RNA, 15 nt, Homo sapiens
uaguacuauugcuau

SEQ ID NO: 416609 - RNA, 14 nt, Homo sapiens
uaguagaugcaucu

SEQ ID NO: 416610 - RNA, 11 nt, Homo sapiens
uaguaggagcu

SEQ ID NO: 416611 - RNA, 21 nt, Homo sapiens
uaguaggagcugagcuuucca

SEQ ID NO: 416612 - RNA, 22 nt, Homo sapiens
uaguaggagcugagcuuuccag

SEQ ID NO: 416613 - RNA, 14 nt, Homo sapiens
uaguagggacuuaa

SEQ ID NO: 416614 - RNA, 15 nt, Homo sapiens
uaguaugaaugcagu

SEQ ID NO: 416615 - RNA, 15 nt, Homo sapiens
uaguauuaacuauua

SEQ ID NO: 416616 - RNA, 16 nt, Homo sapiens
uagucaaggugcucaa

SEQ ID NO: 416617 - RNA, 21 nt, Homo sapiens
uagucaaucaaacagggacac

SEQ ID NO: 416618 - RNA, 17 nt, Homo sapiens
uagucaauuucuacuuc

SEQ ID NO: 416619 - RNA, 20 nt, Homo sapiens
uagucaauuucuacuucugg

SEQ ID NO: 416620 - RNA, 20 nt, Homo sapiens
uagucccacuuacuugggag

SEQ ID NO: 416621 - RNA, 19 nt, Homo sapiens
uaguccgcuuucucuugcu

SEQ ID NO: 416622 - RNA, 17 nt, Homo sapiens
uaguccuggaugacucg

SEQ ID NO: 416623 - RNA, 17 nt, Homo sapiens
uagucucuugauucaua

SEQ ID NO: 416624 - RNA, 13 nt, Homo sapiens
uagucugucaggg

SEQ ID NO: 416625 - RNA, 18 nt, Homo sapiens
uagugacccggaggccac

SEQ ID NO: 416626 - RNA, 17 nt, Homo sapiens
uagugacuguaauuaau

SEQ ID NO: 416627 - RNA, 17 nt, Homo sapiens
uagugacuuccugguga

SEQ ID NO: 416628 - RNA, 15 nt, Homo sapiens
uaguggaaagugauu

SEQ ID NO: 416629 - RNA, 22 nt, Homo sapiens
uagugggccaccccuaaucacu

SEQ ID NO: 416630 - RNA, 21 nt, Homo sapiens
uaguggggaccaaguucauua

SEQ ID NO: 416631 - RNA, 16 nt, Homo sapiens
uagugguacauuccau

SEQ ID NO: 416632 - RNA, 22 nt, Homo sapiens
uagugguauagaguacugcaga

SEQ ID NO: 416633 - RNA, 16 nt, Homo sapiens
uagugucccuuaccug

SEQ ID NO: 416634 - RNA, 23 nt, Homo sapiens
uagugucuugaauguaagaacau

SEQ ID NO: 416635 - RNA, 19 nt, Homo sapiens
uaguguuuugcaagggaau

SEQ ID NO: 416636 - RNA, 16 nt, Homo sapiens
uaguuaaaagccuuuc

SEQ ID NO: 416637 - RNA, 23 nt, Homo sapiens
uaguuaaugaaggugugcuacag

SEQ ID NO: 416638 - RNA, 19 nt, Homo sapiens
uaguuaauuguggcuuuau

SEQ ID NO: 416639 - RNA, 15 nt, Homo sapiens
uaguucauccaaucc

SEQ ID NO: 416640 - RNA, 23 nt, Homo sapiens
uaguugccguggcaacuguggaa

SEQ ID NO: 416641 - RNA, 17 nt, Homo sapiens
uaguugguuuccuucac

SEQ ID NO: 416642 - RNA, 13 nt, Homo sapiens
uaguuucaggcaa

SEQ ID NO: 416643 - RNA, 14 nt, Homo sapiens
uaguuucaggcaag

SEQ ID NO: 416644 - RNA, 19 nt, Homo sapiens
uaguuugcuaagaguuuuc

SEQ ID NO: 416645 - RNA, 20 nt, Homo sapiens
uaguuuuauaaaacucaguu

SEQ ID NO: 416646 - RNA, 20 nt, Homo sapiens
uaguuuuuaaaaaggccuuu

SEQ ID NO: 416647 - RNA, 15 nt, Homo sapiens
uauaaaaucuuucca

SEQ ID NO: 416648 - RNA, 14 nt, Homo sapiens
cuccucugugcucc

SEQ ID NO: 416649 - RNA, 16 nt, Homo sapiens
cuccugacagcaauaa

SEQ ID NO: 416650 - RNA, 14 nt, Homo sapiens
cuccugacuuuuaa

SEQ ID NO: 416651 - RNA, 14 nt, Homo sapiens
cuccugagccugug

SEQ ID NO: 416652 - RNA, 13 nt, Homo sapiens
cuccugauggcca

SEQ ID NO: 416653 - RNA, 23 nt, Homo sapiens
cuccugcucuuucuacaugacug

SEQ ID NO: 416654 - RNA, 17 nt, Homo sapiens
cuccuggcuuccagggg

SEQ ID NO: 416655 - RNA, 13 nt, Homo sapiens
cuccugggcucag

SEQ ID NO: 416656 - RNA, 19 nt, Homo sapiens
cuccugguguggaagagcu

SEQ ID NO: 416657 - RNA, 21 nt, Homo sapiens
cuccugguguggaagagcucc

SEQ ID NO: 416658 - RNA, 14 nt, Homo sapiens
cuccuguacacuga

SEQ ID NO: 416659 - RNA, 20 nt, Homo sapiens
cuccuguagccacuggcaua

SEQ ID NO: 416660 - RNA, 20 nt, Homo sapiens
cuccugucuccucugucagu

SEQ ID NO: 416661 - RNA, 20 nt, Homo sapiens
cuccugugggagaucuucac

SEQ ID NO: 416662 - RNA, 13 nt, Homo sapiens
cuccuguuuccau

SEQ ID NO: 416663 - RNA, 15 nt, Homo sapiens
cuccuguuuccaugg

SEQ ID NO: 416664 - RNA, 19 nt, Homo sapiens
cuccuuaagaacacaaagc

SEQ ID NO: 416665 - RNA, 23 nt, Homo sapiens
cuccuuauagacacuugcuccca

SEQ ID NO: 416666 - RNA, 15 nt, Homo sapiens
cuccuucaagcugcu

SEQ ID NO: 416667 - RNA, 15 nt, Homo sapiens
cuccuuccaccacaa

SEQ ID NO: 416668 - RNA, 21 nt, Homo sapiens
cuccuuccagccugagaugua

SEQ ID NO: 416669 - RNA, 24 nt, Homo sapiens
cuccuucccccagcccaauaaagg

SEQ ID NO: 416670 - RNA, 12 nt, Homo sapiens
cuccuuccucuu

SEQ ID NO: 416671 - RNA, 20 nt, Homo sapiens
cuccuugauuuuaauagaga

SEQ ID NO: 416672 - RNA, 20 nt, Homo sapiens
cuccuuggucuaagugugcu

SEQ ID NO: 416673 - RNA, 18 nt, Homo sapiens
cuccuuucccaacacuuc

SEQ ID NO: 416674 - RNA, 14 nt, Homo sapiens
cuccuuucuugcac

SEQ ID NO: 416675 - RNA, 15 nt, Homo sapiens
cuccuuuucugugaa

SEQ ID NO: 416676 - RNA, 23 nt, Homo sapiens
cuccuuuucugugaagcccuuug

SEQ ID NO: 416677 - RNA, 14 nt, Homo sapiens
cuccuuuugaggcu

SEQ ID NO: 416678 - RNA, 21 nt, Homo sapiens
cucgaaauaauuuuuuaguua

SEQ ID NO: 416679 - RNA, 17 nt, Homo sapiens
cucgaacuugaagcaca

SEQ ID NO: 416680 - RNA, 19 nt, Homo sapiens
guguccaggagaccuucca

SEQ ID NO: 416681 - RNA, 20 nt, Homo sapiens
guguccaggagaccuuccac

SEQ ID NO: 416682 - RNA, 13 nt, Homo sapiens
guguccaugugug

SEQ ID NO: 416683 - RNA, 22 nt, Homo sapiens
guguccccuuccccugcugacc

SEQ ID NO: 416684 - RNA, 22 nt, Homo sapiens
gugucuauucccuggaauucac

SEQ ID NO: 416685 - RNA, 11 nt, Homo sapiens
gugucugcaac

SEQ ID NO: 416686 - RNA, 16 nt, Homo sapiens
gugucuggacauucag

SEQ ID NO: 416687 - RNA, 16 nt, Homo sapiens
gugucuggucguuuga

SEQ ID NO: 416688 - RNA, 12 nt, Homo sapiens
gugugcaagugu

SEQ ID NO: 416689 - RNA, 17 nt, Homo sapiens
gugugcaagugugugca

SEQ ID NO: 416690 - RNA, 20 nt, Homo sapiens
gugugccauagaguuuaaca

SEQ ID NO: 416691 - RNA, 21 nt, Homo sapiens
gugugcccacccguguucucc

SEQ ID NO: 416692 - RNA, 15 nt, Homo sapiens
guguggagcacgugg

SEQ ID NO: 416693 - RNA, 15 nt, Homo sapiens
guguggcaaacauuu

SEQ ID NO: 416694 - RNA, 13 nt, Homo sapiens
gugugucauguca

SEQ ID NO: 416695 - RNA, 20 nt, Homo sapiens
guguguccaugugugugcaa

SEQ ID NO: 416696 - RNA, 11 nt, Homo sapiens
gugugucucau

SEQ ID NO: 416697 - RNA, 15 nt, Homo sapiens
gugugugugcaagug

SEQ ID NO: 416698 - RNA, 16 nt, Homo sapiens
guguuccucuuugcau

SEQ ID NO: 416699 - RNA, 11 nt, Homo sapiens
guguugaucag

SEQ ID NO: 416700 - RNA, 21 nt, Homo sapiens
guguugaugacucacucauaa

SEQ ID NO: 416701 - RNA, 22 nt, Homo sapiens
guguugcauagcauaagccaaa

SEQ ID NO: 416702 - RNA, 23 nt, Homo sapiens
guguuugaaacacucgugugcau

SEQ ID NO: 416703 - RNA, 14 nt, Homo sapiens
guguuuugcaaggg

SEQ ID NO: 416704 - RNA, 16 nt, Homo sapiens
guguuuugcaagggaa

SEQ ID NO: 416705 - RNA, 17 nt, Homo sapiens
guguuuugcaagggaau

SEQ ID NO: 416706 - RNA, 18 nt, Homo sapiens
guguuuugcuaaaggaaa

SEQ ID NO: 416707 - RNA, 22 nt, Homo sapiens
guguuuuuaauaaagacagggu

SEQ ID NO: 416708 - RNA, 21 nt, Homo sapiens
guguuuuucuuuuuccacaag

SEQ ID NO: 416709 - RNA, 17 nt, Homo sapiens
guguuuuugcaggugag

SEQ ID NO: 416710 - RNA, 13 nt, Homo sapiens
guuaaaaagucaa

SEQ ID NO: 416711 - RNA, 20 nt, Homo sapiens
guuaaauagaguauaugcac

SEQ ID NO: 416712 - RNA, 13 nt, Homo sapiens
guuaaaugaacuu

SEQ ID NO: 416713 - RNA, 17 nt, Homo sapiens
guuaacacuguaauauc

SEQ ID NO: 416714 - RNA, 13 nt, Homo sapiens
guuaacaucugaa

SEQ ID NO: 416715 - RNA, 23 nt, Homo sapiens
guuaaccuuuuuguaaauacugc

SEQ ID NO: 416716 - RNA, 20 nt, Homo sapiens
guuaacuaguguuucugcag

SEQ ID NO: 416717 - RNA, 14 nt, Homo sapiens
guuaagccauauga

SEQ ID NO: 416718 - RNA, 12 nt, Homo sapiens
guuaagugcagg

SEQ ID NO: 416719 - RNA, 12 nt, Homo sapiens
guuaagugcuuu

SEQ ID NO: 416720 - RNA, 21 nt, Homo sapiens
guuaaugaaggugugcuacag

SEQ ID NO: 416721 - RNA, 13 nt, Homo sapiens
guuaaugccacaa

SEQ ID NO: 416722 - RNA, 15 nt, Homo sapiens
guuaauguuaauuaa

SEQ ID NO: 416723 - RNA, 16 nt, Homo sapiens
guuaauucagcacuga

SEQ ID NO: 416724 - RNA, 14 nt, Homo sapiens
guuacaaagacaug

SEQ ID NO: 416725 - RNA, 18 nt, Homo sapiens
guuacacccuuucuugac

SEQ ID NO: 416726 - RNA, 21 nt, Homo sapiens
guuacagugaugcugugcuau

SEQ ID NO: 416727 - RNA, 22 nt, Homo sapiens
guuacaguuugagacuuccaaa

SEQ ID NO: 416728 - RNA, 15 nt, Homo sapiens
guuacauguagaaaa

SEQ ID NO: 416729 - RNA, 17 nt, Homo sapiens
guuacucauaaggcaua

SEQ ID NO: 416730 - RNA, 22 nt, Homo sapiens
guuagaagcaaugaauguauau

SEQ ID NO: 416731 - RNA, 21 nt, Homo sapiens
guuagaguuuaauuuugugaa

SEQ ID NO: 416732 - RNA, 13 nt, Homo sapiens
guuagcaggaaau

SEQ ID NO: 416733 - RNA, 13 nt, Homo sapiens
guuagucuuaccg

SEQ ID NO: 416734 - RNA, 17 nt, Homo sapiens
guuagugggaagagcug

SEQ ID NO: 416735 - RNA, 17 nt, Homo sapiens
guuauaaaucaauguca

SEQ ID NO: 416736 - RNA, 18 nt, Homo sapiens
guuauaaaucaaugucac

SEQ ID NO: 416737 - RNA, 23 nt, Homo sapiens
guuauaaaucaaugucacuuaaa

SEQ ID NO: 416738 - RNA, 13 nt, Homo sapiens
guuauauauauca

SEQ ID NO: 416739 - RNA, 22 nt, Homo sapiens
guuauccugcuagcuguagaaa

SEQ ID NO: 416740 - RNA, 14 nt, Homo sapiens
guuauccugugcua

SEQ ID NO: 416741 - RNA, 12 nt, Homo sapiens
guuaucugcuag

SEQ ID NO: 416742 - RNA, 17 nt, Homo sapiens
guuaucuuccacuggaa

SEQ ID NO: 416743 - RNA, 22 nt, Homo sapiens
guuaucuucuaucaaagcacau

SEQ ID NO: 416744 - RNA, 21 nt, Homo sapiens
guuaugagaaaaaaacagcag

SEQ ID NO: 416745 - RNA, 16 nt, Homo sapiens
guuaugucccaugacc

SEQ ID NO: 416746 - RNA, 19 nt, Homo sapiens
guuauuuaugccucuguau

SEQ ID NO: 416747 - RNA, 11 nt, Homo sapiens
guucaaaaaga

SEQ ID NO: 416748 - RNA, 12 nt, Homo sapiens
guucaacauuuu

SEQ ID NO: 416749 - RNA, 13 nt, Homo sapiens
guucaaugaucua

SEQ ID NO: 416750 - RNA, 14 nt, Homo sapiens
guucacaccacagg

SEQ ID NO: 416751 - RNA, 18 nt, Homo sapiens
guucacacuuugcccuau

SEQ ID NO: 416752 - RNA, 17 nt, Homo sapiens
guucacucuacuuagca

SEQ ID NO: 416753 - RNA, 13 nt, Homo sapiens
guucagaccuuca

SEQ ID NO: 416754 - RNA, 21 nt, Homo sapiens
guucagcuccuuccaccacaa

SEQ ID NO: 416755 - RNA, 22 nt, Homo sapiens
guucaggaggagacagucagga

SEQ ID NO: 416756 - RNA, 14 nt, Homo sapiens
guucauccuacccu

SEQ ID NO: 416757 - RNA, 18 nt, Homo sapiens
guucauuugugugcucau

SEQ ID NO: 416758 - RNA, 17 nt, Homo sapiens
guucauuuuagugacug

SEQ ID NO: 416759 - RNA, 16 nt, Homo sapiens
guuccaagacauuguc

SEQ ID NO: 416760 - RNA, 18 nt, Homo sapiens
guuccaaguauuuugcca

SEQ ID NO: 416761 - RNA, 20 nt, Homo sapiens
guuccagaacgucucucacc

SEQ ID NO: 416762 - RNA, 17 nt, Homo sapiens
guuccagauagcagggc

SEQ ID NO: 416763 - RNA, 16 nt, Homo sapiens
guuccagauggggccu

SEQ ID NO: 416764 - RNA, 24 nt, Homo sapiens
guuccauaugugggugucagucag

SEQ ID NO: 416765 - RNA, 22 nt, Homo sapiens
guuccauccaccaccuugccaa

SEQ ID NO: 416766 - RNA, 21 nt, Homo sapiens
guucccacucccucucuugcc

SEQ ID NO: 416767 - RNA, 19 nt, Homo sapiens
guucccagcaaaguuuuca

SEQ ID NO: 416768 - RNA, 13 nt, Homo sapiens
guuccccuggaaa

SEQ ID NO: 416769 - RNA, 17 nt, Homo sapiens
guucccucagugugaag

SEQ ID NO: 416770 - RNA, 22 nt, Homo sapiens
guucccuuggccucagaauuca

SEQ ID NO: 416771 - RNA, 20 nt, Homo sapiens
guuccucauggcuguuaucu

SEQ ID NO: 416772 - RNA, 17 nt, Homo sapiens
guuccucuuugcaugga

SEQ ID NO: 416773 - RNA, 14 nt, Homo sapiens
guucgagacuccau

SEQ ID NO: 416774 - RNA, 17 nt, Homo sapiens
guucuacacucaucuua

SEQ ID NO: 416775 - RNA, 23 nt, Homo sapiens
guucuacuauggcugaguucugg

SEQ ID NO: 416776 - RNA, 15 nt, Homo sapiens
guucuaugauuugua

SEQ ID NO: 416777 - RNA, 15 nt, Homo sapiens
guucuauuuguauau

SEQ ID NO: 416778 - RNA, 22 nt, Homo sapiens
cucuuaguuuuuaaaaaggccu

SEQ ID NO: 416779 - RNA, 13 nt, Homo sapiens
cucuuaugcacac

SEQ ID NO: 416780 - RNA, 15 nt, Homo sapiens
cucuucaacugacca

SEQ ID NO: 416781 - RNA, 19 nt, Homo sapiens
cucuucaacugaccagccu

SEQ ID NO: 416782 - RNA, 21 nt, Homo sapiens
cucuucaacugaccagccucc

SEQ ID NO: 416783 - RNA, 17 nt, Homo sapiens
cucuucaaucucuggaa

SEQ ID NO: 416784 - RNA, 22 nt, Homo sapiens
cucuucagguucuuagugucac

SEQ ID NO: 416785 - RNA, 15 nt, Homo sapiens
cucuucaugagcacu

SEQ ID NO: 416786 - RNA, 21 nt, Homo sapiens
cucuucauucccacugcacuu

SEQ ID NO: 416787 - RNA, 13 nt, Homo sapiens
cucuucccaugac

SEQ ID NO: 416788 - RNA, 16 nt, Homo sapiens
cucuucccaugacugc

SEQ ID NO: 416789 - RNA, 16 nt, Homo sapiens
cucuucccccaugugc

SEQ ID NO: 416790 - RNA, 22 nt, Homo sapiens
cucuuccuggaaugcauucacu

SEQ ID NO: 416791 - RNA, 15 nt, Homo sapiens
cucuucuguaaaaug

SEQ ID NO: 416792 - RNA, 14 nt, Homo sapiens
cucuugaaccacag

SEQ ID NO: 416793 - RNA, 16 nt, Homo sapiens
cucuugaagaugcuga

SEQ ID NO: 416794 - RNA, 13 nt, Homo sapiens
cucuugaauuccu

SEQ ID NO: 416795 - RNA, 22 nt, Homo sapiens
cucuugagguggugccuucuca

SEQ ID NO: 416796 - RNA, 13 nt, Homo sapiens
cucuugcagagaa

SEQ ID NO: 416797 - RNA, 16 nt, Homo sapiens
cucuugccagcauuuu

SEQ ID NO: 416798 - RNA, 21 nt, Homo sapiens
cucuugcccagccggcugcaa

SEQ ID NO: 416799 - RNA, 16 nt, Homo sapiens
cucuugggaagaccag

SEQ ID NO: 416800 - RNA, 20 nt, Homo sapiens
cucuugggaagaccagcuuu

SEQ ID NO: 416801 - RNA, 13 nt, Homo sapiens
cucuugugcugag

SEQ ID NO: 416802 - RNA, 23 nt, Homo sapiens
cucuuuaccuguucaaaauucca

SEQ ID NO: 416803 - RNA, 15 nt, Homo sapiens
cucuuucaaagcuaa

SEQ ID NO: 416804 - RNA, 18 nt, Homo sapiens
cucuuuccucuaacucau

SEQ ID NO: 416805 - RNA, 17 nt, Homo sapiens
cucuuucuacaugacug

SEQ ID NO: 416806 - RNA, 19 nt, Homo sapiens
cucuuugagucaagucaaa

SEQ ID NO: 416807 - RNA, 18 nt, Homo sapiens
cucuuugggccuggcucc

SEQ ID NO: 416808 - RNA, 12 nt, Homo sapiens
cucuuuuacuaa

SEQ ID NO: 416809 - RNA, 19 nt, Homo sapiens
cucuuuuucuuucuuccac

SEQ ID NO: 416810 - RNA, 15 nt, Homo sapiens
cugaaaaucuaauau

SEQ ID NO: 416811 - RNA, 19 nt, Homo sapiens
cugaaacauuugacacaua

SEQ ID NO: 416812 - RNA, 23 nt, Homo sapiens
cugaaaccucugggucaucucuc

SEQ ID NO: 416813 - RNA, 24 nt, Homo sapiens
cugaaaccucugggucaucucuca

SEQ ID NO: 416814 - RNA, 16 nt, Homo sapiens
guuuaccuucagccau

SEQ ID NO: 416815 - RNA, 12 nt, Homo sapiens
guuuacugcugu

SEQ ID NO: 416816 - RNA, 19 nt, Homo sapiens
guuuacuuaucuuaugcca

SEQ ID NO: 416817 - RNA, 12 nt, Homo sapiens
guuuagagcagu

SEQ ID NO: 416818 - RNA, 16 nt, Homo sapiens
guuuauugaaugugau

SEQ ID NO: 416819 - RNA, 20 nt, Homo sapiens
guuuauuuuuauacuuucag

SEQ ID NO: 416820 - RNA, 14 nt, Homo sapiens
guuucaccucccaa

SEQ ID NO: 416821 - RNA, 22 nt, Homo sapiens
guuucagaagcugcagcugguc

SEQ ID NO: 416822 - RNA, 16 nt, Homo sapiens
guuucaguugacaaaa

SEQ ID NO: 416823 - RNA, 20 nt, Homo sapiens
guuucauauccagcugagug

SEQ ID NO: 416824 - RNA, 20 nt, Homo sapiens
guuucauguuuugugacuau

SEQ ID NO: 416825 - RNA, 21 nt, Homo sapiens
guuucccaaaaaccccagugu

SEQ ID NO: 416826 - RNA, 19 nt, Homo sapiens
guuuccuaugacuaauuca

SEQ ID NO: 416827 - RNA, 22 nt, Homo sapiens
guuucggggugaagcaaguuca

SEQ ID NO: 416828 - RNA, 19 nt, Homo sapiens
guuucuagagaacaguuga

SEQ ID NO: 416829 - RNA, 18 nt, Homo sapiens
guuucuauggauucacuu

SEQ ID NO: 416830 - RNA, 16 nt, Homo sapiens
guuucucaagcgcuau

SEQ ID NO: 416831 - RNA, 18 nt, Homo sapiens
guuucugaaccauuacug

SEQ ID NO: 416832 - RNA, 21 nt, Homo sapiens
guuucugaaccauuacuguaa

SEQ ID NO: 416833 - RNA, 14 nt, Homo sapiens
guuucuggaauuga

SEQ ID NO: 416834 - RNA, 16 nt, Homo sapiens
guuucuggaauugaua

SEQ ID NO: 416835 - RNA, 12 nt, Homo sapiens
guuucuguucug

SEQ ID NO: 416836 - RNA, 20 nt, Homo sapiens
guuucuugcucugagugcua

SEQ ID NO: 416837 - RNA, 13 nt, Homo sapiens
guuugaacacaga

SEQ ID NO: 416838 - RNA, 21 nt, Homo sapiens
guuugaacucuucuuugccag

SEQ ID NO: 416839 - RNA, 22 nt, Homo sapiens
guuugaagaugccgcauuugga

SEQ ID NO: 416840 - RNA, 19 nt, Homo sapiens
guuugacaccagggccagu

SEQ ID NO: 416841 - RNA, 23 nt, Homo sapiens
guuugaucccuguuacccagaga

SEQ ID NO: 416842 - RNA, 20 nt, Homo sapiens
guuugcaaucuuauguugau

SEQ ID NO: 416843 - RNA, 17 nt, Homo sapiens
guuugcuuauuguucca

SEQ ID NO: 416844 - RNA, 19 nt, Homo sapiens
guuuggaaguguuaacuau

SEQ ID NO: 416845 - RNA, 20 nt, Homo sapiens
guuuggacuuuuauuuuggc

SEQ ID NO: 416846 - RNA, 14 nt, Homo sapiens
guuuggccaaaaag

SEQ ID NO: 416847 - RNA, 13 nt, Homo sapiens
guuuggggagcag

SEQ ID NO: 416848 - RNA, 14 nt, Homo sapiens
guuuguaaauaaga

SEQ ID NO: 416849 - RNA, 13 nt, Homo sapiens
guuugucaaaaag

SEQ ID NO: 416850 - RNA, 15 nt, Homo sapiens
guuugucauuuugaa

SEQ ID NO: 416851 - RNA, 23 nt, Homo sapiens
guuugucccuccugccaugugua

SEQ ID NO: 416852 - RNA, 14 nt, Homo sapiens
guuuguggccucag

SEQ ID NO: 416853 - RNA, 20 nt, Homo sapiens
guuuguggccucagaauuga

SEQ ID NO: 416854 - RNA, 20 nt, Homo sapiens
guuuguuuucaaaauacuuc

SEQ ID NO: 416855 - RNA, 17 nt, Homo sapiens
guuuuaaaaaaucucaa

SEQ ID NO: 416856 - RNA, 12 nt, Homo sapiens
guuuuaacugua

SEQ ID NO: 416857 - RNA, 19 nt, Homo sapiens
guuuuacacucuagugcca

SEQ ID NO: 416858 - RNA, 23 nt, Homo sapiens
guuuuaccaucugcauccagccu

SEQ ID NO: 416859 - RNA, 16 nt, Homo sapiens
guuuuacuacccaaau

SEQ ID NO: 416860 - RNA, 18 nt, Homo sapiens
guuuuagaguaugcaaga

SEQ ID NO: 416861 - RNA, 16 nt, Homo sapiens
guuuucagauuguaaa

SEQ ID NO: 416862 - RNA, 23 nt, Homo sapiens
guuuucauuuacaggaaauugca

SEQ ID NO: 416863 - RNA, 17 nt, Homo sapiens
guuuugcaugucugcau

SEQ ID NO: 416864 - RNA, 23 nt, Homo sapiens
guuuuggaugaaugcaguauaaa

SEQ ID NO: 416865 - RNA, 21 nt, Homo sapiens
guuuugucaucaauccaggau

SEQ ID NO: 416866 - RNA, 19 nt, Homo sapiens
guuuuuaaaaaggccuuug

SEQ ID NO: 416867 - RNA, 18 nt, Homo sapiens
guuuuuaaaaguuucaau

SEQ ID NO: 416868 - RNA, 17 nt, Homo sapiens
guuuuuaaguacucacu

SEQ ID NO: 416869 - RNA, 18 nt, Homo sapiens
guuuuuacucaaccaaau

SEQ ID NO: 416870 - RNA, 13 nt, Homo sapiens
guuuuuacuguga

SEQ ID NO: 416871 - RNA, 14 nt, Homo sapiens
guuuuuagcuggug

SEQ ID NO: 416872 - RNA, 20 nt, Homo sapiens
guuuuuaugaggugggauau

SEQ ID NO: 416873 - RNA, 22 nt, Homo sapiens
guuuuucuucaacaucaauguu

SEQ ID NO: 416874 - RNA, 13 nt, Homo sapiens
guuuuugagccau

SEQ ID NO: 416875 - RNA, 15 nt, Homo sapiens
guuuuugcaggugag

SEQ ID NO: 416876 - RNA, 17 nt, Homo sapiens
guuuuuguuuuuugcca

SEQ ID NO: 416877 - RNA, 16 nt, Homo sapiens
guuuuuugccauguua

SEQ ID NO: 416878 - RNA, 18 nt, Homo sapiens
uaaaaaaaaaaggaugaa

SEQ ID NO: 416879 - RNA, 20 nt, Homo sapiens
uaaaaaaaaaccuagcaucu

SEQ ID NO: 416880 - RNA, 18 nt, Homo sapiens
uaaaaaaauuuuaauucc

SEQ ID NO: 416881 - RNA, 22 nt, Homo sapiens
uaaaaaacauaaauuucuuuaa

SEQ ID NO: 416882 - RNA, 15 nt, Homo sapiens
uaaaaaacauuugua

SEQ ID NO: 416883 - RNA, 12 nt, Homo sapiens
uaaaaaagcauu

SEQ ID NO: 416884 - RNA, 17 nt, Homo sapiens
uaaaaaauaaaguacgu

SEQ ID NO: 416885 - RNA, 22 nt, Homo sapiens
uaaaaaggccuuugggauuugc

SEQ ID NO: 416886 - RNA, 23 nt, Homo sapiens
uaaaaaggccuuugggauuugcc

SEQ ID NO: 416887 - RNA, 22 nt, Homo sapiens
uaaaaagggcagggcaucuccu

SEQ ID NO: 416888 - RNA, 22 nt, Homo sapiens
uaaaaagucaaacuuucaccuc

SEQ ID NO: 416889 - RNA, 23 nt, Homo sapiens
uaaaaagucugcauuacauuccu

SEQ ID NO: 416890 - RNA, 15 nt, Homo sapiens
uaaaaagucuucacu

SEQ ID NO: 416891 - RNA, 20 nt, Homo sapiens
uaaaaaguuaagcugcuaua

SEQ ID NO: 416892 - RNA, 21 nt, Homo sapiens
uaaaaauaaacucugcacuua

SEQ ID NO: 416893 - RNA, 17 nt, Homo sapiens
uaaaaauaaacuguuau

SEQ ID NO: 416894 - RNA, 17 nt, Homo sapiens
uaaaaauagucuuccac

SEQ ID NO: 416895 - RNA, 13 nt, Homo sapiens
uaaaaaucuuuca

SEQ ID NO: 416896 - RNA, 14 nt, Homo sapiens
uaaaaaugcaugau

SEQ ID NO: 416897 - RNA, 16 nt, Homo sapiens
uaaaaauguccugccu

SEQ ID NO: 416898 - RNA, 19 nt, Homo sapiens
uaaaaauguuaaagaacug

SEQ ID NO: 416899 - RNA, 16 nt, Homo sapiens
uaaaacaaaaccaagc

SEQ ID NO: 416900 - RNA, 15 nt, Homo sapiens
uaaaacaauacucaa

SEQ ID NO: 416901 - RNA, 12 nt, Homo sapiens
uaaaacauuccu

SEQ ID NO: 416902 - RNA, 14 nt, Homo sapiens
uaaaaccuuacuua

SEQ ID NO: 416903 - RNA, 22 nt, Homo sapiens
uaaaaccuuacuuaaagcuugu

SEQ ID NO: 416904 - RNA, 17 nt, Homo sapiens
uaaaacgauuacugacu

SEQ ID NO: 416905 - RNA, 17 nt, Homo sapiens
uaaaacuacacaucccu

SEQ ID NO: 416906 - RNA, 22 nt, Homo sapiens
uaaaacuaggcauuuguaaaua

SEQ ID NO: 416907 - RNA, 18 nt, Homo sapiens
cuggaacacaaccauagc

SEQ ID NO: 416908 - RNA, 23 nt, Homo sapiens
cuggaacacaaccauagccuguu

SEQ ID NO: 416909 - RNA, 16 nt, Homo sapiens
cuggaagccagagaaa

SEQ ID NO: 416910 - RNA, 18 nt, Homo sapiens
cuggaagucaucucauuc

SEQ ID NO: 416911 - RNA, 17 nt, Homo sapiens
cuggaauucagaugcaa

SEQ ID NO: 416912 - RNA, 17 nt, Homo sapiens
cuggaauugauauugaa

SEQ ID NO: 416913 - RNA, 23 nt, Homo sapiens
cuggaauugauauugaaugaugu

SEQ ID NO: 416914 - RNA, 13 nt, Homo sapiens
cuggaccauuuga

SEQ ID NO: 416915 - RNA, 19 nt, Homo sapiens
cuggacucuguggggccac

SEQ ID NO: 416916 - RNA, 18 nt, Homo sapiens
cuggacuggcccuugccc

SEQ ID NO: 416917 - RNA, 12 nt, Homo sapiens
cuggacuuuccu

SEQ ID NO: 416918 - RNA, 21 nt, Homo sapiens
cuggacuuucuccaaaggcac

SEQ ID NO: 416919 - RNA, 21 nt, Homo sapiens
cuggagaaagggaaguggaag

SEQ ID NO: 416920 - RNA, 22 nt, Homo sapiens
cuggagagguuaaggugcaaua

SEQ ID NO: 416921 - RNA, 19 nt, Homo sapiens
cuggagccuccacugccuc

SEQ ID NO: 416922 - RNA, 22 nt, Homo sapiens
cuggaggcccuggucagcuugc

SEQ ID NO: 416923 - RNA, 20 nt, Homo sapiens
cuggaggccggaaucucagc

SEQ ID NO: 416924 - RNA, 22 nt, Homo sapiens
cuggagggcaguggcacgaucu

SEQ ID NO: 416925 - RNA, 20 nt, Homo sapiens
cuggagucaaaacacuugua

SEQ ID NO: 416926 - RNA, 17 nt, Homo sapiens
cuggaguccuguucuca

SEQ ID NO: 416927 - RNA, 19 nt, Homo sapiens
cuggagugcaacggcauga

SEQ ID NO: 416928 - RNA, 20 nt, Homo sapiens
cuggagugcaguggugugau

SEQ ID NO: 416929 - RNA, 17 nt, Homo sapiens
cuggagugugugggggu

SEQ ID NO: 416930 - RNA, 18 nt, Homo sapiens
cuggauaaacuugcuuca

SEQ ID NO: 416931 - RNA, 14 nt, Homo sapiens
cuggaucagggaau

SEQ ID NO: 416932 - RNA, 14 nt, Homo sapiens
cuggcaaacaugug

SEQ ID NO: 416933 - RNA, 14 nt, Homo sapiens
cuggcaacaugaag

SEQ ID NO: 416934 - RNA, 19 nt, Homo sapiens
cuggcagccgugccuucag

SEQ ID NO: 416935 - RNA, 18 nt, Homo sapiens
cuggcagcgccucccgcc

SEQ ID NO: 416936 - RNA, 23 nt, Homo sapiens
cuggcaggagccggcugccuacc

SEQ ID NO: 416937 - RNA, 16 nt, Homo sapiens
cuggcagguggaacuu

SEQ ID NO: 416938 - RNA, 19 nt, Homo sapiens
cuggcauagcccuccugag

SEQ ID NO: 416939 - RNA, 20 nt, Homo sapiens
cuggcaugggaaugaauguc

SEQ ID NO: 416940 - RNA, 19 nt, Homo sapiens
cuggcauuugcaccuaccu

SEQ ID NO: 416941 - RNA, 20 nt, Homo sapiens
cuggccagcaaggcagguug

SEQ ID NO: 416942 - RNA, 23 nt, Homo sapiens
cuggccaguuggaaccacggaga

SEQ ID NO: 416943 - RNA, 15 nt, Homo sapiens
cuggccaugcaagug

SEQ ID NO: 416944 - RNA, 19 nt, Homo sapiens
cuggcccugcccugaggaa

SEQ ID NO: 416945 - RNA, 13 nt, Homo sapiens
cuggcucacagcc

SEQ ID NO: 416946 - RNA, 14 nt, Homo sapiens
cuggcucccaggac

SEQ ID NO: 416947 - RNA, 14 nt, Homo sapiens
cuggcucucuccag

SEQ ID NO: 416948 - RNA, 17 nt, Homo sapiens
cuggcugucugccugua

SEQ ID NO: 416949 - RNA, 13 nt, Homo sapiens
cuggcugugagca

SEQ ID NO: 416950 - RNA, 22 nt, Homo sapiens
cuggcuuuacauggguucaauu

SEQ ID NO: 416951 - RNA, 14 nt, Homo sapiens
uaagaaugcugguu

SEQ ID NO: 416952 - RNA, 20 nt, Homo sapiens
uaagaauuguuuuugaauuu

SEQ ID NO: 416953 - RNA, 18 nt, Homo sapiens
uaagacacuaguagagca

SEQ ID NO: 416954 - RNA, 18 nt, Homo sapiens
uaagacagagucucacuu

SEQ ID NO: 416955 - RNA, 21 nt, Homo sapiens
uaagacauacuccuuccauca

SEQ ID NO: 416956 - RNA, 12 nt, Homo sapiens
uaagacauucac

SEQ ID NO: 416957 - RNA, 17 nt, Homo sapiens
uaagacauucaccaaca

SEQ ID NO: 416958 - RNA, 14 nt, Homo sapiens
uaagacuacuauac

SEQ ID NO: 416959 - RNA, 12 nt, Homo sapiens
uaagagaaauga

SEQ ID NO: 416960 - RNA, 23 nt, Homo sapiens
uaagagacagagccuuguucuau

SEQ ID NO: 416961 - RNA, 17 nt, Homo sapiens
uaagagagugaacauau

SEQ ID NO: 416962 - RNA, 21 nt, Homo sapiens
uaagagagugaacauauccau

SEQ ID NO: 416963 - RNA, 17 nt, Homo sapiens
uaagagccauuuagggg

SEQ ID NO: 416964 - RNA, 21 nt, Homo sapiens
uaagaggauagaauacaugga

SEQ ID NO: 416965 - RNA, 21 nt, Homo sapiens
uaagaggcugcugaaaaccau

SEQ ID NO: 416966 - RNA, 24 nt, Homo sapiens
uaagaguggaaccaacacuaacau

SEQ ID NO: 416967 - RNA, 12 nt, Homo sapiens
uaagauauguga

SEQ ID NO: 416968 - RNA, 14 nt, Homo sapiens
uaagauuuaauugu

SEQ ID NO: 416969 - RNA, 18 nt, Homo sapiens
uaagauuuuacaaaagag

SEQ ID NO: 416970 - RNA, 20 nt, Homo sapiens
uaagcaaccuuaaagcaaua

SEQ ID NO: 416971 - RNA, 19 nt, Homo sapiens
uaagcagaagcacauauga

SEQ ID NO: 416972 - RNA, 16 nt, Homo sapiens
uaagcagaagcauuaa

SEQ ID NO: 416973 - RNA, 12 nt, Homo sapiens
uaagccaaaaaa

SEQ ID NO: 416974 - RNA, 19 nt, Homo sapiens
uaagccaaaaaaugcuugc

SEQ ID NO: 416975 - RNA, 17 nt, Homo sapiens
uaagccaagggccucuu

SEQ ID NO: 416976 - RNA, 17 nt, Homo sapiens
uaagccaauaaauaaua

SEQ ID NO: 416977 - RNA, 22 nt, Homo sapiens
uaagcccacaaucaugccuccc

SEQ ID NO: 416978 - RNA, 23 nt, Homo sapiens
uaagccucucccuccagccaaua

SEQ ID NO: 416979 - RNA, 16 nt, Homo sapiens
uaagcucacacagcua

SEQ ID NO: 416980 - RNA, 15 nt, Homo sapiens
uaagcugcugaaugc

SEQ ID NO: 416981 - RNA, 20 nt, Homo sapiens
uaagcugcugaaugcauuca

SEQ ID NO: 416982 - RNA, 22 nt, Homo sapiens
uaagcugggaaaaaaguuuuga

SEQ ID NO: 416983 - RNA, 21 nt, Homo sapiens
uaagcuguguccuaguucuug

SEQ ID NO: 416984 - RNA, 19 nt, Homo sapiens
uaaggaauauccagucaaa

SEQ ID NO: 416985 - RNA, 15 nt, Homo sapiens
uaaggagacugaggc

SEQ ID NO: 416986 - RNA, 22 nt, Homo sapiens
uaaggcauccacuucacaguuc

SEQ ID NO: 416987 - RNA, 19 nt, Homo sapiens
uaaggccaaggccucagga

SEQ ID NO: 416988 - RNA, 17 nt, Homo sapiens
uaagggagcugagccag

SEQ ID NO: 416989 - RNA, 18 nt, Homo sapiens
uaaggggggaacaugcau

SEQ ID NO: 416990 - RNA, 15 nt, Homo sapiens
uaagggggugcagca

SEQ ID NO: 416991 - RNA, 20 nt, Homo sapiens
uaaggguuaguuuacaauca

SEQ ID NO: 416992 - RNA, 13 nt, Homo sapiens
uaaggugggucca

SEQ ID NO: 416993 - RNA, 16 nt, Homo sapiens
uaagguggguccagga

SEQ ID NO: 416994 - RNA, 13 nt, Homo sapiens
uaaguaaacugcc

SEQ ID NO: 416995 - RNA, 18 nt, Homo sapiens
uaaguaaccucuacaggc

SEQ ID NO: 416996 - RNA, 22 nt, Homo sapiens
uaaguacugaaauacauaugau

SEQ ID NO: 416997 - RNA, 22 nt, Homo sapiens
uaaguaguugguuuccuucaca

SEQ ID NO: 416998 - RNA, 20 nt, Homo sapiens
uaaguauuucagaugcuuua

SEQ ID NO: 416999 - RNA, 16 nt, Homo sapiens
uaagucaccuguauaa

SEQ ID NO: 417000 - RNA, 19 nt, Homo sapiens
uaaguccuguauauguaug

SEQ ID NO: 417001 - RNA, 23 nt, Homo sapiens
uaagugaggaugaaaaaauaaca

SEQ ID NO: 417002 - RNA, 19 nt, Homo sapiens
uaagugcuuuguaauggga

SEQ ID NO: 417003 - RNA, 15 nt, Homo sapiens
uaaguuaauauugga

SEQ ID NO: 417004 - RNA, 23 nt, Homo sapiens
uaaguuucaggauacaugugccg

SEQ ID NO: 417005 - RNA, 18 nt, Homo sapiens
uaauaaaacaucuuucca

SEQ ID NO: 417006 - RNA, 15 nt, Homo sapiens
uaauaaaacugcaca

SEQ ID NO: 417007 - RNA, 17 nt, Homo sapiens
uaauaaaaggaguucag

SEQ ID NO: 417008 - RNA, 15 nt, Homo sapiens
uaauaaaccuccuuc

SEQ ID NO: 417009 - RNA, 13 nt, Homo sapiens
uaauaaagacagg

SEQ ID NO: 417010 - RNA, 19 nt, Homo sapiens
uaauaaaucuguugccaag

SEQ ID NO: 417011 - RNA, 12 nt, Homo sapiens
uaauaacuuugc

SEQ ID NO: 417012 - RNA, 13 nt, Homo sapiens
uaauaauugauca

SEQ ID NO: 417013 - RNA, 14 nt, Homo sapiens
uaauacagcagugu

SEQ ID NO: 417014 - RNA, 23 nt, Homo sapiens
uaauacauggcuaucaucaaaag

SEQ ID NO: 417015 - RNA, 20 nt, Homo sapiens
uaauacccacauuacaggau

SEQ ID NO: 417016 - RNA, 22 nt, Homo sapiens
uaauaccuuaguuuuuuccaca

SEQ ID NO: 417017 - RNA, 14 nt, Homo sapiens
uaauacucaccucc

SEQ ID NO: 417018 - RNA, 14 nt, Homo sapiens
uaauagacagcaau

SEQ ID NO: 417019 - RNA, 19 nt, Homo sapiens
uaauagcuuuuauuguaua

SEQ ID NO: 417020 - RNA, 18 nt, Homo sapiens
uaauaggaagaacaguac

SEQ ID NO: 417021 - RNA, 16 nt, Homo sapiens
uaauaguauaucuaau

SEQ ID NO: 417022 - RNA, 16 nt, Homo sapiens
uaauagucauuccaaa

SEQ ID NO: 417023 - RNA, 15 nt, Homo sapiens
uaauauaacugccuu

SEQ ID NO: 417024 - RNA, 12 nt, Homo sapiens
uaauauacuuua

SEQ ID NO: 417025 - RNA, 13 nt, Homo sapiens
uaauauggcaaaa

SEQ ID NO: 417026 - RNA, 16 nt, Homo sapiens
uaauaugucuucauaa

SEQ ID NO: 417027 - RNA, 21 nt, Homo sapiens
uaaucagacaaaguaauuccu

SEQ ID NO: 417028 - RNA, 12 nt, Homo sapiens
uaaucauaacau

SEQ ID NO: 417029 - RNA, 23 nt, Homo sapiens
uaaucaucuucucuuuuuccaga

SEQ ID NO: 417030 - RNA, 18 nt, Homo sapiens
uaaucccaauuuccccug

SEQ ID NO: 417031 - RNA, 20 nt, Homo sapiens
uaaucccagcauguugagag

SEQ ID NO: 417032 - RNA, 14 nt, Homo sapiens
uaauccuagcacuu

SEQ ID NO: 417033 - RNA, 20 nt, Homo sapiens
uaaucuagagcuaugcacac

SEQ ID NO: 417034 - RNA, 14 nt, Homo sapiens
uaaucuaguuuaca

SEQ ID NO: 417035 - RNA, 20 nt, Homo sapiens
uaaucucuaaaauucuaguc

SEQ ID NO: 417036 - RNA, 21 nt, Homo sapiens
uccucacccugauuucuugcu

SEQ ID NO: 417037 - RNA, 20 nt, Homo sapiens
uccucagguaguacugggaa

SEQ ID NO: 417038 - RNA, 14 nt, Homo sapiens
uccucauggcuguu

SEQ ID NO: 417039 - RNA, 17 nt, Homo sapiens
uccuccacaauagcaga

SEQ ID NO: 417040 - RNA, 16 nt, Homo sapiens
uccuccaccacaagag

SEQ ID NO: 417041 - RNA, 18 nt, Homo sapiens
uccuccacuccaccucca

SEQ ID NO: 417042 - RNA, 23 nt, Homo sapiens
uccuccccaccagucucacccac

SEQ ID NO: 417043 - RNA, 19 nt, Homo sapiens
uccuccuggcuuccagggg

SEQ ID NO: 417044 - RNA, 14 nt, Homo sapiens
uccuccuugcccag

SEQ ID NO: 417045 - RNA, 15 nt, Homo sapiens
uccuccuugucuuaa

SEQ ID NO: 417046 - RNA, 15 nt, Homo sapiens
uccucgcugugccac

SEQ ID NO: 417047 - RNA, 16 nt, Homo sapiens
uccucgugccguccuc

SEQ ID NO: 417048 - RNA, 13 nt, Homo sapiens
uccucuauugaug

SEQ ID NO: 417049 - RNA, 13 nt, Homo sapiens
uccucuccaagcu

SEQ ID NO: 417050 - RNA, 18 nt, Homo sapiens
uccucuccacugccuucg

SEQ ID NO: 417051 - RNA, 19 nt, Homo sapiens
uccucuccugcccagcucu

SEQ ID NO: 417052 - RNA, 13 nt, Homo sapiens
uccucugagcagc

SEQ ID NO: 417053 - RNA, 23 nt, Homo sapiens
uccucugccucccauucugacca

SEQ ID NO: 417054 - RNA, 19 nt, Homo sapiens
uccucuguccaggcacugc

SEQ ID NO: 417055 - RNA, 14 nt, Homo sapiens
uccucuguccucau

SEQ ID NO: 417056 - RNA, 23 nt, Homo sapiens
uccucuuaccuguaauagccuca

SEQ ID NO: 417057 - RNA, 19 nt, Homo sapiens
uccucuugcuauauaaaua

SEQ ID NO: 417058 - RNA, 19 nt, Homo sapiens
uccugaaaaggguguugcu

SEQ ID NO: 417059 - RNA, 19 nt, Homo sapiens
uccugacagaaggacucag

SEQ ID NO: 417060 - RNA, 18 nt, Homo sapiens
uccugaccucaaguaauc

SEQ ID NO: 417061 - RNA, 20 nt, Homo sapiens
uccugaccuccuggacugua

SEQ ID NO: 417062 - RNA, 13 nt, Homo sapiens
uccugacugggaa

SEQ ID NO: 417063 - RNA, 20 nt, Homo sapiens
uccugagcagugccagcuuu

SEQ ID NO: 417064 - RNA, 19 nt, Homo sapiens
uccugaggggauaucccua

SEQ ID NO: 417065 - RNA, 18 nt, Homo sapiens
uccugaguaguaaucuca

SEQ ID NO: 417066 - RNA, 14 nt, Homo sapiens
uccugauaaacauu

SEQ ID NO: 417067 - RNA, 21 nt, Homo sapiens
uccugauaaacauuaaacacu

SEQ ID NO: 417068 - RNA, 13 nt, Homo sapiens
uccugcaacucaa

SEQ ID NO: 417069 - RNA, 16 nt, Homo sapiens
uccugcagugugagau

SEQ ID NO: 417070 - RNA, 14 nt, Homo sapiens
uccugccaguugaa

SEQ ID NO: 417071 - RNA, 17 nt, Homo sapiens
uccugccgcaacaguuu

SEQ ID NO: 417072 - RNA, 21 nt, Homo sapiens
uccugccuucucuucuauccu

SEQ ID NO: 417073 - RNA, 22 nt, Homo sapiens
uccugcgggcgggcgucugcug

SEQ ID NO: 417074 - RNA, 22 nt, Homo sapiens
uccugcuacaacuucagcagua

SEQ ID NO: 417075 - RNA, 16 nt, Homo sapiens
uccugcuagcuguaga

SEQ ID NO: 417076 - RNA, 16 nt, Homo sapiens
uccugcuccucaggaa

SEQ ID NO: 417077 - RNA, 20 nt, Homo sapiens
uccugcuuaaugucagucua

SEQ ID NO: 417078 - RNA, 15 nt, Homo sapiens
uccugcuucugauau

SEQ ID NO: 417079 - RNA, 15 nt, Homo sapiens
uccugcuuuacagga

SEQ ID NO: 417080 - RNA, 23 nt, Homo sapiens
uccuggaaccaaucccgugaaag

SEQ ID NO: 417081 - RNA, 21 nt, Homo sapiens
uccuggcccucuucuuauuca

SEQ ID NO: 417082 - RNA, 20 nt, Homo sapiens
uccuggccuucugaacucca

SEQ ID NO: 417083 - RNA, 21 nt, Homo sapiens
uccuggcugugcacauucucc

SEQ ID NO: 417084 - RNA, 16 nt, Homo sapiens
uccugguagcaugacc

SEQ ID NO: 417085 - RNA, 20 nt, Homo sapiens
uccuguaaucacaacucagc

SEQ ID NO: 417086 - RNA, 20 nt, Homo sapiens
uccugucaccaaggacguua

SEQ ID NO: 417087 - RNA, 14 nt, Homo sapiens
uccugugacuguuu

SEQ ID NO: 417088 - RNA, 19 nt, Homo sapiens
uccugugaugucaugaaag

SEQ ID NO: 417089 - RNA, 23 nt, Homo sapiens
uccuguguccccugaccugucca

SEQ ID NO: 417090 - RNA, 21 nt, Homo sapiens
uccuguguggccugccuucac

SEQ ID NO: 417091 - RNA, 22 nt, Homo sapiens
uccugugugucgcuuaugucua

SEQ ID NO: 417092 - RNA, 20 nt, Homo sapiens
uccuguuaacacuguaauau

SEQ ID NO: 417093 - RNA, 16 nt, Homo sapiens
uccuguucccaugaga

SEQ ID NO: 417094 - RNA, 16 nt, Homo sapiens
uccuguuccugccaca

SEQ ID NO: 417095 - RNA, 22 nt, Homo sapiens
uccuguucucagagcuccacag

SEQ ID NO: 417096 - RNA, 18 nt, Homo sapiens
uccuguugagauggggga

SEQ ID NO: 417097 - RNA, 20 nt, Homo sapiens
uccuguuuaugcauucacaa

SEQ ID NO: 417098 - RNA, 18 nt, Homo sapiens
uccuuaaagguagucaag

SEQ ID NO: 417099 - RNA, 23 nt, Homo sapiens
uccuuaauaacaacagaucugca

SEQ ID NO: 417100 - RNA, 19 nt, Homo sapiens
uccuuaccgugggcacuga

SEQ ID NO: 417101 - RNA, 20 nt, Homo sapiens
uccuuaccgugggcacugaa

SEQ ID NO: 417102 - RNA, 17 nt, Homo sapiens
uccuuagaauacuguau

SEQ ID NO: 417103 - RNA, 19 nt, Homo sapiens
uccuuagucucaagggcua

SEQ ID NO: 417104 - RNA, 18 nt, Homo sapiens
uccuuaugguacacucca

SEQ ID NO: 417105 - RNA, 14 nt, Homo sapiens
uccuucaccaccuc

SEQ ID NO: 417106 - RNA, 16 nt, Homo sapiens
uccuucaccucugaaa

SEQ ID NO: 417107 - RNA, 19 nt, Homo sapiens
uccuucacucccugucaua

SEQ ID NO: 417108 - RNA, 21 nt, Homo sapiens
uccuucacucugacaguauua

SEQ ID NO: 417109 - RNA, 16 nt, Homo sapiens
uccuuccaauuuggaa

SEQ ID NO: 417110 - RNA, 17 nt, Homo sapiens
uccuuccaccaaauacu

SEQ ID NO: 417111 - RNA, 11 nt, Homo sapiens
uccuucccaac

SEQ ID NO: 417112 - RNA, 23 nt, Homo sapiens
uccuucccacuguccuuucucca

SEQ ID NO: 417113 - RNA, 19 nt, Homo sapiens
uccuucccauuucucuaca

SEQ ID NO: 417114 - RNA, 20 nt, Homo sapiens
uccuuccugccaccugcugc

SEQ ID NO: 417115 - RNA, 15 nt, Homo sapiens
uccuucuccauaaag

SEQ ID NO: 417116 - RNA, 14 nt, Homo sapiens
uccuucugugaaag

SEQ ID NO: 417117 - RNA, 13 nt, Homo sapiens
uccuucuugcccu

SEQ ID NO: 417118 - RNA, 14 nt, Homo sapiens
uccuucuugcccug

SEQ ID NO: 417119 - RNA, 22 nt, Homo sapiens
uccuugaggucuugaguuucau

SEQ ID NO: 417120 - RNA, 15 nt, Homo sapiens
gagcucuucauuuau

SEQ ID NO: 417121 - RNA, 14 nt, Homo sapiens
gagcugaaagggag

SEQ ID NO: 417122 - RNA, 20 nt, Homo sapiens
gagcugaugaaacucacaaa

SEQ ID NO: 417123 - RNA, 19 nt, Homo sapiens
gagcugcaguuuccucauc

SEQ ID NO: 417124 - RNA, 13 nt, Homo sapiens
gagcugcucagaa

SEQ ID NO: 417125 - RNA, 17 nt, Homo sapiens
gagcugcugagggaccu

SEQ ID NO: 417126 - RNA, 17 nt, Homo sapiens
gagcugcuguccaggaa

SEQ ID NO: 417127 - RNA, 18 nt, Homo sapiens
gagcuucaguauaaaaga

SEQ ID NO: 417128 - RNA, 18 nt, Homo sapiens
gagcuuccuucugugaaa

SEQ ID NO: 417129 - RNA, 11 nt, Homo sapiens
gagcuugacuu

SEQ ID NO: 417130 - RNA, 13 nt, Homo sapiens
gagcuugacuuca

SEQ ID NO: 417131 - RNA, 13 nt, Homo sapiens
gagcuuggccaga

SEQ ID NO: 417132 - RNA, 22 nt, Homo sapiens
gagcuuguaauugcaccacugc

SEQ ID NO: 417133 - RNA, 20 nt, Homo sapiens
gagcuuuggacgcacacagc

SEQ ID NO: 417134 - RNA, 20 nt, Homo sapiens
gaggaaaaauaaagacaaau

SEQ ID NO: 417135 - RNA, 15 nt, Homo sapiens
gaggaaacucaccug

SEQ ID NO: 417136 - RNA, 20 nt, Homo sapiens
gaggaaauugcagaagcagg

SEQ ID NO: 417137 - RNA, 21 nt, Homo sapiens
gaggaacaaagacaaccacug

SEQ ID NO: 417138 - RNA, 20 nt, Homo sapiens
gaggaagugcacuggcccuc

SEQ ID NO: 417139 - RNA, 16 nt, Homo sapiens
gaggaaucagcucaau

SEQ ID NO: 417140 - RNA, 17 nt, Homo sapiens
gaggacacucgcuugcc

SEQ ID NO: 417141 - RNA, 23 nt, Homo sapiens
gaggacucccugcuuagcucugu

SEQ ID NO: 417142 - RNA, 15 nt, Homo sapiens
gaggacuucugcauc

SEQ ID NO: 417143 - RNA, 19 nt, Homo sapiens
gaggacuucuggcagggaa

SEQ ID NO: 417144 - RNA, 12 nt, Homo sapiens
gaggacuugaac

SEQ ID NO: 417145 - RNA, 17 nt, Homo sapiens
gaggacuuggcaagggc

SEQ ID NO: 417146 - RNA, 16 nt, Homo sapiens
gaggagacccuggaau

SEQ ID NO: 417147 - RNA, 22 nt, Homo sapiens
gaggagccaggcaacuucaguc

SEQ ID NO: 417148 - RNA, 22 nt, Homo sapiens
gaggagcgggaccuguggcucu

SEQ ID NO: 417149 - RNA, 22 nt, Homo sapiens
gaggaggauggucaucgugaca

SEQ ID NO: 417150 - RNA, 23 nt, Homo sapiens
gaggaggcaauugggauggcgcu

SEQ ID NO: 417151 - RNA, 21 nt, Homo sapiens
gaggaguucaaugaucuaggu

SEQ ID NO: 417152 - RNA, 12 nt, Homo sapiens
gaggaucacuug

SEQ ID NO: 417153 - RNA, 13 nt, Homo sapiens
gaggaucauauga

SEQ ID NO: 417154 - RNA, 16 nt, Homo sapiens
gaggaugcugugccuc

SEQ ID NO: 417155 - RNA, 16 nt, Homo sapiens
gaggauuucaucucuu

SEQ ID NO: 417156 - RNA, 15 nt, Homo sapiens
gaggcaaagaacaau

SEQ ID NO: 417157 - RNA, 14 nt, Homo sapiens
gaggcaaaggccag

SEQ ID NO: 417158 - RNA, 20 nt, Homo sapiens
gaggcaaccuguugaauuua

SEQ ID NO: 417159 - RNA, 21 nt, Homo sapiens
gaggcaccugcuggaaaccac

SEQ ID NO: 417160 - RNA, 14 nt, Homo sapiens
gaggcagaaccagc

SEQ ID NO: 417161 - RNA, 21 nt, Homo sapiens
gaggcagaauggugggcucca

SEQ ID NO: 417162 - RNA, 19 nt, Homo sapiens
gaggcagagucucauucug

SEQ ID NO: 417163 - RNA, 20 nt, Homo sapiens
gaggcaggagaaucgcuuga

SEQ ID NO: 417164 - RNA, 13 nt, Homo sapiens
gaggcaguggcag

SEQ ID NO: 417165 - RNA, 12 nt, Homo sapiens
gaucuacaccca

SEQ ID NO: 417166 - RNA, 17 nt, Homo sapiens
gaucuacacccaccaga

SEQ ID NO: 417167 - RNA, 13 nt, Homo sapiens
gaucuaccagcau

SEQ ID NO: 417168 - RNA, 20 nt, Homo sapiens
gaucucaauuugcaguauuc

SEQ ID NO: 417169 - RNA, 18 nt, Homo sapiens
gaucucagcucacugcaa

SEQ ID NO: 417170 - RNA, 13 nt, Homo sapiens
gaucucccuuaau

SEQ ID NO: 417171 - RNA, 18 nt, Homo sapiens
gaucugcagcucccagaa

SEQ ID NO: 417172 - RNA, 14 nt, Homo sapiens
gaucugcaguuuuu

SEQ ID NO: 417173 - RNA, 18 nt, Homo sapiens
gaucugcaguuuuugccu

SEQ ID NO: 417174 - RNA, 12 nt, Homo sapiens
gaucugcuccau

SEQ ID NO: 417175 - RNA, 17 nt, Homo sapiens
gaucugggaacucccaa

SEQ ID NO: 417176 - RNA, 21 nt, Homo sapiens
gaucuggucuaguuaaccuag

SEQ ID NO: 417177 - RNA, 12 nt, Homo sapiens
gaucugugcuca

SEQ ID NO: 417178 - RNA, 18 nt, Homo sapiens
gaucuuaaagcauucccc

SEQ ID NO: 417179 - RNA, 19 nt, Homo sapiens
gaucuugagcaaggcaaga

SEQ ID NO: 417180 - RNA, 19 nt, Homo sapiens
gaugaaaaccacccuauca

SEQ ID NO: 417181 - RNA, 20 nt, Homo sapiens
gaugaaaaugaaucuucaca

SEQ ID NO: 417182 - RNA, 16 nt, Homo sapiens
gaugaaauaacuccuu

SEQ ID NO: 417183 - RNA, 22 nt, Homo sapiens
gaugaagaacacagcaugugcc

SEQ ID NO: 417184 - RNA, 17 nt, Homo sapiens
gaugaauguaugugcac

SEQ ID NO: 417185 - RNA, 18 nt, Homo sapiens
gaugaccaaucucuguga

SEQ ID NO: 417186 - RNA, 15 nt, Homo sapiens
gaugacccucugacc

SEQ ID NO: 417187 - RNA, 19 nt, Homo sapiens
gaugaccuugaaugaugcc

SEQ ID NO: 417188 - RNA, 18 nt, Homo sapiens
gaugacgacgacaacgau

SEQ ID NO: 417189 - RNA, 15 nt, Homo sapiens
gaugagcugguuuga

SEQ ID NO: 417190 - RNA, 13 nt, Homo sapiens
gaugagcuuucuu

SEQ ID NO: 417191 - RNA, 20 nt, Homo sapiens
gaugauaauacccacauuac

SEQ ID NO: 417192 - RNA, 14 nt, Homo sapiens
gaugaugaugacuc

SEQ ID NO: 417193 - RNA, 10 nt, Homo sapiens
gaugaugcug

SEQ ID NO: 417194 - RNA, 22 nt, Homo sapiens
gaugcacgguuucuguucugcc

SEQ ID NO: 417195 - RNA, 20 nt, Homo sapiens
gaugcauuccugagucuucc

SEQ ID NO: 417196 - RNA, 19 nt, Homo sapiens
gaugcgguggcuaaagguc

SEQ ID NO: 417197 - RNA, 14 nt, Homo sapiens
gaugcugugccucc

SEQ ID NO: 417198 - RNA, 14 nt, Homo sapiens
gaugcugugcuaug

SEQ ID NO: 417199 - RNA, 16 nt, Homo sapiens
gaugcuuacuacagaa

SEQ ID NO: 417200 - RNA, 18 nt, Homo sapiens
gauggaauaaagcccuug

SEQ ID NO: 417201 - RNA, 22 nt, Homo sapiens
gauggaauauuccccuaucucu

SEQ ID NO: 417202 - RNA, 21 nt, Homo sapiens
gauggaccuccuucgcuggaa

SEQ ID NO: 417203 - RNA, 22 nt, Homo sapiens
gauggaccuccuucgcuggaag

SEQ ID NO: 417204 - RNA, 16 nt, Homo sapiens
gauggagaaugccagc

SEQ ID NO: 417205 - RNA, 21 nt, Homo sapiens
gauggauaucccuaccuugaa

SEQ ID NO: 417206 - RNA, 13 nt, Homo sapiens
gauggcacugcuu

SEQ ID NO: 417207 - RNA, 15 nt, Homo sapiens
gauggcuuaagccug

SEQ ID NO: 417208 - RNA, 14 nt, Homo sapiens
gaugggaacacugg

SEQ ID NO: 417209 - RNA, 13 nt, Homo sapiens
gaugggacaccca

SEQ ID NO: 417210 - RNA, 19 nt, Homo sapiens
gaugggagugggcaccuca

SEQ ID NO: 417211 - RNA, 18 nt, Homo sapiens
gaugguaacugcacacau

SEQ ID NO: 417212 - RNA, 18 nt, Homo sapiens
gaugguaaucugaggcaa

SEQ ID NO: 417213 - RNA, 21 nt, Homo sapiens
gauggucaucgugacagcagc

SEQ ID NO: 417214 - RNA, 21 nt, Homo sapiens
gaugguuacugaggaccaaag

SEQ ID NO: 417215 - RNA, 16 nt, Homo sapiens
gauguaugaaggcuuu

SEQ ID NO: 417216 - RNA, 14 nt, Homo sapiens
gaugucacaaagau

SEQ ID NO: 417217 - RNA, 22 nt, Homo sapiens
gaugucaucuugagcucuucau

SEQ ID NO: 417218 - RNA, 19 nt, Homo sapiens
gaugucccccaggggccca

SEQ ID NO: 417219 - RNA, 17 nt, Homo sapiens
gaugucucuuguagaag

SEQ ID NO: 417220 - RNA, 17 nt, Homo sapiens
gaugugaucacugagac

SEQ ID NO: 417221 - RNA, 16 nt, Homo sapiens
gaugugccuagacacg

SEQ ID NO: 417222 - RNA, 22 nt, Homo sapiens
gaugugggaaucucccagacuu

SEQ ID NO: 417223 - RNA, 14 nt, Homo sapiens
gaugugucuuacca

SEQ ID NO: 417224 - RNA, 16 nt, Homo sapiens
gaugugucuuaccaga

SEQ ID NO: 417225 - RNA, 18 nt, Homo sapiens
gauguuaggcugggccca

SEQ ID NO: 417226 - RNA, 18 nt, Homo sapiens
gauguugcuuuugcaccu

SEQ ID NO: 417227 - RNA, 21 nt, Homo sapiens
gauguuuaacaaaucuaaucu

SEQ ID NO: 417228 - RNA, 20 nt, Homo sapiens
gauguuuuuaaaaguuucaa

SEQ ID NO: 417229 - RNA, 15 nt, Homo sapiens
gauuaaaagcacaag

SEQ ID NO: 417230 - RNA, 14 nt, Homo sapiens
gauuaaccucugca

SEQ ID NO: 417231 - RNA, 20 nt, Homo sapiens
gauuaaccugcaugcagcaa

SEQ ID NO: 417232 - RNA, 18 nt, Homo sapiens
gauuaauuaaaacacaac

SEQ ID NO: 417233 - RNA, 20 nt, Homo sapiens
gauuaauuugguugucaagu

SEQ ID NO: 417234 - RNA, 19 nt, Homo sapiens
gauuacaggcgugagccac

SEQ ID NO: 417235 - RNA, 14 nt, Homo sapiens
gauuacugucaaua

SEQ ID NO: 417236 - RNA, 19 nt, Homo sapiens
gauuacuuugcugccuuaa

SEQ ID NO: 417237 - RNA, 14 nt, Homo sapiens
gauuagaacacuca

SEQ ID NO: 417238 - RNA, 22 nt, Homo sapiens
gauuagugccuucugcccuccc

SEQ ID NO: 417239 - RNA, 20 nt, Homo sapiens
gauuaucuuguacagccuuu

SEQ ID NO: 417240 - RNA, 16 nt, Homo sapiens
gauuaugaagugacuc

SEQ ID NO: 417241 - RNA, 22 nt, Homo sapiens
gauuauuagccagguaauguga

SEQ ID NO: 417242 - RNA, 14 nt, Homo sapiens
gauucaaaugcaug

SEQ ID NO: 417243 - RNA, 23 nt, Homo sapiens
gauucaauaaaaugcacugacca

SEQ ID NO: 417244 - RNA, 23 nt, Homo sapiens
gauucacuaaagcagcacauagc

SEQ ID NO: 417245 - RNA, 18 nt, Homo sapiens
gauucaggaaugggccaa

SEQ ID NO: 417246 - RNA, 12 nt, Homo sapiens
gauuccagagag

SEQ ID NO: 417247 - RNA, 17 nt, Homo sapiens
gauuccccuggacauau

SEQ ID NO: 417248 - RNA, 19 nt, Homo sapiens
gauucccuguucuuugaag

SEQ ID NO: 417249 - RNA, 17 nt, Homo sapiens
gauucuaaaacauucuu

SEQ ID NO: 417250 - RNA, 17 nt, Homo sapiens
gauucuaaugucuucau

SEQ ID NO: 417251 - RNA, 16 nt, Homo sapiens
gauucuccugccucag

SEQ ID NO: 417252 - RNA, 18 nt, Homo sapiens
gauucugaucccugauca

SEQ ID NO: 417253 - RNA, 14 nt, Homo sapiens
gauucuucccacac

SEQ ID NO: 417254 - RNA, 18 nt, Homo sapiens
gauucuuuaaacuacuga

SEQ ID NO: 417255 - RNA, 17 nt, Homo sapiens
gauugaaggugaccucu

SEQ ID NO: 417256 - RNA, 22 nt, Homo sapiens
gauugaguucaucaugagccgu

SEQ ID NO: 417257 - RNA, 17 nt, Homo sapiens
ucucagagcauguguca

SEQ ID NO: 417258 - RNA, 11 nt, Homo sapiens
ucucagaggac

SEQ ID NO: 417259 - RNA, 15 nt, Homo sapiens
ucucagagucauuga

SEQ ID NO: 417260 - RNA, 15 nt, Homo sapiens
ucucagauugggauu

SEQ ID NO: 417261 - RNA, 22 nt, Homo sapiens
ucucagauugggauuaacauaa

SEQ ID NO: 417262 - RNA, 22 nt, Homo sapiens
ucucagcaaguguacaguauuu

SEQ ID NO: 417263 - RNA, 13 nt, Homo sapiens
ucucagcacuuug

SEQ ID NO: 417264 - RNA, 16 nt, Homo sapiens
ucucagcucacugcaa

SEQ ID NO: 417265 - RNA, 23 nt, Homo sapiens
ucucaggaguaucuuaccuguaa

SEQ ID NO: 417266 - RNA, 22 nt, Homo sapiens
ucucaggauaaaguuugcuaag

SEQ ID NO: 417267 - RNA, 16 nt, Homo sapiens
ucucagguguugccaa

SEQ ID NO: 417268 - RNA, 18 nt, Homo sapiens
ucucaguauccacugucu

SEQ ID NO: 417269 - RNA, 23 nt, Homo sapiens
ucucaguccaccugagcugccau

SEQ ID NO: 417270 - RNA, 21 nt, Homo sapiens
ucucagugcuucuuacuauua

SEQ ID NO: 417271 - RNA, 14 nt, Homo sapiens
ucucaguugcagcc

SEQ ID NO: 417272 - RNA, 20 nt, Homo sapiens
ucucaucacauuuguaaaug

SEQ ID NO: 417273 - RNA, 23 nt, Homo sapiens
ucucaucaguguccucuugcuca

SEQ ID NO: 417274 - RNA, 16 nt, Homo sapiens
ucucaucuaguuugau

SEQ ID NO: 417275 - RNA, 17 nt, Homo sapiens
ucucaugugcuuuguag

SEQ ID NO: 417276 - RNA, 17 nt, Homo sapiens
ucucauuagcucucauc

SEQ ID NO: 417277 - RNA, 21 nt, Homo sapiens
ucucauuuuuaucccauugag

SEQ ID NO: 417278 - RNA, 23 nt, Homo sapiens
ucuccaaaccacuuuuugcagcu

SEQ ID NO: 417279 - RNA, 17 nt, Homo sapiens
ucuccaaaggcacugac

SEQ ID NO: 417280 - RNA, 17 nt, Homo sapiens
ucuccaaaugagaucua

SEQ ID NO: 417281 - RNA, 20 nt, Homo sapiens
ucuccaacuccugaccucag

SEQ ID NO: 417282 - RNA, 18 nt, Homo sapiens
ucuccaagaauacagaaa

SEQ ID NO: 417283 - RNA, 13 nt, Homo sapiens
ucuccacacccau

SEQ ID NO: 417284 - RNA, 18 nt, Homo sapiens
ucuccaccucccccaaac

SEQ ID NO: 417285 - RNA, 19 nt, Homo sapiens
ucuccacuucuuguucccc

SEQ ID NO: 417286 - RNA, 15 nt, Homo sapiens
ucuccagaagccaau

SEQ ID NO: 417287 - RNA, 13 nt, Homo sapiens
ucuccagccucag

SEQ ID NO: 417288 - RNA, 18 nt, Homo sapiens
ucuccaggauuguccaca

SEQ ID NO: 417289 - RNA, 13 nt, Homo sapiens
ucuccaucaccuu

SEQ ID NO: 417290 - RNA, 13 nt, Homo sapiens
ucucccuccaugg

SEQ ID NO: 417291 - RNA, 15 nt, Homo sapiens
ucucccugcuucaua

SEQ ID NO: 417292 - RNA, 17 nt, Homo sapiens
ucucccuuccaccucac

SEQ ID NO: 417293 - RNA, 17 nt, Homo sapiens
ucuccuauguggcagcu

SEQ ID NO: 417294 - RNA, 18 nt, Homo sapiens
ucuccucuuuuguaccca

SEQ ID NO: 417295 - RNA, 18 nt, Homo sapiens
aagguuucugcacauugu

SEQ ID NO: 417296 - RNA, 20 nt, Homo sapiens
aaguaaaaacacuaccucuu

SEQ ID NO: 417297 - RNA, 20 nt, Homo sapiens
aaguaaaaauaaacuguuau

SEQ ID NO: 417298 - RNA, 18 nt, Homo sapiens
aaguaaaauuauucccug

SEQ ID NO: 417299 - RNA, 12 nt, Homo sapiens
aaguaacauaua

SEQ ID NO: 417300 - RNA, 17 nt, Homo sapiens
aaguaagagagcacagu

SEQ ID NO: 417301 - RNA, 18 nt, Homo sapiens
aaguaauccaccugccuc

SEQ ID NO: 417302 - RNA, 13 nt, Homo sapiens
aaguaaugaauuu

SEQ ID NO: 417303 - RNA, 16 nt, Homo sapiens
aaguaccaacugagcc

SEQ ID NO: 417304 - RNA, 15 nt, Homo sapiens
aaguaccuguaguga

SEQ ID NO: 417305 - RNA, 22 nt, Homo sapiens
aaguagcuuuccacauuuguca

SEQ ID NO: 417306 - RNA, 19 nt, Homo sapiens
aaguaggugugacuugaac

SEQ ID NO: 417307 - RNA, 15 nt, Homo sapiens
aaguauacaguucaa

SEQ ID NO: 417308 - RNA, 13 nt, Homo sapiens
aaguaucaugcau

SEQ ID NO: 417309 - RNA, 18 nt, Homo sapiens
aaguaucauuuauuugaa

SEQ ID NO: 417310 - RNA, 16 nt, Homo sapiens
aaguauccaugcaugu

SEQ ID NO: 417311 - RNA, 15 nt, Homo sapiens
aaguaucccaucuaa

SEQ ID NO: 417312 - RNA, 10 nt, Homo sapiens
aaguauuuaa

SEQ ID NO: 417313 - RNA, 17 nt, Homo sapiens
aaguauuuaaauguucu

SEQ ID NO: 417314 - RNA, 16 nt, Homo sapiens
aaguauuuauucagga

SEQ ID NO: 417315 - RNA, 14 nt, Homo sapiens
aagucaacacucuu

SEQ ID NO: 417316 - RNA, 13 nt, Homo sapiens
aagucacugcaca

SEQ ID NO: 417317 - RNA, 17 nt, Homo sapiens
aagucagagaaaacacu

SEQ ID NO: 417318 - RNA, 21 nt, Homo sapiens
aagucaggccucucugggaag

SEQ ID NO: 417319 - RNA, 13 nt, Homo sapiens
aaguccaguguga

SEQ ID NO: 417320 - RNA, 19 nt, Homo sapiens
aagucccugagaagccuca

SEQ ID NO: 417321 - RNA, 19 nt, Homo sapiens
aaguccuacaagcuaaaau

SEQ ID NO: 417322 - RNA, 18 nt, Homo sapiens
aaguccucccuccugcag

SEQ ID NO: 417323 - RNA, 21 nt, Homo sapiens
aagucucaggggaccauuccc

SEQ ID NO: 417324 - RNA, 23 nt, Homo sapiens
aagucugggauguagaacuucaa

SEQ ID NO: 417325 - RNA, 13 nt, Homo sapiens
aagucuuacuguu

SEQ ID NO: 417326 - RNA, 16 nt, Homo sapiens
aagucuucagggaagg

SEQ ID NO: 417327 - RNA, 19 nt, Homo sapiens
aagucuuccugaccaccuu

SEQ ID NO: 417328 - RNA, 13 nt, Homo sapiens
aagugaacuauga

SEQ ID NO: 417329 - RNA, 13 nt, Homo sapiens
aagugacacagca

SEQ ID NO: 417330 - RNA, 13 nt, Homo sapiens
aagugacucucac

SEQ ID NO: 417331 - RNA, 18 nt, Homo sapiens
aagugacucucacaagau

SEQ ID NO: 417332 - RNA, 22 nt, Homo sapiens
aagugagagagacaagaagcaa

SEQ ID NO: 417333 - RNA, 13 nt, Homo sapiens
aagugaggaugaa

SEQ ID NO: 417334 - RNA, 13 nt, Homo sapiens
aagugaguggcau

SEQ ID NO: 417335 - RNA, 19 nt, Homo sapiens
aagugaucauuucacaccc

SEQ ID NO: 417336 - RNA, 21 nt, Homo sapiens
aagugcauuuuuaucugugag

SEQ ID NO: 417337 - RNA, 14 nt, Homo sapiens
aagugccaugcuca

SEQ ID NO: 417338 - RNA, 21 nt, Homo sapiens
aagugcugggauuacaggugu

SEQ ID NO: 417339 - RNA, 23 nt, Homo sapiens
aagugcugggauuacagguguga

SEQ ID NO: 417340 - RNA, 12 nt, Homo sapiens
aaguggagucca

SEQ ID NO: 417341 - RNA, 15 nt, Homo sapiens
aaguggcaagaccaa

SEQ ID NO: 417342 - RNA, 18 nt, Homo sapiens
aaguggggugagugccuc

SEQ ID NO: 417343 - RNA, 14 nt, Homo sapiens
aagugguacaggaa

SEQ ID NO: 417344 - RNA, 15 nt, Homo sapiens
aaguguacuggauuu

SEQ ID NO: 417345 - RNA, 21 nt, Homo sapiens
aaguguaugcacgugugcaca

SEQ ID NO: 417346 - RNA, 16 nt, Homo sapiens
aagugucuaaugcauu

SEQ ID NO: 417347 - RNA, 18 nt, Homo sapiens
aagugucuacaugugcca

SEQ ID NO: 417348 - RNA, 22 nt, Homo sapiens
aagugugaguagagcaugacuu

SEQ ID NO: 417349 - RNA, 13 nt, Homo sapiens
aagugugugcaca

SEQ ID NO: 417350 - RNA, 15 nt, Homo sapiens
aaguuaaaaagucaa

SEQ ID NO: 417351 - RNA, 14 nt, Homo sapiens
aaguuaaagagaca

SEQ ID NO: 417352 - RNA, 16 nt, Homo sapiens
aaguuaaagagacaaa

SEQ ID NO: 417353 - RNA, 23 nt, Homo sapiens
aaguuaagcagccuuucugugga

SEQ ID NO: 417354 - RNA, 21 nt, Homo sapiens
aaguuauaguauaucuggaca

SEQ ID NO: 417355 - RNA, 22 nt, Homo sapiens
aaguuaugcaagggacugugug

SEQ ID NO: 417356 - RNA, 13 nt, Homo sapiens
aaguuauuuacuu

SEQ ID NO: 417357 - RNA, 14 nt, Homo sapiens
aaguucauaggguc

SEQ ID NO: 417358 - RNA, 17 nt, Homo sapiens
aaguucauccaacguga

SEQ ID NO: 417359 - RNA, 13 nt, Homo sapiens
aaguuccuaucuu

SEQ ID NO: 417360 - RNA, 15 nt, Homo sapiens
aaguucucaauguga

SEQ ID NO: 417361 - RNA, 13 nt, Homo sapiens
aaguugagaacaa

SEQ ID NO: 417362 - RNA, 15 nt, Homo sapiens
aaguuuaaauaccag

SEQ ID NO: 417363 - RNA, 19 nt, Homo sapiens
aaguuuacaaucaaaggaa

SEQ ID NO: 417364 - RNA, 22 nt, Homo sapiens
aaguuucaucagucaaugagga

SEQ ID NO: 417365 - RNA, 19 nt, Homo sapiens
aaguuuccccaccagugaa

SEQ ID NO: 417366 - RNA, 17 nt, Homo sapiens
aaguuucuuaaagcaac

SEQ ID NO: 417367 - RNA, 18 nt, Homo sapiens
aaguuugccccagugcua

SEQ ID NO: 417368 - RNA, 19 nt, Homo sapiens
aaguuuggggacaugugau

SEQ ID NO: 417369 - RNA, 15 nt, Homo sapiens
aaguuuuaaccucag

SEQ ID NO: 417370 - RNA, 19 nt, Homo sapiens
aaguuuugccuauccuaag

SEQ ID NO: 417371 - RNA, 20 nt, Homo sapiens
aauaaaaaaaaaaggaugaa

SEQ ID NO: 417372 - RNA, 18 nt, Homo sapiens
aauaaaaaauacaauuca

SEQ ID NO: 417373 - RNA, 15 nt, Homo sapiens
aauaaaaacccugua

SEQ ID NO: 417374 - RNA, 18 nt, Homo sapiens
aauaaaaacccuguaugg

SEQ ID NO: 417375 - RNA, 15 nt, Homo sapiens
aauaaaaagguuuaa

SEQ ID NO: 417376 - RNA, 24 nt, Homo sapiens
aauaaaacccaacagauacuggaa

SEQ ID NO: 417377 - RNA, 24 nt, Homo sapiens
aauaaaacuauuuaaaauuggcac

SEQ ID NO: 417378 - RNA, 14 nt, Homo sapiens
aauaaaacugcaca

SEQ ID NO: 417379 - RNA, 18 nt, Homo sapiens
aauaaaacugcacagugc

SEQ ID NO: 417380 - RNA, 18 nt, Homo sapiens
aauaaaacuuaugcuagu

SEQ ID NO: 417381 - RNA, 17 nt, Homo sapiens
aauaaaaguacaaagca

SEQ ID NO: 417382 - RNA, 16 nt, Homo sapiens
aauaaaaucuaauuaa

SEQ ID NO: 417383 - RNA, 14 nt, Homo sapiens
aauaaacaaucuua

SEQ ID NO: 417384 - RNA, 19 nt, Homo sapiens
aauaaacagcuucaugccu

SEQ ID NO: 417385 - RNA, 17 nt, Homo sapiens
aauaaacgucuugccac

SEQ ID NO: 417386 - RNA, 14 nt, Homo sapiens
aauaaacucacaac

SEQ ID NO: 417387 - RNA, 17 nt, Homo sapiens
aauaaacucacaacucu

SEQ ID NO: 417388 - RNA, 14 nt, Homo sapiens
aauaaacugugcaa

SEQ ID NO: 417389 - RNA, 20 nt, Homo sapiens
aauaaacuuucagaacugcu

SEQ ID NO: 417390 - RNA, 20 nt, Homo sapiens
aauaaagaugcccacugagg

SEQ ID NO: 417391 - RNA, 14 nt, Homo sapiens
aauaaagcaucuca

SEQ ID NO: 417392 - RNA, 14 nt, Homo sapiens
aauaaagcauuuca

SEQ ID NO: 417393 - RNA, 11 nt, Homo sapiens
aauaaagccuc

SEQ ID NO: 417394 - RNA, 12 nt, Homo sapiens
aauaaagccucu

SEQ ID NO: 417395 - RNA, 14 nt, Homo sapiens
aauaaagcuugcaa

SEQ ID NO: 417396 - RNA, 13 nt, Homo sapiens
aauaaaggaugau

SEQ ID NO: 417397 - RNA, 20 nt, Homo sapiens
aauaaagucucuuuuucuca

SEQ ID NO: 417398 - RNA, 14 nt, Homo sapiens
aauaaauacacaau

SEQ ID NO: 417399 - RNA, 15 nt, Homo sapiens
caaaaggagaacugu

SEQ ID NO: 417400 - RNA, 15 nt, Homo sapiens
caaaaggcagcucac

SEQ ID NO: 417401 - RNA, 17 nt, Homo sapiens
caaaagggccauguuuc

SEQ ID NO: 417402 - RNA, 14 nt, Homo sapiens
caaaagggguaauu

SEQ ID NO: 417403 - RNA, 13 nt, Homo sapiens
caaaagucucaau

SEQ ID NO: 417404 - RNA, 18 nt, Homo sapiens
caaaauaaaaagugacac

SEQ ID NO: 417405 - RNA, 16 nt, Homo sapiens
caaaauacagcacuuu

SEQ ID NO: 417406 - RNA, 15 nt, Homo sapiens
caaaauauacauuca

SEQ ID NO: 417407 - RNA, 20 nt, Homo sapiens
caaaaucagugaugggagua

SEQ ID NO: 417408 - RNA, 19 nt, Homo sapiens
caaaauguuaauaaagguu

SEQ ID NO: 417409 - RNA, 20 nt, Homo sapiens
caaaauguuguccuuucccc

SEQ ID NO: 417410 - RNA, 21 nt, Homo sapiens
caaaauuaucagugcucugcu

SEQ ID NO: 417411 - RNA, 23 nt, Homo sapiens
caaacaaaaauauuuugaucaug

SEQ ID NO: 417412 - RNA, 17 nt, Homo sapiens
caaacaaugaaaguggg

SEQ ID NO: 417413 - RNA, 16 nt, Homo sapiens
caaacacacagacucu

SEQ ID NO: 417414 - RNA, 15 nt, Homo sapiens
caaacacauugugaa

SEQ ID NO: 417415 - RNA, 17 nt, Homo sapiens
caaacacauugugaaua

SEQ ID NO: 417416 - RNA, 16 nt, Homo sapiens
caaacagaacacugua

SEQ ID NO: 417417 - RNA, 21 nt, Homo sapiens
caaacagauguuuguuuucaa

SEQ ID NO: 417418 - RNA, 22 nt, Homo sapiens
caaacaggcaguuggccagaga

SEQ ID NO: 417419 - RNA, 17 nt, Homo sapiens
caaacaugaaaacauug

SEQ ID NO: 417420 - RNA, 11 nt, Homo sapiens
caaacaugugc

SEQ ID NO: 417421 - RNA, 16 nt, Homo sapiens
caaacauuauucucaa

SEQ ID NO: 417422 - RNA, 19 nt, Homo sapiens
caaacccagauugaagcua

SEQ ID NO: 417423 - RNA, 15 nt, Homo sapiens
caaacccagccucua

SEQ ID NO: 417424 - RNA, 18 nt, Homo sapiens
caaacccagccucuagaa

SEQ ID NO: 417425 - RNA, 18 nt, Homo sapiens
caaacuacagaauaaugu

SEQ ID NO: 417426 - RNA, 17 nt, Homo sapiens
caaacucacugcucaag

SEQ ID NO: 417427 - RNA, 20 nt, Homo sapiens
caaacucccaggaccuggag

SEQ ID NO: 417428 - RNA, 21 nt, Homo sapiens
caaacucuuugcccaguucau

SEQ ID NO: 417429 - RNA, 15 nt, Homo sapiens
caaacuguacaguuu

SEQ ID NO: 417430 - RNA, 20 nt, Homo sapiens
caaacuguacaguuucuucc

SEQ ID NO: 417431 - RNA, 15 nt, Homo sapiens
caaagaaacagccuu

SEQ ID NO: 417432 - RNA, 19 nt, Homo sapiens
caaagaacccuagcacaaa

SEQ ID NO: 417433 - RNA, 17 nt, Homo sapiens
caaagaaucaacaguga

SEQ ID NO: 417434 - RNA, 16 nt, Homo sapiens
caaagaccaaugugaa

SEQ ID NO: 417435 - RNA, 23 nt, Homo sapiens
caaagacuguacuggccaguguc

SEQ ID NO: 417436 - RNA, 17 nt, Homo sapiens
caaagagaaacuuguaa

SEQ ID NO: 417437 - RNA, 17 nt, Homo sapiens
caaagagaaugccauuc

SEQ ID NO: 417438 - RNA, 14 nt, Homo sapiens
caaagauacaugua

SEQ ID NO: 417439 - RNA, 18 nt, Homo sapiens
caaagcacgaaauguuau

SEQ ID NO: 417440 - RNA, 11 nt, Homo sapiens
caaagcacuug

SEQ ID NO: 417441 - RNA, 22 nt, Homo sapiens
caaagcaggaauugguggcaga

SEQ ID NO: 417442 - RNA, 21 nt, Homo sapiens
caaagcaggaguggaagguga

SEQ ID NO: 417443 - RNA, 23 nt, Homo sapiens
caaagccccuacaacuccagcca

SEQ ID NO: 417444 - RNA, 23 nt, Homo sapiens
caaagcgugguggacaugcacag

SEQ ID NO: 417445 - RNA, 16 nt, Homo sapiens
caaaggaagacuuggc

SEQ ID NO: 417446 - RNA, 16 nt, Homo sapiens
caaaggaagcuuucuc

SEQ ID NO: 417447 - RNA, 18 nt, Homo sapiens
caaaggacaaaaauauaa

SEQ ID NO: 417448 - RNA, 21 nt, Homo sapiens
caaaggcauccauagugcacu

SEQ ID NO: 417449 - RNA, 22 nt, Homo sapiens
caaaggccguuagggaaaucca

SEQ ID NO: 417450 - RNA, 18 nt, Homo sapiens
caaaggcuuucuuuccaa

SEQ ID NO: 417451 - RNA, 13 nt, Homo sapiens
caaagggugggca

SEQ ID NO: 417452 - RNA, 16 nt, Homo sapiens
caaaggugauuuuccu

SEQ ID NO: 417453 - RNA, 14 nt, Homo sapiens
caaaguauguuuca

SEQ ID NO: 417454 - RNA, 15 nt, Homo sapiens
caaagugcugagauu

SEQ ID NO: 417455 - RNA, 18 nt, Homo sapiens
caaagugcugagauuaca

SEQ ID NO: 417456 - RNA, 18 nt, Homo sapiens
caaagugcugggauuaca

SEQ ID NO: 417457 - RNA, 16 nt, Homo sapiens
caaaguguuaaucuua

SEQ ID NO: 417458 - RNA, 19 nt, Homo sapiens
caaaguuacaaauucaagg

SEQ ID NO: 417459 - RNA, 20 nt, Homo sapiens
caaaguuugcucaaggagaa

SEQ ID NO: 417460 - RNA, 20 nt, Homo sapiens
caaaguuuuaaaccuguuaa

SEQ ID NO: 417461 - RNA, 15 nt, Homo sapiens
caaauaaaacauaau

SEQ ID NO: 417462 - RNA, 13 nt, Homo sapiens
caaauaauuauca

SEQ ID NO: 417463 - RNA, 22 nt, Homo sapiens
caaauacauggauaacacauuu

SEQ ID NO: 417464 - RNA, 13 nt, Homo sapiens
caaauaguuucaa

SEQ ID NO: 417465 - RNA, 18 nt, Homo sapiens
caaaucagaaacuuguga

SEQ ID NO: 417466 - RNA, 12 nt, Homo sapiens
caaaucagacac

SEQ ID NO: 417467 - RNA, 21 nt, Homo sapiens
caaaucauucaaaacuuucag

SEQ ID NO: 417468 - RNA, 18 nt, Homo sapiens
caaauccccucccuguga

SEQ ID NO: 417469 - RNA, 20 nt, Homo sapiens
caaauccccucccugugacc

SEQ ID NO: 417470 - RNA, 19 nt, Homo sapiens
caaaucugaaucgaauuac

SEQ ID NO: 417471 - RNA, 13 nt, Homo sapiens
caaaugaaugagc

SEQ ID NO: 417472 - RNA, 14 nt, Homo sapiens
caaaugacaaaaag

SEQ ID NO: 417473 - RNA, 15 nt, Homo sapiens
caaaugacaaaaagc

SEQ ID NO: 417474 - RNA, 13 nt, Homo sapiens
caaaugcagacac

SEQ ID NO: 417475 - RNA, 11 nt, Homo sapiens
caaaugcauga

SEQ ID NO: 417476 - RNA, 20 nt, Homo sapiens
caaaugcaugauauuguaug

SEQ ID NO: 417477 - RNA, 16 nt, Homo sapiens
caaaugcuauauugca

SEQ ID NO: 417478 - RNA, 22 nt, Homo sapiens
caaaugcugugcaaacagugua

SEQ ID NO: 417479 - RNA, 15 nt, Homo sapiens
caaaugcuuuggacu

SEQ ID NO: 417480 - RNA, 23 nt, Homo sapiens
caaauggcagaaccaaagcucaa

SEQ ID NO: 417481 - RNA, 16 nt, Homo sapiens
caaaugggacugaugu

SEQ ID NO: 417482 - RNA, 17 nt, Homo sapiens
caaaugggccugccaaa

SEQ ID NO: 417483 - RNA, 14 nt, Homo sapiens
caaauguccuccag

SEQ ID NO: 417484 - RNA, 12 nt, Homo sapiens
caaauguuauag

SEQ ID NO: 417485 - RNA, 18 nt, Homo sapiens
caaauguugaccuuugag

SEQ ID NO: 417486 - RNA, 15 nt, Homo sapiens
caaauuaagaaucua

SEQ ID NO: 417487 - RNA, 20 nt, Homo sapiens
caaauuauauuugugugaaa

SEQ ID NO: 417488 - RNA, 22 nt, Homo sapiens
caaauucauuuuuuucacugga

SEQ ID NO: 417489 - RNA, 16 nt, Homo sapiens
caaauugauagucaau

SEQ ID NO: 417490 - RNA, 13 nt, Homo sapiens
caaauugcugaga

SEQ ID NO: 417491 - RNA, 15 nt, Homo sapiens
caacaaguuguuuca

SEQ ID NO: 417492 - RNA, 15 nt, Homo sapiens
caacacaccuugccc

SEQ ID NO: 417493 - RNA, 20 nt, Homo sapiens
caacacaugucuagcuuuca

SEQ ID NO: 417494 - RNA, 15 nt, Homo sapiens
caacaccacuaggaa

SEQ ID NO: 417495 - RNA, 19 nt, Homo sapiens
caacaccccucccugccac

SEQ ID NO: 417496 - RNA, 23 nt, Homo sapiens
caacaccuucuuggcuucuggga

SEQ ID NO: 417497 - RNA, 22 nt, Homo sapiens
caacacugcugcuccagugcag

SEQ ID NO: 417498 - RNA, 11 nt, Homo sapiens
caacacuuaag

SEQ ID NO: 417499 - RNA, 14 nt, Homo sapiens
caacacuuuuucca

SEQ ID NO: 417500 - RNA, 13 nt, Homo sapiens
caacagagcaaaa

SEQ ID NO: 417501 - RNA, 14 nt, Homo sapiens
caacagaucugcag

SEQ ID NO: 417502 - RNA, 11 nt, Homo sapiens
caacagcacuu

SEQ ID NO: 417503 - RNA, 14 nt, Homo sapiens
caacaggaaggaac

SEQ ID NO: 417504 - RNA, 19 nt, Homo sapiens
caacaggaaggaaccagaa

SEQ ID NO: 417505 - RNA, 19 nt, Homo sapiens
caacaggcuuaugaauaua

SEQ ID NO: 417506 - RNA, 18 nt, Homo sapiens
caacagugagucugucag

SEQ ID NO: 417507 - RNA, 22 nt, Homo sapiens
caacaguuugaugcugagucau

SEQ ID NO: 417508 - RNA, 21 nt, Homo sapiens
caacauaaaacaaaaccaagc

SEQ ID NO: 417509 - RNA, 22 nt, Homo sapiens
caacaucuuuuuaaccugcaaa

SEQ ID NO: 417510 - RNA, 21 nt, Homo sapiens
caacaugaugaaaucccaucu

SEQ ID NO: 417511 - RNA, 23 nt, Homo sapiens
caacauggugaaaccccgucucu

SEQ ID NO: 417512 - RNA, 18 nt, Homo sapiens
caacauuacaaacaaagg

SEQ ID NO: 417513 - RNA, 20 nt, Homo sapiens
caacauuucucuucagugug

SEQ ID NO: 417514 - RNA, 11 nt, Homo sapiens
caaccaaaauc

SEQ ID NO: 417515 - RNA, 12 nt, Homo sapiens
caaccaauucca

SEQ ID NO: 417516 - RNA, 18 nt, Homo sapiens
caaccaccgagcaggcac

SEQ ID NO: 417517 - RNA, 17 nt, Homo sapiens
caaccacuaauuuguca

SEQ ID NO: 417518 - RNA, 18 nt, Homo sapiens
caaccauaacacuugaug

SEQ ID NO: 417519 - RNA, 17 nt, Homo sapiens
caaccccugcuccaguc

SEQ ID NO: 417520 - RNA, 17 nt, Homo sapiens
caacccuacaguauaua

SEQ ID NO: 417521 - RNA, 21 nt, Homo sapiens
caaccgggaaaggcaucuaag

SEQ ID NO: 417522 - RNA, 14 nt, Homo sapiens
caaccucugccucc

SEQ ID NO: 417523 - RNA, 20 nt, Homo sapiens
caaccugccacaaugugaua

SEQ ID NO: 417524 - RNA, 19 nt, Homo sapiens
caaccuugacuucugccca

SEQ ID NO: 417525 - RNA, 21 nt, Homo sapiens
caaccuugacuucugcccaaa

SEQ ID NO: 417526 - RNA, 19 nt, Homo sapiens
caacguggggcagcacaga

SEQ ID NO: 417527 - RNA, 21 nt, Homo sapiens
caacuaaagaauagugccuca

SEQ ID NO: 417528 - RNA, 22 nt, Homo sapiens
caacuacagaauuucauucauu

SEQ ID NO: 417529 - RNA, 19 nt, Homo sapiens
caacuacccgggccugacc

SEQ ID NO: 417530 - RNA, 12 nt, Homo sapiens
caacuagccauc

SEQ ID NO: 417531 - RNA, 22 nt, Homo sapiens
aauaaauagcuauauccaugua

SEQ ID NO: 417532 - RNA, 18 nt, Homo sapiens
aauaaauaugaauggagu

SEQ ID NO: 417533 - RNA, 13 nt, Homo sapiens
aauaaaugugaga

SEQ ID NO: 417534 - RNA, 22 nt, Homo sapiens
aauaaauuauuuaacuaauuaa

SEQ ID NO: 417535 - RNA, 14 nt, Homo sapiens
aauaaauugcuccu

SEQ ID NO: 417536 - RNA, 23 nt, Homo sapiens
aauaaauuggugauaaguggaaa

SEQ ID NO: 417537 - RNA, 13 nt, Homo sapiens
aauaacacuguac

SEQ ID NO: 417538 - RNA, 19 nt, Homo sapiens
aauaacacuguacugcaau

SEQ ID NO: 417539 - RNA, 21 nt, Homo sapiens
aauaacaucucuuucaucuag

SEQ ID NO: 417540 - RNA, 13 nt, Homo sapiens
aauaacauggccu

SEQ ID NO: 417541 - RNA, 14 nt, Homo sapiens
aauaaccacuuaaa

SEQ ID NO: 417542 - RNA, 22 nt, Homo sapiens
aauaacuaagcaaguauauuua

SEQ ID NO: 417543 - RNA, 17 nt, Homo sapiens
aauaagaaacaugaugu

SEQ ID NO: 417544 - RNA, 17 nt, Homo sapiens
aauaagcacagaaaauc

SEQ ID NO: 417545 - RNA, 14 nt, Homo sapiens
aauaagcuauauua

SEQ ID NO: 417546 - RNA, 20 nt, Homo sapiens
aauaaggcuccuucaugugg

SEQ ID NO: 417547 - RNA, 15 nt, Homo sapiens
aauaaguacauauag

SEQ ID NO: 417548 - RNA, 15 nt, Homo sapiens
aauaauaaauccuca

SEQ ID NO: 417549 - RNA, 13 nt, Homo sapiens
aauaauaaauuaa

SEQ ID NO: 417550 - RNA, 15 nt, Homo sapiens
aauaauaaauuugau

SEQ ID NO: 417551 - RNA, 14 nt, Homo sapiens
aauaauaauaguua

SEQ ID NO: 417552 - RNA, 15 nt, Homo sapiens
aauaauaccauaaua

SEQ ID NO: 417553 - RNA, 19 nt, Homo sapiens
aauaauaccauaauacaug

SEQ ID NO: 417554 - RNA, 18 nt, Homo sapiens
aauaauaugcugccaaau

SEQ ID NO: 417555 - RNA, 17 nt, Homo sapiens
aauaauugcaaauaucc

SEQ ID NO: 417556 - RNA, 22 nt, Homo sapiens
aauaauuuuaagaaaucaaaga

SEQ ID NO: 417557 - RNA, 17 nt, Homo sapiens
aauacaagccacuaccu

SEQ ID NO: 417558 - RNA, 20 nt, Homo sapiens
aauacaagccacuaccuucu

SEQ ID NO: 417559 - RNA, 20 nt, Homo sapiens
aauacaauuacucaccaaaa

SEQ ID NO: 417560 - RNA, 16 nt, Homo sapiens
aauacaauucagucuu

SEQ ID NO: 417561 - RNA, 16 nt, Homo sapiens
aauacacuaauuccuu

SEQ ID NO: 417562 - RNA, 16 nt, Homo sapiens
aauacagcacuuugac

SEQ ID NO: 417563 - RNA, 24 nt, Homo sapiens
aauacagcagugucaucagaagau

SEQ ID NO: 417564 - RNA, 18 nt, Homo sapiens
aauacaugaugauuucag

SEQ ID NO: 417565 - RNA, 16 nt, Homo sapiens
aauaccaguacuugag

SEQ ID NO: 417566 - RNA, 18 nt, Homo sapiens
aauaccauuaaaacugcu

SEQ ID NO: 417567 - RNA, 20 nt, Homo sapiens
aauaccuuuaaauaucauuc

SEQ ID NO: 417568 - RNA, 20 nt, Homo sapiens
aauacuauaaauauauugua

SEQ ID NO: 417569 - RNA, 16 nt, Homo sapiens
aauacuaucucuguau

SEQ ID NO: 417570 - RNA, 14 nt, Homo sapiens
aauacucaccaaaa

SEQ ID NO: 417571 - RNA, 17 nt, Homo sapiens
aauacucaccuccuccc

SEQ ID NO: 417572 - RNA, 22 nt, Homo sapiens
aauacugaaggacacagcagug

SEQ ID NO: 417573 - RNA, 14 nt, Homo sapiens
aauacugagugccu

SEQ ID NO: 417574 - RNA, 20 nt, Homo sapiens
aauacugguuauccugugcu

SEQ ID NO: 417575 - RNA, 21 nt, Homo sapiens
aauacugguuauccugugcua

SEQ ID NO: 417576 - RNA, 19 nt, Homo sapiens
aauacuuccaaagagucau

SEQ ID NO: 417577 - RNA, 18 nt, Homo sapiens
aauacuuugugucuuuug

SEQ ID NO: 417578 - RNA, 17 nt, Homo sapiens
aauagaacuggucuucc

SEQ ID NO: 417579 - RNA, 17 nt, Homo sapiens
aauagaagcuucuugcu

SEQ ID NO: 417580 - RNA, 21 nt, Homo sapiens
aauagaauauaauuaucggaa

SEQ ID NO: 417581 - RNA, 16 nt, Homo sapiens
aauagauacuuuugau

SEQ ID NO: 417582 - RNA, 16 nt, Homo sapiens
aauagaugaguccugu

SEQ ID NO: 417583 - RNA, 17 nt, Homo sapiens
aauagauuuaacccuuc

SEQ ID NO: 417584 - RNA, 20 nt, Homo sapiens
aauagcuuaucuuucaaggu

SEQ ID NO: 417585 - RNA, 17 nt, Homo sapiens
aauaggaagaacaguac

SEQ ID NO: 417586 - RNA, 14 nt, Homo sapiens
aauaggaauaagcu

SEQ ID NO: 417587 - RNA, 17 nt, Homo sapiens
aauaguacuauugcuag

SEQ ID NO: 417588 - RNA, 17 nt, Homo sapiens
aauaguauuaacuauua

SEQ ID NO: 417589 - RNA, 21 nt, Homo sapiens
aauaguauuugagaguucuaa

SEQ ID NO: 417590 - RNA, 9 nt, Homo sapiens
aauagucau

SEQ ID NO: 417591 - RNA, 15 nt, Homo sapiens
aauagugcaacuaug

SEQ ID NO: 417592 - RNA, 16 nt, Homo sapiens
aauagugggaucaaag

SEQ ID NO: 417593 - RNA, 16 nt, Homo sapiens
aauaguuuacauguag

SEQ ID NO: 417594 - RNA, 19 nt, Homo sapiens
aauauaaagaggacuugaa

SEQ ID NO: 417595 - RNA, 16 nt, Homo sapiens
aauauaacugccuuaa

SEQ ID NO: 417596 - RNA, 14 nt, Homo sapiens
aauauacccaucca

SEQ ID NO: 417597 - RNA, 12 nt, Homo sapiens
aauauacucagg

SEQ ID NO: 417598 - RNA, 22 nt, Homo sapiens
aauauagagggcuuaugauuca

SEQ ID NO: 417599 - RNA, 22 nt, Homo sapiens
aauauaguugucuuucuuugcu

SEQ ID NO: 417600 - RNA, 15 nt, Homo sapiens
aauauauuuuaucuu

SEQ ID NO: 417601 - RNA, 14 nt, Homo sapiens
aauaucaacaacaa

SEQ ID NO: 417602 - RNA, 23 nt, Homo sapiens
aauaucauucacuagcuuugccu

SEQ ID NO: 417603 - RNA, 17 nt, Homo sapiens
aauauccaaaccaaaua

SEQ ID NO: 417604 - RNA, 18 nt, Homo sapiens
aauaucuuuaaaugaugu

SEQ ID NO: 417605 - RNA, 19 nt, Homo sapiens
aauaucuuuaaaugaugua

SEQ ID NO: 417606 - RNA, 19 nt, Homo sapiens
aauaugaggggacugcaug

SEQ ID NO: 417607 - RNA, 17 nt, Homo sapiens
aauaugaguuacugaag

SEQ ID NO: 417608 - RNA, 19 nt, Homo sapiens
aauaugauaauaaaggcau

SEQ ID NO: 417609 - RNA, 15 nt, Homo sapiens
aauaugcaugcuucu

SEQ ID NO: 417610 - RNA, 15 nt, Homo sapiens
aauauggacaucugg

SEQ ID NO: 417611 - RNA, 16 nt, Homo sapiens
aauaugggaggaacaa

SEQ ID NO: 417612 - RNA, 23 nt, Homo sapiens
aauaugucugggaaaaagugcac

SEQ ID NO: 417613 - RNA, 13 nt, Homo sapiens
aauauuaaauaca

SEQ ID NO: 417614 - RNA, 13 nt, Homo sapiens
aauauuauaguuu

SEQ ID NO: 417615 - RNA, 11 nt, Homo sapiens
aauauucaaua

SEQ ID NO: 417616 - RNA, 14 nt, Homo sapiens
aauauucuugucca

SEQ ID NO: 417617 - RNA, 18 nt, Homo sapiens
aauauuguguugugaaug

SEQ ID NO: 417618 - RNA, 20 nt, Homo sapiens
aauauuuauuauuuucaccu

SEQ ID NO: 417619 - RNA, 22 nt, Homo sapiens
aauauuuuaaacuacugauuga

SEQ ID NO: 417620 - RNA, 22 nt, Homo sapiens
aauauuuuagauuacaggauua

SEQ ID NO: 417621 - RNA, 20 nt, Homo sapiens
aauauuuuuuuuaacugcau

SEQ ID NO: 417622 - RNA, 14 nt, Homo sapiens
aaucaaagcacuug

SEQ ID NO: 417623 - RNA, 22 nt, Homo sapiens
aaucaauaagagaacucuccuc

SEQ ID NO: 417624 - RNA, 21 nt, Homo sapiens
aaucaauacccuuggcacuga

SEQ ID NO: 417625 - RNA, 20 nt, Homo sapiens
aaucacccuacaagaugcca

SEQ ID NO: 417626 - RNA, 19 nt, Homo sapiens
aaucacgagaucuuccuuc

SEQ ID NO: 417627 - RNA, 18 nt, Homo sapiens
aaucacuauugcuuccua

SEQ ID NO: 417628 - RNA, 15 nt, Homo sapiens
aaucagacucuuuag

SEQ ID NO: 417629 - RNA, 20 nt, Homo sapiens
aaucagagagcucacuaaaa

SEQ ID NO: 417630 - RNA, 17 nt, Homo sapiens
aaucagcauucucacuc

SEQ ID NO: 417631 - RNA, 11 nt, Homo sapiens
aaucaguguga

SEQ ID NO: 417632 - RNA, 21 nt, Homo sapiens
aaucauguuggauagucagcu

SEQ ID NO: 417633 - RNA, 21 nt, Homo sapiens
aaucauuaauucacaugucca

SEQ ID NO: 417634 - RNA, 17 nt, Homo sapiens
aaucauucuacugaaca

SEQ ID NO: 417635 - RNA, 23 nt, Homo sapiens
aaucauugagaaauaaagcacau

SEQ ID NO: 417636 - RNA, 16 nt, Homo sapiens
aaucauuucaguauca

SEQ ID NO: 417637 - RNA, 22 nt, Homo sapiens
aaucauuucaguaucaucucca

SEQ ID NO: 417638 - RNA, 21 nt, Homo sapiens
aaucauuucauguuagucuua

SEQ ID NO: 417639 - RNA, 16 nt, Homo sapiens
aaucauuuugccucuu

SEQ ID NO: 417640 - RNA, 13 nt, Homo sapiens
aauccaaaccaca

SEQ ID NO: 417641 - RNA, 17 nt, Homo sapiens
aauccagagagcagugu

SEQ ID NO: 417642 - RNA, 19 nt, Homo sapiens
aauccagcuacgaauauag

SEQ ID NO: 417643 - RNA, 22 nt, Homo sapiens
aauccagcucccuagacugcau

SEQ ID NO: 417644 - RNA, 21 nt, Homo sapiens
aauccaugugcugcuguggca

SEQ ID NO: 417645 - RNA, 16 nt, Homo sapiens
aaucccaacauuucuc

SEQ ID NO: 417646 - RNA, 22 nt, Homo sapiens
aaucccacuuaucaaaucauuc

SEQ ID NO: 417647 - RNA, 12 nt, Homo sapiens
aaucccagcucc

SEQ ID NO: 417648 - RNA, 21 nt, Homo sapiens
aaucccaguucauguugcuca

SEQ ID NO: 417649 - RNA, 23 nt, Homo sapiens
aaucccccaccuccaacuuuccc

SEQ ID NO: 417650 - RNA, 14 nt, Homo sapiens
aaucccgugaaaga

SEQ ID NO: 417651 - RNA, 18 nt, Homo sapiens
aaucccucuuccuccaaa

SEQ ID NO: 417652 - RNA, 16 nt, Homo sapiens
aauccuagacuugaaa

SEQ ID NO: 417653 - RNA, 22 nt, Homo sapiens
aauccucagguaguacugggaa

SEQ ID NO: 417654 - RNA, 15 nt, Homo sapiens
aauccuccugaguga

SEQ ID NO: 417655 - RNA, 15 nt, Homo sapiens
aauccuuaucccaag

SEQ ID NO: 417656 - RNA, 15 nt, Homo sapiens
aauccuuuacuguua

SEQ ID NO: 417657 - RNA, 22 nt, Homo sapiens
aaucgacuguauucgugcauuu

SEQ ID NO: 417658 - RNA, 11 nt, Homo sapiens
aaucuagacau

SEQ ID NO: 417659 - RNA, 22 nt, Homo sapiens
aaucuagagcuaugcacaccaa

SEQ ID NO: 417660 - RNA, 11 nt, Homo sapiens
aaucucacaaa

SEQ ID NO: 417661 - RNA, 16 nt, Homo sapiens
aaucucacaaaugauc

SEQ ID NO: 417662 - RNA, 13 nt, Homo sapiens
aaucucacacuuc

SEQ ID NO: 417663 - RNA, 14 nt, Homo sapiens
caacuauuuuucca

SEQ ID NO: 417664 - RNA, 16 nt, Homo sapiens
caacucacugugcucc

SEQ ID NO: 417665 - RNA, 17 nt, Homo sapiens
caacucaugaacaaaau

SEQ ID NO: 417666 - RNA, 15 nt, Homo sapiens
caacucuccacucca

SEQ ID NO: 417667 - RNA, 16 nt, Homo sapiens
caacugacuaaccauu

SEQ ID NO: 417668 - RNA, 23 nt, Homo sapiens
caacugcaucaagaugugacaug

SEQ ID NO: 417669 - RNA, 18 nt, Homo sapiens
caacugucuaacuuuaga

SEQ ID NO: 417670 - RNA, 17 nt, Homo sapiens
caacugucuccuaccuc

SEQ ID NO: 417671 - RNA, 22 nt, Homo sapiens
caacuguugauacaaauguuag

SEQ ID NO: 417672 - RNA, 14 nt, Homo sapiens
caacuucagcagua

SEQ ID NO: 417673 - RNA, 21 nt, Homo sapiens
caacuucauuugaugcuaaau

SEQ ID NO: 417674 - RNA, 12 nt, Homo sapiens
caacuucugucc

SEQ ID NO: 417675 - RNA, 15 nt, Homo sapiens
caacuugaauuacaa

SEQ ID NO: 417676 - RNA, 20 nt, Homo sapiens
caacuuguauuaaagacaga

SEQ ID NO: 417677 - RNA, 13 nt, Homo sapiens
caacuuuccagac

SEQ ID NO: 417678 - RNA, 12 nt, Homo sapiens
caacuuucugua

SEQ ID NO: 417679 - RNA, 13 nt, Homo sapiens
caacuuucuguaa

SEQ ID NO: 417680 - RNA, 18 nt, Homo sapiens
caagaaagauaucuauga

SEQ ID NO: 417681 - RNA, 19 nt, Homo sapiens
caagaaagcauugccagcu

SEQ ID NO: 417682 - RNA, 19 nt, Homo sapiens
caagaaagccucagccauu

SEQ ID NO: 417683 - RNA, 20 nt, Homo sapiens
caagaaauaugaagcacuuu

SEQ ID NO: 417684 - RNA, 15 nt, Homo sapiens
caagaaauugauuga

SEQ ID NO: 417685 - RNA, 23 nt, Homo sapiens
caagaacauuaucuuaguggaag

SEQ ID NO: 417686 - RNA, 13 nt, Homo sapiens
caagaaccucucc

SEQ ID NO: 417687 - RNA, 17 nt, Homo sapiens
caagaagcccuccuugc

SEQ ID NO: 417688 - RNA, 20 nt, Homo sapiens
caagaagcccuccuugccac

SEQ ID NO: 417689 - RNA, 17 nt, Homo sapiens
caagaaggaauugacuu

SEQ ID NO: 417690 - RNA, 12 nt, Homo sapiens
caagaaggugag

SEQ ID NO: 417691 - RNA, 21 nt, Homo sapiens
caagaagugggauucaggaau

SEQ ID NO: 417692 - RNA, 23 nt, Homo sapiens
caagaauagaugcugacuguacu

SEQ ID NO: 417693 - RNA, 18 nt, Homo sapiens
caagacaaaaaaaaugaa

SEQ ID NO: 417694 - RNA, 15 nt, Homo sapiens
caagaccccaaaggg

SEQ ID NO: 417695 - RNA, 15 nt, Homo sapiens
caagaggcuaacuca

SEQ ID NO: 417696 - RNA, 21 nt, Homo sapiens
caagaguuuucuuccuuguaa

SEQ ID NO: 417697 - RNA, 16 nt, Homo sapiens
caagauagcaucccau

SEQ ID NO: 417698 - RNA, 21 nt, Homo sapiens
caagauccaaaugcugugcaa

SEQ ID NO: 417699 - RNA, 17 nt, Homo sapiens
caagauccuuaaugcag

SEQ ID NO: 417700 - RNA, 16 nt, Homo sapiens
caagauuaaacugagu

SEQ ID NO: 417701 - RNA, 17 nt, Homo sapiens
caagauugaagucugau

SEQ ID NO: 417702 - RNA, 22 nt, Homo sapiens
caagcaaagaacccauuugcca

SEQ ID NO: 417703 - RNA, 18 nt, Homo sapiens
caagcacuaaaaaguggc

SEQ ID NO: 417704 - RNA, 14 nt, Homo sapiens
caagcacugacacu

SEQ ID NO: 417705 - RNA, 17 nt, Homo sapiens
caagcacuggacuacaa

SEQ ID NO: 417706 - RNA, 20 nt, Homo sapiens
caagcagugaaauaugauaa

SEQ ID NO: 417707 - RNA, 13 nt, Homo sapiens
caagcaucagcaa

SEQ ID NO: 417708 - RNA, 20 nt, Homo sapiens
caagcauuucuagcagugau

SEQ ID NO: 417709 - RNA, 18 nt, Homo sapiens
caagccacagaaaugugu

SEQ ID NO: 417710 - RNA, 22 nt, Homo sapiens
caagccuguucagguuuggcca

SEQ ID NO: 417711 - RNA, 22 nt, Homo sapiens
caagcuaaaauuagaugaacuc

SEQ ID NO: 417712 - RNA, 21 nt, Homo sapiens
caagcugcagggaauuuucau

SEQ ID NO: 417713 - RNA, 23 nt, Homo sapiens
caagcugcucuccuucacucuga

SEQ ID NO: 417714 - RNA, 23 nt, Homo sapiens
caagcuuagaagccaccauguau

SEQ ID NO: 417715 - RNA, 16 nt, Homo sapiens
caaggaaaauggacau

SEQ ID NO: 417716 - RNA, 14 nt, Homo sapiens
caaggaaauagagg

SEQ ID NO: 417717 - RNA, 15 nt, Homo sapiens
caaggaauaaaugag

SEQ ID NO: 417718 - RNA, 18 nt, Homo sapiens
caaggaaugccugugcca

SEQ ID NO: 417719 - RNA, 16 nt, Homo sapiens
caaggaauuucugcuc

SEQ ID NO: 417720 - RNA, 20 nt, Homo sapiens
caaggagcaaacacugaaau

SEQ ID NO: 417721 - RNA, 23 nt, Homo sapiens
caaggauucagcauuauuccucc

SEQ ID NO: 417722 - RNA, 22 nt, Homo sapiens
caaggcaaggggugccugggaa

SEQ ID NO: 417723 - RNA, 17 nt, Homo sapiens
caaggcaggcauaucaa

SEQ ID NO: 417724 - RNA, 18 nt, Homo sapiens
caaggcaggccuuuccua

SEQ ID NO: 417725 - RNA, 19 nt, Homo sapiens
caaggcccauaucugugaa

SEQ ID NO: 417726 - RNA, 14 nt, Homo sapiens
caaggcugcaguga

SEQ ID NO: 417727 - RNA, 18 nt, Homo sapiens
caaggcuuaccugugaua

SEQ ID NO: 417728 - RNA, 9 nt, Homo sapiens
caagggaau

SEQ ID NO: 417729 - RNA, 16 nt, Homo sapiens
caaggggccagcugcc

SEQ ID NO: 417730 - RNA, 19 nt, Homo sapiens
caagggggacugucuuuca

SEQ ID NO: 417731 - RNA, 13 nt, Homo sapiens
caagguccacucc

SEQ ID NO: 417732 - RNA, 17 nt, Homo sapiens
caaggugagggaugcca

SEQ ID NO: 417733 - RNA, 22 nt, Homo sapiens
caaggugggcagggaggcacca

SEQ ID NO: 417734 - RNA, 18 nt, Homo sapiens
caagguggguuccaggga

SEQ ID NO: 417735 - RNA, 18 nt, Homo sapiens
caagguuggcgacuguca

SEQ ID NO: 417736 - RNA, 19 nt, Homo sapiens
caagguuuuggagucagua

SEQ ID NO: 417737 - RNA, 14 nt, Homo sapiens
caaguaacaaugca

SEQ ID NO: 417738 - RNA, 15 nt, Homo sapiens
caaguagcacacuga

SEQ ID NO: 417739 - RNA, 18 nt, Homo sapiens
caaguauccaaccaacuu

SEQ ID NO: 417740 - RNA, 12 nt, Homo sapiens
caagucaccucc

SEQ ID NO: 417741 - RNA, 22 nt, Homo sapiens
caaguccucagugguuggcaau

SEQ ID NO: 417742 - RNA, 12 nt, Homo sapiens
caagugagcaaa

SEQ ID NO: 417743 - RNA, 17 nt, Homo sapiens
caagugccuugagcugc

SEQ ID NO: 417744 - RNA, 19 nt, Homo sapiens
caaguggcaugugcuguga

SEQ ID NO: 417745 - RNA, 15 nt, Homo sapiens
caaguguacaguauu

SEQ ID NO: 417746 - RNA, 21 nt, Homo sapiens
caagugucucaguccaccuga

SEQ ID NO: 417747 - RNA, 16 nt, Homo sapiens
caagugucugugugca

SEQ ID NO: 417748 - RNA, 17 nt, Homo sapiens
caagugugcacuccagc

SEQ ID NO: 417749 - RNA, 24 nt, Homo sapiens
caaguguguaugugcgugugugca

SEQ ID NO: 417750 - RNA, 16 nt, Homo sapiens
caagugugugcaugug

SEQ ID NO: 417751 - RNA, 20 nt, Homo sapiens
caagugugugugcaauguuc

SEQ ID NO: 417752 - RNA, 19 nt, Homo sapiens
caaguucauaguuucugua

SEQ ID NO: 417753 - RNA, 18 nt, Homo sapiens
caaguuccgucaguccaa

SEQ ID NO: 417754 - RNA, 18 nt, Homo sapiens
caaguugcuucucaugga

SEQ ID NO: 417755 - RNA, 20 nt, Homo sapiens
caaguuuaaaggcuguguca

SEQ ID NO: 417756 - RNA, 16 nt, Homo sapiens
caaguuucaucaguca

SEQ ID NO: 417757 - RNA, 22 nt, Homo sapiens
caauaaaaaaaaaccuagcauc

SEQ ID NO: 417758 - RNA, 15 nt, Homo sapiens
caauaaaacauuccu

SEQ ID NO: 417759 - RNA, 21 nt, Homo sapiens
caauaaaacauuccugugaaa

SEQ ID NO: 417760 - RNA, 15 nt, Homo sapiens
caauaaacugugucu

SEQ ID NO: 417761 - RNA, 20 nt, Homo sapiens
caauaaagaugcccacugag

SEQ ID NO: 417762 - RNA, 13 nt, Homo sapiens
caauaaagcacua

SEQ ID NO: 417763 - RNA, 18 nt, Homo sapiens
caauaacuacuguguucc

SEQ ID NO: 417764 - RNA, 22 nt, Homo sapiens
caauaaggggagaguaacccug

SEQ ID NO: 417765 - RNA, 20 nt, Homo sapiens
caauagaacuggucuuccau

SEQ ID NO: 417766 - RNA, 15 nt, Homo sapiens
caauagcgugagcua

SEQ ID NO: 417767 - RNA, 14 nt, Homo sapiens
caauaguuugcaua

SEQ ID NO: 417768 - RNA, 17 nt, Homo sapiens
caauaucugacaguuac

SEQ ID NO: 417769 - RNA, 20 nt, Homo sapiens
caauaugaggggacugcaug

SEQ ID NO: 417770 - RNA, 20 nt, Homo sapiens
caauaugggaggaacaaaga

SEQ ID NO: 417771 - RNA, 16 nt, Homo sapiens
caauauuaaauacaga

SEQ ID NO: 417772 - RNA, 21 nt, Homo sapiens
caauauuaaauacagacacua

SEQ ID NO: 417773 - RNA, 19 nt, Homo sapiens
caauauucuuuuguucuaa

SEQ ID NO: 417774 - RNA, 18 nt, Homo sapiens
caauauuuaagagauuaa

SEQ ID NO: 417775 - RNA, 16 nt, Homo sapiens
caauauuuauuuccag

SEQ ID NO: 417776 - RNA, 14 nt, Homo sapiens
caaucaaagcacuu

SEQ ID NO: 417777 - RNA, 12 nt, Homo sapiens
caaucacacuca

SEQ ID NO: 417778 - RNA, 16 nt, Homo sapiens
caaucagagagcucac

SEQ ID NO: 417779 - RNA, 17 nt, Homo sapiens
caaucagccacauucua

SEQ ID NO: 417780 - RNA, 12 nt, Homo sapiens
caauccuauguc

SEQ ID NO: 417781 - RNA, 21 nt, Homo sapiens
caauccuccccaccagucuca

SEQ ID NO: 417782 - RNA, 16 nt, Homo sapiens
caauccuuccaaauga

SEQ ID NO: 417783 - RNA, 17 nt, Homo sapiens
caaucggguccagagac

SEQ ID NO: 417784 - RNA, 15 nt, Homo sapiens
caaucucacacagcu

SEQ ID NO: 417785 - RNA, 12 nt, Homo sapiens
caaucuguaauu

SEQ ID NO: 417786 - RNA, 14 nt, Homo sapiens
caaucuucuacuuu

SEQ ID NO: 417787 - RNA, 13 nt, Homo sapiens
caaucuuugccuu

SEQ ID NO: 417788 - RNA, 17 nt, Homo sapiens
caaugaccacauccuga

SEQ ID NO: 417789 - RNA, 13 nt, Homo sapiens
caaugaccuguau

SEQ ID NO: 417790 - RNA, 13 nt, Homo sapiens
caaugacugugag

SEQ ID NO: 417791 - RNA, 17 nt, Homo sapiens
caaugauacagucccua

SEQ ID NO: 417792 - RNA, 21 nt, Homo sapiens
caaugauaggaaaaauccauu

SEQ ID NO: 417793 - RNA, 14 nt, Homo sapiens
caaugaugauuaaa

SEQ ID NO: 417794 - RNA, 16 nt, Homo sapiens
caaugccauuuugcua

SEQ ID NO: 417795 - RNA, 14 nt, Homo sapiens
aaucucagcacuuu

SEQ ID NO: 417796 - RNA, 13 nt, Homo sapiens
aaucuccagugga

SEQ ID NO: 417797 - RNA, 19 nt, Homo sapiens
aaucuccuuuguccauuua

SEQ ID NO: 417798 - RNA, 16 nt, Homo sapiens
aaucucucuccuguau

SEQ ID NO: 417799 - RNA, 19 nt, Homo sapiens
aaucucuuauucuaauaaa

SEQ ID NO: 417800 - RNA, 14 nt, Homo sapiens
aaucucuugcacuc

SEQ ID NO: 417801 - RNA, 16 nt, Homo sapiens
aaucucuugcacucaa

SEQ ID NO: 417802 - RNA, 22 nt, Homo sapiens
aaucugacaaagucaugaagcu

SEQ ID NO: 417803 - RNA, 20 nt, Homo sapiens
aaucugacgucaucuugucu

SEQ ID NO: 417804 - RNA, 17 nt, Homo sapiens
aaucugauuggacauuu

SEQ ID NO: 417805 - RNA, 18 nt, Homo sapiens
aaucugcauuuagcacaa

SEQ ID NO: 417806 - RNA, 17 nt, Homo sapiens
aaucuggcauucuacac

SEQ ID NO: 417807 - RNA, 17 nt, Homo sapiens
aaucuguaaaugaacac

SEQ ID NO: 417808 - RNA, 14 nt, Homo sapiens
aaucuguagucacu

SEQ ID NO: 417809 - RNA, 19 nt, Homo sapiens
aaucuuacacaucugccac

SEQ ID NO: 417810 - RNA, 15 nt, Homo sapiens
aaucuucuacuuuaa

SEQ ID NO: 417811 - RNA, 20 nt, Homo sapiens
aaucuuucugcagaaacaga

SEQ ID NO: 417812 - RNA, 16 nt, Homo sapiens
aaucuuugcugaagaa

SEQ ID NO: 417813 - RNA, 22 nt, Homo sapiens
aaugaaaccugugucucugaga

SEQ ID NO: 417814 - RNA, 14 nt, Homo sapiens
aaugaaggccauca

SEQ ID NO: 417815 - RNA, 18 nt, Homo sapiens
aaugaaggccaucaucuc

SEQ ID NO: 417816 - RNA, 16 nt, Homo sapiens
aaugaagggucauuuc

SEQ ID NO: 417817 - RNA, 15 nt, Homo sapiens
aaugaaucuucacaa

SEQ ID NO: 417818 - RNA, 14 nt, Homo sapiens
aaugaauguuuaca

SEQ ID NO: 417819 - RNA, 13 nt, Homo sapiens
aaugaauuuggag

SEQ ID NO: 417820 - RNA, 16 nt, Homo sapiens
aaugacagcggggaag

SEQ ID NO: 417821 - RNA, 10 nt, Homo sapiens
aaugacauuc

SEQ ID NO: 417822 - RNA, 16 nt, Homo sapiens
aaugaccaauauuaua

SEQ ID NO: 417823 - RNA, 12 nt, Homo sapiens
aaugacuauaaa

SEQ ID NO: 417824 - RNA, 13 nt, Homo sapiens
aaugacugucuaa

SEQ ID NO: 417825 - RNA, 12 nt, Homo sapiens
aaugacugugag

SEQ ID NO: 417826 - RNA, 14 nt, Homo sapiens
aaugacuucauuuc

SEQ ID NO: 417827 - RNA, 15 nt, Homo sapiens
aaugagaaucugugc

SEQ ID NO: 417828 - RNA, 15 nt, Homo sapiens
aaugagagagugugg

SEQ ID NO: 417829 - RNA, 21 nt, Homo sapiens
aaugagaggcacacugcuaaa

SEQ ID NO: 417830 - RNA, 19 nt, Homo sapiens
aaugagccacaacacccag

SEQ ID NO: 417831 - RNA, 21 nt, Homo sapiens
aaugagcugcacuccaugagu

SEQ ID NO: 417832 - RNA, 19 nt, Homo sapiens
aaugaggaaacugcacugu

SEQ ID NO: 417833 - RNA, 21 nt, Homo sapiens
aaugaugaguauuaguucccu

SEQ ID NO: 417834 - RNA, 13 nt, Homo sapiens
aaugaugugauac

SEQ ID NO: 417835 - RNA, 14 nt, Homo sapiens
aaugauguuuuccu

SEQ ID NO: 417836 - RNA, 23 nt, Homo sapiens
aaugauuuaaauagaacuugauu

SEQ ID NO: 417837 - RNA, 14 nt, Homo sapiens
aaugauuuuaucug

SEQ ID NO: 417838 - RNA, 10 nt, Homo sapiens
aaugcagugg

SEQ ID NO: 417839 - RNA, 16 nt, Homo sapiens
aaugcauugcuaaaau

SEQ ID NO: 417840 - RNA, 19 nt, Homo sapiens
aaugccaaaauucauucag

SEQ ID NO: 417841 - RNA, 14 nt, Homo sapiens
aaugcuaagggcag

SEQ ID NO: 417842 - RNA, 18 nt, Homo sapiens
aaugcuccauucaggccu

SEQ ID NO: 417843 - RNA, 21 nt, Homo sapiens
aaugcugauuuaaacuucuua

SEQ ID NO: 417844 - RNA, 19 nt, Homo sapiens
aaugcugcacaccaguuac

SEQ ID NO: 417845 - RNA, 15 nt, Homo sapiens
aaugcugcuacuuaa

SEQ ID NO: 417846 - RNA, 16 nt, Homo sapiens
aaugcuggcauuugca

SEQ ID NO: 417847 - RNA, 21 nt, Homo sapiens
aaugcuuccccacgggaacau

SEQ ID NO: 417848 - RNA, 19 nt, Homo sapiens
aauggaaaacugccuguuc

SEQ ID NO: 417849 - RNA, 13 nt, Homo sapiens
aauggaaccaaau

SEQ ID NO: 417850 - RNA, 20 nt, Homo sapiens
aauggagggaauaauaccua

SEQ ID NO: 417851 - RNA, 23 nt, Homo sapiens
aauggcauaggcugacuuuugca

SEQ ID NO: 417852 - RNA, 16 nt, Homo sapiens
aauggccccuccauuu

SEQ ID NO: 417853 - RNA, 19 nt, Homo sapiens
aauggccuuuaucaucuag

SEQ ID NO: 417854 - RNA, 14 nt, Homo sapiens
aaugggacugaugu

SEQ ID NO: 417855 - RNA, 23 nt, Homo sapiens
aauggggguggggaggcaagaac

SEQ ID NO: 417856 - RNA, 19 nt, Homo sapiens
aaugguaggauaucuuggc

SEQ ID NO: 417857 - RNA, 13 nt, Homo sapiens
aauggucaaugcu

SEQ ID NO: 417858 - RNA, 17 nt, Homo sapiens
aaugguguuguaugccu

SEQ ID NO: 417859 - RNA, 15 nt, Homo sapiens
aaugguuuacugcug

SEQ ID NO: 417860 - RNA, 22 nt, Homo sapiens
aaugguuuucuuguguguuuau

SEQ ID NO: 417861 - RNA, 13 nt, Homo sapiens
aauguaaagacaa

SEQ ID NO: 417862 - RNA, 23 nt, Homo sapiens
aauguaagaucguucucugccuc

SEQ ID NO: 417863 - RNA, 16 nt, Homo sapiens
aauguaccugauguac

SEQ ID NO: 417864 - RNA, 17 nt, Homo sapiens
aauguacuacauuugca

SEQ ID NO: 417865 - RNA, 18 nt, Homo sapiens
aauguacuacauuugcau

SEQ ID NO: 417866 - RNA, 19 nt, Homo sapiens
aauguagaccugugagaaa

SEQ ID NO: 417867 - RNA, 15 nt, Homo sapiens
aauguaggacuguau

SEQ ID NO: 417868 - RNA, 19 nt, Homo sapiens
aauguauuuugaaaacacu

SEQ ID NO: 417869 - RNA, 12 nt, Homo sapiens
aaugucacuuaa

SEQ ID NO: 417870 - RNA, 15 nt, Homo sapiens
aaugucagucuacag

SEQ ID NO: 417871 - RNA, 18 nt, Homo sapiens
aaugucagugugacugau

SEQ ID NO: 417872 - RNA, 14 nt, Homo sapiens
aaugucauuugcua

SEQ ID NO: 417873 - RNA, 18 nt, Homo sapiens
aauguccaagcaucagca

SEQ ID NO: 417874 - RNA, 18 nt, Homo sapiens
aaugugguuacuuccuac

SEQ ID NO: 417875 - RNA, 23 nt, Homo sapiens
aaugugguuacuuccuacuguag

SEQ ID NO: 417876 - RNA, 14 nt, Homo sapiens
aaugugucugcaac

SEQ ID NO: 417877 - RNA, 13 nt, Homo sapiens
aauguuaagcaga

SEQ ID NO: 417878 - RNA, 15 nt, Homo sapiens
aauguuacauuauua

SEQ ID NO: 417879 - RNA, 13 nt, Homo sapiens
aauguuauaucau

SEQ ID NO: 417880 - RNA, 19 nt, Homo sapiens
aauguucaggagaguaaaa

SEQ ID NO: 417881 - RNA, 16 nt, Homo sapiens
aauguucuaacagauc

SEQ ID NO: 417882 - RNA, 20 nt, Homo sapiens
aauguucugacagcauuuca

SEQ ID NO: 417883 - RNA, 17 nt, Homo sapiens
aauguugaaacugacuu

SEQ ID NO: 417884 - RNA, 16 nt, Homo sapiens
aauguugaacauucau

SEQ ID NO: 417885 - RNA, 15 nt, Homo sapiens
aauguugaauacuua

SEQ ID NO: 417886 - RNA, 21 nt, Homo sapiens
aauguuuaaaagcaaaacugc

SEQ ID NO: 417887 - RNA, 18 nt, Homo sapiens
aauguuuuaaacauucuu

SEQ ID NO: 417888 - RNA, 20 nt, Homo sapiens
aauguuuucuucaucuguga

SEQ ID NO: 417889 - RNA, 17 nt, Homo sapiens
aauuaaaacacuuucaa

SEQ ID NO: 417890 - RNA, 21 nt, Homo sapiens
aauuaaaccaaggagucugau

SEQ ID NO: 417891 - RNA, 14 nt, Homo sapiens
aauuaaagggcaga

SEQ ID NO: 417892 - RNA, 21 nt, Homo sapiens
aauuaaagggcagauauucuc

SEQ ID NO: 417893 - RNA, 15 nt, Homo sapiens
aauuaacugaagcaa

SEQ ID NO: 417894 - RNA, 17 nt, Homo sapiens
aauuacaauacaucuaa

SEQ ID NO: 417895 - RNA, 15 nt, Homo sapiens
aauuacaucugucau

SEQ ID NO: 417896 - RNA, 14 nt, Homo sapiens
aauuaccugauaag

SEQ ID NO: 417897 - RNA, 23 nt, Homo sapiens
aauuacuuacucaaauucaauga

SEQ ID NO: 417898 - RNA, 17 nt, Homo sapiens
aauuagaaacacacuuu

SEQ ID NO: 417899 - RNA, 16 nt, Homo sapiens
aauuagaaauaucuuc

SEQ ID NO: 417900 - RNA, 14 nt, Homo sapiens
aauuagaugaacuc

SEQ ID NO: 417901 - RNA, 14 nt, Homo sapiens
aauuagcauuccau

SEQ ID NO: 417902 - RNA, 12 nt, Homo sapiens
aauuaguggcac

SEQ ID NO: 417903 - RNA, 14 nt, Homo sapiens
aauuauaccagugu

SEQ ID NO: 417904 - RNA, 21 nt, Homo sapiens
aauuauacuguagcugaugaa

SEQ ID NO: 417905 - RNA, 12 nt, Homo sapiens
aauuauccuccu

SEQ ID NO: 417906 - RNA, 18 nt, Homo sapiens
aauuaucggaagcagugc

SEQ ID NO: 417907 - RNA, 18 nt, Homo sapiens
aauuaucgggaacagugu

SEQ ID NO: 417908 - RNA, 13 nt, Homo sapiens
aauuaucugugau

SEQ ID NO: 417909 - RNA, 15 nt, Homo sapiens
aauuauguaaugcaa

SEQ ID NO: 417910 - RNA, 16 nt, Homo sapiens
aauuaugugcauauua

SEQ ID NO: 417911 - RNA, 14 nt, Homo sapiens
aauuauucuaguca

SEQ ID NO: 417912 - RNA, 20 nt, Homo sapiens
aauuauuuaauaugcaucuu

SEQ ID NO: 417913 - RNA, 16 nt, Homo sapiens
aauucaaagcauguca

SEQ ID NO: 417914 - RNA, 12 nt, Homo sapiens
aauucaaccacu

SEQ ID NO: 417915 - RNA, 14 nt, Homo sapiens
aauucaagcuuucc

SEQ ID NO: 417916 - RNA, 19 nt, Homo sapiens
aauucauagcauccugauu

SEQ ID NO: 417917 - RNA, 23 nt, Homo sapiens
aauucauauaaagugcaauugca

SEQ ID NO: 417918 - RNA, 23 nt, Homo sapiens
aauucaucuuucuaacucaagga

SEQ ID NO: 417919 - RNA, 20 nt, Homo sapiens
aauucauuuuuuucacugga

SEQ ID NO: 417920 - RNA, 13 nt, Homo sapiens
aauuccaauauga

SEQ ID NO: 417921 - RNA, 21 nt, Homo sapiens
aauuccaccaggauuaaucuc

SEQ ID NO: 417922 - RNA, 18 nt, Homo sapiens
aauuccauuuacuugauc

SEQ ID NO: 417923 - RNA, 19 nt, Homo sapiens
aauuccauuuacuugauca

SEQ ID NO: 417924 - RNA, 18 nt, Homo sapiens
aauucccauuuugcaaaa

SEQ ID NO: 417925 - RNA, 13 nt, Homo sapiens
aauuccucuggga

SEQ ID NO: 417926 - RNA, 14 nt, Homo sapiens
aauuccuggcauga

SEQ ID NO: 417927 - RNA, 21 nt, Homo sapiens
aauucuauaggaacauaugaa

SEQ ID NO: 417928 - RNA, 15 nt, Homo sapiens
caaugccugccugaa

SEQ ID NO: 417929 - RNA, 20 nt, Homo sapiens
caaugccugccugaacaaag

SEQ ID NO: 417930 - RNA, 19 nt, Homo sapiens
caaugccuuguuguauucc

SEQ ID NO: 417931 - RNA, 21 nt, Homo sapiens
caaugcuuuguccaugauguc

SEQ ID NO: 417932 - RNA, 18 nt, Homo sapiens
caauggaguggcugccau

SEQ ID NO: 417933 - RNA, 19 nt, Homo sapiens
caauggaguggcugccaug

SEQ ID NO: 417934 - RNA, 14 nt, Homo sapiens
caauggcggacuca

SEQ ID NO: 417935 - RNA, 14 nt, Homo sapiens
caauggcuggguuu

SEQ ID NO: 417936 - RNA, 17 nt, Homo sapiens
caauggugaacugucau

SEQ ID NO: 417937 - RNA, 14 nt, Homo sapiens
caauguaugaauua

SEQ ID NO: 417938 - RNA, 13 nt, Homo sapiens
caaugugauaugu

SEQ ID NO: 417939 - RNA, 13 nt, Homo sapiens
caaugugcacuga

SEQ ID NO: 417940 - RNA, 14 nt, Homo sapiens
caaugugcacuuca

SEQ ID NO: 417941 - RNA, 20 nt, Homo sapiens
caauguggaauuacauaaca

SEQ ID NO: 417942 - RNA, 19 nt, Homo sapiens
caauguuccguucaucuga

SEQ ID NO: 417943 - RNA, 20 nt, Homo sapiens
caauguuuuaaacauucuuc

SEQ ID NO: 417944 - RNA, 14 nt, Homo sapiens
caauuaaagcaaaa

SEQ ID NO: 417945 - RNA, 22 nt, Homo sapiens
caauuaacuccguuuccaaaua

SEQ ID NO: 417946 - RNA, 22 nt, Homo sapiens
caauuaagagagugaacauauc

SEQ ID NO: 417947 - RNA, 21 nt, Homo sapiens
caauuaccugccaaaugcuau

SEQ ID NO: 417948 - RNA, 15 nt, Homo sapiens
caauuacuauucccu

SEQ ID NO: 417949 - RNA, 17 nt, Homo sapiens
caauuacucaccaaaaa

SEQ ID NO: 417950 - RNA, 23 nt, Homo sapiens
caauuauuucagucaucaucuca

SEQ ID NO: 417951 - RNA, 19 nt, Homo sapiens
caauucaguuuuaguuuca

SEQ ID NO: 417952 - RNA, 15 nt, Homo sapiens
caauuccucugggaa

SEQ ID NO: 417953 - RNA, 15 nt, Homo sapiens
caauuggacaauuau

SEQ ID NO: 417954 - RNA, 21 nt, Homo sapiens
caauugucauuuauaaaacca

SEQ ID NO: 417955 - RNA, 21 nt, Homo sapiens
caauugucugccucagccucc

SEQ ID NO: 417956 - RNA, 13 nt, Homo sapiens
caauuugaaauca

SEQ ID NO: 417957 - RNA, 15 nt, Homo sapiens
caauuuguauaaaau

SEQ ID NO: 417958 - RNA, 20 nt, Homo sapiens
caauuuguucagucuuucau

SEQ ID NO: 417959 - RNA, 13 nt, Homo sapiens
caauuuucauccc

SEQ ID NO: 417960 - RNA, 15 nt, Homo sapiens
cacaaaucauuccau

SEQ ID NO: 417961 - RNA, 17 nt, Homo sapiens
cacaaaugcaccuccca

SEQ ID NO: 417962 - RNA, 20 nt, Homo sapiens
cacaaaugguagcauacuuu

SEQ ID NO: 417963 - RNA, 17 nt, Homo sapiens
cacaacaccuccugaua

SEQ ID NO: 417964 - RNA, 17 nt, Homo sapiens
cacaaccuccuccucca

SEQ ID NO: 417965 - RNA, 20 nt, Homo sapiens
cacaaccuccuccuccaguu

SEQ ID NO: 417966 - RNA, 14 nt, Homo sapiens
cacaacuaacaaug

SEQ ID NO: 417967 - RNA, 16 nt, Homo sapiens
cacaacuccaguguuc

SEQ ID NO: 417968 - RNA, 14 nt, Homo sapiens
cacaacucucuggu

SEQ ID NO: 417969 - RNA, 18 nt, Homo sapiens
cacaagcguguuucuaga

SEQ ID NO: 417970 - RNA, 14 nt, Homo sapiens
cacaaggaaggcau

SEQ ID NO: 417971 - RNA, 21 nt, Homo sapiens
cacaagguugcuggcauuugc

SEQ ID NO: 417972 - RNA, 15 nt, Homo sapiens
cacaaguccugugaa

SEQ ID NO: 417973 - RNA, 14 nt, Homo sapiens
cacaauaaauguau

SEQ ID NO: 417974 - RNA, 20 nt, Homo sapiens
cacaauagcaguugaaacaa

SEQ ID NO: 417975 - RNA, 19 nt, Homo sapiens
cacaauguacuauauguau

SEQ ID NO: 417976 - RNA, 13 nt, Homo sapiens
cacacaacugugg

SEQ ID NO: 417977 - RNA, 23 nt, Homo sapiens
cacacaagcagucuuuuucuaca

SEQ ID NO: 417978 - RNA, 16 nt, Homo sapiens
cacacacacacacaaa

SEQ ID NO: 417979 - RNA, 19 nt, Homo sapiens
cacacagcuggggcuguag

SEQ ID NO: 417980 - RNA, 18 nt, Homo sapiens
cacacauuauuaccccac

SEQ ID NO: 417981 - RNA, 18 nt, Homo sapiens
cacacccaugacugcccc

SEQ ID NO: 417982 - RNA, 14 nt, Homo sapiens
cacacccauucaca

SEQ ID NO: 417983 - RNA, 17 nt, Homo sapiens
cacacccccuuuccauc

SEQ ID NO: 417984 - RNA, 13 nt, Homo sapiens
cacaccuacccuc

SEQ ID NO: 417985 - RNA, 20 nt, Homo sapiens
cacaccucacgcucuggaca

SEQ ID NO: 417986 - RNA, 21 nt, Homo sapiens
cacaccuggcccuugcaaucu

SEQ ID NO: 417987 - RNA, 18 nt, Homo sapiens
cacacgcugcccaggcuc

SEQ ID NO: 417988 - RNA, 14 nt, Homo sapiens
cacacguacuuaaa

SEQ ID NO: 417989 - RNA, 21 nt, Homo sapiens
cacacugacauaauguaguga

SEQ ID NO: 417990 - RNA, 18 nt, Homo sapiens
cacacugagacuugaauc

SEQ ID NO: 417991 - RNA, 13 nt, Homo sapiens
cacacugagcaag

SEQ ID NO: 417992 - RNA, 13 nt, Homo sapiens
cacacugcuugug

SEQ ID NO: 417993 - RNA, 15 nt, Homo sapiens
cacacuguaucguga

SEQ ID NO: 417994 - RNA, 14 nt, Homo sapiens
cacacuuccugucc

SEQ ID NO: 417995 - RNA, 13 nt, Homo sapiens
cacacuucuugaa

SEQ ID NO: 417996 - RNA, 17 nt, Homo sapiens
cacacuugggagcaaaa

SEQ ID NO: 417997 - RNA, 22 nt, Homo sapiens
cacagacacacacacgcacgca

SEQ ID NO: 417998 - RNA, 14 nt, Homo sapiens
cacagacacuuaca

SEQ ID NO: 417999 - RNA, 24 nt, Homo sapiens
cacagacuggagacaaugcagaug

SEQ ID NO: 418000 - RNA, 18 nt, Homo sapiens
cacagacuucacacagca

SEQ ID NO: 418001 - RNA, 23 nt, Homo sapiens
cacagacuuccaccaugugcauc

SEQ ID NO: 418002 - RNA, 13 nt, Homo sapiens
cacagagaccccc

SEQ ID NO: 418003 - RNA, 18 nt, Homo sapiens
cacagaggcaguggcagc

SEQ ID NO: 418004 - RNA, 23 nt, Homo sapiens
cacagagugcauugugaggguua

SEQ ID NO: 418005 - RNA, 21 nt, Homo sapiens
cacagauuaaacuucaccuac

SEQ ID NO: 418006 - RNA, 20 nt, Homo sapiens
cacagcaagacuccgucuca

SEQ ID NO: 418007 - RNA, 22 nt, Homo sapiens
cacagcagguuuauccagauga

SEQ ID NO: 418008 - RNA, 16 nt, Homo sapiens
cacagcaugugccaag

SEQ ID NO: 418009 - RNA, 13 nt, Homo sapiens
cacagccauuuca

SEQ ID NO: 418010 - RNA, 17 nt, Homo sapiens
cacagcccgcaugcagc

SEQ ID NO: 418011 - RNA, 15 nt, Homo sapiens
cacagccuccagggc

SEQ ID NO: 418012 - RNA, 16 nt, Homo sapiens
cacagcucaggaacua

SEQ ID NO: 418013 - RNA, 23 nt, Homo sapiens
cacagcugagagacuuuuaauca

SEQ ID NO: 418014 - RNA, 22 nt, Homo sapiens
cacagcugcugugccaggacug

SEQ ID NO: 418015 - RNA, 20 nt, Homo sapiens
cacagcugggcaaagccaca

SEQ ID NO: 418016 - RNA, 19 nt, Homo sapiens
cacaggcagugcaugugaa

SEQ ID NO: 418017 - RNA, 20 nt, Homo sapiens
cacaggcuacaguugaacag

SEQ ID NO: 418018 - RNA, 13 nt, Homo sapiens
cacagggacacag

SEQ ID NO: 418019 - RNA, 14 nt, Homo sapiens
cacagggacacagu

SEQ ID NO: 418020 - RNA, 19 nt, Homo sapiens
cacaggggccccuccucua

SEQ ID NO: 418021 - RNA, 15 nt, Homo sapiens
cacagggucugcucu

SEQ ID NO: 418022 - RNA, 15 nt, Homo sapiens
cacaggguguuggaa

SEQ ID NO: 418023 - RNA, 17 nt, Homo sapiens
cacaguacaauguuuca

SEQ ID NO: 418024 - RNA, 22 nt, Homo sapiens
cacagucucuuuaaucuucagu

SEQ ID NO: 418025 - RNA, 22 nt, Homo sapiens
cacagucuggugcccagacuca

SEQ ID NO: 418026 - RNA, 13 nt, Homo sapiens
cacagugcaucuc

SEQ ID NO: 418027 - RNA, 11 nt, Homo sapiens
cacaguuuaaa

SEQ ID NO: 418028 - RNA, 23 nt, Homo sapiens
cacaguuuauuuuuauacuuuca

SEQ ID NO: 418029 - RNA, 15 nt, Homo sapiens
cacauagauucaccu

SEQ ID NO: 418030 - RNA, 12 nt, Homo sapiens
cacauagcacag

SEQ ID NO: 418031 - RNA, 12 nt, Homo sapiens
cacauagcuggg

SEQ ID NO: 418032 - RNA, 23 nt, Homo sapiens
cacauagcugggauuugaacuga

SEQ ID NO: 418033 - RNA, 15 nt, Homo sapiens
cacauaugucuuacu

SEQ ID NO: 418034 - RNA, 21 nt, Homo sapiens
cacauaugucuuacuacuuua

SEQ ID NO: 418035 - RNA, 23 nt, Homo sapiens
cacaucauggcagugggaccaag

SEQ ID NO: 418036 - RNA, 13 nt, Homo sapiens
cacaucauuggaa

SEQ ID NO: 418037 - RNA, 23 nt, Homo sapiens
cacaugcacacacacacaucuca

SEQ ID NO: 418038 - RNA, 17 nt, Homo sapiens
cacaugcacuacugaaa

SEQ ID NO: 418039 - RNA, 15 nt, Homo sapiens
cacauguggggacag

SEQ ID NO: 418040 - RNA, 20 nt, Homo sapiens
cacauuagagggacagccaa

SEQ ID NO: 418041 - RNA, 19 nt, Homo sapiens
cacauucaugugggcauuu

SEQ ID NO: 418042 - RNA, 20 nt, Homo sapiens
cacauuuacaaaauuacaca

SEQ ID NO: 418043 - RNA, 19 nt, Homo sapiens
cacauuuuacgacaaggau

SEQ ID NO: 418044 - RNA, 21 nt, Homo sapiens
caccaaacugcacacacagcu

SEQ ID NO: 418045 - RNA, 15 nt, Homo sapiens
caccaaaguauuaau

SEQ ID NO: 418046 - RNA, 21 nt, Homo sapiens
caccaaauacuuucugagaug

SEQ ID NO: 418047 - RNA, 22 nt, Homo sapiens
caccaacaacagucagccagcu

SEQ ID NO: 418048 - RNA, 19 nt, Homo sapiens
caccaacucugcacuccau

SEQ ID NO: 418049 - RNA, 22 nt, Homo sapiens
caccaagagccucccugccguu

SEQ ID NO: 418050 - RNA, 19 nt, Homo sapiens
caccaauauuucucagaca

SEQ ID NO: 418051 - RNA, 21 nt, Homo sapiens
caccaauauuucucagacauc

SEQ ID NO: 418052 - RNA, 18 nt, Homo sapiens
caccacacccuugcuugg

SEQ ID NO: 418053 - RNA, 14 nt, Homo sapiens
caccacagacacac

SEQ ID NO: 418054 - RNA, 16 nt, Homo sapiens
caccacagacacacac

SEQ ID NO: 418055 - RNA, 14 nt, Homo sapiens
caccacagagccuc

SEQ ID NO: 418056 - RNA, 15 nt, Homo sapiens
caccaccagcuuaaa

SEQ ID NO: 418057 - RNA, 13 nt, Homo sapiens
caccaccccagcu

SEQ ID NO: 418058 - RNA, 22 nt, Homo sapiens
caccaccggggcacuggcugcu

SEQ ID NO: 418059 - RNA, 17 nt, Homo sapiens
caccacuaagagaauac

SEQ ID NO: 418060 - RNA, 17 nt, Homo sapiens
aauucuauucugaucuu

SEQ ID NO: 418061 - RNA, 17 nt, Homo sapiens
aauucucagaggacuug

SEQ ID NO: 418062 - RNA, 13 nt, Homo sapiens
aauucugaugcua

SEQ ID NO: 418063 - RNA, 16 nt, Homo sapiens
aauucugcuccugaaa

SEQ ID NO: 418064 - RNA, 23 nt, Homo sapiens
aauucugucccugucccugcccc

SEQ ID NO: 418065 - RNA, 13 nt, Homo sapiens
aauucugugaaga

SEQ ID NO: 418066 - RNA, 12 nt, Homo sapiens
aauucuguuaca

SEQ ID NO: 418067 - RNA, 19 nt, Homo sapiens
aauucuuaccucauuugca

SEQ ID NO: 418068 - RNA, 20 nt, Homo sapiens
aauucuuauuuuuccuaaca

SEQ ID NO: 418069 - RNA, 18 nt, Homo sapiens
aauugaaugucaauauga

SEQ ID NO: 418070 - RNA, 11 nt, Homo sapiens
aauugauucaa

SEQ ID NO: 418071 - RNA, 20 nt, Homo sapiens
aauugauugaacguucucaa

SEQ ID NO: 418072 - RNA, 18 nt, Homo sapiens
aauugcaugcugcuuuaa

SEQ ID NO: 418073 - RNA, 12 nt, Homo sapiens
aauugcauuucc

SEQ ID NO: 418074 - RNA, 22 nt, Homo sapiens
aauugccauuggacaguugucu

SEQ ID NO: 418075 - RNA, 16 nt, Homo sapiens
aauuggaaacugacau

SEQ ID NO: 418076 - RNA, 14 nt, Homo sapiens
aauuggguuuuaaa

SEQ ID NO: 418077 - RNA, 13 nt, Homo sapiens
aauuggucauucc

SEQ ID NO: 418078 - RNA, 22 nt, Homo sapiens
aauuggucauuccuaaugcauu

SEQ ID NO: 418079 - RNA, 17 nt, Homo sapiens
aauugguguauaucaug

SEQ ID NO: 418080 - RNA, 14 nt, Homo sapiens
aauuguagccaguu

SEQ ID NO: 418081 - RNA, 16 nt, Homo sapiens
aauuguauuacuuccu

SEQ ID NO: 418082 - RNA, 15 nt, Homo sapiens
aauugugaacagcca

SEQ ID NO: 418083 - RNA, 19 nt, Homo sapiens
aauugugaacucauugcuc

SEQ ID NO: 418084 - RNA, 12 nt, Homo sapiens
aauugugcaaau

SEQ ID NO: 418085 - RNA, 19 nt, Homo sapiens
aauugugcuggucauacau

SEQ ID NO: 418086 - RNA, 19 nt, Homo sapiens
aauuguuugauauugucac

SEQ ID NO: 418087 - RNA, 23 nt, Homo sapiens
aauuguuugucuuuaacugucaa

SEQ ID NO: 418088 - RNA, 15 nt, Homo sapiens
aauuguuuugcacuu

SEQ ID NO: 418089 - RNA, 13 nt, Homo sapiens
aauuuaaccuacu

SEQ ID NO: 418090 - RNA, 17 nt, Homo sapiens
aauuuaaggccugcacu

SEQ ID NO: 418091 - RNA, 17 nt, Homo sapiens
aauuuaggaaugcucaa

SEQ ID NO: 418092 - RNA, 19 nt, Homo sapiens
aauuucaaaaugcauguga

SEQ ID NO: 418093 - RNA, 14 nt, Homo sapiens
aauuucacagauaa

SEQ ID NO: 418094 - RNA, 15 nt, Homo sapiens
aauuucacugaugua

SEQ ID NO: 418095 - RNA, 12 nt, Homo sapiens
aauuucauucau

SEQ ID NO: 418096 - RNA, 15 nt, Homo sapiens
aauuuccaguaccuu

SEQ ID NO: 418097 - RNA, 20 nt, Homo sapiens
aauuucccaaagcagugcau

SEQ ID NO: 418098 - RNA, 14 nt, Homo sapiens
aauuuccuaaugag

SEQ ID NO: 418099 - RNA, 15 nt, Homo sapiens
aauuucuagacagua

SEQ ID NO: 418100 - RNA, 15 nt, Homo sapiens
aauuucuuacuaaac

SEQ ID NO: 418101 - RNA, 14 nt, Homo sapiens
aauuucuuugucau

SEQ ID NO: 418102 - RNA, 14 nt, Homo sapiens
aauuugaaccaaaa

SEQ ID NO: 418103 - RNA, 21 nt, Homo sapiens
aauuugaaccaaaacauuccg

SEQ ID NO: 418104 - RNA, 12 nt, Homo sapiens
aauuugaugaaa

SEQ ID NO: 418105 - RNA, 12 nt, Homo sapiens
aauuugcugcug

SEQ ID NO: 418106 - RNA, 17 nt, Homo sapiens
aauuuguagacauacuu

SEQ ID NO: 418107 - RNA, 15 nt, Homo sapiens
aauuuuaaaguauca

SEQ ID NO: 418108 - RNA, 18 nt, Homo sapiens
aauuuuauugcuggaauc

SEQ ID NO: 418109 - RNA, 15 nt, Homo sapiens
aauuuucacugcugc

SEQ ID NO: 418110 - RNA, 24 nt, Homo sapiens
aauuuucuucaugcaaugacaucu

SEQ ID NO: 418111 - RNA, 12 nt, Homo sapiens
aauuuugauuca

SEQ ID NO: 418112 - RNA, 14 nt, Homo sapiens
aauuuugcauugug

SEQ ID NO: 418113 - RNA, 21 nt, Homo sapiens
aauuuuguaguaguugaugac

SEQ ID NO: 418114 - RNA, 14 nt, Homo sapiens
aauuuuguugauau

SEQ ID NO: 418115 - RNA, 12 nt, Homo sapiens
aauuuuguugca

SEQ ID NO: 418116 - RNA, 19 nt, Homo sapiens
aauuuuuaaaucauuucau

SEQ ID NO: 418117 - RNA, 21 nt, Homo sapiens
aauuuuuacacaaaccugaaa

SEQ ID NO: 418118 - RNA, 22 nt, Homo sapiens
aauuuuuuuucuguaaauggaa

SEQ ID NO: 418119 - RNA, 15 nt, Homo sapiens
acaaaaaauacuuua

SEQ ID NO: 418120 - RNA, 19 nt, Homo sapiens
acaaaaagccuuuuccaga

SEQ ID NO: 418121 - RNA, 16 nt, Homo sapiens
acaaaaaugaacugaa

SEQ ID NO: 418122 - RNA, 12 nt, Homo sapiens
acaaaaccagaa

SEQ ID NO: 418123 - RNA, 16 nt, Homo sapiens
acaaaaccuaacuugc

SEQ ID NO: 418124 - RNA, 14 nt, Homo sapiens
acaaaagauguauc

SEQ ID NO: 418125 - RNA, 15 nt, Homo sapiens
acaaaagauguaucc

SEQ ID NO: 418126 - RNA, 13 nt, Homo sapiens
acaaaaggcuuug

SEQ ID NO: 418127 - RNA, 23 nt, Homo sapiens
acaaacaaccugccacaauguga

SEQ ID NO: 418128 - RNA, 15 nt, Homo sapiens
acaaacacauuguga

SEQ ID NO: 418129 - RNA, 11 nt, Homo sapiens
acaaacaguga

SEQ ID NO: 418130 - RNA, 20 nt, Homo sapiens
acaaacccguuuuaugauuu

SEQ ID NO: 418131 - RNA, 18 nt, Homo sapiens
acaaaccgagugcaauga

SEQ ID NO: 418132 - RNA, 18 nt, Homo sapiens
acaaacugaagauaauga

SEQ ID NO: 418133 - RNA, 18 nt, Homo sapiens
acaaagagaaacuuguaa

SEQ ID NO: 418134 - RNA, 15 nt, Homo sapiens
acaaagcacaguguu

SEQ ID NO: 418135 - RNA, 19 nt, Homo sapiens
acaaagcaguuacuaauau

SEQ ID NO: 418136 - RNA, 23 nt, Homo sapiens
acaaagcugaagaaaaugaagcc

SEQ ID NO: 418137 - RNA, 19 nt, Homo sapiens
acaaagugacauuccugag

SEQ ID NO: 418138 - RNA, 17 nt, Homo sapiens
acaaauaaguaauaucu

SEQ ID NO: 418139 - RNA, 14 nt, Homo sapiens
acaaaucauuccau

SEQ ID NO: 418140 - RNA, 21 nt, Homo sapiens
acaaauccaacgcuuuuccca

SEQ ID NO: 418141 - RNA, 19 nt, Homo sapiens
acaaaugauuuacacugac

SEQ ID NO: 418142 - RNA, 18 nt, Homo sapiens
acaaaugguagcauacuu

SEQ ID NO: 418143 - RNA, 20 nt, Homo sapiens
acaacaaucccagcaucuga

SEQ ID NO: 418144 - RNA, 14 nt, Homo sapiens
acaacauuuuauua

SEQ ID NO: 418145 - RNA, 21 nt, Homo sapiens
acaaccaugagaccacuguua

SEQ ID NO: 418146 - RNA, 23 nt, Homo sapiens
acaaccuccuccuccaguucuga

SEQ ID NO: 418147 - RNA, 18 nt, Homo sapiens
acaaccuguuaccacuuc

SEQ ID NO: 418148 - RNA, 14 nt, Homo sapiens
acaacgaugaugcu

SEQ ID NO: 418149 - RNA, 15 nt, Homo sapiens
acaagaauugcuaaa

SEQ ID NO: 418150 - RNA, 15 nt, Homo sapiens
acaagacacccaagu

SEQ ID NO: 418151 - RNA, 13 nt, Homo sapiens
acaagaugagauu

SEQ ID NO: 418152 - RNA, 15 nt, Homo sapiens
acaagccacuaccuu

SEQ ID NO: 418153 - RNA, 23 nt, Homo sapiens
acaaggcauucaaguguacagug

SEQ ID NO: 418154 - RNA, 23 nt, Homo sapiens
acaagggaagcuucuugcugcca

SEQ ID NO: 418155 - RNA, 23 nt, Homo sapiens
acaaguacaucacccagugguau

SEQ ID NO: 418156 - RNA, 19 nt, Homo sapiens
acaagucucaggggaccau

SEQ ID NO: 418157 - RNA, 17 nt, Homo sapiens
acaagugcucaguucca

SEQ ID NO: 418158 - RNA, 18 nt, Homo sapiens
acaaguugaucaugcagg

SEQ ID NO: 418159 - RNA, 21 nt, Homo sapiens
acaaguugcgacggagagaaa

SEQ ID NO: 418160 - RNA, 16 nt, Homo sapiens
acaauaaacaugucaa

SEQ ID NO: 418161 - RNA, 21 nt, Homo sapiens
acaauaaauguauucaaauac

SEQ ID NO: 418162 - RNA, 18 nt, Homo sapiens
acaauaacucacucucac

SEQ ID NO: 418163 - RNA, 13 nt, Homo sapiens
acaauaagcagag

SEQ ID NO: 418164 - RNA, 18 nt, Homo sapiens
acaauacagauaacauua

SEQ ID NO: 418165 - RNA, 16 nt, Homo sapiens
acaauacgugaaagau

SEQ ID NO: 418166 - RNA, 14 nt, Homo sapiens
acaauaugcuuuac

SEQ ID NO: 418167 - RNA, 16 nt, Homo sapiens
acaaucccagcaucug

SEQ ID NO: 418168 - RNA, 21 nt, Homo sapiens
acaauccccacauaccaucug

SEQ ID NO: 418169 - RNA, 19 nt, Homo sapiens
acaauccucgucugaauca

SEQ ID NO: 418170 - RNA, 18 nt, Homo sapiens
acaauguacaagguaugu

SEQ ID NO: 418171 - RNA, 23 nt, Homo sapiens
acaauguaugugaaaguguaaaa

SEQ ID NO: 418172 - RNA, 15 nt, Homo sapiens
acaaugugcacugaa

SEQ ID NO: 418173 - RNA, 22 nt, Homo sapiens
acaauguuauucguuuugucua

SEQ ID NO: 418174 - RNA, 12 nt, Homo sapiens
acaauguugcac

SEQ ID NO: 418175 - RNA, 22 nt, Homo sapiens
acaauuaagagagugaacauau

SEQ ID NO: 418176 - RNA, 22 nt, Homo sapiens
acaauuaccugccaaaugcuau

SEQ ID NO: 418177 - RNA, 14 nt, Homo sapiens
acaauucugucccu

SEQ ID NO: 418178 - RNA, 18 nt, Homo sapiens
acaauuuauccaaagcau

SEQ ID NO: 418179 - RNA, 22 nt, Homo sapiens
acacaaaacguuaagugaugaa

SEQ ID NO: 418180 - RNA, 19 nt, Homo sapiens
acacaaaauguacccagua

SEQ ID NO: 418181 - RNA, 21 nt, Homo sapiens
acacaaauauugcuuggacua

SEQ ID NO: 418182 - RNA, 13 nt, Homo sapiens
acacaacauguau

SEQ ID NO: 418183 - RNA, 14 nt, Homo sapiens
acacaacauguaug

SEQ ID NO: 418184 - RNA, 15 nt, Homo sapiens
acacaacauguaugu

SEQ ID NO: 418185 - RNA, 12 nt, Homo sapiens
acacaacugugg

SEQ ID NO: 418186 - RNA, 17 nt, Homo sapiens
acacacaaauauugcuu

SEQ ID NO: 418187 - RNA, 11 nt, Homo sapiens
acacacacagc

SEQ ID NO: 418188 - RNA, 14 nt, Homo sapiens
acacacacaucuca

SEQ ID NO: 418189 - RNA, 17 nt, Homo sapiens
acacacccuacaaguug

SEQ ID NO: 418190 - RNA, 13 nt, Homo sapiens
acacacuuuugca

SEQ ID NO: 418191 - RNA, 15 nt, Homo sapiens
acacacuuuugcaca

SEQ ID NO: 418192 - RNA, 22 nt, Homo sapiens
acacagaucagauuaucugguc

SEQ ID NO: 418193 - RNA, 15 nt, Homo sapiens
caccagaagugccau

SEQ ID NO: 418194 - RNA, 16 nt, Homo sapiens
caccagaagugccaug

SEQ ID NO: 418195 - RNA, 16 nt, Homo sapiens
caccagaauugugcaa

SEQ ID NO: 418196 - RNA, 20 nt, Homo sapiens
caccagagcauuuccaacac

SEQ ID NO: 418197 - RNA, 15 nt, Homo sapiens
caccaggagauuaca

SEQ ID NO: 418198 - RNA, 14 nt, Homo sapiens
caccagggacugca

SEQ ID NO: 418199 - RNA, 15 nt, Homo sapiens
caccagggacugcag

SEQ ID NO: 418200 - RNA, 14 nt, Homo sapiens
caccagguccugug

SEQ ID NO: 418201 - RNA, 16 nt, Homo sapiens
caccagguccugugag

SEQ ID NO: 418202 - RNA, 21 nt, Homo sapiens
caccagucucacccacuagga

SEQ ID NO: 418203 - RNA, 13 nt, Homo sapiens
caccaucuggaag

SEQ ID NO: 418204 - RNA, 14 nt, Homo sapiens
caccaugcccagcu

SEQ ID NO: 418205 - RNA, 21 nt, Homo sapiens
cacccaaguugaagacuuugu

SEQ ID NO: 418206 - RNA, 12 nt, Homo sapiens
cacccaccagag

SEQ ID NO: 418207 - RNA, 15 nt, Homo sapiens
cacccaccagggcuc

SEQ ID NO: 418208 - RNA, 19 nt, Homo sapiens
cacccaccauauuguuuga

SEQ ID NO: 418209 - RNA, 19 nt, Homo sapiens
cacccaccuggauucccug

SEQ ID NO: 418210 - RNA, 11 nt, Homo sapiens
cacccacguga

SEQ ID NO: 418211 - RNA, 21 nt, Homo sapiens
cacccagcaaggcacaggcuc

SEQ ID NO: 418212 - RNA, 16 nt, Homo sapiens
cacccagugcugccau

SEQ ID NO: 418213 - RNA, 21 nt, Homo sapiens
cacccauaccagcuagaauca

SEQ ID NO: 418214 - RNA, 22 nt, Homo sapiens
cacccauugucucauugccagu

SEQ ID NO: 418215 - RNA, 15 nt, Homo sapiens
caccccaacucuccc

SEQ ID NO: 418216 - RNA, 22 nt, Homo sapiens
cacccccacccaccuccaccca

SEQ ID NO: 418217 - RNA, 14 nt, Homo sapiens
caccccucaagcca

SEQ ID NO: 418218 - RNA, 22 nt, Homo sapiens
caccccuccaugauuccaaggg

SEQ ID NO: 418219 - RNA, 18 nt, Homo sapiens
caccccucccucugcucu

SEQ ID NO: 418220 - RNA, 18 nt, Homo sapiens
cacccgccgccuccugca

SEQ ID NO: 418221 - RNA, 18 nt, Homo sapiens
cacccuaacucuugcuca

SEQ ID NO: 418222 - RNA, 16 nt, Homo sapiens
cacccugauccucacc

SEQ ID NO: 418223 - RNA, 15 nt, Homo sapiens
cacccuucucaggga

SEQ ID NO: 418224 - RNA, 23 nt, Homo sapiens
cacccuuugugguuacaguuuga

SEQ ID NO: 418225 - RNA, 14 nt, Homo sapiens
caccgagacaguug

SEQ ID NO: 418226 - RNA, 22 nt, Homo sapiens
caccgagaggaaaaaggcuucu

SEQ ID NO: 418227 - RNA, 16 nt, Homo sapiens
caccgaggaguccagu

SEQ ID NO: 418228 - RNA, 13 nt, Homo sapiens
caccgccaugcaa

SEQ ID NO: 418229 - RNA, 17 nt, Homo sapiens
caccguacaucugcaau

SEQ ID NO: 418230 - RNA, 18 nt, Homo sapiens
caccuacgggggcaucug

SEQ ID NO: 418231 - RNA, 16 nt, Homo sapiens
caccuacuaugugcug

SEQ ID NO: 418232 - RNA, 15 nt, Homo sapiens
caccuaucuggaaaa

SEQ ID NO: 418233 - RNA, 14 nt, Homo sapiens
caccuaugacauac

SEQ ID NO: 418234 - RNA, 20 nt, Homo sapiens
caccuaugacauacauggaa

SEQ ID NO: 418235 - RNA, 14 nt, Homo sapiens
caccucaugucauu

SEQ ID NO: 418236 - RNA, 20 nt, Homo sapiens
caccuccacccccaagaaac

SEQ ID NO: 418237 - RNA, 22 nt, Homo sapiens
caccuccuagaggugggcagcu

SEQ ID NO: 418238 - RNA, 15 nt, Homo sapiens
caccuccuccacuca

SEQ ID NO: 418239 - RNA, 14 nt, Homo sapiens
caccuccugcaaua

SEQ ID NO: 418240 - RNA, 19 nt, Homo sapiens
caccugacaauggcagcua

SEQ ID NO: 418241 - RNA, 16 nt, Homo sapiens
caccugaccaaucaga

SEQ ID NO: 418242 - RNA, 17 nt, Homo sapiens
caccugagcuuuggacg

SEQ ID NO: 418243 - RNA, 22 nt, Homo sapiens
caccuggauggaucugcuccau

SEQ ID NO: 418244 - RNA, 21 nt, Homo sapiens
caccuguaaaaacugcacaua

SEQ ID NO: 418245 - RNA, 14 nt, Homo sapiens
caccuguaauccca

SEQ ID NO: 418246 - RNA, 15 nt, Homo sapiens
caccuguagucccag

SEQ ID NO: 418247 - RNA, 14 nt, Homo sapiens
caccugugaguuua

SEQ ID NO: 418248 - RNA, 15 nt, Homo sapiens
caccuucaagcagcu

SEQ ID NO: 418249 - RNA, 18 nt, Homo sapiens
caccuuccugacugggaa

SEQ ID NO: 418250 - RNA, 17 nt, Homo sapiens
cacgacucuuccugcaa

SEQ ID NO: 418251 - RNA, 16 nt, Homo sapiens
cacgaucguuaugcug

SEQ ID NO: 418252 - RNA, 19 nt, Homo sapiens
cacgcaccuguagucccag

SEQ ID NO: 418253 - RNA, 14 nt, Homo sapiens
cacgcagccaggac

SEQ ID NO: 418254 - RNA, 21 nt, Homo sapiens
cacgcaguaacuaaagcuuua

SEQ ID NO: 418255 - RNA, 16 nt, Homo sapiens
cacgcuuugcugcuac

SEQ ID NO: 418256 - RNA, 12 nt, Homo sapiens
cacguccuccac

SEQ ID NO: 418257 - RNA, 13 nt, Homo sapiens
cacgucugccagg

SEQ ID NO: 418258 - RNA, 19 nt, Homo sapiens
cacguggagauagugccag

SEQ ID NO: 418259 - RNA, 12 nt, Homo sapiens
cacguguaugca

SEQ ID NO: 418260 - RNA, 14 nt, Homo sapiens
cacgugugauguau

SEQ ID NO: 418261 - RNA, 18 nt, Homo sapiens
cacguuugauuucuuccu

SEQ ID NO: 418262 - RNA, 14 nt, Homo sapiens
cacguuugccaaau

SEQ ID NO: 418263 - RNA, 20 nt, Homo sapiens
cacuaagaaguuccacuuaa

SEQ ID NO: 418264 - RNA, 18 nt, Homo sapiens
cacuaagagaauacagga

SEQ ID NO: 418265 - RNA, 16 nt, Homo sapiens
cacuaagcuuucuccu

SEQ ID NO: 418266 - RNA, 16 nt, Homo sapiens
cacuaccguaaauguc

SEQ ID NO: 418267 - RNA, 14 nt, Homo sapiens
cacuagaagcacag

SEQ ID NO: 418268 - RNA, 18 nt, Homo sapiens
cacuagagaaacuugaau

SEQ ID NO: 418269 - RNA, 20 nt, Homo sapiens
cacuauagccauuugcccca

SEQ ID NO: 418270 - RNA, 20 nt, Homo sapiens
cacuauucuuaagcacuuug

SEQ ID NO: 418271 - RNA, 14 nt, Homo sapiens
cacuauuggacuuu

SEQ ID NO: 418272 - RNA, 20 nt, Homo sapiens
cacucaacaaaagugcuuug

SEQ ID NO: 418273 - RNA, 22 nt, Homo sapiens
cacucacagagacacagggcau

SEQ ID NO: 418274 - RNA, 17 nt, Homo sapiens
cacucacagauguuuga

SEQ ID NO: 418275 - RNA, 17 nt, Homo sapiens
cacucaggauugggaau

SEQ ID NO: 418276 - RNA, 14 nt, Homo sapiens
cacucaggugaaaa

SEQ ID NO: 418277 - RNA, 21 nt, Homo sapiens
cacucauuaccgucugugauu

SEQ ID NO: 418278 - RNA, 11 nt, Homo sapiens
cacuccagugc

SEQ ID NO: 418279 - RNA, 12 nt, Homo sapiens
cacuccaugagu

SEQ ID NO: 418280 - RNA, 15 nt, Homo sapiens
cacuccauguuugca

SEQ ID NO: 418281 - RNA, 22 nt, Homo sapiens
cacuccuuccugccaccugcug

SEQ ID NO: 418282 - RNA, 21 nt, Homo sapiens
cacuccuuucuugcacuauuc

SEQ ID NO: 418283 - RNA, 14 nt, Homo sapiens
cacucgacucugcu

SEQ ID NO: 418284 - RNA, 13 nt, Homo sapiens
cacucuagugcca

SEQ ID NO: 418285 - RNA, 13 nt, Homo sapiens
cacucugccaggg

SEQ ID NO: 418286 - RNA, 23 nt, Homo sapiens
cacucugguggcaggugccuugu

SEQ ID NO: 418287 - RNA, 13 nt, Homo sapiens
cacucuguuccug

SEQ ID NO: 418288 - RNA, 22 nt, Homo sapiens
cacucuuaugaaaugggcuuua

SEQ ID NO: 418289 - RNA, 23 nt, Homo sapiens
cacucuuauucccaaacuacaga

SEQ ID NO: 418290 - RNA, 15 nt, Homo sapiens
cacucuucuugagca

SEQ ID NO: 418291 - RNA, 19 nt, Homo sapiens
cacugaaacuucaagcacc

SEQ ID NO: 418292 - RNA, 13 nt, Homo sapiens
cacugaauaucau

SEQ ID NO: 418293 - RNA, 14 nt, Homo sapiens
cacugaaucauuaa

SEQ ID NO: 418294 - RNA, 20 nt, Homo sapiens
cacugaaucuccccuccuca

SEQ ID NO: 418295 - RNA, 14 nt, Homo sapiens
cacugaauuccauu

SEQ ID NO: 418296 - RNA, 22 nt, Homo sapiens
cacugagacuugaaucaaguca

SEQ ID NO: 418297 - RNA, 10 nt, Homo sapiens
cacugagaua

SEQ ID NO: 418298 - RNA, 17 nt, Homo sapiens
cacugaggaccagccau

SEQ ID NO: 418299 - RNA, 18 nt, Homo sapiens
cacugaugggcacuggaa

SEQ ID NO: 418300 - RNA, 22 nt, Homo sapiens
cacugauguaaguguuguggaa

SEQ ID NO: 418301 - RNA, 13 nt, Homo sapiens
cacugcaaacccu

SEQ ID NO: 418302 - RNA, 20 nt, Homo sapiens
cacugcacagugcaucucag

SEQ ID NO: 418303 - RNA, 19 nt, Homo sapiens
cacugcuucucggaggcca

SEQ ID NO: 418304 - RNA, 20 nt, Homo sapiens
cacugcuucucggaggccag

SEQ ID NO: 418305 - RNA, 18 nt, Homo sapiens
cacuggcagcaucuucac

SEQ ID NO: 418306 - RNA, 17 nt, Homo sapiens
cacuggcuuuacauggg

SEQ ID NO: 418307 - RNA, 17 nt, Homo sapiens
cacugggaagcuggagu

SEQ ID NO: 418308 - RNA, 13 nt, Homo sapiens
cacugguuuucaa

SEQ ID NO: 418309 - RNA, 22 nt, Homo sapiens
cacuguacaccauaguuuacaa

SEQ ID NO: 418310 - RNA, 19 nt, Homo sapiens
cacugucaagauuaaguua

SEQ ID NO: 418311 - RNA, 22 nt, Homo sapiens
cacugugacuuaagaagccuua

SEQ ID NO: 418312 - RNA, 13 nt, Homo sapiens
cacugugcuccua

SEQ ID NO: 418313 - RNA, 20 nt, Homo sapiens
cacuguggaacacuaaagag

SEQ ID NO: 418314 - RNA, 23 nt, Homo sapiens
cacuguguuuauaugucuugcaa

SEQ ID NO: 418315 - RNA, 19 nt, Homo sapiens
cacuguuaauauucuauua

SEQ ID NO: 418316 - RNA, 13 nt, Homo sapiens
cacuguuagcuuu

SEQ ID NO: 418317 - RNA, 23 nt, Homo sapiens
cacuguuuuauuuuaauucaguu

SEQ ID NO: 418318 - RNA, 15 nt, Homo sapiens
cacuuaaacuuuguc

SEQ ID NO: 418319 - RNA, 22 nt, Homo sapiens
cacuuaaggggggaugucuuga

SEQ ID NO: 418320 - RNA, 18 nt, Homo sapiens
cacuuacacuuuaugcac

SEQ ID NO: 418321 - RNA, 18 nt, Homo sapiens
cacuuagcuaucagaaga

SEQ ID NO: 418322 - RNA, 15 nt, Homo sapiens
cacuuauuuccaugg

SEQ ID NO: 418323 - RNA, 16 nt, Homo sapiens
cacuuauuuccaugga

SEQ ID NO: 418324 - RNA, 22 nt, Homo sapiens
cacuucgcgugcccucgcugcu

SEQ ID NO: 418325 - RNA, 21 nt, Homo sapiens
cacuucuuguuccccacugac

SEQ ID NO: 418326 - RNA, 20 nt, Homo sapiens
acacagauggcaccuguggc

SEQ ID NO: 418327 - RNA, 12 nt, Homo sapiens
acacagcuccuc

SEQ ID NO: 418328 - RNA, 22 nt, Homo sapiens
acacagcugcagagacagagag

SEQ ID NO: 418329 - RNA, 21 nt, Homo sapiens
acacaggccagcuccacagug

SEQ ID NO: 418330 - RNA, 22 nt, Homo sapiens
acacaguagggcuuggugaaug

SEQ ID NO: 418331 - RNA, 20 nt, Homo sapiens
acacagugccuguaaaucuc

SEQ ID NO: 418332 - RNA, 14 nt, Homo sapiens
acacaucaguccac

SEQ ID NO: 418333 - RNA, 18 nt, Homo sapiens
acacaugcucaucccaaa

SEQ ID NO: 418334 - RNA, 18 nt, Homo sapiens
acacaugcucucaauaua

SEQ ID NO: 418335 - RNA, 19 nt, Homo sapiens
acacauugaaugcgcuuua

SEQ ID NO: 418336 - RNA, 11 nt, Homo sapiens
acaccaaaaau

SEQ ID NO: 418337 - RNA, 21 nt, Homo sapiens
acaccaaacgagguuccuggu

SEQ ID NO: 418338 - RNA, 15 nt, Homo sapiens
ccauuaaaacugcuu

SEQ ID NO: 418339 - RNA, 15 nt, Homo sapiens
ccauuaauccaggga

SEQ ID NO: 418340 - RNA, 12 nt, Homo sapiens
ccauuacuguaa

SEQ ID NO: 418341 - RNA, 21 nt, Homo sapiens
ccauuacuuuaauacucaccu

SEQ ID NO: 418342 - RNA, 22 nt, Homo sapiens
ccauucauacccacacacccag

SEQ ID NO: 418343 - RNA, 12 nt, Homo sapiens
ccauugcaaaag

SEQ ID NO: 418344 - RNA, 19 nt, Homo sapiens
ccauuuagcacacugcuug

SEQ ID NO: 418345 - RNA, 14 nt, Homo sapiens
ccauuuuucaucau

SEQ ID NO: 418346 - RNA, 22 nt, Homo sapiens
ccauuuuugucagucugaguca

SEQ ID NO: 418347 - RNA, 22 nt, Homo sapiens
cccaaaagaauuaucaucccaa

SEQ ID NO: 418348 - RNA, 16 nt, Homo sapiens
cccaaacccuucagug

SEQ ID NO: 418349 - RNA, 14 nt, Homo sapiens
cccaaagugcuagu

SEQ ID NO: 418350 - RNA, 19 nt, Homo sapiens
cccaaagugcuaguauuau

SEQ ID NO: 418351 - RNA, 18 nt, Homo sapiens
cccaaaucuacugagcca

SEQ ID NO: 418352 - RNA, 23 nt, Homo sapiens
cccaacagcacuuagguuuuccu

SEQ ID NO: 418353 - RNA, 13 nt, Homo sapiens
cccaagauucaua

SEQ ID NO: 418354 - RNA, 19 nt, Homo sapiens
cccaagcuggagugcagug

SEQ ID NO: 418355 - RNA, 17 nt, Homo sapiens
cccaauaaaagugacuc

SEQ ID NO: 418356 - RNA, 18 nt, Homo sapiens
cccaaucuuucuauauaa

SEQ ID NO: 418357 - RNA, 12 nt, Homo sapiens
cccaauuuccaa

SEQ ID NO: 418358 - RNA, 12 nt, Homo sapiens
cccacaaaauau

SEQ ID NO: 418359 - RNA, 13 nt, Homo sapiens
cccacaaacugcc

SEQ ID NO: 418360 - RNA, 17 nt, Homo sapiens
cccacagcuaccugaga

SEQ ID NO: 418361 - RNA, 18 nt, Homo sapiens
cccacauaauacauucca

SEQ ID NO: 418362 - RNA, 22 nt, Homo sapiens
agagagauggaauaaagcccuu

SEQ ID NO: 418363 - RNA, 13 nt, Homo sapiens
agagagccuggug

SEQ ID NO: 418364 - RNA, 20 nt, Homo sapiens
agagaggccuuuuguuuaaa

SEQ ID NO: 418365 - RNA, 14 nt, Homo sapiens
agagagggggccac

SEQ ID NO: 418366 - RNA, 22 nt, Homo sapiens
agagagguugugaaaacagcag

SEQ ID NO: 418367 - RNA, 16 nt, Homo sapiens
agagaugccaugauau

SEQ ID NO: 418368 - RNA, 20 nt, Homo sapiens
agagauuugguuaagcucac

SEQ ID NO: 418369 - RNA, 13 nt, Homo sapiens
agagcaaaugcua

SEQ ID NO: 418370 - RNA, 23 nt, Homo sapiens
agagcagcacaaagaaacagccu

SEQ ID NO: 418371 - RNA, 23 nt, Homo sapiens
agagcaggcuggcagcucuccag

SEQ ID NO: 418372 - RNA, 21 nt, Homo sapiens
agagcaguaccagcgcucuaa

SEQ ID NO: 418373 - RNA, 23 nt, Homo sapiens
agagcagugauucucucuucucu

SEQ ID NO: 418374 - RNA, 14 nt, Homo sapiens
agagcaguguggaa

SEQ ID NO: 418375 - RNA, 17 nt, Homo sapiens
agagcaucugcucugag

SEQ ID NO: 418376 - RNA, 21 nt, Homo sapiens
agagcaucugucccacuggga

SEQ ID NO: 418377 - RNA, 22 nt, Homo sapiens
agagcaucugucccacugggac

SEQ ID NO: 418378 - RNA, 22 nt, Homo sapiens
agagcauuuccaacaccacaga

SEQ ID NO: 418379 - RNA, 21 nt, Homo sapiens
agagcccggcgccccugccac

SEQ ID NO: 418380 - RNA, 22 nt, Homo sapiens
agagccuguccccgccuucccu

SEQ ID NO: 418381 - RNA, 20 nt, Homo sapiens
agagcgagauuccgucucaa

SEQ ID NO: 418382 - RNA, 18 nt, Homo sapiens
agagcgucauguccuugg

SEQ ID NO: 418383 - RNA, 14 nt, Homo sapiens
agagcuagaugugu

SEQ ID NO: 418384 - RNA, 16 nt, Homo sapiens
agagcuccacagaaga

SEQ ID NO: 418385 - RNA, 22 nt, Homo sapiens
agagcucuuugucucaccagcu

SEQ ID NO: 418386 - RNA, 13 nt, Homo sapiens
agagcuggaugca

SEQ ID NO: 418387 - RNA, 20 nt, Homo sapiens
agaggaaaaaggcuucucca

SEQ ID NO: 418388 - RNA, 22 nt, Homo sapiens
agaggaaaaguaaggugcaguu

SEQ ID NO: 418389 - RNA, 20 nt, Homo sapiens
agaggaauuuuuucuuuuga

SEQ ID NO: 418390 - RNA, 20 nt, Homo sapiens
agaggacccugaguccccac

SEQ ID NO: 418391 - RNA, 15 nt, Homo sapiens
agaggaguucaauga

SEQ ID NO: 418392 - RNA, 17 nt, Homo sapiens
agaggaucggaggcuug

SEQ ID NO: 418393 - RNA, 23 nt, Homo sapiens
agaggaugaauguaugugcacug

SEQ ID NO: 418394 - RNA, 17 nt, Homo sapiens
agaggaugucacaaaga

SEQ ID NO: 418395 - RNA, 16 nt, Homo sapiens
agaggauuuaacugug

SEQ ID NO: 418396 - RNA, 16 nt, Homo sapiens
agaggcccaagcugcc

SEQ ID NO: 418397 - RNA, 22 nt, Homo sapiens
agaggcuaagaugagauuugcc

SEQ ID NO: 418398 - RNA, 11 nt, Homo sapiens
agaggcugcug

SEQ ID NO: 418399 - RNA, 15 nt, Homo sapiens
agaggcuuagagaca

SEQ ID NO: 418400 - RNA, 14 nt, Homo sapiens
agagggagggagca

SEQ ID NO: 418401 - RNA, 18 nt, Homo sapiens
agagguagcgagcugcuc

SEQ ID NO: 418402 - RNA, 14 nt, Homo sapiens
agaggugcugcuuu

SEQ ID NO: 418403 - RNA, 17 nt, Homo sapiens
agagguggagugucaca

SEQ ID NO: 418404 - RNA, 21 nt, Homo sapiens
agagguggagugucacaucuc

SEQ ID NO: 418405 - RNA, 22 nt, Homo sapiens
agagguggagugucacaucucu

SEQ ID NO: 418406 - RNA, 18 nt, Homo sapiens
agaggugggggaugcuga

SEQ ID NO: 418407 - RNA, 22 nt, Homo sapiens
agagguugaggaugcacuggcc

SEQ ID NO: 418408 - RNA, 16 nt, Homo sapiens
agaguaaauauuguca

SEQ ID NO: 418409 - RNA, 20 nt, Homo sapiens
agaguacuuaauauacucag

SEQ ID NO: 418410 - RNA, 20 nt, Homo sapiens
agaguauaugcacuuuccaa

SEQ ID NO: 418411 - RNA, 13 nt, Homo sapiens
agaguaugucagu

SEQ ID NO: 418412 - RNA, 23 nt, Homo sapiens
agagucacuggaacacuaaugag

SEQ ID NO: 418413 - RNA, 21 nt, Homo sapiens
agagucauauugcccaguggu

SEQ ID NO: 418414 - RNA, 21 nt, Homo sapiens
agagucgcaucucagugcagg

SEQ ID NO: 418415 - RNA, 16 nt, Homo sapiens
agagucucccuccauc

SEQ ID NO: 418416 - RNA, 21 nt, Homo sapiens
agagugaaucauccagacucc

SEQ ID NO: 418417 - RNA, 22 nt, Homo sapiens
agaguggaaccaacacuaacau

SEQ ID NO: 418418 - RNA, 21 nt, Homo sapiens
agaguggccaaucccugugug

SEQ ID NO: 418419 - RNA, 21 nt, Homo sapiens
agaguggccuggccaggagcu

SEQ ID NO: 418420 - RNA, 15 nt, Homo sapiens
agaguguuuaacuga

SEQ ID NO: 418421 - RNA, 13 nt, Homo sapiens
agaguugagcaca

SEQ ID NO: 418422 - RNA, 17 nt, Homo sapiens
agaguuggggaaggcaa

SEQ ID NO: 418423 - RNA, 15 nt, Homo sapiens
agaguuuacagacaa

SEQ ID NO: 418424 - RNA, 20 nt, Homo sapiens
agauaacuuaaauaauuuaa

SEQ ID NO: 418425 - RNA, 19 nt, Homo sapiens
agauaacuuccuucacauc

SEQ ID NO: 418426 - RNA, 23 nt, Homo sapiens
agauaacuuccuucacaucuccc

SEQ ID NO: 418427 - RNA, 19 nt, Homo sapiens
agauaaucagugugucuaa

SEQ ID NO: 418428 - RNA, 13 nt, Homo sapiens
agauaauguugcu

SEQ ID NO: 418429 - RNA, 14 nt, Homo sapiens
agauaauguugcuu

SEQ ID NO: 418430 - RNA, 14 nt, Homo sapiens
agauacaaucagcu

SEQ ID NO: 418431 - RNA, 20 nt, Homo sapiens
agauacacaagugagggcuu

SEQ ID NO: 418432 - RNA, 14 nt, Homo sapiens
agauagauuuggaa

SEQ ID NO: 418433 - RNA, 14 nt, Homo sapiens
agauagcagggcau

SEQ ID NO: 418434 - RNA, 12 nt, Homo sapiens
agauagcuuauu

SEQ ID NO: 418435 - RNA, 19 nt, Homo sapiens
agauaggauauacuguaug

SEQ ID NO: 418436 - RNA, 18 nt, Homo sapiens
agauagguggugccagug

SEQ ID NO: 418437 - RNA, 20 nt, Homo sapiens
agauaguagcauacauuuau

SEQ ID NO: 418438 - RNA, 23 nt, Homo sapiens
agauaguuguguuuuuauuguua

SEQ ID NO: 418439 - RNA, 17 nt, Homo sapiens
agauaucuaugacugug

SEQ ID NO: 418440 - RNA, 18 nt, Homo sapiens
agauauuccagaccaaaa

SEQ ID NO: 418441 - RNA, 22 nt, Homo sapiens
agaucaaaauaaaaagugacac

SEQ ID NO: 418442 - RNA, 17 nt, Homo sapiens
agaucaacugaguucag

SEQ ID NO: 418443 - RNA, 17 nt, Homo sapiens
agaucacgccacugcac

SEQ ID NO: 418444 - RNA, 16 nt, Homo sapiens
agaucagaacaugaaa

SEQ ID NO: 418445 - RNA, 13 nt, Homo sapiens
agaucagugccua

SEQ ID NO: 418446 - RNA, 13 nt, Homo sapiens
agaucagugccuc

SEQ ID NO: 418447 - RNA, 18 nt, Homo sapiens
agaucaugaaaguccagc

SEQ ID NO: 418448 - RNA, 22 nt, Homo sapiens
agauccagggacugaagccaaa

SEQ ID NO: 418449 - RNA, 14 nt, Homo sapiens
agaucccagaggau

SEQ ID NO: 418450 - RNA, 15 nt, Homo sapiens
agauccuaccccuga

SEQ ID NO: 418451 - RNA, 13 nt, Homo sapiens
agauccucugaua

SEQ ID NO: 418452 - RNA, 17 nt, Homo sapiens
agauccuuaaugcagag

SEQ ID NO: 418453 - RNA, 19 nt, Homo sapiens
agaucgcaccauugcacuc

SEQ ID NO: 418454 - RNA, 16 nt, Homo sapiens
agaucucccuuaauaa

SEQ ID NO: 418455 - RNA, 21 nt, Homo sapiens
agaucucccuuaauaaacuca

SEQ ID NO: 418456 - RNA, 24 nt, Homo sapiens
agaucucccuuaauaaacucacaa

SEQ ID NO: 418457 - RNA, 20 nt, Homo sapiens
agaucugugggcccagucau

SEQ ID NO: 418458 - RNA, 17 nt, Homo sapiens
agaucuugagagcugcu

SEQ ID NO: 418459 - RNA, 14 nt, Homo sapiens
agaugaaauugcca

SEQ ID NO: 418460 - RNA, 15 nt, Homo sapiens
agaugaauaugagcu

SEQ ID NO: 418461 - RNA, 20 nt, Homo sapiens
agaugagaaaacaggcucac

SEQ ID NO: 418462 - RNA, 16 nt, Homo sapiens
agaugagaagccaaag

SEQ ID NO: 418463 - RNA, 19 nt, Homo sapiens
agaugcaaggaccaggacu

SEQ ID NO: 418464 - RNA, 15 nt, Homo sapiens
agaugcauccaugua

SEQ ID NO: 418465 - RNA, 16 nt, Homo sapiens
agaugccagagcaaag

SEQ ID NO: 418466 - RNA, 21 nt, Homo sapiens
agaugccagcauauacugaag

SEQ ID NO: 418467 - RNA, 23 nt, Homo sapiens
agaugccgcggaaggucccucag

SEQ ID NO: 418468 - RNA, 15 nt, Homo sapiens
agaugcuacuggacu

SEQ ID NO: 418469 - RNA, 20 nt, Homo sapiens
agaugcugacuguacuccuc

SEQ ID NO: 418470 - RNA, 19 nt, Homo sapiens
agauggaaaagaaauugca

SEQ ID NO: 418471 - RNA, 18 nt, Homo sapiens
agauggaauaaagcccuu

SEQ ID NO: 418472 - RNA, 19 nt, Homo sapiens
agauggaaugcuguguuaa

SEQ ID NO: 418473 - RNA, 21 nt, Homo sapiens
agauggagguucucucggagu

SEQ ID NO: 418474 - RNA, 15 nt, Homo sapiens
agauggauuugacac

SEQ ID NO: 418475 - RNA, 21 nt, Homo sapiens
agauggauuugacacacucac

SEQ ID NO: 418476 - RNA, 15 nt, Homo sapiens
agauggcaauuucac

SEQ ID NO: 418477 - RNA, 16 nt, Homo sapiens
agauggcugugccucu

SEQ ID NO: 418478 - RNA, 22 nt, Homo sapiens
agauggcugugccucugccugu

SEQ ID NO: 418479 - RNA, 21 nt, Homo sapiens
agaugggaggaucacuugagg

SEQ ID NO: 418480 - RNA, 16 nt, Homo sapiens
agaugggggacugaga

SEQ ID NO: 418481 - RNA, 15 nt, Homo sapiens
agaugguaugccucu

SEQ ID NO: 418482 - RNA, 15 nt, Homo sapiens
agauguagcauuguu

SEQ ID NO: 418483 - RNA, 22 nt, Homo sapiens
agauguauuaaccuaccuguga

SEQ ID NO: 418484 - RNA, 15 nt, Homo sapiens
agaugugccuagaca

SEQ ID NO: 418485 - RNA, 22 nt, Homo sapiens
agauguggacuuguaugcugcc

SEQ ID NO: 418486 - RNA, 16 nt, Homo sapiens
agaugugucuauggcu

SEQ ID NO: 418487 - RNA, 14 nt, Homo sapiens
agaugugucuuacc

SEQ ID NO: 418488 - RNA, 14 nt, Homo sapiens
agauguuggaccaa

SEQ ID NO: 418489 - RNA, 21 nt, Homo sapiens
agauguuuguuuucaaaauac

SEQ ID NO: 418490 - RNA, 15 nt, Homo sapiens
agauuaaacuucacc

SEQ ID NO: 418491 - RNA, 21 nt, Homo sapiens
agauuauauuggugguucuca

SEQ ID NO: 418492 - RNA, 20 nt, Homo sapiens
cccaccagagugaugugugg

SEQ ID NO: 418493 - RNA, 18 nt, Homo sapiens
cccaccagcccacaucca

SEQ ID NO: 418494 - RNA, 11 nt, Homo sapiens
cccaccagcuc

SEQ ID NO: 418495 - RNA, 23 nt, Homo sapiens
cccaccaugcaccccugauguuc

SEQ ID NO: 418496 - RNA, 14 nt, Homo sapiens
cccacccaccaaau

SEQ ID NO: 418497 - RNA, 16 nt, Homo sapiens
cccacccccucuuugu

SEQ ID NO: 418498 - RNA, 19 nt, Homo sapiens
cccacccucuggagaaggu

SEQ ID NO: 418499 - RNA, 16 nt, Homo sapiens
cccacccugcugccuu

SEQ ID NO: 418500 - RNA, 14 nt, Homo sapiens
cccaccuaccuuca

SEQ ID NO: 418501 - RNA, 23 nt, Homo sapiens
cccacgauuccgaucgacugcca

SEQ ID NO: 418502 - RNA, 13 nt, Homo sapiens
cccacggggugca

SEQ ID NO: 418503 - RNA, 19 nt, Homo sapiens
cccacggggugcaccgaac

SEQ ID NO: 418504 - RNA, 20 nt, Homo sapiens
cccacguggacucugugcuc

SEQ ID NO: 418505 - RNA, 16 nt, Homo sapiens
cccacucccuguccau

SEQ ID NO: 418506 - RNA, 16 nt, Homo sapiens
cccacuuaugcugcug

SEQ ID NO: 418507 - RNA, 12 nt, Homo sapiens
cccacuuugcca

SEQ ID NO: 418508 - RNA, 10 nt, Homo sapiens
cccagaacac

SEQ ID NO: 418509 - RNA, 12 nt, Homo sapiens
cccagaaggcag

SEQ ID NO: 418510 - RNA, 20 nt, Homo sapiens
cccagaccuccccucuuccu

SEQ ID NO: 418511 - RNA, 17 nt, Homo sapiens
cccagacuccaccguca

SEQ ID NO: 418512 - RNA, 15 nt, Homo sapiens
cccagagagagcucu

SEQ ID NO: 418513 - RNA, 13 nt, Homo sapiens
cccagagcacugg

SEQ ID NO: 418514 - RNA, 19 nt, Homo sapiens
cccagaggcucccaaucag

SEQ ID NO: 418515 - RNA, 22 nt, Homo sapiens
cccagagguaagaauagaauuu

SEQ ID NO: 418516 - RNA, 17 nt, Homo sapiens
cccagagugaacacucu

SEQ ID NO: 418517 - RNA, 21 nt, Homo sapiens
cccagauagguggugccagug

SEQ ID NO: 418518 - RNA, 18 nt, Homo sapiens
cccagcaaggaccaguga

SEQ ID NO: 418519 - RNA, 16 nt, Homo sapiens
cccagcauuccagcuc

SEQ ID NO: 418520 - RNA, 17 nt, Homo sapiens
cccagccaccaccacug

SEQ ID NO: 418521 - RNA, 16 nt, Homo sapiens
cccagcccacccugcu

SEQ ID NO: 418522 - RNA, 13 nt, Homo sapiens
cccagcccggcug

SEQ ID NO: 418523 - RNA, 21 nt, Homo sapiens
cccagcccuguucugggugca

SEQ ID NO: 418524 - RNA, 19 nt, Homo sapiens
cccagccgggguggggugc

SEQ ID NO: 418525 - RNA, 20 nt, Homo sapiens
cccagccucuagaacagcca

SEQ ID NO: 418526 - RNA, 20 nt, Homo sapiens
cccagcgacuucugaagggc

SEQ ID NO: 418527 - RNA, 12 nt, Homo sapiens
cccagcuccacu

SEQ ID NO: 418528 - RNA, 22 nt, Homo sapiens
cccagcuccauccuugcaucac

SEQ ID NO: 418529 - RNA, 21 nt, Homo sapiens
cccagcucugacccugaugcu

SEQ ID NO: 418530 - RNA, 19 nt, Homo sapiens
cccagcuugggcccagcug

SEQ ID NO: 418531 - RNA, 20 nt, Homo sapiens
cccaggcuggagugcaaugc

SEQ ID NO: 418532 - RNA, 19 nt, Homo sapiens
cccagggaacuaaagggug

SEQ ID NO: 418533 - RNA, 16 nt, Homo sapiens
cccagggagaggccau

SEQ ID NO: 418534 - RNA, 15 nt, Homo sapiens
cccagggcagggugg

SEQ ID NO: 418535 - RNA, 16 nt, Homo sapiens
cccaggguagacuuug

SEQ ID NO: 418536 - RNA, 13 nt, Homo sapiens
cccagggugcagg

SEQ ID NO: 418537 - RNA, 23 nt, Homo sapiens
cccaggguuacagcaagagccac

SEQ ID NO: 418538 - RNA, 14 nt, Homo sapiens
cccaguaacugcac

SEQ ID NO: 418539 - RNA, 17 nt, Homo sapiens
cccaguaccuccaagca

SEQ ID NO: 418540 - RNA, 23 nt, Homo sapiens
cccaguccucucccaaguccaca

SEQ ID NO: 418541 - RNA, 22 nt, Homo sapiens
cccagugauggcauuacucugc

SEQ ID NO: 418542 - RNA, 22 nt, Homo sapiens
cccaguggaaccaaaacccauc

SEQ ID NO: 418543 - RNA, 21 nt, Homo sapiens
cccaguggaauggaaagaaug

SEQ ID NO: 418544 - RNA, 14 nt, Homo sapiens
cccaguggccucaa

SEQ ID NO: 418545 - RNA, 21 nt, Homo sapiens
cccaguguuugggguguuuca

SEQ ID NO: 418546 - RNA, 17 nt, Homo sapiens
cccaguuugcuggguuu

SEQ ID NO: 418547 - RNA, 18 nt, Homo sapiens
cccaucaucucugccuuu

SEQ ID NO: 418548 - RNA, 17 nt, Homo sapiens
cccauccacaguuguca

SEQ ID NO: 418549 - RNA, 22 nt, Homo sapiens
cccauccaucugcuuacaauuc

SEQ ID NO: 418550 - RNA, 22 nt, Homo sapiens
cccaucccacacccuggaggau

SEQ ID NO: 418551 - RNA, 17 nt, Homo sapiens
cccaucuaaaacucaua

SEQ ID NO: 418552 - RNA, 16 nt, Homo sapiens
cccaucucuacuaaaa

SEQ ID NO: 418553 - RNA, 11 nt, Homo sapiens
cccaucugccg

SEQ ID NO: 418554 - RNA, 13 nt, Homo sapiens
cccaucuuuccuc

SEQ ID NO: 418555 - RNA, 12 nt, Homo sapiens
cccaugagauuc

SEQ ID NO: 418556 - RNA, 23 nt, Homo sapiens
cccaugcacaacucuccaaaaca

SEQ ID NO: 418557 - RNA, 18 nt, Homo sapiens
cccaugguagacugugac

SEQ ID NO: 418558 - RNA, 22 nt, Homo sapiens
cccaugugugagugugugcaag

SEQ ID NO: 418559 - RNA, 23 nt, Homo sapiens
cccauuacuuuaauacucaccuc

SEQ ID NO: 418560 - RNA, 18 nt, Homo sapiens
cccauugugaauguuguc

SEQ ID NO: 418561 - RNA, 15 nt, Homo sapiens
cccauuucuauuuau

SEQ ID NO: 418562 - RNA, 16 nt, Homo sapiens
cccauuugggauuuuc

SEQ ID NO: 418563 - RNA, 18 nt, Homo sapiens
cccauuuguaauguaucu

SEQ ID NO: 418564 - RNA, 14 nt, Homo sapiens
cccauuuugcaaaa

SEQ ID NO: 418565 - RNA, 15 nt, Homo sapiens
ccccaaacccugcuu

SEQ ID NO: 418566 - RNA, 15 nt, Homo sapiens
ccccaaccaggcuaa

SEQ ID NO: 418567 - RNA, 16 nt, Homo sapiens
ccccaaccugcugaag

SEQ ID NO: 418568 - RNA, 19 nt, Homo sapiens
ccccaagcagccagccagu

SEQ ID NO: 418569 - RNA, 23 nt, Homo sapiens
ccccacaauuccauuacuaagaa

SEQ ID NO: 418570 - RNA, 13 nt, Homo sapiens
ccccacaccccag

SEQ ID NO: 418571 - RNA, 11 nt, Homo sapiens
ccccaccagca

SEQ ID NO: 418572 - RNA, 21 nt, Homo sapiens
ccccacccacccucugguccu

SEQ ID NO: 418573 - RNA, 21 nt, Homo sapiens
ccccaccuuugggaucagccu

SEQ ID NO: 418574 - RNA, 22 nt, Homo sapiens
ccccacguggacucugugcuca

SEQ ID NO: 418575 - RNA, 11 nt, Homo sapiens
ccccacugaca

SEQ ID NO: 418576 - RNA, 18 nt, Homo sapiens
ccccagaagcagccauaa

SEQ ID NO: 418577 - RNA, 20 nt, Homo sapiens
ccccagaugccuccucuguc

SEQ ID NO: 418578 - RNA, 15 nt, Homo sapiens
ccccaggagcucagg

SEQ ID NO: 418579 - RNA, 17 nt, Homo sapiens
ccccaucucauucaggu

SEQ ID NO: 418580 - RNA, 19 nt, Homo sapiens
ccccauucuauaaauucaa

SEQ ID NO: 418581 - RNA, 15 nt, Homo sapiens
cccccaaaguucaca

SEQ ID NO: 418582 - RNA, 18 nt, Homo sapiens
cccccacgugacagugcc

SEQ ID NO: 418583 - RNA, 14 nt, Homo sapiens
cccccaugcugccu

SEQ ID NO: 418584 - RNA, 13 nt, Homo sapiens
cccccugugccca

SEQ ID NO: 418585 - RNA, 19 nt, Homo sapiens
ccccgccuccacucuaguu

SEQ ID NO: 418586 - RNA, 20 nt, Homo sapiens
ccccggccacucccugccaa

SEQ ID NO: 418587 - RNA, 12 nt, Homo sapiens
ccccguagcucc

SEQ ID NO: 418588 - RNA, 14 nt, Homo sapiens
ccccuaagagccau

SEQ ID NO: 418589 - RNA, 23 nt, Homo sapiens
ccccuaccagccacgggcacaag

SEQ ID NO: 418590 - RNA, 23 nt, Homo sapiens
ccccuaggacucaggccugccaa

SEQ ID NO: 418591 - RNA, 21 nt, Homo sapiens
ccccucagauuccaccuagag

SEQ ID NO: 418592 - RNA, 12 nt, Homo sapiens
ccccuccaggaa

SEQ ID NO: 418593 - RNA, 19 nt, Homo sapiens
ccccuccuucccuggucca

SEQ ID NO: 418594 - RNA, 15 nt, Homo sapiens
ccccucggcauucac

SEQ ID NO: 418595 - RNA, 20 nt, Homo sapiens
ccccucgugaccuacaggga

SEQ ID NO: 418596 - RNA, 22 nt, Homo sapiens
ccccucugcuggccgggcacag

SEQ ID NO: 418597 - RNA, 19 nt, Homo sapiens
ccccugaaguagaucauaa

SEQ ID NO: 418598 - RNA, 19 nt, Homo sapiens
ccccugaggucaugcauug

SEQ ID NO: 418599 - RNA, 14 nt, Homo sapiens
ccccugccagugaa

SEQ ID NO: 418600 - RNA, 14 nt, Homo sapiens
ccccuggcuuuuca

SEQ ID NO: 418601 - RNA, 16 nt, Homo sapiens
ccccugggacugcugc

SEQ ID NO: 418602 - RNA, 18 nt, Homo sapiens
ccccuggguaacugucaa

SEQ ID NO: 418603 - RNA, 23 nt, Homo sapiens
ccccuucuccccugcacuguaaa

SEQ ID NO: 418604 - RNA, 16 nt, Homo sapiens
ccccuuuccaauucca

SEQ ID NO: 418605 - RNA, 13 nt, Homo sapiens
cccgaaaccagag

SEQ ID NO: 418606 - RNA, 11 nt, Homo sapiens
cccgagcagaa

SEQ ID NO: 418607 - RNA, 18 nt, Homo sapiens
cccgaguaacugagauua

SEQ ID NO: 418608 - RNA, 22 nt, Homo sapiens
cccgcaggcagccccacacccg

SEQ ID NO: 418609 - RNA, 22 nt, Homo sapiens
cccgccuccacucuaguucuag

SEQ ID NO: 418610 - RNA, 14 nt, Homo sapiens
cccgcggguucuag

SEQ ID NO: 418611 - RNA, 14 nt, Homo sapiens
cccuaaaaauucca

SEQ ID NO: 418612 - RNA, 13 nt, Homo sapiens
cccuaacucuugc

SEQ ID NO: 418613 - RNA, 23 nt, Homo sapiens
cccuaacuuaacauugcaucaug

SEQ ID NO: 418614 - RNA, 20 nt, Homo sapiens
cccuaaugccaguuccagcu

SEQ ID NO: 418615 - RNA, 13 nt, Homo sapiens
cccuaauucuuau

SEQ ID NO: 418616 - RNA, 12 nt, Homo sapiens
cccuauuacuug

SEQ ID NO: 418617 - RNA, 15 nt, Homo sapiens
cccucacccaaaaga

SEQ ID NO: 418618 - RNA, 13 nt, Homo sapiens
cccucagauucca

SEQ ID NO: 418619 - RNA, 15 nt, Homo sapiens
cccucagauuccacc

SEQ ID NO: 418620 - RNA, 17 nt, Homo sapiens
cccucagauuccaccua

SEQ ID NO: 418621 - RNA, 20 nt, Homo sapiens
cccucagauuccaccuagag

SEQ ID NO: 418622 - RNA, 17 nt, Homo sapiens
cccuccacaccuccggc

SEQ ID NO: 418623 - RNA, 16 nt, Homo sapiens
cccuccagagcaggag

SEQ ID NO: 418624 - RNA, 12 nt, Homo sapiens
agauuaucuggg

SEQ ID NO: 418625 - RNA, 11 nt, Homo sapiens
agauucaccug

SEQ ID NO: 418626 - RNA, 19 nt, Homo sapiens
agauuccaccuagagcuag

SEQ ID NO: 418627 - RNA, 21 nt, Homo sapiens
agauuccaggcgaugugcaag

SEQ ID NO: 418628 - RNA, 17 nt, Homo sapiens
agauuccauuuuggaaa

SEQ ID NO: 418629 - RNA, 19 nt, Homo sapiens
agauucugggaaaggugcu

SEQ ID NO: 418630 - RNA, 13 nt, Homo sapiens
agauugauacuuu

SEQ ID NO: 418631 - RNA, 17 nt, Homo sapiens
agauugauuaaugaacu

SEQ ID NO: 418632 - RNA, 21 nt, Homo sapiens
agauugauuaaugaacuauug

SEQ ID NO: 418633 - RNA, 21 nt, Homo sapiens
agauuguccagugcaaccaca

SEQ ID NO: 418634 - RNA, 13 nt, Homo sapiens
agauuuaauugua

SEQ ID NO: 418635 - RNA, 13 nt, Homo sapiens
agauuuacccauc

SEQ ID NO: 418636 - RNA, 22 nt, Homo sapiens
agauuuagaaaaaaguuuacaa

SEQ ID NO: 418637 - RNA, 21 nt, Homo sapiens
agauuucccuaaaaauuccac

SEQ ID NO: 418638 - RNA, 13 nt, Homo sapiens
agauuucucaccu

SEQ ID NO: 418639 - RNA, 15 nt, Homo sapiens
agauuugccaaaaac

SEQ ID NO: 418640 - RNA, 17 nt, Homo sapiens
agauuuuacaaaagagg

SEQ ID NO: 418641 - RNA, 17 nt, Homo sapiens
agcaaaacaaagcugau

SEQ ID NO: 418642 - RNA, 17 nt, Homo sapiens
agcaaaacgcauggagu

SEQ ID NO: 418643 - RNA, 22 nt, Homo sapiens
agcaaaaugcugcuuucugccu

SEQ ID NO: 418644 - RNA, 13 nt, Homo sapiens
agcaaaccugccc

SEQ ID NO: 418645 - RNA, 18 nt, Homo sapiens
agcaaaggagacaaagca

SEQ ID NO: 418646 - RNA, 21 nt, Homo sapiens
agcaaagugaagacacuggcu

SEQ ID NO: 418647 - RNA, 19 nt, Homo sapiens
agcaaauauuuaugaccuc

SEQ ID NO: 418648 - RNA, 12 nt, Homo sapiens
agcaaaugagau

SEQ ID NO: 418649 - RNA, 15 nt, Homo sapiens
agcaaauguggcucc

SEQ ID NO: 418650 - RNA, 11 nt, Homo sapiens
agcaacaaaga

SEQ ID NO: 418651 - RNA, 19 nt, Homo sapiens
agcaacaugcuucaugaaa

SEQ ID NO: 418652 - RNA, 17 nt, Homo sapiens
agcaacccuaacaguaa

SEQ ID NO: 418653 - RNA, 18 nt, Homo sapiens
agcaaccucccaacccag

SEQ ID NO: 418654 - RNA, 21 nt, Homo sapiens
agcaaccuguaagacugauaa

SEQ ID NO: 418655 - RNA, 17 nt, Homo sapiens
agcaacucagaaugcuc

SEQ ID NO: 418656 - RNA, 18 nt, Homo sapiens
agcaacuggugacugucc

SEQ ID NO: 418657 - RNA, 19 nt, Homo sapiens
agcaagacccccaucucug

SEQ ID NO: 418658 - RNA, 12 nt, Homo sapiens
agcaagagccac

SEQ ID NO: 418659 - RNA, 23 nt, Homo sapiens
agcaagcaggaucgcugcucaga

SEQ ID NO: 418660 - RNA, 19 nt, Homo sapiens
agcaagcucacuugcuuua

SEQ ID NO: 418661 - RNA, 16 nt, Homo sapiens
agcaagucccaucuca

SEQ ID NO: 418662 - RNA, 18 nt, Homo sapiens
agcaaguuacagugaugc

SEQ ID NO: 418663 - RNA, 18 nt, Homo sapiens
agcaauaaguucauuaaa

SEQ ID NO: 418664 - RNA, 20 nt, Homo sapiens
agcaaugggacuggagucag

SEQ ID NO: 418665 - RNA, 17 nt, Homo sapiens
agcaauucuccugccuc

SEQ ID NO: 418666 - RNA, 14 nt, Homo sapiens
agcacaaauuugcu

SEQ ID NO: 418667 - RNA, 23 nt, Homo sapiens
agcacaaggagugcccgccuuga

SEQ ID NO: 418668 - RNA, 13 nt, Homo sapiens
agcacacugaguu

SEQ ID NO: 418669 - RNA, 17 nt, Homo sapiens
agcacacuugacaucaa

SEQ ID NO: 418670 - RNA, 15 nt, Homo sapiens
agcacagcagcaucu

SEQ ID NO: 418671 - RNA, 20 nt, Homo sapiens
agcacagcagccccugcaca

SEQ ID NO: 418672 - RNA, 16 nt, Homo sapiens
agcacauagcacuggg

SEQ ID NO: 418673 - RNA, 14 nt, Homo sapiens
agcacaucauggca

SEQ ID NO: 418674 - RNA, 14 nt, Homo sapiens
agcaccccaugcca

SEQ ID NO: 418675 - RNA, 14 nt, Homo sapiens
agcaccugcucaac

SEQ ID NO: 418676 - RNA, 22 nt, Homo sapiens
agcaccuucccucucaccaucc

SEQ ID NO: 418677 - RNA, 17 nt, Homo sapiens
agcacuagaagcacagg

SEQ ID NO: 418678 - RNA, 14 nt, Homo sapiens
agcacuagaucucc

SEQ ID NO: 418679 - RNA, 11 nt, Homo sapiens
agcacugacac

SEQ ID NO: 418680 - RNA, 12 nt, Homo sapiens
agcacugacacu

SEQ ID NO: 418681 - RNA, 22 nt, Homo sapiens
agcacuggaauucagaugcaag

SEQ ID NO: 418682 - RNA, 15 nt, Homo sapiens
agcacuguccaguau

SEQ ID NO: 418683 - RNA, 23 nt, Homo sapiens
agcacuuugggaggccaaggugg

SEQ ID NO: 418684 - RNA, 22 nt, Homo sapiens
agcacuuuguuucauauucuca

SEQ ID NO: 418685 - RNA, 15 nt, Homo sapiens
agcagaaucuuugca

SEQ ID NO: 418686 - RNA, 20 nt, Homo sapiens
agcagacacuccaguuugcc

SEQ ID NO: 418687 - RNA, 22 nt, Homo sapiens
agcagagcccucaugugacaug

SEQ ID NO: 418688 - RNA, 21 nt, Homo sapiens
agcagaggaaaauaguggcag

SEQ ID NO: 418689 - RNA, 14 nt, Homo sapiens
agcagagguuggga

SEQ ID NO: 418690 - RNA, 14 nt, Homo sapiens
agcagaguggugga

SEQ ID NO: 418691 - RNA, 22 nt, Homo sapiens
agcagauggucccauuauucua

SEQ ID NO: 418692 - RNA, 14 nt, Homo sapiens
agcagauucuagca

SEQ ID NO: 418693 - RNA, 15 nt, Homo sapiens
agcagcaucuucaaa

SEQ ID NO: 418694 - RNA, 21 nt, Homo sapiens
agcagccaaaccuuuccugua

SEQ ID NO: 418695 - RNA, 18 nt, Homo sapiens
agcagcccuaaggaucuc

SEQ ID NO: 418696 - RNA, 11 nt, Homo sapiens
agcagccucag

SEQ ID NO: 418697 - RNA, 16 nt, Homo sapiens
agcagcgguaccccag

SEQ ID NO: 418698 - RNA, 15 nt, Homo sapiens
agcagcugguggaag

SEQ ID NO: 418699 - RNA, 23 nt, Homo sapiens
agcagcugguggaagaccuggac

SEQ ID NO: 418700 - RNA, 21 nt, Homo sapiens
agcaggaaagaucccaaguca

SEQ ID NO: 418701 - RNA, 21 nt, Homo sapiens
agcaggacucugcccagacca

SEQ ID NO: 418702 - RNA, 21 nt, Homo sapiens
agcaggagcagcugugcugca

SEQ ID NO: 418703 - RNA, 17 nt, Homo sapiens
agcaggagggacaauga

SEQ ID NO: 418704 - RNA, 23 nt, Homo sapiens
agcaggcggccuuuguugcucag

SEQ ID NO: 418705 - RNA, 16 nt, Homo sapiens
agcagggaagugacag

SEQ ID NO: 418706 - RNA, 13 nt, Homo sapiens
agcagggacaccc

SEQ ID NO: 418707 - RNA, 18 nt, Homo sapiens
agcagggauuaaccucug

SEQ ID NO: 418708 - RNA, 14 nt, Homo sapiens
agcagguugcuuca

SEQ ID NO: 418709 - RNA, 20 nt, Homo sapiens
agcagguuuauccagaugaa

SEQ ID NO: 418710 - RNA, 14 nt, Homo sapiens
agcagucacuugau

SEQ ID NO: 418711 - RNA, 19 nt, Homo sapiens
agcagucccaguauucuca

SEQ ID NO: 418712 - RNA, 13 nt, Homo sapiens
agcagucuugcuc

SEQ ID NO: 418713 - RNA, 20 nt, Homo sapiens
agcaguguguacuucuucau

SEQ ID NO: 418714 - RNA, 22 nt, Homo sapiens
agcagugugucuccugcaugca

SEQ ID NO: 418715 - RNA, 23 nt, Homo sapiens
agcaguguuggggguagcggcau

SEQ ID NO: 418716 - RNA, 17 nt, Homo sapiens
agcaguuggucuauuca

SEQ ID NO: 418717 - RNA, 22 nt, Homo sapiens
agcaguuugcuuuguaugcacu

SEQ ID NO: 418718 - RNA, 18 nt, Homo sapiens
agcauaaguuucugggac

SEQ ID NO: 418719 - RNA, 20 nt, Homo sapiens
agcauauauucauaccuguu

SEQ ID NO: 418720 - RNA, 12 nt, Homo sapiens
agcauauggagu

SEQ ID NO: 418721 - RNA, 20 nt, Homo sapiens
agcauauguuguugcuugua

SEQ ID NO: 418722 - RNA, 20 nt, Homo sapiens
agcaucccccaaaguucaca

SEQ ID NO: 418723 - RNA, 15 nt, Homo sapiens
agcauccccugugaa

SEQ ID NO: 418724 - RNA, 20 nt, Homo sapiens
agcauccggcaugagggcug

SEQ ID NO: 418725 - RNA, 18 nt, Homo sapiens
agcauccucucucacaug

SEQ ID NO: 418726 - RNA, 16 nt, Homo sapiens
agcaucugucuuguca

SEQ ID NO: 418727 - RNA, 22 nt, Homo sapiens
agcaucugucuugucauuccag

SEQ ID NO: 418728 - RNA, 17 nt, Homo sapiens
agcaugaagacccugga

SEQ ID NO: 418729 - RNA, 16 nt, Homo sapiens
agcaugaauccagucc

SEQ ID NO: 418730 - RNA, 20 nt, Homo sapiens
agcaugaccugugaccagca

SEQ ID NO: 418731 - RNA, 14 nt, Homo sapiens
agcauguggggaag

SEQ ID NO: 418732 - RNA, 22 nt, Homo sapiens
agcauguguauuuccagugcaa

SEQ ID NO: 418733 - RNA, 13 nt, Homo sapiens
agcaugugucaga

SEQ ID NO: 418734 - RNA, 16 nt, Homo sapiens
agcauguuacugacag

SEQ ID NO: 418735 - RNA, 17 nt, Homo sapiens
agcauuagucacuuuga

SEQ ID NO: 418736 - RNA, 19 nt, Homo sapiens
agcauugccagcucuucca

SEQ ID NO: 418737 - RNA, 17 nt, Homo sapiens
agcauuucaaaauggac

SEQ ID NO: 418738 - RNA, 20 nt, Homo sapiens
agcauuucaccuuucugcaa

SEQ ID NO: 418739 - RNA, 14 nt, Homo sapiens
agcauuuucuugaa

SEQ ID NO: 418740 - RNA, 21 nt, Homo sapiens
agcauuuucuugaaccaauaa

SEQ ID NO: 418741 - RNA, 19 nt, Homo sapiens
agccaaacccuugucagug

SEQ ID NO: 418742 - RNA, 20 nt, Homo sapiens
agccaacacccugucuaaaa

SEQ ID NO: 418743 - RNA, 16 nt, Homo sapiens
agccaacuuuaauugc

SEQ ID NO: 418744 - RNA, 14 nt, Homo sapiens
agccaacuuuugca

SEQ ID NO: 418745 - RNA, 23 nt, Homo sapiens
agccaagucagcuuugccuucca

SEQ ID NO: 418746 - RNA, 19 nt, Homo sapiens
agccaauaggcagcuuucu

SEQ ID NO: 418747 - RNA, 22 nt, Homo sapiens
agccaauaggcagcuuucuuaa

SEQ ID NO: 418748 - RNA, 15 nt, Homo sapiens
agccacaacacccag

SEQ ID NO: 418749 - RNA, 17 nt, Homo sapiens
agccacaauaagccacu

SEQ ID NO: 418750 - RNA, 19 nt, Homo sapiens
agccacaggaauaauaguu

SEQ ID NO: 418751 - RNA, 16 nt, Homo sapiens
agccacccagccagga

SEQ ID NO: 418752 - RNA, 22 nt, Homo sapiens
agccaccuccacccccaagaaa

SEQ ID NO: 418753 - RNA, 16 nt, Homo sapiens
agccaccucucccuca

SEQ ID NO: 418754 - RNA, 17 nt, Homo sapiens
agccaccugucccaccu

SEQ ID NO: 418755 - RNA, 17 nt, Homo sapiens
agccacgucagccaaau

SEQ ID NO: 418756 - RNA, 18 nt, Homo sapiens
cccucccacaugauguca

SEQ ID NO: 418757 - RNA, 15 nt, Homo sapiens
cccuccccugccauu

SEQ ID NO: 418758 - RNA, 12 nt, Homo sapiens
cccucggagcca

SEQ ID NO: 418759 - RNA, 13 nt, Homo sapiens
cccucggcauuca

SEQ ID NO: 418760 - RNA, 19 nt, Homo sapiens
cccucggcauucacacaca

SEQ ID NO: 418761 - RNA, 13 nt, Homo sapiens
cccucgugaccua

SEQ ID NO: 418762 - RNA, 14 nt, Homo sapiens
cccucucacugugu

SEQ ID NO: 418763 - RNA, 17 nt, Homo sapiens
cccucugcugcuuucca

SEQ ID NO: 418764 - RNA, 21 nt, Homo sapiens
cccucuguaacaacucuaguc

SEQ ID NO: 418765 - RNA, 14 nt, Homo sapiens
cccucugugccuaa

SEQ ID NO: 418766 - RNA, 19 nt, Homo sapiens
cccugaccuguccagguga

SEQ ID NO: 418767 - RNA, 22 nt, Homo sapiens
cccugagagcucacaguacaau

SEQ ID NO: 418768 - RNA, 14 nt, Homo sapiens
cccugcacaaagcc

SEQ ID NO: 418769 - RNA, 18 nt, Homo sapiens
cccugcagagaugcggug

SEQ ID NO: 418770 - RNA, 23 nt, Homo sapiens
cccugccccgccccccagagcca

SEQ ID NO: 418771 - RNA, 17 nt, Homo sapiens
cccugccccguggagcc

SEQ ID NO: 418772 - RNA, 16 nt, Homo sapiens
cccugcuaugcagaug

SEQ ID NO: 418773 - RNA, 20 nt, Homo sapiens
cccugcuccacgaagccuua

SEQ ID NO: 418774 - RNA, 14 nt, Homo sapiens
cccugcuccagucc

SEQ ID NO: 418775 - RNA, 22 nt, Homo sapiens
cccugcugaccucccagugacc

SEQ ID NO: 418776 - RNA, 23 nt, Homo sapiens
cccugcuuaucugaaacuuccca

SEQ ID NO: 418777 - RNA, 17 nt, Homo sapiens
cccuggagcaagaccug

SEQ ID NO: 418778 - RNA, 20 nt, Homo sapiens
cccuggcaucugacacugac

SEQ ID NO: 418779 - RNA, 16 nt, Homo sapiens
cccugggcuuugucau

SEQ ID NO: 418780 - RNA, 15 nt, Homo sapiens
cccugggguuuccac

SEQ ID NO: 418781 - RNA, 15 nt, Homo sapiens
cccugguaugugccu

SEQ ID NO: 418782 - RNA, 23 nt, Homo sapiens
cccuggucuccuccccguagcca

SEQ ID NO: 418783 - RNA, 21 nt, Homo sapiens
cccugucccaccaacucugca

SEQ ID NO: 418784 - RNA, 19 nt, Homo sapiens
cccuguccuaagcacuuua

SEQ ID NO: 418785 - RNA, 21 nt, Homo sapiens
cccuguccuaagcacuuuaua

SEQ ID NO: 418786 - RNA, 19 nt, Homo sapiens
cccugugagcaaaaaugcc

SEQ ID NO: 418787 - RNA, 18 nt, Homo sapiens
cccuguguuccuggagaa

SEQ ID NO: 418788 - RNA, 20 nt, Homo sapiens
cccuuaaggguugaaggcag

SEQ ID NO: 418789 - RNA, 17 nt, Homo sapiens
cccuuagccucccugaa

SEQ ID NO: 418790 - RNA, 21 nt, Homo sapiens
cccuuccacuuugaguaccaa

SEQ ID NO: 418791 - RNA, 14 nt, Homo sapiens
cccuucccuuccac

SEQ ID NO: 418792 - RNA, 17 nt, Homo sapiens
cccuucuaggcaucucc

SEQ ID NO: 418793 - RNA, 13 nt, Homo sapiens
cccuucugcugua

SEQ ID NO: 418794 - RNA, 17 nt, Homo sapiens
cccuucuggacacugag

SEQ ID NO: 418795 - RNA, 21 nt, Homo sapiens
cccuucuuuaccuucauuuca

SEQ ID NO: 418796 - RNA, 13 nt, Homo sapiens
cccuucuuugcag

SEQ ID NO: 418797 - RNA, 13 nt, Homo sapiens
cccuugaaccagc

SEQ ID NO: 418798 - RNA, 12 nt, Homo sapiens
cccuugcauuag

SEQ ID NO: 418799 - RNA, 23 nt, Homo sapiens
cccuugccauccuaaaagccacc

SEQ ID NO: 418800 - RNA, 21 nt, Homo sapiens
cccuugcccgccagccagugg

SEQ ID NO: 418801 - RNA, 13 nt, Homo sapiens
cccuugcuucuca

SEQ ID NO: 418802 - RNA, 16 nt, Homo sapiens
cccuuggagccaaugg

SEQ ID NO: 418803 - RNA, 22 nt, Homo sapiens
cccuuggcccucucccaugcac

SEQ ID NO: 418804 - RNA, 19 nt, Homo sapiens
cccuuugaugauuaauuca

SEQ ID NO: 418805 - RNA, 12 nt, Homo sapiens
ccgaaaccagag

SEQ ID NO: 418806 - RNA, 13 nt, Homo sapiens
ccgaaugugcagg

SEQ ID NO: 418807 - RNA, 23 nt, Homo sapiens
ccgacacugcugcaccagaguga

SEQ ID NO: 418808 - RNA, 12 nt, Homo sapiens
ccgagcaaagau

SEQ ID NO: 418809 - RNA, 23 nt, Homo sapiens
ccgagcccagcuacauuccucag

SEQ ID NO: 418810 - RNA, 15 nt, Homo sapiens
ccgaggggccagggu

SEQ ID NO: 418811 - RNA, 20 nt, Homo sapiens
ccgagucucuucuccacugg

SEQ ID NO: 418812 - RNA, 17 nt, Homo sapiens
ccgagugcaaugaauga

SEQ ID NO: 418813 - RNA, 14 nt, Homo sapiens
ccgauaaccacagg

SEQ ID NO: 418814 - RNA, 15 nt, Homo sapiens
ccgaugguacuauuu

SEQ ID NO: 418815 - RNA, 19 nt, Homo sapiens
ccgcaugcagcagcuugcu

SEQ ID NO: 418816 - RNA, 18 nt, Homo sapiens
ccgcaugugucuguauuc

SEQ ID NO: 418817 - RNA, 18 nt, Homo sapiens
ccgcauuuggauuggaug

SEQ ID NO: 418818 - RNA, 13 nt, Homo sapiens
ccgcucacccucc

SEQ ID NO: 418819 - RNA, 22 nt, Homo sapiens
ccgcucuggauccugcacucua

SEQ ID NO: 418820 - RNA, 19 nt, Homo sapiens
ccgcugcgggcccagcuga

SEQ ID NO: 418821 - RNA, 15 nt, Homo sapiens
ccgcugcgugccauc

SEQ ID NO: 418822 - RNA, 20 nt, Homo sapiens
ccgcugggagaaaagccaga

SEQ ID NO: 418823 - RNA, 16 nt, Homo sapiens
ccggacagagcacguu

SEQ ID NO: 418824 - RNA, 19 nt, Homo sapiens
ccggaggcaaaaggcagug

SEQ ID NO: 418825 - RNA, 15 nt, Homo sapiens
ccggaggcugcagug

SEQ ID NO: 418826 - RNA, 21 nt, Homo sapiens
ccggaucuacacccaccagag

SEQ ID NO: 418827 - RNA, 18 nt, Homo sapiens
ccggaugcuucuccauga

SEQ ID NO: 418828 - RNA, 21 nt, Homo sapiens
ccggcgggacccccauguccu

SEQ ID NO: 418829 - RNA, 21 nt, Homo sapiens
ccggcuaugggacugcagugc

SEQ ID NO: 418830 - RNA, 23 nt, Homo sapiens
ccggcuuggcuagucacauauca

SEQ ID NO: 418831 - RNA, 14 nt, Homo sapiens
ccggcuuugcaggg

SEQ ID NO: 418832 - RNA, 14 nt, Homo sapiens
ccgggcaagacuuu

SEQ ID NO: 418833 - RNA, 18 nt, Homo sapiens
ccgggcaugguagcucaa

SEQ ID NO: 418834 - RNA, 16 nt, Homo sapiens
ccgggcugcugcugau

SEQ ID NO: 418835 - RNA, 17 nt, Homo sapiens
ccggugcggugcacugg

SEQ ID NO: 418836 - RNA, 14 nt, Homo sapiens
ccggugugccugug

SEQ ID NO: 418837 - RNA, 17 nt, Homo sapiens
ccguacaucugcaauau

SEQ ID NO: 418838 - RNA, 21 nt, Homo sapiens
ccgucggacugcccccagaaa

SEQ ID NO: 418839 - RNA, 21 nt, Homo sapiens
ccgugagugaaccaucauuau

SEQ ID NO: 418840 - RNA, 15 nt, Homo sapiens
ccguuccagagggaa

SEQ ID NO: 418841 - RNA, 23 nt, Homo sapiens
ccguuguguggguuuacucugug

SEQ ID NO: 418842 - RNA, 12 nt, Homo sapiens
ccguuguuguuu

SEQ ID NO: 418843 - RNA, 13 nt, Homo sapiens
ccguuucuuucaa

SEQ ID NO: 418844 - RNA, 21 nt, Homo sapiens
ccuaaaauuguaugaaaaucc

SEQ ID NO: 418845 - RNA, 11 nt, Homo sapiens
ccuaaagugaa

SEQ ID NO: 418846 - RNA, 14 nt, Homo sapiens
ccuaacaagccuug

SEQ ID NO: 418847 - RNA, 14 nt, Homo sapiens
ccuaagaaaaucau

SEQ ID NO: 418848 - RNA, 13 nt, Homo sapiens
ccuaagaauuccc

SEQ ID NO: 418849 - RNA, 18 nt, Homo sapiens
ccuaagagaugggacuag

SEQ ID NO: 418850 - RNA, 13 nt, Homo sapiens
ccuaagcacuuua

SEQ ID NO: 418851 - RNA, 20 nt, Homo sapiens
ccuaaguuaccuuucuaggu

SEQ ID NO: 418852 - RNA, 21 nt, Homo sapiens
ccuacaagaugccaaggaggu

SEQ ID NO: 418853 - RNA, 22 nt, Homo sapiens
ccuacacaaaauacagcacuuu

SEQ ID NO: 418854 - RNA, 15 nt, Homo sapiens
ccuacagggccacaa

SEQ ID NO: 418855 - RNA, 21 nt, Homo sapiens
ccuacccccuaagagccauuu

SEQ ID NO: 418856 - RNA, 15 nt, Homo sapiens
ccuaccuucauuuca

SEQ ID NO: 418857 - RNA, 21 nt, Homo sapiens
ccuacggagggaccagguguc

SEQ ID NO: 418858 - RNA, 18 nt, Homo sapiens
ccuacugcuuccucugaa

SEQ ID NO: 418859 - RNA, 20 nt, Homo sapiens
ccuacuugcagguuguuguc

SEQ ID NO: 418860 - RNA, 20 nt, Homo sapiens
ccuacuuuauguauggagcu

SEQ ID NO: 418861 - RNA, 22 nt, Homo sapiens
ccuagacucuguaaccaccucu

SEQ ID NO: 418862 - RNA, 13 nt, Homo sapiens
ccuagacuugaaa

SEQ ID NO: 418863 - RNA, 17 nt, Homo sapiens
ccuagccaacaugguga

SEQ ID NO: 418864 - RNA, 22 nt, Homo sapiens
ccuagcugggaaggugaccaca

SEQ ID NO: 418865 - RNA, 18 nt, Homo sapiens
ccuagggccugguccaug

SEQ ID NO: 418866 - RNA, 20 nt, Homo sapiens
ccuaggugggucaacuccaa

SEQ ID NO: 418867 - RNA, 20 nt, Homo sapiens
ccuaguagcugggaugacag

SEQ ID NO: 418868 - RNA, 13 nt, Homo sapiens
ccuaguagcuuuc

SEQ ID NO: 418869 - RNA, 18 nt, Homo sapiens
ccuaguauacccacugca

SEQ ID NO: 418870 - RNA, 19 nt, Homo sapiens
ccuaguggggaggggccug

SEQ ID NO: 418871 - RNA, 21 nt, Homo sapiens
ccuaguggugaaacggaugag

SEQ ID NO: 418872 - RNA, 18 nt, Homo sapiens
ccuaguuucccugaagga

SEQ ID NO: 418873 - RNA, 22 nt, Homo sapiens
ccuauaauuuuaaaguaucauu

SEQ ID NO: 418874 - RNA, 23 nt, Homo sapiens
ccuaucagaaguuucucagcucc

SEQ ID NO: 418875 - RNA, 23 nt, Homo sapiens
ccuaucuaacccucccauggcac

SEQ ID NO: 418876 - RNA, 16 nt, Homo sapiens
ccuaucuguaugucug

SEQ ID NO: 418877 - RNA, 16 nt, Homo sapiens
ccuauggaaagggugu

SEQ ID NO: 418878 - RNA, 16 nt, Homo sapiens
ccuauucuauugcagu

SEQ ID NO: 418879 - RNA, 15 nt, Homo sapiens
ccuauuuacuggaaa

SEQ ID NO: 418880 - RNA, 22 nt, Homo sapiens
ccuauuuuaauuggaauucugg

SEQ ID NO: 418881 - RNA, 21 nt, Homo sapiens
ccucaaacuuccagucaggua

SEQ ID NO: 418882 - RNA, 17 nt, Homo sapiens
ccucaaaugcaguauuu

SEQ ID NO: 418883 - RNA, 21 nt, Homo sapiens
ccucaacucccagccaucugu

SEQ ID NO: 418884 - RNA, 20 nt, Homo sapiens
ccucacaacuccuuccaucc

SEQ ID NO: 418885 - RNA, 23 nt, Homo sapiens
ccucacagagugcauugugaggg

SEQ ID NO: 418886 - RNA, 20 nt, Homo sapiens
ccucaccuggcuucccagga

SEQ ID NO: 418887 - RNA, 14 nt, Homo sapiens
agccacgugaaugg

SEQ ID NO: 418888 - RNA, 15 nt, Homo sapiens
agccacuaccuucug

SEQ ID NO: 418889 - RNA, 18 nt, Homo sapiens
agccacuaccuucugacc

SEQ ID NO: 418890 - RNA, 23 nt, Homo sapiens
agccacuauuguuagucucuuga

SEQ ID NO: 418891 - RNA, 15 nt, Homo sapiens
agccacugugcugaa

SEQ ID NO: 418892 - RNA, 21 nt, Homo sapiens
agccagccacccuaacugagc

SEQ ID NO: 418893 - RNA, 21 nt, Homo sapiens
agccagcccuucccaggccag

SEQ ID NO: 418894 - RNA, 14 nt, Homo sapiens
agccagccugggac

SEQ ID NO: 418895 - RNA, 15 nt, Homo sapiens
agccagcugcagcug

SEQ ID NO: 418896 - RNA, 14 nt, Homo sapiens
agccauaacuugaa

SEQ ID NO: 418897 - RNA, 20 nt, Homo sapiens
agccauauauuuucugagua

SEQ ID NO: 418898 - RNA, 18 nt, Homo sapiens
agccauauucacaccuca

SEQ ID NO: 418899 - RNA, 20 nt, Homo sapiens
agccauuauucucugaugca

SEQ ID NO: 418900 - RNA, 18 nt, Homo sapiens
agccauuccuguucccau

SEQ ID NO: 418901 - RNA, 15 nt, Homo sapiens
agcccacagugcuca

SEQ ID NO: 418902 - RNA, 16 nt, Homo sapiens
agcccauccagucucc

SEQ ID NO: 418903 - RNA, 14 nt, Homo sapiens
agccccacuccaca

SEQ ID NO: 418904 - RNA, 21 nt, Homo sapiens
agccccagggcccugcucagg

SEQ ID NO: 418905 - RNA, 20 nt, Homo sapiens
agccccaucccaaacccuuc

SEQ ID NO: 418906 - RNA, 17 nt, Homo sapiens
agcccccugcacccacc

SEQ ID NO: 418907 - RNA, 24 nt, Homo sapiens
agcccccuggaugggcauugggcu

SEQ ID NO: 418908 - RNA, 16 nt, Homo sapiens
agccccucucuacugu

SEQ ID NO: 418909 - RNA, 19 nt, Homo sapiens
agcccggaugcuucuccau

SEQ ID NO: 418910 - RNA, 17 nt, Homo sapiens
agcccgucaucuucccu

SEQ ID NO: 418911 - RNA, 11 nt, Homo sapiens
agcccuaggcu

SEQ ID NO: 418912 - RNA, 21 nt, Homo sapiens
agcccuagugggagcccagca

SEQ ID NO: 418913 - RNA, 13 nt, Homo sapiens
agcccuauuacuu

SEQ ID NO: 418914 - RNA, 19 nt, Homo sapiens
agcccucaguuuucaguca

SEQ ID NO: 418915 - RNA, 18 nt, Homo sapiens
agcccuccaaaagcacuu

SEQ ID NO: 418916 - RNA, 19 nt, Homo sapiens
agcccucccccagcaguug

SEQ ID NO: 418917 - RNA, 20 nt, Homo sapiens
agcccucugcugcuuuccaa

SEQ ID NO: 418918 - RNA, 13 nt, Homo sapiens
agcccugcugcuu

SEQ ID NO: 418919 - RNA, 14 nt, Homo sapiens
agcccuguguccug

SEQ ID NO: 418920 - RNA, 14 nt, Homo sapiens
agcccuuuacuuga

SEQ ID NO: 418921 - RNA, 12 nt, Homo sapiens
agcccuuuccag

SEQ ID NO: 418922 - RNA, 23 nt, Homo sapiens
agccgagcacgguggugcaugcc

SEQ ID NO: 418923 - RNA, 13 nt, Homo sapiens
agccgagcucucc

SEQ ID NO: 418924 - RNA, 19 nt, Homo sapiens
agccuaagaaaaucaucuu

SEQ ID NO: 418925 - RNA, 15 nt, Homo sapiens
agccuacagaugaac

SEQ ID NO: 418926 - RNA, 21 nt, Homo sapiens
agccuaggggucagggaccaa

SEQ ID NO: 418927 - RNA, 22 nt, Homo sapiens
agccuauaccccuuacuuagca

SEQ ID NO: 418928 - RNA, 14 nt, Homo sapiens
agccucagcucuca

SEQ ID NO: 418929 - RNA, 13 nt, Homo sapiens
agccucaucucuu

SEQ ID NO: 418930 - RNA, 18 nt, Homo sapiens
agccucccccaaagcaau

SEQ ID NO: 418931 - RNA, 17 nt, Homo sapiens
agccuccgccauuccaa

SEQ ID NO: 418932 - RNA, 23 nt, Homo sapiens
agccucucaccuggacuccagua

SEQ ID NO: 418933 - RNA, 23 nt, Homo sapiens
agccucugagccccugggacugc

SEQ ID NO: 418934 - RNA, 16 nt, Homo sapiens
agccucuggcuagagg

SEQ ID NO: 418935 - RNA, 14 nt, Homo sapiens
agccucugugcugc

SEQ ID NO: 418936 - RNA, 20 nt, Homo sapiens
agccucuuuaacagcuuucu

SEQ ID NO: 418937 - RNA, 15 nt, Homo sapiens
agccugagccuuaga

SEQ ID NO: 418938 - RNA, 15 nt, Homo sapiens
agccugaugauggaa

SEQ ID NO: 418939 - RNA, 16 nt, Homo sapiens
agccugccucccaagg

SEQ ID NO: 418940 - RNA, 14 nt, Homo sapiens
agccugcuucccac

SEQ ID NO: 418941 - RNA, 17 nt, Homo sapiens
agccuggacaccucuca

SEQ ID NO: 418942 - RNA, 18 nt, Homo sapiens
agccuggagccccugugu

SEQ ID NO: 418943 - RNA, 21 nt, Homo sapiens
agccuggcacagggcaguggg

SEQ ID NO: 418944 - RNA, 22 nt, Homo sapiens
agccuggcucccaggacacgac

SEQ ID NO: 418945 - RNA, 23 nt, Homo sapiens
agccuguguuagugucuguccau

SEQ ID NO: 418946 - RNA, 16 nt, Homo sapiens
agccuguuugggaugu

SEQ ID NO: 418947 - RNA, 19 nt, Homo sapiens
agccuuaaaaugcauugaa

SEQ ID NO: 418948 - RNA, 15 nt, Homo sapiens
agccuuaagccauag

SEQ ID NO: 418949 - RNA, 19 nt, Homo sapiens
agccuuaagucuuacuguu

SEQ ID NO: 418950 - RNA, 16 nt, Homo sapiens
agccuuagcugccagu

SEQ ID NO: 418951 - RNA, 16 nt, Homo sapiens
agccuugcugccaagu

SEQ ID NO: 418952 - RNA, 20 nt, Homo sapiens
agccuuuuccagaagaucug

SEQ ID NO: 418953 - RNA, 13 nt, Homo sapiens
agcgaacaucuuc

SEQ ID NO: 418954 - RNA, 13 nt, Homo sapiens
agcgaaucucugc

SEQ ID NO: 418955 - RNA, 12 nt, Homo sapiens
agcgauucucau

SEQ ID NO: 418956 - RNA, 20 nt, Homo sapiens
agcgccugccgccccgggga

SEQ ID NO: 418957 - RNA, 17 nt, Homo sapiens
agcgcgggagagaguga

SEQ ID NO: 418958 - RNA, 13 nt, Homo sapiens
agcgggaguggcu

SEQ ID NO: 418959 - RNA, 14 nt, Homo sapiens
agcggguaaaaaga

SEQ ID NO: 418960 - RNA, 17 nt, Homo sapiens
agcguagcuaagugaaa

SEQ ID NO: 418961 - RNA, 18 nt, Homo sapiens
agcgucacaucugcagug

SEQ ID NO: 418962 - RNA, 18 nt, Homo sapiens
agcguuugcugugccagg

SEQ ID NO: 418963 - RNA, 17 nt, Homo sapiens
agcuaacaaguagcaca

SEQ ID NO: 418964 - RNA, 21 nt, Homo sapiens
agcuaacaaguagcacacuga

SEQ ID NO: 418965 - RNA, 22 nt, Homo sapiens
agcuaacauggaaguacuauaa

SEQ ID NO: 418966 - RNA, 22 nt, Homo sapiens
agcuaacgugcugucagcauua

SEQ ID NO: 418967 - RNA, 14 nt, Homo sapiens
agcuaagauuaucu

SEQ ID NO: 418968 - RNA, 19 nt, Homo sapiens
agcuaagugaaaaggucau

SEQ ID NO: 418969 - RNA, 20 nt, Homo sapiens
agcuaaguucuaaguucaug

SEQ ID NO: 418970 - RNA, 20 nt, Homo sapiens
agcuaauaaaauaucauuca

SEQ ID NO: 418971 - RNA, 15 nt, Homo sapiens
agcuaauguaauaac

SEQ ID NO: 418972 - RNA, 15 nt, Homo sapiens
agcuaccagcuaugc

SEQ ID NO: 418973 - RNA, 16 nt, Homo sapiens
agcuacuaaugauguu

SEQ ID NO: 418974 - RNA, 21 nt, Homo sapiens
agcuacucaggagacugaguu

SEQ ID NO: 418975 - RNA, 19 nt, Homo sapiens
agcuagaaucacuugacuu

SEQ ID NO: 418976 - RNA, 20 nt, Homo sapiens
agcuaguuaaacagugccau

SEQ ID NO: 418977 - RNA, 17 nt, Homo sapiens
agcuaguuaugugagaa

SEQ ID NO: 418978 - RNA, 14 nt, Homo sapiens
agcuauaacauuug

SEQ ID NO: 418979 - RNA, 23 nt, Homo sapiens
agcuauaacauuugcugaauaug

SEQ ID NO: 418980 - RNA, 20 nt, Homo sapiens
agcuauauuauacaaauacu

SEQ ID NO: 418981 - RNA, 14 nt, Homo sapiens
agcuaugaauauag

SEQ ID NO: 418982 - RNA, 23 nt, Homo sapiens
agcucaaaguacuacagcaaagc

SEQ ID NO: 418983 - RNA, 17 nt, Homo sapiens
agcucaccaacuacaga

SEQ ID NO: 418984 - RNA, 19 nt, Homo sapiens
agcucagaggagucuggga

SEQ ID NO: 418985 - RNA, 20 nt, Homo sapiens
agcucagaggguuguucucc

SEQ ID NO: 418986 - RNA, 20 nt, Homo sapiens
agcucaggcgcagcccuagu

SEQ ID NO: 418987 - RNA, 18 nt, Homo sapiens
agcuccacagaagacacg

SEQ ID NO: 418988 - RNA, 13 nt, Homo sapiens
agcuccacucuga

SEQ ID NO: 418989 - RNA, 20 nt, Homo sapiens
agcuccaggugcccuguggg

SEQ ID NO: 418990 - RNA, 19 nt, Homo sapiens
agcuccauaauugcaaggg

SEQ ID NO: 418991 - RNA, 21 nt, Homo sapiens
agcucccuccucccaucuccu

SEQ ID NO: 418992 - RNA, 22 nt, Homo sapiens
agcuccgaugcccgcccgggga

SEQ ID NO: 418993 - RNA, 17 nt, Homo sapiens
agcucuauaagagcugg

SEQ ID NO: 418994 - RNA, 18 nt, Homo sapiens
agcucucacaugcacagg

SEQ ID NO: 418995 - RNA, 17 nt, Homo sapiens
agcucuccugggccagg

SEQ ID NO: 418996 - RNA, 12 nt, Homo sapiens
agcucucuggga

SEQ ID NO: 418997 - RNA, 13 nt, Homo sapiens
agcucucuugccg

SEQ ID NO: 418998 - RNA, 15 nt, Homo sapiens
agcucugacugaagg

SEQ ID NO: 418999 - RNA, 23 nt, Homo sapiens
agcucuguccucugucagucaug

SEQ ID NO: 419000 - RNA, 18 nt, Homo sapiens
agcucuguugcagguguc

SEQ ID NO: 419001 - RNA, 15 nt, Homo sapiens
agcucuuaauguugc

SEQ ID NO: 419002 - RNA, 20 nt, Homo sapiens
agcucuuucuucuuugaauu

SEQ ID NO: 419003 - RNA, 14 nt, Homo sapiens
agcucuuuggugcc

SEQ ID NO: 419004 - RNA, 14 nt, Homo sapiens
agcucuuugucuca

SEQ ID NO: 419005 - RNA, 22 nt, Homo sapiens
agcucuuugucucaccagcuca

SEQ ID NO: 419006 - RNA, 14 nt, Homo sapiens
agcugaaaagugau

SEQ ID NO: 419007 - RNA, 15 nt, Homo sapiens
agcugaacacaagca

SEQ ID NO: 419008 - RNA, 20 nt, Homo sapiens
agcugaacacaagcaaaccu

SEQ ID NO: 419009 - RNA, 16 nt, Homo sapiens
agcugacaucuugcac

SEQ ID NO: 419010 - RNA, 22 nt, Homo sapiens
agcugaccucagaggaguuuaa

SEQ ID NO: 419011 - RNA, 15 nt, Homo sapiens
agcugacucauucuu

SEQ ID NO: 419012 - RNA, 14 nt, Homo sapiens
agcugagaugagcc

SEQ ID NO: 419013 - RNA, 16 nt, Homo sapiens
agcugagccagucaug

SEQ ID NO: 419014 - RNA, 15 nt, Homo sapiens
agcugagcuuuccag

SEQ ID NO: 419015 - RNA, 14 nt, Homo sapiens
agcugcaccagcag

SEQ ID NO: 419016 - RNA, 17 nt, Homo sapiens
agcugcacuccaugagu

SEQ ID NO: 419017 - RNA, 22 nt, Homo sapiens
agcugcaggugcccauuagcaa

SEQ ID NO: 419018 - RNA, 11 nt, Homo sapiens
agcugccauuu

SEQ ID NO: 419019 - RNA, 18 nt, Homo sapiens
ccucacgcucuccaucau

SEQ ID NO: 419020 - RNA, 13 nt, Homo sapiens
ccucacuauucaa

SEQ ID NO: 419021 - RNA, 19 nt, Homo sapiens
ccucagaaagucaccagga

SEQ ID NO: 419022 - RNA, 13 nt, Homo sapiens
ccucagacauccc

SEQ ID NO: 419023 - RNA, 12 nt, Homo sapiens
ccucagauucca

SEQ ID NO: 419024 - RNA, 22 nt, Homo sapiens
ccucagauuccaccuagagcua

SEQ ID NO: 419025 - RNA, 23 nt, Homo sapiens
ccucagauuuucuggacuuaguc

SEQ ID NO: 419026 - RNA, 22 nt, Homo sapiens
ccucagcccaggucagcuguua

SEQ ID NO: 419027 - RNA, 11 nt, Homo sapiens
ccucagggugg

SEQ ID NO: 419028 - RNA, 13 nt, Homo sapiens
ccucaggugaucc

SEQ ID NO: 419029 - RNA, 21 nt, Homo sapiens
ccucagguggccccaguucaa

SEQ ID NO: 419030 - RNA, 15 nt, Homo sapiens
ccucagguuugccug

SEQ ID NO: 419031 - RNA, 23 nt, Homo sapiens
ccucagugccacuugacauuccu

SEQ ID NO: 419032 - RNA, 18 nt, Homo sapiens
ccucaguguccucaucua

SEQ ID NO: 419033 - RNA, 12 nt, Homo sapiens
ccucaguucucu

SEQ ID NO: 419034 - RNA, 17 nt, Homo sapiens
ccucaguuuuaucauuu

SEQ ID NO: 419035 - RNA, 20 nt, Homo sapiens
ccucaguuuuaucauuuuca

SEQ ID NO: 419036 - RNA, 22 nt, Homo sapiens
ccucaugauccacccaccucag

SEQ ID NO: 419037 - RNA, 13 nt, Homo sapiens
ccucaugucauuu

SEQ ID NO: 419038 - RNA, 15 nt, Homo sapiens
ccucauucuucucuc

SEQ ID NO: 419039 - RNA, 13 nt, Homo sapiens
ccuccaaaacaca

SEQ ID NO: 419040 - RNA, 16 nt, Homo sapiens
ccuccaaaagcacuua

SEQ ID NO: 419041 - RNA, 20 nt, Homo sapiens
ccuccaagcuccaucuccac

SEQ ID NO: 419042 - RNA, 21 nt, Homo sapiens
ccuccaccccaguccccggga

SEQ ID NO: 419043 - RNA, 12 nt, Homo sapiens
ccuccacuccac

SEQ ID NO: 419044 - RNA, 10 nt, Homo sapiens
ccuccagacc

SEQ ID NO: 419045 - RNA, 23 nt, Homo sapiens
ccuccagcuguacuagugccauu

SEQ ID NO: 419046 - RNA, 16 nt, Homo sapiens
ccuccagcuucuggua

SEQ ID NO: 419047 - RNA, 16 nt, Homo sapiens
ccuccauacucaggac

SEQ ID NO: 419048 - RNA, 15 nt, Homo sapiens
ccucccaaacccagc

SEQ ID NO: 419049 - RNA, 20 nt, Homo sapiens
ccucccaaagugcuaguauu

SEQ ID NO: 419050 - RNA, 23 nt, Homo sapiens
ccucccagugaccccugaccuca

SEQ ID NO: 419051 - RNA, 14 nt, Homo sapiens
ccuccccauggugc

SEQ ID NO: 419052 - RNA, 23 nt, Homo sapiens
ccucccuggggaccaggagcuag

SEQ ID NO: 419053 - RNA, 15 nt, Homo sapiens
ccucccuggucccuu

SEQ ID NO: 419054 - RNA, 21 nt, Homo sapiens
ccucccuguauaagacacuuu

SEQ ID NO: 419055 - RNA, 17 nt, Homo sapiens
ccucccuuggguucuga

SEQ ID NO: 419056 - RNA, 19 nt, Homo sapiens
ccuccgcuccccuuuccca

SEQ ID NO: 419057 - RNA, 17 nt, Homo sapiens
ccuccuaaaguagacuu

SEQ ID NO: 419058 - RNA, 14 nt, Homo sapiens
ccuccucaagaagu

SEQ ID NO: 419059 - RNA, 14 nt, Homo sapiens
ccuccuccugacca

SEQ ID NO: 419060 - RNA, 15 nt, Homo sapiens
ccuccugauggccaa

SEQ ID NO: 419061 - RNA, 15 nt, Homo sapiens
ccuccugcaccgaga

SEQ ID NO: 419062 - RNA, 18 nt, Homo sapiens
ccuccugguaacagcuau

SEQ ID NO: 419063 - RNA, 19 nt, Homo sapiens
ccuccuguugccacacuuu

SEQ ID NO: 419064 - RNA, 17 nt, Homo sapiens
ccucgcaaaaugaugug

SEQ ID NO: 419065 - RNA, 17 nt, Homo sapiens
ccucggccucuacuuug

SEQ ID NO: 419066 - RNA, 13 nt, Homo sapiens
ccucgggacauca

SEQ ID NO: 419067 - RNA, 20 nt, Homo sapiens
ccucggggcaggaagucccu

SEQ ID NO: 419068 - RNA, 21 nt, Homo sapiens
ccucgugguggaaacuuuucu

SEQ ID NO: 419069 - RNA, 16 nt, Homo sapiens
ccucuacuuaaugaga

SEQ ID NO: 419070 - RNA, 21 nt, Homo sapiens
ccucuagguaaacuagcaaaa

SEQ ID NO: 419071 - RNA, 13 nt, Homo sapiens
ccucucacuuugg

SEQ ID NO: 419072 - RNA, 21 nt, Homo sapiens
ccucucagauuguaccauuga

SEQ ID NO: 419073 - RNA, 18 nt, Homo sapiens
ccucucauagaaauugcc

SEQ ID NO: 419074 - RNA, 17 nt, Homo sapiens
ccucucaucaguguccu

SEQ ID NO: 419075 - RNA, 12 nt, Homo sapiens
ccucuccaagcu

SEQ ID NO: 419076 - RNA, 20 nt, Homo sapiens
ccucuccagcccuauggaag

SEQ ID NO: 419077 - RNA, 18 nt, Homo sapiens
ccucucccaaguccacac

SEQ ID NO: 419078 - RNA, 12 nt, Homo sapiens
ccucucuccuuc

SEQ ID NO: 419079 - RNA, 19 nt, Homo sapiens
ccucugaaauuucccacac

SEQ ID NO: 419080 - RNA, 13 nt, Homo sapiens
ccucugaagcauu

SEQ ID NO: 419081 - RNA, 17 nt, Homo sapiens
ccucugcacuacugaca

SEQ ID NO: 419082 - RNA, 22 nt, Homo sapiens
ccucugccggucccccaugcca

SEQ ID NO: 419083 - RNA, 23 nt, Homo sapiens
ccucugccggucccccaugccac

SEQ ID NO: 419084 - RNA, 21 nt, Homo sapiens
ccucugcuaccaucucauuaa

SEQ ID NO: 419085 - RNA, 18 nt, Homo sapiens
ccucugcuguagagccau

SEQ ID NO: 419086 - RNA, 18 nt, Homo sapiens
ccucuggccaaauaugca

SEQ ID NO: 419087 - RNA, 21 nt, Homo sapiens
ccucuguccuggcugugcaca

SEQ ID NO: 419088 - RNA, 14 nt, Homo sapiens
ccucugugcugcac

SEQ ID NO: 419089 - RNA, 19 nt, Homo sapiens
ccucuuccaggaagcacag

SEQ ID NO: 419090 - RNA, 17 nt, Homo sapiens
ccucuucccaugacugc

SEQ ID NO: 419091 - RNA, 21 nt, Homo sapiens
ccucuucccugucuuccccac

SEQ ID NO: 419092 - RNA, 20 nt, Homo sapiens
ccucuucucaagugccuuaa

SEQ ID NO: 419093 - RNA, 19 nt, Homo sapiens
ccucuucuuauucaugcuu

SEQ ID NO: 419094 - RNA, 15 nt, Homo sapiens
ccucuuuaacagcuu

SEQ ID NO: 419095 - RNA, 16 nt, Homo sapiens
ccucuuuaacagcuuu

SEQ ID NO: 419096 - RNA, 18 nt, Homo sapiens
ccucuuuccugugccagg

SEQ ID NO: 419097 - RNA, 16 nt, Homo sapiens
ccucuuucucucugug

SEQ ID NO: 419098 - RNA, 20 nt, Homo sapiens
ccucuuuuaaugucaucucu

SEQ ID NO: 419099 - RNA, 15 nt, Homo sapiens
ccucuuuucucugug

SEQ ID NO: 419100 - RNA, 18 nt, Homo sapiens
ccucuuuucucugugcuu

SEQ ID NO: 419101 - RNA, 22 nt, Homo sapiens
ccugaaaaaguuuuguggauua

SEQ ID NO: 419102 - RNA, 20 nt, Homo sapiens
ccugaaaauaacagaauucu

SEQ ID NO: 419103 - RNA, 19 nt, Homo sapiens
ccugaaagcaacuacagaa

SEQ ID NO: 419104 - RNA, 15 nt, Homo sapiens
ccugaacaagaaaga

SEQ ID NO: 419105 - RNA, 14 nt, Homo sapiens
ccugaacucugcaa

SEQ ID NO: 419106 - RNA, 14 nt, Homo sapiens
ccugacaaccacug

SEQ ID NO: 419107 - RNA, 14 nt, Homo sapiens
ccugaccucaggua

SEQ ID NO: 419108 - RNA, 15 nt, Homo sapiens
ccugagauucuggga

SEQ ID NO: 419109 - RNA, 20 nt, Homo sapiens
ccugaggguggagacuaagc

SEQ ID NO: 419110 - RNA, 15 nt, Homo sapiens
ccugaggguuuccac

SEQ ID NO: 419111 - RNA, 14 nt, Homo sapiens
ccugaggucgucaa

SEQ ID NO: 419112 - RNA, 21 nt, Homo sapiens
ccugaggugaaagggagcuau

SEQ ID NO: 419113 - RNA, 22 nt, Homo sapiens
ccugagucggccccacauggga

SEQ ID NO: 419114 - RNA, 23 nt, Homo sapiens
ccugaguggugccaaacaaaaag

SEQ ID NO: 419115 - RNA, 19 nt, Homo sapiens
ccugaguuucaaguauccu

SEQ ID NO: 419116 - RNA, 18 nt, Homo sapiens
ccugauagucaccugcug

SEQ ID NO: 419117 - RNA, 13 nt, Homo sapiens
ccugauccucacc

SEQ ID NO: 419118 - RNA, 21 nt, Homo sapiens
ccugaugccccuuccccaaga

SEQ ID NO: 419119 - RNA, 16 nt, Homo sapiens
ccugaugcuaugguca

SEQ ID NO: 419120 - RNA, 21 nt, Homo sapiens
ccugcaaacucacugcucaag

SEQ ID NO: 419121 - RNA, 17 nt, Homo sapiens
ccugcaccccugcaguu

SEQ ID NO: 419122 - RNA, 23 nt, Homo sapiens
ccugcaccgagagagauggaaua

SEQ ID NO: 419123 - RNA, 14 nt, Homo sapiens
ccugcacuguaaaa

SEQ ID NO: 419124 - RNA, 20 nt, Homo sapiens
ccugcagccuccuccugacc

SEQ ID NO: 419125 - RNA, 22 nt, Homo sapiens
ccugcagccuccuccugaccac

SEQ ID NO: 419126 - RNA, 16 nt, Homo sapiens
ccugccacaaugugau

SEQ ID NO: 419127 - RNA, 18 nt, Homo sapiens
ccugccagacggcaccca

SEQ ID NO: 419128 - RNA, 22 nt, Homo sapiens
ccugccccaaacaaauaugcaa

SEQ ID NO: 419129 - RNA, 13 nt, Homo sapiens
ccugccccagaga

SEQ ID NO: 419130 - RNA, 22 nt, Homo sapiens
ccugcccuccccagagcacugg

SEQ ID NO: 419131 - RNA, 16 nt, Homo sapiens
ccugcccugcugccgc

SEQ ID NO: 419132 - RNA, 18 nt, Homo sapiens
ccugccucaugcucucua

SEQ ID NO: 419133 - RNA, 22 nt, Homo sapiens
ccugccucccaagguccucuca

SEQ ID NO: 419134 - RNA, 20 nt, Homo sapiens
ccugccugagcccaggagcu

SEQ ID NO: 419135 - RNA, 10 nt, Homo sapiens
ccugccuuca

SEQ ID NO: 419136 - RNA, 20 nt, Homo sapiens
ccugcuagucugucagggcc

SEQ ID NO: 419137 - RNA, 23 nt, Homo sapiens
ccugcucaacauaggccugcuca

SEQ ID NO: 419138 - RNA, 13 nt, Homo sapiens
ccugcuccugacu

SEQ ID NO: 419139 - RNA, 18 nt, Homo sapiens
ccugcucuccucuugcca

SEQ ID NO: 419140 - RNA, 18 nt, Homo sapiens
ccugcuuaaugucagucu

SEQ ID NO: 419141 - RNA, 22 nt, Homo sapiens
ccugcuuagugucccuuaccug

SEQ ID NO: 419142 - RNA, 12 nt, Homo sapiens
ccugcuucacac

SEQ ID NO: 419143 - RNA, 18 nt, Homo sapiens
ccugcuuucuaauuaaaa

SEQ ID NO: 419144 - RNA, 14 nt, Homo sapiens
ccuggaaggcagcu

SEQ ID NO: 419145 - RNA, 12 nt, Homo sapiens
ccuggaauucac

SEQ ID NO: 419146 - RNA, 16 nt, Homo sapiens
ccuggacauauuccca

SEQ ID NO: 419147 - RNA, 14 nt, Homo sapiens
ccuggaccauuuga

SEQ ID NO: 419148 - RNA, 19 nt, Homo sapiens
ccuggacuggaucaagaag

SEQ ID NO: 419149 - RNA, 19 nt, Homo sapiens
ccuggagcccauccagucu

SEQ ID NO: 419150 - RNA, 11 nt, Homo sapiens
ccuggagcucc

SEQ ID NO: 419151 - RNA, 15 nt, Homo sapiens
agcugcucuccuuca

SEQ ID NO: 419152 - RNA, 15 nt, Homo sapiens
agcugcugaaugcau

SEQ ID NO: 419153 - RNA, 18 nt, Homo sapiens
agcugcugaaugcauuca

SEQ ID NO: 419154 - RNA, 16 nt, Homo sapiens
agcugcuggcuugcag

SEQ ID NO: 419155 - RNA, 15 nt, Homo sapiens
agcuggagugcugcu

SEQ ID NO: 419156 - RNA, 17 nt, Homo sapiens
agcuggauuacaggcau

SEQ ID NO: 419157 - RNA, 23 nt, Homo sapiens
agcuggcccgacggcagccagaa

SEQ ID NO: 419158 - RNA, 17 nt, Homo sapiens
agcugggacuacagggg

SEQ ID NO: 419159 - RNA, 19 nt, Homo sapiens
agcugggagaaccaaaaag

SEQ ID NO: 419160 - RNA, 18 nt, Homo sapiens
agcugggauuacaggugu

SEQ ID NO: 419161 - RNA, 22 nt, Homo sapiens
agcugggcaaagccacaaggcu

SEQ ID NO: 419162 - RNA, 17 nt, Homo sapiens
agcugggccccaugcuc

SEQ ID NO: 419163 - RNA, 21 nt, Homo sapiens
agcugguggcaauaaauauua

SEQ ID NO: 419164 - RNA, 20 nt, Homo sapiens
agcuguaacccucacccaca

SEQ ID NO: 419165 - RNA, 14 nt, Homo sapiens
agcuguaaccgaua

SEQ ID NO: 419166 - RNA, 21 nt, Homo sapiens
agcuguaagauaauguugcuu

SEQ ID NO: 419167 - RNA, 16 nt, Homo sapiens
agcuguacaugaugau

SEQ ID NO: 419168 - RNA, 18 nt, Homo sapiens
agcuguacuagugccauu

SEQ ID NO: 419169 - RNA, 21 nt, Homo sapiens
agcuguaguagcccuuucugu

SEQ ID NO: 419170 - RNA, 19 nt, Homo sapiens
agcugucccucacuguuga

SEQ ID NO: 419171 - RNA, 22 nt, Homo sapiens
agcugucucaaaccuccaaaag

SEQ ID NO: 419172 - RNA, 19 nt, Homo sapiens
agcuguggccagcuuguua

SEQ ID NO: 419173 - RNA, 23 nt, Homo sapiens
agcugugguuuucuuuugccaug

SEQ ID NO: 419174 - RNA, 13 nt, Homo sapiens
agcuguguucaca

SEQ ID NO: 419175 - RNA, 23 nt, Homo sapiens
agcuuauuuguauuuuuccucuu

SEQ ID NO: 419176 - RNA, 17 nt, Homo sapiens
agcuucaccagagcauu

SEQ ID NO: 419177 - RNA, 21 nt, Homo sapiens
agcuucauauaccagcaauau

SEQ ID NO: 419178 - RNA, 12 nt, Homo sapiens
agcuuccaugag

SEQ ID NO: 419179 - RNA, 21 nt, Homo sapiens
agcuucccuuuucucccaaga

SEQ ID NO: 419180 - RNA, 18 nt, Homo sapiens
agcuucuagcagcuaagg

SEQ ID NO: 419181 - RNA, 13 nt, Homo sapiens
agcuucugaccuc

SEQ ID NO: 419182 - RNA, 23 nt, Homo sapiens
agcuugaaacauagagggagaga

SEQ ID NO: 419183 - RNA, 19 nt, Homo sapiens
agcuugauucucagcacuu

SEQ ID NO: 419184 - RNA, 14 nt, Homo sapiens
agcuugcaacaaaa

SEQ ID NO: 419185 - RNA, 23 nt, Homo sapiens
agcuugccaauggcggacucaaa

SEQ ID NO: 419186 - RNA, 22 nt, Homo sapiens
agcuuggauggagacuccauga

SEQ ID NO: 419187 - RNA, 24 nt, Homo sapiens
agcuuggccagaagggggccauga

SEQ ID NO: 419188 - RNA, 17 nt, Homo sapiens
agcuuggugucuuggca

SEQ ID NO: 419189 - RNA, 23 nt, Homo sapiens
agcuuguccaacaacuccaggaa

SEQ ID NO: 419190 - RNA, 19 nt, Homo sapiens
agcuuguuguuuuuugcua

SEQ ID NO: 419191 - RNA, 20 nt, Homo sapiens
agcuuuagcuucucugccaa

SEQ ID NO: 419192 - RNA, 19 nt, Homo sapiens
agcuuucagagccagugaa

SEQ ID NO: 419193 - RNA, 19 nt, Homo sapiens
agcuuucaugaccauacaa

SEQ ID NO: 419194 - RNA, 11 nt, Homo sapiens
agcuuucccag

SEQ ID NO: 419195 - RNA, 20 nt, Homo sapiens
agcuuucccuggcucaggga

SEQ ID NO: 419196 - RNA, 19 nt, Homo sapiens
agcuuuggacgcacacagc

SEQ ID NO: 419197 - RNA, 18 nt, Homo sapiens
agcuuuuaaaaauguccu

SEQ ID NO: 419198 - RNA, 12 nt, Homo sapiens
agcuuuucugca

SEQ ID NO: 419199 - RNA, 21 nt, Homo sapiens
aggaaaacugagacucagaca

SEQ ID NO: 419200 - RNA, 21 nt, Homo sapiens
aggaaaagaguaucaaaggca

SEQ ID NO: 419201 - RNA, 16 nt, Homo sapiens
aggaaaauauugacaa

SEQ ID NO: 419202 - RNA, 14 nt, Homo sapiens
aggaaagaucccaa

SEQ ID NO: 419203 - RNA, 17 nt, Homo sapiens
aggaaagcguuuggaaa

SEQ ID NO: 419204 - RNA, 14 nt, Homo sapiens
aggaaaggcaguau

SEQ ID NO: 419205 - RNA, 23 nt, Homo sapiens
aggaaauaguaccuucaauacuu

SEQ ID NO: 419206 - RNA, 18 nt, Homo sapiens
aggaaauauauaugugug

SEQ ID NO: 419207 - RNA, 12 nt, Homo sapiens
aggaaauaucau

SEQ ID NO: 419208 - RNA, 18 nt, Homo sapiens
aggaaauaucauaaugua

SEQ ID NO: 419209 - RNA, 15 nt, Homo sapiens
aggaaauugcaaaga

SEQ ID NO: 419210 - RNA, 13 nt, Homo sapiens
aggaacauuccuu

SEQ ID NO: 419211 - RNA, 16 nt, Homo sapiens
aggaaccccaggagau

SEQ ID NO: 419212 - RNA, 17 nt, Homo sapiens
aggaacgugguucagag

SEQ ID NO: 419213 - RNA, 18 nt, Homo sapiens
aggaacuuuccagcagua

SEQ ID NO: 419214 - RNA, 21 nt, Homo sapiens
aggaagaucuugagagcugcu

SEQ ID NO: 419215 - RNA, 23 nt, Homo sapiens
aggaagcaaaagcaucuauguga

SEQ ID NO: 419216 - RNA, 14 nt, Homo sapiens
aggaagccacugcc

SEQ ID NO: 419217 - RNA, 14 nt, Homo sapiens
aggaaggaugcaaa

SEQ ID NO: 419218 - RNA, 15 nt, Homo sapiens
aggaagggacugguc

SEQ ID NO: 419219 - RNA, 15 nt, Homo sapiens
aggaagggcauccuu

SEQ ID NO: 419220 - RNA, 15 nt, Homo sapiens
aggaagguggugcuu

SEQ ID NO: 419221 - RNA, 14 nt, Homo sapiens
aggaagugacucau

SEQ ID NO: 419222 - RNA, 13 nt, Homo sapiens
aggaaguugcuga

SEQ ID NO: 419223 - RNA, 17 nt, Homo sapiens
aggaauauacauagucu

SEQ ID NO: 419224 - RNA, 17 nt, Homo sapiens
aggaauccacauugcca

SEQ ID NO: 419225 - RNA, 14 nt, Homo sapiens
aggaauuaaacuaa

SEQ ID NO: 419226 - RNA, 17 nt, Homo sapiens
aggaauuucugcucugg

SEQ ID NO: 419227 - RNA, 20 nt, Homo sapiens
aggacaaacagugaauuuaa

SEQ ID NO: 419228 - RNA, 13 nt, Homo sapiens
aggacacagaucu

SEQ ID NO: 419229 - RNA, 21 nt, Homo sapiens
aggacacccucccacaugaug

SEQ ID NO: 419230 - RNA, 17 nt, Homo sapiens
aggacacucgcuugccg

SEQ ID NO: 419231 - RNA, 20 nt, Homo sapiens
aggacagauccagggacuga

SEQ ID NO: 419232 - RNA, 15 nt, Homo sapiens
aggacagcucuuccc

SEQ ID NO: 419233 - RNA, 16 nt, Homo sapiens
aggacagcugcuucug

SEQ ID NO: 419234 - RNA, 21 nt, Homo sapiens
aggacauauucacagugaaca

SEQ ID NO: 419235 - RNA, 19 nt, Homo sapiens
aggaccaacccaugcccug

SEQ ID NO: 419236 - RNA, 13 nt, Homo sapiens
aggaccacagugg

SEQ ID NO: 419237 - RNA, 19 nt, Homo sapiens
aggaccagaagcauuucac

SEQ ID NO: 419238 - RNA, 15 nt, Homo sapiens
aggaccgccaaagaa

SEQ ID NO: 419239 - RNA, 22 nt, Homo sapiens
aggaccuacuguucggacaaaa

SEQ ID NO: 419240 - RNA, 16 nt, Homo sapiens
aggacgauuucacuga

SEQ ID NO: 419241 - RNA, 20 nt, Homo sapiens
aggacgauuucacugacacu

SEQ ID NO: 419242 - RNA, 14 nt, Homo sapiens
aggacucagaggau

SEQ ID NO: 419243 - RNA, 13 nt, Homo sapiens
aggacuggcuuug

SEQ ID NO: 419244 - RNA, 15 nt, Homo sapiens
aggacuucaaaaggu

SEQ ID NO: 419245 - RNA, 16 nt, Homo sapiens
aggacuuccauuugcu

SEQ ID NO: 419246 - RNA, 22 nt, Homo sapiens
aggacuugugccucuugggaga

SEQ ID NO: 419247 - RNA, 15 nt, Homo sapiens
aggagaaaggcauga

SEQ ID NO: 419248 - RNA, 16 nt, Homo sapiens
aggagaaucacuggaa

SEQ ID NO: 419249 - RNA, 23 nt, Homo sapiens
aggagaaucacuggaaccuggga

SEQ ID NO: 419250 - RNA, 14 nt, Homo sapiens
aggagaaugugcag

SEQ ID NO: 419251 - RNA, 20 nt, Homo sapiens
aggagaccuggcacuggaug

SEQ ID NO: 419252 - RNA, 15 nt, Homo sapiens
aggagacuagauugc

SEQ ID NO: 419253 - RNA, 13 nt, Homo sapiens
aggagacugaguu

SEQ ID NO: 419254 - RNA, 23 nt, Homo sapiens
aggagacuuuacauggaugccaa

SEQ ID NO: 419255 - RNA, 15 nt, Homo sapiens
aggagagacuggcca

SEQ ID NO: 419256 - RNA, 20 nt, Homo sapiens
aggagaguaccccccugaga

SEQ ID NO: 419257 - RNA, 14 nt, Homo sapiens
aggagaucauuuag

SEQ ID NO: 419258 - RNA, 12 nt, Homo sapiens
aggagauuacaa

SEQ ID NO: 419259 - RNA, 16 nt, Homo sapiens
aggagcagcugugcug

SEQ ID NO: 419260 - RNA, 16 nt, Homo sapiens
aggagcgcgcgugaua

SEQ ID NO: 419261 - RNA, 16 nt, Homo sapiens
aggagcuaaacaugcu

SEQ ID NO: 419262 - RNA, 18 nt, Homo sapiens
aggagcugagcuuuccag

SEQ ID NO: 419263 - RNA, 18 nt, Homo sapiens
aggagcuuccagcucuaa

SEQ ID NO: 419264 - RNA, 14 nt, Homo sapiens
aggaggaacugguc

SEQ ID NO: 419265 - RNA, 20 nt, Homo sapiens
aggaggaagggacuggucca

SEQ ID NO: 419266 - RNA, 22 nt, Homo sapiens
aggaggaccuggggggggcaag

SEQ ID NO: 419267 - RNA, 22 nt, Homo sapiens
aggaggagaaaucucacuuuuc

SEQ ID NO: 419268 - RNA, 14 nt, Homo sapiens
aggaggaugcugug

SEQ ID NO: 419269 - RNA, 13 nt, Homo sapiens
aggaggcaagcaa

SEQ ID NO: 419270 - RNA, 20 nt, Homo sapiens
aggaggcaagcaagcucucu

SEQ ID NO: 419271 - RNA, 14 nt, Homo sapiens
aggaggcagaaagc

SEQ ID NO: 419272 - RNA, 17 nt, Homo sapiens
aggaggccccuggccca

SEQ ID NO: 419273 - RNA, 20 nt, Homo sapiens
aggaggccugggagggcaag

SEQ ID NO: 419274 - RNA, 20 nt, Homo sapiens
aggaggcuuacaacuccugc

SEQ ID NO: 419275 - RNA, 15 nt, Homo sapiens
aggaggugccugaga

SEQ ID NO: 419276 - RNA, 23 nt, Homo sapiens
aggagguugaggcagcagaauug

SEQ ID NO: 419277 - RNA, 14 nt, Homo sapiens
aggaguaccuggac

SEQ ID NO: 419278 - RNA, 19 nt, Homo sapiens
aggagucgggagcacagcu

SEQ ID NO: 419279 - RNA, 22 nt, Homo sapiens
aggagucuuuguaaugcuugua

SEQ ID NO: 419280 - RNA, 17 nt, Homo sapiens
aggaguucaaugaucua

SEQ ID NO: 419281 - RNA, 14 nt, Homo sapiens
aggaguuuugagaa

SEQ ID NO: 419282 - RNA, 12 nt, Homo sapiens
aggauaugcagu

SEQ ID NO: 419283 - RNA, 14 nt, Homo sapiens
ccuggauguuauau

SEQ ID NO: 419284 - RNA, 18 nt, Homo sapiens
ccuggcaagugggugaaa

SEQ ID NO: 419285 - RNA, 16 nt, Homo sapiens
ccuggcacaccagaag

SEQ ID NO: 419286 - RNA, 20 nt, Homo sapiens
ccuggcagaacugagcuccu

SEQ ID NO: 419287 - RNA, 23 nt, Homo sapiens
ccuggcagcuuuuucaaaguguu

SEQ ID NO: 419288 - RNA, 21 nt, Homo sapiens
ccuggccuuugaggcaaaggc

SEQ ID NO: 419289 - RNA, 21 nt, Homo sapiens
ccuggcgggcagccccugcug

SEQ ID NO: 419290 - RNA, 15 nt, Homo sapiens
ccuggcucacagcca

SEQ ID NO: 419291 - RNA, 17 nt, Homo sapiens
ccuggcucccaagggag

SEQ ID NO: 419292 - RNA, 20 nt, Homo sapiens
ccuggcugcugccauaguuu

SEQ ID NO: 419293 - RNA, 16 nt, Homo sapiens
ccuggcuggugacaga

SEQ ID NO: 419294 - RNA, 20 nt, Homo sapiens
ccuggcugugcacauucucc

SEQ ID NO: 419295 - RNA, 14 nt, Homo sapiens
ccuggcuuugccca

SEQ ID NO: 419296 - RNA, 16 nt, Homo sapiens
ccuggcuuuuacuuua

SEQ ID NO: 419297 - RNA, 18 nt, Homo sapiens
ccugggaaauuugccgau

SEQ ID NO: 419298 - RNA, 16 nt, Homo sapiens
ccugggauggggcaug

SEQ ID NO: 419299 - RNA, 17 nt, Homo sapiens
ccugggcaacaugauga

SEQ ID NO: 419300 - RNA, 22 nt, Homo sapiens
ccugggcagaaaugugcugcaa

SEQ ID NO: 419301 - RNA, 15 nt, Homo sapiens
ccugggccacuggca

SEQ ID NO: 419302 - RNA, 19 nt, Homo sapiens
ccugggcucuuggccgugg

SEQ ID NO: 419303 - RNA, 22 nt, Homo sapiens
ccugggcugggagaaggugcuu

SEQ ID NO: 419304 - RNA, 21 nt, Homo sapiens
ccuggggcuggguguguuuca

SEQ ID NO: 419305 - RNA, 18 nt, Homo sapiens
ccugggggcagugacugg

SEQ ID NO: 419306 - RNA, 23 nt, Homo sapiens
ccugggguuguucacaccacagg

SEQ ID NO: 419307 - RNA, 14 nt, Homo sapiens
ccugggguuuccac

SEQ ID NO: 419308 - RNA, 16 nt, Homo sapiens
ccugggugacgguccu

SEQ ID NO: 419309 - RNA, 16 nt, Homo sapiens
ccuggucaacccgcug

SEQ ID NO: 419310 - RNA, 15 nt, Homo sapiens
ccuggucauuucaaa

SEQ ID NO: 419311 - RNA, 13 nt, Homo sapiens
ccugguccaugau

SEQ ID NO: 419312 - RNA, 23 nt, Homo sapiens
ccugguccccccaaaucuacuga

SEQ ID NO: 419313 - RNA, 18 nt, Homo sapiens
ccuggucccuuggagaca

SEQ ID NO: 419314 - RNA, 14 nt, Homo sapiens
ccugguuuuacccc

SEQ ID NO: 419315 - RNA, 20 nt, Homo sapiens
ccuguaacccuggcacuuaa

SEQ ID NO: 419316 - RNA, 18 nt, Homo sapiens
ccuguaaucacaacucag

SEQ ID NO: 419317 - RNA, 12 nt, Homo sapiens
ccuguacccagc

SEQ ID NO: 419318 - RNA, 16 nt, Homo sapiens
ccuguagccacuggca

SEQ ID NO: 419319 - RNA, 14 nt, Homo sapiens
ccuguagugagaaa

SEQ ID NO: 419320 - RNA, 12 nt, Homo sapiens
ccuguauuccca

SEQ ID NO: 419321 - RNA, 15 nt, Homo sapiens
ccuguccaugccccu

SEQ ID NO: 419322 - RNA, 14 nt, Homo sapiens
ccugucgugccagu

SEQ ID NO: 419323 - RNA, 20 nt, Homo sapiens
ccugucucuuuccacuuugu

SEQ ID NO: 419324 - RNA, 20 nt, Homo sapiens
ccugucuuccaaggagacca

SEQ ID NO: 419325 - RNA, 17 nt, Homo sapiens
ccugugaaucauauguu

SEQ ID NO: 419326 - RNA, 13 nt, Homo sapiens
ccugugacuaugg

SEQ ID NO: 419327 - RNA, 18 nt, Homo sapiens
ccugugguuaacaucuca

SEQ ID NO: 419328 - RNA, 21 nt, Homo sapiens
ccuguguagcucucacaugca

SEQ ID NO: 419329 - RNA, 17 nt, Homo sapiens
ccugugucaucugucag

SEQ ID NO: 419330 - RNA, 23 nt, Homo sapiens
ccuguguccacaucuaacaaagu

SEQ ID NO: 419331 - RNA, 14 nt, Homo sapiens
ccuguguggugcca

SEQ ID NO: 419332 - RNA, 22 nt, Homo sapiens
ccuguguguauguguguguuug

SEQ ID NO: 419333 - RNA, 17 nt, Homo sapiens
ccuguguuccuggagaa

SEQ ID NO: 419334 - RNA, 16 nt, Homo sapiens
ccuguguucugcacau

SEQ ID NO: 419335 - RNA, 15 nt, Homo sapiens
ccuguuaaggcaucc

SEQ ID NO: 419336 - RNA, 23 nt, Homo sapiens
ccuguuaaggcauccacuucaca

SEQ ID NO: 419337 - RNA, 21 nt, Homo sapiens
ccuguuaagucugagaaggcu

SEQ ID NO: 419338 - RNA, 20 nt, Homo sapiens
ccuguuaggggaaaauagua

SEQ ID NO: 419339 - RNA, 14 nt, Homo sapiens
ccuguuaugccaaa

SEQ ID NO: 419340 - RNA, 14 nt, Homo sapiens
ccuguucaaaaagg

SEQ ID NO: 419341 - RNA, 17 nt, Homo sapiens
ccuguucugaacugugg

SEQ ID NO: 419342 - RNA, 18 nt, Homo sapiens
ccuguucugggugcagcu

SEQ ID NO: 419343 - RNA, 20 nt, Homo sapiens
ccuguuguacacuuggguga

SEQ ID NO: 419344 - RNA, 18 nt, Homo sapiens
ccuguuuacgguacuugg

SEQ ID NO: 419345 - RNA, 16 nt, Homo sapiens
ccuguuuccauggguc

SEQ ID NO: 419346 - RNA, 20 nt, Homo sapiens
ccuguuuguggaacaaaagu

SEQ ID NO: 419347 - RNA, 20 nt, Homo sapiens
ccuuaaauuaaacaauuuau

SEQ ID NO: 419348 - RNA, 12 nt, Homo sapiens
ccuuaauaugau

SEQ ID NO: 419349 - RNA, 16 nt, Homo sapiens
ccuuaauaugaucugu

SEQ ID NO: 419350 - RNA, 15 nt, Homo sapiens
ccuuaauauguuaac

SEQ ID NO: 419351 - RNA, 23 nt, Homo sapiens
ccuuacggucaugaugucugcaa

SEQ ID NO: 419352 - RNA, 16 nt, Homo sapiens
ccuuagcaacagccga

SEQ ID NO: 419353 - RNA, 18 nt, Homo sapiens
ccuuagcaaggggcucag

SEQ ID NO: 419354 - RNA, 18 nt, Homo sapiens
ccuuagcccugucugcua

SEQ ID NO: 419355 - RNA, 19 nt, Homo sapiens
ccuuaucaagugucuucca

SEQ ID NO: 419356 - RNA, 16 nt, Homo sapiens
ccuuaugauauucuca

SEQ ID NO: 419357 - RNA, 13 nt, Homo sapiens
ccuuauugaucuu

SEQ ID NO: 419358 - RNA, 18 nt, Homo sapiens
ccuucaaugcaaaauaca

SEQ ID NO: 419359 - RNA, 22 nt, Homo sapiens
ccuucaccaagcuuagaagcca

SEQ ID NO: 419360 - RNA, 17 nt, Homo sapiens
ccuucacuguugcuuaa

SEQ ID NO: 419361 - RNA, 18 nt, Homo sapiens
ccuucacuucugaccaca

SEQ ID NO: 419362 - RNA, 19 nt, Homo sapiens
ccuucaucuucacugcaau

SEQ ID NO: 419363 - RNA, 22 nt, Homo sapiens
ccuucccgcagcaccagccuga

SEQ ID NO: 419364 - RNA, 19 nt, Homo sapiens
ccuucccuccccacagucc

SEQ ID NO: 419365 - RNA, 22 nt, Homo sapiens
ccuuccgugggucaucccagca

SEQ ID NO: 419366 - RNA, 17 nt, Homo sapiens
ccuuccuaauaugcuuu

SEQ ID NO: 419367 - RNA, 18 nt, Homo sapiens
ccuuccuaauaugcuuua

SEQ ID NO: 419368 - RNA, 17 nt, Homo sapiens
ccuuccucacuuccaua

SEQ ID NO: 419369 - RNA, 16 nt, Homo sapiens
ccuuccugacugggaa

SEQ ID NO: 419370 - RNA, 23 nt, Homo sapiens
ccuuccugagaaacguccaucuc

SEQ ID NO: 419371 - RNA, 21 nt, Homo sapiens
ccuuccugggcagcccagaga

SEQ ID NO: 419372 - RNA, 12 nt, Homo sapiens
ccuucucagcuc

SEQ ID NO: 419373 - RNA, 17 nt, Homo sapiens
ccuucuccacagggaca

SEQ ID NO: 419374 - RNA, 18 nt, Homo sapiens
ccuucucccacacugcua

SEQ ID NO: 419375 - RNA, 21 nt, Homo sapiens
ccuucucuacucaugccagau

SEQ ID NO: 419376 - RNA, 16 nt, Homo sapiens
cuguccuaagcacuuu

SEQ ID NO: 419377 - RNA, 16 nt, Homo sapiens
cuguccuacaauauca

SEQ ID NO: 419378 - RNA, 17 nt, Homo sapiens
cuguccucaccgucucg

SEQ ID NO: 419379 - RNA, 15 nt, Homo sapiens
cuguccucucagaac

SEQ ID NO: 419380 - RNA, 18 nt, Homo sapiens
cuguccucuuaagacacu

SEQ ID NO: 419381 - RNA, 23 nt, Homo sapiens
cuguccuugucgcugugcccugg

SEQ ID NO: 419382 - RNA, 22 nt, Homo sapiens
cuguccuuuuggcacugagaua

SEQ ID NO: 419383 - RNA, 13 nt, Homo sapiens
cugucguggacac

SEQ ID NO: 419384 - RNA, 22 nt, Homo sapiens
cugucguuccgguuauguugug

SEQ ID NO: 419385 - RNA, 14 nt, Homo sapiens
cugucucagagaua

SEQ ID NO: 419386 - RNA, 18 nt, Homo sapiens
cugucuggaagacauguc

SEQ ID NO: 419387 - RNA, 16 nt, Homo sapiens
cugucugucccaaaga

SEQ ID NO: 419388 - RNA, 16 nt, Homo sapiens
cugucuugucauucca

SEQ ID NO: 419389 - RNA, 23 nt, Homo sapiens
cugugaaacuguuuaggauuuuc

SEQ ID NO: 419390 - RNA, 23 nt, Homo sapiens
cugugaagcccuuugccuguaga

SEQ ID NO: 419391 - RNA, 14 nt, Homo sapiens
cugugaagccuuua

SEQ ID NO: 419392 - RNA, 15 nt, Homo sapiens
cugugaauaaagcca

SEQ ID NO: 419393 - RNA, 17 nt, Homo sapiens
cugugaauaaagccaca

SEQ ID NO: 419394 - RNA, 22 nt, Homo sapiens
cugugaauguaaaacagagcca

SEQ ID NO: 419395 - RNA, 19 nt, Homo sapiens
cugugaccgggguccugag

SEQ ID NO: 419396 - RNA, 18 nt, Homo sapiens
cugugacuuaagaagccu

SEQ ID NO: 419397 - RNA, 19 nt, Homo sapiens
cugugacuuaagaagccuu

SEQ ID NO: 419398 - RNA, 20 nt, Homo sapiens
cugugacuuaagaagccuua

SEQ ID NO: 419399 - RNA, 18 nt, Homo sapiens
cugugagggagugcagaa

SEQ ID NO: 419400 - RNA, 17 nt, Homo sapiens
cugugaugcaugagcuc

SEQ ID NO: 419401 - RNA, 13 nt, Homo sapiens
cugugcacagcca

SEQ ID NO: 419402 - RNA, 19 nt, Homo sapiens
cugugccaggacugugacu

SEQ ID NO: 419403 - RNA, 15 nt, Homo sapiens
cugugcccaucaucu

SEQ ID NO: 419404 - RNA, 23 nt, Homo sapiens
cugugcccaucaucucugccuuu

SEQ ID NO: 419405 - RNA, 17 nt, Homo sapiens
cugugccuaacaccagc

SEQ ID NO: 419406 - RNA, 17 nt, Homo sapiens
cugugccuaucaccucu

SEQ ID NO: 419407 - RNA, 17 nt, Homo sapiens
cugugccucugccuguc

SEQ ID NO: 419408 - RNA, 21 nt, Homo sapiens
cugugcguuuuagaguaugca

SEQ ID NO: 419409 - RNA, 12 nt, Homo sapiens
cugugcucccuc

SEQ ID NO: 419410 - RNA, 16 nt, Homo sapiens
cugugcuccuguggau

SEQ ID NO: 419411 - RNA, 15 nt, Homo sapiens
cuguggaaagcuuug

SEQ ID NO: 419412 - RNA, 20 nt, Homo sapiens
cuguggaugaugguugcaaa

SEQ ID NO: 419413 - RNA, 14 nt, Homo sapiens
cuguggauucuaua

SEQ ID NO: 419414 - RNA, 19 nt, Homo sapiens
cuguggcucuacaacugag

SEQ ID NO: 419415 - RNA, 17 nt, Homo sapiens
cugugguuaacaucuca

SEQ ID NO: 419416 - RNA, 18 nt, Homo sapiens
cugugguuacagugcaga

SEQ ID NO: 419417 - RNA, 21 nt, Homo sapiens
cugugguuugcuccagaauua

SEQ ID NO: 419418 - RNA, 17 nt, Homo sapiens
cuguguagagccugcau

SEQ ID NO: 419419 - RNA, 15 nt, Homo sapiens
cuguguauucuagug

SEQ ID NO: 419420 - RNA, 23 nt, Homo sapiens
cugugucauggugaugcaaguca

SEQ ID NO: 419421 - RNA, 13 nt, Homo sapiens
cugugugacauca

SEQ ID NO: 419422 - RNA, 16 nt, Homo sapiens
cugugugacucugggu

SEQ ID NO: 419423 - RNA, 20 nt, Homo sapiens
cugugugcaagugugugcac

SEQ ID NO: 419424 - RNA, 23 nt, Homo sapiens
cugugugcuccggagaugaauau

SEQ ID NO: 419425 - RNA, 15 nt, Homo sapiens
cuguguggacuguga

SEQ ID NO: 419426 - RNA, 21 nt, Homo sapiens
cuguguggacugugaugccac

SEQ ID NO: 419427 - RNA, 13 nt, Homo sapiens
cuguguguggaag

SEQ ID NO: 419428 - RNA, 17 nt, Homo sapiens
cuguguuccuggcaaua

SEQ ID NO: 419429 - RNA, 16 nt, Homo sapiens
cuguguucuaugcaaa

SEQ ID NO: 419430 - RNA, 18 nt, Homo sapiens
cuguguuuauaugucuug

SEQ ID NO: 419431 - RNA, 15 nt, Homo sapiens
cuguuaauauucuau

SEQ ID NO: 419432 - RNA, 22 nt, Homo sapiens
cuguuacauccugcuacacuca

SEQ ID NO: 419433 - RNA, 14 nt, Homo sapiens
cuguuacccagaga

SEQ ID NO: 419434 - RNA, 13 nt, Homo sapiens
cuguuacccaggc

SEQ ID NO: 419435 - RNA, 13 nt, Homo sapiens
cuguuagagucca

SEQ ID NO: 419436 - RNA, 13 nt, Homo sapiens
cuguuaguauuaa

SEQ ID NO: 419437 - RNA, 19 nt, Homo sapiens
cuguuaguauuaacuauua

SEQ ID NO: 419438 - RNA, 15 nt, Homo sapiens
cuguuaucugcuaga

SEQ ID NO: 419439 - RNA, 19 nt, Homo sapiens
cuguuaucugcuagaucua

SEQ ID NO: 419440 - RNA, 14 nt, Homo sapiens
cuguucacuuugua

SEQ ID NO: 419441 - RNA, 14 nt, Homo sapiens
cuguucccaugaga

SEQ ID NO: 419442 - RNA, 23 nt, Homo sapiens
cuguucgugcuuguaaugcucac

SEQ ID NO: 419443 - RNA, 16 nt, Homo sapiens
cuguucucacauaaca

SEQ ID NO: 419444 - RNA, 21 nt, Homo sapiens
augcuuauguguugcauaaac

SEQ ID NO: 419445 - RNA, 19 nt, Homo sapiens
augcuuugcucaugcgcaa

SEQ ID NO: 419446 - RNA, 17 nt, Homo sapiens
augcuuuuacuaagcac

SEQ ID NO: 419447 - RNA, 19 nt, Homo sapiens
augcuuuuacuaagcacug

SEQ ID NO: 419448 - RNA, 22 nt, Homo sapiens
auggaaaacuuaguuugugaau

SEQ ID NO: 419449 - RNA, 18 nt, Homo sapiens
auggaaagaaugugggau

SEQ ID NO: 419450 - RNA, 20 nt, Homo sapiens
auggaacacacuuggaugca

SEQ ID NO: 419451 - RNA, 16 nt, Homo sapiens
auggaagggccuucuc

SEQ ID NO: 419452 - RNA, 13 nt, Homo sapiens
auggaagugucug

SEQ ID NO: 419453 - RNA, 16 nt, Homo sapiens
auggaauaaagcccuu

SEQ ID NO: 419454 - RNA, 22 nt, Homo sapiens
auggaaugaccagccuguccaa

SEQ ID NO: 419455 - RNA, 15 nt, Homo sapiens
auggaauuacaugua

SEQ ID NO: 419456 - RNA, 21 nt, Homo sapiens
auggacauauucuuuuuggaa

SEQ ID NO: 419457 - RNA, 20 nt, Homo sapiens
auggaccaauuagcauucca

SEQ ID NO: 419458 - RNA, 22 nt, Homo sapiens
auggacucuucccccacuccuc

SEQ ID NO: 419459 - RNA, 17 nt, Homo sapiens
auggacugcacaaaagu

SEQ ID NO: 419460 - RNA, 21 nt, Homo sapiens
auggagaagacuucuuugcaa

SEQ ID NO: 419461 - RNA, 23 nt, Homo sapiens
auggagcccagccccgcccucca

SEQ ID NO: 419462 - RNA, 23 nt, Homo sapiens
auggagcuguauaacugugcaga

SEQ ID NO: 419463 - RNA, 18 nt, Homo sapiens
auggaggaaagugauauc

SEQ ID NO: 419464 - RNA, 17 nt, Homo sapiens
auggaggaauuucuuga

SEQ ID NO: 419465 - RNA, 17 nt, Homo sapiens
auggaggcaugccaaau

SEQ ID NO: 419466 - RNA, 19 nt, Homo sapiens
auggagguucucucggagu

SEQ ID NO: 419467 - RNA, 19 nt, Homo sapiens
auggaguggcugccaugga

SEQ ID NO: 419468 - RNA, 16 nt, Homo sapiens
auggaguguuugacga

SEQ ID NO: 419469 - RNA, 23 nt, Homo sapiens
auggaguuuuacucuuguugccc

SEQ ID NO: 419470 - RNA, 15 nt, Homo sapiens
auggaugcaugcccu

SEQ ID NO: 419471 - RNA, 23 nt, Homo sapiens
auggauggggguuaccuagcccu

SEQ ID NO: 419472 - RNA, 22 nt, Homo sapiens
auggauuaaauggcaccuguau

SEQ ID NO: 419473 - RNA, 13 nt, Homo sapiens
auggauucacuuc

SEQ ID NO: 419474 - RNA, 15 nt, Homo sapiens
auggauucacuucua

SEQ ID NO: 419475 - RNA, 18 nt, Homo sapiens
auggcaacaaacacauug

SEQ ID NO: 419476 - RNA, 20 nt, Homo sapiens
auggcaacaaacacauugug

SEQ ID NO: 419477 - RNA, 13 nt, Homo sapiens
auggcaccuguau

SEQ ID NO: 419478 - RNA, 16 nt, Homo sapiens
auggcagaaccaaagc

SEQ ID NO: 419479 - RNA, 15 nt, Homo sapiens
auggcagucccaaag

SEQ ID NO: 419480 - RNA, 16 nt, Homo sapiens
auggccaaggggccag

SEQ ID NO: 419481 - RNA, 13 nt, Homo sapiens
auggccacuguga

SEQ ID NO: 419482 - RNA, 13 nt, Homo sapiens
auggccagccaac

SEQ ID NO: 419483 - RNA, 14 nt, Homo sapiens
auggccugugcugg

SEQ ID NO: 419484 - RNA, 20 nt, Homo sapiens
auggcuagaacguguuuaau

SEQ ID NO: 419485 - RNA, 18 nt, Homo sapiens
auggcuggaacacuguac

SEQ ID NO: 419486 - RNA, 12 nt, Homo sapiens
auggcugugaaa

SEQ ID NO: 419487 - RNA, 17 nt, Homo sapiens
auggcugugccucugcc

SEQ ID NO: 419488 - RNA, 13 nt, Homo sapiens
auggcuguugaag

SEQ ID NO: 419489 - RNA, 22 nt, Homo sapiens
auggcuuaauguuuauuccuga

SEQ ID NO: 419490 - RNA, 21 nt, Homo sapiens
auggcuuccgugagacacaag

SEQ ID NO: 419491 - RNA, 15 nt, Homo sapiens
augggaaacuuccaa

SEQ ID NO: 419492 - RNA, 14 nt, Homo sapiens
augggaacacuggu

SEQ ID NO: 419493 - RNA, 13 nt, Homo sapiens
augggacugaugu

SEQ ID NO: 419494 - RNA, 16 nt, Homo sapiens
augggaggaucacuug

SEQ ID NO: 419495 - RNA, 19 nt, Homo sapiens
augggagugggcaccucag

SEQ ID NO: 419496 - RNA, 15 nt, Homo sapiens
augggccugccaaac

SEQ ID NO: 419497 - RNA, 17 nt, Homo sapiens
auggggccacagccaga

SEQ ID NO: 419498 - RNA, 16 nt, Homo sapiens
augggggaaguauucc

SEQ ID NO: 419499 - RNA, 18 nt, Homo sapiens
auggggugggguagggcu

SEQ ID NO: 419500 - RNA, 15 nt, Homo sapiens
auggguaacacugau

SEQ ID NO: 419501 - RNA, 18 nt, Homo sapiens
auggguaacacugauuac

SEQ ID NO: 419502 - RNA, 21 nt, Homo sapiens
auggguagcuucugaccucag

SEQ ID NO: 419503 - RNA, 21 nt, Homo sapiens
auggguuguuaauacuauauu

SEQ ID NO: 419504 - RNA, 14 nt, Homo sapiens
augguaacugcaca

SEQ ID NO: 419505 - RNA, 15 nt, Homo sapiens
augguagacugugac

SEQ ID NO: 419506 - RNA, 19 nt, Homo sapiens
augguaggcuacuuuucag

SEQ ID NO: 419507 - RNA, 20 nt, Homo sapiens
augguccauuucaugugauc

SEQ ID NO: 419508 - RNA, 20 nt, Homo sapiens
auggugaaaccccaucucua

SEQ ID NO: 419509 - RNA, 19 nt, Homo sapiens
auggugaaaccccgucucu

SEQ ID NO: 419510 - RNA, 15 nt, Homo sapiens
auggugaacugucau

SEQ ID NO: 419511 - RNA, 20 nt, Homo sapiens
auggugggagagacugugag

SEQ ID NO: 419512 - RNA, 20 nt, Homo sapiens
auggugugugucucugacaa

SEQ ID NO: 419513 - RNA, 15 nt, Homo sapiens
augguuacugaggac

SEQ ID NO: 419514 - RNA, 15 nt, Homo sapiens
augguucccaauaaa

SEQ ID NO: 419515 - RNA, 14 nt, Homo sapiens
augguuuacugcug

SEQ ID NO: 419516 - RNA, 15 nt, Homo sapiens
augguuuacugcugu

SEQ ID NO: 419517 - RNA, 12 nt, Homo sapiens
auguaaauacca

SEQ ID NO: 419518 - RNA, 12 nt, Homo sapiens
auguaaccaagc

SEQ ID NO: 419519 - RNA, 18 nt, Homo sapiens
auguaagaucguucucug

SEQ ID NO: 419520 - RNA, 17 nt, Homo sapiens
auguacaagguauguac

SEQ ID NO: 419521 - RNA, 22 nt, Homo sapiens
auguacacaguuuaaacacauc

SEQ ID NO: 419522 - RNA, 21 nt, Homo sapiens
auguacaugaagaagcuaaau

SEQ ID NO: 419523 - RNA, 16 nt, Homo sapiens
auguaccaguguacug

SEQ ID NO: 419524 - RNA, 17 nt, Homo sapiens
auguaccugaugcuaug

SEQ ID NO: 419525 - RNA, 19 nt, Homo sapiens
auguacuggagaguggcaa

SEQ ID NO: 419526 - RNA, 15 nt, Homo sapiens
auguaggacuguaua

SEQ ID NO: 419527 - RNA, 21 nt, Homo sapiens
auguaguaguuugggugugua

SEQ ID NO: 419528 - RNA, 22 nt, Homo sapiens
auguaguucuuuguuccugcuu

SEQ ID NO: 419529 - RNA, 22 nt, Homo sapiens
auguaucuaccucacuauucaa

SEQ ID NO: 419530 - RNA, 23 nt, Homo sapiens
auguauguugucuucuucaauac

SEQ ID NO: 419531 - RNA, 21 nt, Homo sapiens
auguauuaagauggucauauu

SEQ ID NO: 419532 - RNA, 13 nt, Homo sapiens
auguauuaugcaa

SEQ ID NO: 419533 - RNA, 18 nt, Homo sapiens
auguauuuugaaaacacu

SEQ ID NO: 419534 - RNA, 19 nt, Homo sapiens
augucaaauaaagcaaagu

SEQ ID NO: 419535 - RNA, 22 nt, Homo sapiens
augucaacuucuggcuccucaa

SEQ ID NO: 419536 - RNA, 15 nt, Homo sapiens
augucaccaagaagg

SEQ ID NO: 419537 - RNA, 16 nt, Homo sapiens
augucaguagugccag

SEQ ID NO: 419538 - RNA, 16 nt, Homo sapiens
augucagucuacaggc

SEQ ID NO: 419539 - RNA, 16 nt, Homo sapiens
augucagugugacuga

SEQ ID NO: 419540 - RNA, 19 nt, Homo sapiens
auguccauuauucaagaaa

SEQ ID NO: 419541 - RNA, 17 nt, Homo sapiens
auguccauuuauaucau

SEQ ID NO: 419542 - RNA, 19 nt, Homo sapiens
augucccagccccugguac

SEQ ID NO: 419543 - RNA, 13 nt, Homo sapiens
augucccaugacc

SEQ ID NO: 419544 - RNA, 17 nt, Homo sapiens
auguccuguggugacag

SEQ ID NO: 419545 - RNA, 17 nt, Homo sapiens
augucuagauaacauuc

SEQ ID NO: 419546 - RNA, 14 nt, Homo sapiens
augucuagcuuuca

SEQ ID NO: 419547 - RNA, 16 nt, Homo sapiens
augucucuaaagcacu

SEQ ID NO: 419548 - RNA, 22 nt, Homo sapiens
augucucuacccacuaugcaca

SEQ ID NO: 419549 - RNA, 16 nt, Homo sapiens
augucucuuguagaag

SEQ ID NO: 419550 - RNA, 19 nt, Homo sapiens
augucugcaaaggagggcc

SEQ ID NO: 419551 - RNA, 23 nt, Homo sapiens
augucuguuucaaugaccuguau

SEQ ID NO: 419552 - RNA, 20 nt, Homo sapiens
augucuuaaauaaaacuauu

SEQ ID NO: 419553 - RNA, 17 nt, Homo sapiens
augucuucauaauauaa

SEQ ID NO: 419554 - RNA, 18 nt, Homo sapiens
augucuugcaaagccuuu

SEQ ID NO: 419555 - RNA, 20 nt, Homo sapiens
augucuugcaaagccuuuaa

SEQ ID NO: 419556 - RNA, 14 nt, Homo sapiens
augucuuuaaaaug

SEQ ID NO: 419557 - RNA, 16 nt, Homo sapiens
augugaaaaauguguc

SEQ ID NO: 419558 - RNA, 18 nt, Homo sapiens
augugaaucgcaaggccu

SEQ ID NO: 419559 - RNA, 21 nt, Homo sapiens
augugaccagacugcacagga

SEQ ID NO: 419560 - RNA, 19 nt, Homo sapiens
augugacccaccagugccu

SEQ ID NO: 419561 - RNA, 21 nt, Homo sapiens
augugacuugagcccagagug

SEQ ID NO: 419562 - RNA, 23 nt, Homo sapiens
augugagaccauuuagcacacug

SEQ ID NO: 419563 - RNA, 15 nt, Homo sapiens
augugauauguguaa

SEQ ID NO: 419564 - RNA, 20 nt, Homo sapiens
augugcaaagucaucaaaga

SEQ ID NO: 419565 - RNA, 13 nt, Homo sapiens
augugccauuuau

SEQ ID NO: 419566 - RNA, 19 nt, Homo sapiens
augugccauuuaugugagu

SEQ ID NO: 419567 - RNA, 21 nt, Homo sapiens
augugcccaguuaaucuugcu

SEQ ID NO: 419568 - RNA, 14 nt, Homo sapiens
augugccuagacac

SEQ ID NO: 419569 - RNA, 15 nt, Homo sapiens
augugcugcaaagag

SEQ ID NO: 419570 - RNA, 19 nt, Homo sapiens
auguggaaaacucacagau

SEQ ID NO: 419571 - RNA, 19 nt, Homo sapiens
auguggaauuacauaacag

SEQ ID NO: 419572 - RNA, 20 nt, Homo sapiens
auguggaccucuacuuucca

SEQ ID NO: 419573 - RNA, 21 nt, Homo sapiens
auguggagcucagcaacaagg

SEQ ID NO: 419574 - RNA, 17 nt, Homo sapiens
auguggcacacaauccu

SEQ ID NO: 419575 - RNA, 18 nt, Homo sapiens
cuguucugggugcagcug

SEQ ID NO: 419576 - RNA, 23 nt, Homo sapiens
cuguugaaggacuacagguauuu

SEQ ID NO: 419577 - RNA, 19 nt, Homo sapiens
cuguugagacugauucaga

SEQ ID NO: 419578 - RNA, 14 nt, Homo sapiens
cuguugaugccguu

SEQ ID NO: 419579 - RNA, 19 nt, Homo sapiens
cuguugauucgucugcgau

SEQ ID NO: 419580 - RNA, 16 nt, Homo sapiens
cuguugcccauugcac

SEQ ID NO: 419581 - RNA, 22 nt, Homo sapiens
cuguuggaagggggucacuuaa

SEQ ID NO: 419582 - RNA, 19 nt, Homo sapiens
cuguuggccccucugcugu

SEQ ID NO: 419583 - RNA, 19 nt, Homo sapiens
cuguuuccauagggugaca

SEQ ID NO: 419584 - RNA, 19 nt, Homo sapiens
cuguuugauacaguauuau

SEQ ID NO: 419585 - RNA, 15 nt, Homo sapiens
cuguuuucaccaucu

SEQ ID NO: 419586 - RNA, 15 nt, Homo sapiens
cuguuuugccuucac

SEQ ID NO: 419587 - RNA, 17 nt, Homo sapiens
cuguuuuuguaguggua

SEQ ID NO: 419588 - RNA, 23 nt, Homo sapiens
cuuaaaauagaaauaagugguua

SEQ ID NO: 419589 - RNA, 19 nt, Homo sapiens
cuuaaaauuaauaaaucau

SEQ ID NO: 419590 - RNA, 20 nt, Homo sapiens
cuuaaacagcagauuucaga

SEQ ID NO: 419591 - RNA, 20 nt, Homo sapiens
cuuaaacuuugucacuucug

SEQ ID NO: 419592 - RNA, 20 nt, Homo sapiens
cuuaaagcauuccccaaaga

SEQ ID NO: 419593 - RNA, 21 nt, Homo sapiens
cuuaaaggcaccaucuaauag

SEQ ID NO: 419594 - RNA, 23 nt, Homo sapiens
cuuaaaggccuggaaccagggag

SEQ ID NO: 419595 - RNA, 23 nt, Homo sapiens
cuuaaauaauaaacaguggaaua

SEQ ID NO: 419596 - RNA, 20 nt, Homo sapiens
cuuaaauauguggaguucau

SEQ ID NO: 419597 - RNA, 23 nt, Homo sapiens
cuuaaaugaaaaaaaugaucuau

SEQ ID NO: 419598 - RNA, 23 nt, Homo sapiens
cuuaaauuuugugauauggagcc

SEQ ID NO: 419599 - RNA, 20 nt, Homo sapiens
cuuaacaacagcuucuugcu

SEQ ID NO: 419600 - RNA, 13 nt, Homo sapiens
cuuaacaugcugu

SEQ ID NO: 419601 - RNA, 13 nt, Homo sapiens
cuuaaccccagua

SEQ ID NO: 419602 - RNA, 18 nt, Homo sapiens
cuuaacuaauuugaaugu

SEQ ID NO: 419603 - RNA, 16 nt, Homo sapiens
cuuaacuauccuaaca

SEQ ID NO: 419604 - RNA, 20 nt, Homo sapiens
cuuaacuuguuugguaguua

SEQ ID NO: 419605 - RNA, 21 nt, Homo sapiens
cuuaagcauuugcguauguaa

SEQ ID NO: 419606 - RNA, 15 nt, Homo sapiens
cuuaaguaucagaaa

SEQ ID NO: 419607 - RNA, 17 nt, Homo sapiens
cuuaauaaacucacaac

SEQ ID NO: 419608 - RNA, 21 nt, Homo sapiens
cuuaauaaacucacaacucuc

SEQ ID NO: 419609 - RNA, 14 nt, Homo sapiens
cuuaauaggcuuua

SEQ ID NO: 419610 - RNA, 14 nt, Homo sapiens
cuuaaucauaucaa

SEQ ID NO: 419611 - RNA, 20 nt, Homo sapiens
cuuaaugccaaguaacaaug

SEQ ID NO: 419612 - RNA, 16 nt, Homo sapiens
cuuaaugguagcaacu

SEQ ID NO: 419613 - RNA, 18 nt, Homo sapiens
cuuaauuaugcuaacaaa

SEQ ID NO: 419614 - RNA, 17 nt, Homo sapiens
cuuaauuccuuucucau

SEQ ID NO: 419615 - RNA, 14 nt, Homo sapiens
cuuaauucugaugc

SEQ ID NO: 419616 - RNA, 18 nt, Homo sapiens
cuuaauugugaacagcca

SEQ ID NO: 419617 - RNA, 17 nt, Homo sapiens
cuuaauuucuaaagaua

SEQ ID NO: 419618 - RNA, 15 nt, Homo sapiens
cuuacaaaacauuuu

SEQ ID NO: 419619 - RNA, 18 nt, Homo sapiens
cuuacacuuuaugcacaa

SEQ ID NO: 419620 - RNA, 21 nt, Homo sapiens
cuuaccagaucuaauauugac

SEQ ID NO: 419621 - RNA, 17 nt, Homo sapiens
cuuaccgugggcacuga

SEQ ID NO: 419622 - RNA, 17 nt, Homo sapiens
cuuacuaaugugcccca

SEQ ID NO: 419623 - RNA, 14 nt, Homo sapiens
cuuacuacuuuaaa

SEQ ID NO: 419624 - RNA, 16 nt, Homo sapiens
cuuacuagaccuguaa

SEQ ID NO: 419625 - RNA, 23 nt, Homo sapiens
cuuacugcuugguccuugauuua

SEQ ID NO: 419626 - RNA, 15 nt, Homo sapiens
cuuacuuaaccugaa

SEQ ID NO: 419627 - RNA, 19 nt, Homo sapiens
cuuacuuaaccugaagcua

SEQ ID NO: 419628 - RNA, 16 nt, Homo sapiens
cuuacuuagcaugcac

SEQ ID NO: 419629 - RNA, 20 nt, Homo sapiens
cuuacuuagcaugcacaaag

SEQ ID NO: 419630 - RNA, 15 nt, Homo sapiens
cuuacuuugugcaaa

SEQ ID NO: 419631 - RNA, 20 nt, Homo sapiens
cuuagaaaucauuguagaaa

SEQ ID NO: 419632 - RNA, 16 nt, Homo sapiens
cuuagaauacuguauu

SEQ ID NO: 419633 - RNA, 13 nt, Homo sapiens
cuuagacacugug

SEQ ID NO: 419634 - RNA, 10 nt, Homo sapiens
cuuagacauu

SEQ ID NO: 419635 - RNA, 14 nt, Homo sapiens
cuuagaggcaaaga

SEQ ID NO: 419636 - RNA, 15 nt, Homo sapiens
cuuagcaugcacaaa

SEQ ID NO: 419637 - RNA, 14 nt, Homo sapiens
cuuagccccaugag

SEQ ID NO: 419638 - RNA, 18 nt, Homo sapiens
cuuagcccuguguccuga

SEQ ID NO: 419639 - RNA, 21 nt, Homo sapiens
cuuagcucacaccugaccaau

SEQ ID NO: 419640 - RNA, 17 nt, Homo sapiens
cuuagcuuuucugcaau

SEQ ID NO: 419641 - RNA, 22 nt, Homo sapiens
cuuagcuuuucugcaauucaac

SEQ ID NO: 419642 - RNA, 20 nt, Homo sapiens
cuuaggcuuacaaugugcac

SEQ ID NO: 419643 - RNA, 11 nt, Homo sapiens
cuuaggugcca

SEQ ID NO: 419644 - RNA, 22 nt, Homo sapiens
cuuagguuggagaugacagaaa

SEQ ID NO: 419645 - RNA, 17 nt, Homo sapiens
cuuagucacuuauuuca

SEQ ID NO: 419646 - RNA, 19 nt, Homo sapiens
cuuauaagaaaacauguaa

SEQ ID NO: 419647 - RNA, 19 nt, Homo sapiens
cuuauaccagguuaccuca

SEQ ID NO: 419648 - RNA, 16 nt, Homo sapiens
cuuauauuucccuaaa

SEQ ID NO: 419649 - RNA, 22 nt, Homo sapiens
cuuaucucccugcuucauaucu

SEQ ID NO: 419650 - RNA, 17 nt, Homo sapiens
cuuaucugugcgugaaa

SEQ ID NO: 419651 - RNA, 23 nt, Homo sapiens
cuuaucuuaggauuuaccaaaua

SEQ ID NO: 419652 - RNA, 16 nt, Homo sapiens
cuuaugauauucucau

SEQ ID NO: 419653 - RNA, 17 nt, Homo sapiens
cuuauggaaagguccug

SEQ ID NO: 419654 - RNA, 18 nt, Homo sapiens
cuuaugggcccagccagc

SEQ ID NO: 419655 - RNA, 18 nt, Homo sapiens
cuuauguaugccuauuca

SEQ ID NO: 419656 - RNA, 12 nt, Homo sapiens
cuuauuuuacac

SEQ ID NO: 419657 - RNA, 20 nt, Homo sapiens
cuucaaaaauuaaaauccag

SEQ ID NO: 419658 - RNA, 17 nt, Homo sapiens
cuucaaccccaugagac

SEQ ID NO: 419659 - RNA, 14 nt, Homo sapiens
cuucaauacuuaaa

SEQ ID NO: 419660 - RNA, 21 nt, Homo sapiens
cuucaaucucuugcacucaaa

SEQ ID NO: 419661 - RNA, 20 nt, Homo sapiens
cuucaaugaacugugcuuuu

SEQ ID NO: 419662 - RNA, 17 nt, Homo sapiens
cuucaaugcaaaauaca

SEQ ID NO: 419663 - RNA, 16 nt, Homo sapiens
cuucaaugcuagaaaa

SEQ ID NO: 419664 - RNA, 17 nt, Homo sapiens
cuucacaccauaacuag

SEQ ID NO: 419665 - RNA, 20 nt, Homo sapiens
cuucacaggcuauucuacuu

SEQ ID NO: 419666 - RNA, 12 nt, Homo sapiens
cuucaccaccuc

SEQ ID NO: 419667 - RNA, 14 nt, Homo sapiens
cuucaccucugaaa

SEQ ID NO: 419668 - RNA, 20 nt, Homo sapiens
cuucagaaaagacacuucaa

SEQ ID NO: 419669 - RNA, 18 nt, Homo sapiens
cuucagagggaaacucag

SEQ ID NO: 419670 - RNA, 16 nt, Homo sapiens
cuucagaguacaucca

SEQ ID NO: 419671 - RNA, 23 nt, Homo sapiens
cuucagcagcuagagcucaguau

SEQ ID NO: 419672 - RNA, 21 nt, Homo sapiens
cuucagccucauucacugucc

SEQ ID NO: 419673 - RNA, 20 nt, Homo sapiens
cuucaggagaugaugugaug

SEQ ID NO: 419674 - RNA, 21 nt, Homo sapiens
cuucaguggugagacuguauc

SEQ ID NO: 419675 - RNA, 12 nt, Homo sapiens
cuucaguguguu

SEQ ID NO: 419676 - RNA, 20 nt, Homo sapiens
cuucaguguguugacuucua

SEQ ID NO: 419677 - RNA, 21 nt, Homo sapiens
cuucauaagauauucuuuaca

SEQ ID NO: 419678 - RNA, 22 nt, Homo sapiens
cuucauaagauauucuuuacaa

SEQ ID NO: 419679 - RNA, 19 nt, Homo sapiens
cuucauauaccagcaauau

SEQ ID NO: 419680 - RNA, 22 nt, Homo sapiens
cuucauccucugagugugacca

SEQ ID NO: 419681 - RNA, 19 nt, Homo sapiens
cuucauccuuagcaacagc

SEQ ID NO: 419682 - RNA, 18 nt, Homo sapiens
cuucaucuucacugcaau

SEQ ID NO: 419683 - RNA, 12 nt, Homo sapiens
cuucaugagcac

SEQ ID NO: 419684 - RNA, 15 nt, Homo sapiens
cuucaugcaaugaca

SEQ ID NO: 419685 - RNA, 16 nt, Homo sapiens
cuucauuuuuccuaac

SEQ ID NO: 419686 - RNA, 17 nt, Homo sapiens
cuuccaaagagucauca

SEQ ID NO: 419687 - RNA, 21 nt, Homo sapiens
cuuccaauuuacauacucugc

SEQ ID NO: 419688 - RNA, 14 nt, Homo sapiens
cuuccagauuacaa

SEQ ID NO: 419689 - RNA, 15 nt, Homo sapiens
cuuccaguugcuugc

SEQ ID NO: 419690 - RNA, 20 nt, Homo sapiens
cuuccauggugcccuguugg

SEQ ID NO: 419691 - RNA, 16 nt, Homo sapiens
cuuccauuugugugug

SEQ ID NO: 419692 - RNA, 19 nt, Homo sapiens
cuucccaacucacugugcu

SEQ ID NO: 419693 - RNA, 20 nt, Homo sapiens
cuucccaagcagcugggauu

SEQ ID NO: 419694 - RNA, 17 nt, Homo sapiens
cuucccacuuugccacu

SEQ ID NO: 419695 - RNA, 20 nt, Homo sapiens
cuucccccaugugccuguca

SEQ ID NO: 419696 - RNA, 22 nt, Homo sapiens
cuucccgaguaacugagauuac

SEQ ID NO: 419697 - RNA, 16 nt, Homo sapiens
cuucccuaguucuuug

SEQ ID NO: 419698 - RNA, 20 nt, Homo sapiens
cuucccugcucagcuucugc

SEQ ID NO: 419699 - RNA, 16 nt, Homo sapiens
cuuccgugagacacaa

SEQ ID NO: 419700 - RNA, 19 nt, Homo sapiens
cuuccgugggucaucccag

SEQ ID NO: 419701 - RNA, 20 nt, Homo sapiens
cuuccuccugauggccaaga

SEQ ID NO: 419702 - RNA, 15 nt, Homo sapiens
cuuccucuccacugc

SEQ ID NO: 419703 - RNA, 19 nt, Homo sapiens
cuuccugaguggugccaaa

SEQ ID NO: 419704 - RNA, 20 nt, Homo sapiens
cuuccugaguggugccaaac

SEQ ID NO: 419705 - RNA, 22 nt, Homo sapiens
cuuccugcaaagggaacugaag

SEQ ID NO: 419706 - RNA, 12 nt, Homo sapiens
auguggcagcug

SEQ ID NO: 419707 - RNA, 14 nt, Homo sapiens
auguggcauguuca

SEQ ID NO: 419708 - RNA, 18 nt, Homo sapiens
auguggccgaggacuuug

SEQ ID NO: 419709 - RNA, 21 nt, Homo sapiens
auguggguagucauucuuaca

SEQ ID NO: 419710 - RNA, 20 nt, Homo sapiens
augugggugucagucaggga

SEQ ID NO: 419711 - RNA, 21 nt, Homo sapiens
augugggugucagucagggac

SEQ ID NO: 419712 - RNA, 16 nt, Homo sapiens
auguguaugugccauu

SEQ ID NO: 419713 - RNA, 12 nt, Homo sapiens
augugucagcca

SEQ ID NO: 419714 - RNA, 14 nt, Homo sapiens
augugucccaguga

SEQ ID NO: 419715 - RNA, 13 nt, Homo sapiens
augugucuuacca

SEQ ID NO: 419716 - RNA, 20 nt, Homo sapiens
augugugagaauaaacuaga

SEQ ID NO: 419717 - RNA, 14 nt, Homo sapiens
augugugagugugu

SEQ ID NO: 419718 - RNA, 16 nt, Homo sapiens
auguguggauguguaa

SEQ ID NO: 419719 - RNA, 20 nt, Homo sapiens
auguguguuguccuucagca

SEQ ID NO: 419720 - RNA, 15 nt, Homo sapiens
auguguugcuauccu

SEQ ID NO: 419721 - RNA, 16 nt, Homo sapiens
auguguugcuuuggau

SEQ ID NO: 419722 - RNA, 23 nt, Homo sapiens
auguguuucagguggaacaggag

SEQ ID NO: 419723 - RNA, 18 nt, Homo sapiens
auguuaagcucuuuauga

SEQ ID NO: 419724 - RNA, 17 nt, Homo sapiens
auguuacacuaagggug

SEQ ID NO: 419725 - RNA, 14 nt, Homo sapiens
auguuaccuucaca

SEQ ID NO: 419726 - RNA, 17 nt, Homo sapiens
auguuaccuucacaugu

SEQ ID NO: 419727 - RNA, 21 nt, Homo sapiens
auguuagauuccucuugccuc

SEQ ID NO: 419728 - RNA, 16 nt, Homo sapiens
auguuaguagcacuga

SEQ ID NO: 419729 - RNA, 18 nt, Homo sapiens
auguuauccaacuauuaa

SEQ ID NO: 419730 - RNA, 24 nt, Homo sapiens
auguuauuggaagcugauucccag

SEQ ID NO: 419731 - RNA, 14 nt, Homo sapiens
auguucauuuguac

SEQ ID NO: 419732 - RNA, 17 nt, Homo sapiens
auguuccauccuguaca

SEQ ID NO: 419733 - RNA, 12 nt, Homo sapiens
auguucucaugu

SEQ ID NO: 419734 - RNA, 15 nt, Homo sapiens
auguugaccuuugag

SEQ ID NO: 419735 - RNA, 20 nt, Homo sapiens
auguugcuuucuuaucccag

SEQ ID NO: 419736 - RNA, 17 nt, Homo sapiens
auguuguuuuaggggcu

SEQ ID NO: 419737 - RNA, 15 nt, Homo sapiens
auguuuaaaagcaua

SEQ ID NO: 419738 - RNA, 23 nt, Homo sapiens
auguuuaugauaauaaaggcacc

SEQ ID NO: 419739 - RNA, 21 nt, Homo sapiens
auguuucaagaaaauggauuu

SEQ ID NO: 419740 - RNA, 22 nt, Homo sapiens
auguuugcuauugacaagucau

SEQ ID NO: 419741 - RNA, 23 nt, Homo sapiens
auguuugcugcucuauauuacaa

SEQ ID NO: 419742 - RNA, 12 nt, Homo sapiens
auuaaaauaaga

SEQ ID NO: 419743 - RNA, 18 nt, Homo sapiens
auuaaaaucacucucagu

SEQ ID NO: 419744 - RNA, 22 nt, Homo sapiens
auuaaaaugucggauuuaucuu

SEQ ID NO: 419745 - RNA, 13 nt, Homo sapiens
auuaaacaccuga

SEQ ID NO: 419746 - RNA, 19 nt, Homo sapiens
auuaaacaccugacacauc

SEQ ID NO: 419747 - RNA, 12 nt, Homo sapiens
auuaaacacugu

SEQ ID NO: 419748 - RNA, 13 nt, Homo sapiens
auuaaacacugua

SEQ ID NO: 419749 - RNA, 15 nt, Homo sapiens
auuaaauaaaucauu

SEQ ID NO: 419750 - RNA, 19 nt, Homo sapiens
auuaaauucucucuaacau

SEQ ID NO: 419751 - RNA, 22 nt, Homo sapiens
auuaaauuuuaauguaaaauuc

SEQ ID NO: 419752 - RNA, 14 nt, Homo sapiens
auuaacaucaaaga

SEQ ID NO: 419753 - RNA, 13 nt, Homo sapiens
auuaaccaaagaa

SEQ ID NO: 419754 - RNA, 13 nt, Homo sapiens
auuaaccucagca

SEQ ID NO: 419755 - RNA, 12 nt, Homo sapiens
auuaacuugagu

SEQ ID NO: 419756 - RNA, 15 nt, Homo sapiens
auuaagacaugcacu

SEQ ID NO: 419757 - RNA, 14 nt, Homo sapiens
auuaagauggucau

SEQ ID NO: 419758 - RNA, 17 nt, Homo sapiens
auuaaguccuacuuuac

SEQ ID NO: 419759 - RNA, 13 nt, Homo sapiens
auuaaguuaucuu

SEQ ID NO: 419760 - RNA, 18 nt, Homo sapiens
auuaaguucucaauguga

SEQ ID NO: 419761 - RNA, 23 nt, Homo sapiens
auuaaucagaaaccccacuucca

SEQ ID NO: 419762 - RNA, 17 nt, Homo sapiens
auuaaucucuaaaauuc

SEQ ID NO: 419763 - RNA, 21 nt, Homo sapiens
auuaaucuucagcugaacaca

SEQ ID NO: 419764 - RNA, 23 nt, Homo sapiens
auuaaucuucagcugaacacaag

SEQ ID NO: 419765 - RNA, 17 nt, Homo sapiens
auuaauuauaccagugu

SEQ ID NO: 419766 - RNA, 16 nt, Homo sapiens
auuacaaaaacauggc

SEQ ID NO: 419767 - RNA, 17 nt, Homo sapiens
auuacaaaaacauggcc

SEQ ID NO: 419768 - RNA, 14 nt, Homo sapiens
auuacaaauuuuca

SEQ ID NO: 419769 - RNA, 23 nt, Homo sapiens
auuacaaauuuucacugcugcuc

SEQ ID NO: 419770 - RNA, 17 nt, Homo sapiens
auuacaaccgguuauca

SEQ ID NO: 419771 - RNA, 15 nt, Homo sapiens
auuacagacaugaac

SEQ ID NO: 419772 - RNA, 18 nt, Homo sapiens
auuacaggcgugagccac

SEQ ID NO: 419773 - RNA, 21 nt, Homo sapiens
auuacaggcgugauccaccac

SEQ ID NO: 419774 - RNA, 12 nt, Homo sapiens
auuacauaacag

SEQ ID NO: 419775 - RNA, 16 nt, Homo sapiens
auuacauggcuguggu

SEQ ID NO: 419776 - RNA, 19 nt, Homo sapiens
auuaccugucaucugggcc

SEQ ID NO: 419777 - RNA, 23 nt, Homo sapiens
auuacuaguacuauuacuaguac

SEQ ID NO: 419778 - RNA, 14 nt, Homo sapiens
auuacucaccaaaa

SEQ ID NO: 419779 - RNA, 15 nt, Homo sapiens
auuacugaaagggag

SEQ ID NO: 419780 - RNA, 16 nt, Homo sapiens
auuacugaugugugca

SEQ ID NO: 419781 - RNA, 13 nt, Homo sapiens
auuacugucuuua

SEQ ID NO: 419782 - RNA, 17 nt, Homo sapiens
auuacuuuaauacucac

SEQ ID NO: 419783 - RNA, 21 nt, Homo sapiens
auuagaaacacacuuuugcac

SEQ ID NO: 419784 - RNA, 20 nt, Homo sapiens
auuagaaauaaagcaucuca

SEQ ID NO: 419785 - RNA, 14 nt, Homo sapiens
auuagaaauaucuu

SEQ ID NO: 419786 - RNA, 13 nt, Homo sapiens
auuagaagccaag

SEQ ID NO: 419787 - RNA, 14 nt, Homo sapiens
auuagacaaugugg

SEQ ID NO: 419788 - RNA, 19 nt, Homo sapiens
auuagagaaugauuucaaa

SEQ ID NO: 419789 - RNA, 21 nt, Homo sapiens
auuagcccacugccuggaaag

SEQ ID NO: 419790 - RNA, 18 nt, Homo sapiens
auuagccuguagcuuaua

SEQ ID NO: 419791 - RNA, 17 nt, Homo sapiens
auuagcuuacugauuaa

SEQ ID NO: 419792 - RNA, 16 nt, Homo sapiens
auuaggacuggcuuug

SEQ ID NO: 419793 - RNA, 23 nt, Homo sapiens
auuaggcuuuuaagaaacacagg

SEQ ID NO: 419794 - RNA, 22 nt, Homo sapiens
auuagguagaugagaaaacagg

SEQ ID NO: 419795 - RNA, 13 nt, Homo sapiens
auuaguggcacuu

SEQ ID NO: 419796 - RNA, 14 nt, Homo sapiens
auuaguuucaggca

SEQ ID NO: 419797 - RNA, 19 nt, Homo sapiens
auuaguuugaagcauugac

SEQ ID NO: 419798 - RNA, 23 nt, Homo sapiens
auuaucaccuuccccucacacuc

SEQ ID NO: 419799 - RNA, 16 nt, Homo sapiens
auuauccuguuacuga

SEQ ID NO: 419800 - RNA, 20 nt, Homo sapiens
auuaucuaguaggucugcac

SEQ ID NO: 419801 - RNA, 18 nt, Homo sapiens
auuauggaauuacucuac

SEQ ID NO: 419802 - RNA, 11 nt, Homo sapiens
auuauggugaa

SEQ ID NO: 419803 - RNA, 15 nt, Homo sapiens
auuauguauguuuac

SEQ ID NO: 419804 - RNA, 14 nt, Homo sapiens
auuauguuuccuaa

SEQ ID NO: 419805 - RNA, 12 nt, Homo sapiens
auuauuccugca

SEQ ID NO: 419806 - RNA, 16 nt, Homo sapiens
auuauucucugaugca

SEQ ID NO: 419807 - RNA, 22 nt, Homo sapiens
auuauuguuccccuaaguggau

SEQ ID NO: 419808 - RNA, 23 nt, Homo sapiens
auuauuuacugacauauaucuau

SEQ ID NO: 419809 - RNA, 14 nt, Homo sapiens
auuauuuaucacau

SEQ ID NO: 419810 - RNA, 17 nt, Homo sapiens
auuauuuuaagcacuug

SEQ ID NO: 419811 - RNA, 21 nt, Homo sapiens
auuauuuuugcucugcucugu

SEQ ID NO: 419812 - RNA, 16 nt, Homo sapiens
auucaaaauaguucua

SEQ ID NO: 419813 - RNA, 22 nt, Homo sapiens
auucaaaccuaaguugcuggac

SEQ ID NO: 419814 - RNA, 13 nt, Homo sapiens
auucaaagcucua

SEQ ID NO: 419815 - RNA, 12 nt, Homo sapiens
auucaaaugcau

SEQ ID NO: 419816 - RNA, 14 nt, Homo sapiens
auucaaccacugua

SEQ ID NO: 419817 - RNA, 21 nt, Homo sapiens
auucaacucuccaauguucua

SEQ ID NO: 419818 - RNA, 18 nt, Homo sapiens
auucaagaaagauaucua

SEQ ID NO: 419819 - RNA, 13 nt, Homo sapiens
auucaaguguaca

SEQ ID NO: 419820 - RNA, 19 nt, Homo sapiens
auucaauaaaaugcacuga

SEQ ID NO: 419821 - RNA, 18 nt, Homo sapiens
auucacaaaauuuccaca

SEQ ID NO: 419822 - RNA, 13 nt, Homo sapiens
auucacaccucac

SEQ ID NO: 419823 - RNA, 22 nt, Homo sapiens
auucaccaacaacagucagcca

SEQ ID NO: 419824 - RNA, 14 nt, Homo sapiens
auucaccaucaugu

SEQ ID NO: 419825 - RNA, 22 nt, Homo sapiens
auucaccuagagucuagaacac

SEQ ID NO: 419826 - RNA, 14 nt, Homo sapiens
auucaccuguaaaa

SEQ ID NO: 419827 - RNA, 13 nt, Homo sapiens
auucacuacaggu

SEQ ID NO: 419828 - RNA, 21 nt, Homo sapiens
auucagaugcaagagaacaau

SEQ ID NO: 419829 - RNA, 22 nt, Homo sapiens
auucagcauuauuccuccagga

SEQ ID NO: 419830 - RNA, 21 nt, Homo sapiens
auucaggacuuaacggcucca

SEQ ID NO: 419831 - RNA, 20 nt, Homo sapiens
auucauacccacacacccag

SEQ ID NO: 419832 - RNA, 22 nt, Homo sapiens
auucauauuuacuucuuauaca

SEQ ID NO: 419833 - RNA, 20 nt, Homo sapiens
auucauuuaaaaugauuaga

SEQ ID NO: 419834 - RNA, 16 nt, Homo sapiens
auuccaaucauuguua

SEQ ID NO: 419835 - RNA, 14 nt, Homo sapiens
auuccacacuacca

SEQ ID NO: 419836 - RNA, 18 nt, Homo sapiens
auuccacagggauaccuu

SEQ ID NO: 419837 - RNA, 22 nt, Homo sapiens
auuccacauccccaccuuccaa

SEQ ID NO: 419838 - RNA, 20 nt, Homo sapiens
cuuccuggcuccaacacugc

SEQ ID NO: 419839 - RNA, 16 nt, Homo sapiens
cuuccuguccagagag

SEQ ID NO: 419840 - RNA, 16 nt, Homo sapiens
cuuccugugacuucag

SEQ ID NO: 419841 - RNA, 19 nt, Homo sapiens
cuuccuucucuacucaugc

SEQ ID NO: 419842 - RNA, 12 nt, Homo sapiens
cuuccuugcucu

SEQ ID NO: 419843 - RNA, 18 nt, Homo sapiens
cuuccuuuuguauccucc

SEQ ID NO: 419844 - RNA, 16 nt, Homo sapiens
cuucggaauccagugc

SEQ ID NO: 419845 - RNA, 23 nt, Homo sapiens
cuucgggaagagaggaguucaau

SEQ ID NO: 419846 - RNA, 12 nt, Homo sapiens
cuucgguuugua

SEQ ID NO: 419847 - RNA, 22 nt, Homo sapiens
cuucgguuuguauuuagugucu

SEQ ID NO: 419848 - RNA, 18 nt, Homo sapiens
cuucuaaguguacuucau

SEQ ID NO: 419849 - RNA, 16 nt, Homo sapiens
cuucuaauccaugugc

SEQ ID NO: 419850 - RNA, 16 nt, Homo sapiens
cuucuacaauuguggu

SEQ ID NO: 419851 - RNA, 17 nt, Homo sapiens
cuucuaccuuccugcaa

SEQ ID NO: 419852 - RNA, 19 nt, Homo sapiens
cuucuaugguugacauugu

SEQ ID NO: 419853 - RNA, 20 nt, Homo sapiens
cuucuaugguugacauugua

SEQ ID NO: 419854 - RNA, 20 nt, Homo sapiens
cuucuauuuauuuauuauua

SEQ ID NO: 419855 - RNA, 21 nt, Homo sapiens
cuucucaagcacugacacuca

SEQ ID NO: 419856 - RNA, 17 nt, Homo sapiens
cuucucaagugccuuaa

SEQ ID NO: 419857 - RNA, 16 nt, Homo sapiens
cuucucacaucugucc

SEQ ID NO: 419858 - RNA, 12 nt, Homo sapiens
cuucucagggac

SEQ ID NO: 419859 - RNA, 23 nt, Homo sapiens
cuucucaguagaaaggaacagaa

SEQ ID NO: 419860 - RNA, 14 nt, Homo sapiens
cuucucauagcauu

SEQ ID NO: 419861 - RNA, 17 nt, Homo sapiens
cuucuccaaaugagauc

SEQ ID NO: 419862 - RNA, 17 nt, Homo sapiens
cuucuccacaaccuccu

SEQ ID NO: 419863 - RNA, 14 nt, Homo sapiens
cuucuccacuggau

SEQ ID NO: 419864 - RNA, 12 nt, Homo sapiens
cuucuccauaaa

SEQ ID NO: 419865 - RNA, 14 nt, Homo sapiens
cuucuccaugagac

SEQ ID NO: 419866 - RNA, 19 nt, Homo sapiens
cuucuccccugcacuguaa

SEQ ID NO: 419867 - RNA, 13 nt, Homo sapiens
cuucucuagacau

SEQ ID NO: 419868 - RNA, 22 nt, Homo sapiens
cuucucuauugggcacagccua

SEQ ID NO: 419869 - RNA, 16 nt, Homo sapiens
cuucucuucuauccug

SEQ ID NO: 419870 - RNA, 14 nt, Homo sapiens
cuucugaagaucuc

SEQ ID NO: 419871 - RNA, 15 nt, Homo sapiens
cuucugaaugcugcu

SEQ ID NO: 419872 - RNA, 13 nt, Homo sapiens
cuucugaccacac

SEQ ID NO: 419873 - RNA, 18 nt, Homo sapiens
cuucugcccccguuccag

SEQ ID NO: 419874 - RNA, 17 nt, Homo sapiens
cuucugccuaagccucu

SEQ ID NO: 419875 - RNA, 15 nt, Homo sapiens
cuucugccuguuaua

SEQ ID NO: 419876 - RNA, 15 nt, Homo sapiens
cuucugcucacauuc

SEQ ID NO: 419877 - RNA, 17 nt, Homo sapiens
cuucugcuguauacugu

SEQ ID NO: 419878 - RNA, 15 nt, Homo sapiens
cuucuggcugucagu

SEQ ID NO: 419879 - RNA, 17 nt, Homo sapiens
cuucuguaguacuccuu

SEQ ID NO: 419880 - RNA, 13 nt, Homo sapiens
cuucuuacuguau

SEQ ID NO: 419881 - RNA, 15 nt, Homo sapiens
cuucuuaugguauaa

SEQ ID NO: 419882 - RNA, 10 nt, Homo sapiens
cuucuuccaa

SEQ ID NO: 419883 - RNA, 22 nt, Homo sapiens
cuucuuccccccaaaacugauu

SEQ ID NO: 419884 - RNA, 23 nt, Homo sapiens
cuucuugcuuguaaaaauaugua

SEQ ID NO: 419885 - RNA, 13 nt, Homo sapiens
cuucuugugaaau

SEQ ID NO: 419886 - RNA, 14 nt, Homo sapiens
cuucuuuuccaauu

SEQ ID NO: 419887 - RNA, 13 nt, Homo sapiens
cuugaaacauaga

SEQ ID NO: 419888 - RNA, 13 nt, Homo sapiens
cuugaaaugaugg

SEQ ID NO: 419889 - RNA, 18 nt, Homo sapiens
cuugaacaaaaaugacag

SEQ ID NO: 419890 - RNA, 13 nt, Homo sapiens
cuugaacccaaga

SEQ ID NO: 419891 - RNA, 15 nt, Homo sapiens
cuugaaguccagugu

SEQ ID NO: 419892 - RNA, 15 nt, Homo sapiens
cuugaauauggaaca

SEQ ID NO: 419893 - RNA, 16 nt, Homo sapiens
cuugaaugaugccaug

SEQ ID NO: 419894 - RNA, 15 nt, Homo sapiens
cuugaaugugucacu

SEQ ID NO: 419895 - RNA, 19 nt, Homo sapiens
cuugaauuccugaccucag

SEQ ID NO: 419896 - RNA, 15 nt, Homo sapiens
cuugaauuccuggaa

SEQ ID NO: 419897 - RNA, 13 nt, Homo sapiens
cuugaauuucaaa

SEQ ID NO: 419898 - RNA, 14 nt, Homo sapiens
cuugaauuucuaga

SEQ ID NO: 419899 - RNA, 12 nt, Homo sapiens
cuugacauuccu

SEQ ID NO: 419900 - RNA, 17 nt, Homo sapiens
cuugaccguacucucac

SEQ ID NO: 419901 - RNA, 22 nt, Homo sapiens
cuugacucaacgagagcacuug

SEQ ID NO: 419902 - RNA, 14 nt, Homo sapiens
cuugacuuugccac

SEQ ID NO: 419903 - RNA, 15 nt, Homo sapiens
cuugacuuugccaca

SEQ ID NO: 419904 - RNA, 21 nt, Homo sapiens
cuugagaaaccuuauuguacc

SEQ ID NO: 419905 - RNA, 12 nt, Homo sapiens
cuugagacccuc

SEQ ID NO: 419906 - RNA, 19 nt, Homo sapiens
cuugagaccuggaaccaga

SEQ ID NO: 419907 - RNA, 21 nt, Homo sapiens
cuugagcaaccuggcuaagau

SEQ ID NO: 419908 - RNA, 19 nt, Homo sapiens
cuugagccucccccaaagc

SEQ ID NO: 419909 - RNA, 17 nt, Homo sapiens
cuugagcugccugcucu

SEQ ID NO: 419910 - RNA, 21 nt, Homo sapiens
cuugaggaccuccaccuggga

SEQ ID NO: 419911 - RNA, 14 nt, Homo sapiens
cuugaggaucauau

SEQ ID NO: 419912 - RNA, 13 nt, Homo sapiens
cuugagggaccaa

SEQ ID NO: 419913 - RNA, 14 nt, Homo sapiens
cuugagggaccaau

SEQ ID NO: 419914 - RNA, 21 nt, Homo sapiens
cuugagguggugccuucucac

SEQ ID NO: 419915 - RNA, 21 nt, Homo sapiens
cuugaguaguuuuuaucugaa

SEQ ID NO: 419916 - RNA, 14 nt, Homo sapiens
cuugaguuggagua

SEQ ID NO: 419917 - RNA, 19 nt, Homo sapiens
cuugauaaaaaauuuauua

SEQ ID NO: 419918 - RNA, 12 nt, Homo sapiens
cuugaugaauaa

SEQ ID NO: 419919 - RNA, 21 nt, Homo sapiens
cuugauuuaucacacaaagca

SEQ ID NO: 419920 - RNA, 22 nt, Homo sapiens
cuugauuuuuuucauuuugcca

SEQ ID NO: 419921 - RNA, 21 nt, Homo sapiens
cuugcacaggccacuugcuca

SEQ ID NO: 419922 - RNA, 17 nt, Homo sapiens
cuugcacgcccaugugu

SEQ ID NO: 419923 - RNA, 20 nt, Homo sapiens
cuugcacgcccaugugugag

SEQ ID NO: 419924 - RNA, 14 nt, Homo sapiens
cuugcacuauucca

SEQ ID NO: 419925 - RNA, 14 nt, Homo sapiens
cuugcacuguaucc

SEQ ID NO: 419926 - RNA, 16 nt, Homo sapiens
cuugcacuguauccaa

SEQ ID NO: 419927 - RNA, 18 nt, Homo sapiens
cuugcaucaagggcuuua

SEQ ID NO: 419928 - RNA, 16 nt, Homo sapiens
cuugcaugugcugcag

SEQ ID NO: 419929 - RNA, 21 nt, Homo sapiens
cuugcauugaauuuagucauu

SEQ ID NO: 419930 - RNA, 16 nt, Homo sapiens
cuugccaccaccagau

SEQ ID NO: 419931 - RNA, 13 nt, Homo sapiens
cuugcccaacucc

SEQ ID NO: 419932 - RNA, 22 nt, Homo sapiens
cuugcccagggugcagugugag

SEQ ID NO: 419933 - RNA, 18 nt, Homo sapiens
cuugccccuguuaccuaa

SEQ ID NO: 419934 - RNA, 21 nt, Homo sapiens
cuugcccuuugagaaacccaa

SEQ ID NO: 419935 - RNA, 19 nt, Homo sapiens
cuugccgacuggcugugag

SEQ ID NO: 419936 - RNA, 15 nt, Homo sapiens
cuugccuaggccaaa

SEQ ID NO: 419937 - RNA, 17 nt, Homo sapiens
cuugccucucucaggag

SEQ ID NO: 419938 - RNA, 18 nt, Homo sapiens
cuugcggucccuucuuac

SEQ ID NO: 419939 - RNA, 20 nt, Homo sapiens
cuugcuaaguuuucauagaa

SEQ ID NO: 419940 - RNA, 15 nt, Homo sapiens
cuugcuaccugugag

SEQ ID NO: 419941 - RNA, 20 nt, Homo sapiens
cuugcucaaccauggcugaa

SEQ ID NO: 419942 - RNA, 21 nt, Homo sapiens
cuugcucagacgagacacccu

SEQ ID NO: 419943 - RNA, 18 nt, Homo sapiens
cuugcuccuaagcaaaag

SEQ ID NO: 419944 - RNA, 12 nt, Homo sapiens
cuugcugugaaa

SEQ ID NO: 419945 - RNA, 13 nt, Homo sapiens
cuugcuguuccca

SEQ ID NO: 419946 - RNA, 16 nt, Homo sapiens
cuugcuuauucacuga

SEQ ID NO: 419947 - RNA, 23 nt, Homo sapiens
cuuggaaaucauugugugucuuc

SEQ ID NO: 419948 - RNA, 16 nt, Homo sapiens
cuuggagaucuuugcu

SEQ ID NO: 419949 - RNA, 13 nt, Homo sapiens
cuuggagcugucc

SEQ ID NO: 419950 - RNA, 21 nt, Homo sapiens
cuuggagggcaugaagacaga

SEQ ID NO: 419951 - RNA, 15 nt, Homo sapiens
cuuggccacggccug

SEQ ID NO: 419952 - RNA, 21 nt, Homo sapiens
cuuggccagcguggcgcagug

SEQ ID NO: 419953 - RNA, 21 nt, Homo sapiens
cuuggccucccaaagugcugg

SEQ ID NO: 419954 - RNA, 18 nt, Homo sapiens
cuuggccuuggggccaga

SEQ ID NO: 419955 - RNA, 22 nt, Homo sapiens
cuuggcgagauuugggggugcu

SEQ ID NO: 419956 - RNA, 19 nt, Homo sapiens
cuuggggauuaucugucau

SEQ ID NO: 419957 - RNA, 15 nt, Homo sapiens
cuuggguaauuaaaa

SEQ ID NO: 419958 - RNA, 17 nt, Homo sapiens
cuuggucuaagugugcu

SEQ ID NO: 419959 - RNA, 19 nt, Homo sapiens
cuuggucucuuucuuucca

SEQ ID NO: 419960 - RNA, 21 nt, Homo sapiens
cuuggugguuaugucccauga

SEQ ID NO: 419961 - RNA, 23 nt, Homo sapiens
cuugguguguucguggagccaca

SEQ ID NO: 419962 - RNA, 19 nt, Homo sapiens
cuugguugugaaccaacug

SEQ ID NO: 419963 - RNA, 22 nt, Homo sapiens
cuugguuuuuuaaaaucuguaa

SEQ ID NO: 419964 - RNA, 11 nt, Homo sapiens
cuuguaaaaag

SEQ ID NO: 419965 - RNA, 18 nt, Homo sapiens
cuuguaaaacugugacau

SEQ ID NO: 419966 - RNA, 13 nt, Homo sapiens
cuuguaaugcuca

SEQ ID NO: 419967 - RNA, 23 nt, Homo sapiens
cuugucaccaguuaaaagcauuu

SEQ ID NO: 419968 - RNA, 12 nt, Homo sapiens
cuugucauccac

SEQ ID NO: 419969 - RNA, 20 nt, Homo sapiens
cuugucauggaaaauguccu

SEQ ID NO: 419970 - RNA, 22 nt, Homo sapiens
cuugucauuuuuaauauuacug

SEQ ID NO: 419971 - RNA, 17 nt, Homo sapiens
auuccaccuagagcuag

SEQ ID NO: 419972 - RNA, 17 nt, Homo sapiens
auuccaccugcaaucaa

SEQ ID NO: 419973 - RNA, 15 nt, Homo sapiens
auuccagcgucuucu

SEQ ID NO: 419974 - RNA, 17 nt, Homo sapiens
auuccaggcgaugugca

SEQ ID NO: 419975 - RNA, 20 nt, Homo sapiens
auuccaggcgaugugcaagu

SEQ ID NO: 419976 - RNA, 22 nt, Homo sapiens
auuccauuacuaagaaacacau

SEQ ID NO: 419977 - RNA, 15 nt, Homo sapiens
auuccauuuacuuga

SEQ ID NO: 419978 - RNA, 14 nt, Homo sapiens
auucccauaacaua

SEQ ID NO: 419979 - RNA, 19 nt, Homo sapiens
auucccuaucuuuuaguuu

SEQ ID NO: 419980 - RNA, 15 nt, Homo sapiens
auucccucucaucca

SEQ ID NO: 419981 - RNA, 19 nt, Homo sapiens
auucccucuccugcccaga

SEQ ID NO: 419982 - RNA, 19 nt, Homo sapiens
auucccuuggauguagucu

SEQ ID NO: 419983 - RNA, 14 nt, Homo sapiens
auuccgaaacauac

SEQ ID NO: 419984 - RNA, 22 nt, Homo sapiens
auuccuaugcugcaauacauua

SEQ ID NO: 419985 - RNA, 20 nt, Homo sapiens
auuccucccaccccaagcaa

SEQ ID NO: 419986 - RNA, 23 nt, Homo sapiens
auuccuccugucuccucugucag

SEQ ID NO: 419987 - RNA, 12 nt, Homo sapiens
auuccucuugcc

SEQ ID NO: 419988 - RNA, 13 nt, Homo sapiens
auuccugauaaua

SEQ ID NO: 419989 - RNA, 19 nt, Homo sapiens
auuccugcaaaauuaccua

SEQ ID NO: 419990 - RNA, 18 nt, Homo sapiens
auuccuguucccaugaga

SEQ ID NO: 419991 - RNA, 14 nt, Homo sapiens
auuccuuagucuca

SEQ ID NO: 419992 - RNA, 14 nt, Homo sapiens
auuccuucuggccu

SEQ ID NO: 419993 - RNA, 20 nt, Homo sapiens
auuccuuggagccacuggga

SEQ ID NO: 419994 - RNA, 18 nt, Homo sapiens
auuccuuucucaucccac

SEQ ID NO: 419995 - RNA, 17 nt, Homo sapiens
auucgcagugcccagug

SEQ ID NO: 419996 - RNA, 18 nt, Homo sapiens
auucgcagugcccaguga

SEQ ID NO: 419997 - RNA, 22 nt, Homo sapiens
auucguacauaauaaguuucau

SEQ ID NO: 419998 - RNA, 13 nt, Homo sapiens
auucuaaaccaaa

SEQ ID NO: 419999 - RNA, 20 nt, Homo sapiens
auucuaaaugaauguuuaca

SEQ ID NO: 420000 - RNA, 21 nt, Homo sapiens
auucuaaguuauuuacuuuua

SEQ ID NO: 420001 - RNA, 16 nt, Homo sapiens
auucuaaugucuucau

SEQ ID NO: 420002 - RNA, 14 nt, Homo sapiens
auucuacugaacag

SEQ ID NO: 420003 - RNA, 18 nt, Homo sapiens
auucuacuucagcuuugg

SEQ ID NO: 420004 - RNA, 12 nt, Homo sapiens
auucuagcaccu

SEQ ID NO: 420005 - RNA, 13 nt, Homo sapiens
auucuaguacuug

SEQ ID NO: 420006 - RNA, 13 nt, Homo sapiens
auucuaugacaau

SEQ ID NO: 420007 - RNA, 14 nt, Homo sapiens
auucuaugacaaua

SEQ ID NO: 420008 - RNA, 18 nt, Homo sapiens
auucucaguauccacugu

SEQ ID NO: 420009 - RNA, 22 nt, Homo sapiens
auucugcuugguuccacaauca

SEQ ID NO: 420010 - RNA, 14 nt, Homo sapiens
auucugucuuccag

SEQ ID NO: 420011 - RNA, 17 nt, Homo sapiens
auucuuaauaggcuuua

SEQ ID NO: 420012 - RNA, 20 nt, Homo sapiens
auucuuauuuaaguuauuga

SEQ ID NO: 420013 - RNA, 10 nt, Homo sapiens
auucuucaaa

SEQ ID NO: 420014 - RNA, 17 nt, Homo sapiens
auucuugauguaaaauc

SEQ ID NO: 420015 - RNA, 18 nt, Homo sapiens
auucuugugccucagcuu

SEQ ID NO: 420016 - RNA, 22 nt, Homo sapiens
auucuuucaauccacaguauug

SEQ ID NO: 420017 - RNA, 15 nt, Homo sapiens
auucuuuccaugcag

SEQ ID NO: 420018 - RNA, 14 nt, Homo sapiens
auucuuuuguucua

SEQ ID NO: 420019 - RNA, 17 nt, Homo sapiens
auugaaagcuuuuguua

SEQ ID NO: 420020 - RNA, 21 nt, Homo sapiens
auugaaagggaguauuacaaa

SEQ ID NO: 420021 - RNA, 24 nt, Homo sapiens
auugaacuuucacauagcacagaa

SEQ ID NO: 420022 - RNA, 22 nt, Homo sapiens
auugaagcuaaaauaaaccaga

SEQ ID NO: 420023 - RNA, 16 nt, Homo sapiens
auugaaggauugugaa

SEQ ID NO: 420024 - RNA, 16 nt, Homo sapiens
auugaauauaacuuuu

SEQ ID NO: 420025 - RNA, 13 nt, Homo sapiens
auugaaugugauu

SEQ ID NO: 420026 - RNA, 18 nt, Homo sapiens
auugaauguuaaugguca

SEQ ID NO: 420027 - RNA, 17 nt, Homo sapiens
auugaauuauuuuguua

SEQ ID NO: 420028 - RNA, 15 nt, Homo sapiens
auugacaacauuuua

SEQ ID NO: 420029 - RNA, 23 nt, Homo sapiens
auugacauguugucacauucuca

SEQ ID NO: 420030 - RNA, 19 nt, Homo sapiens
auugaccaagaacugcaug

SEQ ID NO: 420031 - RNA, 14 nt, Homo sapiens
auugacccuagcca

SEQ ID NO: 420032 - RNA, 17 nt, Homo sapiens
auugacuucuuuuuggc

SEQ ID NO: 420033 - RNA, 19 nt, Homo sapiens
auugagaaagaaacuaaua

SEQ ID NO: 420034 - RNA, 16 nt, Homo sapiens
auugagacacugucaa

SEQ ID NO: 420035 - RNA, 22 nt, Homo sapiens
auugagccccugaggacagggg

SEQ ID NO: 420036 - RNA, 17 nt, Homo sapiens
auugaggggcaacucca

SEQ ID NO: 420037 - RNA, 18 nt, Homo sapiens
auugauagucaauaucaa

SEQ ID NO: 420038 - RNA, 23 nt, Homo sapiens
auugauauacacggaugacuuaa

SEQ ID NO: 420039 - RNA, 17 nt, Homo sapiens
auugauaugcuuauaca

SEQ ID NO: 420040 - RNA, 18 nt, Homo sapiens
auugauauugaaugaugu

SEQ ID NO: 420041 - RNA, 14 nt, Homo sapiens
auugaugacccucu

SEQ ID NO: 420042 - RNA, 19 nt, Homo sapiens
auugaugagcacuccugau

SEQ ID NO: 420043 - RNA, 19 nt, Homo sapiens
auugauuaaguauaucuau

SEQ ID NO: 420044 - RNA, 22 nt, Homo sapiens
auugauuaaugaacuauuguua

SEQ ID NO: 420045 - RNA, 21 nt, Homo sapiens
auugcaaaagguuaagccaua

SEQ ID NO: 420046 - RNA, 18 nt, Homo sapiens
auugcacccuaaauccac

SEQ ID NO: 420047 - RNA, 15 nt, Homo sapiens
auugcacugcuguuc

SEQ ID NO: 420048 - RNA, 20 nt, Homo sapiens
auugcagauaacuuugacuu

SEQ ID NO: 420049 - RNA, 16 nt, Homo sapiens
auugcaguaaugauau

SEQ ID NO: 420050 - RNA, 16 nt, Homo sapiens
auugcccgaaaccaga

SEQ ID NO: 420051 - RNA, 18 nt, Homo sapiens
auugccuaaaucuccagu

SEQ ID NO: 420052 - RNA, 19 nt, Homo sapiens
auugccuccuuauuuauca

SEQ ID NO: 420053 - RNA, 21 nt, Homo sapiens
auugccuuuggcaauucuucu

SEQ ID NO: 420054 - RNA, 14 nt, Homo sapiens
auugcuagccagca

SEQ ID NO: 420055 - RNA, 20 nt, Homo sapiens
auugcuagccagcauuccau

SEQ ID NO: 420056 - RNA, 21 nt, Homo sapiens
auugcuccauuuucuugucaa

SEQ ID NO: 420057 - RNA, 17 nt, Homo sapiens
auugcuuaaaagacauu

SEQ ID NO: 420058 - RNA, 23 nt, Homo sapiens
auugcuuauguaugccuauucag

SEQ ID NO: 420059 - RNA, 13 nt, Homo sapiens
auugcuuuacugg

SEQ ID NO: 420060 - RNA, 15 nt, Homo sapiens
auugcuuuacuggcu

SEQ ID NO: 420061 - RNA, 15 nt, Homo sapiens
auugcuuuuaugaua

SEQ ID NO: 420062 - RNA, 18 nt, Homo sapiens
auuggaauuaaccuggug

SEQ ID NO: 420063 - RNA, 16 nt, Homo sapiens
auuggacagacacaga

SEQ ID NO: 420064 - RNA, 15 nt, Homo sapiens
auuggaccuguucaa

SEQ ID NO: 420065 - RNA, 22 nt, Homo sapiens
auuggcaucucuccccauauau

SEQ ID NO: 420066 - RNA, 19 nt, Homo sapiens
auuggcccugacaaaaagg

SEQ ID NO: 420067 - RNA, 18 nt, Homo sapiens
auuggcuauaacaugucu

SEQ ID NO: 420068 - RNA, 23 nt, Homo sapiens
auugggaguaggaguugcuccua

SEQ ID NO: 420069 - RNA, 19 nt, Homo sapiens
auugggucgugguggagaa

SEQ ID NO: 420070 - RNA, 18 nt, Homo sapiens
auugguccaacaguuuga

SEQ ID NO: 420071 - RNA, 22 nt, Homo sapiens
auuguaaaagcaacaucagcuu

SEQ ID NO: 420072 - RNA, 16 nt, Homo sapiens
auuguaucuguuuaga

SEQ ID NO: 420073 - RNA, 17 nt, Homo sapiens
auugucacaacacugaa

SEQ ID NO: 420074 - RNA, 19 nt, Homo sapiens
auugucagcuacuaaugau

SEQ ID NO: 420075 - RNA, 14 nt, Homo sapiens
auuguccaugccua

SEQ ID NO: 420076 - RNA, 17 nt, Homo sapiens
auugucgcucagcaaua

SEQ ID NO: 420077 - RNA, 16 nt, Homo sapiens
auugucucauugccag

SEQ ID NO: 420078 - RNA, 21 nt, Homo sapiens
auugucuccuuccacaaugac

SEQ ID NO: 420079 - RNA, 22 nt, Homo sapiens
auugucuccuuccacaaugacu

SEQ ID NO: 420080 - RNA, 15 nt, Homo sapiens
auugugagccaccac

SEQ ID NO: 420081 - RNA, 17 nt, Homo sapiens
auugugcugauugugga

SEQ ID NO: 420082 - RNA, 21 nt, Homo sapiens
auuguggaucuuuucauucuc

SEQ ID NO: 420083 - RNA, 22 nt, Homo sapiens
auugugguuuauugaaugugau

SEQ ID NO: 420084 - RNA, 17 nt, Homo sapiens
auuguguccacauaauc

SEQ ID NO: 420085 - RNA, 12 nt, Homo sapiens
auugugugaugu

SEQ ID NO: 420086 - RNA, 15 nt, Homo sapiens
auuguuaauuaucua

SEQ ID NO: 420087 - RNA, 14 nt, Homo sapiens
auuguucccaguga

SEQ ID NO: 420088 - RNA, 21 nt, Homo sapiens
auuguucuuguaaaacuguga

SEQ ID NO: 420089 - RNA, 20 nt, Homo sapiens
auuguuucuccucugaagca

SEQ ID NO: 420090 - RNA, 21 nt, Homo sapiens
auuguuuggcaaugcacugaa

SEQ ID NO: 420091 - RNA, 14 nt, Homo sapiens
auuguuuugccagu

SEQ ID NO: 420092 - RNA, 15 nt, Homo sapiens
auuguuuugccagug

SEQ ID NO: 420093 - RNA, 16 nt, Homo sapiens
auuguuuugccaguga

SEQ ID NO: 420094 - RNA, 15 nt, Homo sapiens
auuuaaaagacaaac

SEQ ID NO: 420095 - RNA, 20 nt, Homo sapiens
auuuaaaaucagacucuuua

SEQ ID NO: 420096 - RNA, 22 nt, Homo sapiens
auuuaaagucuugaauguugaa

SEQ ID NO: 420097 - RNA, 17 nt, Homo sapiens
auuuaaauagaacuuga

SEQ ID NO: 420098 - RNA, 19 nt, Homo sapiens
auuuaaauguaaagacaaa

SEQ ID NO: 420099 - RNA, 15 nt, Homo sapiens
auuuaacccuucaca

SEQ ID NO: 420100 - RNA, 18 nt, Homo sapiens
auuuaagaaugacaggcu

SEQ ID NO: 420101 - RNA, 19 nt, Homo sapiens
auuuaagaaugacaggcuu

SEQ ID NO: 420102 - RNA, 16 nt, Homo sapiens
cuugucccagccucag

SEQ ID NO: 420103 - RNA, 15 nt, Homo sapiens
cuuguccugaugcug

SEQ ID NO: 420104 - RNA, 19 nt, Homo sapiens
cuugucucuuccucugcag

SEQ ID NO: 420105 - RNA, 21 nt, Homo sapiens
cuugucugagaacaaauacaa

SEQ ID NO: 420106 - RNA, 16 nt, Homo sapiens
cuugucugucuaguua

SEQ ID NO: 420107 - RNA, 17 nt, Homo sapiens
cuugucuuaaggucaua

SEQ ID NO: 420108 - RNA, 11 nt, Homo sapiens
cuugugacuag

SEQ ID NO: 420109 - RNA, 19 nt, Homo sapiens
cuugugacuagugcugaag

SEQ ID NO: 420110 - RNA, 18 nt, Homo sapiens
cuuguguacaaacccaga

SEQ ID NO: 420111 - RNA, 17 nt, Homo sapiens
cuuguguccacugugac

SEQ ID NO: 420112 - RNA, 17 nt, Homo sapiens
cuugugugaggcucugu

SEQ ID NO: 420113 - RNA, 16 nt, Homo sapiens
cuuguuccccacugac

SEQ ID NO: 420114 - RNA, 23 nt, Homo sapiens
cuuguuccccacugacagccucc

SEQ ID NO: 420115 - RNA, 22 nt, Homo sapiens
cuuguugacacggccaugacca

SEQ ID NO: 420116 - RNA, 19 nt, Homo sapiens
cuuguugcccucugcaguu

SEQ ID NO: 420117 - RNA, 12 nt, Homo sapiens
cuuguugcugca

SEQ ID NO: 420118 - RNA, 17 nt, Homo sapiens
cuuguugcugcaucucc

SEQ ID NO: 420119 - RNA, 15 nt, Homo sapiens
cuuguuuaccaaaga

SEQ ID NO: 420120 - RNA, 15 nt, Homo sapiens
cuuguuuauuucuga

SEQ ID NO: 420121 - RNA, 13 nt, Homo sapiens
cuuguuugcuuca

SEQ ID NO: 420122 - RNA, 20 nt, Homo sapiens
cuuguuugguaguuagccau

SEQ ID NO: 420123 - RNA, 16 nt, Homo sapiens
cuuguuuuaugcucag

SEQ ID NO: 420124 - RNA, 18 nt, Homo sapiens
cuuguuuucuacuuugcc

SEQ ID NO: 420125 - RNA, 14 nt, Homo sapiens
cuuguuuucuugcc

SEQ ID NO: 420126 - RNA, 14 nt, Homo sapiens
cuuuaaacuacuga

SEQ ID NO: 420127 - RNA, 12 nt, Homo sapiens
cuuuaaauauaa

SEQ ID NO: 420128 - RNA, 16 nt, Homo sapiens
cuuuaaaucugugaug

SEQ ID NO: 420129 - RNA, 17 nt, Homo sapiens
cuuuaaauggaauaauu

SEQ ID NO: 420130 - RNA, 20 nt, Homo sapiens
cuuuaagagaaaugagcugc

SEQ ID NO: 420131 - RNA, 12 nt, Homo sapiens
cuuuaagcacua

SEQ ID NO: 420132 - RNA, 21 nt, Homo sapiens
cuuuaauacucaccuccuccc

SEQ ID NO: 420133 - RNA, 19 nt, Homo sapiens
cuuuaauuuuuuacuauuu

SEQ ID NO: 420134 - RNA, 17 nt, Homo sapiens
cuuuacaaacugaagau

SEQ ID NO: 420135 - RNA, 21 nt, Homo sapiens
cuuuacaaucugcacuuuaac

SEQ ID NO: 420136 - RNA, 17 nt, Homo sapiens
cuuuaguugauuuaaac

SEQ ID NO: 420137 - RNA, 22 nt, Homo sapiens
cuuuaucaaaaaguacaauaau

SEQ ID NO: 420138 - RNA, 13 nt, Homo sapiens
cuuuauguacugc

SEQ ID NO: 420139 - RNA, 17 nt, Homo sapiens
cuuuauuaaugaacugu

SEQ ID NO: 420140 - RNA, 23 nt, Homo sapiens
cuuuauucuuccuugagcuaagc

SEQ ID NO: 420141 - RNA, 16 nt, Homo sapiens
cuuuauuucugaucua

SEQ ID NO: 420142 - RNA, 22 nt, Homo sapiens
cuuucaaaagaagaguuuuaga

SEQ ID NO: 420143 - RNA, 13 nt, Homo sapiens
cuuucaaagagaa

SEQ ID NO: 420144 - RNA, 18 nt, Homo sapiens
cuuucaaagcuaaauucc

SEQ ID NO: 420145 - RNA, 24 nt, Homo sapiens
cuuucaacuuaaaucacugaggca

SEQ ID NO: 420146 - RNA, 22 nt, Homo sapiens
cuuucaauugcagaugccaaaa

SEQ ID NO: 420147 - RNA, 16 nt, Homo sapiens
cuuucagucccaaagc

SEQ ID NO: 420148 - RNA, 15 nt, Homo sapiens
cuuucaucaaaacaa

SEQ ID NO: 420149 - RNA, 15 nt, Homo sapiens
cuuuccaaagcauuu

SEQ ID NO: 420150 - RNA, 13 nt, Homo sapiens
cuuuccaccaagc

SEQ ID NO: 420151 - RNA, 15 nt, Homo sapiens
cuuuccagccguguu

SEQ ID NO: 420152 - RNA, 22 nt, Homo sapiens
cuuuccagggcauaaaacucaa

SEQ ID NO: 420153 - RNA, 17 nt, Homo sapiens
cuuucccacguugacac

SEQ ID NO: 420154 - RNA, 23 nt, Homo sapiens
cuuuccccggaguaccuauugua

SEQ ID NO: 420155 - RNA, 19 nt, Homo sapiens
cuuucccuaaagaacauac

SEQ ID NO: 420156 - RNA, 19 nt, Homo sapiens
cuuucccuagaaagccaua

SEQ ID NO: 420157 - RNA, 18 nt, Homo sapiens
cuuucccuucuuggugcu

SEQ ID NO: 420158 - RNA, 16 nt, Homo sapiens
cuuuccucgccugaca

SEQ ID NO: 420159 - RNA, 14 nt, Homo sapiens
cuuuccuugcucaa

SEQ ID NO: 420160 - RNA, 17 nt, Homo sapiens
cuuuccuuucauccuca

SEQ ID NO: 420161 - RNA, 17 nt, Homo sapiens
cuuucggggugcuccug

SEQ ID NO: 420162 - RNA, 15 nt, Homo sapiens
cuuucuacacuguau

SEQ ID NO: 420163 - RNA, 22 nt, Homo sapiens
cuuucuauuaccccucauuuaa

SEQ ID NO: 420164 - RNA, 21 nt, Homo sapiens
cuuucucgugguagaagccag

SEQ ID NO: 420165 - RNA, 22 nt, Homo sapiens
cuuucucugccagugacagaca

SEQ ID NO: 420166 - RNA, 23 nt, Homo sapiens
cuuucugauaacuagauggugcu

SEQ ID NO: 420167 - RNA, 13 nt, Homo sapiens
cuuucugcaugac

SEQ ID NO: 420168 - RNA, 18 nt, Homo sapiens
cuuucugccaacuuuguu

SEQ ID NO: 420169 - RNA, 15 nt, Homo sapiens
cuuucugcuuugcac

SEQ ID NO: 420170 - RNA, 19 nt, Homo sapiens
cuuucuucucucuuugucc

SEQ ID NO: 420171 - RNA, 19 nt, Homo sapiens
cuuugaagcaguuguguca

SEQ ID NO: 420172 - RNA, 15 nt, Homo sapiens
cuuugaaguggcacc

SEQ ID NO: 420173 - RNA, 20 nt, Homo sapiens
cuuugaauuuuuuuaauugc

SEQ ID NO: 420174 - RNA, 17 nt, Homo sapiens
cuuugagcgagcccauu

SEQ ID NO: 420175 - RNA, 13 nt, Homo sapiens
cuuugaguaccaa

SEQ ID NO: 420176 - RNA, 21 nt, Homo sapiens
cuuugauuuuuugcugcagac

SEQ ID NO: 420177 - RNA, 13 nt, Homo sapiens
cuuugcacugagg

SEQ ID NO: 420178 - RNA, 19 nt, Homo sapiens
cuuugcaguuggacucuca

SEQ ID NO: 420179 - RNA, 15 nt, Homo sapiens
cuuugccuuuaucuc

SEQ ID NO: 420180 - RNA, 23 nt, Homo sapiens
cuuugcugaaugucauuauuuga

SEQ ID NO: 420181 - RNA, 17 nt, Homo sapiens
cuuugcugcagucaucu

SEQ ID NO: 420182 - RNA, 12 nt, Homo sapiens
cuuugcugccag

SEQ ID NO: 420183 - RNA, 20 nt, Homo sapiens
cuuugcugcuggugcuaaaa

SEQ ID NO: 420184 - RNA, 14 nt, Homo sapiens
cuuuggaaagccau

SEQ ID NO: 420185 - RNA, 15 nt, Homo sapiens
cuuuggaucaggaaa

SEQ ID NO: 420186 - RNA, 17 nt, Homo sapiens
cuuuggcuucagaauug

SEQ ID NO: 420187 - RNA, 18 nt, Homo sapiens
cuuugggauucuuuccau

SEQ ID NO: 420188 - RNA, 16 nt, Homo sapiens
cuuugucucaccagcu

SEQ ID NO: 420189 - RNA, 13 nt, Homo sapiens
cuuugugcaauau

SEQ ID NO: 420190 - RNA, 14 nt, Homo sapiens
cuuugugccuuuga

SEQ ID NO: 420191 - RNA, 13 nt, Homo sapiens
cuuuguguagcuc

SEQ ID NO: 420192 - RNA, 21 nt, Homo sapiens
cuuuguguucaguuccacuau

SEQ ID NO: 420193 - RNA, 14 nt, Homo sapiens
cuuuguuuacauga

SEQ ID NO: 420194 - RNA, 15 nt, Homo sapiens
cuuuguuuacaugag

SEQ ID NO: 420195 - RNA, 16 nt, Homo sapiens
cuuuguuuaugaagaa

SEQ ID NO: 420196 - RNA, 15 nt, Homo sapiens
cuuuuaaaaaugucc

SEQ ID NO: 420197 - RNA, 15 nt, Homo sapiens
cuuuuaaaaggagca

SEQ ID NO: 420198 - RNA, 21 nt, Homo sapiens
cuuuuaaauaauauccaccuc

SEQ ID NO: 420199 - RNA, 22 nt, Homo sapiens
cuuuuaaauguugaauauuccc

SEQ ID NO: 420200 - RNA, 16 nt, Homo sapiens
cuuuuaacuucaccuu

SEQ ID NO: 420201 - RNA, 17 nt, Homo sapiens
cuuuuaagaaacacagg

SEQ ID NO: 420202 - RNA, 22 nt, Homo sapiens
cuuuuaaugucauuuguuaaaa

SEQ ID NO: 420203 - RNA, 15 nt, Homo sapiens
cuuuuacagcucuug

SEQ ID NO: 420204 - RNA, 16 nt, Homo sapiens
cuuuuacuaagcacug

SEQ ID NO: 420205 - RNA, 21 nt, Homo sapiens
cuuuuaucucacaaauaagua

SEQ ID NO: 420206 - RNA, 21 nt, Homo sapiens
cuuuuauguguugaugacuca

SEQ ID NO: 420207 - RNA, 22 nt, Homo sapiens
cuuuucaagacuuccucaugaa

SEQ ID NO: 420208 - RNA, 13 nt, Homo sapiens
cuuuucaaugugu

SEQ ID NO: 420209 - RNA, 14 nt, Homo sapiens
cuuuucaaugugug

SEQ ID NO: 420210 - RNA, 23 nt, Homo sapiens
cuuuucacugcuggcugccuuag

SEQ ID NO: 420211 - RNA, 12 nt, Homo sapiens
cuuuucaguuug

SEQ ID NO: 420212 - RNA, 14 nt, Homo sapiens
cuuuucauguagaa

SEQ ID NO: 420213 - RNA, 12 nt, Homo sapiens
cuuuuccagaag

SEQ ID NO: 420214 - RNA, 12 nt, Homo sapiens
cuuuucuaugga

SEQ ID NO: 420215 - RNA, 16 nt, Homo sapiens
cuuuucugaggacuca

SEQ ID NO: 420216 - RNA, 16 nt, Homo sapiens
cuuuucugaucugcag

SEQ ID NO: 420217 - RNA, 18 nt, Homo sapiens
cuuuucugguagguucug

SEQ ID NO: 420218 - RNA, 23 nt, Homo sapiens
cuuuugaaaguuuguucugcaga

SEQ ID NO: 420219 - RNA, 15 nt, Homo sapiens
cuuuugaaaugccac

SEQ ID NO: 420220 - RNA, 20 nt, Homo sapiens
cuuuugaggggcugacuuca

SEQ ID NO: 420221 - RNA, 21 nt, Homo sapiens
cuuuugagugccuuacacaau

SEQ ID NO: 420222 - RNA, 16 nt, Homo sapiens
cuuuugauagauccac

SEQ ID NO: 420223 - RNA, 13 nt, Homo sapiens
cuuuugauaugau

SEQ ID NO: 420224 - RNA, 11 nt, Homo sapiens
cuuuugcacau

SEQ ID NO: 420225 - RNA, 22 nt, Homo sapiens
cuuuugcccacacuugggagca

SEQ ID NO: 420226 - RNA, 23 nt, Homo sapiens
cuuuugggauguuaccuucacau

SEQ ID NO: 420227 - RNA, 18 nt, Homo sapiens
cuuuuguaagguacugaa

SEQ ID NO: 420228 - RNA, 14 nt, Homo sapiens
cuuuuguaucuuaa

SEQ ID NO: 420229 - RNA, 22 nt, Homo sapiens
cuuuuguaucuuaagccaagaa

SEQ ID NO: 420230 - RNA, 14 nt, Homo sapiens
cuuuugucuaauua

SEQ ID NO: 420231 - RNA, 21 nt, Homo sapiens
cuuuugucuaauuaaaacacu

SEQ ID NO: 420232 - RNA, 18 nt, Homo sapiens
cuuuuuaaacaguguuua

SEQ ID NO: 420233 - RNA, 17 nt, Homo sapiens
cuuuuuacaauguauca

SEQ ID NO: 420234 - RNA, 23 nt, Homo sapiens
auuuaagccaucaucagcuuaau

SEQ ID NO: 420235 - RNA, 18 nt, Homo sapiens
auuuaaguuaucaacuuu

SEQ ID NO: 420236 - RNA, 19 nt, Homo sapiens
auuuaaguuaucaacuuua

SEQ ID NO: 420237 - RNA, 15 nt, Homo sapiens
auuuaaguuuuuccc

SEQ ID NO: 420238 - RNA, 19 nt, Homo sapiens
auuuaauaagaaacaugau

SEQ ID NO: 420239 - RNA, 16 nt, Homo sapiens
auuuaaucauuuccag

SEQ ID NO: 420240 - RNA, 15 nt, Homo sapiens
auuuacaagcacgau

SEQ ID NO: 420241 - RNA, 18 nt, Homo sapiens
auuuacagccucacuuga

SEQ ID NO: 420242 - RNA, 20 nt, Homo sapiens
auuuacagccucacuugaau

SEQ ID NO: 420243 - RNA, 14 nt, Homo sapiens
auuuaccuggaaac

SEQ ID NO: 420244 - RNA, 12 nt, Homo sapiens
auuuacuacuua

SEQ ID NO: 420245 - RNA, 19 nt, Homo sapiens
auuuacugacauauaucua

SEQ ID NO: 420246 - RNA, 18 nt, Homo sapiens
auuuacuuguugaugaca

SEQ ID NO: 420247 - RNA, 19 nt, Homo sapiens
auuuacuuuuaccacuauu

SEQ ID NO: 420248 - RNA, 18 nt, Homo sapiens
auuuagauauaacacuau

SEQ ID NO: 420249 - RNA, 19 nt, Homo sapiens
auuuauaacagcauucuug

SEQ ID NO: 420250 - RNA, 19 nt, Homo sapiens
auuuauaauguuaguagaa

SEQ ID NO: 420251 - RNA, 17 nt, Homo sapiens
auuuaucacacaaagca

SEQ ID NO: 420252 - RNA, 14 nt, Homo sapiens
auuuaucagugaca

SEQ ID NO: 420253 - RNA, 13 nt, Homo sapiens
auuuaucauucuu

SEQ ID NO: 420254 - RNA, 12 nt, Homo sapiens
auuuauccaaag

SEQ ID NO: 420255 - RNA, 16 nt, Homo sapiens
auuuauccaagaccug

SEQ ID NO: 420256 - RNA, 14 nt, Homo sapiens
auuuaucugugaau

SEQ ID NO: 420257 - RNA, 20 nt, Homo sapiens
auuuaugccucuguauuuaa

SEQ ID NO: 420258 - RNA, 22 nt, Homo sapiens
auuuaugugaguguguguuugu

SEQ ID NO: 420259 - RNA, 14 nt, Homo sapiens
auuuauuauuucaa

SEQ ID NO: 420260 - RNA, 14 nt, Homo sapiens
auuuauugagcacc

SEQ ID NO: 420261 - RNA, 13 nt, Homo sapiens
auuuauugccugg

SEQ ID NO: 420262 - RNA, 18 nt, Homo sapiens
auuucaguaucaucucca

SEQ ID NO: 420263 - RNA, 13 nt, Homo sapiens
auuucaucaugac

SEQ ID NO: 420264 - RNA, 12 nt, Homo sapiens
auuucaucucuu

SEQ ID NO: 420265 - RNA, 15 nt, Homo sapiens
auuucauucauaucc

SEQ ID NO: 420266 - RNA, 17 nt, Homo sapiens
auuucauuguaugaugu

SEQ ID NO: 420267 - RNA, 21 nt, Homo sapiens
auuuccacaaaaucuguccaa

SEQ ID NO: 420268 - RNA, 21 nt, Homo sapiens
auuuccuaggcugacuaagaa

SEQ ID NO: 420269 - RNA, 17 nt, Homo sapiens
auuuccucugagcuguu

SEQ ID NO: 420270 - RNA, 13 nt, Homo sapiens
auuuccugacaga

SEQ ID NO: 420271 - RNA, 15 nt, Homo sapiens
auuuccuuaaagcaa

SEQ ID NO: 420272 - RNA, 12 nt, Homo sapiens
auuucuagacag

SEQ ID NO: 420273 - RNA, 16 nt, Homo sapiens
auuucuagacaguauu

SEQ ID NO: 420274 - RNA, 20 nt, Homo sapiens
auuucuagacaguauugcca

SEQ ID NO: 420275 - RNA, 19 nt, Homo sapiens
auuucugaucuauacaaau

SEQ ID NO: 420276 - RNA, 11 nt, Homo sapiens
auuucugccag

SEQ ID NO: 420277 - RNA, 12 nt, Homo sapiens
auuucugugaug

SEQ ID NO: 420278 - RNA, 16 nt, Homo sapiens
auuucuguuugaaugc

SEQ ID NO: 420279 - RNA, 21 nt, Homo sapiens
auuucuucaagugaguggcau

SEQ ID NO: 420280 - RNA, 19 nt, Homo sapiens
auuucuuucuuuccuuaau

SEQ ID NO: 420281 - RNA, 11 nt, Homo sapiens
auuucuuugcc

SEQ ID NO: 420282 - RNA, 20 nt, Homo sapiens
auuugaaaaacauacauuau

SEQ ID NO: 420283 - RNA, 13 nt, Homo sapiens
auuugaaauccaa

SEQ ID NO: 420284 - RNA, 21 nt, Homo sapiens
auuugaagaauuaaugacaac

SEQ ID NO: 420285 - RNA, 17 nt, Homo sapiens
auuugaaggucugcaag

SEQ ID NO: 420286 - RNA, 14 nt, Homo sapiens
auuugacacauaaa

SEQ ID NO: 420287 - RNA, 18 nt, Homo sapiens
auuugaccggaucuacac

SEQ ID NO: 420288 - RNA, 22 nt, Homo sapiens
auuugaccggaucuacacccac

SEQ ID NO: 420289 - RNA, 15 nt, Homo sapiens
auuugagacauucca

SEQ ID NO: 420290 - RNA, 17 nt, Homo sapiens
auuugagagcuaacuau

SEQ ID NO: 420291 - RNA, 17 nt, Homo sapiens
auuugauggugaauauu

SEQ ID NO: 420292 - RNA, 16 nt, Homo sapiens
auuugcaaaugcacau

SEQ ID NO: 420293 - RNA, 14 nt, Homo sapiens
auuugcaguauuca

SEQ ID NO: 420294 - RNA, 18 nt, Homo sapiens
auuugcucuuucaucucu

SEQ ID NO: 420295 - RNA, 22 nt, Homo sapiens
auuuggaaagcacuggaauuca

SEQ ID NO: 420296 - RNA, 13 nt, Homo sapiens
auuuggaaauuca

SEQ ID NO: 420297 - RNA, 20 nt, Homo sapiens
auuuggcuucccuaacuuaa

SEQ ID NO: 420298 - RNA, 15 nt, Homo sapiens
auuugggcaucucua

SEQ ID NO: 420299 - RNA, 21 nt, Homo sapiens
auuuguaaagcucacuuuacu

SEQ ID NO: 420300 - RNA, 17 nt, Homo sapiens
auuuguaauugaacuua

SEQ ID NO: 420301 - RNA, 20 nt, Homo sapiens
auuuguaauugaacuuaucc

SEQ ID NO: 420302 - RNA, 19 nt, Homo sapiens
auuugugucaaugggcaau

SEQ ID NO: 420303 - RNA, 17 nt, Homo sapiens
auuugugugugugcaag

SEQ ID NO: 420304 - RNA, 17 nt, Homo sapiens
auuuguuauacuucaaa

SEQ ID NO: 420305 - RNA, 17 nt, Homo sapiens
auuuguuaugauaaaag

SEQ ID NO: 420306 - RNA, 23 nt, Homo sapiens
auuuguucauuaaacgucauuca

SEQ ID NO: 420307 - RNA, 21 nt, Homo sapiens
auuuguuguuuuuaacaacua

SEQ ID NO: 420308 - RNA, 20 nt, Homo sapiens
auuuuaaaaaauaacauauu

SEQ ID NO: 420309 - RNA, 18 nt, Homo sapiens
auuuuaaaucauuaggaa

SEQ ID NO: 420310 - RNA, 13 nt, Homo sapiens
auuuuaagugcuu

SEQ ID NO: 420311 - RNA, 14 nt, Homo sapiens
auuuuacacacaca

SEQ ID NO: 420312 - RNA, 18 nt, Homo sapiens
auuuuaccuagcauuuca

SEQ ID NO: 420313 - RNA, 21 nt, Homo sapiens
auuuuaggcagggauuugagg

SEQ ID NO: 420314 - RNA, 23 nt, Homo sapiens
auuuuagggcuguagacuuacuu

SEQ ID NO: 420315 - RNA, 14 nt, Homo sapiens
auuuuauauaugaa

SEQ ID NO: 420316 - RNA, 19 nt, Homo sapiens
auuuuaugaguucuguaua

SEQ ID NO: 420317 - RNA, 16 nt, Homo sapiens
auuuuaugaucuuggc

SEQ ID NO: 420318 - RNA, 13 nt, Homo sapiens
auuuuauuauaau

SEQ ID NO: 420319 - RNA, 15 nt, Homo sapiens
auuuuauucacauau

SEQ ID NO: 420320 - RNA, 14 nt, Homo sapiens
auuuucaaguaauu

SEQ ID NO: 420321 - RNA, 19 nt, Homo sapiens
auuuuccaaauuacagcau

SEQ ID NO: 420322 - RNA, 17 nt, Homo sapiens
auuuuccauuaauuuca

SEQ ID NO: 420323 - RNA, 17 nt, Homo sapiens
auuuuccuguguccaca

SEQ ID NO: 420324 - RNA, 15 nt, Homo sapiens
auuuucuaaaacaag

SEQ ID NO: 420325 - RNA, 15 nt, Homo sapiens
auuuucuagacuuuc

SEQ ID NO: 420326 - RNA, 22 nt, Homo sapiens
auuuucuccgaaaggcaaaaau

SEQ ID NO: 420327 - RNA, 22 nt, Homo sapiens
auuuucugaucauugguuucuu

SEQ ID NO: 420328 - RNA, 14 nt, Homo sapiens
auuuucuugucaau

SEQ ID NO: 420329 - RNA, 16 nt, Homo sapiens
auuuugaaccauguga

SEQ ID NO: 420330 - RNA, 12 nt, Homo sapiens
auuuugauucag

SEQ ID NO: 420331 - RNA, 15 nt, Homo sapiens
auuuugcagcaguga

SEQ ID NO: 420332 - RNA, 23 nt, Homo sapiens
auuuugcauugugugagcuucua

SEQ ID NO: 420333 - RNA, 20 nt, Homo sapiens
auuuugcccaggcaacagua

SEQ ID NO: 420334 - RNA, 15 nt, Homo sapiens
auuuuggacguguga

SEQ ID NO: 420335 - RNA, 16 nt, Homo sapiens
auuuuggaucuaucac

SEQ ID NO: 420336 - RNA, 16 nt, Homo sapiens
auuuuguggucauuaa

SEQ ID NO: 420337 - RNA, 12 nt, Homo sapiens
auuuuguugcau

SEQ ID NO: 420338 - RNA, 19 nt, Homo sapiens
auuuuuaaaagacuuugau

SEQ ID NO: 420339 - RNA, 16 nt, Homo sapiens
auuuuuaccugccuaa

SEQ ID NO: 420340 - RNA, 17 nt, Homo sapiens
auuuuuaguuugcuaag

SEQ ID NO: 420341 - RNA, 15 nt, Homo sapiens
auuuuuauauagcuu

SEQ ID NO: 420342 - RNA, 22 nt, Homo sapiens
auuuuuccugcuguauccagaa

SEQ ID NO: 420343 - RNA, 18 nt, Homo sapiens
auuuuugcacauucuaca

SEQ ID NO: 420344 - RNA, 22 nt, Homo sapiens
caaaaaaaaugaagacacucaa

SEQ ID NO: 420345 - RNA, 21 nt, Homo sapiens
caaaaaaaugcucacacucca

SEQ ID NO: 420346 - RNA, 15 nt, Homo sapiens
caaaaacauggccuu

SEQ ID NO: 420347 - RNA, 19 nt, Homo sapiens
caaaaacuuuccaugacag

SEQ ID NO: 420348 - RNA, 15 nt, Homo sapiens
caaaaagaaaaccca

SEQ ID NO: 420349 - RNA, 17 nt, Homo sapiens
caaaaagaggcuaugug

SEQ ID NO: 420350 - RNA, 18 nt, Homo sapiens
caaaaagccuuuuccaga

SEQ ID NO: 420351 - RNA, 16 nt, Homo sapiens
caaaaagucauuguaa

SEQ ID NO: 420352 - RNA, 14 nt, Homo sapiens
caaaaauauauuaa

SEQ ID NO: 420353 - RNA, 16 nt, Homo sapiens
caaaaaugggcagcca

SEQ ID NO: 420354 - RNA, 15 nt, Homo sapiens
caaaaauuagcugug

SEQ ID NO: 420355 - RNA, 22 nt, Homo sapiens
caaaacaaacaaccugccacaa

SEQ ID NO: 420356 - RNA, 16 nt, Homo sapiens
caaaacauacccagug

SEQ ID NO: 420357 - RNA, 22 nt, Homo sapiens
caaaacccacggaaagccucau

SEQ ID NO: 420358 - RNA, 17 nt, Homo sapiens
caaaaccugauguuaaa

SEQ ID NO: 420359 - RNA, 18 nt, Homo sapiens
caaaaccugauguuaaaa

SEQ ID NO: 420360 - RNA, 23 nt, Homo sapiens
caaaaccuugcuaauuuucucaa

SEQ ID NO: 420361 - RNA, 17 nt, Homo sapiens
caaaacugaaaaucaau

SEQ ID NO: 420362 - RNA, 15 nt, Homo sapiens
caaaacugacaguaa

SEQ ID NO: 420363 - RNA, 17 nt, Homo sapiens
caaaacugacaguaaau

SEQ ID NO: 420364 - RNA, 19 nt, Homo sapiens
caaaacuuaaaaguauuca

SEQ ID NO: 420365 - RNA, 18 nt, Homo sapiens
caaaagaaguugaucuga

SEQ ID NO: 420366 - RNA, 20 nt, Homo sapiens
caaaagaauugugccucucc

SEQ ID NO: 420367 - RNA, 23 nt, Homo sapiens
cuuuuuagcaaggccuugguguu

SEQ ID NO: 420368 - RNA, 13 nt, Homo sapiens
cuuuuuaugcauu

SEQ ID NO: 420369 - RNA, 14 nt, Homo sapiens
cuuuuucaaagugu

SEQ ID NO: 420370 - RNA, 13 nt, Homo sapiens
cuuuuuccacaag

SEQ ID NO: 420371 - RNA, 19 nt, Homo sapiens
cuuuuucccaacuuuggaa

SEQ ID NO: 420372 - RNA, 18 nt, Homo sapiens
cuuuuucuucuucccucc

SEQ ID NO: 420373 - RNA, 23 nt, Homo sapiens
cuuuuuugucccccaacuugaga

SEQ ID NO: 420374 - RNA, 21 nt, Homo sapiens
gaaaaaaaaauguucauucua

SEQ ID NO: 420375 - RNA, 19 nt, Homo sapiens
gaaaaaaguuuugaugaaa

SEQ ID NO: 420376 - RNA, 16 nt, Homo sapiens
gaaaaaauaacacugu

SEQ ID NO: 420377 - RNA, 18 nt, Homo sapiens
gaaaaaauaacacuguac

SEQ ID NO: 420378 - RNA, 14 nt, Homo sapiens
gaaaaacaaaaagg

SEQ ID NO: 420379 - RNA, 20 nt, Homo sapiens
gaaaaacaaaaaggaaauga

SEQ ID NO: 420380 - RNA, 12 nt, Homo sapiens
gaaaaacagagg

SEQ ID NO: 420381 - RNA, 13 nt, Homo sapiens
gaaaaacaggaaa

SEQ ID NO: 420382 - RNA, 14 nt, Homo sapiens
gaaaaacauacauu

SEQ ID NO: 420383 - RNA, 19 nt, Homo sapiens
gaaaaacauuccaggaaac

SEQ ID NO: 420384 - RNA, 13 nt, Homo sapiens
gaaaaaccaauga

SEQ ID NO: 420385 - RNA, 22 nt, Homo sapiens
gaaaaaccaaugauucauaaca

SEQ ID NO: 420386 - RNA, 16 nt, Homo sapiens
gaaaaacuuuguuaua

SEQ ID NO: 420387 - RNA, 15 nt, Homo sapiens
gaaaaagacacagac

SEQ ID NO: 420388 - RNA, 22 nt, Homo sapiens
gaaaaaggagcuuaccucccac

SEQ ID NO: 420389 - RNA, 17 nt, Homo sapiens
gaaaacaaaaaacaaaa

SEQ ID NO: 420390 - RNA, 20 nt, Homo sapiens
gaaaacaaauauuucacuua

SEQ ID NO: 420391 - RNA, 16 nt, Homo sapiens
gaaaacaacauuggau

SEQ ID NO: 420392 - RNA, 19 nt, Homo sapiens
gaaaacacuaguaccuuca

SEQ ID NO: 420393 - RNA, 15 nt, Homo sapiens
gaaaacauauuugug

SEQ ID NO: 420394 - RNA, 15 nt, Homo sapiens
gaaaaccaacaccau

SEQ ID NO: 420395 - RNA, 16 nt, Homo sapiens
gaaaaccucuuuccaa

SEQ ID NO: 420396 - RNA, 16 nt, Homo sapiens
gaaaacugagacucag

SEQ ID NO: 420397 - RNA, 18 nt, Homo sapiens
gaaaacuuaguuugugaa

SEQ ID NO: 420398 - RNA, 20 nt, Homo sapiens
gaaaagaaauugcaugcagu

SEQ ID NO: 420399 - RNA, 17 nt, Homo sapiens
gaaaagagcacuucaca

SEQ ID NO: 420400 - RNA, 22 nt, Homo sapiens
gaaaagaggggaagagacuugg

SEQ ID NO: 420401 - RNA, 15 nt, Homo sapiens
gaaaagaguauguag

SEQ ID NO: 420402 - RNA, 15 nt, Homo sapiens
gaaaagcugccauuu

SEQ ID NO: 420403 - RNA, 16 nt, Homo sapiens
gaaaaggaagacuaga

SEQ ID NO: 420404 - RNA, 14 nt, Homo sapiens
gaaaaggauaugca

SEQ ID NO: 420405 - RNA, 19 nt, Homo sapiens
gaaaauagagaugagcuuu

SEQ ID NO: 420406 - RNA, 20 nt, Homo sapiens
gaaaauauagaccuaugaua

SEQ ID NO: 420407 - RNA, 21 nt, Homo sapiens
gaaaauauagaccuaugauaa

SEQ ID NO: 420408 - RNA, 17 nt, Homo sapiens
gaaaaucaucuuggcca

SEQ ID NO: 420409 - RNA, 20 nt, Homo sapiens
gaaaauccauucauucaauc

SEQ ID NO: 420410 - RNA, 16 nt, Homo sapiens
gaaaaucgaccacagu

SEQ ID NO: 420411 - RNA, 21 nt, Homo sapiens
gaaaaugaagcccuauuacuu

SEQ ID NO: 420412 - RNA, 16 nt, Homo sapiens
gaaaaugaaucuucac

SEQ ID NO: 420413 - RNA, 17 nt, Homo sapiens
gaaaaugaaucuucaca

SEQ ID NO: 420414 - RNA, 15 nt, Homo sapiens
gaaaauggaugacaa

SEQ ID NO: 420415 - RNA, 11 nt, Homo sapiens
gaaaaugucag

SEQ ID NO: 420416 - RNA, 12 nt, Homo sapiens
caucauguugaa

SEQ ID NO: 420417 - RNA, 15 nt, Homo sapiens
caucauguugaauaa

SEQ ID NO: 420418 - RNA, 15 nt, Homo sapiens
cauccaaacauguau

SEQ ID NO: 420419 - RNA, 18 nt, Homo sapiens
cauccaaaucuagccaga

SEQ ID NO: 420420 - RNA, 13 nt, Homo sapiens
cauccaacugaga

SEQ ID NO: 420421 - RNA, 15 nt, Homo sapiens
cauccagcaugugug

SEQ ID NO: 420422 - RNA, 16 nt, Homo sapiens
cauccaggcucccaaa

SEQ ID NO: 420423 - RNA, 13 nt, Homo sapiens
cauccaucugugg

SEQ ID NO: 420424 - RNA, 15 nt, Homo sapiens
cauccccaccuucca

SEQ ID NO: 420425 - RNA, 14 nt, Homo sapiens
caucccugugagca

SEQ ID NO: 420426 - RNA, 17 nt, Homo sapiens
cauccuccacaauagca

SEQ ID NO: 420427 - RNA, 10 nt, Homo sapiens
cauccuccag

SEQ ID NO: 420428 - RNA, 22 nt, Homo sapiens
cauccugaccuccuggacugua

SEQ ID NO: 420429 - RNA, 17 nt, Homo sapiens
cauccuugcaucacugg

SEQ ID NO: 420430 - RNA, 16 nt, Homo sapiens
cauccuuguacauacu

SEQ ID NO: 420431 - RNA, 18 nt, Homo sapiens
caucgcaguggacugugu

SEQ ID NO: 420432 - RNA, 15 nt, Homo sapiens
caucgcgaugucgca

SEQ ID NO: 420433 - RNA, 20 nt, Homo sapiens
caucggguaagaugcuccug

SEQ ID NO: 420434 - RNA, 16 nt, Homo sapiens
caucgguuuauacuau

SEQ ID NO: 420435 - RNA, 11 nt, Homo sapiens
caucuaagaca

SEQ ID NO: 420436 - RNA, 16 nt, Homo sapiens
caucuacaaucaggag

SEQ ID NO: 420437 - RNA, 20 nt, Homo sapiens
caucuacagaccugcggcuu

SEQ ID NO: 420438 - RNA, 16 nt, Homo sapiens
caucuagcuccauaau

SEQ ID NO: 420439 - RNA, 21 nt, Homo sapiens
caucuagcuccauaauugcaa

SEQ ID NO: 420440 - RNA, 21 nt, Homo sapiens
caucuagggaguaugaagaau

SEQ ID NO: 420441 - RNA, 13 nt, Homo sapiens
caucuauggugug

SEQ ID NO: 420442 - RNA, 14 nt, Homo sapiens
caucucagugcagg

SEQ ID NO: 420443 - RNA, 21 nt, Homo sapiens
caucuccagacucuaccacuu

SEQ ID NO: 420444 - RNA, 23 nt, Homo sapiens
caucuccuucccccagcccaaua

SEQ ID NO: 420445 - RNA, 21 nt, Homo sapiens
caucugaagugucuaaugcau

SEQ ID NO: 420446 - RNA, 18 nt, Homo sapiens
caucuggaaggacaucua

SEQ ID NO: 420447 - RNA, 17 nt, Homo sapiens
caucuggauuuucacac

SEQ ID NO: 420448 - RNA, 14 nt, Homo sapiens
caucuguccagagg

SEQ ID NO: 420449 - RNA, 13 nt, Homo sapiens
caucugucuuguc

SEQ ID NO: 420450 - RNA, 20 nt, Homo sapiens
caucugucuugucauuccag

SEQ ID NO: 420451 - RNA, 19 nt, Homo sapiens
caucuguggaaaugacagc

SEQ ID NO: 420452 - RNA, 19 nt, Homo sapiens
caucuguuugauacaguau

SEQ ID NO: 420453 - RNA, 24 nt, Homo sapiens
caucuuauuugucaguguagauca

SEQ ID NO: 420454 - RNA, 16 nt, Homo sapiens
caucuucacugcaauu

SEQ ID NO: 420455 - RNA, 17 nt, Homo sapiens
caugaaagcaccugccc

SEQ ID NO: 420456 - RNA, 12 nt, Homo sapiens
caugaaccacca

SEQ ID NO: 420457 - RNA, 17 nt, Homo sapiens
caugaagauaaauccaa

SEQ ID NO: 420458 - RNA, 17 nt, Homo sapiens
caugaaucucucaauua

SEQ ID NO: 420459 - RNA, 17 nt, Homo sapiens
caugaauguaucaggaa

SEQ ID NO: 420460 - RNA, 11 nt, Homo sapiens
caugaauucau

SEQ ID NO: 420461 - RNA, 16 nt, Homo sapiens
caugacacucuaguga

SEQ ID NO: 420462 - RNA, 18 nt, Homo sapiens
caugacacucuagugacu

SEQ ID NO: 420463 - RNA, 24 nt, Homo sapiens
caugaccuccguguagugucugua

SEQ ID NO: 420464 - RNA, 18 nt, Homo sapiens
caugaccugugaccagca

SEQ ID NO: 420465 - RNA, 20 nt, Homo sapiens
caugacugcauuuuacugua

SEQ ID NO: 420466 - RNA, 17 nt, Homo sapiens
caugacuuuuccaugua

SEQ ID NO: 420467 - RNA, 14 nt, Homo sapiens
caugagaauaagag

SEQ ID NO: 420468 - RNA, 20 nt, Homo sapiens
caugagaaugucauuugcua

SEQ ID NO: 420469 - RNA, 18 nt, Homo sapiens
caugagaccacuguuauc

SEQ ID NO: 420470 - RNA, 14 nt, Homo sapiens
caugagaugaugcc

SEQ ID NO: 420471 - RNA, 21 nt, Homo sapiens
caugagcgucuguggagccau

SEQ ID NO: 420472 - RNA, 18 nt, Homo sapiens
caugaguucaaauacuuu

SEQ ID NO: 420473 - RNA, 22 nt, Homo sapiens
caugauaaaauaaguaacauau

SEQ ID NO: 420474 - RNA, 15 nt, Homo sapiens
caugauaucacuucu

SEQ ID NO: 420475 - RNA, 17 nt, Homo sapiens
caugauguauuguugcu

SEQ ID NO: 420476 - RNA, 13 nt, Homo sapiens
caugaugucugca

SEQ ID NO: 420477 - RNA, 15 nt, Homo sapiens
caugauuguuuacag

SEQ ID NO: 420478 - RNA, 20 nt, Homo sapiens
caugauuuuggcucacugca

SEQ ID NO: 420479 - RNA, 22 nt, Homo sapiens
caugauuuuuuuuuuucagucc

SEQ ID NO: 420480 - RNA, 18 nt, Homo sapiens
caugcaaagcaacgacua

SEQ ID NO: 420481 - RNA, 15 nt, Homo sapiens
caugcaacuccaugc

SEQ ID NO: 420482 - RNA, 23 nt, Homo sapiens
caugcaagggaugaauuguaaaa

SEQ ID NO: 420483 - RNA, 14 nt, Homo sapiens
caugcacacacaca

SEQ ID NO: 420484 - RNA, 21 nt, Homo sapiens
caugcagcaaggggacaucuu

SEQ ID NO: 420485 - RNA, 18 nt, Homo sapiens
caugcagugccggcugcc

SEQ ID NO: 420486 - RNA, 17 nt, Homo sapiens
caugcaugugcauauag

SEQ ID NO: 420487 - RNA, 21 nt, Homo sapiens
caugcauuuugcagcagugag

SEQ ID NO: 420488 - RNA, 14 nt, Homo sapiens
caugcccagcugcu

SEQ ID NO: 420489 - RNA, 14 nt, Homo sapiens
caugccucagugaa

SEQ ID NO: 420490 - RNA, 22 nt, Homo sapiens
caugccuguaaucccaacacuu

SEQ ID NO: 420491 - RNA, 18 nt, Homo sapiens
caugcucaguuggugcug

SEQ ID NO: 420492 - RNA, 16 nt, Homo sapiens
caugcucccagcauuu

SEQ ID NO: 420493 - RNA, 13 nt, Homo sapiens
caugcuccucacc

SEQ ID NO: 420494 - RNA, 21 nt, Homo sapiens
caugcuggcucccagggccau

SEQ ID NO: 420495 - RNA, 22 nt, Homo sapiens
caugcuggcucccagggccaug

SEQ ID NO: 420496 - RNA, 14 nt, Homo sapiens
caugcuucaugaaa

SEQ ID NO: 420497 - RNA, 21 nt, Homo sapiens
caugcuuccuccuuugcucuu

SEQ ID NO: 420498 - RNA, 23 nt, Homo sapiens
caugcuuuagauuauauauuccg

SEQ ID NO: 420499 - RNA, 18 nt, Homo sapiens
cauggaaacgcaaaugag

SEQ ID NO: 420500 - RNA, 14 nt, Homo sapiens
cauggaaguacuau

SEQ ID NO: 420501 - RNA, 23 nt, Homo sapiens
cauggaggaauugggaccugguu

SEQ ID NO: 420502 - RNA, 14 nt, Homo sapiens
cauggaguguuuga

SEQ ID NO: 420503 - RNA, 15 nt, Homo sapiens
cauggauaacacauu

SEQ ID NO: 420504 - RNA, 13 nt, Homo sapiens
cauggaugcaugc

SEQ ID NO: 420505 - RNA, 19 nt, Homo sapiens
cauggauucauuacagcuu

SEQ ID NO: 420506 - RNA, 19 nt, Homo sapiens
cauggccaccccgugccac

SEQ ID NO: 420507 - RNA, 14 nt, Homo sapiens
cauggccaccucca

SEQ ID NO: 420508 - RNA, 21 nt, Homo sapiens
cauggccagguggccacucca

SEQ ID NO: 420509 - RNA, 14 nt, Homo sapiens
cauggcccugccau

SEQ ID NO: 420510 - RNA, 20 nt, Homo sapiens
cauggccgggcccucuguag

SEQ ID NO: 420511 - RNA, 15 nt, Homo sapiens
cauggccugugcugg

SEQ ID NO: 420512 - RNA, 18 nt, Homo sapiens
cauggcguaaugggccug

SEQ ID NO: 420513 - RNA, 19 nt, Homo sapiens
cauggcuccucaccaccga

SEQ ID NO: 420514 - RNA, 21 nt, Homo sapiens
cauggcugaaggaaaccagug

SEQ ID NO: 420515 - RNA, 16 nt, Homo sapiens
caugggaaacuuccaa

SEQ ID NO: 420516 - RNA, 17 nt, Homo sapiens
caugggaaugaauguca

SEQ ID NO: 420517 - RNA, 13 nt, Homo sapiens
caugggacugugc

SEQ ID NO: 420518 - RNA, 19 nt, Homo sapiens
cauggguggagggucccua

SEQ ID NO: 420519 - RNA, 16 nt, Homo sapiens
caugguagacugugac

SEQ ID NO: 420520 - RNA, 19 nt, Homo sapiens
caugguaggcuacuuuuca

SEQ ID NO: 420521 - RNA, 21 nt, Homo sapiens
caugguccauuucaugugauc

SEQ ID NO: 420522 - RNA, 17 nt, Homo sapiens
caugguuuaaagucaca

SEQ ID NO: 420523 - RNA, 14 nt, Homo sapiens
cauguaaaugcuca

SEQ ID NO: 420524 - RNA, 19 nt, Homo sapiens
cauguaaaugcucaaagau

SEQ ID NO: 420525 - RNA, 21 nt, Homo sapiens
cauguagaauuauaacuaauu

SEQ ID NO: 420526 - RNA, 22 nt, Homo sapiens
cauguaucuaccucacuauuca

SEQ ID NO: 420527 - RNA, 14 nt, Homo sapiens
cauguaugugcgaa

SEQ ID NO: 420528 - RNA, 15 nt, Homo sapiens
cauguauuaccugaa

SEQ ID NO: 420529 - RNA, 21 nt, Homo sapiens
cauguccugcugcuucugcaa

SEQ ID NO: 420530 - RNA, 12 nt, Homo sapiens
caugucuuucag

SEQ ID NO: 420531 - RNA, 22 nt, Homo sapiens
caugugacaugaacccauccaa

SEQ ID NO: 420532 - RNA, 19 nt, Homo sapiens
caugugacuggcaguauua

SEQ ID NO: 420533 - RNA, 14 nt, Homo sapiens
caugugacuguauu

SEQ ID NO: 420534 - RNA, 15 nt, Homo sapiens
gcaugaauagauucu

SEQ ID NO: 420535 - RNA, 13 nt, Homo sapiens
gcaugaaucuucc

SEQ ID NO: 420536 - RNA, 15 nt, Homo sapiens
gcaugaaucuucccu

SEQ ID NO: 420537 - RNA, 20 nt, Homo sapiens
gcaugacaaacacacaucca

SEQ ID NO: 420538 - RNA, 14 nt, Homo sapiens
gcaugacagcuguu

SEQ ID NO: 420539 - RNA, 23 nt, Homo sapiens
gcaugacagcuguuccacagggg

SEQ ID NO: 420540 - RNA, 20 nt, Homo sapiens
gcaugauauuguauguaccu

SEQ ID NO: 420541 - RNA, 16 nt, Homo sapiens
gcaugcagugcccuca

SEQ ID NO: 420542 - RNA, 17 nt, Homo sapiens
gcaugccaaauguucca

SEQ ID NO: 420543 - RNA, 14 nt, Homo sapiens
gcaugccacccuca

SEQ ID NO: 420544 - RNA, 20 nt, Homo sapiens
gcaugcccuaagagugucac

SEQ ID NO: 420545 - RNA, 23 nt, Homo sapiens
gcaugcccuaagagugucacuga

SEQ ID NO: 420546 - RNA, 23 nt, Homo sapiens
caugugugcgagugugugcaugu

SEQ ID NO: 420547 - RNA, 17 nt, Homo sapiens
caugugugcgugugcgu

SEQ ID NO: 420548 - RNA, 20 nt, Homo sapiens
caugugugcgugugcgugca

SEQ ID NO: 420549 - RNA, 15 nt, Homo sapiens
caugugugugcaagu

SEQ ID NO: 420550 - RNA, 15 nt, Homo sapiens
cauguguugcaaauu

SEQ ID NO: 420551 - RNA, 18 nt, Homo sapiens
cauguuauuuauaguguu

SEQ ID NO: 420552 - RNA, 20 nt, Homo sapiens
cauguuccuguuuaugcauu

SEQ ID NO: 420553 - RNA, 17 nt, Homo sapiens
cauguuggauagucagc

SEQ ID NO: 420554 - RNA, 22 nt, Homo sapiens
cauguuggccaggcuggucuca

SEQ ID NO: 420555 - RNA, 16 nt, Homo sapiens
cauguuuaauguuauc

SEQ ID NO: 420556 - RNA, 22 nt, Homo sapiens
cauguuucaagaaaauggauuu

SEQ ID NO: 420557 - RNA, 12 nt, Homo sapiens
cauguuuccauc

SEQ ID NO: 420558 - RNA, 23 nt, Homo sapiens
cauguuucccgcuccaagagaau

SEQ ID NO: 420559 - RNA, 22 nt, Homo sapiens
cauuaaaaggcccuucaccucu

SEQ ID NO: 420560 - RNA, 15 nt, Homo sapiens
cauuaaacacuguaa

SEQ ID NO: 420561 - RNA, 17 nt, Homo sapiens
cauuaacaaaagcaauu

SEQ ID NO: 420562 - RNA, 12 nt, Homo sapiens
cauuaacagugc

SEQ ID NO: 420563 - RNA, 21 nt, Homo sapiens
cauuaacaguuuuccaugaaa

SEQ ID NO: 420564 - RNA, 13 nt, Homo sapiens
cauuaacuucucu

SEQ ID NO: 420565 - RNA, 14 nt, Homo sapiens
cauuaauacaaaga

SEQ ID NO: 420566 - RNA, 23 nt, Homo sapiens
cauuacagagaggagaaacacau

SEQ ID NO: 420567 - RNA, 13 nt, Homo sapiens
cauuacauggcug

SEQ ID NO: 420568 - RNA, 14 nt, Homo sapiens
cauuaccucccuau

SEQ ID NO: 420569 - RNA, 22 nt, Homo sapiens
cauuacuuuaauacucaccucc

SEQ ID NO: 420570 - RNA, 14 nt, Homo sapiens
cauuagaaacugaa

SEQ ID NO: 420571 - RNA, 23 nt, Homo sapiens
cauuagaaacugaaaacuguaaa

SEQ ID NO: 420572 - RNA, 20 nt, Homo sapiens
cauuagcgauccauguaauc

SEQ ID NO: 420573 - RNA, 13 nt, Homo sapiens
cauuagcucucau

SEQ ID NO: 420574 - RNA, 22 nt, Homo sapiens
cauuaggggguuuguugcacag

SEQ ID NO: 420575 - RNA, 15 nt, Homo sapiens
cauuagucacuuuga

SEQ ID NO: 420576 - RNA, 18 nt, Homo sapiens
cauuaucgggagcagugu

SEQ ID NO: 420577 - RNA, 16 nt, Homo sapiens
cauuauuauuacuuuu

SEQ ID NO: 420578 - RNA, 22 nt, Homo sapiens
cauuauucaagaaagauaucua

SEQ ID NO: 420579 - RNA, 20 nt, Homo sapiens
cauuauucucugaugcacug

SEQ ID NO: 420580 - RNA, 21 nt, Homo sapiens
cauuauucucugaugcacugu

SEQ ID NO: 420581 - RNA, 15 nt, Homo sapiens
cauuauucuuucuaa

SEQ ID NO: 420582 - RNA, 18 nt, Homo sapiens
cauuauuucaucaugacu

SEQ ID NO: 420583 - RNA, 17 nt, Homo sapiens
cauuauuuugaauguga

SEQ ID NO: 420584 - RNA, 20 nt, Homo sapiens
cauucaaaagcacaaacccu

SEQ ID NO: 420585 - RNA, 15 nt, Homo sapiens
cauucaaaauaguuc

SEQ ID NO: 420586 - RNA, 17 nt, Homo sapiens
cauucaacucuccaaug

SEQ ID NO: 420587 - RNA, 17 nt, Homo sapiens
cauucacuugcauuucu

SEQ ID NO: 420588 - RNA, 18 nt, Homo sapiens
cauucagauuuaccauaa

SEQ ID NO: 420589 - RNA, 13 nt, Homo sapiens
cauucaguauuaa

SEQ ID NO: 420590 - RNA, 16 nt, Homo sapiens
cauucauauuccugcc

SEQ ID NO: 420591 - RNA, 16 nt, Homo sapiens
cauucaucaagcugua

SEQ ID NO: 420592 - RNA, 22 nt, Homo sapiens
cauucaugagauuggucauuaa

SEQ ID NO: 420593 - RNA, 15 nt, Homo sapiens
cauuccaaauaugag

SEQ ID NO: 420594 - RNA, 10 nt, Homo sapiens
cauuccacau

SEQ ID NO: 420595 - RNA, 22 nt, Homo sapiens
cauuccacauccccaccuucca

SEQ ID NO: 420596 - RNA, 13 nt, Homo sapiens
cauuccaucacag

SEQ ID NO: 420597 - RNA, 13 nt, Homo sapiens
cauuccauuugaa

SEQ ID NO: 420598 - RNA, 20 nt, Homo sapiens
cauucccagaauuugcugca

SEQ ID NO: 420599 - RNA, 13 nt, Homo sapiens
cauucccccaugu

SEQ ID NO: 420600 - RNA, 23 nt, Homo sapiens
cauuccgaaaaaaaaauguucau

SEQ ID NO: 420601 - RNA, 17 nt, Homo sapiens
cauuccucaugaaugua

SEQ ID NO: 420602 - RNA, 21 nt, Homo sapiens
cauuccugaaagaaacaguua

SEQ ID NO: 420603 - RNA, 13 nt, Homo sapiens
cauuccugagauu

SEQ ID NO: 420604 - RNA, 13 nt, Homo sapiens
cauucgucaucac

SEQ ID NO: 420605 - RNA, 23 nt, Homo sapiens
cauucguccuuagaauacuguau

SEQ ID NO: 420606 - RNA, 15 nt, Homo sapiens
cauucuaugacaaua

SEQ ID NO: 420607 - RNA, 15 nt, Homo sapiens
cauucuccugccuca

SEQ ID NO: 420608 - RNA, 15 nt, Homo sapiens
cauucucuuguuauu

SEQ ID NO: 420609 - RNA, 13 nt, Homo sapiens
cauucuucacugu

SEQ ID NO: 420610 - RNA, 14 nt, Homo sapiens
cauucuuccaaaaa

SEQ ID NO: 420611 - RNA, 18 nt, Homo sapiens
cauucuuuaucuugacau

SEQ ID NO: 420612 - RNA, 12 nt, Homo sapiens
cauucuuuuaua

SEQ ID NO: 420613 - RNA, 20 nt, Homo sapiens
cauugaugacccucugaccc

SEQ ID NO: 420614 - RNA, 13 nt, Homo sapiens
cauugcacuccag

SEQ ID NO: 420615 - RNA, 14 nt, Homo sapiens
cauugcacuuuaua

SEQ ID NO: 420616 - RNA, 22 nt, Homo sapiens
cauugcacuuuauaaacacugu

SEQ ID NO: 420617 - RNA, 18 nt, Homo sapiens
cauugcccgaaaccagag

SEQ ID NO: 420618 - RNA, 15 nt, Homo sapiens
cauugccuuccuacc

SEQ ID NO: 420619 - RNA, 15 nt, Homo sapiens
cauugcuuaugacau

SEQ ID NO: 420620 - RNA, 17 nt, Homo sapiens
cauugcuucacuaccca

SEQ ID NO: 420621 - RNA, 15 nt, Homo sapiens
cauugcuuucgugua

SEQ ID NO: 420622 - RNA, 16 nt, Homo sapiens
cauuggaugugcauuu

SEQ ID NO: 420623 - RNA, 19 nt, Homo sapiens
cauugggcugacaccuacc

SEQ ID NO: 420624 - RNA, 20 nt, Homo sapiens
cauuguaaacaaacugugua

SEQ ID NO: 420625 - RNA, 21 nt, Homo sapiens
cauuguaaaguuuaugucacc

SEQ ID NO: 420626 - RNA, 13 nt, Homo sapiens
cauuguaguuaau

SEQ ID NO: 420627 - RNA, 22 nt, Homo sapiens
cauuguaugauguguugugaua

SEQ ID NO: 420628 - RNA, 13 nt, Homo sapiens
cauuguauguauc

SEQ ID NO: 420629 - RNA, 17 nt, Homo sapiens
cauugucaccacacccu

SEQ ID NO: 420630 - RNA, 20 nt, Homo sapiens
cauugugaagcaccuacuau

SEQ ID NO: 420631 - RNA, 15 nt, Homo sapiens
cauugugaggguuaa

SEQ ID NO: 420632 - RNA, 21 nt, Homo sapiens
cauuguggcuccuaucugugu

SEQ ID NO: 420633 - RNA, 20 nt, Homo sapiens
cauuuaauacagcaguguca

SEQ ID NO: 420634 - RNA, 14 nt, Homo sapiens
cauuuacuugauca

SEQ ID NO: 420635 - RNA, 11 nt, Homo sapiens
cauuuacuuuu

SEQ ID NO: 420636 - RNA, 22 nt, Homo sapiens
cauuuagaaaauagagcuuuua

SEQ ID NO: 420637 - RNA, 12 nt, Homo sapiens
cauuuagcacaa

SEQ ID NO: 420638 - RNA, 13 nt, Homo sapiens
cauuuagcacaaa

SEQ ID NO: 420639 - RNA, 19 nt, Homo sapiens
cauuuauuuacaugugauu

SEQ ID NO: 420640 - RNA, 15 nt, Homo sapiens
cauuuauuugaaaaa

SEQ ID NO: 420641 - RNA, 13 nt, Homo sapiens
cauuucagagccc

SEQ ID NO: 420642 - RNA, 13 nt, Homo sapiens
cauuucaguauca

SEQ ID NO: 420643 - RNA, 21 nt, Homo sapiens
cauuucauaaaaaucccucuu

SEQ ID NO: 420644 - RNA, 22 nt, Homo sapiens
cauuuccucaggcaauuccuuu

SEQ ID NO: 420645 - RNA, 14 nt, Homo sapiens
cauuucuacuuuau

SEQ ID NO: 420646 - RNA, 21 nt, Homo sapiens
cauuucuauuuauuuacugag

SEQ ID NO: 420647 - RNA, 17 nt, Homo sapiens
cauuucuucagagggaa

SEQ ID NO: 420648 - RNA, 18 nt, Homo sapiens
cauuucuugguaugauca

SEQ ID NO: 420649 - RNA, 16 nt, Homo sapiens
cauuugcaccuaccuc

SEQ ID NO: 420650 - RNA, 14 nt, Homo sapiens
cauuugcauuugcu

SEQ ID NO: 420651 - RNA, 14 nt, Homo sapiens
cauuugcuuugucc

SEQ ID NO: 420652 - RNA, 21 nt, Homo sapiens
cauuuguaaaugucuuuucaa

SEQ ID NO: 420653 - RNA, 16 nt, Homo sapiens
cauuuguaccucgagu

SEQ ID NO: 420654 - RNA, 12 nt, Homo sapiens
cauuugucacag

SEQ ID NO: 420655 - RNA, 20 nt, Homo sapiens
cauuuguggucugacuccuu

SEQ ID NO: 420656 - RNA, 14 nt, Homo sapiens
cauuuguguggaaa

SEQ ID NO: 420657 - RNA, 18 nt, Homo sapiens
cauuugugugugugcaag

SEQ ID NO: 420658 - RNA, 19 nt, Homo sapiens
cauuugugugugugcaagu

SEQ ID NO: 420659 - RNA, 15 nt, Homo sapiens
cauuuuacugucugu

SEQ ID NO: 420660 - RNA, 22 nt, Homo sapiens
cauuuuauucacauaugucuua

SEQ ID NO: 420661 - RNA, 16 nt, Homo sapiens
cauuuuauucuuuaag

SEQ ID NO: 420662 - RNA, 10 nt, Homo sapiens
cauuuugcca

SEQ ID NO: 420663 - RNA, 11 nt, Homo sapiens
cauuuugccaa

SEQ ID NO: 420664 - RNA, 21 nt, Homo sapiens
cauuuugcuugcgugcuggga

SEQ ID NO: 420665 - RNA, 23 nt, Homo sapiens
cauuuuuaaaggacaaacaguga

SEQ ID NO: 420666 - RNA, 17 nt, Homo sapiens
cauuuuuaaguauuuca

SEQ ID NO: 420667 - RNA, 19 nt, Homo sapiens
cauuuuucauagauaccau

SEQ ID NO: 420668 - RNA, 17 nt, Homo sapiens
cauuuuuuucacuggag

SEQ ID NO: 420669 - RNA, 20 nt, Homo sapiens
gcccauucuaaacuccuuuc

SEQ ID NO: 420670 - RNA, 11 nt, Homo sapiens
gcccauugcac

SEQ ID NO: 420671 - RNA, 12 nt, Homo sapiens
gcccauugcacu

SEQ ID NO: 420672 - RNA, 16 nt, Homo sapiens
gccccaaccugcugaa

SEQ ID NO: 420673 - RNA, 11 nt, Homo sapiens
gccccagagac

SEQ ID NO: 420674 - RNA, 14 nt, Homo sapiens
gccccagaucugcc

SEQ ID NO: 420675 - RNA, 14 nt, Homo sapiens
gccccagcugugac

SEQ ID NO: 420676 - RNA, 17 nt, Homo sapiens
gccccagcugugacuga

SEQ ID NO: 420677 - RNA, 22 nt, Homo sapiens
ccaaacuguaguaauuguuaca

SEQ ID NO: 420678 - RNA, 22 nt, Homo sapiens
ccaaagaccugccugugugcuc

SEQ ID NO: 420679 - RNA, 17 nt, Homo sapiens
ccaaagagaaaagauua

SEQ ID NO: 420680 - RNA, 19 nt, Homo sapiens
ccaaagagcugccuaagag

SEQ ID NO: 420681 - RNA, 22 nt, Homo sapiens
ccaaagcaugauugugaccucc

SEQ ID NO: 420682 - RNA, 18 nt, Homo sapiens
ccaaaggauaaguguccc

SEQ ID NO: 420683 - RNA, 20 nt, Homo sapiens
ccaaaggcauccauagugca

SEQ ID NO: 420684 - RNA, 22 nt, Homo sapiens
ccaaaggggcugcuggggcaug

SEQ ID NO: 420685 - RNA, 15 nt, Homo sapiens
ccaaagguagaacuu

SEQ ID NO: 420686 - RNA, 19 nt, Homo sapiens
ccaaagguuucaacuguaa

SEQ ID NO: 420687 - RNA, 13 nt, Homo sapiens
ccaaaguguuaau

SEQ ID NO: 420688 - RNA, 13 nt, Homo sapiens
ccaaaguuugcuc

SEQ ID NO: 420689 - RNA, 21 nt, Homo sapiens
ccaaauaaaacuugagcccac

SEQ ID NO: 420690 - RNA, 23 nt, Homo sapiens
ccaaauaaacucuaaacauuaau

SEQ ID NO: 420691 - RNA, 15 nt, Homo sapiens
ccaaauaaauauauu

SEQ ID NO: 420692 - RNA, 15 nt, Homo sapiens
ccaaauaaaugcuca

SEQ ID NO: 420693 - RNA, 23 nt, Homo sapiens
ccaaauauaaagaggacuugaac

SEQ ID NO: 420694 - RNA, 15 nt, Homo sapiens
ccaaauaugagaugc

SEQ ID NO: 420695 - RNA, 16 nt, Homo sapiens
ccaaauaugcacuuuc

SEQ ID NO: 420696 - RNA, 16 nt, Homo sapiens
ccaaauccacaagcca

SEQ ID NO: 420697 - RNA, 12 nt, Homo sapiens
ccaaaugagauc

SEQ ID NO: 420698 - RNA, 22 nt, Homo sapiens
ccaaaugcugugcaaacagugu

SEQ ID NO: 420699 - RNA, 13 nt, Homo sapiens
ccaaauguuccau

SEQ ID NO: 420700 - RNA, 12 nt, Homo sapiens
ccaaauuaucaa

SEQ ID NO: 420701 - RNA, 18 nt, Homo sapiens
ccaacaacuccaggaaaa

SEQ ID NO: 420702 - RNA, 17 nt, Homo sapiens
ccaacacaaggugggca

SEQ ID NO: 420703 - RNA, 12 nt, Homo sapiens
ccaacaccacag

SEQ ID NO: 420704 - RNA, 15 nt, Homo sapiens
ccaacaccaucacag

SEQ ID NO: 420705 - RNA, 21 nt, Homo sapiens
ccaacaccugccuccacuucu

SEQ ID NO: 420706 - RNA, 18 nt, Homo sapiens
ccaacagccaagacccaa

SEQ ID NO: 420707 - RNA, 20 nt, Homo sapiens
ccaacaucaacaucuugguc

SEQ ID NO: 420708 - RNA, 19 nt, Homo sapiens
ccaacauugccuugcauuu

SEQ ID NO: 420709 - RNA, 15 nt, Homo sapiens
ccaaccaaugcacac

SEQ ID NO: 420710 - RNA, 21 nt, Homo sapiens
ccaaccaguccucaguucucu

SEQ ID NO: 420711 - RNA, 16 nt, Homo sapiens
ccaacgaaaagcacau

SEQ ID NO: 420712 - RNA, 17 nt, Homo sapiens
ccaacgagcuguacaug

SEQ ID NO: 420713 - RNA, 19 nt, Homo sapiens
ccaacggugguaugcugca

SEQ ID NO: 420714 - RNA, 14 nt, Homo sapiens
ccaacguacuccuc

SEQ ID NO: 420715 - RNA, 21 nt, Homo sapiens
ccaacguggggcagcacagag

SEQ ID NO: 420716 - RNA, 13 nt, Homo sapiens
ccaacuccagggg

SEQ ID NO: 420717 - RNA, 13 nt, Homo sapiens
ccaacuccaugac

SEQ ID NO: 420718 - RNA, 20 nt, Homo sapiens
ccaacuccgcccagccucuc

SEQ ID NO: 420719 - RNA, 17 nt, Homo sapiens
ccaacuuaaguuuagaa

SEQ ID NO: 420720 - RNA, 17 nt, Homo sapiens
ccaagaauucuccaaaa

SEQ ID NO: 420721 - RNA, 15 nt, Homo sapiens
ccaagacagugaagu

SEQ ID NO: 420722 - RNA, 17 nt, Homo sapiens
ccaagacaguggcagca

SEQ ID NO: 420723 - RNA, 22 nt, Homo sapiens
ccaagaccugacucaggcauca

SEQ ID NO: 420724 - RNA, 20 nt, Homo sapiens
ccaagaccuuacaaccacau

SEQ ID NO: 420725 - RNA, 17 nt, Homo sapiens
ccaagagguuaggugaa

SEQ ID NO: 420726 - RNA, 17 nt, Homo sapiens
ccaagaucacaaauagu

SEQ ID NO: 420727 - RNA, 18 nt, Homo sapiens
ccaagcaggaaccccagg

SEQ ID NO: 420728 - RNA, 15 nt, Homo sapiens
ccaagcaugccccac

SEQ ID NO: 420729 - RNA, 21 nt, Homo sapiens
ccaagccaggguuccagacag

SEQ ID NO: 420730 - RNA, 16 nt, Homo sapiens
ccaagcccucaauaag

SEQ ID NO: 420731 - RNA, 18 nt, Homo sapiens
ccaagcuggagugcagug

SEQ ID NO: 420732 - RNA, 14 nt, Homo sapiens
ccaaggcaggcaua

SEQ ID NO: 420733 - RNA, 14 nt, Homo sapiens
ccaagggacagugg

SEQ ID NO: 420734 - RNA, 19 nt, Homo sapiens
ccaagggcagguugaucag

SEQ ID NO: 420735 - RNA, 15 nt, Homo sapiens
ccaaggggcagucug

SEQ ID NO: 420736 - RNA, 20 nt, Homo sapiens
ccaagggguagaaguggcau

SEQ ID NO: 420737 - RNA, 15 nt, Homo sapiens
ccaaguauuuugcca

SEQ ID NO: 420738 - RNA, 14 nt, Homo sapiens
ccaaguccagugug

SEQ ID NO: 420739 - RNA, 18 nt, Homo sapiens
ccaaguccucccucucua

SEQ ID NO: 420740 - RNA, 17 nt, Homo sapiens
ccaagugugugugcaau

SEQ ID NO: 420741 - RNA, 18 nt, Homo sapiens
ccaagugugugugcaaug

SEQ ID NO: 420742 - RNA, 13 nt, Homo sapiens
ccaaguuccguca

SEQ ID NO: 420743 - RNA, 20 nt, Homo sapiens
ccaaguucuucaccucuauc

SEQ ID NO: 420744 - RNA, 17 nt, Homo sapiens
ccaauaaaggucccuua

SEQ ID NO: 420745 - RNA, 20 nt, Homo sapiens
ccaauauuucucagacaucg

SEQ ID NO: 420746 - RNA, 19 nt, Homo sapiens
ccaaucagcuuuuguucua

SEQ ID NO: 420747 - RNA, 20 nt, Homo sapiens
ccaaucagcuuuuguucuag

SEQ ID NO: 420748 - RNA, 19 nt, Homo sapiens
ccaaucccaccaacccuca

SEQ ID NO: 420749 - RNA, 13 nt, Homo sapiens
ccaaucuccauca

SEQ ID NO: 420750 - RNA, 22 nt, Homo sapiens
ccaaucuccggugugagcccac

SEQ ID NO: 420751 - RNA, 13 nt, Homo sapiens
ccaaugcaugcag

SEQ ID NO: 420752 - RNA, 16 nt, Homo sapiens
ccaaugcucuccuuaa

SEQ ID NO: 420753 - RNA, 16 nt, Homo sapiens
ccaauuagcauuccau

SEQ ID NO: 420754 - RNA, 15 nt, Homo sapiens
ccaauuaugugacaa

SEQ ID NO: 420755 - RNA, 16 nt, Homo sapiens
ccaauuccaaguuuua

SEQ ID NO: 420756 - RNA, 16 nt, Homo sapiens
ccacaaacugccuguu

SEQ ID NO: 420757 - RNA, 15 nt, Homo sapiens
ccacaagcaccugcu

SEQ ID NO: 420758 - RNA, 13 nt, Homo sapiens
ccacaagccauuu

SEQ ID NO: 420759 - RNA, 21 nt, Homo sapiens
ccacaaggcugaaaagugcuu

SEQ ID NO: 420760 - RNA, 22 nt, Homo sapiens
ccacaauuagagcuugaugccu

SEQ ID NO: 420761 - RNA, 14 nt, Homo sapiens
ccacacaccacaga

SEQ ID NO: 420762 - RNA, 11 nt, Homo sapiens
ccacaccucag

SEQ ID NO: 420763 - RNA, 22 nt, Homo sapiens
ccacaccuggcccuugcaaucu

SEQ ID NO: 420764 - RNA, 14 nt, Homo sapiens
ccacacguuugcca

SEQ ID NO: 420765 - RNA, 20 nt, Homo sapiens
ccacacuaccaguuucacac

SEQ ID NO: 420766 - RNA, 16 nt, Homo sapiens
ccacacucugacgcaa

SEQ ID NO: 420767 - RNA, 13 nt, Homo sapiens
ccacacugaccac

SEQ ID NO: 420768 - RNA, 14 nt, Homo sapiens
ccacacugcuacac

SEQ ID NO: 420769 - RNA, 21 nt, Homo sapiens
ccacacugcuacacuucugau

SEQ ID NO: 420770 - RNA, 14 nt, Homo sapiens
ccacagaagacacg

SEQ ID NO: 420771 - RNA, 24 nt, Homo sapiens
ccacagaauacaagccacuaccuu

SEQ ID NO: 420772 - RNA, 20 nt, Homo sapiens
ccacagaccuaggauuucau

SEQ ID NO: 420773 - RNA, 17 nt, Homo sapiens
ccacagaggacagugcu

SEQ ID NO: 420774 - RNA, 23 nt, Homo sapiens
ccacagagucuguguguagccag

SEQ ID NO: 420775 - RNA, 23 nt, Homo sapiens
ccacagggcgagacuccgucuca

SEQ ID NO: 420776 - RNA, 22 nt, Homo sapiens
ccacagucucucccugggguuu

SEQ ID NO: 420777 - RNA, 23 nt, Homo sapiens
ccacauggccgggcccucuguag

SEQ ID NO: 420778 - RNA, 22 nt, Homo sapiens
ccacauuagccuuugcacugua

SEQ ID NO: 420779 - RNA, 22 nt, Homo sapiens
ccacauuaggucaccugugcac

SEQ ID NO: 420780 - RNA, 13 nt, Homo sapiens
ccaccaacauaaa

SEQ ID NO: 420781 - RNA, 10 nt, Homo sapiens
ccacccaaac

SEQ ID NO: 420782 - RNA, 13 nt, Homo sapiens
ccaccccagcuca

SEQ ID NO: 420783 - RNA, 23 nt, Homo sapiens
ccacccccaaauuuucuuuuuau

SEQ ID NO: 420784 - RNA, 17 nt, Homo sapiens
ccacccuaauuugcccu

SEQ ID NO: 420785 - RNA, 13 nt, Homo sapiens
ccacccuaguccc

SEQ ID NO: 420786 - RNA, 12 nt, Homo sapiens
ccacccuugugu

SEQ ID NO: 420787 - RNA, 22 nt, Homo sapiens
ccaccuagagcuagaugugucu

SEQ ID NO: 420788 - RNA, 18 nt, Homo sapiens
ccaccucacaacuccuuc

SEQ ID NO: 420789 - RNA, 10 nt, Homo sapiens
ccaccucuca

SEQ ID NO: 420790 - RNA, 10 nt, Homo sapiens
ccaccucucc

SEQ ID NO: 420791 - RNA, 21 nt, Homo sapiens
ccaccucugaggacucuggac

SEQ ID NO: 420792 - RNA, 14 nt, Homo sapiens
ccaccucuucacuc

SEQ ID NO: 420793 - RNA, 15 nt, Homo sapiens
ccaccugcccaucac

SEQ ID NO: 420794 - RNA, 22 nt, Homo sapiens
ccaccugccugcaucugugaaa

SEQ ID NO: 420795 - RNA, 22 nt, Homo sapiens
ccaccuggauggaucugcucca

SEQ ID NO: 420796 - RNA, 14 nt, Homo sapiens
ccaccugugcugcu

SEQ ID NO: 420797 - RNA, 13 nt, Homo sapiens
ccaccuugcacua

SEQ ID NO: 420798 - RNA, 20 nt, Homo sapiens
ccaccuuugggaucagccuc

SEQ ID NO: 420799 - RNA, 20 nt, Homo sapiens
ccacgaccuuugaagagcuu

SEQ ID NO: 420800 - RNA, 21 nt, Homo sapiens
ccacgaggugguagcucugag

SEQ ID NO: 420801 - RNA, 19 nt, Homo sapiens
ccacgcagagccccggagc

SEQ ID NO: 420802 - RNA, 16 nt, Homo sapiens
ccacggcucuaggugg

SEQ ID NO: 420803 - RNA, 19 nt, Homo sapiens
gccuuaauucuuaccucau

SEQ ID NO: 420804 - RNA, 11 nt, Homo sapiens
gccuuacacaa

SEQ ID NO: 420805 - RNA, 15 nt, Homo sapiens
gccuucacuggagac

SEQ ID NO: 420806 - RNA, 21 nt, Homo sapiens
gccuucaucuucacugcaauu

SEQ ID NO: 420807 - RNA, 19 nt, Homo sapiens
uucaacucugugucccagc

SEQ ID NO: 420808 - RNA, 15 nt, Homo sapiens
uucaacuucaggaaa

SEQ ID NO: 420809 - RNA, 22 nt, Homo sapiens
uucaagaaagauaucuaugacu

SEQ ID NO: 420810 - RNA, 14 nt, Homo sapiens
uucaagacuuccuc

SEQ ID NO: 420811 - RNA, 11 nt, Homo sapiens
uucaagagcca

SEQ ID NO: 420812 - RNA, 12 nt, Homo sapiens
uucaagagccag

SEQ ID NO: 420813 - RNA, 18 nt, Homo sapiens
uucaagauuaaacugagu

SEQ ID NO: 420814 - RNA, 16 nt, Homo sapiens
uucaagccugugaaua

SEQ ID NO: 420815 - RNA, 18 nt, Homo sapiens
uucaaggaggaaagaaga

SEQ ID NO: 420816 - RNA, 22 nt, Homo sapiens
uucaagggcugcuucaaacuca

SEQ ID NO: 420817 - RNA, 20 nt, Homo sapiens
uucaagugaguggcaugugg

SEQ ID NO: 420818 - RNA, 21 nt, Homo sapiens
uucaaguguaccugccauaac

SEQ ID NO: 420819 - RNA, 14 nt, Homo sapiens
uucaaguugagaac

SEQ ID NO: 420820 - RNA, 21 nt, Homo sapiens
uucaauaaaaaauacaauuca

SEQ ID NO: 420821 - RNA, 20 nt, Homo sapiens
uucaauaaagcugcugagaa

SEQ ID NO: 420822 - RNA, 23 nt, Homo sapiens
uucaauauccccaagcaguguga

SEQ ID NO: 420823 - RNA, 16 nt, Homo sapiens
uucaaugaacugugcu

SEQ ID NO: 420824 - RNA, 15 nt, Homo sapiens
uucaaugaccuguau

SEQ ID NO: 420825 - RNA, 17 nt, Homo sapiens
uucaaugguugggacaa

SEQ ID NO: 420826 - RNA, 16 nt, Homo sapiens
uucaauugcagaugcc

SEQ ID NO: 420827 - RNA, 21 nt, Homo sapiens
uucacaaauauaguugaacaa

SEQ ID NO: 420828 - RNA, 11 nt, Homo sapiens
uucacacagca

SEQ ID NO: 420829 - RNA, 15 nt, Homo sapiens
uucacagauggaauc

SEQ ID NO: 420830 - RNA, 21 nt, Homo sapiens
uucacaggcagugcaugugaa

SEQ ID NO: 420831 - RNA, 11 nt, Homo sapiens
uucacaguauc

SEQ ID NO: 420832 - RNA, 21 nt, Homo sapiens
uucacauauuuguagcuagaa

SEQ ID NO: 420833 - RNA, 19 nt, Homo sapiens
uucacaugagcuauuucca

SEQ ID NO: 420834 - RNA, 17 nt, Homo sapiens
uucaccagagcauuucc

SEQ ID NO: 420835 - RNA, 16 nt, Homo sapiens
uucaccaggaagaagg

SEQ ID NO: 420836 - RNA, 20 nt, Homo sapiens
uucaccccacucagcucacc

SEQ ID NO: 420837 - RNA, 14 nt, Homo sapiens
uucaccucccaaac

SEQ ID NO: 420838 - RNA, 15 nt, Homo sapiens
uucaccugugacaaa

SEQ ID NO: 420839 - RNA, 12 nt, Homo sapiens
uucacuacaggu

SEQ ID NO: 420840 - RNA, 16 nt, Homo sapiens
uucacuaggaggucau

SEQ ID NO: 420841 - RNA, 16 nt, Homo sapiens
uucacucccaaccuga

SEQ ID NO: 420842 - RNA, 16 nt, Homo sapiens
uucagaaaagacacuu

SEQ ID NO: 420843 - RNA, 16 nt, Homo sapiens
uucagaaacaaagcau

SEQ ID NO: 420844 - RNA, 15 nt, Homo sapiens
uucagagaagucagu

SEQ ID NO: 420845 - RNA, 21 nt, Homo sapiens
uucagauggcaauuucacuga

SEQ ID NO: 420846 - RNA, 22 nt, Homo sapiens
uucagauuuuaaaaagucuuca

SEQ ID NO: 420847 - RNA, 22 nt, Homo sapiens
uucagcacugucccuugccuca

SEQ ID NO: 420848 - RNA, 17 nt, Homo sapiens
uucagccauagcuugau

SEQ ID NO: 420849 - RNA, 19 nt, Homo sapiens
uucagcgagacccuugcau

SEQ ID NO: 420850 - RNA, 20 nt, Homo sapiens
uucagcgagacccuugcauu

SEQ ID NO: 420851 - RNA, 13 nt, Homo sapiens
uucagcugcauac

SEQ ID NO: 420852 - RNA, 22 nt, Homo sapiens
uucagcuguacuucgucuucua

SEQ ID NO: 420853 - RNA, 18 nt, Homo sapiens
uucaggaaaaaugcuuuu

SEQ ID NO: 420854 - RNA, 19 nt, Homo sapiens
uucaggaaguugcugagaa

SEQ ID NO: 420855 - RNA, 18 nt, Homo sapiens
uucaggaaugggccaagc

SEQ ID NO: 420856 - RNA, 16 nt, Homo sapiens
uucaggagaaugugca

SEQ ID NO: 420857 - RNA, 18 nt, Homo sapiens
uucagggcagggcucuga

SEQ ID NO: 420858 - RNA, 13 nt, Homo sapiens
uucagggggccag

SEQ ID NO: 420859 - RNA, 23 nt, Homo sapiens
uucagggggccaggugcacagac

SEQ ID NO: 420860 - RNA, 12 nt, Homo sapiens
uucagguggaac

SEQ ID NO: 420861 - RNA, 21 nt, Homo sapiens
uucaguacacuugguguacug

SEQ ID NO: 420862 - RNA, 13 nt, Homo sapiens
uucaguaccaaag

SEQ ID NO: 420863 - RNA, 15 nt, Homo sapiens
uucaguauacugugu

SEQ ID NO: 420864 - RNA, 17 nt, Homo sapiens
uucaguccacaguacau

SEQ ID NO: 420865 - RNA, 16 nt, Homo sapiens
uucagugccaaaaaca

SEQ ID NO: 420866 - RNA, 19 nt, Homo sapiens
uucaguguguugacuucua

SEQ ID NO: 420867 - RNA, 21 nt, Homo sapiens
uucauaagauauucuuuacaa

SEQ ID NO: 420868 - RNA, 17 nt, Homo sapiens
uucauacagcacuacuu

SEQ ID NO: 420869 - RNA, 16 nt, Homo sapiens
uucauagcauccugau

SEQ ID NO: 420870 - RNA, 14 nt, Homo sapiens
uucauagcuguaua

SEQ ID NO: 420871 - RNA, 13 nt, Homo sapiens
uucauaucucucc

SEQ ID NO: 420872 - RNA, 20 nt, Homo sapiens
uucauauguaccauguacau

SEQ ID NO: 420873 - RNA, 14 nt, Homo sapiens
uucauauucucaga

SEQ ID NO: 420874 - RNA, 22 nt, Homo sapiens
uucauccaacgugaagauacca

SEQ ID NO: 420875 - RNA, 15 nt, Homo sapiens
uucauccguguaacc

SEQ ID NO: 420876 - RNA, 19 nt, Homo sapiens
uucaucuacccugcugacc

SEQ ID NO: 420877 - RNA, 18 nt, Homo sapiens
uucaucugaggaguccaa

SEQ ID NO: 420878 - RNA, 19 nt, Homo sapiens
uucaugauuagcaaguuac

SEQ ID NO: 420879 - RNA, 20 nt, Homo sapiens
uucaugucucuacccacuau

SEQ ID NO: 420880 - RNA, 20 nt, Homo sapiens
uucaugugaucuauuacucu

SEQ ID NO: 420881 - RNA, 13 nt, Homo sapiens
uucauguuuugcu

SEQ ID NO: 420882 - RNA, 22 nt, Homo sapiens
uucauuaauuacccuacuuuca

SEQ ID NO: 420883 - RNA, 22 nt, Homo sapiens
uucauuagcgauccauguaauc

SEQ ID NO: 420884 - RNA, 20 nt, Homo sapiens
uucauuauuggaauuaaccu

SEQ ID NO: 420885 - RNA, 17 nt, Homo sapiens
uucauuauugguuuuaa

SEQ ID NO: 420886 - RNA, 16 nt, Homo sapiens
uucauucuaaaccaaa

SEQ ID NO: 420887 - RNA, 23 nt, Homo sapiens
uucauucucacucugcuuugcau

SEQ ID NO: 420888 - RNA, 23 nt, Homo sapiens
uucauucuccguugucauugacu

SEQ ID NO: 420889 - RNA, 21 nt, Homo sapiens
uucauuuaggugaggaagcaa

SEQ ID NO: 420890 - RNA, 17 nt, Homo sapiens
uucauuugugugcucau

SEQ ID NO: 420891 - RNA, 17 nt, Homo sapiens
uucauuuuuuucacugg

SEQ ID NO: 420892 - RNA, 13 nt, Homo sapiens
uuccaaaauucca

SEQ ID NO: 420893 - RNA, 21 nt, Homo sapiens
uuccaaagguuucaacuguaa

SEQ ID NO: 420894 - RNA, 20 nt, Homo sapiens
uuccaaauuugaauggauua

SEQ ID NO: 420895 - RNA, 14 nt, Homo sapiens
uuccaacaccacag

SEQ ID NO: 420896 - RNA, 17 nt, Homo sapiens
uuccaaguauuuugcca

SEQ ID NO: 420897 - RNA, 18 nt, Homo sapiens
uuccaaguuuauugcccu

SEQ ID NO: 420898 - RNA, 22 nt, Homo sapiens
uuccaauaauugacugguggaa

SEQ ID NO: 420899 - RNA, 13 nt, Homo sapiens
uuccaaugcauug

SEQ ID NO: 420900 - RNA, 18 nt, Homo sapiens
uuccaaugcuuugauccc

SEQ ID NO: 420901 - RNA, 19 nt, Homo sapiens
uuccaauuccaaaauucca

SEQ ID NO: 420902 - RNA, 21 nt, Homo sapiens
uuacccuucugugcccagcuc

SEQ ID NO: 420903 - RNA, 16 nt, Homo sapiens
uuaccgugggcacuga

SEQ ID NO: 420904 - RNA, 14 nt, Homo sapiens
uuaccuaaacagau

SEQ ID NO: 420905 - RNA, 18 nt, Homo sapiens
uuaccucugcauaaauau

SEQ ID NO: 420906 - RNA, 12 nt, Homo sapiens
uuacgacgugau

SEQ ID NO: 420907 - RNA, 13 nt, Homo sapiens
uuacuaaucuuuc

SEQ ID NO: 420908 - RNA, 15 nt, Homo sapiens
uuacuaguacuauua

SEQ ID NO: 420909 - RNA, 11 nt, Homo sapiens
uuacucaaagu

SEQ ID NO: 420910 - RNA, 14 nt, Homo sapiens
uuacuccaccauca

SEQ ID NO: 420911 - RNA, 20 nt, Homo sapiens
uuacugcccaauaugcaguu

SEQ ID NO: 420912 - RNA, 19 nt, Homo sapiens
uuacugguagaaaggcagu

SEQ ID NO: 420913 - RNA, 24 nt, Homo sapiens
uuacuguuuauuucuguuucucau

SEQ ID NO: 420914 - RNA, 17 nt, Homo sapiens
uuacuuaccuaaacaga

SEQ ID NO: 420915 - RNA, 19 nt, Homo sapiens
uuacuuuaauacucaccuc

SEQ ID NO: 420916 - RNA, 14 nt, Homo sapiens
uuacuuugugcaau

SEQ ID NO: 420917 - RNA, 14 nt, Homo sapiens
uuacuuuuucauuc

SEQ ID NO: 420918 - RNA, 12 nt, Homo sapiens
uuagaaacugag

SEQ ID NO: 420919 - RNA, 15 nt, Homo sapiens
uuagaaauaaaugaa

SEQ ID NO: 420920 - RNA, 14 nt, Homo sapiens
uuagaaauauaucu

SEQ ID NO: 420921 - RNA, 14 nt, Homo sapiens
uuagacauaccucu

SEQ ID NO: 420922 - RNA, 19 nt, Homo sapiens
uuagacauuuaucaacugu

SEQ ID NO: 420923 - RNA, 16 nt, Homo sapiens
uuagacccgguccugc

SEQ ID NO: 420924 - RNA, 14 nt, Homo sapiens
uuagagacagggac

SEQ ID NO: 420925 - RNA, 22 nt, Homo sapiens
uuagagacaguugggugagaac

SEQ ID NO: 420926 - RNA, 13 nt, Homo sapiens
uuagagaugcuac

SEQ ID NO: 420927 - RNA, 15 nt, Homo sapiens
uuagaguacagaucc

SEQ ID NO: 420928 - RNA, 21 nt, Homo sapiens
uuagaugagggugacugucaa

SEQ ID NO: 420929 - RNA, 22 nt, Homo sapiens
uuagauuaacccuauuaaucua

SEQ ID NO: 420930 - RNA, 13 nt, Homo sapiens
uuagauugcugaa

SEQ ID NO: 420931 - RNA, 18 nt, Homo sapiens
uuagcaaagcaugccaau

SEQ ID NO: 420932 - RNA, 14 nt, Homo sapiens
uuagcauaauguga

SEQ ID NO: 420933 - RNA, 23 nt, Homo sapiens
uuagcauuccuauugacaacucu

SEQ ID NO: 420934 - RNA, 13 nt, Homo sapiens
uuagccaaaagaa

SEQ ID NO: 420935 - RNA, 15 nt, Homo sapiens
uuagcccacugccug

SEQ ID NO: 420936 - RNA, 14 nt, Homo sapiens
uuagccuugcugua

SEQ ID NO: 420937 - RNA, 23 nt, Homo sapiens
uuagcucucauaggagacccaug

SEQ ID NO: 420938 - RNA, 16 nt, Homo sapiens
uuagcuuacugauuaa

SEQ ID NO: 420939 - RNA, 16 nt, Homo sapiens
uuagcuuuucugcaau

SEQ ID NO: 420940 - RNA, 20 nt, Homo sapiens
uuaggagagagaaaauaauu

SEQ ID NO: 420941 - RNA, 13 nt, Homo sapiens
uuagggaauaauu

SEQ ID NO: 420942 - RNA, 17 nt, Homo sapiens
uuaggggaagugacaag

SEQ ID NO: 420943 - RNA, 14 nt, Homo sapiens
uuaguaaacugugc

SEQ ID NO: 420944 - RNA, 14 nt, Homo sapiens
uuaguccucaccuu

SEQ ID NO: 420945 - RNA, 16 nt, Homo sapiens
uuagucucaagggcua

SEQ ID NO: 420946 - RNA, 16 nt, Homo sapiens
uuagugauugcuuuua

SEQ ID NO: 420947 - RNA, 15 nt, Homo sapiens
uuagugucuguccau

SEQ ID NO: 420948 - RNA, 21 nt, Homo sapiens
uuagugucuugaauguaagaa

SEQ ID NO: 420949 - RNA, 20 nt, Homo sapiens
uuaguuuacaaucagccaca

SEQ ID NO: 420950 - RNA, 13 nt, Homo sapiens
uuaguuugcuaag

SEQ ID NO: 420951 - RNA, 16 nt, Homo sapiens
uuauaaauaauguuca

SEQ ID NO: 420952 - RNA, 12 nt, Homo sapiens
uuauaaauccaa

SEQ ID NO: 420953 - RNA, 16 nt, Homo sapiens
uuauaaauccaaagua

SEQ ID NO: 420954 - RNA, 14 nt, Homo sapiens
uuauaauauacuau

SEQ ID NO: 420955 - RNA, 18 nt, Homo sapiens
uuauaccagagaccugag

SEQ ID NO: 420956 - RNA, 14 nt, Homo sapiens
uuauaccagcaaaa

SEQ ID NO: 420957 - RNA, 14 nt, Homo sapiens
uuauacuaccaagu

SEQ ID NO: 420958 - RNA, 15 nt, Homo sapiens
uuauacuucuuuauu

SEQ ID NO: 420959 - RNA, 22 nt, Homo sapiens
uuauauaauaaaguauuccacc

SEQ ID NO: 420960 - RNA, 19 nt, Homo sapiens
uuauauacuguuauuucac

SEQ ID NO: 420961 - RNA, 19 nt, Homo sapiens
uuauauauaagccaaaaaa

SEQ ID NO: 420962 - RNA, 12 nt, Homo sapiens
uuauauugcuag

SEQ ID NO: 420963 - RNA, 14 nt, Homo sapiens
uuauauuucacuau

SEQ ID NO: 420964 - RNA, 14 nt, Homo sapiens
uuaucaaaaaugca

SEQ ID NO: 420965 - RNA, 20 nt, Homo sapiens
uuaucaaacuucagcuguac

SEQ ID NO: 420966 - RNA, 19 nt, Homo sapiens
uuaucaaucucuaguuguc

SEQ ID NO: 420967 - RNA, 15 nt, Homo sapiens
uuaucauaaauucaa

SEQ ID NO: 420968 - RNA, 15 nt, Homo sapiens
uuaucaucaccucaa

SEQ ID NO: 420969 - RNA, 20 nt, Homo sapiens
uuaucaucccaacagccaag

SEQ ID NO: 420970 - RNA, 14 nt, Homo sapiens
uuauccaagaccug

SEQ ID NO: 420971 - RNA, 18 nt, Homo sapiens
uuauccagaugaacugag

SEQ ID NO: 420972 - RNA, 21 nt, Homo sapiens
uuaucuagcaagaagauucua

SEQ ID NO: 420973 - RNA, 16 nt, Homo sapiens
uuaucuaucaacuaua

SEQ ID NO: 420974 - RNA, 21 nt, Homo sapiens
uuaucucccugcuucauaucu

SEQ ID NO: 420975 - RNA, 22 nt, Homo sapiens
uuaucucccugcuucauaucuc

SEQ ID NO: 420976 - RNA, 15 nt, Homo sapiens
uuaucucugaggcua

SEQ ID NO: 420977 - RNA, 13 nt, Homo sapiens
uuaucugucuuua

SEQ ID NO: 420978 - RNA, 17 nt, Homo sapiens
uuaucuuguacagccuu

SEQ ID NO: 420979 - RNA, 20 nt, Homo sapiens
uuaugaaguuaacagucuca

SEQ ID NO: 420980 - RNA, 12 nt, Homo sapiens
uuaugacuguuu

SEQ ID NO: 420981 - RNA, 20 nt, Homo sapiens
uuaugagaaaugccagugug

SEQ ID NO: 420982 - RNA, 22 nt, Homo sapiens
uuaugauuacuaucauggcaua

SEQ ID NO: 420983 - RNA, 15 nt, Homo sapiens
uuaugcccucagaug

SEQ ID NO: 420984 - RNA, 15 nt, Homo sapiens
uuauggaaguuuucu

SEQ ID NO: 420985 - RNA, 19 nt, Homo sapiens
uuauggcauuuuucuggga

SEQ ID NO: 420986 - RNA, 16 nt, Homo sapiens
uuaugguacacuccag

SEQ ID NO: 420987 - RNA, 14 nt, Homo sapiens
uuauguaaugcaaa

SEQ ID NO: 420988 - RNA, 18 nt, Homo sapiens
uuauguaccuccaugagc

SEQ ID NO: 420989 - RNA, 20 nt, Homo sapiens
uuauguauguauguauuuau

SEQ ID NO: 420990 - RNA, 20 nt, Homo sapiens
uuauuaacauauauuguuau

SEQ ID NO: 420991 - RNA, 18 nt, Homo sapiens
uuauuaauauuauuauga

SEQ ID NO: 420992 - RNA, 14 nt, Homo sapiens
uuauuaauucauua

SEQ ID NO: 420993 - RNA, 15 nt, Homo sapiens
uaugaagucccucua

SEQ ID NO: 420994 - RNA, 17 nt, Homo sapiens
uaugaauggagauuuga

SEQ ID NO: 420995 - RNA, 22 nt, Homo sapiens
uaugacaauuucaaaaugcaug

SEQ ID NO: 420996 - RNA, 22 nt, Homo sapiens
uaugacucaccuugcucugcca

SEQ ID NO: 420997 - RNA, 13 nt, Homo sapiens
uaugagauauuaa

SEQ ID NO: 420998 - RNA, 13 nt, Homo sapiens
uaugaggugggau

SEQ ID NO: 420999 - RNA, 16 nt, Homo sapiens
uaugagucaaugugca

SEQ ID NO: 421000 - RNA, 13 nt, Homo sapiens
uaugaucuuggcu

SEQ ID NO: 421001 - RNA, 23 nt, Homo sapiens
uaugaugguggaucaagacauaa

SEQ ID NO: 421002 - RNA, 16 nt, Homo sapiens
uaugcaaagucucuca

SEQ ID NO: 421003 - RNA, 19 nt, Homo sapiens
uaugcaaaucagucucaca

SEQ ID NO: 421004 - RNA, 13 nt, Homo sapiens
uaugcacaccucc

SEQ ID NO: 421005 - RNA, 16 nt, Homo sapiens
uaugcacgugugcaca

SEQ ID NO: 421006 - RNA, 14 nt, Homo sapiens
uaugcaguaugcuu

SEQ ID NO: 421007 - RNA, 15 nt, Homo sapiens
uaugcagugcugcuu

SEQ ID NO: 421008 - RNA, 15 nt, Homo sapiens
uaugcauuugcauuu

SEQ ID NO: 421009 - RNA, 18 nt, Homo sapiens
uaugcccagguaccaccc

SEQ ID NO: 421010 - RNA, 15 nt, Homo sapiens
uaugccuuaagccaa

SEQ ID NO: 421011 - RNA, 19 nt, Homo sapiens
uaugcugauuuacuacuua

SEQ ID NO: 421012 - RNA, 13 nt, Homo sapiens
uauggaaagggug

SEQ ID NO: 421013 - RNA, 15 nt, Homo sapiens
uauggaacauaugca

SEQ ID NO: 421014 - RNA, 20 nt, Homo sapiens
uauggagagaaaacagaccu

SEQ ID NO: 421015 - RNA, 14 nt, Homo sapiens
uauggauucacuuc

SEQ ID NO: 421016 - RNA, 19 nt, Homo sapiens
uauggcucuggcaccacua

SEQ ID NO: 421017 - RNA, 13 nt, Homo sapiens
uaugggaagccau

SEQ ID NO: 421018 - RNA, 14 nt, Homo sapiens
uaugggaagccaua

SEQ ID NO: 421019 - RNA, 17 nt, Homo sapiens
uaugggaggaacaaaga

SEQ ID NO: 421020 - RNA, 16 nt, Homo sapiens
uaugggcgugaaccac

SEQ ID NO: 421021 - RNA, 16 nt, Homo sapiens
uauggguugcauuugg

SEQ ID NO: 421022 - RNA, 15 nt, Homo sapiens
uauguagauugccuu

SEQ ID NO: 421023 - RNA, 12 nt, Homo sapiens
uauguagcaaug

SEQ ID NO: 421024 - RNA, 18 nt, Homo sapiens
uauguauaacaagccaaa

SEQ ID NO: 421025 - RNA, 14 nt, Homo sapiens
uauguauguaaaaa

SEQ ID NO: 421026 - RNA, 17 nt, Homo sapiens
uaugucagcagcucuga

SEQ ID NO: 421027 - RNA, 13 nt, Homo sapiens
uaugucauacucu

SEQ ID NO: 421028 - RNA, 14 nt, Homo sapiens
uaugucccaugacc

SEQ ID NO: 421029 - RNA, 14 nt, Homo sapiens
uaugucucaugaug

SEQ ID NO: 421030 - RNA, 18 nt, Homo sapiens
uaugucuugcaaagccuu

SEQ ID NO: 421031 - RNA, 14 nt, Homo sapiens
uaugugaagacaga

SEQ ID NO: 421032 - RNA, 18 nt, Homo sapiens
uaugugaauggaaucaua

SEQ ID NO: 421033 - RNA, 19 nt, Homo sapiens
uaugugaauggaaucauau

SEQ ID NO: 421034 - RNA, 18 nt, Homo sapiens
uaugugagaacuuuucau

SEQ ID NO: 421035 - RNA, 11 nt, Homo sapiens
uaugugagcac

SEQ ID NO: 421036 - RNA, 23 nt, Homo sapiens
uaugugaguguguccaagugugu

SEQ ID NO: 421037 - RNA, 16 nt, Homo sapiens
uaugugcgugugugca

SEQ ID NO: 421038 - RNA, 15 nt, Homo sapiens
uauguguaauaucau

SEQ ID NO: 421039 - RNA, 17 nt, Homo sapiens
uauguguguuuugcuaa

SEQ ID NO: 421040 - RNA, 15 nt, Homo sapiens
uauguugaguguuca

SEQ ID NO: 421041 - RNA, 15 nt, Homo sapiens
uauguuuacauauca

SEQ ID NO: 421042 - RNA, 20 nt, Homo sapiens
uauguuuacauaucaccuca

SEQ ID NO: 421043 - RNA, 20 nt, Homo sapiens
uauguuuagugugauuguga

SEQ ID NO: 421044 - RNA, 18 nt, Homo sapiens
uauuaacuauuaguguua

SEQ ID NO: 421045 - RNA, 13 nt, Homo sapiens
uauuaacucugca

SEQ ID NO: 421046 - RNA, 15 nt, Homo sapiens
uauuaaggugucaua

SEQ ID NO: 421047 - RNA, 22 nt, Homo sapiens
uauuaaguucucaaugugaaaa

SEQ ID NO: 421048 - RNA, 15 nt, Homo sapiens
uauuaauaugcaugc

SEQ ID NO: 421049 - RNA, 20 nt, Homo sapiens
uauuaauuguuuugcacuuu

SEQ ID NO: 421050 - RNA, 17 nt, Homo sapiens
gcugccuaggcugaccu

SEQ ID NO: 421051 - RNA, 20 nt, Homo sapiens
gcgugucucugccauguggc

SEQ ID NO: 421052 - RNA, 23 nt, Homo sapiens
gcguguggcucacgugugugacu

SEQ ID NO: 421053 - RNA, 16 nt, Homo sapiens
gcguguguccaugugu

SEQ ID NO: 421054 - RNA, 14 nt, Homo sapiens
gcgugugugcaagu

SEQ ID NO: 421055 - RNA, 15 nt, Homo sapiens
gcgugugugcaagug

SEQ ID NO: 421056 - RNA, 21 nt, Homo sapiens
gcguuguuacaggaagucccu

SEQ ID NO: 421057 - RNA, 20 nt, Homo sapiens
gcuaaaauaaaccagacuca

SEQ ID NO: 421058 - RNA, 16 nt, Homo sapiens
gcuaaacugaugacuu

SEQ ID NO: 421059 - RNA, 20 nt, Homo sapiens
gcuaaauauaaaaacauaaa

SEQ ID NO: 421060 - RNA, 20 nt, Homo sapiens
gcuaaauuuggguacugggu

SEQ ID NO: 421061 - RNA, 15 nt, Homo sapiens
gcuaacaaacugaaa

SEQ ID NO: 421062 - RNA, 22 nt, Homo sapiens
gcuaacuuuuauuaucuucuau

SEQ ID NO: 421063 - RNA, 20 nt, Homo sapiens
gcuaagaaauagacagucag

SEQ ID NO: 421064 - RNA, 14 nt, Homo sapiens
gcuaagccugauga

SEQ ID NO: 421065 - RNA, 19 nt, Homo sapiens
gcuaaggcccccaaacaua

SEQ ID NO: 421066 - RNA, 20 nt, Homo sapiens
gcuaauccaggacagcauua

SEQ ID NO: 421067 - RNA, 14 nt, Homo sapiens
gcuaaucuucaggg

SEQ ID NO: 421068 - RNA, 21 nt, Homo sapiens
gcuaauguaauaacugugaag

SEQ ID NO: 421069 - RNA, 20 nt, Homo sapiens
gcuaauguuuaaaagcaaaa

SEQ ID NO: 421070 - RNA, 22 nt, Homo sapiens
gcuacauugacgagcaugagcu

SEQ ID NO: 421071 - RNA, 23 nt, Homo sapiens
gcuacauugacgagcaugagcug

SEQ ID NO: 421072 - RNA, 18 nt, Homo sapiens
gcuaccaugaagugaaaa

SEQ ID NO: 421073 - RNA, 22 nt, Homo sapiens
gcuacuaaaauauuaguguuau

SEQ ID NO: 421074 - RNA, 20 nt, Homo sapiens
gcuacucaggagacugaguu

SEQ ID NO: 421075 - RNA, 22 nt, Homo sapiens
gcuacugacuauggcuaccaaa

SEQ ID NO: 421076 - RNA, 22 nt, Homo sapiens
gcuacugaugggaaugauuaag

SEQ ID NO: 421077 - RNA, 16 nt, Homo sapiens
cuauuguuucuuucaa

SEQ ID NO: 421078 - RNA, 22 nt, Homo sapiens
cuauuucggaaauacacuacaa

SEQ ID NO: 421079 - RNA, 16 nt, Homo sapiens
cuauuuggaaagcacu

SEQ ID NO: 421080 - RNA, 15 nt, Homo sapiens
cuauuuguucagaga

SEQ ID NO: 421081 - RNA, 13 nt, Homo sapiens
cuauuuucauucu

SEQ ID NO: 421082 - RNA, 16 nt, Homo sapiens
cuauuuuggacgugug

SEQ ID NO: 421083 - RNA, 17 nt, Homo sapiens
cuauuuuggacguguga

SEQ ID NO: 421084 - RNA, 17 nt, Homo sapiens
cuauuuuuaguuugcua

SEQ ID NO: 421085 - RNA, 21 nt, Homo sapiens
cuauuuuuguuaagcgugucu

SEQ ID NO: 421086 - RNA, 13 nt, Homo sapiens
cucaaaacuuaac

SEQ ID NO: 421087 - RNA, 18 nt, Homo sapiens
cucaaacuccugaccuca

SEQ ID NO: 421088 - RNA, 16 nt, Homo sapiens
cucaaaggacugaccu

SEQ ID NO: 421089 - RNA, 18 nt, Homo sapiens
cucaaaugcuacucagua

SEQ ID NO: 421090 - RNA, 17 nt, Homo sapiens
cucaaccauaacacuug

SEQ ID NO: 421091 - RNA, 20 nt, Homo sapiens
cucaaccucaccauugugaa

SEQ ID NO: 421092 - RNA, 19 nt, Homo sapiens
cucaagaaauugccuccuu

SEQ ID NO: 421093 - RNA, 14 nt, Homo sapiens
cucaagaguacaga

SEQ ID NO: 421094 - RNA, 14 nt, Homo sapiens
cucaagauucagua

SEQ ID NO: 421095 - RNA, 14 nt, Homo sapiens
cucaagcacuaaaa

SEQ ID NO: 421096 - RNA, 20 nt, Homo sapiens
cucaaguucauugaugaccc

SEQ ID NO: 421097 - RNA, 16 nt, Homo sapiens
cucaauaagccagcaa

SEQ ID NO: 421098 - RNA, 14 nt, Homo sapiens
cucaauacuugaau

SEQ ID NO: 421099 - RNA, 15 nt, Homo sapiens
cucaauauuccugaa

SEQ ID NO: 421100 - RNA, 15 nt, Homo sapiens
cucaaugugcuguug

SEQ ID NO: 421101 - RNA, 18 nt, Homo sapiens
cucaaugugcuguugauu

SEQ ID NO: 421102 - RNA, 16 nt, Homo sapiens
cucaauuaccaauaug

SEQ ID NO: 421103 - RNA, 14 nt, Homo sapiens
cucacaacucucug

SEQ ID NO: 421104 - RNA, 21 nt, Homo sapiens
cucacagagugcauugugagg

SEQ ID NO: 421105 - RNA, 18 nt, Homo sapiens
cucaccaaaauauaguua

SEQ ID NO: 421106 - RNA, 13 nt, Homo sapiens
cucaccauuucau

SEQ ID NO: 421107 - RNA, 17 nt, Homo sapiens
cucaccauuucauccau

SEQ ID NO: 421108 - RNA, 16 nt, Homo sapiens
cucacccauugucuca

SEQ ID NO: 421109 - RNA, 14 nt, Homo sapiens
cucaccccugggca

SEQ ID NO: 421110 - RNA, 20 nt, Homo sapiens
cucaccguggggcuggaaga

SEQ ID NO: 421111 - RNA, 17 nt, Homo sapiens
cucacgcucccaacaca

SEQ ID NO: 421112 - RNA, 22 nt, Homo sapiens
cucacgggugcaugaaaccacu

SEQ ID NO: 421113 - RNA, 20 nt, Homo sapiens
cucacuccuaggagagccaa

SEQ ID NO: 421114 - RNA, 21 nt, Homo sapiens
cucacucugcuuugcaucccc

SEQ ID NO: 421115 - RNA, 17 nt, Homo sapiens
cucacucuuucuucucu

SEQ ID NO: 421116 - RNA, 21 nt, Homo sapiens
cucacuggaugaaauaacucc

SEQ ID NO: 421117 - RNA, 16 nt, Homo sapiens
cucacuggugcauuua

SEQ ID NO: 421118 - RNA, 15 nt, Homo sapiens
cucacugugcuccua

SEQ ID NO: 421119 - RNA, 10 nt, Homo sapiens
cucacugugu

SEQ ID NO: 421120 - RNA, 12 nt, Homo sapiens
cucacuuuggac

SEQ ID NO: 421121 - RNA, 12 nt, Homo sapiens
cucagaagaugg

SEQ ID NO: 421122 - RNA, 19 nt, Homo sapiens
cucagaagucaguugcaaa

SEQ ID NO: 421123 - RNA, 20 nt, Homo sapiens
cucagaauugaucauuuucc

SEQ ID NO: 421124 - RNA, 13 nt, Homo sapiens
cucagacauucca

SEQ ID NO: 421125 - RNA, 23 nt, Homo sapiens
cucagagcuccacagaagacacg

SEQ ID NO: 421126 - RNA, 18 nt, Homo sapiens
cucagagguagggcugcc

SEQ ID NO: 421127 - RNA, 20 nt, Homo sapiens
cucagaucacuacugcaguc

SEQ ID NO: 421128 - RNA, 12 nt, Homo sapiens
cucagaugucca

SEQ ID NO: 421129 - RNA, 16 nt, Homo sapiens
cucagauuauuuuucc

SEQ ID NO: 421130 - RNA, 16 nt, Homo sapiens
cucagauuccaccuag

SEQ ID NO: 421131 - RNA, 15 nt, Homo sapiens
cucagcaaguguaca

SEQ ID NO: 421132 - RNA, 23 nt, Homo sapiens
cucagcaccugggacccaacaga

SEQ ID NO: 421133 - RNA, 14 nt, Homo sapiens
cucagcagccucag

SEQ ID NO: 421134 - RNA, 18 nt, Homo sapiens
cucagcaguugacaucca

SEQ ID NO: 421135 - RNA, 15 nt, Homo sapiens
cucagccaccccuca

SEQ ID NO: 421136 - RNA, 19 nt, Homo sapiens
cucagccucaaaugcagua

SEQ ID NO: 421137 - RNA, 18 nt, Homo sapiens
cucagccuguuccaugaa

SEQ ID NO: 421138 - RNA, 15 nt, Homo sapiens
cucagcucucuggga

SEQ ID NO: 421139 - RNA, 17 nt, Homo sapiens
cucagcugcacauuccu

SEQ ID NO: 421140 - RNA, 22 nt, Homo sapiens
cucaggauccagucccuuacac

SEQ ID NO: 421141 - RNA, 18 nt, Homo sapiens
gagcucuccugggccagg

SEQ ID NO: 421142 - RNA, 18 nt, Homo sapiens
gagcucucggaacugcau

SEQ ID NO: 421143 - RNA, 21 nt, Homo sapiens
gagcugacccccugcugccau

SEQ ID NO: 421144 - RNA, 21 nt, Homo sapiens
gagcugagaucacaccacugu

SEQ ID NO: 421145 - RNA, 14 nt, Homo sapiens
gagcugagaucacg

SEQ ID NO: 421146 - RNA, 17 nt, Homo sapiens
gagcugagccagucaug

SEQ ID NO: 421147 - RNA, 17 nt, Homo sapiens
gagcugaggacucucac

SEQ ID NO: 421148 - RNA, 14 nt, Homo sapiens
gagcugaguucaug

SEQ ID NO: 421149 - RNA, 20 nt, Homo sapiens
gagcugccauccagggaugc

SEQ ID NO: 421150 - RNA, 21 nt, Homo sapiens
gagcugcugagggaccuugga

SEQ ID NO: 421151 - RNA, 14 nt, Homo sapiens
gagcuggaaggcag

SEQ ID NO: 421152 - RNA, 21 nt, Homo sapiens
gagcuggauuugggagcucug

SEQ ID NO: 421153 - RNA, 22 nt, Homo sapiens
gagcuuggugcgguaggugcug

SEQ ID NO: 421154 - RNA, 21 nt, Homo sapiens
gaggaaaaaugauccagugga

SEQ ID NO: 421155 - RNA, 23 nt, Homo sapiens
gaggaaaauaguggcaggacugu

SEQ ID NO: 421156 - RNA, 19 nt, Homo sapiens
gaggaaucuaaacaaacag

SEQ ID NO: 421157 - RNA, 20 nt, Homo sapiens
gaggaaucuaaacaaacagg

SEQ ID NO: 421158 - RNA, 23 nt, Homo sapiens
gaggaauuucuugauuaauguug

SEQ ID NO: 421159 - RNA, 16 nt, Homo sapiens
gaggacagauuaauag

SEQ ID NO: 421160 - RNA, 21 nt, Homo sapiens
gaggacagggagggaacagac

SEQ ID NO: 421161 - RNA, 14 nt, Homo sapiens
gaggacagugcuga

SEQ ID NO: 421162 - RNA, 18 nt, Homo sapiens
gaggacuuugauugcaca

SEQ ID NO: 421163 - RNA, 22 nt, Homo sapiens
gaggagaacacuagacaugcca

SEQ ID NO: 421164 - RNA, 14 nt, Homo sapiens
gaggagauggccau

SEQ ID NO: 421165 - RNA, 15 nt, Homo sapiens
gaggaggaagucaug

SEQ ID NO: 421166 - RNA, 20 nt, Homo sapiens
gaggaucguggccaacgugg

SEQ ID NO: 421167 - RNA, 17 nt, Homo sapiens
gaggaugauguaauuaa

SEQ ID NO: 421168 - RNA, 15 nt, Homo sapiens
gaggaugcugugccu

SEQ ID NO: 421169 - RNA, 17 nt, Homo sapiens
gaggcagaauaagaaaa

SEQ ID NO: 421170 - RNA, 21 nt, Homo sapiens
gaggcagaggguugcagugag

SEQ ID NO: 421171 - RNA, 13 nt, Homo sapiens
gaggcauuauuug

SEQ ID NO: 421172 - RNA, 14 nt, Homo sapiens
gaggccaaggcagg

SEQ ID NO: 421173 - RNA, 20 nt, Homo sapiens
gaggccaaggugggcggauc

SEQ ID NO: 421174 - RNA, 23 nt, Homo sapiens
gaggccacaugauacuuauucaa

SEQ ID NO: 421175 - RNA, 16 nt, Homo sapiens
gaggccggaaucucag

SEQ ID NO: 421176 - RNA, 22 nt, Homo sapiens
gaggccuggacuuuccugcaac

SEQ ID NO: 421177 - RNA, 19 nt, Homo sapiens
gaggcggguggaucacuug

SEQ ID NO: 421178 - RNA, 19 nt, Homo sapiens
gaggcgugggauccagaga

SEQ ID NO: 421179 - RNA, 11 nt, Homo sapiens
gaggcuaugug

SEQ ID NO: 421180 - RNA, 17 nt, Homo sapiens
gaggcuauuuuaauccu

SEQ ID NO: 421181 - RNA, 18 nt, Homo sapiens
gaggcuccggauguuucu

SEQ ID NO: 421182 - RNA, 18 nt, Homo sapiens
gaggcugagacgcaagga

SEQ ID NO: 421183 - RNA, 20 nt, Homo sapiens
gaggcuuugggagcaaaaua

SEQ ID NO: 421184 - RNA, 18 nt, Homo sapiens
gagggaagcccacccgcc

SEQ ID NO: 421185 - RNA, 13 nt, Homo sapiens
gagggaaggugac

SEQ ID NO: 421186 - RNA, 14 nt, Homo sapiens
gagggagugucugu

SEQ ID NO: 421187 - RNA, 20 nt, Homo sapiens
gagggaugccauaccuugag

SEQ ID NO: 421188 - RNA, 18 nt, Homo sapiens
gagggcagaggugaucac

SEQ ID NO: 421189 - RNA, 16 nt, Homo sapiens
gagggccccugcgugg

SEQ ID NO: 421190 - RNA, 15 nt, Homo sapiens
gagggccuggucacc

SEQ ID NO: 421191 - RNA, 20 nt, Homo sapiens
gaggggacagaguucaggga

SEQ ID NO: 421192 - RNA, 22 nt, Homo sapiens
gaggggccaggccauggccaag

SEQ ID NO: 421193 - RNA, 15 nt, Homo sapiens
gaggggcggggccag

SEQ ID NO: 421194 - RNA, 12 nt, Homo sapiens
gagggugacugu

SEQ ID NO: 421195 - RNA, 21 nt, Homo sapiens
gagggugaggggcuggcacug

SEQ ID NO: 421196 - RNA, 21 nt, Homo sapiens
gagggugucguccugcagugu

SEQ ID NO: 421197 - RNA, 21 nt, Homo sapiens
gaggguuccucuuaggucaga

SEQ ID NO: 421198 - RNA, 12 nt, Homo sapiens
gaggguugcuau

SEQ ID NO: 421199 - RNA, 23 nt, Homo sapiens
gaggguuguucuccuagacugac

SEQ ID NO: 421200 - RNA, 22 nt, Homo sapiens
gagguaccagcaauauguaaau

SEQ ID NO: 421201 - RNA, 18 nt, Homo sapiens
gaggucuuuugacaugug

SEQ ID NO: 421202 - RNA, 15 nt, Homo sapiens
cuaaauuuccagggg

SEQ ID NO: 421203 - RNA, 20 nt, Homo sapiens
cuaaauuuucugaaacugca

SEQ ID NO: 421204 - RNA, 19 nt, Homo sapiens
cuaacaaguagcacacuga

SEQ ID NO: 421205 - RNA, 22 nt, Homo sapiens
cuaacaaguagcacacugaguu

SEQ ID NO: 421206 - RNA, 18 nt, Homo sapiens
cuaacaccacacugacca

SEQ ID NO: 421207 - RNA, 20 nt, Homo sapiens
cuaacagaucagaacaugaa

SEQ ID NO: 421208 - RNA, 14 nt, Homo sapiens
cuaacagccagcuu

SEQ ID NO: 421209 - RNA, 13 nt, Homo sapiens
cuaaccacuaaug

SEQ ID NO: 421210 - RNA, 16 nt, Homo sapiens
cuaaccagccugguca

SEQ ID NO: 421211 - RNA, 17 nt, Homo sapiens
cuaaccagccuggucaa

SEQ ID NO: 421212 - RNA, 15 nt, Homo sapiens
cuaacuauauuugcu

SEQ ID NO: 421213 - RNA, 14 nt, Homo sapiens
cuaacuguaugugu

SEQ ID NO: 421214 - RNA, 17 nt, Homo sapiens
cuaacuuaacauugcau

SEQ ID NO: 421215 - RNA, 17 nt, Homo sapiens
cuaacuucaaggcccau

SEQ ID NO: 421216 - RNA, 14 nt, Homo sapiens
cuaacuuucuugcu

SEQ ID NO: 421217 - RNA, 19 nt, Homo sapiens
cuaagaaauaugcacaaua

SEQ ID NO: 421218 - RNA, 20 nt, Homo sapiens
cuaagaagcgagcacugacc

SEQ ID NO: 421219 - RNA, 16 nt, Homo sapiens
cuaagaagugguguuc

SEQ ID NO: 421220 - RNA, 19 nt, Homo sapiens
cuaagaccuuggcauccuu

SEQ ID NO: 421221 - RNA, 15 nt, Homo sapiens
cuaagagugucacug

SEQ ID NO: 421222 - RNA, 23 nt, Homo sapiens
cuaagagugucacugagcugugu

SEQ ID NO: 421223 - RNA, 13 nt, Homo sapiens
cuaagaguuuucu

SEQ ID NO: 421224 - RNA, 21 nt, Homo sapiens
cuaagauaauuaaaugaaaua

SEQ ID NO: 421225 - RNA, 22 nt, Homo sapiens
cuaagauuacaggcgugagcca

SEQ ID NO: 421226 - RNA, 13 nt, Homo sapiens
cuaagccuguugc

SEQ ID NO: 421227 - RNA, 16 nt, Homo sapiens
cuaagcgcacauucau

SEQ ID NO: 421228 - RNA, 15 nt, Homo sapiens
cuaagugcccaaagu

SEQ ID NO: 421229 - RNA, 22 nt, Homo sapiens
cuaauaaagaaauaauacccug

SEQ ID NO: 421230 - RNA, 18 nt, Homo sapiens
cuaauaauaguacuauua

SEQ ID NO: 421231 - RNA, 18 nt, Homo sapiens
cuaauaucuuaaugaaua

SEQ ID NO: 421232 - RNA, 13 nt, Homo sapiens
cuaauaugccuag

SEQ ID NO: 421233 - RNA, 22 nt, Homo sapiens
cuaaucagcauucucacuccua

SEQ ID NO: 421234 - RNA, 14 nt, Homo sapiens
cuaauccacaaccu

SEQ ID NO: 421235 - RNA, 13 nt, Homo sapiens
cuaauccaugugc

SEQ ID NO: 421236 - RNA, 16 nt, Homo sapiens
cuaaucgaaugaacaa

SEQ ID NO: 421237 - RNA, 13 nt, Homo sapiens
cuaaucugcagug

SEQ ID NO: 421238 - RNA, 20 nt, Homo sapiens
cuaaugauauuuuaugcaaa

SEQ ID NO: 421239 - RNA, 12 nt, Homo sapiens
cuaauggaauau

SEQ ID NO: 421240 - RNA, 15 nt, Homo sapiens
cuaauguaauaacug

SEQ ID NO: 421241 - RNA, 16 nt, Homo sapiens
cuaauguaggacugua

SEQ ID NO: 421242 - RNA, 20 nt, Homo sapiens
cuaauuagaaaauauaguuu

SEQ ID NO: 421243 - RNA, 21 nt, Homo sapiens
cuaauucccauuuugcaaaau

SEQ ID NO: 421244 - RNA, 21 nt, Homo sapiens
cuaauuccccuuccauuccca

SEQ ID NO: 421245 - RNA, 20 nt, Homo sapiens
cuaauuugucacuggaaccu

SEQ ID NO: 421246 - RNA, 16 nt, Homo sapiens
cuacaaaaauacaauu

SEQ ID NO: 421247 - RNA, 17 nt, Homo sapiens
cuacaaaagcaaaguga

SEQ ID NO: 421248 - RNA, 16 nt, Homo sapiens
cuacaaagcugaagaa

SEQ ID NO: 421249 - RNA, 14 nt, Homo sapiens
cuacaagauuuaga

SEQ ID NO: 421250 - RNA, 17 nt, Homo sapiens
cuacagaaagagcguca

SEQ ID NO: 421251 - RNA, 14 nt, Homo sapiens
cuacagaaagcaaa

SEQ ID NO: 421252 - RNA, 22 nt, Homo sapiens
cuacagagcagcuccccaggag

SEQ ID NO: 421253 - RNA, 20 nt, Homo sapiens
cuacagcaaagccuagccug

SEQ ID NO: 421254 - RNA, 20 nt, Homo sapiens
cuacagcaguagggagguca

SEQ ID NO: 421255 - RNA, 20 nt, Homo sapiens
cuacaggaagcaccccaugc

SEQ ID NO: 421256 - RNA, 19 nt, Homo sapiens
cuacagggccacaacugcc

SEQ ID NO: 421257 - RNA, 23 nt, Homo sapiens
cuacaggggaggcugagacgcaa

SEQ ID NO: 421258 - RNA, 18 nt, Homo sapiens
cuacauaaggaugaaggu

SEQ ID NO: 421259 - RNA, 14 nt, Homo sapiens
cuacauaaguaauu

SEQ ID NO: 421260 - RNA, 21 nt, Homo sapiens
cuacaugccucagugaaggac

SEQ ID NO: 421261 - RNA, 11 nt, Homo sapiens
cuacauuccuc

SEQ ID NO: 421262 - RNA, 22 nt, Homo sapiens
cuacauugacgagcaugagcug

SEQ ID NO: 421263 - RNA, 23 nt, Homo sapiens
cuacccacuaugcacagauuaaa

SEQ ID NO: 421264 - RNA, 13 nt, Homo sapiens
cuaguacuaguac

SEQ ID NO: 421265 - RNA, 13 nt, Homo sapiens
cuaguacuauuac

SEQ ID NO: 421266 - RNA, 18 nt, Homo sapiens
cuaguacuauuacuagua

SEQ ID NO: 421267 - RNA, 24 nt, Homo sapiens
cuaguacuauuacuaguacuagua

SEQ ID NO: 421268 - RNA, 13 nt, Homo sapiens
cuaguacuauuau

SEQ ID NO: 421269 - RNA, 12 nt, Homo sapiens
cuaguacuauug

SEQ ID NO: 421270 - RNA, 20 nt, Homo sapiens
cuaguaucuucaaacuuuca

SEQ ID NO: 421271 - RNA, 21 nt, Homo sapiens
cuagucagauggauguagaua

SEQ ID NO: 421272 - RNA, 22 nt, Homo sapiens
cuagucccuguguucugcacau

SEQ ID NO: 421273 - RNA, 19 nt, Homo sapiens
cuagucuccuuugcacuga

SEQ ID NO: 421274 - RNA, 18 nt, Homo sapiens
cuagugacuuccugguga

SEQ ID NO: 421275 - RNA, 22 nt, Homo sapiens
cuagugcucccuuccuccucaa

SEQ ID NO: 421276 - RNA, 15 nt, Homo sapiens
cuagugcugaagcuu

SEQ ID NO: 421277 - RNA, 16 nt, Homo sapiens
cuagugucuuuugccu

SEQ ID NO: 421278 - RNA, 18 nt, Homo sapiens
cuaguuaaacagugccau

SEQ ID NO: 421279 - RNA, 20 nt, Homo sapiens
cuaguucagacacuuuggaa

SEQ ID NO: 421280 - RNA, 14 nt, Homo sapiens
cuaguucuuaggaa

SEQ ID NO: 421281 - RNA, 16 nt, Homo sapiens
cuaguugucacuuucc

SEQ ID NO: 421282 - RNA, 15 nt, Homo sapiens
cuauaaacauaugca

SEQ ID NO: 421283 - RNA, 16 nt, Homo sapiens
cuauaaaguaaagcua

SEQ ID NO: 421284 - RNA, 20 nt, Homo sapiens
cuauaauuccgaaacauaca

SEQ ID NO: 421285 - RNA, 15 nt, Homo sapiens
cuauacauuccugag

SEQ ID NO: 421286 - RNA, 17 nt, Homo sapiens
cuauagaauaaagccuc

SEQ ID NO: 421287 - RNA, 21 nt, Homo sapiens
cuauagagaaaccccugggga

SEQ ID NO: 421288 - RNA, 14 nt, Homo sapiens
cuauagccauuugc

SEQ ID NO: 421289 - RNA, 21 nt, Homo sapiens
cuauauaaaguacuacuguag

SEQ ID NO: 421290 - RNA, 19 nt, Homo sapiens
cuaucaccucuuaugcaca

SEQ ID NO: 421291 - RNA, 20 nt, Homo sapiens
cuaucaccucuuaugcacac

SEQ ID NO: 421292 - RNA, 14 nt, Homo sapiens
cuaucauguugaag

SEQ ID NO: 421293 - RNA, 22 nt, Homo sapiens
cuauccaaagaacuugauuugc

SEQ ID NO: 421294 - RNA, 13 nt, Homo sapiens
cuaucugcaaaua

SEQ ID NO: 421295 - RNA, 17 nt, Homo sapiens
cuaucuuuuaguuuuag

SEQ ID NO: 421296 - RNA, 20 nt, Homo sapiens
cuaugaaaaugagcaucaga

SEQ ID NO: 421297 - RNA, 16 nt, Homo sapiens
cuaugagcacauagga

SEQ ID NO: 421298 - RNA, 17 nt, Homo sapiens
cuaugagcacauaggac

SEQ ID NO: 421299 - RNA, 22 nt, Homo sapiens
cuaugcacaccaaauugcugag

SEQ ID NO: 421300 - RNA, 14 nt, Homo sapiens
cuaugccuguggug

SEQ ID NO: 421301 - RNA, 14 nt, Homo sapiens
cuaugcugcaauac

SEQ ID NO: 421302 - RNA, 18 nt, Homo sapiens
cuaugcuggaaaacugag

SEQ ID NO: 421303 - RNA, 20 nt, Homo sapiens
cuaugcugggguacacagug

SEQ ID NO: 421304 - RNA, 15 nt, Homo sapiens
cuauggagcaaaaca

SEQ ID NO: 421305 - RNA, 15 nt, Homo sapiens
cuaugggggcacuga

SEQ ID NO: 421306 - RNA, 19 nt, Homo sapiens
cuaugucgucguuuucacc

SEQ ID NO: 421307 - RNA, 12 nt, Homo sapiens
cuaugucuguga

SEQ ID NO: 421308 - RNA, 15 nt, Homo sapiens
cuaugugagcacaaa

SEQ ID NO: 421309 - RNA, 19 nt, Homo sapiens
cuaugugccuuucacuuua

SEQ ID NO: 421310 - RNA, 11 nt, Homo sapiens
cuauguucccc

SEQ ID NO: 421311 - RNA, 16 nt, Homo sapiens
cuauuaacaacccaua

SEQ ID NO: 421312 - RNA, 14 nt, Homo sapiens
cuauuaacucugca

SEQ ID NO: 421313 - RNA, 14 nt, Homo sapiens
cuauuaccaugaga

SEQ ID NO: 421314 - RNA, 13 nt, Homo sapiens
cuauuacuaguac

SEQ ID NO: 421315 - RNA, 14 nt, Homo sapiens
cuauuacuaguacu

SEQ ID NO: 421316 - RNA, 16 nt, Homo sapiens
cuauuacuauuacuau

SEQ ID NO: 421317 - RNA, 12 nt, Homo sapiens
cuauuacuauuu

SEQ ID NO: 421318 - RNA, 19 nt, Homo sapiens
cuauucaaaauaaacaaua

SEQ ID NO: 421319 - RNA, 16 nt, Homo sapiens
cuauucagaacuugua

SEQ ID NO: 421320 - RNA, 18 nt, Homo sapiens
cuauucaggagaguagaa

SEQ ID NO: 421321 - RNA, 15 nt, Homo sapiens
cuauucaugucucua

SEQ ID NO: 421322 - RNA, 18 nt, Homo sapiens
cuauucccacuuucauuc

SEQ ID NO: 421323 - RNA, 18 nt, Homo sapiens
cuauucccuaacucucgg

SEQ ID NO: 421324 - RNA, 15 nt, Homo sapiens
cuauucuuaagcacu

SEQ ID NO: 421325 - RNA, 21 nt, Homo sapiens
cuauugauguacagucuguca

SEQ ID NO: 421326 - RNA, 16 nt, Homo sapiens
cuauuggaaugugguc

SEQ ID NO: 421327 - RNA, 21 nt, Homo sapiens
cuauugugggacuuauuacaa

SEQ ID NO: 421328 - RNA, 11 nt, Homo sapiens
ccccaccuacu

SEQ ID NO: 421329 - RNA, 23 nt, Homo sapiens
ccccaccuucccuccaccugcuu

SEQ ID NO: 421330 - RNA, 18 nt, Homo sapiens
ccccacuaggcacugugg

SEQ ID NO: 421331 - RNA, 23 nt, Homo sapiens
ccccagacgcacgugggucuuca

SEQ ID NO: 421332 - RNA, 15 nt, Homo sapiens
ccccagagugacuga

SEQ ID NO: 421333 - RNA, 20 nt, Homo sapiens
ccccagccaucuacuggaua

SEQ ID NO: 421334 - RNA, 17 nt, Homo sapiens
ccccaggggucccagcc

SEQ ID NO: 421335 - RNA, 23 nt, Homo sapiens
ccccagggugagcagggcccuca

SEQ ID NO: 421336 - RNA, 23 nt, Homo sapiens
ccccaguucaaucucccgcugcu

SEQ ID NO: 421337 - RNA, 16 nt, Homo sapiens
ccccaucucugcaaaa

SEQ ID NO: 421338 - RNA, 18 nt, Homo sapiens
ccccaugccuguccagcc

SEQ ID NO: 421339 - RNA, 13 nt, Homo sapiens
ccccauuugcaca

SEQ ID NO: 421340 - RNA, 22 nt, Homo sapiens
cccccacccaccuggauucccu

SEQ ID NO: 421341 - RNA, 15 nt, Homo sapiens
cccccaccuuuggga

SEQ ID NO: 421342 - RNA, 23 nt, Homo sapiens
cccccacguggacucugugcuca

SEQ ID NO: 421343 - RNA, 23 nt, Homo sapiens
cccccagccuggacaccucucau

SEQ ID NO: 421344 - RNA, 21 nt, Homo sapiens
cccccauuaaccagggcacca

SEQ ID NO: 421345 - RNA, 14 nt, Homo sapiens
cccccgugccaaau

SEQ ID NO: 421346 - RNA, 19 nt, Homo sapiens
cccccuguagacuagugcc

SEQ ID NO: 421347 - RNA, 12 nt, Homo sapiens
cccccuugaggg

SEQ ID NO: 421348 - RNA, 21 nt, Homo sapiens
ccccgacacccagcccagcuu

SEQ ID NO: 421349 - RNA, 13 nt, Homo sapiens
ccccgaguuuaaa

SEQ ID NO: 421350 - RNA, 22 nt, Homo sapiens
ccccgauugaaagaaccagaga

SEQ ID NO: 421351 - RNA, 16 nt, Homo sapiens
ccccgcccagugcagu

SEQ ID NO: 421352 - RNA, 19 nt, Homo sapiens
ccccgugggccauggcaau

SEQ ID NO: 421353 - RNA, 12 nt, Homo sapiens
ccccuaaacaaa

SEQ ID NO: 421354 - RNA, 12 nt, Homo sapiens
ccccucaagaaa

SEQ ID NO: 421355 - RNA, 15 nt, Homo sapiens
ccccucagauuccac

SEQ ID NO: 421356 - RNA, 19 nt, Homo sapiens
ccgaaccccccacucccug

SEQ ID NO: 421357 - RNA, 15 nt, Homo sapiens
ccgaagaaggguccu

SEQ ID NO: 421358 - RNA, 18 nt, Homo sapiens
ccgacaaccgaugcucca

SEQ ID NO: 421359 - RNA, 14 nt, Homo sapiens
ccgaccccaucuca

SEQ ID NO: 421360 - RNA, 13 nt, Homo sapiens
ccgacugccugug

SEQ ID NO: 421361 - RNA, 19 nt, Homo sapiens
ccgacugugaaaguaugug

SEQ ID NO: 421362 - RNA, 17 nt, Homo sapiens
ccgagagagauggaaua

SEQ ID NO: 421363 - RNA, 20 nt, Homo sapiens
ccgagcugggggccaugagc

SEQ ID NO: 421364 - RNA, 14 nt, Homo sapiens
ccgaggacuuugau

SEQ ID NO: 421365 - RNA, 16 nt, Homo sapiens
ccgaguaacugagauu

SEQ ID NO: 421366 - RNA, 11 nt, Homo sapiens
ccgagugcaau

SEQ ID NO: 421367 - RNA, 12 nt, Homo sapiens
ccgagugcaaug

SEQ ID NO: 421368 - RNA, 21 nt, Homo sapiens
ccgauacuaguuugcuuugcu

SEQ ID NO: 421369 - RNA, 16 nt, Homo sapiens
ccgcaccuugucaugu

SEQ ID NO: 421370 - RNA, 16 nt, Homo sapiens
ccgcagguuaugucag

SEQ ID NO: 421371 - RNA, 22 nt, Homo sapiens
ccgcaucguggccuugaccucc

SEQ ID NO: 421372 - RNA, 20 nt, Homo sapiens
ccgccaccgugcccggcuaa

SEQ ID NO: 421373 - RNA, 14 nt, Homo sapiens
ccgccagaccucaa

SEQ ID NO: 421374 - RNA, 22 nt, Homo sapiens
ccgcccaccagaccuguucuga

SEQ ID NO: 421375 - RNA, 15 nt, Homo sapiens
ccgcugaccuugcac

SEQ ID NO: 421376 - RNA, 17 nt, Homo sapiens
ccggagagggagucagu

SEQ ID NO: 421377 - RNA, 19 nt, Homo sapiens
ccggcacccugauccucac

SEQ ID NO: 421378 - RNA, 18 nt, Homo sapiens
ccggcaggcccugcagug

SEQ ID NO: 421379 - RNA, 16 nt, Homo sapiens
ccggcgccccugccac

SEQ ID NO: 421380 - RNA, 16 nt, Homo sapiens
ccgggagcaguguccu

SEQ ID NO: 421381 - RNA, 19 nt, Homo sapiens
ccgggcacagcugugguga

SEQ ID NO: 421382 - RNA, 20 nt, Homo sapiens
ccgggugcucagggcugaca

SEQ ID NO: 421383 - RNA, 21 nt, Homo sapiens
ccgguguccuguuccugccac

SEQ ID NO: 421384 - RNA, 16 nt, Homo sapiens
ccgguugcuucuggga

SEQ ID NO: 421385 - RNA, 18 nt, Homo sapiens
ccgucucauauuuuuaca

SEQ ID NO: 421386 - RNA, 11 nt, Homo sapiens
ccgugccuuca

SEQ ID NO: 421387 - RNA, 17 nt, Homo sapiens
ccguggaucugggcaca

SEQ ID NO: 421388 - RNA, 22 nt, Homo sapiens
aggccgggcgcaguggcucacg

SEQ ID NO: 421389 - RNA, 14 nt, Homo sapiens
aggccguggcugcc

SEQ ID NO: 421390 - RNA, 18 nt, Homo sapiens
aggccuaugccaccugca

SEQ ID NO: 421391 - RNA, 14 nt, Homo sapiens
aggccucaguggac

SEQ ID NO: 421392 - RNA, 23 nt, Homo sapiens
aggccugccaaugccacagccaa

SEQ ID NO: 421393 - RNA, 15 nt, Homo sapiens
aggccuguugcuuuu

SEQ ID NO: 421394 - RNA, 19 nt, Homo sapiens
aggcgauccaccugucuca

SEQ ID NO: 421395 - RNA, 17 nt, Homo sapiens
aggcggcuacaugccuc

SEQ ID NO: 421396 - RNA, 13 nt, Homo sapiens
aggcgggggagcc

SEQ ID NO: 421397 - RNA, 20 nt, Homo sapiens
aggcggguggaucacuugag

SEQ ID NO: 421398 - RNA, 13 nt, Homo sapiens
aggcggugagcaa

SEQ ID NO: 421399 - RNA, 23 nt, Homo sapiens
aggcguccgcgcgccagcacaga

SEQ ID NO: 421400 - RNA, 21 nt, Homo sapiens
aggcuaagaugagauuugcca

SEQ ID NO: 421401 - RNA, 13 nt, Homo sapiens
aggcuacuuuuca

SEQ ID NO: 421402 - RNA, 17 nt, Homo sapiens
aggcuauagcugggaac

SEQ ID NO: 421403 - RNA, 17 nt, Homo sapiens
aggcucaauauuccuga

SEQ ID NO: 421404 - RNA, 15 nt, Homo sapiens
aggcucacaacuguu

SEQ ID NO: 421405 - RNA, 17 nt, Homo sapiens
aggcucaggccauggcu

SEQ ID NO: 421406 - RNA, 19 nt, Homo sapiens
aggcucugggcucagggcu

SEQ ID NO: 421407 - RNA, 18 nt, Homo sapiens
aggcugaaaagugcuuug

SEQ ID NO: 421408 - RNA, 17 nt, Homo sapiens
aggcugaacauaaauca

SEQ ID NO: 421409 - RNA, 23 nt, Homo sapiens
aggcugagacugcagaggagcca

SEQ ID NO: 421410 - RNA, 15 nt, Homo sapiens
aggcugcacagcuca

SEQ ID NO: 421411 - RNA, 15 nt, Homo sapiens
aggcugcacugcagu

SEQ ID NO: 421412 - RNA, 20 nt, Homo sapiens
aggcugccuggagaaaggau

SEQ ID NO: 421413 - RNA, 19 nt, Homo sapiens
aggcugcgacugaugaagg

SEQ ID NO: 421414 - RNA, 20 nt, Homo sapiens
aggcugcgacugaugaaggc

SEQ ID NO: 421415 - RNA, 14 nt, Homo sapiens
aggcuggagcuggc

SEQ ID NO: 421416 - RNA, 20 nt, Homo sapiens
aggcuggagugcaguggcac

SEQ ID NO: 421417 - RNA, 20 nt, Homo sapiens
aggcuggagugcaguggcgu

SEQ ID NO: 421418 - RNA, 15 nt, Homo sapiens
aggcuucacccugaa

SEQ ID NO: 421419 - RNA, 16 nt, Homo sapiens
aggcuucuauguccaa

SEQ ID NO: 421420 - RNA, 17 nt, Homo sapiens
aggcuuuccucagcacc

SEQ ID NO: 421421 - RNA, 16 nt, Homo sapiens
agggaaaaaauugcuu

SEQ ID NO: 421422 - RNA, 23 nt, Homo sapiens
agggaaaacaaauauuucacuua

SEQ ID NO: 421423 - RNA, 15 nt, Homo sapiens
agggaaaagauuucu

SEQ ID NO: 421424 - RNA, 18 nt, Homo sapiens
agggaaaaggaguaggga

SEQ ID NO: 421425 - RNA, 22 nt, Homo sapiens
agggaaaaggaguagggaguuc

SEQ ID NO: 421426 - RNA, 17 nt, Homo sapiens
agggaaauucacacugu

SEQ ID NO: 421427 - RNA, 18 nt, Homo sapiens
agggaaauucacacugug

SEQ ID NO: 421428 - RNA, 15 nt, Homo sapiens
agggaagaaagcaga

SEQ ID NO: 421429 - RNA, 18 nt, Homo sapiens
agggaagccccacuugaa

SEQ ID NO: 421430 - RNA, 19 nt, Homo sapiens
agggaagcuggccgagggu

SEQ ID NO: 421431 - RNA, 22 nt, Homo sapiens
agggaagcugucccucacuguu

SEQ ID NO: 421432 - RNA, 21 nt, Homo sapiens
agggaagugacaggacuuuca

SEQ ID NO: 421433 - RNA, 17 nt, Homo sapiens
agggaauucucuuggcu

SEQ ID NO: 421434 - RNA, 16 nt, Homo sapiens
agggacagaugaaugc

SEQ ID NO: 421435 - RNA, 15 nt, Homo sapiens
agggagaagcaugaa

SEQ ID NO: 421436 - RNA, 17 nt, Homo sapiens
agggagacccugggaga

SEQ ID NO: 421437 - RNA, 14 nt, Homo sapiens
agggagagccagcu

SEQ ID NO: 421438 - RNA, 15 nt, Homo sapiens
agggagaggccauga

SEQ ID NO: 421439 - RNA, 17 nt, Homo sapiens
agggagagggaaauaca

SEQ ID NO: 421440 - RNA, 22 nt, Homo sapiens
agggagaucuuggggugcagca

SEQ ID NO: 421441 - RNA, 16 nt, Homo sapiens
agggagccaugcucuu

SEQ ID NO: 421442 - RNA, 14 nt, Homo sapiens
agggagcccggggc

SEQ ID NO: 421443 - RNA, 14 nt, Homo sapiens
agggagcugcucag

SEQ ID NO: 421444 - RNA, 16 nt, Homo sapiens
agggaggcccauguga

SEQ ID NO: 421445 - RNA, 18 nt, Homo sapiens
agggagggaaacccgggg

SEQ ID NO: 421446 - RNA, 21 nt, Homo sapiens
agggaguagugcggugguggu

SEQ ID NO: 421447 - RNA, 18 nt, Homo sapiens
agggaugugugagaauaa

SEQ ID NO: 421448 - RNA, 19 nt, Homo sapiens
agggcacucucugccagcu

SEQ ID NO: 421449 - RNA, 14 nt, Homo sapiens
agggcagaggugga

SEQ ID NO: 421450 - RNA, 23 nt, Homo sapiens
agggcagggcaucuccugugcau

SEQ ID NO: 421451 - RNA, 16 nt, Homo sapiens
agggcagggcucugau

SEQ ID NO: 421452 - RNA, 20 nt, Homo sapiens
agggcagggcuggcaccucu

SEQ ID NO: 421453 - RNA, 22 nt, Homo sapiens
agggcaguguggugggaggggu

SEQ ID NO: 421454 - RNA, 18 nt, Homo sapiens
agggcaucuccugugcau

SEQ ID NO: 421455 - RNA, 17 nt, Homo sapiens
agggcauguugggauaa

SEQ ID NO: 421456 - RNA, 10 nt, Homo sapiens
agggccaguc

SEQ ID NO: 421457 - RNA, 17 nt, Homo sapiens
agggcccagcuguagcc

SEQ ID NO: 421458 - RNA, 14 nt, Homo sapiens
agggccuggucacc

SEQ ID NO: 421459 - RNA, 17 nt, Homo sapiens
agggcgagacuccgucu

SEQ ID NO: 421460 - RNA, 20 nt, Homo sapiens
agggcgagacuccgucucaa

SEQ ID NO: 421461 - RNA, 19 nt, Homo sapiens
agggcgcugagggcagggu

SEQ ID NO: 421462 - RNA, 13 nt, Homo sapiens
agggcucagcucc

SEQ ID NO: 421463 - RNA, 19 nt, Homo sapiens
agggcuccagcauccagcc

SEQ ID NO: 421464 - RNA, 20 nt, Homo sapiens
agggcuuaucuagccaaaga

SEQ ID NO: 421465 - RNA, 17 nt, Homo sapiens
aggggaaggagugugca

SEQ ID NO: 421466 - RNA, 21 nt, Homo sapiens
aggggacugcaugcaagcuca

SEQ ID NO: 421467 - RNA, 20 nt, Homo sapiens
aggggcaauggggugccuac

SEQ ID NO: 421468 - RNA, 21 nt, Homo sapiens
aggggcaggagcucagaugaa

SEQ ID NO: 421469 - RNA, 14 nt, Homo sapiens
aggggccacugggc

SEQ ID NO: 421470 - RNA, 15 nt, Homo sapiens
aggggcucgagugcc

SEQ ID NO: 421471 - RNA, 16 nt, Homo sapiens
aggggcucugcuuccu

SEQ ID NO: 421472 - RNA, 23 nt, Homo sapiens
aggggcugggggugaggggccag

SEQ ID NO: 421473 - RNA, 21 nt, Homo sapiens
aggggcuguggccgucuccuc

SEQ ID NO: 421474 - RNA, 14 nt, Homo sapiens
agggguaauugcau

SEQ ID NO: 421475 - RNA, 17 nt, Homo sapiens
agggguaauugcauucu

SEQ ID NO: 421476 - RNA, 13 nt, Homo sapiens
aggggugcugccu

SEQ ID NO: 421477 - RNA, 19 nt, Homo sapiens
aggggugguccugacucaa

SEQ ID NO: 421478 - RNA, 14 nt, Homo sapiens
aggguaaguuguua

SEQ ID NO: 421479 - RNA, 23 nt, Homo sapiens
aggguagucugguuucuagacuu

SEQ ID NO: 421480 - RNA, 16 nt, Homo sapiens
aggguccgcaccagcu

SEQ ID NO: 421481 - RNA, 14 nt, Homo sapiens
agggucucuucagg

SEQ ID NO: 421482 - RNA, 23 nt, Homo sapiens
agggucugcucuuucucugccag

SEQ ID NO: 421483 - RNA, 23 nt, Homo sapiens
agggucuuccuccuaaauuucca

SEQ ID NO: 421484 - RNA, 23 nt, Homo sapiens
agggucuucuuacaugcauuuga

SEQ ID NO: 421485 - RNA, 11 nt, Homo sapiens
agggugacugu

SEQ ID NO: 421486 - RNA, 19 nt, Homo sapiens
agggugaggcccacucugu

SEQ ID NO: 421487 - RNA, 18 nt, Homo sapiens
aggguggcccuugcaguu

SEQ ID NO: 421488 - RNA, 16 nt, Homo sapiens
aggucuugaguuucau

SEQ ID NO: 421489 - RNA, 19 nt, Homo sapiens
aggugagcaaaaugcugcu

SEQ ID NO: 421490 - RNA, 17 nt, Homo sapiens
aggugagggcaguggga

SEQ ID NO: 421491 - RNA, 15 nt, Homo sapiens
aggugauaguguuga

SEQ ID NO: 421492 - RNA, 19 nt, Homo sapiens
aggugaugguaacugcaca

SEQ ID NO: 421493 - RNA, 21 nt, Homo sapiens
aggugcccugugggagagcaa

SEQ ID NO: 421494 - RNA, 16 nt, Homo sapiens
aggugcuagggugccu

SEQ ID NO: 421495 - RNA, 22 nt, Homo sapiens
agguggccccaguucaaucucc

SEQ ID NO: 421496 - RNA, 13 nt, Homo sapiens
agguggcucagug

SEQ ID NO: 421497 - RNA, 17 nt, Homo sapiens
agguggcucagugccac

SEQ ID NO: 421498 - RNA, 23 nt, Homo sapiens
aggugggauaucccuaugcugcc

SEQ ID NO: 421499 - RNA, 15 nt, Homo sapiens
aggugggcagaucau

SEQ ID NO: 421500 - RNA, 14 nt, Homo sapiens
aggugggcaugcca

SEQ ID NO: 421501 - RNA, 21 nt, Homo sapiens
aggugggcaugccacccucac

SEQ ID NO: 421502 - RNA, 23 nt, Homo sapiens
agguggggcgggaaagccaguga

SEQ ID NO: 421503 - RNA, 13 nt, Homo sapiens
aggugggggagcc

SEQ ID NO: 421504 - RNA, 18 nt, Homo sapiens
aggugggggaugcugagg

SEQ ID NO: 421505 - RNA, 22 nt, Homo sapiens
aggugggucaacuccaaggcaa

SEQ ID NO: 421506 - RNA, 16 nt, Homo sapiens
agguggugccuucuca

SEQ ID NO: 421507 - RNA, 14 nt, Homo sapiens
aggugugacuugaa

SEQ ID NO: 421508 - RNA, 16 nt, Homo sapiens
agguguuaccuucucu

SEQ ID NO: 421509 - RNA, 16 nt, Homo sapiens
agguguugccaaauau

SEQ ID NO: 421510 - RNA, 19 nt, Homo sapiens
agguuauagaguagaagau

SEQ ID NO: 421511 - RNA, 14 nt, Homo sapiens
agguuaugagaaaa

SEQ ID NO: 421512 - RNA, 17 nt, Homo sapiens
agguucaggaagaccac

SEQ ID NO: 421513 - RNA, 13 nt, Homo sapiens
agguugcagugag

SEQ ID NO: 421514 - RNA, 22 nt, Homo sapiens
agguugcuguugugcagugugc

SEQ ID NO: 421515 - RNA, 16 nt, Homo sapiens
agguuggcaccccagc

SEQ ID NO: 421516 - RNA, 12 nt, Homo sapiens
agguuggcagua

SEQ ID NO: 421517 - RNA, 17 nt, Homo sapiens
agguuggcgacugucau

SEQ ID NO: 421518 - RNA, 21 nt, Homo sapiens
agguugucugaagucacugca

SEQ ID NO: 421519 - RNA, 21 nt, Homo sapiens
agguuguuuuuaaaaccacua

SEQ ID NO: 421520 - RNA, 23 nt, Homo sapiens
agguuucaccucccaaacccagc

SEQ ID NO: 421521 - RNA, 13 nt, Homo sapiens
agguuuccuucag

SEQ ID NO: 421522 - RNA, 18 nt, Homo sapiens
agguuucuugaugaucaa

SEQ ID NO: 421523 - RNA, 15 nt, Homo sapiens
agguuuuuacuguga

SEQ ID NO: 421524 - RNA, 14 nt, Homo sapiens
aguaaaaacaauuc

SEQ ID NO: 421525 - RNA, 19 nt, Homo sapiens
aguaaaaacuguucucuau

SEQ ID NO: 421526 - RNA, 13 nt, Homo sapiens
aguaaaauauuca

SEQ ID NO: 421527 - RNA, 16 nt, Homo sapiens
aguaaagaaaugcaua

SEQ ID NO: 421528 - RNA, 18 nt, Homo sapiens
aguaaauuaguaauguac

SEQ ID NO: 421529 - RNA, 11 nt, Homo sapiens
aguaacauaua

SEQ ID NO: 421530 - RNA, 19 nt, Homo sapiens
aguaaccucuacaggcauu

SEQ ID NO: 421531 - RNA, 16 nt, Homo sapiens
aguaacuaaagcuuua

SEQ ID NO: 421532 - RNA, 15 nt, Homo sapiens
aguaacugagauuac

SEQ ID NO: 421533 - RNA, 16 nt, Homo sapiens
aguaagagagcacagu

SEQ ID NO: 421534 - RNA, 22 nt, Homo sapiens
aguaagauauugugugugugaa

SEQ ID NO: 421535 - RNA, 10 nt, Homo sapiens
aguaagccac

SEQ ID NO: 421536 - RNA, 15 nt, Homo sapiens
aguaaguacaaauau

SEQ ID NO: 421537 - RNA, 15 nt, Homo sapiens
aguaaguuuauccaa

SEQ ID NO: 421538 - RNA, 15 nt, Homo sapiens
aguaauagagcaaaa

SEQ ID NO: 421539 - RNA, 17 nt, Homo sapiens
aguaauauauaaugugg

SEQ ID NO: 421540 - RNA, 15 nt, Homo sapiens
aguaauaucuuucag

SEQ ID NO: 421541 - RNA, 13 nt, Homo sapiens
aguacuauuaaca

SEQ ID NO: 421542 - RNA, 17 nt, Homo sapiens
aguacugaaauacauau

SEQ ID NO: 421543 - RNA, 14 nt, Homo sapiens
aguagaaucucagc

SEQ ID NO: 421544 - RNA, 17 nt, Homo sapiens
aguagaaucucagcacu

SEQ ID NO: 421545 - RNA, 12 nt, Homo sapiens
aguagagcaaag

SEQ ID NO: 421546 - RNA, 21 nt, Homo sapiens
aguagagucacuggaacacua

SEQ ID NO: 421547 - RNA, 21 nt, Homo sapiens
aguagaucuguggcgauauga

SEQ ID NO: 421548 - RNA, 10 nt, Homo sapiens
aguagcucuu

SEQ ID NO: 421549 - RNA, 18 nt, Homo sapiens
aguagcugggaugacagg

SEQ ID NO: 421550 - RNA, 21 nt, Homo sapiens
aguagcugggauuacaggugu

SEQ ID NO: 421551 - RNA, 17 nt, Homo sapiens
aguaggaguugcuccua

SEQ ID NO: 421552 - RNA, 16 nt, Homo sapiens
aguaggcuaaaaacau

SEQ ID NO: 421553 - RNA, 16 nt, Homo sapiens
aguagugccugugauc

SEQ ID NO: 421554 - RNA, 17 nt, Homo sapiens
aguaguuuuuaucugaa

SEQ ID NO: 421555 - RNA, 20 nt, Homo sapiens
aguauacuagaaaguaauac

SEQ ID NO: 421556 - RNA, 14 nt, Homo sapiens
aguauauauagaau

SEQ ID NO: 421557 - RNA, 19 nt, Homo sapiens
aguauccugcuucugauau

SEQ ID NO: 421558 - RNA, 19 nt, Homo sapiens
aguaugagucaaugugcag

SEQ ID NO: 421559 - RNA, 13 nt, Homo sapiens
aguauuauuaaca

SEQ ID NO: 421560 - RNA, 21 nt, Homo sapiens
aguauuccuuuccugaucacu

SEQ ID NO: 421561 - RNA, 17 nt, Homo sapiens
aguauucuguaccauag

SEQ ID NO: 421562 - RNA, 13 nt, Homo sapiens
aguauuuuaccua

SEQ ID NO: 421563 - RNA, 15 nt, Homo sapiens
agucaaacagugugg

SEQ ID NO: 421564 - RNA, 18 nt, Homo sapiens
agucaaacuuucaccuca

SEQ ID NO: 421565 - RNA, 19 nt, Homo sapiens
agucaaacuuucaccucag

SEQ ID NO: 421566 - RNA, 21 nt, Homo sapiens
agucaaauuuggauuuuccac

SEQ ID NO: 421567 - RNA, 15 nt, Homo sapiens
agucaacacucuucu

SEQ ID NO: 421568 - RNA, 14 nt, Homo sapiens
agucaacagugaaa

SEQ ID NO: 421569 - RNA, 15 nt, Homo sapiens
agucaacagugaaau

SEQ ID NO: 421570 - RNA, 20 nt, Homo sapiens
agucaacucuucagccucau

SEQ ID NO: 421571 - RNA, 16 nt, Homo sapiens
agucaaggugcucaau

SEQ ID NO: 421572 - RNA, 14 nt, Homo sapiens
agucaagugugccu

SEQ ID NO: 421573 - RNA, 13 nt, Homo sapiens
agucacacugcug

SEQ ID NO: 421574 - RNA, 21 nt, Homo sapiens
agucacccucuucaagcuuuu

SEQ ID NO: 421575 - RNA, 23 nt, Homo sapiens
agucaccuccuccacucacucca

SEQ ID NO: 421576 - RNA, 13 nt, Homo sapiens
agucacguguauu

SEQ ID NO: 421577 - RNA, 16 nt, Homo sapiens
agucagagaaaacacu

SEQ ID NO: 421578 - RNA, 14 nt, Homo sapiens
agucaggagccagc

SEQ ID NO: 421579 - RNA, 18 nt, Homo sapiens
agucagguuugaguagag

SEQ ID NO: 421580 - RNA, 15 nt, Homo sapiens
agucauauaccuaua

SEQ ID NO: 421581 - RNA, 13 nt, Homo sapiens
agucauauugccc

SEQ ID NO: 421582 - RNA, 13 nt, Homo sapiens
agucaucaucuca

SEQ ID NO: 421583 - RNA, 15 nt, Homo sapiens
agucaucucauucca

SEQ ID NO: 421584 - RNA, 13 nt, Homo sapiens
agucaugaagcuc

SEQ ID NO: 421585 - RNA, 19 nt, Homo sapiens
agucauuaugagaggcaau

SEQ ID NO: 421586 - RNA, 21 nt, Homo sapiens
agucauuggguuuuaucagug

SEQ ID NO: 421587 - RNA, 22 nt, Homo sapiens
agucauugucgcucagcaauag

SEQ ID NO: 421588 - RNA, 21 nt, Homo sapiens
agucauuugcugagcauguac

SEQ ID NO: 421589 - RNA, 21 nt, Homo sapiens
aguccaaaauaucgagugaau

SEQ ID NO: 421590 - RNA, 21 nt, Homo sapiens
aguccacuuguucuguacuug

SEQ ID NO: 421591 - RNA, 16 nt, Homo sapiens
aguccagcacuggaag

SEQ ID NO: 421592 - RNA, 22 nt, Homo sapiens
aguccagcuccuuaaacugacg

SEQ ID NO: 421593 - RNA, 17 nt, Homo sapiens
auccucccuacuuccaa

SEQ ID NO: 421594 - RNA, 20 nt, Homo sapiens
auccucugcuaccaucucau

SEQ ID NO: 421595 - RNA, 20 nt, Homo sapiens
auccucuugccaccguccca

SEQ ID NO: 421596 - RNA, 14 nt, Homo sapiens
auccugaacaagaa

SEQ ID NO: 421597 - RNA, 20 nt, Homo sapiens
auccugaguaguaaucucac

SEQ ID NO: 421598 - RNA, 15 nt, Homo sapiens
auccugcuacacuca

SEQ ID NO: 421599 - RNA, 20 nt, Homo sapiens
auccuguacaagugcucagu

SEQ ID NO: 421600 - RNA, 18 nt, Homo sapiens
auccuuaaugcagagcua

SEQ ID NO: 421601 - RNA, 15 nt, Homo sapiens
auccuuccaaagaau

SEQ ID NO: 421602 - RNA, 14 nt, Homo sapiens
auccuugcaucacu

SEQ ID NO: 421603 - RNA, 12 nt, Homo sapiens
auccuugcuaag

SEQ ID NO: 421604 - RNA, 21 nt, Homo sapiens
auccuuguugacacggccaug

SEQ ID NO: 421605 - RNA, 16 nt, Homo sapiens
auccuuuauagcuuug

SEQ ID NO: 421606 - RNA, 22 nt, Homo sapiens
auccuuuccacccuauucccua

SEQ ID NO: 421607 - RNA, 23 nt, Homo sapiens
auccuuuguucucccaaaucuga

SEQ ID NO: 421608 - RNA, 23 nt, Homo sapiens
auccuuuuuucucuucuguccau

SEQ ID NO: 421609 - RNA, 20 nt, Homo sapiens
aucgcgccaguacauuccaa

SEQ ID NO: 421610 - RNA, 16 nt, Homo sapiens
aucgggcaaugggagg

SEQ ID NO: 421611 - RNA, 17 nt, Homo sapiens
aucggggccagaggcag

SEQ ID NO: 421612 - RNA, 14 nt, Homo sapiens
aucgucauuuugca

SEQ ID NO: 421613 - RNA, 13 nt, Homo sapiens
aucuaaaucuuca

SEQ ID NO: 421614 - RNA, 18 nt, Homo sapiens
aucuaagccuuuccauaa

SEQ ID NO: 421615 - RNA, 22 nt, Homo sapiens
aucuacacagcaguaugaauga

SEQ ID NO: 421616 - RNA, 18 nt, Homo sapiens
aucuacacccaccagagu

SEQ ID NO: 421617 - RNA, 19 nt, Homo sapiens
aucuacauaaggaugaagg

SEQ ID NO: 421618 - RNA, 14 nt, Homo sapiens
aucuaccagcauaa

SEQ ID NO: 421619 - RNA, 17 nt, Homo sapiens
aucuacccagucaugua

SEQ ID NO: 421620 - RNA, 15 nt, Homo sapiens
aucuaccugcuccuu

SEQ ID NO: 421621 - RNA, 16 nt, Homo sapiens
aucuaccuguguguau

SEQ ID NO: 421622 - RNA, 15 nt, Homo sapiens
aucuacuacucuguc

SEQ ID NO: 421623 - RNA, 21 nt, Homo sapiens
aucuacuagaaccuucuaauc

SEQ ID NO: 421624 - RNA, 15 nt, Homo sapiens
aucuacuucuacauc

SEQ ID NO: 421625 - RNA, 17 nt, Homo sapiens
aucuacuucuacaucca

SEQ ID NO: 421626 - RNA, 20 nt, Homo sapiens
aucuagccagagcccuucac

SEQ ID NO: 421627 - RNA, 22 nt, Homo sapiens
aucuaguuaagucgcugaacaa

SEQ ID NO: 421628 - RNA, 17 nt, Homo sapiens
aucuaguuuacagaaaa

SEQ ID NO: 421629 - RNA, 13 nt, Homo sapiens
aucuauacauacc

SEQ ID NO: 421630 - RNA, 14 nt, Homo sapiens
aucuauagcacaua

SEQ ID NO: 421631 - RNA, 17 nt, Homo sapiens
aucuaucaccugucauc

SEQ ID NO: 421632 - RNA, 12 nt, Homo sapiens
aucuauggauug

SEQ ID NO: 421633 - RNA, 16 nt, Homo sapiens
aucuauuacucugaca

SEQ ID NO: 421634 - RNA, 19 nt, Homo sapiens
aucuauugcagauauuuga

SEQ ID NO: 421635 - RNA, 14 nt, Homo sapiens
aucucaauuugcag

SEQ ID NO: 421636 - RNA, 18 nt, Homo sapiens
aucucacuuaauacagau

SEQ ID NO: 421637 - RNA, 21 nt, Homo sapiens
aucucacuuuucuccaugagu

SEQ ID NO: 421638 - RNA, 19 nt, Homo sapiens
aucucagcauuuuuauucc

SEQ ID NO: 421639 - RNA, 17 nt, Homo sapiens
aucucagccagccucca

SEQ ID NO: 421640 - RNA, 23 nt, Homo sapiens
aucucagccagccuccagcaccu

SEQ ID NO: 421641 - RNA, 17 nt, Homo sapiens
aucucauagguugccaa

SEQ ID NO: 421642 - RNA, 22 nt, Homo sapiens
aucuccaggccccuuaccugca

SEQ ID NO: 421643 - RNA, 13 nt, Homo sapiens
aucuccaguaucc

SEQ ID NO: 421644 - RNA, 20 nt, Homo sapiens
aucuccaguauucuugucaa

SEQ ID NO: 421645 - RNA, 17 nt, Homo sapiens
aucuccauauguuacac

SEQ ID NO: 421646 - RNA, 19 nt, Homo sapiens
aucuccaucauaugccuga

SEQ ID NO: 421647 - RNA, 16 nt, Homo sapiens
aucucccuuccaccuc

SEQ ID NO: 421648 - RNA, 13 nt, Homo sapiens
aucuccuccaugu

SEQ ID NO: 421649 - RNA, 22 nt, Homo sapiens
aucuccuugauuacauaauguu

SEQ ID NO: 421650 - RNA, 16 nt, Homo sapiens
aucucuaauauggcaa

SEQ ID NO: 421651 - RNA, 16 nt, Homo sapiens
aucucuacuaccacaa

SEQ ID NO: 421652 - RNA, 16 nt, Homo sapiens
aucucuauaacagauc

SEQ ID NO: 421653 - RNA, 14 nt, Homo sapiens
aucucucuuuacau

SEQ ID NO: 421654 - RNA, 18 nt, Homo sapiens
aucucugauuaaauuuaa

SEQ ID NO: 421655 - RNA, 16 nt, Homo sapiens
aucucuguaaaccacu

SEQ ID NO: 421656 - RNA, 19 nt, Homo sapiens
aucucuuaugggauuacau

SEQ ID NO: 421657 - RNA, 19 nt, Homo sapiens
aucugaacacauacuagaa

SEQ ID NO: 421658 - RNA, 14 nt, Homo sapiens
aucugaacucucaa

SEQ ID NO: 421659 - RNA, 14 nt, Homo sapiens
aucugacacugaca

SEQ ID NO: 421660 - RNA, 18 nt, Homo sapiens
aucugcaaauaguuucaa

SEQ ID NO: 421661 - RNA, 20 nt, Homo sapiens
aucugcaauguuuuugugua

SEQ ID NO: 421662 - RNA, 22 nt, Homo sapiens
aucugcagggagcaacucucca

SEQ ID NO: 421663 - RNA, 19 nt, Homo sapiens
aucugcauuucuacauguu

SEQ ID NO: 421664 - RNA, 18 nt, Homo sapiens
aucugcauuuucacccca

SEQ ID NO: 421665 - RNA, 18 nt, Homo sapiens
aucugcccaauccugggu

SEQ ID NO: 421666 - RNA, 15 nt, Homo sapiens
aucugcucugagacg

SEQ ID NO: 421667 - RNA, 19 nt, Homo sapiens
aucugcuuaccacaucaca

SEQ ID NO: 421668 - RNA, 14 nt, Homo sapiens
aucuggaaggacau

SEQ ID NO: 421669 - RNA, 20 nt, Homo sapiens
aucuggacuuauuuuuggac

SEQ ID NO: 421670 - RNA, 17 nt, Homo sapiens
aucugggcaaaugaaaa

SEQ ID NO: 421671 - RNA, 17 nt, Homo sapiens
aucuggggaaggaccaa

SEQ ID NO: 421672 - RNA, 16 nt, Homo sapiens
aucuggggauggagaa

SEQ ID NO: 421673 - RNA, 17 nt, Homo sapiens
aucuggguaucuuucca

SEQ ID NO: 421674 - RNA, 16 nt, Homo sapiens
aucuggucccuugcag

SEQ ID NO: 421675 - RNA, 13 nt, Homo sapiens
aucuggugcgugu

SEQ ID NO: 421676 - RNA, 14 nt, Homo sapiens
aucuguacauauua

SEQ ID NO: 421677 - RNA, 18 nt, Homo sapiens
aucuguaugucugccuaa

SEQ ID NO: 421678 - RNA, 14 nt, Homo sapiens
aucugucuugucau

SEQ ID NO: 421679 - RNA, 17 nt, Homo sapiens
aucugucuugucauucc

SEQ ID NO: 421680 - RNA, 20 nt, Homo sapiens
aucugugcagucaucaacaa

SEQ ID NO: 421681 - RNA, 18 nt, Homo sapiens
aucugugcccagagaugg

SEQ ID NO: 421682 - RNA, 14 nt, Homo sapiens
aucuguguuuacuu

SEQ ID NO: 421683 - RNA, 15 nt, Homo sapiens
aucuguguuuacuua

SEQ ID NO: 421684 - RNA, 18 nt, Homo sapiens
aucuguuaaccaaauaaa

SEQ ID NO: 421685 - RNA, 20 nt, Homo sapiens
aucuguuugaucccuguuac

SEQ ID NO: 421686 - RNA, 15 nt, Homo sapiens
aucuguuuuacugcu

SEQ ID NO: 421687 - RNA, 17 nt, Homo sapiens
aucuuacacaucugcca

SEQ ID NO: 421688 - RNA, 18 nt, Homo sapiens
aucuuacacaucugccac

SEQ ID NO: 421689 - RNA, 15 nt, Homo sapiens
aucuuacagucagca

SEQ ID NO: 421690 - RNA, 15 nt, Homo sapiens
aucuuaggauuuacc

SEQ ID NO: 421691 - RNA, 17 nt, Homo sapiens
aucuuaguagagauuuc

SEQ ID NO: 421692 - RNA, 12 nt, Homo sapiens
aucuucacaaaa

SEQ ID NO: 421693 - RNA, 17 nt, Homo sapiens
aucuucacaaaacacuu

SEQ ID NO: 421694 - RNA, 18 nt, Homo sapiens
aucuucacugaauaucau

SEQ ID NO: 421695 - RNA, 15 nt, Homo sapiens
aucuucacugcaauu

SEQ ID NO: 421696 - RNA, 23 nt, Homo sapiens
aucuucacuucuaaaugcauauc

SEQ ID NO: 421697 - RNA, 17 nt, Homo sapiens
aucuucccacuuugcca

SEQ ID NO: 421698 - RNA, 23 nt, Homo sapiens
aucuuccccaacgaaaagcacau

SEQ ID NO: 421699 - RNA, 16 nt, Homo sapiens
aucuugccuggaaaga

SEQ ID NO: 421700 - RNA, 14 nt, Homo sapiens
aucuuggacugaca

SEQ ID NO: 421701 - RNA, 19 nt, Homo sapiens
aucuuggagacaauuacaa

SEQ ID NO: 421702 - RNA, 18 nt, Homo sapiens
aucuuggcuuugccacac

SEQ ID NO: 421703 - RNA, 18 nt, Homo sapiens
aucuugucccagccucag

SEQ ID NO: 421704 - RNA, 17 nt, Homo sapiens
aucuuuaaagacuugau

SEQ ID NO: 421705 - RNA, 14 nt, Homo sapiens
aucuuuaagaauag

SEQ ID NO: 421706 - RNA, 10 nt, Homo sapiens
aucuuucuac

SEQ ID NO: 421707 - RNA, 20 nt, Homo sapiens
aucuuugcaagaaagucaga

SEQ ID NO: 421708 - RNA, 23 nt, Homo sapiens
aucuuuguacagaagaggauuca

SEQ ID NO: 421709 - RNA, 14 nt, Homo sapiens
aucuuuuuccuccc

SEQ ID NO: 421710 - RNA, 19 nt, Homo sapiens
aucuuuuuuuuaggcaaaa

SEQ ID NO: 421711 - RNA, 14 nt, Homo sapiens
augaaaacaccuga

SEQ ID NO: 421712 - RNA, 16 nt, Homo sapiens
augaaacauuuuguca

SEQ ID NO: 421713 - RNA, 14 nt, Homo sapiens
augaaaccacugga

SEQ ID NO: 421714 - RNA, 13 nt, Homo sapiens
augaaacuaugca

SEQ ID NO: 421715 - RNA, 13 nt, Homo sapiens
augaaagaggcau

SEQ ID NO: 421716 - RNA, 17 nt, Homo sapiens
augaaagaggcauuccc

SEQ ID NO: 421717 - RNA, 16 nt, Homo sapiens
augaaauacuugacaa

SEQ ID NO: 421718 - RNA, 20 nt, Homo sapiens
augaaauucuugaaguucau

SEQ ID NO: 421719 - RNA, 13 nt, Homo sapiens
augaaauugccaa

SEQ ID NO: 421720 - RNA, 14 nt, Homo sapiens
augaacccauccaa

SEQ ID NO: 421721 - RNA, 15 nt, Homo sapiens
augaacuauuguuaa

SEQ ID NO: 421722 - RNA, 15 nt, Homo sapiens
augaacucuucucaa

SEQ ID NO: 421723 - RNA, 18 nt, Homo sapiens
augaacucuucucaacuc

SEQ ID NO: 421724 - RNA, 17 nt, Homo sapiens
augaacuggaccugcac

SEQ ID NO: 421725 - RNA, 12 nt, Homo sapiens
augaacugugac

SEQ ID NO: 421726 - RNA, 17 nt, Homo sapiens
augaagaaugcauucaa

SEQ ID NO: 421727 - RNA, 11 nt, Homo sapiens
augaagacacu

SEQ ID NO: 421728 - RNA, 14 nt, Homo sapiens
augaagacagauac

SEQ ID NO: 421729 - RNA, 19 nt, Homo sapiens
augaagauaaggaugauac

SEQ ID NO: 421730 - RNA, 15 nt, Homo sapiens
augaagauaccauca

SEQ ID NO: 421731 - RNA, 17 nt, Homo sapiens
augaagcaaacacacag

SEQ ID NO: 421732 - RNA, 18 nt, Homo sapiens
augaaguauugcuaauau

SEQ ID NO: 421733 - RNA, 15 nt, Homo sapiens
augaauaaacacuuu

SEQ ID NO: 421734 - RNA, 20 nt, Homo sapiens
augaauauuuuguaacuauu

SEQ ID NO: 421735 - RNA, 21 nt, Homo sapiens
augaaucucaagauucaguag

SEQ ID NO: 421736 - RNA, 17 nt, Homo sapiens
augaaucuucccuguca

SEQ ID NO: 421737 - RNA, 23 nt, Homo sapiens
augaaugaaauauaaacugugag

SEQ ID NO: 421738 - RNA, 17 nt, Homo sapiens
augaaugacauugaacu

SEQ ID NO: 421739 - RNA, 23 nt, Homo sapiens
augaauguuuacacucuuuguaa

SEQ ID NO: 421740 - RNA, 19 nt, Homo sapiens
augaauugcauuuuacuuu

SEQ ID NO: 421741 - RNA, 18 nt, Homo sapiens
augacaaacacacaucca

SEQ ID NO: 421742 - RNA, 20 nt, Homo sapiens
augacaaaguuacaaauuca

SEQ ID NO: 421743 - RNA, 19 nt, Homo sapiens
augacaacaaaagggaaaa

SEQ ID NO: 421744 - RNA, 20 nt, Homo sapiens
augacagcuguuccacaggg

SEQ ID NO: 421745 - RNA, 17 nt, Homo sapiens
augacaucugucuagga

SEQ ID NO: 421746 - RNA, 15 nt, Homo sapiens
augacauugaacuga

SEQ ID NO: 421747 - RNA, 16 nt, Homo sapiens
augaccacauccugaa

SEQ ID NO: 421748 - RNA, 18 nt, Homo sapiens
augaccaguuuaccugaa

SEQ ID NO: 421749 - RNA, 23 nt, Homo sapiens
augacccccaaccaaguggcucc

SEQ ID NO: 421750 - RNA, 20 nt, Homo sapiens
augaccuugaaugaugccau

SEQ ID NO: 421751 - RNA, 18 nt, Homo sapiens
augacugcacccagcucc

SEQ ID NO: 421752 - RNA, 17 nt, Homo sapiens
augacugugaccaccuu

SEQ ID NO: 421753 - RNA, 23 nt, Homo sapiens
augagaaaacaggcucacagaga

SEQ ID NO: 421754 - RNA, 14 nt, Homo sapiens
augagaaaagggaa

SEQ ID NO: 421755 - RNA, 14 nt, Homo sapiens
augagaaaugccag

SEQ ID NO: 421756 - RNA, 16 nt, Homo sapiens
augagaagaacacauc

SEQ ID NO: 421757 - RNA, 16 nt, Homo sapiens
augagaaguacuuugu

SEQ ID NO: 421758 - RNA, 17 nt, Homo sapiens
augagaccacuguuauc

SEQ ID NO: 421759 - RNA, 21 nt, Homo sapiens
augagaguucuuuauauucaa

SEQ ID NO: 421760 - RNA, 14 nt, Homo sapiens
augagauuggaaaa

SEQ ID NO: 421761 - RNA, 13 nt, Homo sapiens
augagauuggcau

SEQ ID NO: 421762 - RNA, 21 nt, Homo sapiens
augagcaagaggcuaacucag

SEQ ID NO: 421763 - RNA, 14 nt, Homo sapiens
augagcacuuugua

SEQ ID NO: 421764 - RNA, 13 nt, Homo sapiens
augagcaguccag

SEQ ID NO: 421765 - RNA, 16 nt, Homo sapiens
augagccucuccuugc

SEQ ID NO: 421766 - RNA, 11 nt, Homo sapiens
augagcucaaa

SEQ ID NO: 421767 - RNA, 14 nt, Homo sapiens
augagcuccagacc

SEQ ID NO: 421768 - RNA, 17 nt, Homo sapiens
augagcugguuugacuc

SEQ ID NO: 421769 - RNA, 13 nt, Homo sapiens
augagcuuccuuc

SEQ ID NO: 421770 - RNA, 14 nt, Homo sapiens
augaggcuucucag

SEQ ID NO: 421771 - RNA, 22 nt, Homo sapiens
augagucggauacccuggagca

SEQ ID NO: 421772 - RNA, 16 nt, Homo sapiens
augagugucaacucca

SEQ ID NO: 421773 - RNA, 16 nt, Homo sapiens
augaguuuuacauuac

SEQ ID NO: 421774 - RNA, 19 nt, Homo sapiens
augauaaaaaaguguccua

SEQ ID NO: 421775 - RNA, 19 nt, Homo sapiens
augauaaauuugacuguua

SEQ ID NO: 421776 - RNA, 23 nt, Homo sapiens
augauauuuuaugcaaacaguuc

SEQ ID NO: 421777 - RNA, 20 nt, Homo sapiens
augaucaaaaccugugccag

SEQ ID NO: 421778 - RNA, 16 nt, Homo sapiens
augauccagggauugg

SEQ ID NO: 421779 - RNA, 20 nt, Homo sapiens
augaucccuguguugucucu

SEQ ID NO: 421780 - RNA, 12 nt, Homo sapiens
augaucuagguu

SEQ ID NO: 421781 - RNA, 19 nt, Homo sapiens
augaucuagguuuaacuca

SEQ ID NO: 421782 - RNA, 16 nt, Homo sapiens
augaugaaaucccauc

SEQ ID NO: 421783 - RNA, 18 nt, Homo sapiens
augaugagccuucgugcc

SEQ ID NO: 421784 - RNA, 18 nt, Homo sapiens
augaugcgggacugcugg

SEQ ID NO: 421785 - RNA, 14 nt, Homo sapiens
augaugguggauca

SEQ ID NO: 421786 - RNA, 16 nt, Homo sapiens
augauguauuguugcu

SEQ ID NO: 421787 - RNA, 17 nt, Homo sapiens
augauguauuguugcuu

SEQ ID NO: 421788 - RNA, 14 nt, Homo sapiens
augaugucugcaaa

SEQ ID NO: 421789 - RNA, 20 nt, Homo sapiens
augaugugaaaggaccaguu

SEQ ID NO: 421790 - RNA, 13 nt, Homo sapiens
augauuaaugugu

SEQ ID NO: 421791 - RNA, 14 nt, Homo sapiens
augauucauaacaa

SEQ ID NO: 421792 - RNA, 21 nt, Homo sapiens
augauucuuuguuacaggcac

SEQ ID NO: 421793 - RNA, 21 nt, Homo sapiens
augauuggauuauucauuuaa

SEQ ID NO: 421794 - RNA, 15 nt, Homo sapiens
augauuuaggcuucu

SEQ ID NO: 421795 - RNA, 18 nt, Homo sapiens
augauuuagggaagcagg

SEQ ID NO: 421796 - RNA, 23 nt, Homo sapiens
augauuucuagcaggcaggaagu

SEQ ID NO: 421797 - RNA, 17 nt, Homo sapiens
augauuuuuaaguacaa

SEQ ID NO: 421798 - RNA, 18 nt, Homo sapiens
augauuuuuguguaucca

SEQ ID NO: 421799 - RNA, 22 nt, Homo sapiens
augauuuuuguguauccaguau

SEQ ID NO: 421800 - RNA, 17 nt, Homo sapiens
augcaaagaacucacca

SEQ ID NO: 421801 - RNA, 14 nt, Homo sapiens
augcaacuccaugc

SEQ ID NO: 421802 - RNA, 13 nt, Homo sapiens
augcaagcccuuu

SEQ ID NO: 421803 - RNA, 15 nt, Homo sapiens
augcaagggacugug

SEQ ID NO: 421804 - RNA, 17 nt, Homo sapiens
augcaagucgccaggca

SEQ ID NO: 421805 - RNA, 20 nt, Homo sapiens
augcaauccuuccaaaugag

SEQ ID NO: 421806 - RNA, 17 nt, Homo sapiens
augcacaaaguguauuc

SEQ ID NO: 421807 - RNA, 20 nt, Homo sapiens
augcacaacucuccaaaaca

SEQ ID NO: 421808 - RNA, 19 nt, Homo sapiens
augcacacaaacaccuccu

SEQ ID NO: 421809 - RNA, 21 nt, Homo sapiens
augcacacacacacaucucau

SEQ ID NO: 421810 - RNA, 14 nt, Homo sapiens
augcacagaacaag

SEQ ID NO: 421811 - RNA, 19 nt, Homo sapiens
augcacagcuaacauggaa

SEQ ID NO: 421812 - RNA, 17 nt, Homo sapiens
augcacauuugugcaua

SEQ ID NO: 421813 - RNA, 14 nt, Homo sapiens
augcacgaucucag

SEQ ID NO: 421814 - RNA, 21 nt, Homo sapiens
augcacugggguaccacaugg

SEQ ID NO: 421815 - RNA, 18 nt, Homo sapiens
augcacuugaaaugaugg

SEQ ID NO: 421816 - RNA, 21 nt, Homo sapiens
augcagcaaggggacaucuua

SEQ ID NO: 421817 - RNA, 15 nt, Homo sapiens
augcagcauacaaaa

SEQ ID NO: 421818 - RNA, 22 nt, Homo sapiens
augcagccacugugcugaauuc

SEQ ID NO: 421819 - RNA, 13 nt, Homo sapiens
augcaguauaaaa

SEQ ID NO: 421820 - RNA, 14 nt, Homo sapiens
augcagugcugcuu

SEQ ID NO: 421821 - RNA, 18 nt, Homo sapiens
augcagugucagcuccuc

SEQ ID NO: 421822 - RNA, 18 nt, Homo sapiens
augcaguuuuaagaauug

SEQ ID NO: 421823 - RNA, 23 nt, Homo sapiens
augcaugagaacuaaauagauuu

SEQ ID NO: 421824 - RNA, 16 nt, Homo sapiens
augcaugugcauauag

SEQ ID NO: 421825 - RNA, 22 nt, Homo sapiens
augccaaagugucuacaugugc

SEQ ID NO: 421826 - RNA, 21 nt, Homo sapiens
augccaaucucuucuaaaaaa

SEQ ID NO: 421827 - RNA, 23 nt, Homo sapiens
augccaauuucucuuaaguacug

SEQ ID NO: 421828 - RNA, 15 nt, Homo sapiens
augccacauuuugcu

SEQ ID NO: 421829 - RNA, 12 nt, Homo sapiens
augccaccaccc

SEQ ID NO: 421830 - RNA, 16 nt, Homo sapiens
augccacgugccauug

SEQ ID NO: 421831 - RNA, 22 nt, Homo sapiens
augccaguaacgcgucuuccug

SEQ ID NO: 421832 - RNA, 14 nt, Homo sapiens
augcccacugagga

SEQ ID NO: 421833 - RNA, 22 nt, Homo sapiens
augccgucucauauuuuuacaa

SEQ ID NO: 421834 - RNA, 20 nt, Homo sapiens
augccuauguacucuacgcc

SEQ ID NO: 421835 - RNA, 20 nt, Homo sapiens
augccucacgagauuugcca

SEQ ID NO: 421836 - RNA, 20 nt, Homo sapiens
augccugcggggugucugua

SEQ ID NO: 421837 - RNA, 15 nt, Homo sapiens
augccuuaagccaau

SEQ ID NO: 421838 - RNA, 23 nt, Homo sapiens
augccuuguugaugaagcacauu

SEQ ID NO: 421839 - RNA, 20 nt, Homo sapiens
augcggaguccauuauuuga

SEQ ID NO: 421840 - RNA, 12 nt, Homo sapiens
augcggcuuccg

SEQ ID NO: 421841 - RNA, 16 nt, Homo sapiens
augcgguucagggcug

SEQ ID NO: 421842 - RNA, 15 nt, Homo sapiens
augcgucuacccaga

SEQ ID NO: 421843 - RNA, 16 nt, Homo sapiens
augcuauuucacucua

SEQ ID NO: 421844 - RNA, 19 nt, Homo sapiens
augcucaguauugagacac

SEQ ID NO: 421845 - RNA, 19 nt, Homo sapiens
augcucaguuggugcugcu

SEQ ID NO: 421846 - RNA, 18 nt, Homo sapiens
augcugaauaucuguuca

SEQ ID NO: 421847 - RNA, 13 nt, Homo sapiens
augcugacuguac

SEQ ID NO: 421848 - RNA, 17 nt, Homo sapiens
augcugagaagaucuga

SEQ ID NO: 421849 - RNA, 20 nt, Homo sapiens
augcugccaaccagcuuguc

SEQ ID NO: 421850 - RNA, 22 nt, Homo sapiens
augcugcuaugaagacuacuuu

SEQ ID NO: 421851 - RNA, 15 nt, Homo sapiens
uuuccuccccuuuga

SEQ ID NO: 421852 - RNA, 21 nt, Homo sapiens
uuuccucgccuaggccuguga

SEQ ID NO: 421853 - RNA, 15 nt, Homo sapiens
uuuccugacagggaa

SEQ ID NO: 421854 - RNA, 19 nt, Homo sapiens
uuuccuguagucccauuga

SEQ ID NO: 421855 - RNA, 20 nt, Homo sapiens
uuuccuguagucccauugau

SEQ ID NO: 421856 - RNA, 15 nt, Homo sapiens
uuuccugugccaacc

SEQ ID NO: 421857 - RNA, 16 nt, Homo sapiens
uuuccuuaaacugugu

SEQ ID NO: 421858 - RNA, 15 nt, Homo sapiens
uuuccuuugcgcaaa

SEQ ID NO: 421859 - RNA, 19 nt, Homo sapiens
uuucguuaacauugaccaa

SEQ ID NO: 421860 - RNA, 13 nt, Homo sapiens
uuucuacucgagu

SEQ ID NO: 421861 - RNA, 16 nt, Homo sapiens
uuucuaucacauauuu

SEQ ID NO: 421862 - RNA, 15 nt, Homo sapiens
uuucucauucuugcc

SEQ ID NO: 421863 - RNA, 22 nt, Homo sapiens
uuucucgcacaauacaacucac

SEQ ID NO: 421864 - RNA, 15 nt, Homo sapiens
uuucucugccaguga

SEQ ID NO: 421865 - RNA, 15 nt, Homo sapiens
uuucugauucuucaa

SEQ ID NO: 421866 - RNA, 12 nt, Homo sapiens
uuucugugagaa

SEQ ID NO: 421867 - RNA, 13 nt, Homo sapiens
uuucugugagaau

SEQ ID NO: 421868 - RNA, 20 nt, Homo sapiens
uuucuguggagagugagaau

SEQ ID NO: 421869 - RNA, 15 nt, Homo sapiens
uuucuguuguuucuu

SEQ ID NO: 421870 - RNA, 19 nt, Homo sapiens
uuucuuaacuauccuaaca

SEQ ID NO: 421871 - RNA, 19 nt, Homo sapiens
uuucuuaucccagugauca

SEQ ID NO: 421872 - RNA, 21 nt, Homo sapiens
uuucuuccaaagcacauugaa

SEQ ID NO: 421873 - RNA, 19 nt, Homo sapiens
uuucuuccuauuuccuugu

SEQ ID NO: 421874 - RNA, 20 nt, Homo sapiens
uuucuuccuuaaacuccugu

SEQ ID NO: 421875 - RNA, 19 nt, Homo sapiens
uuucuucuacaaccagagc

SEQ ID NO: 421876 - RNA, 22 nt, Homo sapiens
uuucuucuugugauugcugcca

SEQ ID NO: 421877 - RNA, 16 nt, Homo sapiens
uuucuugccacacagu

SEQ ID NO: 421878 - RNA, 17 nt, Homo sapiens
uuucuugcuaagcucca

SEQ ID NO: 421879 - RNA, 13 nt, Homo sapiens
uuucuugcuuuca

SEQ ID NO: 421880 - RNA, 14 nt, Homo sapiens
uuucuuuaucauug

SEQ ID NO: 421881 - RNA, 22 nt, Homo sapiens
uuugaaaaacauacauuaucaa

SEQ ID NO: 421882 - RNA, 12 nt, Homo sapiens
uuugaaaacacc

SEQ ID NO: 421883 - RNA, 24 nt, Homo sapiens
uuugaaaaccaacaccaucacagc

SEQ ID NO: 421884 - RNA, 15 nt, Homo sapiens
uuugaaagcuguaua

SEQ ID NO: 421885 - RNA, 12 nt, Homo sapiens
uuugaaauccaa

SEQ ID NO: 421886 - RNA, 14 nt, Homo sapiens
uuugaagaccaguc

SEQ ID NO: 421887 - RNA, 17 nt, Homo sapiens
uuugaagcagucuugcu

SEQ ID NO: 421888 - RNA, 20 nt, Homo sapiens
uuugaagcagucuugcucug

SEQ ID NO: 421889 - RNA, 23 nt, Homo sapiens
uuugaaugaugagccuucgugcc

SEQ ID NO: 421890 - RNA, 21 nt, Homo sapiens
uuugaauguuaagcagaugga

SEQ ID NO: 421891 - RNA, 16 nt, Homo sapiens
uuugacccuauucaug

SEQ ID NO: 421892 - RNA, 17 nt, Homo sapiens
uuugaccggaucuacac

SEQ ID NO: 421893 - RNA, 20 nt, Homo sapiens
uuugacuuucugucugugga

SEQ ID NO: 421894 - RNA, 20 nt, Homo sapiens
uuugacuuucuucugaauau

SEQ ID NO: 421895 - RNA, 13 nt, Homo sapiens
uuugagaauguuu

SEQ ID NO: 421896 - RNA, 21 nt, Homo sapiens
uuugaggcaaaggccagcagc

SEQ ID NO: 421897 - RNA, 16 nt, Homo sapiens
uuugagguuuccuuca

SEQ ID NO: 421898 - RNA, 20 nt, Homo sapiens
uuugauaguugguguucaaa

SEQ ID NO: 421899 - RNA, 13 nt, Homo sapiens
uuugaucuucagg

SEQ ID NO: 421900 - RNA, 24 nt, Homo sapiens
uuugcaggcccagaggagccaagu

SEQ ID NO: 421901 - RNA, 13 nt, Homo sapiens
uuugccacugcaa

SEQ ID NO: 421902 - RNA, 12 nt, Homo sapiens
uuugccacugga

SEQ ID NO: 421903 - RNA, 15 nt, Homo sapiens
uuugcccuucacugu

SEQ ID NO: 421904 - RNA, 13 nt, Homo sapiens
uuugcgcuaaaaa

SEQ ID NO: 421905 - RNA, 18 nt, Homo sapiens
uuugcuaagugaggauga

SEQ ID NO: 421906 - RNA, 17 nt, Homo sapiens
uuugcuagagcuaacag

SEQ ID NO: 421907 - RNA, 17 nt, Homo sapiens
uuugcugcagucaucua

SEQ ID NO: 421908 - RNA, 20 nt, Homo sapiens
uuugcugcucuauauuacaa

SEQ ID NO: 421909 - RNA, 16 nt, Homo sapiens
uuugcugcuguggaaa

SEQ ID NO: 421910 - RNA, 22 nt, Homo sapiens
uuugcuucuuaugguauaauaa

SEQ ID NO: 421911 - RNA, 22 nt, Homo sapiens
uuuggaaucuucucuuugacaa

SEQ ID NO: 421912 - RNA, 14 nt, Homo sapiens
uuuggauguuucca

SEQ ID NO: 421913 - RNA, 15 nt, Homo sapiens
uuuggauuguaucaa

SEQ ID NO: 421914 - RNA, 13 nt, Homo sapiens
uuugggaaauucu

SEQ ID NO: 421915 - RNA, 19 nt, Homo sapiens
uuuggggacuuguagggau

SEQ ID NO: 421916 - RNA, 13 nt, Homo sapiens
uuugggggauuca

SEQ ID NO: 421917 - RNA, 20 nt, Homo sapiens
uuugggggugcuaauccagg

SEQ ID NO: 421918 - RNA, 23 nt, Homo sapiens
uuugggggugcuaauccaggaca

SEQ ID NO: 421919 - RNA, 11 nt, Homo sapiens
uuugggguccu

SEQ ID NO: 421920 - RNA, 14 nt, Homo sapiens
uuugggugaucuga

SEQ ID NO: 421921 - RNA, 23 nt, Homo sapiens
uuuggguggaauggacuacucca

SEQ ID NO: 421922 - RNA, 17 nt, Homo sapiens
uuuggguuuugggucuu

SEQ ID NO: 421923 - RNA, 17 nt, Homo sapiens
uuugguuaccaauuuaa

SEQ ID NO: 421924 - RNA, 23 nt, Homo sapiens
uuugguuguguaagagaauguug

SEQ ID NO: 421925 - RNA, 20 nt, Homo sapiens
uuuguaaauuaauacuucau

SEQ ID NO: 421926 - RNA, 16 nt, Homo sapiens
uuuguaaccauaugau

SEQ ID NO: 421927 - RNA, 14 nt, Homo sapiens
uuuguaauugcuua

SEQ ID NO: 421928 - RNA, 11 nt, Homo sapiens
uuuguaccauu

SEQ ID NO: 421929 - RNA, 17 nt, Homo sapiens
uuuguaguuuuugcuga

SEQ ID NO: 421930 - RNA, 23 nt, Homo sapiens
uuugucaguguagaucaacucau

SEQ ID NO: 421931 - RNA, 22 nt, Homo sapiens
uuugucccggggcuccacugaa

SEQ ID NO: 421932 - RNA, 23 nt, Homo sapiens
uuugugaaaugaaaacauguaau

SEQ ID NO: 421933 - RNA, 20 nt, Homo sapiens
uuugugcaaaagcaggcuug

SEQ ID NO: 421934 - RNA, 13 nt, Homo sapiens
uuugugcauaaau

SEQ ID NO: 421935 - RNA, 22 nt, Homo sapiens
uuugugcauguauauuacugau

SEQ ID NO: 421936 - RNA, 19 nt, Homo sapiens
uuuguguaauauuacuuua

SEQ ID NO: 421937 - RNA, 13 nt, Homo sapiens
uuugugugauuga

SEQ ID NO: 421938 - RNA, 15 nt, Homo sapiens
uuuguuacacuguua

SEQ ID NO: 421939 - RNA, 12 nt, Homo sapiens
uuuguugcccag

SEQ ID NO: 421940 - RNA, 12 nt, Homo sapiens
uuuguugcucag

SEQ ID NO: 421941 - RNA, 12 nt, Homo sapiens
uuuguuguaaaa

SEQ ID NO: 421942 - RNA, 20 nt, Homo sapiens
uuuguuguuuuuaacaacua

SEQ ID NO: 421943 - RNA, 14 nt, Homo sapiens
uuuguuuaugaaga

SEQ ID NO: 421944 - RNA, 15 nt, Homo sapiens
uuuuaaaaauugauu

SEQ ID NO: 421945 - RNA, 22 nt, Homo sapiens
uuuuaaaaguuucaaugugauu

SEQ ID NO: 421946 - RNA, 16 nt, Homo sapiens
uuuuaaaauugcagca

SEQ ID NO: 421947 - RNA, 21 nt, Homo sapiens
uuuuaaagaaaacuugcacuu

SEQ ID NO: 421948 - RNA, 16 nt, Homo sapiens
uuuuaaauaccacaag

SEQ ID NO: 421949 - RNA, 15 nt, Homo sapiens
uuuuaaaucauuuca

SEQ ID NO: 421950 - RNA, 23 nt, Homo sapiens
uuuuaaauuccugcuuaauguca

SEQ ID NO: 421951 - RNA, 20 nt, Homo sapiens
uuuuaacaaacgcauuaaga

SEQ ID NO: 421952 - RNA, 19 nt, Homo sapiens
uuuuaagaugugucuucaa

SEQ ID NO: 421953 - RNA, 20 nt, Homo sapiens
uuuuaaggcuaaaacuuaac

SEQ ID NO: 421954 - RNA, 22 nt, Homo sapiens
uuuuaaucaaaugcuuuggacu

SEQ ID NO: 421955 - RNA, 20 nt, Homo sapiens
uuuuacacucuagugccaua

SEQ ID NO: 421956 - RNA, 15 nt, Homo sapiens
uuuuacucaaccaaa

SEQ ID NO: 421957 - RNA, 11 nt, Homo sapiens
uuuuacuucca

SEQ ID NO: 421958 - RNA, 14 nt, Homo sapiens
uuuuagacuaacuu

SEQ ID NO: 421959 - RNA, 13 nt, Homo sapiens
uuuuagauuccua

SEQ ID NO: 421960 - RNA, 20 nt, Homo sapiens
uuuuaggcaaaaccuuguga

SEQ ID NO: 421961 - RNA, 16 nt, Homo sapiens
uuuuauacuaccaagu

SEQ ID NO: 421962 - RNA, 21 nt, Homo sapiens
uuuucaaagauguguugcuau

SEQ ID NO: 421963 - RNA, 22 nt, Homo sapiens
uuuucaaguugagaacaaaaau

SEQ ID NO: 421964 - RNA, 23 nt, Homo sapiens
uuuucacaccuuguggagaacau

SEQ ID NO: 421965 - RNA, 22 nt, Homo sapiens
uuuucagaaaauauuauguguu

SEQ ID NO: 421966 - RNA, 21 nt, Homo sapiens
uuuucagcacccccacccacc

SEQ ID NO: 421967 - RNA, 17 nt, Homo sapiens
uuuucaggaauacauuu

SEQ ID NO: 421968 - RNA, 15 nt, Homo sapiens
uuuucauuauugguu

SEQ ID NO: 421969 - RNA, 12 nt, Homo sapiens
uuuuccaggaau

SEQ ID NO: 421970 - RNA, 13 nt, Homo sapiens
uuuuccauguguu

SEQ ID NO: 421971 - RNA, 15 nt, Homo sapiens
uuuuccuccuugucu

SEQ ID NO: 421972 - RNA, 18 nt, Homo sapiens
uuuuccucgccuaggccu

SEQ ID NO: 421973 - RNA, 18 nt, Homo sapiens
uuuuccuucagagugaau

SEQ ID NO: 421974 - RNA, 13 nt, Homo sapiens
uuuucuaaaaagu

SEQ ID NO: 421975 - RNA, 14 nt, Homo sapiens
uuuucuaagcaauu

SEQ ID NO: 421976 - RNA, 21 nt, Homo sapiens
uuuucuaagguucucauagga

SEQ ID NO: 421977 - RNA, 16 nt, Homo sapiens
uuuucuacuuugccac

SEQ ID NO: 421978 - RNA, 13 nt, Homo sapiens
uuuucucaucucc

SEQ ID NO: 421979 - RNA, 15 nt, Homo sapiens
uuuucucuguauaac

SEQ ID NO: 421980 - RNA, 21 nt, Homo sapiens
uuuucucuguguuuguuccua

SEQ ID NO: 421981 - RNA, 14 nt, Homo sapiens
uuuucugccaggga

SEQ ID NO: 421982 - RNA, 22 nt, Homo sapiens
uuuucuuacuagaccuguaacu

SEQ ID NO: 421983 - RNA, 18 nt, Homo sapiens
uuguugaugaagcacauu

SEQ ID NO: 421984 - RNA, 18 nt, Homo sapiens
uuguugccuucaucuuca

SEQ ID NO: 421985 - RNA, 18 nt, Homo sapiens
uuguugcuguuguucaga

SEQ ID NO: 421986 - RNA, 23 nt, Homo sapiens
uuguugguuuggccacucuugac

SEQ ID NO: 421987 - RNA, 19 nt, Homo sapiens
uuguuucaaccaagucaug

SEQ ID NO: 421988 - RNA, 18 nt, Homo sapiens
uuguuucaaccaguuuga

SEQ ID NO: 421989 - RNA, 19 nt, Homo sapiens
uuguuugugaaacaaaaaa

SEQ ID NO: 421990 - RNA, 17 nt, Homo sapiens
uuguuuuaaaauagcuu

SEQ ID NO: 421991 - RNA, 20 nt, Homo sapiens
uuguuuuacaucuuuuggga

SEQ ID NO: 421992 - RNA, 23 nt, Homo sapiens
uuguuuuauccacaacuuuucaa

SEQ ID NO: 421993 - RNA, 16 nt, Homo sapiens
uuguuuuuuaagguga

SEQ ID NO: 421994 - RNA, 13 nt, Homo sapiens
uuguuuuuugcca

SEQ ID NO: 421995 - RNA, 23 nt, Homo sapiens
uuuaaaaaaauacaguauucugu

SEQ ID NO: 421996 - RNA, 13 nt, Homo sapiens
uuuaaaaagcaaa

SEQ ID NO: 421997 - RNA, 14 nt, Homo sapiens
uuuaaaaaggccuu

SEQ ID NO: 421998 - RNA, 12 nt, Homo sapiens
uuuaaaaccacu

SEQ ID NO: 421999 - RNA, 17 nt, Homo sapiens
uuuaaaagacuuugaug

SEQ ID NO: 422000 - RNA, 12 nt, Homo sapiens
guaccacugcua

SEQ ID NO: 422001 - RNA, 22 nt, Homo sapiens
guaccauuuaugaagguuuguu

SEQ ID NO: 422002 - RNA, 14 nt, Homo sapiens
guacccuuccaccu

SEQ ID NO: 422003 - RNA, 15 nt, Homo sapiens
guaccugacuuccac

SEQ ID NO: 422004 - RNA, 14 nt, Homo sapiens
guaccugaugcuau

SEQ ID NO: 422005 - RNA, 14 nt, Homo sapiens
guaccuuucuucac

SEQ ID NO: 422006 - RNA, 14 nt, Homo sapiens
guacgggaggguaa

SEQ ID NO: 422007 - RNA, 12 nt, Homo sapiens
guacuacaguau

SEQ ID NO: 422008 - RNA, 14 nt, Homo sapiens
guacuacauuugca

SEQ ID NO: 422009 - RNA, 14 nt, Homo sapiens
guacuagugccauu

SEQ ID NO: 422010 - RNA, 16 nt, Homo sapiens
guacuaugacacuguu

SEQ ID NO: 422011 - RNA, 22 nt, Homo sapiens
guacucaucugacuugaacucu

SEQ ID NO: 422012 - RNA, 13 nt, Homo sapiens
guacuccucagac

SEQ ID NO: 422013 - RNA, 15 nt, Homo sapiens
guacucucugcucua

SEQ ID NO: 422014 - RNA, 17 nt, Homo sapiens
guacugagacauuacag

SEQ ID NO: 422015 - RNA, 15 nt, Homo sapiens
guacugagggacaag

SEQ ID NO: 422016 - RNA, 15 nt, Homo sapiens
guacuggccaguguc

SEQ ID NO: 422017 - RNA, 14 nt, Homo sapiens
guacugugcugauu

SEQ ID NO: 422018 - RNA, 20 nt, Homo sapiens
guacuucuucauccauagac

SEQ ID NO: 422019 - RNA, 16 nt, Homo sapiens
guacuugggaggccaa

SEQ ID NO: 422020 - RNA, 22 nt, Homo sapiens
uucaugcaauccuuccaaauga

SEQ ID NO: 422021 - RNA, 10 nt, Homo sapiens
uucaugccug

SEQ ID NO: 422022 - RNA, 19 nt, Homo sapiens
uucauggugaaaauguacu

SEQ ID NO: 422023 - RNA, 15 nt, Homo sapiens
uucauguaaccaaga

SEQ ID NO: 422024 - RNA, 20 nt, Homo sapiens
uucauguuuugcuaaugcuc

SEQ ID NO: 422025 - RNA, 23 nt, Homo sapiens
uucauuaaaauagauuaucccac

SEQ ID NO: 422026 - RNA, 16 nt, Homo sapiens
uucauuaaccaaagaa

SEQ ID NO: 422027 - RNA, 23 nt, Homo sapiens
uucauuacuugauuaagauuuua

SEQ ID NO: 422028 - RNA, 17 nt, Homo sapiens
uucauucacaguuugau

SEQ ID NO: 422029 - RNA, 15 nt, Homo sapiens
uucauucccucccca

SEQ ID NO: 422030 - RNA, 16 nt, Homo sapiens
uucauuguaugaugug

SEQ ID NO: 422031 - RNA, 18 nt, Homo sapiens
uucauuuaaaaugauuag

SEQ ID NO: 422032 - RNA, 21 nt, Homo sapiens
uuccaaaauaauuuuaagaaa

SEQ ID NO: 422033 - RNA, 21 nt, Homo sapiens
uuccaaaccugacagauguca

SEQ ID NO: 422034 - RNA, 22 nt, Homo sapiens
uuccaaauucaguaaauuuugg

SEQ ID NO: 422035 - RNA, 14 nt, Homo sapiens
uuccaacacacaau

SEQ ID NO: 422036 - RNA, 16 nt, Homo sapiens
uuccaaguuuauugcc

SEQ ID NO: 422037 - RNA, 17 nt, Homo sapiens
uuccaaguuuauugccc

SEQ ID NO: 422038 - RNA, 14 nt, Homo sapiens
uuccaaugaugcuu

SEQ ID NO: 422039 - RNA, 19 nt, Homo sapiens
uuccaaugcuuugaucccu

SEQ ID NO: 422040 - RNA, 17 nt, Homo sapiens
uuccaccaaauucugaa

SEQ ID NO: 422041 - RNA, 18 nt, Homo sapiens
uuccacccugucuaggca

SEQ ID NO: 422042 - RNA, 18 nt, Homo sapiens
uuccaccuagagcuagau

SEQ ID NO: 422043 - RNA, 23 nt, Homo sapiens
uuccacuuagaaauugcauuucc

SEQ ID NO: 422044 - RNA, 14 nt, Homo sapiens
uuccagauuacaaa

SEQ ID NO: 422045 - RNA, 21 nt, Homo sapiens
uuccagccguguuguagcuaa

SEQ ID NO: 422046 - RNA, 21 nt, Homo sapiens
uuccaggagccuggcaccuuu

SEQ ID NO: 422047 - RNA, 20 nt, Homo sapiens
uuccaggauaaggagacuga

SEQ ID NO: 422048 - RNA, 17 nt, Homo sapiens
uuccaggcgaugugcaa

SEQ ID NO: 422049 - RNA, 18 nt, Homo sapiens
uuccaggcgaugugcaag

SEQ ID NO: 422050 - RNA, 21 nt, Homo sapiens
uuccaggcgaugugcaagugu

SEQ ID NO: 422051 - RNA, 22 nt, Homo sapiens
uuccagggggcagcccagugga

SEQ ID NO: 422052 - RNA, 16 nt, Homo sapiens
uuccagguuccaucca

SEQ ID NO: 422053 - RNA, 14 nt, Homo sapiens
uuccagguucuggu

SEQ ID NO: 422054 - RNA, 14 nt, Homo sapiens
uuccaguacuuccu

SEQ ID NO: 422055 - RNA, 17 nt, Homo sapiens
uuccaguggccuggcuc

SEQ ID NO: 422056 - RNA, 21 nt, Homo sapiens
uuccaguuuuuugccacugca

SEQ ID NO: 422057 - RNA, 23 nt, Homo sapiens
uuccauagcuucauccacugaau

SEQ ID NO: 422058 - RNA, 18 nt, Homo sapiens
uuccauaggacauacugc

SEQ ID NO: 422059 - RNA, 22 nt, Homo sapiens
uuccaugagaacagcaggguag

SEQ ID NO: 422060 - RNA, 18 nt, Homo sapiens
uuccaugucugaaguuug

SEQ ID NO: 422061 - RNA, 16 nt, Homo sapiens
uuccauuaugauucuu

SEQ ID NO: 422062 - RNA, 15 nt, Homo sapiens
uuccauuccaagccu

SEQ ID NO: 422063 - RNA, 15 nt, Homo sapiens
uuccauuuacuugau

SEQ ID NO: 422064 - RNA, 22 nt, Homo sapiens
uuccauuugugugugugcaagu

SEQ ID NO: 422065 - RNA, 17 nt, Homo sapiens
uucccaacucacugugc

SEQ ID NO: 422066 - RNA, 20 nt, Homo sapiens
uucccaacucacugugcucc

SEQ ID NO: 422067 - RNA, 15 nt, Homo sapiens
uucccaaggccaguc

SEQ ID NO: 422068 - RNA, 23 nt, Homo sapiens
uucccaaugcuuuguccaugaug

SEQ ID NO: 422069 - RNA, 23 nt, Homo sapiens
uucccaauuaggaaguguaacag

SEQ ID NO: 422070 - RNA, 18 nt, Homo sapiens
uucccacauaauacauuc

SEQ ID NO: 422071 - RNA, 14 nt, Homo sapiens
uucccacugcacuu

SEQ ID NO: 422072 - RNA, 11 nt, Homo sapiens
uucccauaaca

SEQ ID NO: 422073 - RNA, 22 nt, Homo sapiens
uucccauaacauaaaagugcua

SEQ ID NO: 422074 - RNA, 21 nt, Homo sapiens
uucccaucuuaaauuucuaaa

SEQ ID NO: 422075 - RNA, 13 nt, Homo sapiens
uucccauggaaug

SEQ ID NO: 422076 - RNA, 21 nt, Homo sapiens
uucccauuacuuuaauacuca

SEQ ID NO: 422077 - RNA, 14 nt, Homo sapiens
uucccauucuugca

SEQ ID NO: 422078 - RNA, 17 nt, Homo sapiens
uuccccaaaggcaucca

SEQ ID NO: 422079 - RNA, 19 nt, Homo sapiens
uuccccacgggaacauuau

SEQ ID NO: 422080 - RNA, 12 nt, Homo sapiens
uuccccacugac

SEQ ID NO: 422081 - RNA, 21 nt, Homo sapiens
uuccccagcgucccagucucu

SEQ ID NO: 422082 - RNA, 15 nt, Homo sapiens
uucccccaguaccuc

SEQ ID NO: 422083 - RNA, 15 nt, Homo sapiens
uucccccgcaaugug

SEQ ID NO: 422084 - RNA, 16 nt, Homo sapiens
uucccccuaauucuua

SEQ ID NO: 422085 - RNA, 11 nt, Homo sapiens
uuccccggagc

SEQ ID NO: 422086 - RNA, 20 nt, Homo sapiens
uuccccuauccuguucuucc

SEQ ID NO: 422087 - RNA, 19 nt, Homo sapiens
uucccuaaaauacauuuaa

SEQ ID NO: 422088 - RNA, 20 nt, Homo sapiens
uucccuaacuuaacauugca

SEQ ID NO: 422089 - RNA, 19 nt, Homo sapiens
uucccuacuuccugugacu

SEQ ID NO: 422090 - RNA, 17 nt, Homo sapiens
uucccuccaccagugug

SEQ ID NO: 422091 - RNA, 22 nt, Homo sapiens
uucccuccucgggcuucucgcc

SEQ ID NO: 422092 - RNA, 19 nt, Homo sapiens
uucccucuggcacuccaga

SEQ ID NO: 422093 - RNA, 17 nt, Homo sapiens
uucccugacuugcuuua

SEQ ID NO: 422094 - RNA, 16 nt, Homo sapiens
uucccugggguacuac

SEQ ID NO: 422095 - RNA, 18 nt, Homo sapiens
uucccuuggauguagucu

SEQ ID NO: 422096 - RNA, 17 nt, Homo sapiens
uuccgagggcacuaccg

SEQ ID NO: 422097 - RNA, 14 nt, Homo sapiens
uuccguucaucuga

SEQ ID NO: 422098 - RNA, 20 nt, Homo sapiens
uuccuaagccuguugcugaa

SEQ ID NO: 422099 - RNA, 16 nt, Homo sapiens
uuccuaauaugcuuua

SEQ ID NO: 422100 - RNA, 16 nt, Homo sapiens
uuccuacugggggcaa

SEQ ID NO: 422101 - RNA, 21 nt, Homo sapiens
uuccuagggaugugugagaau

SEQ ID NO: 422102 - RNA, 22 nt, Homo sapiens
uuccuauuaaucuucagcugaa

SEQ ID NO: 422103 - RNA, 13 nt, Homo sapiens
uuccucacucaga

SEQ ID NO: 422104 - RNA, 19 nt, Homo sapiens
uuccucaugaaucucucaa

SEQ ID NO: 422105 - RNA, 16 nt, Homo sapiens
uuccucaugaauguaa

SEQ ID NO: 422106 - RNA, 19 nt, Homo sapiens
uuccuccccgagucagggc

SEQ ID NO: 422107 - RNA, 20 nt, Homo sapiens
uuccuccugaagccucugcc

SEQ ID NO: 422108 - RNA, 13 nt, Homo sapiens
uuccucucucuca

SEQ ID NO: 422109 - RNA, 20 nt, Homo sapiens
uuccucugcuguagagccau

SEQ ID NO: 422110 - RNA, 17 nt, Homo sapiens
uuccuggaaugcauuca

SEQ ID NO: 422111 - RNA, 22 nt, Homo sapiens
uuccuggacuggcccuugccca

SEQ ID NO: 422112 - RNA, 15 nt, Homo sapiens
uuccuggcaauagug

SEQ ID NO: 422113 - RNA, 23 nt, Homo sapiens
uuccugggccuucucagcucucc

SEQ ID NO: 422114 - RNA, 22 nt, Homo sapiens
uuccuguggggggaaguccaug

SEQ ID NO: 422115 - RNA, 17 nt, Homo sapiens
uuccuuaggagauguca

SEQ ID NO: 422116 - RNA, 13 nt, Homo sapiens
uuccuuagucuca

SEQ ID NO: 422117 - RNA, 14 nt, Homo sapiens
uuccuuuaauccca

SEQ ID NO: 422118 - RNA, 19 nt, Homo sapiens
uuccuuugaaagcuguaua

SEQ ID NO: 422119 - RNA, 18 nt, Homo sapiens
uucgaaaacagaugagaa

SEQ ID NO: 422120 - RNA, 19 nt, Homo sapiens
uucgcagugcccagugaug

SEQ ID NO: 422121 - RNA, 16 nt, Homo sapiens
uucgccccucugggcu

SEQ ID NO: 422122 - RNA, 19 nt, Homo sapiens
uucgcgcuggaauccagaa

SEQ ID NO: 422123 - RNA, 23 nt, Homo sapiens
uucgggaagagaggaguucaaug

SEQ ID NO: 422124 - RNA, 17 nt, Homo sapiens
uucgggauucuuugaca

SEQ ID NO: 422125 - RNA, 14 nt, Homo sapiens
uucguacaguucuu

SEQ ID NO: 422126 - RNA, 21 nt, Homo sapiens
uucguccuuagaauacuguau

SEQ ID NO: 422127 - RNA, 23 nt, Homo sapiens
uucuaaaaagucaauucaucuag

SEQ ID NO: 422128 - RNA, 23 nt, Homo sapiens
uucuaaaugaauguuuacacucu

SEQ ID NO: 422129 - RNA, 19 nt, Homo sapiens
uucuaauuucaaaaauaua

SEQ ID NO: 422130 - RNA, 18 nt, Homo sapiens
ugcugaccaaaugccugg

SEQ ID NO: 422131 - RNA, 15 nt, Homo sapiens
ugcugaccccaggaa

SEQ ID NO: 422132 - RNA, 16 nt, Homo sapiens
ugcugaccccaggaag

SEQ ID NO: 422133 - RNA, 23 nt, Homo sapiens
ugcugagggaccuuggagagcuc

SEQ ID NO: 422134 - RNA, 20 nt, Homo sapiens
ugcugaguauguuaagcucu

SEQ ID NO: 422135 - RNA, 15 nt, Homo sapiens
ugcugaucgugcuaa

SEQ ID NO: 422136 - RNA, 23 nt, Homo sapiens
ugcugauggcuugacaugugcaa

SEQ ID NO: 422137 - RNA, 23 nt, Homo sapiens
ugcugauucaauaaaaugcacug

SEQ ID NO: 422138 - RNA, 15 nt, Homo sapiens
ugcugcagucaucua

SEQ ID NO: 422139 - RNA, 15 nt, Homo sapiens
ugcugcaugcgacag

SEQ ID NO: 422140 - RNA, 21 nt, Homo sapiens
ugcugccagccacuucauccc

SEQ ID NO: 422141 - RNA, 14 nt, Homo sapiens
ugcugccaucucca

SEQ ID NO: 422142 - RNA, 21 nt, Homo sapiens
ugcugcccagggucaguguau

SEQ ID NO: 422143 - RNA, 17 nt, Homo sapiens
ugcugcuccagugcagg

SEQ ID NO: 422144 - RNA, 15 nt, Homo sapiens
ugcugcugccuuuag

SEQ ID NO: 422145 - RNA, 18 nt, Homo sapiens
ugcugcuuucuuguugcu

SEQ ID NO: 422146 - RNA, 18 nt, Homo sapiens
ugcugcuuugcuucuuca

SEQ ID NO: 422147 - RNA, 23 nt, Homo sapiens
ugcuggcacagacuucacacagc

SEQ ID NO: 422148 - RNA, 22 nt, Homo sapiens
ugcuggccaggguagacuugga

SEQ ID NO: 422149 - RNA, 23 nt, Homo sapiens
ugcugggacugagccagucccag

SEQ ID NO: 422150 - RNA, 17 nt, Homo sapiens
ugcugggagcagaacag

SEQ ID NO: 422151 - RNA, 19 nt, Homo sapiens
ugcuggguuuccacacagc

SEQ ID NO: 422152 - RNA, 21 nt, Homo sapiens
ugcuggguuuccacacagccu

SEQ ID NO: 422153 - RNA, 16 nt, Homo sapiens
ugcuggucuauuuuga

SEQ ID NO: 422154 - RNA, 18 nt, Homo sapiens
ugcuggugagaggugcaa

SEQ ID NO: 422155 - RNA, 17 nt, Homo sapiens
ugcuguaacucagacau

SEQ ID NO: 422156 - RNA, 17 nt, Homo sapiens
ugcuguauugauaucac

SEQ ID NO: 422157 - RNA, 16 nt, Homo sapiens
ugcugugaaacagugu

SEQ ID NO: 422158 - RNA, 22 nt, Homo sapiens
ugcugugaggcuguccuguaca

SEQ ID NO: 422159 - RNA, 11 nt, Homo sapiens
ugcugugccaa

SEQ ID NO: 422160 - RNA, 13 nt, Homo sapiens
ugcuguuucuaca

SEQ ID NO: 422161 - RNA, 21 nt, Homo sapiens
ugcuuaaaauuaauaaaucau

SEQ ID NO: 422162 - RNA, 16 nt, Homo sapiens
ugcuuaaacaaaguga

SEQ ID NO: 422163 - RNA, 13 nt, Homo sapiens
ugcuuaaucugag

SEQ ID NO: 422164 - RNA, 22 nt, Homo sapiens
ugcuuagaugagggugacuguc

SEQ ID NO: 422165 - RNA, 21 nt, Homo sapiens
ugcuuauaagcaacaugaauu

SEQ ID NO: 422166 - RNA, 16 nt, Homo sapiens
ugcuuauguaugccua

SEQ ID NO: 422167 - RNA, 20 nt, Homo sapiens
ugcuuauguaugccuauuca

SEQ ID NO: 422168 - RNA, 14 nt, Homo sapiens
ugcuucccaaacuc

SEQ ID NO: 422169 - RNA, 21 nt, Homo sapiens
ugcuuccccacgggaacauua

SEQ ID NO: 422170 - RNA, 23 nt, Homo sapiens
ugcuucccggcgucccuaccucc

SEQ ID NO: 422171 - RNA, 16 nt, Homo sapiens
ugcuuccugacaauca

SEQ ID NO: 422172 - RNA, 23 nt, Homo sapiens
ugcuuccugcacauagacauucc

SEQ ID NO: 422173 - RNA, 12 nt, Homo sapiens
ugcuucucucac

SEQ ID NO: 422174 - RNA, 13 nt, Homo sapiens
ugcuucuguagaa

SEQ ID NO: 422175 - RNA, 21 nt, Homo sapiens
ugcuucuucaauggcaccuuc

SEQ ID NO: 422176 - RNA, 21 nt, Homo sapiens
ugcuugaacccagaaggcaga

SEQ ID NO: 422177 - RNA, 20 nt, Homo sapiens
ugcuugccgacuggcuguga

SEQ ID NO: 422178 - RNA, 17 nt, Homo sapiens
ugcuugggaucuucaau

SEQ ID NO: 422179 - RNA, 15 nt, Homo sapiens
ugcuuguacuaagcc

SEQ ID NO: 422180 - RNA, 22 nt, Homo sapiens
ugcuuguggucacacuguggaa

SEQ ID NO: 422181 - RNA, 17 nt, Homo sapiens
ugcuuucuauuaucuau

SEQ ID NO: 422182 - RNA, 17 nt, Homo sapiens
ugcuuugcugcuaugaa

SEQ ID NO: 422183 - RNA, 16 nt, Homo sapiens
ugcuuuucauguagaa

SEQ ID NO: 422184 - RNA, 15 nt, Homo sapiens
ugcuuuuccaucuaa

SEQ ID NO: 422185 - RNA, 17 nt, Homo sapiens
ugcuuuuggagcugaga

SEQ ID NO: 422186 - RNA, 14 nt, Homo sapiens
ugcuuuuuuuccaa

SEQ ID NO: 422187 - RNA, 17 nt, Homo sapiens
uggaaaaaauuagacaa

SEQ ID NO: 422188 - RNA, 14 nt, Homo sapiens
uggaaaacugccug

SEQ ID NO: 422189 - RNA, 13 nt, Homo sapiens
uggaaaaugauua

SEQ ID NO: 422190 - RNA, 23 nt, Homo sapiens
uggaaaccuugcugcuaugcugu

SEQ ID NO: 422191 - RNA, 23 nt, Homo sapiens
uggaaagauuauccuguuacuga

SEQ ID NO: 422192 - RNA, 16 nt, Homo sapiens
uggaaagcacuggaau

SEQ ID NO: 422193 - RNA, 13 nt, Homo sapiens
uggaaagguccug

SEQ ID NO: 422194 - RNA, 18 nt, Homo sapiens
uggaaauccuguuacuua

SEQ ID NO: 422195 - RNA, 16 nt, Homo sapiens
uggaaauuauguggaa

SEQ ID NO: 422196 - RNA, 14 nt, Homo sapiens
uggaacacaaccau

SEQ ID NO: 422197 - RNA, 13 nt, Homo sapiens
uggaacaccuccu

SEQ ID NO: 422198 - RNA, 13 nt, Homo sapiens
uggaacaccuguc

SEQ ID NO: 422199 - RNA, 19 nt, Homo sapiens
uggaacacucucugagaug

SEQ ID NO: 422200 - RNA, 13 nt, Homo sapiens
ugcccccuuucag

SEQ ID NO: 422201 - RNA, 18 nt, Homo sapiens
ugccccgcuauuccucac

SEQ ID NO: 422202 - RNA, 14 nt, Homo sapiens
ugccccuccuguac

SEQ ID NO: 422203 - RNA, 16 nt, Homo sapiens
ugccccuccuguacau

SEQ ID NO: 422204 - RNA, 17 nt, Homo sapiens
ugccccuggaccaguac

SEQ ID NO: 422205 - RNA, 15 nt, Homo sapiens
ugcccgaaaccagag

SEQ ID NO: 422206 - RNA, 18 nt, Homo sapiens
ugcccgaccccaucucau

SEQ ID NO: 422207 - RNA, 18 nt, Homo sapiens
ugcccgagagcucuuagu

SEQ ID NO: 422208 - RNA, 22 nt, Homo sapiens
ugcccggccggagaacaucugc

SEQ ID NO: 422209 - RNA, 20 nt, Homo sapiens
ugcccuccaauccuuuccac

SEQ ID NO: 422210 - RNA, 20 nt, Homo sapiens
ugcccuccccagagcacugg

SEQ ID NO: 422211 - RNA, 20 nt, Homo sapiens
ugcccuucagcauccucagu

SEQ ID NO: 422212 - RNA, 17 nt, Homo sapiens
ugccgacuggcugugag

SEQ ID NO: 422213 - RNA, 21 nt, Homo sapiens
ugccgauuuccuaagcuguug

SEQ ID NO: 422214 - RNA, 14 nt, Homo sapiens
ugccgcaugacaac

SEQ ID NO: 422215 - RNA, 19 nt, Homo sapiens
ugccgcuggaggccaccaa

SEQ ID NO: 422216 - RNA, 19 nt, Homo sapiens
ugccggcucuuuccuugcu

SEQ ID NO: 422217 - RNA, 14 nt, Homo sapiens
ugccguuucuuuca

SEQ ID NO: 422218 - RNA, 16 nt, Homo sapiens
ugccuaauuccuggca

SEQ ID NO: 422219 - RNA, 12 nt, Homo sapiens
ugccuaccccag

SEQ ID NO: 422220 - RNA, 13 nt, Homo sapiens
ugccuagggccug

SEQ ID NO: 422221 - RNA, 15 nt, Homo sapiens
ugccucaaaauugug

SEQ ID NO: 422222 - RNA, 14 nt, Homo sapiens
ugccucacaucucc

SEQ ID NO: 422223 - RNA, 14 nt, Homo sapiens
ugccucagccuccc

SEQ ID NO: 422224 - RNA, 15 nt, Homo sapiens
ugccucagccuucca

SEQ ID NO: 422225 - RNA, 16 nt, Homo sapiens
ugccucagcuucccaa

SEQ ID NO: 422226 - RNA, 18 nt, Homo sapiens
ugccucccaagguccucu

SEQ ID NO: 422227 - RNA, 22 nt, Homo sapiens
ugccucccacccuucucaggga

SEQ ID NO: 422228 - RNA, 15 nt, Homo sapiens
ugccuccccuccucu

SEQ ID NO: 422229 - RNA, 18 nt, Homo sapiens
ugccucccuuucugggag

SEQ ID NO: 422230 - RNA, 14 nt, Homo sapiens
ugccuccucugggg

SEQ ID NO: 422231 - RNA, 22 nt, Homo sapiens
ugccuccuggacuguucacggc

SEQ ID NO: 422232 - RNA, 23 nt, Homo sapiens
ugccucucccaaguccaguguga

SEQ ID NO: 422233 - RNA, 14 nt, Homo sapiens
ugccucuccccaaa

SEQ ID NO: 422234 - RNA, 21 nt, Homo sapiens
ugccucucccgucgucucuuc

SEQ ID NO: 422235 - RNA, 16 nt, Homo sapiens
ugccucugccacacuc

SEQ ID NO: 422236 - RNA, 15 nt, Homo sapiens
ugccucuguauuuaa

SEQ ID NO: 422237 - RNA, 23 nt, Homo sapiens
ugccugccccaaacaaauaugca

SEQ ID NO: 422238 - RNA, 21 nt, Homo sapiens
ugccugccucaugcucucuau

SEQ ID NO: 422239 - RNA, 22 nt, Homo sapiens
ugccugcucugcagcccacaga

SEQ ID NO: 422240 - RNA, 15 nt, Homo sapiens
ugccugguaccagag

SEQ ID NO: 422241 - RNA, 16 nt, Homo sapiens
ugccugguaccagagg

SEQ ID NO: 422242 - RNA, 20 nt, Homo sapiens
ugccuguagagccagccuug

SEQ ID NO: 422243 - RNA, 15 nt, Homo sapiens
ugccuuaagccaaua

SEQ ID NO: 422244 - RNA, 18 nt, Homo sapiens
ugccuuagggacagaauu

SEQ ID NO: 422245 - RNA, 14 nt, Homo sapiens
ugccuucacccaua

SEQ ID NO: 422246 - RNA, 23 nt, Homo sapiens
ugccuuccacgcugucuccagac

SEQ ID NO: 422247 - RNA, 21 nt, Homo sapiens
ugccuucucuucuauccugca

SEQ ID NO: 422248 - RNA, 17 nt, Homo sapiens
ugccuuguccucagggc

SEQ ID NO: 422249 - RNA, 15 nt, Homo sapiens
ugccuuguuguauuc

SEQ ID NO: 422250 - RNA, 21 nt, Homo sapiens
ugccuuugggaggcagcauca

SEQ ID NO: 422251 - RNA, 13 nt, Homo sapiens
ugcgagacauugg

SEQ ID NO: 422252 - RNA, 16 nt, Homo sapiens
ugcgcugugccaaagc

SEQ ID NO: 422253 - RNA, 21 nt, Homo sapiens
ugcgggcauuuugaaugugau

SEQ ID NO: 422254 - RNA, 18 nt, Homo sapiens
ugcggggggcaccagagg

SEQ ID NO: 422255 - RNA, 15 nt, Homo sapiens
ugcgguaggugcugg

SEQ ID NO: 422256 - RNA, 16 nt, Homo sapiens
ugcggucccuucuuac

SEQ ID NO: 422257 - RNA, 19 nt, Homo sapiens
ugcggugugagauggugcc

SEQ ID NO: 422258 - RNA, 13 nt, Homo sapiens
ugcgguucagggc

SEQ ID NO: 422259 - RNA, 21 nt, Homo sapiens
ugcgucagaccaguacuggga

SEQ ID NO: 422260 - RNA, 15 nt, Homo sapiens
ugcgucccacugagu

SEQ ID NO: 422261 - RNA, 14 nt, Homo sapiens
ugcgugcaugugca

SEQ ID NO: 422262 - RNA, 17 nt, Homo sapiens
ugcgugugcgugcaugu

SEQ ID NO: 422263 - RNA, 13 nt, Homo sapiens
ugcuaaaacaaca

SEQ ID NO: 422264 - RNA, 20 nt, Homo sapiens
ugcuaaaggaaaaaaccauc

SEQ ID NO: 422265 - RNA, 22 nt, Homo sapiens
ugcuaaaggaaaaaaccaucca

SEQ ID NO: 422266 - RNA, 17 nt, Homo sapiens
ugcuaaauauaaaaaca

SEQ ID NO: 422267 - RNA, 22 nt, Homo sapiens
ugcuaagaagcgagcacugacc

SEQ ID NO: 422268 - RNA, 12 nt, Homo sapiens
ugcuaagcucca

SEQ ID NO: 422269 - RNA, 21 nt, Homo sapiens
ugcuaaucagggaggucauuu

SEQ ID NO: 422270 - RNA, 15 nt, Homo sapiens
ugcuaaucuucaggg

SEQ ID NO: 422271 - RNA, 20 nt, Homo sapiens
ugcuacaaauacucuuagga

SEQ ID NO: 422272 - RNA, 21 nt, Homo sapiens
ugcuacagaaaauaaucuggu

SEQ ID NO: 422273 - RNA, 15 nt, Homo sapiens
ugcuacguaaucuca

SEQ ID NO: 422274 - RNA, 17 nt, Homo sapiens
ugcuacuuaauuccuuu

SEQ ID NO: 422275 - RNA, 23 nt, Homo sapiens
ugcuagguuguuuuuaaaaccac

SEQ ID NO: 422276 - RNA, 17 nt, Homo sapiens
ugcuaguacuaguacua

SEQ ID NO: 422277 - RNA, 23 nt, Homo sapiens
ugcuagugggcccucucucuggg

SEQ ID NO: 422278 - RNA, 21 nt, Homo sapiens
ugcuauaauuccgaaacauac

SEQ ID NO: 422279 - RNA, 20 nt, Homo sapiens
ugcuauauaaauaaagcaaa

SEQ ID NO: 422280 - RNA, 21 nt, Homo sapiens
ugcuauaugccuuaagccaau

SEQ ID NO: 422281 - RNA, 18 nt, Homo sapiens
ugcuauauugcacuguga

SEQ ID NO: 422282 - RNA, 15 nt, Homo sapiens
ugcuaucgcaccacu

SEQ ID NO: 422283 - RNA, 17 nt, Homo sapiens
ugcuaugucucuaucca

SEQ ID NO: 422284 - RNA, 21 nt, Homo sapiens
ugcuauuacuaguacuauuac

SEQ ID NO: 422285 - RNA, 13 nt, Homo sapiens
ugcucaagugcag

SEQ ID NO: 422286 - RNA, 13 nt, Homo sapiens
ugcucacauauga

SEQ ID NO: 422287 - RNA, 17 nt, Homo sapiens
ugcucagcaugauucuu

SEQ ID NO: 422288 - RNA, 13 nt, Homo sapiens
ugcucagugcaaa

SEQ ID NO: 422289 - RNA, 13 nt, Homo sapiens
ugcucagugccuc

SEQ ID NO: 422290 - RNA, 15 nt, Homo sapiens
ugcucaguggaucac

SEQ ID NO: 422291 - RNA, 19 nt, Homo sapiens
ugcucaguuggugcugcuu

SEQ ID NO: 422292 - RNA, 13 nt, Homo sapiens
ugcucauaaucug

SEQ ID NO: 422293 - RNA, 17 nt, Homo sapiens
ugcucauguaugugcga

SEQ ID NO: 422294 - RNA, 20 nt, Homo sapiens
ugcuccauuuucuugucaau

SEQ ID NO: 422295 - RNA, 15 nt, Homo sapiens
ugcucccagccugcu

SEQ ID NO: 422296 - RNA, 19 nt, Homo sapiens
ugcuccccacccgccuccc

SEQ ID NO: 422297 - RNA, 16 nt, Homo sapiens
ugcuccgugugucuca

SEQ ID NO: 422298 - RNA, 14 nt, Homo sapiens
ugcuccuaaaggca

SEQ ID NO: 422299 - RNA, 16 nt, Homo sapiens
ugcucggacacaguuu

SEQ ID NO: 422300 - RNA, 16 nt, Homo sapiens
ugcucucauaggaguu

SEQ ID NO: 422301 - RNA, 22 nt, Homo sapiens
ugcucugagugcuagcuagcca

SEQ ID NO: 422302 - RNA, 16 nt, Homo sapiens
ugcucuuaugccauuu

SEQ ID NO: 422303 - RNA, 16 nt, Homo sapiens
ugcucuuucucugcca

SEQ ID NO: 422304 - RNA, 17 nt, Homo sapiens
ugcugaaaaccaucugg

SEQ ID NO: 422305 - RNA, 13 nt, Homo sapiens
ugcugaacagugg

SEQ ID NO: 422306 - RNA, 19 nt, Homo sapiens
ugcugacagauguuccauc

SEQ ID NO: 422307 - RNA, 15 nt, Homo sapiens
ugcugagcacccucu

SEQ ID NO: 422308 - RNA, 17 nt, Homo sapiens
ugcugaggcucugaccc

SEQ ID NO: 422309 - RNA, 22 nt, Homo sapiens
ugcugcaccccaaguccagguc

SEQ ID NO: 422310 - RNA, 17 nt, Homo sapiens
ugcugcaccccaugugg

SEQ ID NO: 422311 - RNA, 20 nt, Homo sapiens
ugcugcagacaaguggacag

SEQ ID NO: 422312 - RNA, 13 nt, Homo sapiens
ugcugcaucuccc

SEQ ID NO: 422313 - RNA, 15 nt, Homo sapiens
ugcugccaucuccag

SEQ ID NO: 422314 - RNA, 13 nt, Homo sapiens
ugcugccuagggu

SEQ ID NO: 422315 - RNA, 15 nt, Homo sapiens
ugcugcgucagacca

SEQ ID NO: 422316 - RNA, 18 nt, Homo sapiens
ugcugcucuauauuacaa

SEQ ID NO: 422317 - RNA, 23 nt, Homo sapiens
ugcugcugagugcaccacuucaa

SEQ ID NO: 422318 - RNA, 24 nt, Homo sapiens
gcuggugcacaugacauuuguccu

SEQ ID NO: 422319 - RNA, 21 nt, Homo sapiens
gcuggugggggcauccuugag

SEQ ID NO: 422320 - RNA, 15 nt, Homo sapiens
gcugguuguugccag

SEQ ID NO: 422321 - RNA, 16 nt, Homo sapiens
gcuguaccaagccccu

SEQ ID NO: 422322 - RNA, 23 nt, Homo sapiens
gcuguauuuucuuuuauaucugu

SEQ ID NO: 422323 - RNA, 16 nt, Homo sapiens
gcugucuggggccuuu

SEQ ID NO: 422324 - RNA, 23 nt, Homo sapiens
gcugugaaaauuacacccaugca

SEQ ID NO: 422325 - RNA, 11 nt, Homo sapiens
gcugugccacc

SEQ ID NO: 422326 - RNA, 19 nt, Homo sapiens
gcugugccaggacugugac

SEQ ID NO: 422327 - RNA, 21 nt, Homo sapiens
gcuguggcauuguugaugcuc

SEQ ID NO: 422328 - RNA, 23 nt, Homo sapiens
gcuguggccgucuccucccucag

SEQ ID NO: 422329 - RNA, 16 nt, Homo sapiens
gcuguggggcauagaa

SEQ ID NO: 422330 - RNA, 21 nt, Homo sapiens
uggaacagcgggagaccugug

SEQ ID NO: 422331 - RNA, 17 nt, Homo sapiens
uggaacugcugccauga

SEQ ID NO: 422332 - RNA, 13 nt, Homo sapiens
uggaagaccccac

SEQ ID NO: 422333 - RNA, 17 nt, Homo sapiens
uggaagaguaguaauag

SEQ ID NO: 422334 - RNA, 12 nt, Homo sapiens
uggaagauuugu

SEQ ID NO: 422335 - RNA, 13 nt, Homo sapiens
uggaaggucauca

SEQ ID NO: 422336 - RNA, 16 nt, Homo sapiens
uggaaguuuucuucua

SEQ ID NO: 422337 - RNA, 17 nt, Homo sapiens
uggaauaaagcccuuga

SEQ ID NO: 422338 - RNA, 19 nt, Homo sapiens
uggaauaaagcccuugaac

SEQ ID NO: 422339 - RNA, 17 nt, Homo sapiens
uggaauagggaacugua

SEQ ID NO: 422340 - RNA, 21 nt, Homo sapiens
uggaauauaaggaaagcaaua

SEQ ID NO: 422341 - RNA, 19 nt, Homo sapiens
uggaaucagcuuuuaauaa

SEQ ID NO: 422342 - RNA, 22 nt, Homo sapiens
uggaaugcauaucgcugggcuc

SEQ ID NO: 422343 - RNA, 16 nt, Homo sapiens
uggaaugccauuugca

SEQ ID NO: 422344 - RNA, 16 nt, Homo sapiens
uggaaugcuguguuaa

SEQ ID NO: 422345 - RNA, 13 nt, Homo sapiens
uggaauguaauca

SEQ ID NO: 422346 - RNA, 15 nt, Homo sapiens
uggaauuacauaaca

SEQ ID NO: 422347 - RNA, 20 nt, Homo sapiens
uggaauuaccugauaaggga

SEQ ID NO: 422348 - RNA, 19 nt, Homo sapiens
uggacaaaccgagugcaau

SEQ ID NO: 422349 - RNA, 19 nt, Homo sapiens
uggacaacagagaugccau

SEQ ID NO: 422350 - RNA, 22 nt, Homo sapiens
uggacaaucaugaaauaugcau

SEQ ID NO: 422351 - RNA, 15 nt, Homo sapiens
uggacacacacagcu

SEQ ID NO: 422352 - RNA, 22 nt, Homo sapiens
uggacaggaggcccccaucuau

SEQ ID NO: 422353 - RNA, 15 nt, Homo sapiens
uggaccaguacuccc

SEQ ID NO: 422354 - RNA, 19 nt, Homo sapiens
uggacucgcuagugauuaa

SEQ ID NO: 422355 - RNA, 14 nt, Homo sapiens
uggacucugugcuc

SEQ ID NO: 422356 - RNA, 18 nt, Homo sapiens
uggacuggaggugggcau

SEQ ID NO: 422357 - RNA, 18 nt, Homo sapiens
uggacuuucuccaaaggc

SEQ ID NO: 422358 - RNA, 20 nt, Homo sapiens
uggagaaaauggacguguua

SEQ ID NO: 422359 - RNA, 19 nt, Homo sapiens
uggagaaagggaaguggaa

SEQ ID NO: 422360 - RNA, 23 nt, Homo sapiens
uggagaacaaagaccaaugugaa

SEQ ID NO: 422361 - RNA, 18 nt, Homo sapiens
uggagaacaugcauacua

SEQ ID NO: 422362 - RNA, 23 nt, Homo sapiens
uggagaacuugcucaagugcagg

SEQ ID NO: 422363 - RNA, 19 nt, Homo sapiens
uggagaagacuucuuugca

SEQ ID NO: 422364 - RNA, 17 nt, Homo sapiens
uggagaaggcauuccag

SEQ ID NO: 422365 - RNA, 17 nt, Homo sapiens
uggagaaucugcugcau

SEQ ID NO: 422366 - RNA, 22 nt, Homo sapiens
uggagacacaacuauuuuucca

SEQ ID NO: 422367 - RNA, 22 nt, Homo sapiens
uggagacuguccacuucuagcu

SEQ ID NO: 422368 - RNA, 21 nt, Homo sapiens
uggagagaccagccuuucuuc

SEQ ID NO: 422369 - RNA, 16 nt, Homo sapiens
uggagaggaaaagcca

SEQ ID NO: 422370 - RNA, 19 nt, Homo sapiens
uggagagggaaugugaaau

SEQ ID NO: 422371 - RNA, 21 nt, Homo sapiens
uggagauaccagagacucuga

SEQ ID NO: 422372 - RNA, 21 nt, Homo sapiens
uggagauggguguggcagugu

SEQ ID NO: 422373 - RNA, 20 nt, Homo sapiens
uggagccagcagggcuguga

SEQ ID NO: 422374 - RNA, 22 nt, Homo sapiens
uggagccagcagggcugugaug

SEQ ID NO: 422375 - RNA, 14 nt, Homo sapiens
uggagccccugugu

SEQ ID NO: 422376 - RNA, 15 nt, Homo sapiens
uggagccccugugug

SEQ ID NO: 422377 - RNA, 15 nt, Homo sapiens
uggagcccgugcagu

SEQ ID NO: 422378 - RNA, 16 nt, Homo sapiens
uggagcccgugcagua

SEQ ID NO: 422379 - RNA, 14 nt, Homo sapiens
uggagcugcuucca

SEQ ID NO: 422380 - RNA, 23 nt, Homo sapiens
uggaggaaacuuccaacuuuuac

SEQ ID NO: 422381 - RNA, 21 nt, Homo sapiens
uggagggauaagccagcugca

SEQ ID NO: 422382 - RNA, 23 nt, Homo sapiens
uggagggcgccaucuauggugug

SEQ ID NO: 422383 - RNA, 13 nt, Homo sapiens
uggaggggggagc

SEQ ID NO: 422384 - RNA, 19 nt, Homo sapiens
uggagggucccuaauucuc

SEQ ID NO: 422385 - RNA, 13 nt, Homo sapiens
uggaggugaugaa

SEQ ID NO: 422386 - RNA, 15 nt, Homo sapiens
uggaguccuguucuc

SEQ ID NO: 422387 - RNA, 20 nt, Homo sapiens
uggagucggaucuagccaug

SEQ ID NO: 422388 - RNA, 15 nt, Homo sapiens
uggauaacauugcua

SEQ ID NO: 422389 - RNA, 21 nt, Homo sapiens
uggauaucccuaccuugaaag

SEQ ID NO: 422390 - RNA, 13 nt, Homo sapiens
uggaucagaaaga

SEQ ID NO: 422391 - RNA, 14 nt, Homo sapiens
uggaucuaccagca

SEQ ID NO: 422392 - RNA, 20 nt, Homo sapiens
uggaucuaucaccugucauc

SEQ ID NO: 422393 - RNA, 22 nt, Homo sapiens
uggaugccaaccggucacccag

SEQ ID NO: 422394 - RNA, 20 nt, Homo sapiens
uggaugccugggucucuggg

SEQ ID NO: 422395 - RNA, 20 nt, Homo sapiens
uggauggaguuaaacuugau

SEQ ID NO: 422396 - RNA, 16 nt, Homo sapiens
uggaugucaccaagaa

SEQ ID NO: 422397 - RNA, 21 nt, Homo sapiens
uggaugugcauuucugugaug

SEQ ID NO: 422398 - RNA, 15 nt, Homo sapiens
uggauuaugaaguga

SEQ ID NO: 422399 - RNA, 15 nt, Homo sapiens
uggauugcacguggc

SEQ ID NO: 422400 - RNA, 21 nt, Homo sapiens
uggauuuagacucauggaaua

SEQ ID NO: 422401 - RNA, 19 nt, Homo sapiens
uggauuuucuuucuaugua

SEQ ID NO: 422402 - RNA, 21 nt, Homo sapiens
uggauuuuguggaggugagaa

SEQ ID NO: 422403 - RNA, 22 nt, Homo sapiens
uggcaaaagacauccucaaaag

SEQ ID NO: 422404 - RNA, 17 nt, Homo sapiens
uggcaaacaugugcaac

SEQ ID NO: 422405 - RNA, 16 nt, Homo sapiens
uggcaaaugaaagcau

SEQ ID NO: 422406 - RNA, 21 nt, Homo sapiens
uggcaaauguagcccugcauc

SEQ ID NO: 422407 - RNA, 15 nt, Homo sapiens
uggcaagcagggaaa

SEQ ID NO: 422408 - RNA, 22 nt, Homo sapiens
uggcaauucuucuucucaagca

SEQ ID NO: 422409 - RNA, 20 nt, Homo sapiens
uggcacagaaagggcagcuu

SEQ ID NO: 422410 - RNA, 19 nt, Homo sapiens
uggcaccaaagaugcagcc

SEQ ID NO: 422411 - RNA, 18 nt, Homo sapiens
uggcacccgggaaugacu

SEQ ID NO: 422412 - RNA, 16 nt, Homo sapiens
uggcaccuucagacuu

SEQ ID NO: 422413 - RNA, 16 nt, Homo sapiens
uggcacuggaugcaga

SEQ ID NO: 422414 - RNA, 20 nt, Homo sapiens
uggcacuuuuucacauaagc

SEQ ID NO: 422415 - RNA, 21 nt, Homo sapiens
uggcagaagggaauugcucag

SEQ ID NO: 422416 - RNA, 20 nt, Homo sapiens
uggcagaccgugaccaucuu

SEQ ID NO: 422417 - RNA, 20 nt, Homo sapiens
uggcagaggcagggaagcuc

SEQ ID NO: 422418 - RNA, 14 nt, Homo sapiens
uggcagauuuuaca

SEQ ID NO: 422419 - RNA, 15 nt, Homo sapiens
uggcagauuuuacaa

SEQ ID NO: 422420 - RNA, 17 nt, Homo sapiens
uggcagcauacacagau

SEQ ID NO: 422421 - RNA, 21 nt, Homo sapiens
uggcagcaucuucacuucuaa

SEQ ID NO: 422422 - RNA, 17 nt, Homo sapiens
uggcagccgugccuuca

SEQ ID NO: 422423 - RNA, 14 nt, Homo sapiens
uggcagcucaaaau

SEQ ID NO: 422424 - RNA, 14 nt, Homo sapiens
uggcagcuuuuuca

SEQ ID NO: 422425 - RNA, 21 nt, Homo sapiens
uggcagguggccagggcucca

SEQ ID NO: 422426 - RNA, 18 nt, Homo sapiens
uggcauccccuuuauuaa

SEQ ID NO: 422427 - RNA, 22 nt, Homo sapiens
uggcaucuuggaaaucauugug

SEQ ID NO: 422428 - RNA, 16 nt, Homo sapiens
uggcauuagcucucau

SEQ ID NO: 422429 - RNA, 14 nt, Homo sapiens
uggcauuugcugaa

SEQ ID NO: 422430 - RNA, 18 nt, Homo sapiens
uggccaaauaugcacuuu

SEQ ID NO: 422431 - RNA, 16 nt, Homo sapiens
uggccaauagucauau

SEQ ID NO: 422432 - RNA, 18 nt, Homo sapiens
uggccaauagucauaugu

SEQ ID NO: 422433 - RNA, 19 nt, Homo sapiens
uggccacaauccuccccac

SEQ ID NO: 422434 - RNA, 19 nt, Homo sapiens
uggccacauccaacauuuc

SEQ ID NO: 422435 - RNA, 23 nt, Homo sapiens
uggccaccuccagggacaaagag

SEQ ID NO: 422436 - RNA, 19 nt, Homo sapiens
uggccacgcagccaggaca

SEQ ID NO: 422437 - RNA, 20 nt, Homo sapiens
uggccacgcagccaggacac

SEQ ID NO: 422438 - RNA, 12 nt, Homo sapiens
uggccacucugc

SEQ ID NO: 422439 - RNA, 13 nt, Homo sapiens
uggccacucuuga

SEQ ID NO: 422440 - RNA, 22 nt, Homo sapiens
uggccagaagggggccaugagg

SEQ ID NO: 422441 - RNA, 23 nt, Homo sapiens
uggccagagagccuggugcugcu

SEQ ID NO: 422442 - RNA, 22 nt, Homo sapiens
uggccaggagguuggugacuga

SEQ ID NO: 422443 - RNA, 18 nt, Homo sapiens
uggccaggcuggucucaa

SEQ ID NO: 422444 - RNA, 23 nt, Homo sapiens
uggccaguuggaaccacggagau

SEQ ID NO: 422445 - RNA, 18 nt, Homo sapiens
uggccauguucauucaca

SEQ ID NO: 422446 - RNA, 21 nt, Homo sapiens
uggcccaagugguuugugcua

SEQ ID NO: 422447 - RNA, 13 nt, Homo sapiens
uggcccagccaaa

SEQ ID NO: 422448 - RNA, 20 nt, Homo sapiens
uggcccagcuccccaagaaa

SEQ ID NO: 422449 - RNA, 24 nt, Homo sapiens
uggccccuucacuucugaccacac

SEQ ID NO: 422450 - RNA, 14 nt, Homo sapiens
uggccgcuucccua

SEQ ID NO: 422451 - RNA, 14 nt, Homo sapiens
uggccugcacuggu

SEQ ID NO: 422452 - RNA, 19 nt, Homo sapiens
uggccuucugaacuccaua

SEQ ID NO: 422453 - RNA, 21 nt, Homo sapiens
uggcgcgggaggcaccagcuc

SEQ ID NO: 422454 - RNA, 18 nt, Homo sapiens
uggcggaaccuggcugcg

SEQ ID NO: 422455 - RNA, 21 nt, Homo sapiens
uggcggcuuccuguccacucu

SEQ ID NO: 422456 - RNA, 14 nt, Homo sapiens
uggcuaaauucaug

SEQ ID NO: 422457 - RNA, 20 nt, Homo sapiens
uggcuaagauacugcugaug

SEQ ID NO: 422458 - RNA, 17 nt, Homo sapiens
uggcuacacacaaacca

SEQ ID NO: 422459 - RNA, 13 nt, Homo sapiens
uggcuaguacugu

SEQ ID NO: 422460 - RNA, 14 nt, Homo sapiens
ugguggacaugcac

SEQ ID NO: 422461 - RNA, 20 nt, Homo sapiens
ugguggacaugcacagcuaa

SEQ ID NO: 422462 - RNA, 23 nt, Homo sapiens
ugguggcagaguggauucuugaa

SEQ ID NO: 422463 - RNA, 18 nt, Homo sapiens
ugguggcagauuuuacaa

SEQ ID NO: 422464 - RNA, 20 nt, Homo sapiens
ugguggggugugcaugccac

SEQ ID NO: 422465 - RNA, 17 nt, Homo sapiens
uggugggucuauguucc

SEQ ID NO: 422466 - RNA, 19 nt, Homo sapiens
uggugugaggcccccggag

SEQ ID NO: 422467 - RNA, 13 nt, Homo sapiens
uggugugaucucg

SEQ ID NO: 422468 - RNA, 22 nt, Homo sapiens
ugguguuuagaaugucaguuga

SEQ ID NO: 422469 - RNA, 21 nt, Homo sapiens
ugguuaaaucaauucugauac

SEQ ID NO: 422470 - RNA, 14 nt, Homo sapiens
ugguuaacaucuca

SEQ ID NO: 422471 - RNA, 15 nt, Homo sapiens
ugguuaacaucucag

SEQ ID NO: 422472 - RNA, 20 nt, Homo sapiens
ugguucaggccaagccccuu

SEQ ID NO: 422473 - RNA, 15 nt, Homo sapiens
ugguucccauuugcu

SEQ ID NO: 422474 - RNA, 21 nt, Homo sapiens
ugguucucacugccuccuaca

SEQ ID NO: 422475 - RNA, 21 nt, Homo sapiens
ugguugaaaagauuccauuuu

SEQ ID NO: 422476 - RNA, 21 nt, Homo sapiens
ugguuguacuacaguauacuu

SEQ ID NO: 422477 - RNA, 20 nt, Homo sapiens
ugguuguggcgugugaguca

SEQ ID NO: 422478 - RNA, 22 nt, Homo sapiens
ugguuuaccuggggauccaauu

SEQ ID NO: 422479 - RNA, 14 nt, Homo sapiens
ugguuuacugcugu

SEQ ID NO: 422480 - RNA, 17 nt, Homo sapiens
ugguuuauugaauguga

SEQ ID NO: 422481 - RNA, 20 nt, Homo sapiens
ugguuuauugaaugugauuu

SEQ ID NO: 422482 - RNA, 13 nt, Homo sapiens
ugguuugccaugu

SEQ ID NO: 422483 - RNA, 20 nt, Homo sapiens
ugguuuuaaaaaagcauuau

SEQ ID NO: 422484 - RNA, 13 nt, Homo sapiens
ugguuuuuacuca

SEQ ID NO: 422485 - RNA, 14 nt, Homo sapiens
ugguuuuugagcca

SEQ ID NO: 422486 - RNA, 23 nt, Homo sapiens
ugguuuuuguugagucucugaac

SEQ ID NO: 422487 - RNA, 17 nt, Homo sapiens
ugguuuuuuagugcaau

SEQ ID NO: 422488 - RNA, 17 nt, Homo sapiens
uguaaaaaaaagucuua

SEQ ID NO: 422489 - RNA, 13 nt, Homo sapiens
uguaaaacuguga

SEQ ID NO: 422490 - RNA, 17 nt, Homo sapiens
uguaaaauagaauguua

SEQ ID NO: 422491 - RNA, 20 nt, Homo sapiens
uguaaaaugugaagugaaug

SEQ ID NO: 422492 - RNA, 17 nt, Homo sapiens
uguaaaauucauagcau

SEQ ID NO: 422493 - RNA, 16 nt, Homo sapiens
uguaaacacucagcug

SEQ ID NO: 422494 - RNA, 13 nt, Homo sapiens
uguaaacuaguac

SEQ ID NO: 422495 - RNA, 18 nt, Homo sapiens
uguaaagaauuuagcugu

SEQ ID NO: 422496 - RNA, 12 nt, Homo sapiens
uguaaauaaaua

SEQ ID NO: 422497 - RNA, 20 nt, Homo sapiens
uguaaauaccagacugcagg

SEQ ID NO: 422498 - RNA, 18 nt, Homo sapiens
uguaaauauacacuauuu

SEQ ID NO: 422499 - RNA, 21 nt, Homo sapiens
uguaaauaucccagagaacaa

SEQ ID NO: 422500 - RNA, 22 nt, Homo sapiens
uguaaauaucccagagaacaau

SEQ ID NO: 422501 - RNA, 20 nt, Homo sapiens
uguaaauggaagcacugcca

SEQ ID NO: 422502 - RNA, 15 nt, Homo sapiens
uguaaauuucucaaa

SEQ ID NO: 422503 - RNA, 23 nt, Homo sapiens
uguaacacagcugagagacuuuu

SEQ ID NO: 422504 - RNA, 16 nt, Homo sapiens
uguaaccgauaugcac

SEQ ID NO: 422505 - RNA, 19 nt, Homo sapiens
uguaacucaaaggguggaa

SEQ ID NO: 422506 - RNA, 17 nt, Homo sapiens
uguaagauuuagcaccc

SEQ ID NO: 422507 - RNA, 14 nt, Homo sapiens
uguaagccaaguca

SEQ ID NO: 422508 - RNA, 21 nt, Homo sapiens
uguaagugagagagacaagaa

SEQ ID NO: 422509 - RNA, 19 nt, Homo sapiens
uguaaucccagcacuuugg

SEQ ID NO: 422510 - RNA, 21 nt, Homo sapiens
uguaaugaggugguacuauga

SEQ ID NO: 422511 - RNA, 22 nt, Homo sapiens
uguaaugguaucuuaaagugug

SEQ ID NO: 422512 - RNA, 18 nt, Homo sapiens
uguaauuccucccuaaga

SEQ ID NO: 422513 - RNA, 21 nt, Homo sapiens
uguacaguauguucaaaguca

SEQ ID NO: 422514 - RNA, 15 nt, Homo sapiens
uguacauugugggau

SEQ ID NO: 422515 - RNA, 19 nt, Homo sapiens
uguaccaagccccuuggcc

SEQ ID NO: 422516 - RNA, 18 nt, Homo sapiens
uguacccugcuguauaau

SEQ ID NO: 422517 - RNA, 15 nt, Homo sapiens
uguaccgagaacugg

SEQ ID NO: 422518 - RNA, 23 nt, Homo sapiens
uguaccgggcuggccugugccua

SEQ ID NO: 422519 - RNA, 16 nt, Homo sapiens
uguaccugacuuccac

SEQ ID NO: 422520 - RNA, 14 nt, Homo sapiens
uguacuacaguaua

SEQ ID NO: 422521 - RNA, 15 nt, Homo sapiens
uguacuagugccauu

SEQ ID NO: 422522 - RNA, 23 nt, Homo sapiens
uguacucuacgccaaagugcagc

SEQ ID NO: 422523 - RNA, 17 nt, Homo sapiens
uguacugagacauuaca

SEQ ID NO: 422524 - RNA, 18 nt, Homo sapiens
uguacugcauguuaccau

SEQ ID NO: 422525 - RNA, 18 nt, Homo sapiens
uguagacuuacuuuccua

SEQ ID NO: 422526 - RNA, 15 nt, Homo sapiens
uguagauacuagcua

SEQ ID NO: 422527 - RNA, 17 nt, Homo sapiens
uguagauauugugaagu

SEQ ID NO: 422528 - RNA, 22 nt, Homo sapiens
uguagaugggggaacugugaau

SEQ ID NO: 422529 - RNA, 13 nt, Homo sapiens
uguagaugugcau

SEQ ID NO: 422530 - RNA, 24 nt, Homo sapiens
uguagcaaauuucgagcauaagaa

SEQ ID NO: 422531 - RNA, 13 nt, Homo sapiens
uguagcauauaaa

SEQ ID NO: 422532 - RNA, 21 nt, Homo sapiens
uguagccacuggcauagcccu

SEQ ID NO: 422533 - RNA, 19 nt, Homo sapiens
uguagccauggcucaggca

SEQ ID NO: 422534 - RNA, 18 nt, Homo sapiens
uguaggaaaagcuguucc

SEQ ID NO: 422535 - RNA, 13 nt, Homo sapiens
uguaggacuguau

SEQ ID NO: 422536 - RNA, 22 nt, Homo sapiens
uguagugucuguaauaccuuag

SEQ ID NO: 422537 - RNA, 14 nt, Homo sapiens
uguaguuuguauua

SEQ ID NO: 422538 - RNA, 23 nt, Homo sapiens
uguauaaaaaagaaaacuugugu

SEQ ID NO: 422539 - RNA, 22 nt, Homo sapiens
uguauaaacaagccuaacauug

SEQ ID NO: 422540 - RNA, 15 nt, Homo sapiens
uguauaaacuaucag

SEQ ID NO: 422541 - RNA, 17 nt, Homo sapiens
uguauacaaacaggugc

SEQ ID NO: 422542 - RNA, 16 nt, Homo sapiens
uguauaccaugaugca

SEQ ID NO: 422543 - RNA, 22 nt, Homo sapiens
uguauaucauacauuguuuuca

SEQ ID NO: 422544 - RNA, 14 nt, Homo sapiens
uguauauuuguaaa

SEQ ID NO: 422545 - RNA, 13 nt, Homo sapiens
uguauccaaguua

SEQ ID NO: 422546 - RNA, 19 nt, Homo sapiens
uguaucccaacuccuauaa

SEQ ID NO: 422547 - RNA, 13 nt, Homo sapiens
uguauccugauaa

SEQ ID NO: 422548 - RNA, 16 nt, Homo sapiens
uguaucuuauucacau

SEQ ID NO: 422549 - RNA, 13 nt, Homo sapiens
uguauggauaugu

SEQ ID NO: 422550 - RNA, 15 nt, Homo sapiens
uguaugucugccuaa

SEQ ID NO: 422551 - RNA, 19 nt, Homo sapiens
uguauguuaugaacaugca

SEQ ID NO: 422552 - RNA, 17 nt, Homo sapiens
uguauuaaccuaccugu

SEQ ID NO: 422553 - RNA, 19 nt, Homo sapiens
uguauuccucacauucaca

SEQ ID NO: 422554 - RNA, 15 nt, Homo sapiens
uguauucgugcauuu

SEQ ID NO: 422555 - RNA, 19 nt, Homo sapiens
uguauucugcaacagccug

SEQ ID NO: 422556 - RNA, 21 nt, Homo sapiens
uguauugcagcuaagcucaaa

SEQ ID NO: 422557 - RNA, 20 nt, Homo sapiens
uguauugugcugauugugga

SEQ ID NO: 422558 - RNA, 16 nt, Homo sapiens
uguauuuagugauuau

SEQ ID NO: 422559 - RNA, 20 nt, Homo sapiens
uguauuuccagugcaauugu

SEQ ID NO: 422560 - RNA, 16 nt, Homo sapiens
uguauuuuaugaucuu

SEQ ID NO: 422561 - RNA, 18 nt, Homo sapiens
uguauuuugaaaacacuu

SEQ ID NO: 422562 - RNA, 20 nt, Homo sapiens
ugucaaacauaggacuggaa

SEQ ID NO: 422563 - RNA, 15 nt, Homo sapiens
ugucaaaccugcaaa

SEQ ID NO: 422564 - RNA, 15 nt, Homo sapiens
ugucaaauggaugua

SEQ ID NO: 422565 - RNA, 20 nt, Homo sapiens
ugucaacaguauacaaaaga

SEQ ID NO: 422566 - RNA, 23 nt, Homo sapiens
ugucaaccuugugugagugugac

SEQ ID NO: 422567 - RNA, 18 nt, Homo sapiens
ugucaacugaacacugua

SEQ ID NO: 422568 - RNA, 15 nt, Homo sapiens
ugucaauaguauuaa

SEQ ID NO: 422569 - RNA, 17 nt, Homo sapiens
ugucaauaugagauauu

SEQ ID NO: 422570 - RNA, 16 nt, Homo sapiens
ugucaaugacaguuuc

SEQ ID NO: 422571 - RNA, 21 nt, Homo sapiens
ugucacaaccucucugaucuu

SEQ ID NO: 422572 - RNA, 19 nt, Homo sapiens
ugucacuacaaaaauacaa

SEQ ID NO: 422573 - RNA, 17 nt, Homo sapiens
ugucacucugccucuaa

SEQ ID NO: 422574 - RNA, 21 nt, Homo sapiens
ugucagaaaccaguuauguga

SEQ ID NO: 422575 - RNA, 20 nt, Homo sapiens
ugucagagcugggaguagca

SEQ ID NO: 422576 - RNA, 21 nt, Homo sapiens
ugucagccauuccuguuccca

SEQ ID NO: 422577 - RNA, 23 nt, Homo sapiens
ugucagggucaaacuacauugag

SEQ ID NO: 422578 - RNA, 14 nt, Homo sapiens
ugucagucagggac

SEQ ID NO: 422579 - RNA, 16 nt, Homo sapiens
ugucagucagggacaa

SEQ ID NO: 422580 - RNA, 20 nt, Homo sapiens
ugucaguuugugaagugauu

SEQ ID NO: 422581 - RNA, 17 nt, Homo sapiens
ugucauauaagauucau

SEQ ID NO: 422582 - RNA, 19 nt, Homo sapiens
ugucaucugggccaccagc

SEQ ID NO: 422583 - RNA, 19 nt, Homo sapiens
ugucauggugaugcaaguc

SEQ ID NO: 422584 - RNA, 12 nt, Homo sapiens
ugucauguguau

SEQ ID NO: 422585 - RNA, 14 nt, Homo sapiens
ugucauugcuuuac

SEQ ID NO: 422586 - RNA, 17 nt, Homo sapiens
ugucauuucuacuuuga

SEQ ID NO: 422587 - RNA, 17 nt, Homo sapiens
uguccaccugugcugcu

SEQ ID NO: 422588 - RNA, 20 nt, Homo sapiens
uguccagaggcugcaaggau

SEQ ID NO: 422589 - RNA, 13 nt, Homo sapiens
uguccagcagcug

SEQ ID NO: 422590 - RNA, 18 nt, Homo sapiens
uguccaggagaccuucca

SEQ ID NO: 422591 - RNA, 22 nt, Homo sapiens
uggcucacaaaagguuaaugga

SEQ ID NO: 422592 - RNA, 20 nt, Homo sapiens
uggcucagugccaccuaugc

SEQ ID NO: 422593 - RNA, 17 nt, Homo sapiens
uggcucaugucuauaau

SEQ ID NO: 422594 - RNA, 14 nt, Homo sapiens
uggcucccaggaca

SEQ ID NO: 422595 - RNA, 22 nt, Homo sapiens
uggcuccccuuuuucuuccuca

SEQ ID NO: 422596 - RNA, 14 nt, Homo sapiens
uggcuccuaucugu

SEQ ID NO: 422597 - RNA, 16 nt, Homo sapiens
uggcuccuaucugugu

SEQ ID NO: 422598 - RNA, 21 nt, Homo sapiens
uggcucucuccaggauccaga

SEQ ID NO: 422599 - RNA, 23 nt, Homo sapiens
uggcucugucaccgccaugcaac

SEQ ID NO: 422600 - RNA, 15 nt, Homo sapiens
uggcugaaaaucacu

SEQ ID NO: 422601 - RNA, 19 nt, Homo sapiens
uggcugaaaaucacuauaa

SEQ ID NO: 422602 - RNA, 14 nt, Homo sapiens
uggcugcuuuccua

SEQ ID NO: 422603 - RNA, 12 nt, Homo sapiens
uggcuggcugcc

SEQ ID NO: 422604 - RNA, 18 nt, Homo sapiens
uggcugggagggggcccu

SEQ ID NO: 422605 - RNA, 21 nt, Homo sapiens
uggcuggguuugggcagugga

SEQ ID NO: 422606 - RNA, 17 nt, Homo sapiens
uggcugguuucugagag

SEQ ID NO: 422607 - RNA, 21 nt, Homo sapiens
uggcuguccucuuaagacacu

SEQ ID NO: 422608 - RNA, 11 nt, Homo sapiens
uggcugugaaa

SEQ ID NO: 422609 - RNA, 11 nt, Homo sapiens
uggcugugaga

SEQ ID NO: 422610 - RNA, 19 nt, Homo sapiens
uggcuuauaaacacauuga

SEQ ID NO: 422611 - RNA, 22 nt, Homo sapiens
uggcuugggacuaaaugcccug

SEQ ID NO: 422612 - RNA, 16 nt, Homo sapiens
uggcuuucccuuccag

SEQ ID NO: 422613 - RNA, 16 nt, Homo sapiens
uggcuuucuggcugcu

SEQ ID NO: 422614 - RNA, 19 nt, Homo sapiens
uggcuuugucccacagcuu

SEQ ID NO: 422615 - RNA, 16 nt, Homo sapiens
uggcuuugugcuuguu

SEQ ID NO: 422616 - RNA, 16 nt, Homo sapiens
ugggaaaacagugaau

SEQ ID NO: 422617 - RNA, 22 nt, Homo sapiens
ugggaagaugcuggccccaaaa

SEQ ID NO: 422618 - RNA, 19 nt, Homo sapiens
ugggaaggcuaaguucagu

SEQ ID NO: 422619 - RNA, 16 nt, Homo sapiens
ugggacacagagaccc

SEQ ID NO: 422620 - RNA, 22 nt, Homo sapiens
ugggaccaacuuccuguugaug

SEQ ID NO: 422621 - RNA, 12 nt, Homo sapiens
ugggaccccaaa

SEQ ID NO: 422622 - RNA, 23 nt, Homo sapiens
ugggaccucaguuuuaucauuuu

SEQ ID NO: 422623 - RNA, 14 nt, Homo sapiens
ugggacguggucag

SEQ ID NO: 422624 - RNA, 16 nt, Homo sapiens
ugggacugaugucauc

SEQ ID NO: 422625 - RNA, 19 nt, Homo sapiens
ugggacugcugcuucuuaa

SEQ ID NO: 422626 - RNA, 22 nt, Homo sapiens
ugggagaaguggccccucguga

SEQ ID NO: 422627 - RNA, 19 nt, Homo sapiens
ugggagaucuucacucugg

SEQ ID NO: 422628 - RNA, 15 nt, Homo sapiens
ugggagccugaggca

SEQ ID NO: 422629 - RNA, 22 nt, Homo sapiens
ugggagcucuguuuucaugcua

SEQ ID NO: 422630 - RNA, 16 nt, Homo sapiens
ugggaggaucacuuga

SEQ ID NO: 422631 - RNA, 20 nt, Homo sapiens
ugggaguucagcugcuucuc

SEQ ID NO: 422632 - RNA, 17 nt, Homo sapiens
ugggauguucagcacug

SEQ ID NO: 422633 - RNA, 14 nt, Homo sapiens
ugggauuaacauaa

SEQ ID NO: 422634 - RNA, 15 nt, Homo sapiens
ugggauuacaggugu

SEQ ID NO: 422635 - RNA, 14 nt, Homo sapiens
ugggauuugaacca

SEQ ID NO: 422636 - RNA, 16 nt, Homo sapiens
ugggcaaacaggcagu

SEQ ID NO: 422637 - RNA, 18 nt, Homo sapiens
ugggcaacauagcaagac

SEQ ID NO: 422638 - RNA, 16 nt, Homo sapiens
ugggcaagugaggcaa

SEQ ID NO: 422639 - RNA, 21 nt, Homo sapiens
ugggcaccuuccuaauaugcu

SEQ ID NO: 422640 - RNA, 13 nt, Homo sapiens
ugggcagcuguua

SEQ ID NO: 422641 - RNA, 13 nt, Homo sapiens
ugggcaugccacc

SEQ ID NO: 422642 - RNA, 16 nt, Homo sapiens
ugggccaagccagggu

SEQ ID NO: 422643 - RNA, 20 nt, Homo sapiens
ugggccaagccaggguucca

SEQ ID NO: 422644 - RNA, 15 nt, Homo sapiens
ugggccagaacacac

SEQ ID NO: 422645 - RNA, 20 nt, Homo sapiens
ugggccccucugacucccaa

SEQ ID NO: 422646 - RNA, 14 nt, Homo sapiens
ugggccucauucua

SEQ ID NO: 422647 - RNA, 21 nt, Homo sapiens
ugggccuccugacagcaauaa

SEQ ID NO: 422648 - RNA, 17 nt, Homo sapiens
ugggccucugacucuga

SEQ ID NO: 422649 - RNA, 14 nt, Homo sapiens
ugggccugccaaac

SEQ ID NO: 422650 - RNA, 13 nt, Homo sapiens
ugggcuuacaggc

SEQ ID NO: 422651 - RNA, 17 nt, Homo sapiens
ugggcuuuugaacugua

SEQ ID NO: 422652 - RNA, 12 nt, Homo sapiens
uggggaacucaa

SEQ ID NO: 422653 - RNA, 19 nt, Homo sapiens
uggggaagaguggucuuga

SEQ ID NO: 422654 - RNA, 23 nt, Homo sapiens
uggggagaggagugggaaauuga

SEQ ID NO: 422655 - RNA, 20 nt, Homo sapiens
uggggagccauaagggacau

SEQ ID NO: 422656 - RNA, 19 nt, Homo sapiens
uggggagggagguguuuaa

SEQ ID NO: 422657 - RNA, 15 nt, Homo sapiens
uggggaggggugcuc

SEQ ID NO: 422658 - RNA, 17 nt, Homo sapiens
uggggaugguccacugu

SEQ ID NO: 422659 - RNA, 17 nt, Homo sapiens
uggggauguaaccaagc

SEQ ID NO: 422660 - RNA, 18 nt, Homo sapiens
uggggauuaucugucauu

SEQ ID NO: 422661 - RNA, 18 nt, Homo sapiens
uggggccccaaagcccag

SEQ ID NO: 422662 - RNA, 17 nt, Homo sapiens
uggggccgaaagaacag

SEQ ID NO: 422663 - RNA, 19 nt, Homo sapiens
uggggcugagugaaaacau

SEQ ID NO: 422664 - RNA, 15 nt, Homo sapiens
ugggggaacugugaa

SEQ ID NO: 422665 - RNA, 14 nt, Homo sapiens
ugggggaugcuuca

SEQ ID NO: 422666 - RNA, 17 nt, Homo sapiens
ugggggccccucggcau

SEQ ID NO: 422667 - RNA, 21 nt, Homo sapiens
ugggggccuuguggcacucca

SEQ ID NO: 422668 - RNA, 16 nt, Homo sapiens
ugggggcugugauauu

SEQ ID NO: 422669 - RNA, 16 nt, Homo sapiens
ugggggcuugcaagua

SEQ ID NO: 422670 - RNA, 15 nt, Homo sapiens
uggggggcacagcca

SEQ ID NO: 422671 - RNA, 23 nt, Homo sapiens
ugggggugaggggccaggccaug

SEQ ID NO: 422672 - RNA, 17 nt, Homo sapiens
uggggguuaccaaaaau

SEQ ID NO: 422673 - RNA, 18 nt, Homo sapiens
ugggguccccacucccug

SEQ ID NO: 422674 - RNA, 22 nt, Homo sapiens
uggggucugugaucacccucuc

SEQ ID NO: 422675 - RNA, 14 nt, Homo sapiens
uggggugaucucau

SEQ ID NO: 422676 - RNA, 16 nt, Homo sapiens
ugggguuccccuggaa

SEQ ID NO: 422677 - RNA, 17 nt, Homo sapiens
ugggguuccccuggaaa

SEQ ID NO: 422678 - RNA, 22 nt, Homo sapiens
ugggguugaaaauucaaaaagu

SEQ ID NO: 422679 - RNA, 21 nt, Homo sapiens
ugggguuguucacaccacagg

SEQ ID NO: 422680 - RNA, 17 nt, Homo sapiens
ugggguuucaccaucuu

SEQ ID NO: 422681 - RNA, 22 nt, Homo sapiens
ugggguuucucuuuuccacuga

SEQ ID NO: 422682 - RNA, 20 nt, Homo sapiens
ugggguuuuaguauguguca

SEQ ID NO: 422683 - RNA, 21 nt, Homo sapiens
uggguaaugugaaggcccaag

SEQ ID NO: 422684 - RNA, 15 nt, Homo sapiens
uggguagcuauacuc

SEQ ID NO: 422685 - RNA, 16 nt, Homo sapiens
uggguaucaaacagcu

SEQ ID NO: 422686 - RNA, 18 nt, Homo sapiens
uggguauguguugccaaa

SEQ ID NO: 422687 - RNA, 16 nt, Homo sapiens
uggguauuuaauaaga

SEQ ID NO: 422688 - RNA, 15 nt, Homo sapiens
ugggucagcuugaau

SEQ ID NO: 422689 - RNA, 14 nt, Homo sapiens
ugggucccagcuaa

SEQ ID NO: 422690 - RNA, 14 nt, Homo sapiens
ugggucuauguucc

SEQ ID NO: 422691 - RNA, 18 nt, Homo sapiens
ugggugacagagcgagac

SEQ ID NO: 422692 - RNA, 12 nt, Homo sapiens
ugggugagaaau

SEQ ID NO: 422693 - RNA, 22 nt, Homo sapiens
uggguuccaauccuggcucugu

SEQ ID NO: 422694 - RNA, 15 nt, Homo sapiens
uggguuuacucugug

SEQ ID NO: 422695 - RNA, 15 nt, Homo sapiens
uggguuuuuuaguug

SEQ ID NO: 422696 - RNA, 16 nt, Homo sapiens
ugguacuaaggagaau

SEQ ID NO: 422697 - RNA, 21 nt, Homo sapiens
ugguagaagaugaaucaguau

SEQ ID NO: 422698 - RNA, 15 nt, Homo sapiens
ugguaguuuggaaag

SEQ ID NO: 422699 - RNA, 21 nt, Homo sapiens
ugguauaaggaaauaucauaa

SEQ ID NO: 422700 - RNA, 12 nt, Homo sapiens
ugguaucucuuu

SEQ ID NO: 422701 - RNA, 12 nt, Homo sapiens
ugguaugugaca

SEQ ID NO: 422702 - RNA, 21 nt, Homo sapiens
uggucaagauuuugaaugcuu

SEQ ID NO: 422703 - RNA, 14 nt, Homo sapiens
uggucagauuugaa

SEQ ID NO: 422704 - RNA, 17 nt, Homo sapiens
uggucagggcagggcuc

SEQ ID NO: 422705 - RNA, 19 nt, Homo sapiens
uggucagguuauacuccuc

SEQ ID NO: 422706 - RNA, 21 nt, Homo sapiens
uggucauacucuuuuucccaa

SEQ ID NO: 422707 - RNA, 23 nt, Homo sapiens
uggucaucgugacagcagcagcu

SEQ ID NO: 422708 - RNA, 16 nt, Homo sapiens
ugguccaacaguuuga

SEQ ID NO: 422709 - RNA, 18 nt, Homo sapiens
ugguccaggcuugggcuc

SEQ ID NO: 422710 - RNA, 15 nt, Homo sapiens
uggucccauuauucu

SEQ ID NO: 422711 - RNA, 16 nt, Homo sapiens
uggucccuaugggcuu

SEQ ID NO: 422712 - RNA, 17 nt, Homo sapiens
uggucuugaacuccuga

SEQ ID NO: 422713 - RNA, 18 nt, Homo sapiens
uggucuugagaugucuuc

SEQ ID NO: 422714 - RNA, 19 nt, Homo sapiens
uggugaagaauggacuuaa

SEQ ID NO: 422715 - RNA, 22 nt, Homo sapiens
uggugagaaucgaccucacugu

SEQ ID NO: 422716 - RNA, 18 nt, Homo sapiens
uggugaggcgaaggccag

SEQ ID NO: 422717 - RNA, 19 nt, Homo sapiens
uggugaggggccacugggc

SEQ ID NO: 422718 - RNA, 16 nt, Homo sapiens
uggugaucagugcaau

SEQ ID NO: 422719 - RNA, 15 nt, Homo sapiens
uggugauuucuugcu

SEQ ID NO: 422720 - RNA, 22 nt, Homo sapiens
uggugcacuuuucugugucaua

SEQ ID NO: 422721 - RNA, 14 nt, Homo sapiens
uggugccaaacaaa

SEQ ID NO: 422722 - RNA, 15 nt, Homo sapiens
uggugccccacagcu

SEQ ID NO: 422723 - RNA, 20 nt, Homo sapiens
uguccaugccuacagauaau

SEQ ID NO: 422724 - RNA, 17 nt, Homo sapiens
uguccaugugugugcaa

SEQ ID NO: 422725 - RNA, 15 nt, Homo sapiens
uguccauuaucugcu

SEQ ID NO: 422726 - RNA, 12 nt, Homo sapiens
ugucccaaagaa

SEQ ID NO: 422727 - RNA, 19 nt, Homo sapiens
ugucccaccaacucugcac

SEQ ID NO: 422728 - RNA, 13 nt, Homo sapiens
ugucccagaguua

SEQ ID NO: 422729 - RNA, 19 nt, Homo sapiens
ugucccaguuaacuguuaa

SEQ ID NO: 422730 - RNA, 23 nt, Homo sapiens
uguccccgccuucccucacucuu

SEQ ID NO: 422731 - RNA, 22 nt, Homo sapiens
ugucccugccccgccccccaga

SEQ ID NO: 422732 - RNA, 16 nt, Homo sapiens
uguccguccucuuccc

SEQ ID NO: 422733 - RNA, 14 nt, Homo sapiens
uguccuaagcacuu

SEQ ID NO: 422734 - RNA, 17 nt, Homo sapiens
uguccucugucagucau

SEQ ID NO: 422735 - RNA, 15 nt, Homo sapiens
uguccucuugcucaa

SEQ ID NO: 422736 - RNA, 22 nt, Homo sapiens
uguccuuggcagaggcagggaa

SEQ ID NO: 422737 - RNA, 16 nt, Homo sapiens
ugucguccugcagugu

SEQ ID NO: 422738 - RNA, 18 nt, Homo sapiens
ugucgucuuagcaagaag

SEQ ID NO: 422739 - RNA, 16 nt, Homo sapiens
ugucuaaagcagggaa

SEQ ID NO: 422740 - RNA, 22 nt, Homo sapiens
ugucuaagaauaaugacguauu

SEQ ID NO: 422741 - RNA, 19 nt, Homo sapiens
ugucuaccuuccuccucaa

SEQ ID NO: 422742 - RNA, 22 nt, Homo sapiens
ugucuagaauccugcuuuacag

SEQ ID NO: 422743 - RNA, 17 nt, Homo sapiens
ugucuaggcacaugugg

SEQ ID NO: 422744 - RNA, 22 nt, Homo sapiens
ugucucaaaccuccaaaagccc

SEQ ID NO: 422745 - RNA, 21 nt, Homo sapiens
ugucucaaagcaucaaauaau

SEQ ID NO: 422746 - RNA, 9 nt, Homo sapiens
ugucucaug

SEQ ID NO: 422747 - RNA, 21 nt, Homo sapiens
ugucuccacccguguccagca

SEQ ID NO: 422748 - RNA, 21 nt, Homo sapiens
ugucuccagggcccccaccga

SEQ ID NO: 422749 - RNA, 18 nt, Homo sapiens
ugucuccuuucucuuaug

SEQ ID NO: 422750 - RNA, 18 nt, Homo sapiens
ugucucuacccacuaugc

SEQ ID NO: 422751 - RNA, 19 nt, Homo sapiens
ugucucugccauguggcag

SEQ ID NO: 422752 - RNA, 21 nt, Homo sapiens
ugucucuuagaaauacuugug

SEQ ID NO: 422753 - RNA, 21 nt, Homo sapiens
ugucugaagguaauacuauaa

SEQ ID NO: 422754 - RNA, 14 nt, Homo sapiens
ugucugacaaccuc

SEQ ID NO: 422755 - RNA, 18 nt, Homo sapiens
ugucugacacaugcucuc

SEQ ID NO: 422756 - RNA, 11 nt, Homo sapiens
ugucugagaac

SEQ ID NO: 422757 - RNA, 21 nt, Homo sapiens
ugucugauucuaugccuguau

SEQ ID NO: 422758 - RNA, 15 nt, Homo sapiens
ugucugcaacaugga

SEQ ID NO: 422759 - RNA, 22 nt, Homo sapiens
ugucugcaugaaggucuaccug

SEQ ID NO: 422760 - RNA, 15 nt, Homo sapiens
ugucugucaccacau

SEQ ID NO: 422761 - RNA, 14 nt, Homo sapiens
ugucugugugcaag

SEQ ID NO: 422762 - RNA, 16 nt, Homo sapiens
ugucuguucauggaga

SEQ ID NO: 422763 - RNA, 12 nt, Homo sapiens
ugucuuaccaga

SEQ ID NO: 422764 - RNA, 16 nt, Homo sapiens
ugucuuacuacuuuaa

SEQ ID NO: 422765 - RNA, 15 nt, Homo sapiens
ugucuuagacacugu

SEQ ID NO: 422766 - RNA, 16 nt, Homo sapiens
ugucuuagacacugug

SEQ ID NO: 422767 - RNA, 18 nt, Homo sapiens
ugucuuauaagaaaacau

SEQ ID NO: 422768 - RNA, 14 nt, Homo sapiens
ugucuucacuauuc

SEQ ID NO: 422769 - RNA, 12 nt, Homo sapiens
ugucuuccauaa

SEQ ID NO: 422770 - RNA, 19 nt, Homo sapiens
ugucuugcaaagccuuuaa

SEQ ID NO: 422771 - RNA, 16 nt, Homo sapiens
ugucuuuucaaaagga

SEQ ID NO: 422772 - RNA, 22 nt, Homo sapiens
ugugaagccuuuaucuauggga

SEQ ID NO: 422773 - RNA, 23 nt, Homo sapiens
ugugaagccuuuaucuaugggag

SEQ ID NO: 422774 - RNA, 16 nt, Homo sapiens
ugugaagugauugaca

SEQ ID NO: 422775 - RNA, 16 nt, Homo sapiens
ugugaaguggaaaugu

SEQ ID NO: 422776 - RNA, 20 nt, Homo sapiens
ugugaauaaaaacccuguau

SEQ ID NO: 422777 - RNA, 14 nt, Homo sapiens
ugugaaugaucucu

SEQ ID NO: 422778 - RNA, 18 nt, Homo sapiens
ugugaauugaagucauca

SEQ ID NO: 422779 - RNA, 21 nt, Homo sapiens
ugugacaaccuuuguguaaua

SEQ ID NO: 422780 - RNA, 20 nt, Homo sapiens
ugugacaugaacccauccaa

SEQ ID NO: 422781 - RNA, 19 nt, Homo sapiens
ugugacggggguuggggug

SEQ ID NO: 422782 - RNA, 18 nt, Homo sapiens
ugugacugcugccauuuu

SEQ ID NO: 422783 - RNA, 23 nt, Homo sapiens
ugugacuuugaacacaucucuua

SEQ ID NO: 422784 - RNA, 17 nt, Homo sapiens
ugugagaacuuuucaua

SEQ ID NO: 422785 - RNA, 19 nt, Homo sapiens
ugugagaauaaagcauuuc

SEQ ID NO: 422786 - RNA, 18 nt, Homo sapiens
ugugagauuucucauuga

SEQ ID NO: 422787 - RNA, 11 nt, Homo sapiens
ugugagcaaag

SEQ ID NO: 422788 - RNA, 17 nt, Homo sapiens
ugugagggacaugcuca

SEQ ID NO: 422789 - RNA, 15 nt, Homo sapiens
ugugagugugugcaa

SEQ ID NO: 422790 - RNA, 19 nt, Homo sapiens
ugugauguuaugaauacau

SEQ ID NO: 422791 - RNA, 16 nt, Homo sapiens
ugugauguuuguccug

SEQ ID NO: 422792 - RNA, 12 nt, Homo sapiens
ugugauugccau

SEQ ID NO: 422793 - RNA, 14 nt, Homo sapiens
ugugcaaacagugu

SEQ ID NO: 422794 - RNA, 21 nt, Homo sapiens
ugugcaacgugggcaagucau

SEQ ID NO: 422795 - RNA, 21 nt, Homo sapiens
ugugcaagugucugugugcaa

SEQ ID NO: 422796 - RNA, 20 nt, Homo sapiens
ugugcaaguguguaugugcg

SEQ ID NO: 422797 - RNA, 17 nt, Homo sapiens
ugugcacacauuaggca

SEQ ID NO: 422798 - RNA, 16 nt, Homo sapiens
ugugcacacuuccagg

SEQ ID NO: 422799 - RNA, 18 nt, Homo sapiens
ugugcacacuuccaggcc

SEQ ID NO: 422800 - RNA, 14 nt, Homo sapiens
ugugcacagccaug

SEQ ID NO: 422801 - RNA, 14 nt, Homo sapiens
ugugcacaugugug

SEQ ID NO: 422802 - RNA, 15 nt, Homo sapiens
ugugcagcuuuccag

SEQ ID NO: 422803 - RNA, 19 nt, Homo sapiens
ugugcauaaaaguuaacau

SEQ ID NO: 422804 - RNA, 20 nt, Homo sapiens
ugugccagaaacagugggag

SEQ ID NO: 422805 - RNA, 16 nt, Homo sapiens
ugugccccaugccugu

SEQ ID NO: 422806 - RNA, 23 nt, Homo sapiens
ugugcccucuuaagugugcacag

SEQ ID NO: 422807 - RNA, 19 nt, Homo sapiens
ugugccuagugauguagaa

SEQ ID NO: 422808 - RNA, 18 nt, Homo sapiens
ugugccuuugaccaucuc

SEQ ID NO: 422809 - RNA, 15 nt, Homo sapiens
ugugcgugugugcaa

SEQ ID NO: 422810 - RNA, 16 nt, Homo sapiens
ugugcgugugugcaag

SEQ ID NO: 422811 - RNA, 22 nt, Homo sapiens
ugugcucccucggucaccugug

SEQ ID NO: 422812 - RNA, 20 nt, Homo sapiens
ugugcucucccaaagccaua

SEQ ID NO: 422813 - RNA, 17 nt, Homo sapiens
ugugcuuugccacugaa

SEQ ID NO: 422814 - RNA, 22 nt, Homo sapiens
ugugcuuuucgcuuucuuucug

SEQ ID NO: 422815 - RNA, 14 nt, Homo sapiens
ugugcuuuugcaaa

SEQ ID NO: 422816 - RNA, 23 nt, Homo sapiens
ugugcuuuugcauuaaacuguga

SEQ ID NO: 422817 - RNA, 20 nt, Homo sapiens
uguggaccucuacuuuccag

SEQ ID NO: 422818 - RNA, 18 nt, Homo sapiens
uguggacugggaagcauu

SEQ ID NO: 422819 - RNA, 22 nt, Homo sapiens
uguggauaaggcuuaggugcca

SEQ ID NO: 422820 - RNA, 17 nt, Homo sapiens
uguggauacagucauua

SEQ ID NO: 422821 - RNA, 13 nt, Homo sapiens
uguggaugcucuu

SEQ ID NO: 422822 - RNA, 23 nt, Homo sapiens
uguggccuugcccgccagccuca

SEQ ID NO: 422823 - RNA, 16 nt, Homo sapiens
uguggccuuggucuaa

SEQ ID NO: 422824 - RNA, 20 nt, Homo sapiens
ugugggaccugcuccaggcu

SEQ ID NO: 422825 - RNA, 22 nt, Homo sapiens
ugugggcuggugccccacagcu

SEQ ID NO: 422826 - RNA, 18 nt, Homo sapiens
uguggggaagaguggucu

SEQ ID NO: 422827 - RNA, 20 nt, Homo sapiens
ugugguccagaagaaauuau

SEQ ID NO: 422828 - RNA, 20 nt, Homo sapiens
uguggucugcugccucagga

SEQ ID NO: 422829 - RNA, 22 nt, Homo sapiens
uguggugacaggcccaguggaa

SEQ ID NO: 422830 - RNA, 19 nt, Homo sapiens
uguguaaaggaacaacuga

SEQ ID NO: 422831 - RNA, 17 nt, Homo sapiens
uguguauucuagugaau

SEQ ID NO: 422832 - RNA, 17 nt, Homo sapiens
uguguauuuaacugccu

SEQ ID NO: 422833 - RNA, 18 nt, Homo sapiens
uguguauuuccagugcaa

SEQ ID NO: 422834 - RNA, 19 nt, Homo sapiens
uguguccaugugugugcaa

SEQ ID NO: 422835 - RNA, 13 nt, Homo sapiens
uguguccugauga

SEQ ID NO: 422836 - RNA, 18 nt, Homo sapiens
ugugucgcuuaugucuau

SEQ ID NO: 422837 - RNA, 13 nt, Homo sapiens
ugugucuacuguc

SEQ ID NO: 422838 - RNA, 21 nt, Homo sapiens
ugugucuagcaaagccaccaa

SEQ ID NO: 422839 - RNA, 19 nt, Homo sapiens
ugugucuuuuuuuacuuau

SEQ ID NO: 422840 - RNA, 15 nt, Homo sapiens
ugugugaaaauguga

SEQ ID NO: 422841 - RNA, 10 nt, Homo sapiens
ugugugaaag

SEQ ID NO: 422842 - RNA, 13 nt, Homo sapiens
ugugugcaagugu

SEQ ID NO: 422843 - RNA, 19 nt, Homo sapiens
ugugugcacaugugugcgu

SEQ ID NO: 422844 - RNA, 12 nt, Homo sapiens
ugugugccauca

SEQ ID NO: 422845 - RNA, 14 nt, Homo sapiens
uguguggacuguga

SEQ ID NO: 422846 - RNA, 14 nt, Homo sapiens
ugugugggcuguga

SEQ ID NO: 422847 - RNA, 14 nt, Homo sapiens
uguguggggcccaa

SEQ ID NO: 422848 - RNA, 17 nt, Homo sapiens
ugugugguauucaacua

SEQ ID NO: 422849 - RNA, 15 nt, Homo sapiens
ugugugugcaagugu

SEQ ID NO: 422850 - RNA, 20 nt, Homo sapiens
uguguguugccacaggacac

SEQ ID NO: 422851 - RNA, 15 nt, Homo sapiens
uguguuaagugcagg

SEQ ID NO: 422852 - RNA, 13 nt, Homo sapiens
uguguuaguaaua

SEQ ID NO: 422853 - RNA, 17 nt, Homo sapiens
uguguucaaucugugaa

SEQ ID NO: 422854 - RNA, 14 nt, Homo sapiens
uguguucacacugu

SEQ ID NO: 422855 - RNA, 19 nt, Homo sapiens
aaacuacucuugaauuccu

SEQ ID NO: 422856 - RNA, 16 nt, Homo sapiens
aaacuaguacuauuau

SEQ ID NO: 422857 - RNA, 12 nt, Homo sapiens
aaacucaccauu

SEQ ID NO: 422858 - RNA, 23 nt, Homo sapiens
aaacucaugacugagucuggcaa

SEQ ID NO: 422859 - RNA, 19 nt, Homo sapiens
aaacugacgcuagucaaua

SEQ ID NO: 422860 - RNA, 23 nt, Homo sapiens
aaacugagucuguggacacugug

SEQ ID NO: 422861 - RNA, 14 nt, Homo sapiens
aaacugaugacuua

SEQ ID NO: 422862 - RNA, 12 nt, Homo sapiens
aaacugcacugu

SEQ ID NO: 422863 - RNA, 12 nt, Homo sapiens
aaacugccuguu

SEQ ID NO: 422864 - RNA, 23 nt, Homo sapiens
aaacugccuguuaagucugagaa

SEQ ID NO: 422865 - RNA, 21 nt, Homo sapiens
aaacugugagauaaauaucau

SEQ ID NO: 422866 - RNA, 19 nt, Homo sapiens
aaacuuagaucaucaguca

SEQ ID NO: 422867 - RNA, 18 nt, Homo sapiens
aaacuuaugcuaguuuau

SEQ ID NO: 422868 - RNA, 19 nt, Homo sapiens
aaacuuccaagaccugacu

SEQ ID NO: 422869 - RNA, 15 nt, Homo sapiens
aaacuuccagguucc

SEQ ID NO: 422870 - RNA, 23 nt, Homo sapiens
aaacuuggaauuuguaaccucag

SEQ ID NO: 422871 - RNA, 22 nt, Homo sapiens
aaacuuguaauggucucugaaa

SEQ ID NO: 422872 - RNA, 19 nt, Homo sapiens
aaacuuuacucuaagucuc

SEQ ID NO: 422873 - RNA, 23 nt, Homo sapiens
aaacuuugacgagucaccuucca

SEQ ID NO: 422874 - RNA, 23 nt, Homo sapiens
aaacuuugugccuuugaccaucu

SEQ ID NO: 422875 - RNA, 23 nt, Homo sapiens
aaacuuuucuuaaaaaguuauaa

SEQ ID NO: 422876 - RNA, 19 nt, Homo sapiens
aaagaaaauauaguuugau

SEQ ID NO: 422877 - RNA, 16 nt, Homo sapiens
aaagaaacaccacuua

SEQ ID NO: 422878 - RNA, 16 nt, Homo sapiens
aaagaaagcugugaaa

SEQ ID NO: 422879 - RNA, 18 nt, Homo sapiens
aaagaaaucuucauuuau

SEQ ID NO: 422880 - RNA, 14 nt, Homo sapiens
aaagaacacccauc

SEQ ID NO: 422881 - RNA, 19 nt, Homo sapiens
aaagaacugccccaucucc

SEQ ID NO: 422882 - RNA, 15 nt, Homo sapiens
aaagaauguacauua

SEQ ID NO: 422883 - RNA, 18 nt, Homo sapiens
aaagacaccuacugagug

SEQ ID NO: 422884 - RNA, 9 nt, Homo sapiens
aaagacaga

SEQ ID NO: 422885 - RNA, 15 nt, Homo sapiens
aaagacaggagguaa

SEQ ID NO: 422886 - RNA, 12 nt, Homo sapiens
aaagacaugggg

SEQ ID NO: 422887 - RNA, 14 nt, Homo sapiens
aaagaccaauguga

SEQ ID NO: 422888 - RNA, 23 nt, Homo sapiens
aaagacugaaucuaccugcccua

SEQ ID NO: 422889 - RNA, 18 nt, Homo sapiens
aaagagcagccuggcuaa

SEQ ID NO: 422890 - RNA, 17 nt, Homo sapiens
aaagagcgucauguccu

SEQ ID NO: 422891 - RNA, 13 nt, Homo sapiens
aaagaggacuuga

SEQ ID NO: 422892 - RNA, 21 nt, Homo sapiens
aaagaggcagucuucuuagca

SEQ ID NO: 422893 - RNA, 18 nt, Homo sapiens
aaagaggggaagagacuu

SEQ ID NO: 422894 - RNA, 14 nt, Homo sapiens
aaagaguaucaaag

SEQ ID NO: 422895 - RNA, 18 nt, Homo sapiens
aaagaguggaacuaucca

SEQ ID NO: 422896 - RNA, 14 nt, Homo sapiens
aaagauacacugac

SEQ ID NO: 422897 - RNA, 16 nt, Homo sapiens
aaagauacgacuuuau

SEQ ID NO: 422898 - RNA, 15 nt, Homo sapiens
aaagauggaagugua

SEQ ID NO: 422899 - RNA, 21 nt, Homo sapiens
aaagauggcugugccucugcc

SEQ ID NO: 422900 - RNA, 18 nt, Homo sapiens
aaagauggcuuccgugag

SEQ ID NO: 422901 - RNA, 19 nt, Homo sapiens
aaagcaacgacuacuuugc

SEQ ID NO: 422902 - RNA, 23 nt, Homo sapiens
aaagcaacgacuacuuugcuacg

SEQ ID NO: 422903 - RNA, 24 nt, Homo sapiens
aaagcaaugcaauuccucuugggu

SEQ ID NO: 422904 - RNA, 21 nt, Homo sapiens
aaagcacccuguaucacagac

SEQ ID NO: 422905 - RNA, 13 nt, Homo sapiens
aaagcacuggaau

SEQ ID NO: 422906 - RNA, 13 nt, Homo sapiens
aaagcagugcaug

SEQ ID NO: 422907 - RNA, 16 nt, Homo sapiens
aaagcaguguuuucac

SEQ ID NO: 422908 - RNA, 22 nt, Homo sapiens
aaagcaguguuuucaccucaua

SEQ ID NO: 422909 - RNA, 19 nt, Homo sapiens
aaagcaguuacuaauaugc

SEQ ID NO: 422910 - RNA, 18 nt, Homo sapiens
aaagcaucacacaguggc

SEQ ID NO: 422911 - RNA, 15 nt, Homo sapiens
aaagcauccaugugu

SEQ ID NO: 422912 - RNA, 17 nt, Homo sapiens
aaagcaucccugugagc

SEQ ID NO: 422913 - RNA, 22 nt, Homo sapiens
aaagcaugcucaguauugagac

SEQ ID NO: 422914 - RNA, 11 nt, Homo sapiens
aaagcauuauc

SEQ ID NO: 422915 - RNA, 16 nt, Homo sapiens
aaagccauaacuugaa

SEQ ID NO: 422916 - RNA, 21 nt, Homo sapiens
aaagccucagccauucacugc

SEQ ID NO: 422917 - RNA, 21 nt, Homo sapiens
aaagccucgggccacaugggu

SEQ ID NO: 422918 - RNA, 17 nt, Homo sapiens
aaagccucugugcugca

SEQ ID NO: 422919 - RNA, 23 nt, Homo sapiens
aaagccuuuuccagaagaucuga

SEQ ID NO: 422920 - RNA, 22 nt, Homo sapiens
aaagcuagaggagauugcucug

SEQ ID NO: 422921 - RNA, 12 nt, Homo sapiens
aaagcugccauu

SEQ ID NO: 422922 - RNA, 13 nt, Homo sapiens
aaagcugccugua

SEQ ID NO: 422923 - RNA, 18 nt, Homo sapiens
aaagcuucuaucccagga

SEQ ID NO: 422924 - RNA, 21 nt, Homo sapiens
aaagcuuguggccccuuuuac

SEQ ID NO: 422925 - RNA, 17 nt, Homo sapiens
aaagcuuuauugagaua

SEQ ID NO: 422926 - RNA, 15 nt, Homo sapiens
aaaggaaaccaagug

SEQ ID NO: 422927 - RNA, 13 nt, Homo sapiens
aaaggaagaugua

SEQ ID NO: 422928 - RNA, 14 nt, Homo sapiens
aaaggacaaaaaua

SEQ ID NO: 422929 - RNA, 13 nt, Homo sapiens
aaaggacucugcu

SEQ ID NO: 422930 - RNA, 15 nt, Homo sapiens
aaaggaggacaggga

SEQ ID NO: 422931 - RNA, 18 nt, Homo sapiens
aaaggauuuuggaaaaga

SEQ ID NO: 422932 - RNA, 16 nt, Homo sapiens
aaaggcagcaaccauu

SEQ ID NO: 422933 - RNA, 11 nt, Homo sapiens
aaaggcaguuc

SEQ ID NO: 422934 - RNA, 18 nt, Homo sapiens
aaagggagccaugcucuu

SEQ ID NO: 422935 - RNA, 20 nt, Homo sapiens
aaagggcagcuucagucucu

SEQ ID NO: 422936 - RNA, 17 nt, Homo sapiens
aaagguagugaguaauu

SEQ ID NO: 422937 - RNA, 13 nt, Homo sapiens
aaaggucaucuca

SEQ ID NO: 422938 - RNA, 15 nt, Homo sapiens
aaagguucucaggug

SEQ ID NO: 422939 - RNA, 23 nt, Homo sapiens
aaagguuguacauaguggucauu

SEQ ID NO: 422940 - RNA, 22 nt, Homo sapiens
aaagguuuaaugucagggucaa

SEQ ID NO: 422941 - RNA, 13 nt, Homo sapiens
aaaguaaggugca

SEQ ID NO: 422942 - RNA, 18 nt, Homo sapiens
aaaguacuacuguagaac

SEQ ID NO: 422943 - RNA, 19 nt, Homo sapiens
aaaguacucagaggcugac

SEQ ID NO: 422944 - RNA, 15 nt, Homo sapiens
aaaguacuucaggca

SEQ ID NO: 422945 - RNA, 22 nt, Homo sapiens
aaaguacuucaggcacgcugcc

SEQ ID NO: 422946 - RNA, 14 nt, Homo sapiens
aaaguaucauuuau

SEQ ID NO: 422947 - RNA, 17 nt, Homo sapiens
aaaguauuccaccuuaa

SEQ ID NO: 422948 - RNA, 17 nt, Homo sapiens
aaagucagaucuggucu

SEQ ID NO: 422949 - RNA, 15 nt, Homo sapiens
aaaguccacaguuua

SEQ ID NO: 422950 - RNA, 19 nt, Homo sapiens
aaagucuuaacaacagcuu

SEQ ID NO: 422951 - RNA, 14 nt, Homo sapiens
aaagugacacagca

SEQ ID NO: 422952 - RNA, 21 nt, Homo sapiens
aaagugagaugggaagggcuu

SEQ ID NO: 422953 - RNA, 19 nt, Homo sapiens
aaagugcaguagugucacu

SEQ ID NO: 422954 - RNA, 22 nt, Homo sapiens
aaagugcugggauuacaggcgu

SEQ ID NO: 422955 - RNA, 21 nt, Homo sapiens
aaaguggugagaggcauccag

SEQ ID NO: 422956 - RNA, 19 nt, Homo sapiens
aaaguguaauagcauacau

SEQ ID NO: 422957 - RNA, 16 nt, Homo sapiens
aaagugucuacaugug

SEQ ID NO: 422958 - RNA, 17 nt, Homo sapiens
aaagugugucacccuuu

SEQ ID NO: 422959 - RNA, 15 nt, Homo sapiens
aaaguuaaacauuga

SEQ ID NO: 422960 - RNA, 22 nt, Homo sapiens
aaaguuccacuuagagaacaaa

SEQ ID NO: 422961 - RNA, 22 nt, Homo sapiens
aaaguucucagaacuguuggcu

SEQ ID NO: 422962 - RNA, 23 nt, Homo sapiens
aaaguuugggaagggaugggaga

SEQ ID NO: 422963 - RNA, 23 nt, Homo sapiens
aaaguuuuaugagaaaugccagu

SEQ ID NO: 422964 - RNA, 15 nt, Homo sapiens
aaaguuuugaugaaa

SEQ ID NO: 422965 - RNA, 22 nt, Homo sapiens
aaauaaaaagugacacagcagc

SEQ ID NO: 422966 - RNA, 23 nt, Homo sapiens
aaauaaaaaucauucuacugaac

SEQ ID NO: 422967 - RNA, 15 nt, Homo sapiens
aaauaaaacuaagcu

SEQ ID NO: 422968 - RNA, 17 nt, Homo sapiens
aaauaaaaugcagacag

SEQ ID NO: 422969 - RNA, 20 nt, Homo sapiens
aaauaaacacuagacuguau

SEQ ID NO: 422970 - RNA, 15 nt, Homo sapiens
aaauaaaccagacuc

SEQ ID NO: 422971 - RNA, 13 nt, Homo sapiens
aaauaaacuguua

SEQ ID NO: 422972 - RNA, 17 nt, Homo sapiens
aaauaaagcugauagca

SEQ ID NO: 422973 - RNA, 18 nt, Homo sapiens
aaauaaaggugacuggga

SEQ ID NO: 422974 - RNA, 15 nt, Homo sapiens
aaauaaauacauucu

SEQ ID NO: 422975 - RNA, 16 nt, Homo sapiens
aaauaaauagcuauau

SEQ ID NO: 422976 - RNA, 21 nt, Homo sapiens
aaauaaauugccucccuuccu

SEQ ID NO: 422977 - RNA, 15 nt, Homo sapiens
aaauaacaaguacca

SEQ ID NO: 422978 - RNA, 12 nt, Homo sapiens
aaauaacacugu

SEQ ID NO: 422979 - RNA, 13 nt, Homo sapiens
aaauaacacugua

SEQ ID NO: 422980 - RNA, 19 nt, Homo sapiens
aaauaacacuguacugcaa

SEQ ID NO: 422981 - RNA, 12 nt, Homo sapiens
aaauaacauugc

SEQ ID NO: 422982 - RNA, 21 nt, Homo sapiens
aaauaaccacaagguccacuc

SEQ ID NO: 422983 - RNA, 14 nt, Homo sapiens
aaauaagagauuug

SEQ ID NO: 422984 - RNA, 23 nt, Homo sapiens
aaauaaggccucauccuccacug

SEQ ID NO: 422985 - RNA, 14 nt, Homo sapiens
aaauaaggcuccuu

SEQ ID NO: 422986 - RNA, 18 nt, Homo sapiens
aaauaauaaccauggcaa

SEQ ID NO: 422987 - RNA, 19 nt, Homo sapiens
aacagagaugccaugauau

SEQ ID NO: 422988 - RNA, 22 nt, Homo sapiens
aacagagcaagacucugucuca

SEQ ID NO: 422989 - RNA, 20 nt, Homo sapiens
aacagaggcaggaguggcag

SEQ ID NO: 422990 - RNA, 19 nt, Homo sapiens
aacagauuuguucauuccg

SEQ ID NO: 422991 - RNA, 18 nt, Homo sapiens
aacagcacuggcucucuc

SEQ ID NO: 422992 - RNA, 18 nt, Homo sapiens
aacagcagaacuucugaa

SEQ ID NO: 422993 - RNA, 22 nt, Homo sapiens
aacagcagucccaguauucuca

SEQ ID NO: 422994 - RNA, 21 nt, Homo sapiens
aacagcauucuugucacaaua

SEQ ID NO: 422995 - RNA, 21 nt, Homo sapiens
aacagcgggagaccugugcua

SEQ ID NO: 422996 - RNA, 22 nt, Homo sapiens
aacagcgggagaccugugcuag

SEQ ID NO: 422997 - RNA, 15 nt, Homo sapiens
aacagcugucucuaa

SEQ ID NO: 422998 - RNA, 18 nt, Homo sapiens
aacaggaaggaaccagaa

SEQ ID NO: 422999 - RNA, 18 nt, Homo sapiens
aacaggaauccacauugc

SEQ ID NO: 423000 - RNA, 17 nt, Homo sapiens
aacaggacuugaauuca

SEQ ID NO: 423001 - RNA, 23 nt, Homo sapiens
aacaggugcugaacugugcauca

SEQ ID NO: 423002 - RNA, 19 nt, Homo sapiens
aacagguucuccaggugau

SEQ ID NO: 423003 - RNA, 17 nt, Homo sapiens
aacaguaccugugccug

SEQ ID NO: 423004 - RNA, 16 nt, Homo sapiens
aacaguguucugagcc

SEQ ID NO: 423005 - RNA, 17 nt, Homo sapiens
aacaguguuggcuuuca

SEQ ID NO: 423006 - RNA, 14 nt, Homo sapiens
aacaguuacuccag

SEQ ID NO: 423007 - RNA, 16 nt, Homo sapiens
aacaguuuuccaugaa

SEQ ID NO: 423008 - RNA, 21 nt, Homo sapiens
aacauaaauuucuuuaaucau

SEQ ID NO: 423009 - RNA, 20 nt, Homo sapiens
aacauauuuaaagucuugaa

SEQ ID NO: 423010 - RNA, 16 nt, Homo sapiens
aacaucaguucaugcc

SEQ ID NO: 423011 - RNA, 14 nt, Homo sapiens
aacaucucuuucau

SEQ ID NO: 423012 - RNA, 20 nt, Homo sapiens
aacaugaaaacauugaugaa

SEQ ID NO: 423013 - RNA, 20 nt, Homo sapiens
aacaugcuaaauaguucuau

SEQ ID NO: 423014 - RNA, 14 nt, Homo sapiens
aacauggaaguacu

SEQ ID NO: 423015 - RNA, 23 nt, Homo sapiens
aacauggccuuggagggcaugaa

SEQ ID NO: 423016 - RNA, 16 nt, Homo sapiens
aacauggccuuugcuu

SEQ ID NO: 423017 - RNA, 16 nt, Homo sapiens
aacaugguuaccucug

SEQ ID NO: 423018 - RNA, 23 nt, Homo sapiens
aacauguaauaaaaaguauaugu

SEQ ID NO: 423019 - RNA, 23 nt, Homo sapiens
aacauguauguggauacagucau

SEQ ID NO: 423020 - RNA, 18 nt, Homo sapiens
aacauuaaacacuguaau

SEQ ID NO: 423021 - RNA, 16 nt, Homo sapiens
aacauuaggcuguggu

SEQ ID NO: 423022 - RNA, 20 nt, Homo sapiens
aacauucacacagggcucuu

SEQ ID NO: 423023 - RNA, 15 nt, Homo sapiens
aacauucaucaagcu

SEQ ID NO: 423024 - RNA, 17 nt, Homo sapiens
aacauuccaaugcauug

SEQ ID NO: 423025 - RNA, 14 nt, Homo sapiens
aacauugaccaaga

SEQ ID NO: 423026 - RNA, 13 nt, Homo sapiens
aacauuugccaaa

SEQ ID NO: 423027 - RNA, 14 nt, Homo sapiens
aacauuugccaaac

SEQ ID NO: 423028 - RNA, 22 nt, Homo sapiens
aacauuuggaaaccaugcacua

SEQ ID NO: 423029 - RNA, 19 nt, Homo sapiens
aacauuugggagacugagc

SEQ ID NO: 423030 - RNA, 19 nt, Homo sapiens
aacauuuuugauucuagcu

SEQ ID NO: 423031 - RNA, 20 nt, Homo sapiens
aaccaacaccaucacagcuu

SEQ ID NO: 423032 - RNA, 14 nt, Homo sapiens
aaccaacugccuua

SEQ ID NO: 423033 - RNA, 15 nt, Homo sapiens
aaccaagaucuauaa

SEQ ID NO: 423034 - RNA, 22 nt, Homo sapiens
aaccaagccuuggcucguucuc

SEQ ID NO: 423035 - RNA, 20 nt, Homo sapiens
aaccaauacuccacugcuca

SEQ ID NO: 423036 - RNA, 13 nt, Homo sapiens
aaccaaugcacac

SEQ ID NO: 423037 - RNA, 15 nt, Homo sapiens
aaccacacuucuuga

SEQ ID NO: 423038 - RNA, 19 nt, Homo sapiens
aaccaccgcauaugcaugc

SEQ ID NO: 423039 - RNA, 22 nt, Homo sapiens
aaccacuaugaagcuaccucaa

SEQ ID NO: 423040 - RNA, 18 nt, Homo sapiens
aaccacugcgaccacaag

SEQ ID NO: 423041 - RNA, 13 nt, Homo sapiens
aaccacugggauc

SEQ ID NO: 423042 - RNA, 21 nt, Homo sapiens
aaccacuuaaaaaauguccau

SEQ ID NO: 423043 - RNA, 18 nt, Homo sapiens
aaccagaauuaggucaag

SEQ ID NO: 423044 - RNA, 20 nt, Homo sapiens
aaccagcucuuuggugccag

SEQ ID NO: 423045 - RNA, 16 nt, Homo sapiens
aaccagguuuagacag

SEQ ID NO: 423046 - RNA, 12 nt, Homo sapiens
aaccaugacugu

SEQ ID NO: 423047 - RNA, 14 nt, Homo sapiens
aaccauuacuguaa

SEQ ID NO: 423048 - RNA, 19 nt, Homo sapiens
aacccaccccgcuuucgua

SEQ ID NO: 423049 - RNA, 14 nt, Homo sapiens
aacccacuuugucu

SEQ ID NO: 423050 - RNA, 20 nt, Homo sapiens
aacccaggagauggaaguug

SEQ ID NO: 423051 - RNA, 22 nt, Homo sapiens
aacccauaggcacuugggaugu

SEQ ID NO: 423052 - RNA, 16 nt, Homo sapiens
aaccccugcuccaguc

SEQ ID NO: 423053 - RNA, 19 nt, Homo sapiens
aacccuacgaaagcacagu

SEQ ID NO: 423054 - RNA, 21 nt, Homo sapiens
aacccugagggacuuggcagu

SEQ ID NO: 423055 - RNA, 19 nt, Homo sapiens
aacccuguauggcacuuau

SEQ ID NO: 423056 - RNA, 14 nt, Homo sapiens
aacccuugcuugca

SEQ ID NO: 423057 - RNA, 17 nt, Homo sapiens
aaccuagcaucuuacaa

SEQ ID NO: 423058 - RNA, 14 nt, Homo sapiens
aaccucacugcccu

SEQ ID NO: 423059 - RNA, 20 nt, Homo sapiens
aaccucccccccaaauacuc

SEQ ID NO: 423060 - RNA, 14 nt, Homo sapiens
aaccuccuuuacca

SEQ ID NO: 423061 - RNA, 13 nt, Homo sapiens
aaccucugaugcc

SEQ ID NO: 423062 - RNA, 21 nt, Homo sapiens
aaccucuggcuagaggacaua

SEQ ID NO: 423063 - RNA, 22 nt, Homo sapiens
aaccucugggucaucucucaca

SEQ ID NO: 423064 - RNA, 15 nt, Homo sapiens
aaccugccacaaugu

SEQ ID NO: 423065 - RNA, 12 nt, Homo sapiens
aaccuugcugcu

SEQ ID NO: 423066 - RNA, 11 nt, Homo sapiens
aaccuuucaaa

SEQ ID NO: 423067 - RNA, 18 nt, Homo sapiens
aaccuuuugagugccuua

SEQ ID NO: 423068 - RNA, 11 nt, Homo sapiens
aacgccagucu

SEQ ID NO: 423069 - RNA, 23 nt, Homo sapiens
aacgccgcugacugccacccaca

SEQ ID NO: 423070 - RNA, 23 nt, Homo sapiens
aacguccagcucguucucugggc

SEQ ID NO: 423071 - RNA, 15 nt, Homo sapiens
aacguccaucucucu

SEQ ID NO: 423072 - RNA, 22 nt, Homo sapiens
aacguuuacuuaucuuaugcca

SEQ ID NO: 423073 - RNA, 15 nt, Homo sapiens
aacuaaacagauaaa

SEQ ID NO: 423074 - RNA, 22 nt, Homo sapiens
aacuaaagccaaggguauccaa

SEQ ID NO: 423075 - RNA, 22 nt, Homo sapiens
aacuaaagcuuuaggaugacug

SEQ ID NO: 423076 - RNA, 19 nt, Homo sapiens
aacuaagaaauaugcacaa

SEQ ID NO: 423077 - RNA, 22 nt, Homo sapiens
aacuaaggacaggauggcugug

SEQ ID NO: 423078 - RNA, 16 nt, Homo sapiens
aacuaccagauuugag

SEQ ID NO: 423079 - RNA, 17 nt, Homo sapiens
aacuacuaaagugccua

SEQ ID NO: 423080 - RNA, 13 nt, Homo sapiens
aacuacuguacau

SEQ ID NO: 423081 - RNA, 15 nt, Homo sapiens
aacuagcaaaaggau

SEQ ID NO: 423082 - RNA, 19 nt, Homo sapiens
aacuagguaacaguuugau

SEQ ID NO: 423083 - RNA, 17 nt, Homo sapiens
aacuauaggcuucuucc

SEQ ID NO: 423084 - RNA, 15 nt, Homo sapiens
aacuauguaaugcuu

SEQ ID NO: 423085 - RNA, 16 nt, Homo sapiens
aacucaacuuugacaa

SEQ ID NO: 423086 - RNA, 14 nt, Homo sapiens
aacucaccauuuca

SEQ ID NO: 423087 - RNA, 12 nt, Homo sapiens
aacucacugugc

SEQ ID NO: 423088 - RNA, 15 nt, Homo sapiens
aacucacugugcucc

SEQ ID NO: 423089 - RNA, 21 nt, Homo sapiens
aacuccagccacccagccagg

SEQ ID NO: 423090 - RNA, 13 nt, Homo sapiens
aacuccaguguuc

SEQ ID NO: 423091 - RNA, 20 nt, Homo sapiens
aacuccaucugcugccauga

SEQ ID NO: 423092 - RNA, 23 nt, Homo sapiens
aacuccggaaugaccagcaugau

SEQ ID NO: 423093 - RNA, 10 nt, Homo sapiens
aacuccuucc

SEQ ID NO: 423094 - RNA, 21 nt, Homo sapiens
aacucuagaugguaugccucu

SEQ ID NO: 423095 - RNA, 15 nt, Homo sapiens
aacucuagccaaaug

SEQ ID NO: 423096 - RNA, 18 nt, Homo sapiens
aacucuccccagugccug

SEQ ID NO: 423097 - RNA, 22 nt, Homo sapiens
aacucugcaacugaauacuuga

SEQ ID NO: 423098 - RNA, 22 nt, Homo sapiens
uggauugugggaauuaaggaag

SEQ ID NO: 423099 - RNA, 17 nt, Homo sapiens
uggauuugccugugcca

SEQ ID NO: 423100 - RNA, 15 nt, Homo sapiens
uggcaaagugcugua

SEQ ID NO: 423101 - RNA, 19 nt, Homo sapiens
uggcaaauguagcccugca

SEQ ID NO: 423102 - RNA, 17 nt, Homo sapiens
uggcaacagaaaacaau

SEQ ID NO: 423103 - RNA, 12 nt, Homo sapiens
ugguagcucuga

SEQ ID NO: 423104 - RNA, 14 nt, Homo sapiens
ugguagcucugagc

SEQ ID NO: 423105 - RNA, 17 nt, Homo sapiens
ugguaggauaucuuggc

SEQ ID NO: 423106 - RNA, 21 nt, Homo sapiens
ugguagguucugucugugcca

SEQ ID NO: 423107 - RNA, 14 nt, Homo sapiens
ugguauacuauaga

SEQ ID NO: 423108 - RNA, 13 nt, Homo sapiens
ugguaucugcaug

SEQ ID NO: 423109 - RNA, 23 nt, Homo sapiens
ugguauucaacuaauacaugguu

SEQ ID NO: 423110 - RNA, 13 nt, Homo sapiens
ugguauuuggaua

SEQ ID NO: 423111 - RNA, 15 nt, Homo sapiens
uggucaaagcaacug

SEQ ID NO: 423112 - RNA, 21 nt, Homo sapiens
uggucauuugguggcucuaac

SEQ ID NO: 423113 - RNA, 16 nt, Homo sapiens
ugguccacauucugcu

SEQ ID NO: 423114 - RNA, 14 nt, Homo sapiens
ugguccgaucuuug

SEQ ID NO: 423115 - RNA, 20 nt, Homo sapiens
ugguccugacucaacauguu

SEQ ID NO: 423116 - RNA, 23 nt, Homo sapiens
uggucgccugcauuucuccgugc

SEQ ID NO: 423117 - RNA, 16 nt, Homo sapiens
uggucuccucucagcu

SEQ ID NO: 423118 - RNA, 10 nt, Homo sapiens
uggucucuuu

SEQ ID NO: 423119 - RNA, 15 nt, Homo sapiens
uggucuguacuccuu

SEQ ID NO: 423120 - RNA, 13 nt, Homo sapiens
uggucuugaucuc

SEQ ID NO: 423121 - RNA, 16 nt, Homo sapiens
uggugaaaauguacug

SEQ ID NO: 423122 - RNA, 18 nt, Homo sapiens
uggugaauauuacauugc

SEQ ID NO: 423123 - RNA, 14 nt, Homo sapiens
uggugaaugcugcu

SEQ ID NO: 423124 - RNA, 17 nt, Homo sapiens
uggugacugaaacauuc

SEQ ID NO: 423125 - RNA, 14 nt, Homo sapiens
uggugacuuuugaa

SEQ ID NO: 423126 - RNA, 14 nt, Homo sapiens
uggugaggcaauaa

SEQ ID NO: 423127 - RNA, 14 nt, Homo sapiens
uggugaucagugca

SEQ ID NO: 423128 - RNA, 19 nt, Homo sapiens
uggugcaguaaccauuuaa

SEQ ID NO: 423129 - RNA, 13 nt, Homo sapiens
uggugccuggaaa

SEQ ID NO: 423130 - RNA, 22 nt, Homo sapiens
uggugccuucucacaucugucc

SEQ ID NO: 423131 - RNA, 18 nt, Homo sapiens
ugguggccuaauuuacaa

SEQ ID NO: 423132 - RNA, 17 nt, Homo sapiens
uggugggaacauucgag

SEQ ID NO: 423133 - RNA, 16 nt, Homo sapiens
ugguggguucagggga

SEQ ID NO: 423134 - RNA, 13 nt, Homo sapiens
uggugguucucag

SEQ ID NO: 423135 - RNA, 23 nt, Homo sapiens
uggugugaucucggcucacugca

SEQ ID NO: 423136 - RNA, 14 nt, Homo sapiens
ugguguggcugcuc

SEQ ID NO: 423137 - RNA, 19 nt, Homo sapiens
ugguguucaaaaaaacacu

SEQ ID NO: 423138 - RNA, 21 nt, Homo sapiens
ugguguucuugcuaacuuugc

SEQ ID NO: 423139 - RNA, 18 nt, Homo sapiens
ugguuaauaaaacugcac

SEQ ID NO: 423140 - RNA, 19 nt, Homo sapiens
ugguuaauaaaacugcaca

SEQ ID NO: 423141 - RNA, 12 nt, Homo sapiens
ugguuaccucug

SEQ ID NO: 423142 - RNA, 23 nt, Homo sapiens
ugguuacugaggaccaaagauac

SEQ ID NO: 423143 - RNA, 20 nt, Homo sapiens
ugguuauuucucaacaaagc

SEQ ID NO: 423144 - RNA, 11 nt, Homo sapiens
ugguucagugg

SEQ ID NO: 423145 - RNA, 15 nt, Homo sapiens
ugguuccacucagcu

SEQ ID NO: 423146 - RNA, 19 nt, Homo sapiens
ugguuccaugccugagggu

SEQ ID NO: 423147 - RNA, 11 nt, Homo sapiens
ugguucugcuu

SEQ ID NO: 423148 - RNA, 14 nt, Homo sapiens
ugguuuaaaccaaa

SEQ ID NO: 423149 - RNA, 14 nt, Homo sapiens
ugguuuaaagucac

SEQ ID NO: 423150 - RNA, 18 nt, Homo sapiens
ugguuucaguugacaaaa

SEQ ID NO: 423151 - RNA, 17 nt, Homo sapiens
ugguuuuaaaaaagcau

SEQ ID NO: 423152 - RNA, 19 nt, Homo sapiens
ugguuuuuaaguacucacu

SEQ ID NO: 423153 - RNA, 20 nt, Homo sapiens
ugguuuuuacucaaccaaau

SEQ ID NO: 423154 - RNA, 17 nt, Homo sapiens
uguaaauacacauagca

SEQ ID NO: 423155 - RNA, 18 nt, Homo sapiens
uguaaauacacauagcau

SEQ ID NO: 423156 - RNA, 18 nt, Homo sapiens
uguaaaucauuauaaaua

SEQ ID NO: 423157 - RNA, 16 nt, Homo sapiens
uguaaaugcucaaaga

SEQ ID NO: 423158 - RNA, 17 nt, Homo sapiens
uguaaaugcucaaagau

SEQ ID NO: 423159 - RNA, 16 nt, Homo sapiens
uguaaauuauuguaaa

SEQ ID NO: 423160 - RNA, 14 nt, Homo sapiens
uguaaauuauuuca

SEQ ID NO: 423161 - RNA, 18 nt, Homo sapiens
uguaaauuuaacugcaua

SEQ ID NO: 423162 - RNA, 21 nt, Homo sapiens
uguaacaucacuauccaugca

SEQ ID NO: 423163 - RNA, 14 nt, Homo sapiens
uguaacccgcucau

SEQ ID NO: 423164 - RNA, 15 nt, Homo sapiens
uguaacuugugcuuu

SEQ ID NO: 423165 - RNA, 15 nt, Homo sapiens
uguaagaggugcucu

SEQ ID NO: 423166 - RNA, 18 nt, Homo sapiens
uguaaucccaguacuugg

SEQ ID NO: 423167 - RNA, 19 nt, Homo sapiens
uguaauccuagcacuuugg

SEQ ID NO: 423168 - RNA, 14 nt, Homo sapiens
uguaauugucucaa

SEQ ID NO: 423169 - RNA, 18 nt, Homo sapiens
uguacaauuuucauccca

SEQ ID NO: 423170 - RNA, 22 nt, Homo sapiens
uguacacaacaccuaaaaccag

SEQ ID NO: 423171 - RNA, 17 nt, Homo sapiens
uguacacugacuugaga

SEQ ID NO: 423172 - RNA, 18 nt, Homo sapiens
uguacacuuucugucuca

SEQ ID NO: 423173 - RNA, 15 nt, Homo sapiens
uguacagacaacaaa

SEQ ID NO: 423174 - RNA, 16 nt, Homo sapiens
uguacaggcagaugaa

SEQ ID NO: 423175 - RNA, 19 nt, Homo sapiens
uguacagugaaaagucucc

SEQ ID NO: 423176 - RNA, 18 nt, Homo sapiens
uguacagugucugugcca

SEQ ID NO: 423177 - RNA, 20 nt, Homo sapiens
uguacaguuauacauaccuc

SEQ ID NO: 423178 - RNA, 20 nt, Homo sapiens
uguacauaguggucauuugg

SEQ ID NO: 423179 - RNA, 13 nt, Homo sapiens
uguacauguggaa

SEQ ID NO: 423180 - RNA, 21 nt, Homo sapiens
uguacauguggaaaacucaca

SEQ ID NO: 423181 - RNA, 22 nt, Homo sapiens
uguacauguuccuguuuaugca

SEQ ID NO: 423182 - RNA, 14 nt, Homo sapiens
uguaccaguguacu

SEQ ID NO: 423183 - RNA, 16 nt, Homo sapiens
uguacccugcuguaua

SEQ ID NO: 423184 - RNA, 23 nt, Homo sapiens
uguaccucucucugcuccucacc

SEQ ID NO: 423185 - RNA, 15 nt, Homo sapiens
uguaccugaugcuau

SEQ ID NO: 423186 - RNA, 13 nt, Homo sapiens
uguaccuuucuaa

SEQ ID NO: 423187 - RNA, 23 nt, Homo sapiens
uguaccuuucuucacugcagauu

SEQ ID NO: 423188 - RNA, 15 nt, Homo sapiens
uguacuacaguauac

SEQ ID NO: 423189 - RNA, 15 nt, Homo sapiens
uguacuacauuugca

SEQ ID NO: 423190 - RNA, 18 nt, Homo sapiens
uguacuagugccauugga

SEQ ID NO: 423191 - RNA, 13 nt, Homo sapiens
uguacuauuuaac

SEQ ID NO: 423192 - RNA, 18 nt, Homo sapiens
uguacugaguauugauaa

SEQ ID NO: 423193 - RNA, 14 nt, Homo sapiens
uguagaacugcaau

SEQ ID NO: 423194 - RNA, 13 nt, Homo sapiens
uguagaacuucaa

SEQ ID NO: 423195 - RNA, 19 nt, Homo sapiens
uguagaauuauaacuaauu

SEQ ID NO: 423196 - RNA, 20 nt, Homo sapiens
uguagagauggggucucaca

SEQ ID NO: 423197 - RNA, 16 nt, Homo sapiens
uguagagcuucuggca

SEQ ID NO: 423198 - RNA, 18 nt, Homo sapiens
uguagaguuguuucuuaa

SEQ ID NO: 423199 - RNA, 14 nt, Homo sapiens
uguagauugccuuu

SEQ ID NO: 423200 - RNA, 17 nt, Homo sapiens
uguagcaucugagaagg

SEQ ID NO: 423201 - RNA, 13 nt, Homo sapiens
uguagcucuaugg

SEQ ID NO: 423202 - RNA, 13 nt, Homo sapiens
uguagcugaugaa

SEQ ID NO: 423203 - RNA, 18 nt, Homo sapiens
uguaggguaccuuccagu

SEQ ID NO: 423204 - RNA, 15 nt, Homo sapiens
uguagguaauauugu

SEQ ID NO: 423205 - RNA, 14 nt, Homo sapiens
uguaguagucucau

SEQ ID NO: 423206 - RNA, 19 nt, Homo sapiens
uguaguguucuccacuaau

SEQ ID NO: 423207 - RNA, 18 nt, Homo sapiens
uguauaaagccauuauuc

SEQ ID NO: 423208 - RNA, 22 nt, Homo sapiens
uguauaacauuuaaaaauguua

SEQ ID NO: 423209 - RNA, 23 nt, Homo sapiens
uguauaaccccaccuugccaagc

SEQ ID NO: 423210 - RNA, 20 nt, Homo sapiens
uguauaauuggaguagauau

SEQ ID NO: 423211 - RNA, 16 nt, Homo sapiens
uguauacaaacaggug

SEQ ID NO: 423212 - RNA, 18 nt, Homo sapiens
uguauacuguacugagac

SEQ ID NO: 423213 - RNA, 15 nt, Homo sapiens
uguaucaaguggcau

SEQ ID NO: 423214 - RNA, 19 nt, Homo sapiens
uguauccaacugcauccag

SEQ ID NO: 423215 - RNA, 19 nt, Homo sapiens
uguaucuaccucacuauuc

SEQ ID NO: 423216 - RNA, 15 nt, Homo sapiens
uguaugcacgugugc

SEQ ID NO: 423217 - RNA, 12 nt, Homo sapiens
uguaugcacuuu

SEQ ID NO: 423218 - RNA, 13 nt, Homo sapiens
uguaugugccauu

SEQ ID NO: 423219 - RNA, 13 nt, Homo sapiens
uguaugugugaau

SEQ ID NO: 423220 - RNA, 23 nt, Homo sapiens
uguauucacgugcagcagcaaca

SEQ ID NO: 423221 - RNA, 18 nt, Homo sapiens
uguauuccugccuuugau

SEQ ID NO: 423222 - RNA, 19 nt, Homo sapiens
uguauucuagcuaauguaa

SEQ ID NO: 423223 - RNA, 16 nt, Homo sapiens
uguauugucugacaca

SEQ ID NO: 423224 - RNA, 19 nt, Homo sapiens
uguauuguucccagugaca

SEQ ID NO: 423225 - RNA, 15 nt, Homo sapiens
uguauuuagugauua

SEQ ID NO: 423226 - RNA, 20 nt, Homo sapiens
ugucaacuccaggacuugcu

SEQ ID NO: 423227 - RNA, 16 nt, Homo sapiens
ugucaacuucaguuga

SEQ ID NO: 423228 - RNA, 18 nt, Homo sapiens
ugucaagauuaaguuaua

SEQ ID NO: 423229 - RNA, 21 nt, Homo sapiens
ugucaauaguauuaacuauua

SEQ ID NO: 423230 - RNA, 14 nt, Homo sapiens
ugucacaaugcucc

SEQ ID NO: 423231 - RNA, 12 nt, Homo sapiens
ugucacaucucu

SEQ ID NO: 423232 - RNA, 13 nt, Homo sapiens
ugucaccacaucu

SEQ ID NO: 423233 - RNA, 23 nt, Homo sapiens
ugagacagcaguaucacaggcca

SEQ ID NO: 423234 - RNA, 12 nt, Homo sapiens
ugagacauucca

SEQ ID NO: 423235 - RNA, 17 nt, Homo sapiens
ugagaccacuguuauca

SEQ ID NO: 423236 - RNA, 22 nt, Homo sapiens
ugagagagagugagagcacaaa

SEQ ID NO: 423237 - RNA, 23 nt, Homo sapiens
ugagagauagcuuauuacucuga

SEQ ID NO: 423238 - RNA, 20 nt, Homo sapiens
ugagagcccaaucacugccu

SEQ ID NO: 423239 - RNA, 14 nt, Homo sapiens
ugagaggcaaugau

SEQ ID NO: 423240 - RNA, 20 nt, Homo sapiens
ugagaguacucacuuuucac

SEQ ID NO: 423241 - RNA, 23 nt, Homo sapiens
ugagaguacucacuuuucacuug

SEQ ID NO: 423242 - RNA, 15 nt, Homo sapiens
ugagagugaaaccau

SEQ ID NO: 423243 - RNA, 18 nt, Homo sapiens
ugagagugucucugauaa

SEQ ID NO: 423244 - RNA, 22 nt, Homo sapiens
ugagauauaucuuuauacuuaa

SEQ ID NO: 423245 - RNA, 16 nt, Homo sapiens
ugagaucacagccucc

SEQ ID NO: 423246 - RNA, 20 nt, Homo sapiens
ugagauuuccugacagggaa

SEQ ID NO: 423247 - RNA, 15 nt, Homo sapiens
ugagcaaaaaugcca

SEQ ID NO: 423248 - RNA, 18 nt, Homo sapiens
ugagcaaacugaagccca

SEQ ID NO: 423249 - RNA, 23 nt, Homo sapiens
ugagcaaguuuucaccuaucugg

SEQ ID NO: 423250 - RNA, 14 nt, Homo sapiens
ugagcaauggagug

SEQ ID NO: 423251 - RNA, 23 nt, Homo sapiens
ugagcaauggaguggcugccaug

SEQ ID NO: 423252 - RNA, 19 nt, Homo sapiens
ugagcacaaagguagcuuu

SEQ ID NO: 423253 - RNA, 21 nt, Homo sapiens
ugagcacaggcaacauuacaa

SEQ ID NO: 423254 - RNA, 16 nt, Homo sapiens
cuagauuuucuacuuu

SEQ ID NO: 423255 - RNA, 23 nt, Homo sapiens
cuagcaaauggcagaaccaaagc

SEQ ID NO: 423256 - RNA, 20 nt, Homo sapiens
cuagcaacccuaacaguaag

SEQ ID NO: 423257 - RNA, 21 nt, Homo sapiens
cuagccauuggugcacaggau

SEQ ID NO: 423258 - RNA, 19 nt, Homo sapiens
cuagcuagaaauaugauuu

SEQ ID NO: 423259 - RNA, 17 nt, Homo sapiens
cuagcuccauaauugca

SEQ ID NO: 423260 - RNA, 21 nt, Homo sapiens
cuagcugggaaggugaccaca

SEQ ID NO: 423261 - RNA, 14 nt, Homo sapiens
cuaggauaagcacu

SEQ ID NO: 423262 - RNA, 21 nt, Homo sapiens
cuaggauaagcacuagaucuc

SEQ ID NO: 423263 - RNA, 22 nt, Homo sapiens
cuaggauaagcacuagaucucc

SEQ ID NO: 423264 - RNA, 12 nt, Homo sapiens
cuaggcaucucc

SEQ ID NO: 423265 - RNA, 22 nt, Homo sapiens
cuagggucuugggggucagggg

SEQ ID NO: 423266 - RNA, 22 nt, Homo sapiens
cuagguaucauucaacucucca

SEQ ID NO: 423267 - RNA, 23 nt, Homo sapiens
cuagguuucaccucccaaaccca

SEQ ID NO: 423268 - RNA, 12 nt, Homo sapiens
cuaguacuagua

SEQ ID NO: 423269 - RNA, 12 nt, Homo sapiens
cuaguacuauua

SEQ ID NO: 423270 - RNA, 12 nt, Homo sapiens
cuaguacuguau

SEQ ID NO: 423271 - RNA, 13 nt, Homo sapiens
cuaguacuguauu

SEQ ID NO: 423272 - RNA, 15 nt, Homo sapiens
cuagucacauaucaa

SEQ ID NO: 423273 - RNA, 19 nt, Homo sapiens
cuagucagccacaugggaa

SEQ ID NO: 423274 - RNA, 21 nt, Homo sapiens
cuagucguggagaugucuucg

SEQ ID NO: 423275 - RNA, 16 nt, Homo sapiens
cuagugauuucugggg

SEQ ID NO: 423276 - RNA, 20 nt, Homo sapiens
cuagugcagagagguuguga

SEQ ID NO: 423277 - RNA, 13 nt, Homo sapiens
cuagugggcaggu

SEQ ID NO: 423278 - RNA, 20 nt, Homo sapiens
cuaguguuucugcagaggca

SEQ ID NO: 423279 - RNA, 14 nt, Homo sapiens
gucagcacauguug

SEQ ID NO: 423280 - RNA, 22 nt, Homo sapiens
gucagcacauguugcuaaugac

SEQ ID NO: 423281 - RNA, 18 nt, Homo sapiens
gucagcagagcuucagag

SEQ ID NO: 423282 - RNA, 19 nt, Homo sapiens
gucagcagggccacugagu

SEQ ID NO: 423283 - RNA, 22 nt, Homo sapiens
gucagccaaaugacuucauuuc

SEQ ID NO: 423284 - RNA, 18 nt, Homo sapiens
gucagcccugcugucaga

SEQ ID NO: 423285 - RNA, 21 nt, Homo sapiens
gucagcuacuaaugauguuuu

SEQ ID NO: 423286 - RNA, 19 nt, Homo sapiens
gucaggaggugccugagag

SEQ ID NO: 423287 - RNA, 12 nt, Homo sapiens
gucagucaggga

SEQ ID NO: 423288 - RNA, 13 nt, Homo sapiens
gucagucuacagg

SEQ ID NO: 423289 - RNA, 18 nt, Homo sapiens
gucaucaacaaaagggag

SEQ ID NO: 423290 - RNA, 19 nt, Homo sapiens
gucaucaacaauuugacca

SEQ ID NO: 423291 - RNA, 19 nt, Homo sapiens
gucaucaaccgaugguccu

SEQ ID NO: 423292 - RNA, 12 nt, Homo sapiens
gucaucaucuca

SEQ ID NO: 423293 - RNA, 20 nt, Homo sapiens
gucaucuccaucagcuguaa

SEQ ID NO: 423294 - RNA, 19 nt, Homo sapiens
gucaugauggagacuucag

SEQ ID NO: 423295 - RNA, 13 nt, Homo sapiens
gucaugauuucaa

SEQ ID NO: 423296 - RNA, 23 nt, Homo sapiens
gucauguaagggaagcuggaauu

SEQ ID NO: 423297 - RNA, 13 nt, Homo sapiens
gucauuugcuaau

SEQ ID NO: 423298 - RNA, 20 nt, Homo sapiens
guccaacaacuccaggaaaa

SEQ ID NO: 423299 - RNA, 13 nt, Homo sapiens
guccaagggccau

SEQ ID NO: 423300 - RNA, 16 nt, Homo sapiens
guccaaguccaaccug

SEQ ID NO: 423301 - RNA, 13 nt, Homo sapiens
guccaagucuucu

SEQ ID NO: 423302 - RNA, 22 nt, Homo sapiens
guccaagugugugugcgugugu

SEQ ID NO: 423303 - RNA, 22 nt, Homo sapiens
guccacagaguuuguaguaaau

SEQ ID NO: 423304 - RNA, 21 nt, Homo sapiens
guccacauaauccacgcucau

SEQ ID NO: 423305 - RNA, 18 nt, Homo sapiens
guccacucucggggcccu

SEQ ID NO: 423306 - RNA, 15 nt, Homo sapiens
guccacucugagucg

SEQ ID NO: 423307 - RNA, 14 nt, Homo sapiens
guccacuucuagcu

SEQ ID NO: 423308 - RNA, 21 nt, Homo sapiens
guccagaaaauaggguggaca

SEQ ID NO: 423309 - RNA, 14 nt, Homo sapiens
guccagaccugggc

SEQ ID NO: 423310 - RNA, 13 nt, Homo sapiens
guccagcacugga

SEQ ID NO: 423311 - RNA, 16 nt, Homo sapiens
guccagcucguucucu

SEQ ID NO: 423312 - RNA, 11 nt, Homo sapiens
guccaggaaac

SEQ ID NO: 423313 - RNA, 19 nt, Homo sapiens
guccaggaaggcagcugcu

SEQ ID NO: 423314 - RNA, 14 nt, Homo sapiens
guccaguauucuac

SEQ ID NO: 423315 - RNA, 13 nt, Homo sapiens
guccagugcaacc

SEQ ID NO: 423316 - RNA, 18 nt, Homo sapiens
guccaguuucccaaaaac

SEQ ID NO: 423317 - RNA, 21 nt, Homo sapiens
guccaugauguccuuguuauu

SEQ ID NO: 423318 - RNA, 19 nt, Homo sapiens
guccaugugugugcaagug

SEQ ID NO: 423319 - RNA, 12 nt, Homo sapiens
guccauugaaag

SEQ ID NO: 423320 - RNA, 16 nt, Homo sapiens
guccauuuaccuggaa

SEQ ID NO: 423321 - RNA, 17 nt, Homo sapiens
guccauuucaugugauc

SEQ ID NO: 423322 - RNA, 15 nt, Homo sapiens
gucccaaucuuacca

SEQ ID NO: 423323 - RNA, 19 nt, Homo sapiens
gucccagaaccacacuguu

SEQ ID NO: 423324 - RNA, 19 nt, Homo sapiens
gucccagagguuaucugcc

SEQ ID NO: 423325 - RNA, 15 nt, Homo sapiens
gucccagcuacucag

SEQ ID NO: 423326 - RNA, 12 nt, Homo sapiens
gucccagucucu

SEQ ID NO: 423327 - RNA, 21 nt, Homo sapiens
gucccaugaccuugggguaca

SEQ ID NO: 423328 - RNA, 16 nt, Homo sapiens
gucccauugauguacu

SEQ ID NO: 423329 - RNA, 19 nt, Homo sapiens
guccccacucccuguccau

SEQ ID NO: 423330 - RNA, 22 nt, Homo sapiens
guccccccaaaucuacugagcc

SEQ ID NO: 423331 - RNA, 21 nt, Homo sapiens
gucccccccuaacuuucuugc

SEQ ID NO: 423332 - RNA, 19 nt, Homo sapiens
guccccgcucagucuuuga

SEQ ID NO: 423333 - RNA, 14 nt, Homo sapiens
guccccuuguucua

SEQ ID NO: 423334 - RNA, 16 nt, Homo sapiens
gucccucucucuggaa

SEQ ID NO: 423335 - RNA, 21 nt, Homo sapiens
gucccucugccuugcacaaaa

SEQ ID NO: 423336 - RNA, 21 nt, Homo sapiens
gucccugagaagccucauggg

SEQ ID NO: 423337 - RNA, 12 nt, Homo sapiens
gucccuguggua

SEQ ID NO: 423338 - RNA, 22 nt, Homo sapiens
gucccuguuagcauaaugugag

SEQ ID NO: 423339 - RNA, 23 nt, Homo sapiens
gucccuucuucccuaaucagcuc

SEQ ID NO: 423340 - RNA, 13 nt, Homo sapiens
gucccuuggagac

SEQ ID NO: 423341 - RNA, 14 nt, Homo sapiens
guccgcaccagcug

SEQ ID NO: 423342 - RNA, 14 nt, Homo sapiens
guccggacccaccu

SEQ ID NO: 423343 - RNA, 17 nt, Homo sapiens
guccucacucccagucc

SEQ ID NO: 423344 - RNA, 23 nt, Homo sapiens
guccucagggcucuaccaagaca

SEQ ID NO: 423345 - RNA, 13 nt, Homo sapiens
guccuccaaaaca

SEQ ID NO: 423346 - RNA, 19 nt, Homo sapiens
guccucuacuuaaugagau

SEQ ID NO: 423347 - RNA, 17 nt, Homo sapiens
guccucuuaagacacua

SEQ ID NO: 423348 - RNA, 13 nt, Homo sapiens
guccugaugcugu

SEQ ID NO: 423349 - RNA, 18 nt, Homo sapiens
guccugaugcugugcuca

SEQ ID NO: 423350 - RNA, 12 nt, Homo sapiens
guccugcagugu

SEQ ID NO: 423351 - RNA, 22 nt, Homo sapiens
guccuggcugugcacauucucc

SEQ ID NO: 423352 - RNA, 20 nt, Homo sapiens
guccugugagcaaagugcag

SEQ ID NO: 423353 - RNA, 22 nt, Homo sapiens
guccugugcggugucaccauga

SEQ ID NO: 423354 - RNA, 23 nt, Homo sapiens
guccuucagugagccccucccca

SEQ ID NO: 423355 - RNA, 22 nt, Homo sapiens
guccuugauuuaucacacaaag

SEQ ID NO: 423356 - RNA, 23 nt, Homo sapiens
guccuuuccuucucgucuuccuc

SEQ ID NO: 423357 - RNA, 22 nt, Homo sapiens
guccuuucuuuugaaaugccac

SEQ ID NO: 423358 - RNA, 21 nt, Homo sapiens
guccuuuuuuauacaggaaaa

SEQ ID NO: 423359 - RNA, 19 nt, Homo sapiens
gucgaauguuagauuccuc

SEQ ID NO: 423360 - RNA, 15 nt, Homo sapiens
gucgacuuugagcug

SEQ ID NO: 423361 - RNA, 15 nt, Homo sapiens
gucguccugcagugu

SEQ ID NO: 423362 - RNA, 21 nt, Homo sapiens
gucuaaagcagggaagugaca

SEQ ID NO: 423363 - RNA, 17 nt, Homo sapiens
gucuacugucuggaaga

SEQ ID NO: 423364 - RNA, 21 nt, Homo sapiens
gucuagaggcaacaguguucu

SEQ ID NO: 423365 - RNA, 17 nt, Homo sapiens
gucuagcaaagccacca

SEQ ID NO: 423366 - RNA, 20 nt, Homo sapiens
gucuauuuuuuuaacugaaa

SEQ ID NO: 423367 - RNA, 22 nt, Homo sapiens
gucucaaaccuccaaaagcccu

SEQ ID NO: 423368 - RNA, 21 nt, Homo sapiens
gucucaaacuccugaccucaa

SEQ ID NO: 423369 - RNA, 18 nt, Homo sapiens
gucucacuuuuauugaua

SEQ ID NO: 423370 - RNA, 15 nt, Homo sapiens
gucucaguccaccug

SEQ ID NO: 423371 - RNA, 15 nt, Homo sapiens
gucucaguuucacuu

SEQ ID NO: 423372 - RNA, 11 nt, Homo sapiens
gucucauucug

SEQ ID NO: 423373 - RNA, 13 nt, Homo sapiens
gucucauugccag

SEQ ID NO: 423374 - RNA, 22 nt, Homo sapiens
gucuccaagaauguuuugcuag

SEQ ID NO: 423375 - RNA, 20 nt, Homo sapiens
gucucccuccgacuccagau

SEQ ID NO: 423376 - RNA, 15 nt, Homo sapiens
gucuccucugucagu

SEQ ID NO: 423377 - RNA, 23 nt, Homo sapiens
gucuccuuugcacugagggccac

SEQ ID NO: 423378 - RNA, 13 nt, Homo sapiens
gucucgcuuuguu

SEQ ID NO: 423379 - RNA, 20 nt, Homo sapiens
gucucucggguucaagcaau

SEQ ID NO: 423380 - RNA, 20 nt, Homo sapiens
gucugaagguaauacuauaa

SEQ ID NO: 423381 - RNA, 23 nt, Homo sapiens
gucugaaucauccgaggcaaaga

SEQ ID NO: 423382 - RNA, 23 nt, Homo sapiens
gucugcacacauaacacacauca

SEQ ID NO: 423383 - RNA, 16 nt, Homo sapiens
uaccaguguacugcuu

SEQ ID NO: 423384 - RNA, 13 nt, Homo sapiens
uaccaugcugcuu

SEQ ID NO: 423385 - RNA, 15 nt, Homo sapiens
uacccaccugagcuu

SEQ ID NO: 423386 - RNA, 18 nt, Homo sapiens
uacccaccugagcuuugg

SEQ ID NO: 423387 - RNA, 19 nt, Homo sapiens
uacccaccugagcuuugga

SEQ ID NO: 423388 - RNA, 21 nt, Homo sapiens
uacccaccugagcuuuggaca

SEQ ID NO: 423389 - RNA, 19 nt, Homo sapiens
uaccccugcucccauuccu

SEQ ID NO: 423390 - RNA, 23 nt, Homo sapiens
uacccuugugagagcccauuccc

SEQ ID NO: 423391 - RNA, 15 nt, Homo sapiens
uacccuuucccaaac

SEQ ID NO: 423392 - RNA, 12 nt, Homo sapiens
uaccguagcuuu

SEQ ID NO: 423393 - RNA, 13 nt, Homo sapiens
uaccuacaaaaug

SEQ ID NO: 423394 - RNA, 15 nt, Homo sapiens
uaccuaccacagugu

SEQ ID NO: 423395 - RNA, 18 nt, Homo sapiens
uaccuaccguagcuuuuu

SEQ ID NO: 423396 - RNA, 15 nt, Homo sapiens
uaccuaugcuucuag

SEQ ID NO: 423397 - RNA, 19 nt, Homo sapiens
uaccucacagagugcauug

SEQ ID NO: 423398 - RNA, 12 nt, Homo sapiens
uaccucacuuuu

SEQ ID NO: 423399 - RNA, 20 nt, Homo sapiens
uaccucugaucaaagcaccu

SEQ ID NO: 423400 - RNA, 15 nt, Homo sapiens
uaccugaggccagga

SEQ ID NO: 423401 - RNA, 12 nt, Homo sapiens
uaccugccucag

SEQ ID NO: 423402 - RNA, 17 nt, Homo sapiens
uaccuguagacugugga

SEQ ID NO: 423403 - RNA, 21 nt, Homo sapiens
uaccuguagacuguggaacua

SEQ ID NO: 423404 - RNA, 21 nt, Homo sapiens
uaccugugaaucauauguugu

SEQ ID NO: 423405 - RNA, 12 nt, Homo sapiens
uaccuguucaaa

SEQ ID NO: 423406 - RNA, 24 nt, Homo sapiens
uaccuuggaauuggaauuacugua

SEQ ID NO: 423407 - RNA, 22 nt, Homo sapiens
uaccuuuuauuuuaauguuucc

SEQ ID NO: 423408 - RNA, 13 nt, Homo sapiens
uacgaaagcacag

SEQ ID NO: 423409 - RNA, 22 nt, Homo sapiens
uacgcucugcucaaugaaaccu

SEQ ID NO: 423410 - RNA, 19 nt, Homo sapiens
uacggucaugaugucugca

SEQ ID NO: 423411 - RNA, 16 nt, Homo sapiens
uacgugagggggagcu

SEQ ID NO: 423412 - RNA, 14 nt, Homo sapiens
uacguucuuuucaa

SEQ ID NO: 423413 - RNA, 12 nt, Homo sapiens
uacuaaauauga

SEQ ID NO: 423414 - RNA, 18 nt, Homo sapiens
uacuaaccaccauuuccc

SEQ ID NO: 423415 - RNA, 13 nt, Homo sapiens
uacuacauuauua

SEQ ID NO: 423416 - RNA, 14 nt, Homo sapiens
uacuaccacaagga

SEQ ID NO: 423417 - RNA, 17 nt, Homo sapiens
uacuacccgagcccagc

SEQ ID NO: 423418 - RNA, 22 nt, Homo sapiens
uacuacccgagcccagcuacau

SEQ ID NO: 423419 - RNA, 12 nt, Homo sapiens
uacuacucucca

SEQ ID NO: 423420 - RNA, 17 nt, Homo sapiens
uacuagcagucacuuga

SEQ ID NO: 423421 - RNA, 16 nt, Homo sapiens
uacuauaaaaaacauu

SEQ ID NO: 423422 - RNA, 20 nt, Homo sapiens
uacuauuauggaauuacucu

SEQ ID NO: 423423 - RNA, 21 nt, Homo sapiens
uacuauuauggaauuacucua

SEQ ID NO: 423424 - RNA, 20 nt, Homo sapiens
uacuauucuguuaaaaucag

SEQ ID NO: 423425 - RNA, 17 nt, Homo sapiens
uacuauugcuaguacua

SEQ ID NO: 423426 - RNA, 14 nt, Homo sapiens
uacucaaacauguu

SEQ ID NO: 423427 - RNA, 18 nt, Homo sapiens
uacucuaugugauuuauu

SEQ ID NO: 423428 - RNA, 14 nt, Homo sapiens
uacucuccuagaga

SEQ ID NO: 423429 - RNA, 18 nt, Homo sapiens
uacucugauacucuuuaa

SEQ ID NO: 423430 - RNA, 13 nt, Homo sapiens
uacucugcacuau

SEQ ID NO: 423431 - RNA, 13 nt, Homo sapiens
uacucuguguaaa

SEQ ID NO: 423432 - RNA, 15 nt, Homo sapiens
uacucuuuguagcaa

SEQ ID NO: 423433 - RNA, 16 nt, Homo sapiens
uacucuuuucccaaga

SEQ ID NO: 423434 - RNA, 23 nt, Homo sapiens
uacugaacaaucaaagcacuugg

SEQ ID NO: 423435 - RNA, 21 nt, Homo sapiens
cuguggaacacuaaagagcua

SEQ ID NO: 423436 - RNA, 17 nt, Homo sapiens
cuguggcaaaugccagg

SEQ ID NO: 423437 - RNA, 22 nt, Homo sapiens
cugugggucgcgugaugcgcau

SEQ ID NO: 423438 - RNA, 23 nt, Homo sapiens
cugugguugcagccugaccaaaa

SEQ ID NO: 423439 - RNA, 19 nt, Homo sapiens
cugugguuugcuccagaau

SEQ ID NO: 423440 - RNA, 23 nt, Homo sapiens
cugugguuuguuaucaguacaau

SEQ ID NO: 423441 - RNA, 14 nt, Homo sapiens
cuguguagcucuca

SEQ ID NO: 423442 - RNA, 23 nt, Homo sapiens
cuguguagcucucacaugcacag

SEQ ID NO: 423443 - RNA, 18 nt, Homo sapiens
cuguguaucucagcauuu

SEQ ID NO: 423444 - RNA, 15 nt, Homo sapiens
cuguguauucuaguu

SEQ ID NO: 423445 - RNA, 23 nt, Homo sapiens
cugugugagcguguccacagagu

SEQ ID NO: 423446 - RNA, 19 nt, Homo sapiens
cugugugaugaacuuucuc

SEQ ID NO: 423447 - RNA, 23 nt, Homo sapiens
cuguguggacugugaugccacac

SEQ ID NO: 423448 - RNA, 22 nt, Homo sapiens
cugugugggauacuuaguggua

SEQ ID NO: 423449 - RNA, 20 nt, Homo sapiens
cugugugucgcuuaugucua

SEQ ID NO: 423450 - RNA, 16 nt, Homo sapiens
cuguguguggggccca

SEQ ID NO: 423451 - RNA, 15 nt, Homo sapiens
cuguguguugccaca

SEQ ID NO: 423452 - RNA, 20 nt, Homo sapiens
cuguguuuuuccuccauaaa

SEQ ID NO: 423453 - RNA, 15 nt, Homo sapiens
cuguuaaaugaacuu

SEQ ID NO: 423454 - RNA, 23 nt, Homo sapiens
cuguuaacuaguguuucugcaga

SEQ ID NO: 423455 - RNA, 15 nt, Homo sapiens
cuguuaauaguacua

SEQ ID NO: 423456 - RNA, 18 nt, Homo sapiens
cuguuaauaguacuauua

SEQ ID NO: 423457 - RNA, 17 nt, Homo sapiens
cuguuacuuaccuaaac

SEQ ID NO: 423458 - RNA, 16 nt, Homo sapiens
cuguuagucauuugcu

SEQ ID NO: 423459 - RNA, 18 nt, Homo sapiens
cuguuagugacagagccc

SEQ ID NO: 423460 - RNA, 13 nt, Homo sapiens
cuguuaugccaaa

SEQ ID NO: 423461 - RNA, 15 nt, Homo sapiens
cuguucaaaauucca

SEQ ID NO: 423462 - RNA, 15 nt, Homo sapiens
cuguucacuuuucaa

SEQ ID NO: 423463 - RNA, 13 nt, Homo sapiens
cuguucauggcac

SEQ ID NO: 423464 - RNA, 19 nt, Homo sapiens
cuguucauuguaagcacuu

SEQ ID NO: 423465 - RNA, 16 nt, Homo sapiens
cuguucccaucccuga

SEQ ID NO: 423466 - RNA, 13 nt, Homo sapiens
cuguucccaugag

SEQ ID NO: 423467 - RNA, 11 nt, Homo sapiens
cuguuccugcc

SEQ ID NO: 423468 - RNA, 17 nt, Homo sapiens
cuguuccuuaugauauu

SEQ ID NO: 423469 - RNA, 21 nt, Homo sapiens
cuguuccuuaugauauucuca

SEQ ID NO: 423470 - RNA, 22 nt, Homo sapiens
cuguucucagagcuccacagaa

SEQ ID NO: 423471 - RNA, 18 nt, Homo sapiens
cuguucuuuaagacuuuu

SEQ ID NO: 423472 - RNA, 22 nt, Homo sapiens
cuguugaaaauuauuuuaaaca

SEQ ID NO: 423473 - RNA, 23 nt, Homo sapiens
cuguugagaugggggacugagag

SEQ ID NO: 423474 - RNA, 14 nt, Homo sapiens
cuguugcaccucag

SEQ ID NO: 423475 - RNA, 11 nt, Homo sapiens
cuguugccaca

SEQ ID NO: 423476 - RNA, 23 nt, Homo sapiens
cuguugccacacuuucacugggg

SEQ ID NO: 423477 - RNA, 20 nt, Homo sapiens
cuguuucccuucccuuccac

SEQ ID NO: 423478 - RNA, 20 nt, Homo sapiens
cuguuucuaauuugcugcug

SEQ ID NO: 423479 - RNA, 15 nt, Homo sapiens
cuguuucugaaccau

SEQ ID NO: 423480 - RNA, 13 nt, Homo sapiens
cuguuuguuaaaa

SEQ ID NO: 423481 - RNA, 17 nt, Homo sapiens
cuguuuuaugugcacac

SEQ ID NO: 423482 - RNA, 20 nt, Homo sapiens
cuguuuugcauggaguauua

SEQ ID NO: 423483 - RNA, 16 nt, Homo sapiens
cuuaaaaaauguccau

SEQ ID NO: 423484 - RNA, 16 nt, Homo sapiens
cuuaaaaaguuauaac

SEQ ID NO: 423485 - RNA, 23 nt, Homo sapiens
cuuaaacuguguggacugugaug

SEQ ID NO: 423486 - RNA, 23 nt, Homo sapiens
cuuaaagcuuguuuguucuaguu

SEQ ID NO: 423487 - RNA, 16 nt, Homo sapiens
cuuaaaggcuguggua

SEQ ID NO: 423488 - RNA, 13 nt, Homo sapiens
cuuaaaucacuga

SEQ ID NO: 423489 - RNA, 21 nt, Homo sapiens
cuuaaauggaauuauuuugaa

SEQ ID NO: 423490 - RNA, 16 nt, Homo sapiens
cuuaaccccucugagc

SEQ ID NO: 423491 - RNA, 17 nt, Homo sapiens
cuuaacggcuccaggau

SEQ ID NO: 423492 - RNA, 22 nt, Homo sapiens
cuuaacuauccuaacaagccuu

SEQ ID NO: 423493 - RNA, 18 nt, Homo sapiens
cuuaacugcauuuuuaga

SEQ ID NO: 423494 - RNA, 12 nt, Homo sapiens
cuuaagcacuuu

SEQ ID NO: 423495 - RNA, 17 nt, Homo sapiens
cuuaaggcuugaaguaa

SEQ ID NO: 423496 - RNA, 23 nt, Homo sapiens
cuuaaggcuugaaguaaccuuau

SEQ ID NO: 423497 - RNA, 23 nt, Homo sapiens
cuuaaggucauaaaaauauuguu

SEQ ID NO: 423498 - RNA, 22 nt, Homo sapiens
cuuaaguacugaaauacauaug

SEQ ID NO: 423499 - RNA, 15 nt, Homo sapiens
cuuaauaaacucaca

SEQ ID NO: 423500 - RNA, 16 nt, Homo sapiens
cuuaauaaacucacaa

SEQ ID NO: 423501 - RNA, 17 nt, Homo sapiens
cuuaauaacaacagauc

SEQ ID NO: 423502 - RNA, 14 nt, Homo sapiens
cuuaauaugaucug

SEQ ID NO: 423503 - RNA, 21 nt, Homo sapiens
cuuaaugucagucuacaggcc

SEQ ID NO: 423504 - RNA, 23 nt, Homo sapiens
cuuaaugucagucuacaggccuu

SEQ ID NO: 423505 - RNA, 22 nt, Homo sapiens
cuuaauguucugaauaauuucu

SEQ ID NO: 423506 - RNA, 16 nt, Homo sapiens
cuuaauuaaauaucaa

SEQ ID NO: 423507 - RNA, 20 nt, Homo sapiens
cuuacaacugcucuagauua

SEQ ID NO: 423508 - RNA, 15 nt, Homo sapiens
cuuacaauucccugc

SEQ ID NO: 423509 - RNA, 20 nt, Homo sapiens
cuuacacuuuaugcacaaaa

SEQ ID NO: 423510 - RNA, 18 nt, Homo sapiens
cuuacagucagcacagaa

SEQ ID NO: 423511 - RNA, 20 nt, Homo sapiens
cuuacauuauuacuccuugc

SEQ ID NO: 423512 - RNA, 19 nt, Homo sapiens
cuucugacacugaaacuuc

SEQ ID NO: 423513 - RNA, 22 nt, Homo sapiens
cuucugaugucucuaaagcacu

SEQ ID NO: 423514 - RNA, 11 nt, Homo sapiens
cuucugccuaa

SEQ ID NO: 423515 - RNA, 15 nt, Homo sapiens
cuucugcugcccuga

SEQ ID NO: 423516 - RNA, 21 nt, Homo sapiens
cuucugucucuaugagagaua

SEQ ID NO: 423517 - RNA, 21 nt, Homo sapiens
cuucugugucugucaccacau

SEQ ID NO: 423518 - RNA, 21 nt, Homo sapiens
cuucuuaauauaacugccuua

SEQ ID NO: 423519 - RNA, 17 nt, Homo sapiens
cuucuucauccauagac

SEQ ID NO: 423520 - RNA, 18 nt, Homo sapiens
cuucuucccucccuaucu

SEQ ID NO: 423521 - RNA, 14 nt, Homo sapiens
cuucuucucaagca

SEQ ID NO: 423522 - RNA, 16 nt, Homo sapiens
cuucuugaaacagccu

SEQ ID NO: 423523 - RNA, 15 nt, Homo sapiens
cuugaaaguagcaau

SEQ ID NO: 423524 - RNA, 22 nt, Homo sapiens
cuugaaaugaugguaaguuaau

SEQ ID NO: 423525 - RNA, 13 nt, Homo sapiens
cuugaacugagac

SEQ ID NO: 423526 - RNA, 16 nt, Homo sapiens
cuugaagaauauuguu

SEQ ID NO: 423527 - RNA, 19 nt, Homo sapiens
cuugaagggggauaugaau

SEQ ID NO: 423528 - RNA, 20 nt, Homo sapiens
cuugaagggggauaugaaug

SEQ ID NO: 423529 - RNA, 19 nt, Homo sapiens
cuugaagugaucauuucac

SEQ ID NO: 423530 - RNA, 23 nt, Homo sapiens
cuugaauguaagaacaugaccuc

SEQ ID NO: 423531 - RNA, 18 nt, Homo sapiens
cuugacccccuugagggu

SEQ ID NO: 423532 - RNA, 13 nt, Homo sapiens
cuugagacccucu

SEQ ID NO: 423533 - RNA, 21 nt, Homo sapiens
cuugagagaaaaagugccccu

SEQ ID NO: 423534 - RNA, 21 nt, Homo sapiens
cuugagaggaugaauguaugu

SEQ ID NO: 423535 - RNA, 15 nt, Homo sapiens
cuugagcaaauuacc

SEQ ID NO: 423536 - RNA, 21 nt, Homo sapiens
cuugagcagaccgugauuugg

SEQ ID NO: 423537 - RNA, 20 nt, Homo sapiens
cuugagccaguaauuggucc

SEQ ID NO: 423538 - RNA, 23 nt, Homo sapiens
cuugagcccaggaaguccagaac

SEQ ID NO: 423539 - RNA, 17 nt, Homo sapiens
cuugagccugagccuua

SEQ ID NO: 423540 - RNA, 21 nt, Homo sapiens
cuugaggauuuugaguaucuc

SEQ ID NO: 423541 - RNA, 23 nt, Homo sapiens
cuugaggggcccacagacagauc

SEQ ID NO: 423542 - RNA, 22 nt, Homo sapiens
cuugaggguaauaaacuuagaa

SEQ ID NO: 423543 - RNA, 16 nt, Homo sapiens
cuugauauuuuccaaa

SEQ ID NO: 423544 - RNA, 19 nt, Homo sapiens
cuugaucaugaaucacugc

SEQ ID NO: 423545 - RNA, 12 nt, Homo sapiens
cuugaucauucu

SEQ ID NO: 423546 - RNA, 14 nt, Homo sapiens
cuugaucauucuca

SEQ ID NO: 423547 - RNA, 19 nt, Homo sapiens
cuugaucuccugaccucau

SEQ ID NO: 423548 - RNA, 19 nt, Homo sapiens
cuugaugaauaaacacuuu

SEQ ID NO: 423549 - RNA, 20 nt, Homo sapiens
cuugaugaauaaacacuuuu

SEQ ID NO: 423550 - RNA, 16 nt, Homo sapiens
cuugauggagaaggaa

SEQ ID NO: 423551 - RNA, 20 nt, Homo sapiens
cuugauuagugccuucugcc

SEQ ID NO: 423552 - RNA, 12 nt, Homo sapiens
cuugauugcuca

SEQ ID NO: 423553 - RNA, 21 nt, Homo sapiens
cuugauuuuuuucauuuugcc

SEQ ID NO: 423554 - RNA, 13 nt, Homo sapiens
cuugcaaagccuu

SEQ ID NO: 423555 - RNA, 14 nt, Homo sapiens
cuugcaaagccuuu

SEQ ID NO: 423556 - RNA, 19 nt, Homo sapiens
cuugcaacacacagacaca

SEQ ID NO: 423557 - RNA, 15 nt, Homo sapiens
cuugcaagggaccau

SEQ ID NO: 423558 - RNA, 14 nt, Homo sapiens
cuugcaagucccau

SEQ ID NO: 423559 - RNA, 22 nt, Homo sapiens
cuugcacaggccacuugcucag

SEQ ID NO: 423560 - RNA, 15 nt, Homo sapiens
cuugcacccaugugu

SEQ ID NO: 423561 - RNA, 15 nt, Homo sapiens
cuugcacuauuccac

SEQ ID NO: 423562 - RNA, 12 nt, Homo sapiens
cuugcacuauug

SEQ ID NO: 423563 - RNA, 17 nt, Homo sapiens
cuugcagcuaguuuucu

SEQ ID NO: 423564 - RNA, 12 nt, Homo sapiens
cuugccaauggu

SEQ ID NO: 423565 - RNA, 23 nt, Homo sapiens
cuugccauuuucaagaaagcauu

SEQ ID NO: 423566 - RNA, 17 nt, Homo sapiens
cuugcccagacuacagg

SEQ ID NO: 423567 - RNA, 19 nt, Homo sapiens
cuugcccagacuacagggc

SEQ ID NO: 423568 - RNA, 14 nt, Homo sapiens
cuugcccaugcaca

SEQ ID NO: 423569 - RNA, 14 nt, Homo sapiens
uaggacuacacuga

SEQ ID NO: 423570 - RNA, 23 nt, Homo sapiens
uaggagaccagaagugaauggga

SEQ ID NO: 423571 - RNA, 13 nt, Homo sapiens
uaggagcuuccag

SEQ ID NO: 423572 - RNA, 16 nt, Homo sapiens
uaggaggcugaggcag

SEQ ID NO: 423573 - RNA, 17 nt, Homo sapiens
uaggaguugaguacagu

SEQ ID NO: 423574 - RNA, 20 nt, Homo sapiens
uaggcaauggugaacuguca

SEQ ID NO: 423575 - RNA, 23 nt, Homo sapiens
uaggcagcaagggcugauucuag

SEQ ID NO: 423576 - RNA, 14 nt, Homo sapiens
uaggccaucuguaa

SEQ ID NO: 423577 - RNA, 17 nt, Homo sapiens
uaggcuuuuaaaagcau

SEQ ID NO: 423578 - RNA, 19 nt, Homo sapiens
uagggaauaauuagaaaca

SEQ ID NO: 423579 - RNA, 22 nt, Homo sapiens
uagggacucagggccaugccug

SEQ ID NO: 423580 - RNA, 15 nt, Homo sapiens
uagggaugugugaga

SEQ ID NO: 423581 - RNA, 22 nt, Homo sapiens
uagggcaaagaaucaacaguga

SEQ ID NO: 423582 - RNA, 23 nt, Homo sapiens
uaggguacucaucugacuugaac

SEQ ID NO: 423583 - RNA, 16 nt, Homo sapiens
uaggguggcccuugca

SEQ ID NO: 423584 - RNA, 23 nt, Homo sapiens
uagguaguagaaucucagcacuu

SEQ ID NO: 423585 - RNA, 17 nt, Homo sapiens
uagguauauauaugcca

SEQ ID NO: 423586 - RNA, 14 nt, Homo sapiens
uagguaucauucaa

SEQ ID NO: 423587 - RNA, 17 nt, Homo sapiens
uagguaucauucaacuc

SEQ ID NO: 423588 - RNA, 20 nt, Homo sapiens
uaggugaccccaucucugcu

SEQ ID NO: 423589 - RNA, 17 nt, Homo sapiens
uaggugaggaagcaaaa

SEQ ID NO: 423590 - RNA, 18 nt, Homo sapiens
uaggugggauuacaggug

SEQ ID NO: 423591 - RNA, 19 nt, Homo sapiens
uaggugggauuacaggugc

SEQ ID NO: 423592 - RNA, 16 nt, Homo sapiens
uaggugugacuugaac

SEQ ID NO: 423593 - RNA, 16 nt, Homo sapiens
uagguuaauaaaucaa

SEQ ID NO: 423594 - RNA, 20 nt, Homo sapiens
uagguuaauaaaucaagcca

SEQ ID NO: 423595 - RNA, 15 nt, Homo sapiens
uagguugcacauuca

SEQ ID NO: 423596 - RNA, 19 nt, Homo sapiens
uagguuuaacucagaucac

SEQ ID NO: 423597 - RNA, 13 nt, Homo sapiens
uagguuucaccuc

SEQ ID NO: 423598 - RNA, 12 nt, Homo sapiens
uaguaaagacau

SEQ ID NO: 423599 - RNA, 15 nt, Homo sapiens
uaguacccaccugag

SEQ ID NO: 423600 - RNA, 19 nt, Homo sapiens
uaguaccuguaagcauuuu

SEQ ID NO: 423601 - RNA, 11 nt, Homo sapiens
uaguacuccuu

SEQ ID NO: 423602 - RNA, 13 nt, Homo sapiens
uaguacugggaau

SEQ ID NO: 423603 - RNA, 23 nt, Homo sapiens
uaguacuugggagaccuguaauc

SEQ ID NO: 423604 - RNA, 14 nt, Homo sapiens
uaguagcauuucaa

SEQ ID NO: 423605 - RNA, 17 nt, Homo sapiens
uagucaaggugcucaau

SEQ ID NO: 423606 - RNA, 13 nt, Homo sapiens
uagucaauaucaa

SEQ ID NO: 423607 - RNA, 13 nt, Homo sapiens
uagucaauccaag

SEQ ID NO: 423608 - RNA, 16 nt, Homo sapiens
uagucaauccaagacu

SEQ ID NO: 423609 - RNA, 22 nt, Homo sapiens
uagucauucuuacaauugcacu

SEQ ID NO: 423610 - RNA, 18 nt, Homo sapiens
uaguccuauucuauugca

SEQ ID NO: 423611 - RNA, 20 nt, Homo sapiens
uagucgagcuugggcaauuu

SEQ ID NO: 423612 - RNA, 18 nt, Homo sapiens
uagucuccuuugcacuga

SEQ ID NO: 423613 - RNA, 21 nt, Homo sapiens
uagugcaugaauagauucucu

SEQ ID NO: 423614 - RNA, 19 nt, Homo sapiens
uagugccauuggaauaaua

SEQ ID NO: 423615 - RNA, 11 nt, Homo sapiens
uagugcuucuu

SEQ ID NO: 423616 - RNA, 23 nt, Homo sapiens
uagugcuuuaccuuuauuaauga

SEQ ID NO: 423617 - RNA, 21 nt, Homo sapiens
uaguggcaaaugaaagcauaa

SEQ ID NO: 423618 - RNA, 19 nt, Homo sapiens
uaguggccaaauagcacau

SEQ ID NO: 423619 - RNA, 15 nt, Homo sapiens
uagugguaugucucu

SEQ ID NO: 423620 - RNA, 15 nt, Homo sapiens
uaguggucauuuggu

SEQ ID NO: 423621 - RNA, 17 nt, Homo sapiens
uaguguauaccaccugu

SEQ ID NO: 423622 - RNA, 16 nt, Homo sapiens
uaguuaaacagugcca

SEQ ID NO: 423623 - RNA, 15 nt, Homo sapiens
uaguuagccaucuaa

SEQ ID NO: 423624 - RNA, 17 nt, Homo sapiens
uaguucccucaguguga

SEQ ID NO: 423625 - RNA, 11 nt, Homo sapiens
uaguucuagau

SEQ ID NO: 423626 - RNA, 16 nt, Homo sapiens
uaguucuaucaggaaa

SEQ ID NO: 423627 - RNA, 21 nt, Homo sapiens
uaguucuuaagcauuugcgua

SEQ ID NO: 423628 - RNA, 13 nt, Homo sapiens
uaguugaaaggga

SEQ ID NO: 423629 - RNA, 20 nt, Homo sapiens
uaguugauauguaacaguug

SEQ ID NO: 423630 - RNA, 16 nt, Homo sapiens
uaguugggucugaaag

SEQ ID NO: 423631 - RNA, 17 nt, Homo sapiens
uaguuucugauucacua

SEQ ID NO: 423632 - RNA, 16 nt, Homo sapiens
uaguuuuaguugcaga

SEQ ID NO: 423633 - RNA, 14 nt, Homo sapiens
uauaaaaucuagau

SEQ ID NO: 423634 - RNA, 18 nt, Homo sapiens
uauaaauuugaaauccaa

SEQ ID NO: 423635 - RNA, 22 nt, Homo sapiens
uauaacaugucuuucagcauua

SEQ ID NO: 423636 - RNA, 19 nt, Homo sapiens
uauaacucauggcaggcau

SEQ ID NO: 423637 - RNA, 19 nt, Homo sapiens
uauaacuccuuguuucaga

SEQ ID NO: 423638 - RNA, 12 nt, Homo sapiens
uauaacucugca

SEQ ID NO: 423639 - RNA, 20 nt, Homo sapiens
uauaagcagaagcacauaug

SEQ ID NO: 423640 - RNA, 15 nt, Homo sapiens
uauaagucacaaaga

SEQ ID NO: 423641 - RNA, 14 nt, Homo sapiens
uauaauuaacauaa

SEQ ID NO: 423642 - RNA, 21 nt, Homo sapiens
ucaagggcuagcaucccugag

SEQ ID NO: 423643 - RNA, 17 nt, Homo sapiens
ucaagggcugcuucaaa

SEQ ID NO: 423644 - RNA, 14 nt, Homo sapiens
ucaaggugcucaau

SEQ ID NO: 423645 - RNA, 13 nt, Homo sapiens
ucaaggugggccu

SEQ ID NO: 423646 - RNA, 13 nt, Homo sapiens
ucaaguaauccac

SEQ ID NO: 423647 - RNA, 19 nt, Homo sapiens
ucaaguauuuauucaggaa

SEQ ID NO: 423648 - RNA, 16 nt, Homo sapiens
ucaagucaaucauuuc

SEQ ID NO: 423649 - RNA, 11 nt, Homo sapiens
ucaagugauag

SEQ ID NO: 423650 - RNA, 15 nt, Homo sapiens
ucaaguugcuucuca

SEQ ID NO: 423651 - RNA, 16 nt, Homo sapiens
ucaaguugcuucucau

SEQ ID NO: 423652 - RNA, 15 nt, Homo sapiens
ucaaguugugcuugu

SEQ ID NO: 423653 - RNA, 18 nt, Homo sapiens
ucaaguuugaacucugua

SEQ ID NO: 423654 - RNA, 16 nt, Homo sapiens
ucaauaaaaugugauu

SEQ ID NO: 423655 - RNA, 19 nt, Homo sapiens
ucaauaacuauugcugcuu

SEQ ID NO: 423656 - RNA, 15 nt, Homo sapiens
ucaauaagccagcaa

SEQ ID NO: 423657 - RNA, 21 nt, Homo sapiens
ucaauacuuaaaaauagucuu

SEQ ID NO: 423658 - RNA, 16 nt, Homo sapiens
ucaauaguauuaacua

SEQ ID NO: 423659 - RNA, 14 nt, Homo sapiens
ucaauauuccugaa

SEQ ID NO: 423660 - RNA, 13 nt, Homo sapiens
ucaaucaaacagg

SEQ ID NO: 423661 - RNA, 15 nt, Homo sapiens
ucaaucuucaaugaa

SEQ ID NO: 423662 - RNA, 13 nt, Homo sapiens
ucaaugaacugug

SEQ ID NO: 423663 - RNA, 14 nt, Homo sapiens
ucaaugaacugugc

SEQ ID NO: 423664 - RNA, 12 nt, Homo sapiens
ucaaugaccugu

SEQ ID NO: 423665 - RNA, 13 nt, Homo sapiens
ucaaugaccugua

SEQ ID NO: 423666 - RNA, 11 nt, Homo sapiens
ucaaugaucua

SEQ ID NO: 423667 - RNA, 20 nt, Homo sapiens
ucaaugccucacgagauuug

SEQ ID NO: 423668 - RNA, 16 nt, Homo sapiens
ucaauggaaccaaaua

SEQ ID NO: 423669 - RNA, 19 nt, Homo sapiens
ucaaugugcuguugauucu

SEQ ID NO: 423670 - RNA, 17 nt, Homo sapiens
ucaauguucauuguaau

SEQ ID NO: 423671 - RNA, 18 nt, Homo sapiens
ucaauugcagaugccaaa

SEQ ID NO: 423672 - RNA, 23 nt, Homo sapiens
ucaauuuacuuuuuaaacagugu

SEQ ID NO: 423673 - RNA, 19 nt, Homo sapiens
ucaauuuguucagucuuuc

SEQ ID NO: 423674 - RNA, 17 nt, Homo sapiens
ucacaaaaaaaguaauu

SEQ ID NO: 423675 - RNA, 16 nt, Homo sapiens
ucacaaacuacaaagc

SEQ ID NO: 423676 - RNA, 23 nt, Homo sapiens
ucacaaagaguucuggaaaagaa

SEQ ID NO: 423677 - RNA, 17 nt, Homo sapiens
ucacaaauaaacauaau

SEQ ID NO: 423678 - RNA, 14 nt, Homo sapiens
ucacaacagaucaa

SEQ ID NO: 423679 - RNA, 15 nt, Homo sapiens
ucacaacuccuucca

SEQ ID NO: 423680 - RNA, 14 nt, Homo sapiens
ucacaacucucugg

SEQ ID NO: 423681 - RNA, 17 nt, Homo sapiens
ucacaacucuucuuucc

SEQ ID NO: 423682 - RNA, 22 nt, Homo sapiens
ucacaagaaaaaggaagccacu

SEQ ID NO: 423683 - RNA, 18 nt, Homo sapiens
ucacaaggcauucaagug

SEQ ID NO: 423684 - RNA, 15 nt, Homo sapiens
ucacaaggucaggag

SEQ ID NO: 423685 - RNA, 21 nt, Homo sapiens
ucacacacacagcugggcaaa

SEQ ID NO: 423686 - RNA, 12 nt, Homo sapiens
ucacacacagcc

SEQ ID NO: 423687 - RNA, 14 nt, Homo sapiens
ucacacacauggaa

SEQ ID NO: 423688 - RNA, 18 nt, Homo sapiens
ucacacagggcucuuuga

SEQ ID NO: 423689 - RNA, 14 nt, Homo sapiens
ucacaccugaccaa

SEQ ID NO: 423690 - RNA, 16 nt, Homo sapiens
ucacacucauaacuca

SEQ ID NO: 423691 - RNA, 23 nt, Homo sapiens
ucacacucucuucuuacuguauu

SEQ ID NO: 423692 - RNA, 22 nt, Homo sapiens
ucacagaaaguucuuaaacuca

SEQ ID NO: 423693 - RNA, 13 nt, Homo sapiens
ucacagacuggca

SEQ ID NO: 423694 - RNA, 24 nt, Homo sapiens
ucacagagauuugguuaagcucac

SEQ ID NO: 423695 - RNA, 20 nt, Homo sapiens
ucacagcaguacuugcucaa

SEQ ID NO: 423696 - RNA, 21 nt, Homo sapiens
ucacagggacccacauccaaa

SEQ ID NO: 423697 - RNA, 15 nt, Homo sapiens
ucacauagcacagaa

SEQ ID NO: 423698 - RNA, 14 nt, Homo sapiens
ucacauaugucuua

SEQ ID NO: 423699 - RNA, 22 nt, Homo sapiens
ucacaucucccuuccaccucac

SEQ ID NO: 423700 - RNA, 17 nt, Homo sapiens
ucacaucugcaguggag

SEQ ID NO: 423701 - RNA, 18 nt, Homo sapiens
ucacaugagcuauuucca

SEQ ID NO: 423702 - RNA, 15 nt, Homo sapiens
ucacauguccauuau

SEQ ID NO: 423703 - RNA, 22 nt, Homo sapiens
ucacauguccuauuacugaugu

SEQ ID NO: 423704 - RNA, 11 nt, Homo sapiens
ucacauucccu

SEQ ID NO: 423705 - RNA, 22 nt, Homo sapiens
ucacauucccucucauccaggu

SEQ ID NO: 423706 - RNA, 15 nt, Homo sapiens
ucacauuuguaaaug

SEQ ID NO: 423707 - RNA, 16 nt, Homo sapiens
ucaccaacuacagaaa

SEQ ID NO: 423708 - RNA, 15 nt, Homo sapiens
ucaccaauaacuuca

SEQ ID NO: 423709 - RNA, 17 nt, Homo sapiens
ucaccaccgagacaguu

SEQ ID NO: 423710 - RNA, 18 nt, Homo sapiens
ucaccagagcauuuccaa

SEQ ID NO: 423711 - RNA, 19 nt, Homo sapiens
gaaagaguugccauaauga

SEQ ID NO: 423712 - RNA, 18 nt, Homo sapiens
gaaagaugggcaaaagac

SEQ ID NO: 423713 - RNA, 21 nt, Homo sapiens
gaaagauugauuaaugaacua

SEQ ID NO: 423714 - RNA, 21 nt, Homo sapiens
gaaagcagccaaaccuuuccu

SEQ ID NO: 423715 - RNA, 22 nt, Homo sapiens
gaaagccauauuccagcaguga

SEQ ID NO: 423716 - RNA, 22 nt, Homo sapiens
gaaagcguuuuguuaucuucua

SEQ ID NO: 423717 - RNA, 19 nt, Homo sapiens
gaaagcuuucaugaccaua

SEQ ID NO: 423718 - RNA, 12 nt, Homo sapiens
gaaagcuuugaa

SEQ ID NO: 423719 - RNA, 13 nt, Homo sapiens
gaaaggagacaau

SEQ ID NO: 423720 - RNA, 19 nt, Homo sapiens
gaaaggcaucuaagacauu

SEQ ID NO: 423721 - RNA, 23 nt, Homo sapiens
gaaagggagcagagaaggccagg

SEQ ID NO: 423722 - RNA, 13 nt, Homo sapiens
gaaagggagcuau

SEQ ID NO: 423723 - RNA, 14 nt, Homo sapiens
gaaagguaaucuga

SEQ ID NO: 423724 - RNA, 23 nt, Homo sapiens
gaaagguagcccccgagggaugu

SEQ ID NO: 423725 - RNA, 14 nt, Homo sapiens
gaaaggucaucuca

SEQ ID NO: 423726 - RNA, 17 nt, Homo sapiens
gaaaguccagcacugga

SEQ ID NO: 423727 - RNA, 18 nt, Homo sapiens
gaaaguccagcacuggaa

SEQ ID NO: 423728 - RNA, 16 nt, Homo sapiens
gaaagugacuaccaga

SEQ ID NO: 423729 - RNA, 15 nt, Homo sapiens
gaaauaaauguaccu

SEQ ID NO: 423730 - RNA, 16 nt, Homo sapiens
gaaauaaccugugaau

SEQ ID NO: 423731 - RNA, 19 nt, Homo sapiens
gaaauacccaacgcacaaa

SEQ ID NO: 423732 - RNA, 13 nt, Homo sapiens
gaaauacuuucag

SEQ ID NO: 423733 - RNA, 16 nt, Homo sapiens
gaaauaguaccuucaa

SEQ ID NO: 423734 - RNA, 20 nt, Homo sapiens
gaaauauaacaaguggguga

SEQ ID NO: 423735 - RNA, 21 nt, Homo sapiens
gaaauauaacaagugggugaa

SEQ ID NO: 423736 - RNA, 22 nt, Homo sapiens
gaaauauauauguguguguaug

SEQ ID NO: 423737 - RNA, 17 nt, Homo sapiens
gaaauaugaagcacuuu

SEQ ID NO: 423738 - RNA, 14 nt, Homo sapiens
gaaauauucacaag

SEQ ID NO: 423739 - RNA, 14 nt, Homo sapiens
gaaaucauacugua

SEQ ID NO: 423740 - RNA, 18 nt, Homo sapiens
gaaaucauugugugucuu

SEQ ID NO: 423741 - RNA, 19 nt, Homo sapiens
gaaaucauugugugucuuc

SEQ ID NO: 423742 - RNA, 18 nt, Homo sapiens
gaaaugagaaacuuugau

SEQ ID NO: 423743 - RNA, 17 nt, Homo sapiens
gaaaugagcugcacucc

SEQ ID NO: 423744 - RNA, 13 nt, Homo sapiens
gaaaugccagugu

SEQ ID NO: 423745 - RNA, 20 nt, Homo sapiens
gaaaugcugccugccugucu

SEQ ID NO: 423746 - RNA, 24 nt, Homo sapiens
gaaaugggaguagggggguggaca

SEQ ID NO: 423747 - RNA, 21 nt, Homo sapiens
gaaaugggcuuuaacaaaaca

SEQ ID NO: 423748 - RNA, 22 nt, Homo sapiens
gaaauguauuuugaaaacacuu

SEQ ID NO: 423749 - RNA, 22 nt, Homo sapiens
gaaaugucuccacccgugucca

SEQ ID NO: 423750 - RNA, 17 nt, Homo sapiens
gaaaugugcaagaguau

SEQ ID NO: 423751 - RNA, 13 nt, Homo sapiens
gaaaugugcugca

SEQ ID NO: 423752 - RNA, 16 nt, Homo sapiens
gaaaugugcugcaaag

SEQ ID NO: 423753 - RNA, 19 nt, Homo sapiens
gaaauguuacauguagaaa

SEQ ID NO: 423754 - RNA, 13 nt, Homo sapiens
gaaauguuuccag

SEQ ID NO: 423755 - RNA, 15 nt, Homo sapiens
gaaauuagggcucua

SEQ ID NO: 423756 - RNA, 23 nt, Homo sapiens
gaaauuagugaguuuccuucuac

SEQ ID NO: 423757 - RNA, 17 nt, Homo sapiens
gaaauuccucuguagaa

SEQ ID NO: 423758 - RNA, 14 nt, Homo sapiens
gaaauucuguggug

SEQ ID NO: 423759 - RNA, 18 nt, Homo sapiens
gaaauugcucauaaucug

SEQ ID NO: 423760 - RNA, 16 nt, Homo sapiens
gaaauuuuaagccaaa

SEQ ID NO: 423761 - RNA, 20 nt, Homo sapiens
gaaauuuuaagccaaaaaca

SEQ ID NO: 423762 - RNA, 21 nt, Homo sapiens
gaaauuuuaucucuucuuccu

SEQ ID NO: 423763 - RNA, 19 nt, Homo sapiens
gaaauuuuggugaaugugg

SEQ ID NO: 423764 - RNA, 19 nt, Homo sapiens
gaacaaaguccacaguuua

SEQ ID NO: 423765 - RNA, 15 nt, Homo sapiens
gaacaagaaagagua

SEQ ID NO: 423766 - RNA, 20 nt, Homo sapiens
gaacaauuuuuuuucuguaa

SEQ ID NO: 423767 - RNA, 13 nt, Homo sapiens
gaacacacugaga

SEQ ID NO: 423768 - RNA, 19 nt, Homo sapiens
gaacacacugagacuugaa

SEQ ID NO: 423769 - RNA, 22 nt, Homo sapiens
gaacacacugagacuugaauca

SEQ ID NO: 423770 - RNA, 13 nt, Homo sapiens
gaacacagaucau

SEQ ID NO: 423771 - RNA, 13 nt, Homo sapiens
gaacacagugccu

SEQ ID NO: 423772 - RNA, 12 nt, Homo sapiens
ucauuacagcuu

SEQ ID NO: 423773 - RNA, 23 nt, Homo sapiens
ucauuaccgucugugauugccau

SEQ ID NO: 423774 - RNA, 20 nt, Homo sapiens
ucauuauaaacgugaugauc

SEQ ID NO: 423775 - RNA, 16 nt, Homo sapiens
ucauuauuuuuuacaa

SEQ ID NO: 423776 - RNA, 22 nt, Homo sapiens
ucauuauuuuuuacaauggcca

SEQ ID NO: 423777 - RNA, 17 nt, Homo sapiens
ucauucaauaucugaca

SEQ ID NO: 423778 - RNA, 14 nt, Homo sapiens
ucauucaguacuua

SEQ ID NO: 423779 - RNA, 16 nt, Homo sapiens
ucauuccaccuuccca

SEQ ID NO: 423780 - RNA, 17 nt, Homo sapiens
ucauuccaccuucccau

SEQ ID NO: 423781 - RNA, 22 nt, Homo sapiens
ucauuccugaaagaaacaguua

SEQ ID NO: 423782 - RNA, 16 nt, Homo sapiens
ucauucuagcaccuug

SEQ ID NO: 423783 - RNA, 19 nt, Homo sapiens
ucauucucaguauccacug

SEQ ID NO: 423784 - RNA, 22 nt, Homo sapiens
ucauucucaguauccacugucu

SEQ ID NO: 423785 - RNA, 22 nt, Homo sapiens
ucauucuuacaauugcacugcu

SEQ ID NO: 423786 - RNA, 18 nt, Homo sapiens
ucauucuuucugcuauau

SEQ ID NO: 423787 - RNA, 22 nt, Homo sapiens
ucauucuuuuaaauguugaaua

SEQ ID NO: 423788 - RNA, 17 nt, Homo sapiens
ucauuguaaucuuucau

SEQ ID NO: 423789 - RNA, 17 nt, Homo sapiens
ucauuguagaaacacag

SEQ ID NO: 423790 - RNA, 22 nt, Homo sapiens
ucauugucccugaaugcuccau

SEQ ID NO: 423791 - RNA, 19 nt, Homo sapiens
ucauugucgcucagcaaua

SEQ ID NO: 423792 - RNA, 21 nt, Homo sapiens
ucauuuauuauuucaauguga

SEQ ID NO: 423793 - RNA, 18 nt, Homo sapiens
ucauuugcagcugcuggu

SEQ ID NO: 423794 - RNA, 15 nt, Homo sapiens
ucauuuguucauuaa

SEQ ID NO: 423795 - RNA, 23 nt, Homo sapiens
ucauuuuaacuuuaucacauuau

SEQ ID NO: 423796 - RNA, 21 nt, Homo sapiens
ucauuuugccaaaaaggggua

SEQ ID NO: 423797 - RNA, 15 nt, Homo sapiens
uccaaaaacagugau

SEQ ID NO: 423798 - RNA, 22 nt, Homo sapiens
uccaaaaauuauuauaagcauu

SEQ ID NO: 423799 - RNA, 18 nt, Homo sapiens
uccaaaauuccaucccua

SEQ ID NO: 423800 - RNA, 11 nt, Homo sapiens
uccaaaccaca

SEQ ID NO: 423801 - RNA, 17 nt, Homo sapiens
uccaaagacuguacugg

SEQ ID NO: 423802 - RNA, 20 nt, Homo sapiens
uccaaagcacauugaaagag

SEQ ID NO: 423803 - RNA, 14 nt, Homo sapiens
uccaaaugagccac

SEQ ID NO: 423804 - RNA, 20 nt, Homo sapiens
uccaaauuacagcauauaua

SEQ ID NO: 423805 - RNA, 15 nt, Homo sapiens
uccaaauucuuuauu

SEQ ID NO: 423806 - RNA, 17 nt, Homo sapiens
uccaacaccacagacac

SEQ ID NO: 423807 - RNA, 19 nt, Homo sapiens
uccaacagugagucuguca

SEQ ID NO: 423808 - RNA, 13 nt, Homo sapiens
uccaaccacucau

SEQ ID NO: 423809 - RNA, 13 nt, Homo sapiens
uccaacccaugca

SEQ ID NO: 423810 - RNA, 19 nt, Homo sapiens
uccaaccugccugugcaug

SEQ ID NO: 423811 - RNA, 20 nt, Homo sapiens
uccaacguggggcagcacag

SEQ ID NO: 423812 - RNA, 12 nt, Homo sapiens
uccaacuauguc

SEQ ID NO: 423813 - RNA, 20 nt, Homo sapiens
uccaacuuuuaccuggcugc

SEQ ID NO: 423814 - RNA, 20 nt, Homo sapiens
uccaagcaaaaacaaauggg

SEQ ID NO: 423815 - RNA, 23 nt, Homo sapiens
uccaagccugaccacgcuuucua

SEQ ID NO: 423816 - RNA, 16 nt, Homo sapiens
uccaagucaacacucu

SEQ ID NO: 423817 - RNA, 20 nt, Homo sapiens
uccaagucucucugugaaua

SEQ ID NO: 423818 - RNA, 19 nt, Homo sapiens
uccaaguuuuaauuuuuaa

SEQ ID NO: 423819 - RNA, 15 nt, Homo sapiens
uccaaucuccaucac

SEQ ID NO: 423820 - RNA, 17 nt, Homo sapiens
uccaauuacuccaccau

SEQ ID NO: 423821 - RNA, 19 nt, Homo sapiens
uccaauuuggaaucuucuc

SEQ ID NO: 423822 - RNA, 11 nt, Homo sapiens
uccacaaggaa

SEQ ID NO: 423823 - RNA, 21 nt, Homo sapiens
uccacacagccugucuucaga

SEQ ID NO: 423824 - RNA, 19 nt, Homo sapiens
uccacagaauacaagccac

SEQ ID NO: 423825 - RNA, 14 nt, Homo sapiens
uccacagaguauaa

SEQ ID NO: 423826 - RNA, 19 nt, Homo sapiens
uccacagggauaccuuaau

SEQ ID NO: 423827 - RNA, 14 nt, Homo sapiens
uccacagugcugcu

SEQ ID NO: 423828 - RNA, 17 nt, Homo sapiens
uccacaguguugccaga

SEQ ID NO: 423829 - RNA, 17 nt, Homo sapiens
uccacaguuaggccaag

SEQ ID NO: 423830 - RNA, 14 nt, Homo sapiens
uccacaguugucag

SEQ ID NO: 423831 - RNA, 15 nt, Homo sapiens
uccacaguugucagu

SEQ ID NO: 423832 - RNA, 22 nt, Homo sapiens
uccacauaaaaagaaaugugaa

SEQ ID NO: 423833 - RNA, 16 nt, Homo sapiens
uccaccaaauucugaa

SEQ ID NO: 423834 - RNA, 15 nt, Homo sapiens
uccaccaaguucuca

SEQ ID NO: 423835 - RNA, 15 nt, Homo sapiens
uccacccagugcugc

SEQ ID NO: 423836 - RNA, 17 nt, Homo sapiens
uccacccccuccuguca

SEQ ID NO: 423837 - RNA, 19 nt, Homo sapiens
uccacccccuccugucacc

SEQ ID NO: 423838 - RNA, 22 nt, Homo sapiens
uccaccuccucuccaccugcug

SEQ ID NO: 423839 - RNA, 21 nt, Homo sapiens
uccaccuguaaaaacugcaca

SEQ ID NO: 423840 - RNA, 15 nt, Homo sapiens
uccacggcuggauac

SEQ ID NO: 423841 - RNA, 13 nt, Homo sapiens
uccacguaucuuu

SEQ ID NO: 423842 - RNA, 22 nt, Homo sapiens
uccacuaggugcccagucuuga

SEQ ID NO: 423843 - RNA, 17 nt, Homo sapiens
uccacucccacugccag

SEQ ID NO: 423844 - RNA, 17 nt, Homo sapiens
uccacuuugaguaccaa

SEQ ID NO: 423845 - RNA, 22 nt, Homo sapiens
uccagacccugccugagcccag

SEQ ID NO: 423846 - RNA, 16 nt, Homo sapiens
uccagaggugagggag

SEQ ID NO: 423847 - RNA, 16 nt, Homo sapiens
uccagaggugauggua

SEQ ID NO: 423848 - RNA, 15 nt, Homo sapiens
uccagauauuucaca

SEQ ID NO: 423849 - RNA, 17 nt, Homo sapiens
gacacaggggacacuga

SEQ ID NO: 423850 - RNA, 16 nt, Homo sapiens
gacacaguuguuucag

SEQ ID NO: 423851 - RNA, 13 nt, Homo sapiens
gacacaugcuguu

SEQ ID NO: 423852 - RNA, 17 nt, Homo sapiens
gacaccaagaaaccacu

SEQ ID NO: 423853 - RNA, 22 nt, Homo sapiens
gacaccaagaaaccacugggca

SEQ ID NO: 423854 - RNA, 15 nt, Homo sapiens
gacaccaccaaggcu

SEQ ID NO: 423855 - RNA, 14 nt, Homo sapiens
gacacccaacacuu

SEQ ID NO: 423856 - RNA, 15 nt, Homo sapiens
gacacccaacacuuu

SEQ ID NO: 423857 - RNA, 19 nt, Homo sapiens
gacacugaaggcaaaucuc

SEQ ID NO: 423858 - RNA, 23 nt, Homo sapiens
gacagaaggccuugaagaauuug

SEQ ID NO: 423859 - RNA, 13 nt, Homo sapiens
gacagagucucac

SEQ ID NO: 423860 - RNA, 20 nt, Homo sapiens
gacagaucaauggcgcagug

SEQ ID NO: 423861 - RNA, 23 nt, Homo sapiens
gacagauuccaggcgaugugcaa

SEQ ID NO: 423862 - RNA, 17 nt, Homo sapiens
gacagcaagggcuugca

SEQ ID NO: 423863 - RNA, 17 nt, Homo sapiens
gacagcuaggcugagau

SEQ ID NO: 423864 - RNA, 17 nt, Homo sapiens
gacagcucuuccccacc

SEQ ID NO: 423865 - RNA, 21 nt, Homo sapiens
gacagcugcuucugugcauuu

SEQ ID NO: 423866 - RNA, 16 nt, Homo sapiens
gacaggagccacaggg

SEQ ID NO: 423867 - RNA, 15 nt, Homo sapiens
gacaguaaagaccau

SEQ ID NO: 423868 - RNA, 15 nt, Homo sapiens
gacaguaaaucucac

SEQ ID NO: 423869 - RNA, 16 nt, Homo sapiens
gacaguaucacugucu

SEQ ID NO: 423870 - RNA, 15 nt, Homo sapiens
gacaguauccacaau

SEQ ID NO: 423871 - RNA, 17 nt, Homo sapiens
gacaguguuuucuggga

SEQ ID NO: 423872 - RNA, 16 nt, Homo sapiens
gacauacccucuaaaa

SEQ ID NO: 423873 - RNA, 17 nt, Homo sapiens
gacauauaucuauuaca

SEQ ID NO: 423874 - RNA, 13 nt, Homo sapiens
gacauauuugaau

SEQ ID NO: 423875 - RNA, 16 nt, Homo sapiens
gacaucaggugaucca

SEQ ID NO: 423876 - RNA, 19 nt, Homo sapiens
gacaucuuaggcuggccag

SEQ ID NO: 423877 - RNA, 12 nt, Homo sapiens
gacaucuucaau

SEQ ID NO: 423878 - RNA, 14 nt, Homo sapiens
gacaugcacuauga

SEQ ID NO: 423879 - RNA, 14 nt, Homo sapiens
gacaugggccuccc

SEQ ID NO: 423880 - RNA, 22 nt, Homo sapiens
gacauguccccauggcuguggg

SEQ ID NO: 423881 - RNA, 17 nt, Homo sapiens
gacaugugacaucuacc

SEQ ID NO: 423882 - RNA, 16 nt, Homo sapiens
gacauguggggccagg

SEQ ID NO: 423883 - RNA, 17 nt, Homo sapiens
gacauucuucacugucu

SEQ ID NO: 423884 - RNA, 24 nt, Homo sapiens
gaccaaaugccugguaccagagga

SEQ ID NO: 423885 - RNA, 14 nt, Homo sapiens
gaccaacuuccugu

SEQ ID NO: 423886 - RNA, 23 nt, Homo sapiens
gaccaauugcccugccaggcugu

SEQ ID NO: 423887 - RNA, 23 nt, Homo sapiens
gaccacacuuccuguccagagag

SEQ ID NO: 423888 - RNA, 21 nt, Homo sapiens
gaccacagcagggauugggau

SEQ ID NO: 423889 - RNA, 19 nt, Homo sapiens
gaccaccucucaauauuca

SEQ ID NO: 423890 - RNA, 12 nt, Homo sapiens
gaccacuccugu

SEQ ID NO: 423891 - RNA, 17 nt, Homo sapiens
gaccagaagcauuucac

SEQ ID NO: 423892 - RNA, 14 nt, Homo sapiens
gaccagcccggcca

SEQ ID NO: 423893 - RNA, 14 nt, Homo sapiens
gaccaggccaccau

SEQ ID NO: 423894 - RNA, 17 nt, Homo sapiens
gaccaguuguugauaac

SEQ ID NO: 423895 - RNA, 16 nt, Homo sapiens
gaccaguuuaccugaa

SEQ ID NO: 423896 - RNA, 17 nt, Homo sapiens
gaccaguuuuguaucaa

SEQ ID NO: 423897 - RNA, 18 nt, Homo sapiens
gaccaguuuuguaucaaa

SEQ ID NO: 423898 - RNA, 20 nt, Homo sapiens
gaccauaaaggcauggcauu

SEQ ID NO: 423899 - RNA, 15 nt, Homo sapiens
gaccauucauaccca

SEQ ID NO: 423900 - RNA, 17 nt, Homo sapiens
gacccacacugcuacac

SEQ ID NO: 423901 - RNA, 13 nt, Homo sapiens
gacccaccuucaa

SEQ ID NO: 423902 - RNA, 11 nt, Homo sapiens
gccagugacag

SEQ ID NO: 423903 - RNA, 22 nt, Homo sapiens
gccaguggagacuggaacacaa

SEQ ID NO: 423904 - RNA, 16 nt, Homo sapiens
gccauaaaccaauaaa

SEQ ID NO: 423905 - RNA, 14 nt, Homo sapiens
gccauaacuugaaa

SEQ ID NO: 423906 - RNA, 17 nt, Homo sapiens
gccauaauucuaaguua

SEQ ID NO: 423907 - RNA, 19 nt, Homo sapiens
gccauaccugguaagcaaa

SEQ ID NO: 423908 - RNA, 23 nt, Homo sapiens
gccauaccugguaagcaaaaacu

SEQ ID NO: 423909 - RNA, 18 nt, Homo sapiens
gccauacugccuuugcag

SEQ ID NO: 423910 - RNA, 14 nt, Homo sapiens
gccauagcuugauu

SEQ ID NO: 423911 - RNA, 21 nt, Homo sapiens
gccaucaauuuuaacauuuga

SEQ ID NO: 423912 - RNA, 18 nt, Homo sapiens
gccaucaucagcuuaauu

SEQ ID NO: 423913 - RNA, 12 nt, Homo sapiens
gccaucaugccu

SEQ ID NO: 423914 - RNA, 18 nt, Homo sapiens
gccauccuaaaagccacc

SEQ ID NO: 423915 - RNA, 14 nt, Homo sapiens
gccaucucugaacu

SEQ ID NO: 423916 - RNA, 19 nt, Homo sapiens
gccaucuguaaauauccca

SEQ ID NO: 423917 - RNA, 19 nt, Homo sapiens
gccaugaggccucagugga

SEQ ID NO: 423918 - RNA, 19 nt, Homo sapiens
gccauggacucuacacugu

SEQ ID NO: 423919 - RNA, 18 nt, Homo sapiens
gccauguaccaguguacu

SEQ ID NO: 423920 - RNA, 19 nt, Homo sapiens
gccauguaccaguguacug

SEQ ID NO: 423921 - RNA, 23 nt, Homo sapiens
gccauguuucaagaaaauggauu

SEQ ID NO: 423922 - RNA, 23 nt, Homo sapiens
gcccaaaucaauaaacugugucu

SEQ ID NO: 423923 - RNA, 18 nt, Homo sapiens
gcccaagguaaacaguuu

SEQ ID NO: 423924 - RNA, 20 nt, Homo sapiens
gcccacacccgacaccagcc

SEQ ID NO: 423925 - RNA, 16 nt, Homo sapiens
gcccacagaggacagu

SEQ ID NO: 423926 - RNA, 14 nt, Homo sapiens
gcccaccugcauca

SEQ ID NO: 423927 - RNA, 13 nt, Homo sapiens
gcccacuucaggg

SEQ ID NO: 423928 - RNA, 18 nt, Homo sapiens
gcccagaaaacugucauu

SEQ ID NO: 423929 - RNA, 19 nt, Homo sapiens
gcccagaaaucauacugua

SEQ ID NO: 423930 - RNA, 17 nt, Homo sapiens
gcccagacccccagugu

SEQ ID NO: 423931 - RNA, 19 nt, Homo sapiens
gcccagcaaggaccaguga

SEQ ID NO: 423932 - RNA, 13 nt, Homo sapiens
gcccagcggcccc

SEQ ID NO: 423933 - RNA, 22 nt, Homo sapiens
gcccagcggccccucccacaca

SEQ ID NO: 423934 - RNA, 12 nt, Homo sapiens
gcccagcuacau

SEQ ID NO: 423935 - RNA, 16 nt, Homo sapiens
gcccagcuacauuccu

SEQ ID NO: 423936 - RNA, 18 nt, Homo sapiens
gcccaggcaacaguacuu

SEQ ID NO: 423937 - RNA, 17 nt, Homo sapiens
gcccaggccugccuguu

SEQ ID NO: 423938 - RNA, 14 nt, Homo sapiens
gcccaggcucugcu

SEQ ID NO: 423939 - RNA, 20 nt, Homo sapiens
gcccaggcuggagggcagug

SEQ ID NO: 423940 - RNA, 18 nt, Homo sapiens
gcccaggcuggagugcaa

SEQ ID NO: 423941 - RNA, 20 nt, Homo sapiens
gcccaggcuggagugcaacg

SEQ ID NO: 423942 - RNA, 19 nt, Homo sapiens
gcccaggcuggagugcaau

SEQ ID NO: 423943 - RNA, 20 nt, Homo sapiens
gcccaggcuggagugcaaug

SEQ ID NO: 423944 - RNA, 19 nt, Homo sapiens
gcccaggcuggagugcagu

SEQ ID NO: 423945 - RNA, 20 nt, Homo sapiens
gcccaggcuggagugcagug

SEQ ID NO: 423946 - RNA, 20 nt, Homo sapiens
gcccaggucccagugccauu

SEQ ID NO: 423947 - RNA, 17 nt, Homo sapiens
gcccagguuacaaagac

SEQ ID NO: 423948 - RNA, 17 nt, Homo sapiens
gcccagucccuggagcu

SEQ ID NO: 423949 - RNA, 14 nt, Homo sapiens
gcccauaucuguga

SEQ ID NO: 423950 - RNA, 18 nt, Homo sapiens
gcccaucauacgcauggu

SEQ ID NO: 423951 - RNA, 22 nt, Homo sapiens
gcccaucaucucugccuuugag

SEQ ID NO: 423952 - RNA, 15 nt, Homo sapiens
gcccauccaucugcu

SEQ ID NO: 423953 - RNA, 23 nt, Homo sapiens
gcccaugggauaugugguguaua

SEQ ID NO: 423954 - RNA, 16 nt, Homo sapiens
gccccaacuccagggg

SEQ ID NO: 423955 - RNA, 22 nt, Homo sapiens
gccccacccaguuucuggaaaa

SEQ ID NO: 423956 - RNA, 13 nt, Homo sapiens
gccccacuugaag

SEQ ID NO: 423957 - RNA, 23 nt, Homo sapiens
gccccagagcuguuuauggccuc

SEQ ID NO: 423958 - RNA, 20 nt, Homo sapiens
gccccagaugcgcugugcca

SEQ ID NO: 423959 - RNA, 18 nt, Homo sapiens
gccccagcgagucuggag

SEQ ID NO: 423960 - RNA, 21 nt, Homo sapiens
gcccccagauagagcugggug

SEQ ID NO: 423961 - RNA, 17 nt, Homo sapiens
gcccccagcugcuccuc

SEQ ID NO: 423962 - RNA, 14 nt, Homo sapiens
gccccccuucccac

SEQ ID NO: 423963 - RNA, 21 nt, Homo sapiens
gcccccgagcugggggccaug

SEQ ID NO: 423964 - RNA, 15 nt, Homo sapiens
gcccccucagggaug

SEQ ID NO: 423965 - RNA, 16 nt, Homo sapiens
gccccgccccccagag

SEQ ID NO: 423966 - RNA, 14 nt, Homo sapiens
gccccgugaacuca

SEQ ID NO: 423967 - RNA, 20 nt, Homo sapiens
gccccucagugguuuccucg

SEQ ID NO: 423968 - RNA, 20 nt, Homo sapiens
gccccuccccaacuccuucc

SEQ ID NO: 423969 - RNA, 21 nt, Homo sapiens
gccccucgcugcugcuacuac

SEQ ID NO: 423970 - RNA, 20 nt, Homo sapiens
gccccucucuguuuacccuc

SEQ ID NO: 423971 - RNA, 17 nt, Homo sapiens
gccccucugcccagcuu

SEQ ID NO: 423972 - RNA, 18 nt, Homo sapiens
gcccgacagccuggcaca

SEQ ID NO: 423973 - RNA, 21 nt, Homo sapiens
gcccgcugcgugccaucacuc

SEQ ID NO: 423974 - RNA, 16 nt, Homo sapiens
gcccgggccccuggca

SEQ ID NO: 423975 - RNA, 16 nt, Homo sapiens
gcccggggcagcugcc

SEQ ID NO: 423976 - RNA, 22 nt, Homo sapiens
gcccuaagagugucacugagcu

SEQ ID NO: 423977 - RNA, 16 nt, Homo sapiens
gcccuaagggacuuaa

SEQ ID NO: 423978 - RNA, 21 nt, Homo sapiens
gcccuaggcuacccuugccaa

SEQ ID NO: 423979 - RNA, 22 nt, Homo sapiens
gcccucaauaagccagcaaacc

SEQ ID NO: 423980 - RNA, 12 nt, Homo sapiens
gcccucacagag

SEQ ID NO: 423981 - RNA, 19 nt, Homo sapiens
gcccucaggggacuugaau

SEQ ID NO: 423982 - RNA, 18 nt, Homo sapiens
gcccuccaaaagcacuua

SEQ ID NO: 423983 - RNA, 20 nt, Homo sapiens
gcccuccccagagcacuggg

SEQ ID NO: 423984 - RNA, 22 nt, Homo sapiens
gcccucccuggcugugagcagc

SEQ ID NO: 423985 - RNA, 11 nt, Homo sapiens
gcccucgcugc

SEQ ID NO: 423986 - RNA, 14 nt, Homo sapiens
gcccucgcugcuuc

SEQ ID NO: 423987 - RNA, 18 nt, Homo sapiens
gcccugaaccucugaugc

SEQ ID NO: 423988 - RNA, 20 nt, Homo sapiens
gcccugaauccauaaaggca

SEQ ID NO: 423989 - RNA, 17 nt, Homo sapiens
gcccugcaccugugcag

SEQ ID NO: 423990 - RNA, 16 nt, Homo sapiens
gcccuggcuggguuca

SEQ ID NO: 423991 - RNA, 21 nt, Homo sapiens
gcccuuagucauauaaccaaa

SEQ ID NO: 423992 - RNA, 13 nt, Homo sapiens
gcccuuccagugg

SEQ ID NO: 423993 - RNA, 22 nt, Homo sapiens
gcccuuccuccugaagccucug

SEQ ID NO: 423994 - RNA, 20 nt, Homo sapiens
gcccuucuaccuuccugcaa

SEQ ID NO: 423995 - RNA, 18 nt, Homo sapiens
gccgaaaaggauaugcag

SEQ ID NO: 423996 - RNA, 13 nt, Homo sapiens
gccgaaugugcag

SEQ ID NO: 423997 - RNA, 21 nt, Homo sapiens
gccgcauggccccuccaggaa

SEQ ID NO: 423998 - RNA, 13 nt, Homo sapiens
gccgccacuggcu

SEQ ID NO: 423999 - RNA, 15 nt, Homo sapiens
gccgcuaccuggacu

SEQ ID NO: 424000 - RNA, 12 nt, Homo sapiens
gccgcugggaga

SEQ ID NO: 424001 - RNA, 15 nt, Homo sapiens
gccggcuguggagca

SEQ ID NO: 424002 - RNA, 14 nt, Homo sapiens
gccgggcgcagugg

SEQ ID NO: 424003 - RNA, 16 nt, Homo sapiens
ucuugagcaguggcug

SEQ ID NO: 424004 - RNA, 23 nt, Homo sapiens
ucuugcccugagcuuuccgggga

SEQ ID NO: 424005 - RNA, 17 nt, Homo sapiens
ucuugccucucucagga

SEQ ID NO: 424006 - RNA, 17 nt, Homo sapiens
ucuugcucaaguugaug

SEQ ID NO: 424007 - RNA, 17 nt, Homo sapiens
ucuugcugggcauacuu

SEQ ID NO: 424008 - RNA, 22 nt, Homo sapiens
ucuugcuguaacucagacauuc

SEQ ID NO: 424009 - RNA, 15 nt, Homo sapiens
ucuugcuuguaaaaa

SEQ ID NO: 424010 - RNA, 15 nt, Homo sapiens
ucuuggagcugagau

SEQ ID NO: 424011 - RNA, 15 nt, Homo sapiens
ucuuggcuuugccac

SEQ ID NO: 424012 - RNA, 13 nt, Homo sapiens
ucuugggaaaaua

SEQ ID NO: 424013 - RNA, 19 nt, Homo sapiens
ucuugggaagaccagcuuu

SEQ ID NO: 424014 - RNA, 21 nt, Homo sapiens
ucuugggccccagaccccagg

SEQ ID NO: 424015 - RNA, 18 nt, Homo sapiens
ucuuggggugcagcacuu

SEQ ID NO: 424016 - RNA, 18 nt, Homo sapiens
ucuuggguucaagugauu

SEQ ID NO: 424017 - RNA, 22 nt, Homo sapiens
ucuuggugccuuuugugugaug

SEQ ID NO: 424018 - RNA, 23 nt, Homo sapiens
ucuuggugccuuuugugugaugc

SEQ ID NO: 424019 - RNA, 16 nt, Homo sapiens
ucuuguaaaccuggag

SEQ ID NO: 424020 - RNA, 14 nt, Homo sapiens
ucuugucauuccag

SEQ ID NO: 424021 - RNA, 20 nt, Homo sapiens
ucuugucauuccaggugcca

SEQ ID NO: 424022 - RNA, 14 nt, Homo sapiens
ucuuguugcucaaa

SEQ ID NO: 424023 - RNA, 13 nt, Homo sapiens
ucuuguugcugca

SEQ ID NO: 424024 - RNA, 18 nt, Homo sapiens
ucuuguugcugcaucucc

SEQ ID NO: 424025 - RNA, 17 nt, Homo sapiens
ucuuguuuuauauaccu

SEQ ID NO: 424026 - RNA, 22 nt, Homo sapiens
ucuuguuuuuuuuuuccacuua

SEQ ID NO: 424027 - RNA, 14 nt, Homo sapiens
ucuuuaaaggcauc

SEQ ID NO: 424028 - RNA, 20 nt, Homo sapiens
ucuuuaaaggcaucuacaca

SEQ ID NO: 424029 - RNA, 19 nt, Homo sapiens
ucuuuaaaugcguuccuca

SEQ ID NO: 424030 - RNA, 14 nt, Homo sapiens
ucuuuaacauacau

SEQ ID NO: 424031 - RNA, 13 nt, Homo sapiens
cuggaauugcuca

SEQ ID NO: 424032 - RNA, 13 nt, Homo sapiens
cuggaccaaagcu

SEQ ID NO: 424033 - RNA, 14 nt, Homo sapiens
cuggaccaaagcug

SEQ ID NO: 424034 - RNA, 20 nt, Homo sapiens
cuggacuggcccuugcccaa

SEQ ID NO: 424035 - RNA, 19 nt, Homo sapiens
cuggacuuucuccaaaggc

SEQ ID NO: 424036 - RNA, 17 nt, Homo sapiens
cuggacuuuugcagcuu

SEQ ID NO: 424037 - RNA, 20 nt, Homo sapiens
cuggagaccgcuucaccccu

SEQ ID NO: 424038 - RNA, 20 nt, Homo sapiens
cuggagcccauccagucucc

SEQ ID NO: 424039 - RNA, 20 nt, Homo sapiens
cuggagccuccacugccucu

SEQ ID NO: 424040 - RNA, 18 nt, Homo sapiens
cuggaggccggaaucuca

SEQ ID NO: 424041 - RNA, 19 nt, Homo sapiens
cuggagugcaguggcguga

SEQ ID NO: 424042 - RNA, 20 nt, Homo sapiens
cuggagugcaguggcgugau

SEQ ID NO: 424043 - RNA, 14 nt, Homo sapiens
cuggagugcugcuu

SEQ ID NO: 424044 - RNA, 21 nt, Homo sapiens
cuggauaucgucauuuugcag

SEQ ID NO: 424045 - RNA, 21 nt, Homo sapiens
cuggaucuaccagcauaaaua

SEQ ID NO: 424046 - RNA, 17 nt, Homo sapiens
cuggaugaaauaacucc

SEQ ID NO: 424047 - RNA, 19 nt, Homo sapiens
cuggaugagacuuccaaac

SEQ ID NO: 424048 - RNA, 21 nt, Homo sapiens
cuggauuggggauggggacaa

SEQ ID NO: 424049 - RNA, 22 nt, Homo sapiens
cuggauuuccuaggcugacuaa

SEQ ID NO: 424050 - RNA, 20 nt, Homo sapiens
cuggcagagaagagaccaag

SEQ ID NO: 424051 - RNA, 20 nt, Homo sapiens
cuggcaggagacacuggucu

SEQ ID NO: 424052 - RNA, 23 nt, Homo sapiens
cuggcagggcaggcagagcucag

SEQ ID NO: 424053 - RNA, 16 nt, Homo sapiens
cuggcaugacacucua

SEQ ID NO: 424054 - RNA, 20 nt, Homo sapiens
cuggccaaauaugcacuuuc

SEQ ID NO: 424055 - RNA, 14 nt, Homo sapiens
cuggccacgcagcc

SEQ ID NO: 424056 - RNA, 23 nt, Homo sapiens
cuggccaguagcugccaaaaaga

SEQ ID NO: 424057 - RNA, 20 nt, Homo sapiens
cuggccccgggcucuggcca

SEQ ID NO: 424058 - RNA, 13 nt, Homo sapiens
cuggccccugugc

SEQ ID NO: 424059 - RNA, 22 nt, Homo sapiens
cuggccuauuuuggacguguga

SEQ ID NO: 424060 - RNA, 23 nt, Homo sapiens
cuggccuggaucuccccacucua

SEQ ID NO: 424061 - RNA, 22 nt, Homo sapiens
cuggcggagggaugcagguggg

SEQ ID NO: 424062 - RNA, 22 nt, Homo sapiens
cuggcuagaguccucacuccca

SEQ ID NO: 424063 - RNA, 15 nt, Homo sapiens
cuggcucacagccac

SEQ ID NO: 424064 - RNA, 17 nt, Homo sapiens
cuggcuuuacauuuuau

SEQ ID NO: 424065 - RNA, 21 nt, Homo sapiens
cugggaaaggaaagaagaaau

SEQ ID NO: 424066 - RNA, 14 nt, Homo sapiens
cugggaacucccaa

SEQ ID NO: 424067 - RNA, 21 nt, Homo sapiens
cugggaacugugccuuugagu

SEQ ID NO: 424068 - RNA, 18 nt, Homo sapiens
cugggaaggugaccacau

SEQ ID NO: 424069 - RNA, 15 nt, Homo sapiens
cugggacucauucac

SEQ ID NO: 424070 - RNA, 22 nt, Homo sapiens
cugggagacuuugaagaccagu

SEQ ID NO: 424071 - RNA, 16 nt, Homo sapiens
cugggaggggugcugc

SEQ ID NO: 424072 - RNA, 17 nt, Homo sapiens
cugggaggggugcugcc

SEQ ID NO: 424073 - RNA, 13 nt, Homo sapiens
cugggauggggca

SEQ ID NO: 424074 - RNA, 14 nt, Homo sapiens
cugggauguagaac

SEQ ID NO: 424075 - RNA, 21 nt, Homo sapiens
cugggauuacaggcgugaucc

SEQ ID NO: 424076 - RNA, 22 nt, Homo sapiens
cugggcaagggggaacaaauca

SEQ ID NO: 424077 - RNA, 12 nt, Homo sapiens
cugggcacaauc

SEQ ID NO: 424078 - RNA, 14 nt, Homo sapiens
cugggccaccagcu

SEQ ID NO: 424079 - RNA, 13 nt, Homo sapiens
cugggcccagaag

SEQ ID NO: 424080 - RNA, 13 nt, Homo sapiens
cugggcccuaggc

SEQ ID NO: 424081 - RNA, 14 nt, Homo sapiens
cugggcccuaggca

SEQ ID NO: 424082 - RNA, 21 nt, Homo sapiens
cugggccuccugacagcaaua

SEQ ID NO: 424083 - RNA, 14 nt, Homo sapiens
cugggcucaagcaa

SEQ ID NO: 424084 - RNA, 22 nt, Homo sapiens
cugggcuuacaggcaugagcca

SEQ ID NO: 424085 - RNA, 19 nt, Homo sapiens
cugggcuuguuguuuuuaa

SEQ ID NO: 424086 - RNA, 19 nt, Homo sapiens
cugggcuuugucaugucuc

SEQ ID NO: 424087 - RNA, 14 nt, Homo sapiens
cuggggcaauggga

SEQ ID NO: 424088 - RNA, 15 nt, Homo sapiens
cuggggcaaugggag

SEQ ID NO: 424089 - RNA, 16 nt, Homo sapiens
cugggggccucugccu

SEQ ID NO: 424090 - RNA, 22 nt, Homo sapiens
cugggguuguucacaccacagg

SEQ ID NO: 424091 - RNA, 21 nt, Homo sapiens
cugggucucgcuuuguugccc

SEQ ID NO: 424092 - RNA, 20 nt, Homo sapiens
cugggugaguggggagacac

SEQ ID NO: 424093 - RNA, 14 nt, Homo sapiens
cugggugaucacca

SEQ ID NO: 424094 - RNA, 20 nt, Homo sapiens
augaagcuaccucaaacuuc

SEQ ID NO: 424095 - RNA, 14 nt, Homo sapiens
augaaggugugcua

SEQ ID NO: 424096 - RNA, 16 nt, Homo sapiens
augaaggugugcuaca

SEQ ID NO: 424097 - RNA, 15 nt, Homo sapiens
augaaguauugcuaa

SEQ ID NO: 424098 - RNA, 17 nt, Homo sapiens
augaagugacucucaca

SEQ ID NO: 424099 - RNA, 13 nt, Homo sapiens
augaauacauuuc

SEQ ID NO: 424100 - RNA, 20 nt, Homo sapiens
augaauagaugugaucacug

SEQ ID NO: 424101 - RNA, 13 nt, Homo sapiens
augaauagccagg

SEQ ID NO: 424102 - RNA, 23 nt, Homo sapiens
augaauagccaggccugaccuca

SEQ ID NO: 424103 - RNA, 21 nt, Homo sapiens
augaaucuucacaaaacacuu

SEQ ID NO: 424104 - RNA, 22 nt, Homo sapiens
augaauucauacucuguugccu

SEQ ID NO: 424105 - RNA, 16 nt, Homo sapiens
augacaacuuugccag

SEQ ID NO: 424106 - RNA, 22 nt, Homo sapiens
augacaaggauuagaacacuca

SEQ ID NO: 424107 - RNA, 21 nt, Homo sapiens
augacaauaaauuuuaucuca

SEQ ID NO: 424108 - RNA, 17 nt, Homo sapiens
augacagggaugccaac

SEQ ID NO: 424109 - RNA, 15 nt, Homo sapiens
augacaucuccucca

SEQ ID NO: 424110 - RNA, 14 nt, Homo sapiens
augacaucuucaaa

SEQ ID NO: 424111 - RNA, 23 nt, Homo sapiens
augaccaauccuaugucauuucu

SEQ ID NO: 424112 - RNA, 21 nt, Homo sapiens
augaccuccguguagugucug

SEQ ID NO: 424113 - RNA, 18 nt, Homo sapiens
augaccugaucauuacau

SEQ ID NO: 424114 - RNA, 23 nt, Homo sapiens
augaccuguuauuaccauuagca

SEQ ID NO: 424115 - RNA, 16 nt, Homo sapiens
augaccuugggguaca

SEQ ID NO: 424116 - RNA, 21 nt, Homo sapiens
augacucaccuugcucugcca

SEQ ID NO: 424117 - RNA, 17 nt, Homo sapiens
augacugagucuggcaa

SEQ ID NO: 424118 - RNA, 20 nt, Homo sapiens
augacugcauuuuacuguac

SEQ ID NO: 424119 - RNA, 11 nt, Homo sapiens
augacugcccc

SEQ ID NO: 424120 - RNA, 12 nt, Homo sapiens
augacugugagc

SEQ ID NO: 424121 - RNA, 15 nt, Homo sapiens
augacuucacccacg

SEQ ID NO: 424122 - RNA, 19 nt, Homo sapiens
augagaaauuuuguugaua

SEQ ID NO: 424123 - RNA, 14 nt, Homo sapiens
augagaacuaaaua

SEQ ID NO: 424124 - RNA, 14 nt, Homo sapiens
augagaagccaaag

SEQ ID NO: 424125 - RNA, 14 nt, Homo sapiens
augagaaguacuuu

SEQ ID NO: 424126 - RNA, 18 nt, Homo sapiens
augagaagucaacaguga

SEQ ID NO: 424127 - RNA, 22 nt, Homo sapiens
augagauuggucauuaaauacu

SEQ ID NO: 424128 - RNA, 18 nt, Homo sapiens
augagcauccucucucac

SEQ ID NO: 424129 - RNA, 13 nt, Homo sapiens
augagcuccagac

SEQ ID NO: 424130 - RNA, 16 nt, Homo sapiens
augagcucccucgcug

SEQ ID NO: 424131 - RNA, 20 nt, Homo sapiens
augagcugcacuccaugagu

SEQ ID NO: 424132 - RNA, 20 nt, Homo sapiens
augaggaggcagaaagcaga

SEQ ID NO: 424133 - RNA, 21 nt, Homo sapiens
augaggcacgccugccuucuc

SEQ ID NO: 424134 - RNA, 14 nt, Homo sapiens
augagggcugagau

SEQ ID NO: 424135 - RNA, 16 nt, Homo sapiens
augagggugacuguca

SEQ ID NO: 424136 - RNA, 22 nt, Homo sapiens
augagguuggaaagaguugcca

SEQ ID NO: 424137 - RNA, 17 nt, Homo sapiens
augaguucaaauacuuu

SEQ ID NO: 424138 - RNA, 21 nt, Homo sapiens
augaguuuuacauuacaaauu

SEQ ID NO: 424139 - RNA, 21 nt, Homo sapiens
augaguuuuugauagcuuuau

SEQ ID NO: 424140 - RNA, 22 nt, Homo sapiens
augaguuuuugauagcuuuauu

SEQ ID NO: 424141 - RNA, 22 nt, Homo sapiens
augauaaaauaaguaacauaua

SEQ ID NO: 424142 - RNA, 17 nt, Homo sapiens
augauaauaaaggcauu

SEQ ID NO: 424143 - RNA, 16 nt, Homo sapiens
augauacacaccuuuc

SEQ ID NO: 424144 - RNA, 15 nt, Homo sapiens
augauacagucucca

SEQ ID NO: 424145 - RNA, 12 nt, Homo sapiens
augauacuugag

SEQ ID NO: 424146 - RNA, 19 nt, Homo sapiens
augauauauauguauaauu

SEQ ID NO: 424147 - RNA, 13 nt, Homo sapiens
augauauucucau

SEQ ID NO: 424148 - RNA, 17 nt, Homo sapiens
augauauucucauuauu

SEQ ID NO: 424149 - RNA, 19 nt, Homo sapiens
augaucaaaaccugugcca

SEQ ID NO: 424150 - RNA, 15 nt, Homo sapiens
augaucgcuaucuag

SEQ ID NO: 424151 - RNA, 15 nt, Homo sapiens
augaucuagguuuaa

SEQ ID NO: 424152 - RNA, 21 nt, Homo sapiens
augaucucuuaggaagccuuu

SEQ ID NO: 424153 - RNA, 13 nt, Homo sapiens
augaucugucaaa

SEQ ID NO: 424154 - RNA, 22 nt, Homo sapiens
augaucuguggagaauguacac

SEQ ID NO: 424155 - RNA, 23 nt, Homo sapiens
augaugaaggggauacgcuggag

SEQ ID NO: 424156 - RNA, 12 nt, Homo sapiens
augaugaucugg

SEQ ID NO: 424157 - RNA, 15 nt, Homo sapiens
augaugauguggaag

SEQ ID NO: 424158 - RNA, 23 nt, Homo sapiens
augaugccaugaggaacaaggca

SEQ ID NO: 424159 - RNA, 19 nt, Homo sapiens
augauucuccucucccaaa

SEQ ID NO: 424160 - RNA, 15 nt, Homo sapiens
caaagcaccuugaau

SEQ ID NO: 424161 - RNA, 22 nt, Homo sapiens
caaagcaugccaauuucucuua

SEQ ID NO: 424162 - RNA, 12 nt, Homo sapiens
caaagcauguga

SEQ ID NO: 424163 - RNA, 14 nt, Homo sapiens
caaagcauuugacu

SEQ ID NO: 424164 - RNA, 23 nt, Homo sapiens
caaagcuuggugucuuggcacug

SEQ ID NO: 424165 - RNA, 13 nt, Homo sapiens
caaaggacaguac

SEQ ID NO: 424166 - RNA, 15 nt, Homo sapiens
caaaggacugaccug

SEQ ID NO: 424167 - RNA, 24 nt, Homo sapiens
caaaggaggcuuacaacuccugca

SEQ ID NO: 424168 - RNA, 19 nt, Homo sapiens
caaaggcaccugaaugugu

SEQ ID NO: 424169 - RNA, 21 nt, Homo sapiens
caaaggcuuucuuuccaaucc

SEQ ID NO: 424170 - RNA, 16 nt, Homo sapiens
caaaguaaagacugag

SEQ ID NO: 424171 - RNA, 11 nt, Homo sapiens
caaaguaauag

SEQ ID NO: 424172 - RNA, 19 nt, Homo sapiens
caaagugaaagacauuuca

SEQ ID NO: 424173 - RNA, 19 nt, Homo sapiens
caaagugcugggauuacag

SEQ ID NO: 424174 - RNA, 16 nt, Homo sapiens
caaagugguacaggaa

SEQ ID NO: 424175 - RNA, 23 nt, Homo sapiens
caaaguguacaauuuucauccca

SEQ ID NO: 424176 - RNA, 13 nt, Homo sapiens
caaauaaaaucua

SEQ ID NO: 424177 - RNA, 14 nt, Homo sapiens
caaauaagaaaccu

SEQ ID NO: 424178 - RNA, 22 nt, Homo sapiens
caaauaauaaaaacagaaggaa

SEQ ID NO: 424179 - RNA, 14 nt, Homo sapiens
caaauacuaucucu

SEQ ID NO: 424180 - RNA, 12 nt, Homo sapiens
caaauagcacau

SEQ ID NO: 424181 - RNA, 18 nt, Homo sapiens
caaauagugcaacuauga

SEQ ID NO: 424182 - RNA, 15 nt, Homo sapiens
caaauaugcacuuuc

SEQ ID NO: 424183 - RNA, 22 nt, Homo sapiens
caaauaugcacuuucccuagaa

SEQ ID NO: 424184 - RNA, 15 nt, Homo sapiens
caaauauuucacuua

SEQ ID NO: 424185 - RNA, 22 nt, Homo sapiens
caaaucaauaaacugugucugu

SEQ ID NO: 424186 - RNA, 17 nt, Homo sapiens
caaauccacaagccauu

SEQ ID NO: 424187 - RNA, 16 nt, Homo sapiens
caaauccccuccccaa

SEQ ID NO: 424188 - RNA, 17 nt, Homo sapiens
caaauccucccuacuuc

SEQ ID NO: 424189 - RNA, 18 nt, Homo sapiens
caaauccucccuacuucc

SEQ ID NO: 424190 - RNA, 21 nt, Homo sapiens
caaaucuggguaucuuuccag

SEQ ID NO: 424191 - RNA, 22 nt, Homo sapiens
caaaugaaugagcucucuaaua

SEQ ID NO: 424192 - RNA, 23 nt, Homo sapiens
caaaugaccgcacguucucugcc

SEQ ID NO: 424193 - RNA, 22 nt, Homo sapiens
caaaugcaugauauuguaugua

SEQ ID NO: 424194 - RNA, 19 nt, Homo sapiens
caaaugccuuucuagcaau

SEQ ID NO: 424195 - RNA, 22 nt, Homo sapiens
caaaugccuuucuagcaauugc

SEQ ID NO: 424196 - RNA, 17 nt, Homo sapiens
caaaugcuauacugugu

SEQ ID NO: 424197 - RNA, 12 nt, Homo sapiens
caaaugcuauau

SEQ ID NO: 424198 - RNA, 16 nt, Homo sapiens
caaaugcuauuugaua

SEQ ID NO: 424199 - RNA, 23 nt, Homo sapiens
caaauguccgauccccgaccuuc

SEQ ID NO: 424200 - RNA, 23 nt, Homo sapiens
caaaugucuucaugaccuacuuc

SEQ ID NO: 424201 - RNA, 20 nt, Homo sapiens
caaauuaucuuuuuucuucc

SEQ ID NO: 424202 - RNA, 15 nt, Homo sapiens
caaauuauucuaguc

SEQ ID NO: 424203 - RNA, 23 nt, Homo sapiens
caaauucaaugaaucaaauccaa

SEQ ID NO: 424204 - RNA, 23 nt, Homo sapiens
caaauucauuuuuuucacuggag

SEQ ID NO: 424205 - RNA, 17 nt, Homo sapiens
caaauuucgagcauaag

SEQ ID NO: 424206 - RNA, 19 nt, Homo sapiens
caaauuuucacugcugcuc

SEQ ID NO: 424207 - RNA, 15 nt, Homo sapiens
caacaagaauauugu

SEQ ID NO: 424208 - RNA, 21 nt, Homo sapiens
caacaagauccuuaaugcaga

SEQ ID NO: 424209 - RNA, 20 nt, Homo sapiens
caacaaggcugcacagcuca

SEQ ID NO: 424210 - RNA, 16 nt, Homo sapiens
caacacaccuugccca

SEQ ID NO: 424211 - RNA, 12 nt, Homo sapiens
caacaccaaaaa

SEQ ID NO: 424212 - RNA, 14 nt, Homo sapiens
caacaccaucacag

SEQ ID NO: 424213 - RNA, 18 nt, Homo sapiens
caacacccaaguugaaga

SEQ ID NO: 424214 - RNA, 15 nt, Homo sapiens
caacaccuguggaua

SEQ ID NO: 424215 - RNA, 17 nt, Homo sapiens
caacacuaauacacuaa

SEQ ID NO: 424216 - RNA, 14 nt, Homo sapiens
caacacugcugcuc

SEQ ID NO: 424217 - RNA, 11 nt, Homo sapiens
caacacuuugg

SEQ ID NO: 424218 - RNA, 16 nt, Homo sapiens
caacaguauacaaaag

SEQ ID NO: 424219 - RNA, 16 nt, Homo sapiens
caacagugaacagcuu

SEQ ID NO: 424220 - RNA, 17 nt, Homo sapiens
caacaguguucugagcc

SEQ ID NO: 424221 - RNA, 18 nt, Homo sapiens
caacaguuaaacuugcaa

SEQ ID NO: 424222 - RNA, 18 nt, Homo sapiens
caacaguuugaugcugag

SEQ ID NO: 424223 - RNA, 21 nt, Homo sapiens
caacaguuugaugcugaguca

SEQ ID NO: 424224 - RNA, 22 nt, Homo sapiens
caacauaauuaaauuuugaguu

SEQ ID NO: 424225 - RNA, 17 nt, Homo sapiens
caacaugguuaccucug

SEQ ID NO: 424226 - RNA, 16 nt, Homo sapiens
caacauuuaaugagca

SEQ ID NO: 424227 - RNA, 24 nt, Homo sapiens
caaccaacggccgacugccuguga

SEQ ID NO: 424228 - RNA, 20 nt, Homo sapiens
caaccaauuccaaguuuuaa

SEQ ID NO: 424229 - RNA, 13 nt, Homo sapiens
caaccacaugcag

SEQ ID NO: 424230 - RNA, 22 nt, Homo sapiens
caaccacugcgaccacaagaag

SEQ ID NO: 424231 - RNA, 21 nt, Homo sapiens
caaccacuguaaaaugaaauu

SEQ ID NO: 424232 - RNA, 22 nt, Homo sapiens
caaccaggaagaguucuauccc

SEQ ID NO: 424233 - RNA, 16 nt, Homo sapiens
caaccaggaguaccug

SEQ ID NO: 424234 - RNA, 18 nt, Homo sapiens
caacccauucacuacagg

SEQ ID NO: 424235 - RNA, 15 nt, Homo sapiens
caaccccugcuccag

SEQ ID NO: 424236 - RNA, 21 nt, Homo sapiens
caaccgcaucugcucaucuga

SEQ ID NO: 424237 - RNA, 19 nt, Homo sapiens
caaccucaaugcccugcca

SEQ ID NO: 424238 - RNA, 13 nt, Homo sapiens
caaccugcacuuc

SEQ ID NO: 424239 - RNA, 18 nt, Homo sapiens
caaccugccugugcauga

SEQ ID NO: 424240 - RNA, 14 nt, Homo sapiens
caaccugugaugag

SEQ ID NO: 424241 - RNA, 20 nt, Homo sapiens
caaccuguugaauuuacucu

SEQ ID NO: 424242 - RNA, 15 nt, Homo sapiens
caaccuugugugagu

SEQ ID NO: 424243 - RNA, 13 nt, Homo sapiens
caacgaaaagcac

SEQ ID NO: 424244 - RNA, 15 nt, Homo sapiens
caacgaaaagcacau

SEQ ID NO: 424245 - RNA, 23 nt, Homo sapiens
caacgaacauggcaugugaaaag

SEQ ID NO: 424246 - RNA, 22 nt, Homo sapiens
gaacagcgggagaccugugcua

SEQ ID NO: 424247 - RNA, 22 nt, Homo sapiens
gaacagggaugcuaucucgcua

SEQ ID NO: 424248 - RNA, 22 nt, Homo sapiens
gaacaggggucgccaacacuug

SEQ ID NO: 424249 - RNA, 15 nt, Homo sapiens
gaacaguccauugaa

SEQ ID NO: 424250 - RNA, 23 nt, Homo sapiens
gaacaguuuaugcagugcugcuu

SEQ ID NO: 424251 - RNA, 17 nt, Homo sapiens
gaacaucugccuugcug

SEQ ID NO: 424252 - RNA, 20 nt, Homo sapiens
gaacaugcagcaaggggaca

SEQ ID NO: 424253 - RNA, 13 nt, Homo sapiens
gaacaugcaguuc

SEQ ID NO: 424254 - RNA, 21 nt, Homo sapiens
gaacauggccaauagucauau

SEQ ID NO: 424255 - RNA, 22 nt, Homo sapiens
gaacauuaacaaaagcaauugu

SEQ ID NO: 424256 - RNA, 19 nt, Homo sapiens
gaacauucagauuuaccau

SEQ ID NO: 424257 - RNA, 17 nt, Homo sapiens
gaaccaaaaagaggcua

SEQ ID NO: 424258 - RNA, 18 nt, Homo sapiens
gaaccaaggcagccucca

SEQ ID NO: 424259 - RNA, 14 nt, Homo sapiens
gaaccaauaaugua

SEQ ID NO: 424260 - RNA, 15 nt, Homo sapiens
gaaccauuacuguaa

SEQ ID NO: 424261 - RNA, 16 nt, Homo sapiens
gaacccauuugccaug

SEQ ID NO: 424262 - RNA, 15 nt, Homo sapiens
gaacccccuccagac

SEQ ID NO: 424263 - RNA, 21 nt, Homo sapiens
gaaccucuccaucaucuuccg

SEQ ID NO: 424264 - RNA, 13 nt, Homo sapiens
gaaccuuuccucu

SEQ ID NO: 424265 - RNA, 18 nt, Homo sapiens
gaaccuuugucaacuuca

SEQ ID NO: 424266 - RNA, 16 nt, Homo sapiens
gaacgugguucagaga

SEQ ID NO: 424267 - RNA, 16 nt, Homo sapiens
gaacuaugaacuacaa

SEQ ID NO: 424268 - RNA, 18 nt, Homo sapiens
gaacuccggaaugaccag

SEQ ID NO: 424269 - RNA, 21 nt, Homo sapiens
gaacuccuggccucaagccau

SEQ ID NO: 424270 - RNA, 17 nt, Homo sapiens
gaacucugaauaugccu

SEQ ID NO: 424271 - RNA, 17 nt, Homo sapiens
gaacucugggcacuuuu

SEQ ID NO: 424272 - RNA, 18 nt, Homo sapiens
gaacucuguaaaaccuca

SEQ ID NO: 424273 - RNA, 21 nt, Homo sapiens
gaacucugugcaggugcugcc

SEQ ID NO: 424274 - RNA, 15 nt, Homo sapiens
gaacugcaugcugcu

SEQ ID NO: 424275 - RNA, 15 nt, Homo sapiens
gaacugcuucuaaga

SEQ ID NO: 424276 - RNA, 15 nt, Homo sapiens
gaacugcuugcauuu

SEQ ID NO: 424277 - RNA, 21 nt, Homo sapiens
gaacugcuuuaucccacggaa

SEQ ID NO: 424278 - RNA, 17 nt, Homo sapiens
gaacugguccaggccag

SEQ ID NO: 424279 - RNA, 12 nt, Homo sapiens
gaacugugacag

SEQ ID NO: 424280 - RNA, 23 nt, Homo sapiens
gaacuuaauuaccuaagagccac

SEQ ID NO: 424281 - RNA, 12 nt, Homo sapiens
gaacuuccuccc

SEQ ID NO: 424282 - RNA, 20 nt, Homo sapiens
gaacuugcugcugagugcac

SEQ ID NO: 424283 - RNA, 22 nt, Homo sapiens
gaacuuuguccgguggaaggcc

SEQ ID NO: 424284 - RNA, 18 nt, Homo sapiens
gaagaaaagcugccauuu

SEQ ID NO: 424285 - RNA, 14 nt, Homo sapiens
gaagaaagacuccu

SEQ ID NO: 424286 - RNA, 20 nt, Homo sapiens
gaagaacaucaagauaccuu

SEQ ID NO: 424287 - RNA, 15 nt, Homo sapiens
gaagaaugagcaaga

SEQ ID NO: 424288 - RNA, 17 nt, Homo sapiens
gaagaauugaaaaacca

SEQ ID NO: 424289 - RNA, 20 nt, Homo sapiens
gaauuuuauuuauaaaugag

SEQ ID NO: 424290 - RNA, 20 nt, Homo sapiens
gaauuuucucuaacuucaag

SEQ ID NO: 424291 - RNA, 20 nt, Homo sapiens
gaauuuugcacaguuaccug

SEQ ID NO: 424292 - RNA, 14 nt, Homo sapiens
gaauuuuugcacau

SEQ ID NO: 424293 - RNA, 17 nt, Homo sapiens
gacaaaauaaacauuuu

SEQ ID NO: 424294 - RNA, 16 nt, Homo sapiens
gacaaauguugaccuu

SEQ ID NO: 424295 - RNA, 22 nt, Homo sapiens
gacaaccaacggccgacugccu

SEQ ID NO: 424296 - RNA, 16 nt, Homo sapiens
gacaacgaugaugcuu

SEQ ID NO: 424297 - RNA, 22 nt, Homo sapiens
gacaagaaauccuaguggccuc

SEQ ID NO: 424298 - RNA, 15 nt, Homo sapiens
gacaaggaaggacag

SEQ ID NO: 424299 - RNA, 19 nt, Homo sapiens
gacaaggauuagaacacuc

SEQ ID NO: 424300 - RNA, 22 nt, Homo sapiens
gacaaguuuaaaggcuguguca

SEQ ID NO: 424301 - RNA, 20 nt, Homo sapiens
gacaauaaaacauuccugug

SEQ ID NO: 424302 - RNA, 23 nt, Homo sapiens
gacaauaaaacauuccugugaaa

SEQ ID NO: 424303 - RNA, 15 nt, Homo sapiens
gacaauaaaauggaa

SEQ ID NO: 424304 - RNA, 22 nt, Homo sapiens
gacaauaaaauggaaagguccu

SEQ ID NO: 424305 - RNA, 13 nt, Homo sapiens
gacaaucuaaaaa

SEQ ID NO: 424306 - RNA, 21 nt, Homo sapiens
gacacaaccacuaauuuguca

SEQ ID NO: 424307 - RNA, 21 nt, Homo sapiens
gacacaacuauuuuuccaaaa

SEQ ID NO: 424308 - RNA, 15 nt, Homo sapiens
gacacacagccuuuc

SEQ ID NO: 424309 - RNA, 14 nt, Homo sapiens
gacacacucaccau

SEQ ID NO: 424310 - RNA, 21 nt, Homo sapiens
gacacagauggcaccuguggc

SEQ ID NO: 424311 - RNA, 22 nt, Homo sapiens
gacacagcccaugggccagaac

SEQ ID NO: 424312 - RNA, 20 nt, Homo sapiens
gacacccaacacuuuuucca

SEQ ID NO: 424313 - RNA, 20 nt, Homo sapiens
gacacccaguggaaccaaaa

SEQ ID NO: 424314 - RNA, 21 nt, Homo sapiens
gacacccuaacucuugcucac

SEQ ID NO: 424315 - RNA, 14 nt, Homo sapiens
gacacguucuugcc

SEQ ID NO: 424316 - RNA, 20 nt, Homo sapiens
gacacuugccuucuucaccc

SEQ ID NO: 424317 - RNA, 16 nt, Homo sapiens
gacagacacugcugaa

SEQ ID NO: 424318 - RNA, 15 nt, Homo sapiens
gacagacagaaggca

SEQ ID NO: 424319 - RNA, 17 nt, Homo sapiens
gacagacaggcucuuag

SEQ ID NO: 424320 - RNA, 16 nt, Homo sapiens
gacagauacuccucca

SEQ ID NO: 424321 - RNA, 17 nt, Homo sapiens
gacagauacuccuccaa

SEQ ID NO: 424322 - RNA, 17 nt, Homo sapiens
gacagaucaauggcgca

SEQ ID NO: 424323 - RNA, 21 nt, Homo sapiens
gacagauuccaggcgaugugc

SEQ ID NO: 424324 - RNA, 13 nt, Homo sapiens
gacagccaaaagu

SEQ ID NO: 424325 - RNA, 13 nt, Homo sapiens
gacagccuggcac

SEQ ID NO: 424326 - RNA, 21 nt, Homo sapiens
gacaggaagacuggagacugu

SEQ ID NO: 424327 - RNA, 20 nt, Homo sapiens
gacaggaagcccaaggcagu

SEQ ID NO: 424328 - RNA, 19 nt, Homo sapiens
gacaggacagcauggugca

SEQ ID NO: 424329 - RNA, 14 nt, Homo sapiens
gacaggacuuucau

SEQ ID NO: 424330 - RNA, 17 nt, Homo sapiens
gacaggauggcugugug

SEQ ID NO: 424331 - RNA, 15 nt, Homo sapiens
gacaggcagacacau

SEQ ID NO: 424332 - RNA, 21 nt, Homo sapiens
gacagggaauagugggaucaa

SEQ ID NO: 424333 - RNA, 13 nt, Homo sapiens
gacaggggagaaa

SEQ ID NO: 424334 - RNA, 14 nt, Homo sapiens
gacaguauugccac

SEQ ID NO: 424335 - RNA, 18 nt, Homo sapiens
gacaguggucuaauucaa

SEQ ID NO: 424336 - RNA, 12 nt, Homo sapiens
gacauaccucuc

SEQ ID NO: 424337 - RNA, 13 nt, Homo sapiens
gacauauaucuau

SEQ ID NO: 424338 - RNA, 16 nt, Homo sapiens
gacauauucacaguga

SEQ ID NO: 424339 - RNA, 13 nt, Homo sapiens
gacauccacagga

SEQ ID NO: 424340 - RNA, 14 nt, Homo sapiens
gacauccugugaug

SEQ ID NO: 424341 - RNA, 13 nt, Homo sapiens
gacaucuaccucc

SEQ ID NO: 424342 - RNA, 16 nt, Homo sapiens
gacaucugucuaggaa

SEQ ID NO: 424343 - RNA, 16 nt, Homo sapiens
gacaugcggcugccca

SEQ ID NO: 424344 - RNA, 15 nt, Homo sapiens
gacauguggggccag

SEQ ID NO: 424345 - RNA, 12 nt, Homo sapiens
gacauguguuaa

SEQ ID NO: 424346 - RNA, 23 nt, Homo sapiens
gacauguucccuucuccuuccaa

SEQ ID NO: 424347 - RNA, 21 nt, Homo sapiens
gaccaaaaugacaaugaugau

SEQ ID NO: 424348 - RNA, 19 nt, Homo sapiens
gaccaaauggaaauaaagc

SEQ ID NO: 424349 - RNA, 12 nt, Homo sapiens
gaccaaugcauu

SEQ ID NO: 424350 - RNA, 18 nt, Homo sapiens
gaccaauuagcauuccau

SEQ ID NO: 424351 - RNA, 23 nt, Homo sapiens
gaccacaaggcugaaaagugcuu

SEQ ID NO: 424352 - RNA, 17 nt, Homo sapiens
gaccagagcaccucagc

SEQ ID NO: 424353 - RNA, 17 nt, Homo sapiens
gaccaguccuguuugca

SEQ ID NO: 424354 - RNA, 20 nt, Homo sapiens
gaccaguugggagcacugga

SEQ ID NO: 424355 - RNA, 12 nt, Homo sapiens
gaccaugcugcc

SEQ ID NO: 424356 - RNA, 14 nt, Homo sapiens
gacccacaaacugc

SEQ ID NO: 424357 - RNA, 19 nt, Homo sapiens
gacccacgaacgcucuuag

SEQ ID NO: 424358 - RNA, 20 nt, Homo sapiens
gaccccagagggaccagcug

SEQ ID NO: 424359 - RNA, 19 nt, Homo sapiens
gaccccauccagccagggg

SEQ ID NO: 424360 - RNA, 16 nt, Homo sapiens
gacccccgugccaaau

SEQ ID NO: 424361 - RNA, 18 nt, Homo sapiens
gaccccuguucccaugcu

SEQ ID NO: 424362 - RNA, 20 nt, Homo sapiens
gacccggaggggccuggcag

SEQ ID NO: 424363 - RNA, 15 nt, Homo sapiens
gacccucaaugccaa

SEQ ID NO: 424364 - RNA, 17 nt, Homo sapiens
gacccucccacuggugc

SEQ ID NO: 424365 - RNA, 18 nt, Homo sapiens
gacccuucagggccagaa

SEQ ID NO: 424366 - RNA, 21 nt, Homo sapiens
gaccgggccgcuagaugggca

SEQ ID NO: 424367 - RNA, 15 nt, Homo sapiens
gaccgugugugaaau

SEQ ID NO: 424368 - RNA, 14 nt, Homo sapiens
gaccguugcacaaa

SEQ ID NO: 424369 - RNA, 23 nt, Homo sapiens
gaccuaacauucgaucucauuca

SEQ ID NO: 424370 - RNA, 13 nt, Homo sapiens
gaccuaaccacuu

SEQ ID NO: 424371 - RNA, 16 nt, Homo sapiens
gaccuaauaucauuuu

SEQ ID NO: 424372 - RNA, 14 nt, Homo sapiens
gaccuccacauuaa

SEQ ID NO: 424373 - RNA, 23 nt, Homo sapiens
gaccucccucccuccccaguguu

SEQ ID NO: 424374 - RNA, 21 nt, Homo sapiens
gaccuccugagcgaugacuca

SEQ ID NO: 424375 - RNA, 12 nt, Homo sapiens
gaccugagcucc

SEQ ID NO: 424376 - RNA, 21 nt, Homo sapiens
gaccuggauaauuauaucaga

SEQ ID NO: 424377 - RNA, 14 nt, Homo sapiens
gaccuggcaucuug

SEQ ID NO: 424378 - RNA, 18 nt, Homo sapiens
gaccuggggggggcaaga

SEQ ID NO: 424379 - RNA, 22 nt, Homo sapiens
gaccugugaccagcacugucuc

SEQ ID NO: 424380 - RNA, 19 nt, Homo sapiens
gaccuuaucugugcgugaa

SEQ ID NO: 424381 - RNA, 19 nt, Homo sapiens
gaccuuggaggaaugacaa

SEQ ID NO: 424382 - RNA, 14 nt, Homo sapiens
caaugcuuugucca

SEQ ID NO: 424383 - RNA, 21 nt, Homo sapiens
caauggaguggcugccaugga

SEQ ID NO: 424384 - RNA, 19 nt, Homo sapiens
caauggccuuuaucaucua

SEQ ID NO: 424385 - RNA, 20 nt, Homo sapiens
caaugggacuggagucagau

SEQ ID NO: 424386 - RNA, 20 nt, Homo sapiens
caaugucacaaccucucuga

SEQ ID NO: 424387 - RNA, 22 nt, Homo sapiens
caaugugaaaaaugugucugua

SEQ ID NO: 424388 - RNA, 20 nt, Homo sapiens
caaugugaagacacuacaga

SEQ ID NO: 424389 - RNA, 18 nt, Homo sapiens
caauuaaacccagaacca

SEQ ID NO: 424390 - RNA, 17 nt, Homo sapiens
caauuaaagguccugcc

SEQ ID NO: 424391 - RNA, 14 nt, Homo sapiens
caauuaacucugga

SEQ ID NO: 424392 - RNA, 16 nt, Homo sapiens
caauuaacugaagcaa

SEQ ID NO: 424393 - RNA, 13 nt, Homo sapiens
caauuaccaauau

SEQ ID NO: 424394 - RNA, 15 nt, Homo sapiens
caauuagcauuccau

SEQ ID NO: 424395 - RNA, 13 nt, Homo sapiens
caauuaugugaca

SEQ ID NO: 424396 - RNA, 14 nt, Homo sapiens
caauuaugugacaa

SEQ ID NO: 424397 - RNA, 21 nt, Homo sapiens
caauuaugugacaaccuuugu

SEQ ID NO: 424398 - RNA, 15 nt, Homo sapiens
caauugcagaugcca

SEQ ID NO: 424399 - RNA, 16 nt, Homo sapiens
caauugcagaugccaa

SEQ ID NO: 424400 - RNA, 18 nt, Homo sapiens
caauuuaaggaacacaga

SEQ ID NO: 424401 - RNA, 12 nt, Homo sapiens
caauuuacuuuu

SEQ ID NO: 424402 - RNA, 11 nt, Homo sapiens
caauuuaguuc

SEQ ID NO: 424403 - RNA, 12 nt, Homo sapiens
caauuuauccaa

SEQ ID NO: 424404 - RNA, 13 nt, Homo sapiens
caauuuauccaac

SEQ ID NO: 424405 - RNA, 21 nt, Homo sapiens
caauuuccggccaacaguuaa

SEQ ID NO: 424406 - RNA, 17 nt, Homo sapiens
caauuucuaaauuugca

SEQ ID NO: 424407 - RNA, 23 nt, Homo sapiens
caauuucuugcucuaucucucaa

SEQ ID NO: 424408 - RNA, 23 nt, Homo sapiens
caauuugggucccagcuaaagag

SEQ ID NO: 424409 - RNA, 19 nt, Homo sapiens
caauuuguaauugcuuaca

SEQ ID NO: 424410 - RNA, 14 nt, Homo sapiens
caauuuucuauuua

SEQ ID NO: 424411 - RNA, 18 nt, Homo sapiens
caauuuuuuuucuguaaa

SEQ ID NO: 424412 - RNA, 21 nt, Homo sapiens
cacaaaaagaaagcugugaaa

SEQ ID NO: 424413 - RNA, 14 nt, Homo sapiens
cacaaaagucucaa

SEQ ID NO: 424414 - RNA, 22 nt, Homo sapiens
cacaaaagucucaauguuccau

SEQ ID NO: 424415 - RNA, 20 nt, Homo sapiens
cacaaaauguaggguuauaa

SEQ ID NO: 424416 - RNA, 13 nt, Homo sapiens
cacaaaccaguau

SEQ ID NO: 424417 - RNA, 14 nt, Homo sapiens
cacaaauauaguug

SEQ ID NO: 424418 - RNA, 23 nt, Homo sapiens
cacaaaucaaagcaagggcucca

SEQ ID NO: 424419 - RNA, 16 nt, Homo sapiens
gagccaccucacccag

SEQ ID NO: 424420 - RNA, 13 nt, Homo sapiens
gagccacuaccuu

SEQ ID NO: 424421 - RNA, 17 nt, Homo sapiens
gagccagccuugcagua

SEQ ID NO: 424422 - RNA, 16 nt, Homo sapiens
gagccagggcuguccu

SEQ ID NO: 424423 - RNA, 13 nt, Homo sapiens
gagccauccuccu

SEQ ID NO: 424424 - RNA, 23 nt, Homo sapiens
gagcccaauguauuaugaucucu

SEQ ID NO: 424425 - RNA, 19 nt, Homo sapiens
gagcccagaagcucaaggc

SEQ ID NO: 424426 - RNA, 17 nt, Homo sapiens
gagcccauccagucucc

SEQ ID NO: 424427 - RNA, 21 nt, Homo sapiens
gagccggcugccuaccagggg

SEQ ID NO: 424428 - RNA, 17 nt, Homo sapiens
gagccuccugacccugu

SEQ ID NO: 424429 - RNA, 18 nt, Homo sapiens
gagccuccugacccugug

SEQ ID NO: 424430 - RNA, 20 nt, Homo sapiens
gagccucgccccuccagugu

SEQ ID NO: 424431 - RNA, 14 nt, Homo sapiens
gagccucgggacau

SEQ ID NO: 424432 - RNA, 17 nt, Homo sapiens
gagccugcaaacucacu

SEQ ID NO: 424433 - RNA, 18 nt, Homo sapiens
gagccuguguuagugucu

SEQ ID NO: 424434 - RNA, 20 nt, Homo sapiens
gagcgcaagauagauuugga

SEQ ID NO: 424435 - RNA, 19 nt, Homo sapiens
gagcuagaugugucuuacc

SEQ ID NO: 424436 - RNA, 14 nt, Homo sapiens
gagcucaaacuggc

SEQ ID NO: 424437 - RNA, 16 nt, Homo sapiens
gagcucccucgcugua

SEQ ID NO: 424438 - RNA, 17 nt, Homo sapiens
gagcugcucugcuauau

SEQ ID NO: 424439 - RNA, 16 nt, Homo sapiens
gagcuggaacacucuc

SEQ ID NO: 424440 - RNA, 13 nt, Homo sapiens
gagcugggggcca

SEQ ID NO: 424441 - RNA, 14 nt, Homo sapiens
gagcugggggccau

SEQ ID NO: 424442 - RNA, 17 nt, Homo sapiens
gagcuggggggcgugga

SEQ ID NO: 424443 - RNA, 16 nt, Homo sapiens
gagcugucugaacuca

SEQ ID NO: 424444 - RNA, 14 nt, Homo sapiens
gagcugucuuguca

SEQ ID NO: 424445 - RNA, 17 nt, Homo sapiens
gagcugucuugucaucu

SEQ ID NO: 424446 - RNA, 13 nt, Homo sapiens
gagcuucaguaua

SEQ ID NO: 424447 - RNA, 18 nt, Homo sapiens
gagcuucauauaccagca

SEQ ID NO: 424448 - RNA, 20 nt, Homo sapiens
gagcuugagcuccccuggag

SEQ ID NO: 424449 - RNA, 23 nt, Homo sapiens
gagcuuggccagaagggggccau

SEQ ID NO: 424450 - RNA, 17 nt, Homo sapiens
gagcuuuaguccuagag

SEQ ID NO: 424451 - RNA, 13 nt, Homo sapiens
gagcuuucugaua

SEQ ID NO: 424452 - RNA, 20 nt, Homo sapiens
gagcuuuuaaaaauguccug

SEQ ID NO: 424453 - RNA, 20 nt, Homo sapiens
gagcuuuugguaugugacau

SEQ ID NO: 424454 - RNA, 24 nt, Homo sapiens
gaggaaauguuggaacucugugca

SEQ ID NO: 424455 - RNA, 15 nt, Homo sapiens
gaggaacgugguuca

SEQ ID NO: 424456 - RNA, 22 nt, Homo sapiens
gaggaagggacugguccaggca

SEQ ID NO: 424457 - RNA, 15 nt, Homo sapiens
gaggaaucagcucaa

SEQ ID NO: 424458 - RNA, 19 nt, Homo sapiens
gaggaaucuuuuacugugg

SEQ ID NO: 424459 - RNA, 13 nt, Homo sapiens
gaggaaugcuccc

SEQ ID NO: 424460 - RNA, 15 nt, Homo sapiens
gaggacagaaccaac

SEQ ID NO: 424461 - RNA, 22 nt, Homo sapiens
gaggaccccagcuuuucuugcc

SEQ ID NO: 424462 - RNA, 16 nt, Homo sapiens
gaggacccgggaccac

SEQ ID NO: 424463 - RNA, 18 nt, Homo sapiens
gaggacucucacgauaug

SEQ ID NO: 424464 - RNA, 14 nt, Homo sapiens
gaggagcccucauc

SEQ ID NO: 424465 - RNA, 20 nt, Homo sapiens
gaggagccggugcucuggaa

SEQ ID NO: 424466 - RNA, 15 nt, Homo sapiens
gaggaggauccgggc

SEQ ID NO: 424467 - RNA, 14 nt, Homo sapiens
gaggaguaauggca

SEQ ID NO: 424468 - RNA, 12 nt, Homo sapiens
gaggaguucaau

SEQ ID NO: 424469 - RNA, 15 nt, Homo sapiens
gaggaguucaaugau

SEQ ID NO: 424470 - RNA, 22 nt, Homo sapiens
gaggaugaauguaugugcacug

SEQ ID NO: 424471 - RNA, 12 nt, Homo sapiens
gaggauugcacu

SEQ ID NO: 424472 - RNA, 20 nt, Homo sapiens
gaggcaagagaauugcuuga

SEQ ID NO: 424473 - RNA, 17 nt, Homo sapiens
gaggcaaugacugugag

SEQ ID NO: 424474 - RNA, 16 nt, Homo sapiens
gaggcagaaccuggug

SEQ ID NO: 424475 - RNA, 14 nt, Homo sapiens
gaggcagaggacag

SEQ ID NO: 424476 - RNA, 17 nt, Homo sapiens
gaggcaggggcucugcu

SEQ ID NO: 424477 - RNA, 13 nt, Homo sapiens
gaggcaucaguug

SEQ ID NO: 424478 - RNA, 20 nt, Homo sapiens
gaggcaucaguugcuauaua

SEQ ID NO: 424479 - RNA, 20 nt, Homo sapiens
gaggcauucccagaauuugc

SEQ ID NO: 424480 - RNA, 14 nt, Homo sapiens
gaggccccuggugg

SEQ ID NO: 424481 - RNA, 13 nt, Homo sapiens
gaggcccuaggcg

SEQ ID NO: 424482 - RNA, 19 nt, Homo sapiens
gaggcucccaaucagcuuu

SEQ ID NO: 424483 - RNA, 16 nt, Homo sapiens
gaggcugaggcaagag

SEQ ID NO: 424484 - RNA, 18 nt, Homo sapiens
gaggcugaggcgggugga

SEQ ID NO: 424485 - RNA, 22 nt, Homo sapiens
gaggcuucuccuucuccuuccc

SEQ ID NO: 424486 - RNA, 15 nt, Homo sapiens
gaggcuuuucccacc

SEQ ID NO: 424487 - RNA, 13 nt, Homo sapiens
gagggaaacaaaa

SEQ ID NO: 424488 - RNA, 16 nt, Homo sapiens
gagggaaauacaagga

SEQ ID NO: 424489 - RNA, 22 nt, Homo sapiens
gagggaacccugacuacagaaa

SEQ ID NO: 424490 - RNA, 14 nt, Homo sapiens
gagggaagcagugu

SEQ ID NO: 424491 - RNA, 20 nt, Homo sapiens
gagggacaacgaacauggca

SEQ ID NO: 424492 - RNA, 19 nt, Homo sapiens
gagggaccaauauuaccau

SEQ ID NO: 424493 - RNA, 13 nt, Homo sapiens
gagggacugccuc

SEQ ID NO: 424494 - RNA, 15 nt, Homo sapiens
gagggagaagcauga

SEQ ID NO: 424495 - RNA, 15 nt, Homo sapiens
gagggagggucagug

SEQ ID NO: 424496 - RNA, 17 nt, Homo sapiens
gagggaggguggccuaa

SEQ ID NO: 424497 - RNA, 22 nt, Homo sapiens
gagggaguacaaagacagggaa

SEQ ID NO: 424498 - RNA, 12 nt, Homo sapiens
gagggagugcag

SEQ ID NO: 424499 - RNA, 20 nt, Homo sapiens
gagggaguggguuaaacaca

SEQ ID NO: 424500 - RNA, 13 nt, Homo sapiens
gagggaugcagug

SEQ ID NO: 424501 - RNA, 20 nt, Homo sapiens
gagggcagcuggagaucuua

SEQ ID NO: 424502 - RNA, 17 nt, Homo sapiens
gagggcaggguucuaga

SEQ ID NO: 424503 - RNA, 17 nt, Homo sapiens
gagggcccacuucaggg

SEQ ID NO: 424504 - RNA, 22 nt, Homo sapiens
gagggcgccaucuauggugugg

SEQ ID NO: 424505 - RNA, 15 nt, Homo sapiens
gagggcugccugaaa

SEQ ID NO: 424506 - RNA, 23 nt, Homo sapiens
gaggggaaacgcaaaaccugcag

SEQ ID NO: 424507 - RNA, 17 nt, Homo sapiens
gaggggacugcaugcaa

SEQ ID NO: 424508 - RNA, 16 nt, Homo sapiens
gaggggcugacucagu

SEQ ID NO: 424509 - RNA, 21 nt, Homo sapiens
gaggggucagcucuggccaca

SEQ ID NO: 424510 - RNA, 12 nt, Homo sapiens
gaggggugcugc

SEQ ID NO: 424511 - RNA, 13 nt, Homo sapiens
gaggggugcugcc

SEQ ID NO: 424512 - RNA, 13 nt, Homo sapiens
gagggucauuuuc

SEQ ID NO: 424513 - RNA, 12 nt, Homo sapiens
gaggguuuccac

SEQ ID NO: 424514 - RNA, 15 nt, Homo sapiens
gaggguuuugcucuu

SEQ ID NO: 424515 - RNA, 13 nt, Homo sapiens
gagguaagaauag

SEQ ID NO: 424516 - RNA, 14 nt, Homo sapiens
gagguacgaaaaga

SEQ ID NO: 424517 - RNA, 18 nt, Homo sapiens
gagguccgacaaaccugg

SEQ ID NO: 424518 - RNA, 17 nt, Homo sapiens
gaggucuccucuagacu

SEQ ID NO: 424519 - RNA, 16 nt, Homo sapiens
gaggucucuugaggga

SEQ ID NO: 424520 - RNA, 20 nt, Homo sapiens
gaggugggaggauugcuuga

SEQ ID NO: 424521 - RNA, 22 nt, Homo sapiens
cacuguaaucuuaaaaguguaa

SEQ ID NO: 424522 - RNA, 17 nt, Homo sapiens
cacuguauaacauuuaa

SEQ ID NO: 424523 - RNA, 18 nt, Homo sapiens
cacugucccuugccucaa

SEQ ID NO: 424524 - RNA, 22 nt, Homo sapiens
cacuguccugggcgcccuggaa

SEQ ID NO: 424525 - RNA, 17 nt, Homo sapiens
cacugugcuugcuccua

SEQ ID NO: 424526 - RNA, 19 nt, Homo sapiens
cacuguguuuauaugucuu

SEQ ID NO: 424527 - RNA, 20 nt, Homo sapiens
cacuguuaauaguacuauua

SEQ ID NO: 424528 - RNA, 18 nt, Homo sapiens
cacuuaaaaaauguccau

SEQ ID NO: 424529 - RNA, 12 nt, Homo sapiens
cacuuaccuuau

SEQ ID NO: 424530 - RNA, 12 nt, Homo sapiens
cacuucauaucu

SEQ ID NO: 424531 - RNA, 20 nt, Homo sapiens
cacuucauccccucccagau

SEQ ID NO: 424532 - RNA, 21 nt, Homo sapiens
cacuucccauuuguguuucag

SEQ ID NO: 424533 - RNA, 9 nt, Homo sapiens
cacuucuua

SEQ ID NO: 424534 - RNA, 19 nt, Homo sapiens
cacuugaaggaagaagucu

SEQ ID NO: 424535 - RNA, 18 nt, Homo sapiens
cacuugaaugugucacua

SEQ ID NO: 424536 - RNA, 15 nt, Homo sapiens
cacuugacuuugcca

SEQ ID NO: 424537 - RNA, 16 nt, Homo sapiens
cacuugacuuugccac

SEQ ID NO: 424538 - RNA, 23 nt, Homo sapiens
cacuugauuuuuuucauuuugcc

SEQ ID NO: 424539 - RNA, 20 nt, Homo sapiens
cacuugccccuguuaccuaa

SEQ ID NO: 424540 - RNA, 22 nt, Homo sapiens
cacuugggauugucuuacuguu

SEQ ID NO: 424541 - RNA, 19 nt, Homo sapiens
cacuugggucuucccugua

SEQ ID NO: 424542 - RNA, 13 nt, Homo sapiens
cacuugguguacu

SEQ ID NO: 424543 - RNA, 22 nt, Homo sapiens
cacuuguaagaaaaugagacaa

SEQ ID NO: 424544 - RNA, 14 nt, Homo sapiens
cacuugucacuaca

SEQ ID NO: 424545 - RNA, 21 nt, Homo sapiens
cacuuugcagaccugggacuu

SEQ ID NO: 424546 - RNA, 16 nt, Homo sapiens
cacuuugccacuggau

SEQ ID NO: 424547 - RNA, 21 nt, Homo sapiens
cacuuugggaggccaaggugg

SEQ ID NO: 424548 - RNA, 19 nt, Homo sapiens
cacuuugggaggcugaggc

SEQ ID NO: 424549 - RNA, 17 nt, Homo sapiens
cacuuuuuuccugucaa

SEQ ID NO: 424550 - RNA, 20 nt, Homo sapiens
gaugugugucucaccccuca

SEQ ID NO: 424551 - RNA, 18 nt, Homo sapiens
gauguuuaguaauacagc

SEQ ID NO: 424552 - RNA, 15 nt, Homo sapiens
gauguuuccaaugcu

SEQ ID NO: 424553 - RNA, 15 nt, Homo sapiens
gauguuuguuuucaa

SEQ ID NO: 424554 - RNA, 16 nt, Homo sapiens
gauuaaguauaucuau

SEQ ID NO: 424555 - RNA, 15 nt, Homo sapiens
gauuaauguuuugua

SEQ ID NO: 424556 - RNA, 21 nt, Homo sapiens
gauuaauuaaaacacaacauc

SEQ ID NO: 424557 - RNA, 20 nt, Homo sapiens
gauuacuaucauggcauaua

SEQ ID NO: 424558 - RNA, 16 nt, Homo sapiens
gauuacuuuugggagg

SEQ ID NO: 424559 - RNA, 14 nt, Homo sapiens
gauuagacagucaa

SEQ ID NO: 424560 - RNA, 14 nt, Homo sapiens
gauuaucugucauu

SEQ ID NO: 424561 - RNA, 23 nt, Homo sapiens
gauuauuuguuauuuguacaguu

SEQ ID NO: 424562 - RNA, 14 nt, Homo sapiens
gauucaaaucuaug

SEQ ID NO: 424563 - RNA, 13 nt, Homo sapiens
gauucaacacaua

SEQ ID NO: 424564 - RNA, 21 nt, Homo sapiens
gauucaagacucaauguggaa

SEQ ID NO: 424565 - RNA, 22 nt, Homo sapiens
gauucaauaaaaugcacugacc

SEQ ID NO: 424566 - RNA, 13 nt, Homo sapiens
gauucacuauuag

SEQ ID NO: 424567 - RNA, 23 nt, Homo sapiens
gauuccaggcgaugugcaagugu

SEQ ID NO: 424568 - RNA, 15 nt, Homo sapiens
gauuccccuggacau

SEQ ID NO: 424569 - RNA, 16 nt, Homo sapiens
gauucuaaaacauucu

SEQ ID NO: 424570 - RNA, 17 nt, Homo sapiens
gauucuaaauguucaug

SEQ ID NO: 424571 - RNA, 15 nt, Homo sapiens
gauucuccugccuca

SEQ ID NO: 424572 - RNA, 15 nt, Homo sapiens
gauucucgacucuuu

SEQ ID NO: 424573 - RNA, 18 nt, Homo sapiens
gauucucugcgagcaaca

SEQ ID NO: 424574 - RNA, 21 nt, Homo sapiens
gauucugggaaaggugcucaa

SEQ ID NO: 424575 - RNA, 21 nt, Homo sapiens
gauucuugugccucagcuucc

SEQ ID NO: 424576 - RNA, 19 nt, Homo sapiens
gauugagcagaacccagac

SEQ ID NO: 424577 - RNA, 19 nt, Homo sapiens
gauugauagaguguuauca

SEQ ID NO: 424578 - RNA, 14 nt, Homo sapiens
gauugcucuggaag

SEQ ID NO: 424579 - RNA, 19 nt, Homo sapiens
gauugggauuaacauaaaa

SEQ ID NO: 424580 - RNA, 17 nt, Homo sapiens
gauuguacgugggagag

SEQ ID NO: 424581 - RNA, 17 nt, Homo sapiens
gauuuaaaaacuggaac

SEQ ID NO: 424582 - RNA, 16 nt, Homo sapiens
gauuuaaaaaugccaa

SEQ ID NO: 424583 - RNA, 15 nt, Homo sapiens
gauuuaacugugaac

SEQ ID NO: 424584 - RNA, 15 nt, Homo sapiens
gauuuaucacacaaa

SEQ ID NO: 424585 - RNA, 16 nt, Homo sapiens
gauuuaugaucacuug

SEQ ID NO: 424586 - RNA, 19 nt, Homo sapiens
gauuuaugaucacuuggaa

SEQ ID NO: 424587 - RNA, 23 nt, Homo sapiens
gauuucaccccacagacacuuac

SEQ ID NO: 424588 - RNA, 21 nt, Homo sapiens
gauuucagaucauauuucaca

SEQ ID NO: 424589 - RNA, 23 nt, Homo sapiens
gauuuccugcugccauccucacc

SEQ ID NO: 424590 - RNA, 18 nt, Homo sapiens
gauuucucauugaucaca

SEQ ID NO: 424591 - RNA, 22 nt, Homo sapiens
gauuugccagcacaggggcccc

SEQ ID NO: 424592 - RNA, 13 nt, Homo sapiens
gauuugccugugc

SEQ ID NO: 424593 - RNA, 17 nt, Homo sapiens
gauuugggggugcaaug

SEQ ID NO: 424594 - RNA, 18 nt, Homo sapiens
gauuuuacacaccaccag

SEQ ID NO: 424595 - RNA, 21 nt, Homo sapiens
gauuuucaagaucaaacuucc

SEQ ID NO: 424596 - RNA, 20 nt, Homo sapiens
gauuuucaauaauagacuua

SEQ ID NO: 424597 - RNA, 21 nt, Homo sapiens
gauuuuggaaaagaaacaaua

SEQ ID NO: 424598 - RNA, 16 nt, Homo sapiens
gauuuuucucaucucc

SEQ ID NO: 424599 - RNA, 13 nt, Homo sapiens
gcaaaaaacuaau

SEQ ID NO: 424600 - RNA, 17 nt, Homo sapiens
gcaaaaaacuaauguga

SEQ ID NO: 424601 - RNA, 15 nt, Homo sapiens
gcaaaacauugcugc

SEQ ID NO: 424602 - RNA, 11 nt, Homo sapiens
gcaaaacugca

SEQ ID NO: 424603 - RNA, 14 nt, Homo sapiens
gcaaaaggcagcuc

SEQ ID NO: 424604 - RNA, 18 nt, Homo sapiens
gcaaaaugcugcuuucug

SEQ ID NO: 424605 - RNA, 18 nt, Homo sapiens
gcaaacucacugcucaag

SEQ ID NO: 424606 - RNA, 19 nt, Homo sapiens
gcaaagaacccauuugcca

SEQ ID NO: 424607 - RNA, 19 nt, Homo sapiens
gcaaagcaacgacuacuuu

SEQ ID NO: 424608 - RNA, 15 nt, Homo sapiens
gcaaaggccagcagc

SEQ ID NO: 424609 - RNA, 16 nt, Homo sapiens
gcaaaggccagcagca

SEQ ID NO: 424610 - RNA, 17 nt, Homo sapiens
gcaaaguaccaacugag

SEQ ID NO: 424611 - RNA, 21 nt, Homo sapiens
gcaaaguaccaacugagccaa

SEQ ID NO: 424612 - RNA, 13 nt, Homo sapiens
gcaaagugcugua

SEQ ID NO: 424613 - RNA, 13 nt, Homo sapiens
gcaaaucagacac

SEQ ID NO: 424614 - RNA, 20 nt, Homo sapiens
gcaaauguccaagcaucagc

SEQ ID NO: 424615 - RNA, 21 nt, Homo sapiens
gcaaauuccaccccuccuucc

SEQ ID NO: 424616 - RNA, 14 nt, Homo sapiens
gcaacagagcaaaa

SEQ ID NO: 424617 - RNA, 13 nt, Homo sapiens
gcaacagcacugg

SEQ ID NO: 424618 - RNA, 14 nt, Homo sapiens
gcaacagccuguuu

SEQ ID NO: 424619 - RNA, 20 nt, Homo sapiens
gcaacaggaaggaaccagaa

SEQ ID NO: 424620 - RNA, 14 nt, Homo sapiens
gcaacaugcuucau

SEQ ID NO: 424621 - RNA, 12 nt, Homo sapiens
gcaacauuacaa

SEQ ID NO: 424622 - RNA, 17 nt, Homo sapiens
gcaaccacacaccucac

SEQ ID NO: 424623 - RNA, 21 nt, Homo sapiens
gcaaccuccgccuccuggguu

SEQ ID NO: 424624 - RNA, 16 nt, Homo sapiens
gcaacggggaggccaa

SEQ ID NO: 424625 - RNA, 11 nt, Homo sapiens
gcaacuuugau

SEQ ID NO: 424626 - RNA, 13 nt, Homo sapiens
gcaagaagacugu

SEQ ID NO: 424627 - RNA, 17 nt, Homo sapiens
gcaagacuguugcucaa

SEQ ID NO: 424628 - RNA, 20 nt, Homo sapiens
gcaagagaacaauguuucuu

SEQ ID NO: 424629 - RNA, 13 nt, Homo sapiens
gcaagcagggaaa

SEQ ID NO: 424630 - RNA, 19 nt, Homo sapiens
gcaagcccgucaucuuccc

SEQ ID NO: 424631 - RNA, 15 nt, Homo sapiens
gcaagcuaacugcuu

SEQ ID NO: 424632 - RNA, 22 nt, Homo sapiens
gcaaggacugcagggacugcca

SEQ ID NO: 424633 - RNA, 15 nt, Homo sapiens
gcaaggccugugcug

SEQ ID NO: 424634 - RNA, 17 nt, Homo sapiens
gcaaggccugugcugca

SEQ ID NO: 424635 - RNA, 21 nt, Homo sapiens
gcaaguaugugagugugucca

SEQ ID NO: 424636 - RNA, 14 nt, Homo sapiens
gcaagucccaugau

SEQ ID NO: 424637 - RNA, 15 nt, Homo sapiens
gcaagucgccaggca

SEQ ID NO: 424638 - RNA, 16 nt, Homo sapiens
gcaaguguaugcacgu

SEQ ID NO: 424639 - RNA, 21 nt, Homo sapiens
gcaagugugugcacaugugug

SEQ ID NO: 424640 - RNA, 19 nt, Homo sapiens
gcaaguuucaucagucaau

SEQ ID NO: 424641 - RNA, 14 nt, Homo sapiens
gcaauaaauaccag

SEQ ID NO: 424642 - RNA, 14 nt, Homo sapiens
gcaauaaauauuag

SEQ ID NO: 424643 - RNA, 19 nt, Homo sapiens
gcaauauuuauagggcuuu

SEQ ID NO: 424644 - RNA, 17 nt, Homo sapiens
gcaaucaaacgaagaca

SEQ ID NO: 424645 - RNA, 23 nt, Homo sapiens
gcaaucaaguccuacaagcuaaa

SEQ ID NO: 424646 - RNA, 15 nt, Homo sapiens
gcaaucuaugacuca

SEQ ID NO: 424647 - RNA, 17 nt, Homo sapiens
gcaaucuuugccuuuau

SEQ ID NO: 424648 - RNA, 17 nt, Homo sapiens
gcaaugcaauguggaaa

SEQ ID NO: 424649 - RNA, 19 nt, Homo sapiens
gcaaugccuagacuuccca

SEQ ID NO: 424650 - RNA, 19 nt, Homo sapiens
gcaauguaucccuucucac

SEQ ID NO: 424651 - RNA, 19 nt, Homo sapiens
gcaauuacaauacaucuaa

SEQ ID NO: 424652 - RNA, 21 nt, Homo sapiens
gcaauugaauuaaauuaggaa

SEQ ID NO: 424653 - RNA, 13 nt, Homo sapiens
gcaauugcuucuc

SEQ ID NO: 424654 - RNA, 16 nt, Homo sapiens
gcaauuucacugaugu

SEQ ID NO: 424655 - RNA, 17 nt, Homo sapiens
gcaauuuuguaaauuga

SEQ ID NO: 424656 - RNA, 23 nt, Homo sapiens
gcaauuuuuuuauacuaccaagu

SEQ ID NO: 424657 - RNA, 13 nt, Homo sapiens
gcacaagcauucc

SEQ ID NO: 424658 - RNA, 19 nt, Homo sapiens
gcacacacacacaucucau

SEQ ID NO: 424659 - RNA, 15 nt, Homo sapiens
gcacacaccugccug

SEQ ID NO: 424660 - RNA, 18 nt, Homo sapiens
caggaagcccaaggcagu

SEQ ID NO: 424661 - RNA, 21 nt, Homo sapiens
caggaaggcggggcuucaacc

SEQ ID NO: 424662 - RNA, 13 nt, Homo sapiens
caggaaguacugg

SEQ ID NO: 424663 - RNA, 20 nt, Homo sapiens
caggacaacuuuacaaaaca

SEQ ID NO: 424664 - RNA, 17 nt, Homo sapiens
caggacacgacuuguaa

SEQ ID NO: 424665 - RNA, 14 nt, Homo sapiens
caggaccaggagcc

SEQ ID NO: 424666 - RNA, 15 nt, Homo sapiens
caggaccuggagaca

SEQ ID NO: 424667 - RNA, 12 nt, Homo sapiens
caggacuagcug

SEQ ID NO: 424668 - RNA, 14 nt, Homo sapiens
caggagaaagaagg

SEQ ID NO: 424669 - RNA, 14 nt, Homo sapiens
caggagacauuggu

SEQ ID NO: 424670 - RNA, 18 nt, Homo sapiens
caggagaccuggcacugg

SEQ ID NO: 424671 - RNA, 22 nt, Homo sapiens
caggagaccuggcacuggaugc

SEQ ID NO: 424672 - RNA, 14 nt, Homo sapiens
caggagagcccucu

SEQ ID NO: 424673 - RNA, 17 nt, Homo sapiens
caggagaugaugugaug

SEQ ID NO: 424674 - RNA, 13 nt, Homo sapiens
caggagauuacaa

SEQ ID NO: 424675 - RNA, 19 nt, Homo sapiens
caggagcauuuugugucuu

SEQ ID NO: 424676 - RNA, 16 nt, Homo sapiens
caggagccagcagggc

SEQ ID NO: 424677 - RNA, 10 nt, Homo sapiens
caggagcuca

SEQ ID NO: 424678 - RNA, 21 nt, Homo sapiens
caggaggagggcgcaugugug

SEQ ID NO: 424679 - RNA, 17 nt, Homo sapiens
caggaggaucacuugag

SEQ ID NO: 424680 - RNA, 18 nt, Homo sapiens
caggaggaucacuugagg

SEQ ID NO: 424681 - RNA, 15 nt, Homo sapiens
cccaguccuccagac

SEQ ID NO: 424682 - RNA, 15 nt, Homo sapiens
cccagugaucaccug

SEQ ID NO: 424683 - RNA, 16 nt, Homo sapiens
cccaguggaacaguca

SEQ ID NO: 424684 - RNA, 19 nt, Homo sapiens
cccaguucauguugcucag

SEQ ID NO: 424685 - RNA, 14 nt, Homo sapiens
cccauagcuuccau

SEQ ID NO: 424686 - RNA, 19 nt, Homo sapiens
ggaagaaaagcugccauuu

SEQ ID NO: 424687 - RNA, 11 nt, Homo sapiens
ggaagaagcaa

SEQ ID NO: 424688 - RNA, 23 nt, Homo sapiens
ggaagaccagcuuugcagugaca

SEQ ID NO: 424689 - RNA, 19 nt, Homo sapiens
ggaagacuagaggcuugca

SEQ ID NO: 424690 - RNA, 19 nt, Homo sapiens
ggaagagagagacccucac

SEQ ID NO: 424691 - RNA, 12 nt, Homo sapiens
ggaagagcuaau

SEQ ID NO: 424692 - RNA, 10 nt, Homo sapiens
ggaagagcuc

SEQ ID NO: 424693 - RNA, 23 nt, Homo sapiens
ggaagagcuggguaccaggccac

SEQ ID NO: 424694 - RNA, 15 nt, Homo sapiens
ggaagcaagauguga

SEQ ID NO: 424695 - RNA, 14 nt, Homo sapiens
ggaagcacaggcca

SEQ ID NO: 424696 - RNA, 20 nt, Homo sapiens
ggaagcagaaucuuugcaag

SEQ ID NO: 424697 - RNA, 17 nt, Homo sapiens
ggaagccccacuugaag

SEQ ID NO: 424698 - RNA, 15 nt, Homo sapiens
ggaagcucuaccgca

SEQ ID NO: 424699 - RNA, 16 nt, Homo sapiens
ggaagcugucccucac

SEQ ID NO: 424700 - RNA, 19 nt, Homo sapiens
ggaagcuucuugcugccag

SEQ ID NO: 424701 - RNA, 19 nt, Homo sapiens
ggaagcuuggggaacccau

SEQ ID NO: 424702 - RNA, 17 nt, Homo sapiens
ggaaggcaaaugaugcc

SEQ ID NO: 424703 - RNA, 19 nt, Homo sapiens
ggaaggucuccccaugugc

SEQ ID NO: 424704 - RNA, 14 nt, Homo sapiens
ggaagucucaaaga

SEQ ID NO: 424705 - RNA, 20 nt, Homo sapiens
ggaagugacaggacuuucau

SEQ ID NO: 424706 - RNA, 15 nt, Homo sapiens
ggaaguguaacagcu

SEQ ID NO: 424707 - RNA, 21 nt, Homo sapiens
ggaauauaaggaaagcaauaa

SEQ ID NO: 424708 - RNA, 19 nt, Homo sapiens
ggaaucuuuuacuguggag

SEQ ID NO: 424709 - RNA, 18 nt, Homo sapiens
ggaaugggccaagccagg

SEQ ID NO: 424710 - RNA, 22 nt, Homo sapiens
ggaauggugcccuuggaggcaa

SEQ ID NO: 424711 - RNA, 17 nt, Homo sapiens
ggaauuagaaauauauc

SEQ ID NO: 424712 - RNA, 14 nt, Homo sapiens
ggaauugguguaua

SEQ ID NO: 424713 - RNA, 18 nt, Homo sapiens
ggacaacagagaugccau

SEQ ID NO: 424714 - RNA, 17 nt, Homo sapiens
ggacaacgaacauggca

SEQ ID NO: 424715 - RNA, 18 nt, Homo sapiens
ggacacaaaaaaauggaa

SEQ ID NO: 424716 - RNA, 17 nt, Homo sapiens
ggacacugaaccuuguu

SEQ ID NO: 424717 - RNA, 21 nt, Homo sapiens
ggacagaucaauggcgcagug

SEQ ID NO: 424718 - RNA, 17 nt, Homo sapiens
ggacagaugaaugccgu

SEQ ID NO: 424719 - RNA, 22 nt, Homo sapiens
ggacagcccgccgucagggugg

SEQ ID NO: 424720 - RNA, 21 nt, Homo sapiens
ggacagcugcuucugugcauu

SEQ ID NO: 424721 - RNA, 18 nt, Homo sapiens
ggacaggauggcugugug

SEQ ID NO: 424722 - RNA, 16 nt, Homo sapiens
ggacaguggaugcugc

SEQ ID NO: 424723 - RNA, 23 nt, Homo sapiens
ggacauggugugccacaggcugc

SEQ ID NO: 424724 - RNA, 16 nt, Homo sapiens
ggaccagaagcauuuc

SEQ ID NO: 424725 - RNA, 16 nt, Homo sapiens
ggaccaggagccaggu

SEQ ID NO: 424726 - RNA, 17 nt, Homo sapiens
ggaccaguggugccuug

SEQ ID NO: 424727 - RNA, 14 nt, Homo sapiens
ggaccucaguuucu

SEQ ID NO: 424728 - RNA, 19 nt, Homo sapiens
ggaccuccaccugggagau

SEQ ID NO: 424729 - RNA, 14 nt, Homo sapiens
ggaccuguccaugc

SEQ ID NO: 424730 - RNA, 12 nt, Homo sapiens
ggacgaggucaa

SEQ ID NO: 424731 - RNA, 23 nt, Homo sapiens
ggacuauauaaaguacuacugua

SEQ ID NO: 424732 - RNA, 22 nt, Homo sapiens
ggacucaggccugccaaugcca

SEQ ID NO: 424733 - RNA, 13 nt, Homo sapiens
ggacucuugcucu

SEQ ID NO: 424734 - RNA, 14 nt, Homo sapiens
ggacugguccaggc

SEQ ID NO: 424735 - RNA, 18 nt, Homo sapiens
ggacuuccuugcucuccc

SEQ ID NO: 424736 - RNA, 14 nt, Homo sapiens
ggacuucugcaucu

SEQ ID NO: 424737 - RNA, 17 nt, Homo sapiens
ggacuugcuuccaagcc

SEQ ID NO: 424738 - RNA, 22 nt, Homo sapiens
ggacuugguuuguuauaucagg

SEQ ID NO: 424739 - RNA, 15 nt, Homo sapiens
ggagaaaagccagau

SEQ ID NO: 424740 - RNA, 23 nt, Homo sapiens
ggagaaccucguugacaugcaca

SEQ ID NO: 424741 - RNA, 22 nt, Homo sapiens
ggagaaggagagggaguacaaa

SEQ ID NO: 424742 - RNA, 24 nt, Homo sapiens
ggagaauuauauagguugugcaaa

SEQ ID NO: 424743 - RNA, 17 nt, Homo sapiens
ggagacacuguucccaa

SEQ ID NO: 424744 - RNA, 21 nt, Homo sapiens
ggagacagucaggaagccucc

SEQ ID NO: 424745 - RNA, 14 nt, Homo sapiens
ggagacccaugugc

SEQ ID NO: 424746 - RNA, 15 nt, Homo sapiens
ggagaccuggcacug

SEQ ID NO: 424747 - RNA, 17 nt, Homo sapiens
ggagaccuggcacugga

SEQ ID NO: 424748 - RNA, 21 nt, Homo sapiens
ggagaccuuccacaaagggua

SEQ ID NO: 424749 - RNA, 13 nt, Homo sapiens
ggagacuccauga

SEQ ID NO: 424750 - RNA, 12 nt, Homo sapiens
ggagacuuguau

SEQ ID NO: 424751 - RNA, 22 nt, Homo sapiens
ggagagaaugagagagugugga

SEQ ID NO: 424752 - RNA, 13 nt, Homo sapiens
ggagagagccuug

SEQ ID NO: 424753 - RNA, 15 nt, Homo sapiens
ggagagcagcuggcu

SEQ ID NO: 424754 - RNA, 15 nt, Homo sapiens
ggagagcccaggccu

SEQ ID NO: 424755 - RNA, 23 nt, Homo sapiens
ggagagcccggcgccccugccac

SEQ ID NO: 424756 - RNA, 17 nt, Homo sapiens
ggagagggcagaggucc

SEQ ID NO: 424757 - RNA, 19 nt, Homo sapiens
ggagaguugaccguuuuca

SEQ ID NO: 424758 - RNA, 21 nt, Homo sapiens
ggagaucgcaucauugcacuc

SEQ ID NO: 424759 - RNA, 14 nt, Homo sapiens
ggagaugggaugcu

SEQ ID NO: 424760 - RNA, 21 nt, Homo sapiens
ggagauuucuuguugcucaaa

SEQ ID NO: 424761 - RNA, 15 nt, Homo sapiens
ggagcaaaacaaagc

SEQ ID NO: 424762 - RNA, 19 nt, Homo sapiens
ggagcaugggccuggccac

SEQ ID NO: 424763 - RNA, 22 nt, Homo sapiens
ggagcauuuugugucuuaagaa

SEQ ID NO: 424764 - RNA, 14 nt, Homo sapiens
ggagccacaggcag

SEQ ID NO: 424765 - RNA, 16 nt, Homo sapiens
ggagccauaagggaca

SEQ ID NO: 424766 - RNA, 15 nt, Homo sapiens
ggagcccgugcagua

SEQ ID NO: 424767 - RNA, 14 nt, Homo sapiens
ggagcccucaucuu

SEQ ID NO: 424768 - RNA, 22 nt, Homo sapiens
ggagcccugggguuuccacaca

SEQ ID NO: 424769 - RNA, 18 nt, Homo sapiens
ggagccuccugacccugu

SEQ ID NO: 424770 - RNA, 23 nt, Homo sapiens
ggagcucuucaggccucccucuc

SEQ ID NO: 424771 - RNA, 21 nt, Homo sapiens
ggagcugaugaaacucacaaa

SEQ ID NO: 424772 - RNA, 20 nt, Homo sapiens
ggaggaacgugguucagaga

SEQ ID NO: 424773 - RNA, 18 nt, Homo sapiens
ggaggaaugcucccccau

SEQ ID NO: 424774 - RNA, 20 nt, Homo sapiens
ggaggagccuuggaguguaa

SEQ ID NO: 424775 - RNA, 12 nt, Homo sapiens
ggaggaugacca

SEQ ID NO: 424776 - RNA, 20 nt, Homo sapiens
ggaggccaagccugcagcuu

SEQ ID NO: 424777 - RNA, 14 nt, Homo sapiens
ggaggccaaggugg

SEQ ID NO: 424778 - RNA, 16 nt, Homo sapiens
ggaggccaaggugggc

SEQ ID NO: 424779 - RNA, 14 nt, Homo sapiens
ggaggccaggcccu

SEQ ID NO: 424780 - RNA, 14 nt, Homo sapiens
ggaggccugaugcu

SEQ ID NO: 424781 - RNA, 15 nt, Homo sapiens
ggaggcugaggcaag

SEQ ID NO: 424782 - RNA, 14 nt, Homo sapiens
ggagggcagccacg

SEQ ID NO: 424783 - RNA, 14 nt, Homo sapiens
ggaggggugguccu

SEQ ID NO: 424784 - RNA, 17 nt, Homo sapiens
ggagguacgaaaagagg

SEQ ID NO: 424785 - RNA, 14 nt, Homo sapiens
ggaggucgacccca

SEQ ID NO: 424786 - RNA, 21 nt, Homo sapiens
ggagguuuguuugugugaaag

SEQ ID NO: 424787 - RNA, 19 nt, Homo sapiens
ggaguccacuuuccucucu

SEQ ID NO: 424788 - RNA, 19 nt, Homo sapiens
ggagucggaucuagccaug

SEQ ID NO: 424789 - RNA, 22 nt, Homo sapiens
ggagucucugccacccacucag

SEQ ID NO: 424790 - RNA, 21 nt, Homo sapiens
ggagucugccuccaugcugca

SEQ ID NO: 424791 - RNA, 15 nt, Homo sapiens
ggagugaacauuucu

SEQ ID NO: 424792 - RNA, 16 nt, Homo sapiens
ggaguggaaacaaagg

SEQ ID NO: 424793 - RNA, 16 nt, Homo sapiens
ggaguggaaggugagg

SEQ ID NO: 424794 - RNA, 14 nt, Homo sapiens
ggaguggcugccau

SEQ ID NO: 424795 - RNA, 15 nt, Homo sapiens
ggaguguucuguggg

SEQ ID NO: 424796 - RNA, 15 nt, Homo sapiens
ggaguuaacuacccu

SEQ ID NO: 424797 - RNA, 15 nt, Homo sapiens
ggaguucagcugcuu

SEQ ID NO: 424798 - RNA, 12 nt, Homo sapiens
ggauaacaccac

SEQ ID NO: 424799 - RNA, 18 nt, Homo sapiens
ggauaagcacuagaucuc

SEQ ID NO: 424800 - RNA, 17 nt, Homo sapiens
ggauacuggugcaguca

SEQ ID NO: 424801 - RNA, 12 nt, Homo sapiens
ggauaugcagua

SEQ ID NO: 424802 - RNA, 20 nt, Homo sapiens
ggauauuaacaacaauaaca

SEQ ID NO: 424803 - RNA, 14 nt, Homo sapiens
ggaucaagacauaa

SEQ ID NO: 424804 - RNA, 12 nt, Homo sapiens
ggaucagugggg

SEQ ID NO: 424805 - RNA, 20 nt, Homo sapiens
ggaucauguaaaugcucaaa

SEQ ID NO: 424806 - RNA, 14 nt, Homo sapiens
ggauccugcacucu

SEQ ID NO: 424807 - RNA, 13 nt, Homo sapiens
ggaucugcagcuc

SEQ ID NO: 424808 - RNA, 13 nt, Homo sapiens
ggaucugggcaaa

SEQ ID NO: 424809 - RNA, 19 nt, Homo sapiens
ggaucuggggaaggaccaa

SEQ ID NO: 424810 - RNA, 17 nt, Homo sapiens
ggaucuuuucauucuca

SEQ ID NO: 424811 - RNA, 20 nt, Homo sapiens
ggaugaagauucuccugugc

SEQ ID NO: 424812 - RNA, 21 nt, Homo sapiens
ccucaggguggggggugacag

SEQ ID NO: 424813 - RNA, 20 nt, Homo sapiens
ccucagguggccccaguuca

SEQ ID NO: 424814 - RNA, 19 nt, Homo sapiens
ccucauccacuaggugccc

SEQ ID NO: 424815 - RNA, 14 nt, Homo sapiens
ccucauccaugcag

SEQ ID NO: 424816 - RNA, 14 nt, Homo sapiens
ccucauggacucca

SEQ ID NO: 424817 - RNA, 12 nt, Homo sapiens
ccucauguucuc

SEQ ID NO: 424818 - RNA, 21 nt, Homo sapiens
ccucauuacugccaacaguuu

SEQ ID NO: 424819 - RNA, 20 nt, Homo sapiens
ccucauugcauuuauugcag

SEQ ID NO: 424820 - RNA, 22 nt, Homo sapiens
ccucauugcauuuauugcaguu

SEQ ID NO: 424821 - RNA, 16 nt, Homo sapiens
ccucauuuaucacucu

SEQ ID NO: 424822 - RNA, 12 nt, Homo sapiens
ccucauuugcau

SEQ ID NO: 424823 - RNA, 19 nt, Homo sapiens
ccuccaagugaaugaguuu

SEQ ID NO: 424824 - RNA, 20 nt, Homo sapiens
ggcugcgaacugugcaguua

SEQ ID NO: 424825 - RNA, 20 nt, Homo sapiens
ggcuggacuggaggugggca

SEQ ID NO: 424826 - RNA, 22 nt, Homo sapiens
ggcuggacuggaggugggcaug

SEQ ID NO: 424827 - RNA, 15 nt, Homo sapiens
ggcuggagugcaaug

SEQ ID NO: 424828 - RNA, 19 nt, Homo sapiens
ggcuggagugcaguggcgu

SEQ ID NO: 424829 - RNA, 17 nt, Homo sapiens
ggcuggauagguaugca

SEQ ID NO: 424830 - RNA, 11 nt, Homo sapiens
ggcuggcacug

SEQ ID NO: 424831 - RNA, 18 nt, Homo sapiens
ggcuggcugaguggaaug

SEQ ID NO: 424832 - RNA, 12 nt, Homo sapiens
ggcuggcuuccu

SEQ ID NO: 424833 - RNA, 20 nt, Homo sapiens
ggcuggguuuucaggggcuu

SEQ ID NO: 424834 - RNA, 18 nt, Homo sapiens
ggcuggucuuggugaaca

SEQ ID NO: 424835 - RNA, 21 nt, Homo sapiens
ggcuguagcaacccuuuccaa

SEQ ID NO: 424836 - RNA, 21 nt, Homo sapiens
ggcuuagacuucgacucagga

SEQ ID NO: 424837 - RNA, 13 nt, Homo sapiens
ggcuuaugcccuc

SEQ ID NO: 424838 - RNA, 15 nt, Homo sapiens
ggcuucaagagccag

SEQ ID NO: 424839 - RNA, 17 nt, Homo sapiens
ggcuucagccccugggg

SEQ ID NO: 424840 - RNA, 16 nt, Homo sapiens
ggcuucgggcagggaa

SEQ ID NO: 424841 - RNA, 19 nt, Homo sapiens
ggcuucucuugagucacac

SEQ ID NO: 424842 - RNA, 22 nt, Homo sapiens
ggcuucucuugcuaccugugag

SEQ ID NO: 424843 - RNA, 17 nt, Homo sapiens
ggcuucugucucuauga

SEQ ID NO: 424844 - RNA, 16 nt, Homo sapiens
ggcuugaaaugcauua

SEQ ID NO: 424845 - RNA, 15 nt, Homo sapiens
ggcuugacucaggau

SEQ ID NO: 424846 - RNA, 16 nt, Homo sapiens
ggcuugauauuuucca

SEQ ID NO: 424847 - RNA, 14 nt, Homo sapiens
ggcuugcagugcgc

SEQ ID NO: 424848 - RNA, 16 nt, Homo sapiens
ggcuuggaagggcgcu

SEQ ID NO: 424849 - RNA, 17 nt, Homo sapiens
ggcuuuaagcgaggcag

SEQ ID NO: 424850 - RNA, 20 nt, Homo sapiens
ggcuuuacauggguucaauu

SEQ ID NO: 424851 - RNA, 23 nt, Homo sapiens
ggcuuuacauggguucaauugga

SEQ ID NO: 424852 - RNA, 17 nt, Homo sapiens
ggcuuuccucagcaccu

SEQ ID NO: 424853 - RNA, 19 nt, Homo sapiens
ggcuuuuaagaaacacagg

SEQ ID NO: 424854 - RNA, 13 nt, Homo sapiens
ggcuuuugaacug

SEQ ID NO: 424855 - RNA, 14 nt, Homo sapiens
gggaaagcagagug

SEQ ID NO: 424856 - RNA, 18 nt, Homo sapiens
gggaaaggugcucaaaga

SEQ ID NO: 424857 - RNA, 18 nt, Homo sapiens
gggaacauuauuccugca

SEQ ID NO: 424858 - RNA, 14 nt, Homo sapiens
gggaagaaacacuc

SEQ ID NO: 424859 - RNA, 12 nt, Homo sapiens
gggaagaacucu

SEQ ID NO: 424860 - RNA, 21 nt, Homo sapiens
gggaaggaaggcguguccagg

SEQ ID NO: 424861 - RNA, 15 nt, Homo sapiens
gggaaggagugugca

SEQ ID NO: 424862 - RNA, 18 nt, Homo sapiens
gggaaggcaaaugaugcc

SEQ ID NO: 424863 - RNA, 23 nt, Homo sapiens
gggaaggucccgaauggagucca

SEQ ID NO: 424864 - RNA, 15 nt, Homo sapiens
gggacacaggggcaa

SEQ ID NO: 424865 - RNA, 22 nt, Homo sapiens
gggacacggccucuggggagac

SEQ ID NO: 424866 - RNA, 13 nt, Homo sapiens
gggaccgccagau

SEQ ID NO: 424867 - RNA, 12 nt, Homo sapiens
gggacuaggacc

SEQ ID NO: 424868 - RNA, 16 nt, Homo sapiens
gggacucagggccaug

SEQ ID NO: 424869 - RNA, 11 nt, Homo sapiens
gggacugcugc

SEQ ID NO: 424870 - RNA, 16 nt, Homo sapiens
gggacugggagucaga

SEQ ID NO: 424871 - RNA, 14 nt, Homo sapiens
gggacuuccuugcu

SEQ ID NO: 424872 - RNA, 12 nt, Homo sapiens
gggagaaaaaga

SEQ ID NO: 424873 - RNA, 16 nt, Homo sapiens
gggagagacugugagg

SEQ ID NO: 424874 - RNA, 23 nt, Homo sapiens
gggagagccaaggccuaugccac

SEQ ID NO: 424875 - RNA, 13 nt, Homo sapiens
gggagcagugucu

SEQ ID NO: 424876 - RNA, 23 nt, Homo sapiens
gggagccaauacugagugccugc

SEQ ID NO: 424877 - RNA, 21 nt, Homo sapiens
gggaggacaaaggugauuuuc

SEQ ID NO: 424878 - RNA, 23 nt, Homo sapiens
gggaggauugcuugaacccaaga

SEQ ID NO: 424879 - RNA, 20 nt, Homo sapiens
gggaguaggacauaccagcu

SEQ ID NO: 424880 - RNA, 21 nt, Homo sapiens
gggagucagucuucacuugca

SEQ ID NO: 424881 - RNA, 23 nt, Homo sapiens
gggauaaguaaguuugauuucau

SEQ ID NO: 424882 - RNA, 23 nt, Homo sapiens
gggauacuuagugguaugucucu

SEQ ID NO: 424883 - RNA, 23 nt, Homo sapiens
gggaucagccuccgccauuccaa

SEQ ID NO: 424884 - RNA, 13 nt, Homo sapiens
gggaugcuugccu

SEQ ID NO: 424885 - RNA, 17 nt, Homo sapiens
gggaugggaacacuggu

SEQ ID NO: 424886 - RNA, 19 nt, Homo sapiens
gggaugucugaaaucagug

SEQ ID NO: 424887 - RNA, 22 nt, Homo sapiens
gggauugucuuacuguugcaua

SEQ ID NO: 424888 - RNA, 16 nt, Homo sapiens
gggauuuuucauucuu

SEQ ID NO: 424889 - RNA, 23 nt, Homo sapiens
gggcaaaagacgggaagcaagau

SEQ ID NO: 424890 - RNA, 23 nt, Homo sapiens
gggcaaagaacugccccaucucc

SEQ ID NO: 424891 - RNA, 22 nt, Homo sapiens
gggcaaggugagggaugccaua

SEQ ID NO: 424892 - RNA, 22 nt, Homo sapiens
gggcaccacccgcuuucuugcu

SEQ ID NO: 424893 - RNA, 17 nt, Homo sapiens
gggcagagcucagagga

SEQ ID NO: 424894 - RNA, 14 nt, Homo sapiens
gggcagauauucuc

SEQ ID NO: 424895 - RNA, 15 nt, Homo sapiens
gggcagaucauuuga

SEQ ID NO: 424896 - RNA, 15 nt, Homo sapiens
gggcagcuggcagga

SEQ ID NO: 424897 - RNA, 21 nt, Homo sapiens
gggcaggggcugcauccucag

SEQ ID NO: 424898 - RNA, 17 nt, Homo sapiens
gggcauccaccucccag

SEQ ID NO: 424899 - RNA, 18 nt, Homo sapiens
gggcaucugccccucccc

SEQ ID NO: 424900 - RNA, 21 nt, Homo sapiens
gggcaugggggaggcucugaa

SEQ ID NO: 424901 - RNA, 16 nt, Homo sapiens
gggccacaugggucca

SEQ ID NO: 424902 - RNA, 19 nt, Homo sapiens
gggcccagaggcacagccg

SEQ ID NO: 424903 - RNA, 14 nt, Homo sapiens
gggccccucagagc

SEQ ID NO: 424904 - RNA, 22 nt, Homo sapiens
gggccgaauccccucccuguca

SEQ ID NO: 424905 - RNA, 14 nt, Homo sapiens
gggccgccuccucc

SEQ ID NO: 424906 - RNA, 13 nt, Homo sapiens
gggccuacugcca

SEQ ID NO: 424907 - RNA, 13 nt, Homo sapiens
gggccucauucua

SEQ ID NO: 424908 - RNA, 16 nt, Homo sapiens
gggccucgggaccuca

SEQ ID NO: 424909 - RNA, 22 nt, Homo sapiens
gggccugcugcgucagaccagu

SEQ ID NO: 424910 - RNA, 20 nt, Homo sapiens
gggcggggggcaccuacuac

SEQ ID NO: 424911 - RNA, 18 nt, Homo sapiens
gggcguggagagcccggc

SEQ ID NO: 424912 - RNA, 12 nt, Homo sapiens
gggcucauucuu

SEQ ID NO: 424913 - RNA, 16 nt, Homo sapiens
gggcuccuguuucuca

SEQ ID NO: 424914 - RNA, 18 nt, Homo sapiens
gggcucugacccaagugg

SEQ ID NO: 424915 - RNA, 14 nt, Homo sapiens
gggcugagacugga

SEQ ID NO: 424916 - RNA, 20 nt, Homo sapiens
gggcugagccccuccucucc

SEQ ID NO: 424917 - RNA, 15 nt, Homo sapiens
gggcugcccuggugc

SEQ ID NO: 424918 - RNA, 19 nt, Homo sapiens
gggcugggagaaggugcuu

SEQ ID NO: 424919 - RNA, 22 nt, Homo sapiens
gggcuguccugagcccccugca

SEQ ID NO: 424920 - RNA, 19 nt, Homo sapiens
gggcuuugauuccaucucc

SEQ ID NO: 424921 - RNA, 15 nt, Homo sapiens
ggggacugucuuuca

SEQ ID NO: 424922 - RNA, 17 nt, Homo sapiens
ggggagcccaggccugg

SEQ ID NO: 424923 - RNA, 17 nt, Homo sapiens
ggggcaagccugagugg

SEQ ID NO: 424924 - RNA, 14 nt, Homo sapiens
ggggcacuguuucu

SEQ ID NO: 424925 - RNA, 12 nt, Homo sapiens
ggggcagcacag

SEQ ID NO: 424926 - RNA, 16 nt, Homo sapiens
ggggccuagacucugu

SEQ ID NO: 424927 - RNA, 19 nt, Homo sapiens
ggggccuagggagccgcac

SEQ ID NO: 424928 - RNA, 19 nt, Homo sapiens
gggggaaaaaaaaaaaaga

SEQ ID NO: 424929 - RNA, 12 nt, Homo sapiens
gggggaugcuga

SEQ ID NO: 424930 - RNA, 18 nt, Homo sapiens
gggggccagcagcagggg

SEQ ID NO: 424931 - RNA, 18 nt, Homo sapiens
gggggucuauacauuccu

SEQ ID NO: 424932 - RNA, 16 nt, Homo sapiens
gggguccccacucccu

SEQ ID NO: 424933 - RNA, 11 nt, Homo sapiens
gggguggagca

SEQ ID NO: 424934 - RNA, 13 nt, Homo sapiens
gggguggagcaug

SEQ ID NO: 424935 - RNA, 20 nt, Homo sapiens
ggggugguuuuugagccaug

SEQ ID NO: 424936 - RNA, 13 nt, Homo sapiens
ggguaacacugau

SEQ ID NO: 424937 - RNA, 21 nt, Homo sapiens
ggguaagaugcuccugguggc

SEQ ID NO: 424938 - RNA, 13 nt, Homo sapiens
ggguagaucucaa

SEQ ID NO: 424939 - RNA, 15 nt, Homo sapiens
ggguauugaaugugg

SEQ ID NO: 424940 - RNA, 13 nt, Homo sapiens
gggucaacaucuu

SEQ ID NO: 424941 - RNA, 21 nt, Homo sapiens
gggucaucccagcaccugcca

SEQ ID NO: 424942 - RNA, 22 nt, Homo sapiens
aguuucuugagaucugcugaca

SEQ ID NO: 424943 - RNA, 17 nt, Homo sapiens
aguuucuuuggccagaa

SEQ ID NO: 424944 - RNA, 18 nt, Homo sapiens
aguuugaagcauugaccu

SEQ ID NO: 424945 - RNA, 19 nt, Homo sapiens
aguuugagaccacccuggg

SEQ ID NO: 424946 - RNA, 19 nt, Homo sapiens
aguuugauaugggcuuucu

SEQ ID NO: 424947 - RNA, 17 nt, Homo sapiens
aguuugcuagugacuaa

SEQ ID NO: 424948 - RNA, 17 nt, Homo sapiens
aguuugcuuuguaugca

SEQ ID NO: 424949 - RNA, 19 nt, Homo sapiens
aguuugcuuuguaugcacu

SEQ ID NO: 424950 - RNA, 20 nt, Homo sapiens
aguuuuacacucuagugcca

SEQ ID NO: 424951 - RNA, 23 nt, Homo sapiens
aguuuuauuuuuucgugcacucu

SEQ ID NO: 424952 - RNA, 14 nt, Homo sapiens
aguuuuuccuaguc

SEQ ID NO: 424953 - RNA, 13 nt, Homo sapiens
auaaaaacccugu

SEQ ID NO: 424954 - RNA, 20 nt, Homo sapiens
auaaaaagugacacagcagc

SEQ ID NO: 424955 - RNA, 21 nt, Homo sapiens
auaaaaauauuguguugugaa

SEQ ID NO: 424956 - RNA, 22 nt, Homo sapiens
auaaaacaaaacaaacaaccug

SEQ ID NO: 424957 - RNA, 19 nt, Homo sapiens
auaaaacagaauauugaca

SEQ ID NO: 424958 - RNA, 23 nt, Homo sapiens
auaaaacagaauauugacaagcu

SEQ ID NO: 424959 - RNA, 19 nt, Homo sapiens
auaaaacaugggaaucucc

SEQ ID NO: 424960 - RNA, 13 nt, Homo sapiens
auaaaacuuuccu

SEQ ID NO: 424961 - RNA, 13 nt, Homo sapiens
auaaaagugcuac

SEQ ID NO: 424962 - RNA, 19 nt, Homo sapiens
auaaaaucuuuccaucuca

SEQ ID NO: 424963 - RNA, 13 nt, Homo sapiens
auaaaaugcauuu

SEQ ID NO: 424964 - RNA, 15 nt, Homo sapiens
auaaaauguauucaa

SEQ ID NO: 424965 - RNA, 14 nt, Homo sapiens
auaaaauuagcuug

SEQ ID NO: 424966 - RNA, 23 nt, Homo sapiens
auaaaauuggcaccaugugccau

SEQ ID NO: 424967 - RNA, 17 nt, Homo sapiens
auaaacaaucuuagaca

SEQ ID NO: 424968 - RNA, 19 nt, Homo sapiens
auaaacacuagacuguauc

SEQ ID NO: 424969 - RNA, 14 nt, Homo sapiens
auaaaccagacuca

SEQ ID NO: 424970 - RNA, 15 nt, Homo sapiens
auaaacgaaacauuu

SEQ ID NO: 424971 - RNA, 13 nt, Homo sapiens
auaaacugugaga

SEQ ID NO: 424972 - RNA, 22 nt, Homo sapiens
auaaagaaaaaaauaguuuuac

SEQ ID NO: 424973 - RNA, 15 nt, Homo sapiens
auaaagaaauaauac

SEQ ID NO: 424974 - RNA, 17 nt, Homo sapiens
auaaagaaauccagauc

SEQ ID NO: 424975 - RNA, 15 nt, Homo sapiens
auaaagacaggguuu

SEQ ID NO: 424976 - RNA, 13 nt, Homo sapiens
auaaagacuucau

SEQ ID NO: 424977 - RNA, 15 nt, Homo sapiens
auaaagcccuugaac

SEQ ID NO: 424978 - RNA, 23 nt, Homo sapiens
auaaagccuugugaucacuuucu

SEQ ID NO: 424979 - RNA, 18 nt, Homo sapiens
auaaagcgaauggaccau

SEQ ID NO: 424980 - RNA, 15 nt, Homo sapiens
auaaaggcauggcau

SEQ ID NO: 424981 - RNA, 15 nt, Homo sapiens
auaaaggucauauug

SEQ ID NO: 424982 - RNA, 21 nt, Homo sapiens
auaaaguauccaugcaugugc

SEQ ID NO: 424983 - RNA, 17 nt, Homo sapiens
auaaaguccucuucccu

SEQ ID NO: 424984 - RNA, 20 nt, Homo sapiens
auaaaguuuuugacuuccuu

SEQ ID NO: 424985 - RNA, 12 nt, Homo sapiens
auaaauaaccaa

SEQ ID NO: 424986 - RNA, 19 nt, Homo sapiens
auaaauacuuuaacuucca

SEQ ID NO: 424987 - RNA, 15 nt, Homo sapiens
auaaauauacuaaua

SEQ ID NO: 424988 - RNA, 23 nt, Homo sapiens
auaaauccucagguaguacuggg

SEQ ID NO: 424989 - RNA, 19 nt, Homo sapiens
auaaaucuaacaguuacuc

SEQ ID NO: 424990 - RNA, 22 nt, Homo sapiens
auaaaugagcaaauggaacaau

SEQ ID NO: 424991 - RNA, 14 nt, Homo sapiens
auaaaugcauuaaa

SEQ ID NO: 424992 - RNA, 18 nt, Homo sapiens
auaaauguguggugcuaa

SEQ ID NO: 424993 - RNA, 15 nt, Homo sapiens
auaaauuaagacuuu

SEQ ID NO: 424994 - RNA, 19 nt, Homo sapiens
auaaauugcauaaagcaua

SEQ ID NO: 424995 - RNA, 12 nt, Homo sapiens
auaaauugccuc

SEQ ID NO: 424996 - RNA, 14 nt, Homo sapiens
auaaauuggcuccu

SEQ ID NO: 424997 - RNA, 19 nt, Homo sapiens
auaacaagccaaacauucu

SEQ ID NO: 424998 - RNA, 21 nt, Homo sapiens
auaacacuguacugcaauaag

SEQ ID NO: 424999 - RNA, 12 nt, Homo sapiens
auaacacuguga

SEQ ID NO: 425000 - RNA, 14 nt, Homo sapiens
auaacagaaagaac

SEQ ID NO: 425001 - RNA, 23 nt, Homo sapiens
auaacagaaagaacgugaucucc

SEQ ID NO: 425002 - RNA, 15 nt, Homo sapiens
auaacagcaaauaac

SEQ ID NO: 425003 - RNA, 12 nt, Homo sapiens
auaacaguauuu

SEQ ID NO: 425004 - RNA, 21 nt, Homo sapiens
auaacaugucuuucagcauua

SEQ ID NO: 425005 - RNA, 16 nt, Homo sapiens
auaacuauugcugcuu

SEQ ID NO: 425006 - RNA, 18 nt, Homo sapiens
auaacucugcacuacucc

SEQ ID NO: 425007 - RNA, 12 nt, Homo sapiens
auaacugugaag

SEQ ID NO: 425008 - RNA, 20 nt, Homo sapiens
auaacuugugauuccagggc

SEQ ID NO: 425009 - RNA, 14 nt, Homo sapiens
auaacuuuuuccaa

SEQ ID NO: 425010 - RNA, 16 nt, Homo sapiens
auaagaaaacauguaa

SEQ ID NO: 425011 - RNA, 13 nt, Homo sapiens
auaagacuacuau

SEQ ID NO: 425012 - RNA, 19 nt, Homo sapiens
auaagagcuggaugcacau

SEQ ID NO: 425013 - RNA, 20 nt, Homo sapiens
auaagaguuggcuggucaac

SEQ ID NO: 425014 - RNA, 16 nt, Homo sapiens
auaagauacaucacag

SEQ ID NO: 425015 - RNA, 16 nt, Homo sapiens
auaagauauuguacau

SEQ ID NO: 425016 - RNA, 18 nt, Homo sapiens
auaagcacuagaucuccc

SEQ ID NO: 425017 - RNA, 22 nt, Homo sapiens
auaagcacuagaucucccuuaa

SEQ ID NO: 425018 - RNA, 18 nt, Homo sapiens
auaagcuaaagaggcuga

SEQ ID NO: 425019 - RNA, 16 nt, Homo sapiens
auaagcuaugucacua

SEQ ID NO: 425020 - RNA, 15 nt, Homo sapiens
auaaggaaagcaaua

SEQ ID NO: 425021 - RNA, 23 nt, Homo sapiens
auaaggccucauccuccacugaa

SEQ ID NO: 425022 - RNA, 14 nt, Homo sapiens
auaaguaauaucuu

SEQ ID NO: 425023 - RNA, 12 nt, Homo sapiens
auaaguuucaua

SEQ ID NO: 425024 - RNA, 16 nt, Homo sapiens
auaauaaacaguggaa

SEQ ID NO: 425025 - RNA, 14 nt, Homo sapiens
auaauaaauuugau

SEQ ID NO: 425026 - RNA, 22 nt, Homo sapiens
auaauacaucuuuaucauuaaa

SEQ ID NO: 425027 - RNA, 19 nt, Homo sapiens
auaauaguacuauuacuau

SEQ ID NO: 425028 - RNA, 16 nt, Homo sapiens
auaauaugcugccaaa

SEQ ID NO: 425029 - RNA, 16 nt, Homo sapiens
auaaucagugugucua

SEQ ID NO: 425030 - RNA, 16 nt, Homo sapiens
auaaucccagcacuuu

SEQ ID NO: 425031 - RNA, 20 nt, Homo sapiens
auaaucugacaaagucauga

SEQ ID NO: 425032 - RNA, 12 nt, Homo sapiens
auaaucuggugu

SEQ ID NO: 425033 - RNA, 11 nt, Homo sapiens
auaaugcacug

SEQ ID NO: 425034 - RNA, 18 nt, Homo sapiens
auaaugcuuuuacuaagc

SEQ ID NO: 425035 - RNA, 16 nt, Homo sapiens
auaauguuacauuauu

SEQ ID NO: 425036 - RNA, 20 nt, Homo sapiens
auaauguuaguagcacugag

SEQ ID NO: 425037 - RNA, 12 nt, Homo sapiens
auaauguuauag

SEQ ID NO: 425038 - RNA, 21 nt, Homo sapiens
auaauuaaaaaaaaaacuuca

SEQ ID NO: 425039 - RNA, 20 nt, Homo sapiens
auaauuaaaugaaauacuug

SEQ ID NO: 425040 - RNA, 24 nt, Homo sapiens
auaauucagagugguuucauugcc

SEQ ID NO: 425041 - RNA, 22 nt, Homo sapiens
auaauugguuagaaccuccuau

SEQ ID NO: 425042 - RNA, 15 nt, Homo sapiens
auaauuuucauucau

SEQ ID NO: 425043 - RNA, 11 nt, Homo sapiens
auaauuuugcc

SEQ ID NO: 425044 - RNA, 17 nt, Homo sapiens
auacaaaagggucuuga

SEQ ID NO: 425045 - RNA, 20 nt, Homo sapiens
auacaaauugauagucaaua

SEQ ID NO: 425046 - RNA, 12 nt, Homo sapiens
auacaaugcaug

SEQ ID NO: 425047 - RNA, 23 nt, Homo sapiens
auacaauucaaguugcuucucau

SEQ ID NO: 425048 - RNA, 20 nt, Homo sapiens
auacacaagagggacuguau

SEQ ID NO: 425049 - RNA, 12 nt, Homo sapiens
auacacacaaaa

SEQ ID NO: 425050 - RNA, 16 nt, Homo sapiens
auacacagaugaaggu

SEQ ID NO: 425051 - RNA, 14 nt, Homo sapiens
auacagcacuuuga

SEQ ID NO: 425052 - RNA, 21 nt, Homo sapiens
auacaguauucuguaccauag

SEQ ID NO: 425053 - RNA, 22 nt, Homo sapiens
auacaguauucuguaccauagc

SEQ ID NO: 425054 - RNA, 13 nt, Homo sapiens
auacagugauaug

SEQ ID NO: 425055 - RNA, 17 nt, Homo sapiens
auacauaugaggacaag

SEQ ID NO: 425056 - RNA, 20 nt, Homo sapiens
auacauggaaacgcaaauga

SEQ ID NO: 425057 - RNA, 19 nt, Homo sapiens
auacauggaauagcaccug

SEQ ID NO: 425058 - RNA, 14 nt, Homo sapiens
auacauggguagcu

SEQ ID NO: 425059 - RNA, 18 nt, Homo sapiens
auacauggguagcuucug

SEQ ID NO: 425060 - RNA, 19 nt, Homo sapiens
auacauggguagcuucuga

SEQ ID NO: 425061 - RNA, 16 nt, Homo sapiens
auacauuccugagauu

SEQ ID NO: 425062 - RNA, 20 nt, Homo sapiens
auacauucuuuaucuugaca

SEQ ID NO: 425063 - RNA, 15 nt, Homo sapiens
auacauuugauaaag

SEQ ID NO: 425064 - RNA, 14 nt, Homo sapiens
auaccaaagcaguu

SEQ ID NO: 425065 - RNA, 19 nt, Homo sapiens
auaccaagaugccaucugu

SEQ ID NO: 425066 - RNA, 16 nt, Homo sapiens
auaccagguuaccuca

SEQ ID NO: 425067 - RNA, 16 nt, Homo sapiens
auaccaguacuugagg

SEQ ID NO: 425068 - RNA, 15 nt, Homo sapiens
auaccaucuguagag

SEQ ID NO: 425069 - RNA, 21 nt, Homo sapiens
auaccccggugugccugugga

SEQ ID NO: 425070 - RNA, 18 nt, Homo sapiens
auaccccuaguaucuggc

SEQ ID NO: 425071 - RNA, 15 nt, Homo sapiens
auaccuggcuuuuac

SEQ ID NO: 425072 - RNA, 18 nt, Homo sapiens
auaccuggcuuuuacuuu

SEQ ID NO: 425073 - RNA, 19 nt, Homo sapiens
auaccugguaagcaaaaac

SEQ ID NO: 425074 - RNA, 20 nt, Homo sapiens
auaccugguaagcaaaaacu

SEQ ID NO: 425075 - RNA, 21 nt, Homo sapiens
auaccuguugagacugauuca

SEQ ID NO: 425076 - RNA, 15 nt, Homo sapiens
auaccuguuguacac

SEQ ID NO: 425077 - RNA, 19 nt, Homo sapiens
auacuacaaauuaguguca

SEQ ID NO: 425078 - RNA, 23 nt, Homo sapiens
auacuaguuugcuuugcugacca

SEQ ID NO: 425079 - RNA, 18 nt, Homo sapiens
auacucuguguaaucucu

SEQ ID NO: 425080 - RNA, 22 nt, Homo sapiens
auacugaauuucuuugauuuaa

SEQ ID NO: 425081 - RNA, 15 nt, Homo sapiens
auacugaugagacaa

SEQ ID NO: 425082 - RNA, 18 nt, Homo sapiens
auacugcacuuuagugua

SEQ ID NO: 425083 - RNA, 22 nt, Homo sapiens
auacugcauguaagccaaguca

SEQ ID NO: 425084 - RNA, 20 nt, Homo sapiens
auacugguuauccugugcua

SEQ ID NO: 425085 - RNA, 15 nt, Homo sapiens
auacuguaacacugu

SEQ ID NO: 425086 - RNA, 22 nt, Homo sapiens
auacuguaugccggcuccuuca

SEQ ID NO: 425087 - RNA, 14 nt, Homo sapiens
auacuuagugguau

SEQ ID NO: 425088 - RNA, 16 nt, Homo sapiens
auacuucuaccaacau

SEQ ID NO: 425089 - RNA, 13 nt, Homo sapiens
auacuucuuuuua

SEQ ID NO: 425090 - RNA, 19 nt, Homo sapiens
auacuucuuuuucauuauu

SEQ ID NO: 425091 - RNA, 18 nt, Homo sapiens
auacuuuuuuucacaguu

SEQ ID NO: 425092 - RNA, 14 nt, Homo sapiens
auagaaaacugaaa

SEQ ID NO: 425093 - RNA, 23 nt, Homo sapiens
auagaaauguaaaaguacucuga

SEQ ID NO: 425094 - RNA, 17 nt, Homo sapiens
auagaacauauuuuccu

SEQ ID NO: 425095 - RNA, 20 nt, Homo sapiens
auagaacucugggcugccau

SEQ ID NO: 425096 - RNA, 20 nt, Homo sapiens
auagaacuggucuuccauuu

SEQ ID NO: 425097 - RNA, 20 nt, Homo sapiens
auagaacugucccacaaaau

SEQ ID NO: 425098 - RNA, 22 nt, Homo sapiens
auagaagaaaagcacugggaga

SEQ ID NO: 425099 - RNA, 15 nt, Homo sapiens
auagaagaaaaucca

SEQ ID NO: 425100 - RNA, 22 nt, Homo sapiens
auagaagaaaauccauucauuc

SEQ ID NO: 425101 - RNA, 12 nt, Homo sapiens
auagaaguccau

SEQ ID NO: 425102 - RNA, 18 nt, Homo sapiens
auagaauaaaauauaauu

SEQ ID NO: 425103 - RNA, 22 nt, Homo sapiens
auagaauacauggaaacgcaaa

SEQ ID NO: 425104 - RNA, 17 nt, Homo sapiens
auagacacuugcuccca

SEQ ID NO: 425105 - RNA, 17 nt, Homo sapiens
auagaccccaagcauuc

SEQ ID NO: 425106 - RNA, 14 nt, Homo sapiens
auagaccuaugaua

SEQ ID NO: 425107 - RNA, 23 nt, Homo sapiens
auagagcuuuuaaaaauguccug

SEQ ID NO: 425108 - RNA, 18 nt, Homo sapiens
auagaggaggauggucau

SEQ ID NO: 425109 - RNA, 18 nt, Homo sapiens
auagaggggggcugccug

SEQ ID NO: 425110 - RNA, 15 nt, Homo sapiens
auagcaccauugcac

SEQ ID NO: 425111 - RNA, 16 nt, Homo sapiens
auagcaccauugcacu

SEQ ID NO: 425112 - RNA, 16 nt, Homo sapiens
auagccaaaaacuuuu

SEQ ID NO: 425113 - RNA, 15 nt, Homo sapiens
auagccaaucaucua

SEQ ID NO: 425114 - RNA, 14 nt, Homo sapiens
auagccauuugccc

SEQ ID NO: 425115 - RNA, 21 nt, Homo sapiens
auagcgcugcucuuaugccau

SEQ ID NO: 425116 - RNA, 18 nt, Homo sapiens
auagcuccuucaugcuuu

SEQ ID NO: 425117 - RNA, 16 nt, Homo sapiens
auaggacauacugcau

SEQ ID NO: 425118 - RNA, 20 nt, Homo sapiens
auaggacucuagacggcauc

SEQ ID NO: 425119 - RNA, 19 nt, Homo sapiens
auaggagacuuguacaguu

SEQ ID NO: 425120 - RNA, 17 nt, Homo sapiens
auaggauauacuguaug

SEQ ID NO: 425121 - RNA, 15 nt, Homo sapiens
auaggccugggugcu

SEQ ID NO: 425122 - RNA, 22 nt, Homo sapiens
auaggcugacuuuugcagaugg

SEQ ID NO: 425123 - RNA, 19 nt, Homo sapiens
auagggugcaguuuuccag

SEQ ID NO: 425124 - RNA, 17 nt, Homo sapiens
auagguagauccagauc

SEQ ID NO: 425125 - RNA, 14 nt, Homo sapiens
auaguaaaugcuuu

SEQ ID NO: 425126 - RNA, 14 nt, Homo sapiens
auaguaauaucaau

SEQ ID NO: 425127 - RNA, 13 nt, Homo sapiens
auaguacuauuac

SEQ ID NO: 425128 - RNA, 20 nt, Homo sapiens
auaguacucuuuguagcaaa

SEQ ID NO: 425129 - RNA, 17 nt, Homo sapiens
auaguaugaaugcagug

SEQ ID NO: 425130 - RNA, 22 nt, Homo sapiens
auagucauuccaaauaugagau

SEQ ID NO: 425131 - RNA, 15 nt, Homo sapiens
auaguccucugcuaa

SEQ ID NO: 425132 - RNA, 18 nt, Homo sapiens
auagugcacuagcauuuu

SEQ ID NO: 425133 - RNA, 16 nt, Homo sapiens
auagugucccacggug

SEQ ID NO: 425134 - RNA, 12 nt, Homo sapiens
auaguguugcuu

SEQ ID NO: 425135 - RNA, 22 nt, Homo sapiens
auauaaaauauauauugcauag

SEQ ID NO: 425136 - RNA, 12 nt, Homo sapiens
auauaaacaaug

SEQ ID NO: 425137 - RNA, 22 nt, Homo sapiens
auauaaaccgugugucauguca

SEQ ID NO: 425138 - RNA, 18 nt, Homo sapiens
auauaaagaggacuugaa

SEQ ID NO: 425139 - RNA, 19 nt, Homo sapiens
aggagggguuaaagcugcc

SEQ ID NO: 425140 - RNA, 22 nt, Homo sapiens
aggaguccaguuugugcaagac

SEQ ID NO: 425141 - RNA, 17 nt, Homo sapiens
aggaguggcagcugucc

SEQ ID NO: 425142 - RNA, 17 nt, Homo sapiens
aggagugggauuauuca

SEQ ID NO: 425143 - RNA, 22 nt, Homo sapiens
aggaguuguuucugacccacug

SEQ ID NO: 425144 - RNA, 18 nt, Homo sapiens
aggauacuuuacaugguu

SEQ ID NO: 425145 - RNA, 17 nt, Homo sapiens
aggauagaauacaugga

SEQ ID NO: 425146 - RNA, 13 nt, Homo sapiens
aggauaugcagua

SEQ ID NO: 425147 - RNA, 13 nt, Homo sapiens
aggauauuaacaa

SEQ ID NO: 425148 - RNA, 14 nt, Homo sapiens
aggauccgugcugu

SEQ ID NO: 425149 - RNA, 20 nt, Homo sapiens
aggaucuucccacuuugcca

SEQ ID NO: 425150 - RNA, 17 nt, Homo sapiens
aggaugaaagacaaaga

SEQ ID NO: 425151 - RNA, 19 nt, Homo sapiens
aggaugaauguaugugcac

SEQ ID NO: 425152 - RNA, 21 nt, Homo sapiens
aggaugaauguaugugcacug

SEQ ID NO: 425153 - RNA, 20 nt, Homo sapiens
aggaugauuguacagaauca

SEQ ID NO: 425154 - RNA, 22 nt, Homo sapiens
aggaugauuuccuggggcacag

SEQ ID NO: 425155 - RNA, 12 nt, Homo sapiens
aggaugcacagu

SEQ ID NO: 425156 - RNA, 16 nt, Homo sapiens
aggaugcuucugcuca

SEQ ID NO: 425157 - RNA, 18 nt, Homo sapiens
aggaugcuucugcucaca

SEQ ID NO: 425158 - RNA, 17 nt, Homo sapiens
aggauuaagauacacuc

SEQ ID NO: 425159 - RNA, 15 nt, Homo sapiens
aggauuagacaguca

SEQ ID NO: 425160 - RNA, 18 nt, Homo sapiens
aggauuauagauacuuaa

SEQ ID NO: 425161 - RNA, 14 nt, Homo sapiens
aggauucagcuauu

SEQ ID NO: 425162 - RNA, 20 nt, Homo sapiens
aggauuccgucuucucucau

SEQ ID NO: 425163 - RNA, 16 nt, Homo sapiens
aggauuugaaaacacc

SEQ ID NO: 425164 - RNA, 16 nt, Homo sapiens
aggauuuucugaccuu

SEQ ID NO: 425165 - RNA, 17 nt, Homo sapiens
aggauuuuguauugcca

SEQ ID NO: 425166 - RNA, 14 nt, Homo sapiens
aggcaaaaggcagu

SEQ ID NO: 425167 - RNA, 20 nt, Homo sapiens
aggcaaagagaaaagccacg

SEQ ID NO: 425168 - RNA, 13 nt, Homo sapiens
aggcaaaggccag

SEQ ID NO: 425169 - RNA, 14 nt, Homo sapiens
aggcaacauuacaa

SEQ ID NO: 425170 - RNA, 17 nt, Homo sapiens
aggcaagcaagcucucu

SEQ ID NO: 425171 - RNA, 21 nt, Homo sapiens
aggcaagcaagcucucuugcc

SEQ ID NO: 425172 - RNA, 19 nt, Homo sapiens
aggcaagccccucagcccu

SEQ ID NO: 425173 - RNA, 13 nt, Homo sapiens
aggcaauggugaa

SEQ ID NO: 425174 - RNA, 14 nt, Homo sapiens
aggcagaaaacugg

SEQ ID NO: 425175 - RNA, 17 nt, Homo sapiens
aggcagaauggugggcu

SEQ ID NO: 425176 - RNA, 17 nt, Homo sapiens
aggcagagggucacuuu

SEQ ID NO: 425177 - RNA, 12 nt, Homo sapiens
aggcagaucugu

SEQ ID NO: 425178 - RNA, 13 nt, Homo sapiens
aggcagcugaaaa

SEQ ID NO: 425179 - RNA, 15 nt, Homo sapiens
aggcaggaggaucac

SEQ ID NO: 425180 - RNA, 15 nt, Homo sapiens
aggcaggaguggcag

SEQ ID NO: 425181 - RNA, 19 nt, Homo sapiens
aggcaguaugccaaggguc

SEQ ID NO: 425182 - RNA, 18 nt, Homo sapiens
aggcagucuucuaccaaa

SEQ ID NO: 425183 - RNA, 20 nt, Homo sapiens
aggcaguguuccucaccaau

SEQ ID NO: 425184 - RNA, 17 nt, Homo sapiens
aggcaguuggccagaga

SEQ ID NO: 425185 - RNA, 18 nt, Homo sapiens
aggcaucuccucucccca

SEQ ID NO: 425186 - RNA, 15 nt, Homo sapiens
aggcaugguagcuca

SEQ ID NO: 425187 - RNA, 18 nt, Homo sapiens
aggcauugagacuucaag

SEQ ID NO: 425188 - RNA, 14 nt, Homo sapiens
aggcauuugccuaa

SEQ ID NO: 425189 - RNA, 15 nt, Homo sapiens
aggccaccagcugcu

SEQ ID NO: 425190 - RNA, 16 nt, Homo sapiens
aggccacccacugugg

SEQ ID NO: 425191 - RNA, 16 nt, Homo sapiens
aggccauuuguguuua

SEQ ID NO: 425192 - RNA, 20 nt, Homo sapiens
aggcccaagagcagagucug

SEQ ID NO: 425193 - RNA, 17 nt, Homo sapiens
aggcccaaggaguaagu

SEQ ID NO: 425194 - RNA, 14 nt, Homo sapiens
aggcccacauugcc

SEQ ID NO: 425195 - RNA, 13 nt, Homo sapiens
aggcccacucugu

SEQ ID NO: 425196 - RNA, 17 nt, Homo sapiens
aggccccuuaccugcag

SEQ ID NO: 425197 - RNA, 16 nt, Homo sapiens
aggcccuccaugggcu

SEQ ID NO: 425198 - RNA, 20 nt, Homo sapiens
aggcccuguccuaagcacuu

SEQ ID NO: 425199 - RNA, 20 nt, Homo sapiens
aggccgggcgcgguggcuca

SEQ ID NO: 425200 - RNA, 23 nt, Homo sapiens
aggccgggugcaguggcuccuau

SEQ ID NO: 425201 - RNA, 17 nt, Homo sapiens
aggccguccucccgggc

SEQ ID NO: 425202 - RNA, 19 nt, Homo sapiens
aggccugaaauguuuccag

SEQ ID NO: 425203 - RNA, 22 nt, Homo sapiens
aggccugaccucaagcaaccau

SEQ ID NO: 425204 - RNA, 21 nt, Homo sapiens
aggccugcacucuuauuucac

SEQ ID NO: 425205 - RNA, 14 nt, Homo sapiens
aggccugcccuccc

SEQ ID NO: 425206 - RNA, 13 nt, Homo sapiens
aggccugugcugc

SEQ ID NO: 425207 - RNA, 18 nt, Homo sapiens
aggccuucugauuucaag

SEQ ID NO: 425208 - RNA, 24 nt, Homo sapiens
aggccuugaagaauacacugugac

SEQ ID NO: 425209 - RNA, 14 nt, Homo sapiens
aggccuuuugcccg

SEQ ID NO: 425210 - RNA, 15 nt, Homo sapiens
aggcgauccaccugu

SEQ ID NO: 425211 - RNA, 17 nt, Homo sapiens
aggcgaugugcaagugu

SEQ ID NO: 425212 - RNA, 17 nt, Homo sapiens
aggcgauucuccugccu

SEQ ID NO: 425213 - RNA, 20 nt, Homo sapiens
aggcgauucuccugccucag

SEQ ID NO: 425214 - RNA, 21 nt, Homo sapiens
aggcgccccuucccccuccaa

SEQ ID NO: 425215 - RNA, 16 nt, Homo sapiens
aggcgccugccaucau

SEQ ID NO: 425216 - RNA, 12 nt, Homo sapiens
aggcggugagca

SEQ ID NO: 425217 - RNA, 19 nt, Homo sapiens
aggcuaaaacaaaucucag

SEQ ID NO: 425218 - RNA, 13 nt, Homo sapiens
aggcuaugugagc

SEQ ID NO: 425219 - RNA, 14 nt, Homo sapiens
aggcucccaaaaga

SEQ ID NO: 425220 - RNA, 19 nt, Homo sapiens
aggcucccagacccagggc

SEQ ID NO: 425221 - RNA, 18 nt, Homo sapiens
aggcugaauuacagugaa

SEQ ID NO: 425222 - RNA, 15 nt, Homo sapiens
aggcugacuaagaau

SEQ ID NO: 425223 - RNA, 18 nt, Homo sapiens
aggcugcagucccuggaa

SEQ ID NO: 425224 - RNA, 18 nt, Homo sapiens
aggcuggagugcaaugca

SEQ ID NO: 425225 - RNA, 19 nt, Homo sapiens
aggcuggagugcaaugcac

SEQ ID NO: 425226 - RNA, 15 nt, Homo sapiens
aggcuggagugcagu

SEQ ID NO: 425227 - RNA, 20 nt, Homo sapiens
aggcuggagugcaguggugu

SEQ ID NO: 425228 - RNA, 19 nt, Homo sapiens
aggcugucaauuacaggaa

SEQ ID NO: 425229 - RNA, 16 nt, Homo sapiens
aggcugugggccucaa

SEQ ID NO: 425230 - RNA, 23 nt, Homo sapiens
aggcuguggugcaguaaccauuu

SEQ ID NO: 425231 - RNA, 12 nt, Homo sapiens
aggcuuacaacu

SEQ ID NO: 425232 - RNA, 23 nt, Homo sapiens
aggcuugaucaugaaucacugca

SEQ ID NO: 425233 - RNA, 21 nt, Homo sapiens
aggcuuggcacacugccagug

SEQ ID NO: 425234 - RNA, 23 nt, Homo sapiens
aggcuuucagaagcucuucuaaa

SEQ ID NO: 425235 - RNA, 21 nt, Homo sapiens
agggaaccugguacauccagu

SEQ ID NO: 425236 - RNA, 16 nt, Homo sapiens
agggaagcaucugucu

SEQ ID NO: 425237 - RNA, 21 nt, Homo sapiens
agggaagcugucccucacugu

SEQ ID NO: 425238 - RNA, 16 nt, Homo sapiens
agggaaugugaaauuu

SEQ ID NO: 425239 - RNA, 19 nt, Homo sapiens
agggaauugaggucugcuc

SEQ ID NO: 425240 - RNA, 16 nt, Homo sapiens
agggaauuuucauugg

SEQ ID NO: 425241 - RNA, 15 nt, Homo sapiens
agggacaagggauuc

SEQ ID NO: 425242 - RNA, 13 nt, Homo sapiens
agggacagaauua

SEQ ID NO: 425243 - RNA, 13 nt, Homo sapiens
agggaccaggugu

SEQ ID NO: 425244 - RNA, 21 nt, Homo sapiens
agggacucagggccaugccug

SEQ ID NO: 425245 - RNA, 17 nt, Homo sapiens
agggacugaagccaaag

SEQ ID NO: 425246 - RNA, 16 nt, Homo sapiens
agggacugccucugcc

SEQ ID NO: 425247 - RNA, 23 nt, Homo sapiens
agggacuucccuagaagucuuca

SEQ ID NO: 425248 - RNA, 17 nt, Homo sapiens
agggagaaaaagaaaca

SEQ ID NO: 425249 - RNA, 14 nt, Homo sapiens
agggagcaccagau

SEQ ID NO: 425250 - RNA, 19 nt, Homo sapiens
agggagccgcaccuuguca

SEQ ID NO: 425251 - RNA, 21 nt, Homo sapiens
agggagcuaucaggaacagcu

SEQ ID NO: 425252 - RNA, 21 nt, Homo sapiens
agggaggaaucgaggaaccag

SEQ ID NO: 425253 - RNA, 15 nt, Homo sapiens
agggaugccauaccu

SEQ ID NO: 425254 - RNA, 17 nt, Homo sapiens
agggauguggagcacaa

SEQ ID NO: 425255 - RNA, 20 nt, Homo sapiens
agggauugggucguggugga

SEQ ID NO: 425256 - RNA, 12 nt, Homo sapiens
agggcacuaccg

SEQ ID NO: 425257 - RNA, 15 nt, Homo sapiens
agggcagagccaugg

SEQ ID NO: 425258 - RNA, 14 nt, Homo sapiens
agggcaggcccaaa

SEQ ID NO: 425259 - RNA, 18 nt, Homo sapiens
agggcaguaccugggaaa

SEQ ID NO: 425260 - RNA, 15 nt, Homo sapiens
agggcaucuccagga

SEQ ID NO: 425261 - RNA, 16 nt, Homo sapiens
agggcaucuccaggaa

SEQ ID NO: 425262 - RNA, 17 nt, Homo sapiens
agggcauggccaggugg

SEQ ID NO: 425263 - RNA, 18 nt, Homo sapiens
agggccaagcaccuagcc

SEQ ID NO: 425264 - RNA, 18 nt, Homo sapiens
agggccccacucagggau

SEQ ID NO: 425265 - RNA, 14 nt, Homo sapiens
agggcccuaccuga

SEQ ID NO: 425266 - RNA, 14 nt, Homo sapiens
agggcccugcucag

SEQ ID NO: 425267 - RNA, 15 nt, Homo sapiens
agggcuagugacuug

SEQ ID NO: 425268 - RNA, 22 nt, Homo sapiens
agggcugccccuguagguugcu

SEQ ID NO: 425269 - RNA, 18 nt, Homo sapiens
agggcuggcaccucucaa

SEQ ID NO: 425270 - RNA, 16 nt, Homo sapiens
agggcuggcccgggga

SEQ ID NO: 425271 - RNA, 14 nt, Homo sapiens
agggcuggguguau

SEQ ID NO: 425272 - RNA, 16 nt, Homo sapiens
aggggaaaguucucag

SEQ ID NO: 425273 - RNA, 16 nt, Homo sapiens
aggggaagagacuugg

SEQ ID NO: 425274 - RNA, 20 nt, Homo sapiens
aggggacucagcccugaggu

SEQ ID NO: 425275 - RNA, 18 nt, Homo sapiens
aggggagaguaacccugu

SEQ ID NO: 425276 - RNA, 19 nt, Homo sapiens
aggggauugaagcccucca

SEQ ID NO: 425277 - RNA, 14 nt, Homo sapiens
aggggcaacgaaga

SEQ ID NO: 425278 - RNA, 16 nt, Homo sapiens
aggggcagccaggaca

SEQ ID NO: 425279 - RNA, 21 nt, Homo sapiens
aggggccccuccucugugcuc

SEQ ID NO: 425280 - RNA, 20 nt, Homo sapiens
aggggcugucucccaaugaa

SEQ ID NO: 425281 - RNA, 16 nt, Homo sapiens
agggggaacaaaucac

SEQ ID NO: 425282 - RNA, 21 nt, Homo sapiens
agggggcgaagggaucagccc

SEQ ID NO: 425283 - RNA, 16 nt, Homo sapiens
agggggcuauucccug

SEQ ID NO: 425284 - RNA, 15 nt, Homo sapiens
agggguauguucccu

SEQ ID NO: 425285 - RNA, 16 nt, Homo sapiens
aggggucagggaccaa

SEQ ID NO: 425286 - RNA, 13 nt, Homo sapiens
agggguguuccaa

SEQ ID NO: 425287 - RNA, 20 nt, Homo sapiens
aggguacuuuaagacauacu

SEQ ID NO: 425288 - RNA, 23 nt, Homo sapiens
aggguagaaaaaggagcuuaccu

SEQ ID NO: 425289 - RNA, 18 nt, Homo sapiens
aggguaugggaagccaua

SEQ ID NO: 425290 - RNA, 16 nt, Homo sapiens
agggucagugccaagu

SEQ ID NO: 425291 - RNA, 22 nt, Homo sapiens
agggucagugccaagucucagg

SEQ ID NO: 425292 - RNA, 20 nt, Homo sapiens
aggguccuacggagggacca

SEQ ID NO: 425293 - RNA, 13 nt, Homo sapiens
agggucucuucag

SEQ ID NO: 425294 - RNA, 19 nt, Homo sapiens
agggucuucuuacaugcau

SEQ ID NO: 425295 - RNA, 13 nt, Homo sapiens
agggugacggggg

SEQ ID NO: 425296 - RNA, 16 nt, Homo sapiens
agggugcagugugagu

SEQ ID NO: 425297 - RNA, 21 nt, Homo sapiens
aggguggugaccaaugcauua

SEQ ID NO: 425298 - RNA, 19 nt, Homo sapiens
aggguguuggaagaugcau

SEQ ID NO: 425299 - RNA, 15 nt, Homo sapiens
aggguucagggcaug

SEQ ID NO: 425300 - RNA, 20 nt, Homo sapiens
aggguugcuugggccacugc

SEQ ID NO: 425301 - RNA, 19 nt, Homo sapiens
agguaauccggagugagca

SEQ ID NO: 425302 - RNA, 17 nt, Homo sapiens
agguaauuucuugugcc

SEQ ID NO: 425303 - RNA, 18 nt, Homo sapiens
agguacccaaggucacau

SEQ ID NO: 425304 - RNA, 20 nt, Homo sapiens
agguagaccaggauuucuaa

SEQ ID NO: 425305 - RNA, 18 nt, Homo sapiens
agguagaguuugaucaua

SEQ ID NO: 425306 - RNA, 22 nt, Homo sapiens
agguaguagaaucucagcacuu

SEQ ID NO: 425307 - RNA, 23 nt, Homo sapiens
agguaguagaaucucagcacuuu

SEQ ID NO: 425308 - RNA, 15 nt, Homo sapiens
agguagugaguaauu

SEQ ID NO: 425309 - RNA, 15 nt, Homo sapiens
agguaucaaaauguu

SEQ ID NO: 425310 - RNA, 22 nt, Homo sapiens
agguaugugucagccaugacca

SEQ ID NO: 425311 - RNA, 14 nt, Homo sapiens
agguauugauugaa

SEQ ID NO: 425312 - RNA, 18 nt, Homo sapiens
aggucaauuuccugaugc

SEQ ID NO: 425313 - RNA, 18 nt, Homo sapiens
aggucagcucccaucuca

SEQ ID NO: 425314 - RNA, 12 nt, Homo sapiens
aggucagugcuu

SEQ ID NO: 425315 - RNA, 22 nt, Homo sapiens
aggucauauauuuuuugcuacu

SEQ ID NO: 425316 - RNA, 19 nt, Homo sapiens
agguccccuccacauccca

SEQ ID NO: 425317 - RNA, 17 nt, Homo sapiens
aggucccuggaccagcc

SEQ ID NO: 425318 - RNA, 22 nt, Homo sapiens
agguccgcccgaccaggaucag

SEQ ID NO: 425319 - RNA, 15 nt, Homo sapiens
agguccugcugugga

SEQ ID NO: 425320 - RNA, 17 nt, Homo sapiens
agguccugugagcaaag

SEQ ID NO: 425321 - RNA, 21 nt, Homo sapiens
aggucguuuuuuucauuccau

SEQ ID NO: 425322 - RNA, 14 nt, Homo sapiens
aggucuaaugauau

SEQ ID NO: 425323 - RNA, 20 nt, Homo sapiens
aggucuaccugaaaauucaa

SEQ ID NO: 425324 - RNA, 17 nt, Homo sapiens
aggucuccaccccucaa

SEQ ID NO: 425325 - RNA, 23 nt, Homo sapiens
aggucuccaccccucaagccagg

SEQ ID NO: 425326 - RNA, 20 nt, Homo sapiens
aggucuuuuacauacaguga

SEQ ID NO: 425327 - RNA, 21 nt, Homo sapiens
aggucuuuuacauacagugau

SEQ ID NO: 425328 - RNA, 21 nt, Homo sapiens
aggugacuuuccuaugacacu

SEQ ID NO: 425329 - RNA, 23 nt, Homo sapiens
aggugacuuuccuaugacacuca

SEQ ID NO: 425330 - RNA, 21 nt, Homo sapiens
aggugaggcguucuccugcuu

SEQ ID NO: 425331 - RNA, 17 nt, Homo sapiens
aggugagggaugccaua

SEQ ID NO: 425332 - RNA, 15 nt, Homo sapiens
aggugauagcauugc

SEQ ID NO: 425333 - RNA, 16 nt, Homo sapiens
aggugcuuauucucaa

SEQ ID NO: 425334 - RNA, 16 nt, Homo sapiens
agguggaguaggugaa

SEQ ID NO: 425335 - RNA, 17 nt, Homo sapiens
agguggauucaugucca

SEQ ID NO: 425336 - RNA, 16 nt, Homo sapiens
agguggccccaguuca

SEQ ID NO: 425337 - RNA, 19 nt, Homo sapiens
aggugggcagaucauuuga

SEQ ID NO: 425338 - RNA, 13 nt, Homo sapiens
agguggguucuga

SEQ ID NO: 425339 - RNA, 13 nt, Homo sapiens
agguggugccagu

SEQ ID NO: 425340 - RNA, 17 nt, Homo sapiens
aggugucauagcuauga

SEQ ID NO: 425341 - RNA, 13 nt, Homo sapiens
agguguccggggg

SEQ ID NO: 425342 - RNA, 13 nt, Homo sapiens
aggugucucucac

SEQ ID NO: 425343 - RNA, 17 nt, Homo sapiens
aggugucuggacauuca

SEQ ID NO: 425344 - RNA, 15 nt, Homo sapiens
agguguuuaguugca

SEQ ID NO: 425345 - RNA, 16 nt, Homo sapiens
agguuaaggugcaaua

SEQ ID NO: 425346 - RNA, 13 nt, Homo sapiens
agguuccaaauuc

SEQ ID NO: 425347 - RNA, 22 nt, Homo sapiens
agguuccauccaccaccuugcc

SEQ ID NO: 425348 - RNA, 17 nt, Homo sapiens
agguucucagcaagugu

SEQ ID NO: 425349 - RNA, 14 nt, Homo sapiens
agguucuuuccaug

SEQ ID NO: 425350 - RNA, 22 nt, Homo sapiens
agguucuuuuuuuuuucaggaa

SEQ ID NO: 425351 - RNA, 20 nt, Homo sapiens
agguugcuguugugcagugu

SEQ ID NO: 425352 - RNA, 14 nt, Homo sapiens
agguuggugacuga

SEQ ID NO: 425353 - RNA, 13 nt, Homo sapiens
agguugugaaaac

SEQ ID NO: 425354 - RNA, 22 nt, Homo sapiens
agguugugaugauagcacuggu

SEQ ID NO: 425355 - RNA, 13 nt, Homo sapiens
agguuucaccucc

SEQ ID NO: 425356 - RNA, 19 nt, Homo sapiens
agguuucacuguucaugaa

SEQ ID NO: 425357 - RNA, 13 nt, Homo sapiens
agguuugcaaaga

SEQ ID NO: 425358 - RNA, 23 nt, Homo sapiens
agguuuggcccccucacuaucuc

SEQ ID NO: 425359 - RNA, 15 nt, Homo sapiens
aguaaaaagaacaac

SEQ ID NO: 425360 - RNA, 19 nt, Homo sapiens
aguaaaaauaaacuguuau

SEQ ID NO: 425361 - RNA, 23 nt, Homo sapiens
aguaaaacaaaaauucacaagcu

SEQ ID NO: 425362 - RNA, 12 nt, Homo sapiens
aguaaacugugc

SEQ ID NO: 425363 - RNA, 12 nt, Homo sapiens
aguaaagccacg

SEQ ID NO: 425364 - RNA, 17 nt, Homo sapiens
aguaaaggccaugugaa

SEQ ID NO: 425365 - RNA, 13 nt, Homo sapiens
aguaaaucucaca

SEQ ID NO: 425366 - RNA, 15 nt, Homo sapiens
aguaaaugcuaccuc

SEQ ID NO: 425367 - RNA, 22 nt, Homo sapiens
aguaaaugcuagguuaauucca

SEQ ID NO: 425368 - RNA, 14 nt, Homo sapiens
aguaacaaugcaug

SEQ ID NO: 425369 - RNA, 16 nt, Homo sapiens
aguaacaaugcaugcu

SEQ ID NO: 425370 - RNA, 19 nt, Homo sapiens
aguaacccugucuaaugaa

SEQ ID NO: 425371 - RNA, 15 nt, Homo sapiens
aguaagaagacauga

SEQ ID NO: 425372 - RNA, 18 nt, Homo sapiens
aguaagagcuggugucug

SEQ ID NO: 425373 - RNA, 16 nt, Homo sapiens
aguaagcugcucuauu

SEQ ID NO: 425374 - RNA, 12 nt, Homo sapiens
aguaaguacaaa

SEQ ID NO: 425375 - RNA, 19 nt, Homo sapiens
aguaaguuuauccaaaucu

SEQ ID NO: 425376 - RNA, 19 nt, Homo sapiens
aguaauaaaacaucuuucc

SEQ ID NO: 425377 - RNA, 22 nt, Homo sapiens
aguaauagagcaaaauugaugu

SEQ ID NO: 425378 - RNA, 19 nt, Homo sapiens
aguaauagcgccucuuuua

SEQ ID NO: 425379 - RNA, 14 nt, Homo sapiens
aguaauggcauuuu

SEQ ID NO: 425380 - RNA, 16 nt, Homo sapiens
aguaauuuugcacaga

SEQ ID NO: 425381 - RNA, 21 nt, Homo sapiens
aguacaauaauaaauccucag

SEQ ID NO: 425382 - RNA, 21 nt, Homo sapiens
aguacauaaggaguugccgca

SEQ ID NO: 425383 - RNA, 17 nt, Homo sapiens
aguacccaccugagcuu

SEQ ID NO: 425384 - RNA, 15 nt, Homo sapiens
aguacccaggaugau

SEQ ID NO: 425385 - RNA, 20 nt, Homo sapiens
aguacuauuacuaguacuag

SEQ ID NO: 425386 - RNA, 20 nt, Homo sapiens
aguacuauugcuaguacuag

SEQ ID NO: 425387 - RNA, 22 nt, Homo sapiens
aguacuauugcuaguacuagua

SEQ ID NO: 425388 - RNA, 15 nt, Homo sapiens
aguacuccugcaaaa

SEQ ID NO: 425389 - RNA, 12 nt, Homo sapiens
aguacugggaag

SEQ ID NO: 425390 - RNA, 15 nt, Homo sapiens
aguacuuuaccuccu

SEQ ID NO: 425391 - RNA, 15 nt, Homo sapiens
aguagaaauuguucc

SEQ ID NO: 425392 - RNA, 16 nt, Homo sapiens
aguagaagauuugaug

SEQ ID NO: 425393 - RNA, 18 nt, Homo sapiens
aguagagaacccagauga

SEQ ID NO: 425394 - RNA, 15 nt, Homo sapiens
aguagagaaguaucc

SEQ ID NO: 425395 - RNA, 15 nt, Homo sapiens
aguagagucacugga

SEQ ID NO: 425396 - RNA, 16 nt, Homo sapiens
aguagcauacauuuau

SEQ ID NO: 425397 - RNA, 12 nt, Homo sapiens
aguagcauauau

SEQ ID NO: 425398 - RNA, 23 nt, Homo sapiens
aguagcuaggugcacauauacau

SEQ ID NO: 425399 - RNA, 16 nt, Homo sapiens
aguagcuggauuacag

SEQ ID NO: 425400 - RNA, 17 nt, Homo sapiens
aguaggagcugagcuuu

SEQ ID NO: 425401 - RNA, 13 nt, Homo sapiens
aguaggugggucu

SEQ ID NO: 425402 - RNA, 14 nt, Homo sapiens
aguaguaaucucac

SEQ ID NO: 425403 - RNA, 13 nt, Homo sapiens
aguaguacuugaa

SEQ ID NO: 425404 - RNA, 15 nt, Homo sapiens
aguagucaaggugcu

SEQ ID NO: 425405 - RNA, 12 nt, Homo sapiens
aguauacugugu

SEQ ID NO: 425406 - RNA, 18 nt, Homo sapiens
aguauacuuuuguuucag

SEQ ID NO: 425407 - RNA, 15 nt, Homo sapiens
aguauccaugcaugu

SEQ ID NO: 425408 - RNA, 15 nt, Homo sapiens
aguaugaagacacug

SEQ ID NO: 425409 - RNA, 22 nt, Homo sapiens
aguaugcuuaaugguagcaacu

SEQ ID NO: 425410 - RNA, 23 nt, Homo sapiens
aguauggauugaaggauugugaa

SEQ ID NO: 425411 - RNA, 21 nt, Homo sapiens
aguaugugaguguguccaagu

SEQ ID NO: 425412 - RNA, 13 nt, Homo sapiens
aguaugugucuag

SEQ ID NO: 425413 - RNA, 17 nt, Homo sapiens
aguauguuaagcucuuu

SEQ ID NO: 425414 - RNA, 20 nt, Homo sapiens
aguauuacaaaaacauggcc

SEQ ID NO: 425415 - RNA, 13 nt, Homo sapiens
aguauucaucugu

SEQ ID NO: 425416 - RNA, 16 nt, Homo sapiens
aguauucuugucaaaa

SEQ ID NO: 425417 - RNA, 16 nt, Homo sapiens
aguauuguccauauca

SEQ ID NO: 425418 - RNA, 13 nt, Homo sapiens
aguauuuugccac

SEQ ID NO: 425419 - RNA, 16 nt, Homo sapiens
agucaaaacacuugua

SEQ ID NO: 425420 - RNA, 19 nt, Homo sapiens
agucaaccaccacagauag

SEQ ID NO: 425421 - RNA, 13 nt, Homo sapiens
agucaaugugcag

SEQ ID NO: 425422 - RNA, 18 nt, Homo sapiens
agucacaaagaguucugg

SEQ ID NO: 425423 - RNA, 12 nt, Homo sapiens
agucacauauca

SEQ ID NO: 425424 - RNA, 18 nt, Homo sapiens
agucacauuuuuuaaaca

SEQ ID NO: 425425 - RNA, 21 nt, Homo sapiens
agucacuuugccagagccuga

SEQ ID NO: 425426 - RNA, 19 nt, Homo sapiens
agucagcaacagagcaaaa

SEQ ID NO: 425427 - RNA, 13 nt, Homo sapiens
agucagccagcuu

SEQ ID NO: 425428 - RNA, 20 nt, Homo sapiens
agucagcuguaccaagcccc

SEQ ID NO: 425429 - RNA, 16 nt, Homo sapiens
agucagcuuucagagc

SEQ ID NO: 425430 - RNA, 15 nt, Homo sapiens
agucaugggaacgca

SEQ ID NO: 425431 - RNA, 19 nt, Homo sapiens
agucauuugcugagcaugu

SEQ ID NO: 425432 - RNA, 16 nt, Homo sapiens
aguccaaaugugauca

SEQ ID NO: 425433 - RNA, 22 nt, Homo sapiens
aguccaaccugccugugcauga

SEQ ID NO: 425434 - RNA, 16 nt, Homo sapiens
aguccacaguacauaa

SEQ ID NO: 425435 - RNA, 16 nt, Homo sapiens
aguccacuucugcucu

SEQ ID NO: 425436 - RNA, 17 nt, Homo sapiens
aguccagaugugccuag

SEQ ID NO: 425437 - RNA, 20 nt, Homo sapiens
aguccaguccucacaugccc

SEQ ID NO: 425438 - RNA, 16 nt, Homo sapiens
aguccaucuucuuuau

SEQ ID NO: 425439 - RNA, 15 nt, Homo sapiens
aguccauugcaaaag

SEQ ID NO: 425440 - RNA, 18 nt, Homo sapiens
agucccagcuacauggga

SEQ ID NO: 425441 - RNA, 15 nt, Homo sapiens
agucccagcuacuca

SEQ ID NO: 425442 - RNA, 22 nt, Homo sapiens
agucccaucucaccucuaggcc

SEQ ID NO: 425443 - RNA, 19 nt, Homo sapiens
agucccccuauccuuggca

SEQ ID NO: 425444 - RNA, 13 nt, Homo sapiens
agucccucagcca

SEQ ID NO: 425445 - RNA, 17 nt, Homo sapiens
aguccuacaagcuaaaa

SEQ ID NO: 425446 - RNA, 10 nt, Homo sapiens
aguccucaca

SEQ ID NO: 425447 - RNA, 20 nt, Homo sapiens
aguccucagugguuggcaau

SEQ ID NO: 425448 - RNA, 21 nt, Homo sapiens
aguccugcaaguccauagcug

SEQ ID NO: 425449 - RNA, 13 nt, Homo sapiens
aguccugggagac

SEQ ID NO: 425450 - RNA, 16 nt, Homo sapiens
aguccugguucagugg

SEQ ID NO: 425451 - RNA, 12 nt, Homo sapiens
aguccuguucuc

SEQ ID NO: 425452 - RNA, 17 nt, Homo sapiens
aguccuguuugcaggga

SEQ ID NO: 425453 - RNA, 16 nt, Homo sapiens
agucggaucuagucca

SEQ ID NO: 425454 - RNA, 20 nt, Homo sapiens
agucguggagaugucuucgu

SEQ ID NO: 425455 - RNA, 13 nt, Homo sapiens
agucuaaaguuua

SEQ ID NO: 425456 - RNA, 14 nt, Homo sapiens
agucuauugcaguu

SEQ ID NO: 425457 - RNA, 18 nt, Homo sapiens
agucucauuacagauuua

SEQ ID NO: 425458 - RNA, 17 nt, Homo sapiens
agucuccuuugcacuga

SEQ ID NO: 425459 - RNA, 15 nt, Homo sapiens
agucucuugauucau

SEQ ID NO: 425460 - RNA, 16 nt, Homo sapiens
agucugcuucauuucc

SEQ ID NO: 425461 - RNA, 18 nt, Homo sapiens
agucuggcaaacaugugc

SEQ ID NO: 425462 - RNA, 21 nt, Homo sapiens
agucuggcaaacaugugcaac

SEQ ID NO: 425463 - RNA, 19 nt, Homo sapiens
agucugugaauaaagccac

SEQ ID NO: 425464 - RNA, 16 nt, Homo sapiens
agucuuaacaacagcu

SEQ ID NO: 425465 - RNA, 22 nt, Homo sapiens
agucuuaacaacagcuucuugc

SEQ ID NO: 425466 - RNA, 10 nt, Homo sapiens
agucuucuca

SEQ ID NO: 425467 - RNA, 20 nt, Homo sapiens
agucuuuauuguguaucaua

SEQ ID NO: 425468 - RNA, 17 nt, Homo sapiens
agucuuuguacagacaa

SEQ ID NO: 425469 - RNA, 18 nt, Homo sapiens
agucuuugucaaugcucu

SEQ ID NO: 425470 - RNA, 15 nt, Homo sapiens
agugaaaacaucugc

SEQ ID NO: 425471 - RNA, 21 nt, Homo sapiens
agugaaaagucucccuuucca

SEQ ID NO: 425472 - RNA, 13 nt, Homo sapiens
agugaaaccauga

SEQ ID NO: 425473 - RNA, 13 nt, Homo sapiens
agugaacacacuc

SEQ ID NO: 425474 - RNA, 19 nt, Homo sapiens
agugaacacucuacuacau

SEQ ID NO: 425475 - RNA, 22 nt, Homo sapiens
agugaagcugggagaaccaaaa

SEQ ID NO: 425476 - RNA, 23 nt, Homo sapiens
agugaaucauccagacuccucau

SEQ ID NO: 425477 - RNA, 14 nt, Homo sapiens
agugacagcuugag

SEQ ID NO: 425478 - RNA, 20 nt, Homo sapiens
agugacagcuugaguggguu

SEQ ID NO: 425479 - RNA, 17 nt, Homo sapiens
agugaccuaaccacuua

SEQ ID NO: 425480 - RNA, 22 nt, Homo sapiens
agugacuguuuggcuuauaaac

SEQ ID NO: 425481 - RNA, 14 nt, Homo sapiens
agugagagcacaaa

SEQ ID NO: 425482 - RNA, 19 nt, Homo sapiens
agugagagucucccuccau

SEQ ID NO: 425483 - RNA, 21 nt, Homo sapiens
agugagcucgccauucacuga

SEQ ID NO: 425484 - RNA, 15 nt, Homo sapiens
agugagcugauauca

SEQ ID NO: 425485 - RNA, 16 nt, Homo sapiens
agugagcugugaucac

SEQ ID NO: 425486 - RNA, 13 nt, Homo sapiens
agugagucucuuc

SEQ ID NO: 425487 - RNA, 15 nt, Homo sapiens
agugaucaccugcca

SEQ ID NO: 425488 - RNA, 19 nt, Homo sapiens
agugaugcaggcaguguaa

SEQ ID NO: 425489 - RNA, 16 nt, Homo sapiens
agugauucuccugccu

SEQ ID NO: 425490 - RNA, 17 nt, Homo sapiens
agugauugauagagugu

SEQ ID NO: 425491 - RNA, 17 nt, Homo sapiens
agugauuugggggugca

SEQ ID NO: 425492 - RNA, 20 nt, Homo sapiens
agugauuugggggugcaaug

SEQ ID NO: 425493 - RNA, 17 nt, Homo sapiens
agugcaacagcacuggc

SEQ ID NO: 425494 - RNA, 17 nt, Homo sapiens
agugcaacggcaugauu

SEQ ID NO: 425495 - RNA, 17 nt, Homo sapiens
agugcagaucugugcuc

SEQ ID NO: 425496 - RNA, 19 nt, Homo sapiens
agugcaguggcgugaucuc

SEQ ID NO: 425497 - RNA, 14 nt, Homo sapiens
agugcaucucagcc

SEQ ID NO: 425498 - RNA, 17 nt, Homo sapiens
agugccggcugccaaga

SEQ ID NO: 425499 - RNA, 14 nt, Homo sapiens
agugccggcugugg

SEQ ID NO: 425500 - RNA, 13 nt, Homo sapiens
agugccugggaau

SEQ ID NO: 425501 - RNA, 13 nt, Homo sapiens
agugcuacuugag

SEQ ID NO: 425502 - RNA, 17 nt, Homo sapiens
agugcugggauuacaau

SEQ ID NO: 425503 - RNA, 18 nt, Homo sapiens
agugcuggucacuaacca

SEQ ID NO: 425504 - RNA, 23 nt, Homo sapiens
agugcuguugguggcagugacuu

SEQ ID NO: 425505 - RNA, 14 nt, Homo sapiens
agugcuuggcacau

SEQ ID NO: 425506 - RNA, 12 nt, Homo sapiens
aguggaaaaaga

SEQ ID NO: 425507 - RNA, 16 nt, Homo sapiens
aguggaaaaugcaaug

SEQ ID NO: 425508 - RNA, 21 nt, Homo sapiens
aguggaaacaaagggugggca

SEQ ID NO: 425509 - RNA, 19 nt, Homo sapiens
aguggaaaccuugcugcua

SEQ ID NO: 425510 - RNA, 18 nt, Homo sapiens
aguggauggaagugucug

SEQ ID NO: 425511 - RNA, 16 nt, Homo sapiens
aguggauugcauuucu

SEQ ID NO: 425512 - RNA, 15 nt, Homo sapiens
aguggcaagaccaaa

SEQ ID NO: 425513 - RNA, 18 nt, Homo sapiens
aguggcaccuaauaaaga

SEQ ID NO: 425514 - RNA, 18 nt, Homo sapiens
aguggcagcaacaaagga

SEQ ID NO: 425515 - RNA, 19 nt, Homo sapiens
aguggcauuaaacauuuga

SEQ ID NO: 425516 - RNA, 21 nt, Homo sapiens
aguggccccucgugaccuaca

SEQ ID NO: 425517 - RNA, 14 nt, Homo sapiens
aguggccuggccag

SEQ ID NO: 425518 - RNA, 13 nt, Homo sapiens
aguggcuuuuuaa

SEQ ID NO: 425519 - RNA, 15 nt, Homo sapiens
agugggaaugcagug

SEQ ID NO: 425520 - RNA, 13 nt, Homo sapiens
agugggacccaua

SEQ ID NO: 425521 - RNA, 14 nt, Homo sapiens
agugggcagugcau

SEQ ID NO: 425522 - RNA, 20 nt, Homo sapiens
agugggcagugcauguggaa

SEQ ID NO: 425523 - RNA, 15 nt, Homo sapiens
aguggucaggcaucu

SEQ ID NO: 425524 - RNA, 18 nt, Homo sapiens
aguggucaggcaucuucc

SEQ ID NO: 425525 - RNA, 15 nt, Homo sapiens
aguggucgcuuacuu

SEQ ID NO: 425526 - RNA, 22 nt, Homo sapiens
agugguggaggggccaccucag

SEQ ID NO: 425527 - RNA, 14 nt, Homo sapiens
agugguggcaaaag

SEQ ID NO: 425528 - RNA, 15 nt, Homo sapiens
aguggugugaucucg

SEQ ID NO: 425529 - RNA, 21 nt, Homo sapiens
agugguguuuagaaugucagu

SEQ ID NO: 425530 - RNA, 20 nt, Homo sapiens
aguguauaccaccuguacau

SEQ ID NO: 425531 - RNA, 17 nt, Homo sapiens
aguguaugcacgugugc

SEQ ID NO: 425532 - RNA, 14 nt, Homo sapiens
agugucacaucucu

SEQ ID NO: 425533 - RNA, 21 nt, Homo sapiens
agugucacuuaccuagauuua

SEQ ID NO: 425534 - RNA, 15 nt, Homo sapiens
agugugacugaucuc

SEQ ID NO: 425535 - RNA, 23 nt, Homo sapiens
aguguggccacgugggcaaacag

SEQ ID NO: 425536 - RNA, 13 nt, Homo sapiens
agugugugcaagu

SEQ ID NO: 425537 - RNA, 20 nt, Homo sapiens
agcacaagaaguuucuucag

SEQ ID NO: 425538 - RNA, 15 nt, Homo sapiens
agcacagcugugagg

SEQ ID NO: 425539 - RNA, 20 nt, Homo sapiens
agcacaggauuaggacugaa

SEQ ID NO: 425540 - RNA, 21 nt, Homo sapiens
agcacauuuccucucuaucuu

SEQ ID NO: 425541 - RNA, 15 nt, Homo sapiens
agcaccacccuaguc

SEQ ID NO: 425542 - RNA, 15 nt, Homo sapiens
agcaccaggacucag

SEQ ID NO: 425543 - RNA, 14 nt, Homo sapiens
agcaccauugcacu

SEQ ID NO: 425544 - RNA, 17 nt, Homo sapiens
agcacccugggugccau

SEQ ID NO: 425545 - RNA, 17 nt, Homo sapiens
agcacuacauaaacuga

SEQ ID NO: 425546 - RNA, 18 nt, Homo sapiens
agcacuacauaaacugac

SEQ ID NO: 425547 - RNA, 23 nt, Homo sapiens
agcacuacauaaacugacuuuau

SEQ ID NO: 425548 - RNA, 20 nt, Homo sapiens
agcacuaccauuguacccug

SEQ ID NO: 425549 - RNA, 20 nt, Homo sapiens
agcacuagaucucccuuaau

SEQ ID NO: 425550 - RNA, 16 nt, Homo sapiens
agcacuauuguuuaga

SEQ ID NO: 425551 - RNA, 21 nt, Homo sapiens
agcacuguuggagcuacugca

SEQ ID NO: 425552 - RNA, 19 nt, Homo sapiens
agcacuuuguuucauauuc

SEQ ID NO: 425553 - RNA, 13 nt, Homo sapiens
agcagaaccaaag

SEQ ID NO: 425554 - RNA, 13 nt, Homo sapiens
agcagaacccaga

SEQ ID NO: 425555 - RNA, 14 nt, Homo sapiens
agcagaacccagac

SEQ ID NO: 425556 - RNA, 15 nt, Homo sapiens
agcagaccgugauuu

SEQ ID NO: 425557 - RNA, 21 nt, Homo sapiens
agcagaugaccccuccccuaa

SEQ ID NO: 425558 - RNA, 18 nt, Homo sapiens
agcagauggaaugcugug

SEQ ID NO: 425559 - RNA, 16 nt, Homo sapiens
agcagauuguguaaca

SEQ ID NO: 425560 - RNA, 14 nt, Homo sapiens
agcagcaacugugu

SEQ ID NO: 425561 - RNA, 15 nt, Homo sapiens
agcagcaacuguguc

SEQ ID NO: 425562 - RNA, 19 nt, Homo sapiens
agcagcacaauucuguccc

SEQ ID NO: 425563 - RNA, 14 nt, Homo sapiens
agcagcacuuauaa

SEQ ID NO: 425564 - RNA, 16 nt, Homo sapiens
agcagcccuuuuuaca

SEQ ID NO: 425565 - RNA, 19 nt, Homo sapiens
agcagccuuacuauucaua

SEQ ID NO: 425566 - RNA, 21 nt, Homo sapiens
agcagcuccccaggagcucag

SEQ ID NO: 425567 - RNA, 15 nt, Homo sapiens
agcaggaaaccugug

SEQ ID NO: 425568 - RNA, 23 nt, Homo sapiens
agcaggaaggugacucugaccuu

SEQ ID NO: 425569 - RNA, 13 nt, Homo sapiens
agcaggagcagcu

SEQ ID NO: 425570 - RNA, 14 nt, Homo sapiens
agcaggagcagcug

SEQ ID NO: 425571 - RNA, 18 nt, Homo sapiens
agcaggucugcaggccac

SEQ ID NO: 425572 - RNA, 22 nt, Homo sapiens
agcaggugagcaaaaugcugcu

SEQ ID NO: 425573 - RNA, 14 nt, Homo sapiens
agcagucauaagcu

SEQ ID NO: 425574 - RNA, 20 nt, Homo sapiens
agcagucuacccaccucagc

SEQ ID NO: 425575 - RNA, 16 nt, Homo sapiens
agcagugaugaaaaug

SEQ ID NO: 425576 - RNA, 17 nt, Homo sapiens
agcagugccuuccauaa

SEQ ID NO: 425577 - RNA, 15 nt, Homo sapiens
agcagugucuuccau

SEQ ID NO: 425578 - RNA, 17 nt, Homo sapiens
agcagugucuuccauaa

SEQ ID NO: 425579 - RNA, 19 nt, Homo sapiens
agcaguguuuucaccucau

SEQ ID NO: 425580 - RNA, 14 nt, Homo sapiens
agcaguucugcaaa

SEQ ID NO: 425581 - RNA, 13 nt, Homo sapiens
agcauacuuuaua

SEQ ID NO: 425582 - RNA, 13 nt, Homo sapiens
agcauauacugaa

SEQ ID NO: 425583 - RNA, 19 nt, Homo sapiens
agcaucagagaguguacau

SEQ ID NO: 425584 - RNA, 11 nt, Homo sapiens
agcauccaugu

SEQ ID NO: 425585 - RNA, 16 nt, Homo sapiens
agcauccccugugaac

SEQ ID NO: 425586 - RNA, 16 nt, Homo sapiens
agcauccucaguuccu

SEQ ID NO: 425587 - RNA, 16 nt, Homo sapiens
agcaucugcucugaga

SEQ ID NO: 425588 - RNA, 14 nt, Homo sapiens
agcaucugucucaa

SEQ ID NO: 425589 - RNA, 17 nt, Homo sapiens
agcaucugucuugucau

SEQ ID NO: 425590 - RNA, 22 nt, Homo sapiens
agcaucuucacuucuaaaugca

SEQ ID NO: 425591 - RNA, 16 nt, Homo sapiens
agcaugcacaaagugu

SEQ ID NO: 425592 - RNA, 23 nt, Homo sapiens
agcaugcucaguuggugcugcuu

SEQ ID NO: 425593 - RNA, 15 nt, Homo sapiens
agcauggacucuggg

SEQ ID NO: 425594 - RNA, 16 nt, Homo sapiens
agcauggacucugggu

SEQ ID NO: 425595 - RNA, 17 nt, Homo sapiens
agcauggagagccucuu

SEQ ID NO: 425596 - RNA, 12 nt, Homo sapiens
agcaugugccaa

SEQ ID NO: 425597 - RNA, 19 nt, Homo sapiens
agcauguggggaagcaaga

SEQ ID NO: 425598 - RNA, 14 nt, Homo sapiens
agcauguucuugga

SEQ ID NO: 425599 - RNA, 18 nt, Homo sapiens
agcauuagucacuuugaa

SEQ ID NO: 425600 - RNA, 23 nt, Homo sapiens
agcauuauaaaccccuccaauuc

SEQ ID NO: 425601 - RNA, 19 nt, Homo sapiens
agcauucuugucacaauaa

SEQ ID NO: 425602 - RNA, 14 nt, Homo sapiens
agcauugcuuucgu

SEQ ID NO: 425603 - RNA, 21 nt, Homo sapiens
agcauuggguagcuauacuca

SEQ ID NO: 425604 - RNA, 15 nt, Homo sapiens
agcauuuagacucuc

SEQ ID NO: 425605 - RNA, 20 nt, Homo sapiens
agcauuuccaacaccacaga

SEQ ID NO: 425606 - RNA, 16 nt, Homo sapiens
agcauuucuagcagug

SEQ ID NO: 425607 - RNA, 18 nt, Homo sapiens
agccaaagagaaugccau

SEQ ID NO: 425608 - RNA, 19 nt, Homo sapiens
agccaaagagaaugccauu

SEQ ID NO: 425609 - RNA, 23 nt, Homo sapiens
agccaaaggauaaguguccccua

SEQ ID NO: 425610 - RNA, 14 nt, Homo sapiens
agccaaaugguuua

SEQ ID NO: 425611 - RNA, 13 nt, Homo sapiens
agccaaauguaau

SEQ ID NO: 425612 - RNA, 18 nt, Homo sapiens
agccaacuuuaauugcuu

SEQ ID NO: 425613 - RNA, 23 nt, Homo sapiens
agccaacuuuugcauguuuugua

SEQ ID NO: 425614 - RNA, 12 nt, Homo sapiens
agccaagaccca

SEQ ID NO: 425615 - RNA, 20 nt, Homo sapiens
agccaagaucacgccacugc

SEQ ID NO: 425616 - RNA, 21 nt, Homo sapiens
agccaagcaaaccaaugguga

SEQ ID NO: 425617 - RNA, 23 nt, Homo sapiens
agccaaguucacaccacugccau

SEQ ID NO: 425618 - RNA, 21 nt, Homo sapiens
agccacaccacaggaucugaa

SEQ ID NO: 425619 - RNA, 13 nt, Homo sapiens
agccacagugggg

SEQ ID NO: 425620 - RNA, 21 nt, Homo sapiens
agccacaguggggcccauggc

SEQ ID NO: 425621 - RNA, 19 nt, Homo sapiens
agccaccauguauguggaa

SEQ ID NO: 425622 - RNA, 22 nt, Homo sapiens
agccacccaggccacugaccuc

SEQ ID NO: 425623 - RNA, 23 nt, Homo sapiens
agccaccgcgcccagccucaucu

SEQ ID NO: 425624 - RNA, 19 nt, Homo sapiens
agccacuuauuuccaugga

SEQ ID NO: 425625 - RNA, 18 nt, Homo sapiens
agccagaauucacuagga

SEQ ID NO: 425626 - RNA, 14 nt, Homo sapiens
agccagacgagguc

SEQ ID NO: 425627 - RNA, 13 nt, Homo sapiens
agccagcaaacca

SEQ ID NO: 425628 - RNA, 12 nt, Homo sapiens
agccagcagggu

SEQ ID NO: 425629 - RNA, 15 nt, Homo sapiens
agccaggacaucucu

SEQ ID NO: 425630 - RNA, 18 nt, Homo sapiens
agccaggacaucucugcc

SEQ ID NO: 425631 - RNA, 14 nt, Homo sapiens
agccaggaccaccu

SEQ ID NO: 425632 - RNA, 17 nt, Homo sapiens
agccaggccugaccuca

SEQ ID NO: 425633 - RNA, 16 nt, Homo sapiens
agccaggcugccaagg

SEQ ID NO: 425634 - RNA, 22 nt, Homo sapiens
agccaggguggucuugaucucc

SEQ ID NO: 425635 - RNA, 14 nt, Homo sapiens
agccagucccucag

SEQ ID NO: 425636 - RNA, 10 nt, Homo sapiens
agccagugac

SEQ ID NO: 425637 - RNA, 15 nt, Homo sapiens
agccauaacuugaaa

SEQ ID NO: 425638 - RNA, 15 nt, Homo sapiens
agccauaugacaauu

SEQ ID NO: 425639 - RNA, 22 nt, Homo sapiens
agccaucaauuuuaacauuuga

SEQ ID NO: 425640 - RNA, 21 nt, Homo sapiens
agccaucuaaugcuuguuuau

SEQ ID NO: 425641 - RNA, 14 nt, Homo sapiens
agccaucuacugga

SEQ ID NO: 425642 - RNA, 17 nt, Homo sapiens
agccauggaacccugcc

SEQ ID NO: 425643 - RNA, 22 nt, Homo sapiens
agccauuccuguucccaugaga

SEQ ID NO: 425644 - RNA, 14 nt, Homo sapiens
agcccacacuugag

SEQ ID NO: 425645 - RNA, 13 nt, Homo sapiens
agcccacagugcu

SEQ ID NO: 425646 - RNA, 21 nt, Homo sapiens
agcccacccugggaugggcca

SEQ ID NO: 425647 - RNA, 20 nt, Homo sapiens
agcccacuguuaauauucua

SEQ ID NO: 425648 - RNA, 14 nt, Homo sapiens
agcccagacuuccu

SEQ ID NO: 425649 - RNA, 15 nt, Homo sapiens
agcccagcccggcug

SEQ ID NO: 425650 - RNA, 15 nt, Homo sapiens
agcccaggacucuaa

SEQ ID NO: 425651 - RNA, 17 nt, Homo sapiens
agcccaggaggacugcc

SEQ ID NO: 425652 - RNA, 15 nt, Homo sapiens
agcccaggucacugu

SEQ ID NO: 425653 - RNA, 13 nt, Homo sapiens
agcccaguagcca

SEQ ID NO: 425654 - RNA, 12 nt, Homo sapiens
agccccagcuga

SEQ ID NO: 425655 - RNA, 15 nt, Homo sapiens
agcccccuguccuuc

SEQ ID NO: 425656 - RNA, 23 nt, Homo sapiens
agccccggugugcggugcauaca

SEQ ID NO: 425657 - RNA, 17 nt, Homo sapiens
agccccuggggccuaga

SEQ ID NO: 425658 - RNA, 20 nt, Homo sapiens
agccccuguauggcacuggc

SEQ ID NO: 425659 - RNA, 16 nt, Homo sapiens
agcccgccgucagggu

SEQ ID NO: 425660 - RNA, 19 nt, Homo sapiens
agcccgccugccgugcaug

SEQ ID NO: 425661 - RNA, 15 nt, Homo sapiens
agcccggcagggaag

SEQ ID NO: 425662 - RNA, 17 nt, Homo sapiens
agcccuaaauaaaucua

SEQ ID NO: 425663 - RNA, 24 nt, Homo sapiens
agcccuauggaagucucaagguca

SEQ ID NO: 425664 - RNA, 13 nt, Homo sapiens
agcccucacagcu

SEQ ID NO: 425665 - RNA, 19 nt, Homo sapiens
agcccuccaaaagcacuua

SEQ ID NO: 425666 - RNA, 15 nt, Homo sapiens
agcccucucacugug

SEQ ID NO: 425667 - RNA, 15 nt, Homo sapiens
agcccugaggugaaa

SEQ ID NO: 425668 - RNA, 17 nt, Homo sapiens
agcccugggguuuccac

SEQ ID NO: 425669 - RNA, 22 nt, Homo sapiens
agcccuguucugggugcagcug

SEQ ID NO: 425670 - RNA, 19 nt, Homo sapiens
acggugcguuuggccaaaa

SEQ ID NO: 425671 - RNA, 21 nt, Homo sapiens
acguauauuucauugaauacu

SEQ ID NO: 425672 - RNA, 16 nt, Homo sapiens
acguaugguggcucau

SEQ ID NO: 425673 - RNA, 13 nt, Homo sapiens
acgucagccaaau

SEQ ID NO: 425674 - RNA, 16 nt, Homo sapiens
acguccaccccagugc

SEQ ID NO: 425675 - RNA, 14 nt, Homo sapiens
acgugccauugucu

SEQ ID NO: 425676 - RNA, 17 nt, Homo sapiens
acguggagauagugcca

SEQ ID NO: 425677 - RNA, 19 nt, Homo sapiens
acguggagauagugccagg

SEQ ID NO: 425678 - RNA, 15 nt, Homo sapiens
acgugggcaagucau

SEQ ID NO: 425679 - RNA, 17 nt, Homo sapiens
acgugggcggcagagag

SEQ ID NO: 425680 - RNA, 15 nt, Homo sapiens
acguguaacuugugc

SEQ ID NO: 425681 - RNA, 19 nt, Homo sapiens
acguguuaugacuccagaa

SEQ ID NO: 425682 - RNA, 17 nt, Homo sapiens
acguucauuugugugcu

SEQ ID NO: 425683 - RNA, 16 nt, Homo sapiens
acuaaaagugauguga

SEQ ID NO: 425684 - RNA, 20 nt, Homo sapiens
acuaaaauauuaguguuauu

SEQ ID NO: 425685 - RNA, 13 nt, Homo sapiens
acuaaauacugua

SEQ ID NO: 425686 - RNA, 15 nt, Homo sapiens
acuaaauuucucagu

SEQ ID NO: 425687 - RNA, 17 nt, Homo sapiens
acuaacagauaagcaag

SEQ ID NO: 425688 - RNA, 18 nt, Homo sapiens
acuaaccuggguucccuu

SEQ ID NO: 425689 - RNA, 15 nt, Homo sapiens
acuaagaaauaugca

SEQ ID NO: 425690 - RNA, 17 nt, Homo sapiens
acuaagaagugguguuc

SEQ ID NO: 425691 - RNA, 12 nt, Homo sapiens
acuaagcacugu

SEQ ID NO: 425692 - RNA, 12 nt, Homo sapiens
acuaagccagga

SEQ ID NO: 425693 - RNA, 17 nt, Homo sapiens
acuaauuuuguacguau

SEQ ID NO: 425694 - RNA, 14 nt, Homo sapiens
acuacaaauguuaa

SEQ ID NO: 425695 - RNA, 15 nt, Homo sapiens
acuacagaaagcaaa

SEQ ID NO: 425696 - RNA, 15 nt, Homo sapiens
acuacagacauuaaa

SEQ ID NO: 425697 - RNA, 21 nt, Homo sapiens
acuacagguauuuucaucaag

SEQ ID NO: 425698 - RNA, 23 nt, Homo sapiens
acuacaugugacuggcaguauua

SEQ ID NO: 425699 - RNA, 19 nt, Homo sapiens
agaggauucugucuuccag

SEQ ID NO: 425700 - RNA, 19 nt, Homo sapiens
agaggauuuaacugugaac

SEQ ID NO: 425701 - RNA, 22 nt, Homo sapiens
agaggcaaugauuguuaauuua

SEQ ID NO: 425702 - RNA, 20 nt, Homo sapiens
agaggcagaacccuggugag

SEQ ID NO: 425703 - RNA, 19 nt, Homo sapiens
agaggcagggaagcucuac

SEQ ID NO: 425704 - RNA, 13 nt, Homo sapiens
agaggcucugaga

SEQ ID NO: 425705 - RNA, 14 nt, Homo sapiens
agagggaugcagug

SEQ ID NO: 425706 - RNA, 15 nt, Homo sapiens
agaggggcagccgcu

SEQ ID NO: 425707 - RNA, 14 nt, Homo sapiens
agaggggggcugcc

SEQ ID NO: 425708 - RNA, 20 nt, Homo sapiens
agagguggaacuuaauuacc

SEQ ID NO: 425709 - RNA, 21 nt, Homo sapiens
agaggugugugccuagugaug

SEQ ID NO: 425710 - RNA, 18 nt, Homo sapiens
agagguuaaggugcaaua

SEQ ID NO: 425711 - RNA, 18 nt, Homo sapiens
agaguaaacuauucuaua

SEQ ID NO: 425712 - RNA, 18 nt, Homo sapiens
agaguauaaauaaccaau

SEQ ID NO: 425713 - RNA, 14 nt, Homo sapiens
agaguauacuuugu

SEQ ID NO: 425714 - RNA, 16 nt, Homo sapiens
agaguauaugcacuuu

SEQ ID NO: 425715 - RNA, 14 nt, Homo sapiens
agagucacuggaac

SEQ ID NO: 425716 - RNA, 15 nt, Homo sapiens
agagucauuguuaca

SEQ ID NO: 425717 - RNA, 17 nt, Homo sapiens
agagugaaaccaugacu

SEQ ID NO: 425718 - RNA, 17 nt, Homo sapiens
agagugacuaguacaaa

SEQ ID NO: 425719 - RNA, 16 nt, Homo sapiens
agagugagagcacaaa

SEQ ID NO: 425720 - RNA, 19 nt, Homo sapiens
agaguggucuuucuggaga

SEQ ID NO: 425721 - RNA, 20 nt, Homo sapiens
agaguguggaaaaaaaaaga

SEQ ID NO: 425722 - RNA, 12 nt, Homo sapiens
agaguucaggga

SEQ ID NO: 425723 - RNA, 17 nt, Homo sapiens
agaguucuauccccaag

SEQ ID NO: 425724 - RNA, 18 nt, Homo sapiens
agaguucuggaaaagaac

SEQ ID NO: 425725 - RNA, 14 nt, Homo sapiens
agaguugagcucuc

SEQ ID NO: 425726 - RNA, 21 nt, Homo sapiens
agaguuggcuggucaacuuga

SEQ ID NO: 425727 - RNA, 21 nt, Homo sapiens
agaguuuucagggaguacaca

SEQ ID NO: 425728 - RNA, 16 nt, Homo sapiens
agauaaaaucuucaac

SEQ ID NO: 425729 - RNA, 21 nt, Homo sapiens
agauaacuugagcaccgucau

SEQ ID NO: 425730 - RNA, 18 nt, Homo sapiens
agauaaucagugugucua

SEQ ID NO: 425731 - RNA, 14 nt, Homo sapiens
agauacuagcuauc

SEQ ID NO: 425732 - RNA, 22 nt, Homo sapiens
agauagguggugccaguggcuu

SEQ ID NO: 425733 - RNA, 14 nt, Homo sapiens
agauagugccaggu

SEQ ID NO: 425734 - RNA, 20 nt, Homo sapiens
agauagugccagguggcuca

SEQ ID NO: 425735 - RNA, 22 nt, Homo sapiens
agauagugccagguggcucagu

SEQ ID NO: 425736 - RNA, 23 nt, Homo sapiens
agauauaucccggaugaggcuga

SEQ ID NO: 425737 - RNA, 15 nt, Homo sapiens
agauauuccagacca

SEQ ID NO: 425738 - RNA, 14 nt, Homo sapiens
agauauucuuuaca

SEQ ID NO: 425739 - RNA, 15 nt, Homo sapiens
agauauucuuuacaa

SEQ ID NO: 425740 - RNA, 14 nt, Homo sapiens
agauauuucacauu

SEQ ID NO: 425741 - RNA, 18 nt, Homo sapiens
agauauuuuuauauagac

SEQ ID NO: 425742 - RNA, 18 nt, Homo sapiens
agaucaauggcgcagugc

SEQ ID NO: 425743 - RNA, 20 nt, Homo sapiens
agauccagauccagacugua

SEQ ID NO: 425744 - RNA, 15 nt, Homo sapiens
agauccagggacuga

SEQ ID NO: 425745 - RNA, 17 nt, Homo sapiens
agauccgagucuaccca

SEQ ID NO: 425746 - RNA, 13 nt, Homo sapiens
agaucgcaucauu

SEQ ID NO: 425747 - RNA, 14 nt, Homo sapiens
agaucuccaaagcu

SEQ ID NO: 425748 - RNA, 13 nt, Homo sapiens
agaucucccuuaa

SEQ ID NO: 425749 - RNA, 15 nt, Homo sapiens
agaucucccuuaaua

SEQ ID NO: 425750 - RNA, 18 nt, Homo sapiens
agaucuggucccuugcag

SEQ ID NO: 425751 - RNA, 14 nt, Homo sapiens
agaucuuaagauuc

SEQ ID NO: 425752 - RNA, 16 nt, Homo sapiens
agaucuucacucuggg

SEQ ID NO: 425753 - RNA, 18 nt, Homo sapiens
agaucuuggcccuguuaa

SEQ ID NO: 425754 - RNA, 16 nt, Homo sapiens
agaucuuggggugcag

SEQ ID NO: 425755 - RNA, 18 nt, Homo sapiens
agaugaaauuuauuucca

SEQ ID NO: 425756 - RNA, 14 nt, Homo sapiens
agaugaacugagaa

SEQ ID NO: 425757 - RNA, 20 nt, Homo sapiens
agaugagauuggcauggcuu

SEQ ID NO: 425758 - RNA, 22 nt, Homo sapiens
agaugagccccacguggagcuc

SEQ ID NO: 425759 - RNA, 16 nt, Homo sapiens
agaugagggugacugu

SEQ ID NO: 425760 - RNA, 14 nt, Homo sapiens
agaugaguccuguu

SEQ ID NO: 425761 - RNA, 22 nt, Homo sapiens
agaugauaaaaggaaucuggca

SEQ ID NO: 425762 - RNA, 13 nt, Homo sapiens
agaugaugugaug

SEQ ID NO: 425763 - RNA, 20 nt, Homo sapiens
agaugaugugauggaacaca

SEQ ID NO: 425764 - RNA, 15 nt, Homo sapiens
agaugcccuccaauc

SEQ ID NO: 425765 - RNA, 20 nt, Homo sapiens
agaugccuccucuguccuca

SEQ ID NO: 425766 - RNA, 16 nt, Homo sapiens
agaugcuacuggacuu

SEQ ID NO: 425767 - RNA, 21 nt, Homo sapiens
agaugcuagaaaaauguucuu

SEQ ID NO: 425768 - RNA, 15 nt, Homo sapiens
agaugcucugugaaa

SEQ ID NO: 425769 - RNA, 16 nt, Homo sapiens
agauggaaaagaaauu

SEQ ID NO: 425770 - RNA, 20 nt, Homo sapiens
agauggaaaagaaauugcau

SEQ ID NO: 425771 - RNA, 17 nt, Homo sapiens
agauggaauaaagcccu

SEQ ID NO: 425772 - RNA, 19 nt, Homo sapiens
agauggaauuagaaauaua

SEQ ID NO: 425773 - RNA, 21 nt, Homo sapiens
agauggauuugggugaucuga

SEQ ID NO: 425774 - RNA, 13 nt, Homo sapiens
agauggccaugua

SEQ ID NO: 425775 - RNA, 22 nt, Homo sapiens
agauggcuuccgugagacacaa

SEQ ID NO: 425776 - RNA, 15 nt, Homo sapiens
agaugggacugggag

SEQ ID NO: 425777 - RNA, 18 nt, Homo sapiens
agaugggaugcuugccua

SEQ ID NO: 425778 - RNA, 21 nt, Homo sapiens
agaugggcaaaagacgggaag

SEQ ID NO: 425779 - RNA, 21 nt, Homo sapiens
agaugguaccgugcaucgcac

SEQ ID NO: 425780 - RNA, 18 nt, Homo sapiens
agaugguucccuuuguug

SEQ ID NO: 425781 - RNA, 17 nt, Homo sapiens
agauguaccauguuaaa

SEQ ID NO: 425782 - RNA, 14 nt, Homo sapiens
agauguaucaugau

SEQ ID NO: 425783 - RNA, 15 nt, Homo sapiens
agauguauuaugcaa

SEQ ID NO: 425784 - RNA, 17 nt, Homo sapiens
agauguccaaacuaauu

SEQ ID NO: 425785 - RNA, 21 nt, Homo sapiens
agaugucccugaagucuugca

SEQ ID NO: 425786 - RNA, 16 nt, Homo sapiens
agaugucuaagacagg

SEQ ID NO: 425787 - RNA, 19 nt, Homo sapiens
agaugucuucugccuguua

SEQ ID NO: 425788 - RNA, 17 nt, Homo sapiens
agaugugaucacugaga

SEQ ID NO: 425789 - RNA, 19 nt, Homo sapiens
agauguggcaaagugcugu

SEQ ID NO: 425790 - RNA, 16 nt, Homo sapiens
agaugugucuuaccag

SEQ ID NO: 425791 - RNA, 19 nt, Homo sapiens
agauguuccauccuguaca

SEQ ID NO: 425792 - RNA, 20 nt, Homo sapiens
agauguuguguuuacguuac

SEQ ID NO: 425793 - RNA, 19 nt, Homo sapiens
agauuauauugagacaaaa

SEQ ID NO: 425794 - RNA, 17 nt, Homo sapiens
agauuauggaaguuuuc

SEQ ID NO: 425795 - RNA, 19 nt, Homo sapiens
agauuauuuacugacauau

SEQ ID NO: 425796 - RNA, 23 nt, Homo sapiens
agauugcucuggggcuugcuauu

SEQ ID NO: 425797 - RNA, 20 nt, Homo sapiens
agauuggcaccccuuucuag

SEQ ID NO: 425798 - RNA, 17 nt, Homo sapiens
agauuuaagguuucaca

SEQ ID NO: 425799 - RNA, 22 nt, Homo sapiens
agauuuaauuguaauugucuca

SEQ ID NO: 425800 - RNA, 12 nt, Homo sapiens
agauuucucacc

SEQ ID NO: 425801 - RNA, 19 nt, Homo sapiens
agauuuggaauaggaauaa

SEQ ID NO: 425802 - RNA, 20 nt, Homo sapiens
agauuuuauuuucaagcaaa

SEQ ID NO: 425803 - RNA, 22 nt, Homo sapiens
agauuuugaaugcuuccugaca

SEQ ID NO: 425804 - RNA, 15 nt, Homo sapiens
agcaaaaggcagcuc

SEQ ID NO: 425805 - RNA, 14 nt, Homo sapiens
agcaaaaugcugcu

SEQ ID NO: 425806 - RNA, 13 nt, Homo sapiens
agcaaacuuggaa

SEQ ID NO: 425807 - RNA, 20 nt, Homo sapiens
agcaaagcaugccaauuucu

SEQ ID NO: 425808 - RNA, 16 nt, Homo sapiens
agcaaagcugaugaca

SEQ ID NO: 425809 - RNA, 14 nt, Homo sapiens
agcaaauaccaaag

SEQ ID NO: 425810 - RNA, 21 nt, Homo sapiens
agcaaauauguuugcauuaaa

SEQ ID NO: 425811 - RNA, 19 nt, Homo sapiens
agcaaaucccaacauuucu

SEQ ID NO: 425812 - RNA, 22 nt, Homo sapiens
agcaaaugagauguaugcccaa

SEQ ID NO: 425813 - RNA, 12 nt, Homo sapiens
agcaacagugcc

SEQ ID NO: 425814 - RNA, 23 nt, Homo sapiens
agcaacaugaauuaagaacugac

SEQ ID NO: 425815 - RNA, 18 nt, Homo sapiens
agcaacccuaacaguaag

SEQ ID NO: 425816 - RNA, 12 nt, Homo sapiens
agcaacuuugau

SEQ ID NO: 425817 - RNA, 23 nt, Homo sapiens
agcaauccuccugagugauccca

SEQ ID NO: 425818 - RNA, 17 nt, Homo sapiens
agcaauccugcaagaac

SEQ ID NO: 425819 - RNA, 14 nt, Homo sapiens
agcaaugaugucca

SEQ ID NO: 425820 - RNA, 21 nt, Homo sapiens
agcaauggaguggcugccaug

SEQ ID NO: 425821 - RNA, 18 nt, Homo sapiens
agcaaugggacuggaguc

SEQ ID NO: 425822 - RNA, 20 nt, Homo sapiens
agcaauuauuuuaagcacuu

SEQ ID NO: 425823 - RNA, 20 nt, Homo sapiens
agcaauuguauuacuuccuc

SEQ ID NO: 425824 - RNA, 18 nt, Homo sapiens
auauaaggaaagcaauaa

SEQ ID NO: 425825 - RNA, 13 nt, Homo sapiens
auauacacaaaga

SEQ ID NO: 425826 - RNA, 20 nt, Homo sapiens
auauacuauuuucauucucu

SEQ ID NO: 425827 - RNA, 11 nt, Homo sapiens
auauacuguua

SEQ ID NO: 425828 - RNA, 18 nt, Homo sapiens
auauagcuugaaacauag

SEQ ID NO: 425829 - RNA, 17 nt, Homo sapiens
auauaguaugaaugcag

SEQ ID NO: 425830 - RNA, 17 nt, Homo sapiens
auauaucuuuauacuua

SEQ ID NO: 425831 - RNA, 18 nt, Homo sapiens
auauaugccuucccccac

SEQ ID NO: 425832 - RNA, 16 nt, Homo sapiens
auauauggggggccaa

SEQ ID NO: 425833 - RNA, 14 nt, Homo sapiens
auauauugcugcug

SEQ ID NO: 425834 - RNA, 14 nt, Homo sapiens
auaucagagcucuu

SEQ ID NO: 425835 - RNA, 11 nt, Homo sapiens
auaucagggaa

SEQ ID NO: 425836 - RNA, 23 nt, Homo sapiens
auaucauucacccaaaacaaagu

SEQ ID NO: 425837 - RNA, 17 nt, Homo sapiens
auauccaaagacuguac

SEQ ID NO: 425838 - RNA, 16 nt, Homo sapiens
auauccagcugaguga

SEQ ID NO: 425839 - RNA, 16 nt, Homo sapiens
auauccagucaaagac

SEQ ID NO: 425840 - RNA, 14 nt, Homo sapiens
auauccauaaccuc

SEQ ID NO: 425841 - RNA, 15 nt, Homo sapiens
auauccauaaccucu

SEQ ID NO: 425842 - RNA, 14 nt, Homo sapiens
auaucccuaccuug

SEQ ID NO: 425843 - RNA, 14 nt, Homo sapiens
auaucgaucucuua

SEQ ID NO: 425844 - RNA, 21 nt, Homo sapiens
auaucugaacacauacuagaa

SEQ ID NO: 425845 - RNA, 20 nt, Homo sapiens
auaucuugaagaauauuguu

SEQ ID NO: 425846 - RNA, 20 nt, Homo sapiens
auaucuuuaaauaaauguga

SEQ ID NO: 425847 - RNA, 15 nt, Homo sapiens
auaucuuugcacuga

SEQ ID NO: 425848 - RNA, 22 nt, Homo sapiens
auaugaaaugauaaagauguca

SEQ ID NO: 425849 - RNA, 21 nt, Homo sapiens
auaugaguuacugaaggugau

SEQ ID NO: 425850 - RNA, 21 nt, Homo sapiens
auaugauaaauuugacuguua

SEQ ID NO: 425851 - RNA, 18 nt, Homo sapiens
auaugauuguaacauauu

SEQ ID NO: 425852 - RNA, 14 nt, Homo sapiens
auaugcacuugaaa

SEQ ID NO: 425853 - RNA, 16 nt, Homo sapiens
auaugcaguucugcag

SEQ ID NO: 425854 - RNA, 16 nt, Homo sapiens
auaugcuuuacaaucu

SEQ ID NO: 425855 - RNA, 16 nt, Homo sapiens
auauggaaauccuguu

SEQ ID NO: 425856 - RNA, 16 nt, Homo sapiens
auaugggaggaacaaa

SEQ ID NO: 425857 - RNA, 18 nt, Homo sapiens
auauguauaucuuugcac

SEQ ID NO: 425858 - RNA, 13 nt, Homo sapiens
auaugucuugcaa

SEQ ID NO: 425859 - RNA, 10 nt, Homo sapiens
auaugugaga

SEQ ID NO: 425860 - RNA, 14 nt, Homo sapiens
auauguugcucagu

SEQ ID NO: 425861 - RNA, 19 nt, Homo sapiens
auauguuuauauacugggu

SEQ ID NO: 425862 - RNA, 18 nt, Homo sapiens
auauuaaggcaguaugcc

SEQ ID NO: 425863 - RNA, 21 nt, Homo sapiens
auauuacugaucuuaccuuua

SEQ ID NO: 425864 - RNA, 17 nt, Homo sapiens
auauuauaauaauguuc

SEQ ID NO: 425865 - RNA, 18 nt, Homo sapiens
auauucaacagcucacca

SEQ ID NO: 425866 - RNA, 21 nt, Homo sapiens
auauuccagcagugaaacuug

SEQ ID NO: 425867 - RNA, 20 nt, Homo sapiens
auauucccuuguauggauau

SEQ ID NO: 425868 - RNA, 20 nt, Homo sapiens
auauucuaagccaguuuuca

SEQ ID NO: 425869 - RNA, 17 nt, Homo sapiens
auauucugcaacacugu

SEQ ID NO: 425870 - RNA, 20 nt, Homo sapiens
auauugagaucagcauucaa

SEQ ID NO: 425871 - RNA, 19 nt, Homo sapiens
auauugauaaaaccauaca

SEQ ID NO: 425872 - RNA, 22 nt, Homo sapiens
auauugugauuuuaauuugacc

SEQ ID NO: 425873 - RNA, 16 nt, Homo sapiens
auauugugcaugcaaa

SEQ ID NO: 425874 - RNA, 21 nt, Homo sapiens
auauuuaaauguaaagacaaa

SEQ ID NO: 425875 - RNA, 17 nt, Homo sapiens
auauuuaagcaacaucu

SEQ ID NO: 425876 - RNA, 21 nt, Homo sapiens
auauuuaauaggauaaauuaa

SEQ ID NO: 425877 - RNA, 19 nt, Homo sapiens
auauuuccuucaccaccuc

SEQ ID NO: 425878 - RNA, 17 nt, Homo sapiens
auauuucuugcuuucaa

SEQ ID NO: 425879 - RNA, 19 nt, Homo sapiens
auauuugaaagaagucaaa

SEQ ID NO: 425880 - RNA, 22 nt, Homo sapiens
auauuuuagauuacaggauuaa

SEQ ID NO: 425881 - RNA, 14 nt, Homo sapiens
auauuuuugccaua

SEQ ID NO: 425882 - RNA, 19 nt, Homo sapiens
auauuuuugccauaaugac

SEQ ID NO: 425883 - RNA, 13 nt, Homo sapiens
auauuuuuuacaa

SEQ ID NO: 425884 - RNA, 18 nt, Homo sapiens
aucaaaagcuuauucauc

SEQ ID NO: 425885 - RNA, 19 nt, Homo sapiens
aucaaacacacuuccagcu

SEQ ID NO: 425886 - RNA, 18 nt, Homo sapiens
aucaaaccuacuauaaaa

SEQ ID NO: 425887 - RNA, 12 nt, Homo sapiens
aucaaacuucca

SEQ ID NO: 425888 - RNA, 12 nt, Homo sapiens
aucaaagcacau

SEQ ID NO: 425889 - RNA, 12 nt, Homo sapiens
aucaaagcacuu

SEQ ID NO: 425890 - RNA, 20 nt, Homo sapiens
aucaacccaauaauucugua

SEQ ID NO: 425891 - RNA, 14 nt, Homo sapiens
aucaacccacuuaa

SEQ ID NO: 425892 - RNA, 14 nt, Homo sapiens
aucaacuguugaua

SEQ ID NO: 425893 - RNA, 20 nt, Homo sapiens
aucaacuuaauucuguuaca

SEQ ID NO: 425894 - RNA, 15 nt, Homo sapiens
aucaagaugugacau

SEQ ID NO: 425895 - RNA, 17 nt, Homo sapiens
aucaagcccuuuacuug

SEQ ID NO: 425896 - RNA, 17 nt, Homo sapiens
aucaagcuccaucuuau

SEQ ID NO: 425897 - RNA, 17 nt, Homo sapiens
aucaaggcugccuggag

SEQ ID NO: 425898 - RNA, 22 nt, Homo sapiens
aucaagucugugaaagucuccu

SEQ ID NO: 425899 - RNA, 15 nt, Homo sapiens
aucaauaaaggggaa

SEQ ID NO: 425900 - RNA, 15 nt, Homo sapiens
aucaaugucacuuaa

SEQ ID NO: 425901 - RNA, 19 nt, Homo sapiens
aucacaaccacaaccaaca

SEQ ID NO: 425902 - RNA, 17 nt, Homo sapiens
aucacaauguacuauau

SEQ ID NO: 425903 - RNA, 19 nt, Homo sapiens
aucacauaugcuuacucuu

SEQ ID NO: 425904 - RNA, 19 nt, Homo sapiens
aucaccagaaaugauagcg

SEQ ID NO: 425905 - RNA, 12 nt, Homo sapiens
aucacuacugca

SEQ ID NO: 425906 - RNA, 17 nt, Homo sapiens
aucacuauugcuuccua

SEQ ID NO: 425907 - RNA, 16 nt, Homo sapiens
aucacucaaccauaac

SEQ ID NO: 425908 - RNA, 23 nt, Homo sapiens
aucacucggcuguggagaacaaa

SEQ ID NO: 425909 - RNA, 22 nt, Homo sapiens
aucacugcaccucuuugucaca

SEQ ID NO: 425910 - RNA, 16 nt, Homo sapiens
aucacuuuaugucuca

SEQ ID NO: 425911 - RNA, 18 nt, Homo sapiens
aucagaaaccccacuucc

SEQ ID NO: 425912 - RNA, 13 nt, Homo sapiens
aucagaauauuaa

SEQ ID NO: 425913 - RNA, 14 nt, Homo sapiens
aucagaauguuuca

SEQ ID NO: 425914 - RNA, 19 nt, Homo sapiens
aucagacacaauuagagaa

SEQ ID NO: 425915 - RNA, 22 nt, Homo sapiens
aucagaccauaauguuacauua

SEQ ID NO: 425916 - RNA, 13 nt, Homo sapiens
aucagacuaguga

SEQ ID NO: 425917 - RNA, 18 nt, Homo sapiens
aucagacugcuuugagaa

SEQ ID NO: 425918 - RNA, 14 nt, Homo sapiens
aucagaguggccaa

SEQ ID NO: 425919 - RNA, 14 nt, Homo sapiens
aucagcagugauug

SEQ ID NO: 425920 - RNA, 19 nt, Homo sapiens
aucagccccgcuccucccc

SEQ ID NO: 425921 - RNA, 20 nt, Homo sapiens
aucagccuccgccauuccaa

SEQ ID NO: 425922 - RNA, 14 nt, Homo sapiens
aucagccucuggcc

SEQ ID NO: 425923 - RNA, 15 nt, Homo sapiens
aucagcuaugcaaau

SEQ ID NO: 425924 - RNA, 14 nt, Homo sapiens
aucagcucucugca

SEQ ID NO: 425925 - RNA, 21 nt, Homo sapiens
aucagggaaaaggaguaggga

SEQ ID NO: 425926 - RNA, 22 nt, Homo sapiens
aucaggucauuauuuuuuacaa

SEQ ID NO: 425927 - RNA, 17 nt, Homo sapiens
aucaguaugaagacacu

SEQ ID NO: 425928 - RNA, 20 nt, Homo sapiens
aucaguccacccccauugug

SEQ ID NO: 425929 - RNA, 23 nt, Homo sapiens
aucagucuuugucaaugcucuaa

SEQ ID NO: 425930 - RNA, 23 nt, Homo sapiens
aucagugacagaguucacuauaa

SEQ ID NO: 425931 - RNA, 11 nt, Homo sapiens
aucagugaugg

SEQ ID NO: 425932 - RNA, 11 nt, Homo sapiens
aucagugcaug

SEQ ID NO: 425933 - RNA, 19 nt, Homo sapiens
aucaguggacaaggggaga

SEQ ID NO: 425934 - RNA, 22 nt, Homo sapiens
aucaguggggccccaaagccca

SEQ ID NO: 425935 - RNA, 11 nt, Homo sapiens
aucaguguuua

SEQ ID NO: 425936 - RNA, 15 nt, Homo sapiens
aucaguuaauggcuc

SEQ ID NO: 425937 - RNA, 23 nt, Homo sapiens
aucauauaauaaauguacauuaa

SEQ ID NO: 425938 - RNA, 17 nt, Homo sapiens
aucaucccaacagccaa

SEQ ID NO: 425939 - RNA, 18 nt, Homo sapiens
aucaucuagggaguauga

SEQ ID NO: 425940 - RNA, 23 nt, Homo sapiens
aucaugaaaguccagcacuggaa

SEQ ID NO: 425941 - RNA, 14 nt, Homo sapiens
aucaugcccugccu

SEQ ID NO: 425942 - RNA, 17 nt, Homo sapiens
aucauggucucagucau

SEQ ID NO: 425943 - RNA, 14 nt, Homo sapiens
aucaugucauugau

SEQ ID NO: 425944 - RNA, 18 nt, Homo sapiens
aucauuauaaauaauguu

SEQ ID NO: 425945 - RNA, 15 nt, Homo sapiens
aucauucaacucucc

SEQ ID NO: 425946 - RNA, 16 nt, Homo sapiens
aucauucaacucucca

SEQ ID NO: 425947 - RNA, 21 nt, Homo sapiens
aucauuccccccgugaagucu

SEQ ID NO: 425948 - RNA, 15 nt, Homo sapiens
aucauucucaguauc

SEQ ID NO: 425949 - RNA, 22 nt, Homo sapiens
aucauugagaaauaaagcacau

SEQ ID NO: 425950 - RNA, 23 nt, Homo sapiens
aucauugagaaauaaagcacauu

SEQ ID NO: 425951 - RNA, 13 nt, Homo sapiens
aucauuuauuuga

SEQ ID NO: 425952 - RNA, 17 nt, Homo sapiens
auccaaaugcugugcaa

SEQ ID NO: 425953 - RNA, 21 nt, Homo sapiens
auccaagaccuuacaaccaca

SEQ ID NO: 425954 - RNA, 12 nt, Homo sapiens
auccaauggauu

SEQ ID NO: 425955 - RNA, 14 nt, Homo sapiens
auccaauguaugaa

SEQ ID NO: 425956 - RNA, 15 nt, Homo sapiens
auccacaagccauuu

SEQ ID NO: 425957 - RNA, 22 nt, Homo sapiens
agccgccaggaccgccaaagaa

SEQ ID NO: 425958 - RNA, 15 nt, Homo sapiens
agccgccauugccac

SEQ ID NO: 425959 - RNA, 14 nt, Homo sapiens
agccggcacagggu

SEQ ID NO: 425960 - RNA, 15 nt, Homo sapiens
agccguccauggcac

SEQ ID NO: 425961 - RNA, 15 nt, Homo sapiens
agccgugaugcucag

SEQ ID NO: 425962 - RNA, 15 nt, Homo sapiens
agccgugcagcuggg

SEQ ID NO: 425963 - RNA, 17 nt, Homo sapiens
agccguugcuaaugcca

SEQ ID NO: 425964 - RNA, 12 nt, Homo sapiens
agccuacugucu

SEQ ID NO: 425965 - RNA, 21 nt, Homo sapiens
agccuacugucuccuucccac

SEQ ID NO: 425966 - RNA, 21 nt, Homo sapiens
agccuacuuucacacuaagaa

SEQ ID NO: 425967 - RNA, 13 nt, Homo sapiens
agccuacuuuuca

SEQ ID NO: 425968 - RNA, 15 nt, Homo sapiens
agccuauggcaucuu

SEQ ID NO: 425969 - RNA, 16 nt, Homo sapiens
agccucaaaugcagua

SEQ ID NO: 425970 - RNA, 18 nt, Homo sapiens
agccucagcaacagccag

SEQ ID NO: 425971 - RNA, 15 nt, Homo sapiens
agccucauucacugu

SEQ ID NO: 425972 - RNA, 16 nt, Homo sapiens
agccucauucacuguc

SEQ ID NO: 425973 - RNA, 14 nt, Homo sapiens
agccuccagcaccu

SEQ ID NO: 425974 - RNA, 19 nt, Homo sapiens
agccuccgcgccuugccuc

SEQ ID NO: 425975 - RNA, 15 nt, Homo sapiens
agccuccuccugacc

SEQ ID NO: 425976 - RNA, 14 nt, Homo sapiens
agccucgaacuccu

SEQ ID NO: 425977 - RNA, 15 nt, Homo sapiens
agccucgaauaucuu

SEQ ID NO: 425978 - RNA, 18 nt, Homo sapiens
agccucuagaacagccag

SEQ ID NO: 425979 - RNA, 22 nt, Homo sapiens
agccucuagaacagccagaccc

SEQ ID NO: 425980 - RNA, 15 nt, Homo sapiens
agccucucaccugga

SEQ ID NO: 425981 - RNA, 16 nt, Homo sapiens
agccucucaccuggac

SEQ ID NO: 425982 - RNA, 22 nt, Homo sapiens
agccucucccuccagccaauag

SEQ ID NO: 425983 - RNA, 22 nt, Homo sapiens
agccucugucgcccuuagucau

SEQ ID NO: 425984 - RNA, 23 nt, Homo sapiens
agccucuugagcugaaguaaugu

SEQ ID NO: 425985 - RNA, 16 nt, Homo sapiens
agccucuuuaacagcu

SEQ ID NO: 425986 - RNA, 13 nt, Homo sapiens
agccugaccaaaa

SEQ ID NO: 425987 - RNA, 15 nt, Homo sapiens
agccugaccaaaagu

SEQ ID NO: 425988 - RNA, 14 nt, Homo sapiens
agccugaguuugcu

SEQ ID NO: 425989 - RNA, 18 nt, Homo sapiens
agccugcagaauccagcu

SEQ ID NO: 425990 - RNA, 14 nt, Homo sapiens
agccugcagcuuuc

SEQ ID NO: 425991 - RNA, 19 nt, Homo sapiens
agccugcagcuuucuggaa

SEQ ID NO: 425992 - RNA, 15 nt, Homo sapiens
agccugcaucugucu

SEQ ID NO: 425993 - RNA, 19 nt, Homo sapiens
agccugcguggccuggggc

SEQ ID NO: 425994 - RNA, 12 nt, Homo sapiens
agccugcugauu

SEQ ID NO: 425995 - RNA, 19 nt, Homo sapiens
agccuggagccccugugug

SEQ ID NO: 425996 - RNA, 19 nt, Homo sapiens
agccuggccccugugcacc

SEQ ID NO: 425997 - RNA, 19 nt, Homo sapiens
agccuggcucccaggacac

SEQ ID NO: 425998 - RNA, 20 nt, Homo sapiens
agccuggggccuggcaggga

SEQ ID NO: 425999 - RNA, 21 nt, Homo sapiens
agccugggugagaauccugcc

SEQ ID NO: 426000 - RNA, 18 nt, Homo sapiens
agccugguggcaauaagg

SEQ ID NO: 426001 - RNA, 20 nt, Homo sapiens
agccuguagcuuauauuuga

SEQ ID NO: 426002 - RNA, 21 nt, Homo sapiens
agccuguccugguacagcagg

SEQ ID NO: 426003 - RNA, 17 nt, Homo sapiens
agccugucucucccuac

SEQ ID NO: 426004 - RNA, 23 nt, Homo sapiens
agccuguggcaucuuugccuugg

SEQ ID NO: 426005 - RNA, 14 nt, Homo sapiens
agccugugggagaa

SEQ ID NO: 426006 - RNA, 17 nt, Homo sapiens
agccuuaaaaugcauug

SEQ ID NO: 426007 - RNA, 13 nt, Homo sapiens
agccuuaagccau

SEQ ID NO: 426008 - RNA, 15 nt, Homo sapiens
agccuuauccagcau

SEQ ID NO: 426009 - RNA, 13 nt, Homo sapiens
agccuugugauca

SEQ ID NO: 426010 - RNA, 19 nt, Homo sapiens
agccuuuaucuaugggaga

SEQ ID NO: 426011 - RNA, 13 nt, Homo sapiens
agccuuugaucuu

SEQ ID NO: 426012 - RNA, 14 nt, Homo sapiens
agccuuugccuccc

SEQ ID NO: 426013 - RNA, 12 nt, Homo sapiens
agcgaacaucuu

SEQ ID NO: 426014 - RNA, 14 nt, Homo sapiens
agcgaaucucugcc

SEQ ID NO: 426015 - RNA, 16 nt, Homo sapiens
agcgauaauuuuuaga

SEQ ID NO: 426016 - RNA, 22 nt, Homo sapiens
agcgcagguuuaguuuacucaa

SEQ ID NO: 426017 - RNA, 20 nt, Homo sapiens
agcgcaguggggugaucuca

SEQ ID NO: 426018 - RNA, 21 nt, Homo sapiens
agcgcugcucuuaugccauuu

SEQ ID NO: 426019 - RNA, 20 nt, Homo sapiens
agcggcuucaagagccagag

SEQ ID NO: 426020 - RNA, 20 nt, Homo sapiens
agcgucagcgggcgcugcug

SEQ ID NO: 426021 - RNA, 19 nt, Homo sapiens
agcgucauguccuuggcag

SEQ ID NO: 426022 - RNA, 15 nt, Homo sapiens
agcgucccagucucu

SEQ ID NO: 426023 - RNA, 19 nt, Homo sapiens
agcgucccagucucuggca

SEQ ID NO: 426024 - RNA, 21 nt, Homo sapiens
agcgugcaguagagagcaaag

SEQ ID NO: 426025 - RNA, 24 nt, Homo sapiens
agcgugcauaaguuaacuuccaau

SEQ ID NO: 426026 - RNA, 22 nt, Homo sapiens
agcguguguggggguacuagaa

SEQ ID NO: 426027 - RNA, 17 nt, Homo sapiens
agcguucuucaggagau

SEQ ID NO: 426028 - RNA, 19 nt, Homo sapiens
agcguuuccuuucuucccu

SEQ ID NO: 426029 - RNA, 18 nt, Homo sapiens
agcuaaaaugauuuuauc

SEQ ID NO: 426030 - RNA, 13 nt, Homo sapiens
agcuaacacuggc

SEQ ID NO: 426031 - RNA, 16 nt, Homo sapiens
agcuaacuuauuuucc

SEQ ID NO: 426032 - RNA, 15 nt, Homo sapiens
agcuaagccugauga

SEQ ID NO: 426033 - RNA, 12 nt, Homo sapiens
agcuaagugaaa

SEQ ID NO: 426034 - RNA, 22 nt, Homo sapiens
agcuaagugaauuuuugcacau

SEQ ID NO: 426035 - RNA, 23 nt, Homo sapiens
agcuaauccacaaccuguuacca

SEQ ID NO: 426036 - RNA, 12 nt, Homo sapiens
agcuacauuccu

SEQ ID NO: 426037 - RNA, 23 nt, Homo sapiens
agcuaccagguguucuacacuca

SEQ ID NO: 426038 - RNA, 21 nt, Homo sapiens
agcuacccacagagcaaguga

SEQ ID NO: 426039 - RNA, 21 nt, Homo sapiens
agcuaccucaaacuuccaguc

SEQ ID NO: 426040 - RNA, 13 nt, Homo sapiens
agcuacuaaugau

SEQ ID NO: 426041 - RNA, 15 nt, Homo sapiens
agcuacuauaugcau

SEQ ID NO: 426042 - RNA, 14 nt, Homo sapiens
agcuacugacuaug

SEQ ID NO: 426043 - RNA, 13 nt, Homo sapiens
agcuacuugccuu

SEQ ID NO: 426044 - RNA, 17 nt, Homo sapiens
agcuagagcucaguaua

SEQ ID NO: 426045 - RNA, 18 nt, Homo sapiens
agcuagagcuuuaccuga

SEQ ID NO: 426046 - RNA, 23 nt, Homo sapiens
agcuagaggacuucuggcaggga

SEQ ID NO: 426047 - RNA, 16 nt, Homo sapiens
agcuagaugugucuua

SEQ ID NO: 426048 - RNA, 20 nt, Homo sapiens
agcuaggugcacauauacau

SEQ ID NO: 426049 - RNA, 14 nt, Homo sapiens
agcuagucuuucac

SEQ ID NO: 426050 - RNA, 18 nt, Homo sapiens
agcuauaacaacucuauu

SEQ ID NO: 426051 - RNA, 17 nt, Homo sapiens
agcuaugggagccccag

SEQ ID NO: 426052 - RNA, 21 nt, Homo sapiens
agcuauuaagaaaaucacauu

SEQ ID NO: 426053 - RNA, 21 nt, Homo sapiens
agcucacaguacaauguuuca

SEQ ID NO: 426054 - RNA, 13 nt, Homo sapiens
agcucacccaagg

SEQ ID NO: 426055 - RNA, 16 nt, Homo sapiens
agcucaccguggugcu

SEQ ID NO: 426056 - RNA, 15 nt, Homo sapiens
agcucaggauggcuc

SEQ ID NO: 426057 - RNA, 15 nt, Homo sapiens
agcuccacucagggc

SEQ ID NO: 426058 - RNA, 13 nt, Homo sapiens
agcuccagcuuua

SEQ ID NO: 426059 - RNA, 21 nt, Homo sapiens
agcuccauaauugcaagggaa

SEQ ID NO: 426060 - RNA, 19 nt, Homo sapiens
agcucccaggacgcaggga

SEQ ID NO: 426061 - RNA, 17 nt, Homo sapiens
agcuccgccucccgggu

SEQ ID NO: 426062 - RNA, 17 nt, Homo sapiens
agcuccuaguagcuuuc

SEQ ID NO: 426063 - RNA, 13 nt, Homo sapiens
agcuccugggaag

SEQ ID NO: 426064 - RNA, 18 nt, Homo sapiens
agcucuacacaacaugua

SEQ ID NO: 426065 - RNA, 16 nt, Homo sapiens
agcucucacaugcaca

SEQ ID NO: 426066 - RNA, 15 nt, Homo sapiens
agcucucaguugcag

SEQ ID NO: 426067 - RNA, 16 nt, Homo sapiens
agcucuccugacuuuu

SEQ ID NO: 426068 - RNA, 21 nt, Homo sapiens
agcucucuugccgaggagcca

SEQ ID NO: 426069 - RNA, 15 nt, Homo sapiens
agcucuguuuuacaa

SEQ ID NO: 426070 - RNA, 19 nt, Homo sapiens
agcucuguuuuacaauaaa

SEQ ID NO: 426071 - RNA, 14 nt, Homo sapiens
agcucuucugggca

SEQ ID NO: 426072 - RNA, 20 nt, Homo sapiens
agcucuuugucucaccagcu

SEQ ID NO: 426073 - RNA, 15 nt, Homo sapiens
agcucuuuugagcau

SEQ ID NO: 426074 - RNA, 22 nt, Homo sapiens
agcugaaagauugauuaaugaa

SEQ ID NO: 426075 - RNA, 14 nt, Homo sapiens
agcugaacacaagc

SEQ ID NO: 426076 - RNA, 23 nt, Homo sapiens
agcugaacaguguuggcuuucau

SEQ ID NO: 426077 - RNA, 20 nt, Homo sapiens
agcugagaucacaccacugu

SEQ ID NO: 426078 - RNA, 15 nt, Homo sapiens
agcugagauggaacc

SEQ ID NO: 426079 - RNA, 14 nt, Homo sapiens
agcugagcuuucca

SEQ ID NO: 426080 - RNA, 19 nt, Homo sapiens
agcugauccagagcacaga

SEQ ID NO: 426081 - RNA, 17 nt, Homo sapiens
agcugauucccagagca

SEQ ID NO: 426082 - RNA, 18 nt, Homo sapiens
agcugauuuuaacaauaa

SEQ ID NO: 426083 - RNA, 18 nt, Homo sapiens
agcugcaggugcccauua

SEQ ID NO: 426084 - RNA, 14 nt, Homo sapiens
agcugccaagcacu

SEQ ID NO: 426085 - RNA, 18 nt, Homo sapiens
agcugccauccagggaug

SEQ ID NO: 426086 - RNA, 14 nt, Homo sapiens
agcugccucacuuc

SEQ ID NO: 426087 - RNA, 19 nt, Homo sapiens
agcugccucugccacugac

SEQ ID NO: 426088 - RNA, 13 nt, Homo sapiens
agcugcucauuuc

SEQ ID NO: 426089 - RNA, 16 nt, Homo sapiens
agcugcucauuucacu

SEQ ID NO: 426090 - RNA, 13 nt, Homo sapiens
agcugcucuugca

SEQ ID NO: 426091 - RNA, 16 nt, Homo sapiens
agcugcugacucacuu

SEQ ID NO: 426092 - RNA, 13 nt, Homo sapiens
agcugcuggccag

SEQ ID NO: 426093 - RNA, 16 nt, Homo sapiens
agcugcuguccaggaa

SEQ ID NO: 426094 - RNA, 19 nt, Homo sapiens
agcugcugugaacauuugu

SEQ ID NO: 426095 - RNA, 22 nt, Homo sapiens
agcugcugugaacauuugugua

SEQ ID NO: 426096 - RNA, 19 nt, Homo sapiens
agcugcuguuagauguccu

SEQ ID NO: 426097 - RNA, 16 nt, Homo sapiens
agcugcuguuuuuaga

SEQ ID NO: 426098 - RNA, 15 nt, Homo sapiens
agcugcuucugugca

SEQ ID NO: 426099 - RNA, 15 nt, Homo sapiens
agcuggaaaaccucc

SEQ ID NO: 426100 - RNA, 21 nt, Homo sapiens
agcuggaacacucucugagau

SEQ ID NO: 426101 - RNA, 23 nt, Homo sapiens
agcuggauuuccuaggcugacua

SEQ ID NO: 426102 - RNA, 18 nt, Homo sapiens
agcuggcaaacugugaau

SEQ ID NO: 426103 - RNA, 17 nt, Homo sapiens
agcugggggccaugagc

SEQ ID NO: 426104 - RNA, 20 nt, Homo sapiens
agcugggggccaugagcucc

SEQ ID NO: 426105 - RNA, 20 nt, Homo sapiens
agcuggggggcuguccugag

SEQ ID NO: 426106 - RNA, 18 nt, Homo sapiens
agcuggguaccaggccac

SEQ ID NO: 426107 - RNA, 18 nt, Homo sapiens
agcugguaaacuauuugu

SEQ ID NO: 426108 - RNA, 12 nt, Homo sapiens
agcuggugacag

SEQ ID NO: 426109 - RNA, 14 nt, Homo sapiens
agcuguagccaugg

SEQ ID NO: 426110 - RNA, 15 nt, Homo sapiens
agcugucgacuucau

SEQ ID NO: 426111 - RNA, 19 nt, Homo sapiens
agcugucgacuucaugaca

SEQ ID NO: 426112 - RNA, 13 nt, Homo sapiens
agcugucuuguca

SEQ ID NO: 426113 - RNA, 14 nt, Homo sapiens
agcugucuugucau

SEQ ID NO: 426114 - RNA, 10 nt, Homo sapiens
agcugugaaa

SEQ ID NO: 426115 - RNA, 14 nt, Homo sapiens
agcugugugcaguc

SEQ ID NO: 426116 - RNA, 18 nt, Homo sapiens
agcuguuacuuucuuuca

SEQ ID NO: 426117 - RNA, 17 nt, Homo sapiens
agcuguuuauggccuca

SEQ ID NO: 426118 - RNA, 18 nt, Homo sapiens
agcuguuuauggccucag

SEQ ID NO: 426119 - RNA, 22 nt, Homo sapiens
agcuuagccaaugugggagcag

SEQ ID NO: 426120 - RNA, 12 nt, Homo sapiens
agcuuagcuguc

SEQ ID NO: 426121 - RNA, 20 nt, Homo sapiens
agcuuauacaauucagagaa

SEQ ID NO: 426122 - RNA, 21 nt, Homo sapiens
agcuucacuuaaaaucaaauu

SEQ ID NO: 426123 - RNA, 16 nt, Homo sapiens
agcuucaucuacccuu

SEQ ID NO: 426124 - RNA, 19 nt, Homo sapiens
agcuucaucuugagccuga

SEQ ID NO: 426125 - RNA, 22 nt, Homo sapiens
agcuucccgaguaacugagauu

SEQ ID NO: 426126 - RNA, 16 nt, Homo sapiens
agcuucuaucccagga

SEQ ID NO: 426127 - RNA, 14 nt, Homo sapiens
agcuucucugugaa

SEQ ID NO: 426128 - RNA, 21 nt, Homo sapiens
agcuucuuaauauaacugccu

SEQ ID NO: 426129 - RNA, 18 nt, Homo sapiens
agcuucuuuacuacugca

SEQ ID NO: 426130 - RNA, 23 nt, Homo sapiens
agcuuggauggagacuccaugag

SEQ ID NO: 426131 - RNA, 20 nt, Homo sapiens
agcuuguggccccuuuuacu

SEQ ID NO: 426132 - RNA, 13 nt, Homo sapiens
agcuuguuucccu

SEQ ID NO: 426133 - RNA, 18 nt, Homo sapiens
agcuuguuucuauacugu

SEQ ID NO: 426134 - RNA, 13 nt, Homo sapiens
agcuuuccgggga

SEQ ID NO: 426135 - RNA, 17 nt, Homo sapiens
agcuuuccggggaggag

SEQ ID NO: 426136 - RNA, 21 nt, Homo sapiens
agcuuucuucuacaaccagag

SEQ ID NO: 426137 - RNA, 21 nt, Homo sapiens
agcuuucuuuuuaaagcuuuu

SEQ ID NO: 426138 - RNA, 15 nt, Homo sapiens
agcuuugcagugaaa

SEQ ID NO: 426139 - RNA, 23 nt, Homo sapiens
agcuuugcagugaaagcuuucau

SEQ ID NO: 426140 - RNA, 20 nt, Homo sapiens
agcuuuggacacacacagcu

SEQ ID NO: 426141 - RNA, 12 nt, Homo sapiens
agcuuuucccaa

SEQ ID NO: 426142 - RNA, 18 nt, Homo sapiens
agcuuuugaaauccagaa

SEQ ID NO: 426143 - RNA, 23 nt, Homo sapiens
agcuuuugaggggcugacuucaa

SEQ ID NO: 426144 - RNA, 23 nt, Homo sapiens
agcuuuuuaccguucacuucccc

SEQ ID NO: 426145 - RNA, 17 nt, Homo sapiens
aggaaaaaauuaauacu

SEQ ID NO: 426146 - RNA, 22 nt, Homo sapiens
aggaaaaacagaacauuucuca

SEQ ID NO: 426147 - RNA, 18 nt, Homo sapiens
aggaaaagauucaaagcu

SEQ ID NO: 426148 - RNA, 19 nt, Homo sapiens
aggaaaaguuauugugaua

SEQ ID NO: 426149 - RNA, 21 nt, Homo sapiens
aggaaaggggcgagcacccac

SEQ ID NO: 426150 - RNA, 21 nt, Homo sapiens
aggaaauccagccccauagaa

SEQ ID NO: 426151 - RNA, 22 nt, Homo sapiens
aggaaaugaauauucaacagcu

SEQ ID NO: 426152 - RNA, 22 nt, Homo sapiens
aggaacacccggaaagacugaa

SEQ ID NO: 426153 - RNA, 23 nt, Homo sapiens
aggaacacccggaaagacugaaa

SEQ ID NO: 426154 - RNA, 14 nt, Homo sapiens
aggaacagaguaua

SEQ ID NO: 426155 - RNA, 20 nt, Homo sapiens
aggaacauuccuuagucuca

SEQ ID NO: 426156 - RNA, 22 nt, Homo sapiens
aggaacucuucaugagcacuuu

SEQ ID NO: 426157 - RNA, 21 nt, Homo sapiens
aggaacugggccuugugugcu

SEQ ID NO: 426158 - RNA, 13 nt, Homo sapiens
aggaacuggucca

SEQ ID NO: 426159 - RNA, 14 nt, Homo sapiens
aggaacugguccag

SEQ ID NO: 426160 - RNA, 20 nt, Homo sapiens
aggaacugguccaggccagg

SEQ ID NO: 426161 - RNA, 16 nt, Homo sapiens
aggaagagcaggcacc

SEQ ID NO: 426162 - RNA, 16 nt, Homo sapiens
aggaagccacugccag

SEQ ID NO: 426163 - RNA, 22 nt, Homo sapiens
aggaagcuuggggaacccauga

SEQ ID NO: 426164 - RNA, 15 nt, Homo sapiens
aggaaggaaccagaa

SEQ ID NO: 426165 - RNA, 15 nt, Homo sapiens
aggaaggcagcugcu

SEQ ID NO: 426166 - RNA, 18 nt, Homo sapiens
aggaagggacugguccag

SEQ ID NO: 426167 - RNA, 20 nt, Homo sapiens
aggaagggacugguccaggc

SEQ ID NO: 426168 - RNA, 13 nt, Homo sapiens
aggaagggccaga

SEQ ID NO: 426169 - RNA, 21 nt, Homo sapiens
aggaagguaugugucagccau

SEQ ID NO: 426170 - RNA, 17 nt, Homo sapiens
aggaagucccuugccau

SEQ ID NO: 426171 - RNA, 21 nt, Homo sapiens
aggaagugauaacacuggagu

SEQ ID NO: 426172 - RNA, 14 nt, Homo sapiens
aggaagugggagaa

SEQ ID NO: 426173 - RNA, 14 nt, Homo sapiens
aggaauaaugauac

SEQ ID NO: 426174 - RNA, 14 nt, Homo sapiens
aggaaucagcucaa

SEQ ID NO: 426175 - RNA, 14 nt, Homo sapiens
aggaauugcgucau

SEQ ID NO: 426176 - RNA, 12 nt, Homo sapiens
aggaauuucuga

SEQ ID NO: 426177 - RNA, 15 nt, Homo sapiens
aggaauuucugcucu

SEQ ID NO: 426178 - RNA, 14 nt, Homo sapiens
aggacacagcagug

SEQ ID NO: 426179 - RNA, 13 nt, Homo sapiens
aggacacagucag

SEQ ID NO: 426180 - RNA, 18 nt, Homo sapiens
aggacaccuuuuaacuca

SEQ ID NO: 426181 - RNA, 15 nt, Homo sapiens
aggacacugaugggu

SEQ ID NO: 426182 - RNA, 12 nt, Homo sapiens
aggacagcauua

SEQ ID NO: 426183 - RNA, 13 nt, Homo sapiens
aggacaggggcau

SEQ ID NO: 426184 - RNA, 18 nt, Homo sapiens
aggacagugcugacccca

SEQ ID NO: 426185 - RNA, 15 nt, Homo sapiens
aggacaguggaugcu

SEQ ID NO: 426186 - RNA, 17 nt, Homo sapiens
aggacaguggaugcugc

SEQ ID NO: 426187 - RNA, 13 nt, Homo sapiens
aggaccacuccug

SEQ ID NO: 426188 - RNA, 14 nt, Homo sapiens
aggaccagccagac

SEQ ID NO: 426189 - RNA, 22 nt, Homo sapiens
aggaccaggagccagguguccu

SEQ ID NO: 426190 - RNA, 21 nt, Homo sapiens
aggaccaguuucuugaagucc

SEQ ID NO: 426191 - RNA, 23 nt, Homo sapiens
aggaccucugggcuuugauucca

SEQ ID NO: 426192 - RNA, 19 nt, Homo sapiens
aggacucccuccucaccuc

SEQ ID NO: 426193 - RNA, 21 nt, Homo sapiens
aggacucucuuucuuccacua

SEQ ID NO: 426194 - RNA, 18 nt, Homo sapiens
aggacuggcuuuguccca

SEQ ID NO: 426195 - RNA, 18 nt, Homo sapiens
aggacuguugacauccaa

SEQ ID NO: 426196 - RNA, 15 nt, Homo sapiens
aggacuugaaagcau

SEQ ID NO: 426197 - RNA, 20 nt, Homo sapiens
aggacuugaauucaaagcau

SEQ ID NO: 426198 - RNA, 20 nt, Homo sapiens
aggacuuuagggaucugggg

SEQ ID NO: 426199 - RNA, 13 nt, Homo sapiens
aggagaaacacau

SEQ ID NO: 426200 - RNA, 14 nt, Homo sapiens
aggagaacacuaga

SEQ ID NO: 426201 - RNA, 21 nt, Homo sapiens
aggagaacacuagacaugcca

SEQ ID NO: 426202 - RNA, 21 nt, Homo sapiens
aggagaaccacuacaugcagc

SEQ ID NO: 426203 - RNA, 21 nt, Homo sapiens
aggagaacugcuguguucuca

SEQ ID NO: 426204 - RNA, 13 nt, Homo sapiens
aggagaacugugc

SEQ ID NO: 426205 - RNA, 15 nt, Homo sapiens
aggagaacugugcuc

SEQ ID NO: 426206 - RNA, 22 nt, Homo sapiens
aggagaccuggcacuggaugca

SEQ ID NO: 426207 - RNA, 21 nt, Homo sapiens
aggagacuuuacauggaugcc

SEQ ID NO: 426208 - RNA, 23 nt, Homo sapiens
aggagaggaaaaguaaggugcag

SEQ ID NO: 426209 - RNA, 16 nt, Homo sapiens
aggagaugaugugaug

SEQ ID NO: 426210 - RNA, 19 nt, Homo sapiens
aggagauuuuccuuccuac

SEQ ID NO: 426211 - RNA, 14 nt, Homo sapiens
aggagcacuuccaa

SEQ ID NO: 426212 - RNA, 13 nt, Homo sapiens
aggagccacaggg

SEQ ID NO: 426213 - RNA, 17 nt, Homo sapiens
aggagccggugcucugg

SEQ ID NO: 426214 - RNA, 21 nt, Homo sapiens
aggagccuauggcaucuuccc

SEQ ID NO: 426215 - RNA, 20 nt, Homo sapiens
aggagcggccagaagaucua

SEQ ID NO: 426216 - RNA, 12 nt, Homo sapiens
aggagcucagau

SEQ ID NO: 426217 - RNA, 21 nt, Homo sapiens
aggagcugcuggcuugcagug

SEQ ID NO: 426218 - RNA, 17 nt, Homo sapiens
aggaggcuggcagguau

SEQ ID NO: 426219 - RNA, 22 nt, Homo sapiens
aggagggcagagacuuuguguu

SEQ ID NO: 426220 - RNA, 15 nt, Homo sapiens
aggagggcagccacg

SEQ ID NO: 426221 - RNA, 16 nt, Homo sapiens
aggagggcccuaccug

SEQ ID NO: 426222 - RNA, 16 nt, Homo sapiens
auccacaauagcugac

SEQ ID NO: 426223 - RNA, 20 nt, Homo sapiens
auccacagaaccuuugucaa

SEQ ID NO: 426224 - RNA, 17 nt, Homo sapiens
auccacaguauuguucu

SEQ ID NO: 426225 - RNA, 14 nt, Homo sapiens
auccacauuuuaac

SEQ ID NO: 426226 - RNA, 18 nt, Homo sapiens
auccacccaccuuggccu

SEQ ID NO: 426227 - RNA, 12 nt, Homo sapiens
auccaccucucc

SEQ ID NO: 426228 - RNA, 22 nt, Homo sapiens
auccacgccaaguggaagccac

SEQ ID NO: 426229 - RNA, 15 nt, Homo sapiens
auccacuucacaguu

SEQ ID NO: 426230 - RNA, 15 nt, Homo sapiens
auccagauccagacu

SEQ ID NO: 426231 - RNA, 17 nt, Homo sapiens
auccagaugaacugaga

SEQ ID NO: 426232 - RNA, 16 nt, Homo sapiens
auccagcaggcagcug

SEQ ID NO: 426233 - RNA, 19 nt, Homo sapiens
auccagcaucccaagauca

SEQ ID NO: 426234 - RNA, 18 nt, Homo sapiens
auccagccuccugcuaac

SEQ ID NO: 426235 - RNA, 12 nt, Homo sapiens
auccaggacagc

SEQ ID NO: 426236 - RNA, 16 nt, Homo sapiens
auccagucucccaacu

SEQ ID NO: 426237 - RNA, 21 nt, Homo sapiens
auccaguggggucucagucca

SEQ ID NO: 426238 - RNA, 20 nt, Homo sapiens
auccauacaaaacuaucggu

SEQ ID NO: 426239 - RNA, 18 nt, Homo sapiens
auccauagacacaguauu

SEQ ID NO: 426240 - RNA, 20 nt, Homo sapiens
auccaugcaugugcauauag

SEQ ID NO: 426241 - RNA, 16 nt, Homo sapiens
auccaugccauaagca

SEQ ID NO: 426242 - RNA, 17 nt, Homo sapiens
auccaugcggccggccu

SEQ ID NO: 426243 - RNA, 10 nt, Homo sapiens
auccauguga

SEQ ID NO: 426244 - RNA, 14 nt, Homo sapiens
auccaugugcugcu

SEQ ID NO: 426245 - RNA, 21 nt, Homo sapiens
auccaugugcugcuguggcau

SEQ ID NO: 426246 - RNA, 23 nt, Homo sapiens
aucccaauaaaguccucuucccu

SEQ ID NO: 426247 - RNA, 21 nt, Homo sapiens
aucccacuuaucaaaucauuc

SEQ ID NO: 426248 - RNA, 15 nt, Homo sapiens
aucccagcuacucag

SEQ ID NO: 426249 - RNA, 14 nt, Homo sapiens
auccccauccucca

SEQ ID NO: 426250 - RNA, 14 nt, Homo sapiens
aucccccuccuugc

SEQ ID NO: 426251 - RNA, 15 nt, Homo sapiens
auccccucccuguga

SEQ ID NO: 426252 - RNA, 13 nt, Homo sapiens
auccccuuuauua

SEQ ID NO: 426253 - RNA, 18 nt, Homo sapiens
aucccguaccucuuccca

SEQ ID NO: 426254 - RNA, 23 nt, Homo sapiens
aucccguaccucuucccaugacu

SEQ ID NO: 426255 - RNA, 12 nt, Homo sapiens
aucccuaccccc

SEQ ID NO: 426256 - RNA, 16 nt, Homo sapiens
aucccugugagcaaaa

SEQ ID NO: 426257 - RNA, 23 nt, Homo sapiens
aucccuguucauuguaagcacuu

SEQ ID NO: 426258 - RNA, 17 nt, Homo sapiens
aucccuucucacagcac

SEQ ID NO: 426259 - RNA, 18 nt, Homo sapiens
aucccuucucacagcaca

SEQ ID NO: 426260 - RNA, 19 nt, Homo sapiens
aucccuuucucucuugucc

SEQ ID NO: 426261 - RNA, 15 nt, Homo sapiens
auccgccuaccucag

SEQ ID NO: 426262 - RNA, 15 nt, Homo sapiens
auccuaacacauuau

SEQ ID NO: 426263 - RNA, 18 nt, Homo sapiens
auccuagcugugugcagu

SEQ ID NO: 426264 - RNA, 19 nt, Homo sapiens
auccuaugguaacugauga

SEQ ID NO: 426265 - RNA, 23 nt, Homo sapiens
auccuaugucauuucuacuuuga

SEQ ID NO: 426266 - RNA, 20 nt, Homo sapiens
auccucacugggugggguga

SEQ ID NO: 426267 - RNA, 14 nt, Homo sapiens
auccuccugcaaga

SEQ ID NO: 426268 - RNA, 21 nt, Homo sapiens
auccuccuucacucccuguca

SEQ ID NO: 426269 - RNA, 22 nt, Homo sapiens
auccucugagugugaccaggca

SEQ ID NO: 426270 - RNA, 17 nt, Homo sapiens
auccucugguucuucau

SEQ ID NO: 426271 - RNA, 18 nt, Homo sapiens
auccugcuagcuguagaa

SEQ ID NO: 426272 - RNA, 18 nt, Homo sapiens
auccuggagccccugugu

SEQ ID NO: 426273 - RNA, 14 nt, Homo sapiens
auccuggaguucug

SEQ ID NO: 426274 - RNA, 16 nt, Homo sapiens
auccugugugucuuuu

SEQ ID NO: 426275 - RNA, 15 nt, Homo sapiens
aaagaugcuauucuu

SEQ ID NO: 426276 - RNA, 17 nt, Homo sapiens
aaagauggaaguguauu

SEQ ID NO: 426277 - RNA, 20 nt, Homo sapiens
aaagaugugcagauaucaca

SEQ ID NO: 426278 - RNA, 21 nt, Homo sapiens
aaagauucuuuaaacuacuga

SEQ ID NO: 426279 - RNA, 15 nt, Homo sapiens
aaagcaacuccauca

SEQ ID NO: 426280 - RNA, 12 nt, Homo sapiens
aaagcacagugu

SEQ ID NO: 426281 - RNA, 17 nt, Homo sapiens
aaagcaggcaagcaugu

SEQ ID NO: 426282 - RNA, 23 nt, Homo sapiens
aaagcagugcaugcugucccuua

SEQ ID NO: 426283 - RNA, 22 nt, Homo sapiens
aaagcauccauguguggacuca

SEQ ID NO: 426284 - RNA, 16 nt, Homo sapiens
aaagcaucccugugag

SEQ ID NO: 426285 - RNA, 14 nt, Homo sapiens
aaagcaugccaauu

SEQ ID NO: 426286 - RNA, 20 nt, Homo sapiens
aaagcauguggcauguucau

SEQ ID NO: 426287 - RNA, 22 nt, Homo sapiens
aaagcauugccagcucuuccaa

SEQ ID NO: 426288 - RNA, 17 nt, Homo sapiens
aaagccauaacuugaaa

SEQ ID NO: 426289 - RNA, 14 nt, Homo sapiens
aaagcccuugaacc

SEQ ID NO: 426290 - RNA, 17 nt, Homo sapiens
aaagcccuugaaccagc

SEQ ID NO: 426291 - RNA, 22 nt, Homo sapiens
aaagccucagcaacagccagug

SEQ ID NO: 426292 - RNA, 16 nt, Homo sapiens
aaagccugaguuugcu

SEQ ID NO: 426293 - RNA, 23 nt, Homo sapiens
aaagccuuaucaagugucuucca

SEQ ID NO: 426294 - RNA, 16 nt, Homo sapiens
aaagccuuucauacca

SEQ ID NO: 426295 - RNA, 17 nt, Homo sapiens
aaagccuuuuccagaag

SEQ ID NO: 426296 - RNA, 22 nt, Homo sapiens
aaagcggccgaugggagucucc

SEQ ID NO: 426297 - RNA, 15 nt, Homo sapiens
aaagcuaaauuccac

SEQ ID NO: 426298 - RNA, 19 nt, Homo sapiens
aaaggaaaacucaccauuu

SEQ ID NO: 426299 - RNA, 22 nt, Homo sapiens
aaaggaagucucugggcccaga

SEQ ID NO: 426300 - RNA, 21 nt, Homo sapiens
aaaggacucugcuucagucca

SEQ ID NO: 426301 - RNA, 22 nt, Homo sapiens
aaaggacucugcuucaguccac

SEQ ID NO: 426302 - RNA, 14 nt, Homo sapiens
aaaggacucuugag

SEQ ID NO: 426303 - RNA, 12 nt, Homo sapiens
aaaggacugacc

SEQ ID NO: 426304 - RNA, 15 nt, Homo sapiens
aaaggauaugcagua

SEQ ID NO: 426305 - RNA, 21 nt, Homo sapiens
aaaggaucucuauaacagauc

SEQ ID NO: 426306 - RNA, 22 nt, Homo sapiens
aaaggcauccauagugcacuag

SEQ ID NO: 426307 - RNA, 19 nt, Homo sapiens
aaaggcaugaaucuucccu

SEQ ID NO: 426308 - RNA, 20 nt, Homo sapiens
aaaggcccuucaccucugga

SEQ ID NO: 426309 - RNA, 19 nt, Homo sapiens
aaaggcgguacuaguucag

SEQ ID NO: 426310 - RNA, 18 nt, Homo sapiens
aaaggcugaacauaaauc

SEQ ID NO: 426311 - RNA, 23 nt, Homo sapiens
aaaggcuuaggacuucaaaaggu

SEQ ID NO: 426312 - RNA, 16 nt, Homo sapiens
aaagggaaaacaaaua

SEQ ID NO: 426313 - RNA, 19 nt, Homo sapiens
aaagggagaacauggccaa

SEQ ID NO: 426314 - RNA, 19 nt, Homo sapiens
aaaggggacagaucuugag

SEQ ID NO: 426315 - RNA, 17 nt, Homo sapiens
aaaggguucuguaaaau

SEQ ID NO: 426316 - RNA, 14 nt, Homo sapiens
aaaggucauugugg

SEQ ID NO: 426317 - RNA, 12 nt, Homo sapiens
aaaggugcucaa

SEQ ID NO: 426318 - RNA, 15 nt, Homo sapiens
aaagguuuaauguca

SEQ ID NO: 426319 - RNA, 19 nt, Homo sapiens
aaaguaaaaacacuaccuc

SEQ ID NO: 426320 - RNA, 15 nt, Homo sapiens
aaaguaaauugccuu

SEQ ID NO: 426321 - RNA, 13 nt, Homo sapiens
aaaguagccacgu

SEQ ID NO: 426322 - RNA, 19 nt, Homo sapiens
aaaguagguauacaaaaga

SEQ ID NO: 426323 - RNA, 20 nt, Homo sapiens
aaagucaaacuuucaccuca

SEQ ID NO: 426324 - RNA, 14 nt, Homo sapiens
aaagucaucaaaga

SEQ ID NO: 426325 - RNA, 20 nt, Homo sapiens
aaagucugcauuacauuccu

SEQ ID NO: 426326 - RNA, 14 nt, Homo sapiens
aaagugacuaccag

SEQ ID NO: 426327 - RNA, 9 nt, Homo sapiens
aaagugaug

SEQ ID NO: 426328 - RNA, 22 nt, Homo sapiens
aaagugcaaguggaugcauucc

SEQ ID NO: 426329 - RNA, 15 nt, Homo sapiens
aaagugcagcccuuc

SEQ ID NO: 426330 - RNA, 17 nt, Homo sapiens
aaagugcagcccuuccu

SEQ ID NO: 426331 - RNA, 14 nt, Homo sapiens
aaagugugagcaaa

SEQ ID NO: 426332 - RNA, 20 nt, Homo sapiens
aaaguguuuuucuuuaauca

SEQ ID NO: 426333 - RNA, 15 nt, Homo sapiens
aaaguuaaccuaccu

SEQ ID NO: 426334 - RNA, 19 nt, Homo sapiens
aaaguuacugaucacagga

SEQ ID NO: 426335 - RNA, 18 nt, Homo sapiens
aaaguuauuauguagcug

SEQ ID NO: 426336 - RNA, 15 nt, Homo sapiens
aaaguuauugugaua

SEQ ID NO: 426337 - RNA, 13 nt, Homo sapiens
aaaguugaugcua

SEQ ID NO: 426338 - RNA, 17 nt, Homo sapiens
aaaguuuaaauaccagu

SEQ ID NO: 426339 - RNA, 21 nt, Homo sapiens
aaaguuuccccaccagugaau

SEQ ID NO: 426340 - RNA, 12 nt, Homo sapiens
aaaguuugcuca

SEQ ID NO: 426341 - RNA, 21 nt, Homo sapiens
aaaguuuuaggguacaguuug

SEQ ID NO: 426342 - RNA, 14 nt, Homo sapiens
aaaguuuugccuau

SEQ ID NO: 426343 - RNA, 13 nt, Homo sapiens
aaauaaagcuuuu

SEQ ID NO: 426344 - RNA, 20 nt, Homo sapiens
aaauaaagguuagauaaguc

SEQ ID NO: 426345 - RNA, 22 nt, Homo sapiens
aaauaaaguauauauagaaucu

SEQ ID NO: 426346 - RNA, 17 nt, Homo sapiens
aaauaaaguaucaugca

SEQ ID NO: 426347 - RNA, 15 nt, Homo sapiens
aaauaaauagcuaua

SEQ ID NO: 426348 - RNA, 18 nt, Homo sapiens
aaauaaauauacuaauaa

SEQ ID NO: 426349 - RNA, 13 nt, Homo sapiens
aaauaaaugugca

SEQ ID NO: 426350 - RNA, 13 nt, Homo sapiens
aaauaacauggcc

SEQ ID NO: 426351 - RNA, 15 nt, Homo sapiens
aaauaagaaugauuu

SEQ ID NO: 426352 - RNA, 18 nt, Homo sapiens
aaauaaguaacauauaaa

SEQ ID NO: 426353 - RNA, 19 nt, Homo sapiens
aaauaauaaacaguggaau

SEQ ID NO: 426354 - RNA, 12 nt, Homo sapiens
aaauacauauga

SEQ ID NO: 426355 - RNA, 16 nt, Homo sapiens
aaauacccaacgcaca

SEQ ID NO: 426356 - RNA, 15 nt, Homo sapiens
aaauacuauuggaca

SEQ ID NO: 426357 - RNA, 19 nt, Homo sapiens
aucuucagggcacugcugc

SEQ ID NO: 426358 - RNA, 18 nt, Homo sapiens
aucuuccccaacgaaaag

SEQ ID NO: 426359 - RNA, 17 nt, Homo sapiens
aucuucccuuuccuccc

SEQ ID NO: 426360 - RNA, 15 nt, Homo sapiens
aucuuccugcugcug

SEQ ID NO: 426361 - RNA, 12 nt, Homo sapiens
aucuucuacuuu

SEQ ID NO: 426362 - RNA, 19 nt, Homo sapiens
aucuucuaucaaagcacau

SEQ ID NO: 426363 - RNA, 18 nt, Homo sapiens
aucuucucuuugacaauu

SEQ ID NO: 426364 - RNA, 19 nt, Homo sapiens
aucuuggauuaugaaguga

SEQ ID NO: 426365 - RNA, 15 nt, Homo sapiens
aucuuggggugcagc

SEQ ID NO: 426366 - RNA, 15 nt, Homo sapiens
aucuuguacagccuu

SEQ ID NO: 426367 - RNA, 22 nt, Homo sapiens
aucuuguggucugcugccucag

SEQ ID NO: 426368 - RNA, 21 nt, Homo sapiens
aucuuuaaauaaaugugagaa

SEQ ID NO: 426369 - RNA, 20 nt, Homo sapiens
aucuuuauacuuaaacagcu

SEQ ID NO: 426370 - RNA, 18 nt, Homo sapiens
aucuuuauuaaauauuca

SEQ ID NO: 426371 - RNA, 13 nt, Homo sapiens
aucuuuccuccaa

SEQ ID NO: 426372 - RNA, 18 nt, Homo sapiens
aucuuucuuuaccugaga

SEQ ID NO: 426373 - RNA, 17 nt, Homo sapiens
aucuuuuauuucauuca

SEQ ID NO: 426374 - RNA, 13 nt, Homo sapiens
aucuuuucuacuu

SEQ ID NO: 426375 - RNA, 19 nt, Homo sapiens
aucuuuuuuaggcuucucc

SEQ ID NO: 426376 - RNA, 23 nt, Homo sapiens
augaaaaauaguguguccaugca

SEQ ID NO: 426377 - RNA, 20 nt, Homo sapiens
augaaaaccacccuaucauc

SEQ ID NO: 426378 - RNA, 14 nt, Homo sapiens
augaaaaugaaucu

SEQ ID NO: 426379 - RNA, 17 nt, Homo sapiens
augaaaaugaaucuuca

SEQ ID NO: 426380 - RNA, 16 nt, Homo sapiens
augaaaauuaggauuu

SEQ ID NO: 426381 - RNA, 14 nt, Homo sapiens
augaaaauucuuga

SEQ ID NO: 426382 - RNA, 22 nt, Homo sapiens
augaaacuccugauuuuguagu

SEQ ID NO: 426383 - RNA, 17 nt, Homo sapiens
augaaagguaaucugaa

SEQ ID NO: 426384 - RNA, 13 nt, Homo sapiens
augaaauaugcau

SEQ ID NO: 426385 - RNA, 17 nt, Homo sapiens
augaaaugacugucuaa

SEQ ID NO: 426386 - RNA, 16 nt, Homo sapiens
augaaaugggcuuuaa

SEQ ID NO: 426387 - RNA, 20 nt, Homo sapiens
augaacaaugugugggauaa

SEQ ID NO: 426388 - RNA, 16 nt, Homo sapiens
augaacaugcaguuca

SEQ ID NO: 426389 - RNA, 18 nt, Homo sapiens
augaaccauuaagaacaa

SEQ ID NO: 426390 - RNA, 18 nt, Homo sapiens
augaacccauccaaugga

SEQ ID NO: 426391 - RNA, 16 nt, Homo sapiens
augaacucuuaaucaa

SEQ ID NO: 426392 - RNA, 17 nt, Homo sapiens
augaagaaagauacuaa

SEQ ID NO: 426393 - RNA, 18 nt, Homo sapiens
augaagacagauacuccu

SEQ ID NO: 426394 - RNA, 20 nt, Homo sapiens
augaagacccuggaguucaa

SEQ ID NO: 426395 - RNA, 21 nt, Homo sapiens
augaagauucuccugugcuag

SEQ ID NO: 426396 - RNA, 11 nt, Homo sapiens
augaagcacau

SEQ ID NO: 426397 - RNA, 22 nt, Homo sapiens
augaagguuuguuccuuuguua

SEQ ID NO: 426398 - RNA, 21 nt, Homo sapiens
augaagucccucuaugucguc

SEQ ID NO: 426399 - RNA, 17 nt, Homo sapiens
augaauaaacacuuuuu

SEQ ID NO: 426400 - RNA, 21 nt, Homo sapiens
augaauauauuuaagcaacau

SEQ ID NO: 426401 - RNA, 18 nt, Homo sapiens
augaauauuuuguaacua

SEQ ID NO: 426402 - RNA, 12 nt, Homo sapiens
augaaucacugc

SEQ ID NO: 426403 - RNA, 14 nt, Homo sapiens
augaauguaaauuu

SEQ ID NO: 426404 - RNA, 14 nt, Homo sapiens
augaauuagccaaa

SEQ ID NO: 426405 - RNA, 11 nt, Homo sapiens
accucccugac

SEQ ID NO: 426406 - RNA, 23 nt, Homo sapiens
accuccuauccuuggagagcagc

SEQ ID NO: 426407 - RNA, 21 nt, Homo sapiens
accuccuccuccaguucugau

SEQ ID NO: 426408 - RNA, 20 nt, Homo sapiens
accuccuccucuggacaaag

SEQ ID NO: 426409 - RNA, 14 nt, Homo sapiens
accuccuuuaccag

SEQ ID NO: 426410 - RNA, 19 nt, Homo sapiens
accucggccucccaaagug

SEQ ID NO: 426411 - RNA, 13 nt, Homo sapiens
accucgugaucca

SEQ ID NO: 426412 - RNA, 14 nt, Homo sapiens
accucgugcuuuaa

SEQ ID NO: 426413 - RNA, 15 nt, Homo sapiens
accucgugcuuuaag

SEQ ID NO: 426414 - RNA, 17 nt, Homo sapiens
accucucacacuggcuc

SEQ ID NO: 426415 - RNA, 15 nt, Homo sapiens
accucugaucaaagc

SEQ ID NO: 426416 - RNA, 20 nt, Homo sapiens
accucugccuccuaaguuca

SEQ ID NO: 426417 - RNA, 19 nt, Homo sapiens
accucugggucaucucuca

SEQ ID NO: 426418 - RNA, 17 nt, Homo sapiens
accucuguuguccuccc

SEQ ID NO: 426419 - RNA, 18 nt, Homo sapiens
accucuguuguccucccc

SEQ ID NO: 426420 - RNA, 14 nt, Homo sapiens
accucuuagcuuuu

SEQ ID NO: 426421 - RNA, 16 nt, Homo sapiens
accucuucccaugacu

SEQ ID NO: 426422 - RNA, 16 nt, Homo sapiens
accucuuugucacagg

SEQ ID NO: 426423 - RNA, 22 nt, Homo sapiens
accucuuuugagacuuugccca

SEQ ID NO: 426424 - RNA, 23 nt, Homo sapiens
accugaaaaaguuuuguggauua

SEQ ID NO: 426425 - RNA, 19 nt, Homo sapiens
accugaacucugcaacuga

SEQ ID NO: 426426 - RNA, 20 nt, Homo sapiens
accugaccucugaagagcug

SEQ ID NO: 426427 - RNA, 12 nt, Homo sapiens
accugacuucca

SEQ ID NO: 426428 - RNA, 13 nt, Homo sapiens
accugacuuccac

SEQ ID NO: 426429 - RNA, 12 nt, Homo sapiens
accugagcugcc

SEQ ID NO: 426430 - RNA, 14 nt, Homo sapiens
accugagcugccau

SEQ ID NO: 426431 - RNA, 19 nt, Homo sapiens
accugagcugguggcugug

SEQ ID NO: 426432 - RNA, 11 nt, Homo sapiens
accugagcuuu

SEQ ID NO: 426433 - RNA, 23 nt, Homo sapiens
accugagggggcccaucccugcc

SEQ ID NO: 426434 - RNA, 13 nt, Homo sapiens
accugcacuucau

SEQ ID NO: 426435 - RNA, 15 nt, Homo sapiens
accugccacuaggcu

SEQ ID NO: 426436 - RNA, 19 nt, Homo sapiens
accugcggcuccccugugu

SEQ ID NO: 426437 - RNA, 11 nt, Homo sapiens
accugcugcug

SEQ ID NO: 426438 - RNA, 13 nt, Homo sapiens
accugcuggugag

SEQ ID NO: 426439 - RNA, 14 nt, Homo sapiens
accugcuucuauua

SEQ ID NO: 426440 - RNA, 23 nt, Homo sapiens
accugcuuugagauuuccugaca

SEQ ID NO: 426441 - RNA, 14 nt, Homo sapiens
accuggaaccagag

SEQ ID NO: 426442 - RNA, 20 nt, Homo sapiens
accuggacuggaucaagaag

SEQ ID NO: 426443 - RNA, 21 nt, Homo sapiens
accuggagcggcuauuccagg

SEQ ID NO: 426444 - RNA, 16 nt, Homo sapiens
accuggcccuugcaau

SEQ ID NO: 426445 - RNA, 19 nt, Homo sapiens
accuggcccuugcaaucuu

SEQ ID NO: 426446 - RNA, 14 nt, Homo sapiens
accuggcuuuuacu

SEQ ID NO: 426447 - RNA, 17 nt, Homo sapiens
accuggcuuuuacuuua

SEQ ID NO: 426448 - RNA, 18 nt, Homo sapiens
accugggcuuaaguuuua

SEQ ID NO: 426449 - RNA, 23 nt, Homo sapiens
accuggggauccaauugauguau

SEQ ID NO: 426450 - RNA, 19 nt, Homo sapiens
accuggguaacaaagugag

SEQ ID NO: 426451 - RNA, 16 nt, Homo sapiens
accugguuaccacagu

SEQ ID NO: 426452 - RNA, 22 nt, Homo sapiens
accugguuuccugggauucaaa

SEQ ID NO: 426453 - RNA, 16 nt, Homo sapiens
accuguaauagccuca

SEQ ID NO: 426454 - RNA, 17 nt, Homo sapiens
accuguagaaaagugag

SEQ ID NO: 426455 - RNA, 22 nt, Homo sapiens
accugucuuccaaggagaccaa

SEQ ID NO: 426456 - RNA, 15 nt, Homo sapiens
accuguucaaaaagg

SEQ ID NO: 426457 - RNA, 15 nt, Homo sapiens
accuuaaaauuagca

SEQ ID NO: 426458 - RNA, 14 nt, Homo sapiens
accuuagaaaucau

SEQ ID NO: 426459 - RNA, 14 nt, Homo sapiens
accuuauugaucuu

SEQ ID NO: 426460 - RNA, 12 nt, Homo sapiens
accuucaaagcu

SEQ ID NO: 426461 - RNA, 17 nt, Homo sapiens
accuucagauccuaccc

SEQ ID NO: 426462 - RNA, 16 nt, Homo sapiens
accuucccaugcccug

SEQ ID NO: 426463 - RNA, 15 nt, Homo sapiens
accuucccccaacua

SEQ ID NO: 426464 - RNA, 18 nt, Homo sapiens
accuuccccucacacucc

SEQ ID NO: 426465 - RNA, 17 nt, Homo sapiens
accuucugaagaucuca

SEQ ID NO: 426466 - RNA, 15 nt, Homo sapiens
accuucugaccuccc

SEQ ID NO: 426467 - RNA, 14 nt, Homo sapiens
accuugacgugugu

SEQ ID NO: 426468 - RNA, 20 nt, Homo sapiens
accuugcacuauuggacuuu

SEQ ID NO: 426469 - RNA, 19 nt, Homo sapiens
accuuggaggaaugacaau

SEQ ID NO: 426470 - RNA, 14 nt, Homo sapiens
accuuggcauccuu

SEQ ID NO: 426471 - RNA, 21 nt, Homo sapiens
accuuguacagaaccagcacu

SEQ ID NO: 426472 - RNA, 20 nt, Homo sapiens
accuuuaagagaaaugagcu

SEQ ID NO: 426473 - RNA, 23 nt, Homo sapiens
accuuuauuaaugaacugugaca

SEQ ID NO: 426474 - RNA, 18 nt, Homo sapiens
accuuucuaaaccucucu

SEQ ID NO: 426475 - RNA, 23 nt, Homo sapiens
accuuugacacugacagaugugu

SEQ ID NO: 426476 - RNA, 14 nt, Homo sapiens
accuuuguguaaua

SEQ ID NO: 426477 - RNA, 21 nt, Homo sapiens
accuuuuaucaauaaagcacu

SEQ ID NO: 426478 - RNA, 19 nt, Homo sapiens
accuuuuccugcggcauca

SEQ ID NO: 426479 - RNA, 12 nt, Homo sapiens
acgaaacauuua

SEQ ID NO: 426480 - RNA, 13 nt, Homo sapiens
acgaaaucuaggu

SEQ ID NO: 426481 - RNA, 15 nt, Homo sapiens
acgaaggccucugaa

SEQ ID NO: 426482 - RNA, 13 nt, Homo sapiens
acgaaggggcccc

SEQ ID NO: 426483 - RNA, 22 nt, Homo sapiens
acgaauauagaggguuuugcuc

SEQ ID NO: 426484 - RNA, 13 nt, Homo sapiens
acgacaacgauga

SEQ ID NO: 426485 - RNA, 11 nt, Homo sapiens
acgacucuucc

SEQ ID NO: 426486 - RNA, 13 nt, Homo sapiens
acgacuucagggc

SEQ ID NO: 426487 - RNA, 15 nt, Homo sapiens
acgagcuaguuaaac

SEQ ID NO: 426488 - RNA, 19 nt, Homo sapiens
acgagcugcuguccaggaa

SEQ ID NO: 426489 - RNA, 19 nt, Homo sapiens
acgaggcaaugacugugag

SEQ ID NO: 426490 - RNA, 21 nt, Homo sapiens
acgaggugguagcucugagcc

SEQ ID NO: 426491 - RNA, 20 nt, Homo sapiens
acgauguuaaaacaaauuaa

SEQ ID NO: 426492 - RNA, 19 nt, Homo sapiens
acgcaaccaccaccaacca

SEQ ID NO: 426493 - RNA, 16 nt, Homo sapiens
acgcacugguaugugu

SEQ ID NO: 426494 - RNA, 12 nt, Homo sapiens
acgcagccagga

SEQ ID NO: 426495 - RNA, 20 nt, Homo sapiens
acgccaaagugcagcccuuc

SEQ ID NO: 426496 - RNA, 18 nt, Homo sapiens
acgcgcguacagaucucu

SEQ ID NO: 426497 - RNA, 16 nt, Homo sapiens
acgcugguagagaugg

SEQ ID NO: 426498 - RNA, 18 nt, Homo sapiens
acggaccgcauccuccag

SEQ ID NO: 426499 - RNA, 14 nt, Homo sapiens
acggacucccgggc

SEQ ID NO: 426500 - RNA, 15 nt, Homo sapiens
acggauaguagacag

SEQ ID NO: 426501 - RNA, 15 nt, Homo sapiens
acggcagcuguagcu

SEQ ID NO: 426502 - RNA, 12 nt, Homo sapiens
acggccacugca

SEQ ID NO: 426503 - RNA, 19 nt, Homo sapiens
acggcguuucaccauguug

SEQ ID NO: 426504 - RNA, 17 nt, Homo sapiens
auggauaagcuugucua

SEQ ID NO: 426505 - RNA, 12 nt, Homo sapiens
auggauucacuu

SEQ ID NO: 426506 - RNA, 21 nt, Homo sapiens
auggcaacaaacacauuguga

SEQ ID NO: 426507 - RNA, 12 nt, Homo sapiens
auggcaccugug

SEQ ID NO: 426508 - RNA, 15 nt, Homo sapiens
auggcaccuuuugca

SEQ ID NO: 426509 - RNA, 11 nt, Homo sapiens
auggcacuggc

SEQ ID NO: 426510 - RNA, 12 nt, Homo sapiens
auggcacuggca

SEQ ID NO: 426511 - RNA, 19 nt, Homo sapiens
auggcaggcaucuguaaga

SEQ ID NO: 426512 - RNA, 13 nt, Homo sapiens
auggccugugcug

SEQ ID NO: 426513 - RNA, 16 nt, Homo sapiens
auggccuuugcuugaa

SEQ ID NO: 426514 - RNA, 18 nt, Homo sapiens
auggcggucagccccuuc

SEQ ID NO: 426515 - RNA, 16 nt, Homo sapiens
auggcuaccaaaaaga

SEQ ID NO: 426516 - RNA, 18 nt, Homo sapiens
auggcucaggcaagcccc

SEQ ID NO: 426517 - RNA, 17 nt, Homo sapiens
auggcucuggcacagug

SEQ ID NO: 426518 - RNA, 18 nt, Homo sapiens
auggcucuggcaccacua

SEQ ID NO: 426519 - RNA, 14 nt, Homo sapiens
auggcugugaaaau

SEQ ID NO: 426520 - RNA, 21 nt, Homo sapiens
auggcuuauugugugaaggua

SEQ ID NO: 426521 - RNA, 18 nt, Homo sapiens
auggcuuuccacaucccc

SEQ ID NO: 426522 - RNA, 17 nt, Homo sapiens
augggaaccccuucauc

SEQ ID NO: 426523 - RNA, 21 nt, Homo sapiens
augggacugaugucaucuuga

SEQ ID NO: 426524 - RNA, 20 nt, Homo sapiens
augggagauuaaaaccagag

SEQ ID NO: 426525 - RNA, 14 nt, Homo sapiens
augggagugggcac

SEQ ID NO: 426526 - RNA, 14 nt, Homo sapiens
augggcacuggaaa

SEQ ID NO: 426527 - RNA, 14 nt, Homo sapiens
augggcacuugaga

SEQ ID NO: 426528 - RNA, 21 nt, Homo sapiens
augggccaagccaggguucca

SEQ ID NO: 426529 - RNA, 14 nt, Homo sapiens
augggggaugcuuc

SEQ ID NO: 426530 - RNA, 21 nt, Homo sapiens
auggggugcaccuguccaaua

SEQ ID NO: 426531 - RNA, 20 nt, Homo sapiens
auggguaucaaacagcucag

SEQ ID NO: 426532 - RNA, 18 nt, Homo sapiens
auggguccacugcaccag

SEQ ID NO: 426533 - RNA, 23 nt, Homo sapiens
augguaaccgagccagcagcuga

SEQ ID NO: 426534 - RNA, 14 nt, Homo sapiens
augguaacugauga

SEQ ID NO: 426535 - RNA, 21 nt, Homo sapiens
augguacuaguguuuuuuaga

SEQ ID NO: 426536 - RNA, 18 nt, Homo sapiens
augguacuauguuagccc

SEQ ID NO: 426537 - RNA, 23 nt, Homo sapiens
augguacucuuguugaguucugu

SEQ ID NO: 426538 - RNA, 17 nt, Homo sapiens
augguaugccucugugu

SEQ ID NO: 426539 - RNA, 16 nt, Homo sapiens
auggucaaugcuagca

SEQ ID NO: 426540 - RNA, 19 nt, Homo sapiens
auggucaaugcuagcacaa

SEQ ID NO: 426541 - RNA, 18 nt, Homo sapiens
auggugagcugaguucau

SEQ ID NO: 426542 - RNA, 14 nt, Homo sapiens
auggugcacuggaa

SEQ ID NO: 426543 - RNA, 19 nt, Homo sapiens
auggugcccuuggaggcaa

SEQ ID NO: 426544 - RNA, 13 nt, Homo sapiens
auggugggcucca

SEQ ID NO: 426545 - RNA, 14 nt, Homo sapiens
augguguagcuguc

SEQ ID NO: 426546 - RNA, 19 nt, Homo sapiens
augguugauggguucuaau

SEQ ID NO: 426547 - RNA, 17 nt, Homo sapiens
augguuuaaagucacag

SEQ ID NO: 426548 - RNA, 12 nt, Homo sapiens
auguaaccaaga

SEQ ID NO: 426549 - RNA, 21 nt, Homo sapiens
auguaauugaauaaaguugaa

SEQ ID NO: 426550 - RNA, 18 nt, Homo sapiens
auguacaugaagaagcua

SEQ ID NO: 426551 - RNA, 19 nt, Homo sapiens
auguagaaagauacacuga

SEQ ID NO: 426552 - RNA, 20 nt, Homo sapiens
auguagaauuauaacuaauu

SEQ ID NO: 426553 - RNA, 22 nt, Homo sapiens
auguaguuuuacuugguguuua

SEQ ID NO: 426554 - RNA, 14 nt, Homo sapiens
auguauaucuuugc

SEQ ID NO: 426555 - RNA, 19 nt, Homo sapiens
auguauaucuuugcacuga

SEQ ID NO: 426556 - RNA, 20 nt, Homo sapiens
auguaucccaacuccuauaa

SEQ ID NO: 426557 - RNA, 14 nt, Homo sapiens
auguauguauuuau

SEQ ID NO: 426558 - RNA, 18 nt, Homo sapiens
auguauguuuacauauca

SEQ ID NO: 426559 - RNA, 12 nt, Homo sapiens
auguauuaugca

SEQ ID NO: 426560 - RNA, 14 nt, Homo sapiens
auguauuaugcaaa

SEQ ID NO: 426561 - RNA, 20 nt, Homo sapiens
auguauuggauacgcuccag

SEQ ID NO: 426562 - RNA, 19 nt, Homo sapiens
auguauuuugaaaacacuu

SEQ ID NO: 426563 - RNA, 17 nt, Homo sapiens
augucaaauaaagcaaa

SEQ ID NO: 426564 - RNA, 12 nt, Homo sapiens
augucaaaugga

SEQ ID NO: 426565 - RNA, 20 nt, Homo sapiens
augucaaauggauguaauau

SEQ ID NO: 426566 - RNA, 24 nt, Homo sapiens
augucaacauuuuugauucuagcu

SEQ ID NO: 426567 - RNA, 20 nt, Homo sapiens
augucaccuccccaucaucc

SEQ ID NO: 426568 - RNA, 17 nt, Homo sapiens
augucagaaaccaguua

SEQ ID NO: 426569 - RNA, 18 nt, Homo sapiens
augucagcagcucugaga

SEQ ID NO: 426570 - RNA, 18 nt, Homo sapiens
augucaguagugccagaa

SEQ ID NO: 426571 - RNA, 17 nt, Homo sapiens
augucagucuacaggcc

SEQ ID NO: 426572 - RNA, 15 nt, Homo sapiens
auguccaaacuaauu

SEQ ID NO: 426573 - RNA, 13 nt, Homo sapiens
augucccaaauaa

SEQ ID NO: 426574 - RNA, 12 nt, Homo sapiens
augucccaugac

SEQ ID NO: 426575 - RNA, 15 nt, Homo sapiens
auguccccauggcug

SEQ ID NO: 426576 - RNA, 20 nt, Homo sapiens
augucccugaagucuugcau

SEQ ID NO: 426577 - RNA, 21 nt, Homo sapiens
augucccuuucuuggccaguu

SEQ ID NO: 426578 - RNA, 19 nt, Homo sapiens
auguccuaaggacacacua

SEQ ID NO: 426579 - RNA, 15 nt, Homo sapiens
auguccugccuuuua

SEQ ID NO: 426580 - RNA, 19 nt, Homo sapiens
augucuaacaggacuugaa

SEQ ID NO: 426581 - RNA, 14 nt, Homo sapiens
augucuacugcuug

SEQ ID NO: 426582 - RNA, 16 nt, Homo sapiens
augucuauaacuccuu

SEQ ID NO: 426583 - RNA, 17 nt, Homo sapiens
augucuauaaucccagc

SEQ ID NO: 426584 - RNA, 20 nt, Homo sapiens
augucucugcuuccauggcu

SEQ ID NO: 426585 - RNA, 20 nt, Homo sapiens
augucugaaguuugccccag

SEQ ID NO: 426586 - RNA, 18 nt, Homo sapiens
augucuguagcuccucaa

SEQ ID NO: 426587 - RNA, 22 nt, Homo sapiens
augucuguagcuccucaacuca

SEQ ID NO: 426588 - RNA, 16 nt, Homo sapiens
augucuucauaauaua

SEQ ID NO: 426589 - RNA, 20 nt, Homo sapiens
augucuucucguuaaggaga

SEQ ID NO: 426590 - RNA, 17 nt, Homo sapiens
augucuugcaaagccuu

SEQ ID NO: 426591 - RNA, 17 nt, Homo sapiens
augucuuuaucaaagga

SEQ ID NO: 426592 - RNA, 19 nt, Homo sapiens
augucuuuuaucauugcag

SEQ ID NO: 426593 - RNA, 16 nt, Homo sapiens
aacacauacaaaagaa

SEQ ID NO: 426594 - RNA, 19 nt, Homo sapiens
aacacauuucuaauuugaa

SEQ ID NO: 426595 - RNA, 19 nt, Homo sapiens
aacaccacuuaaucuucuc

SEQ ID NO: 426596 - RNA, 14 nt, Homo sapiens
aacaccagauucca

SEQ ID NO: 426597 - RNA, 20 nt, Homo sapiens
aacaccaggagagcuucucc

SEQ ID NO: 426598 - RNA, 15 nt, Homo sapiens
aacaccaucacagcu

SEQ ID NO: 426599 - RNA, 23 nt, Homo sapiens
aacaccuucuuggcuucugggac

SEQ ID NO: 426600 - RNA, 15 nt, Homo sapiens
aacacuagacuguau

SEQ ID NO: 426601 - RNA, 21 nt, Homo sapiens
aacacugcugcuccagugcag

SEQ ID NO: 426602 - RNA, 15 nt, Homo sapiens
aacacuguacugagg

SEQ ID NO: 426603 - RNA, 15 nt, Homo sapiens
aacacuguacugcaa

SEQ ID NO: 426604 - RNA, 16 nt, Homo sapiens
aacacuucgagcacug

SEQ ID NO: 426605 - RNA, 16 nt, Homo sapiens
aacacuuugagcauuu

SEQ ID NO: 426606 - RNA, 19 nt, Homo sapiens
aacagaacauuucucaugu

SEQ ID NO: 426607 - RNA, 12 nt, Homo sapiens
aacagcacuggc

SEQ ID NO: 426608 - RNA, 13 nt, Homo sapiens
aacagcagaacuu

SEQ ID NO: 426609 - RNA, 12 nt, Homo sapiens
aacagccagcuu

SEQ ID NO: 426610 - RNA, 13 nt, Homo sapiens
aacagccagugga

SEQ ID NO: 426611 - RNA, 18 nt, Homo sapiens
aacagcucaaagaguaaa

SEQ ID NO: 426612 - RNA, 20 nt, Homo sapiens
aacagcuguaaucuaugaau

SEQ ID NO: 426613 - RNA, 18 nt, Homo sapiens
aacaggcucaauauuccu

SEQ ID NO: 426614 - RNA, 18 nt, Homo sapiens
aacagggaugcuaucucg

SEQ ID NO: 426615 - RNA, 22 nt, Homo sapiens
aacaggucuuugaaauaugcau

SEQ ID NO: 426616 - RNA, 20 nt, Homo sapiens
aacagucacccuucugggca

SEQ ID NO: 426617 - RNA, 12 nt, Homo sapiens
aacagugccauu

SEQ ID NO: 426618 - RNA, 13 nt, Homo sapiens
aacagugcuguaa

SEQ ID NO: 426619 - RNA, 20 nt, Homo sapiens
aacaguuguaccacugcuaa

SEQ ID NO: 426620 - RNA, 13 nt, Homo sapiens
aacaguugugaac

SEQ ID NO: 426621 - RNA, 15 nt, Homo sapiens
aacaguuuuccauga

SEQ ID NO: 426622 - RNA, 19 nt, Homo sapiens
aacauaaaauaaacacuag

SEQ ID NO: 426623 - RNA, 19 nt, Homo sapiens
aacauaacuguaacauaua

SEQ ID NO: 426624 - RNA, 15 nt, Homo sapiens
aacauaaucuaguuu

SEQ ID NO: 426625 - RNA, 21 nt, Homo sapiens
aacauacauuaucaacauguu

SEQ ID NO: 426626 - RNA, 20 nt, Homo sapiens
aacauaggccugcucagccu

SEQ ID NO: 426627 - RNA, 22 nt, Homo sapiens
aacauauaauauauguuuuaaa

SEQ ID NO: 426628 - RNA, 19 nt, Homo sapiens
aacauauauuuuauuuuca

SEQ ID NO: 426629 - RNA, 21 nt, Homo sapiens
aacaucuuggucagauuugaa

SEQ ID NO: 426630 - RNA, 18 nt, Homo sapiens
aacaucuuuuacauucug

SEQ ID NO: 426631 - RNA, 20 nt, Homo sapiens
aacaucuuuuucuacucgag

SEQ ID NO: 426632 - RNA, 14 nt, Homo sapiens
aacaugcuaccuga

SEQ ID NO: 426633 - RNA, 13 nt, Homo sapiens
aacaugcuuuaga

SEQ ID NO: 426634 - RNA, 17 nt, Homo sapiens
aacaugggcaaagggag

SEQ ID NO: 426635 - RNA, 14 nt, Homo sapiens
aacauggugugugu

SEQ ID NO: 426636 - RNA, 18 nt, Homo sapiens
aacauuaacaaaagcaau

SEQ ID NO: 426637 - RNA, 18 nt, Homo sapiens
aacauuauuuauucagcu

SEQ ID NO: 426638 - RNA, 18 nt, Homo sapiens
aacauucauagcuggucu

SEQ ID NO: 426639 - RNA, 21 nt, Homo sapiens
aacauucaucaagcuguacau

SEQ ID NO: 426640 - RNA, 17 nt, Homo sapiens
aacauuccuuagucuca

SEQ ID NO: 426641 - RNA, 13 nt, Homo sapiens
aacauugcacuuu

SEQ ID NO: 426642 - RNA, 14 nt, Homo sapiens
aacauugcacuuua

SEQ ID NO: 426643 - RNA, 13 nt, Homo sapiens
aacauugcaugua

SEQ ID NO: 426644 - RNA, 11 nt, Homo sapiens
aacauuugcca

SEQ ID NO: 426645 - RNA, 12 nt, Homo sapiens
aacauuugccaa

SEQ ID NO: 426646 - RNA, 20 nt, Homo sapiens
aacauuugcugaauaugcaa

SEQ ID NO: 426647 - RNA, 13 nt, Homo sapiens
aaccaaaacagag

SEQ ID NO: 426648 - RNA, 13 nt, Homo sapiens
aaccaaacggaac

SEQ ID NO: 426649 - RNA, 19 nt, Homo sapiens
aaccaaacggaacucuuca

SEQ ID NO: 426650 - RNA, 15 nt, Homo sapiens
aaccaacccauguau

SEQ ID NO: 426651 - RNA, 16 nt, Homo sapiens
aaccaacgggucugug

SEQ ID NO: 426652 - RNA, 21 nt, Homo sapiens
aaccaacugaacgacaaagca

SEQ ID NO: 426653 - RNA, 19 nt, Homo sapiens
aaccaaguggcucccacac

SEQ ID NO: 426654 - RNA, 9 nt, Homo sapiens
aaccaauga

SEQ ID NO: 426655 - RNA, 12 nt, Homo sapiens
aaccaaugauuc

SEQ ID NO: 426656 - RNA, 18 nt, Homo sapiens
aaccacuucauucuugaa

SEQ ID NO: 426657 - RNA, 22 nt, Homo sapiens
aaccagaaguuucuacauucuc

SEQ ID NO: 426658 - RNA, 23 nt, Homo sapiens
aaccagaauuaggucaaguucau

SEQ ID NO: 426659 - RNA, 13 nt, Homo sapiens
aaccagagaggcu

SEQ ID NO: 426660 - RNA, 16 nt, Homo sapiens
aaccagagccacaggc

SEQ ID NO: 426661 - RNA, 19 nt, Homo sapiens
aaccagcucuuuggugcca

SEQ ID NO: 426662 - RNA, 19 nt, Homo sapiens
aaccaggguuuaucuuuug

SEQ ID NO: 426663 - RNA, 18 nt, Homo sapiens
aaccaguuaugugaauga

SEQ ID NO: 426664 - RNA, 12 nt, Homo sapiens
aaccaguucucu

SEQ ID NO: 426665 - RNA, 16 nt, Homo sapiens
aaccaugacugugacc

SEQ ID NO: 426666 - RNA, 22 nt, Homo sapiens
aaccaugagaccacuguuauca

SEQ ID NO: 426667 - RNA, 15 nt, Homo sapiens
aaccauuacuguaau

SEQ ID NO: 426668 - RNA, 22 nt, Homo sapiens
aacccacaagcugccucugaca

SEQ ID NO: 426669 - RNA, 15 nt, Homo sapiens
aacccacagccaaac

SEQ ID NO: 426670 - RNA, 17 nt, Homo sapiens
aacccagacccugaguc

SEQ ID NO: 426671 - RNA, 16 nt, Homo sapiens
aaccccaaacuguuga

SEQ ID NO: 426672 - RNA, 13 nt, Homo sapiens
aaccccaugggcu

SEQ ID NO: 426673 - RNA, 15 nt, Homo sapiens
aaccccccuccccaa

SEQ ID NO: 426674 - RNA, 22 nt, Homo sapiens
aaccccucuuagcuuacaggaa

SEQ ID NO: 426675 - RNA, 20 nt, Homo sapiens
aaccccuuugcugguugcug

SEQ ID NO: 426676 - RNA, 22 nt, Homo sapiens
aaccccuuuucaguuugaacuc

SEQ ID NO: 426677 - RNA, 23 nt, Homo sapiens
aaccccuuuucaguuugaacucu

SEQ ID NO: 426678 - RNA, 17 nt, Homo sapiens
aacccgggcgcugccug

SEQ ID NO: 426679 - RNA, 20 nt, Homo sapiens
aacccuguggggccugaugg

SEQ ID NO: 426680 - RNA, 20 nt, Homo sapiens
aaccgacacuccuacaagau

SEQ ID NO: 426681 - RNA, 22 nt, Homo sapiens
aaccgaugcuccagccaacccc

SEQ ID NO: 426682 - RNA, 18 nt, Homo sapiens
aaccgaugguccucacaa

SEQ ID NO: 426683 - RNA, 22 nt, Homo sapiens
aaccgaugguccucacaagccu

SEQ ID NO: 426684 - RNA, 15 nt, Homo sapiens
aaccgcaucugcuca

SEQ ID NO: 426685 - RNA, 22 nt, Homo sapiens
aaccuacuagacaaugauguga

SEQ ID NO: 426686 - RNA, 20 nt, Homo sapiens
aaccucaagggcuuucccac

SEQ ID NO: 426687 - RNA, 16 nt, Homo sapiens
aaccucaccauuguga

SEQ ID NO: 426688 - RNA, 15 nt, Homo sapiens
aaccucauuccccaa

SEQ ID NO: 426689 - RNA, 21 nt, Homo sapiens
aaccucauuccccaaccacuu

SEQ ID NO: 426690 - RNA, 18 nt, Homo sapiens
aaccuccauccugccagg

SEQ ID NO: 426691 - RNA, 18 nt, Homo sapiens
aaccuccccaacagcacu

SEQ ID NO: 426692 - RNA, 20 nt, Homo sapiens
aaccuccgccuccuggguuc

SEQ ID NO: 426693 - RNA, 23 nt, Homo sapiens
aaccucuggcuagaggacauauu

SEQ ID NO: 426694 - RNA, 19 nt, Homo sapiens
aaccucuuuucugcaucau

SEQ ID NO: 426695 - RNA, 21 nt, Homo sapiens
aaccugaugccccuuccccaa

SEQ ID NO: 426696 - RNA, 18 nt, Homo sapiens
aaccugcacuucauaucu

SEQ ID NO: 426697 - RNA, 13 nt, Homo sapiens
aaccugcucuccu

SEQ ID NO: 426698 - RNA, 17 nt, Homo sapiens
aaccugugaugagggga

SEQ ID NO: 426699 - RNA, 13 nt, Homo sapiens
aaccugugccagg

SEQ ID NO: 426700 - RNA, 18 nt, Homo sapiens
aaccuuauuguaccucuc

SEQ ID NO: 426701 - RNA, 15 nt, Homo sapiens
aaccuuccucuugag

SEQ ID NO: 426702 - RNA, 17 nt, Homo sapiens
aaccuuuuaucaauaaa

SEQ ID NO: 426703 - RNA, 21 nt, Homo sapiens
aacgacgguuucaaaccagga

SEQ ID NO: 426704 - RNA, 20 nt, Homo sapiens
aacgaggcaaugacugugag

SEQ ID NO: 426705 - RNA, 13 nt, Homo sapiens
aacgcagccucca

SEQ ID NO: 426706 - RNA, 17 nt, Homo sapiens
aacgccgcugacugcca

SEQ ID NO: 426707 - RNA, 14 nt, Homo sapiens
aacggaacucuuca

SEQ ID NO: 426708 - RNA, 14 nt, Homo sapiens
aacgucucucaccu

SEQ ID NO: 426709 - RNA, 12 nt, Homo sapiens
aacgugaucucc

SEQ ID NO: 426710 - RNA, 14 nt, Homo sapiens
aacguggggcagca

SEQ ID NO: 426711 - RNA, 14 nt, Homo sapiens
aacuaacaaugccu

SEQ ID NO: 426712 - RNA, 18 nt, Homo sapiens
aacuaauaaaacuuugac

SEQ ID NO: 426713 - RNA, 13 nt, Homo sapiens
aacuaauuugaau

SEQ ID NO: 426714 - RNA, 22 nt, Homo sapiens
aacuacagaguuuaugauuuaa

SEQ ID NO: 426715 - RNA, 16 nt, Homo sapiens
aacuaccagugggcau

SEQ ID NO: 426716 - RNA, 21 nt, Homo sapiens
aacuaccauguggccauuaac

SEQ ID NO: 426717 - RNA, 23 nt, Homo sapiens
aacuaccauguggccauuaacaa

SEQ ID NO: 426718 - RNA, 20 nt, Homo sapiens
aacuacuaaagugccuaccc

SEQ ID NO: 426719 - RNA, 20 nt, Homo sapiens
aacuacuuucuuaauaucac

SEQ ID NO: 426720 - RNA, 18 nt, Homo sapiens
aacuauaagcccacuguu

SEQ ID NO: 426721 - RNA, 19 nt, Homo sapiens
aacucacaacucucugguu

SEQ ID NO: 426722 - RNA, 15 nt, Homo sapiens
aacucaccauuucau

SEQ ID NO: 426723 - RNA, 18 nt, Homo sapiens
aacucaccauuucaucca

SEQ ID NO: 426724 - RNA, 15 nt, Homo sapiens
aacucacugcucaag

SEQ ID NO: 426725 - RNA, 22 nt, Homo sapiens
augugaauaaauucuauaggaa

SEQ ID NO: 426726 - RNA, 15 nt, Homo sapiens
augugaaucccucaa

SEQ ID NO: 426727 - RNA, 15 nt, Homo sapiens
augugacuggcagua

SEQ ID NO: 426728 - RNA, 18 nt, Homo sapiens
augugagauuacuuuguc

SEQ ID NO: 426729 - RNA, 21 nt, Homo sapiens
augugagcaugaaacuaugca

SEQ ID NO: 426730 - RNA, 12 nt, Homo sapiens
augugagugugu

SEQ ID NO: 426731 - RNA, 15 nt, Homo sapiens
augugauauuuucac

SEQ ID NO: 426732 - RNA, 17 nt, Homo sapiens
augugaucaucuuugcu

SEQ ID NO: 426733 - RNA, 17 nt, Homo sapiens
augugauuaaguuccua

SEQ ID NO: 426734 - RNA, 17 nt, Homo sapiens
augugauuuaugcauuu

SEQ ID NO: 426735 - RNA, 16 nt, Homo sapiens
augugauuucccucag

SEQ ID NO: 426736 - RNA, 17 nt, Homo sapiens
augugcagauaucacag

SEQ ID NO: 426737 - RNA, 21 nt, Homo sapiens
augugcuguugauucuuucaa

SEQ ID NO: 426738 - RNA, 21 nt, Homo sapiens
auguggaagaacuuaggcauc

SEQ ID NO: 426739 - RNA, 19 nt, Homo sapiens
auguggaaggcagcagagc

SEQ ID NO: 426740 - RNA, 17 nt, Homo sapiens
auguggaaggucaucaa

SEQ ID NO: 426741 - RNA, 19 nt, Homo sapiens
auguggagcucagcaacaa

SEQ ID NO: 426742 - RNA, 15 nt, Homo sapiens
auguggauacaguca

SEQ ID NO: 426743 - RNA, 16 nt, Homo sapiens
auguggauacagucau

SEQ ID NO: 426744 - RNA, 18 nt, Homo sapiens
auguggcaaagugcugua

SEQ ID NO: 426745 - RNA, 15 nt, Homo sapiens
auguggguugugaua

SEQ ID NO: 426746 - RNA, 17 nt, Homo sapiens
augugguuacuuccuac

SEQ ID NO: 426747 - RNA, 20 nt, Homo sapiens
augugugagauaacuuccuu

SEQ ID NO: 426748 - RNA, 14 nt, Homo sapiens
augugugauuucac

SEQ ID NO: 426749 - RNA, 16 nt, Homo sapiens
augugugcuuggaaaa

SEQ ID NO: 426750 - RNA, 13 nt, Homo sapiens
augugugugcuca

SEQ ID NO: 426751 - RNA, 19 nt, Homo sapiens
auguguguguauguuugca

SEQ ID NO: 426752 - RNA, 15 nt, Homo sapiens
auguguguucaugca

SEQ ID NO: 426753 - RNA, 16 nt, Homo sapiens
auguguguucaugcac

SEQ ID NO: 426754 - RNA, 19 nt, Homo sapiens
auguguuauuugucacaaa

SEQ ID NO: 426755 - RNA, 11 nt, Homo sapiens
auguguugcau

SEQ ID NO: 426756 - RNA, 22 nt, Homo sapiens
auguuaacaacuugaauuacaa

SEQ ID NO: 426757 - RNA, 13 nt, Homo sapiens
auguuacugacca

SEQ ID NO: 426758 - RNA, 14 nt, Homo sapiens
auguuacugaccag

SEQ ID NO: 426759 - RNA, 21 nt, Homo sapiens
auguuauucuuccuucccaac

SEQ ID NO: 426760 - RNA, 22 nt, Homo sapiens
auguucauuaaguucugaaugu

SEQ ID NO: 426761 - RNA, 17 nt, Homo sapiens
auguuccguucaucuga

SEQ ID NO: 426762 - RNA, 15 nt, Homo sapiens
auguucuauuguggg

SEQ ID NO: 426763 - RNA, 13 nt, Homo sapiens
auguucugacagc

SEQ ID NO: 426764 - RNA, 17 nt, Homo sapiens
aacugguccaggccagg

SEQ ID NO: 426765 - RNA, 23 nt, Homo sapiens
aacugguuccuagggauguguga

SEQ ID NO: 426766 - RNA, 17 nt, Homo sapiens
aacuguaaaauacuucu

SEQ ID NO: 426767 - RNA, 19 nt, Homo sapiens
aacuguaaaauacuucuuu

SEQ ID NO: 426768 - RNA, 19 nt, Homo sapiens
aacuguaguaauuguuaca

SEQ ID NO: 426769 - RNA, 16 nt, Homo sapiens
aacuguccucuuucag

SEQ ID NO: 426770 - RNA, 19 nt, Homo sapiens
aacugucucguacuagaau

SEQ ID NO: 426771 - RNA, 18 nt, Homo sapiens
aacugucuugugagcuga

SEQ ID NO: 426772 - RNA, 21 nt, Homo sapiens
aacugugcagagacuuuaucc

SEQ ID NO: 426773 - RNA, 17 nt, Homo sapiens
aacuguguauguacaua

SEQ ID NO: 426774 - RNA, 18 nt, Homo sapiens
aacuguguauguacauau

SEQ ID NO: 426775 - RNA, 22 nt, Homo sapiens
aacuguuaguauuaacuauuag

SEQ ID NO: 426776 - RNA, 22 nt, Homo sapiens
aacuguucuggccucagaccaa

SEQ ID NO: 426777 - RNA, 18 nt, Homo sapiens
aacuuaaaaagucugcau

SEQ ID NO: 426778 - RNA, 15 nt, Homo sapiens
aacuuaaaucacuga

SEQ ID NO: 426779 - RNA, 15 nt, Homo sapiens
aacuuaacaugcugu

SEQ ID NO: 426780 - RNA, 23 nt, Homo sapiens
aacuuaauuaccuaagagccaca

SEQ ID NO: 426781 - RNA, 20 nt, Homo sapiens
aacuuaauuauaagcuaugu

SEQ ID NO: 426782 - RNA, 16 nt, Homo sapiens
aacuuagcucacaccu

SEQ ID NO: 426783 - RNA, 14 nt, Homo sapiens
aacuucaccuuaaa

SEQ ID NO: 426784 - RNA, 22 nt, Homo sapiens
aacuucaggaaagcagcaguuu

SEQ ID NO: 426785 - RNA, 13 nt, Homo sapiens
aacuucagggauc

SEQ ID NO: 426786 - RNA, 12 nt, Homo sapiens
aacuucugccuc

SEQ ID NO: 426787 - RNA, 17 nt, Homo sapiens
aacuucuuaacuggcaa

SEQ ID NO: 426788 - RNA, 17 nt, Homo sapiens
aacuugagcauguuacu

SEQ ID NO: 426789 - RNA, 19 nt, Homo sapiens
aacuugaggacacaugucc

SEQ ID NO: 426790 - RNA, 20 nt, Homo sapiens
aacuugaggacacaugucca

SEQ ID NO: 426791 - RNA, 23 nt, Homo sapiens
aacuugaggacacauguccagug

SEQ ID NO: 426792 - RNA, 14 nt, Homo sapiens
aacuugauuguuga

SEQ ID NO: 426793 - RNA, 18 nt, Homo sapiens
aacuugggggaggaggaa

SEQ ID NO: 426794 - RNA, 18 nt, Homo sapiens
aacuugugcuuuugcaaa

SEQ ID NO: 426795 - RNA, 12 nt, Homo sapiens
aacuuucuugcu

SEQ ID NO: 426796 - RNA, 13 nt, Homo sapiens
aacuuugcauguu

SEQ ID NO: 426797 - RNA, 19 nt, Homo sapiens
aacuuuggugaacaguuuu

SEQ ID NO: 426798 - RNA, 13 nt, Homo sapiens
aacuuuguauuaa

SEQ ID NO: 426799 - RNA, 18 nt, Homo sapiens
aacuuuguauuaaugugu

SEQ ID NO: 426800 - RNA, 20 nt, Homo sapiens
aacuuuugguaucuacuucu

SEQ ID NO: 426801 - RNA, 21 nt, Homo sapiens
aacuuuuguaagguacugaau

SEQ ID NO: 426802 - RNA, 15 nt, Homo sapiens
aagaaaaaauaucuu

SEQ ID NO: 426803 - RNA, 14 nt, Homo sapiens
aagaaaagcacugg

SEQ ID NO: 426804 - RNA, 15 nt, Homo sapiens
aagaaaauaccaagg

SEQ ID NO: 426805 - RNA, 14 nt, Homo sapiens
aagaaaauccauuc

SEQ ID NO: 426806 - RNA, 14 nt, Homo sapiens
aagaaaaugagaca

SEQ ID NO: 426807 - RNA, 16 nt, Homo sapiens
aagaaaauggaugaca

SEQ ID NO: 426808 - RNA, 16 nt, Homo sapiens
aagaaaauggauuuaa

SEQ ID NO: 426809 - RNA, 20 nt, Homo sapiens
aagaaagacucuauucucaa

SEQ ID NO: 426810 - RNA, 18 nt, Homo sapiens
aagaaauaaaaucuaauu

SEQ ID NO: 426811 - RNA, 20 nt, Homo sapiens
aagaaauuagggcucuaauu

SEQ ID NO: 426812 - RNA, 20 nt, Homo sapiens
aagaaauuuaaucaguguga

SEQ ID NO: 426813 - RNA, 18 nt, Homo sapiens
aagaacaacugccaagaa

SEQ ID NO: 426814 - RNA, 17 nt, Homo sapiens
aagaacaguccauugaa

SEQ ID NO: 426815 - RNA, 22 nt, Homo sapiens
aagaaccagagaggcucugaga

SEQ ID NO: 426816 - RNA, 17 nt, Homo sapiens
aagaacccuagcacaaa

SEQ ID NO: 426817 - RNA, 13 nt, Homo sapiens
aagaaccucucac

SEQ ID NO: 426818 - RNA, 18 nt, Homo sapiens
aagaacugccccaucucc

SEQ ID NO: 426819 - RNA, 19 nt, Homo sapiens
aagaacugcuuaguauuag

SEQ ID NO: 426820 - RNA, 12 nt, Homo sapiens
aagaacuguauu

SEQ ID NO: 426821 - RNA, 16 nt, Homo sapiens
aagaacuuuagcaugg

SEQ ID NO: 426822 - RNA, 19 nt, Homo sapiens
aagaacuuuagcaugguau

SEQ ID NO: 426823 - RNA, 15 nt, Homo sapiens
aagaagaaccaucuu

SEQ ID NO: 426824 - RNA, 11 nt, Homo sapiens
aagaagacugg

SEQ ID NO: 426825 - RNA, 18 nt, Homo sapiens
aagaagaguuuacagaca

SEQ ID NO: 426826 - RNA, 17 nt, Homo sapiens
aagaagugggacuuccc

SEQ ID NO: 426827 - RNA, 19 nt, Homo sapiens
aagaaguguccgagaacua

SEQ ID NO: 426828 - RNA, 14 nt, Homo sapiens
aagaauaccaauau

SEQ ID NO: 426829 - RNA, 14 nt, Homo sapiens
aagaaucaccuaau

SEQ ID NO: 426830 - RNA, 15 nt, Homo sapiens
aagaauguacauuac

SEQ ID NO: 426831 - RNA, 21 nt, Homo sapiens
aagaauguuauccaacuauua

SEQ ID NO: 426832 - RNA, 14 nt, Homo sapiens
aagaauuaaugaca

SEQ ID NO: 426833 - RNA, 17 nt, Homo sapiens
aagaauuccaaccgacc

SEQ ID NO: 426834 - RNA, 23 nt, Homo sapiens
aagaauugugccucucccaaguc

SEQ ID NO: 426835 - RNA, 21 nt, Homo sapiens
aagacaaaugggccugccaaa

SEQ ID NO: 426836 - RNA, 21 nt, Homo sapiens
aagacacguguuuuuguaucu

SEQ ID NO: 426837 - RNA, 13 nt, Homo sapiens
aagacacucaauc

SEQ ID NO: 426838 - RNA, 17 nt, Homo sapiens
aagacagauacuccucc

SEQ ID NO: 426839 - RNA, 18 nt, Homo sapiens
aagacaguaaagaccauu

SEQ ID NO: 426840 - RNA, 15 nt, Homo sapiens
aagacauucuuccaa

SEQ ID NO: 426841 - RNA, 22 nt, Homo sapiens
aagaccagucacagccauuuca

SEQ ID NO: 426842 - RNA, 20 nt, Homo sapiens
aagaccaguccuguuugcag

SEQ ID NO: 426843 - RNA, 20 nt, Homo sapiens
aagacccucaaugccaagaa

SEQ ID NO: 426844 - RNA, 13 nt, Homo sapiens
aagaccuggaccg

SEQ ID NO: 426845 - RNA, 19 nt, Homo sapiens
aagaccuucugaagaucuc

SEQ ID NO: 426846 - RNA, 21 nt, Homo sapiens
aagacuaaucgaaugaacaaa

SEQ ID NO: 426847 - RNA, 13 nt, Homo sapiens
aagacuacuauac

SEQ ID NO: 426848 - RNA, 15 nt, Homo sapiens
aagacucuauucuca

SEQ ID NO: 426849 - RNA, 16 nt, Homo sapiens
aagacucuauucucaa

SEQ ID NO: 426850 - RNA, 15 nt, Homo sapiens
aagacuguugcucaa

SEQ ID NO: 426851 - RNA, 14 nt, Homo sapiens
aagacuucuuugca

SEQ ID NO: 426852 - RNA, 18 nt, Homo sapiens
aagacuuggcccaggaaa

SEQ ID NO: 426853 - RNA, 16 nt, Homo sapiens
aagacuugguguccuu

SEQ ID NO: 426854 - RNA, 15 nt, Homo sapiens
aagacuuugauccag

SEQ ID NO: 426855 - RNA, 15 nt, Homo sapiens
aagagaaaugagcug

SEQ ID NO: 426856 - RNA, 16 nt, Homo sapiens
aagagaaccgagcaaa

SEQ ID NO: 426857 - RNA, 18 nt, Homo sapiens
aagagaaccgagcaaaga

SEQ ID NO: 426858 - RNA, 19 nt, Homo sapiens
aagagaggaguucaaugau

SEQ ID NO: 426859 - RNA, 21 nt, Homo sapiens
auucaaaacuuucagcuggag

SEQ ID NO: 426860 - RNA, 17 nt, Homo sapiens
auucaaacugccuauau

SEQ ID NO: 426861 - RNA, 17 nt, Homo sapiens
auucaaagaaucaccua

SEQ ID NO: 426862 - RNA, 14 nt, Homo sapiens
auucaaaugcauga

SEQ ID NO: 426863 - RNA, 14 nt, Homo sapiens
auucaacauuugcu

SEQ ID NO: 426864 - RNA, 16 nt, Homo sapiens
auucaacucuccaaug

SEQ ID NO: 426865 - RNA, 16 nt, Homo sapiens
auucaagauuggacau

SEQ ID NO: 426866 - RNA, 14 nt, Homo sapiens
auucaagccuguga

SEQ ID NO: 426867 - RNA, 15 nt, Homo sapiens
auucaagccugugaa

SEQ ID NO: 426868 - RNA, 17 nt, Homo sapiens
auucaauaagaagucaa

SEQ ID NO: 426869 - RNA, 17 nt, Homo sapiens
auucaaucaaccugcac

SEQ ID NO: 426870 - RNA, 15 nt, Homo sapiens
auucaaucauuuugg

SEQ ID NO: 426871 - RNA, 17 nt, Homo sapiens
auucagcauuauuccuc

SEQ ID NO: 426872 - RNA, 16 nt, Homo sapiens
auucaguacuuuauga

SEQ ID NO: 426873 - RNA, 15 nt, Homo sapiens
auucaguaguaacag

SEQ ID NO: 426874 - RNA, 15 nt, Homo sapiens
auucauaaagugaau

SEQ ID NO: 426875 - RNA, 11 nt, Homo sapiens
auucauaacaa

SEQ ID NO: 426876 - RNA, 13 nt, Homo sapiens
auuccaagucaac

SEQ ID NO: 426877 - RNA, 16 nt, Homo sapiens
auuccagcgucuucua

SEQ ID NO: 426878 - RNA, 23 nt, Homo sapiens
auucccaagccaaaaaccuuagc

SEQ ID NO: 426879 - RNA, 20 nt, Homo sapiens
auucccaccauucuaccuga

SEQ ID NO: 426880 - RNA, 13 nt, Homo sapiens
auucccacugcac

SEQ ID NO: 426881 - RNA, 22 nt, Homo sapiens
auucccaugguagacugugaca

SEQ ID NO: 426882 - RNA, 17 nt, Homo sapiens
auucccauuuugcaaaa

SEQ ID NO: 426883 - RNA, 20 nt, Homo sapiens
auucccggcuggacuuuugc

SEQ ID NO: 426884 - RNA, 14 nt, Homo sapiens
auucccucuugcua

SEQ ID NO: 426885 - RNA, 11 nt, Homo sapiens
auucccugugu

SEQ ID NO: 426886 - RNA, 23 nt, Homo sapiens
auucccuguuaaaauuuaaccua

SEQ ID NO: 426887 - RNA, 17 nt, Homo sapiens
auuccgaucgacugcca

SEQ ID NO: 426888 - RNA, 20 nt, Homo sapiens
auuccgaucgacugccaagc

SEQ ID NO: 426889 - RNA, 16 nt, Homo sapiens
auuccuaccauacaau

SEQ ID NO: 426890 - RNA, 16 nt, Homo sapiens
auuccuaugcugcaau

SEQ ID NO: 426891 - RNA, 15 nt, Homo sapiens
auuccucagcugcca

SEQ ID NO: 426892 - RNA, 15 nt, Homo sapiens
auuccucuugccucu

SEQ ID NO: 426893 - RNA, 20 nt, Homo sapiens
auuccugauaauaauugauc

SEQ ID NO: 426894 - RNA, 18 nt, Homo sapiens
auuccuggaauaaaccac

SEQ ID NO: 426895 - RNA, 16 nt, Homo sapiens
acaccaagaaaccacu

SEQ ID NO: 426896 - RNA, 17 nt, Homo sapiens
acaccagcccugcugcu

SEQ ID NO: 426897 - RNA, 17 nt, Homo sapiens
acaccaggagagcuucu

SEQ ID NO: 426898 - RNA, 18 nt, Homo sapiens
acaccaggccguccuccc

SEQ ID NO: 426899 - RNA, 20 nt, Homo sapiens
acaccauaguuuacaauauu

SEQ ID NO: 426900 - RNA, 21 nt, Homo sapiens
acaccauaguuuacaauauua

SEQ ID NO: 426901 - RNA, 23 nt, Homo sapiens
acacccaaguugaagacuuuguu

SEQ ID NO: 426902 - RNA, 23 nt, Homo sapiens
acaccccugcucuacccaugagc

SEQ ID NO: 426903 - RNA, 16 nt, Homo sapiens
acacccuuucuugaca

SEQ ID NO: 426904 - RNA, 16 nt, Homo sapiens
acaccgcugcacucaa

SEQ ID NO: 426905 - RNA, 16 nt, Homo sapiens
acaccucaguucccuu

SEQ ID NO: 426906 - RNA, 16 nt, Homo sapiens
acaccugacacaucuu

SEQ ID NO: 426907 - RNA, 15 nt, Homo sapiens
acaccugaccaauca

SEQ ID NO: 426908 - RNA, 19 nt, Homo sapiens
acaccugccuccacuucuc

SEQ ID NO: 426909 - RNA, 16 nt, Homo sapiens
acaccuggaccauuug

SEQ ID NO: 426910 - RNA, 20 nt, Homo sapiens
acaccuggcccuugcaaucu

SEQ ID NO: 426911 - RNA, 22 nt, Homo sapiens
acaccuggucuguuuucugugc

SEQ ID NO: 426912 - RNA, 21 nt, Homo sapiens
acaccuguggauaaaacauua

SEQ ID NO: 426913 - RNA, 12 nt, Homo sapiens
acaccuguugca

SEQ ID NO: 426914 - RNA, 14 nt, Homo sapiens
acaccuucuuggcu

SEQ ID NO: 426915 - RNA, 22 nt, Homo sapiens
acaccuucuuggcuucugggac

SEQ ID NO: 426916 - RNA, 20 nt, Homo sapiens
acaccuuguggagaacaugc

SEQ ID NO: 426917 - RNA, 13 nt, Homo sapiens
acacgacuuguaa

SEQ ID NO: 426918 - RNA, 14 nt, Homo sapiens
acacgccacaacuc

SEQ ID NO: 426919 - RNA, 21 nt, Homo sapiens
acacggaugacuuaacugcau

SEQ ID NO: 426920 - RNA, 18 nt, Homo sapiens
acacguacaaaauccagc

SEQ ID NO: 426921 - RNA, 15 nt, Homo sapiens
acacguuugccaaau

SEQ ID NO: 426922 - RNA, 20 nt, Homo sapiens
acacuaaccuggguucccuu

SEQ ID NO: 426923 - RNA, 16 nt, Homo sapiens
acacuaauucugucag

SEQ ID NO: 426924 - RNA, 14 nt, Homo sapiens
acacuaccaguuuc

SEQ ID NO: 426925 - RNA, 16 nt, Homo sapiens
acacuaguagagcaaa

SEQ ID NO: 426926 - RNA, 21 nt, Homo sapiens
acacuaguuuugugccagccg

SEQ ID NO: 426927 - RNA, 15 nt, Homo sapiens
acacucaaucuagaa

SEQ ID NO: 426928 - RNA, 17 nt, Homo sapiens
acacuccaguuugccca

SEQ ID NO: 426929 - RNA, 20 nt, Homo sapiens
acacuccuacaagauuuaga

SEQ ID NO: 426930 - RNA, 20 nt, Homo sapiens
acacucgugugcaugagaau

SEQ ID NO: 426931 - RNA, 22 nt, Homo sapiens
acacucgugugcaugagaaugu

SEQ ID NO: 426932 - RNA, 19 nt, Homo sapiens
acacucuacaaaaugacua

SEQ ID NO: 426933 - RNA, 18 nt, Homo sapiens
acacucuacuacauguga

SEQ ID NO: 426934 - RNA, 15 nt, Homo sapiens
acacucuagugccau

SEQ ID NO: 426935 - RNA, 20 nt, Homo sapiens
acacucucuucuuacuguau

SEQ ID NO: 426936 - RNA, 19 nt, Homo sapiens
acacugaaccuuguugaug

SEQ ID NO: 426937 - RNA, 14 nt, Homo sapiens
acacugacuugaga

SEQ ID NO: 426938 - RNA, 17 nt, Homo sapiens
acacugagauauucagc

SEQ ID NO: 426939 - RNA, 18 nt, Homo sapiens
acacugagauauucagcc

SEQ ID NO: 426940 - RNA, 23 nt, Homo sapiens
acacugagcaaguuuucaccuau

SEQ ID NO: 426941 - RNA, 13 nt, Homo sapiens
acacugccagugu

SEQ ID NO: 426942 - RNA, 12 nt, Homo sapiens
acacugcugcuc

SEQ ID NO: 426943 - RNA, 22 nt, Homo sapiens
acacugcugcuccagugcagga

SEQ ID NO: 426944 - RNA, 14 nt, Homo sapiens
acacugugacuuaa

SEQ ID NO: 426945 - RNA, 22 nt, Homo sapiens
acacuguucccagcuaccagcu

SEQ ID NO: 426946 - RNA, 15 nt, Homo sapiens
acacuuacacuuuau

SEQ ID NO: 426947 - RNA, 12 nt, Homo sapiens
acacuuacuguu

SEQ ID NO: 426948 - RNA, 22 nt, Homo sapiens
acacuuaucugucucuucuaca

SEQ ID NO: 426949 - RNA, 18 nt, Homo sapiens
acacuucauccuauagag

SEQ ID NO: 426950 - RNA, 19 nt, Homo sapiens
acacuucugugagaccccc

SEQ ID NO: 426951 - RNA, 24 nt, Homo sapiens
acacuugcucccaacccauucacu

SEQ ID NO: 426952 - RNA, 21 nt, Homo sapiens
acacuuggagcccgugcagua

SEQ ID NO: 426953 - RNA, 16 nt, Homo sapiens
acacuuggaugcaggg

SEQ ID NO: 426954 - RNA, 21 nt, Homo sapiens
acacuuguaaauaaagcugau

SEQ ID NO: 426955 - RNA, 17 nt, Homo sapiens
acacuuucaaagagaaa

SEQ ID NO: 426956 - RNA, 15 nt, Homo sapiens
acacuuugagcauuu

SEQ ID NO: 426957 - RNA, 15 nt, Homo sapiens
acagaaaacgguuaa

SEQ ID NO: 426958 - RNA, 19 nt, Homo sapiens
acagaaacgagauuugcca

SEQ ID NO: 426959 - RNA, 17 nt, Homo sapiens
acagaaauuaccccggg

SEQ ID NO: 426960 - RNA, 21 nt, Homo sapiens
acagaacaacaacaaagcaug

SEQ ID NO: 426961 - RNA, 21 nt, Homo sapiens
acagaaccaacgggucugugg

SEQ ID NO: 426962 - RNA, 19 nt, Homo sapiens
acagaacucgaugcacuga

SEQ ID NO: 426963 - RNA, 15 nt, Homo sapiens
acagaacugcaguca

SEQ ID NO: 426964 - RNA, 23 nt, Homo sapiens
acagaagacccgcucuccaucuu

SEQ ID NO: 426965 - RNA, 15 nt, Homo sapiens
acagaauacaagcca

SEQ ID NO: 426966 - RNA, 18 nt, Homo sapiens
acagacaacaaaccuguu

SEQ ID NO: 426967 - RNA, 20 nt, Homo sapiens
acagacaccaaguuccguca

SEQ ID NO: 426968 - RNA, 16 nt, Homo sapiens
acagacagagaaggca

SEQ ID NO: 426969 - RNA, 14 nt, Homo sapiens
acagacaugaacca

SEQ ID NO: 426970 - RNA, 12 nt, Homo sapiens
acagaccuaaua

SEQ ID NO: 426971 - RNA, 16 nt, Homo sapiens
acagaccuaauaucau

SEQ ID NO: 426972 - RNA, 15 nt, Homo sapiens
acagacuggagacaa

SEQ ID NO: 426973 - RNA, 23 nt, Homo sapiens
acagagauuugguuaagcucaca

SEQ ID NO: 426974 - RNA, 18 nt, Homo sapiens
acagagcagaucagucuu

SEQ ID NO: 426975 - RNA, 17 nt, Homo sapiens
acagagccaacucacuc

SEQ ID NO: 426976 - RNA, 15 nt, Homo sapiens
acagagcguccuucc

SEQ ID NO: 426977 - RNA, 23 nt, Homo sapiens
acagagcugccucucgguggcca

SEQ ID NO: 426978 - RNA, 15 nt, Homo sapiens
acagaggucucugcc

SEQ ID NO: 426979 - RNA, 19 nt, Homo sapiens
acagagugaacacucuacu

SEQ ID NO: 426980 - RNA, 17 nt, Homo sapiens
acagagugcauugugag

SEQ ID NO: 426981 - RNA, 22 nt, Homo sapiens
acagaguguggucccuccacua

SEQ ID NO: 426982 - RNA, 17 nt, Homo sapiens
acagauaauuuacuuau

SEQ ID NO: 426983 - RNA, 20 nt, Homo sapiens
acagaugccauggccugugc

SEQ ID NO: 426984 - RNA, 22 nt, Homo sapiens
acagauggaauuagaaauauau

SEQ ID NO: 426985 - RNA, 21 nt, Homo sapiens
acagauuccaggcgaugugca

SEQ ID NO: 426986 - RNA, 13 nt, Homo sapiens
acagauuuguuca

SEQ ID NO: 426987 - RNA, 15 nt, Homo sapiens
acagauuuguucauu

SEQ ID NO: 426988 - RNA, 17 nt, Homo sapiens
acagauuuguucauucc

SEQ ID NO: 426989 - RNA, 20 nt, Homo sapiens
acagcacuggcucucuccag

SEQ ID NO: 426990 - RNA, 17 nt, Homo sapiens
acagcagccccugcaca

SEQ ID NO: 426991 - RNA, 19 nt, Homo sapiens
acagcaggaugugccugug

SEQ ID NO: 426992 - RNA, 14 nt, Homo sapiens
acagcagggacaag

SEQ ID NO: 426993 - RNA, 18 nt, Homo sapiens
acagcagggacaagauac

SEQ ID NO: 426994 - RNA, 20 nt, Homo sapiens
acagcagggucuugcuguaa

SEQ ID NO: 426995 - RNA, 21 nt, Homo sapiens
acagcagucccaguauucuca

SEQ ID NO: 426996 - RNA, 14 nt, Homo sapiens
acagcauguguauu

SEQ ID NO: 426997 - RNA, 23 nt, Homo sapiens
acagcauuacacgccacaacucc

SEQ ID NO: 426998 - RNA, 22 nt, Homo sapiens
acagccaugauucuuuugccca

SEQ ID NO: 426999 - RNA, 14 nt, Homo sapiens
acagccuggcacag

SEQ ID NO: 427000 - RNA, 15 nt, Homo sapiens
acagccugucuucag

SEQ ID NO: 427001 - RNA, 14 nt, Homo sapiens
acagcuauuucuca

SEQ ID NO: 427002 - RNA, 14 nt, Homo sapiens
acagcugcagagac

SEQ ID NO: 427003 - RNA, 17 nt, Homo sapiens
acagcugcaggugccca

SEQ ID NO: 427004 - RNA, 20 nt, Homo sapiens
acagcuucuuuacuacugca

SEQ ID NO: 427005 - RNA, 18 nt, Homo sapiens
acaggaaggaaccagaag

SEQ ID NO: 427006 - RNA, 20 nt, Homo sapiens
acaggaaguacuggagaaaa

SEQ ID NO: 427007 - RNA, 16 nt, Homo sapiens
acaggacaacuuuaca

SEQ ID NO: 427008 - RNA, 15 nt, Homo sapiens
acaggagaccuggca

SEQ ID NO: 427009 - RNA, 20 nt, Homo sapiens
acaggaggcaagcaagcucu

SEQ ID NO: 427010 - RNA, 21 nt, Homo sapiens
acaggaucauguaaaugcuca

SEQ ID NO: 427011 - RNA, 19 nt, Homo sapiens
acaggauuauuggaaauuu

SEQ ID NO: 427012 - RNA, 16 nt, Homo sapiens
acaggcaacauuacaa

SEQ ID NO: 427013 - RNA, 20 nt, Homo sapiens
acaggcacccaccaccaugc

SEQ ID NO: 427014 - RNA, 16 nt, Homo sapiens
cacuugaggccaguga

SEQ ID NO: 427015 - RNA, 18 nt, Homo sapiens
cacuugcacgcccaugug

SEQ ID NO: 427016 - RNA, 12 nt, Homo sapiens
cacuugcacugg

SEQ ID NO: 427017 - RNA, 23 nt, Homo sapiens
cacuugcacugugcuugcuccua

SEQ ID NO: 427018 - RNA, 12 nt, Homo sapiens
cacuugccccag

SEQ ID NO: 427019 - RNA, 13 nt, Homo sapiens
cacuuggaugcag

SEQ ID NO: 427020 - RNA, 16 nt, Homo sapiens
cacuuggaugcagggu

SEQ ID NO: 427021 - RNA, 18 nt, Homo sapiens
cacuugggagcaaaagau

SEQ ID NO: 427022 - RNA, 17 nt, Homo sapiens
cacuugggauugucuua

SEQ ID NO: 427023 - RNA, 23 nt, Homo sapiens
cacuuggggauuaucugucauuc

SEQ ID NO: 427024 - RNA, 16 nt, Homo sapiens
accaagaguauuccau

SEQ ID NO: 427025 - RNA, 16 nt, Homo sapiens
accaagaugccaucug

SEQ ID NO: 427026 - RNA, 18 nt, Homo sapiens
accaagcguuucccaguc

SEQ ID NO: 427027 - RNA, 23 nt, Homo sapiens
accaagcguuucccagucuuagc

SEQ ID NO: 427028 - RNA, 17 nt, Homo sapiens
accaaggaacaggaaac

SEQ ID NO: 427029 - RNA, 14 nt, Homo sapiens
accaaggcagccuc

SEQ ID NO: 427030 - RNA, 20 nt, Homo sapiens
accaagugccuugagcugcc

SEQ ID NO: 427031 - RNA, 15 nt, Homo sapiens
accaaguggcuccca

SEQ ID NO: 427032 - RNA, 14 nt, Homo sapiens
accaauaacuucag

SEQ ID NO: 427033 - RNA, 16 nt, Homo sapiens
accaauauuaccaucu

SEQ ID NO: 427034 - RNA, 17 nt, Homo sapiens
accaauauuaccaucuu

SEQ ID NO: 427035 - RNA, 20 nt, Homo sapiens
accaauauuaccaucuuaau

SEQ ID NO: 427036 - RNA, 18 nt, Homo sapiens
accaauauucuuuuguuc

SEQ ID NO: 427037 - RNA, 17 nt, Homo sapiens
accaaugauucauaaca

SEQ ID NO: 427038 - RNA, 12 nt, Homo sapiens
accaaugcacac

SEQ ID NO: 427039 - RNA, 22 nt, Homo sapiens
accaauguugugauuaacauca

SEQ ID NO: 427040 - RNA, 18 nt, Homo sapiens
accaauuccaaguuuuaa

SEQ ID NO: 427041 - RNA, 15 nt, Homo sapiens
accacagacgccacc

SEQ ID NO: 427042 - RNA, 15 nt, Homo sapiens
accacagucuuaggg

SEQ ID NO: 427043 - RNA, 17 nt, Homo sapiens
accacauauacagcagg

SEQ ID NO: 427044 - RNA, 14 nt, Homo sapiens
accacaucuugucu

SEQ ID NO: 427045 - RNA, 12 nt, Homo sapiens
accacaucuuuu

SEQ ID NO: 427046 - RNA, 14 nt, Homo sapiens
accaccaaccacug

SEQ ID NO: 427047 - RNA, 20 nt, Homo sapiens
accaccaagaaagccuucaa

SEQ ID NO: 427048 - RNA, 21 nt, Homo sapiens
accaccccucccucugcucuc

SEQ ID NO: 427049 - RNA, 23 nt, Homo sapiens
accaccgcccuccucgcugugcc

SEQ ID NO: 427050 - RNA, 17 nt, Homo sapiens
accaccucguccucgug

SEQ ID NO: 427051 - RNA, 14 nt, Homo sapiens
accacgaggaaaag

SEQ ID NO: 427052 - RNA, 14 nt, Homo sapiens
accacgcccagcua

SEQ ID NO: 427053 - RNA, 23 nt, Homo sapiens
accacuacaugcagcccaugccc

SEQ ID NO: 427054 - RNA, 13 nt, Homo sapiens
accacucaggaau

SEQ ID NO: 427055 - RNA, 13 nt, Homo sapiens
accacugagcccu

SEQ ID NO: 427056 - RNA, 14 nt, Homo sapiens
accacugaguccac

SEQ ID NO: 427057 - RNA, 19 nt, Homo sapiens
accacugcuuccauuuaau

SEQ ID NO: 427058 - RNA, 15 nt, Homo sapiens
accacuuacggacag

SEQ ID NO: 427059 - RNA, 21 nt, Homo sapiens
accacuuuccccgugggccau

SEQ ID NO: 427060 - RNA, 17 nt, Homo sapiens
accagaagcauuucacc

SEQ ID NO: 427061 - RNA, 20 nt, Homo sapiens
accagaagugccaugcucag

SEQ ID NO: 427062 - RNA, 13 nt, Homo sapiens
accagaaugauuu

SEQ ID NO: 427063 - RNA, 19 nt, Homo sapiens
accagaauggggacaucuu

SEQ ID NO: 427064 - RNA, 16 nt, Homo sapiens
accagaauugugcaaa

SEQ ID NO: 427065 - RNA, 16 nt, Homo sapiens
accagacacguacaaa

SEQ ID NO: 427066 - RNA, 20 nt, Homo sapiens
accagagaaaugaaagucag

SEQ ID NO: 427067 - RNA, 11 nt, Homo sapiens
accagaggcag

SEQ ID NO: 427068 - RNA, 22 nt, Homo sapiens
accagauaaagaacuaaaucau

SEQ ID NO: 427069 - RNA, 16 nt, Homo sapiens
accagcccacauccag

SEQ ID NO: 427070 - RNA, 15 nt, Homo sapiens
accaggaaccucuuc

SEQ ID NO: 427071 - RNA, 22 nt, Homo sapiens
accaggacuaaugcauguggua

SEQ ID NO: 427072 - RNA, 13 nt, Homo sapiens
accaggcacugcc

SEQ ID NO: 427073 - RNA, 16 nt, Homo sapiens
accaggccaccaucug

SEQ ID NO: 427074 - RNA, 23 nt, Homo sapiens
accaggcuucccaaaccaagugc

SEQ ID NO: 427075 - RNA, 15 nt, Homo sapiens
accagguuaccucac

SEQ ID NO: 427076 - RNA, 15 nt, Homo sapiens
accaguacugggaag

SEQ ID NO: 427077 - RNA, 19 nt, Homo sapiens
accagucagggacagcagc

SEQ ID NO: 427078 - RNA, 13 nt, Homo sapiens
accaguccaugag

SEQ ID NO: 427079 - RNA, 22 nt, Homo sapiens
accaguccuguuugcagggaag

SEQ ID NO: 427080 - RNA, 12 nt, Homo sapiens
accagugaauga

SEQ ID NO: 427081 - RNA, 14 nt, Homo sapiens
accaguguacugcu

SEQ ID NO: 427082 - RNA, 16 nt, Homo sapiens
accaguguuaguggga

SEQ ID NO: 427083 - RNA, 22 nt, Homo sapiens
accaguguuagugggaagagcu

SEQ ID NO: 427084 - RNA, 19 nt, Homo sapiens
accaguuaaaagcauuuua

SEQ ID NO: 427085 - RNA, 19 nt, Homo sapiens
accaguugggagcacugga

SEQ ID NO: 427086 - RNA, 16 nt, Homo sapiens
accaguuguugauaac

SEQ ID NO: 427087 - RNA, 21 nt, Homo sapiens
accauaagcuuuuucucugaa

SEQ ID NO: 427088 - RNA, 19 nt, Homo sapiens
accauaagggacugugcca

SEQ ID NO: 427089 - RNA, 11 nt, Homo sapiens
accauaaugua

SEQ ID NO: 427090 - RNA, 14 nt, Homo sapiens
accauaauguuaca

SEQ ID NO: 427091 - RNA, 14 nt, Homo sapiens
accaucaccucucu

SEQ ID NO: 427092 - RNA, 13 nt, Homo sapiens
accaucaguauau

SEQ ID NO: 427093 - RNA, 14 nt, Homo sapiens
accaucaguuacug

SEQ ID NO: 427094 - RNA, 22 nt, Homo sapiens
accaucauuauaaacgugauga

SEQ ID NO: 427095 - RNA, 15 nt, Homo sapiens
accauccccuccuag

SEQ ID NO: 427096 - RNA, 11 nt, Homo sapiens
accaucugcau

SEQ ID NO: 427097 - RNA, 12 nt, Homo sapiens
accaucuuaauc

SEQ ID NO: 427098 - RNA, 11 nt, Homo sapiens
accaugaauga

SEQ ID NO: 427099 - RNA, 21 nt, Homo sapiens
accaugagaccacuguuauca

SEQ ID NO: 427100 - RNA, 13 nt, Homo sapiens
accaugagcaccu

SEQ ID NO: 427101 - RNA, 23 nt, Homo sapiens
accaugugauuauggacaucgau

SEQ ID NO: 427102 - RNA, 18 nt, Homo sapiens
accauguggccauuaaca

SEQ ID NO: 427103 - RNA, 14 nt, Homo sapiens
accauguugcccag

SEQ ID NO: 427104 - RNA, 22 nt, Homo sapiens
accauuauggcuuugugcuugu

SEQ ID NO: 427105 - RNA, 21 nt, Homo sapiens
acccaacagagaccagcuucu

SEQ ID NO: 427106 - RNA, 19 nt, Homo sapiens
acccaaguugaagacuuug

SEQ ID NO: 427107 - RNA, 18 nt, Homo sapiens
acccacagccccugcugg

SEQ ID NO: 427108 - RNA, 11 nt, Homo sapiens
acccaccauug

SEQ ID NO: 427109 - RNA, 18 nt, Homo sapiens
acccacccuaauuugccc

SEQ ID NO: 427110 - RNA, 21 nt, Homo sapiens
acccacccucugguccuucug

SEQ ID NO: 427111 - RNA, 18 nt, Homo sapiens
acccaccuucaagcagcu

SEQ ID NO: 427112 - RNA, 15 nt, Homo sapiens
acccacggcucucgu

SEQ ID NO: 427113 - RNA, 20 nt, Homo sapiens
acccacuaugcacagauuaa

SEQ ID NO: 427114 - RNA, 12 nt, Homo sapiens
acccacucuuca

SEQ ID NO: 427115 - RNA, 23 nt, Homo sapiens
acccacuuaguccacucugaguc

SEQ ID NO: 427116 - RNA, 21 nt, Homo sapiens
acccagauugaagcuaaaaua

SEQ ID NO: 427117 - RNA, 15 nt, Homo sapiens
acccagcaacuccaa

SEQ ID NO: 427118 - RNA, 14 nt, Homo sapiens
acccagcacccaca

SEQ ID NO: 427119 - RNA, 19 nt, Homo sapiens
acccagcaugcuaccugaa

SEQ ID NO: 427120 - RNA, 16 nt, Homo sapiens
acccagcccagcuugc

SEQ ID NO: 427121 - RNA, 21 nt, Homo sapiens
acccagcccuuguuagauuca

SEQ ID NO: 427122 - RNA, 15 nt, Homo sapiens
acccagccucuagaa

SEQ ID NO: 427123 - RNA, 22 nt, Homo sapiens
acccagccucuagaacagccag

SEQ ID NO: 427124 - RNA, 15 nt, Homo sapiens
acccagcuccagggg

SEQ ID NO: 427125 - RNA, 20 nt, Homo sapiens
acccagcuugugccuguggu

SEQ ID NO: 427126 - RNA, 15 nt, Homo sapiens
acccagggugcauua

SEQ ID NO: 427127 - RNA, 15 nt, Homo sapiens
acccauaacuaccag

SEQ ID NO: 427128 - RNA, 20 nt, Homo sapiens
acccaucgucuuuaacccca

SEQ ID NO: 427129 - RNA, 19 nt, Homo sapiens
acccauggguccaugggaa

SEQ ID NO: 427130 - RNA, 16 nt, Homo sapiens
acccauucacuacagg

SEQ ID NO: 427131 - RNA, 20 nt, Homo sapiens
acccauucguggugaucaau

SEQ ID NO: 427132 - RNA, 14 nt, Homo sapiens
accccaacucuccc

SEQ ID NO: 427133 - RNA, 20 nt, Homo sapiens
accccaauuaacugaagcaa

SEQ ID NO: 427134 - RNA, 16 nt, Homo sapiens
accccaccagcaauac

SEQ ID NO: 427135 - RNA, 22 nt, Homo sapiens
accccaccuugccaagcuuucu

SEQ ID NO: 427136 - RNA, 17 nt, Homo sapiens
accccacuuaugcugcu

SEQ ID NO: 427137 - RNA, 16 nt, Homo sapiens
accccagccacuccuc

SEQ ID NO: 427138 - RNA, 19 nt, Homo sapiens
accccaggaagugggagaa

SEQ ID NO: 427139 - RNA, 19 nt, Homo sapiens
accccagggccuacugcca

SEQ ID NO: 427140 - RNA, 15 nt, Homo sapiens
accccaucucuacua

SEQ ID NO: 427141 - RNA, 12 nt, Homo sapiens
accccauuugau

SEQ ID NO: 427142 - RNA, 19 nt, Homo sapiens
acccccaccacucuugacu

SEQ ID NO: 427143 - RNA, 21 nt, Homo sapiens
acccccagcaacccuccuauc

SEQ ID NO: 427144 - RNA, 18 nt, Homo sapiens
acccccaucucugcaaaa

SEQ ID NO: 427145 - RNA, 13 nt, Homo sapiens
acccccaucuuuu

SEQ ID NO: 427146 - RNA, 16 nt, Homo sapiens
acccccauguccuccg

SEQ ID NO: 427147 - RNA, 17 nt, Homo sapiens
accccgcggugcucugg

SEQ ID NO: 427148 - RNA, 12 nt, Homo sapiens
accccuacagcc

SEQ ID NO: 427149 - RNA, 18 nt, Homo sapiens
accccuccaugauuccaa

SEQ ID NO: 427150 - RNA, 12 nt, Homo sapiens
accccucuggcc

SEQ ID NO: 427151 - RNA, 13 nt, Homo sapiens
accccugaccuca

SEQ ID NO: 427152 - RNA, 20 nt, Homo sapiens
accccugcucuacccaugag

SEQ ID NO: 427153 - RNA, 23 nt, Homo sapiens
accccuuacuuagcaugcacaaa

SEQ ID NO: 427154 - RNA, 12 nt, Homo sapiens
caggcaccagca

SEQ ID NO: 427155 - RNA, 14 nt, Homo sapiens
caucugaagugucu

SEQ ID NO: 427156 - RNA, 11 nt, Homo sapiens
caucugcaaua

SEQ ID NO: 427157 - RNA, 15 nt, Homo sapiens
caucugcagcucuuu

SEQ ID NO: 427158 - RNA, 20 nt, Homo sapiens
caucugcaguggagccugaa

SEQ ID NO: 427159 - RNA, 21 nt, Homo sapiens
caucugccaccggaaauacca

SEQ ID NO: 427160 - RNA, 16 nt, Homo sapiens
caucugcugagcucug

SEQ ID NO: 427161 - RNA, 15 nt, Homo sapiens
accuuuggagcaaag

SEQ ID NO: 427162 - RNA, 17 nt, Homo sapiens
accuuuggagcaaagcu

SEQ ID NO: 427163 - RNA, 17 nt, Homo sapiens
accuuuuugacuuuucc

SEQ ID NO: 427164 - RNA, 12 nt, Homo sapiens
acgaaagcacag

SEQ ID NO: 427165 - RNA, 18 nt, Homo sapiens
acgaagccuuaagccaua

SEQ ID NO: 427166 - RNA, 18 nt, Homo sapiens
acgaagcuuaguauaaac

SEQ ID NO: 427167 - RNA, 14 nt, Homo sapiens
acgaaucagacuca

SEQ ID NO: 427168 - RNA, 18 nt, Homo sapiens
acgacaagugcugaacag

SEQ ID NO: 427169 - RNA, 21 nt, Homo sapiens
acgaggcaaugacugugagcg

SEQ ID NO: 427170 - RNA, 19 nt, Homo sapiens
acgagggaugggauuucau

SEQ ID NO: 427171 - RNA, 18 nt, Homo sapiens
acgauuuugaacauacuu

SEQ ID NO: 427172 - RNA, 20 nt, Homo sapiens
acgcacacacacacacagga

SEQ ID NO: 427173 - RNA, 22 nt, Homo sapiens
acgcacaugcgaccccgaggaa

SEQ ID NO: 427174 - RNA, 13 nt, Homo sapiens
acgcaguaacuaa

SEQ ID NO: 427175 - RNA, 15 nt, Homo sapiens
acgcccuccccagac

SEQ ID NO: 427176 - RNA, 17 nt, Homo sapiens
acgccuccccuuuguga

SEQ ID NO: 427177 - RNA, 17 nt, Homo sapiens
acgccuguaaucccagc

SEQ ID NO: 427178 - RNA, 14 nt, Homo sapiens
acgcuccccugaga

SEQ ID NO: 427179 - RNA, 21 nt, Homo sapiens
acgcugcccaggcucugcuga

SEQ ID NO: 427180 - RNA, 15 nt, Homo sapiens
acgcugucuccagac

SEQ ID NO: 427181 - RNA, 18 nt, Homo sapiens
acgcuuuucccaccucuu

SEQ ID NO: 427182 - RNA, 22 nt, Homo sapiens
acggaagaggcugcugagaaag

SEQ ID NO: 427183 - RNA, 22 nt, Homo sapiens
acggaccugcuuugagauuucc

SEQ ID NO: 427184 - RNA, 17 nt, Homo sapiens
acggagaucuccuugcc

SEQ ID NO: 427185 - RNA, 16 nt, Homo sapiens
acggagucuugcucug

SEQ ID NO: 427186 - RNA, 23 nt, Homo sapiens
acggaguuuaguuuuauauugcu

SEQ ID NO: 427187 - RNA, 23 nt, Homo sapiens
acggaugauuggauuauucauuu

SEQ ID NO: 427188 - RNA, 12 nt, Homo sapiens
acggcacugugg

SEQ ID NO: 427189 - RNA, 16 nt, Homo sapiens
acggcgcccccagugu

SEQ ID NO: 427190 - RNA, 17 nt, Homo sapiens
acggcuaagaggcugcu

SEQ ID NO: 427191 - RNA, 13 nt, Homo sapiens
acggcucuaggug

SEQ ID NO: 427192 - RNA, 21 nt, Homo sapiens
acgggcaaagaaaacacacaa

SEQ ID NO: 427193 - RNA, 16 nt, Homo sapiens
acggggcuugcaacuu

SEQ ID NO: 427194 - RNA, 19 nt, Homo sapiens
acgggguuggcuguuccag

SEQ ID NO: 427195 - RNA, 12 nt, Homo sapiens
acgguaccagug

SEQ ID NO: 427196 - RNA, 20 nt, Homo sapiens
acgguggugcaugccuguaa

SEQ ID NO: 427197 - RNA, 20 nt, Homo sapiens
acgguuucuuuguuacuuua

SEQ ID NO: 427198 - RNA, 18 nt, Homo sapiens
acguaauuuguuauauca

SEQ ID NO: 427199 - RNA, 23 nt, Homo sapiens
acguacaaaauccagcuaugaau

SEQ ID NO: 427200 - RNA, 15 nt, Homo sapiens
acguccuuccacuuc

SEQ ID NO: 427201 - RNA, 17 nt, Homo sapiens
acgucuguggacugaau

SEQ ID NO: 427202 - RNA, 14 nt, Homo sapiens
acgugccuccagca

SEQ ID NO: 427203 - RNA, 18 nt, Homo sapiens
acgugcgugucucugcca

SEQ ID NO: 427204 - RNA, 18 nt, Homo sapiens
acguggacucugugcuca

SEQ ID NO: 427205 - RNA, 17 nt, Homo sapiens
acguggccucuugagca

SEQ ID NO: 427206 - RNA, 13 nt, Homo sapiens
acgugggcauuuu

SEQ ID NO: 427207 - RNA, 12 nt, Homo sapiens
acgugugaggau

SEQ ID NO: 427208 - RNA, 22 nt, Homo sapiens
acgugugaguggucaggcaucu

SEQ ID NO: 427209 - RNA, 23 nt, Homo sapiens
acguuaaaggcauuuuauuccag

SEQ ID NO: 427210 - RNA, 13 nt, Homo sapiens
acguuugccaaau

SEQ ID NO: 427211 - RNA, 16 nt, Homo sapiens
acuaaaaauacaaaaa

SEQ ID NO: 427212 - RNA, 18 nt, Homo sapiens
acuaaacagacuauuuaa

SEQ ID NO: 427213 - RNA, 14 nt, Homo sapiens
acuaaagauaucag

SEQ ID NO: 427214 - RNA, 12 nt, Homo sapiens
acuaaagcuuua

SEQ ID NO: 427215 - RNA, 22 nt, Homo sapiens
acuaaagggugugggucaggga

SEQ ID NO: 427216 - RNA, 18 nt, Homo sapiens
acuaaccauccccaacuc

SEQ ID NO: 427217 - RNA, 18 nt, Homo sapiens
acuaacugcaaaugcauc

SEQ ID NO: 427218 - RNA, 23 nt, Homo sapiens
acuaaguaaccucuacaggcauu

SEQ ID NO: 427219 - RNA, 16 nt, Homo sapiens
acuaaugucagcacau

SEQ ID NO: 427220 - RNA, 16 nt, Homo sapiens
acuacaaagcuucuau

SEQ ID NO: 427221 - RNA, 13 nt, Homo sapiens
acuacaagggcau

SEQ ID NO: 427222 - RNA, 17 nt, Homo sapiens
acuacaugcaaggcacu

SEQ ID NO: 427223 - RNA, 21 nt, Homo sapiens
acuacaugugacuggcaguau

SEQ ID NO: 427224 - RNA, 21 nt, Homo sapiens
acuacuaaagugccuacccca

SEQ ID NO: 427225 - RNA, 16 nt, Homo sapiens
acuacugaacuguuac

SEQ ID NO: 427226 - RNA, 14 nt, Homo sapiens
acuacugcaaaaag

SEQ ID NO: 427227 - RNA, 12 nt, Homo sapiens
acuacugcaguc

SEQ ID NO: 427228 - RNA, 18 nt, Homo sapiens
acuagaacacaaauccaa

SEQ ID NO: 427229 - RNA, 13 nt, Homo sapiens
acuagaagcacag

SEQ ID NO: 427230 - RNA, 17 nt, Homo sapiens
acuagagaaacuugaau

SEQ ID NO: 427231 - RNA, 18 nt, Homo sapiens
acuagaggcuugcauaau

SEQ ID NO: 427232 - RNA, 15 nt, Homo sapiens
acuagauaacuuaaa

SEQ ID NO: 427233 - RNA, 15 nt, Homo sapiens
acuagauugcaugcu

SEQ ID NO: 427234 - RNA, 19 nt, Homo sapiens
acuagcauuauaccaagag

SEQ ID NO: 427235 - RNA, 13 nt, Homo sapiens
acuaggagaccag

SEQ ID NO: 427236 - RNA, 14 nt, Homo sapiens
acuagguuuaucuc

SEQ ID NO: 427237 - RNA, 13 nt, Homo sapiens
acuagguuucacc

SEQ ID NO: 427238 - RNA, 12 nt, Homo sapiens
acuagugccauu

SEQ ID NO: 427239 - RNA, 21 nt, Homo sapiens
acuauaaagcaguagacaauc

SEQ ID NO: 427240 - RNA, 14 nt, Homo sapiens
acuauaaccaucag

SEQ ID NO: 427241 - RNA, 15 nt, Homo sapiens
acuauccuugcuaag

SEQ ID NO: 427242 - RNA, 19 nt, Homo sapiens
acuaugggcccgagcucau

SEQ ID NO: 427243 - RNA, 16 nt, Homo sapiens
acuauuacaccaaaua

SEQ ID NO: 427244 - RNA, 13 nt, Homo sapiens
acuauuaguauua

SEQ ID NO: 427245 - RNA, 14 nt, Homo sapiens
acuauuaguguuaa

SEQ ID NO: 427246 - RNA, 21 nt, Homo sapiens
acuauuggacagacacagagg

SEQ ID NO: 427247 - RNA, 21 nt, Homo sapiens
acuauuuuugauagcacacau

SEQ ID NO: 427248 - RNA, 20 nt, Homo sapiens
acucaaguccuuaccucuuc

SEQ ID NO: 427249 - RNA, 12 nt, Homo sapiens
acucacaggcua

SEQ ID NO: 427250 - RNA, 14 nt, Homo sapiens
acucaccaaaauau

SEQ ID NO: 427251 - RNA, 20 nt, Homo sapiens
acucacuccacaacccaaga

SEQ ID NO: 427252 - RNA, 11 nt, Homo sapiens
acucacuccag

SEQ ID NO: 427253 - RNA, 19 nt, Homo sapiens
acucagaggcugacacuga

SEQ ID NO: 427254 - RNA, 15 nt, Homo sapiens
acucagcaguugaca

SEQ ID NO: 427255 - RNA, 13 nt, Homo sapiens
acucagccaagac

SEQ ID NO: 427256 - RNA, 23 nt, Homo sapiens
acucagccuuaagaaagcuauau

SEQ ID NO: 427257 - RNA, 18 nt, Homo sapiens
acucaggaauguuugcug

SEQ ID NO: 427258 - RNA, 17 nt, Homo sapiens
acucaguauauagccuu

SEQ ID NO: 427259 - RNA, 22 nt, Homo sapiens
acucauccuuuuuaaaugagac

SEQ ID NO: 427260 - RNA, 20 nt, Homo sapiens
acucaucuuagugccugaga

SEQ ID NO: 427261 - RNA, 16 nt, Homo sapiens
acucauugucugugga

SEQ ID NO: 427262 - RNA, 22 nt, Homo sapiens
acucauuucauuccuaacacag

SEQ ID NO: 427263 - RNA, 17 nt, Homo sapiens
acuccaccaucaccucu

SEQ ID NO: 427264 - RNA, 23 nt, Homo sapiens
acuccacccguucccacugcccu

SEQ ID NO: 427265 - RNA, 19 nt, Homo sapiens
acuccacuccccucaucca

SEQ ID NO: 427266 - RNA, 20 nt, Homo sapiens
acuccaggauccuccuggag

SEQ ID NO: 427267 - RNA, 12 nt, Homo sapiens
acucccagacau

SEQ ID NO: 427268 - RNA, 18 nt, Homo sapiens
acucccugucauaguuac

SEQ ID NO: 427269 - RNA, 20 nt, Homo sapiens
acuccgggaccauugaccuc

SEQ ID NO: 427270 - RNA, 14 nt, Homo sapiens
acuccuagcugacu

SEQ ID NO: 427271 - RNA, 14 nt, Homo sapiens
acuccuccaaggca

SEQ ID NO: 427272 - RNA, 20 nt, Homo sapiens
acuccucuccgcaguuccug

SEQ ID NO: 427273 - RNA, 14 nt, Homo sapiens
acuccucugucaua

SEQ ID NO: 427274 - RNA, 19 nt, Homo sapiens
acuccucuguccaggcacu

SEQ ID NO: 427275 - RNA, 18 nt, Homo sapiens
acuccucuuauuugcuca

SEQ ID NO: 427276 - RNA, 14 nt, Homo sapiens
acuccucuuuacac

SEQ ID NO: 427277 - RNA, 17 nt, Homo sapiens
acuccugaccucaggua

SEQ ID NO: 427278 - RNA, 18 nt, Homo sapiens
acuccugaccucagguga

SEQ ID NO: 427279 - RNA, 12 nt, Homo sapiens
acuccugcaaaa

SEQ ID NO: 427280 - RNA, 21 nt, Homo sapiens
acuccuuaggcuuuguugaau

SEQ ID NO: 427281 - RNA, 16 nt, Homo sapiens
acuccuuccucuuugc

SEQ ID NO: 427282 - RNA, 16 nt, Homo sapiens
acucgcuucucuguga

SEQ ID NO: 427283 - RNA, 17 nt, Homo sapiens
acucggcgugcuccuuu

SEQ ID NO: 427284 - RNA, 14 nt, Homo sapiens
acucuacacuguga

SEQ ID NO: 427285 - RNA, 16 nt, Homo sapiens
acucuacgccaaagug

SEQ ID NO: 427286 - RNA, 18 nt, Homo sapiens
acuuaccuagauuuacag

SEQ ID NO: 427287 - RNA, 14 nt, Homo sapiens
acuuacucuugucg

SEQ ID NO: 427288 - RNA, 23 nt, Homo sapiens
acuuagaaauugcauuuccugac

SEQ ID NO: 427289 - RNA, 21 nt, Homo sapiens
acuuagaauuaguggcacuug

SEQ ID NO: 427290 - RNA, 23 nt, Homo sapiens
acuuagaucaucagucaccgaag

SEQ ID NO: 427291 - RNA, 17 nt, Homo sapiens
acuuagcaugucccuac

SEQ ID NO: 427292 - RNA, 12 nt, Homo sapiens
acuuagcucaca

SEQ ID NO: 427293 - RNA, 14 nt, Homo sapiens
acuuagucaugagg

SEQ ID NO: 427294 - RNA, 17 nt, Homo sapiens
acuuaucaaaucauuca

SEQ ID NO: 427295 - RNA, 14 nt, Homo sapiens
acuucaaaucagag

SEQ ID NO: 427296 - RNA, 13 nt, Homo sapiens
acuucaagcuuuu

SEQ ID NO: 427297 - RNA, 13 nt, Homo sapiens
acuucaagugacc

SEQ ID NO: 427298 - RNA, 21 nt, Homo sapiens
cauucccagaauuugcugcau

SEQ ID NO: 427299 - RNA, 18 nt, Homo sapiens
cauuccucaugaauguaa

SEQ ID NO: 427300 - RNA, 19 nt, Homo sapiens
cauuccucaugaauguaaa

SEQ ID NO: 427301 - RNA, 19 nt, Homo sapiens
cauuccuguucccaugaga

SEQ ID NO: 427302 - RNA, 20 nt, Homo sapiens
cauuccuguucccaugagau

SEQ ID NO: 427303 - RNA, 21 nt, Homo sapiens
cauuccuuagcagcucaggcg

SEQ ID NO: 427304 - RNA, 18 nt, Homo sapiens
cauuccuuuaaauucucc

SEQ ID NO: 427305 - RNA, 14 nt, Homo sapiens
cauucuaaaccaaa

SEQ ID NO: 427306 - RNA, 15 nt, Homo sapiens
cauucuaaaccaaaa

SEQ ID NO: 427307 - RNA, 11 nt, Homo sapiens
cauucuagcac

SEQ ID NO: 427308 - RNA, 17 nt, Homo sapiens
cauucucaauacuugaa

SEQ ID NO: 427309 - RNA, 16 nt, Homo sapiens
cauucucaguauccac

SEQ ID NO: 427310 - RNA, 21 nt, Homo sapiens
cauucucccuugauuccacuu

SEQ ID NO: 427311 - RNA, 20 nt, Homo sapiens
cauucugaaggccuuguuaa

SEQ ID NO: 427312 - RNA, 22 nt, Homo sapiens
cauucugguuuugacaucagca

SEQ ID NO: 427313 - RNA, 15 nt, Homo sapiens
cauucuucacugucu

SEQ ID NO: 427314 - RNA, 23 nt, Homo sapiens
cauucuuuucagcuuguuucuau

SEQ ID NO: 427315 - RNA, 20 nt, Homo sapiens
cauugaaagagaaccaguuu

SEQ ID NO: 427316 - RNA, 18 nt, Homo sapiens
cauugaaagggaguauua

SEQ ID NO: 427317 - RNA, 16 nt, Homo sapiens
cauugaaauaauaaua

SEQ ID NO: 427318 - RNA, 20 nt, Homo sapiens
cauugaccaagaacugcaug

SEQ ID NO: 427319 - RNA, 17 nt, Homo sapiens
cauugaccuuuuauuua

SEQ ID NO: 427320 - RNA, 19 nt, Homo sapiens
cauugaugaacugccaaag

SEQ ID NO: 427321 - RNA, 14 nt, Homo sapiens
cauugccuuccuac

SEQ ID NO: 427322 - RNA, 17 nt, Homo sapiens
cauugcuaaacugauga

SEQ ID NO: 427323 - RNA, 15 nt, Homo sapiens
cauuguccucugagc

SEQ ID NO: 427324 - RNA, 12 nt, Homo sapiens
cauugucugugg

SEQ ID NO: 427325 - RNA, 17 nt, Homo sapiens
cauuguggcuccuaucu

SEQ ID NO: 427326 - RNA, 22 nt, Homo sapiens
cauuuaaucauuuccagcaaaa

SEQ ID NO: 427327 - RNA, 16 nt, Homo sapiens
cauuuacuugaucauu

SEQ ID NO: 427328 - RNA, 13 nt, Homo sapiens
cauuuagauuuug

SEQ ID NO: 427329 - RNA, 23 nt, Homo sapiens
cauuuagcuuguucacacuuugc

SEQ ID NO: 427330 - RNA, 12 nt, Homo sapiens
cauuuauagaau

SEQ ID NO: 427331 - RNA, 13 nt, Homo sapiens
cauuuauguguga

SEQ ID NO: 427332 - RNA, 17 nt, Homo sapiens
cauuuauuuacauguga

SEQ ID NO: 427333 - RNA, 18 nt, Homo sapiens
cauuuauuuugacuguga

SEQ ID NO: 427334 - RNA, 18 nt, Homo sapiens
cauuuauuuuuagccauu

SEQ ID NO: 427335 - RNA, 13 nt, Homo sapiens
cauuucacacccu

SEQ ID NO: 427336 - RNA, 14 nt, Homo sapiens
cauuucaccuguga

SEQ ID NO: 427337 - RNA, 17 nt, Homo sapiens
cauuucaccuuucugca

SEQ ID NO: 427338 - RNA, 14 nt, Homo sapiens
cauuucagcuguga

SEQ ID NO: 427339 - RNA, 16 nt, Homo sapiens
cauuucauuaaccaaa

SEQ ID NO: 427340 - RNA, 13 nt, Homo sapiens
cauuucuugaugu

SEQ ID NO: 427341 - RNA, 16 nt, Homo sapiens
cauuugaagcagugau

SEQ ID NO: 427342 - RNA, 15 nt, Homo sapiens
cauuugagaauaguu

SEQ ID NO: 427343 - RNA, 15 nt, Homo sapiens
cauuugcaccuaccu

SEQ ID NO: 427344 - RNA, 15 nt, Homo sapiens
cauuugcauuugcuc

SEQ ID NO: 427345 - RNA, 16 nt, Homo sapiens
cauuugcugcauuuca

SEQ ID NO: 427346 - RNA, 18 nt, Homo sapiens
cauuuggccuugugcggu

SEQ ID NO: 427347 - RNA, 18 nt, Homo sapiens
cauuugggacugucuuga

SEQ ID NO: 427348 - RNA, 16 nt, Homo sapiens
cauuugugugugugca

SEQ ID NO: 427349 - RNA, 16 nt, Homo sapiens
cauuuguuaaaauaca

SEQ ID NO: 427350 - RNA, 18 nt, Homo sapiens
cauuuguugugacuggca

SEQ ID NO: 427351 - RNA, 15 nt, Homo sapiens
cauuuuauaucugga

SEQ ID NO: 427352 - RNA, 14 nt, Homo sapiens
cauuuucaccccac

SEQ ID NO: 427353 - RNA, 14 nt, Homo sapiens
cauuuugaauguga

SEQ ID NO: 427354 - RNA, 14 nt, Homo sapiens
cauuuugcaaaauu

SEQ ID NO: 427355 - RNA, 19 nt, Homo sapiens
cauuuugcaaaauuuccag

SEQ ID NO: 427356 - RNA, 20 nt, Homo sapiens
cauuuuguauguauguguag

SEQ ID NO: 427357 - RNA, 18 nt, Homo sapiens
cauuuuucuacugcucuu

SEQ ID NO: 427358 - RNA, 19 nt, Homo sapiens
cauuuuuguauuuuguaca

SEQ ID NO: 427359 - RNA, 18 nt, Homo sapiens
cauuuuuguuucugaaaa

SEQ ID NO: 427360 - RNA, 22 nt, Homo sapiens
cauuuuuuucacuggaguuaca

SEQ ID NO: 427361 - RNA, 12 nt, Homo sapiens
ccaaaagcacuu

SEQ ID NO: 427362 - RNA, 22 nt, Homo sapiens
ccaaaagggccauguuucaaga

SEQ ID NO: 427363 - RNA, 22 nt, Homo sapiens
ccaaaaucuuaucauggucuca

SEQ ID NO: 427364 - RNA, 19 nt, Homo sapiens
ccaaacccagccucuagaa

SEQ ID NO: 427365 - RNA, 23 nt, Homo sapiens
ccaaagagcugccuaagaggcaa

SEQ ID NO: 427366 - RNA, 15 nt, Homo sapiens
ccaaaggaagcuuuc

SEQ ID NO: 427367 - RNA, 21 nt, Homo sapiens
ccaaaggaagcuuucucugcu

SEQ ID NO: 427368 - RNA, 20 nt, Homo sapiens
ccaaagggaaaacucuucau

SEQ ID NO: 427369 - RNA, 12 nt, Homo sapiens
ccaaagggccca

SEQ ID NO: 427370 - RNA, 17 nt, Homo sapiens
ccaaagggccccuuucu

SEQ ID NO: 427371 - RNA, 19 nt, Homo sapiens
ccaaaguuugcucaaggag

SEQ ID NO: 427372 - RNA, 16 nt, Homo sapiens
ccaaauaaaacuugag

SEQ ID NO: 427373 - RNA, 16 nt, Homo sapiens
ccaaauaaauuuauaa

SEQ ID NO: 427374 - RNA, 14 nt, Homo sapiens
ccaaauaugagaug

SEQ ID NO: 427375 - RNA, 14 nt, Homo sapiens
ccaaaugacuucau

SEQ ID NO: 427376 - RNA, 22 nt, Homo sapiens
ccaaaugcagggaggggaggca

SEQ ID NO: 427377 - RNA, 20 nt, Homo sapiens
ccaaauugaugggugggcua

SEQ ID NO: 427378 - RNA, 22 nt, Homo sapiens
ccaacagaggggcagccaggac

SEQ ID NO: 427379 - RNA, 22 nt, Homo sapiens
ccaacaguuugaugcugaguca

SEQ ID NO: 427380 - RNA, 21 nt, Homo sapiens
ccaacauaaaacaaaaccaag

SEQ ID NO: 427381 - RNA, 15 nt, Homo sapiens
ccaacuacagaaaga

SEQ ID NO: 427382 - RNA, 11 nt, Homo sapiens
ccaacuauuaa

SEQ ID NO: 427383 - RNA, 15 nt, Homo sapiens
ccaacucacugugcu

SEQ ID NO: 427384 - RNA, 12 nt, Homo sapiens
ccaacucuagcc

SEQ ID NO: 427385 - RNA, 20 nt, Homo sapiens
ccaacuuaggcuacagaaug

SEQ ID NO: 427386 - RNA, 19 nt, Homo sapiens
ccaacuucauuugaugcua

SEQ ID NO: 427387 - RNA, 20 nt, Homo sapiens
ccaacuugguucugcuucaa

SEQ ID NO: 427388 - RNA, 23 nt, Homo sapiens
ccaacuuguaaauacaccaccuc

SEQ ID NO: 427389 - RNA, 23 nt, Homo sapiens
ccaacuuucccuccaccagugug

SEQ ID NO: 427390 - RNA, 15 nt, Homo sapiens
ccaacuuuucaucca

SEQ ID NO: 427391 - RNA, 20 nt, Homo sapiens
ccaagaaagccuucaagaug

SEQ ID NO: 427392 - RNA, 19 nt, Homo sapiens
ccaagaacugcauggaccu

SEQ ID NO: 427393 - RNA, 13 nt, Homo sapiens
ccaagaaggugag

SEQ ID NO: 427394 - RNA, 14 nt, Homo sapiens
ccaagacccaacag

SEQ ID NO: 427395 - RNA, 17 nt, Homo sapiens
ccaagacuugguguccu

SEQ ID NO: 427396 - RNA, 20 nt, Homo sapiens
ccaagaggaaaauauugaca

SEQ ID NO: 427397 - RNA, 14 nt, Homo sapiens
ccaagaugagcugc

SEQ ID NO: 427398 - RNA, 22 nt, Homo sapiens
ccaagauggaggggcugacuca

SEQ ID NO: 427399 - RNA, 21 nt, Homo sapiens
ccaagcaaaccaauggugauc

SEQ ID NO: 427400 - RNA, 20 nt, Homo sapiens
ccaagcaugccccacccacc

SEQ ID NO: 427401 - RNA, 14 nt, Homo sapiens
ccaagccaggguuc

SEQ ID NO: 427402 - RNA, 22 nt, Homo sapiens
ccaagccaucacaggcucugca

SEQ ID NO: 427403 - RNA, 23 nt, Homo sapiens
ccaagcccugccccuccuguaca

SEQ ID NO: 427404 - RNA, 13 nt, Homo sapiens
ccaagccugacca

SEQ ID NO: 427405 - RNA, 23 nt, Homo sapiens
ccaagcguuucccagucuuagcc

SEQ ID NO: 427406 - RNA, 17 nt, Homo sapiens
ccaagcugcucauuuca

SEQ ID NO: 427407 - RNA, 17 nt, Homo sapiens
ccaagcuggagugcagu

SEQ ID NO: 427408 - RNA, 15 nt, Homo sapiens
ccaagcuugucuuua

SEQ ID NO: 427409 - RNA, 15 nt, Homo sapiens
ccaaggaaaauggac

SEQ ID NO: 427410 - RNA, 16 nt, Homo sapiens
ccaaggaacaggaaac

SEQ ID NO: 427411 - RNA, 17 nt, Homo sapiens
ccaaggagaaaggcaug

SEQ ID NO: 427412 - RNA, 20 nt, Homo sapiens
ccaaggagaaaggcaugaau

SEQ ID NO: 427413 - RNA, 13 nt, Homo sapiens
ccaaggaguggaa

SEQ ID NO: 427414 - RNA, 16 nt, Homo sapiens
ccaaggcucugagcaa

SEQ ID NO: 427415 - RNA, 14 nt, Homo sapiens
ccaagggucuuccu

SEQ ID NO: 427416 - RNA, 20 nt, Homo sapiens
ccagcccagacccccagugu

SEQ ID NO: 427417 - RNA, 20 nt, Homo sapiens
ccagcccuauggaagucuca

SEQ ID NO: 427418 - RNA, 20 nt, Homo sapiens
ccagccgugaugcucaggcu

SEQ ID NO: 427419 - RNA, 16 nt, Homo sapiens
ccagccuccaugcugc

SEQ ID NO: 427420 - RNA, 13 nt, Homo sapiens
ccagccucuagaa

SEQ ID NO: 427421 - RNA, 14 nt, Homo sapiens
ccagccucuagaac

SEQ ID NO: 427422 - RNA, 17 nt, Homo sapiens
ccagccuggacaccucu

SEQ ID NO: 427423 - RNA, 20 nt, Homo sapiens
ccagccugggugacagagca

SEQ ID NO: 427424 - RNA, 19 nt, Homo sapiens
ccagccuguccaacagagg

SEQ ID NO: 427425 - RNA, 22 nt, Homo sapiens
ccagccuuagagacuagacaaa

SEQ ID NO: 427426 - RNA, 19 nt, Homo sapiens
ccagcgcccgcugggcuga

SEQ ID NO: 427427 - RNA, 20 nt, Homo sapiens
ccagcguucuucaggagaug

SEQ ID NO: 427428 - RNA, 23 nt, Homo sapiens
ccagcuacauuccucagcugcca

SEQ ID NO: 427429 - RNA, 15 nt, Homo sapiens
ccagcuacucaggag

SEQ ID NO: 427430 - RNA, 12 nt, Homo sapiens
ccagcuaugaau

SEQ ID NO: 427431 - RNA, 13 nt, Homo sapiens
ccagcucaucucc

SEQ ID NO: 427432 - RNA, 16 nt, Homo sapiens
ccagcuccacuggccu

SEQ ID NO: 427433 - RNA, 22 nt, Homo sapiens
ccagcuccauccuugcaucacu

SEQ ID NO: 427434 - RNA, 21 nt, Homo sapiens
agaacggcaugugaauucugu

SEQ ID NO: 427435 - RNA, 17 nt, Homo sapiens
agaacucaccacaagcc

SEQ ID NO: 427436 - RNA, 20 nt, Homo sapiens
agaacuccuguguguggaag

SEQ ID NO: 427437 - RNA, 12 nt, Homo sapiens
agaacucugaau

SEQ ID NO: 427438 - RNA, 16 nt, Homo sapiens
agaacugcaauuucca

SEQ ID NO: 427439 - RNA, 14 nt, Homo sapiens
agaacugcagucag

SEQ ID NO: 427440 - RNA, 16 nt, Homo sapiens
agaacugguucuugcc

SEQ ID NO: 427441 - RNA, 17 nt, Homo sapiens
agaacuguauuuaguga

SEQ ID NO: 427442 - RNA, 17 nt, Homo sapiens
agaacuguucucaugga

SEQ ID NO: 427443 - RNA, 14 nt, Homo sapiens
agaacuucaagaag

SEQ ID NO: 427444 - RNA, 15 nt, Homo sapiens
agaagaaaacauaua

SEQ ID NO: 427445 - RNA, 16 nt, Homo sapiens
agaagaaagcaaaaaa

SEQ ID NO: 427446 - RNA, 20 nt, Homo sapiens
agaagacauccugagcagug

SEQ ID NO: 427447 - RNA, 20 nt, Homo sapiens
agaagacucgucuuggcaca

SEQ ID NO: 427448 - RNA, 17 nt, Homo sapiens
agaagacuucuuugcaa

SEQ ID NO: 427449 - RNA, 15 nt, Homo sapiens
agaagagaccaagcu

SEQ ID NO: 427450 - RNA, 12 nt, Homo sapiens
agaagagggaga

SEQ ID NO: 427451 - RNA, 18 nt, Homo sapiens
agaagcaaaccugauaca

SEQ ID NO: 427452 - RNA, 20 nt, Homo sapiens
agaagcccagguuacaaaga

SEQ ID NO: 427453 - RNA, 15 nt, Homo sapiens
agaagccuuuuccau

SEQ ID NO: 427454 - RNA, 20 nt, Homo sapiens
agaagcuuguauuaucagug

SEQ ID NO: 427455 - RNA, 12 nt, Homo sapiens
agaaggaaagca

SEQ ID NO: 427456 - RNA, 18 nt, Homo sapiens
agaaggcaggaucaaaga

SEQ ID NO: 427457 - RNA, 15 nt, Homo sapiens
agaaggcauuccagg

SEQ ID NO: 427458 - RNA, 15 nt, Homo sapiens
agaagguugugauga

SEQ ID NO: 427459 - RNA, 20 nt, Homo sapiens
agaagucagagaaaacacuu

SEQ ID NO: 427460 - RNA, 11 nt, Homo sapiens
agaagugccau

SEQ ID NO: 427461 - RNA, 21 nt, Homo sapiens
agaaguggcauaaaugucuaa

SEQ ID NO: 427462 - RNA, 18 nt, Homo sapiens
agaagugggagugggaga

SEQ ID NO: 427463 - RNA, 20 nt, Homo sapiens
agaauaaagccuugugauca

SEQ ID NO: 427464 - RNA, 14 nt, Homo sapiens
agaauaaaguccaa

SEQ ID NO: 427465 - RNA, 18 nt, Homo sapiens
agaauacaguaagcugcu

SEQ ID NO: 427466 - RNA, 13 nt, Homo sapiens
agaauaccaauau

SEQ ID NO: 427467 - RNA, 14 nt, Homo sapiens
agaauaucugggau

SEQ ID NO: 427468 - RNA, 19 nt, Homo sapiens
agaauauuuauuaccucug

SEQ ID NO: 427469 - RNA, 14 nt, Homo sapiens
agaaucaagucugu

SEQ ID NO: 427470 - RNA, 21 nt, Homo sapiens
agaaucacuugacuuugccac

SEQ ID NO: 427471 - RNA, 18 nt, Homo sapiens
agaaucagaauuguagcc

SEQ ID NO: 427472 - RNA, 15 nt, Homo sapiens
agaaucaugggaugu

SEQ ID NO: 427473 - RNA, 21 nt, Homo sapiens
agaaucccuaagccuagcugg

SEQ ID NO: 427474 - RNA, 13 nt, Homo sapiens
agaaucuagccuc

SEQ ID NO: 427475 - RNA, 15 nt, Homo sapiens
agaaucucagcacuu

SEQ ID NO: 427476 - RNA, 16 nt, Homo sapiens
agaaucucagcacuuu

SEQ ID NO: 427477 - RNA, 14 nt, Homo sapiens
agaaugaaguggag

SEQ ID NO: 427478 - RNA, 19 nt, Homo sapiens
agaaugccagcccaaagcu

SEQ ID NO: 427479 - RNA, 13 nt, Homo sapiens
agaauggugggcu

SEQ ID NO: 427480 - RNA, 15 nt, Homo sapiens
agaauguacauuacc

SEQ ID NO: 427481 - RNA, 18 nt, Homo sapiens
agaauuauaagucacaaa

SEQ ID NO: 427482 - RNA, 18 nt, Homo sapiens
agaauuauacagaccuaa

SEQ ID NO: 427483 - RNA, 16 nt, Homo sapiens
agaauuaucaucccaa

SEQ ID NO: 427484 - RNA, 10 nt, Homo sapiens
agaauuccuu

SEQ ID NO: 427485 - RNA, 13 nt, Homo sapiens
agaauugugcaaa

SEQ ID NO: 427486 - RNA, 20 nt, Homo sapiens
agaauugugcuggucauaca

SEQ ID NO: 427487 - RNA, 13 nt, Homo sapiens
agaauuuagcuua

SEQ ID NO: 427488 - RNA, 18 nt, Homo sapiens
agaauuuccuaaugagau

SEQ ID NO: 427489 - RNA, 17 nt, Homo sapiens
agacaaaggcccagaaa

SEQ ID NO: 427490 - RNA, 22 nt, Homo sapiens
agacaaaugggacugaugucau

SEQ ID NO: 427491 - RNA, 21 nt, Homo sapiens
agacaaaugggccugccaaac

SEQ ID NO: 427492 - RNA, 15 nt, Homo sapiens
agacaaccacuggga

SEQ ID NO: 427493 - RNA, 14 nt, Homo sapiens
agacaagccugagu

SEQ ID NO: 427494 - RNA, 13 nt, Homo sapiens
agacacaguauug

SEQ ID NO: 427495 - RNA, 17 nt, Homo sapiens
agacacaucuccuccau

SEQ ID NO: 427496 - RNA, 17 nt, Homo sapiens
agacacccuaacucuug

SEQ ID NO: 427497 - RNA, 15 nt, Homo sapiens
agacacuggucucag

SEQ ID NO: 427498 - RNA, 11 nt, Homo sapiens
agacacugugg

SEQ ID NO: 427499 - RNA, 16 nt, Homo sapiens
agacagacuugagaac

SEQ ID NO: 427500 - RNA, 18 nt, Homo sapiens
agacagagccuuguucua

SEQ ID NO: 427501 - RNA, 15 nt, Homo sapiens
agacagagucucacu

SEQ ID NO: 427502 - RNA, 14 nt, Homo sapiens
agacagcugucuug

SEQ ID NO: 427503 - RNA, 19 nt, Homo sapiens
agacaggaagguggugcuu

SEQ ID NO: 427504 - RNA, 16 nt, Homo sapiens
agacaggcucuuagca

SEQ ID NO: 427505 - RNA, 21 nt, Homo sapiens
agacagggaauagugggauca

SEQ ID NO: 427506 - RNA, 20 nt, Homo sapiens
agacaggguuucaccauguu

SEQ ID NO: 427507 - RNA, 23 nt, Homo sapiens
agacaguaugagucaaugugcag

SEQ ID NO: 427508 - RNA, 15 nt, Homo sapiens
agacaguauugccac

SEQ ID NO: 427509 - RNA, 18 nt, Homo sapiens
agacaguggaucaugaaa

SEQ ID NO: 427510 - RNA, 19 nt, Homo sapiens
agacaguguuuucugggau

SEQ ID NO: 427511 - RNA, 20 nt, Homo sapiens
agacaguguuuugccauguu

SEQ ID NO: 427512 - RNA, 16 nt, Homo sapiens
agacauaaauuacuuu

SEQ ID NO: 427513 - RNA, 18 nt, Homo sapiens
agacauaaguaaaugagc

SEQ ID NO: 427514 - RNA, 19 nt, Homo sapiens
agacauaccucucaacuua

SEQ ID NO: 427515 - RNA, 11 nt, Homo sapiens
agacauacucc

SEQ ID NO: 427516 - RNA, 17 nt, Homo sapiens
agacauccugagcagug

SEQ ID NO: 427517 - RNA, 14 nt, Homo sapiens
agacauccugugau

SEQ ID NO: 427518 - RNA, 23 nt, Homo sapiens
agacaugaaauugagucauuuua

SEQ ID NO: 427519 - RNA, 18 nt, Homo sapiens
agacauggagacuccugc

SEQ ID NO: 427520 - RNA, 19 nt, Homo sapiens
agaccaagccggugcccac

SEQ ID NO: 427521 - RNA, 17 nt, Homo sapiens
agaccaaguccuggcua

SEQ ID NO: 427522 - RNA, 21 nt, Homo sapiens
agaccacaaaaauugacucaa

SEQ ID NO: 427523 - RNA, 13 nt, Homo sapiens
agaccaccucuca

SEQ ID NO: 427524 - RNA, 17 nt, Homo sapiens
agaccaguacugggaag

SEQ ID NO: 427525 - RNA, 22 nt, Homo sapiens
agaccagucacagccauuucaa

SEQ ID NO: 427526 - RNA, 17 nt, Homo sapiens
agacccaacaggugcug

SEQ ID NO: 427527 - RNA, 18 nt, Homo sapiens
agaccccugcuccugacu

SEQ ID NO: 427528 - RNA, 14 nt, Homo sapiens
agaccccuuggcca

SEQ ID NO: 427529 - RNA, 15 nt, Homo sapiens
agaccuaaugcuccu

SEQ ID NO: 427530 - RNA, 16 nt, Homo sapiens
agaccuaggauuucau

SEQ ID NO: 427531 - RNA, 18 nt, Homo sapiens
agaccugccugugugcuc

SEQ ID NO: 427532 - RNA, 21 nt, Homo sapiens
agaccuggagcggcuauucca

SEQ ID NO: 427533 - RNA, 21 nt, Homo sapiens
agaccuggcacuggaugcaga

SEQ ID NO: 427534 - RNA, 17 nt, Homo sapiens
agaccuuuggagcaaag

SEQ ID NO: 427535 - RNA, 15 nt, Homo sapiens
agacggagucuugcu

SEQ ID NO: 427536 - RNA, 12 nt, Homo sapiens
agacuaaggugg

SEQ ID NO: 427537 - RNA, 15 nt, Homo sapiens
agacuacaauuccug

SEQ ID NO: 427538 - RNA, 16 nt, Homo sapiens
agacuagacuacucaa

SEQ ID NO: 427539 - RNA, 23 nt, Homo sapiens
agacuauuaauaaauaagacugu

SEQ ID NO: 427540 - RNA, 13 nt, Homo sapiens
agacuccaugaga

SEQ ID NO: 427541 - RNA, 17 nt, Homo sapiens
agacucgagagggcuga

SEQ ID NO: 427542 - RNA, 13 nt, Homo sapiens
agacugaauuuaa

SEQ ID NO: 427543 - RNA, 18 nt, Homo sapiens
agacuggaacacaaccau

SEQ ID NO: 427544 - RNA, 17 nt, Homo sapiens
agacuggcagccaggga

SEQ ID NO: 427545 - RNA, 14 nt, Homo sapiens
agacuguacuggcc

SEQ ID NO: 427546 - RNA, 20 nt, Homo sapiens
agacugugacaacugucuaa

SEQ ID NO: 427547 - RNA, 14 nt, Homo sapiens
agggaauccagcuc

SEQ ID NO: 427548 - RNA, 22 nt, Homo sapiens
agggacagcaugccccuuggcu

SEQ ID NO: 427549 - RNA, 14 nt, Homo sapiens
agggacagccaaaa

SEQ ID NO: 427550 - RNA, 18 nt, Homo sapiens
agggaccaaggaccccuc

SEQ ID NO: 427551 - RNA, 14 nt, Homo sapiens
agggaccagguguc

SEQ ID NO: 427552 - RNA, 22 nt, Homo sapiens
agggacugguccaggcaugggu

SEQ ID NO: 427553 - RNA, 24 nt, Homo sapiens
agggacuucccuagaagucuucau

SEQ ID NO: 427554 - RNA, 21 nt, Homo sapiens
agggagaguuggggaaggcaa

SEQ ID NO: 427555 - RNA, 21 nt, Homo sapiens
agggagcaacucuccacucca

SEQ ID NO: 427556 - RNA, 16 nt, Homo sapiens
agggagguuugugaga

SEQ ID NO: 427557 - RNA, 14 nt, Homo sapiens
agggauaagcaaaa

SEQ ID NO: 427558 - RNA, 15 nt, Homo sapiens
agggauaagccagcu

SEQ ID NO: 427559 - RNA, 21 nt, Homo sapiens
agggauagaggggggcugccu

SEQ ID NO: 427560 - RNA, 15 nt, Homo sapiens
agggaucuggggaag

SEQ ID NO: 427561 - RNA, 13 nt, Homo sapiens
agggaugcagugc

SEQ ID NO: 427562 - RNA, 19 nt, Homo sapiens
agggaugggagaguggcuu

SEQ ID NO: 427563 - RNA, 16 nt, Homo sapiens
agggauuccccuaacc

SEQ ID NO: 427564 - RNA, 23 nt, Homo sapiens
agggcacucucugccagcuccac

SEQ ID NO: 427565 - RNA, 15 nt, Homo sapiens
agggcacugcugcug

SEQ ID NO: 427566 - RNA, 18 nt, Homo sapiens
agggcacugcugcugccu

SEQ ID NO: 427567 - RNA, 16 nt, Homo sapiens
agggcagaggugauca

SEQ ID NO: 427568 - RNA, 18 nt, Homo sapiens
agggcagcuucagucucu

SEQ ID NO: 427569 - RNA, 17 nt, Homo sapiens
agggcaggguucuagaa

SEQ ID NO: 427570 - RNA, 14 nt, Homo sapiens
agggcaucaucuau

SEQ ID NO: 427571 - RNA, 18 nt, Homo sapiens
agggcauccaacugagaa

SEQ ID NO: 427572 - RNA, 16 nt, Homo sapiens
agggcauguugggaua

SEQ ID NO: 427573 - RNA, 15 nt, Homo sapiens
agggcccacuuguau

SEQ ID NO: 427574 - RNA, 15 nt, Homo sapiens
agggcccgaccuggg

SEQ ID NO: 427575 - RNA, 14 nt, Homo sapiens
agggccgcccgggc

SEQ ID NO: 427576 - RNA, 20 nt, Homo sapiens
agggccuucuccacagggac

SEQ ID NO: 427577 - RNA, 14 nt, Homo sapiens
agggcucagcuccu

SEQ ID NO: 427578 - RNA, 14 nt, Homo sapiens
agggcucuuugaug

SEQ ID NO: 427579 - RNA, 19 nt, Homo sapiens
agggcugccaccaagguga

SEQ ID NO: 427580 - RNA, 22 nt, Homo sapiens
agggcugggcagguccugggga

SEQ ID NO: 427581 - RNA, 21 nt, Homo sapiens
agggcuucugccuaagccucu

SEQ ID NO: 427582 - RNA, 22 nt, Homo sapiens
aggggaucuaaaaggaggacag

SEQ ID NO: 427583 - RNA, 17 nt, Homo sapiens
aggggccucuggcugcc

SEQ ID NO: 427584 - RNA, 12 nt, Homo sapiens
aggggccuggaa

SEQ ID NO: 427585 - RNA, 14 nt, Homo sapiens
aggggcuggcacug

SEQ ID NO: 427586 - RNA, 18 nt, Homo sapiens
agggggcaugaagcacau

SEQ ID NO: 427587 - RNA, 15 nt, Homo sapiens
ccuuuagcuuucuaa

SEQ ID NO: 427588 - RNA, 20 nt, Homo sapiens
ccuuuaggaagguauguguc

SEQ ID NO: 427589 - RNA, 21 nt, Homo sapiens
ccuuuaucaaaaaaagacuca

SEQ ID NO: 427590 - RNA, 22 nt, Homo sapiens
ccuuuauuaaugaacugugaca

SEQ ID NO: 427591 - RNA, 23 nt, Homo sapiens
ccuuuauuaaugaacugugacag

SEQ ID NO: 427592 - RNA, 19 nt, Homo sapiens
ccuuuauuccuucauuuca

SEQ ID NO: 427593 - RNA, 20 nt, Homo sapiens
ccuuucagaugucuucugcc

SEQ ID NO: 427594 - RNA, 11 nt, Homo sapiens
ccuuuccauaa

SEQ ID NO: 427595 - RNA, 16 nt, Homo sapiens
ccuuuccauaaggaau

SEQ ID NO: 427596 - RNA, 22 nt, Homo sapiens
ccuuuccugaucacuaugcauu

SEQ ID NO: 427597 - RNA, 18 nt, Homo sapiens
ccuuucuugacaaaaccu

SEQ ID NO: 427598 - RNA, 18 nt, Homo sapiens
ccuuucuuuugaaaugcc

SEQ ID NO: 427599 - RNA, 19 nt, Homo sapiens
ccuuugaauaaaaaugcac

SEQ ID NO: 427600 - RNA, 23 nt, Homo sapiens
ccuuugagcccacaaagccuuau

SEQ ID NO: 427601 - RNA, 19 nt, Homo sapiens
ccuuugaggcaaaggccag

SEQ ID NO: 427602 - RNA, 15 nt, Homo sapiens
ccuuugcaaugcaag

SEQ ID NO: 427603 - RNA, 21 nt, Homo sapiens
ccuuugcucuugggaagacca

SEQ ID NO: 427604 - RNA, 22 nt, Homo sapiens
ccuuugggaggcagcaucaggg

SEQ ID NO: 427605 - RNA, 22 nt, Homo sapiens
ccuuugggccucugcuucucuc

SEQ ID NO: 427606 - RNA, 18 nt, Homo sapiens
ccuuugugguuacaguuu

SEQ ID NO: 427607 - RNA, 11 nt, Homo sapiens
ccuuuguguaa

SEQ ID NO: 427608 - RNA, 19 nt, Homo sapiens
ccuuuuaaauggcaugaca

SEQ ID NO: 427609 - RNA, 14 nt, Homo sapiens
ccuuuucaugauuu

SEQ ID NO: 427610 - RNA, 21 nt, Homo sapiens
ccuuuucuauuccuucuggcc

SEQ ID NO: 427611 - RNA, 14 nt, Homo sapiens
ccuuuugauauuaa

SEQ ID NO: 427612 - RNA, 11 nt, Homo sapiens
ccuuuugcccg

SEQ ID NO: 427613 - RNA, 13 nt, Homo sapiens
ccuuuuuauaggu

SEQ ID NO: 427614 - RNA, 19 nt, Homo sapiens
ccuuuuuuauacaggaaaa

SEQ ID NO: 427615 - RNA, 19 nt, Homo sapiens
cgaaaagaggggaagagac

SEQ ID NO: 427616 - RNA, 17 nt, Homo sapiens
cgaaaaggauaugcagu

SEQ ID NO: 427617 - RNA, 14 nt, Homo sapiens
cgaauggcagcaua

SEQ ID NO: 427618 - RNA, 18 nt, Homo sapiens
cgaauguuagauuccucu

SEQ ID NO: 427619 - RNA, 19 nt, Homo sapiens
cgacagaaaaccucaaggg

SEQ ID NO: 427620 - RNA, 22 nt, Homo sapiens
cgacugccugugaaguggaugg

SEQ ID NO: 427621 - RNA, 16 nt, Homo sapiens
cgagcacuguccagua

SEQ ID NO: 427622 - RNA, 15 nt, Homo sapiens
cgaggacgcauucca

SEQ ID NO: 427623 - RNA, 21 nt, Homo sapiens
cgaggagugccguguguugca

SEQ ID NO: 427624 - RNA, 17 nt, Homo sapiens
cgaggcgaggcugccuc

SEQ ID NO: 427625 - RNA, 18 nt, Homo sapiens
cgagggaugggauuucau

SEQ ID NO: 427626 - RNA, 22 nt, Homo sapiens
cgagggaugggauuucauguaa

SEQ ID NO: 427627 - RNA, 22 nt, Homo sapiens
cgagggcacuaccgggggcucu

SEQ ID NO: 427628 - RNA, 14 nt, Homo sapiens
cgagggcggccagg

SEQ ID NO: 427629 - RNA, 19 nt, Homo sapiens
cgaggugguagcucugagc

SEQ ID NO: 427630 - RNA, 15 nt, Homo sapiens
cgaguaacugagauu

SEQ ID NO: 427631 - RNA, 20 nt, Homo sapiens
cgaguggauuguaggugcaa

SEQ ID NO: 427632 - RNA, 15 nt, Homo sapiens
cgaguggccauggca

SEQ ID NO: 427633 - RNA, 11 nt, Homo sapiens
cgaguuacaga

SEQ ID NO: 427634 - RNA, 14 nt, Homo sapiens
cgaguuacagacaa

SEQ ID NO: 427635 - RNA, 15 nt, Homo sapiens
cgaguuacagacaaa

SEQ ID NO: 427636 - RNA, 13 nt, Homo sapiens
cgauaaccacagg

SEQ ID NO: 427637 - RNA, 13 nt, Homo sapiens
cgaucacucuggu

SEQ ID NO: 427638 - RNA, 18 nt, Homo sapiens
cgaucauggcucacugca

SEQ ID NO: 427639 - RNA, 12 nt, Homo sapiens
cgaugugcaagu

SEQ ID NO: 427640 - RNA, 19 nt, Homo sapiens
cgauugaaagaaccagaga

SEQ ID NO: 427641 - RNA, 17 nt, Homo sapiens
cgcaaaacccacugacc

SEQ ID NO: 427642 - RNA, 13 nt, Homo sapiens
cgcacgcacacac

SEQ ID NO: 427643 - RNA, 21 nt, Homo sapiens
cgcagaaaacaagaugagauu

SEQ ID NO: 427644 - RNA, 14 nt, Homo sapiens
cgcaggucaccuua

SEQ ID NO: 427645 - RNA, 21 nt, Homo sapiens
cgcagguuaugucagcagcuc

SEQ ID NO: 427646 - RNA, 22 nt, Homo sapiens
cgcaugugucuguauucauaca

SEQ ID NO: 427647 - RNA, 15 nt, Homo sapiens
cgccauggccgugua

SEQ ID NO: 427648 - RNA, 12 nt, Homo sapiens
cgcccucaggcu

SEQ ID NO: 427649 - RNA, 13 nt, Homo sapiens
cgccucgcuucac

SEQ ID NO: 427650 - RNA, 22 nt, Homo sapiens
cgccuguaaucccagcacuuug

SEQ ID NO: 427651 - RNA, 21 nt, Homo sapiens
cgccuugccuccucacccacc

SEQ ID NO: 427652 - RNA, 13 nt, Homo sapiens
cgcgcaccgccca

SEQ ID NO: 427653 - RNA, 18 nt, Homo sapiens
cgcgggaggcaccagcuc

SEQ ID NO: 427654 - RNA, 16 nt, Homo sapiens
cgcuaccucuccagcc

SEQ ID NO: 427655 - RNA, 17 nt, Homo sapiens
cgcucacaccuguaauc

SEQ ID NO: 427656 - RNA, 13 nt, Homo sapiens
cgcuccccugaga

SEQ ID NO: 427657 - RNA, 16 nt, Homo sapiens
cgcuccucugccuugg

SEQ ID NO: 427658 - RNA, 22 nt, Homo sapiens
cgcucugaauuggauccagggg

SEQ ID NO: 427659 - RNA, 16 nt, Homo sapiens
cgcugacugccaccca

SEQ ID NO: 427660 - RNA, 14 nt, Homo sapiens
cgcugcgugccauc

SEQ ID NO: 427661 - RNA, 17 nt, Homo sapiens
cgcugcucagaccugug

SEQ ID NO: 427662 - RNA, 18 nt, Homo sapiens
cgcugcucuuaugccauu

SEQ ID NO: 427663 - RNA, 23 nt, Homo sapiens
cgcuguccaaguguuucuuguua

SEQ ID NO: 427664 - RNA, 18 nt, Homo sapiens
cgcuguguccccgcgggc

SEQ ID NO: 427665 - RNA, 16 nt, Homo sapiens
cggaacucuucaucuu

SEQ ID NO: 427666 - RNA, 18 nt, Homo sapiens
cggaagcugucgacuuca

SEQ ID NO: 427667 - RNA, 23 nt, Homo sapiens
cggaagcugucgacuucaugaca

SEQ ID NO: 427668 - RNA, 18 nt, Homo sapiens
cggaagugaccacagaag

SEQ ID NO: 427669 - RNA, 21 nt, Homo sapiens
cggaauccagugcuuccacag

SEQ ID NO: 427670 - RNA, 17 nt, Homo sapiens
cggacugcccccagaaa

SEQ ID NO: 427671 - RNA, 16 nt, Homo sapiens
cggagaucuccuugcc

SEQ ID NO: 427672 - RNA, 19 nt, Homo sapiens
cggagccaaugaacagcuc

SEQ ID NO: 427673 - RNA, 15 nt, Homo sapiens
cggaggagguggaca

SEQ ID NO: 427674 - RNA, 22 nt, Homo sapiens
cggagggccccugcgugggggc

SEQ ID NO: 427675 - RNA, 13 nt, Homo sapiens
cggaguugugcac

SEQ ID NO: 427676 - RNA, 21 nt, Homo sapiens
cggaucuggggcucugggaua

SEQ ID NO: 427677 - RNA, 19 nt, Homo sapiens
cuacaaaaugacuaggaua

SEQ ID NO: 427678 - RNA, 19 nt, Homo sapiens
cuacaauccuaccuuuuga

SEQ ID NO: 427679 - RNA, 14 nt, Homo sapiens
cuacacaauuuaau

SEQ ID NO: 427680 - RNA, 12 nt, Homo sapiens
cuacacacaaac

SEQ ID NO: 427681 - RNA, 14 nt, Homo sapiens
cuacacacaaacca

SEQ ID NO: 427682 - RNA, 15 nt, Homo sapiens
cuacacaccauuucu

SEQ ID NO: 427683 - RNA, 20 nt, Homo sapiens
cuacacccuuggacuugagg

SEQ ID NO: 427684 - RNA, 13 nt, Homo sapiens
cuacaccuguugc

SEQ ID NO: 427685 - RNA, 13 nt, Homo sapiens
cuacagagcagac

SEQ ID NO: 427686 - RNA, 19 nt, Homo sapiens
cuacagagcagacaguuaa

SEQ ID NO: 427687 - RNA, 13 nt, Homo sapiens
cuacaguauauaa

SEQ ID NO: 427688 - RNA, 14 nt, Homo sapiens
cuacaugacugggc

SEQ ID NO: 427689 - RNA, 22 nt, Homo sapiens
cuacaugugccaccaacauaaa

SEQ ID NO: 427690 - RNA, 12 nt, Homo sapiens
cuacauuugcau

SEQ ID NO: 427691 - RNA, 16 nt, Homo sapiens
cuaccaaccucugaag

SEQ ID NO: 427692 - RNA, 18 nt, Homo sapiens
cuaccaagugaccauaaa

SEQ ID NO: 427693 - RNA, 13 nt, Homo sapiens
cuaccacaguguc

SEQ ID NO: 427694 - RNA, 15 nt, Homo sapiens
cuaccacagugucug

SEQ ID NO: 427695 - RNA, 14 nt, Homo sapiens
cuaccacucaggaa

SEQ ID NO: 427696 - RNA, 13 nt, Homo sapiens
cuaccacuuugaa

SEQ ID NO: 427697 - RNA, 13 nt, Homo sapiens
cuaccagauuuga

SEQ ID NO: 427698 - RNA, 15 nt, Homo sapiens
cuaccaggcuguaaa

SEQ ID NO: 427699 - RNA, 19 nt, Homo sapiens
cuacccacagagcaaguga

SEQ ID NO: 427700 - RNA, 22 nt, Homo sapiens
cuacccgcccgcguccaacccc

SEQ ID NO: 427701 - RNA, 12 nt, Homo sapiens
cuaccucaaggg

SEQ ID NO: 427702 - RNA, 14 nt, Homo sapiens
cuaccucagccucc

SEQ ID NO: 427703 - RNA, 13 nt, Homo sapiens
cuaccucuuccag

SEQ ID NO: 427704 - RNA, 13 nt, Homo sapiens
cuaccugccucag

SEQ ID NO: 427705 - RNA, 17 nt, Homo sapiens
cuaccuuuguccaggcc

SEQ ID NO: 427706 - RNA, 15 nt, Homo sapiens
cuacgaaagcacagu

SEQ ID NO: 427707 - RNA, 20 nt, Homo sapiens
cuacgaagaaagacuccuuu

SEQ ID NO: 427708 - RNA, 17 nt, Homo sapiens
cuacgaauauagagggu

SEQ ID NO: 427709 - RNA, 17 nt, Homo sapiens
cuacguaaucucacuua

SEQ ID NO: 427710 - RNA, 13 nt, Homo sapiens
cuacgugcuccuc

SEQ ID NO: 427711 - RNA, 21 nt, Homo sapiens
cuacuaaagugccuaccccag

SEQ ID NO: 427712 - RNA, 16 nt, Homo sapiens
cuacuacaugugacug

SEQ ID NO: 427713 - RNA, 22 nt, Homo sapiens
cuacuagagucugaacagcugu

SEQ ID NO: 427714 - RNA, 13 nt, Homo sapiens
cuacuauaugcau

SEQ ID NO: 427715 - RNA, 13 nt, Homo sapiens
cuacuauucuguu

SEQ ID NO: 427716 - RNA, 21 nt, Homo sapiens
cuacuccucugcagugccuug

SEQ ID NO: 427717 - RNA, 17 nt, Homo sapiens
cuacucgaguuacagac

SEQ ID NO: 427718 - RNA, 14 nt, Homo sapiens
cuacucuccagcuu

SEQ ID NO: 427719 - RNA, 14 nt, Homo sapiens
cuacucucuugcca

SEQ ID NO: 427720 - RNA, 14 nt, Homo sapiens
cuacucugugccag

SEQ ID NO: 427721 - RNA, 18 nt, Homo sapiens
cuacugaaauuuacacaa

SEQ ID NO: 427722 - RNA, 21 nt, Homo sapiens
cuacugaacaguccaucuucu

SEQ ID NO: 427723 - RNA, 12 nt, Homo sapiens
cuacugaucaac

SEQ ID NO: 427724 - RNA, 17 nt, Homo sapiens
aguaugaagacacuguc

SEQ ID NO: 427725 - RNA, 15 nt, Homo sapiens
aguaugaaugcagug

SEQ ID NO: 427726 - RNA, 14 nt, Homo sapiens
aguaugugugguuu

SEQ ID NO: 427727 - RNA, 21 nt, Homo sapiens
aguauuaacuauuaguguuaa

SEQ ID NO: 427728 - RNA, 23 nt, Homo sapiens
aguauuagaagcagaucauuucc

SEQ ID NO: 427729 - RNA, 15 nt, Homo sapiens
aguauucaucugugu

SEQ ID NO: 427730 - RNA, 14 nt, Homo sapiens
aguauucucagagc

SEQ ID NO: 427731 - RNA, 12 nt, Homo sapiens
aguauugcuaau

SEQ ID NO: 427732 - RNA, 15 nt, Homo sapiens
aguauuguggcugca

SEQ ID NO: 427733 - RNA, 15 nt, Homo sapiens
agucaaaacacuugu

SEQ ID NO: 427734 - RNA, 23 nt, Homo sapiens
agucaauaaaccugggcaaguga

SEQ ID NO: 427735 - RNA, 16 nt, Homo sapiens
agucacagccauuuca

SEQ ID NO: 427736 - RNA, 22 nt, Homo sapiens
agucacaggucuuuucuuggcg

SEQ ID NO: 427737 - RNA, 17 nt, Homo sapiens
agucacccuucugggca

SEQ ID NO: 427738 - RNA, 16 nt, Homo sapiens
agucaccgaagguccu

SEQ ID NO: 427739 - RNA, 13 nt, Homo sapiens
agucaccugccca

SEQ ID NO: 427740 - RNA, 13 nt, Homo sapiens
agucaccuuccag

SEQ ID NO: 427741 - RNA, 23 nt, Homo sapiens
agucacugcacagugcaucucag

SEQ ID NO: 427742 - RNA, 13 nt, Homo sapiens
agucaggauuuau

SEQ ID NO: 427743 - RNA, 15 nt, Homo sapiens
agucaggcuucucuu

SEQ ID NO: 427744 - RNA, 19 nt, Homo sapiens
agucaguugcaaauuuuag

SEQ ID NO: 427745 - RNA, 14 nt, Homo sapiens
agucauauaccuau

SEQ ID NO: 427746 - RNA, 20 nt, Homo sapiens
agucauauugaggcauucaa

SEQ ID NO: 427747 - RNA, 13 nt, Homo sapiens
agucaucaaagau

SEQ ID NO: 427748 - RNA, 14 nt, Homo sapiens
agucaucaucucau

SEQ ID NO: 427749 - RNA, 16 nt, Homo sapiens
agucaucucauuccac

SEQ ID NO: 427750 - RNA, 22 nt, Homo sapiens
agucauggagaaucugcugcau

SEQ ID NO: 427751 - RNA, 20 nt, Homo sapiens
agucaugguuguggcgugug

SEQ ID NO: 427752 - RNA, 19 nt, Homo sapiens
agucauuguaaucuuucau

SEQ ID NO: 427753 - RNA, 21 nt, Homo sapiens
agucauugucgcucagcaaua

SEQ ID NO: 427754 - RNA, 22 nt, Homo sapiens
aguccaaauaacaaguaccaaa

SEQ ID NO: 427755 - RNA, 19 nt, Homo sapiens
aguccacccccauugugaa

SEQ ID NO: 427756 - RNA, 22 nt, Homo sapiens
aguccacucugagucgauuaac

SEQ ID NO: 427757 - RNA, 22 nt, Homo sapiens
aguccacuuguucuguacuugu

SEQ ID NO: 427758 - RNA, 16 nt, Homo sapiens
aguccacuuuccucuc

SEQ ID NO: 427759 - RNA, 16 nt, Homo sapiens
aguccagauauuucac

SEQ ID NO: 427760 - RNA, 17 nt, Homo sapiens
aguccagauauuucaca

SEQ ID NO: 427761 - RNA, 12 nt, Homo sapiens
aguccagcacug

SEQ ID NO: 427762 - RNA, 15 nt, Homo sapiens
aguccagcacuggaa

SEQ ID NO: 427763 - RNA, 12 nt, Homo sapiens
aguccaguguga

SEQ ID NO: 427764 - RNA, 16 nt, Homo sapiens
aguccagugugacuuu

SEQ ID NO: 427765 - RNA, 16 nt, Homo sapiens
agucccaguauucuca

SEQ ID NO: 427766 - RNA, 22 nt, Homo sapiens
agucccuucucucuuccuugcu

SEQ ID NO: 427767 - RNA, 17 nt, Homo sapiens
aguccuauucuauugca

SEQ ID NO: 427768 - RNA, 15 nt, Homo sapiens
aguccucaguucucu

SEQ ID NO: 427769 - RNA, 16 nt, Homo sapiens
aguccugucaccaagg

SEQ ID NO: 427770 - RNA, 23 nt, Homo sapiens
agucgugccuguuugcuuagcau

SEQ ID NO: 427771 - RNA, 21 nt, Homo sapiens
agucucacuuuuauugauaaa

SEQ ID NO: 427772 - RNA, 22 nt, Homo sapiens
agucucacuuuuauugauaaaa

SEQ ID NO: 427773 - RNA, 17 nt, Homo sapiens
agucucuuaauucugau

SEQ ID NO: 427774 - RNA, 22 nt, Homo sapiens
agucucuuuaaucuucaguuuu

SEQ ID NO: 427775 - RNA, 13 nt, Homo sapiens
agucugaacagcu

SEQ ID NO: 427776 - RNA, 13 nt, Homo sapiens
agucugaagcugg

SEQ ID NO: 427777 - RNA, 18 nt, Homo sapiens
agucugcuuaccaaaaca

SEQ ID NO: 427778 - RNA, 17 nt, Homo sapiens
agucuggccugccaggc

SEQ ID NO: 427779 - RNA, 21 nt, Homo sapiens
agucugggauguagaacuuca

SEQ ID NO: 427780 - RNA, 20 nt, Homo sapiens
agucugugaauaaagccaca

SEQ ID NO: 427781 - RNA, 18 nt, Homo sapiens
agucuugauagcaagcgu

SEQ ID NO: 427782 - RNA, 12 nt, Homo sapiens
agucuuugcuca

SEQ ID NO: 427783 - RNA, 18 nt, Homo sapiens
agucuuuguuuacaugag

SEQ ID NO: 427784 - RNA, 14 nt, Homo sapiens
agugaaaaguagag

SEQ ID NO: 427785 - RNA, 15 nt, Homo sapiens
agugaaaccaugacu

SEQ ID NO: 427786 - RNA, 18 nt, Homo sapiens
agugaaagagaguaccau

SEQ ID NO: 427787 - RNA, 12 nt, Homo sapiens
agugaacauauc

SEQ ID NO: 427788 - RNA, 24 nt, Homo sapiens
agugaaugaaagucuugugacuag

SEQ ID NO: 427789 - RNA, 12 nt, Homo sapiens
agugacagaucc

SEQ ID NO: 427790 - RNA, 18 nt, Homo sapiens
agugacaggacuuucauu

SEQ ID NO: 427791 - RNA, 22 nt, Homo sapiens
agugacuugugucccaugaucc

SEQ ID NO: 427792 - RNA, 13 nt, Homo sapiens
agugagaaacuga

SEQ ID NO: 427793 - RNA, 13 nt, Homo sapiens
agugagagcuucc

SEQ ID NO: 427794 - RNA, 11 nt, Homo sapiens
agugagcaaac

SEQ ID NO: 427795 - RNA, 22 nt, Homo sapiens
agugagcacucacgcccuaagc

SEQ ID NO: 427796 - RNA, 22 nt, Homo sapiens
agugagccccuccccagccagc

SEQ ID NO: 427797 - RNA, 10 nt, Homo sapiens
agugagcucg

SEQ ID NO: 427798 - RNA, 22 nt, Homo sapiens
agugagggucuucuuacaugca

SEQ ID NO: 427799 - RNA, 22 nt, Homo sapiens
agugauaucccccagccucaag

SEQ ID NO: 427800 - RNA, 17 nt, Homo sapiens
agugauauuguggguaa

SEQ ID NO: 427801 - RNA, 12 nt, Homo sapiens
agugaugggagu

SEQ ID NO: 427802 - RNA, 15 nt, Homo sapiens
agugauguguggucu

SEQ ID NO: 427803 - RNA, 22 nt, Homo sapiens
agugcaacagcacuggcucucu

SEQ ID NO: 427804 - RNA, 19 nt, Homo sapiens
agugcaaccacacaccuca

SEQ ID NO: 427805 - RNA, 12 nt, Homo sapiens
agugcaccacuu

SEQ ID NO: 427806 - RNA, 18 nt, Homo sapiens
agugcaccucucaucagc

SEQ ID NO: 427807 - RNA, 19 nt, Homo sapiens
agugcagaccccuuggcca

SEQ ID NO: 427808 - RNA, 17 nt, Homo sapiens
agugcagaggcugagca

SEQ ID NO: 427809 - RNA, 17 nt, Homo sapiens
cuauauugcacugugac

SEQ ID NO: 427810 - RNA, 21 nt, Homo sapiens
cuauauuugcuuuuugcuaac

SEQ ID NO: 427811 - RNA, 15 nt, Homo sapiens
cuaucaccugucauc

SEQ ID NO: 427812 - RNA, 20 nt, Homo sapiens
cuauccagccgcaaauccau

SEQ ID NO: 427813 - RNA, 17 nt, Homo sapiens
cuaugacauacauggaa

SEQ ID NO: 427814 - RNA, 15 nt, Homo sapiens
cuaugacuguguuua

SEQ ID NO: 427815 - RNA, 16 nt, Homo sapiens
cuaugagagauagcuu

SEQ ID NO: 427816 - RNA, 21 nt, Homo sapiens
cuaugauuaaaagccacuguu

SEQ ID NO: 427817 - RNA, 16 nt, Homo sapiens
cuaugccugccucaaa

SEQ ID NO: 427818 - RNA, 21 nt, Homo sapiens
cuaugggagauuaaaaccaga

SEQ ID NO: 427819 - RNA, 21 nt, Homo sapiens
cuauggguggggcacuccuuu

SEQ ID NO: 427820 - RNA, 20 nt, Homo sapiens
cuauuaaagugauuucauuc

SEQ ID NO: 427821 - RNA, 19 nt, Homo sapiens
cuauuaaaucuugcaacug

SEQ ID NO: 427822 - RNA, 22 nt, Homo sapiens
cuauuaagauacuuagauuaga

SEQ ID NO: 427823 - RNA, 12 nt, Homo sapiens
cuauuacuauua

SEQ ID NO: 427824 - RNA, 16 nt, Homo sapiens
cuauucagacaagcaa

SEQ ID NO: 427825 - RNA, 19 nt, Homo sapiens
cuauucccacuuucauuca

SEQ ID NO: 427826 - RNA, 19 nt, Homo sapiens
cuauucccuuugacuucag

SEQ ID NO: 427827 - RNA, 13 nt, Homo sapiens
cuauuccuaggcc

SEQ ID NO: 427828 - RNA, 13 nt, Homo sapiens
cuauucuauugca

SEQ ID NO: 427829 - RNA, 17 nt, Homo sapiens
cuauucuugauguaaaa

SEQ ID NO: 427830 - RNA, 14 nt, Homo sapiens
cuauucuuugacca

SEQ ID NO: 427831 - RNA, 14 nt, Homo sapiens
cuauugcuaguacu

SEQ ID NO: 427832 - RNA, 19 nt, Homo sapiens
cuauuguagauaacacuau

SEQ ID NO: 427833 - RNA, 20 nt, Homo sapiens
cuauuguauuauuuggaguu

SEQ ID NO: 427834 - RNA, 23 nt, Homo sapiens
cuauuguugaugggcacuugaga

SEQ ID NO: 427835 - RNA, 17 nt, Homo sapiens
cuauuucaggcacauca

SEQ ID NO: 427836 - RNA, 20 nt, Homo sapiens
cuauuugagauugaugacaa

SEQ ID NO: 427837 - RNA, 18 nt, Homo sapiens
cuauuuggaaagcacugg

SEQ ID NO: 427838 - RNA, 21 nt, Homo sapiens
cuauuuuuuacuacauaauua

SEQ ID NO: 427839 - RNA, 16 nt, Homo sapiens
cucaaaaggaaaccaa

SEQ ID NO: 427840 - RNA, 20 nt, Homo sapiens
cucaaaaugugccgucuuug

SEQ ID NO: 427841 - RNA, 15 nt, Homo sapiens
cucaaacacagagag

SEQ ID NO: 427842 - RNA, 22 nt, Homo sapiens
cucaaacagccacgagguggua

SEQ ID NO: 427843 - RNA, 18 nt, Homo sapiens
cucaaacccccagccuca

SEQ ID NO: 427844 - RNA, 21 nt, Homo sapiens
cucaaacccuguggggccuga

SEQ ID NO: 427845 - RNA, 22 nt, Homo sapiens
cucaaaccuaccacucaggaau

SEQ ID NO: 427846 - RNA, 16 nt, Homo sapiens
cucaaacuuccaguca

SEQ ID NO: 427847 - RNA, 22 nt, Homo sapiens
cucaacaagggagagaccucau

SEQ ID NO: 427848 - RNA, 18 nt, Homo sapiens
cucaacguugcuccccau

SEQ ID NO: 427849 - RNA, 12 nt, Homo sapiens
cucaacucccag

SEQ ID NO: 427850 - RNA, 22 nt, Homo sapiens
cucaacucccagccaucuguau

SEQ ID NO: 427851 - RNA, 22 nt, Homo sapiens
cucaacuuacauaugucuucaa

SEQ ID NO: 427852 - RNA, 16 nt, Homo sapiens
cucaagaugaaggcaa

SEQ ID NO: 427853 - RNA, 16 nt, Homo sapiens
cucaagcaaccaugaa

SEQ ID NO: 427854 - RNA, 14 nt, Homo sapiens
cucaagcacugaca

SEQ ID NO: 427855 - RNA, 15 nt, Homo sapiens
cucaaggacuugaaa

SEQ ID NO: 427856 - RNA, 21 nt, Homo sapiens
cucaaggcugcagugagccaa

SEQ ID NO: 427857 - RNA, 17 nt, Homo sapiens
cucaagggcuuucccac

SEQ ID NO: 427858 - RNA, 14 nt, Homo sapiens
agugguggugaaca

SEQ ID NO: 427859 - RNA, 22 nt, Homo sapiens
agugguggugaacagaacaaaa

SEQ ID NO: 427860 - RNA, 23 nt, Homo sapiens
agugguggugaacagaacaaaag

SEQ ID NO: 427861 - RNA, 20 nt, Homo sapiens
agugguguuccaugacuuca

SEQ ID NO: 427862 - RNA, 14 nt, Homo sapiens
agugucacugagcu

SEQ ID NO: 427863 - RNA, 18 nt, Homo sapiens
agugucacugagcugugu

SEQ ID NO: 427864 - RNA, 22 nt, Homo sapiens
agugucacuuuuuuccugucaa

SEQ ID NO: 427865 - RNA, 15 nt, Homo sapiens
agugucccuuaccug

SEQ ID NO: 427866 - RNA, 14 nt, Homo sapiens
aguguccucuugcu

SEQ ID NO: 427867 - RNA, 17 nt, Homo sapiens
aguguccucuugcucaa

SEQ ID NO: 427868 - RNA, 18 nt, Homo sapiens
aguguccucuugcucaaa

SEQ ID NO: 427869 - RNA, 13 nt, Homo sapiens
agugucucagucc

SEQ ID NO: 427870 - RNA, 16 nt, Homo sapiens
agugucugugccaugg

SEQ ID NO: 427871 - RNA, 14 nt, Homo sapiens
agugucuugaaugu

SEQ ID NO: 427872 - RNA, 14 nt, Homo sapiens
agugugccugcuau

SEQ ID NO: 427873 - RNA, 15 nt, Homo sapiens
agugugcugcaugga

SEQ ID NO: 427874 - RNA, 22 nt, Homo sapiens
aguguggggcgggggucuauac

SEQ ID NO: 427875 - RNA, 15 nt, Homo sapiens
aguguggucccucca

SEQ ID NO: 427876 - RNA, 19 nt, Homo sapiens
aguguggugggaggggugu

SEQ ID NO: 427877 - RNA, 13 nt, Homo sapiens
agugugugugcgu

SEQ ID NO: 427878 - RNA, 15 nt, Homo sapiens
aguguuaagugacau

SEQ ID NO: 427879 - RNA, 22 nt, Homo sapiens
aguguuaucagucauaacuaaa

SEQ ID NO: 427880 - RNA, 13 nt, Homo sapiens
aguguucaagaaa

SEQ ID NO: 427881 - RNA, 17 nt, Homo sapiens
aguguuccucaccaaua

SEQ ID NO: 427882 - RNA, 17 nt, Homo sapiens
aguguucuccacuaaua

SEQ ID NO: 427883 - RNA, 22 nt, Homo sapiens
aguguugcccaggcuggucuca

SEQ ID NO: 427884 - RNA, 16 nt, Homo sapiens
aguguuuagcauuaaa

SEQ ID NO: 427885 - RNA, 17 nt, Homo sapiens
aguguuuugcaagggaa

SEQ ID NO: 427886 - RNA, 18 nt, Homo sapiens
aguguuuuugcaggugag

SEQ ID NO: 427887 - RNA, 15 nt, Homo sapiens
aguguuuuuuauuca

SEQ ID NO: 427888 - RNA, 21 nt, Homo sapiens
aguuaaauagaguauaugcac

SEQ ID NO: 427889 - RNA, 19 nt, Homo sapiens
aguuacuauccuggcuuug

SEQ ID NO: 427890 - RNA, 17 nt, Homo sapiens
aguuacugaucacagga

SEQ ID NO: 427891 - RNA, 11 nt, Homo sapiens
aguuacuugaa

SEQ ID NO: 427892 - RNA, 22 nt, Homo sapiens
aguuauaaaucaaugucacuua

SEQ ID NO: 427893 - RNA, 12 nt, Homo sapiens
aguuauaaccaa

SEQ ID NO: 427894 - RNA, 13 nt, Homo sapiens
aguuauaaccaac

SEQ ID NO: 427895 - RNA, 17 nt, Homo sapiens
aguuauuuacuuuuacc

SEQ ID NO: 427896 - RNA, 12 nt, Homo sapiens
aguucaaauacu

SEQ ID NO: 427897 - RNA, 20 nt, Homo sapiens
aguucaaauuuugcauugug

SEQ ID NO: 427898 - RNA, 18 nt, Homo sapiens
aguucaauugugucugug

SEQ ID NO: 427899 - RNA, 20 nt, Homo sapiens
aguucaccuacccugaguga

SEQ ID NO: 427900 - RNA, 13 nt, Homo sapiens
aguucacugcaac

SEQ ID NO: 427901 - RNA, 12 nt, Homo sapiens
aguucacuuccu

SEQ ID NO: 427902 - RNA, 18 nt, Homo sapiens
aguucauagggucucuuc

SEQ ID NO: 427903 - RNA, 18 nt, Homo sapiens
aguucauauguaccaugu

SEQ ID NO: 427904 - RNA, 20 nt, Homo sapiens
aguuccauuuaaauugacuu

SEQ ID NO: 427905 - RNA, 19 nt, Homo sapiens
aguucccccaguaccucca

SEQ ID NO: 427906 - RNA, 17 nt, Homo sapiens
aguucccuuggccucag

SEQ ID NO: 427907 - RNA, 22 nt, Homo sapiens
aguuccuuaggagaugucauga

SEQ ID NO: 427908 - RNA, 14 nt, Homo sapiens
aguucuacaguuaa

SEQ ID NO: 427909 - RNA, 14 nt, Homo sapiens
aguucucauccaca

SEQ ID NO: 427910 - RNA, 19 nt, Homo sapiens
aguucugaauaacuugaag

SEQ ID NO: 427911 - RNA, 15 nt, Homo sapiens
aguucugaauguuaa

SEQ ID NO: 427912 - RNA, 22 nt, Homo sapiens
aguucuguuguguuugucaaaa

SEQ ID NO: 427913 - RNA, 21 nt, Homo sapiens
aguucuuuauaacaaaacagg

SEQ ID NO: 427914 - RNA, 13 nt, Homo sapiens
aguugaaacaaga

SEQ ID NO: 427915 - RNA, 16 nt, Homo sapiens
aguugagcacaggcaa

SEQ ID NO: 427916 - RNA, 13 nt, Homo sapiens
aguugaucaugca

SEQ ID NO: 427917 - RNA, 21 nt, Homo sapiens
aguugcaaauuuuagcguuaa

SEQ ID NO: 427918 - RNA, 23 nt, Homo sapiens
aguugcccugccaucgccuccau

SEQ ID NO: 427919 - RNA, 15 nt, Homo sapiens
aguugcuagcaacaa

SEQ ID NO: 427920 - RNA, 17 nt, Homo sapiens
aguugcuguaagcaccu

SEQ ID NO: 427921 - RNA, 21 nt, Homo sapiens
aguuggaaaaacaaaugccau

SEQ ID NO: 427922 - RNA, 23 nt, Homo sapiens
aguuggaaaaacaaaugccauau

SEQ ID NO: 427923 - RNA, 17 nt, Homo sapiens
aguuggacucucaggga

SEQ ID NO: 427924 - RNA, 14 nt, Homo sapiens
aguuggugcugcuu

SEQ ID NO: 427925 - RNA, 15 nt, Homo sapiens
aguuggugcugcuuu

SEQ ID NO: 427926 - RNA, 16 nt, Homo sapiens
aguuguaccacugcua

SEQ ID NO: 427927 - RNA, 20 nt, Homo sapiens
aguugucagcuuugacuuua

SEQ ID NO: 427928 - RNA, 18 nt, Homo sapiens
aguugugaagaggggcca

SEQ ID NO: 427929 - RNA, 20 nt, Homo sapiens
aguuguuuucccgagcaaag

SEQ ID NO: 427930 - RNA, 22 nt, Homo sapiens
aguuuaaaaaaauaacaucuga

SEQ ID NO: 427931 - RNA, 19 nt, Homo sapiens
aguuuagauuuuaaucaaa

SEQ ID NO: 427932 - RNA, 22 nt, Homo sapiens
aguuuaggacccaagguggucu

SEQ ID NO: 427933 - RNA, 20 nt, Homo sapiens
aguuuauuuuuauacuuuca

SEQ ID NO: 427934 - RNA, 18 nt, Homo sapiens
aguuucaaaauguuaaca

SEQ ID NO: 427935 - RNA, 22 nt, Homo sapiens
aguuucaaugugauucuaaugu

SEQ ID NO: 427936 - RNA, 12 nt, Homo sapiens
aguuucaggcaa

SEQ ID NO: 427937 - RNA, 20 nt, Homo sapiens
aguuucauuuaugauacaaa

SEQ ID NO: 427938 - RNA, 23 nt, Homo sapiens
aguuuccagcuaagccugaugau

SEQ ID NO: 427939 - RNA, 22 nt, Homo sapiens
aaugauuuaaauagaacuugau

SEQ ID NO: 427940 - RNA, 18 nt, Homo sapiens
aaugauuuuaucugugaa

SEQ ID NO: 427941 - RNA, 15 nt, Homo sapiens
aaugauuuugacaua

SEQ ID NO: 427942 - RNA, 21 nt, Homo sapiens
aaugauuuugacauacaggag

SEQ ID NO: 427943 - RNA, 18 nt, Homo sapiens
aaugcaauccaugccaua

SEQ ID NO: 427944 - RNA, 16 nt, Homo sapiens
aaugcaaugucuuaaa

SEQ ID NO: 427945 - RNA, 14 nt, Homo sapiens
aaugcaauguggaa

SEQ ID NO: 427946 - RNA, 18 nt, Homo sapiens
aaugcacauagcuaucaa

SEQ ID NO: 427947 - RNA, 13 nt, Homo sapiens
aaugcacugacca

SEQ ID NO: 427948 - RNA, 20 nt, Homo sapiens
aaugcagcaguaaauccaag

SEQ ID NO: 427949 - RNA, 13 nt, Homo sapiens
aaugcaugauaau

SEQ ID NO: 427950 - RNA, 13 nt, Homo sapiens
aaugcaugugauu

SEQ ID NO: 427951 - RNA, 14 nt, Homo sapiens
aaugcauucagggg

SEQ ID NO: 427952 - RNA, 14 nt, Homo sapiens
aaugcauugcuaaa

SEQ ID NO: 427953 - RNA, 19 nt, Homo sapiens
aaugcauuuuauucuuuaa

SEQ ID NO: 427954 - RNA, 15 nt, Homo sapiens
aaugccaaguaacaa

SEQ ID NO: 427955 - RNA, 20 nt, Homo sapiens
aaugccaaguaacaaugcau

SEQ ID NO: 427956 - RNA, 17 nt, Homo sapiens
aaugccaaucucuucua

SEQ ID NO: 427957 - RNA, 17 nt, Homo sapiens
aaugccacaaaacugac

SEQ ID NO: 427958 - RNA, 20 nt, Homo sapiens
aaugccacauuuugcuuuau

SEQ ID NO: 427959 - RNA, 21 nt, Homo sapiens
aaugccaggcagaaaacuggc

SEQ ID NO: 427960 - RNA, 15 nt, Homo sapiens
aaugccauucucuug

SEQ ID NO: 427961 - RNA, 22 nt, Homo sapiens
aaugccugguaccagaggaugg

SEQ ID NO: 427962 - RNA, 23 nt, Homo sapiens
aaugccuuguugaugaagcacau

SEQ ID NO: 427963 - RNA, 17 nt, Homo sapiens
aaugcuauggacugcac

SEQ ID NO: 427964 - RNA, 14 nt, Homo sapiens
aaugcucaaugugc

SEQ ID NO: 427965 - RNA, 20 nt, Homo sapiens
aaugcuccauucaggccuau

SEQ ID NO: 427966 - RNA, 12 nt, Homo sapiens
aaugcugagaag

SEQ ID NO: 427967 - RNA, 12 nt, Homo sapiens
aaugcuguagaa

SEQ ID NO: 427968 - RNA, 18 nt, Homo sapiens
aaugcuuuggacuuuuga

SEQ ID NO: 427969 - RNA, 14 nt, Homo sapiens
aauggaaagguccu

SEQ ID NO: 427970 - RNA, 18 nt, Homo sapiens
aauggaacaaacaaugaa

SEQ ID NO: 427971 - RNA, 15 nt, Homo sapiens
aauggacguacuggu

SEQ ID NO: 427972 - RNA, 22 nt, Homo sapiens
aauggcaugcugaaacucgaag

SEQ ID NO: 427973 - RNA, 18 nt, Homo sapiens
aauggcccaguccucucc

SEQ ID NO: 427974 - RNA, 17 nt, Homo sapiens
aauggcgcagugccucu

SEQ ID NO: 427975 - RNA, 12 nt, Homo sapiens
aauggcuuccag

SEQ ID NO: 427976 - RNA, 20 nt, Homo sapiens
aaugguaggauaucuuggcu

SEQ ID NO: 427977 - RNA, 19 nt, Homo sapiens
aaugguuuucuaauaucuu

SEQ ID NO: 427978 - RNA, 22 nt, Homo sapiens
aauguaaagacaaaaaacuaua

SEQ ID NO: 427979 - RNA, 17 nt, Homo sapiens
aauguacaaagauacuu

SEQ ID NO: 427980 - RNA, 13 nt, Homo sapiens
aauguacuacauu

SEQ ID NO: 427981 - RNA, 16 nt, Homo sapiens
aauguacuacauuugc

SEQ ID NO: 427982 - RNA, 23 nt, Homo sapiens
aauguauauugauguaacugugu

SEQ ID NO: 427983 - RNA, 17 nt, Homo sapiens
aauguaucaacauauuu

SEQ ID NO: 427984 - RNA, 13 nt, Homo sapiens
aauguaugugaaa

SEQ ID NO: 427985 - RNA, 13 nt, Homo sapiens
aauguaugugcac

SEQ ID NO: 427986 - RNA, 21 nt, Homo sapiens
aauguauuuugaaaacacuua

SEQ ID NO: 427987 - RNA, 19 nt, Homo sapiens
aaugucagaaaccaguuau

SEQ ID NO: 427988 - RNA, 19 nt, Homo sapiens
aaugucagcacauguugcu

SEQ ID NO: 427989 - RNA, 23 nt, Homo sapiens
aaugucagucuacaggccuuuca

SEQ ID NO: 427990 - RNA, 17 nt, Homo sapiens
aaugucagugugacuga

SEQ ID NO: 427991 - RNA, 12 nt, Homo sapiens
aaugucauuugc

SEQ ID NO: 427992 - RNA, 12 nt, Homo sapiens
aaugugaacuua

SEQ ID NO: 427993 - RNA, 22 nt, Homo sapiens
aaugugacuugagcccagagug

SEQ ID NO: 427994 - RNA, 14 nt, Homo sapiens
aaugugagaacugu

SEQ ID NO: 427995 - RNA, 18 nt, Homo sapiens
aaugugcaaagucaucaa

SEQ ID NO: 427996 - RNA, 17 nt, Homo sapiens
aaugugcagugucuugu

SEQ ID NO: 427997 - RNA, 12 nt, Homo sapiens
aaugugccccau

SEQ ID NO: 427998 - RNA, 17 nt, Homo sapiens
aauguggaaggucauca

SEQ ID NO: 427999 - RNA, 20 nt, Homo sapiens
aauguggccgaggacuuuga

SEQ ID NO: 428000 - RNA, 14 nt, Homo sapiens
aauguguggugcua

SEQ ID NO: 428001 - RNA, 21 nt, Homo sapiens
aauguguggugcuaacuguau

SEQ ID NO: 428002 - RNA, 17 nt, Homo sapiens
aauguguuaagugcagg

SEQ ID NO: 428003 - RNA, 20 nt, Homo sapiens
aauguguuauuugucacaaa

SEQ ID NO: 428004 - RNA, 19 nt, Homo sapiens
aauguuacugaucaugcau

SEQ ID NO: 428005 - RNA, 20 nt, Homo sapiens
aauguuagauuccucuugcc

SEQ ID NO: 428006 - RNA, 22 nt, Homo sapiens
aauguuauuuuuuaauuauuau

SEQ ID NO: 428007 - RNA, 21 nt, Homo sapiens
aauguuccaugucugaaguuu

SEQ ID NO: 428008 - RNA, 18 nt, Homo sapiens
aauguuccguucaucuga

SEQ ID NO: 428009 - RNA, 13 nt, Homo sapiens
aauguucugacau

SEQ ID NO: 428010 - RNA, 13 nt, Homo sapiens
aauguuucagcug

SEQ ID NO: 428011 - RNA, 20 nt, Homo sapiens
aauguuugcugcucuauauu

SEQ ID NO: 428012 - RNA, 22 nt, Homo sapiens
aauguuugucuggauuggcuau

SEQ ID NO: 428013 - RNA, 19 nt, Homo sapiens
aauuaaaaaauaguugcaa

SEQ ID NO: 428014 - RNA, 12 nt, Homo sapiens
aauuaaaaucca

SEQ ID NO: 428015 - RNA, 21 nt, Homo sapiens
aauuaaaggaaaaaaauggaa

SEQ ID NO: 428016 - RNA, 14 nt, Homo sapiens
aauuaaaguauaca

SEQ ID NO: 428017 - RNA, 21 nt, Homo sapiens
aauuaaauauugaaacacugu

SEQ ID NO: 428018 - RNA, 19 nt, Homo sapiens
aauuaaauuucacaauaua

SEQ ID NO: 428019 - RNA, 12 nt, Homo sapiens
aauuaacuugag

SEQ ID NO: 428020 - RNA, 22 nt, Homo sapiens
aauuaagggagcugagccaguc

SEQ ID NO: 428021 - RNA, 21 nt, Homo sapiens
aauuacccuacuuucauuccu

SEQ ID NO: 428022 - RNA, 15 nt, Homo sapiens
aauuacucaccaaaa

SEQ ID NO: 428023 - RNA, 16 nt, Homo sapiens
aauuacuuauauucau

SEQ ID NO: 428024 - RNA, 18 nt, Homo sapiens
aauuacuuuuucauucuu

SEQ ID NO: 428025 - RNA, 16 nt, Homo sapiens
aauuagaaaguagcca

SEQ ID NO: 428026 - RNA, 20 nt, Homo sapiens
aauuagaucgguucugugcc

SEQ ID NO: 428027 - RNA, 13 nt, Homo sapiens
aauuagaugaacu

SEQ ID NO: 428028 - RNA, 14 nt, Homo sapiens
aauuaguggcacuu

SEQ ID NO: 428029 - RNA, 15 nt, Homo sapiens
aauuauaagucacaa

SEQ ID NO: 428030 - RNA, 12 nt, Homo sapiens
aauuauaaugca

SEQ ID NO: 428031 - RNA, 14 nt, Homo sapiens
aauuauaguuucaa

SEQ ID NO: 428032 - RNA, 13 nt, Homo sapiens
aauuauaugauau

SEQ ID NO: 428033 - RNA, 20 nt, Homo sapiens
aauuaucacaauguacuaua

SEQ ID NO: 428034 - RNA, 20 nt, Homo sapiens
aauuaucggaagcagugccu

SEQ ID NO: 428035 - RNA, 16 nt, Homo sapiens
aauuaugucaaaugga

SEQ ID NO: 428036 - RNA, 21 nt, Homo sapiens
aauucaaagaaucaccuaauu

SEQ ID NO: 428037 - RNA, 23 nt, Homo sapiens
aauucaaugacagggaugccaac

SEQ ID NO: 428038 - RNA, 22 nt, Homo sapiens
aauucagagaauagcaguuuca

SEQ ID NO: 428039 - RNA, 16 nt, Homo sapiens
aauucaguaguaacag

SEQ ID NO: 428040 - RNA, 15 nt, Homo sapiens
aauuccaaucauugu

SEQ ID NO: 428041 - RNA, 13 nt, Homo sapiens
aauuccgcauuua

SEQ ID NO: 428042 - RNA, 16 nt, Homo sapiens
aauucuagucucugau

SEQ ID NO: 428043 - RNA, 19 nt, Homo sapiens
aauucuccugccucagccu

SEQ ID NO: 428044 - RNA, 20 nt, Homo sapiens
aauucugcaacuagccaagg

SEQ ID NO: 428045 - RNA, 19 nt, Homo sapiens
aauucuguauuaacugaau

SEQ ID NO: 428046 - RNA, 20 nt, Homo sapiens
aauucuguggcaguuuuaaa

SEQ ID NO: 428047 - RNA, 16 nt, Homo sapiens
aauucuugaaguucau

SEQ ID NO: 428048 - RNA, 17 nt, Homo sapiens
aauucuuuauucuuccu

SEQ ID NO: 428049 - RNA, 19 nt, Homo sapiens
aauucuuuguuuccucuuu

SEQ ID NO: 428050 - RNA, 21 nt, Homo sapiens
aauugaagacacguucuugcc

SEQ ID NO: 428051 - RNA, 16 nt, Homo sapiens
aauugacauguuguca

SEQ ID NO: 428052 - RNA, 19 nt, Homo sapiens
aauugauauugaaugaugu

SEQ ID NO: 428053 - RNA, 17 nt, Homo sapiens
aauugcagcaguugcua

SEQ ID NO: 428054 - RNA, 20 nt, Homo sapiens
aauugccuucuagacacuga

SEQ ID NO: 428055 - RNA, 21 nt, Homo sapiens
aauugccuucuagacacugaa

SEQ ID NO: 428056 - RNA, 14 nt, Homo sapiens
aauugcucagagaa

SEQ ID NO: 428057 - RNA, 16 nt, Homo sapiens
aauugcugcaucuuag

SEQ ID NO: 428058 - RNA, 18 nt, Homo sapiens
aauugguuaaucacuuaa

SEQ ID NO: 428059 - RNA, 16 nt, Homo sapiens
aauuguaauugucuca

SEQ ID NO: 428060 - RNA, 11 nt, Homo sapiens
aauugucucaa

SEQ ID NO: 428061 - RNA, 17 nt, Homo sapiens
aauugugaucagaccau

SEQ ID NO: 428062 - RNA, 17 nt, Homo sapiens
aauuguuuuuugcucuu

SEQ ID NO: 428063 - RNA, 17 nt, Homo sapiens
aauuuaauauacugcau

SEQ ID NO: 428064 - RNA, 22 nt, Homo sapiens
aauuuacuguugcccauugcac

SEQ ID NO: 428065 - RNA, 22 nt, Homo sapiens
aauuuacuuuuuaaacaguguu

SEQ ID NO: 428066 - RNA, 22 nt, Homo sapiens
aauuuaggaaugcucaaugugc

SEQ ID NO: 428067 - RNA, 20 nt, Homo sapiens
aauuuaggauggaauacuuc

SEQ ID NO: 428068 - RNA, 16 nt, Homo sapiens
aauuuauaacaauuga

SEQ ID NO: 428069 - RNA, 18 nt, Homo sapiens
aauuuauucaauuccucu

SEQ ID NO: 428070 - RNA, 22 nt, Homo sapiens
aauuuauuuauuaagauggauu

SEQ ID NO: 428071 - RNA, 17 nt, Homo sapiens
aauuucaaaaugcaugu

SEQ ID NO: 428072 - RNA, 23 nt, Homo sapiens
aauuucagugaaaugguguauag

SEQ ID NO: 428073 - RNA, 13 nt, Homo sapiens
aauuuccaugugu

SEQ ID NO: 428074 - RNA, 22 nt, Homo sapiens
aauuuccugaugcauauugccc

SEQ ID NO: 428075 - RNA, 21 nt, Homo sapiens
aauuucuacuucuggaaguca

SEQ ID NO: 428076 - RNA, 12 nt, Homo sapiens
aauuucucuuaa

SEQ ID NO: 428077 - RNA, 14 nt, Homo sapiens
aauuugaaauccaa

SEQ ID NO: 428078 - RNA, 14 nt, Homo sapiens
aauuugaauguggu

SEQ ID NO: 428079 - RNA, 21 nt, Homo sapiens
aauuugaccagaaaauaugau

SEQ ID NO: 428080 - RNA, 22 nt, Homo sapiens
aauuugacugguucaccugugu

SEQ ID NO: 428081 - RNA, 21 nt, Homo sapiens
aauuuggguacugggugcugu

SEQ ID NO: 428082 - RNA, 19 nt, Homo sapiens
aauuuguucagucuuucau

SEQ ID NO: 428083 - RNA, 20 nt, Homo sapiens
aauuuuaauuccugauuaaa

SEQ ID NO: 428084 - RNA, 17 nt, Homo sapiens
aauuuuaucucuucuuc

SEQ ID NO: 428085 - RNA, 18 nt, Homo sapiens
aauuuucacagccaugau

SEQ ID NO: 428086 - RNA, 21 nt, Homo sapiens
aauuuucuagauuuucuacuu

SEQ ID NO: 428087 - RNA, 13 nt, Homo sapiens
aauuuugcacaga

SEQ ID NO: 428088 - RNA, 21 nt, Homo sapiens
aauuuuguugcaucauguuga

SEQ ID NO: 428089 - RNA, 20 nt, Homo sapiens
aauuuuuaaaagacuuugau

SEQ ID NO: 428090 - RNA, 19 nt, Homo sapiens
aauuuuuuaaaaagcaaaa

SEQ ID NO: 428091 - RNA, 15 nt, Homo sapiens
acaaaaaacaacuga

SEQ ID NO: 428092 - RNA, 14 nt, Homo sapiens
acaaaaacauggcc

SEQ ID NO: 428093 - RNA, 23 nt, Homo sapiens
acaaaaaggaaaugaauauucaa

SEQ ID NO: 428094 - RNA, 22 nt, Homo sapiens
acaaaaauucacaagcugccuc

SEQ ID NO: 428095 - RNA, 22 nt, Homo sapiens
acaaaacugacaguaaaucuca

SEQ ID NO: 428096 - RNA, 14 nt, Homo sapiens
acaaaagccucuca

SEQ ID NO: 428097 - RNA, 11 nt, Homo sapiens
acaaaagcuau

SEQ ID NO: 428098 - RNA, 17 nt, Homo sapiens
acaaacaaccugccaca

SEQ ID NO: 428099 - RNA, 11 nt, Homo sapiens
acaaacugcaa

SEQ ID NO: 428100 - RNA, 15 nt, Homo sapiens
acaaacugccuguua

SEQ ID NO: 428101 - RNA, 14 nt, Homo sapiens
acaaagaaauagca

SEQ ID NO: 428102 - RNA, 11 nt, Homo sapiens
acaaagacagg

SEQ ID NO: 428103 - RNA, 22 nt, Homo sapiens
acaaagcaggaguggaagguga

SEQ ID NO: 428104 - RNA, 14 nt, Homo sapiens
acaaagcaugguau

SEQ ID NO: 428105 - RNA, 19 nt, Homo sapiens
acaaagcauuugacuuucu

SEQ ID NO: 428106 - RNA, 15 nt, Homo sapiens
acaaagcccuuccau

SEQ ID NO: 428107 - RNA, 13 nt, Homo sapiens
acaaagcuucuau

SEQ ID NO: 428108 - RNA, 15 nt, Homo sapiens
acaaaggauuugaaa

SEQ ID NO: 428109 - RNA, 15 nt, Homo sapiens
acaaagugacauucc

SEQ ID NO: 428110 - RNA, 12 nt, Homo sapiens
acaaauaaacuu

SEQ ID NO: 428111 - RNA, 21 nt, Homo sapiens
acaaauaaagcugcugugaac

SEQ ID NO: 428112 - RNA, 23 nt, Homo sapiens
acaaauagucggauuagaaauaa

SEQ ID NO: 428113 - RNA, 19 nt, Homo sapiens
acaaauagugcaacuauga

SEQ ID NO: 428114 - RNA, 19 nt, Homo sapiens
acaaauauugcuuggacua

SEQ ID NO: 428115 - RNA, 20 nt, Homo sapiens
acaaaugggacugaugucau

SEQ ID NO: 428116 - RNA, 22 nt, Homo sapiens
acaacaaagcaugcucaguauu

SEQ ID NO: 428117 - RNA, 22 nt, Homo sapiens
acaacaauuuaggaaugcucaa

SEQ ID NO: 428118 - RNA, 16 nt, Homo sapiens
acaacaccccacagga

SEQ ID NO: 428119 - RNA, 20 nt, Homo sapiens
acaacagagaugccaugaua

SEQ ID NO: 428120 - RNA, 15 nt, Homo sapiens
acaacaguaccugaa

SEQ ID NO: 428121 - RNA, 17 nt, Homo sapiens
acaacagucagccagcu

SEQ ID NO: 428122 - RNA, 23 nt, Homo sapiens
acaacaugcuagguagugaccua

SEQ ID NO: 428123 - RNA, 22 nt, Homo sapiens
acaaccaacggccgacugccug

SEQ ID NO: 428124 - RNA, 21 nt, Homo sapiens
acaaccacauuucuggccauu

SEQ ID NO: 428125 - RNA, 13 nt, Homo sapiens
acaaccacuggga

SEQ ID NO: 428126 - RNA, 14 nt, Homo sapiens
acaaccacugggau

SEQ ID NO: 428127 - RNA, 19 nt, Homo sapiens
acaacccaccccgcuuucg

SEQ ID NO: 428128 - RNA, 13 nt, Homo sapiens
acaaccuuugugu

SEQ ID NO: 428129 - RNA, 18 nt, Homo sapiens
acaacuaauuauaaugca

SEQ ID NO: 428130 - RNA, 14 nt, Homo sapiens
acaacucuagucag

SEQ ID NO: 428131 - RNA, 17 nt, Homo sapiens
acaacugucuaacuuua

SEQ ID NO: 428132 - RNA, 17 nt, Homo sapiens
acaacuucuaauugcca

SEQ ID NO: 428133 - RNA, 16 nt, Homo sapiens
acaacuugaauuacaa

SEQ ID NO: 428134 - RNA, 20 nt, Homo sapiens
acaagaaagaguaacacuga

SEQ ID NO: 428135 - RNA, 21 nt, Homo sapiens
acaagaaagaguaacacugag

SEQ ID NO: 428136 - RNA, 15 nt, Homo sapiens
acaagaagugggagu

SEQ ID NO: 428137 - RNA, 17 nt, Homo sapiens
acaagaccccgucucaa

SEQ ID NO: 428138 - RNA, 17 nt, Homo sapiens
acaagagacaugagauu

SEQ ID NO: 428139 - RNA, 18 nt, Homo sapiens
acaagauccuuaaugcag

SEQ ID NO: 428140 - RNA, 20 nt, Homo sapiens
acaagauccuuaaugcagag

SEQ ID NO: 428141 - RNA, 19 nt, Homo sapiens
acaagcagucuuuuucuac

SEQ ID NO: 428142 - RNA, 19 nt, Homo sapiens
acaagcgaaucucugccuu

SEQ ID NO: 428143 - RNA, 21 nt, Homo sapiens
acaaguaccacucuuggucag

SEQ ID NO: 428144 - RNA, 13 nt, Homo sapiens
acaaguagcacac

SEQ ID NO: 428145 - RNA, 14 nt, Homo sapiens
acaagucucagggg

SEQ ID NO: 428146 - RNA, 23 nt, Homo sapiens
acaagugccuccuggacuguuca

SEQ ID NO: 428147 - RNA, 15 nt, Homo sapiens
acaagugcugaacag

SEQ ID NO: 428148 - RNA, 15 nt, Homo sapiens
acaagugggugaaug

SEQ ID NO: 428149 - RNA, 20 nt, Homo sapiens
acaaguguacagaagaauuu

SEQ ID NO: 428150 - RNA, 18 nt, Homo sapiens
acaaguuuuaauccagaa

SEQ ID NO: 428151 - RNA, 16 nt, Homo sapiens
acaauaaaacauuccu

SEQ ID NO: 428152 - RNA, 14 nt, Homo sapiens
acaauaaauguauu

SEQ ID NO: 428153 - RNA, 15 nt, Homo sapiens
acaauaacacugucu

SEQ ID NO: 428154 - RNA, 23 nt, Homo sapiens
acaaucaacucuaauagugcuua

SEQ ID NO: 428155 - RNA, 13 nt, Homo sapiens
acaaucacacuca

SEQ ID NO: 428156 - RNA, 19 nt, Homo sapiens
acaaucaugaaauaugcau

SEQ ID NO: 428157 - RNA, 19 nt, Homo sapiens
acaaugaccacauccugaa

SEQ ID NO: 428158 - RNA, 21 nt, Homo sapiens
acaaugauaggaaaaauccau

SEQ ID NO: 428159 - RNA, 15 nt, Homo sapiens
acaauggcaauagga

SEQ ID NO: 428160 - RNA, 11 nt, Homo sapiens
acaaugugcac

SEQ ID NO: 428161 - RNA, 15 nt, Homo sapiens
acaauuaaagcaaaa

SEQ ID NO: 428162 - RNA, 23 nt, Homo sapiens
acaauuaagagagugaacauauc

SEQ ID NO: 428163 - RNA, 22 nt, Homo sapiens
acaauucauuuacccauuuacu

SEQ ID NO: 428164 - RNA, 21 nt, Homo sapiens
acaauuuauccaaagcauugc

SEQ ID NO: 428165 - RNA, 18 nt, Homo sapiens
acaauuucaaaaugcaug

SEQ ID NO: 428166 - RNA, 15 nt, Homo sapiens
acaauuuucauccca

SEQ ID NO: 428167 - RNA, 19 nt, Homo sapiens
acacaaaauacagcacuuu

SEQ ID NO: 428168 - RNA, 13 nt, Homo sapiens
acacaaauccaac

SEQ ID NO: 428169 - RNA, 12 nt, Homo sapiens
acacaacaugua

SEQ ID NO: 428170 - RNA, 20 nt, Homo sapiens
acacaaccacuaauuuguca

SEQ ID NO: 428171 - RNA, 18 nt, Homo sapiens
acacaagacuuuccccau

SEQ ID NO: 428172 - RNA, 17 nt, Homo sapiens
acacaaguagauugauc

SEQ ID NO: 428173 - RNA, 12 nt, Homo sapiens
acacacaaaaga

SEQ ID NO: 428174 - RNA, 18 nt, Homo sapiens
acacacaaaugcagacac

SEQ ID NO: 428175 - RNA, 12 nt, Homo sapiens
acacacaauuaa

SEQ ID NO: 428176 - RNA, 17 nt, Homo sapiens
acacacagcuucuagug

SEQ ID NO: 428177 - RNA, 12 nt, Homo sapiens
acacacauggaa

SEQ ID NO: 428178 - RNA, 14 nt, Homo sapiens
acacaccuugccca

SEQ ID NO: 428179 - RNA, 20 nt, Homo sapiens
acacacuuucugacugcaac

SEQ ID NO: 428180 - RNA, 19 nt, Homo sapiens
acacagacucugugagauu

SEQ ID NO: 428181 - RNA, 21 nt, Homo sapiens
acacagagguuuuaaacaguc

SEQ ID NO: 428182 - RNA, 14 nt, Homo sapiens
acacagaugaaggu

SEQ ID NO: 428183 - RNA, 15 nt, Homo sapiens
acacagcaguaugaa

SEQ ID NO: 428184 - RNA, 22 nt, Homo sapiens
acacagcaguaugaaugauguu

SEQ ID NO: 428185 - RNA, 15 nt, Homo sapiens
acacagcaugugcca

SEQ ID NO: 428186 - RNA, 9 nt, Homo sapiens
acacagcca

SEQ ID NO: 428187 - RNA, 22 nt, Homo sapiens
acacagccccggaaugcuucca

SEQ ID NO: 428188 - RNA, 17 nt, Homo sapiens
acacagcugcagagaca

SEQ ID NO: 428189 - RNA, 21 nt, Homo sapiens
acacagcugcagagacagaga

SEQ ID NO: 428190 - RNA, 17 nt, Homo sapiens
acacaggaguccuuucu

SEQ ID NO: 428191 - RNA, 12 nt, Homo sapiens
acacaggcaaag

SEQ ID NO: 428192 - RNA, 16 nt, Homo sapiens
acacaggggacacuga

SEQ ID NO: 428193 - RNA, 17 nt, Homo sapiens
acacaguaaaauauuca

SEQ ID NO: 428194 - RNA, 13 nt, Homo sapiens
acacagucagauu

SEQ ID NO: 428195 - RNA, 14 nt, Homo sapiens
acacagucaugugu

SEQ ID NO: 428196 - RNA, 21 nt, Homo sapiens
acacaucccggccucuuccac

SEQ ID NO: 428197 - RNA, 13 nt, Homo sapiens
acaccaaaccaaa

SEQ ID NO: 428198 - RNA, 13 nt, Homo sapiens
acaccacacauac

SEQ ID NO: 428199 - RNA, 21 nt, Homo sapiens
acaccacuuggagaucuuugc

SEQ ID NO: 428200 - RNA, 16 nt, Homo sapiens
acaccagaagugccau

SEQ ID NO: 428201 - RNA, 20 nt, Homo sapiens
acaccaggcugugggccuca

SEQ ID NO: 428202 - RNA, 17 nt, Homo sapiens
acaccagggaugguacu

SEQ ID NO: 428203 - RNA, 22 nt, Homo sapiens
acacccccaccuccugcaauaa

SEQ ID NO: 428204 - RNA, 17 nt, Homo sapiens
acaccccucccugccac

SEQ ID NO: 428205 - RNA, 19 nt, Homo sapiens
acaccguacaucugcaaua

SEQ ID NO: 428206 - RNA, 18 nt, Homo sapiens
acacgccacaacuccagu

SEQ ID NO: 428207 - RNA, 21 nt, Homo sapiens
acacgcccuccccagacucca

SEQ ID NO: 428208 - RNA, 15 nt, Homo sapiens
acacguuacuagcag

SEQ ID NO: 428209 - RNA, 14 nt, Homo sapiens
acacuaacauauaa

SEQ ID NO: 428210 - RNA, 15 nt, Homo sapiens
acacuaacauauaau

SEQ ID NO: 428211 - RNA, 18 nt, Homo sapiens
acacuaacauauaauguu

SEQ ID NO: 428212 - RNA, 13 nt, Homo sapiens
acacuagucugug

SEQ ID NO: 428213 - RNA, 18 nt, Homo sapiens
acacuauuuuugauagca

SEQ ID NO: 428214 - RNA, 13 nt, Homo sapiens
acacucaccauuu

SEQ ID NO: 428215 - RNA, 15 nt, Homo sapiens
acacucaccauuuaa

SEQ ID NO: 428216 - RNA, 16 nt, Homo sapiens
acacucuagugccaua

SEQ ID NO: 428217 - RNA, 16 nt, Homo sapiens
acacucuugguagaag

SEQ ID NO: 428218 - RNA, 20 nt, Homo sapiens
acacugagauauucagccca

SEQ ID NO: 428219 - RNA, 18 nt, Homo sapiens
acacugaguuugaacaca

SEQ ID NO: 428220 - RNA, 19 nt, Homo sapiens
acacugcgaacucucagga

SEQ ID NO: 428221 - RNA, 19 nt, Homo sapiens
acacugcuaggugggccag

SEQ ID NO: 428222 - RNA, 20 nt, Homo sapiens
acacugcuaggugggccagc

SEQ ID NO: 428223 - RNA, 19 nt, Homo sapiens
acacugcugcuccagugca

SEQ ID NO: 428224 - RNA, 20 nt, Homo sapiens
acacugcugcuccagugcag

SEQ ID NO: 428225 - RNA, 19 nt, Homo sapiens
acacugcugggaaguggcu

SEQ ID NO: 428226 - RNA, 21 nt, Homo sapiens
acacuguauuguaaguggaaa

SEQ ID NO: 428227 - RNA, 12 nt, Homo sapiens
acacugugaugu

SEQ ID NO: 428228 - RNA, 17 nt, Homo sapiens
acacuuagcaucccaca

SEQ ID NO: 428229 - RNA, 17 nt, Homo sapiens
acacuuauugcuuugaa

SEQ ID NO: 428230 - RNA, 14 nt, Homo sapiens
acacuuggaugcag

SEQ ID NO: 428231 - RNA, 23 nt, Homo sapiens
acacuugugugugggcugugagu

SEQ ID NO: 428232 - RNA, 17 nt, Homo sapiens
acacuuucacuggggau

SEQ ID NO: 428233 - RNA, 22 nt, Homo sapiens
acagaaauggggaauucucuaa

SEQ ID NO: 428234 - RNA, 20 nt, Homo sapiens
acagaacacacugagacuug

SEQ ID NO: 428235 - RNA, 18 nt, Homo sapiens
acagaacucgaugcacug

SEQ ID NO: 428236 - RNA, 15 nt, Homo sapiens
acagaaggccuugaa

SEQ ID NO: 428237 - RNA, 18 nt, Homo sapiens
acagaauaauguguuaaa

SEQ ID NO: 428238 - RNA, 17 nt, Homo sapiens
acagaauauucuguaaa

SEQ ID NO: 428239 - RNA, 14 nt, Homo sapiens
acagaauugcuccu

SEQ ID NO: 428240 - RNA, 23 nt, Homo sapiens
acagaauuucauucauuugugcu

SEQ ID NO: 428241 - RNA, 12 nt, Homo sapiens
acagacaaagcg

SEQ ID NO: 428242 - RNA, 22 nt, Homo sapiens
acagacaaagcgugguggacau

SEQ ID NO: 428243 - RNA, 16 nt, Homo sapiens
acagacacgugugagu

SEQ ID NO: 428244 - RNA, 14 nt, Homo sapiens
acagacaggcucuu

SEQ ID NO: 428245 - RNA, 17 nt, Homo sapiens
acagaccucggcugugu

SEQ ID NO: 428246 - RNA, 21 nt, Homo sapiens
acagacgucccuccacguuca

SEQ ID NO: 428247 - RNA, 13 nt, Homo sapiens
acagacuacauuu

SEQ ID NO: 428248 - RNA, 15 nt, Homo sapiens
acagacucugugaga

SEQ ID NO: 428249 - RNA, 20 nt, Homo sapiens
acagagcgagauuccgucuc

SEQ ID NO: 428250 - RNA, 17 nt, Homo sapiens
acagaggagagucccag

SEQ ID NO: 428251 - RNA, 17 nt, Homo sapiens
acagaguggaucuggag

SEQ ID NO: 428252 - RNA, 21 nt, Homo sapiens
acagaguggucuuucuggaga

SEQ ID NO: 428253 - RNA, 14 nt, Homo sapiens
acagauacuccucc

SEQ ID NO: 428254 - RNA, 13 nt, Homo sapiens
acagauauuccag

SEQ ID NO: 428255 - RNA, 22 nt, Homo sapiens
acagauccagggacugaagcca

SEQ ID NO: 428256 - RNA, 13 nt, Homo sapiens
acagaucuucaac

SEQ ID NO: 428257 - RNA, 19 nt, Homo sapiens
acagaucuugagcaaggca

SEQ ID NO: 428258 - RNA, 15 nt, Homo sapiens
acagauuaaacuuca

SEQ ID NO: 428259 - RNA, 19 nt, Homo sapiens
acagauugcugcuucugcu

SEQ ID NO: 428260 - RNA, 19 nt, Homo sapiens
acagauuuuagacaaggac

SEQ ID NO: 428261 - RNA, 21 nt, Homo sapiens
acagcaaaaccauugcuucac

SEQ ID NO: 428262 - RNA, 18 nt, Homo sapiens
acagcaagacuccgucuc

SEQ ID NO: 428263 - RNA, 19 nt, Homo sapiens
acagcaagacuccgucuca

SEQ ID NO: 428264 - RNA, 20 nt, Homo sapiens
acagcaagacuccgucucaa

SEQ ID NO: 428265 - RNA, 12 nt, Homo sapiens
acagcacuuuga

SEQ ID NO: 428266 - RNA, 15 nt, Homo sapiens
acagcagaacuucug

SEQ ID NO: 428267 - RNA, 13 nt, Homo sapiens
acagcagauuuca

SEQ ID NO: 428268 - RNA, 16 nt, Homo sapiens
acagcagccucugaag

SEQ ID NO: 428269 - RNA, 18 nt, Homo sapiens
acagcaucaggugggaaa

SEQ ID NO: 428270 - RNA, 13 nt, Homo sapiens
acagcauguguau

SEQ ID NO: 428271 - RNA, 17 nt, Homo sapiens
acagcauucuugucaca

SEQ ID NO: 428272 - RNA, 11 nt, Homo sapiens
acagcauuuca

SEQ ID NO: 428273 - RNA, 12 nt, Homo sapiens
acagccaugauu

SEQ ID NO: 428274 - RNA, 22 nt, Homo sapiens
acagccggggccugccuagcac

SEQ ID NO: 428275 - RNA, 14 nt, Homo sapiens
acagccguuugaau

SEQ ID NO: 428276 - RNA, 21 nt, Homo sapiens
acagccucccacccccaucuc

SEQ ID NO: 428277 - RNA, 17 nt, Homo sapiens
acagccucuuacuugcc

SEQ ID NO: 428278 - RNA, 20 nt, Homo sapiens
acagccugcacacaccugcc

SEQ ID NO: 428279 - RNA, 23 nt, Homo sapiens
acagccuggccccugugcaccga

SEQ ID NO: 428280 - RNA, 17 nt, Homo sapiens
acagccuucacuggaga

SEQ ID NO: 428281 - RNA, 17 nt, Homo sapiens
acagcuaacaaguagca

SEQ ID NO: 428282 - RNA, 15 nt, Homo sapiens
acagcuaacauggaa

SEQ ID NO: 428283 - RNA, 21 nt, Homo sapiens
acagcuccuccucuuggagcu

SEQ ID NO: 428284 - RNA, 13 nt, Homo sapiens
acagcucuuggca

SEQ ID NO: 428285 - RNA, 17 nt, Homo sapiens
acagcugaaagauugau

SEQ ID NO: 428286 - RNA, 15 nt, Homo sapiens
acagcugacauggag

SEQ ID NO: 428287 - RNA, 15 nt, Homo sapiens
acagcuuaaucaaaa

SEQ ID NO: 428288 - RNA, 22 nt, Homo sapiens
acagcuucacuuaaaaucaaau

SEQ ID NO: 428289 - RNA, 20 nt, Homo sapiens
acaggaagcaccccaugcca

SEQ ID NO: 428290 - RNA, 17 nt, Homo sapiens
acaggaaggaaccagaa

SEQ ID NO: 428291 - RNA, 21 nt, Homo sapiens
acaggaggaacugguccaggc

SEQ ID NO: 428292 - RNA, 22 nt, Homo sapiens
acaggaggaggagauggccaua

SEQ ID NO: 428293 - RNA, 13 nt, Homo sapiens
acaggaucaugua

SEQ ID NO: 428294 - RNA, 23 nt, Homo sapiens
acaggaucauguaaaugcucaaa

SEQ ID NO: 428295 - RNA, 17 nt, Homo sapiens
acaggauucucuucuca

SEQ ID NO: 428296 - RNA, 23 nt, Homo sapiens
acaggcaacauuacaaacaaagg

SEQ ID NO: 428297 - RNA, 13 nt, Homo sapiens
acaggcacugugu

SEQ ID NO: 428298 - RNA, 15 nt, Homo sapiens
acaggccauggugca

SEQ ID NO: 428299 - RNA, 22 nt, Homo sapiens
acaggccauggugcacaaaagg

SEQ ID NO: 428300 - RNA, 22 nt, Homo sapiens
acaggcccuuccucuccacugc

SEQ ID NO: 428301 - RNA, 22 nt, Homo sapiens
acagggcauccaacugagaaaa

SEQ ID NO: 428302 - RNA, 14 nt, Homo sapiens
acaggggacacuga

SEQ ID NO: 428303 - RNA, 17 nt, Homo sapiens
acaggggcuggugggca

SEQ ID NO: 428304 - RNA, 19 nt, Homo sapiens
acagggucugcucuuucuc

SEQ ID NO: 428305 - RNA, 18 nt, Homo sapiens
acagguucuccaggugau

SEQ ID NO: 428306 - RNA, 20 nt, Homo sapiens
acaguagggcuuggugaaug

SEQ ID NO: 428307 - RNA, 17 nt, Homo sapiens
acaguagguuggcagua

SEQ ID NO: 428308 - RNA, 12 nt, Homo sapiens
acaguaucacug

SEQ ID NO: 428309 - RNA, 14 nt, Homo sapiens
acaguauccacaau

SEQ ID NO: 428310 - RNA, 18 nt, Homo sapiens
acaguaugagucaaugug

SEQ ID NO: 428311 - RNA, 20 nt, Homo sapiens
acaguauucuguaccauagc

SEQ ID NO: 428312 - RNA, 13 nt, Homo sapiens
acaguauugccac

SEQ ID NO: 428313 - RNA, 13 nt, Homo sapiens
acagucauuuaaa

SEQ ID NO: 428314 - RNA, 14 nt, Homo sapiens
acaguccauugaaa

SEQ ID NO: 428315 - RNA, 14 nt, Homo sapiens
acagucucaagcac

SEQ ID NO: 428316 - RNA, 17 nt, Homo sapiens
acagucucaagcacuaa

SEQ ID NO: 428317 - RNA, 21 nt, Homo sapiens
acagugaaguucaaaugcccu

SEQ ID NO: 428318 - RNA, 21 nt, Homo sapiens
acagugaugcugugcuaugaa

SEQ ID NO: 428319 - RNA, 19 nt, Homo sapiens
acagugccuggcaaggccu

SEQ ID NO: 428320 - RNA, 12 nt, Homo sapiens
acagugcuuuau

SEQ ID NO: 428321 - RNA, 21 nt, Homo sapiens
acaguggaggaagagggacag

SEQ ID NO: 428322 - RNA, 17 nt, Homo sapiens
acagugggggugccugg

SEQ ID NO: 428323 - RNA, 22 nt, Homo sapiens
acagugucugugccauggauuu

SEQ ID NO: 428324 - RNA, 21 nt, Homo sapiens
acaguguugccagagccuuaa

SEQ ID NO: 428325 - RNA, 22 nt, Homo sapiens
acaguuaaaggcaacccugagg

SEQ ID NO: 428326 - RNA, 20 nt, Homo sapiens
acaguuaagagaaaugagcu

SEQ ID NO: 428327 - RNA, 21 nt, Homo sapiens
acaguuaagagaaaugagcuu

SEQ ID NO: 428328 - RNA, 14 nt, Homo sapiens
acaguugaacagaa

SEQ ID NO: 428329 - RNA, 22 nt, Homo sapiens
acaguuuauuuuuauacuuuca

SEQ ID NO: 428330 - RNA, 16 nt, Homo sapiens
acaguuucuuccccaa

SEQ ID NO: 428331 - RNA, 19 nt, Homo sapiens
acaguuugaugcugaguca

SEQ ID NO: 428332 - RNA, 18 nt, Homo sapiens
accaguguuaagugacau

SEQ ID NO: 428333 - RNA, 20 nt, Homo sapiens
accaguugaauaaaagugca

SEQ ID NO: 428334 - RNA, 12 nt, Homo sapiens
accaguuuaccu

SEQ ID NO: 428335 - RNA, 21 nt, Homo sapiens
accauaagggacugugccaga

SEQ ID NO: 428336 - RNA, 18 nt, Homo sapiens
accauaguuuacaauauu

SEQ ID NO: 428337 - RNA, 15 nt, Homo sapiens
accaucacagcuugu

SEQ ID NO: 428338 - RNA, 11 nt, Homo sapiens
accaucaugua

SEQ ID NO: 428339 - RNA, 20 nt, Homo sapiens
accaucucaggccaccugcc

SEQ ID NO: 428340 - RNA, 11 nt, Homo sapiens
accaucuccua

SEQ ID NO: 428341 - RNA, 21 nt, Homo sapiens
accaucuggaaggacaucuac

SEQ ID NO: 428342 - RNA, 11 nt, Homo sapiens
accaugacugu

SEQ ID NO: 428343 - RNA, 19 nt, Homo sapiens
accaugagaccacuguuau

SEQ ID NO: 428344 - RNA, 11 nt, Homo sapiens
accaugcugcc

SEQ ID NO: 428345 - RNA, 13 nt, Homo sapiens
accauguacauga

SEQ ID NO: 428346 - RNA, 20 nt, Homo sapiens
accauguacaugaagaagcu

SEQ ID NO: 428347 - RNA, 14 nt, Homo sapiens
accaugucacugug

SEQ ID NO: 428348 - RNA, 14 nt, Homo sapiens
accauguggccauu

SEQ ID NO: 428349 - RNA, 12 nt, Homo sapiens
accauuacugua

SEQ ID NO: 428350 - RNA, 14 nt, Homo sapiens
accauuacuguaau

SEQ ID NO: 428351 - RNA, 19 nt, Homo sapiens
accauuauggcuuugugcu

SEQ ID NO: 428352 - RNA, 22 nt, Homo sapiens
accauucaucuuuccuuugcuc

SEQ ID NO: 428353 - RNA, 19 nt, Homo sapiens
accauuguacccugcugua

SEQ ID NO: 428354 - RNA, 21 nt, Homo sapiens
accauuguacccugcuguaua

SEQ ID NO: 428355 - RNA, 18 nt, Homo sapiens
accauuuagcacacugcu

SEQ ID NO: 428356 - RNA, 20 nt, Homo sapiens
accauuuagcacacugcuug

SEQ ID NO: 428357 - RNA, 23 nt, Homo sapiens
accauuuguaauaaaguauauaa

SEQ ID NO: 428358 - RNA, 14 nt, Homo sapiens
acccaacucugggc

SEQ ID NO: 428359 - RNA, 22 nt, Homo sapiens
acccaauuaaguccuacuuuac

SEQ ID NO: 428360 - RNA, 12 nt, Homo sapiens
acccaauuucca

SEQ ID NO: 428361 - RNA, 13 nt, Homo sapiens
acccacacaagcg

SEQ ID NO: 428362 - RNA, 14 nt, Homo sapiens
acccacauccaaac

SEQ ID NO: 428363 - RNA, 16 nt, Homo sapiens
acccacauccaaacau

SEQ ID NO: 428364 - RNA, 16 nt, Homo sapiens
acccacauuacaggau

SEQ ID NO: 428365 - RNA, 15 nt, Homo sapiens
acccaccaaaugccu

SEQ ID NO: 428366 - RNA, 15 nt, Homo sapiens
acccaccaccaugcc

SEQ ID NO: 428367 - RNA, 18 nt, Homo sapiens
acccacggaaagccucau

SEQ ID NO: 428368 - RNA, 23 nt, Homo sapiens
acccacucugcuuugacugagca

SEQ ID NO: 428369 - RNA, 14 nt, Homo sapiens
acccagaugcucuc

SEQ ID NO: 428370 - RNA, 18 nt, Homo sapiens
acccagcccaaccgggaa

SEQ ID NO: 428371 - RNA, 13 nt, Homo sapiens
acccagccucuag

SEQ ID NO: 428372 - RNA, 15 nt, Homo sapiens
acccagcuacucugu

SEQ ID NO: 428373 - RNA, 21 nt, Homo sapiens
acccagcuacucuguccaggc

SEQ ID NO: 428374 - RNA, 20 nt, Homo sapiens
acccaggacuuccauuugcu

SEQ ID NO: 428375 - RNA, 22 nt, Homo sapiens
acccauccuaccaaugcaugca

SEQ ID NO: 428376 - RNA, 20 nt, Homo sapiens
acccaucgugguaugugaau

SEQ ID NO: 428377 - RNA, 15 nt, Homo sapiens
acccaugacugcccc

SEQ ID NO: 428378 - RNA, 18 nt, Homo sapiens
acccauucacuacaggug

SEQ ID NO: 428379 - RNA, 14 nt, Homo sapiens
acccauugucucau

SEQ ID NO: 428380 - RNA, 15 nt, Homo sapiens
accccaaagcuuucc

SEQ ID NO: 428381 - RNA, 15 nt, Homo sapiens
accccaagcaggaac

SEQ ID NO: 428382 - RNA, 20 nt, Homo sapiens
accccacaccccagcccacc

SEQ ID NO: 428383 - RNA, 19 nt, Homo sapiens
accccacagaucaguuuuc

SEQ ID NO: 428384 - RNA, 18 nt, Homo sapiens
accccagcgccugugcug

SEQ ID NO: 428385 - RNA, 21 nt, Homo sapiens
accccagcuccauccuugcau

SEQ ID NO: 428386 - RNA, 22 nt, Homo sapiens
accccagcuccauccuugcauc

SEQ ID NO: 428387 - RNA, 11 nt, Homo sapiens
accccaucuca

SEQ ID NO: 428388 - RNA, 12 nt, Homo sapiens
accccaucucau

SEQ ID NO: 428389 - RNA, 14 nt, Homo sapiens
accccaugccaaag

SEQ ID NO: 428390 - RNA, 16 nt, Homo sapiens
acccccaccacuaaga

SEQ ID NO: 428391 - RNA, 12 nt, Homo sapiens
acccccaugcug

SEQ ID NO: 428392 - RNA, 17 nt, Homo sapiens
acccccgccacggccac

SEQ ID NO: 428393 - RNA, 21 nt, Homo sapiens
accccggcaggcccugcagug

SEQ ID NO: 428394 - RNA, 14 nt, Homo sapiens
accccguagcucca

SEQ ID NO: 428395 - RNA, 19 nt, Homo sapiens
accccuacagccugcacac

SEQ ID NO: 428396 - RNA, 18 nt, Homo sapiens
accccuccccuaaugccu

SEQ ID NO: 428397 - RNA, 18 nt, Homo sapiens
accccugaccucacugug

SEQ ID NO: 428398 - RNA, 13 nt, Homo sapiens
accccugcccagg

SEQ ID NO: 428399 - RNA, 17 nt, Homo sapiens
accccugcucuacccau

SEQ ID NO: 428400 - RNA, 15 nt, Homo sapiens
accccuuagccuccc

SEQ ID NO: 428401 - RNA, 23 nt, Homo sapiens
accccuugcccaaccaaugcaca

SEQ ID NO: 428402 - RNA, 22 nt, Homo sapiens
acccuaaugccaguuccagcuu

SEQ ID NO: 428403 - RNA, 15 nt, Homo sapiens
acccuaauguggcag

SEQ ID NO: 428404 - RNA, 21 nt, Homo sapiens
acccuauauguggcauuccuu

SEQ ID NO: 428405 - RNA, 15 nt, Homo sapiens
acccuaucaucaguu

SEQ ID NO: 428406 - RNA, 16 nt, Homo sapiens
acccuauucaugucuc

SEQ ID NO: 428407 - RNA, 21 nt, Homo sapiens
acccuauuuagaaauggauuu

SEQ ID NO: 428408 - RNA, 18 nt, Homo sapiens
acccucaaugccaagaaa

SEQ ID NO: 428409 - RNA, 16 nt, Homo sapiens
acccucacucugccag

SEQ ID NO: 428410 - RNA, 15 nt, Homo sapiens
acccuccucaagaag

SEQ ID NO: 428411 - RNA, 21 nt, Homo sapiens
acccugaaugguuccaugccu

SEQ ID NO: 428412 - RNA, 13 nt, Homo sapiens
acccugcagagau

SEQ ID NO: 428413 - RNA, 20 nt, Homo sapiens
acccugcagcuaugcuggaa

SEQ ID NO: 428414 - RNA, 16 nt, Homo sapiens
acccugccaacuuucc

SEQ ID NO: 428415 - RNA, 15 nt, Homo sapiens
acccugccagacuga

SEQ ID NO: 428416 - RNA, 18 nt, Homo sapiens
acccugccuuaucuugca

SEQ ID NO: 428417 - RNA, 22 nt, Homo sapiens
acccugcugaccucccagugac

SEQ ID NO: 428418 - RNA, 24 nt, Homo sapiens
acccuggaaacuaccagugggcau

SEQ ID NO: 428419 - RNA, 18 nt, Homo sapiens
acccugggguaaguggag

SEQ ID NO: 428420 - RNA, 17 nt, Homo sapiens
acccugggucaccuucc

SEQ ID NO: 428421 - RNA, 14 nt, Homo sapiens
acccugggugccau

SEQ ID NO: 428422 - RNA, 21 nt, Homo sapiens
acccugucuaggcacaugugg

SEQ ID NO: 428423 - RNA, 13 nt, Homo sapiens
acccugugcucaa

SEQ ID NO: 428424 - RNA, 14 nt, Homo sapiens
acccuguuuuacaa

SEQ ID NO: 428425 - RNA, 22 nt, Homo sapiens
acccuucugcuguauacuguac

SEQ ID NO: 428426 - RNA, 13 nt, Homo sapiens
acccuucugggca

SEQ ID NO: 428427 - RNA, 19 nt, Homo sapiens
acccuuguguccacuguga

SEQ ID NO: 428428 - RNA, 20 nt, Homo sapiens
acccuuguguccacugugac

SEQ ID NO: 428429 - RNA, 13 nt, Homo sapiens
accgagugcaaug

SEQ ID NO: 428430 - RNA, 19 nt, Homo sapiens
accgauuucagcacaugca

SEQ ID NO: 428431 - RNA, 16 nt, Homo sapiens
accgcaauaugggagg

SEQ ID NO: 428432 - RNA, 20 nt, Homo sapiens
accgccaugcaacuccaugc

SEQ ID NO: 428433 - RNA, 13 nt, Homo sapiens
accgccugcuuca

SEQ ID NO: 428434 - RNA, 21 nt, Homo sapiens
accgcgcccagccucaucucu

SEQ ID NO: 428435 - RNA, 18 nt, Homo sapiens
accggaucuacacccacc

SEQ ID NO: 428436 - RNA, 21 nt, Homo sapiens
accgggcuggccugugccuau

SEQ ID NO: 428437 - RNA, 15 nt, Homo sapiens
accguaaauguccau

SEQ ID NO: 428438 - RNA, 16 nt, Homo sapiens
accguacaucugcaau

SEQ ID NO: 428439 - RNA, 14 nt, Homo sapiens
accgugggcacuga

SEQ ID NO: 428440 - RNA, 13 nt, Homo sapiens
accguugcacaaa

SEQ ID NO: 428441 - RNA, 17 nt, Homo sapiens
accguugcacaaaaagg

SEQ ID NO: 428442 - RNA, 23 nt, Homo sapiens
accuaaaaggaaaucucacccca

SEQ ID NO: 428443 - RNA, 22 nt, Homo sapiens
accuaaagaauaugaauggauu

SEQ ID NO: 428444 - RNA, 14 nt, Homo sapiens
accuaaaugaugcc

SEQ ID NO: 428445 - RNA, 16 nt, Homo sapiens
accuaaauuugguucu

SEQ ID NO: 428446 - RNA, 19 nt, Homo sapiens
accuaaccacuuagcaugu

SEQ ID NO: 428447 - RNA, 16 nt, Homo sapiens
accuacaaaaugagau

SEQ ID NO: 428448 - RNA, 16 nt, Homo sapiens
accuaccaugcugcuu

SEQ ID NO: 428449 - RNA, 22 nt, Homo sapiens
accuaccccaguucaucucugc

SEQ ID NO: 428450 - RNA, 13 nt, Homo sapiens
accuaggauuuca

SEQ ID NO: 428451 - RNA, 21 nt, Homo sapiens
accuauagaaauguauuuuga

SEQ ID NO: 428452 - RNA, 19 nt, Homo sapiens
accuaugacauacauggaa

SEQ ID NO: 428453 - RNA, 21 nt, Homo sapiens
accuaugagauggccaugcuc

SEQ ID NO: 428454 - RNA, 11 nt, Homo sapiens
accuaugccug

SEQ ID NO: 428455 - RNA, 17 nt, Homo sapiens
accuaugugugugcuuu

SEQ ID NO: 428456 - RNA, 13 nt, Homo sapiens
accuauguuugcu

SEQ ID NO: 428457 - RNA, 11 nt, Homo sapiens
accuauugcca

SEQ ID NO: 428458 - RNA, 15 nt, Homo sapiens
accuauuuuuuucuc

SEQ ID NO: 428459 - RNA, 22 nt, Homo sapiens
accucaccagaauugugcaaau

SEQ ID NO: 428460 - RNA, 21 nt, Homo sapiens
accucaccccguuacagcucc

SEQ ID NO: 428461 - RNA, 21 nt, Homo sapiens
accucacgcucuggacaugau

SEQ ID NO: 428462 - RNA, 14 nt, Homo sapiens
accucacuauucaa

SEQ ID NO: 428463 - RNA, 19 nt, Homo sapiens
accucagccucccaaagug

SEQ ID NO: 428464 - RNA, 16 nt, Homo sapiens
accucagcugcacauu

SEQ ID NO: 428465 - RNA, 18 nt, Homo sapiens
accucaggcagaggaugu

SEQ ID NO: 428466 - RNA, 14 nt, Homo sapiens
accucauaugcuau

SEQ ID NO: 428467 - RNA, 12 nt, Homo sapiens
accucauuugca

SEQ ID NO: 428468 - RNA, 14 nt, Homo sapiens
accucauuugcauc

SEQ ID NO: 428469 - RNA, 17 nt, Homo sapiens
accuccaaaagcccuga

SEQ ID NO: 428470 - RNA, 14 nt, Homo sapiens
accuccaacuuucc

SEQ ID NO: 428471 - RNA, 17 nt, Homo sapiens
accuccacccacugucc

SEQ ID NO: 428472 - RNA, 12 nt, Homo sapiens
accucccaguga

SEQ ID NO: 428473 - RNA, 21 nt, Homo sapiens
accucccugacccgucuaaua

SEQ ID NO: 428474 - RNA, 16 nt, Homo sapiens
accuccuccuccaguu

SEQ ID NO: 428475 - RNA, 22 nt, Homo sapiens
accuccuccuccaguucugaug

SEQ ID NO: 428476 - RNA, 22 nt, Homo sapiens
accuccuuagcccugucugcua

SEQ ID NO: 428477 - RNA, 12 nt, Homo sapiens
accucggcugug

SEQ ID NO: 428478 - RNA, 17 nt, Homo sapiens
accucguugacaugcac

SEQ ID NO: 428479 - RNA, 17 nt, Homo sapiens
accucuaccuguuccca

SEQ ID NO: 428480 - RNA, 13 nt, Homo sapiens
accucuacuuucc

SEQ ID NO: 428481 - RNA, 14 nt, Homo sapiens
accucuacuuucca

SEQ ID NO: 428482 - RNA, 16 nt, Homo sapiens
accucucaacuuacau

SEQ ID NO: 428483 - RNA, 14 nt, Homo sapiens
accucuccagccuc

SEQ ID NO: 428484 - RNA, 17 nt, Homo sapiens
accucucucugcuccuc

SEQ ID NO: 428485 - RNA, 14 nt, Homo sapiens
accucugcacuacu

SEQ ID NO: 428486 - RNA, 15 nt, Homo sapiens
accucugccccagau

SEQ ID NO: 428487 - RNA, 11 nt, Homo sapiens
accucuuguuu

SEQ ID NO: 428488 - RNA, 12 nt, Homo sapiens
accucuuuccaa

SEQ ID NO: 428489 - RNA, 18 nt, Homo sapiens
accugaaagaagcccagg

SEQ ID NO: 428490 - RNA, 18 nt, Homo sapiens
accugacaauggcagcua

SEQ ID NO: 428491 - RNA, 14 nt, Homo sapiens
accugagauggagg

SEQ ID NO: 428492 - RNA, 16 nt, Homo sapiens
accugauuuccauuug

SEQ ID NO: 428493 - RNA, 18 nt, Homo sapiens
accugauuuccauuugca

SEQ ID NO: 428494 - RNA, 17 nt, Homo sapiens
accugcacuucauaucu

SEQ ID NO: 428495 - RNA, 18 nt, Homo sapiens
accugcacuucauaucua

SEQ ID NO: 428496 - RNA, 13 nt, Homo sapiens
accugcaguuccu

SEQ ID NO: 428497 - RNA, 17 nt, Homo sapiens
accugccacaaugugau

SEQ ID NO: 428498 - RNA, 15 nt, Homo sapiens
accugcccugccuga

SEQ ID NO: 428499 - RNA, 20 nt, Homo sapiens
accugccugcaucugugaaa

SEQ ID NO: 428500 - RNA, 19 nt, Homo sapiens
accugcgccuggcucuguc

SEQ ID NO: 428501 - RNA, 20 nt, Homo sapiens
accugcgccuggcucuguca

SEQ ID NO: 428502 - RNA, 18 nt, Homo sapiens
accugcugguuguugcca

SEQ ID NO: 428503 - RNA, 23 nt, Homo sapiens
accuggacauuccccauccugca

SEQ ID NO: 428504 - RNA, 23 nt, Homo sapiens
accuggcacagaaagggcagcuu

SEQ ID NO: 428505 - RNA, 22 nt, Homo sapiens
accuggcuucccaggacccugg

SEQ ID NO: 428506 - RNA, 15 nt, Homo sapiens
accugggcccuaggc

SEQ ID NO: 428507 - RNA, 20 nt, Homo sapiens
accugggcuuaaguuuuacu

SEQ ID NO: 428508 - RNA, 14 nt, Homo sapiens
accuggucauuuca

SEQ ID NO: 428509 - RNA, 23 nt, Homo sapiens
accuggucuguuuucugugcacu

SEQ ID NO: 428510 - RNA, 14 nt, Homo sapiens
accuguaaaacuuu

SEQ ID NO: 428511 - RNA, 15 nt, Homo sapiens
accuguaaucucagc

SEQ ID NO: 428512 - RNA, 14 nt, Homo sapiens
accuguagacugug

SEQ ID NO: 428513 - RNA, 20 nt, Homo sapiens
accuguagacuguggaacua

SEQ ID NO: 428514 - RNA, 11 nt, Homo sapiens
accugucaaug

SEQ ID NO: 428515 - RNA, 16 nt, Homo sapiens
accugucaucugggcc

SEQ ID NO: 428516 - RNA, 16 nt, Homo sapiens
accugucccaccucaa

SEQ ID NO: 428517 - RNA, 22 nt, Homo sapiens
accugucccucuccuauguggc

SEQ ID NO: 428518 - RNA, 18 nt, Homo sapiens
accugucuaggucuccuc

SEQ ID NO: 428519 - RNA, 18 nt, Homo sapiens
accugucucauagccucg

SEQ ID NO: 428520 - RNA, 21 nt, Homo sapiens
accugugagcauccuucccag

SEQ ID NO: 428521 - RNA, 21 nt, Homo sapiens
accugugcacagccauggcug

SEQ ID NO: 428522 - RNA, 17 nt, Homo sapiens
accugugguaucuuuaa

SEQ ID NO: 428523 - RNA, 23 nt, Homo sapiens
accugugugagagaauuuaucac

SEQ ID NO: 428524 - RNA, 22 nt, Homo sapiens
accuguguguucuuuugauaca

SEQ ID NO: 428525 - RNA, 15 nt, Homo sapiens
accuguguucuugcu

SEQ ID NO: 428526 - RNA, 19 nt, Homo sapiens
accuguucaaaauuccauu

SEQ ID NO: 428527 - RNA, 19 nt, Homo sapiens
accuguuuuuaagcuguuu

SEQ ID NO: 428528 - RNA, 14 nt, Homo sapiens
accuuaaacaagcu

SEQ ID NO: 428529 - RNA, 17 nt, Homo sapiens
accuuauuguaccucuc

SEQ ID NO: 428530 - RNA, 15 nt, Homo sapiens
accuucaauacuuaa

SEQ ID NO: 428531 - RNA, 18 nt, Homo sapiens
accuucaugcuuacuauu

SEQ ID NO: 428532 - RNA, 13 nt, Homo sapiens
accuucauucucc

SEQ ID NO: 428533 - RNA, 23 nt, Homo sapiens
accuucuaauccaugugcugcug

SEQ ID NO: 428534 - RNA, 12 nt, Homo sapiens
accuucucagga

SEQ ID NO: 428535 - RNA, 20 nt, Homo sapiens
accuucuguggcucacagaa

SEQ ID NO: 428536 - RNA, 13 nt, Homo sapiens
accuucuuccaca

SEQ ID NO: 428537 - RNA, 12 nt, Homo sapiens
accuucuuggcu

SEQ ID NO: 428538 - RNA, 19 nt, Homo sapiens
accuugaagaaccucucac

SEQ ID NO: 428539 - RNA, 18 nt, Homo sapiens
accuugaaugaugccaug

SEQ ID NO: 428540 - RNA, 19 nt, Homo sapiens
accuugacuucugcccaaa

SEQ ID NO: 428541 - RNA, 22 nt, Homo sapiens
accuugacuugauuagugccuu

SEQ ID NO: 428542 - RNA, 18 nt, Homo sapiens
accuugaucccaauccuu

SEQ ID NO: 428543 - RNA, 14 nt, Homo sapiens
accuugcucugcca

SEQ ID NO: 428544 - RNA, 12 nt, Homo sapiens
accuugcugcua

SEQ ID NO: 428545 - RNA, 23 nt, Homo sapiens
accuuggaucucggucacaggga

SEQ ID NO: 428546 - RNA, 13 nt, Homo sapiens
accuuguuucccu

SEQ ID NO: 428547 - RNA, 14 nt, Homo sapiens
accuuuauauuugg

SEQ ID NO: 428548 - RNA, 17 nt, Homo sapiens
accuuucaaauuucaca

SEQ ID NO: 428549 - RNA, 23 nt, Homo sapiens
accuuucacaagggcaaacuuuu

SEQ ID NO: 428550 - RNA, 21 nt, Homo sapiens
accuuucaugugccugaaggc

SEQ ID NO: 428551 - RNA, 22 nt, Homo sapiens
accuuugaggucuaaacaaaua

SEQ ID NO: 428552 - RNA, 23 nt, Homo sapiens
accuuuugggaaaugcugauuua

SEQ ID NO: 428553 - RNA, 19 nt, Homo sapiens
accuuuuugacuuuuccaa

SEQ ID NO: 428554 - RNA, 14 nt, Homo sapiens
acgaaaauaaagua

SEQ ID NO: 428555 - RNA, 18 nt, Homo sapiens
acgaaacacagaacucag

SEQ ID NO: 428556 - RNA, 14 nt, Homo sapiens
acgaaacacugugc

SEQ ID NO: 428557 - RNA, 11 nt, Homo sapiens
acgaaacugcu

SEQ ID NO: 428558 - RNA, 16 nt, Homo sapiens
acgaagcuuaguauaa

SEQ ID NO: 428559 - RNA, 17 nt, Homo sapiens
acgaaggccuguguguu

SEQ ID NO: 428560 - RNA, 21 nt, Homo sapiens
acgaauggcagcauacacaga

SEQ ID NO: 428561 - RNA, 21 nt, Homo sapiens
acgagacacccuaacucuugc

SEQ ID NO: 428562 - RNA, 16 nt, Homo sapiens
acgagagagucuucca

SEQ ID NO: 428563 - RNA, 21 nt, Homo sapiens
acgaggcugggccaagccagg

SEQ ID NO: 428564 - RNA, 20 nt, Homo sapiens
acgaggugguagcucugagc

SEQ ID NO: 428565 - RNA, 20 nt, Homo sapiens
acgagucaccugcaagcccc

SEQ ID NO: 428566 - RNA, 17 nt, Homo sapiens
acgauaugcaaguucau

SEQ ID NO: 428567 - RNA, 12 nt, Homo sapiens
acgaucucagcu

SEQ ID NO: 428568 - RNA, 13 nt, Homo sapiens
acgaucucagcuc

SEQ ID NO: 428569 - RNA, 20 nt, Homo sapiens
acgaucucagcucacugcaa

SEQ ID NO: 428570 - RNA, 13 nt, Homo sapiens
acgauuucagcua

SEQ ID NO: 428571 - RNA, 18 nt, Homo sapiens
acgcaccuguagucccag

SEQ ID NO: 428572 - RNA, 16 nt, Homo sapiens
acgcaguaacuaaagc

SEQ ID NO: 428573 - RNA, 20 nt, Homo sapiens
acgcccaugugugagugugu

SEQ ID NO: 428574 - RNA, 12 nt, Homo sapiens
acgccuccccaa

SEQ ID NO: 428575 - RNA, 13 nt, Homo sapiens
acgccuccccaau

SEQ ID NO: 428576 - RNA, 14 nt, Homo sapiens
acgccugcccuccc

SEQ ID NO: 428577 - RNA, 19 nt, Homo sapiens
acgccugcccuccccagag

SEQ ID NO: 428578 - RNA, 21 nt, Homo sapiens
acgccuguaaucccagcacuu

SEQ ID NO: 428579 - RNA, 14 nt, Homo sapiens
acuugcaaguccca

SEQ ID NO: 428580 - RNA, 18 nt, Homo sapiens
acuugcacgcccaugugu

SEQ ID NO: 428581 - RNA, 14 nt, Homo sapiens
acuugcacugugcu

SEQ ID NO: 428582 - RNA, 12 nt, Homo sapiens
acuugccaagaa

SEQ ID NO: 428583 - RNA, 20 nt, Homo sapiens
acuugcucaauaaaggucau

SEQ ID NO: 428584 - RNA, 23 nt, Homo sapiens
acuugcugcugagugcaccacuu

SEQ ID NO: 428585 - RNA, 21 nt, Homo sapiens
acuugcuuuaugccuucuuau

SEQ ID NO: 428586 - RNA, 17 nt, Homo sapiens
acuuggaaaugggagac

SEQ ID NO: 428587 - RNA, 19 nt, Homo sapiens
acuuggggauuaucuguca

SEQ ID NO: 428588 - RNA, 20 nt, Homo sapiens
acuuggggauuaucugucau

SEQ ID NO: 428589 - RNA, 24 nt, Homo sapiens
acuugggugaaaaguauggcagug

SEQ ID NO: 428590 - RNA, 23 nt, Homo sapiens
acuuguaagaaaaugagacaaaa

SEQ ID NO: 428591 - RNA, 19 nt, Homo sapiens
acuugucuucccuucugau

SEQ ID NO: 428592 - RNA, 22 nt, Homo sapiens
acuugugcugaucgugcuaaau

SEQ ID NO: 428593 - RNA, 14 nt, Homo sapiens
acuuuaacugacuu

SEQ ID NO: 428594 - RNA, 16 nt, Homo sapiens
acuuuaacugacuuaa

SEQ ID NO: 428595 - RNA, 21 nt, Homo sapiens
acuuuagaagugcauuucuga

SEQ ID NO: 428596 - RNA, 23 nt, Homo sapiens
acuuuagggcuaaccaguucucu

SEQ ID NO: 428597 - RNA, 13 nt, Homo sapiens
acuuuaucaauua

SEQ ID NO: 428598 - RNA, 13 nt, Homo sapiens
acuuuccucucuc

SEQ ID NO: 428599 - RNA, 15 nt, Homo sapiens
acuuuccucuuccac

SEQ ID NO: 428600 - RNA, 12 nt, Homo sapiens
acuuugaaaaua

SEQ ID NO: 428601 - RNA, 15 nt, Homo sapiens
acuuugccacuggau

SEQ ID NO: 428602 - RNA, 11 nt, Homo sapiens
acuuugggacg

SEQ ID NO: 428603 - RNA, 22 nt, Homo sapiens
acuuuguacccaucaugugcuc

SEQ ID NO: 428604 - RNA, 19 nt, Homo sapiens
acuuuguauuaauguguua

SEQ ID NO: 428605 - RNA, 16 nt, Homo sapiens
acuuugugcaauauga

SEQ ID NO: 428606 - RNA, 23 nt, Homo sapiens
acuuuuaaguugcugaugaacuc

SEQ ID NO: 428607 - RNA, 17 nt, Homo sapiens
acuuuuaauuagugaug

SEQ ID NO: 428608 - RNA, 15 nt, Homo sapiens
acuuuuauaaauuaa

SEQ ID NO: 428609 - RNA, 20 nt, Homo sapiens
acuuuucuaacauaugucua

SEQ ID NO: 428610 - RNA, 21 nt, Homo sapiens
acuuuucuuaaaaaguuauaa

SEQ ID NO: 428611 - RNA, 17 nt, Homo sapiens
acuuuugaagaacaaaa

SEQ ID NO: 428612 - RNA, 13 nt, Homo sapiens
acuuuugaagucc

SEQ ID NO: 428613 - RNA, 21 nt, Homo sapiens
acuuuugcagcuuccuuccaa

SEQ ID NO: 428614 - RNA, 17 nt, Homo sapiens
acuuuuuagccagugac

SEQ ID NO: 428615 - RNA, 13 nt, Homo sapiens
acuuuuugcagcu

SEQ ID NO: 428616 - RNA, 19 nt, Homo sapiens
agaaaaaaaaggcaguauu

SEQ ID NO: 428617 - RNA, 20 nt, Homo sapiens
agaaaaaauaacacacauau

SEQ ID NO: 428618 - RNA, 17 nt, Homo sapiens
agaaaaacaccgcuucu

SEQ ID NO: 428619 - RNA, 21 nt, Homo sapiens
agaaaaacaccgcuucugccu

SEQ ID NO: 428620 - RNA, 13 nt, Homo sapiens
agaaaaaccaaug

SEQ ID NO: 428621 - RNA, 20 nt, Homo sapiens
agaaaaaggacucugcuuca

SEQ ID NO: 428622 - RNA, 22 nt, Homo sapiens
agaaaacagaccuaaugcuccu

SEQ ID NO: 428623 - RNA, 15 nt, Homo sapiens
agaaaagacacuuca

SEQ ID NO: 428624 - RNA, 14 nt, Homo sapiens
agaaaagcugccau

SEQ ID NO: 428625 - RNA, 19 nt, Homo sapiens
agaaaagcugccauuuccc

SEQ ID NO: 428626 - RNA, 17 nt, Homo sapiens
agaaaauaaauuuaacu

SEQ ID NO: 428627 - RNA, 15 nt, Homo sapiens
agaaaauacaauaaa

SEQ ID NO: 428628 - RNA, 14 nt, Homo sapiens
agaaaauaugauau

SEQ ID NO: 428629 - RNA, 16 nt, Homo sapiens
agaaaaugaagcccua

SEQ ID NO: 428630 - RNA, 19 nt, Homo sapiens
agaaaauggacguguuaug

SEQ ID NO: 428631 - RNA, 20 nt, Homo sapiens
agaaaaugugucugcaacau

SEQ ID NO: 428632 - RNA, 18 nt, Homo sapiens
agaaacacacuuuugcac

SEQ ID NO: 428633 - RNA, 19 nt, Homo sapiens
agaaacacacuuuugcaca

SEQ ID NO: 428634 - RNA, 14 nt, Homo sapiens
agaaacagcuuuca

SEQ ID NO: 428635 - RNA, 17 nt, Homo sapiens
agaaaccacugggcaua

SEQ ID NO: 428636 - RNA, 24 nt, Homo sapiens
agaaacccuuccacguguaugcaa

SEQ ID NO: 428637 - RNA, 20 nt, Homo sapiens
agaaaccuuauuguaccucu

SEQ ID NO: 428638 - RNA, 16 nt, Homo sapiens
agaaacuugcuuauca

SEQ ID NO: 428639 - RNA, 14 nt, Homo sapiens
agaaagaguucagu

SEQ ID NO: 428640 - RNA, 23 nt, Homo sapiens
agaaagcagaggcuggccucaga

SEQ ID NO: 428641 - RNA, 12 nt, Homo sapiens
agaaagccaaau

SEQ ID NO: 428642 - RNA, 23 nt, Homo sapiens
agaaagccauauuccagcaguga

SEQ ID NO: 428643 - RNA, 18 nt, Homo sapiens
agaaagugaagcaaauca

SEQ ID NO: 428644 - RNA, 22 nt, Homo sapiens
agaaaguggcagagccaggauu

SEQ ID NO: 428645 - RNA, 18 nt, Homo sapiens
agaaaguucuuaaacuca

SEQ ID NO: 428646 - RNA, 19 nt, Homo sapiens
agaaauaaaagaagcugcu

SEQ ID NO: 428647 - RNA, 18 nt, Homo sapiens
agaaauaaaccucauccu

SEQ ID NO: 428648 - RNA, 17 nt, Homo sapiens
agaaauaauacccugcc

SEQ ID NO: 428649 - RNA, 14 nt, Homo sapiens
agaaauaauaugca

SEQ ID NO: 428650 - RNA, 15 nt, Homo sapiens
agaaauaauaugcau

SEQ ID NO: 428651 - RNA, 13 nt, Homo sapiens
agaaauacuuuca

SEQ ID NO: 428652 - RNA, 10 nt, Homo sapiens
agaaauaucu

SEQ ID NO: 428653 - RNA, 22 nt, Homo sapiens
agaaaucccaguucauguugcu

SEQ ID NO: 428654 - RNA, 18 nt, Homo sapiens
agaaaugaugauguggaa

SEQ ID NO: 428655 - RNA, 21 nt, Homo sapiens
agaaauuuuuuuccagaauug

SEQ ID NO: 428656 - RNA, 15 nt, Homo sapiens
agaacaaacaccucc

SEQ ID NO: 428657 - RNA, 20 nt, Homo sapiens
agaacaagaccccgucucaa

SEQ ID NO: 428658 - RNA, 18 nt, Homo sapiens
agaacacacucuacaaaa

SEQ ID NO: 428659 - RNA, 17 nt, Homo sapiens
agaacacguuggcucag

SEQ ID NO: 428660 - RNA, 19 nt, Homo sapiens
agaacagggaugcuaucuc

SEQ ID NO: 428661 - RNA, 23 nt, Homo sapiens
agaacaggggucgccaacacuug

SEQ ID NO: 428662 - RNA, 15 nt, Homo sapiens
agaacaucaagauac

SEQ ID NO: 428663 - RNA, 15 nt, Homo sapiens
agaacauuaagagau

SEQ ID NO: 428664 - RNA, 23 nt, Homo sapiens
agaacccauuugccaugcugcua

SEQ ID NO: 428665 - RNA, 18 nt, Homo sapiens
agaacccuuggagccaau

SEQ ID NO: 428666 - RNA, 13 nt, Homo sapiens
agaaccucuuccc

SEQ ID NO: 428667 - RNA, 14 nt, Homo sapiens
agaaccugguggcu

SEQ ID NO: 428668 - RNA, 16 nt, Homo sapiens
agaacucaugugauuu

SEQ ID NO: 428669 - RNA, 16 nt, Homo sapiens
agaacugcagucagca

SEQ ID NO: 428670 - RNA, 22 nt, Homo sapiens
agaacugcccagccucagcuga

SEQ ID NO: 428671 - RNA, 15 nt, Homo sapiens
agaacugcuugcauu

SEQ ID NO: 428672 - RNA, 12 nt, Homo sapiens
agaacugugcuc

SEQ ID NO: 428673 - RNA, 17 nt, Homo sapiens
agaacuguucauuucca

SEQ ID NO: 428674 - RNA, 23 nt, Homo sapiens
agaacuucugaaaccucuggguc

SEQ ID NO: 428675 - RNA, 16 nt, Homo sapiens
agaacuugucccucag

SEQ ID NO: 428676 - RNA, 14 nt, Homo sapiens
agaauauuguuaaa

SEQ ID NO: 428677 - RNA, 15 nt, Homo sapiens
agaaucaagucugug

SEQ ID NO: 428678 - RNA, 21 nt, Homo sapiens
agaaucaccuaauuaauuuca

SEQ ID NO: 428679 - RNA, 17 nt, Homo sapiens
agaaucacuugacuuug

SEQ ID NO: 428680 - RNA, 20 nt, Homo sapiens
agaaucacuugacuuugcca

SEQ ID NO: 428681 - RNA, 20 nt, Homo sapiens
agaauccugccucuccccaa

SEQ ID NO: 428682 - RNA, 17 nt, Homo sapiens
agaaucugcagcuaacu

SEQ ID NO: 428683 - RNA, 19 nt, Homo sapiens
agaaucugcauuuagcaca

SEQ ID NO: 428684 - RNA, 16 nt, Homo sapiens
agaaugagcaagaggc

SEQ ID NO: 428685 - RNA, 12 nt, Homo sapiens
agaaugcaugua

SEQ ID NO: 428686 - RNA, 21 nt, Homo sapiens
agaauggggcuuccauggugg

SEQ ID NO: 428687 - RNA, 21 nt, Homo sapiens
agaauguauggagaguuacau

SEQ ID NO: 428688 - RNA, 14 nt, Homo sapiens
agaaugucauuugc

SEQ ID NO: 428689 - RNA, 21 nt, Homo sapiens
agaauguuacuuuggaaugac

SEQ ID NO: 428690 - RNA, 15 nt, Homo sapiens
agaauuaaugacaac

SEQ ID NO: 428691 - RNA, 18 nt, Homo sapiens
agaauuaguggcacuugc

SEQ ID NO: 428692 - RNA, 14 nt, Homo sapiens
agaauuauuacauc

SEQ ID NO: 428693 - RNA, 17 nt, Homo sapiens
agaauucaaggaggaaa

SEQ ID NO: 428694 - RNA, 16 nt, Homo sapiens
agaauucauuaugcug

SEQ ID NO: 428695 - RNA, 16 nt, Homo sapiens
agaauucuuauacaca

SEQ ID NO: 428696 - RNA, 17 nt, Homo sapiens
agaauugaaaaaccauu

SEQ ID NO: 428697 - RNA, 18 nt, Homo sapiens
agaauugaaaaaccauuu

SEQ ID NO: 428698 - RNA, 19 nt, Homo sapiens
agaauugaaugucaauaug

SEQ ID NO: 428699 - RNA, 23 nt, Homo sapiens
agaauugcuccugcaugcaacua

SEQ ID NO: 428700 - RNA, 19 nt, Homo sapiens
agaauugcuugaacccagg

SEQ ID NO: 428701 - RNA, 14 nt, Homo sapiens
agaauuuagcugua

SEQ ID NO: 428702 - RNA, 19 nt, Homo sapiens
agaauuucccaaagcagug

SEQ ID NO: 428703 - RNA, 19 nt, Homo sapiens
agacaaaaucuuaaaugcc

SEQ ID NO: 428704 - RNA, 20 nt, Homo sapiens
agacaauuuauccaaagcau

SEQ ID NO: 428705 - RNA, 14 nt, Homo sapiens
agacacacacacac

SEQ ID NO: 428706 - RNA, 21 nt, Homo sapiens
agacacaguauugacuucuuu

SEQ ID NO: 428707 - RNA, 18 nt, Homo sapiens
agacaccaaguuccguca

SEQ ID NO: 428708 - RNA, 20 nt, Homo sapiens
agacaccaauggauccuugu

SEQ ID NO: 428709 - RNA, 15 nt, Homo sapiens
agacacccaguggaa

SEQ ID NO: 428710 - RNA, 11 nt, Homo sapiens
agacaccucag

SEQ ID NO: 428711 - RNA, 15 nt, Homo sapiens
agacacguucuugcc

SEQ ID NO: 428712 - RNA, 18 nt, Homo sapiens
agacacuaguagagcaaa

SEQ ID NO: 428713 - RNA, 13 nt, Homo sapiens
agacagagacaau

SEQ ID NO: 428714 - RNA, 20 nt, Homo sapiens
agacagagcagaucagucuu

SEQ ID NO: 428715 - RNA, 19 nt, Homo sapiens
agacagcagggacaagaua

SEQ ID NO: 428716 - RNA, 15 nt, Homo sapiens
agacaggaagaccaa

SEQ ID NO: 428717 - RNA, 14 nt, Homo sapiens
agacaguaaagacc

SEQ ID NO: 428718 - RNA, 17 nt, Homo sapiens
agacaguaacauuucau

SEQ ID NO: 428719 - RNA, 18 nt, Homo sapiens
agacauaaauuacuuuuu

SEQ ID NO: 428720 - RNA, 13 nt, Homo sapiens
agacauaccucuc

SEQ ID NO: 428721 - RNA, 17 nt, Homo sapiens
agacauacuccuuccau

SEQ ID NO: 428722 - RNA, 19 nt, Homo sapiens
agacauacuccuuccauca

SEQ ID NO: 428723 - RNA, 18 nt, Homo sapiens
agacauucauugucccug

SEQ ID NO: 428724 - RNA, 14 nt, Homo sapiens
agacauucuuccaa

SEQ ID NO: 428725 - RNA, 14 nt, Homo sapiens
agaccacaccaagg

SEQ ID NO: 428726 - RNA, 18 nt, Homo sapiens
agaccaccucucaauauu

SEQ ID NO: 428727 - RNA, 15 nt, Homo sapiens
agaccagcuucuagc

SEQ ID NO: 428728 - RNA, 17 nt, Homo sapiens
agaccagcuuugcagug

SEQ ID NO: 428729 - RNA, 18 nt, Homo sapiens
agaccaggaggcugcaag

SEQ ID NO: 428730 - RNA, 13 nt, Homo sapiens
agaccaguacugg

SEQ ID NO: 428731 - RNA, 13 nt, Homo sapiens
agaccaguccaug

SEQ ID NO: 428732 - RNA, 19 nt, Homo sapiens
agaccagucuggccaauau

SEQ ID NO: 428733 - RNA, 14 nt, Homo sapiens
agaccauaauguua

SEQ ID NO: 428734 - RNA, 15 nt, Homo sapiens
agaccauaauguuac

SEQ ID NO: 428735 - RNA, 16 nt, Homo sapiens
agaccauaauguuaca

SEQ ID NO: 428736 - RNA, 20 nt, Homo sapiens
agaccauuuaucugggauua

SEQ ID NO: 428737 - RNA, 17 nt, Homo sapiens
agacccccacaccucag

SEQ ID NO: 428738 - RNA, 22 nt, Homo sapiens
agacccccaucucugcaaaaaa

SEQ ID NO: 428739 - RNA, 18 nt, Homo sapiens
agaccccccaucagugga

SEQ ID NO: 428740 - RNA, 13 nt, Homo sapiens
agaccccuuggcc

SEQ ID NO: 428741 - RNA, 16 nt, Homo sapiens
agacccucuucucugg

SEQ ID NO: 428742 - RNA, 19 nt, Homo sapiens
agacccugagacuccagaa

SEQ ID NO: 428743 - RNA, 22 nt, Homo sapiens
agacccugaguccuugggccag

SEQ ID NO: 428744 - RNA, 15 nt, Homo sapiens
agaccgugugugaaa

SEQ ID NO: 428745 - RNA, 23 nt, Homo sapiens
agaccugaaagaugggcaaaaga

SEQ ID NO: 428746 - RNA, 12 nt, Homo sapiens
agaccugccugu

SEQ ID NO: 428747 - RNA, 11 nt, Homo sapiens
agaccuuccac

SEQ ID NO: 428748 - RNA, 20 nt, Homo sapiens
agaccuugucuccacaaaaa

SEQ ID NO: 428749 - RNA, 21 nt, Homo sapiens
agacgugcacuuggugcugcg

SEQ ID NO: 428750 - RNA, 15 nt, Homo sapiens
agacuagauugccuu

SEQ ID NO: 428751 - RNA, 13 nt, Homo sapiens
agacuagugccgu

SEQ ID NO: 428752 - RNA, 21 nt, Homo sapiens
agacuaugugucaugauuuca

SEQ ID NO: 428753 - RNA, 16 nt, Homo sapiens
agacucagccaagaca

SEQ ID NO: 428754 - RNA, 19 nt, Homo sapiens
agacucagguuccagaaca

SEQ ID NO: 428755 - RNA, 20 nt, Homo sapiens
agacucgauaguggugguga

SEQ ID NO: 428756 - RNA, 22 nt, Homo sapiens
agacucgauagugguggugaac

SEQ ID NO: 428757 - RNA, 16 nt, Homo sapiens
agacucuguaaccacc

SEQ ID NO: 428758 - RNA, 14 nt, Homo sapiens
agacugaaagaaua

SEQ ID NO: 428759 - RNA, 18 nt, Homo sapiens
agacugaaagcagcagcu

SEQ ID NO: 428760 - RNA, 21 nt, Homo sapiens
agacuggguuccucuccaagc

SEQ ID NO: 428761 - RNA, 23 nt, Homo sapiens
agacuguugcucaaaucuauuca

SEQ ID NO: 428762 - RNA, 14 nt, Homo sapiens
agacuucuuugcaa

SEQ ID NO: 428763 - RNA, 13 nt, Homo sapiens
agacuuugcccag

SEQ ID NO: 428764 - RNA, 16 nt, Homo sapiens
agagaaaaaccaauga

SEQ ID NO: 428765 - RNA, 12 nt, Homo sapiens
agagaaaagcca

SEQ ID NO: 428766 - RNA, 18 nt, Homo sapiens
agagaaacuugaaugcuc

SEQ ID NO: 428767 - RNA, 20 nt, Homo sapiens
agagaaacuugaaugcucca

SEQ ID NO: 428768 - RNA, 14 nt, Homo sapiens
agagaaaugagcug

SEQ ID NO: 428769 - RNA, 13 nt, Homo sapiens
agagaacagggau

SEQ ID NO: 428770 - RNA, 21 nt, Homo sapiens
agagacaauaaaacauuccug

SEQ ID NO: 428771 - RNA, 21 nt, Homo sapiens
agagacaggguuucacugugu

SEQ ID NO: 428772 - RNA, 16 nt, Homo sapiens
agagacccccgugcca

SEQ ID NO: 428773 - RNA, 14 nt, Homo sapiens
agagacuagacaaa

SEQ ID NO: 428774 - RNA, 17 nt, Homo sapiens
agagacuagacaaauaa

SEQ ID NO: 428775 - RNA, 17 nt, Homo sapiens
agagacucacacuggac

SEQ ID NO: 428776 - RNA, 12 nt, Homo sapiens
agagacuggcca

SEQ ID NO: 428777 - RNA, 12 nt, Homo sapiens
agagacuguaga

SEQ ID NO: 428778 - RNA, 13 nt, Homo sapiens
agagacugugagg

SEQ ID NO: 428779 - RNA, 23 nt, Homo sapiens
agagacuuuauccaugccaauag

SEQ ID NO: 428780 - RNA, 14 nt, Homo sapiens
agagagaaccaagc

SEQ ID NO: 428781 - RNA, 14 nt, Homo sapiens
agagagaagugccc

SEQ ID NO: 428782 - RNA, 18 nt, Homo sapiens
agagagacagacuugaga

SEQ ID NO: 428783 - RNA, 19 nt, Homo sapiens
agagagccuggugcugcug

SEQ ID NO: 428784 - RNA, 19 nt, Homo sapiens
agagaggaguucaaugauc

SEQ ID NO: 428785 - RNA, 15 nt, Homo sapiens
agagaggcucugaga

SEQ ID NO: 428786 - RNA, 21 nt, Homo sapiens
agagagucuuccagguacuga

SEQ ID NO: 428787 - RNA, 22 nt, Homo sapiens
agagagucuuccagguacugau

SEQ ID NO: 428788 - RNA, 18 nt, Homo sapiens
agagagugagagcacaaa

SEQ ID NO: 428789 - RNA, 23 nt, Homo sapiens
agagaucuaaucccuucaaggaa

SEQ ID NO: 428790 - RNA, 15 nt, Homo sapiens
agagaugccaugaua

SEQ ID NO: 428791 - RNA, 19 nt, Homo sapiens
agagaugccaugauaucac

SEQ ID NO: 428792 - RNA, 21 nt, Homo sapiens
agagauggaauaaagcccuug

SEQ ID NO: 428793 - RNA, 16 nt, Homo sapiens
agagaugggguuucac

SEQ ID NO: 428794 - RNA, 21 nt, Homo sapiens
agagaugggguuucaccaugu

SEQ ID NO: 428795 - RNA, 20 nt, Homo sapiens
agagauuagccuguagcuua

SEQ ID NO: 428796 - RNA, 14 nt, Homo sapiens
agagauucauuauu

SEQ ID NO: 428797 - RNA, 20 nt, Homo sapiens
agagcaagacucugucucaa

SEQ ID NO: 428798 - RNA, 16 nt, Homo sapiens
agagcaaucguguaua

SEQ ID NO: 428799 - RNA, 21 nt, Homo sapiens
agagcaaucuugcugugaaac

SEQ ID NO: 428800 - RNA, 22 nt, Homo sapiens
agagcagauucuagcacaucau

SEQ ID NO: 428801 - RNA, 21 nt, Homo sapiens
agagcaggcuggcagcucucc

SEQ ID NO: 428802 - RNA, 12 nt, Homo sapiens
agagcaucucuu

SEQ ID NO: 428803 - RNA, 20 nt, Homo sapiens
agagcaucugcucugagacg

SEQ ID NO: 428804 - RNA, 23 nt, Homo sapiens
agagccacccaggccacugaccu

SEQ ID NO: 428805 - RNA, 19 nt, Homo sapiens
agagccagggcuguccuua

SEQ ID NO: 428806 - RNA, 11 nt, Homo sapiens
agagccaguga

SEQ ID NO: 428807 - RNA, 12 nt, Homo sapiens
agagccagugaa

SEQ ID NO: 428808 - RNA, 21 nt, Homo sapiens
augcuuacuacagaaagcaaa

SEQ ID NO: 428809 - RNA, 20 nt, Homo sapiens
augcuuauaagcaacaugaa

SEQ ID NO: 428810 - RNA, 17 nt, Homo sapiens
augcuuauguguugcau

SEQ ID NO: 428811 - RNA, 14 nt, Homo sapiens
augcuucaguugua

SEQ ID NO: 428812 - RNA, 15 nt, Homo sapiens
augcuuccugacaau

SEQ ID NO: 428813 - RNA, 20 nt, Homo sapiens
augcuugcuucaaccccaug

SEQ ID NO: 428814 - RNA, 23 nt, Homo sapiens
augcuugcuucaaccccaugaga

SEQ ID NO: 428815 - RNA, 14 nt, Homo sapiens
augcuuguacaguu

SEQ ID NO: 428816 - RNA, 14 nt, Homo sapiens
augcuuucuacuca

SEQ ID NO: 428817 - RNA, 22 nt, Homo sapiens
augcuuuguuuucccacacaua

SEQ ID NO: 428818 - RNA, 20 nt, Homo sapiens
augcuuuuacuaagcacugu

SEQ ID NO: 428819 - RNA, 18 nt, Homo sapiens
auggaaaacuuaguuugu

SEQ ID NO: 428820 - RNA, 12 nt, Homo sapiens
auggaaccaaau

SEQ ID NO: 428821 - RNA, 18 nt, Homo sapiens
auggaaguggcagugaaa

SEQ ID NO: 428822 - RNA, 15 nt, Homo sapiens
auggaauaaaccauu

SEQ ID NO: 428823 - RNA, 19 nt, Homo sapiens
auggaauuagaaauauauc

SEQ ID NO: 428824 - RNA, 20 nt, Homo sapiens
auggaauuagaaauauaucu

SEQ ID NO: 428825 - RNA, 19 nt, Homo sapiens
auggaccaauuagcauucc

SEQ ID NO: 428826 - RNA, 19 nt, Homo sapiens
auggaccaggaagcccuga

SEQ ID NO: 428827 - RNA, 17 nt, Homo sapiens
auggacucuguggugcc

SEQ ID NO: 428828 - RNA, 17 nt, Homo sapiens
auggacucuucccccac

SEQ ID NO: 428829 - RNA, 16 nt, Homo sapiens
auggagaaaaugcuua

SEQ ID NO: 428830 - RNA, 18 nt, Homo sapiens
auggagaaucugcugcau

SEQ ID NO: 428831 - RNA, 18 nt, Homo sapiens
auggagcaagugagcacu

SEQ ID NO: 428832 - RNA, 14 nt, Homo sapiens
auggagugccugua

SEQ ID NO: 428833 - RNA, 15 nt, Homo sapiens
auggagugccuguac

SEQ ID NO: 428834 - RNA, 22 nt, Homo sapiens
auggaguuaaacuugaugccag

SEQ ID NO: 428835 - RNA, 17 nt, Homo sapiens
auggauaucccuaccuu

SEQ ID NO: 428836 - RNA, 17 nt, Homo sapiens
auggaucuuaaagcauu

SEQ ID NO: 428837 - RNA, 16 nt, Homo sapiens
auggauuaaauggcac

SEQ ID NO: 428838 - RNA, 14 nt, Homo sapiens
auggcaacaaacac

SEQ ID NO: 428839 - RNA, 22 nt, Homo sapiens
auggcaacaaacacauugugaa

SEQ ID NO: 428840 - RNA, 17 nt, Homo sapiens
auggcaauuucacugau

SEQ ID NO: 428841 - RNA, 16 nt, Homo sapiens
auggcaccuuuugcac

SEQ ID NO: 428842 - RNA, 15 nt, Homo sapiens
auggcagaaccaaag

SEQ ID NO: 428843 - RNA, 14 nt, Homo sapiens
auggcagaagggaa

SEQ ID NO: 428844 - RNA, 14 nt, Homo sapiens
auggcaugcugaaa

SEQ ID NO: 428845 - RNA, 19 nt, Homo sapiens
auggccacaacaugaaaac

SEQ ID NO: 428846 - RNA, 15 nt, Homo sapiens
auggcuauauggcaa

SEQ ID NO: 428847 - RNA, 16 nt, Homo sapiens
auggcucggccaggca

SEQ ID NO: 428848 - RNA, 19 nt, Homo sapiens
auggcuuaagccuguguau

SEQ ID NO: 428849 - RNA, 23 nt, Homo sapiens
auggcuuuuuuuuguagccaguc

SEQ ID NO: 428850 - RNA, 20 nt, Homo sapiens
augggaaccuaguacucucu

SEQ ID NO: 428851 - RNA, 18 nt, Homo sapiens
augggacacccaacacuu

SEQ ID NO: 428852 - RNA, 17 nt, Homo sapiens
augggacugaugucauc

SEQ ID NO: 428853 - RNA, 14 nt, Homo sapiens
augggagaaccucg

SEQ ID NO: 428854 - RNA, 18 nt, Homo sapiens
augggagccucagacuca

SEQ ID NO: 428855 - RNA, 16 nt, Homo sapiens
augggaugcuugccua

SEQ ID NO: 428856 - RNA, 17 nt, Homo sapiens
augggauuacauguuau

SEQ ID NO: 428857 - RNA, 15 nt, Homo sapiens
augggccaagccagg

SEQ ID NO: 428858 - RNA, 16 nt, Homo sapiens
augggccagaacacac

SEQ ID NO: 428859 - RNA, 14 nt, Homo sapiens
augggccuggccac

SEQ ID NO: 428860 - RNA, 23 nt, Homo sapiens
augggggccaaggagaaaggcau

SEQ ID NO: 428861 - RNA, 20 nt, Homo sapiens
auggggguggggaggcaaga

SEQ ID NO: 428862 - RNA, 21 nt, Homo sapiens
auggggguggggaggcaagaa

SEQ ID NO: 428863 - RNA, 15 nt, Homo sapiens
auggggugcaugaua

SEQ ID NO: 428864 - RNA, 18 nt, Homo sapiens
augggguggaauagggaa

SEQ ID NO: 428865 - RNA, 14 nt, Homo sapiens
augggucaaagccg

SEQ ID NO: 428866 - RNA, 18 nt, Homo sapiens
augggugaaaaaugguaa

SEQ ID NO: 428867 - RNA, 15 nt, Homo sapiens
auggguugcauuugg

SEQ ID NO: 428868 - RNA, 15 nt, Homo sapiens
augguacuacaacca

SEQ ID NO: 428869 - RNA, 17 nt, Homo sapiens
augguagacaauuugcc

SEQ ID NO: 428870 - RNA, 16 nt, Homo sapiens
augguagacugugaca

SEQ ID NO: 428871 - RNA, 18 nt, Homo sapiens
augguauauauuuugaaa

SEQ ID NO: 428872 - RNA, 20 nt, Homo sapiens
auggucaacacuuaaggguu

SEQ ID NO: 428873 - RNA, 20 nt, Homo sapiens
auggucaaugcuagcacaau

SEQ ID NO: 428874 - RNA, 17 nt, Homo sapiens
auggucaucgugacagc

SEQ ID NO: 428875 - RNA, 19 nt, Homo sapiens
augguccauuucaugugau

SEQ ID NO: 428876 - RNA, 20 nt, Homo sapiens
auggucccaggaagcaggga

SEQ ID NO: 428877 - RNA, 14 nt, Homo sapiens
auggucuugaucuc

SEQ ID NO: 428878 - RNA, 19 nt, Homo sapiens
auggugagcugaguucaug

SEQ ID NO: 428879 - RNA, 19 nt, Homo sapiens
auggugaggcgaaggccag

SEQ ID NO: 428880 - RNA, 19 nt, Homo sapiens
augguggcacgugccugua

SEQ ID NO: 428881 - RNA, 20 nt, Homo sapiens
augguggcgcgcaccuguaa

SEQ ID NO: 428882 - RNA, 19 nt, Homo sapiens
augguggggcaugccugua

SEQ ID NO: 428883 - RNA, 14 nt, Homo sapiens
augguguguuaaag

SEQ ID NO: 428884 - RNA, 21 nt, Homo sapiens
augguuguacuacaguauacu

SEQ ID NO: 428885 - RNA, 21 nt, Homo sapiens
augguuuccaagggucuuccu

SEQ ID NO: 428886 - RNA, 13 nt, Homo sapiens
augguuucuccag

SEQ ID NO: 428887 - RNA, 14 nt, Homo sapiens
augguuuuguggau

SEQ ID NO: 428888 - RNA, 15 nt, Homo sapiens
auguaacgaauggua

SEQ ID NO: 428889 - RNA, 21 nt, Homo sapiens
auguaacgaaugguacuacaa

SEQ ID NO: 428890 - RNA, 21 nt, Homo sapiens
auguaacuuaauuauaagcua

SEQ ID NO: 428891 - RNA, 23 nt, Homo sapiens
auguaacuuaauuauaagcuaug

SEQ ID NO: 428892 - RNA, 24 nt, Homo sapiens
auguaaggucuucuuguguccuga

SEQ ID NO: 428893 - RNA, 17 nt, Homo sapiens
auguacaaagauacuug

SEQ ID NO: 428894 - RNA, 19 nt, Homo sapiens
auguacuacauuugcaugc

SEQ ID NO: 428895 - RNA, 16 nt, Homo sapiens
auguacucuacgccaa

SEQ ID NO: 428896 - RNA, 12 nt, Homo sapiens
auguacugagag

SEQ ID NO: 428897 - RNA, 19 nt, Homo sapiens
auguacuuaagaguggcau

SEQ ID NO: 428898 - RNA, 23 nt, Homo sapiens
auguagaaauauuauaaauccaa

SEQ ID NO: 428899 - RNA, 15 nt, Homo sapiens
auguagacauuaucu

SEQ ID NO: 428900 - RNA, 13 nt, Homo sapiens
auguagauugccu

SEQ ID NO: 428901 - RNA, 16 nt, Homo sapiens
auguagcaaaacgcau

SEQ ID NO: 428902 - RNA, 23 nt, Homo sapiens
auguagcuauuuuucuuguugca

SEQ ID NO: 428903 - RNA, 20 nt, Homo sapiens
auguagcugaaacaaaaaug

SEQ ID NO: 428904 - RNA, 19 nt, Homo sapiens
auguaggugauguuuccag

SEQ ID NO: 428905 - RNA, 13 nt, Homo sapiens
auguagugcaguc

SEQ ID NO: 428906 - RNA, 13 nt, Homo sapiens
auguaguuuucuu

SEQ ID NO: 428907 - RNA, 21 nt, Homo sapiens
auguaucaugauugauugaau

SEQ ID NO: 428908 - RNA, 13 nt, Homo sapiens
auguaugcugauu

SEQ ID NO: 428909 - RNA, 20 nt, Homo sapiens
auguauggagcucuaaccca

SEQ ID NO: 428910 - RNA, 12 nt, Homo sapiens
auguaugugcac

SEQ ID NO: 428911 - RNA, 15 nt, Homo sapiens
auguauuaauacuua

SEQ ID NO: 428912 - RNA, 17 nt, Homo sapiens
auguauuagccagucau

SEQ ID NO: 428913 - RNA, 23 nt, Homo sapiens
auguauugcagugcggcucacau

SEQ ID NO: 428914 - RNA, 18 nt, Homo sapiens
auguauuguaaacaugug

SEQ ID NO: 428915 - RNA, 21 nt, Homo sapiens
augucaaaccugcaaauucag

SEQ ID NO: 428916 - RNA, 16 nt, Homo sapiens
augucaaauaucucag

SEQ ID NO: 428917 - RNA, 17 nt, Homo sapiens
augucaaauaucucaga

SEQ ID NO: 428918 - RNA, 18 nt, Homo sapiens
augucaauaugagauauu

SEQ ID NO: 428919 - RNA, 18 nt, Homo sapiens
augucacaaccucucuga

SEQ ID NO: 428920 - RNA, 18 nt, Homo sapiens
augucagguacauaacau

SEQ ID NO: 428921 - RNA, 21 nt, Homo sapiens
augucauagaagaaaauccau

SEQ ID NO: 428922 - RNA, 14 nt, Homo sapiens
augucauuugcuaa

SEQ ID NO: 428923 - RNA, 22 nt, Homo sapiens
auguccagaagaauauucagga

SEQ ID NO: 428924 - RNA, 15 nt, Homo sapiens
augucccaacuugua

SEQ ID NO: 428925 - RNA, 20 nt, Homo sapiens
augucccccaccucuuuucc

SEQ ID NO: 428926 - RNA, 12 nt, Homo sapiens
auguccuauuac

SEQ ID NO: 428927 - RNA, 22 nt, Homo sapiens
augucuaaagcagggaagugac

SEQ ID NO: 428928 - RNA, 18 nt, Homo sapiens
augucuccaucuugaugc

SEQ ID NO: 428929 - RNA, 21 nt, Homo sapiens
augucucuaagccaacuuuaa

SEQ ID NO: 428930 - RNA, 19 nt, Homo sapiens
augucugagagaccaucuc

SEQ ID NO: 428931 - RNA, 17 nt, Homo sapiens
caaguccuuaccucuuc

SEQ ID NO: 428932 - RNA, 18 nt, Homo sapiens
caagucuucucaagaucc

SEQ ID NO: 428933 - RNA, 23 nt, Homo sapiens
caagugaccauaaaggcauggca

SEQ ID NO: 428934 - RNA, 19 nt, Homo sapiens
caagugagggcuuuuuaac

SEQ ID NO: 428935 - RNA, 14 nt, Homo sapiens
caagugggugaaug

SEQ ID NO: 428936 - RNA, 14 nt, Homo sapiens
caaguguacaguga

SEQ ID NO: 428937 - RNA, 12 nt, Homo sapiens
caaguguaccug

SEQ ID NO: 428938 - RNA, 22 nt, Homo sapiens
caaguguaugcacgugugcaca

SEQ ID NO: 428939 - RNA, 15 nt, Homo sapiens
caagugucucagucc

SEQ ID NO: 428940 - RNA, 13 nt, Homo sapiens
caagugucugugu

SEQ ID NO: 428941 - RNA, 18 nt, Homo sapiens
caagugucugugugcaag

SEQ ID NO: 428942 - RNA, 17 nt, Homo sapiens
caaguguguaugugcgu

SEQ ID NO: 428943 - RNA, 16 nt, Homo sapiens
caagugugugcacaug

SEQ ID NO: 428944 - RNA, 13 nt, Homo sapiens
caagugugugcau

SEQ ID NO: 428945 - RNA, 22 nt, Homo sapiens
caagugugugcaugugugcgag

SEQ ID NO: 428946 - RNA, 23 nt, Homo sapiens
caaguucauugaugacccucuga

SEQ ID NO: 428947 - RNA, 14 nt, Homo sapiens
caaguucuucaccu

SEQ ID NO: 428948 - RNA, 16 nt, Homo sapiens
caaguugaucaugcag

SEQ ID NO: 428949 - RNA, 21 nt, Homo sapiens
caaguugugcaugcaaccaga

SEQ ID NO: 428950 - RNA, 22 nt, Homo sapiens
caaguugugccuuucacagcuu

SEQ ID NO: 428951 - RNA, 21 nt, Homo sapiens
caccugggcugaggaggcagu

SEQ ID NO: 428952 - RNA, 23 nt, Homo sapiens
caccugguuccggaauccugucc

SEQ ID NO: 428953 - RNA, 20 nt, Homo sapiens
caccuguggccucucaguca

SEQ ID NO: 428954 - RNA, 16 nt, Homo sapiens
caccuuaaaauuagca

SEQ ID NO: 428955 - RNA, 20 nt, Homo sapiens
caccuuccuaauaugcuuua

SEQ ID NO: 428956 - RNA, 20 nt, Homo sapiens
caccuugaucccaauccuua

SEQ ID NO: 428957 - RNA, 15 nt, Homo sapiens
caccuugccaagcuu

SEQ ID NO: 428958 - RNA, 19 nt, Homo sapiens
caccuugcccaugcacaag

SEQ ID NO: 428959 - RNA, 14 nt, Homo sapiens
caccuugucaugua

SEQ ID NO: 428960 - RNA, 23 nt, Homo sapiens
cacgagcaaagugaagacacugg

SEQ ID NO: 428961 - RNA, 12 nt, Homo sapiens
cacgaggaaaag

SEQ ID NO: 428962 - RNA, 22 nt, Homo sapiens
cacgauaugcaaguucauccaa

SEQ ID NO: 428963 - RNA, 12 nt, Homo sapiens
cacgcacgcaca

SEQ ID NO: 428964 - RNA, 14 nt, Homo sapiens
cacgccaacagccc

SEQ ID NO: 428965 - RNA, 16 nt, Homo sapiens
cacgccacaacuccag

SEQ ID NO: 428966 - RNA, 18 nt, Homo sapiens
cacgccacaacuccagug

SEQ ID NO: 428967 - RNA, 23 nt, Homo sapiens
cacgccacaacuccaguguuccc

SEQ ID NO: 428968 - RNA, 19 nt, Homo sapiens
cacgccugguucuguacau

SEQ ID NO: 428969 - RNA, 21 nt, Homo sapiens
cacgccugguucuguacaugu

SEQ ID NO: 428970 - RNA, 16 nt, Homo sapiens
cacgccuguaauccca

SEQ ID NO: 428971 - RNA, 22 nt, Homo sapiens
cacgccuguaaucccagcacuu

SEQ ID NO: 428972 - RNA, 15 nt, Homo sapiens
cacgcucaucuugca

SEQ ID NO: 428973 - RNA, 12 nt, Homo sapiens
cacgcuuucaug

SEQ ID NO: 428974 - RNA, 12 nt, Homo sapiens
cacggaaagccu

SEQ ID NO: 428975 - RNA, 15 nt, Homo sapiens
cacggaaagccucau

SEQ ID NO: 428976 - RNA, 19 nt, Homo sapiens
cacggcagcuguagcuccc

SEQ ID NO: 428977 - RNA, 16 nt, Homo sapiens
cacggcuuauaccagg

SEQ ID NO: 428978 - RNA, 20 nt, Homo sapiens
cacgggguauuuuaggcagg

SEQ ID NO: 428979 - RNA, 13 nt, Homo sapiens
cacgggugcauga

SEQ ID NO: 428980 - RNA, 23 nt, Homo sapiens
cacgguggcucacgccuguaauc

SEQ ID NO: 428981 - RNA, 21 nt, Homo sapiens
cacguaugguggcucaugucu

SEQ ID NO: 428982 - RNA, 20 nt, Homo sapiens
cacguggagauagugccagg

SEQ ID NO: 428983 - RNA, 14 nt, Homo sapiens
cacguggcaccucc

SEQ ID NO: 428984 - RNA, 20 nt, Homo sapiens
cacguguuuuuguaucuuua

SEQ ID NO: 428985 - RNA, 22 nt, Homo sapiens
cacguuacuagcagucacuuga

SEQ ID NO: 428986 - RNA, 22 nt, Homo sapiens
cacuaagggguauguucccucu

SEQ ID NO: 428987 - RNA, 20 nt, Homo sapiens
cacuaauaauaguacuauua

SEQ ID NO: 428988 - RNA, 19 nt, Homo sapiens
cacuaaugaggaaacugca

SEQ ID NO: 428989 - RNA, 11 nt, Homo sapiens
cacuaauuccu

SEQ ID NO: 428990 - RNA, 19 nt, Homo sapiens
cacuaauuugucacuggaa

SEQ ID NO: 428991 - RNA, 14 nt, Homo sapiens
cacuacauucugaa

SEQ ID NO: 428992 - RNA, 13 nt, Homo sapiens
cacuaccacauua

SEQ ID NO: 428993 - RNA, 19 nt, Homo sapiens
cacuaccuucugaccuccc

SEQ ID NO: 428994 - RNA, 14 nt, Homo sapiens
cacuagacuguauc

SEQ ID NO: 428995 - RNA, 12 nt, Homo sapiens
cacuagaucucc

SEQ ID NO: 428996 - RNA, 13 nt, Homo sapiens
cacuagguuucac

SEQ ID NO: 428997 - RNA, 16 nt, Homo sapiens
cacuagguuucaccuc

SEQ ID NO: 428998 - RNA, 17 nt, Homo sapiens
cacuagguuucaccucc

SEQ ID NO: 428999 - RNA, 21 nt, Homo sapiens
cacuagguuucaccucccaaa

SEQ ID NO: 429000 - RNA, 18 nt, Homo sapiens
cacuauucuuaagcacuu

SEQ ID NO: 429001 - RNA, 21 nt, Homo sapiens
cacucaauaaagaaugaauuu

SEQ ID NO: 429002 - RNA, 19 nt, Homo sapiens
cacucacaggcuacaguug

SEQ ID NO: 429003 - RNA, 21 nt, Homo sapiens
cacucacuccacaacccaaga

SEQ ID NO: 429004 - RNA, 12 nt, Homo sapiens
cacucacuccag

SEQ ID NO: 429005 - RNA, 11 nt, Homo sapiens
cacucagggau

SEQ ID NO: 429006 - RNA, 17 nt, Homo sapiens
cacucagugcagcaaua

SEQ ID NO: 429007 - RNA, 17 nt, Homo sapiens
cacucauaugaguaucu

SEQ ID NO: 429008 - RNA, 19 nt, Homo sapiens
cacuccagaacaaaccucu

SEQ ID NO: 429009 - RNA, 21 nt, Homo sapiens
cacuccaggauauugacaaga

SEQ ID NO: 429010 - RNA, 11 nt, Homo sapiens
cacuccaugag

SEQ ID NO: 429011 - RNA, 22 nt, Homo sapiens
cacucccuuuccccucuucccu

SEQ ID NO: 429012 - RNA, 19 nt, Homo sapiens
cacucgccuucugcuucca

SEQ ID NO: 429013 - RNA, 22 nt, Homo sapiens
cacucuaccugaaccugcacac

SEQ ID NO: 429014 - RNA, 13 nt, Homo sapiens
cacucuacuacau

SEQ ID NO: 429015 - RNA, 17 nt, Homo sapiens
cacucuauuaaaucuug

SEQ ID NO: 429016 - RNA, 16 nt, Homo sapiens
cacucucagugcuucu

SEQ ID NO: 429017 - RNA, 14 nt, Homo sapiens
cacucucuacuggu

SEQ ID NO: 429018 - RNA, 21 nt, Homo sapiens
cacucuuaucuacauaaggau

SEQ ID NO: 429019 - RNA, 21 nt, Homo sapiens
cacucuuuugagcaguaaaug

SEQ ID NO: 429020 - RNA, 21 nt, Homo sapiens
auuguuccucuuuguuuauga

SEQ ID NO: 429021 - RNA, 17 nt, Homo sapiens
auuguucugggugauuu

SEQ ID NO: 429022 - RNA, 21 nt, Homo sapiens
auuguugaugggcacuugaga

SEQ ID NO: 429023 - RNA, 16 nt, Homo sapiens
auuguuuuugaauuua

SEQ ID NO: 429024 - RNA, 19 nt, Homo sapiens
auuuaaaaaaaaacauuca

SEQ ID NO: 429025 - RNA, 21 nt, Homo sapiens
auuuaaaaaacuaacacccag

SEQ ID NO: 429026 - RNA, 14 nt, Homo sapiens
auuuaaaacaauga

SEQ ID NO: 429027 - RNA, 18 nt, Homo sapiens
auuuaaaagcaucucagc

SEQ ID NO: 429028 - RNA, 15 nt, Homo sapiens
auuuaaaaucauuca

SEQ ID NO: 429029 - RNA, 15 nt, Homo sapiens
auuuaaacuucuuaa

SEQ ID NO: 429030 - RNA, 20 nt, Homo sapiens
auuuaaauaaaguuacuuga

SEQ ID NO: 429031 - RNA, 18 nt, Homo sapiens
auuuaaauagaacuugau

SEQ ID NO: 429032 - RNA, 19 nt, Homo sapiens
auuuaaauagaacuugauu

SEQ ID NO: 429033 - RNA, 11 nt, Homo sapiens
caaauguguac

SEQ ID NO: 429034 - RNA, 18 nt, Homo sapiens
caaaugugucccagugaa

SEQ ID NO: 429035 - RNA, 16 nt, Homo sapiens
caaauuaucaagcuaa

SEQ ID NO: 429036 - RNA, 21 nt, Homo sapiens
caaauuccugcaaaauuaccu

SEQ ID NO: 429037 - RNA, 16 nt, Homo sapiens
caaauucucugagaug

SEQ ID NO: 429038 - RNA, 11 nt, Homo sapiens
caaauucugug

SEQ ID NO: 429039 - RNA, 15 nt, Homo sapiens
caaauugaggacuua

SEQ ID NO: 429040 - RNA, 15 nt, Homo sapiens
caaauugauagucaa

SEQ ID NO: 429041 - RNA, 16 nt, Homo sapiens
caacaaccacacuuaa

SEQ ID NO: 429042 - RNA, 18 nt, Homo sapiens
caacaacuuuguuucuca

SEQ ID NO: 429043 - RNA, 19 nt, Homo sapiens
caacaauggggugggccca

SEQ ID NO: 429044 - RNA, 21 nt, Homo sapiens
caacaauuuaggaaugcucaa

SEQ ID NO: 429045 - RNA, 17 nt, Homo sapiens
caacacuguacacauaa

SEQ ID NO: 429046 - RNA, 18 nt, Homo sapiens
caacagaagcuuccauuc

SEQ ID NO: 429047 - RNA, 15 nt, Homo sapiens
caacagcuucuugcu

SEQ ID NO: 429048 - RNA, 22 nt, Homo sapiens
caacagcuucuugcuuguaaaa

SEQ ID NO: 429049 - RNA, 17 nt, Homo sapiens
caacagugagucuguca

SEQ ID NO: 429050 - RNA, 18 nt, Homo sapiens
ccgugugugaaauucucu

SEQ ID NO: 429051 - RNA, 16 nt, Homo sapiens
ccuaaaauuguaugaa

SEQ ID NO: 429052 - RNA, 13 nt, Homo sapiens
ccuaaagcagcca

SEQ ID NO: 429053 - RNA, 21 nt, Homo sapiens
ccuaaagcccucuucaggggu

SEQ ID NO: 429054 - RNA, 20 nt, Homo sapiens
ccuaaauauccaaagacugu

SEQ ID NO: 429055 - RNA, 21 nt, Homo sapiens
ccuaacauucgaucucauuca

SEQ ID NO: 429056 - RNA, 9 nt, Homo sapiens
ccuaaccac

SEQ ID NO: 429057 - RNA, 23 nt, Homo sapiens
ccuaaccucuuuucugcaucauc

SEQ ID NO: 429058 - RNA, 18 nt, Homo sapiens
ccuaacuuaacauugcau

SEQ ID NO: 429059 - RNA, 11 nt, Homo sapiens
ccuaagcacuu

SEQ ID NO: 429060 - RNA, 14 nt, Homo sapiens
ccuaagcacuuuau

SEQ ID NO: 429061 - RNA, 17 nt, Homo sapiens
ccuaagcauguguccca

SEQ ID NO: 429062 - RNA, 23 nt, Homo sapiens
ccuaauagacuuagccccaugag

SEQ ID NO: 429063 - RNA, 12 nt, Homo sapiens
ccuaauaucauu

SEQ ID NO: 429064 - RNA, 18 nt, Homo sapiens
ccuaaugagaagucaaca

SEQ ID NO: 429065 - RNA, 15 nt, Homo sapiens
ccuaauguggcagcu

SEQ ID NO: 429066 - RNA, 13 nt, Homo sapiens
ccuaauucucuuc

SEQ ID NO: 429067 - RNA, 23 nt, Homo sapiens
ccuaauucucuucgcugugaugc

SEQ ID NO: 429068 - RNA, 14 nt, Homo sapiens
ccuacaagauuuag

SEQ ID NO: 429069 - RNA, 18 nt, Homo sapiens
ccuacagggaacugggaa

SEQ ID NO: 429070 - RNA, 19 nt, Homo sapiens
ccuacccaccgauggagcc

SEQ ID NO: 429071 - RNA, 15 nt, Homo sapiens
ccuaccguagcuuuu

SEQ ID NO: 429072 - RNA, 19 nt, Homo sapiens
ccuagaaagccauauucca

SEQ ID NO: 429073 - RNA, 15 nt, Homo sapiens
ccuagagcuagaugu

SEQ ID NO: 429074 - RNA, 14 nt, Homo sapiens
ccuagcauuucaaa

SEQ ID NO: 429075 - RNA, 17 nt, Homo sapiens
ccuagccugcauaucau

SEQ ID NO: 429076 - RNA, 14 nt, Homo sapiens
ccuaggauuccucc

SEQ ID NO: 429077 - RNA, 18 nt, Homo sapiens
ccuaggccaaaugcacaa

SEQ ID NO: 429078 - RNA, 12 nt, Homo sapiens
ccuaggcuaccc

SEQ ID NO: 429079 - RNA, 23 nt, Homo sapiens
ccuauauuuuacaaagcauguga

SEQ ID NO: 429080 - RNA, 11 nt, Homo sapiens
ccuaucaccuc

SEQ ID NO: 429081 - RNA, 16 nt, Homo sapiens
ccuaugacauacaugg

SEQ ID NO: 429082 - RNA, 14 nt, Homo sapiens
ccuaugcugcaaua

SEQ ID NO: 429083 - RNA, 17 nt, Homo sapiens
ccuaugguaacugauga

SEQ ID NO: 429084 - RNA, 15 nt, Homo sapiens
ccuaugguuuugcug

SEQ ID NO: 429085 - RNA, 21 nt, Homo sapiens
ccuaugucauuucuacuuuga

SEQ ID NO: 429086 - RNA, 22 nt, Homo sapiens
ccuauguccuaaggacacacua

SEQ ID NO: 429087 - RNA, 19 nt, Homo sapiens
ccuauuuagaaauggauuu

SEQ ID NO: 429088 - RNA, 16 nt, Homo sapiens
ccuauuucauuaguag

SEQ ID NO: 429089 - RNA, 13 nt, Homo sapiens
ccuauuuccccac

SEQ ID NO: 429090 - RNA, 15 nt, Homo sapiens
ccuauuuguuuucau

SEQ ID NO: 429091 - RNA, 11 nt, Homo sapiens
ccucaaaagaa

SEQ ID NO: 429092 - RNA, 16 nt, Homo sapiens
ccucaaaugcaguauu

SEQ ID NO: 429093 - RNA, 19 nt, Homo sapiens
ccucaacaaagaagaacca

SEQ ID NO: 429094 - RNA, 19 nt, Homo sapiens
ccucaagaaguaauaauuu

SEQ ID NO: 429095 - RNA, 18 nt, Homo sapiens
ccucaagcaaggaagcag

SEQ ID NO: 429096 - RNA, 19 nt, Homo sapiens
ccucaauaagccagcaaac

SEQ ID NO: 429097 - RNA, 18 nt, Homo sapiens
ccucaauggaaccaaaua

SEQ ID NO: 429098 - RNA, 14 nt, Homo sapiens
ccucaccaccgaga

SEQ ID NO: 429099 - RNA, 16 nt, Homo sapiens
ccucacccgaaucucc

SEQ ID NO: 429100 - RNA, 13 nt, Homo sapiens
ccucacuccacuc

SEQ ID NO: 429101 - RNA, 19 nt, Homo sapiens
ccucacuggugcauuuaaa

SEQ ID NO: 429102 - RNA, 20 nt, Homo sapiens
ccucacuggugcauuuaaaa

SEQ ID NO: 429103 - RNA, 20 nt, Homo sapiens
ccucagaaagucaccaggac

SEQ ID NO: 429104 - RNA, 15 nt, Homo sapiens
ccucagccucucaaa

SEQ ID NO: 429105 - RNA, 15 nt, Homo sapiens
ccucaggggacuuga

SEQ ID NO: 429106 - RNA, 18 nt, Homo sapiens
ccucagguaguacuggga

SEQ ID NO: 429107 - RNA, 23 nt, Homo sapiens
ccucagucuuugggggauucaaa

SEQ ID NO: 429108 - RNA, 14 nt, Homo sapiens
ccucaguuccugca

SEQ ID NO: 429109 - RNA, 21 nt, Homo sapiens
ccucaguucucugccacccau

SEQ ID NO: 429110 - RNA, 20 nt, Homo sapiens
ccucaguuuucagucaaguu

SEQ ID NO: 429111 - RNA, 19 nt, Homo sapiens
ccucaguuuuuccuaguca

SEQ ID NO: 429112 - RNA, 21 nt, Homo sapiens
ccucauauacuugaauauuau

SEQ ID NO: 429113 - RNA, 20 nt, Homo sapiens
ccucauauggcccaguguca

SEQ ID NO: 429114 - RNA, 17 nt, Homo sapiens
ccucauccuccacugaa

SEQ ID NO: 429115 - RNA, 17 nt, Homo sapiens
ccucaugcucucuauag

SEQ ID NO: 429116 - RNA, 18 nt, Homo sapiens
ccucauggcucuggcaca

SEQ ID NO: 429117 - RNA, 23 nt, Homo sapiens
ccucauggcucuggcacagugua

SEQ ID NO: 429118 - RNA, 13 nt, Homo sapiens
ccucauucacugu

SEQ ID NO: 429119 - RNA, 13 nt, Homo sapiens
ccucauuccugaa

SEQ ID NO: 429120 - RNA, 14 nt, Homo sapiens
ccucauucuucucu

SEQ ID NO: 429121 - RNA, 13 nt, Homo sapiens
ccuccaaaagccc

SEQ ID NO: 429122 - RNA, 13 nt, Homo sapiens
ccuccaaccagga

SEQ ID NO: 429123 - RNA, 23 nt, Homo sapiens
ccuccaagaagcccuccuugcca

SEQ ID NO: 429124 - RNA, 14 nt, Homo sapiens
ccuccaucagccag

SEQ ID NO: 429125 - RNA, 15 nt, Homo sapiens
ccuccaugauuccaa

SEQ ID NO: 429126 - RNA, 19 nt, Homo sapiens
ccucccaagguccucucag

SEQ ID NO: 429127 - RNA, 22 nt, Homo sapiens
ccucccagcagcgguaccccag

SEQ ID NO: 429128 - RNA, 18 nt, Homo sapiens
ccucccaguuugcugggu

SEQ ID NO: 429129 - RNA, 17 nt, Homo sapiens
ccuccccacaguccuca

SEQ ID NO: 429130 - RNA, 17 nt, Homo sapiens
ccucccugccaccaggc

SEQ ID NO: 429131 - RNA, 17 nt, Homo sapiens
ccuccgugauccaucca

SEQ ID NO: 429132 - RNA, 14 nt, Homo sapiens
ccuccucaaaccua

SEQ ID NO: 429133 - RNA, 15 nt, Homo sapiens
ccuccucaccuuaau

SEQ ID NO: 429134 - RNA, 16 nt, Homo sapiens
ccuccugacagcaaua

SEQ ID NO: 429135 - RNA, 12 nt, Homo sapiens
ccuccugcugag

SEQ ID NO: 429136 - RNA, 13 nt, Homo sapiens
ccuccuguacaua

SEQ ID NO: 429137 - RNA, 18 nt, Homo sapiens
ccucgaacccacacugca

SEQ ID NO: 429138 - RNA, 18 nt, Homo sapiens
ccucgggacaucaaaaac

SEQ ID NO: 429139 - RNA, 16 nt, Homo sapiens
ccucggggcagggcag

SEQ ID NO: 429140 - RNA, 14 nt, Homo sapiens
ccucuacuuuccag

SEQ ID NO: 429141 - RNA, 13 nt, Homo sapiens
ccucuagaacagc

SEQ ID NO: 429142 - RNA, 15 nt, Homo sapiens
ccucuagaacagcca

SEQ ID NO: 429143 - RNA, 17 nt, Homo sapiens
ccucuagaacagccaga

SEQ ID NO: 429144 - RNA, 18 nt, Homo sapiens
ccucucagagucauugaa

SEQ ID NO: 429145 - RNA, 23 nt, Homo sapiens
ccucuccaaggguggugaccaau

SEQ ID NO: 429146 - RNA, 20 nt, Homo sapiens
ccucucccaaguccagugug

SEQ ID NO: 429147 - RNA, 12 nt, Homo sapiens
ccucucccaguu

SEQ ID NO: 429148 - RNA, 16 nt, Homo sapiens
ccucuccgcaguuccu

SEQ ID NO: 429149 - RNA, 16 nt, Homo sapiens
ccucucgcauggugug

SEQ ID NO: 429150 - RNA, 19 nt, Homo sapiens
ccucucuccuuccugcugu

SEQ ID NO: 429151 - RNA, 14 nt, Homo sapiens
ccucugaagcauuu

SEQ ID NO: 429152 - RNA, 21 nt, Homo sapiens
ccucugacauuuauccaagac

SEQ ID NO: 429153 - RNA, 16 nt, Homo sapiens
ccucugagcugcaguu

SEQ ID NO: 429154 - RNA, 14 nt, Homo sapiens
ccucugcagccuga

SEQ ID NO: 429155 - RNA, 20 nt, Homo sapiens
ccucugccucccaggcucaa

SEQ ID NO: 429156 - RNA, 16 nt, Homo sapiens
ccucugccuugcacaa

SEQ ID NO: 429157 - RNA, 22 nt, Homo sapiens
ccucugcuggccgggcacagcu

SEQ ID NO: 429158 - RNA, 13 nt, Homo sapiens
ccucuggacaaag

SEQ ID NO: 429159 - RNA, 17 nt, Homo sapiens
ccucuggagcuuugcag

SEQ ID NO: 429160 - RNA, 21 nt, Homo sapiens
ccucuggccaaauaugcacuu

SEQ ID NO: 429161 - RNA, 19 nt, Homo sapiens
ccucugguuccacucagcu

SEQ ID NO: 429162 - RNA, 17 nt, Homo sapiens
ccucugugccauggaug

SEQ ID NO: 429163 - RNA, 19 nt, Homo sapiens
ccucugugccauggaugau

SEQ ID NO: 429164 - RNA, 23 nt, Homo sapiens
ccucugugcucccucggucaccu

SEQ ID NO: 429165 - RNA, 15 nt, Homo sapiens
ccucuguguaucuca

SEQ ID NO: 429166 - RNA, 19 nt, Homo sapiens
ccucuuaaagcugccugua

SEQ ID NO: 429167 - RNA, 13 nt, Homo sapiens
ccucuuaccugua

SEQ ID NO: 429168 - RNA, 13 nt, Homo sapiens
ccucuuccacuuu

SEQ ID NO: 429169 - RNA, 15 nt, Homo sapiens
ccucuucccaugacu

SEQ ID NO: 429170 - RNA, 24 nt, Homo sapiens
ccucuuccccagaaaggagacuag

SEQ ID NO: 429171 - RNA, 15 nt, Homo sapiens
ccucuugcuauauaa

SEQ ID NO: 429172 - RNA, 18 nt, Homo sapiens
ccucuuuucccucucuag

SEQ ID NO: 429173 - RNA, 14 nt, Homo sapiens
ccugaaaaccaucc

SEQ ID NO: 429174 - RNA, 13 nt, Homo sapiens
ccugaaaauccaa

SEQ ID NO: 429175 - RNA, 17 nt, Homo sapiens
ccugaaacaacccaaag

SEQ ID NO: 429176 - RNA, 14 nt, Homo sapiens
ccugaaacacuuuu

SEQ ID NO: 429177 - RNA, 18 nt, Homo sapiens
ccugaaacagccaugucc

SEQ ID NO: 429178 - RNA, 20 nt, Homo sapiens
ccugaaacuuacacacaaaa

SEQ ID NO: 429179 - RNA, 22 nt, Homo sapiens
ccugaaagcaacuacagaauuu

SEQ ID NO: 429180 - RNA, 12 nt, Homo sapiens
ccugaaaggaag

SEQ ID NO: 429181 - RNA, 15 nt, Homo sapiens
ccugaacucugcaac

SEQ ID NO: 429182 - RNA, 19 nt, Homo sapiens
ccugaagcaacacugccag

SEQ ID NO: 429183 - RNA, 22 nt, Homo sapiens
ccuugagaggcaugacagcugu

SEQ ID NO: 429184 - RNA, 19 nt, Homo sapiens
ccuugagccccagaggcag

SEQ ID NO: 429185 - RNA, 21 nt, Homo sapiens
ccuugcacuauuggacuuugg

SEQ ID NO: 429186 - RNA, 20 nt, Homo sapiens
ccuugcaucaagggcuuuau

SEQ ID NO: 429187 - RNA, 23 nt, Homo sapiens
ccuugcccgccagccaguggccg

SEQ ID NO: 429188 - RNA, 14 nt, Homo sapiens
ccuugcuaaccuaa

SEQ ID NO: 429189 - RNA, 20 nt, Homo sapiens
ccuugcucucccucuucuca

SEQ ID NO: 429190 - RNA, 14 nt, Homo sapiens
ccuugcucugccau

SEQ ID NO: 429191 - RNA, 15 nt, Homo sapiens
ccuugcucugccauc

SEQ ID NO: 429192 - RNA, 15 nt, Homo sapiens
ccuugcuuucucuuc

SEQ ID NO: 429193 - RNA, 20 nt, Homo sapiens
ccuuggccuccccugcugaa

SEQ ID NO: 429194 - RNA, 23 nt, Homo sapiens
ccuugggccuuucagucccaaag

SEQ ID NO: 429195 - RNA, 13 nt, Homo sapiens
ccuugguggcagg

SEQ ID NO: 429196 - RNA, 21 nt, Homo sapiens
ccuugguguuucuuuuuccac

SEQ ID NO: 429197 - RNA, 14 nt, Homo sapiens
ccuuguuacacauu

SEQ ID NO: 429198 - RNA, 19 nt, Homo sapiens
ccuuguugaugaagcacau

SEQ ID NO: 429199 - RNA, 20 nt, Homo sapiens
ccuuguugaugaagcacauu

SEQ ID NO: 429200 - RNA, 20 nt, Homo sapiens
ccuuguuugccuuuaggcag

SEQ ID NO: 429201 - RNA, 14 nt, Homo sapiens
ccuuuauagcuuug

SEQ ID NO: 429202 - RNA, 14 nt, Homo sapiens
ccuuuaucucugag

SEQ ID NO: 429203 - RNA, 23 nt, Homo sapiens
ccuuucaaauuuaggauggaaua

SEQ ID NO: 429204 - RNA, 17 nt, Homo sapiens
ccuuucaggaagggaga

SEQ ID NO: 429205 - RNA, 15 nt, Homo sapiens
ccuuuccaauuccaa

SEQ ID NO: 429206 - RNA, 13 nt, Homo sapiens
ccuuucgagcucu

SEQ ID NO: 429207 - RNA, 14 nt, Homo sapiens
ccuuucuaaaccuc

SEQ ID NO: 429208 - RNA, 17 nt, Homo sapiens
ccuuucuaaaccucucu

SEQ ID NO: 429209 - RNA, 14 nt, Homo sapiens
ccuuucucauccca

SEQ ID NO: 429210 - RNA, 23 nt, Homo sapiens
ccuuucugaggaguaaaaagacu

SEQ ID NO: 429211 - RNA, 13 nt, Homo sapiens
ccuuugagggcag

SEQ ID NO: 429212 - RNA, 15 nt, Homo sapiens
ccuuugauguggaug

SEQ ID NO: 429213 - RNA, 17 nt, Homo sapiens
ccuuugauguggaugaa

SEQ ID NO: 429214 - RNA, 21 nt, Homo sapiens
ccuuugcaguuggacucucag

SEQ ID NO: 429215 - RNA, 23 nt, Homo sapiens
ccuuuggagcuuuuuucuuuaag

SEQ ID NO: 429216 - RNA, 17 nt, Homo sapiens
ccuuuggcaauucuucu

SEQ ID NO: 429217 - RNA, 21 nt, Homo sapiens
ccuuuggcaauucuucuucuc

SEQ ID NO: 429218 - RNA, 14 nt, Homo sapiens
ccuuugggauuugc

SEQ ID NO: 429219 - RNA, 16 nt, Homo sapiens
ccuuugggauuugccg

SEQ ID NO: 429220 - RNA, 13 nt, Homo sapiens
ccuuuguguaaua

SEQ ID NO: 429221 - RNA, 15 nt, Homo sapiens
ccuuuuaacucaccu

SEQ ID NO: 429222 - RNA, 21 nt, Homo sapiens
ccuuuuagccuaguucaucca

SEQ ID NO: 429223 - RNA, 16 nt, Homo sapiens
ccuuuuauaccagaga

SEQ ID NO: 429224 - RNA, 20 nt, Homo sapiens
ccuuuuaucaauaaagcacu

SEQ ID NO: 429225 - RNA, 21 nt, Homo sapiens
ccuuuucuuuuucccuugaac

SEQ ID NO: 429226 - RNA, 20 nt, Homo sapiens
ccuuuugacagcugugcugu

SEQ ID NO: 429227 - RNA, 16 nt, Homo sapiens
ccuuuugccaaucuca

SEQ ID NO: 429228 - RNA, 16 nt, Homo sapiens
ccuuuuggcacugaga

SEQ ID NO: 429229 - RNA, 16 nt, Homo sapiens
ccuuuuggccuuugua

SEQ ID NO: 429230 - RNA, 15 nt, Homo sapiens
ccuuuuucuaccuuu

SEQ ID NO: 429231 - RNA, 16 nt, Homo sapiens
ccuuuuugccauuuca

SEQ ID NO: 429232 - RNA, 17 nt, Homo sapiens
ccuuuuuuauacaggaa

SEQ ID NO: 429233 - RNA, 20 nt, Homo sapiens
ccuuuuuuuaaaauucaccc

SEQ ID NO: 429234 - RNA, 17 nt, Homo sapiens
cgaaaaccacaaaaaga

SEQ ID NO: 429235 - RNA, 17 nt, Homo sapiens
cgaaaucaagaaacuca

SEQ ID NO: 429236 - RNA, 18 nt, Homo sapiens
cgaaccccccacucccug

SEQ ID NO: 429237 - RNA, 22 nt, Homo sapiens
cgaacgcucuuagcuuucucag

SEQ ID NO: 429238 - RNA, 21 nt, Homo sapiens
cgaacuuggguuugcgcuaaa

SEQ ID NO: 429239 - RNA, 22 nt, Homo sapiens
cgaagaccuucugaagaucuca

SEQ ID NO: 429240 - RNA, 19 nt, Homo sapiens
cgaagccaucgcgcuccuu

SEQ ID NO: 429241 - RNA, 16 nt, Homo sapiens
cgaauccccuaaacaa

SEQ ID NO: 429242 - RNA, 12 nt, Homo sapiens
cgaaucugagaa

SEQ ID NO: 429243 - RNA, 18 nt, Homo sapiens
cgaauuucucacucccuu

SEQ ID NO: 429244 - RNA, 23 nt, Homo sapiens
cgacgguuucaaaccaggauuuu

SEQ ID NO: 429245 - RNA, 16 nt, Homo sapiens
cgacugaugaaggcau

SEQ ID NO: 429246 - RNA, 20 nt, Homo sapiens
cgacuucaugacaagcauuu

SEQ ID NO: 429247 - RNA, 17 nt, Homo sapiens
cgagacugagaggcaga

SEQ ID NO: 429248 - RNA, 20 nt, Homo sapiens
cgagauagcaccauugcacu

SEQ ID NO: 429249 - RNA, 21 nt, Homo sapiens
cgagauagcaccauugcacuc

SEQ ID NO: 429250 - RNA, 19 nt, Homo sapiens
cgagcccagcuacauuccu

SEQ ID NO: 429251 - RNA, 15 nt, Homo sapiens
cgagccgagcucucc

SEQ ID NO: 429252 - RNA, 18 nt, Homo sapiens
cgagcuacucucuugcca

SEQ ID NO: 429253 - RNA, 17 nt, Homo sapiens
cgaggcaaugacuguga

SEQ ID NO: 429254 - RNA, 13 nt, Homo sapiens
cgagucuggagac

SEQ ID NO: 429255 - RNA, 17 nt, Homo sapiens
cgauagugguggugaac

SEQ ID NO: 429256 - RNA, 15 nt, Homo sapiens
cucaggccugccaau

SEQ ID NO: 429257 - RNA, 15 nt, Homo sapiens
cucaggcuugaaaug

SEQ ID NO: 429258 - RNA, 19 nt, Homo sapiens
cucagggcugacacgucca

SEQ ID NO: 429259 - RNA, 17 nt, Homo sapiens
cucagguaguacuggga

SEQ ID NO: 429260 - RNA, 14 nt, Homo sapiens
cucaggucccugca

SEQ ID NO: 429261 - RNA, 22 nt, Homo sapiens
cucaggugaaaauccaucucau

SEQ ID NO: 429262 - RNA, 14 nt, Homo sapiens
cucaggugaucuac

SEQ ID NO: 429263 - RNA, 21 nt, Homo sapiens
cucaggugaucuaccugccuc

SEQ ID NO: 429264 - RNA, 16 nt, Homo sapiens
cucagguguugccaaa

SEQ ID NO: 429265 - RNA, 15 nt, Homo sapiens
cucagguucuuucca

SEQ ID NO: 429266 - RNA, 22 nt, Homo sapiens
cucaguggaucacacacaugga

SEQ ID NO: 429267 - RNA, 16 nt, Homo sapiens
cucaguuccugcagca

SEQ ID NO: 429268 - RNA, 20 nt, Homo sapiens
cucaguuggaaucauugcua

SEQ ID NO: 429269 - RNA, 21 nt, Homo sapiens
cucaguuggaaucauugcuaa

SEQ ID NO: 429270 - RNA, 23 nt, Homo sapiens
cucaguuggaaucauugcuaaua

SEQ ID NO: 429271 - RNA, 17 nt, Homo sapiens
cucaguuucacuuucac

SEQ ID NO: 429272 - RNA, 18 nt, Homo sapiens
cucaguuucucuggagac

SEQ ID NO: 429273 - RNA, 17 nt, Homo sapiens
cucaguuucuguuguuu

SEQ ID NO: 429274 - RNA, 21 nt, Homo sapiens
cucaguuugucagacuuuaaa

SEQ ID NO: 429275 - RNA, 14 nt, Homo sapiens
cucauagcauuaac

SEQ ID NO: 429276 - RNA, 22 nt, Homo sapiens
cucaucaguguccucuugcuca

SEQ ID NO: 429277 - RNA, 22 nt, Homo sapiens
cucaucauaaaauaaaguauau

SEQ ID NO: 429278 - RNA, 21 nt, Homo sapiens
cucaucccccagccacagugg

SEQ ID NO: 429279 - RNA, 20 nt, Homo sapiens
cucauccuuuuuaaaugaga

SEQ ID NO: 429280 - RNA, 20 nt, Homo sapiens
cucaugcggcccagccaugg

SEQ ID NO: 429281 - RNA, 17 nt, Homo sapiens
cucaugcucucuauaga

SEQ ID NO: 429282 - RNA, 16 nt, Homo sapiens
cucauggcagucccaa

SEQ ID NO: 429283 - RNA, 16 nt, Homo sapiens
cucauuauuucaucau

SEQ ID NO: 429284 - RNA, 15 nt, Homo sapiens
cucauucacuguccu

SEQ ID NO: 429285 - RNA, 17 nt, Homo sapiens
cucauucuagcaccuug

SEQ ID NO: 429286 - RNA, 11 nt, Homo sapiens
cucauuugcau

SEQ ID NO: 429287 - RNA, 15 nt, Homo sapiens
cuccaaaagcacuua

SEQ ID NO: 429288 - RNA, 15 nt, Homo sapiens
cuccaaaggcacuga

SEQ ID NO: 429289 - RNA, 20 nt, Homo sapiens
cuccaaaguuuuaaaccugu

SEQ ID NO: 429290 - RNA, 18 nt, Homo sapiens
cuccaacuccugaccuca

SEQ ID NO: 429291 - RNA, 14 nt, Homo sapiens
cuccaagaagcccu

SEQ ID NO: 429292 - RNA, 13 nt, Homo sapiens
cuccaagcuccau

SEQ ID NO: 429293 - RNA, 22 nt, Homo sapiens
cuccaaggauccucuccacucc

SEQ ID NO: 429294 - RNA, 23 nt, Homo sapiens
cuccacaauagcagacaguguuu

SEQ ID NO: 429295 - RNA, 20 nt, Homo sapiens
cuccacaguuaggccaagaa

SEQ ID NO: 429296 - RNA, 13 nt, Homo sapiens
cuccaccagugug

SEQ ID NO: 429297 - RNA, 18 nt, Homo sapiens
cuccaccaucaccucucu

SEQ ID NO: 429298 - RNA, 16 nt, Homo sapiens
cuccaccccacucaca

SEQ ID NO: 429299 - RNA, 17 nt, Homo sapiens
cuccaccggugccuccu

SEQ ID NO: 429300 - RNA, 14 nt, Homo sapiens
cuccacgcccuggg

SEQ ID NO: 429301 - RNA, 14 nt, Homo sapiens
cuccacucacucca

SEQ ID NO: 429302 - RNA, 12 nt, Homo sapiens
cuccacugccuc

SEQ ID NO: 429303 - RNA, 17 nt, Homo sapiens
cuccacuguguccagag

SEQ ID NO: 429304 - RNA, 17 nt, Homo sapiens
cuccagaaucugcuguu

SEQ ID NO: 429305 - RNA, 18 nt, Homo sapiens
cuccagcccacagugcuc

SEQ ID NO: 429306 - RNA, 20 nt, Homo sapiens
cuccagccugggcaacagag

SEQ ID NO: 429307 - RNA, 23 nt, Homo sapiens
cuccagcgaguaccccagccacu

SEQ ID NO: 429308 - RNA, 17 nt, Homo sapiens
cuccagcgguugccuuu

SEQ ID NO: 429309 - RNA, 22 nt, Homo sapiens
cuccagcuguacuagugccauu

SEQ ID NO: 429310 - RNA, 16 nt, Homo sapiens
cuccagggacaaagag

SEQ ID NO: 429311 - RNA, 22 nt, Homo sapiens
cuccagugcuuggcugccccac

SEQ ID NO: 429312 - RNA, 16 nt, Homo sapiens
cuccagugucuaccuu

SEQ ID NO: 429313 - RNA, 16 nt, Homo sapiens
cuccauaaaaguccug

SEQ ID NO: 429314 - RNA, 23 nt, Homo sapiens
cuccauauuggacauccccagaa

SEQ ID NO: 429315 - RNA, 17 nt, Homo sapiens
cuccauauuuauuuaaa

SEQ ID NO: 429316 - RNA, 23 nt, Homo sapiens
cuccauccucgucugucaaugac

SEQ ID NO: 429317 - RNA, 15 nt, Homo sapiens
cuccaugacuggcug

SEQ ID NO: 429318 - RNA, 16 nt, Homo sapiens
cuccaugagacacauc

SEQ ID NO: 429319 - RNA, 14 nt, Homo sapiens
cucccaaacccagc

SEQ ID NO: 429320 - RNA, 16 nt, Homo sapiens
cucccaaagugcuagu

SEQ ID NO: 429321 - RNA, 21 nt, Homo sapiens
cucccaaagugcugagauuac

SEQ ID NO: 429322 - RNA, 20 nt, Homo sapiens
cucccaaagugcugggauua

SEQ ID NO: 429323 - RNA, 14 nt, Homo sapiens
cucccaagcguucc

SEQ ID NO: 429324 - RNA, 15 nt, Homo sapiens
cuccugauguuuuuc

SEQ ID NO: 429325 - RNA, 12 nt, Homo sapiens
cuccugcaaaau

SEQ ID NO: 429326 - RNA, 14 nt, Homo sapiens
cuccugcccagcuc

SEQ ID NO: 429327 - RNA, 16 nt, Homo sapiens
cuccugccucagccuu

SEQ ID NO: 429328 - RNA, 23 nt, Homo sapiens
cuccuggaggcccuggucagcuu

SEQ ID NO: 429329 - RNA, 23 nt, Homo sapiens
cuccugggaaggagggagcugcu

SEQ ID NO: 429330 - RNA, 16 nt, Homo sapiens
cuccugguaacagcua

SEQ ID NO: 429331 - RNA, 16 nt, Homo sapiens
cuccuggucuugagau

SEQ ID NO: 429332 - RNA, 18 nt, Homo sapiens
cuccugugggagaucuuc

SEQ ID NO: 429333 - RNA, 20 nt, Homo sapiens
cuccuucacucccugucaua

SEQ ID NO: 429334 - RNA, 14 nt, Homo sapiens
cuccuuccaccaca

SEQ ID NO: 429335 - RNA, 15 nt, Homo sapiens
cuccuuccagccuga

SEQ ID NO: 429336 - RNA, 13 nt, Homo sapiens
cuccuucccgccg

SEQ ID NO: 429337 - RNA, 15 nt, Homo sapiens
cuccuucuugcccug

SEQ ID NO: 429338 - RNA, 21 nt, Homo sapiens
cuccuugcccuagaugagccc

SEQ ID NO: 429339 - RNA, 21 nt, Homo sapiens
cuccuuguuccuagaguagag

SEQ ID NO: 429340 - RNA, 14 nt, Homo sapiens
cuccuuucucuuau

SEQ ID NO: 429341 - RNA, 15 nt, Homo sapiens
cuccuuucuugcacu

SEQ ID NO: 429342 - RNA, 18 nt, Homo sapiens
cuccuuuuucuaccuuuu

SEQ ID NO: 429343 - RNA, 21 nt, Homo sapiens
cucgaagucauggccaccucc

SEQ ID NO: 429344 - RNA, 15 nt, Homo sapiens
cucgcuucauaggca

SEQ ID NO: 429345 - RNA, 22 nt, Homo sapiens
cucggcauucacacacagccug

SEQ ID NO: 429346 - RNA, 14 nt, Homo sapiens
cucggucugagaag

SEQ ID NO: 429347 - RNA, 17 nt, Homo sapiens
cucgucuuggcacaauc

SEQ ID NO: 429348 - RNA, 23 nt, Homo sapiens
cucgugguggaaacuuuucuuaa

SEQ ID NO: 429349 - RNA, 16 nt, Homo sapiens
cucuaaaaaagaacuu

SEQ ID NO: 429350 - RNA, 14 nt, Homo sapiens
cucuaacaccacac

SEQ ID NO: 429351 - RNA, 20 nt, Homo sapiens
cucuaacaccacacugacca

SEQ ID NO: 429352 - RNA, 14 nt, Homo sapiens
cucuaaguguaaaa

SEQ ID NO: 429353 - RNA, 14 nt, Homo sapiens
cucuacacugugaa

SEQ ID NO: 429354 - RNA, 16 nt, Homo sapiens
cucuacccacuaugca

SEQ ID NO: 429355 - RNA, 19 nt, Homo sapiens
cucuacccacuaugcacag

SEQ ID NO: 429356 - RNA, 17 nt, Homo sapiens
cucuaccccugcuccca

SEQ ID NO: 429357 - RNA, 15 nt, Homo sapiens
cucuacgugcuccuc

SEQ ID NO: 429358 - RNA, 16 nt, Homo sapiens
cucuacuuaaugagau

SEQ ID NO: 429359 - RNA, 17 nt, Homo sapiens
cucuagaacagccagac

SEQ ID NO: 429360 - RNA, 23 nt, Homo sapiens
cucuagaacagccagacccugca

SEQ ID NO: 429361 - RNA, 20 nt, Homo sapiens
cucuagugacuuccugguga

SEQ ID NO: 429362 - RNA, 21 nt, Homo sapiens
cucuauagacucuaggacaua

SEQ ID NO: 429363 - RNA, 13 nt, Homo sapiens
cucuauauuacaa

SEQ ID NO: 429364 - RNA, 12 nt, Homo sapiens
cucuaucugcaa

SEQ ID NO: 429365 - RNA, 16 nt, Homo sapiens
cucuauuaaaauuacu

SEQ ID NO: 429366 - RNA, 13 nt, Homo sapiens
cucucacacuggc

SEQ ID NO: 429367 - RNA, 18 nt, Homo sapiens
cucucacccccacacugg

SEQ ID NO: 429368 - RNA, 16 nt, Homo sapiens
cucucaccuccuaaag

SEQ ID NO: 429369 - RNA, 16 nt, Homo sapiens
cucuccaaaacacuua

SEQ ID NO: 429370 - RNA, 13 nt, Homo sapiens
cucuccacuccau

SEQ ID NO: 429371 - RNA, 22 nt, Homo sapiens
cucuccugauuauuuaucacau

SEQ ID NO: 429372 - RNA, 21 nt, Homo sapiens
cucuccuuauagacacuugcu

SEQ ID NO: 429373 - RNA, 21 nt, Homo sapiens
cucucggaacugcaugcugcu

SEQ ID NO: 429374 - RNA, 19 nt, Homo sapiens
cucucggcuggaagaacau

SEQ ID NO: 429375 - RNA, 15 nt, Homo sapiens
cucucucugcuccuc

SEQ ID NO: 429376 - RNA, 23 nt, Homo sapiens
cucucugaauacccaaaacacac

SEQ ID NO: 429377 - RNA, 18 nt, Homo sapiens
cucucugcaccugucuca

SEQ ID NO: 429378 - RNA, 21 nt, Homo sapiens
cucucugcuggguuuccacac

SEQ ID NO: 429379 - RNA, 21 nt, Homo sapiens
cucucuuucuuccacuacccu

SEQ ID NO: 429380 - RNA, 15 nt, Homo sapiens
cucugaaauuuccca

SEQ ID NO: 429381 - RNA, 18 nt, Homo sapiens
cucugaagcauguuucau

SEQ ID NO: 429382 - RNA, 21 nt, Homo sapiens
cucugacccugaugcuuaaua

SEQ ID NO: 429383 - RNA, 23 nt, Homo sapiens
cucugacgcaaaaccacuuuccu

SEQ ID NO: 429384 - RNA, 13 nt, Homo sapiens
cucugacucccaa

SEQ ID NO: 429385 - RNA, 23 nt, Homo sapiens
cucugacuguaaaauacauggua

SEQ ID NO: 429386 - RNA, 16 nt, Homo sapiens
cucugagcuguuaucu

SEQ ID NO: 429387 - RNA, 15 nt, Homo sapiens
cucugaggcuaugga

SEQ ID NO: 429388 - RNA, 15 nt, Homo sapiens
cucugagugcuagcu

SEQ ID NO: 429389 - RNA, 12 nt, Homo sapiens
cucugauaccuc

SEQ ID NO: 429390 - RNA, 17 nt, Homo sapiens
cucugaucaaagcaccu

SEQ ID NO: 429391 - RNA, 19 nt, Homo sapiens
cucugcacuauagccauuu

SEQ ID NO: 429392 - RNA, 17 nt, Homo sapiens
cucugcagcccucagau

SEQ ID NO: 429393 - RNA, 15 nt, Homo sapiens
cucugcaggacacag

SEQ ID NO: 429394 - RNA, 23 nt, Homo sapiens
cucugcauguguguuguccuuca

SEQ ID NO: 429395 - RNA, 20 nt, Homo sapiens
cucugccacccacucaggau

SEQ ID NO: 429396 - RNA, 13 nt, Homo sapiens
cucugccacugac

SEQ ID NO: 429397 - RNA, 20 nt, Homo sapiens
cucugccccuucuguuucca

SEQ ID NO: 429398 - RNA, 18 nt, Homo sapiens
cucugcuccgugugucuc

SEQ ID NO: 429399 - RNA, 11 nt, Homo sapiens
cucugcuccuc

SEQ ID NO: 429400 - RNA, 14 nt, Homo sapiens
cucugcugaaggaa

SEQ ID NO: 429401 - RNA, 15 nt, Homo sapiens
cucuggcacagugua

SEQ ID NO: 429402 - RNA, 18 nt, Homo sapiens
cucuggcuaaauucaugc

SEQ ID NO: 429403 - RNA, 19 nt, Homo sapiens
cucuggcuaaauucaugcu

SEQ ID NO: 429404 - RNA, 19 nt, Homo sapiens
cucugggaggggugcugcc

SEQ ID NO: 429405 - RNA, 17 nt, Homo sapiens
cucugggccuucucacc

SEQ ID NO: 429406 - RNA, 22 nt, Homo sapiens
cucuggggaagggaaccagccc

SEQ ID NO: 429407 - RNA, 22 nt, Homo sapiens
cucuggggucuuuuuaugcauu

SEQ ID NO: 429408 - RNA, 15 nt, Homo sapiens
cucuggguuucauau

SEQ ID NO: 429409 - RNA, 11 nt, Homo sapiens
cucuguaaaac

SEQ ID NO: 429410 - RNA, 20 nt, Homo sapiens
cucuguaacaucacuaucca

SEQ ID NO: 429411 - RNA, 23 nt, Homo sapiens
cucuguagaauuuagcuuauaca

SEQ ID NO: 429412 - RNA, 10 nt, Homo sapiens
cucuguccac

SEQ ID NO: 429413 - RNA, 19 nt, Homo sapiens
cucuguccuaaauaucuca

SEQ ID NO: 429414 - RNA, 21 nt, Homo sapiens
cucuguccuggcugugcacau

SEQ ID NO: 429415 - RNA, 18 nt, Homo sapiens
cucugucgcccuuaguca

SEQ ID NO: 429416 - RNA, 14 nt, Homo sapiens
cucuguguaucuca

SEQ ID NO: 429417 - RNA, 14 nt, Homo sapiens
cucuguuuacccuc

SEQ ID NO: 429418 - RNA, 13 nt, Homo sapiens
cucuuaagacacu

SEQ ID NO: 429419 - RNA, 20 nt, Homo sapiens
cucuuaagugugcacagaua

SEQ ID NO: 429420 - RNA, 17 nt, Homo sapiens
cucuuaaucaaauagca

SEQ ID NO: 429421 - RNA, 14 nt, Homo sapiens
cucuuaauguugcu

SEQ ID NO: 429422 - RNA, 17 nt, Homo sapiens
cucuuagcuuacaggaa

SEQ ID NO: 429423 - RNA, 19 nt, Homo sapiens
cucuuaguuuuuaaaaagg

SEQ ID NO: 429424 - RNA, 23 nt, Homo sapiens
cucuuaguuuuuaaaaaggccuu

SEQ ID NO: 429425 - RNA, 15 nt, Homo sapiens
cucuuauaaaaucaa

SEQ ID NO: 429426 - RNA, 21 nt, Homo sapiens
cucuuauaaaaucaauaagag

SEQ ID NO: 429427 - RNA, 17 nt, Homo sapiens
cucuuauccaacaucaa

SEQ ID NO: 429428 - RNA, 14 nt, Homo sapiens
cucuuaugccauuu

SEQ ID NO: 429429 - RNA, 15 nt, Homo sapiens
cucuuauuugcucac

SEQ ID NO: 429430 - RNA, 18 nt, Homo sapiens
cucuucaacugaccagcc

SEQ ID NO: 429431 - RNA, 20 nt, Homo sapiens
cucuucagccucauucacug

SEQ ID NO: 429432 - RNA, 16 nt, Homo sapiens
cucuuccaaucuccau

SEQ ID NO: 429433 - RNA, 14 nt, Homo sapiens
cucuuccaggaagc

SEQ ID NO: 429434 - RNA, 18 nt, Homo sapiens
cucuuccuggaaugcauu

SEQ ID NO: 429435 - RNA, 23 nt, Homo sapiens
cucuuccuugcuuucucuucuaa

SEQ ID NO: 429436 - RNA, 23 nt, Homo sapiens
cucuucuacguauaaauaugaaa

SEQ ID NO: 429437 - RNA, 14 nt, Homo sapiens
cucuucuccacugg

SEQ ID NO: 429438 - RNA, 15 nt, Homo sapiens
cucuucuuacuguau

SEQ ID NO: 429439 - RNA, 17 nt, Homo sapiens
cucuugagucacacugc

SEQ ID NO: 429440 - RNA, 15 nt, Homo sapiens
cucuugccucucuca

SEQ ID NO: 429441 - RNA, 22 nt, Homo sapiens
cucuugcuaccugugagcaucc

SEQ ID NO: 429442 - RNA, 12 nt, Homo sapiens
cucuugcucaaa

SEQ ID NO: 429443 - RNA, 11 nt, Homo sapiens
cucuugcucac

SEQ ID NO: 429444 - RNA, 19 nt, Homo sapiens
cucuuguuuacgacgugau

SEQ ID NO: 429445 - RNA, 21 nt, Homo sapiens
cucuuucaauugcagaugcca

SEQ ID NO: 429446 - RNA, 19 nt, Homo sapiens
cucuuucaucuagcuccau

SEQ ID NO: 429447 - RNA, 20 nt, Homo sapiens
cucuuuccuccuuccaugga

SEQ ID NO: 429448 - RNA, 15 nt, Homo sapiens
cucuuuccuugcuca

SEQ ID NO: 429449 - RNA, 18 nt, Homo sapiens
cucuuucuacaugacugg

SEQ ID NO: 429450 - RNA, 13 nt, Homo sapiens
cucuuuugccucc

SEQ ID NO: 429451 - RNA, 13 nt, Homo sapiens
ccugaaugaaaua

SEQ ID NO: 429452 - RNA, 15 nt, Homo sapiens
ccugacaagugaagu

SEQ ID NO: 429453 - RNA, 20 nt, Homo sapiens
ccugacacaggggacacuga

SEQ ID NO: 429454 - RNA, 18 nt, Homo sapiens
ccugacaucaggugaucc

SEQ ID NO: 429455 - RNA, 22 nt, Homo sapiens
ccugacaugugacaucuaccuc

SEQ ID NO: 429456 - RNA, 21 nt, Homo sapiens
ccugacccugugaugccugac

SEQ ID NO: 429457 - RNA, 12 nt, Homo sapiens
ccugaccucacu

SEQ ID NO: 429458 - RNA, 16 nt, Homo sapiens
ccugaccugagacugu

SEQ ID NO: 429459 - RNA, 16 nt, Homo sapiens
ccugacucaggcauca

SEQ ID NO: 429460 - RNA, 18 nt, Homo sapiens
ccugacucgucugacugu

SEQ ID NO: 429461 - RNA, 17 nt, Homo sapiens
ccugacuuuuaauguca

SEQ ID NO: 429462 - RNA, 18 nt, Homo sapiens
ccugagaagccucauggg

SEQ ID NO: 429463 - RNA, 18 nt, Homo sapiens
ccugagagguuucugggg

SEQ ID NO: 429464 - RNA, 17 nt, Homo sapiens
ccugagcagugccagcu

SEQ ID NO: 429465 - RNA, 20 nt, Homo sapiens
ccugagguugcuuuauccua

SEQ ID NO: 429466 - RNA, 17 nt, Homo sapiens
ccugauacuggguacaa

SEQ ID NO: 429467 - RNA, 17 nt, Homo sapiens
ccugaucaccaggugaa

SEQ ID NO: 429468 - RNA, 17 nt, Homo sapiens
ccugaucacuaugcauu

SEQ ID NO: 429469 - RNA, 17 nt, Homo sapiens
ccugaugcgucuaccca

SEQ ID NO: 429470 - RNA, 12 nt, Homo sapiens
ccugauggugcu

SEQ ID NO: 429471 - RNA, 20 nt, Homo sapiens
ccugauuggggccucaccca

SEQ ID NO: 429472 - RNA, 18 nt, Homo sapiens
ccugcaccccugcaguuu

SEQ ID NO: 429473 - RNA, 16 nt, Homo sapiens
ccugcaggcugcaguc

SEQ ID NO: 429474 - RNA, 17 nt, Homo sapiens
ccugcagggaucauagc

SEQ ID NO: 429475 - RNA, 16 nt, Homo sapiens
ccugcaggguaggggg

SEQ ID NO: 429476 - RNA, 16 nt, Homo sapiens
ccugcaggucacugaa

SEQ ID NO: 429477 - RNA, 14 nt, Homo sapiens
ccugccaaugccac

SEQ ID NO: 429478 - RNA, 15 nt, Homo sapiens
ccugccaggcugcua

SEQ ID NO: 429479 - RNA, 21 nt, Homo sapiens
ccugccagggcccgaccuggg

SEQ ID NO: 429480 - RNA, 20 nt, Homo sapiens
ccugccagugagcucgccau

SEQ ID NO: 429481 - RNA, 14 nt, Homo sapiens
ccugccccagagaa

SEQ ID NO: 429482 - RNA, 17 nt, Homo sapiens
ccugccccugcccgaga

SEQ ID NO: 429483 - RNA, 19 nt, Homo sapiens
ccugccccuuccuccuuca

SEQ ID NO: 429484 - RNA, 18 nt, Homo sapiens
ccugcccgagagcucuua

SEQ ID NO: 429485 - RNA, 18 nt, Homo sapiens
ccugcccgccccaagccc

SEQ ID NO: 429486 - RNA, 15 nt, Homo sapiens
ccugcccucccccac

SEQ ID NO: 429487 - RNA, 20 nt, Homo sapiens
ccugccggccgcccagacac

SEQ ID NO: 429488 - RNA, 21 nt, Homo sapiens
ccugccugcaucugugaaaag

SEQ ID NO: 429489 - RNA, 15 nt, Homo sapiens
ccugccugugaguga

SEQ ID NO: 429490 - RNA, 18 nt, Homo sapiens
ccugcgugggggccaguc

SEQ ID NO: 429491 - RNA, 16 nt, Homo sapiens
ccugcuagcuguagaa

SEQ ID NO: 429492 - RNA, 14 nt, Homo sapiens
ccugcuauuuccca

SEQ ID NO: 429493 - RNA, 19 nt, Homo sapiens
ccugcuccacgaagccuua

SEQ ID NO: 429494 - RNA, 12 nt, Homo sapiens
ccugcugccauc

SEQ ID NO: 429495 - RNA, 16 nt, Homo sapiens
ccugcugccccagcug

SEQ ID NO: 429496 - RNA, 10 nt, Homo sapiens
ccugcuggaa

SEQ ID NO: 429497 - RNA, 23 nt, Homo sapiens
ccugcuggaaaccacacuucuug

SEQ ID NO: 429498 - RNA, 18 nt, Homo sapiens
ccugcuuugaggacaaag

SEQ ID NO: 429499 - RNA, 18 nt, Homo sapiens
ccuggaaagaggcagucu

SEQ ID NO: 429500 - RNA, 21 nt, Homo sapiens
ccuggaaagaggcagucuucu

SEQ ID NO: 429501 - RNA, 15 nt, Homo sapiens
ccuggacuuuccugc

SEQ ID NO: 429502 - RNA, 22 nt, Homo sapiens
ccuggagaaggcauuccagggu

SEQ ID NO: 429503 - RNA, 17 nt, Homo sapiens
ccuggaucuaccagcau

SEQ ID NO: 429504 - RNA, 19 nt, Homo sapiens
ccuggauguguggggcaug

SEQ ID NO: 429505 - RNA, 13 nt, Homo sapiens
ccuggcacaccag

SEQ ID NO: 429506 - RNA, 20 nt, Homo sapiens
ccuggcacuggaugcagaaa

SEQ ID NO: 429507 - RNA, 15 nt, Homo sapiens
ccuggccgaugguac

SEQ ID NO: 429508 - RNA, 18 nt, Homo sapiens
ccuggccucagccagcug

SEQ ID NO: 429509 - RNA, 14 nt, Homo sapiens
ccuggcucaucucu

SEQ ID NO: 429510 - RNA, 15 nt, Homo sapiens
ccuggcuuccagggg

SEQ ID NO: 429511 - RNA, 21 nt, Homo sapiens
ccugggaaggcuaaguucagu

SEQ ID NO: 429512 - RNA, 19 nt, Homo sapiens
ccugggaauguauuauucu

SEQ ID NO: 429513 - RNA, 12 nt, Homo sapiens
ccugggauucaa

SEQ ID NO: 429514 - RNA, 17 nt, Homo sapiens
ccugggcaauuccgcau

SEQ ID NO: 429515 - RNA, 17 nt, Homo sapiens
ccugggcagaaaugugc

SEQ ID NO: 429516 - RNA, 20 nt, Homo sapiens
ccugggccaccaugcacuca

SEQ ID NO: 429517 - RNA, 16 nt, Homo sapiens
ccugggcccuuccuau

SEQ ID NO: 429518 - RNA, 22 nt, Homo sapiens
ccuggggcuggguguguuucag

SEQ ID NO: 429519 - RNA, 19 nt, Homo sapiens
ccuggggcuucuccugacc

SEQ ID NO: 429520 - RNA, 17 nt, Homo sapiens
ccuggggggcacagcca

SEQ ID NO: 429521 - RNA, 18 nt, Homo sapiens
ccugggucucugggcaca

SEQ ID NO: 429522 - RNA, 18 nt, Homo sapiens
ccugguaaauauauuuca

SEQ ID NO: 429523 - RNA, 17 nt, Homo sapiens
ccuggucaacaugguga

SEQ ID NO: 429524 - RNA, 15 nt, Homo sapiens
ccugguuaccacagu

SEQ ID NO: 429525 - RNA, 15 nt, Homo sapiens
ccuguaggaaacaga

SEQ ID NO: 429526 - RNA, 19 nt, Homo sapiens
ccuguagucccauugaugu

SEQ ID NO: 429527 - RNA, 20 nt, Homo sapiens
ccugucaaguuaacaaggaa

SEQ ID NO: 429528 - RNA, 14 nt, Homo sapiens
ccugucacuacugg

SEQ ID NO: 429529 - RNA, 15 nt, Homo sapiens
ccugucacucagcug

SEQ ID NO: 429530 - RNA, 21 nt, Homo sapiens
ccugucaggcucuuacagcca

SEQ ID NO: 429531 - RNA, 23 nt, Homo sapiens
ccugucccagagguuaucugccu

SEQ ID NO: 429532 - RNA, 16 nt, Homo sapiens
ccugucgugccagucc

SEQ ID NO: 429533 - RNA, 21 nt, Homo sapiens
ccugucuaggucaguacccac

SEQ ID NO: 429534 - RNA, 22 nt, Homo sapiens
ccugucuaggucuccucagggu

SEQ ID NO: 429535 - RNA, 14 nt, Homo sapiens
ccugucuccagggc

SEQ ID NO: 429536 - RNA, 21 nt, Homo sapiens
ccugucugcuaggcgcugggg

SEQ ID NO: 429537 - RNA, 17 nt, Homo sapiens
ccugugaccagcacugu

SEQ ID NO: 429538 - RNA, 21 nt, Homo sapiens
ccugugacccucucacuuugg

SEQ ID NO: 429539 - RNA, 12 nt, Homo sapiens
ccugugaccucc

SEQ ID NO: 429540 - RNA, 12 nt, Homo sapiens
ccugugaucgug

SEQ ID NO: 429541 - RNA, 18 nt, Homo sapiens
ccugugcccaucaucucu

SEQ ID NO: 429542 - RNA, 16 nt, Homo sapiens
ccugugccuaacacca

SEQ ID NO: 429543 - RNA, 11 nt, Homo sapiens
ccugugccugg

SEQ ID NO: 429544 - RNA, 12 nt, Homo sapiens
ccugugcuacag

SEQ ID NO: 429545 - RNA, 21 nt, Homo sapiens
ccugugggaguccacuuuccu

SEQ ID NO: 429546 - RNA, 19 nt, Homo sapiens
ccugugguuugcuccagaa

SEQ ID NO: 429547 - RNA, 15 nt, Homo sapiens
ccuguguagcucuca

SEQ ID NO: 429548 - RNA, 16 nt, Homo sapiens
ccuguguauaaagcca

SEQ ID NO: 429549 - RNA, 19 nt, Homo sapiens
ccuguguauaaagccauua

SEQ ID NO: 429550 - RNA, 14 nt, Homo sapiens
ccuguguggaccau

SEQ ID NO: 429551 - RNA, 21 nt, Homo sapiens
ccuguguugucucuagagcag

SEQ ID NO: 429552 - RNA, 20 nt, Homo sapiens
ccuguucuuugaaguggcac

SEQ ID NO: 429553 - RNA, 15 nt, Homo sapiens
ccuuaaaaugcauug

SEQ ID NO: 429554 - RNA, 16 nt, Homo sapiens
ccuuaaacuccuguga

SEQ ID NO: 429555 - RNA, 14 nt, Homo sapiens
ccuuaagaccugaa

SEQ ID NO: 429556 - RNA, 21 nt, Homo sapiens
ccuuaagccaauauuuacuca

SEQ ID NO: 429557 - RNA, 22 nt, Homo sapiens
ccuuaccacgcaguaacuaaag

SEQ ID NO: 429558 - RNA, 20 nt, Homo sapiens
ccuuacggucaugaugucug

SEQ ID NO: 429559 - RNA, 11 nt, Homo sapiens
ccuuacucuga

SEQ ID NO: 429560 - RNA, 17 nt, Homo sapiens
ccuuagaauacuguauu

SEQ ID NO: 429561 - RNA, 16 nt, Homo sapiens
ccuuaucauaaauuca

SEQ ID NO: 429562 - RNA, 14 nt, Homo sapiens
ccuuaugauauucu

SEQ ID NO: 429563 - RNA, 17 nt, Homo sapiens
ccuuaugauauucucau

SEQ ID NO: 429564 - RNA, 19 nt, Homo sapiens
ccuuauuuauauucaucaa

SEQ ID NO: 429565 - RNA, 11 nt, Homo sapiens
ccuucagaaaa

SEQ ID NO: 429566 - RNA, 17 nt, Homo sapiens
ccuucagaaaagacacu

SEQ ID NO: 429567 - RNA, 15 nt, Homo sapiens
ccuucaguacugcag

SEQ ID NO: 429568 - RNA, 22 nt, Homo sapiens
ccuucaugccugggccugcagg

SEQ ID NO: 429569 - RNA, 19 nt, Homo sapiens
ccuuccaccucacaacucc

SEQ ID NO: 429570 - RNA, 14 nt, Homo sapiens
ccuuccacugccuc

SEQ ID NO: 429571 - RNA, 23 nt, Homo sapiens
ccuuccccagcgucccagucucu

SEQ ID NO: 429572 - RNA, 19 nt, Homo sapiens
ccuuccccuugaaccucau

SEQ ID NO: 429573 - RNA, 17 nt, Homo sapiens
ccuucguuaacugugua

SEQ ID NO: 429574 - RNA, 14 nt, Homo sapiens
ccuucuaacuaaac

SEQ ID NO: 429575 - RNA, 12 nt, Homo sapiens
ccuucuccaaau

SEQ ID NO: 429576 - RNA, 20 nt, Homo sapiens
ccuucucucaccuccuaaag

SEQ ID NO: 429577 - RNA, 20 nt, Homo sapiens
ccuucucugcuccaccacau

SEQ ID NO: 429578 - RNA, 16 nt, Homo sapiens
ccuucugaagaucuca

SEQ ID NO: 429579 - RNA, 21 nt, Homo sapiens
ccuucuggacacugagagggc

SEQ ID NO: 429580 - RNA, 20 nt, Homo sapiens
ccuucugugcccagcucagu

SEQ ID NO: 429581 - RNA, 22 nt, Homo sapiens
ccuucuuacuuaaccugaagcu

SEQ ID NO: 429582 - RNA, 12 nt, Homo sapiens
ccuugaccuucc

SEQ ID NO: 429583 - RNA, 17 nt, Homo sapiens
cugaucauuaaagccug

SEQ ID NO: 429584 - RNA, 14 nt, Homo sapiens
cugaucauuacaug

SEQ ID NO: 429585 - RNA, 20 nt, Homo sapiens
cugauccccuuugguuuuac

SEQ ID NO: 429586 - RNA, 20 nt, Homo sapiens
cugaucucucgugauugaua

SEQ ID NO: 429587 - RNA, 20 nt, Homo sapiens
cugaucugcaguuuuugccu

SEQ ID NO: 429588 - RNA, 14 nt, Homo sapiens
cugaucuguaccua

SEQ ID NO: 429589 - RNA, 14 nt, Homo sapiens
cugaugacaacuuc

SEQ ID NO: 429590 - RNA, 21 nt, Homo sapiens
cugaugacacugagaacagau

SEQ ID NO: 429591 - RNA, 14 nt, Homo sapiens
cugaugcagaaaga

SEQ ID NO: 429592 - RNA, 21 nt, Homo sapiens
cugauggauaucccuaccuug

SEQ ID NO: 429593 - RNA, 14 nt, Homo sapiens
cugauggcuugaca

SEQ ID NO: 429594 - RNA, 21 nt, Homo sapiens
cugauggcuugacaugugcaa

SEQ ID NO: 429595 - RNA, 19 nt, Homo sapiens
cugauguaccugaugcuau

SEQ ID NO: 429596 - RNA, 14 nt, Homo sapiens
cugauucuaggaua

SEQ ID NO: 429597 - RNA, 15 nt, Homo sapiens
cugauugcacacccc

SEQ ID NO: 429598 - RNA, 22 nt, Homo sapiens
cugauuguggaucuuuucauuc

SEQ ID NO: 429599 - RNA, 22 nt, Homo sapiens
cugauuuaaacuucuuaacugg

SEQ ID NO: 429600 - RNA, 17 nt, Homo sapiens
cugauuuuaacaauaac

SEQ ID NO: 429601 - RNA, 19 nt, Homo sapiens
cugcaaacucacugcucaa

SEQ ID NO: 429602 - RNA, 17 nt, Homo sapiens
cugcaaaggacagaucc

SEQ ID NO: 429603 - RNA, 18 nt, Homo sapiens
cugcaaaggacagaucca

SEQ ID NO: 429604 - RNA, 22 nt, Homo sapiens
cugcaaaggacagauccaggga

SEQ ID NO: 429605 - RNA, 22 nt, Homo sapiens
cugcaaaggcaccugaaugugu

SEQ ID NO: 429606 - RNA, 20 nt, Homo sapiens
cugcaaauacuuccaaagag

SEQ ID NO: 429607 - RNA, 18 nt, Homo sapiens
cugcaaauucaguaguaa

SEQ ID NO: 429608 - RNA, 16 nt, Homo sapiens
cugcaagcacaucugc

SEQ ID NO: 429609 - RNA, 16 nt, Homo sapiens
cugcaagcccacuggc

SEQ ID NO: 429610 - RNA, 21 nt, Homo sapiens
cugcaagucuccuagaagccc

SEQ ID NO: 429611 - RNA, 18 nt, Homo sapiens
cugcaauaugaauucaag

SEQ ID NO: 429612 - RNA, 19 nt, Homo sapiens
cugcacaacugacuuccaa

SEQ ID NO: 429613 - RNA, 17 nt, Homo sapiens
cugcaccgagagagaug

SEQ ID NO: 429614 - RNA, 22 nt, Homo sapiens
cugcaccgagagagauggaaua

SEQ ID NO: 429615 - RNA, 17 nt, Homo sapiens
cugcacuaaaacccauc

SEQ ID NO: 429616 - RNA, 17 nt, Homo sapiens
cugcacuauagccauuu

SEQ ID NO: 429617 - RNA, 20 nt, Homo sapiens
cugcacuccagccugggcaa

SEQ ID NO: 429618 - RNA, 15 nt, Homo sapiens
cugcagccccccaga

SEQ ID NO: 429619 - RNA, 16 nt, Homo sapiens
cugcagccccccagag

SEQ ID NO: 429620 - RNA, 15 nt, Homo sapiens
cugcagcggcacaaa

SEQ ID NO: 429621 - RNA, 19 nt, Homo sapiens
cugcagcugggccccaugc

SEQ ID NO: 429622 - RNA, 20 nt, Homo sapiens
cugcagguacuuccucaguc

SEQ ID NO: 429623 - RNA, 17 nt, Homo sapiens
cugcagugucugugauu

SEQ ID NO: 429624 - RNA, 21 nt, Homo sapiens
cugcaguuuccucaucuguca

SEQ ID NO: 429625 - RNA, 15 nt, Homo sapiens
cugcauaguauucca

SEQ ID NO: 429626 - RNA, 23 nt, Homo sapiens
cugcauccuacuccuaccugguc

SEQ ID NO: 429627 - RNA, 22 nt, Homo sapiens
cugcaucuccccucagauucca

SEQ ID NO: 429628 - RNA, 22 nt, Homo sapiens
cugcaugacaaacacacaucca

SEQ ID NO: 429629 - RNA, 19 nt, Homo sapiens
cugcauggagugagcagua

SEQ ID NO: 429630 - RNA, 15 nt, Homo sapiens
cugcauuuagcacaa

SEQ ID NO: 429631 - RNA, 16 nt, Homo sapiens
cugcauuuagcacaaa

SEQ ID NO: 429632 - RNA, 10 nt, Homo sapiens
cugcauuuca

SEQ ID NO: 429633 - RNA, 16 nt, Homo sapiens
cugcauuuuacuguac

SEQ ID NO: 429634 - RNA, 23 nt, Homo sapiens
cugcauuuucuggguucugggug

SEQ ID NO: 429635 - RNA, 18 nt, Homo sapiens
cugccaacuccaugacca

SEQ ID NO: 429636 - RNA, 19 nt, Homo sapiens
cugccaauaaacuguuaca

SEQ ID NO: 429637 - RNA, 15 nt, Homo sapiens
cugccacaaugugau

SEQ ID NO: 429638 - RNA, 16 nt, Homo sapiens
cugccacaaugugaua

SEQ ID NO: 429639 - RNA, 14 nt, Homo sapiens
cugccacccacuca

SEQ ID NO: 429640 - RNA, 13 nt, Homo sapiens
cugccaccugccc

SEQ ID NO: 429641 - RNA, 11 nt, Homo sapiens
cugccagagaa

SEQ ID NO: 429642 - RNA, 20 nt, Homo sapiens
cugccagggcccgaccuggg

SEQ ID NO: 429643 - RNA, 22 nt, Homo sapiens
cugccagugagcucgccauuca

SEQ ID NO: 429644 - RNA, 15 nt, Homo sapiens
cugccaucaugccug

SEQ ID NO: 429645 - RNA, 17 nt, Homo sapiens
cugccaugccacugcca

SEQ ID NO: 429646 - RNA, 12 nt, Homo sapiens
cugccauggaag

SEQ ID NO: 429647 - RNA, 18 nt, Homo sapiens
cugcccaaagcagcacuu

SEQ ID NO: 429648 - RNA, 19 nt, Homo sapiens
cugcccaaagcagcacuua

SEQ ID NO: 429649 - RNA, 17 nt, Homo sapiens
cugcccacauacgugag

SEQ ID NO: 429650 - RNA, 16 nt, Homo sapiens
cugcccaccuccugga

SEQ ID NO: 429651 - RNA, 22 nt, Homo sapiens
cugcccaggcagucuuugcuca

SEQ ID NO: 429652 - RNA, 18 nt, Homo sapiens
cugcccauuguaacuuau

SEQ ID NO: 429653 - RNA, 15 nt, Homo sapiens
cugccccacccucaa

SEQ ID NO: 429654 - RNA, 12 nt, Homo sapiens
cugccccagaga

SEQ ID NO: 429655 - RNA, 19 nt, Homo sapiens
cugccccaggccugaaaga

SEQ ID NO: 429656 - RNA, 19 nt, Homo sapiens
cugcccccucccccgcaga

SEQ ID NO: 429657 - RNA, 17 nt, Homo sapiens
cugcccgagagcucuua

SEQ ID NO: 429658 - RNA, 15 nt, Homo sapiens
cugccgcuaccugga

SEQ ID NO: 429659 - RNA, 20 nt, Homo sapiens
cugccggucccccaugccac

SEQ ID NO: 429660 - RNA, 20 nt, Homo sapiens
cugccucagguguccgcuau

SEQ ID NO: 429661 - RNA, 18 nt, Homo sapiens
cugccucccacgcuggga

SEQ ID NO: 429662 - RNA, 18 nt, Homo sapiens
cugccuccccaacccugc

SEQ ID NO: 429663 - RNA, 22 nt, Homo sapiens
cugccucugacagcagccugug

SEQ ID NO: 429664 - RNA, 14 nt, Homo sapiens
cugccucuggguga

SEQ ID NO: 429665 - RNA, 22 nt, Homo sapiens
cugccuguuauaacucugcacu

SEQ ID NO: 429666 - RNA, 22 nt, Homo sapiens
cugccuucuccccuccaaguga

SEQ ID NO: 429667 - RNA, 23 nt, Homo sapiens
cugcgaaacccagcguucuucag

SEQ ID NO: 429668 - RNA, 13 nt, Homo sapiens
cugcgacugauga

SEQ ID NO: 429669 - RNA, 19 nt, Homo sapiens
cugcuaaaggacaguggau

SEQ ID NO: 429670 - RNA, 15 nt, Homo sapiens
cugcuaacuccuagc

SEQ ID NO: 429671 - RNA, 14 nt, Homo sapiens
cugcuaccaucuca

SEQ ID NO: 429672 - RNA, 17 nt, Homo sapiens
cugcuagggaauaucaa

SEQ ID NO: 429673 - RNA, 22 nt, Homo sapiens
cugcuauaugccuuaagccaau

SEQ ID NO: 429674 - RNA, 24 nt, Homo sapiens
cugcuauaugccuuaagccaauau

SEQ ID NO: 429675 - RNA, 22 nt, Homo sapiens
cugcucagaaugccgcaugaca

SEQ ID NO: 429676 - RNA, 16 nt, Homo sapiens
cugcuccaguccugga

SEQ ID NO: 429677 - RNA, 13 nt, Homo sapiens
cugcuccaugcag

SEQ ID NO: 429678 - RNA, 14 nt, Homo sapiens
cugcuccaugcaga

SEQ ID NO: 429679 - RNA, 13 nt, Homo sapiens
cugcucccauucc

SEQ ID NO: 429680 - RNA, 18 nt, Homo sapiens
cugcucggccgucuucac

SEQ ID NO: 429681 - RNA, 18 nt, Homo sapiens
cugcucgggaaggccuga

SEQ ID NO: 429682 - RNA, 12 nt, Homo sapiens
cugcucugcuau

SEQ ID NO: 429683 - RNA, 20 nt, Homo sapiens
cugcucugguuagaaaaagg

SEQ ID NO: 429684 - RNA, 17 nt, Homo sapiens
cugcugaaggaggguca

SEQ ID NO: 429685 - RNA, 15 nt, Homo sapiens
cugcugagugaauga

SEQ ID NO: 429686 - RNA, 16 nt, Homo sapiens
cugcugccaucuccag

SEQ ID NO: 429687 - RNA, 18 nt, Homo sapiens
cugcugcuccagugcagg

SEQ ID NO: 429688 - RNA, 15 nt, Homo sapiens
cugcugcugcuaauc

SEQ ID NO: 429689 - RNA, 16 nt, Homo sapiens
cugcuggaaaugcuga

SEQ ID NO: 429690 - RNA, 14 nt, Homo sapiens
cugcuggucuucaa

SEQ ID NO: 429691 - RNA, 16 nt, Homo sapiens
cugcuguuacuguuaa

SEQ ID NO: 429692 - RNA, 16 nt, Homo sapiens
cugcuguuuuauguca

SEQ ID NO: 429693 - RNA, 21 nt, Homo sapiens
cugcuuacaauucccugcugu

SEQ ID NO: 429694 - RNA, 16 nt, Homo sapiens
cugcuuacuaaugugc

SEQ ID NO: 429695 - RNA, 13 nt, Homo sapiens
cugcuuaguauua

SEQ ID NO: 429696 - RNA, 22 nt, Homo sapiens
cugcuuaucugaaacuucccaa

SEQ ID NO: 429697 - RNA, 18 nt, Homo sapiens
cugcuucacgauucuuac

SEQ ID NO: 429698 - RNA, 13 nt, Homo sapiens
cugcuucagucca

SEQ ID NO: 429699 - RNA, 13 nt, Homo sapiens
cugcuucauaucu

SEQ ID NO: 429700 - RNA, 19 nt, Homo sapiens
cugcuucccaaacucccag

SEQ ID NO: 429701 - RNA, 16 nt, Homo sapiens
cugcuucugauaugca

SEQ ID NO: 429702 - RNA, 13 nt, Homo sapiens
cugcuuguguuaa

SEQ ID NO: 429703 - RNA, 13 nt, Homo sapiens
cuguauauguugu

SEQ ID NO: 429704 - RNA, 18 nt, Homo sapiens
cuguaucggagacaguga

SEQ ID NO: 429705 - RNA, 16 nt, Homo sapiens
cuguaugauuccuuga

SEQ ID NO: 429706 - RNA, 17 nt, Homo sapiens
cuguaugguauaugcau

SEQ ID NO: 429707 - RNA, 18 nt, Homo sapiens
cuguaugguauaugcaug

SEQ ID NO: 429708 - RNA, 13 nt, Homo sapiens
cuguauuaacuga

SEQ ID NO: 429709 - RNA, 16 nt, Homo sapiens
cuguauuacauaaaua

SEQ ID NO: 429710 - RNA, 16 nt, Homo sapiens
cuguauuaccuauuca

SEQ ID NO: 429711 - RNA, 16 nt, Homo sapiens
cuguauuuagugauua

SEQ ID NO: 429712 - RNA, 20 nt, Homo sapiens
cuguauuugagacuaggaua

SEQ ID NO: 429713 - RNA, 23 nt, Homo sapiens
cuguauuuguaucucugaagcau

SEQ ID NO: 429714 - RNA, 19 nt, Homo sapiens
cuguauuuugccagacuua

SEQ ID NO: 429715 - RNA, 20 nt, Homo sapiens
cuguauuuuuuuuuuccauu

SEQ ID NO: 429716 - RNA, 13 nt, Homo sapiens
cugucaaagugag

SEQ ID NO: 429717 - RNA, 12 nt, Homo sapiens
cugucagagccg

SEQ ID NO: 429718 - RNA, 16 nt, Homo sapiens
cugucagaggcuaaga

SEQ ID NO: 429719 - RNA, 17 nt, Homo sapiens
cuguccaccaccaccug

SEQ ID NO: 429720 - RNA, 12 nt, Homo sapiens
cuguccagagag

SEQ ID NO: 429721 - RNA, 21 nt, Homo sapiens
cuguccaggaacuuuccagca

SEQ ID NO: 429722 - RNA, 20 nt, Homo sapiens
cugucccccuacccaccgau

SEQ ID NO: 429723 - RNA, 20 nt, Homo sapiens
cuguccccgagccgagcucu

SEQ ID NO: 429724 - RNA, 17 nt, Homo sapiens
cuguccuacaauaucau

SEQ ID NO: 429725 - RNA, 21 nt, Homo sapiens
cuguccuggaucugcucuaga

SEQ ID NO: 429726 - RNA, 18 nt, Homo sapiens
cuguccuucccacggcca

SEQ ID NO: 429727 - RNA, 20 nt, Homo sapiens
cugucgcaugagaacauuaa

SEQ ID NO: 429728 - RNA, 13 nt, Homo sapiens
cugucuacugugg

SEQ ID NO: 429729 - RNA, 15 nt, Homo sapiens
cugucuaggcacaug

SEQ ID NO: 429730 - RNA, 13 nt, Homo sapiens
cugucuccagggc

SEQ ID NO: 429731 - RNA, 16 nt, Homo sapiens
cugucucuaugagaga

SEQ ID NO: 429732 - RNA, 14 nt, Homo sapiens
cugucugacaaccu

SEQ ID NO: 429733 - RNA, 14 nt, Homo sapiens
cugucugucugucu

SEQ ID NO: 429734 - RNA, 20 nt, Homo sapiens
cugucuuccaaggagaccaa

SEQ ID NO: 429735 - RNA, 14 nt, Homo sapiens
cugucuugagaaaa

SEQ ID NO: 429736 - RNA, 16 nt, Homo sapiens
cugucuugugagcuga

SEQ ID NO: 429737 - RNA, 21 nt, Homo sapiens
cugugaaaguacauuuggaga

SEQ ID NO: 429738 - RNA, 14 nt, Homo sapiens
cugugaagcccuuu

SEQ ID NO: 429739 - RNA, 18 nt, Homo sapiens
cugugaagcccuuugccu

SEQ ID NO: 429740 - RNA, 21 nt, Homo sapiens
cugugaauaaaaacccuguau

SEQ ID NO: 429741 - RNA, 15 nt, Homo sapiens
cugugaauacuugaa

SEQ ID NO: 429742 - RNA, 11 nt, Homo sapiens
cugugacuccu

SEQ ID NO: 429743 - RNA, 21 nt, Homo sapiens
cugugacuuaagaagccuuac

SEQ ID NO: 429744 - RNA, 20 nt, Homo sapiens
cugugauguuaugaauacau

SEQ ID NO: 429745 - RNA, 23 nt, Homo sapiens
cugugauugccauuucuucccaa

SEQ ID NO: 429746 - RNA, 20 nt, Homo sapiens
cugugcaacgugggcaaguc

SEQ ID NO: 429747 - RNA, 14 nt, Homo sapiens
cugugcacauucuc

SEQ ID NO: 429748 - RNA, 12 nt, Homo sapiens
cugugcacugua

SEQ ID NO: 429749 - RNA, 15 nt, Homo sapiens
cugugcaugaccuga

SEQ ID NO: 429750 - RNA, 14 nt, Homo sapiens
cugugccaaagcca

SEQ ID NO: 429751 - RNA, 15 nt, Homo sapiens
cugugccaggacugu

SEQ ID NO: 429752 - RNA, 16 nt, Homo sapiens
cugugccgccaccucu

SEQ ID NO: 429753 - RNA, 18 nt, Homo sapiens
cugugccuaacaccagcg

SEQ ID NO: 429754 - RNA, 15 nt, Homo sapiens
cugugccuaacagca

SEQ ID NO: 429755 - RNA, 16 nt, Homo sapiens
cugugccuaucaccuc

SEQ ID NO: 429756 - RNA, 16 nt, Homo sapiens
cugugccuuuuaucua

SEQ ID NO: 429757 - RNA, 21 nt, Homo sapiens
cugugcggugucaccaugagc

SEQ ID NO: 429758 - RNA, 23 nt, Homo sapiens
cugugcggugucaccaugagcac

SEQ ID NO: 429759 - RNA, 22 nt, Homo sapiens
cugugcuaccucuaacaccaca

SEQ ID NO: 429760 - RNA, 15 nt, Homo sapiens
cugugcuaugaauuu

SEQ ID NO: 429761 - RNA, 21 nt, Homo sapiens
cuguggaggccugaugcugcc

SEQ ID NO: 429762 - RNA, 14 nt, Homo sapiens
cuguggauaacauu

SEQ ID NO: 429763 - RNA, 16 nt, Homo sapiens
cuguggauacccuuac

SEQ ID NO: 429764 - RNA, 11 nt, Homo sapiens
cuguggcacag

SEQ ID NO: 429765 - RNA, 16 nt, Homo sapiens
cuguggcaucuuugcc

SEQ ID NO: 429766 - RNA, 14 nt, Homo sapiens
cuguggccauuugu

SEQ ID NO: 429767 - RNA, 17 nt, Homo sapiens
cuguggccucucaguca

SEQ ID NO: 429768 - RNA, 20 nt, Homo sapiens
cuguggcucugcaugacaaa

SEQ ID NO: 429769 - RNA, 23 nt, Homo sapiens
cuguggcuucuccgucacuccau

SEQ ID NO: 429770 - RNA, 14 nt, Homo sapiens
cugugggaguccac

SEQ ID NO: 429771 - RNA, 15 nt, Homo sapiens
cugugggcccaguca

SEQ ID NO: 429772 - RNA, 15 nt, Homo sapiens
cuguggguauucacc

SEQ ID NO: 429773 - RNA, 21 nt, Homo sapiens
cuguggugcccucugacaagg

SEQ ID NO: 429774 - RNA, 16 nt, Homo sapiens
cugugguuaacaucuc

SEQ ID NO: 429775 - RNA, 18 nt, Homo sapiens
cuguguaaccagcaguca

SEQ ID NO: 429776 - RNA, 21 nt, Homo sapiens
cuguguauuuaacugccuugu

SEQ ID NO: 429777 - RNA, 13 nt, Homo sapiens
cuguguccccgcg

SEQ ID NO: 429778 - RNA, 16 nt, Homo sapiens
cugugugcaagugugu

SEQ ID NO: 429779 - RNA, 23 nt, Homo sapiens
cugugugcaagugugugcacaug

SEQ ID NO: 429780 - RNA, 13 nt, Homo sapiens
cuguguggaccau

SEQ ID NO: 429781 - RNA, 22 nt, Homo sapiens
cuguguggacugugaugccaca

SEQ ID NO: 429782 - RNA, 13 nt, Homo sapiens
cugugugucucca

SEQ ID NO: 429783 - RNA, 21 nt, Homo sapiens
cuguguugugauuccccggag

SEQ ID NO: 429784 - RNA, 16 nt, Homo sapiens
cuguguuuugugaggu

SEQ ID NO: 429785 - RNA, 17 nt, Homo sapiens
cuguuagcauaauguga

SEQ ID NO: 429786 - RNA, 12 nt, Homo sapiens
cuguuaguauua

SEQ ID NO: 429787 - RNA, 20 nt, Homo sapiens
cuguucauuguaagcacuuu

SEQ ID NO: 429788 - RNA, 12 nt, Homo sapiens
cuguuccaagug

SEQ ID NO: 429789 - RNA, 21 nt, Homo sapiens
cuguucccccacccuccaugc

SEQ ID NO: 429790 - RNA, 15 nt, Homo sapiens
cuguuccugccacau

SEQ ID NO: 429791 - RNA, 13 nt, Homo sapiens
cuguuccuuauga

SEQ ID NO: 429792 - RNA, 16 nt, Homo sapiens
cuguuccuuaugauau

SEQ ID NO: 429793 - RNA, 19 nt, Homo sapiens
cuguucuggccucagacca

SEQ ID NO: 429794 - RNA, 13 nt, Homo sapiens
cuguugacaucca

SEQ ID NO: 429795 - RNA, 22 nt, Homo sapiens
cuguugaguuggacacacugua

SEQ ID NO: 429796 - RNA, 15 nt, Homo sapiens
cuguugcauuuacuu

SEQ ID NO: 429797 - RNA, 15 nt, Homo sapiens
cuguugcccauugca

SEQ ID NO: 429798 - RNA, 19 nt, Homo sapiens
cuguugccuuugcucuuau

SEQ ID NO: 429799 - RNA, 12 nt, Homo sapiens
cuguugcucaaa

SEQ ID NO: 429800 - RNA, 21 nt, Homo sapiens
cuguuggccucaagcaaggaa

SEQ ID NO: 429801 - RNA, 20 nt, Homo sapiens
cuguuuacgguacuugguaa

SEQ ID NO: 429802 - RNA, 18 nt, Homo sapiens
cuguuucaaugaccugua

SEQ ID NO: 429803 - RNA, 19 nt, Homo sapiens
cuguuucugcagccacuau

SEQ ID NO: 429804 - RNA, 16 nt, Homo sapiens
cuguuucuuuccagca

SEQ ID NO: 429805 - RNA, 17 nt, Homo sapiens
cuguuuugcauggagua

SEQ ID NO: 429806 - RNA, 21 nt, Homo sapiens
cuguuuugcauggaguauuau

SEQ ID NO: 429807 - RNA, 21 nt, Homo sapiens
cuuaaaaagucugcauuacau

SEQ ID NO: 429808 - RNA, 19 nt, Homo sapiens
cuuaaaagauucacuaaag

SEQ ID NO: 429809 - RNA, 13 nt, Homo sapiens
cuuaaaaguauuc

SEQ ID NO: 429810 - RNA, 16 nt, Homo sapiens
cuuaaaauaagugaau

SEQ ID NO: 429811 - RNA, 14 nt, Homo sapiens
cuuaaaauuagcau

SEQ ID NO: 429812 - RNA, 12 nt, Homo sapiens
cuuaaacaucau

SEQ ID NO: 429813 - RNA, 22 nt, Homo sapiens
cuuaaaguucugggcagcuaaa

SEQ ID NO: 429814 - RNA, 17 nt, Homo sapiens
cuuaaauauacaacuuu

SEQ ID NO: 429815 - RNA, 17 nt, Homo sapiens
cuuaaaucugugaagua

SEQ ID NO: 429816 - RNA, 22 nt, Homo sapiens
cuuaacaacugacuaaccauug

SEQ ID NO: 429817 - RNA, 14 nt, Homo sapiens
cuuaacuauccuaa

SEQ ID NO: 429818 - RNA, 15 nt, Homo sapiens
cuuaacuuaauucaa

SEQ ID NO: 429819 - RNA, 12 nt, Homo sapiens
cuuaagauuugg

SEQ ID NO: 429820 - RNA, 16 nt, Homo sapiens
cuuaagcagaagcauu

SEQ ID NO: 429821 - RNA, 14 nt, Homo sapiens
cuuaagccaagaag

SEQ ID NO: 429822 - RNA, 11 nt, Homo sapiens
cuuaagccaua

SEQ ID NO: 429823 - RNA, 23 nt, Homo sapiens
cuuaaggggggcagggagugaug

SEQ ID NO: 429824 - RNA, 14 nt, Homo sapiens
cuuaauauguuaac

SEQ ID NO: 429825 - RNA, 23 nt, Homo sapiens
cuuaaucaguguagccccaagaa

SEQ ID NO: 429826 - RNA, 15 nt, Homo sapiens
cuuaauguuuauucc

SEQ ID NO: 429827 - RNA, 11 nt, Homo sapiens
cuuaauuaccu

SEQ ID NO: 429828 - RNA, 20 nt, Homo sapiens
cuuaauuaccuaagagccac

SEQ ID NO: 429829 - RNA, 22 nt, Homo sapiens
cuuaauucuuaccucauuugca

SEQ ID NO: 429830 - RNA, 17 nt, Homo sapiens
cuuacaacuccugcauc

SEQ ID NO: 429831 - RNA, 18 nt, Homo sapiens
cuuacaauacaauaguau

SEQ ID NO: 429832 - RNA, 16 nt, Homo sapiens
gaaaaguguaauagca

SEQ ID NO: 429833 - RNA, 20 nt, Homo sapiens
gaaaauaauugcaaauaucc

SEQ ID NO: 429834 - RNA, 14 nt, Homo sapiens
gaaaauaugauaua

SEQ ID NO: 429835 - RNA, 21 nt, Homo sapiens
gaaaauauuuuguugccuuca

SEQ ID NO: 429836 - RNA, 15 nt, Homo sapiens
gaaaaucaacccaau

SEQ ID NO: 429837 - RNA, 14 nt, Homo sapiens
gaaaauccuaccaa

SEQ ID NO: 429838 - RNA, 12 nt, Homo sapiens
gaaaaucuguaa

SEQ ID NO: 429839 - RNA, 12 nt, Homo sapiens
gaaaaugaaucu

SEQ ID NO: 429840 - RNA, 22 nt, Homo sapiens
gaaaauggaugacaaagaaaau

SEQ ID NO: 429841 - RNA, 20 nt, Homo sapiens
gaaaaugucagaaaccaguu

SEQ ID NO: 429842 - RNA, 11 nt, Homo sapiens
gaaaauuacac

SEQ ID NO: 429843 - RNA, 20 nt, Homo sapiens
gaaacaaaaaaguguucccu

SEQ ID NO: 429844 - RNA, 15 nt, Homo sapiens
gaaacaaagcauuug

SEQ ID NO: 429845 - RNA, 17 nt, Homo sapiens
gaaacaauuucuguguc

SEQ ID NO: 429846 - RNA, 17 nt, Homo sapiens
gaaacagcuugaugcug

SEQ ID NO: 429847 - RNA, 14 nt, Homo sapiens
gaaacaugauguga

SEQ ID NO: 429848 - RNA, 16 nt, Homo sapiens
gaaacauuaugccuua

SEQ ID NO: 429849 - RNA, 16 nt, Homo sapiens
gaaaccagagccuuuc

SEQ ID NO: 429850 - RNA, 19 nt, Homo sapiens
gaaaccagccaacccaagu

SEQ ID NO: 429851 - RNA, 12 nt, Homo sapiens
gaaaccaugacu

SEQ ID NO: 429852 - RNA, 12 nt, Homo sapiens
gaaacccgggga

SEQ ID NO: 429853 - RNA, 19 nt, Homo sapiens
gaaaccucugggucaucuc

SEQ ID NO: 429854 - RNA, 20 nt, Homo sapiens
gaaacuaauauuuuauguga

SEQ ID NO: 429855 - RNA, 11 nt, Homo sapiens
gaaacugcucc

SEQ ID NO: 429856 - RNA, 16 nt, Homo sapiens
gaaacuucaagcacca

SEQ ID NO: 429857 - RNA, 18 nt, Homo sapiens
gaaacuugugaaguggaa

SEQ ID NO: 429858 - RNA, 13 nt, Homo sapiens
gaaagaacaucag

SEQ ID NO: 429859 - RNA, 20 nt, Homo sapiens
gaaagacugaaagaauacau

SEQ ID NO: 429860 - RNA, 15 nt, Homo sapiens
gaaagagaguaccau

SEQ ID NO: 429861 - RNA, 14 nt, Homo sapiens
gaaagauggaacuu

SEQ ID NO: 429862 - RNA, 18 nt, Homo sapiens
gaaagcaccgcagcaugu

SEQ ID NO: 429863 - RNA, 11 nt, Homo sapiens
gaaagcacugg

SEQ ID NO: 429864 - RNA, 14 nt, Homo sapiens
gaaagcacuggaau

SEQ ID NO: 429865 - RNA, 21 nt, Homo sapiens
gaaagcaugucucugcuucca

SEQ ID NO: 429866 - RNA, 22 nt, Homo sapiens
gaaagcaugucucugcuuccau

SEQ ID NO: 429867 - RNA, 13 nt, Homo sapiens
gaaagcauugcca

SEQ ID NO: 429868 - RNA, 14 nt, Homo sapiens
gaaagcauugccag

SEQ ID NO: 429869 - RNA, 22 nt, Homo sapiens
gaaagcuguggccagcuuguua

SEQ ID NO: 429870 - RNA, 21 nt, Homo sapiens
gaaaggcaaaaaugugcccuu

SEQ ID NO: 429871 - RNA, 18 nt, Homo sapiens
gaaaggcaucuaagacau

SEQ ID NO: 429872 - RNA, 17 nt, Homo sapiens
gaaaggcugaacauaaa

SEQ ID NO: 429873 - RNA, 19 nt, Homo sapiens
gaaagggguccgauguuug

SEQ ID NO: 429874 - RNA, 19 nt, Homo sapiens
gaaaggucauuguggcuau

SEQ ID NO: 429875 - RNA, 16 nt, Homo sapiens
gaaaguacauuuggag

SEQ ID NO: 429876 - RNA, 19 nt, Homo sapiens
gaaagucaugcacauaccu

SEQ ID NO: 429877 - RNA, 14 nt, Homo sapiens
gaaagugacuacca

SEQ ID NO: 429878 - RNA, 12 nt, Homo sapiens
gaaagugauauc

SEQ ID NO: 429879 - RNA, 22 nt, Homo sapiens
gaaaguucccccaucaguuccc

SEQ ID NO: 429880 - RNA, 12 nt, Homo sapiens
gaaaguucuuaa

SEQ ID NO: 429881 - RNA, 22 nt, Homo sapiens
gaaauaaauguaccugauguac

SEQ ID NO: 429882 - RNA, 15 nt, Homo sapiens
gaaauaacacuguga

SEQ ID NO: 429883 - RNA, 21 nt, Homo sapiens
gaaauaauaaauuaacauuau

SEQ ID NO: 429884 - RNA, 14 nt, Homo sapiens
gaaauacuugacaa

SEQ ID NO: 429885 - RNA, 21 nt, Homo sapiens
gaaauaguuauuuuaauaccu

SEQ ID NO: 429886 - RNA, 15 nt, Homo sapiens
gaaauaugcauguac

SEQ ID NO: 429887 - RNA, 13 nt, Homo sapiens
gaaauauucacaa

SEQ ID NO: 429888 - RNA, 20 nt, Homo sapiens
gaaaucauacuuugccaaau

SEQ ID NO: 429889 - RNA, 11 nt, Homo sapiens
gaaauccaaac

SEQ ID NO: 429890 - RNA, 20 nt, Homo sapiens
gaaauccaacuccaggguua

SEQ ID NO: 429891 - RNA, 21 nt, Homo sapiens
gaaaugaauagccaggccuga

SEQ ID NO: 429892 - RNA, 13 nt, Homo sapiens
gaaaugaauauuc

SEQ ID NO: 429893 - RNA, 22 nt, Homo sapiens
gaaaugaugaaaagguugccug

SEQ ID NO: 429894 - RNA, 20 nt, Homo sapiens
gaaauggauuuaucaucacc

SEQ ID NO: 429895 - RNA, 22 nt, Homo sapiens
gaaauuacuggagccaugucua

SEQ ID NO: 429896 - RNA, 16 nt, Homo sapiens
gaaauucacaaaguua

SEQ ID NO: 429897 - RNA, 16 nt, Homo sapiens
gaaauuccucuguaga

SEQ ID NO: 429898 - RNA, 12 nt, Homo sapiens
gaaauucugcug

SEQ ID NO: 429899 - RNA, 18 nt, Homo sapiens
gaaauuuaaucaguguga

SEQ ID NO: 429900 - RNA, 21 nt, Homo sapiens
gaaauuucaaaguauguuuca

SEQ ID NO: 429901 - RNA, 18 nt, Homo sapiens
gaaauuucccacacccca

SEQ ID NO: 429902 - RNA, 16 nt, Homo sapiens
gaacaaauacaauuca

SEQ ID NO: 429903 - RNA, 18 nt, Homo sapiens
gaacaaauacaauucagu

SEQ ID NO: 429904 - RNA, 17 nt, Homo sapiens
gaacaaauaugauucuc

SEQ ID NO: 429905 - RNA, 17 nt, Homo sapiens
gaacaagaauugcuaaa

SEQ ID NO: 429906 - RNA, 12 nt, Homo sapiens
gaacaagccaca

SEQ ID NO: 429907 - RNA, 17 nt, Homo sapiens
gaacaaucaaagcacuu

SEQ ID NO: 429908 - RNA, 18 nt, Homo sapiens
gaacacagcaugugccaa

SEQ ID NO: 429909 - RNA, 19 nt, Homo sapiens
gaacacagcaugugccaag

SEQ ID NO: 429910 - RNA, 20 nt, Homo sapiens
gaacacauuucuaauuugaa

SEQ ID NO: 429911 - RNA, 18 nt, Homo sapiens
gaaucuccccuccucaca

SEQ ID NO: 429912 - RNA, 21 nt, Homo sapiens
gaaucugcauuuagcacaaaa

SEQ ID NO: 429913 - RNA, 21 nt, Homo sapiens
gaaucuguagaggagccugga

SEQ ID NO: 429914 - RNA, 20 nt, Homo sapiens
gaaugaaugucagugugacu

SEQ ID NO: 429915 - RNA, 13 nt, Homo sapiens
gaaugacaggcuu

SEQ ID NO: 429916 - RNA, 19 nt, Homo sapiens
gaaugaggaacaaucacaa

SEQ ID NO: 429917 - RNA, 16 nt, Homo sapiens
gaaugaugugauacaa

SEQ ID NO: 429918 - RNA, 20 nt, Homo sapiens
gaaugauucccucuugcuau

SEQ ID NO: 429919 - RNA, 13 nt, Homo sapiens
gaaugcagggaag

SEQ ID NO: 429920 - RNA, 11 nt, Homo sapiens
gaaugcagugg

SEQ ID NO: 429921 - RNA, 18 nt, Homo sapiens
gaaugccagcccaaagcu

SEQ ID NO: 429922 - RNA, 15 nt, Homo sapiens
gaaugcuccauucag

SEQ ID NO: 429923 - RNA, 14 nt, Homo sapiens
gaaugcuguguuaa

SEQ ID NO: 429924 - RNA, 15 nt, Homo sapiens
gaauggggaccuggg

SEQ ID NO: 429925 - RNA, 18 nt, Homo sapiens
gaaugucaguagugccag

SEQ ID NO: 429926 - RNA, 20 nt, Homo sapiens
gaauguuagauuccucuugc

SEQ ID NO: 429927 - RNA, 23 nt, Homo sapiens
gaauguucccugcacccuggaaa

SEQ ID NO: 429928 - RNA, 19 nt, Homo sapiens
gaauuaaggaagugacuca

SEQ ID NO: 429929 - RNA, 19 nt, Homo sapiens
gaauuagaagaaaauggau

SEQ ID NO: 429930 - RNA, 17 nt, Homo sapiens
gaauuauaagucacaaa

SEQ ID NO: 429931 - RNA, 19 nt, Homo sapiens
gaauuauuuuuguguuucu

SEQ ID NO: 429932 - RNA, 21 nt, Homo sapiens
gaauucaaggaggaaagaaga

SEQ ID NO: 429933 - RNA, 21 nt, Homo sapiens
gaauucauuaugcugugguca

SEQ ID NO: 429934 - RNA, 22 nt, Homo sapiens
gaauugauucaagauuggacau

SEQ ID NO: 429935 - RNA, 21 nt, Homo sapiens
gaauugcgucauguaagggaa

SEQ ID NO: 429936 - RNA, 14 nt, Homo sapiens
gaauuuaaugucua

SEQ ID NO: 429937 - RNA, 21 nt, Homo sapiens
gaauuuagcuuauacaauuca

SEQ ID NO: 429938 - RNA, 16 nt, Homo sapiens
gaauuuaucugugaau

SEQ ID NO: 429939 - RNA, 21 nt, Homo sapiens
gaauuucccaaagcagugcau

SEQ ID NO: 429940 - RNA, 18 nt, Homo sapiens
gaauuuccucuauugaug

SEQ ID NO: 429941 - RNA, 13 nt, Homo sapiens
gaauuucuagaca

SEQ ID NO: 429942 - RNA, 22 nt, Homo sapiens
gaauuucuagacaguauugcca

SEQ ID NO: 429943 - RNA, 19 nt, Homo sapiens
gaauuugggccucuuguac

SEQ ID NO: 429944 - RNA, 16 nt, Homo sapiens
gaauuuuaaaagcaua

SEQ ID NO: 429945 - RNA, 19 nt, Homo sapiens
gaauuuuuuuuaacauucc

SEQ ID NO: 429946 - RNA, 12 nt, Homo sapiens
gacaaacaguga

SEQ ID NO: 429947 - RNA, 16 nt, Homo sapiens
gacaaaccgagugcaa

SEQ ID NO: 429948 - RNA, 21 nt, Homo sapiens
gacaaauauuuuagaagcuaa

SEQ ID NO: 429949 - RNA, 19 nt, Homo sapiens
gacaaaugggccugccaaa

SEQ ID NO: 429950 - RNA, 11 nt, Homo sapiens
gacaacaggca

SEQ ID NO: 429951 - RNA, 12 nt, Homo sapiens
gacaacauuuua

SEQ ID NO: 429952 - RNA, 22 nt, Homo sapiens
gacaacgaacauggcaugugaa

SEQ ID NO: 429953 - RNA, 17 nt, Homo sapiens
gacaacgccaacugccc

SEQ ID NO: 429954 - RNA, 19 nt, Homo sapiens
gacaauaaauuuuaucuca

SEQ ID NO: 429955 - RNA, 20 nt, Homo sapiens
gacaaucaugaaauaugcau

SEQ ID NO: 429956 - RNA, 22 nt, Homo sapiens
gacaauccccacauaccaucug

SEQ ID NO: 429957 - RNA, 16 nt, Homo sapiens
gacaaugaugaugaua

SEQ ID NO: 429958 - RNA, 21 nt, Homo sapiens
gacaauucccgggcccuucag

SEQ ID NO: 429959 - RNA, 17 nt, Homo sapiens
gacaauuucaaaaugca

SEQ ID NO: 429960 - RNA, 19 nt, Homo sapiens
gacaauuucaaaaugcaug

SEQ ID NO: 429961 - RNA, 19 nt, Homo sapiens
gacacaauguugcacugaa

SEQ ID NO: 429962 - RNA, 19 nt, Homo sapiens
gacacacacacacacacaa

SEQ ID NO: 429963 - RNA, 11 nt, Homo sapiens
gacacacugua

SEQ ID NO: 429964 - RNA, 12 nt, Homo sapiens
gacacacuguaa

SEQ ID NO: 429965 - RNA, 18 nt, Homo sapiens
gacacagacaaagugaca

SEQ ID NO: 429966 - RNA, 23 nt, Homo sapiens
gacacaggccagcuccacagugu

SEQ ID NO: 429967 - RNA, 19 nt, Homo sapiens
gccuccaccgagccagcuu

SEQ ID NO: 429968 - RNA, 15 nt, Homo sapiens
gccuccaguccaguu

SEQ ID NO: 429969 - RNA, 14 nt, Homo sapiens
gccuccaugcugcc

SEQ ID NO: 429970 - RNA, 20 nt, Homo sapiens
gccucccaaggaaaauggac

SEQ ID NO: 429971 - RNA, 18 nt, Homo sapiens
gccucccacccuucucag

SEQ ID NO: 429972 - RNA, 14 nt, Homo sapiens
gccucccccaaagc

SEQ ID NO: 429973 - RNA, 20 nt, Homo sapiens
gccucccuucccagugggcu

SEQ ID NO: 429974 - RNA, 11 nt, Homo sapiens
gccuccucacc

SEQ ID NO: 429975 - RNA, 14 nt, Homo sapiens
gccuccucacccac

SEQ ID NO: 429976 - RNA, 21 nt, Homo sapiens
gccuccucucucaaacugggg

SEQ ID NO: 429977 - RNA, 15 nt, Homo sapiens
gccuccugcaccgag

SEQ ID NO: 429978 - RNA, 20 nt, Homo sapiens
gccuccugcugaguggucca

SEQ ID NO: 429979 - RNA, 15 nt, Homo sapiens
gccucgaauaucuua

SEQ ID NO: 429980 - RNA, 14 nt, Homo sapiens
gccucuacuuuauc

SEQ ID NO: 429981 - RNA, 18 nt, Homo sapiens
gccucucccaaguccagu

SEQ ID NO: 429982 - RNA, 22 nt, Homo sapiens
gccucugccccuggccuuugag

SEQ ID NO: 429983 - RNA, 12 nt, Homo sapiens
gccucuggaaaa

SEQ ID NO: 429984 - RNA, 21 nt, Homo sapiens
gccucuggagggggcagaaga

SEQ ID NO: 429985 - RNA, 21 nt, Homo sapiens
gccucugggaggggugcugcc

SEQ ID NO: 429986 - RNA, 17 nt, Homo sapiens
gccucuguguaucucag

SEQ ID NO: 429987 - RNA, 21 nt, Homo sapiens
gccucuuuuaaugucaucucu

SEQ ID NO: 429988 - RNA, 19 nt, Homo sapiens
gccucuuuucucugugcuu

SEQ ID NO: 429989 - RNA, 19 nt, Homo sapiens
gccugaccucaagcaacca

SEQ ID NO: 429990 - RNA, 17 nt, Homo sapiens
gccugacuaauuuugua

SEQ ID NO: 429991 - RNA, 17 nt, Homo sapiens
gccugagcuggggccac

SEQ ID NO: 429992 - RNA, 22 nt, Homo sapiens
gccugaguuggcguugugggca

SEQ ID NO: 429993 - RNA, 17 nt, Homo sapiens
gccugaucaccagguga

SEQ ID NO: 429994 - RNA, 23 nt, Homo sapiens
gccugauggugcucacgacucuu

SEQ ID NO: 429995 - RNA, 22 nt, Homo sapiens
gccugcaaacucacugcucaag

SEQ ID NO: 429996 - RNA, 12 nt, Homo sapiens
gccugcacacac

SEQ ID NO: 429997 - RNA, 15 nt, Homo sapiens
gccugcacacaccug

SEQ ID NO: 429998 - RNA, 22 nt, Homo sapiens
gccugcaucugucuguccuucc

SEQ ID NO: 429999 - RNA, 16 nt, Homo sapiens
gccugcaucugugaaa

SEQ ID NO: 430000 - RNA, 20 nt, Homo sapiens
gccugccucaugcucucuau

SEQ ID NO: 430001 - RNA, 20 nt, Homo sapiens
gccugcggaguugugcacgu

SEQ ID NO: 430002 - RNA, 12 nt, Homo sapiens
gccugcucugca

SEQ ID NO: 430003 - RNA, 22 nt, Homo sapiens
gccuggagaaaggauggcagcc

SEQ ID NO: 430004 - RNA, 21 nt, Homo sapiens
gccuggagucggaucuagcca

SEQ ID NO: 430005 - RNA, 20 nt, Homo sapiens
gccuggccaggagcucuuca

SEQ ID NO: 430006 - RNA, 20 nt, Homo sapiens
gccuggccaucauggugaaa

SEQ ID NO: 430007 - RNA, 20 nt, Homo sapiens
gccuggcuaacauggugaaa

SEQ ID NO: 430008 - RNA, 21 nt, Homo sapiens
gccuggcuccccacgagucac

SEQ ID NO: 430009 - RNA, 21 nt, Homo sapiens
gccuggcucugucaccgccau

SEQ ID NO: 430010 - RNA, 18 nt, Homo sapiens
gccuggcuggaauacuua

SEQ ID NO: 430011 - RNA, 22 nt, Homo sapiens
gccugggagggugguuccuguu

SEQ ID NO: 430012 - RNA, 17 nt, Homo sapiens
gccugggcuuaugcccu

SEQ ID NO: 430013 - RNA, 18 nt, Homo sapiens
gccuggggauguaaccaa

SEQ ID NO: 430014 - RNA, 16 nt, Homo sapiens
gccugggggcagugac

SEQ ID NO: 430015 - RNA, 22 nt, Homo sapiens
gccuguaaucccaacacuuugg

SEQ ID NO: 430016 - RNA, 19 nt, Homo sapiens
gccuguaaucccagcuacu

SEQ ID NO: 430017 - RNA, 15 nt, Homo sapiens
gccugucacuacugg

SEQ ID NO: 430018 - RNA, 18 nt, Homo sapiens
gccugucaguuucaugga

SEQ ID NO: 430019 - RNA, 23 nt, Homo sapiens
gccugucgcaugagaacauuaac

SEQ ID NO: 430020 - RNA, 21 nt, Homo sapiens
gccugucucuuuccacuuugu

SEQ ID NO: 430021 - RNA, 14 nt, Homo sapiens
gccugugacuuuca

SEQ ID NO: 430022 - RNA, 20 nt, Homo sapiens
gccugugagguaacugggau

SEQ ID NO: 430023 - RNA, 13 nt, Homo sapiens
gccuguggugaag

SEQ ID NO: 430024 - RNA, 19 nt, Homo sapiens
gccugugguuaacaucuca

SEQ ID NO: 430025 - RNA, 19 nt, Homo sapiens
gccugugguuacagugcag

SEQ ID NO: 430026 - RNA, 20 nt, Homo sapiens
gccuguuauaacucugcacu

SEQ ID NO: 430027 - RNA, 18 nt, Homo sapiens
gccuuagggacagaauua

SEQ ID NO: 430028 - RNA, 14 nt, Homo sapiens
gccuuaucuugcac

SEQ ID NO: 430029 - RNA, 22 nt, Homo sapiens
gccuuccacgcugucuccagac

SEQ ID NO: 430030 - RNA, 21 nt, Homo sapiens
gccuuccaggcagacacagcu

SEQ ID NO: 430031 - RNA, 16 nt, Homo sapiens
gccuuccucugcagcu

SEQ ID NO: 430032 - RNA, 17 nt, Homo sapiens
gccuuccugcccuacag

SEQ ID NO: 430033 - RNA, 17 nt, Homo sapiens
gccuucucaccacagag

SEQ ID NO: 430034 - RNA, 18 nt, Homo sapiens
gccuucuuauugcuuuua

SEQ ID NO: 430035 - RNA, 15 nt, Homo sapiens
gccuugccuccucac

SEQ ID NO: 430036 - RNA, 16 nt, Homo sapiens
gccuuuaaaucuguga

SEQ ID NO: 430037 - RNA, 16 nt, Homo sapiens
gccuuuagucgcugag

SEQ ID NO: 430038 - RNA, 16 nt, Homo sapiens
gccuuucuuccaucag

SEQ ID NO: 430039 - RNA, 15 nt, Homo sapiens
gccuuugaccaucuc

SEQ ID NO: 430040 - RNA, 14 nt, Homo sapiens
gccuuugcuugaaa

SEQ ID NO: 430041 - RNA, 17 nt, Homo sapiens
gccuuuuggguuugccu

SEQ ID NO: 430042 - RNA, 15 nt, Homo sapiens
gcgaacugugcaguu

SEQ ID NO: 430043 - RNA, 16 nt, Homo sapiens
gcgaacugugcaguua

SEQ ID NO: 430044 - RNA, 19 nt, Homo sapiens
gcgagacuccgucucaaaa

SEQ ID NO: 430045 - RNA, 20 nt, Homo sapiens
gcgagagguggagugucaca

SEQ ID NO: 430046 - RNA, 11 nt, Homo sapiens
gcgaugugcaa

SEQ ID NO: 430047 - RNA, 14 nt, Homo sapiens
gcgaugugcaagug

SEQ ID NO: 430048 - RNA, 19 nt, Homo sapiens
gcgauucccuguguagcuc

SEQ ID NO: 430049 - RNA, 15 nt, Homo sapiens
gcgcccuuaccuucc

SEQ ID NO: 430050 - RNA, 22 nt, Homo sapiens
gcgcgagccaugauguggagug

SEQ ID NO: 430051 - RNA, 18 nt, Homo sapiens
gcgcgugauagaagaaaa

SEQ ID NO: 430052 - RNA, 20 nt, Homo sapiens
gcgcuccucugcagccugag

SEQ ID NO: 430053 - RNA, 13 nt, Homo sapiens
gcggaaccauagc

SEQ ID NO: 430054 - RNA, 13 nt, Homo sapiens
gcggaagugacca

SEQ ID NO: 430055 - RNA, 11 nt, Homo sapiens
gcggagcugca

SEQ ID NO: 430056 - RNA, 23 nt, Homo sapiens
gcguauccuaugguaacugauga

SEQ ID NO: 430057 - RNA, 14 nt, Homo sapiens
gcgucauguaaggg

SEQ ID NO: 430058 - RNA, 14 nt, Homo sapiens
gcgucuggcacacu

SEQ ID NO: 430059 - RNA, 23 nt, Homo sapiens
ggguucauuauuggaauuaaccu

SEQ ID NO: 430060 - RNA, 20 nt, Homo sapiens
ggguucguggaaagggugcu

SEQ ID NO: 430061 - RNA, 21 nt, Homo sapiens
ggguuggcuguuccagacuca

SEQ ID NO: 430062 - RNA, 12 nt, Homo sapiens
ggguugggcucu

SEQ ID NO: 430063 - RNA, 19 nt, Homo sapiens
ggguuguucacaccacagg

SEQ ID NO: 430064 - RNA, 20 nt, Homo sapiens
ggguuucaccaucuuggcca

SEQ ID NO: 430065 - RNA, 17 nt, Homo sapiens
ggguuucauauccagcu

SEQ ID NO: 430066 - RNA, 22 nt, Homo sapiens
ggguuuuguggucaucuauucu

SEQ ID NO: 430067 - RNA, 18 nt, Homo sapiens
gguaauuuguaucugaag

SEQ ID NO: 430068 - RNA, 14 nt, Homo sapiens
gguagaaaggcagu

SEQ ID NO: 430069 - RNA, 13 nt, Homo sapiens
gguagaagcccuu

SEQ ID NO: 430070 - RNA, 15 nt, Homo sapiens
gugaguguguccaag

SEQ ID NO: 430071 - RNA, 16 nt, Homo sapiens
gugagugugugcaagu

SEQ ID NO: 430072 - RNA, 12 nt, Homo sapiens
gugaguucucac

SEQ ID NO: 430073 - RNA, 16 nt, Homo sapiens
gugauacaaauugaua

SEQ ID NO: 430074 - RNA, 16 nt, Homo sapiens
gugauccgccuaccuc

SEQ ID NO: 430075 - RNA, 17 nt, Homo sapiens
gugaugauagcacuggu

SEQ ID NO: 430076 - RNA, 12 nt, Homo sapiens
gugaugaugcug

SEQ ID NO: 430077 - RNA, 13 nt, Homo sapiens
gugaugaugcugu

SEQ ID NO: 430078 - RNA, 18 nt, Homo sapiens
gugaugaugcugugacaa

SEQ ID NO: 430079 - RNA, 23 nt, Homo sapiens
gugauggcgcgggaggcaccagc

SEQ ID NO: 430080 - RNA, 10 nt, Homo sapiens
gugauuuucc

SEQ ID NO: 430081 - RNA, 15 nt, Homo sapiens
gugcacaucucugcu

SEQ ID NO: 430082 - RNA, 18 nt, Homo sapiens
gugcaccacuucaaguga

SEQ ID NO: 430083 - RNA, 17 nt, Homo sapiens
gugcaccgaguggccau

SEQ ID NO: 430084 - RNA, 14 nt, Homo sapiens
gugcacggggccag

SEQ ID NO: 430085 - RNA, 15 nt, Homo sapiens
gugcacggggccagc

SEQ ID NO: 430086 - RNA, 17 nt, Homo sapiens
gugcacugucacuuugc

SEQ ID NO: 430087 - RNA, 14 nt, Homo sapiens
gugcagaaacuacc

SEQ ID NO: 430088 - RNA, 18 nt, Homo sapiens
gugcagauaucacagagg

SEQ ID NO: 430089 - RNA, 16 nt, Homo sapiens
gugcagaugggcuguu

SEQ ID NO: 430090 - RNA, 13 nt, Homo sapiens
gugcagugucuug

SEQ ID NO: 430091 - RNA, 16 nt, Homo sapiens
gugcauaauuuugcca

SEQ ID NO: 430092 - RNA, 16 nt, Homo sapiens
gugcauauuaaaacaa

SEQ ID NO: 430093 - RNA, 18 nt, Homo sapiens
gugcauggccacagccac

SEQ ID NO: 430094 - RNA, 22 nt, Homo sapiens
gugcauuugagaauaguuuucc

SEQ ID NO: 430095 - RNA, 23 nt, Homo sapiens
gugccaagcagagguugggaggc

SEQ ID NO: 430096 - RNA, 16 nt, Homo sapiens
gugccaaguuccacuu

SEQ ID NO: 430097 - RNA, 14 nt, Homo sapiens
gugcccacagcccg

SEQ ID NO: 430098 - RNA, 22 nt, Homo sapiens
gugcccacccgucuucaaucuc

SEQ ID NO: 430099 - RNA, 13 nt, Homo sapiens
gugccccaugccu

SEQ ID NO: 430100 - RNA, 20 nt, Homo sapiens
gugggauacuuagugguaug

SEQ ID NO: 430101 - RNA, 20 nt, Homo sapiens
gugggccucaaggacuugaa

SEQ ID NO: 430102 - RNA, 15 nt, Homo sapiens
guggggauuggggga

SEQ ID NO: 430103 - RNA, 19 nt, Homo sapiens
gugguacuuuauucuugcu

SEQ ID NO: 430104 - RNA, 20 nt, Homo sapiens
guggucagagggacugucag

SEQ ID NO: 430105 - RNA, 18 nt, Homo sapiens
guggugaacagaacaaaa

SEQ ID NO: 430106 - RNA, 20 nt, Homo sapiens
guggugaacagaacaaaagg

SEQ ID NO: 430107 - RNA, 20 nt, Homo sapiens
guggugacaggcccagugga

SEQ ID NO: 430108 - RNA, 21 nt, Homo sapiens
guggugcagccccaggaccaa

SEQ ID NO: 430109 - RNA, 20 nt, Homo sapiens
gugguuuauugaaugugauu

SEQ ID NO: 430110 - RNA, 19 nt, Homo sapiens
gugguuugcuccagaauua

SEQ ID NO: 430111 - RNA, 23 nt, Homo sapiens
guguaaauggagcuuguacauau

SEQ ID NO: 430112 - RNA, 18 nt, Homo sapiens
guguaauaucauuucaua

SEQ ID NO: 430113 - RNA, 15 nt, Homo sapiens
guguagugucuguaa

SEQ ID NO: 430114 - RNA, 13 nt, Homo sapiens
guguaugcacgug

SEQ ID NO: 430115 - RNA, 16 nt, Homo sapiens
gugucagucagggaca

SEQ ID NO: 430116 - RNA, 14 nt, Homo sapiens
gugucauaccacaa

SEQ ID NO: 430117 - RNA, 18 nt, Homo sapiens
gugucaugauuucaauga

SEQ ID NO: 430118 - RNA, 17 nt, Homo sapiens
guguccaugccuuccau

SEQ ID NO: 430119 - RNA, 14 nt, Homo sapiens
guguccccugccug

SEQ ID NO: 430120 - RNA, 21 nt, Homo sapiens
guguccuucuuccucaagucu

SEQ ID NO: 430121 - RNA, 19 nt, Homo sapiens
gugucuaguuugcauacuu

SEQ ID NO: 430122 - RNA, 15 nt, Homo sapiens
gugucucugccaugu

SEQ ID NO: 430123 - RNA, 13 nt, Homo sapiens
gugucucuguaua

SEQ ID NO: 430124 - RNA, 15 nt, Homo sapiens
gugucuggacauuca

SEQ ID NO: 430125 - RNA, 16 nt, Homo sapiens
gugucuuuuguucucu

SEQ ID NO: 430126 - RNA, 15 nt, Homo sapiens
gugugaagaucacgu

SEQ ID NO: 430127 - RNA, 20 nt, Homo sapiens
gugugcaugagaaugucauu

SEQ ID NO: 430128 - RNA, 21 nt, Homo sapiens
gugugcaugugugugcucagg

SEQ ID NO: 430129 - RNA, 13 nt, Homo sapiens
gugugcgugcaug

SEQ ID NO: 430130 - RNA, 15 nt, Homo sapiens
guguggccugccuuc

SEQ ID NO: 430131 - RNA, 14 nt, Homo sapiens
guguggcuuggaac

SEQ ID NO: 430132 - RNA, 22 nt, Homo sapiens
guguggcuuggaacauuuggga

SEQ ID NO: 430133 - RNA, 13 nt, Homo sapiens
guguguaugcuga

SEQ ID NO: 430134 - RNA, 13 nt, Homo sapiens
guguguccaugca

SEQ ID NO: 430135 - RNA, 20 nt, Homo sapiens
gugugucugguggguggagu

SEQ ID NO: 430136 - RNA, 12 nt, Homo sapiens
gugugugccauc

SEQ ID NO: 430137 - RNA, 17 nt, Homo sapiens
gugugugcgugugucca

SEQ ID NO: 430138 - RNA, 23 nt, Homo sapiens
guguguggggcccaagcaugccc

SEQ ID NO: 430139 - RNA, 14 nt, Homo sapiens
gugugugucucuga

SEQ ID NO: 430140 - RNA, 14 nt, Homo sapiens
guguuaagugacau

SEQ ID NO: 430141 - RNA, 21 nt, Homo sapiens
guguuacgcacacguacuuaa

SEQ ID NO: 430142 - RNA, 16 nt, Homo sapiens
guguuccucaccaaua

SEQ ID NO: 430143 - RNA, 17 nt, Homo sapiens
guguucugauuagaaau

SEQ ID NO: 430144 - RNA, 21 nt, Homo sapiens
guguucuucucaaggacacau

SEQ ID NO: 430145 - RNA, 20 nt, Homo sapiens
guguucuugcuaacuuugcc

SEQ ID NO: 430146 - RNA, 14 nt, Homo sapiens
guguugacugcugc

SEQ ID NO: 430147 - RNA, 22 nt, Homo sapiens
guguugggaccugcugcuccau

SEQ ID NO: 430148 - RNA, 12 nt, Homo sapiens
guguuguucaua

SEQ ID NO: 430149 - RNA, 19 nt, Homo sapiens
guguuuaauuaaauuucac

SEQ ID NO: 430150 - RNA, 20 nt, Homo sapiens
guguuugcacuauacuuucu

SEQ ID NO: 430151 - RNA, 12 nt, Homo sapiens
guguuugggauc

SEQ ID NO: 430152 - RNA, 20 nt, Homo sapiens
guguuugguucuggggcccc

SEQ ID NO: 430153 - RNA, 18 nt, Homo sapiens
guguuuuaaaacauucac

SEQ ID NO: 430154 - RNA, 16 nt, Homo sapiens
guguuuugucuucaac

SEQ ID NO: 430155 - RNA, 17 nt, Homo sapiens
guuaaacauugaaguaa

SEQ ID NO: 430156 - RNA, 12 nt, Homo sapiens
guuaacaucuca

SEQ ID NO: 430157 - RNA, 19 nt, Homo sapiens
guuaaccucagugucauuu

SEQ ID NO: 430158 - RNA, 21 nt, Homo sapiens
guuaagcagauggaaugcugu

SEQ ID NO: 430159 - RNA, 21 nt, Homo sapiens
guuaagcccccuccucacccc

SEQ ID NO: 430160 - RNA, 18 nt, Homo sapiens
guuaaggugaacgcacuu

SEQ ID NO: 430161 - RNA, 19 nt, Homo sapiens
guuaauaaaucaagccaua

SEQ ID NO: 430162 - RNA, 23 nt, Homo sapiens
guuaauggucaaugcuagcacaa

SEQ ID NO: 430163 - RNA, 14 nt, Homo sapiens
guuaauucuugcca

SEQ ID NO: 430164 - RNA, 22 nt, Homo sapiens
guuaauuuuuccuauauugcau

SEQ ID NO: 430165 - RNA, 22 nt, Homo sapiens
guuacaaauucaaggagauaua

SEQ ID NO: 430166 - RNA, 17 nt, Homo sapiens
guuacaggaagucccuu

SEQ ID NO: 430167 - RNA, 10 nt, Homo sapiens
guuaccuaau

SEQ ID NO: 430168 - RNA, 13 nt, Homo sapiens
guuaccugcacac

SEQ ID NO: 430169 - RNA, 14 nt, Homo sapiens
guuacucauuuuau

SEQ ID NO: 430170 - RNA, 15 nt, Homo sapiens
guuacugaaggugau

SEQ ID NO: 430171 - RNA, 15 nt, Homo sapiens
guuacugaccagcaa

SEQ ID NO: 430172 - RNA, 23 nt, Homo sapiens
guuagaaucccauggauguuucu

SEQ ID NO: 430173 - RNA, 13 nt, Homo sapiens
guuagaauuucug

SEQ ID NO: 430174 - RNA, 16 nt, Homo sapiens
guuagagcagaauuca

SEQ ID NO: 430175 - RNA, 13 nt, Homo sapiens
guuagauguccuc

SEQ ID NO: 430176 - RNA, 19 nt, Homo sapiens
guuagccuggugacaggca

SEQ ID NO: 430177 - RNA, 15 nt, Homo sapiens
guuaguaccuagugg

SEQ ID NO: 430178 - RNA, 19 nt, Homo sapiens
guuauaaaucaaugucacu

SEQ ID NO: 430179 - RNA, 19 nt, Homo sapiens
guuauaacucugcacuacu

SEQ ID NO: 430180 - RNA, 22 nt, Homo sapiens
guuauaauaauguuaacaugga

SEQ ID NO: 430181 - RNA, 14 nt, Homo sapiens
guuauaguugauau

SEQ ID NO: 430182 - RNA, 15 nt, Homo sapiens
guuauccaacuauua

SEQ ID NO: 430183 - RNA, 15 nt, Homo sapiens
guuauccugugcuac

SEQ ID NO: 430184 - RNA, 19 nt, Homo sapiens
guuaucuuguguauggaua

SEQ ID NO: 430185 - RNA, 22 nt, Homo sapiens
guuauuaguccaaaugugauca

SEQ ID NO: 430186 - RNA, 17 nt, Homo sapiens
guuauuauuucuucauu

SEQ ID NO: 430187 - RNA, 16 nt, Homo sapiens
guuauucaauaacuau

SEQ ID NO: 430188 - RNA, 16 nt, Homo sapiens
guuauugaaucuuaau

SEQ ID NO: 430189 - RNA, 17 nt, Homo sapiens
guucaaagcaaccaccu

SEQ ID NO: 430190 - RNA, 13 nt, Homo sapiens
guucacacuuugc

SEQ ID NO: 430191 - RNA, 11 nt, Homo sapiens
guucacuccca

SEQ ID NO: 430192 - RNA, 11 nt, Homo sapiens
guucacuuccc

SEQ ID NO: 430193 - RNA, 19 nt, Homo sapiens
guucagagaucguuccuau

SEQ ID NO: 430194 - RNA, 14 nt, Homo sapiens
guucagaugugcau

SEQ ID NO: 430195 - RNA, 13 nt, Homo sapiens
guucaguucuguu

SEQ ID NO: 430196 - RNA, 17 nt, Homo sapiens
guucaugggcaccucau

SEQ ID NO: 430197 - RNA, 17 nt, Homo sapiens
guuccaaguauuuugcc

SEQ ID NO: 430198 - RNA, 11 nt, Homo sapiens
guuccaagugu

SEQ ID NO: 430199 - RNA, 22 nt, Homo sapiens
uaaugcuuuuacuaagcacugu

SEQ ID NO: 430200 - RNA, 13 nt, Homo sapiens
uaauggaggccaa

SEQ ID NO: 430201 - RNA, 17 nt, Homo sapiens
uaauggcuaguacugua

SEQ ID NO: 430202 - RNA, 18 nt, Homo sapiens
uaauggcuaguacuguau

SEQ ID NO: 430203 - RNA, 23 nt, Homo sapiens
uaauggcucaucaacaaucacaa

SEQ ID NO: 430204 - RNA, 14 nt, Homo sapiens
uaaugguguuuuaa

SEQ ID NO: 430205 - RNA, 14 nt, Homo sapiens
uaaugucaggguca

SEQ ID NO: 430206 - RNA, 13 nt, Homo sapiens
uaauguuacauua

SEQ ID NO: 430207 - RNA, 21 nt, Homo sapiens
uaauguuagaauugauuucca

SEQ ID NO: 430208 - RNA, 11 nt, Homo sapiens
uaauguuauag

SEQ ID NO: 430209 - RNA, 20 nt, Homo sapiens
uaauguuauccucuugcuau

SEQ ID NO: 430210 - RNA, 18 nt, Homo sapiens
uaauguuccaugucugaa

SEQ ID NO: 430211 - RNA, 22 nt, Homo sapiens
uaauguuuaaaagcaaaacugc

SEQ ID NO: 430212 - RNA, 15 nt, Homo sapiens
uaauuaaaacacaac

SEQ ID NO: 430213 - RNA, 20 nt, Homo sapiens
uaauuaaaugaaauacuuga

SEQ ID NO: 430214 - RNA, 23 nt, Homo sapiens
uaauuaaauuuugaguucuacau

SEQ ID NO: 430215 - RNA, 23 nt, Homo sapiens
uaauuagaaacacacuuuugcac

SEQ ID NO: 430216 - RNA, 19 nt, Homo sapiens
uaauuaucacaauguacua

SEQ ID NO: 430217 - RNA, 21 nt, Homo sapiens
uaauuaucggaagcagugccu

SEQ ID NO: 430218 - RNA, 17 nt, Homo sapiens
uaauuauguuuaccuca

SEQ ID NO: 430219 - RNA, 16 nt, Homo sapiens
uaauucaaaagaucaa

SEQ ID NO: 430220 - RNA, 19 nt, Homo sapiens
uaauucaagaaaacaacuu

SEQ ID NO: 430221 - RNA, 14 nt, Homo sapiens
uaauuccaauauga

SEQ ID NO: 430222 - RNA, 15 nt, Homo sapiens
uaauucuaaguuauu

SEQ ID NO: 430223 - RNA, 17 nt, Homo sapiens
uaauucuauacuguuga

SEQ ID NO: 430224 - RNA, 13 nt, Homo sapiens
uaauucugaugcu

SEQ ID NO: 430225 - RNA, 15 nt, Homo sapiens
uaauucuuaccucau

SEQ ID NO: 430226 - RNA, 12 nt, Homo sapiens
uaauugcauucu

SEQ ID NO: 430227 - RNA, 12 nt, Homo sapiens
uaauugccaugu

SEQ ID NO: 430228 - RNA, 19 nt, Homo sapiens
uaauugccuaaaucuccag

SEQ ID NO: 430229 - RNA, 13 nt, Homo sapiens
uaauuguguacaa

SEQ ID NO: 430230 - RNA, 21 nt, Homo sapiens
uaauugugugacuuuuucaga

SEQ ID NO: 430231 - RNA, 21 nt, Homo sapiens
uaauuuauuuaauauacuuua

SEQ ID NO: 430232 - RNA, 14 nt, Homo sapiens
uaauuucagugccu

SEQ ID NO: 430233 - RNA, 18 nt, Homo sapiens
uaauuuguaucugaagga

SEQ ID NO: 430234 - RNA, 17 nt, Homo sapiens
uaauuuuaaaguaucau

SEQ ID NO: 430235 - RNA, 18 nt, Homo sapiens
uaauuuuacaugucucau

SEQ ID NO: 430236 - RNA, 18 nt, Homo sapiens
uaauuuugugcucuuucc

SEQ ID NO: 430237 - RNA, 21 nt, Homo sapiens
uaauuuuuaaaagacuuugau

SEQ ID NO: 430238 - RNA, 16 nt, Homo sapiens
uacaaaaacauggccu

SEQ ID NO: 430239 - RNA, 19 nt, Homo sapiens
uacaaacaaaggauuugaa

SEQ ID NO: 430240 - RNA, 21 nt, Homo sapiens
uacaacaaucccagcaucuga

SEQ ID NO: 430241 - RNA, 21 nt, Homo sapiens
uacaacauaaucuaguuuaca

SEQ ID NO: 430242 - RNA, 16 nt, Homo sapiens
uacaaccgguuaucag

SEQ ID NO: 430243 - RNA, 18 nt, Homo sapiens
uacaacugaucauuugca

SEQ ID NO: 430244 - RNA, 18 nt, Homo sapiens
uacaauuguaaaacugag

SEQ ID NO: 430245 - RNA, 22 nt, Homo sapiens
uacacaaaauacagcacuuuga

SEQ ID NO: 430246 - RNA, 12 nt, Homo sapiens
uacacaacaugu

SEQ ID NO: 430247 - RNA, 19 nt, Homo sapiens
uacacaaggaaggcauuug

SEQ ID NO: 430248 - RNA, 18 nt, Homo sapiens
uacacacuuuuuaagaaa

SEQ ID NO: 430249 - RNA, 16 nt, Homo sapiens
uacacauagcauguaa

SEQ ID NO: 430250 - RNA, 15 nt, Homo sapiens
uacacccccaccucc

SEQ ID NO: 430251 - RNA, 14 nt, Homo sapiens
uacaccucugggcc

SEQ ID NO: 430252 - RNA, 18 nt, Homo sapiens
uacaccuugcuaaccuaa

SEQ ID NO: 430253 - RNA, 18 nt, Homo sapiens
uacacguugaaaaucaac

SEQ ID NO: 430254 - RNA, 17 nt, Homo sapiens
uacacugaaucauuaac

SEQ ID NO: 430255 - RNA, 17 nt, Homo sapiens
uacacuugguguacugg

SEQ ID NO: 430256 - RNA, 22 nt, Homo sapiens
uacagaaagagcgucauguccu

SEQ ID NO: 430257 - RNA, 17 nt, Homo sapiens
uacagaaauuaccccgg

SEQ ID NO: 430258 - RNA, 23 nt, Homo sapiens
uacagaaucauugcuuaugacau

SEQ ID NO: 430259 - RNA, 19 nt, Homo sapiens
uacagacaacaaaccuguu

SEQ ID NO: 430260 - RNA, 19 nt, Homo sapiens
uacagauugcugcuucugc

SEQ ID NO: 430261 - RNA, 15 nt, Homo sapiens
uacagcaagagccac

SEQ ID NO: 430262 - RNA, 16 nt, Homo sapiens
uacagcacuacucugu

SEQ ID NO: 430263 - RNA, 16 nt, Homo sapiens
uacagccugcacacac

SEQ ID NO: 430264 - RNA, 18 nt, Homo sapiens
uacagccuucacuggaga

SEQ ID NO: 430265 - RNA, 21 nt, Homo sapiens
uacaggaagcaccccaugcca

SEQ ID NO: 430266 - RNA, 22 nt, Homo sapiens
uacaggaucauguaaaugcuca

SEQ ID NO: 430267 - RNA, 20 nt, Homo sapiens
uacaggcgugauccaccaca

SEQ ID NO: 430268 - RNA, 18 nt, Homo sapiens
uacaggugaaggcucuca

SEQ ID NO: 430269 - RNA, 15 nt, Homo sapiens
uacaguacacagaua

SEQ ID NO: 430270 - RNA, 22 nt, Homo sapiens
uacaguauuguggcugcacuug

SEQ ID NO: 430271 - RNA, 19 nt, Homo sapiens
uacagucagcacagaacac

SEQ ID NO: 430272 - RNA, 24 nt, Homo sapiens
uacaguuaauuaugugcauauuaa

SEQ ID NO: 430273 - RNA, 14 nt, Homo sapiens
uacaguucauaaau

SEQ ID NO: 430274 - RNA, 13 nt, Homo sapiens
uacauaaacugac

SEQ ID NO: 430275 - RNA, 20 nt, Homo sapiens
uacauaauguuaguagcacu

SEQ ID NO: 430276 - RNA, 16 nt, Homo sapiens
uacauacauuguauag

SEQ ID NO: 430277 - RNA, 20 nt, Homo sapiens
uacauaguggucauuuggug

SEQ ID NO: 430278 - RNA, 15 nt, Homo sapiens
uacauauuacuguug

SEQ ID NO: 430279 - RNA, 19 nt, Homo sapiens
uacaucaaugguguguuaa

SEQ ID NO: 430280 - RNA, 20 nt, Homo sapiens
uacauccagucacuuugcca

SEQ ID NO: 430281 - RNA, 13 nt, Homo sapiens
uacaucuaaguca

SEQ ID NO: 430282 - RNA, 11 nt, Homo sapiens
uacaucuggcc

SEQ ID NO: 430283 - RNA, 12 nt, Homo sapiens
uacaucuuuauu

SEQ ID NO: 430284 - RNA, 11 nt, Homo sapiens
uacaugacugg

SEQ ID NO: 430285 - RNA, 19 nt, Homo sapiens
uacaugcagcccaugccca

SEQ ID NO: 430286 - RNA, 19 nt, Homo sapiens
uacaugccucagugaagga

SEQ ID NO: 430287 - RNA, 17 nt, Homo sapiens
uacauggaauagcaccu

SEQ ID NO: 430288 - RNA, 11 nt, Homo sapiens
uacauggguag

SEQ ID NO: 430289 - RNA, 14 nt, Homo sapiens
uacauggguucaau

SEQ ID NO: 430290 - RNA, 12 nt, Homo sapiens
uacauguaaaau

SEQ ID NO: 430291 - RNA, 19 nt, Homo sapiens
uacauguguggauguguaa

SEQ ID NO: 430292 - RNA, 19 nt, Homo sapiens
uacauguuuuagacagaga

SEQ ID NO: 430293 - RNA, 21 nt, Homo sapiens
uacauuauuacuccuugccau

SEQ ID NO: 430294 - RNA, 19 nt, Homo sapiens
uacauuccucagcugccaa

SEQ ID NO: 430295 - RNA, 15 nt, Homo sapiens
uacauuccugagauu

SEQ ID NO: 430296 - RNA, 14 nt, Homo sapiens
uacauuguaaauag

SEQ ID NO: 430297 - RNA, 17 nt, Homo sapiens
uacauuucaccuacuuu

SEQ ID NO: 430298 - RNA, 14 nt, Homo sapiens
uaccaaaacauaag

SEQ ID NO: 430299 - RNA, 15 nt, Homo sapiens
uaccaaaagggccau

SEQ ID NO: 430300 - RNA, 18 nt, Homo sapiens
uaccaaagaaacaccacu

SEQ ID NO: 430301 - RNA, 14 nt, Homo sapiens
uaccaaucauuuua

SEQ ID NO: 430302 - RNA, 14 nt, Homo sapiens
uaccacaauucauu

SEQ ID NO: 430303 - RNA, 22 nt, Homo sapiens
uaccacaugguccauuucaugu

SEQ ID NO: 430304 - RNA, 15 nt, Homo sapiens
uaccagagacucuga

SEQ ID NO: 430305 - RNA, 13 nt, Homo sapiens
uaccagcuaugcc

SEQ ID NO: 430306 - RNA, 22 nt, Homo sapiens
uaccagggcucuguauucugca

SEQ ID NO: 430307 - RNA, 16 nt, Homo sapiens
uaccagguuaccucac

SEQ ID NO: 430308 - RNA, 15 nt, Homo sapiens
uaccaucugcaucca

SEQ ID NO: 430309 - RNA, 14 nt, Homo sapiens
uaccaucuguagag

SEQ ID NO: 430310 - RNA, 16 nt, Homo sapiens
uaccaugaugcaugga

SEQ ID NO: 430311 - RNA, 15 nt, Homo sapiens
uaccauuuauuugcu

SEQ ID NO: 430312 - RNA, 22 nt, Homo sapiens
uaccauuuguaauaaaguauau

SEQ ID NO: 430313 - RNA, 16 nt, Homo sapiens
uacccacagagugugg

SEQ ID NO: 430314 - RNA, 12 nt, Homo sapiens
uacccaccugag

SEQ ID NO: 430315 - RNA, 21 nt, Homo sapiens
uacccaccugagcuuuggacg

SEQ ID NO: 430316 - RNA, 23 nt, Homo sapiens
uacccagagaauauauacauucu

SEQ ID NO: 430317 - RNA, 12 nt, Homo sapiens
uacccucccacc

SEQ ID NO: 430318 - RNA, 21 nt, Homo sapiens
uacccucuaaaaaagaacuuu

SEQ ID NO: 430319 - RNA, 19 nt, Homo sapiens
uacccuggagcaagaccug

SEQ ID NO: 430320 - RNA, 18 nt, Homo sapiens
uaccguaacaauguuugu

SEQ ID NO: 430321 - RNA, 23 nt, Homo sapiens
uaccguucacuuccccuuccaac

SEQ ID NO: 430322 - RNA, 14 nt, Homo sapiens
uaccuauugcugua

SEQ ID NO: 430323 - RNA, 11 nt, Homo sapiens
uaccucaaggg

SEQ ID NO: 430324 - RNA, 23 nt, Homo sapiens
uaccucacagagugcauugugag

SEQ ID NO: 430325 - RNA, 23 nt, Homo sapiens
uaccucuaaguacauauguagau

SEQ ID NO: 430326 - RNA, 13 nt, Homo sapiens
uaccugaaaggaa

SEQ ID NO: 430327 - RNA, 22 nt, Homo sapiens
uaccugaagucuuuguacagac

SEQ ID NO: 430328 - RNA, 14 nt, Homo sapiens
uaccugacaggggu

SEQ ID NO: 430329 - RNA, 19 nt, Homo sapiens
uaccugagauggaggaguc

SEQ ID NO: 430330 - RNA, 16 nt, Homo sapiens
uaccuggaaaccagaa

SEQ ID NO: 430331 - RNA, 17 nt, Homo sapiens
uagaugugucuuaccag

SEQ ID NO: 430332 - RNA, 18 nt, Homo sapiens
uagauuuuucucaucucc

SEQ ID NO: 430333 - RNA, 20 nt, Homo sapiens
uagcaacaugcuucaugaaa

SEQ ID NO: 430334 - RNA, 15 nt, Homo sapiens
uagcaccauugcacu

SEQ ID NO: 430335 - RNA, 23 nt, Homo sapiens
uagcaccccccauuggggcuaua

SEQ ID NO: 430336 - RNA, 14 nt, Homo sapiens
uagcagacaguguu

SEQ ID NO: 430337 - RNA, 19 nt, Homo sapiens
uagcaggcccagcuggggc

SEQ ID NO: 430338 - RNA, 21 nt, Homo sapiens
uagcagucaucaucuuuuugu

SEQ ID NO: 430339 - RNA, 20 nt, Homo sapiens
uagcaguucugcaaauagaa

SEQ ID NO: 430340 - RNA, 16 nt, Homo sapiens
uagcauuaacuaaucu

SEQ ID NO: 430341 - RNA, 14 nt, Homo sapiens
uagccagcuguguu

SEQ ID NO: 430342 - RNA, 16 nt, Homo sapiens
uagccaucuaaugcuu

SEQ ID NO: 430343 - RNA, 20 nt, Homo sapiens
uagccccuuagccaguugua

SEQ ID NO: 430344 - RNA, 17 nt, Homo sapiens
uagccugaaaauccaaa

SEQ ID NO: 430345 - RNA, 19 nt, Homo sapiens
uagccugaauucuuuucaa

SEQ ID NO: 430346 - RNA, 14 nt, Homo sapiens
uagccuguagcuua

SEQ ID NO: 430347 - RNA, 17 nt, Homo sapiens
uagccuuugucauuuua

SEQ ID NO: 430348 - RNA, 21 nt, Homo sapiens
uagcgcugcucuuaugccauu

SEQ ID NO: 430349 - RNA, 17 nt, Homo sapiens
uagcuaauuuaggaguu

SEQ ID NO: 430350 - RNA, 22 nt, Homo sapiens
uagcuagaauauccuauacugg

SEQ ID NO: 430351 - RNA, 14 nt, Homo sapiens
uagcuauaacaacu

SEQ ID NO: 430352 - RNA, 15 nt, Homo sapiens
uagcuauauccaugu

SEQ ID NO: 430353 - RNA, 20 nt, Homo sapiens
uagcuauuuuucuuguugca

SEQ ID NO: 430354 - RNA, 22 nt, Homo sapiens
uagcucccuccucccaucuccu

SEQ ID NO: 430355 - RNA, 12 nt, Homo sapiens
uagcucuauggg

SEQ ID NO: 430356 - RNA, 18 nt, Homo sapiens
uagcucucacaugcacag

SEQ ID NO: 430357 - RNA, 19 nt, Homo sapiens
uagcuggcugcagaacucc

SEQ ID NO: 430358 - RNA, 14 nt, Homo sapiens
uagcugggauuuga

SEQ ID NO: 430359 - RNA, 16 nt, Homo sapiens
uagcuguccucucaga

SEQ ID NO: 430360 - RNA, 19 nt, Homo sapiens
uagcuuacaggaagcuuuu

SEQ ID NO: 430361 - RNA, 16 nt, Homo sapiens
uagcuuacugauuaac

SEQ ID NO: 430362 - RNA, 14 nt, Homo sapiens
uagcuuagcugucu

SEQ ID NO: 430363 - RNA, 24 nt, Homo sapiens
uagcuuuacauuuucaguaccaaa

SEQ ID NO: 430364 - RNA, 17 nt, Homo sapiens
uaggaaauugcucauaa

SEQ ID NO: 430365 - RNA, 16 nt, Homo sapiens
uaggaagagaaaccag

SEQ ID NO: 430366 - RNA, 24 nt, Homo sapiens
uaggaaucccagaggugggauccu

SEQ ID NO: 430367 - RNA, 19 nt, Homo sapiens
uaggagaaaccagcuuuua

SEQ ID NO: 430368 - RNA, 20 nt, Homo sapiens
uaggagaacugucaugagua

SEQ ID NO: 430369 - RNA, 22 nt, Homo sapiens
uaggagcuuccagcucuaauaa

SEQ ID NO: 430370 - RNA, 14 nt, Homo sapiens
uaggaggaugcugu

SEQ ID NO: 430371 - RNA, 19 nt, Homo sapiens
uaggaguuaacuacccuac

SEQ ID NO: 430372 - RNA, 17 nt, Homo sapiens
uaggauaagcacuagau

SEQ ID NO: 430373 - RNA, 21 nt, Homo sapiens
uaggauaagcacuagaucucc

SEQ ID NO: 430374 - RNA, 16 nt, Homo sapiens
uaggauauacuguaug

SEQ ID NO: 430375 - RNA, 17 nt, Homo sapiens
uaggcacaaaaccagaa

SEQ ID NO: 430376 - RNA, 19 nt, Homo sapiens
uaggcauacucuccaggau

SEQ ID NO: 430377 - RNA, 11 nt, Homo sapiens
uaggcauuugu

SEQ ID NO: 430378 - RNA, 22 nt, Homo sapiens
uaggccucaguguccucaucua

SEQ ID NO: 430379 - RNA, 12 nt, Homo sapiens
uaggcucugcac

SEQ ID NO: 430380 - RNA, 16 nt, Homo sapiens
uaggcugacaccaaga

SEQ ID NO: 430381 - RNA, 16 nt, Homo sapiens
uaggcugggcccagag

SEQ ID NO: 430382 - RNA, 14 nt, Homo sapiens
uagggaagcucagg

SEQ ID NO: 430383 - RNA, 18 nt, Homo sapiens
uaggggccgaguccagga

SEQ ID NO: 430384 - RNA, 17 nt, Homo sapiens
uaggguccuggcccucu

SEQ ID NO: 430385 - RNA, 22 nt, Homo sapiens
uaggguuauuaguccaaaugug

SEQ ID NO: 430386 - RNA, 16 nt, Homo sapiens
uaggucuccucagggu

SEQ ID NO: 430387 - RNA, 17 nt, Homo sapiens
uaggucuccucagggug

SEQ ID NO: 430388 - RNA, 18 nt, Homo sapiens
uagguuaacauuuguaau

SEQ ID NO: 430389 - RNA, 13 nt, Homo sapiens
uagguuggcagua

SEQ ID NO: 430390 - RNA, 14 nt, Homo sapiens
uagguuucaccucc

SEQ ID NO: 430391 - RNA, 13 nt, Homo sapiens
uaguaaacugugc

SEQ ID NO: 430392 - RNA, 16 nt, Homo sapiens
uaguaauaccuacuug

SEQ ID NO: 430393 - RNA, 12 nt, Homo sapiens
uaguacuugaaa

SEQ ID NO: 430394 - RNA, 13 nt, Homo sapiens
uaguagagcaaag

SEQ ID NO: 430395 - RNA, 23 nt, Homo sapiens
uagucaagagaaguacagaaugu

SEQ ID NO: 430396 - RNA, 18 nt, Homo sapiens
uagucaaucaaacaggga

SEQ ID NO: 430397 - RNA, 13 nt, Homo sapiens
uagucacauauca

SEQ ID NO: 430398 - RNA, 14 nt, Homo sapiens
uagucacauaucaa

SEQ ID NO: 430399 - RNA, 22 nt, Homo sapiens
uaguccaaauaacaaguaccaa

SEQ ID NO: 430400 - RNA, 21 nt, Homo sapiens
uagucccauugauguacuuua

SEQ ID NO: 430401 - RNA, 23 nt, Homo sapiens
uagucccggcaaccagauuucag

SEQ ID NO: 430402 - RNA, 18 nt, Homo sapiens
uaguccggacccaccuca

SEQ ID NO: 430403 - RNA, 19 nt, Homo sapiens
uaguccggacccaccucac

SEQ ID NO: 430404 - RNA, 17 nt, Homo sapiens
uagugaccuaaccacuu

SEQ ID NO: 430405 - RNA, 16 nt, Homo sapiens
uagugaugcaggcagu

SEQ ID NO: 430406 - RNA, 14 nt, Homo sapiens
uagugcacuagcau

SEQ ID NO: 430407 - RNA, 23 nt, Homo sapiens
uagugccagaaagagagaaccaa

SEQ ID NO: 430408 - RNA, 23 nt, Homo sapiens
uagugccagguggcucagugcca

SEQ ID NO: 430409 - RNA, 17 nt, Homo sapiens
uagugcugaagcuuauu

SEQ ID NO: 430410 - RNA, 19 nt, Homo sapiens
uagugguguuuuaaagaga

SEQ ID NO: 430411 - RNA, 15 nt, Homo sapiens
uagugugugcaauuu

SEQ ID NO: 430412 - RNA, 18 nt, Homo sapiens
uaguuaaauuggcuuguu

SEQ ID NO: 430413 - RNA, 16 nt, Homo sapiens
uaguuaccuacugagu

SEQ ID NO: 430414 - RNA, 15 nt, Homo sapiens
uaguucuucauccca

SEQ ID NO: 430415 - RNA, 19 nt, Homo sapiens
uaguucuuuguuccugcuu

SEQ ID NO: 430416 - RNA, 20 nt, Homo sapiens
uaguugccguggcaacugug

SEQ ID NO: 430417 - RNA, 21 nt, Homo sapiens
uaguugccguggcaacugugg

SEQ ID NO: 430418 - RNA, 14 nt, Homo sapiens
uaguuucugauuca

SEQ ID NO: 430419 - RNA, 23 nt, Homo sapiens
uaguuuuaaacucauuuuugcca

SEQ ID NO: 430420 - RNA, 14 nt, Homo sapiens
uaguuuugggauau

SEQ ID NO: 430421 - RNA, 21 nt, Homo sapiens
uaguuuuuaaaaaggccuuug

SEQ ID NO: 430422 - RNA, 14 nt, Homo sapiens
uauaaacacauaau

SEQ ID NO: 430423 - RNA, 14 nt, Homo sapiens
uauaaacauaugca

SEQ ID NO: 430424 - RNA, 16 nt, Homo sapiens
uauaaagaggacuuga

SEQ ID NO: 430425 - RNA, 13 nt, Homo sapiens
uauaaauaaagca

SEQ ID NO: 430426 - RNA, 22 nt, Homo sapiens
uauaaaugagcaaauggaacaa

SEQ ID NO: 430427 - RNA, 14 nt, Homo sapiens
uauaaauguaaaaa

SEQ ID NO: 430428 - RNA, 15 nt, Homo sapiens
uauaaauguacuaca

SEQ ID NO: 430429 - RNA, 19 nt, Homo sapiens
uauaaauguguggugcuaa

SEQ ID NO: 430430 - RNA, 13 nt, Homo sapiens
uauaacaauugau

SEQ ID NO: 430431 - RNA, 15 nt, Homo sapiens
uauaacagcaaauaa

SEQ ID NO: 430432 - RNA, 19 nt, Homo sapiens
uauaaccccaccuugccaa

SEQ ID NO: 430433 - RNA, 12 nt, Homo sapiens
uauaaccccagc

SEQ ID NO: 430434 - RNA, 18 nt, Homo sapiens
uauaacucugcacuacuc

SEQ ID NO: 430435 - RNA, 22 nt, Homo sapiens
uauaagaaaagcagacgcagca

SEQ ID NO: 430436 - RNA, 19 nt, Homo sapiens
uauaagauucauauuuacu

SEQ ID NO: 430437 - RNA, 15 nt, Homo sapiens
uauaauaaaugggaa

SEQ ID NO: 430438 - RNA, 17 nt, Homo sapiens
uauaauaaaugggcaca

SEQ ID NO: 430439 - RNA, 17 nt, Homo sapiens
uauaaucccagcacuuu

SEQ ID NO: 430440 - RNA, 20 nt, Homo sapiens
uauaaucccuuuacaucugu

SEQ ID NO: 430441 - RNA, 21 nt, Homo sapiens
uauacacuauuugugagcaaa

SEQ ID NO: 430442 - RNA, 19 nt, Homo sapiens
uauacagaaagauugguaa

SEQ ID NO: 430443 - RNA, 21 nt, Homo sapiens
uauacauaaaguauccaugca

SEQ ID NO: 430444 - RNA, 21 nt, Homo sapiens
uauacauagucuuuguuuaca

SEQ ID NO: 430445 - RNA, 21 nt, Homo sapiens
uauacaucuagcacagcugug

SEQ ID NO: 430446 - RNA, 13 nt, Homo sapiens
uauaccaaaaggg

SEQ ID NO: 430447 - RNA, 18 nt, Homo sapiens
uauaccagguuaccucac

SEQ ID NO: 430448 - RNA, 14 nt, Homo sapiens
uauacuguuuacug

SEQ ID NO: 430449 - RNA, 18 nt, Homo sapiens
uauagaaaaagcacagcu

SEQ ID NO: 430450 - RNA, 19 nt, Homo sapiens
uauagagucaaccaccaca

SEQ ID NO: 430451 - RNA, 13 nt, Homo sapiens
uauagcagucauc

SEQ ID NO: 430452 - RNA, 13 nt, Homo sapiens
uauagcugggaac

SEQ ID NO: 430453 - RNA, 21 nt, Homo sapiens
uauaggaaaaguuauugugau

SEQ ID NO: 430454 - RNA, 13 nt, Homo sapiens
uauagucacauuu

SEQ ID NO: 430455 - RNA, 20 nt, Homo sapiens
uauaguuaucaaucucuagu

SEQ ID NO: 430456 - RNA, 14 nt, Homo sapiens
uauauaaaaauggg

SEQ ID NO: 430457 - RNA, 16 nt, Homo sapiens
uauauaagccaaaaaa

SEQ ID NO: 430458 - RNA, 20 nt, Homo sapiens
uauauaaugguuuacugcug

SEQ ID NO: 430459 - RNA, 21 nt, Homo sapiens
uauauaaugguuuacugcugu

SEQ ID NO: 430460 - RNA, 17 nt, Homo sapiens
uauauaguaugaaugca

SEQ ID NO: 430461 - RNA, 16 nt, Homo sapiens
uauauauacauguaua

SEQ ID NO: 430462 - RNA, 19 nt, Homo sapiens
uauauauuuauaacucauc

SEQ ID NO: 430463 - RNA, 12 nt, Homo sapiens
uauaucagggaa

SEQ ID NO: 430464 - RNA, 14 nt, Homo sapiens
uauaucuuugcacu

SEQ ID NO: 430465 - RNA, 19 nt, Homo sapiens
uauaugaacuuaacaugcu

SEQ ID NO: 430466 - RNA, 18 nt, Homo sapiens
uauauguagaguguuuua

SEQ ID NO: 430467 - RNA, 12 nt, Homo sapiens
uauaugucuugc

SEQ ID NO: 430468 - RNA, 15 nt, Homo sapiens
uauauucauaccugu

SEQ ID NO: 430469 - RNA, 16 nt, Homo sapiens
uauauucauaccuguu

SEQ ID NO: 430470 - RNA, 19 nt, Homo sapiens
uauauuccgcacucaagga

SEQ ID NO: 430471 - RNA, 14 nt, Homo sapiens
uauauucuaagcca

SEQ ID NO: 430472 - RNA, 19 nt, Homo sapiens
uauauuuuugguugucaau

SEQ ID NO: 430473 - RNA, 23 nt, Homo sapiens
uaucaaaaagguuucugcacauu

SEQ ID NO: 430474 - RNA, 20 nt, Homo sapiens
uaucaaaaaguacaauaaua

SEQ ID NO: 430475 - RNA, 22 nt, Homo sapiens
uaucaaaaaugcaaauucucag

SEQ ID NO: 430476 - RNA, 18 nt, Homo sapiens
uaucaaaaugaaugccag

SEQ ID NO: 430477 - RNA, 21 nt, Homo sapiens
uaucaaaucuguauauguugu

SEQ ID NO: 430478 - RNA, 14 nt, Homo sapiens
uaucaacccagaaa

SEQ ID NO: 430479 - RNA, 14 nt, Homo sapiens
uaucacacaaagca

SEQ ID NO: 430480 - RNA, 15 nt, Homo sapiens
uaucaccucauggcc

SEQ ID NO: 430481 - RNA, 16 nt, Homo sapiens
uaucagaccucugauc

SEQ ID NO: 430482 - RNA, 15 nt, Homo sapiens
uaucagcucucugca

SEQ ID NO: 430483 - RNA, 18 nt, Homo sapiens
uaucagcucucugcagaa

SEQ ID NO: 430484 - RNA, 13 nt, Homo sapiens
uaucaguuuccag

SEQ ID NO: 430485 - RNA, 18 nt, Homo sapiens
uaucauuauagcauguaa

SEQ ID NO: 430486 - RNA, 14 nt, Homo sapiens
uaucauucacccaa

SEQ ID NO: 430487 - RNA, 16 nt, Homo sapiens
uauccaagaccugaaa

SEQ ID NO: 430488 - RNA, 14 nt, Homo sapiens
uauccaaguuggac

SEQ ID NO: 430489 - RNA, 13 nt, Homo sapiens
uauccaugcaugu

SEQ ID NO: 430490 - RNA, 15 nt, Homo sapiens
uauccaugcaugugc

SEQ ID NO: 430491 - RNA, 22 nt, Homo sapiens
uauccauucuuucugauaacua

SEQ ID NO: 430492 - RNA, 18 nt, Homo sapiens
uaucccagagaacaauca

SEQ ID NO: 430493 - RNA, 22 nt, Homo sapiens
uauccuuccaaaaaauuaaaac

SEQ ID NO: 430494 - RNA, 22 nt, Homo sapiens
uaucggagacagugaucuccau

SEQ ID NO: 430495 - RNA, 17 nt, Homo sapiens
uaucgggaacaguguuu

SEQ ID NO: 430496 - RNA, 15 nt, Homo sapiens
uaucuaaaaucugcu

SEQ ID NO: 430497 - RNA, 15 nt, Homo sapiens
uaucuacauaaggau

SEQ ID NO: 430498 - RNA, 21 nt, Homo sapiens
uaucuacccagucauguacug

SEQ ID NO: 430499 - RNA, 23 nt, Homo sapiens
uaucuagauagcugacucauucu

SEQ ID NO: 430500 - RNA, 12 nt, Homo sapiens
uaucuaugacug

SEQ ID NO: 430501 - RNA, 15 nt, Homo sapiens
uaucuccucuugggc

SEQ ID NO: 430502 - RNA, 19 nt, Homo sapiens
uaucucgcuagccauauau

SEQ ID NO: 430503 - RNA, 21 nt, Homo sapiens
uaucucugaagcauguuucau

SEQ ID NO: 430504 - RNA, 15 nt, Homo sapiens
uaucuggacaagcca

SEQ ID NO: 430505 - RNA, 20 nt, Homo sapiens
uaucugggcaugguggcaca

SEQ ID NO: 430506 - RNA, 12 nt, Homo sapiens
uaucugucauuc

SEQ ID NO: 430507 - RNA, 11 nt, Homo sapiens
uaucugugaaa

SEQ ID NO: 430508 - RNA, 16 nt, Homo sapiens
uaucuuaaaucuguga

SEQ ID NO: 430509 - RNA, 13 nt, Homo sapiens
uaucuuaauuccu

SEQ ID NO: 430510 - RNA, 22 nt, Homo sapiens
uaucuuaggauuuaccaaauag

SEQ ID NO: 430511 - RNA, 18 nt, Homo sapiens
uaucuugaaaaaguauug

SEQ ID NO: 430512 - RNA, 22 nt, Homo sapiens
uaucuugcuuuuuuucaccaau

SEQ ID NO: 430513 - RNA, 15 nt, Homo sapiens
uaucuuugcacugaa

SEQ ID NO: 430514 - RNA, 18 nt, Homo sapiens
uaugaaaagaggggacca

SEQ ID NO: 430515 - RNA, 19 nt, Homo sapiens
uaugaagucccucuauguc

SEQ ID NO: 430516 - RNA, 17 nt, Homo sapiens
uaugaauacauuucuac

SEQ ID NO: 430517 - RNA, 16 nt, Homo sapiens
uaugaauuaagcugua

SEQ ID NO: 430518 - RNA, 12 nt, Homo sapiens
uaugaauucauu

SEQ ID NO: 430519 - RNA, 13 nt, Homo sapiens
uaugaauucauuc

SEQ ID NO: 430520 - RNA, 21 nt, Homo sapiens
uaugacaauuucaaaaugcau

SEQ ID NO: 430521 - RNA, 21 nt, Homo sapiens
uaugacaugaucgcuuucuac

SEQ ID NO: 430522 - RNA, 14 nt, Homo sapiens
uaugaccauaaaau

SEQ ID NO: 430523 - RNA, 20 nt, Homo sapiens
uaugagaacugguucuugcc

SEQ ID NO: 430524 - RNA, 23 nt, Homo sapiens
uaugagacguuuuuggaagagua

SEQ ID NO: 430525 - RNA, 18 nt, Homo sapiens
uaugagccuuugcacagg

SEQ ID NO: 430526 - RNA, 14 nt, Homo sapiens
uaugaggcuauuaa

SEQ ID NO: 430527 - RNA, 19 nt, Homo sapiens
uaugauaaaacacugcccu

SEQ ID NO: 430528 - RNA, 17 nt, Homo sapiens
uaugauauauauguaua

SEQ ID NO: 430529 - RNA, 18 nt, Homo sapiens
uaugauguguugugauag

SEQ ID NO: 430530 - RNA, 21 nt, Homo sapiens
uaugauucuccucucccaaau

SEQ ID NO: 430531 - RNA, 18 nt, Homo sapiens
uaugauuuugaugcacaa

SEQ ID NO: 430532 - RNA, 20 nt, Homo sapiens
uaugcaaagucucucauuuc

SEQ ID NO: 430533 - RNA, 14 nt, Homo sapiens
uaugcaagggacug

SEQ ID NO: 430534 - RNA, 20 nt, Homo sapiens
uaugcacaccaaauugcuga

SEQ ID NO: 430535 - RNA, 12 nt, Homo sapiens
uaugcaguaugc

SEQ ID NO: 430536 - RNA, 13 nt, Homo sapiens
uaugcagugcugc

SEQ ID NO: 430537 - RNA, 22 nt, Homo sapiens
uaugcagugcugcuuugccaaa

SEQ ID NO: 430538 - RNA, 13 nt, Homo sapiens
uaugcagugucag

SEQ ID NO: 430539 - RNA, 12 nt, Homo sapiens
uaugcauaucag

SEQ ID NO: 430540 - RNA, 22 nt, Homo sapiens
uaugcaucuuugagaauauuau

SEQ ID NO: 430541 - RNA, 16 nt, Homo sapiens
uaugcauguagcauau

SEQ ID NO: 430542 - RNA, 17 nt, Homo sapiens
uaugccggcuccuucaa

SEQ ID NO: 430543 - RNA, 17 nt, Homo sapiens
uaugccugccucaaagg

SEQ ID NO: 430544 - RNA, 13 nt, Homo sapiens
uaugccuucuuau

SEQ ID NO: 430545 - RNA, 20 nt, Homo sapiens
uaugccuuuaaaucugugau

SEQ ID NO: 430546 - RNA, 14 nt, Homo sapiens
uaugcugaaacaga

SEQ ID NO: 430547 - RNA, 18 nt, Homo sapiens
uauggaacauaugcacag

SEQ ID NO: 430548 - RNA, 23 nt, Homo sapiens
uauggauauaccacaauucauuu

SEQ ID NO: 430549 - RNA, 13 nt, Homo sapiens
uauggcacuggca

SEQ ID NO: 430550 - RNA, 20 nt, Homo sapiens
uaugggggcacugaggacca

SEQ ID NO: 430551 - RNA, 13 nt, Homo sapiens
uauggggggccaa

SEQ ID NO: 430552 - RNA, 15 nt, Homo sapiens
uaugguagcuuuuac

SEQ ID NO: 430553 - RNA, 21 nt, Homo sapiens
uauguauaacaagccaaacau

SEQ ID NO: 430554 - RNA, 15 nt, Homo sapiens
uaugucaguccaaua

SEQ ID NO: 430555 - RNA, 15 nt, Homo sapiens
uaugucucacaggga

SEQ ID NO: 430556 - RNA, 12 nt, Homo sapiens
uaugucugccua

SEQ ID NO: 430557 - RNA, 19 nt, Homo sapiens
uaugugagugaaaguacuu

SEQ ID NO: 430558 - RNA, 20 nt, Homo sapiens
uaugugcacugucacuuugc

SEQ ID NO: 430559 - RNA, 17 nt, Homo sapiens
uaugugcagcuuuccag

SEQ ID NO: 430560 - RNA, 20 nt, Homo sapiens
uauguggcagcuggggagca

SEQ ID NO: 430561 - RNA, 14 nt, Homo sapiens
uaugugucuuuauc

SEQ ID NO: 430562 - RNA, 21 nt, Homo sapiens
uauguguguguguguaugugu

SEQ ID NO: 430563 - RNA, 15 nt, Homo sapiens
uauguguugccaaag

SEQ ID NO: 430564 - RNA, 20 nt, Homo sapiens
uauguucuccccuacauuag

SEQ ID NO: 430565 - RNA, 12 nt, Homo sapiens
uauguugcaauc

SEQ ID NO: 430566 - RNA, 14 nt, Homo sapiens
uauguugcuccagu

SEQ ID NO: 430567 - RNA, 16 nt, Homo sapiens
uauguuguugcuugua

SEQ ID NO: 430568 - RNA, 16 nt, Homo sapiens
uauuaaaaaaguggug

SEQ ID NO: 430569 - RNA, 21 nt, Homo sapiens
uauuaaaauuuuuugauguca

SEQ ID NO: 430570 - RNA, 16 nt, Homo sapiens
uauuaaaucuugcaac

SEQ ID NO: 430571 - RNA, 23 nt, Homo sapiens
uauuaacacuaauaauaguacua

SEQ ID NO: 430572 - RNA, 19 nt, Homo sapiens
uauuaaccucagcauuuac

SEQ ID NO: 430573 - RNA, 12 nt, Homo sapiens
uauuaagauauc

SEQ ID NO: 430574 - RNA, 16 nt, Homo sapiens
uauuaagugugcuuau

SEQ ID NO: 430575 - RNA, 23 nt, Homo sapiens
uauuaauaugaguuacugaaggu

SEQ ID NO: 430576 - RNA, 13 nt, Homo sapiens
uauuaaucaccuc

SEQ ID NO: 430577 - RNA, 18 nt, Homo sapiens
uauuacuguugcauuuac

SEQ ID NO: 430578 - RNA, 21 nt, Homo sapiens
uauuagauugcugaauuaagg

SEQ ID NO: 430579 - RNA, 15 nt, Homo sapiens
uauuauacaaauacu

SEQ ID NO: 430580 - RNA, 13 nt, Homo sapiens
uauuauaguauuc

SEQ ID NO: 430581 - RNA, 13 nt, Homo sapiens
uauuauguccauu

SEQ ID NO: 430582 - RNA, 20 nt, Homo sapiens
uauucaaacauuauucucaa

SEQ ID NO: 430583 - RNA, 19 nt, Homo sapiens
uauucaagaaagauaucua

SEQ ID NO: 430584 - RNA, 15 nt, Homo sapiens
uauucacaguaucug

SEQ ID NO: 430585 - RNA, 22 nt, Homo sapiens
uauucagaaaagaugugcagau

SEQ ID NO: 430586 - RNA, 14 nt, Homo sapiens
uauucaggagagua

SEQ ID NO: 430587 - RNA, 17 nt, Homo sapiens
uauucauacagcacuac

SEQ ID NO: 430588 - RNA, 23 nt, Homo sapiens
uauuccagcagugaaacuugugc

SEQ ID NO: 430589 - RNA, 14 nt, Homo sapiens
uauucccccaaagc

SEQ ID NO: 430590 - RNA, 23 nt, Homo sapiens
uauuccgggugccauucccacua

SEQ ID NO: 430591 - RNA, 15 nt, Homo sapiens
uauuccuaugcugca

SEQ ID NO: 430592 - RNA, 16 nt, Homo sapiens
uauucucaaccagaga

SEQ ID NO: 430593 - RNA, 16 nt, Homo sapiens
uauucucucuaugcaa

SEQ ID NO: 430594 - RNA, 15 nt, Homo sapiens
uauucugcaacagcc

SEQ ID NO: 430595 - RNA, 14 nt, Homo sapiens
uauucuugucaaaa

SEQ ID NO: 430596 - RNA, 16 nt, Homo sapiens
uaccuggacuggauca

SEQ ID NO: 430597 - RNA, 11 nt, Homo sapiens
uaccugggaaa

SEQ ID NO: 430598 - RNA, 13 nt, Homo sapiens
uaccugggcauuc

SEQ ID NO: 430599 - RNA, 16 nt, Homo sapiens
uaccuguacacugacu

SEQ ID NO: 430600 - RNA, 15 nt, Homo sapiens
uaccuuauugaucuu

SEQ ID NO: 430601 - RNA, 18 nt, Homo sapiens
uaccuuauugaucuuugc

SEQ ID NO: 430602 - RNA, 17 nt, Homo sapiens
uaccuugagccaguaau

SEQ ID NO: 430603 - RNA, 17 nt, Homo sapiens
uaccuuucuucacugca

SEQ ID NO: 430604 - RNA, 23 nt, Homo sapiens
uaccuuuguaacggcucuuagca

SEQ ID NO: 430605 - RNA, 15 nt, Homo sapiens
uacgccagaacugcu

SEQ ID NO: 430606 - RNA, 14 nt, Homo sapiens
uacgcucucugucu

SEQ ID NO: 430607 - RNA, 17 nt, Homo sapiens
uacgcucugcucaauga

SEQ ID NO: 430608 - RNA, 13 nt, Homo sapiens
uacggcagucaca

SEQ ID NO: 430609 - RNA, 13 nt, Homo sapiens
uacgggaggguaa

SEQ ID NO: 430610 - RNA, 21 nt, Homo sapiens
uacguggcaaauuaacuugag

SEQ ID NO: 430611 - RNA, 14 nt, Homo sapiens
uacgugucugaauc

SEQ ID NO: 430612 - RNA, 15 nt, Homo sapiens
uacguguuuacuugg

SEQ ID NO: 430613 - RNA, 15 nt, Homo sapiens
uacuacuauucuguu

SEQ ID NO: 430614 - RNA, 13 nt, Homo sapiens
uacuacuguagaa

SEQ ID NO: 430615 - RNA, 21 nt, Homo sapiens
uacuagcuuuugaaauccaga

SEQ ID NO: 430616 - RNA, 19 nt, Homo sapiens
uacuaggagaggggggcca

SEQ ID NO: 430617 - RNA, 13 nt, Homo sapiens
uacuagugccauu

SEQ ID NO: 430618 - RNA, 16 nt, Homo sapiens
uacuaucauggcauau

SEQ ID NO: 430619 - RNA, 20 nt, Homo sapiens
uacuaucucuguauuguucu

SEQ ID NO: 430620 - RNA, 17 nt, Homo sapiens
uacuauuacuauuacua

SEQ ID NO: 430621 - RNA, 17 nt, Homo sapiens
uacuauucccuuugacu

SEQ ID NO: 430622 - RNA, 17 nt, Homo sapiens
uacuauugcuauuacua

SEQ ID NO: 430623 - RNA, 23 nt, Homo sapiens
uacucagaggcugacacugacau

SEQ ID NO: 430624 - RNA, 22 nt, Homo sapiens
uacucagcaacuguuagcuggg

SEQ ID NO: 430625 - RNA, 14 nt, Homo sapiens
uacuccagccuggg

SEQ ID NO: 430626 - RNA, 22 nt, Homo sapiens
uacuccaguauaugcugaugga

SEQ ID NO: 430627 - RNA, 16 nt, Homo sapiens
uacuccuuccaucaaa

SEQ ID NO: 430628 - RNA, 16 nt, Homo sapiens
uacucgaguuacagac

SEQ ID NO: 430629 - RNA, 22 nt, Homo sapiens
uacugaaagggagggguggaga

SEQ ID NO: 430630 - RNA, 15 nt, Homo sapiens
uacugaaauacauau

SEQ ID NO: 430631 - RNA, 17 nt, Homo sapiens
uacugaaauacauauga

SEQ ID NO: 430632 - RNA, 21 nt, Homo sapiens
uacugaacaaucaaagcacuu

SEQ ID NO: 430633 - RNA, 16 nt, Homo sapiens
uacugagaggaggggu

SEQ ID NO: 430634 - RNA, 21 nt, Homo sapiens
uacugagugccugcagcaucu

SEQ ID NO: 430635 - RNA, 17 nt, Homo sapiens
uacugaguucucaucca

SEQ ID NO: 430636 - RNA, 14 nt, Homo sapiens
uacugauuaacuca

SEQ ID NO: 430637 - RNA, 17 nt, Homo sapiens
uacugcaauauuuggau

SEQ ID NO: 430638 - RNA, 17 nt, Homo sapiens
uacugcccaauaugcag

SEQ ID NO: 430639 - RNA, 22 nt, Homo sapiens
uacugcugucauuguccaugcc

SEQ ID NO: 430640 - RNA, 21 nt, Homo sapiens
uacugguuauccugugcuaca

SEQ ID NO: 430641 - RNA, 22 nt, Homo sapiens
uacugguuuguaugauguauua

SEQ ID NO: 430642 - RNA, 22 nt, Homo sapiens
uacuguaaagaauuuagcugua

SEQ ID NO: 430643 - RNA, 21 nt, Homo sapiens
uacugucagcgagcugugcaa

SEQ ID NO: 430644 - RNA, 15 nt, Homo sapiens
uacuguuauuucacu

SEQ ID NO: 430645 - RNA, 19 nt, Homo sapiens
uacuuaaaaauagucuucc

SEQ ID NO: 430646 - RNA, 13 nt, Homo sapiens
uacuuaacugugu

SEQ ID NO: 430647 - RNA, 13 nt, Homo sapiens
uacuuagugguau

SEQ ID NO: 430648 - RNA, 15 nt, Homo sapiens
uacuuaucuuaugcc

SEQ ID NO: 430649 - RNA, 15 nt, Homo sapiens
uacuucagucuugga

SEQ ID NO: 430650 - RNA, 15 nt, Homo sapiens
uacuuccuacuguag

SEQ ID NO: 430651 - RNA, 19 nt, Homo sapiens
uacuucuacauccaaugua

SEQ ID NO: 430652 - RNA, 22 nt, Homo sapiens
uacuucuacauccaauguauga

SEQ ID NO: 430653 - RNA, 16 nt, Homo sapiens
uacuucuugugcuuua

SEQ ID NO: 430654 - RNA, 23 nt, Homo sapiens
uacuucuugugcuuuacucugaa

SEQ ID NO: 430655 - RNA, 16 nt, Homo sapiens
uacuucuuuuucauua

SEQ ID NO: 430656 - RNA, 15 nt, Homo sapiens
uacuugagccuuuaa

SEQ ID NO: 430657 - RNA, 19 nt, Homo sapiens
uacuugggagaccuguaau

SEQ ID NO: 430658 - RNA, 20 nt, Homo sapiens
uacuuuauuucugaucuaua

SEQ ID NO: 430659 - RNA, 24 nt, Homo sapiens
uacuuugggacgcccacguggcag

SEQ ID NO: 430660 - RNA, 17 nt, Homo sapiens
uacuuuuuaaacagugu

SEQ ID NO: 430661 - RNA, 21 nt, Homo sapiens
uacuuuuuguaaaaagcuuca

SEQ ID NO: 430662 - RNA, 19 nt, Homo sapiens
uacuuuuuuauagcuuaac

SEQ ID NO: 430663 - RNA, 20 nt, Homo sapiens
uagaaaacgcgaccuuggcc

SEQ ID NO: 430664 - RNA, 18 nt, Homo sapiens
uagaaacacacuuuugca

SEQ ID NO: 430665 - RNA, 17 nt, Homo sapiens
uagaaagccauauucca

SEQ ID NO: 430666 - RNA, 22 nt, Homo sapiens
uagaaagccccucaccucagga

SEQ ID NO: 430667 - RNA, 21 nt, Homo sapiens
uagaaagcuggcaacaugaag

SEQ ID NO: 430668 - RNA, 14 nt, Homo sapiens
uagaaagggucccu

SEQ ID NO: 430669 - RNA, 19 nt, Homo sapiens
uagaaauacccaacgcaca

SEQ ID NO: 430670 - RNA, 13 nt, Homo sapiens
uagaaaugaauuu

SEQ ID NO: 430671 - RNA, 12 nt, Homo sapiens
uagaaauggauu

SEQ ID NO: 430672 - RNA, 13 nt, Homo sapiens
uagaaauggauuu

SEQ ID NO: 430673 - RNA, 17 nt, Homo sapiens
uagaacugcaauuucca

SEQ ID NO: 430674 - RNA, 15 nt, Homo sapiens
uagaacuuucugcuu

SEQ ID NO: 430675 - RNA, 23 nt, Homo sapiens
uagaagccaccauguauguggaa

SEQ ID NO: 430676 - RNA, 20 nt, Homo sapiens
uagaagccaguacagagaaa

SEQ ID NO: 430677 - RNA, 21 nt, Homo sapiens
uagaagcuaauguaggacugu

SEQ ID NO: 430678 - RNA, 15 nt, Homo sapiens
uagaagcuucuugcu

SEQ ID NO: 430679 - RNA, 19 nt, Homo sapiens
uagaauaaaauuguaaaau

SEQ ID NO: 430680 - RNA, 15 nt, Homo sapiens
uagaauacuuuuuaa

SEQ ID NO: 430681 - RNA, 18 nt, Homo sapiens
uagaauauccuauacugg

SEQ ID NO: 430682 - RNA, 20 nt, Homo sapiens
uagaauauuuauuaccucug

SEQ ID NO: 430683 - RNA, 23 nt, Homo sapiens
uagaauauuuauuaccucugaua

SEQ ID NO: 430684 - RNA, 18 nt, Homo sapiens
uagaaucaagucugugaa

SEQ ID NO: 430685 - RNA, 20 nt, Homo sapiens
uagaaucagccuagggguca

SEQ ID NO: 430686 - RNA, 18 nt, Homo sapiens
uagaauccugcuuuacag

SEQ ID NO: 430687 - RNA, 15 nt, Homo sapiens
uagaauugauuucca

SEQ ID NO: 430688 - RNA, 22 nt, Homo sapiens
uagacaaaggccuuaacaaacg

SEQ ID NO: 430689 - RNA, 14 nt, Homo sapiens
uagacauaccucuc

SEQ ID NO: 430690 - RNA, 13 nt, Homo sapiens
uagacauuuauca

SEQ ID NO: 430691 - RNA, 16 nt, Homo sapiens
uagaccuccagcuguu

SEQ ID NO: 430692 - RNA, 15 nt, Homo sapiens
uagacgaacagcuga

SEQ ID NO: 430693 - RNA, 21 nt, Homo sapiens
uagacgagcaggcuucuuccc

SEQ ID NO: 430694 - RNA, 15 nt, Homo sapiens
uagacuacucaauau

SEQ ID NO: 430695 - RNA, 22 nt, Homo sapiens
uagacugacccugaucagucua

SEQ ID NO: 430696 - RNA, 20 nt, Homo sapiens
uagacuggccaugcaagugg

SEQ ID NO: 430697 - RNA, 22 nt, Homo sapiens
uagacuuuuaacuucaccuuaa

SEQ ID NO: 430698 - RNA, 15 nt, Homo sapiens
uagagaaugauuuca

SEQ ID NO: 430699 - RNA, 22 nt, Homo sapiens
uagagacaggguuucacugugu

SEQ ID NO: 430700 - RNA, 24 nt, Homo sapiens
uagagacuucuaaaucauaaucau

SEQ ID NO: 430701 - RNA, 16 nt, Homo sapiens
uagagagaaacagcuu

SEQ ID NO: 430702 - RNA, 18 nt, Homo sapiens
uagagaggggacuggggg

SEQ ID NO: 430703 - RNA, 18 nt, Homo sapiens
uagagcagaauucauuau

SEQ ID NO: 430704 - RNA, 20 nt, Homo sapiens
uagagcaucugucccacugg

SEQ ID NO: 430705 - RNA, 16 nt, Homo sapiens
uagagcuagauguguc

SEQ ID NO: 430706 - RNA, 19 nt, Homo sapiens
uagagcuagaugugucuua

SEQ ID NO: 430707 - RNA, 21 nt, Homo sapiens
uagaggacuucuggcagggaa

SEQ ID NO: 430708 - RNA, 18 nt, Homo sapiens
uagaggcaaagaacaauu

SEQ ID NO: 430709 - RNA, 21 nt, Homo sapiens
uagaggggcucugggagacuu

SEQ ID NO: 430710 - RNA, 14 nt, Homo sapiens
uagaguauaugcac

SEQ ID NO: 430711 - RNA, 15 nt, Homo sapiens
uagaguggcgauuga

SEQ ID NO: 430712 - RNA, 18 nt, Homo sapiens
uagaguguuaucagucau

SEQ ID NO: 430713 - RNA, 14 nt, Homo sapiens
uagaguuugaucau

SEQ ID NO: 430714 - RNA, 22 nt, Homo sapiens
uagauacagauccgcauguguc

SEQ ID NO: 430715 - RNA, 17 nt, Homo sapiens
uagauauaacacuaugu

SEQ ID NO: 430716 - RNA, 14 nt, Homo sapiens
uagauauaugccuu

SEQ ID NO: 430717 - RNA, 17 nt, Homo sapiens
uagauaucaauguuaau

SEQ ID NO: 430718 - RNA, 15 nt, Homo sapiens
uagaucauaagacug

SEQ ID NO: 430719 - RNA, 14 nt, Homo sapiens
uagaucucccuuaa

SEQ ID NO: 430720 - RNA, 13 nt, Homo sapiens
uagaucuccugua

SEQ ID NO: 430721 - RNA, 23 nt, Homo sapiens
uagaucugagcccucccucuucc

SEQ ID NO: 430722 - RNA, 23 nt, Homo sapiens
uagaucuuacaucugcagcucuu

SEQ ID NO: 430723 - RNA, 15 nt, Homo sapiens
uagaugaguccuguu

SEQ ID NO: 430724 - RNA, 15 nt, Homo sapiens
uagauggaugaauua

SEQ ID NO: 430725 - RNA, 12 nt, Homo sapiens
uagaugugcauu

SEQ ID NO: 430726 - RNA, 13 nt, Homo sapiens
uagaugugucuua

SEQ ID NO: 430727 - RNA, 14 nt, Homo sapiens
uagaugugucuuac

SEQ ID NO: 430728 - RNA, 13 nt, Homo sapiens
ucacaacacugaa

SEQ ID NO: 430729 - RNA, 18 nt, Homo sapiens
ucacaaccccugcuccag

SEQ ID NO: 430730 - RNA, 17 nt, Homo sapiens
ucacaaccucucugauc

SEQ ID NO: 430731 - RNA, 19 nt, Homo sapiens
ucacaacuccuuccauccu

SEQ ID NO: 430732 - RNA, 13 nt, Homo sapiens
ucacaagcugccu

SEQ ID NO: 430733 - RNA, 20 nt, Homo sapiens
ucacaaguaggagacacaga

SEQ ID NO: 430734 - RNA, 21 nt, Homo sapiens
ucacaaguaggagacacagau

SEQ ID NO: 430735 - RNA, 13 nt, Homo sapiens
ucaggugauccac

SEQ ID NO: 430736 - RNA, 23 nt, Homo sapiens
ucagguuugggguucguggaaag

SEQ ID NO: 430737 - RNA, 21 nt, Homo sapiens
ucaguaauagcugaaccuguu

SEQ ID NO: 430738 - RNA, 17 nt, Homo sapiens
ucaguacccaccugagc

SEQ ID NO: 430739 - RNA, 18 nt, Homo sapiens
ucaguauaaaagacaaaa

SEQ ID NO: 430740 - RNA, 14 nt, Homo sapiens
ucaguauacugugu

SEQ ID NO: 430741 - RNA, 18 nt, Homo sapiens
ucaguauucccagccuug

SEQ ID NO: 430742 - RNA, 21 nt, Homo sapiens
ucagucaugcguccacuuucc

SEQ ID NO: 430743 - RNA, 17 nt, Homo sapiens
ucaguccaauaaauuau

SEQ ID NO: 430744 - RNA, 15 nt, Homo sapiens
ucaguccaccugagc

SEQ ID NO: 430745 - RNA, 15 nt, Homo sapiens
ucaguccaguccuca

SEQ ID NO: 430746 - RNA, 16 nt, Homo sapiens
ucagucccccaccaca

SEQ ID NO: 430747 - RNA, 14 nt, Homo sapiens
ucagucuggugcuc

SEQ ID NO: 430748 - RNA, 17 nt, Homo sapiens
ucagucuucacuugcac

SEQ ID NO: 430749 - RNA, 17 nt, Homo sapiens
ucagugaagcccaggag

SEQ ID NO: 430750 - RNA, 23 nt, Homo sapiens
ucagugacagaguucacuauaaa

SEQ ID NO: 430751 - RNA, 21 nt, Homo sapiens
ucagugcacaaaucauuccau

SEQ ID NO: 430752 - RNA, 14 nt, Homo sapiens
ucagugcaggagag

SEQ ID NO: 430753 - RNA, 21 nt, Homo sapiens
ucagugccaaaaacaacaaca

SEQ ID NO: 430754 - RNA, 22 nt, Homo sapiens
ucaguuaauggcucaucaacaa

SEQ ID NO: 430755 - RNA, 21 nt, Homo sapiens
ucaguuauucauucugugauc

SEQ ID NO: 430756 - RNA, 15 nt, Homo sapiens
ucaguuccauggcaa

SEQ ID NO: 430757 - RNA, 16 nt, Homo sapiens
ucaguugacaaaauau

SEQ ID NO: 430758 - RNA, 14 nt, Homo sapiens
ucaguuggugcugc

SEQ ID NO: 430759 - RNA, 15 nt, Homo sapiens
ucaguuggugcugcu

SEQ ID NO: 430760 - RNA, 23 nt, Homo sapiens
ucaguuguaacauucuauuucaa

SEQ ID NO: 430761 - RNA, 15 nt, Homo sapiens
ucaguuuuccuaguc

SEQ ID NO: 430762 - RNA, 14 nt, Homo sapiens
ucauaaugacuuaa

SEQ ID NO: 430763 - RNA, 14 nt, Homo sapiens
ucauaaugugcaaa

SEQ ID NO: 430764 - RNA, 20 nt, Homo sapiens
ucauaccuguuguacacuug

SEQ ID NO: 430765 - RNA, 14 nt, Homo sapiens
ucauacgguuguau

SEQ ID NO: 430766 - RNA, 18 nt, Homo sapiens
ucauagccaaaaacuuuu

SEQ ID NO: 430767 - RNA, 13 nt, Homo sapiens
ucauaucaagaaa

SEQ ID NO: 430768 - RNA, 19 nt, Homo sapiens
ucauaugaauuagccaaaa

SEQ ID NO: 430769 - RNA, 18 nt, Homo sapiens
ucauauggcccaguguca

SEQ ID NO: 430770 - RNA, 18 nt, Homo sapiens
ucaucaaaacaaaacagc

SEQ ID NO: 430771 - RNA, 21 nt, Homo sapiens
ucaucaaaacaaaacagcagc

SEQ ID NO: 430772 - RNA, 12 nt, Homo sapiens
ucaucacuggau

SEQ ID NO: 430773 - RNA, 22 nt, Homo sapiens
ucaucacuuaauuacuuacuca

SEQ ID NO: 430774 - RNA, 23 nt, Homo sapiens
ucaucaguguccucuugcucaaa

SEQ ID NO: 430775 - RNA, 21 nt, Homo sapiens
ucauccauagacacaguauug

SEQ ID NO: 430776 - RNA, 19 nt, Homo sapiens
ucauccaugcagauaacag

SEQ ID NO: 430777 - RNA, 20 nt, Homo sapiens
ucauccuacccuaaugccag

SEQ ID NO: 430778 - RNA, 15 nt, Homo sapiens
ucauccuccacugaa

SEQ ID NO: 430779 - RNA, 22 nt, Homo sapiens
ucaucuacacagcaguaugaau

SEQ ID NO: 430780 - RNA, 16 nt, Homo sapiens
ucaucucugccuuuga

SEQ ID NO: 430781 - RNA, 17 nt, Homo sapiens
ucaucucugccuuugag

SEQ ID NO: 430782 - RNA, 14 nt, Homo sapiens
ucaucucuuuauuc

SEQ ID NO: 430783 - RNA, 13 nt, Homo sapiens
ucaucuguagaua

SEQ ID NO: 430784 - RNA, 16 nt, Homo sapiens
ucaucuugagccugag

SEQ ID NO: 430785 - RNA, 18 nt, Homo sapiens
ucaucuuggccacuuuaa

SEQ ID NO: 430786 - RNA, 13 nt, Homo sapiens
ucaugaagccuug

SEQ ID NO: 430787 - RNA, 23 nt, Homo sapiens
ucaugaagcucaguuuggcugua

SEQ ID NO: 430788 - RNA, 13 nt, Homo sapiens
ucaugaauucaua

SEQ ID NO: 430789 - RNA, 22 nt, Homo sapiens
ucaugacuuuuccauguaucua

SEQ ID NO: 430790 - RNA, 23 nt, Homo sapiens
ucaugccaccauggccagccaac

SEQ ID NO: 430791 - RNA, 20 nt, Homo sapiens
ucauggagaaucugcugcau

SEQ ID NO: 430792 - RNA, 11 nt, Homo sapiens
ucauggcauau

SEQ ID NO: 430793 - RNA, 17 nt, Homo sapiens
ucauggcucacugcagc

SEQ ID NO: 430794 - RNA, 15 nt, Homo sapiens
ucauggguuaugugu

SEQ ID NO: 430795 - RNA, 14 nt, Homo sapiens
ucauggugaugcaa

SEQ ID NO: 430796 - RNA, 17 nt, Homo sapiens
ucauguaaaugcucaaa

SEQ ID NO: 430797 - RNA, 14 nt, Homo sapiens
ucauguaaccaaga

SEQ ID NO: 430798 - RNA, 19 nt, Homo sapiens
ucauguaaccaagaguauu

SEQ ID NO: 430799 - RNA, 14 nt, Homo sapiens
ucaugugaacccgg

SEQ ID NO: 430800 - RNA, 18 nt, Homo sapiens
ucaugugcuuuguagcuu

SEQ ID NO: 430801 - RNA, 12 nt, Homo sapiens
ucauguucucau

SEQ ID NO: 430802 - RNA, 15 nt, Homo sapiens
ucauguugaagucaa

SEQ ID NO: 430803 - RNA, 22 nt, Homo sapiens
ucauguugaagucaaauuugga

SEQ ID NO: 430804 - RNA, 14 nt, Homo sapiens
ucauuaacagugcu

SEQ ID NO: 430805 - RNA, 22 nt, Homo sapiens
ucauuacagauuuaguuuacca

SEQ ID NO: 430806 - RNA, 12 nt, Homo sapiens
ucauucacuguc

SEQ ID NO: 430807 - RNA, 22 nt, Homo sapiens
ucauuccaccauggcuaaggca

SEQ ID NO: 430808 - RNA, 19 nt, Homo sapiens
ucauuccaugugcccaguu

SEQ ID NO: 430809 - RNA, 18 nt, Homo sapiens
ucauucccacugcacuug

SEQ ID NO: 430810 - RNA, 20 nt, Homo sapiens
ucauuccuaacacagcaugu

SEQ ID NO: 430811 - RNA, 13 nt, Homo sapiens
ucauucuacugaa

SEQ ID NO: 430812 - RNA, 12 nt, Homo sapiens
ucauucuagcac

SEQ ID NO: 430813 - RNA, 12 nt, Homo sapiens
ucauucucagua

SEQ ID NO: 430814 - RNA, 12 nt, Homo sapiens
ucauucuuuaua

SEQ ID NO: 430815 - RNA, 17 nt, Homo sapiens
ucauugaagacccucaa

SEQ ID NO: 430816 - RNA, 22 nt, Homo sapiens
ucauugaagacccucaaugcca

SEQ ID NO: 430817 - RNA, 21 nt, Homo sapiens
ucauugcuaaacugaugacuu

SEQ ID NO: 430818 - RNA, 17 nt, Homo sapiens
ucauuggccacugucuc

SEQ ID NO: 430819 - RNA, 23 nt, Homo sapiens
ucauuggccacugucuccacuca

SEQ ID NO: 430820 - RNA, 18 nt, Homo sapiens
ucauugggccauguuuaa

SEQ ID NO: 430821 - RNA, 13 nt, Homo sapiens
ucauuuagcauug

SEQ ID NO: 430822 - RNA, 22 nt, Homo sapiens
ucauuuaggugaggaagcaaaa

SEQ ID NO: 430823 - RNA, 21 nt, Homo sapiens
ucauuuauucuucuuuuccaa

SEQ ID NO: 430824 - RNA, 15 nt, Homo sapiens
ucauuuauugagcac

SEQ ID NO: 430825 - RNA, 23 nt, Homo sapiens
ucauuucauuguaugauguguug

SEQ ID NO: 430826 - RNA, 15 nt, Homo sapiens
ucauuucuacugaag

SEQ ID NO: 430827 - RNA, 21 nt, Homo sapiens
ucauuuguaccucgaguuuua

SEQ ID NO: 430828 - RNA, 18 nt, Homo sapiens
ucauuugucuuugaacgu

SEQ ID NO: 430829 - RNA, 14 nt, Homo sapiens
ucauuuucaccucc

SEQ ID NO: 430830 - RNA, 12 nt, Homo sapiens
ucauuuugccaa

SEQ ID NO: 430831 - RNA, 20 nt, Homo sapiens
ucauuuuuuaagugacuuua

SEQ ID NO: 430832 - RNA, 18 nt, Homo sapiens
uccaaaaacagugauuaa

SEQ ID NO: 430833 - RNA, 15 nt, Homo sapiens
uccaaaagcacuuac

SEQ ID NO: 430834 - RNA, 18 nt, Homo sapiens
uccaaaauaucgagugaa

SEQ ID NO: 430835 - RNA, 19 nt, Homo sapiens
uccaaauaacaaguaccaa

SEQ ID NO: 430836 - RNA, 17 nt, Homo sapiens
uccaaaugcugugcaaa

SEQ ID NO: 430837 - RNA, 21 nt, Homo sapiens
uccaaauuugaauggauuaaa

SEQ ID NO: 430838 - RNA, 19 nt, Homo sapiens
uccaacacuuugagcauuu

SEQ ID NO: 430839 - RNA, 12 nt, Homo sapiens
uccaaccacuca

SEQ ID NO: 430840 - RNA, 13 nt, Homo sapiens
uccaaccaggcag

SEQ ID NO: 430841 - RNA, 20 nt, Homo sapiens
uccaacccauuuaaucacca

SEQ ID NO: 430842 - RNA, 15 nt, Homo sapiens
uccaacuauguccag

SEQ ID NO: 430843 - RNA, 21 nt, Homo sapiens
uccaacuuaggcuacagaaug

SEQ ID NO: 430844 - RNA, 22 nt, Homo sapiens
uccaagaagcccuccuugccac

SEQ ID NO: 430845 - RNA, 18 nt, Homo sapiens
uccaagacaguuguauca

SEQ ID NO: 430846 - RNA, 20 nt, Homo sapiens
uccaaggacucuaaaagggg

SEQ ID NO: 430847 - RNA, 22 nt, Homo sapiens
uccaaggguaugggaagccaua

SEQ ID NO: 430848 - RNA, 19 nt, Homo sapiens
uccaagguguaacucuaau

SEQ ID NO: 430849 - RNA, 17 nt, Homo sapiens
uccaagugugugugcaa

SEQ ID NO: 430850 - RNA, 18 nt, Homo sapiens
uccaagugugugugcaau

SEQ ID NO: 430851 - RNA, 16 nt, Homo sapiens
uccaaugcauugcuaa

SEQ ID NO: 430852 - RNA, 18 nt, Homo sapiens
uccaaugugcccagucau

SEQ ID NO: 430853 - RNA, 20 nt, Homo sapiens
uccaauugaacuuucacaua

SEQ ID NO: 430854 - RNA, 19 nt, Homo sapiens
uccaauuuuguugcaucau

SEQ ID NO: 430855 - RNA, 17 nt, Homo sapiens
uccacaaaaucugucca

SEQ ID NO: 430856 - RNA, 23 nt, Homo sapiens
uccacacauuuaaaacauuugaa

SEQ ID NO: 430857 - RNA, 14 nt, Homo sapiens
uccacacuaccaca

SEQ ID NO: 430858 - RNA, 21 nt, Homo sapiens
uccacagaguuuguaguaaau

SEQ ID NO: 430859 - RNA, 18 nt, Homo sapiens
uccacauccccaccuucc

SEQ ID NO: 430860 - RNA, 19 nt, Homo sapiens
uccacauccccaccuucca

SEQ ID NO: 430861 - RNA, 20 nt, Homo sapiens
uccacauccccaccuuccaa

SEQ ID NO: 430862 - RNA, 15 nt, Homo sapiens
uccacaucuaacaaa

SEQ ID NO: 430863 - RNA, 15 nt, Homo sapiens
ucuuuccaggcuucc

SEQ ID NO: 430864 - RNA, 17 nt, Homo sapiens
ucuuuccauuaugauuc

SEQ ID NO: 430865 - RNA, 20 nt, Homo sapiens
ucuuucccuaaagaacauac

SEQ ID NO: 430866 - RNA, 12 nt, Homo sapiens
ucuuuccuagau

SEQ ID NO: 430867 - RNA, 12 nt, Homo sapiens
ucuuuccuccaa

SEQ ID NO: 430868 - RNA, 15 nt, Homo sapiens
ucuuuccucccugaa

SEQ ID NO: 430869 - RNA, 22 nt, Homo sapiens
ucuuuccucccugaagcugugc

SEQ ID NO: 430870 - RNA, 15 nt, Homo sapiens
ucuuucucucuuucc

SEQ ID NO: 430871 - RNA, 13 nt, Homo sapiens
ucuuucuuucugc

SEQ ID NO: 430872 - RNA, 16 nt, Homo sapiens
ucuuugacaacgccaa

SEQ ID NO: 430873 - RNA, 18 nt, Homo sapiens
ucuuugacuauaacaaaa

SEQ ID NO: 430874 - RNA, 18 nt, Homo sapiens
ucuuugagggacugccuc

SEQ ID NO: 430875 - RNA, 18 nt, Homo sapiens
ucuuugcugccagccacu

SEQ ID NO: 430876 - RNA, 22 nt, Homo sapiens
ucuuugcugccagccacuucau

SEQ ID NO: 430877 - RNA, 19 nt, Homo sapiens
ugaauaagacaacaaagag

SEQ ID NO: 430878 - RNA, 21 nt, Homo sapiens
ugaauaaguugauucuguccc

SEQ ID NO: 430879 - RNA, 15 nt, Homo sapiens
ugaauagugaggcug

SEQ ID NO: 430880 - RNA, 18 nt, Homo sapiens
ugaauauaaauguacuac

SEQ ID NO: 430881 - RNA, 16 nt, Homo sapiens
ugaauauucaacagcu

SEQ ID NO: 430882 - RNA, 20 nt, Homo sapiens
ugaaucaguaugaagacacu

SEQ ID NO: 430883 - RNA, 17 nt, Homo sapiens
ugaaucugaaagagcau

SEQ ID NO: 430884 - RNA, 12 nt, Homo sapiens
ugaaucuucaca

SEQ ID NO: 430885 - RNA, 16 nt, Homo sapiens
ugaaucuucccuguca

SEQ ID NO: 430886 - RNA, 15 nt, Homo sapiens
ugaaucuugucccag

SEQ ID NO: 430887 - RNA, 23 nt, Homo sapiens
ugaaugaaauauaaacugugaga

SEQ ID NO: 430888 - RNA, 22 nt, Homo sapiens
ugaaugccaguccagaugugcc

SEQ ID NO: 430889 - RNA, 14 nt, Homo sapiens
ugaaugcuccauua

SEQ ID NO: 430890 - RNA, 20 nt, Homo sapiens
ugaaugcugcugagugaaug

SEQ ID NO: 430891 - RNA, 21 nt, Homo sapiens
ugaaugcugcugagugaauga

SEQ ID NO: 430892 - RNA, 14 nt, Homo sapiens
ugagcucaaaguac

SEQ ID NO: 430893 - RNA, 17 nt, Homo sapiens
ugagcucccccuuccca

SEQ ID NO: 430894 - RNA, 15 nt, Homo sapiens
ugagcugacaucuca

SEQ ID NO: 430895 - RNA, 13 nt, Homo sapiens
ugagcuguuaucu

SEQ ID NO: 430896 - RNA, 14 nt, Homo sapiens
ugagcuugauucua

SEQ ID NO: 430897 - RNA, 23 nt, Homo sapiens
ugagcuuggccagaagggggcca

SEQ ID NO: 430898 - RNA, 22 nt, Homo sapiens
ugagcuuuggacacacacagcu

SEQ ID NO: 430899 - RNA, 23 nt, Homo sapiens
ugaggaaaagaaaaucuuuuuaa

SEQ ID NO: 430900 - RNA, 14 nt, Homo sapiens
ugaggaagccuaaa

SEQ ID NO: 430901 - RNA, 20 nt, Homo sapiens
ugaggaagccuaaauaaaaa

SEQ ID NO: 430902 - RNA, 12 nt, Homo sapiens
ugaggacaaaga

SEQ ID NO: 430903 - RNA, 15 nt, Homo sapiens
ugaggacaauccccc

SEQ ID NO: 430904 - RNA, 19 nt, Homo sapiens
ugaggacauaaaucuucca

SEQ ID NO: 430905 - RNA, 15 nt, Homo sapiens
ugaggaccaaagaua

SEQ ID NO: 430906 - RNA, 23 nt, Homo sapiens
ugaggaccacuccuguacacuga

SEQ ID NO: 430907 - RNA, 12 nt, Homo sapiens
ugaggacucugg

SEQ ID NO: 430908 - RNA, 18 nt, Homo sapiens
ugaggagggcagcuggag

SEQ ID NO: 430909 - RNA, 23 nt, Homo sapiens
ugaggaugaaaaaauaacacugu

SEQ ID NO: 430910 - RNA, 23 nt, Homo sapiens
ugaggcaaucuaagggagucauu

SEQ ID NO: 430911 - RNA, 16 nt, Homo sapiens
ugaggcagaaccuggu

SEQ ID NO: 430912 - RNA, 20 nt, Homo sapiens
ugaggcauuuuuacuacuau

SEQ ID NO: 430913 - RNA, 16 nt, Homo sapiens
ugaggcccacucuguu

SEQ ID NO: 430914 - RNA, 19 nt, Homo sapiens
ugaggccuccagcuucagg

SEQ ID NO: 430915 - RNA, 21 nt, Homo sapiens
ugaggcggguggaucacuuga

SEQ ID NO: 430916 - RNA, 16 nt, Homo sapiens
ugaggcgugggaucca

SEQ ID NO: 430917 - RNA, 14 nt, Homo sapiens
ugaggcugcaccca

SEQ ID NO: 430918 - RNA, 15 nt, Homo sapiens
ugaggcuuccaggcu

SEQ ID NO: 430919 - RNA, 14 nt, Homo sapiens
ugagggcaggguuc

SEQ ID NO: 430920 - RNA, 16 nt, Homo sapiens
ugaggggaugcaacaa

SEQ ID NO: 430921 - RNA, 17 nt, Homo sapiens
ugaggggcuggcacuga

SEQ ID NO: 430922 - RNA, 18 nt, Homo sapiens
ugagggucuuugcaagaa

SEQ ID NO: 430923 - RNA, 21 nt, Homo sapiens
ugagguaccaguuguauuuaa

SEQ ID NO: 430924 - RNA, 16 nt, Homo sapiens
ugaggucucuugaggg

SEQ ID NO: 430925 - RNA, 19 nt, Homo sapiens
ugaggucuuuuacauacag

SEQ ID NO: 430926 - RNA, 19 nt, Homo sapiens
ugaguagagagcaagggaa

SEQ ID NO: 430927 - RNA, 17 nt, Homo sapiens
ugaguagcucuccugac

SEQ ID NO: 430928 - RNA, 17 nt, Homo sapiens
ugaguagggacucaggg

SEQ ID NO: 430929 - RNA, 20 nt, Homo sapiens
ugaguauugauaaacuuuga

SEQ ID NO: 430930 - RNA, 23 nt, Homo sapiens
ugagucaaaagccugggugagaa

SEQ ID NO: 430931 - RNA, 14 nt, Homo sapiens
ugaguccaguuccc

SEQ ID NO: 430932 - RNA, 21 nt, Homo sapiens
ugagucccuuaaccccucuga

SEQ ID NO: 430933 - RNA, 18 nt, Homo sapiens
ugagucccuuccaggcca

SEQ ID NO: 430934 - RNA, 15 nt, Homo sapiens
ugaguccuggcaugg

SEQ ID NO: 430935 - RNA, 17 nt, Homo sapiens
ugagugaaaacaucugc

SEQ ID NO: 430936 - RNA, 12 nt, Homo sapiens
ugagugccuuac

SEQ ID NO: 430937 - RNA, 16 nt, Homo sapiens
ugaguggcagccaugc

SEQ ID NO: 430938 - RNA, 15 nt, Homo sapiens
ugaguguaaguguga

SEQ ID NO: 430939 - RNA, 19 nt, Homo sapiens
ugaguguguccaagugugu

SEQ ID NO: 430940 - RNA, 14 nt, Homo sapiens
ugaguucuacauaa

SEQ ID NO: 430941 - RNA, 21 nt, Homo sapiens
ugaguugcccaucauacgcau

SEQ ID NO: 430942 - RNA, 20 nt, Homo sapiens
ugaguuguuuaaacagucaa

SEQ ID NO: 430943 - RNA, 20 nt, Homo sapiens
ugaguuuuugauagcuuuau

SEQ ID NO: 430944 - RNA, 21 nt, Homo sapiens
ugaguuuuugauagcuuuauu

SEQ ID NO: 430945 - RNA, 21 nt, Homo sapiens
ugauaaaauaaguaacauaua

SEQ ID NO: 430946 - RNA, 14 nt, Homo sapiens
ugauaaauuugacu

SEQ ID NO: 430947 - RNA, 12 nt, Homo sapiens
ugauaaguaaau

SEQ ID NO: 430948 - RNA, 16 nt, Homo sapiens
ugauaccacgaggaaa

SEQ ID NO: 430949 - RNA, 19 nt, Homo sapiens
ugauacuuguuccagaugg

SEQ ID NO: 430950 - RNA, 16 nt, Homo sapiens
ugauagaauaaagccu

SEQ ID NO: 430951 - RNA, 13 nt, Homo sapiens
ugauagcuuuauu

SEQ ID NO: 430952 - RNA, 21 nt, Homo sapiens
ugauaggagacuuguacaguu

SEQ ID NO: 430953 - RNA, 20 nt, Homo sapiens
ugauaguguuuuguacuugu

SEQ ID NO: 430954 - RNA, 18 nt, Homo sapiens
ugauaucccccagccuca

SEQ ID NO: 430955 - RNA, 18 nt, Homo sapiens
ugauauugaccaugugau

SEQ ID NO: 430956 - RNA, 16 nt, Homo sapiens
ugaucaaagcaccuug

SEQ ID NO: 430957 - RNA, 16 nt, Homo sapiens
ugaucaccugccaaau

SEQ ID NO: 430958 - RNA, 18 nt, Homo sapiens
ugaucacuccagugcacu

SEQ ID NO: 430959 - RNA, 17 nt, Homo sapiens
ugaucauuacauggcug

SEQ ID NO: 430960 - RNA, 14 nt, Homo sapiens
ugauccaguggaca

SEQ ID NO: 430961 - RNA, 18 nt, Homo sapiens
ugaucccuucuuacuuaa

SEQ ID NO: 430962 - RNA, 20 nt, Homo sapiens
ugaucgauguuaaacgucac

SEQ ID NO: 430963 - RNA, 15 nt, Homo sapiens
ugaucuauacaaauu

SEQ ID NO: 430964 - RNA, 18 nt, Homo sapiens
ugaucuguggagaaugua

SEQ ID NO: 430965 - RNA, 22 nt, Homo sapiens
ugaucuguggagaauguacaca

SEQ ID NO: 430966 - RNA, 17 nt, Homo sapiens
ugaugaauaaacacuuu

SEQ ID NO: 430967 - RNA, 15 nt, Homo sapiens
ugaugacccucugac

SEQ ID NO: 430968 - RNA, 15 nt, Homo sapiens
ugaugacgacgacaa

SEQ ID NO: 430969 - RNA, 21 nt, Homo sapiens
ugaugaucaaaaccugugcca

SEQ ID NO: 430970 - RNA, 17 nt, Homo sapiens
ugaugauuaauucaccu

SEQ ID NO: 430971 - RNA, 16 nt, Homo sapiens
ugaugcucacauauga

SEQ ID NO: 430972 - RNA, 14 nt, Homo sapiens
ugaugcugugcuau

SEQ ID NO: 430973 - RNA, 16 nt, Homo sapiens
ugauggaagcaccuaa

SEQ ID NO: 430974 - RNA, 14 nt, Homo sapiens
ugauguaacugugu

SEQ ID NO: 430975 - RNA, 19 nt, Homo sapiens
ugauguacagucugucaug

SEQ ID NO: 430976 - RNA, 19 nt, Homo sapiens
ugauguauuguugcuuuuu

SEQ ID NO: 430977 - RNA, 12 nt, Homo sapiens
ugaugugcucau

SEQ ID NO: 430978 - RNA, 14 nt, Homo sapiens
ugauuaaguuccua

SEQ ID NO: 430979 - RNA, 18 nt, Homo sapiens
ugauuagaagccaagaca

SEQ ID NO: 430980 - RNA, 21 nt, Homo sapiens
ugauucagccaaaugcaggga

SEQ ID NO: 430981 - RNA, 12 nt, Homo sapiens
ugauucuauguc

SEQ ID NO: 430982 - RNA, 13 nt, Homo sapiens
ugauugcugccau

SEQ ID NO: 430983 - RNA, 13 nt, Homo sapiens
ugauugcuuuuau

SEQ ID NO: 430984 - RNA, 17 nt, Homo sapiens
ugauugucagcuacuaa

SEQ ID NO: 430985 - RNA, 15 nt, Homo sapiens
ugauugucuuagaca

SEQ ID NO: 430986 - RNA, 16 nt, Homo sapiens
ugauuuaaacucuuag

SEQ ID NO: 430987 - RNA, 13 nt, Homo sapiens
ugauuuacaagac

SEQ ID NO: 430988 - RNA, 21 nt, Homo sapiens
ugauuuacuacuuaugcguaa

SEQ ID NO: 430989 - RNA, 16 nt, Homo sapiens
ugauuuaugaucacuu

SEQ ID NO: 430990 - RNA, 15 nt, Homo sapiens
ugauuuccauuugca

SEQ ID NO: 430991 - RNA, 18 nt, Homo sapiens
ugauuugucccuaugcau

SEQ ID NO: 430992 - RNA, 20 nt, Homo sapiens
ugauuuuuuucauuuugcca

SEQ ID NO: 430993 - RNA, 16 nt, Homo sapiens
ugcaaaaaacucagag

SEQ ID NO: 430994 - RNA, 21 nt, Homo sapiens
ugcaaaaccggcaaccuguaa

SEQ ID NO: 430995 - RNA, 22 nt, Homo sapiens
ugcaaaagcaggcuugugcuuu

SEQ ID NO: 430996 - RNA, 18 nt, Homo sapiens
ugcaaaauuaccuacccc

SEQ ID NO: 430997 - RNA, 13 nt, Homo sapiens
ugcaaaauuucca

SEQ ID NO: 430998 - RNA, 12 nt, Homo sapiens
ugcaaacagugu

SEQ ID NO: 430999 - RNA, 14 nt, Homo sapiens
ugcaaacaucuuca

SEQ ID NO: 431000 - RNA, 15 nt, Homo sapiens
ugcaaagcauuugag

SEQ ID NO: 431001 - RNA, 21 nt, Homo sapiens
ugcaaaggacagauccaggga

SEQ ID NO: 431002 - RNA, 21 nt, Homo sapiens
ugcaaaggagggccucagaga

SEQ ID NO: 431003 - RNA, 17 nt, Homo sapiens
ugcaaauccccucccca

SEQ ID NO: 431004 - RNA, 19 nt, Homo sapiens
ugcccuucacuguugcuua

SEQ ID NO: 431005 - RNA, 14 nt, Homo sapiens
ugcccuuugggguc

SEQ ID NO: 431006 - RNA, 19 nt, Homo sapiens
ugcccuuuuaaauggcaug

SEQ ID NO: 431007 - RNA, 22 nt, Homo sapiens
ugcccuuuuaaauggcaugaca

SEQ ID NO: 431008 - RNA, 21 nt, Homo sapiens
ugccgaagaugagacugccca

SEQ ID NO: 431009 - RNA, 14 nt, Homo sapiens
ugccgaaugugcag

SEQ ID NO: 431010 - RNA, 16 nt, Homo sapiens
ugccgacuggcuguga

SEQ ID NO: 431011 - RNA, 16 nt, Homo sapiens
ugccgagccuaaugaa

SEQ ID NO: 431012 - RNA, 12 nt, Homo sapiens
ugccgcauuugg

SEQ ID NO: 431013 - RNA, 19 nt, Homo sapiens
ugccggguucuagucuccu

SEQ ID NO: 431014 - RNA, 12 nt, Homo sapiens
ugccgugagcag

SEQ ID NO: 431015 - RNA, 23 nt, Homo sapiens
ugccguucgcugagucccagcaa

SEQ ID NO: 431016 - RNA, 18 nt, Homo sapiens
ugccucagccucccgagu

SEQ ID NO: 431017 - RNA, 16 nt, Homo sapiens
ugccucagccuuccaa

SEQ ID NO: 431018 - RNA, 18 nt, Homo sapiens
ugccucagccuuccaaag

SEQ ID NO: 431019 - RNA, 13 nt, Homo sapiens
ugccucagcugug

SEQ ID NO: 431020 - RNA, 12 nt, Homo sapiens
ugccucaggaau

SEQ ID NO: 431021 - RNA, 21 nt, Homo sapiens
ugccucccacccuucucaggg

SEQ ID NO: 431022 - RNA, 23 nt, Homo sapiens
ugccucccacccuucucagggac

SEQ ID NO: 431023 - RNA, 16 nt, Homo sapiens
ugccuccugccugccc

SEQ ID NO: 431024 - RNA, 14 nt, Homo sapiens
ugccucucucagga

SEQ ID NO: 431025 - RNA, 22 nt, Homo sapiens
ugccucugggaggggugcugcc

SEQ ID NO: 431026 - RNA, 14 nt, Homo sapiens
ugccugagcccagg

SEQ ID NO: 431027 - RNA, 20 nt, Homo sapiens
ugccugccccccucaucuca

SEQ ID NO: 431028 - RNA, 22 nt, Homo sapiens
ugccugcggaguugugcacgua

SEQ ID NO: 431029 - RNA, 15 nt, Homo sapiens
ugccuggcaaggccu

SEQ ID NO: 431030 - RNA, 17 nt, Homo sapiens
ugccugggaucaguggg

SEQ ID NO: 431031 - RNA, 19 nt, Homo sapiens
ugccugggccugugcagca

SEQ ID NO: 431032 - RNA, 15 nt, Homo sapiens
ugccuguauuuccaa

SEQ ID NO: 431033 - RNA, 16 nt, Homo sapiens
ugccuguauuuccaac

SEQ ID NO: 431034 - RNA, 18 nt, Homo sapiens
ugccugucccucucaggc

SEQ ID NO: 431035 - RNA, 20 nt, Homo sapiens
ugccuguuauaacucugcac

SEQ ID NO: 431036 - RNA, 20 nt, Homo sapiens
ugccuguucccauucuugca

SEQ ID NO: 431037 - RNA, 19 nt, Homo sapiens
ugccuuccgugggucaucc

SEQ ID NO: 431038 - RNA, 19 nt, Homo sapiens
ugccuuccuacccucucua

SEQ ID NO: 431039 - RNA, 22 nt, Homo sapiens
ugccuucucuguucccuugcag

SEQ ID NO: 431040 - RNA, 15 nt, Homo sapiens
ugccuucucuucuau

SEQ ID NO: 431041 - RNA, 21 nt, Homo sapiens
ugccuuguugaugaagcacau

SEQ ID NO: 431042 - RNA, 18 nt, Homo sapiens
ugccuuuagaaacugagu

SEQ ID NO: 431043 - RNA, 14 nt, Homo sapiens
ugccuuucacuuua

SEQ ID NO: 431044 - RNA, 21 nt, Homo sapiens
ugccuuuuaucuauuugagau

SEQ ID NO: 431045 - RNA, 21 nt, Homo sapiens
ugcgccgagaccgcagaggga

SEQ ID NO: 431046 - RNA, 16 nt, Homo sapiens
ugcggaguugugcacg

SEQ ID NO: 431047 - RNA, 13 nt, Homo sapiens
ugcggcuuuucag

SEQ ID NO: 431048 - RNA, 12 nt, Homo sapiens
ugcggugcauac

SEQ ID NO: 431049 - RNA, 23 nt, Homo sapiens
ugcggugcauacacccccaccuc

SEQ ID NO: 431050 - RNA, 22 nt, Homo sapiens
ugcgucagaccaguacugggaa

SEQ ID NO: 431051 - RNA, 12 nt, Homo sapiens
ugcgucuaccca

SEQ ID NO: 431052 - RNA, 11 nt, Homo sapiens
ugcgugccauc

SEQ ID NO: 431053 - RNA, 23 nt, Homo sapiens
ugcgugccaucacucaaccauaa

SEQ ID NO: 431054 - RNA, 13 nt, Homo sapiens
ugcgugggggcca

SEQ ID NO: 431055 - RNA, 13 nt, Homo sapiens
ugcgugugugcaa

SEQ ID NO: 431056 - RNA, 16 nt, Homo sapiens
ugcguuagaaugagga

SEQ ID NO: 431057 - RNA, 21 nt, Homo sapiens
ugcguuuuagaguaugcaaga

SEQ ID NO: 431058 - RNA, 19 nt, Homo sapiens
ugcuaagggcaggcccaaa

SEQ ID NO: 431059 - RNA, 21 nt, Homo sapiens
ugcuaauaaaugaccaguuua

SEQ ID NO: 431060 - RNA, 23 nt, Homo sapiens
ugcuaaucaugugggugagccag

SEQ ID NO: 431061 - RNA, 14 nt, Homo sapiens
ugcuaccaucucau

SEQ ID NO: 431062 - RNA, 16 nt, Homo sapiens
ugcuacugaugggaau

SEQ ID NO: 431063 - RNA, 22 nt, Homo sapiens
ugcuagcaaauggcagaaccaa

SEQ ID NO: 431064 - RNA, 20 nt, Homo sapiens
ugcuaggcgcuggggagacu

SEQ ID NO: 431065 - RNA, 19 nt, Homo sapiens
ugcuauaauauauaaugaa

SEQ ID NO: 431066 - RNA, 22 nt, Homo sapiens
ugcuaucucgcuagccauauau

SEQ ID NO: 431067 - RNA, 15 nt, Homo sapiens
ugcuauuacuaguac

SEQ ID NO: 431068 - RNA, 15 nt, Homo sapiens
ugcuauuucccaagc

SEQ ID NO: 431069 - RNA, 12 nt, Homo sapiens
ugcucacauucc

SEQ ID NO: 431070 - RNA, 18 nt, Homo sapiens
ugcucacccauugucuca

SEQ ID NO: 431071 - RNA, 13 nt, Homo sapiens
ugcucacucccua

SEQ ID NO: 431072 - RNA, 20 nt, Homo sapiens
ugcucaggcuugaaaugcau

SEQ ID NO: 431073 - RNA, 16 nt, Homo sapiens
ugcucaguauugagac

SEQ ID NO: 431074 - RNA, 20 nt, Homo sapiens
ugcucaguuggugcugcuuu

SEQ ID NO: 431075 - RNA, 17 nt, Homo sapiens
ugcucauuucacuauuc

SEQ ID NO: 431076 - RNA, 14 nt, Homo sapiens
ugcuccagaauuaa

SEQ ID NO: 431077 - RNA, 12 nt, Homo sapiens
ugcuccaugcag

SEQ ID NO: 431078 - RNA, 17 nt, Homo sapiens
ugcuccauuaauccagg

SEQ ID NO: 431079 - RNA, 17 nt, Homo sapiens
ugcucccaacccauuca

SEQ ID NO: 431080 - RNA, 15 nt, Homo sapiens
ugcucccaugcucau

SEQ ID NO: 431081 - RNA, 17 nt, Homo sapiens
ugcuccuggagccuuug

SEQ ID NO: 431082 - RNA, 17 nt, Homo sapiens
ugcuccuuguuccuaga

SEQ ID NO: 431083 - RNA, 18 nt, Homo sapiens
ugcucguaugaauucauu

SEQ ID NO: 431084 - RNA, 19 nt, Homo sapiens
ugcucugcuggucuucaau

SEQ ID NO: 431085 - RNA, 20 nt, Homo sapiens
ugcucuggaagccugcugau

SEQ ID NO: 431086 - RNA, 18 nt, Homo sapiens
ugcucuggggcuugcuau

SEQ ID NO: 431087 - RNA, 18 nt, Homo sapiens
ugcucuguuuugcaugga

SEQ ID NO: 431088 - RNA, 23 nt, Homo sapiens
ugcucuuuaugaaugaaaaaaca

SEQ ID NO: 431089 - RNA, 16 nt, Homo sapiens
ugcugaaguacagucc

SEQ ID NO: 431090 - RNA, 15 nt, Homo sapiens
ugcugagcauguacu

SEQ ID NO: 431091 - RNA, 22 nt, Homo sapiens
ugcugaugaucaaaaccugugc

SEQ ID NO: 431092 - RNA, 16 nt, Homo sapiens
ugcugauggcuugaca

SEQ ID NO: 431093 - RNA, 21 nt, Homo sapiens
ugcugcaucuccccucagauu

SEQ ID NO: 431094 - RNA, 18 nt, Homo sapiens
ugcugccaccaaaucugu

SEQ ID NO: 431095 - RNA, 18 nt, Homo sapiens
ugcugcccugaugcgucu

SEQ ID NO: 431096 - RNA, 11 nt, Homo sapiens
ugcugccuuaa

SEQ ID NO: 431097 - RNA, 13 nt, Homo sapiens
ugcugcuaugaaa

SEQ ID NO: 431098 - RNA, 16 nt, Homo sapiens
ugcugcuccagugcag

SEQ ID NO: 431099 - RNA, 13 nt, Homo sapiens
ugcugcuccaugg

SEQ ID NO: 431100 - RNA, 14 nt, Homo sapiens
ugcugcuccaugga

SEQ ID NO: 431101 - RNA, 19 nt, Homo sapiens
ugcugcugagugcaccacu

SEQ ID NO: 431102 - RNA, 23 nt, Homo sapiens
ugcugcugcgcccuuaccuuccc

SEQ ID NO: 431103 - RNA, 22 nt, Homo sapiens
ugcugcuugugccucccuuccc

SEQ ID NO: 431104 - RNA, 18 nt, Homo sapiens
ugcuggaggaaaacugag

SEQ ID NO: 431105 - RNA, 20 nt, Homo sapiens
ugcuggaguccuguucucag

SEQ ID NO: 431106 - RNA, 22 nt, Homo sapiens
ugcuggcauuugcaccuaccuc

SEQ ID NO: 431107 - RNA, 14 nt, Homo sapiens
ugcuggccccaaaa

SEQ ID NO: 431108 - RNA, 19 nt, Homo sapiens
ugcuggccgggcacagcug

SEQ ID NO: 431109 - RNA, 18 nt, Homo sapiens
ugcuggccuggaucuccc

SEQ ID NO: 431110 - RNA, 19 nt, Homo sapiens
uggaugcacagaugccaug

SEQ ID NO: 431111 - RNA, 17 nt, Homo sapiens
uggaugccaaccgguca

SEQ ID NO: 431112 - RNA, 21 nt, Homo sapiens
uggaugggagugggcaccuca

SEQ ID NO: 431113 - RNA, 16 nt, Homo sapiens
uggauguacuuaagag

SEQ ID NO: 431114 - RNA, 14 nt, Homo sapiens
uggauguagucagu

SEQ ID NO: 431115 - RNA, 20 nt, Homo sapiens
uggaugugcauuucugugau

SEQ ID NO: 431116 - RNA, 21 nt, Homo sapiens
uggauuacaggcaugugccac

SEQ ID NO: 431117 - RNA, 23 nt, Homo sapiens
uggauucauuacagcuuaaucaa

SEQ ID NO: 431118 - RNA, 13 nt, Homo sapiens
uggauucuggaug

SEQ ID NO: 431119 - RNA, 20 nt, Homo sapiens
uggauucuucccacacagaa

SEQ ID NO: 431120 - RNA, 17 nt, Homo sapiens
uggauugggagauuuca

SEQ ID NO: 431121 - RNA, 20 nt, Homo sapiens
uggauugugggaauuaagga

SEQ ID NO: 431122 - RNA, 18 nt, Homo sapiens
uggauuuuccaccaaauu

SEQ ID NO: 431123 - RNA, 13 nt, Homo sapiens
uggcaaaagacau

SEQ ID NO: 431124 - RNA, 20 nt, Homo sapiens
uggcaacaaacacauuguga

SEQ ID NO: 431125 - RNA, 20 nt, Homo sapiens
uggcaacaugaagaaugcau

SEQ ID NO: 431126 - RNA, 15 nt, Homo sapiens
uggcaauaggacaaa

SEQ ID NO: 431127 - RNA, 20 nt, Homo sapiens
uggcaauauaaggggaugag

SEQ ID NO: 431128 - RNA, 18 nt, Homo sapiens
uggcaauucuucuucuca

SEQ ID NO: 431129 - RNA, 15 nt, Homo sapiens
uggcacacugccagu

SEQ ID NO: 431130 - RNA, 17 nt, Homo sapiens
uggcacacugccagugu

SEQ ID NO: 431131 - RNA, 23 nt, Homo sapiens
uggcacaugacaacuuugccagc

SEQ ID NO: 431132 - RNA, 13 nt, Homo sapiens
uggcaccucucaa

SEQ ID NO: 431133 - RNA, 21 nt, Homo sapiens
uggcacuagcauuauaccaag

SEQ ID NO: 431134 - RNA, 18 nt, Homo sapiens
uggcacuguuagugacag

SEQ ID NO: 431135 - RNA, 21 nt, Homo sapiens
uggcacuugcaagucccauga

SEQ ID NO: 431136 - RNA, 19 nt, Homo sapiens
uggcagaaccaaagcucaa

SEQ ID NO: 431137 - RNA, 20 nt, Homo sapiens
uggcagaagggaauugcuca

SEQ ID NO: 431138 - RNA, 14 nt, Homo sapiens
uuacugaccagcaa

SEQ ID NO: 431139 - RNA, 15 nt, Homo sapiens
uuacugauuaacuca

SEQ ID NO: 431140 - RNA, 13 nt, Homo sapiens
uuacuguucaugg

SEQ ID NO: 431141 - RNA, 17 nt, Homo sapiens
uuacuuaacuuaauuca

SEQ ID NO: 431142 - RNA, 23 nt, Homo sapiens
uuacuuagagaugcuacugucag

SEQ ID NO: 431143 - RNA, 20 nt, Homo sapiens
uuacuuccgguuucuucaua

SEQ ID NO: 431144 - RNA, 20 nt, Homo sapiens
uuacuugaggaucauaugaa

SEQ ID NO: 431145 - RNA, 17 nt, Homo sapiens
uuagaaaauagagcuuu

SEQ ID NO: 431146 - RNA, 15 nt, Homo sapiens
uuagaaacacacuuu

SEQ ID NO: 431147 - RNA, 16 nt, Homo sapiens
uuagaaacacacuuuu

SEQ ID NO: 431148 - RNA, 19 nt, Homo sapiens
uuagaaauaaagcaucuca

SEQ ID NO: 431149 - RNA, 12 nt, Homo sapiens
uuagaaauggau

SEQ ID NO: 431150 - RNA, 22 nt, Homo sapiens
uuagaacucauuagcuguguga

SEQ ID NO: 431151 - RNA, 18 nt, Homo sapiens
uuagaagaaaacauauau

SEQ ID NO: 431152 - RNA, 17 nt, Homo sapiens
uuagaauggggcuucca

SEQ ID NO: 431153 - RNA, 19 nt, Homo sapiens
uuagaauguugaaacugac

SEQ ID NO: 431154 - RNA, 23 nt, Homo sapiens
uuagacagucaaggaguggcuua

SEQ ID NO: 431155 - RNA, 17 nt, Homo sapiens
uuagagaaugauuucaa

SEQ ID NO: 431156 - RNA, 16 nt, Homo sapiens
uuagagcagaauucau

SEQ ID NO: 431157 - RNA, 14 nt, Homo sapiens
uuagaggagcccac

SEQ ID NO: 431158 - RNA, 17 nt, Homo sapiens
uuagauguugguggugc

SEQ ID NO: 431159 - RNA, 13 nt, Homo sapiens
uuagauugccacu

SEQ ID NO: 431160 - RNA, 21 nt, Homo sapiens
uuagcaccucuuuuugaacag

SEQ ID NO: 431161 - RNA, 17 nt, Homo sapiens
uuagcaugaaagguaau

SEQ ID NO: 431162 - RNA, 13 nt, Homo sapiens
uuagccaaaggau

SEQ ID NO: 431163 - RNA, 17 nt, Homo sapiens
uuagccagguaauguga

SEQ ID NO: 431164 - RNA, 16 nt, Homo sapiens
uuagccccgaguuuaa

SEQ ID NO: 431165 - RNA, 14 nt, Homo sapiens
uuaggagaaaccag

SEQ ID NO: 431166 - RNA, 23 nt, Homo sapiens
uuaggauuuaacagucauuuaaa

SEQ ID NO: 431167 - RNA, 21 nt, Homo sapiens
uuaggcaauggugaacuguca

SEQ ID NO: 431168 - RNA, 22 nt, Homo sapiens
uuaggcaauggugaacugucau

SEQ ID NO: 431169 - RNA, 16 nt, Homo sapiens
uuaggcaccagaagaa

SEQ ID NO: 431170 - RNA, 18 nt, Homo sapiens
uuaggccagggucucacu

SEQ ID NO: 431171 - RNA, 13 nt, Homo sapiens
uuaguauucugcc

SEQ ID NO: 431172 - RNA, 16 nt, Homo sapiens
uuagugugauugugaa

SEQ ID NO: 431173 - RNA, 17 nt, Homo sapiens
uuaguuuccguuuccag

SEQ ID NO: 431174 - RNA, 15 nt, Homo sapiens
uuaguuuuuuccaca

SEQ ID NO: 431175 - RNA, 14 nt, Homo sapiens
uuauaaaaucuuuc

SEQ ID NO: 431176 - RNA, 19 nt, Homo sapiens
uuauaaaugagcaaaugga

SEQ ID NO: 431177 - RNA, 19 nt, Homo sapiens
uuauaagauuuaauuguaa

SEQ ID NO: 431178 - RNA, 16 nt, Homo sapiens
uuauaauaauguucuc

SEQ ID NO: 431179 - RNA, 21 nt, Homo sapiens
uuauacaucaccuuuuugacu

SEQ ID NO: 431180 - RNA, 14 nt, Homo sapiens
uuauacauggguag

SEQ ID NO: 431181 - RNA, 13 nt, Homo sapiens
uuauacauuugau

SEQ ID NO: 431182 - RNA, 14 nt, Homo sapiens
uuauaccaguguua

SEQ ID NO: 431183 - RNA, 22 nt, Homo sapiens
uuauaccaguguuaagugacau

SEQ ID NO: 431184 - RNA, 11 nt, Homo sapiens
uuauacuccuc

SEQ ID NO: 431185 - RNA, 19 nt, Homo sapiens
uuauacugauugcacaccc

SEQ ID NO: 431186 - RNA, 22 nt, Homo sapiens
uuauaguuucagauauauauca

SEQ ID NO: 431187 - RNA, 14 nt, Homo sapiens
uuauauaauucaag

SEQ ID NO: 431188 - RNA, 16 nt, Homo sapiens
uuauauacaguacaca

SEQ ID NO: 431189 - RNA, 18 nt, Homo sapiens
uuauauaugaaaacuaag

SEQ ID NO: 431190 - RNA, 19 nt, Homo sapiens
uuauaucagacugcuuuga

SEQ ID NO: 431191 - RNA, 15 nt, Homo sapiens
uuauaucagaguaug

SEQ ID NO: 431192 - RNA, 14 nt, Homo sapiens
uuauauuugucuca

SEQ ID NO: 431193 - RNA, 20 nt, Homo sapiens
uuaucaaaaaguacaauaau

SEQ ID NO: 431194 - RNA, 15 nt, Homo sapiens
uuaucaaaucauuca

SEQ ID NO: 431195 - RNA, 17 nt, Homo sapiens
uuaucaagugucuucca

SEQ ID NO: 431196 - RNA, 14 nt, Homo sapiens
uuaucaauaguucc

SEQ ID NO: 431197 - RNA, 19 nt, Homo sapiens
uuaucacaauguacuauau

SEQ ID NO: 431198 - RNA, 19 nt, Homo sapiens
uuaucacacuucugugaga

SEQ ID NO: 431199 - RNA, 23 nt, Homo sapiens
uuaucagugaauauaaauguacu

SEQ ID NO: 431200 - RNA, 13 nt, Homo sapiens
uuaucauugcuaa

SEQ ID NO: 431201 - RNA, 14 nt, Homo sapiens
uuauccaacuauua

SEQ ID NO: 431202 - RNA, 22 nt, Homo sapiens
uuaucccacggaaaaugccaau

SEQ ID NO: 431203 - RNA, 16 nt, Homo sapiens
uuauccucuugcuaua

SEQ ID NO: 431204 - RNA, 15 nt, Homo sapiens
uuaucgaaaguaaaa

SEQ ID NO: 431205 - RNA, 18 nt, Homo sapiens
uuaucgggagcagugucu

SEQ ID NO: 431206 - RNA, 17 nt, Homo sapiens
uuaucuagaacauucag

SEQ ID NO: 431207 - RNA, 19 nt, Homo sapiens
uuaucuagccaaagagcuc

SEQ ID NO: 431208 - RNA, 19 nt, Homo sapiens
uuaucugauccuuguggca

SEQ ID NO: 431209 - RNA, 15 nt, Homo sapiens
uuaucugcuguuccu

SEQ ID NO: 431210 - RNA, 17 nt, Homo sapiens
uuaucugucucuucuac

SEQ ID NO: 431211 - RNA, 23 nt, Homo sapiens
uuaucugugcgugaaacacacca

SEQ ID NO: 431212 - RNA, 15 nt, Homo sapiens
uuaucuuaucuagca

SEQ ID NO: 431213 - RNA, 13 nt, Homo sapiens
uuaucuuaugcca

SEQ ID NO: 431214 - RNA, 15 nt, Homo sapiens
uuaucuugacauuca

SEQ ID NO: 431215 - RNA, 15 nt, Homo sapiens
uuaucuugucucugg

SEQ ID NO: 431216 - RNA, 17 nt, Homo sapiens
uuaugacuccagaauuu

SEQ ID NO: 431217 - RNA, 16 nt, Homo sapiens
uuaugacuccuugaua

SEQ ID NO: 431218 - RNA, 21 nt, Homo sapiens
uuaugagaacugguucuugcc

SEQ ID NO: 431219 - RNA, 23 nt, Homo sapiens
uuaugagaggcaaugauuguuaa

SEQ ID NO: 431220 - RNA, 17 nt, Homo sapiens
uuaugaguucuguauaa

SEQ ID NO: 431221 - RNA, 22 nt, Homo sapiens
uuaugauauaauaaauauauau

SEQ ID NO: 431222 - RNA, 14 nt, Homo sapiens
uuaugccaaagugu

SEQ ID NO: 431223 - RNA, 11 nt, Homo sapiens
uuauguacugc

SEQ ID NO: 431224 - RNA, 17 nt, Homo sapiens
uuaugucaccagaauau

SEQ ID NO: 431225 - RNA, 12 nt, Homo sapiens
uuaugucuauau

SEQ ID NO: 431226 - RNA, 16 nt, Homo sapiens
uuaugugaauggaauc

SEQ ID NO: 431227 - RNA, 11 nt, Homo sapiens
uuaugugacaa

SEQ ID NO: 431228 - RNA, 23 nt, Homo sapiens
uuaugugaguguguguuugugcu

SEQ ID NO: 431229 - RNA, 19 nt, Homo sapiens
uuauuacauggggucuaga

SEQ ID NO: 431230 - RNA, 16 nt, Homo sapiens
uuauuaccauuagcau

SEQ ID NO: 431231 - RNA, 21 nt, Homo sapiens
uuauuaccucugauaccucaa

SEQ ID NO: 431232 - RNA, 14 nt, Homo sapiens
uucugggugcagcu

SEQ ID NO: 431233 - RNA, 14 nt, Homo sapiens
uucuguaguacucc

SEQ ID NO: 431234 - RNA, 17 nt, Homo sapiens
uucuguauuaacugaau

SEQ ID NO: 431235 - RNA, 21 nt, Homo sapiens
uucuguccuuuuggcacugag

SEQ ID NO: 431236 - RNA, 12 nt, Homo sapiens
uucugugagaau

SEQ ID NO: 431237 - RNA, 12 nt, Homo sapiens
uucuguggcuca

SEQ ID NO: 431238 - RNA, 13 nt, Homo sapiens
uucugugucauac

SEQ ID NO: 431239 - RNA, 15 nt, Homo sapiens
uucugugugaacuga

SEQ ID NO: 431240 - RNA, 14 nt, Homo sapiens
uucuguuuccauag

SEQ ID NO: 431241 - RNA, 12 nt, Homo sapiens
uucuguuuccca

SEQ ID NO: 431242 - RNA, 15 nt, Homo sapiens
uucuuaaacucagaa

SEQ ID NO: 431243 - RNA, 22 nt, Homo sapiens
uucuuaaauggaauuauuuuga

SEQ ID NO: 431244 - RNA, 22 nt, Homo sapiens
uucuuaaccccaguaagccacu

SEQ ID NO: 431245 - RNA, 16 nt, Homo sapiens
uucuuacaauugcacu

SEQ ID NO: 431246 - RNA, 21 nt, Homo sapiens
uucuuacaauugcacugcugu

SEQ ID NO: 431247 - RNA, 18 nt, Homo sapiens
uucuuaccucauuugcau

SEQ ID NO: 431248 - RNA, 13 nt, Homo sapiens
uucuuacuguauu

SEQ ID NO: 431249 - RNA, 15 nt, Homo sapiens
uucuucauccauaga

SEQ ID NO: 431250 - RNA, 14 nt, Homo sapiens
uucuucaucccacu

SEQ ID NO: 431251 - RNA, 11 nt, Homo sapiens
uucuuccaaaa

SEQ ID NO: 431252 - RNA, 22 nt, Homo sapiens
uucuucccuucucucucucuca

SEQ ID NO: 431253 - RNA, 23 nt, Homo sapiens
uucuucuaaugagucgacuuuga

SEQ ID NO: 431254 - RNA, 24 nt, Homo sapiens
uucuucuagaguaauuaucuguga

SEQ ID NO: 431255 - RNA, 13 nt, Homo sapiens
uucuucuuuuugc

SEQ ID NO: 431256 - RNA, 16 nt, Homo sapiens
uucuugaaccaauaau

SEQ ID NO: 431257 - RNA, 18 nt, Homo sapiens
uucuugcucuaucucuca

SEQ ID NO: 431258 - RNA, 23 nt, Homo sapiens
uucuugggaaaauaucacuuugu

SEQ ID NO: 431259 - RNA, 15 nt, Homo sapiens
uucuuguuaagugcu

SEQ ID NO: 431260 - RNA, 14 nt, Homo sapiens
uucuuguugcugca

SEQ ID NO: 431261 - RNA, 23 nt, Homo sapiens
uucuuuaacauacaucuaaguca

SEQ ID NO: 431262 - RNA, 18 nt, Homo sapiens
uucuuucagauguuuauu

SEQ ID NO: 431263 - RNA, 20 nt, Homo sapiens
uucuuugacauuugguggua

SEQ ID NO: 431264 - RNA, 9 nt, Homo sapiens
uucuuugau

SEQ ID NO: 431265 - RNA, 16 nt, Homo sapiens
uucuuugcugcaguca

SEQ ID NO: 431266 - RNA, 19 nt, Homo sapiens
uucuuuucccaucaccaga

SEQ ID NO: 431267 - RNA, 13 nt, Homo sapiens
uucuuuuuccaca

SEQ ID NO: 431268 - RNA, 18 nt, Homo sapiens
uucuuuuucguuggugua

SEQ ID NO: 431269 - RNA, 18 nt, Homo sapiens
uugaaaaauggcaaagaa

SEQ ID NO: 431270 - RNA, 18 nt, Homo sapiens
uugaaaaccucuuuccaa

SEQ ID NO: 431271 - RNA, 21 nt, Homo sapiens
uugaaaaggcgguacuaguuc

SEQ ID NO: 431272 - RNA, 15 nt, Homo sapiens
uugaaacauuugcca

SEQ ID NO: 431273 - RNA, 15 nt, Homo sapiens
uugaaaccuuugaca

SEQ ID NO: 431274 - RNA, 18 nt, Homo sapiens
uugaaagaacaucaguuc

SEQ ID NO: 431275 - RNA, 11 nt, Homo sapiens
uugaaagaaga

SEQ ID NO: 431276 - RNA, 15 nt, Homo sapiens
uuuaaagaagucucu

SEQ ID NO: 431277 - RNA, 15 nt, Homo sapiens
uuuaaagagaaugua

SEQ ID NO: 431278 - RNA, 13 nt, Homo sapiens
uuuaaaggacaaa

SEQ ID NO: 431279 - RNA, 14 nt, Homo sapiens
uuuaaaguuuaaau

SEQ ID NO: 431280 - RNA, 15 nt, Homo sapiens
uuuaaaucugugaug

SEQ ID NO: 431281 - RNA, 18 nt, Homo sapiens
uuuaacaggaagaucuua

SEQ ID NO: 431282 - RNA, 21 nt, Homo sapiens
uuuaacuucugccuguggaac

SEQ ID NO: 431283 - RNA, 17 nt, Homo sapiens
uuuaagaaugacaggcu

SEQ ID NO: 431284 - RNA, 18 nt, Homo sapiens
uuuaagacagagucucac

SEQ ID NO: 431285 - RNA, 14 nt, Homo sapiens
uuuaagcuaccaau

SEQ ID NO: 431286 - RNA, 14 nt, Homo sapiens
uuuaagguaacaaa

SEQ ID NO: 431287 - RNA, 16 nt, Homo sapiens
uuuaaggucugacuga

SEQ ID NO: 431288 - RNA, 18 nt, Homo sapiens
uuuaaggugaguucucac

SEQ ID NO: 431289 - RNA, 13 nt, Homo sapiens
uuuaaguacucac

SEQ ID NO: 431290 - RNA, 15 nt, Homo sapiens
uuuaauacaggguag

SEQ ID NO: 431291 - RNA, 17 nt, Homo sapiens
uuuaauacucaccuccu

SEQ ID NO: 431292 - RNA, 16 nt, Homo sapiens
uuuaaucccacuugcc

SEQ ID NO: 431293 - RNA, 21 nt, Homo sapiens
uuuaaugugagacagcaaguu

SEQ ID NO: 431294 - RNA, 20 nt, Homo sapiens
uuuaauguuauccucuugcu

SEQ ID NO: 431295 - RNA, 16 nt, Homo sapiens
uuuaauguuuccuuua

SEQ ID NO: 431296 - RNA, 14 nt, Homo sapiens
uuuaauuacaacag

SEQ ID NO: 431297 - RNA, 18 nt, Homo sapiens
uuuaauuagaaauaucuu

SEQ ID NO: 431298 - RNA, 19 nt, Homo sapiens
uuuaauuuugugaaucuau

SEQ ID NO: 431299 - RNA, 23 nt, Homo sapiens
uuuaauuuuuaaaagacuuugau

SEQ ID NO: 431300 - RNA, 23 nt, Homo sapiens
uuuacaauaaaacuuugcugcca

SEQ ID NO: 431301 - RNA, 16 nt, Homo sapiens
uuuacagcucuuggca

SEQ ID NO: 431302 - RNA, 21 nt, Homo sapiens
uuuacauaucaccucauggcc

SEQ ID NO: 431303 - RNA, 19 nt, Homo sapiens
uuuacauuuucaguaccaa

SEQ ID NO: 431304 - RNA, 17 nt, Homo sapiens
uuuaccugagaccaguu

SEQ ID NO: 431305 - RNA, 22 nt, Homo sapiens
uuuacggugauauugugcaugc

SEQ ID NO: 431306 - RNA, 19 nt, Homo sapiens
uuuacugucuguaagagaa

SEQ ID NO: 431307 - RNA, 19 nt, Homo sapiens
uuuacuuaucuuaugccac

SEQ ID NO: 431308 - RNA, 23 nt, Homo sapiens
uuuacuuauuuaaaaaugcauga

SEQ ID NO: 431309 - RNA, 20 nt, Homo sapiens
uuuacuugaggaucauauga

SEQ ID NO: 431310 - RNA, 18 nt, Homo sapiens
uuuacuugaucauucuca

SEQ ID NO: 431311 - RNA, 17 nt, Homo sapiens
uuuacuuugugcaauau

SEQ ID NO: 431312 - RNA, 16 nt, Homo sapiens
uuuacuuuuaccacua

SEQ ID NO: 431313 - RNA, 20 nt, Homo sapiens
uuuacuuuuaccacuauuua

SEQ ID NO: 431314 - RNA, 23 nt, Homo sapiens
uuuagaaaaaaguuuacaacaua

SEQ ID NO: 431315 - RNA, 16 nt, Homo sapiens
uuuagaaauuacaagu

SEQ ID NO: 431316 - RNA, 17 nt, Homo sapiens
uuuagauuuuaaucaaa

SEQ ID NO: 431317 - RNA, 19 nt, Homo sapiens
uuuagcguagcuaagugaa

SEQ ID NO: 431318 - RNA, 13 nt, Homo sapiens
uuuagcguguaaa

SEQ ID NO: 431319 - RNA, 23 nt, Homo sapiens
uuuaggaaugcucaaugugcugu

SEQ ID NO: 431320 - RNA, 14 nt, Homo sapiens
uuuagugggugaga

SEQ ID NO: 431321 - RNA, 20 nt, Homo sapiens
uuuauaaaugagcaaaugga

SEQ ID NO: 431322 - RNA, 23 nt, Homo sapiens
uuuauagaacauauuuuccuuua

SEQ ID NO: 431323 - RNA, 13 nt, Homo sapiens
uuuauauacuggg

SEQ ID NO: 431324 - RNA, 13 nt, Homo sapiens
uuuauauaugaag

SEQ ID NO: 431325 - RNA, 14 nt, Homo sapiens
uuuaucaaaggaga

SEQ ID NO: 431326 - RNA, 11 nt, Homo sapiens
aaaaaaagaga

SEQ ID NO: 431327 - RNA, 16 nt, Homo sapiens
aaaaaacacaucuggc

SEQ ID NO: 431328 - RNA, 21 nt, Homo sapiens
aaaaaacauuuguacauuccu

SEQ ID NO: 431329 - RNA, 20 nt, Homo sapiens
aaaaaaucucuccccaaugc

SEQ ID NO: 431330 - RNA, 22 nt, Homo sapiens
aaaaaaugaucuauugcagaua

SEQ ID NO: 431331 - RNA, 19 nt, Homo sapiens
aaaaaaugcucacacucca

SEQ ID NO: 431332 - RNA, 13 nt, Homo sapiens
aaaaaauguucau

SEQ ID NO: 431333 - RNA, 20 nt, Homo sapiens
aaaaacaacugaccaguugu

SEQ ID NO: 431334 - RNA, 14 nt, Homo sapiens
aaaaacauacauua

SEQ ID NO: 431335 - RNA, 13 nt, Homo sapiens
aaaaacaugucau

SEQ ID NO: 431336 - RNA, 11 nt, Homo sapiens
aaaaacauuca

SEQ ID NO: 431337 - RNA, 13 nt, Homo sapiens
aaaaacauucuua

SEQ ID NO: 431338 - RNA, 12 nt, Homo sapiens
aaaaaccaauga

SEQ ID NO: 431339 - RNA, 22 nt, Homo sapiens
aaaaacccugcuaaaugacuua

SEQ ID NO: 431340 - RNA, 18 nt, Homo sapiens
aaaaacuaacacccaguc

SEQ ID NO: 431341 - RNA, 12 nt, Homo sapiens
aaaaacugcaca

SEQ ID NO: 431342 - RNA, 15 nt, Homo sapiens
aaaaaggacucugcu

SEQ ID NO: 431343 - RNA, 17 nt, Homo sapiens
aaaaaggacucugcuuc

SEQ ID NO: 431344 - RNA, 12 nt, Homo sapiens
aaaaaggccuuu

SEQ ID NO: 431345 - RNA, 16 nt, Homo sapiens
aaaaaguuaaacauug

SEQ ID NO: 431346 - RNA, 21 nt, Homo sapiens
aaaaauaaaacuuuucaugua

SEQ ID NO: 431347 - RNA, 19 nt, Homo sapiens
aaaaauaaaaugcauuuaa

SEQ ID NO: 431348 - RNA, 21 nt, Homo sapiens
aaaaauaaacucugcacuuau

SEQ ID NO: 431349 - RNA, 16 nt, Homo sapiens
aaaaauaaagcauuau

SEQ ID NO: 431350 - RNA, 20 nt, Homo sapiens
aaaaauaaccaaaaaaugug

SEQ ID NO: 431351 - RNA, 21 nt, Homo sapiens
aaaaauacuucugcaacucau

SEQ ID NO: 431352 - RNA, 11 nt, Homo sapiens
aaaaauacuuu

SEQ ID NO: 431353 - RNA, 19 nt, Homo sapiens
aaaaauauauuuaaugaua

SEQ ID NO: 431354 - RNA, 21 nt, Homo sapiens
aaaaauauguugaguguucau

SEQ ID NO: 431355 - RNA, 14 nt, Homo sapiens
aaaaaugugagcua

SEQ ID NO: 431356 - RNA, 16 nt, Homo sapiens
aaaaaugugucuguaa

SEQ ID NO: 431357 - RNA, 23 nt, Homo sapiens
aaaaauuugaaccaaaacauucc

SEQ ID NO: 431358 - RNA, 15 nt, Homo sapiens
aaaacaaaaccaagc

SEQ ID NO: 431359 - RNA, 14 nt, Homo sapiens
aaaacaacuuccuu

SEQ ID NO: 431360 - RNA, 20 nt, Homo sapiens
aaaacaaguuuagaaagcug

SEQ ID NO: 431361 - RNA, 18 nt, Homo sapiens
aaaacacaaaguguauaa

SEQ ID NO: 431362 - RNA, 14 nt, Homo sapiens
aaaacacauugccu

SEQ ID NO: 431363 - RNA, 19 nt, Homo sapiens
aaaacaccgcuucugccuu

SEQ ID NO: 431364 - RNA, 21 nt, Homo sapiens
aaaacacugcuguucuuuaaa

SEQ ID NO: 431365 - RNA, 18 nt, Homo sapiens
aaaacagaacauuucuca

SEQ ID NO: 431366 - RNA, 14 nt, Homo sapiens
aaaacagacccucc

SEQ ID NO: 431367 - RNA, 23 nt, Homo sapiens
aaaacauuagaagaaaacauaua

SEQ ID NO: 431368 - RNA, 14 nt, Homo sapiens
aaaacauuuguaca

SEQ ID NO: 431369 - RNA, 17 nt, Homo sapiens
aaaacauuuuaaaauca

SEQ ID NO: 431370 - RNA, 17 nt, Homo sapiens
aaaacccgaaucugaga

SEQ ID NO: 431371 - RNA, 18 nt, Homo sapiens
aaaacccgacaacauuuc

SEQ ID NO: 431372 - RNA, 12 nt, Homo sapiens
aaaaccuagcau

SEQ ID NO: 431373 - RNA, 18 nt, Homo sapiens
aaaacggcccucuugaag

SEQ ID NO: 431374 - RNA, 21 nt, Homo sapiens
aaaacucugguaaaugaucac

SEQ ID NO: 431375 - RNA, 18 nt, Homo sapiens
aaaacugcacagugcugu

SEQ ID NO: 431376 - RNA, 12 nt, Homo sapiens
aaaacugugaca

SEQ ID NO: 431377 - RNA, 20 nt, Homo sapiens
aaaacuuaccuauaaauuaa

SEQ ID NO: 431378 - RNA, 13 nt, Homo sapiens
aaaacuuaguuug

SEQ ID NO: 431379 - RNA, 21 nt, Homo sapiens
aaaacuucauucuaaaccaaa

SEQ ID NO: 431380 - RNA, 17 nt, Homo sapiens
aaaagaaacaauaugcu

SEQ ID NO: 431381 - RNA, 17 nt, Homo sapiens
aaaagaaagcugugaaa

SEQ ID NO: 431382 - RNA, 20 nt, Homo sapiens
acauuuaugaguaacuauua

SEQ ID NO: 431383 - RNA, 22 nt, Homo sapiens
acauuucuuaauugcaacuuuu

SEQ ID NO: 431384 - RNA, 14 nt, Homo sapiens
acauuugaugucua

SEQ ID NO: 431385 - RNA, 12 nt, Homo sapiens
acauuugccaaa

SEQ ID NO: 431386 - RNA, 19 nt, Homo sapiens
accaaaaugacaaugauga

SEQ ID NO: 431387 - RNA, 20 nt, Homo sapiens
accaaauacuuucugagaug

SEQ ID NO: 431388 - RNA, 12 nt, Homo sapiens
accaaauucuga

SEQ ID NO: 431389 - RNA, 18 nt, Homo sapiens
accaaauucugaauuugu

SEQ ID NO: 431390 - RNA, 20 nt, Homo sapiens
accaacccugcaggccucau

SEQ ID NO: 431391 - RNA, 19 nt, Homo sapiens
accaagaccccaaagggcc

SEQ ID NO: 431392 - RNA, 21 nt, Homo sapiens
accaaggccucggcagaacuc

SEQ ID NO: 431393 - RNA, 14 nt, Homo sapiens
accaaguacagccu

SEQ ID NO: 431394 - RNA, 14 nt, Homo sapiens
accaaucucuguga

SEQ ID NO: 431395 - RNA, 16 nt, Homo sapiens
accaaugcauuaccuu

SEQ ID NO: 431396 - RNA, 13 nt, Homo sapiens
accaauuccucau

SEQ ID NO: 431397 - RNA, 14 nt, Homo sapiens
accacaauauguau

SEQ ID NO: 431398 - RNA, 21 nt, Homo sapiens
accacacacacccuuccccac

SEQ ID NO: 431399 - RNA, 13 nt, Homo sapiens
accacacaccuca

SEQ ID NO: 431400 - RNA, 22 nt, Homo sapiens
accacacugaccacacuguauc

SEQ ID NO: 431401 - RNA, 14 nt, Homo sapiens
accacacuucuuga

SEQ ID NO: 431402 - RNA, 18 nt, Homo sapiens
accacagaagcuuguauu

SEQ ID NO: 431403 - RNA, 13 nt, Homo sapiens
accacagcugcug

SEQ ID NO: 431404 - RNA, 11 nt, Homo sapiens
accaccccagc

SEQ ID NO: 431405 - RNA, 15 nt, Homo sapiens
accacccugggaccc

SEQ ID NO: 431406 - RNA, 20 nt, Homo sapiens
accacgaggaaaagaacaaa

SEQ ID NO: 431407 - RNA, 21 nt, Homo sapiens
accacguccuuauuggaauaa

SEQ ID NO: 431408 - RNA, 16 nt, Homo sapiens
accacuguguauuuaa

SEQ ID NO: 431409 - RNA, 21 nt, Homo sapiens
accacuuaugcauagauauau

SEQ ID NO: 431410 - RNA, 11 nt, Homo sapiens
accacuuugaa

SEQ ID NO: 431411 - RNA, 20 nt, Homo sapiens
accacuuuuaauuguuacuc

SEQ ID NO: 431412 - RNA, 15 nt, Homo sapiens
accagaagccaaaga

SEQ ID NO: 431413 - RNA, 20 nt, Homo sapiens
accagacccuggcaucugac

SEQ ID NO: 431414 - RNA, 21 nt, Homo sapiens
accagaccuguucugaccuca

SEQ ID NO: 431415 - RNA, 15 nt, Homo sapiens
accagacugcacagg

SEQ ID NO: 431416 - RNA, 14 nt, Homo sapiens
accagagacucuga

SEQ ID NO: 431417 - RNA, 14 nt, Homo sapiens
accagagcaccuca

SEQ ID NO: 431418 - RNA, 13 nt, Homo sapiens
accagagcauuuc

SEQ ID NO: 431419 - RNA, 18 nt, Homo sapiens
accagaugcuacuggacu

SEQ ID NO: 431420 - RNA, 16 nt, Homo sapiens
accagcccugcugcuu

SEQ ID NO: 431421 - RNA, 18 nt, Homo sapiens
accagccuccuguuugca

SEQ ID NO: 431422 - RNA, 22 nt, Homo sapiens
accagccuggccaucaugguga

SEQ ID NO: 431423 - RNA, 16 nt, Homo sapiens
accagcuccacuggcc

SEQ ID NO: 431424 - RNA, 19 nt, Homo sapiens
accagcuuguuugugaaac

SEQ ID NO: 431425 - RNA, 22 nt, Homo sapiens
accaggaaccuccuccacacca

SEQ ID NO: 431426 - RNA, 17 nt, Homo sapiens
accaggagcuagcccag

SEQ ID NO: 431427 - RNA, 15 nt, Homo sapiens
accagggcucagcuc

SEQ ID NO: 431428 - RNA, 20 nt, Homo sapiens
accagguguuaaaaaccauu

SEQ ID NO: 431429 - RNA, 16 nt, Homo sapiens
accagguuaccucacu

SEQ ID NO: 431430 - RNA, 19 nt, Homo sapiens
accagugcaacagcacugg

SEQ ID NO: 431431 - RNA, 15 nt, Homo sapiens
accaguggggauuug

SEQ ID NO: 431432 - RNA, 15 nt, Homo sapiens
accaguguacugcuu

SEQ ID NO: 431433 - RNA, 17 nt, Homo sapiens
accagugugacaucuac

SEQ ID NO: 431434 - RNA, 18 nt, Homo sapiens
accagugugacaucuaca

SEQ ID NO: 431435 - RNA, 14 nt, Homo sapiens
accagugugcuugg

SEQ ID NO: 431436 - RNA, 15 nt, Homo sapiens
accaguuacuguuca

SEQ ID NO: 431437 - RNA, 23 nt, Homo sapiens
accaguuucuugaaguccagugu

SEQ ID NO: 431438 - RNA, 21 nt, Homo sapiens
accaguuugaaccaagaacuu

SEQ ID NO: 431439 - RNA, 22 nt, Homo sapiens
accauaaaauaaauaaucucau

SEQ ID NO: 431440 - RNA, 12 nt, Homo sapiens
accauaacacuu

SEQ ID NO: 431441 - RNA, 14 nt, Homo sapiens
accauacugaggga

SEQ ID NO: 431442 - RNA, 23 nt, Homo sapiens
accauagccuguuucguagccau

SEQ ID NO: 431443 - RNA, 16 nt, Homo sapiens
accaucaguuacuggu

SEQ ID NO: 431444 - RNA, 18 nt, Homo sapiens
accaucccaccucuggau

SEQ ID NO: 431445 - RNA, 12 nt, Homo sapiens
accaucucaggc

SEQ ID NO: 431446 - RNA, 19 nt, Homo sapiens
accaucuggaaggacaucu

SEQ ID NO: 431447 - RNA, 16 nt, Homo sapiens
accaucuuaaucuuua

SEQ ID NO: 431448 - RNA, 13 nt, Homo sapiens
accaucuuggcca

SEQ ID NO: 431449 - RNA, 22 nt, Homo sapiens
accaugagaccacuguuaucaa

SEQ ID NO: 431450 - RNA, 22 nt, Homo sapiens
accaugagcaccuccagcugua

SEQ ID NO: 431451 - RNA, 17 nt, Homo sapiens
accaugcccagcucaga

SEQ ID NO: 431452 - RNA, 18 nt, Homo sapiens
accaugugccaucuguac

SEQ ID NO: 431453 - RNA, 12 nt, Homo sapiens
accauuccacau

SEQ ID NO: 431454 - RNA, 21 nt, Homo sapiens
accauucuaccugaggccagg

SEQ ID NO: 431455 - RNA, 19 nt, Homo sapiens
accauugaccucagcugca

SEQ ID NO: 431456 - RNA, 17 nt, Homo sapiens
accauuuccccuguggu

SEQ ID NO: 431457 - RNA, 21 nt, Homo sapiens
accauuuugaaauauucacaa

SEQ ID NO: 431458 - RNA, 18 nt, Homo sapiens
acccaaggucaccaaaca

SEQ ID NO: 431459 - RNA, 14 nt, Homo sapiens
acccaaguccaggc

SEQ ID NO: 431460 - RNA, 19 nt, Homo sapiens
acccaccagggcucagcuc

SEQ ID NO: 431461 - RNA, 14 nt, Homo sapiens
acccacccagcacc

SEQ ID NO: 431462 - RNA, 18 nt, Homo sapiens
acccaccuggauucccug

SEQ ID NO: 431463 - RNA, 19 nt, Homo sapiens
acccagaaggcagagguug

SEQ ID NO: 431464 - RNA, 18 nt, Homo sapiens
acccagccucuagaacag

SEQ ID NO: 431465 - RNA, 14 nt, Homo sapiens
acccaggaagggaa

SEQ ID NO: 431466 - RNA, 12 nt, Homo sapiens
acccaggaugau

SEQ ID NO: 431467 - RNA, 15 nt, Homo sapiens
acccaggccacugac

SEQ ID NO: 431468 - RNA, 16 nt, Homo sapiens
acccagggcagugugg

SEQ ID NO: 431469 - RNA, 23 nt, Homo sapiens
acccaguucugaauaacuugaag

SEQ ID NO: 431470 - RNA, 14 nt, Homo sapiens
acccauauuacaga

SEQ ID NO: 431471 - RNA, 18 nt, Homo sapiens
acccaucgugguauguga

SEQ ID NO: 431472 - RNA, 20 nt, Homo sapiens
acccaugcccugccaagccu

SEQ ID NO: 431473 - RNA, 21 nt, Homo sapiens
acccauuuacuuguugaugac

SEQ ID NO: 431474 - RNA, 13 nt, Homo sapiens
accccaaacccca

SEQ ID NO: 431475 - RNA, 20 nt, Homo sapiens
accccaaggucagcucccau

SEQ ID NO: 431476 - RNA, 17 nt, Homo sapiens
accccacagacacuuac

SEQ ID NO: 431477 - RNA, 17 nt, Homo sapiens
accccaccuugccaagc

SEQ ID NO: 431478 - RNA, 23 nt, Homo sapiens
accccagagauucccaagccaaa

SEQ ID NO: 431479 - RNA, 13 nt, Homo sapiens
accccagcauucc

SEQ ID NO: 431480 - RNA, 22 nt, Homo sapiens
accccagccccaacuccagggg

SEQ ID NO: 431481 - RNA, 15 nt, Homo sapiens
accccaguaagccac

SEQ ID NO: 431482 - RNA, 20 nt, Homo sapiens
acccccuccuccagcaauag

SEQ ID NO: 431483 - RNA, 16 nt, Homo sapiens
acccccuccugucacc

SEQ ID NO: 431484 - RNA, 22 nt, Homo sapiens
accccgaccaccugcccaaccu

SEQ ID NO: 431485 - RNA, 18 nt, Homo sapiens
accccgggcaagacuuuu

SEQ ID NO: 431486 - RNA, 19 nt, Homo sapiens
accccgucugccccuugac

SEQ ID NO: 431487 - RNA, 12 nt, Homo sapiens
accccgugccac

SEQ ID NO: 431488 - RNA, 14 nt, Homo sapiens
accccugcuccuga

SEQ ID NO: 431489 - RNA, 14 nt, Homo sapiens
accccuuagccucc

SEQ ID NO: 431490 - RNA, 18 nt, Homo sapiens
accccuuagccucccuga

SEQ ID NO: 431491 - RNA, 22 nt, Homo sapiens
accccuuucuaguucaaugccu

SEQ ID NO: 431492 - RNA, 19 nt, Homo sapiens
acccgagcccagcuacauu

SEQ ID NO: 431493 - RNA, 15 nt, Homo sapiens
acccuaggucuccac

SEQ ID NO: 431494 - RNA, 17 nt, Homo sapiens
acccuaguuucccugaa

SEQ ID NO: 431495 - RNA, 16 nt, Homo sapiens
acccuauauguggcau

SEQ ID NO: 431496 - RNA, 22 nt, Homo sapiens
acccucagcuggcggaaccugg

SEQ ID NO: 431497 - RNA, 16 nt, Homo sapiens
acccucauuucugcca

SEQ ID NO: 431498 - RNA, 19 nt, Homo sapiens
acccucccccaccauucca

SEQ ID NO: 431499 - RNA, 21 nt, Homo sapiens
acccuccuguaaaauacuauu

SEQ ID NO: 431500 - RNA, 21 nt, Homo sapiens
acccucucauguuucccuacu

SEQ ID NO: 431501 - RNA, 17 nt, Homo sapiens
acccugaggguuuccac

SEQ ID NO: 431502 - RNA, 19 nt, Homo sapiens
acccugccuuaucuugcac

SEQ ID NO: 431503 - RNA, 16 nt, Homo sapiens
acccugggaucucagg

SEQ ID NO: 431504 - RNA, 23 nt, Homo sapiens
acccuggugaccagcaccaucuc

SEQ ID NO: 431505 - RNA, 20 nt, Homo sapiens
acccuguaccauccauggag

SEQ ID NO: 431506 - RNA, 11 nt, Homo sapiens
acccugugacc

SEQ ID NO: 431507 - RNA, 23 nt, Homo sapiens
acccugugacccucucacuuugg

SEQ ID NO: 431508 - RNA, 14 nt, Homo sapiens
acccuucucaggga

SEQ ID NO: 431509 - RNA, 19 nt, Homo sapiens
acccuucugucuguaagau

SEQ ID NO: 431510 - RNA, 16 nt, Homo sapiens
acccuuggacuugagg

SEQ ID NO: 431511 - RNA, 22 nt, Homo sapiens
acccuugugagagcccauuccc

SEQ ID NO: 431512 - RNA, 13 nt, Homo sapiens
acuucugcucugg

SEQ ID NO: 431513 - RNA, 15 nt, Homo sapiens
acuucuggcuccuca

SEQ ID NO: 431514 - RNA, 21 nt, Homo sapiens
acuucuuaacuggcaacaguu

SEQ ID NO: 431515 - RNA, 18 nt, Homo sapiens
acuucuuauacauuugau

SEQ ID NO: 431516 - RNA, 19 nt, Homo sapiens
acuucuuauacauuugaua

SEQ ID NO: 431517 - RNA, 18 nt, Homo sapiens
acuucuuugcaacaauaa

SEQ ID NO: 431518 - RNA, 19 nt, Homo sapiens
acuugaaagcauccaugug

SEQ ID NO: 431519 - RNA, 23 nt, Homo sapiens
acuugaaaguuuuccaguauuga

SEQ ID NO: 431520 - RNA, 14 nt, Homo sapiens
acuugaauuacaac

SEQ ID NO: 431521 - RNA, 24 nt, Homo sapiens
acuugacaagucaggagacacugu

SEQ ID NO: 431522 - RNA, 20 nt, Homo sapiens
acuugagaggaugaauguau

SEQ ID NO: 431523 - RNA, 12 nt, Homo sapiens
acuugagcaugu

SEQ ID NO: 431524 - RNA, 19 nt, Homo sapiens
acuugaggaucauaugaau

SEQ ID NO: 431525 - RNA, 20 nt, Homo sapiens
acuugaugaauaaacacuuu

SEQ ID NO: 431526 - RNA, 17 nt, Homo sapiens
acuugauguguuaucuc

SEQ ID NO: 431527 - RNA, 22 nt, Homo sapiens
acuugauuuuuuucauuuugcc

SEQ ID NO: 431528 - RNA, 16 nt, Homo sapiens
acuugcacccaugugu

SEQ ID NO: 431529 - RNA, 13 nt, Homo sapiens
acuugcacugugc

SEQ ID NO: 431530 - RNA, 11 nt, Homo sapiens
acuugcacuug

SEQ ID NO: 431531 - RNA, 20 nt, Homo sapiens
acuuggauugggagauuuca

SEQ ID NO: 431532 - RNA, 14 nt, Homo sapiens
acuugggagcaaaa

SEQ ID NO: 431533 - RNA, 23 nt, Homo sapiens
acuuggggauuaucugucauuca

SEQ ID NO: 431534 - RNA, 14 nt, Homo sapiens
acuugggugaaaag

SEQ ID NO: 431535 - RNA, 20 nt, Homo sapiens
acuuguaacuaaaguauuua

SEQ ID NO: 431536 - RNA, 19 nt, Homo sapiens
acuuguugaugacauuugg

SEQ ID NO: 431537 - RNA, 19 nt, Homo sapiens
acuuuaaauccuaccaaag

SEQ ID NO: 431538 - RNA, 20 nt, Homo sapiens
acuuuaaauccuaccaaagu

SEQ ID NO: 431539 - RNA, 15 nt, Homo sapiens
acuuuaaauggaaua

SEQ ID NO: 431540 - RNA, 13 nt, Homo sapiens
acuuuaagcacua

SEQ ID NO: 431541 - RNA, 22 nt, Homo sapiens
acuuuagguaguagaaucucag

SEQ ID NO: 431542 - RNA, 20 nt, Homo sapiens
acuuuagugauugcuuuuau

SEQ ID NO: 431543 - RNA, 17 nt, Homo sapiens
acuuuauuucugaucua

SEQ ID NO: 431544 - RNA, 22 nt, Homo sapiens
acuuuauuucugaucuauacaa

SEQ ID NO: 431545 - RNA, 15 nt, Homo sapiens
acuuuccaggcuagu

SEQ ID NO: 431546 - RNA, 19 nt, Homo sapiens
acuuucccuagaaagccau

SEQ ID NO: 431547 - RNA, 11 nt, Homo sapiens
acuuuccugca

SEQ ID NO: 431548 - RNA, 19 nt, Homo sapiens
acuuucucuucauacuuuu

SEQ ID NO: 431549 - RNA, 14 nt, Homo sapiens
acuuugaucucugc

SEQ ID NO: 431550 - RNA, 16 nt, Homo sapiens
acuuugaucucugcuu

SEQ ID NO: 431551 - RNA, 22 nt, Homo sapiens
acuuuggaauguacucuguuca

SEQ ID NO: 431552 - RNA, 17 nt, Homo sapiens
acuuugggauucuuucc

SEQ ID NO: 431553 - RNA, 18 nt, Homo sapiens
acuuuguccccucaccuc

SEQ ID NO: 431554 - RNA, 21 nt, Homo sapiens
acuuuucaagcugcugaagga

SEQ ID NO: 431555 - RNA, 12 nt, Homo sapiens
acuuuucacagu

SEQ ID NO: 431556 - RNA, 16 nt, Homo sapiens
acuuuucacaguaugg

SEQ ID NO: 431557 - RNA, 18 nt, Homo sapiens
acuuuucguuaacauuga

SEQ ID NO: 431558 - RNA, 20 nt, Homo sapiens
acuuuucuuucagccaagaa

SEQ ID NO: 431559 - RNA, 16 nt, Homo sapiens
acuuuuuagccaguga

SEQ ID NO: 431560 - RNA, 22 nt, Homo sapiens
acuuuuucagaguugcuuuaaa

SEQ ID NO: 431561 - RNA, 11 nt, Homo sapiens
acuuuuugccc

SEQ ID NO: 431562 - RNA, 19 nt, Homo sapiens
acuuuuuuccugucaauau

SEQ ID NO: 431563 - RNA, 15 nt, Homo sapiens
agaaaaaaguuuaca

SEQ ID NO: 431564 - RNA, 15 nt, Homo sapiens
agaaaaacaugucau

SEQ ID NO: 431565 - RNA, 16 nt, Homo sapiens
agaaaacaaucugccc

SEQ ID NO: 431566 - RNA, 23 nt, Homo sapiens
agaaaacucugguaaaugaucac

SEQ ID NO: 431567 - RNA, 12 nt, Homo sapiens
agaaaagacacu

SEQ ID NO: 431568 - RNA, 15 nt, Homo sapiens
agaaaagcacuggga

SEQ ID NO: 431569 - RNA, 22 nt, Homo sapiens
agaaaaggagcauccuuaccuc

SEQ ID NO: 431570 - RNA, 12 nt, Homo sapiens
agaaaauaaacc

SEQ ID NO: 431571 - RNA, 17 nt, Homo sapiens
agaaaauagagcuuuua

SEQ ID NO: 431572 - RNA, 19 nt, Homo sapiens
agaaaauaggguggacaga

SEQ ID NO: 431573 - RNA, 15 nt, Homo sapiens
agaaaaucacacuua

SEQ ID NO: 431574 - RNA, 18 nt, Homo sapiens
agaaaaucaucuuggcca

SEQ ID NO: 431575 - RNA, 19 nt, Homo sapiens
agaaaauccauucauucaa

SEQ ID NO: 431576 - RNA, 16 nt, Homo sapiens
agaaaaugagacaaaa

SEQ ID NO: 431577 - RNA, 16 nt, Homo sapiens
agaaaaugugccauuu

SEQ ID NO: 431578 - RNA, 16 nt, Homo sapiens
agaaaauuaugcagcu

SEQ ID NO: 431579 - RNA, 14 nt, Homo sapiens
agaaacaauaugcu

SEQ ID NO: 431580 - RNA, 11 nt, Homo sapiens
agaaacacagg

SEQ ID NO: 431581 - RNA, 19 nt, Homo sapiens
agaaacaccacuuaaucuu

SEQ ID NO: 431582 - RNA, 19 nt, Homo sapiens
agaaacacucuuauuccca

SEQ ID NO: 431583 - RNA, 18 nt, Homo sapiens
agaaacagagcaguacca

SEQ ID NO: 431584 - RNA, 20 nt, Homo sapiens
agaaacagauaacaccaaac

SEQ ID NO: 431585 - RNA, 22 nt, Homo sapiens
agaaacagugggagcccugacc

SEQ ID NO: 431586 - RNA, 15 nt, Homo sapiens
agaaaccuaaaauaa

SEQ ID NO: 431587 - RNA, 13 nt, Homo sapiens
agaaaccucggga

SEQ ID NO: 431588 - RNA, 20 nt, Homo sapiens
agaaacgagauuugccaaaa

SEQ ID NO: 431589 - RNA, 12 nt, Homo sapiens
agaaacugaguc

SEQ ID NO: 431590 - RNA, 17 nt, Homo sapiens
agaaagaacgugaucuc

SEQ ID NO: 431591 - RNA, 17 nt, Homo sapiens
agaaagaagcacucugc

SEQ ID NO: 431592 - RNA, 12 nt, Homo sapiens
agaaagaaggcu

SEQ ID NO: 431593 - RNA, 17 nt, Homo sapiens
agaaagagagaaccaag

SEQ ID NO: 431594 - RNA, 14 nt, Homo sapiens
agaaagauacuaau

SEQ ID NO: 431595 - RNA, 16 nt, Homo sapiens
agaaagauucaauuaa

SEQ ID NO: 431596 - RNA, 22 nt, Homo sapiens
agaaagcaggagcagcugugcu

SEQ ID NO: 431597 - RNA, 14 nt, Homo sapiens
agaaagccauauuc

SEQ ID NO: 431598 - RNA, 21 nt, Homo sapiens
agaaagccccucaccucagga

SEQ ID NO: 431599 - RNA, 16 nt, Homo sapiens
agaaaggcucauaccu

SEQ ID NO: 431600 - RNA, 16 nt, Homo sapiens
agaaaguaauacaaua

SEQ ID NO: 431601 - RNA, 22 nt, Homo sapiens
agaaaguuuccccaccagugaa

SEQ ID NO: 431602 - RNA, 23 nt, Homo sapiens
agaaaguuuccccaccagugaau

SEQ ID NO: 431603 - RNA, 17 nt, Homo sapiens
agaaauaaagcaucuca

SEQ ID NO: 431604 - RNA, 13 nt, Homo sapiens
agaaauacuugug

SEQ ID NO: 431605 - RNA, 17 nt, Homo sapiens
agaaauacuuucaggca

SEQ ID NO: 431606 - RNA, 23 nt, Homo sapiens
agaaaucccaguucauguugcuc

SEQ ID NO: 431607 - RNA, 13 nt, Homo sapiens
agaaauccuagug

SEQ ID NO: 431608 - RNA, 22 nt, Homo sapiens
agaaaucuuguuggcaaaucag

SEQ ID NO: 431609 - RNA, 20 nt, Homo sapiens
agaaaugcauaccaguaauu

SEQ ID NO: 431610 - RNA, 23 nt, Homo sapiens
agaaauggcuuuccacaucccca

SEQ ID NO: 431611 - RNA, 14 nt, Homo sapiens
agaaauucuguggu

SEQ ID NO: 431612 - RNA, 14 nt, Homo sapiens
agaacaaaaccucu

SEQ ID NO: 431613 - RNA, 18 nt, Homo sapiens
agaacacuagacaugcca

SEQ ID NO: 431614 - RNA, 13 nt, Homo sapiens
agaacagccagac

SEQ ID NO: 431615 - RNA, 17 nt, Homo sapiens
agaacaguccauugaaa

SEQ ID NO: 431616 - RNA, 20 nt, Homo sapiens
agaacagucccucacaccug

SEQ ID NO: 431617 - RNA, 19 nt, Homo sapiens
agaacaugaccuccgugua

SEQ ID NO: 431618 - RNA, 17 nt, Homo sapiens
agaacaugagugcugau

SEQ ID NO: 431619 - RNA, 23 nt, Homo sapiens
agaaccaaaaagaggcuauguga

SEQ ID NO: 431620 - RNA, 20 nt, Homo sapiens
agaacccagaugaucucuua

SEQ ID NO: 431621 - RNA, 16 nt, Homo sapiens
agaacccuagcacaaa

SEQ ID NO: 431622 - RNA, 16 nt, Homo sapiens
agaaccgagcaaagau

SEQ ID NO: 431623 - RNA, 18 nt, Homo sapiens
agaaccgagcaaagauca

SEQ ID NO: 431624 - RNA, 13 nt, Homo sapiens
agaaccucuccau

SEQ ID NO: 431625 - RNA, 16 nt, Homo sapiens
agaacgaagccaccuu

SEQ ID NO: 431626 - RNA, 13 nt, Homo sapiens
agaacgucucuca

SEQ ID NO: 431627 - RNA, 21 nt, Homo sapiens
agaacuagugguggcucugag

SEQ ID NO: 431628 - RNA, 23 nt, Homo sapiens
agaacucucugucuucucuccac

SEQ ID NO: 431629 - RNA, 13 nt, Homo sapiens
agaacugagcucc

SEQ ID NO: 431630 - RNA, 18 nt, Homo sapiens
agaacugccccaucuccu

SEQ ID NO: 431631 - RNA, 18 nt, Homo sapiens
agaacugcuuaguauuag

SEQ ID NO: 431632 - RNA, 22 nt, Homo sapiens
agaacuggucuuccauuuugcc

SEQ ID NO: 431633 - RNA, 13 nt, Homo sapiens
agaacuguucuca

SEQ ID NO: 431634 - RNA, 14 nt, Homo sapiens
agaacuugaccccc

SEQ ID NO: 431635 - RNA, 16 nt, Homo sapiens
agaacuugauuugcau

SEQ ID NO: 431636 - RNA, 18 nt, Homo sapiens
agaagaaaagcacuggga

SEQ ID NO: 431637 - RNA, 18 nt, Homo sapiens
agaagaaauuauuuaaua

SEQ ID NO: 431638 - RNA, 14 nt, Homo sapiens
agaagacacguguu

SEQ ID NO: 431639 - RNA, 18 nt, Homo sapiens
agaagaccacaccaagga

SEQ ID NO: 431640 - RNA, 18 nt, Homo sapiens
agaagacucgucuuggca

SEQ ID NO: 431641 - RNA, 13 nt, Homo sapiens
agaagacuggaag

SEQ ID NO: 431642 - RNA, 13 nt, Homo sapiens
agcuaccagcuau

SEQ ID NO: 431643 - RNA, 13 nt, Homo sapiens
agcuaccaggugu

SEQ ID NO: 431644 - RNA, 13 nt, Homo sapiens
agcuacccugaaa

SEQ ID NO: 431645 - RNA, 19 nt, Homo sapiens
agcuagaggacuucuggca

SEQ ID NO: 431646 - RNA, 19 nt, Homo sapiens
agcuagaugugucuuacca

SEQ ID NO: 431647 - RNA, 17 nt, Homo sapiens
agcuaguggcuucaaaa

SEQ ID NO: 431648 - RNA, 20 nt, Homo sapiens
agcuaugaagaaaacacaaa

SEQ ID NO: 431649 - RNA, 20 nt, Homo sapiens
agcuaugcaaaucagucuca

SEQ ID NO: 431650 - RNA, 14 nt, Homo sapiens
agcuauuuccauuc

SEQ ID NO: 431651 - RNA, 17 nt, Homo sapiens
agcucacaccugaccaa

SEQ ID NO: 431652 - RNA, 14 nt, Homo sapiens
agcucacaguacaa

SEQ ID NO: 431653 - RNA, 19 nt, Homo sapiens
agcucagaaacgaaaucua

SEQ ID NO: 431654 - RNA, 20 nt, Homo sapiens
agcucagaggagucugggaa

SEQ ID NO: 431655 - RNA, 14 nt, Homo sapiens
agcucaggaucucu

SEQ ID NO: 431656 - RNA, 17 nt, Homo sapiens
agcucaggcgcagcccu

SEQ ID NO: 431657 - RNA, 11 nt, Homo sapiens
agcucaugccc

SEQ ID NO: 431658 - RNA, 22 nt, Homo sapiens
agcuccaagagguuuuucagcu

SEQ ID NO: 431659 - RNA, 12 nt, Homo sapiens
agcuccacagaa

SEQ ID NO: 431660 - RNA, 13 nt, Homo sapiens
agcuccacagugu

SEQ ID NO: 431661 - RNA, 16 nt, Homo sapiens
agcuccauaauugcaa

SEQ ID NO: 431662 - RNA, 23 nt, Homo sapiens
agcuccccccaagaugagcugca

SEQ ID NO: 431663 - RNA, 18 nt, Homo sapiens
agcucccgagcuacucuc

SEQ ID NO: 431664 - RNA, 13 nt, Homo sapiens
agcuccuacaugg

SEQ ID NO: 431665 - RNA, 16 nt, Homo sapiens
agcucgcauuugucaa

SEQ ID NO: 431666 - RNA, 23 nt, Homo sapiens
agcucggaacuuacuguguaaau

SEQ ID NO: 431667 - RNA, 19 nt, Homo sapiens
agcucuacgugcuccucag

SEQ ID NO: 431668 - RNA, 14 nt, Homo sapiens
agcucuaucugcaa

SEQ ID NO: 431669 - RNA, 15 nt, Homo sapiens
agcucucacaugcac

SEQ ID NO: 431670 - RNA, 17 nt, Homo sapiens
agcucucaguugcagcc

SEQ ID NO: 431671 - RNA, 16 nt, Homo sapiens
agcucucaucuaguuu

SEQ ID NO: 431672 - RNA, 19 nt, Homo sapiens
agcucuccccaaacuugcu

SEQ ID NO: 431673 - RNA, 12 nt, Homo sapiens
agcucucugcaa

SEQ ID NO: 431674 - RNA, 21 nt, Homo sapiens
agcucucugcaaagaugauuu

SEQ ID NO: 431675 - RNA, 14 nt, Homo sapiens
agcucugcuugccg

SEQ ID NO: 431676 - RNA, 17 nt, Homo sapiens
agcucugugggagacca

SEQ ID NO: 431677 - RNA, 15 nt, Homo sapiens
agcucuguguugcca

SEQ ID NO: 431678 - RNA, 21 nt, Homo sapiens
agcucuucaggccucccucuc

SEQ ID NO: 431679 - RNA, 14 nt, Homo sapiens
agcucuuguugcuu

SEQ ID NO: 431680 - RNA, 21 nt, Homo sapiens
agcucuuugucucaccagcuc

SEQ ID NO: 431681 - RNA, 13 nt, Homo sapiens
agcugaaagggag

SEQ ID NO: 431682 - RNA, 22 nt, Homo sapiens
agcugaagaaaaugaagcccua

SEQ ID NO: 431683 - RNA, 15 nt, Homo sapiens
agcugagagacuuuu

SEQ ID NO: 431684 - RNA, 14 nt, Homo sapiens
agcugagccaguca

SEQ ID NO: 431685 - RNA, 14 nt, Homo sapiens
agcugagugucugu

SEQ ID NO: 431686 - RNA, 14 nt, Homo sapiens
agcugcacauuccu

SEQ ID NO: 431687 - RNA, 15 nt, Homo sapiens
agcugcacauuccug

SEQ ID NO: 431688 - RNA, 15 nt, Homo sapiens
agcugcagugucugu

SEQ ID NO: 431689 - RNA, 23 nt, Homo sapiens
agcugcaguuuccucaucuguca

SEQ ID NO: 431690 - RNA, 18 nt, Homo sapiens
agcugccaaaaagaacac

SEQ ID NO: 431691 - RNA, 14 nt, Homo sapiens
agcugcucuugcau

SEQ ID NO: 431692 - RNA, 20 nt, Homo sapiens
agcugcugucaggucugaua

SEQ ID NO: 431693 - RNA, 14 nt, Homo sapiens
agcugcuguccagg

SEQ ID NO: 431694 - RNA, 23 nt, Homo sapiens
agcugcugugccaggacugugac

SEQ ID NO: 431695 - RNA, 18 nt, Homo sapiens
agcugcuguuuuuagacu

SEQ ID NO: 431696 - RNA, 14 nt, Homo sapiens
agcuggaaaaccuc

SEQ ID NO: 431697 - RNA, 23 nt, Homo sapiens
agcuggaagggucaacaucuuuu

SEQ ID NO: 431698 - RNA, 19 nt, Homo sapiens
agcuggacaugcuuuggca

SEQ ID NO: 431699 - RNA, 18 nt, Homo sapiens
agcuggaccaguggugcc

SEQ ID NO: 431700 - RNA, 23 nt, Homo sapiens
agcuggcaggagagagccuuggc

SEQ ID NO: 431701 - RNA, 14 nt, Homo sapiens
agcuggcgucuguc

SEQ ID NO: 431702 - RNA, 23 nt, Homo sapiens
agcuggcucuccaccuuguuaca

SEQ ID NO: 431703 - RNA, 20 nt, Homo sapiens
agcugggagaaccaaaaaga

SEQ ID NO: 431704 - RNA, 17 nt, Homo sapiens
agcugggcaaagccaca

SEQ ID NO: 431705 - RNA, 15 nt, Homo sapiens
agcuggggacagcuu

SEQ ID NO: 431706 - RNA, 16 nt, Homo sapiens
agcuggggacagcuuu

SEQ ID NO: 431707 - RNA, 16 nt, Homo sapiens
agcuggggauguuuag

SEQ ID NO: 431708 - RNA, 21 nt, Homo sapiens
agcuggggauguuuaguaaua

SEQ ID NO: 431709 - RNA, 14 nt, Homo sapiens
agcugguaaacuau

SEQ ID NO: 431710 - RNA, 16 nt, Homo sapiens
agcugguggcaauaaa

SEQ ID NO: 431711 - RNA, 20 nt, Homo sapiens
agcuguaaaaagagagaaaa

SEQ ID NO: 431712 - RNA, 21 nt, Homo sapiens
agcuguaaccgauaugcacuu

SEQ ID NO: 431713 - RNA, 23 nt, Homo sapiens
agcuguacccuugagaccuggaa

SEQ ID NO: 431714 - RNA, 17 nt, Homo sapiens
agcuguagccauggcuc

SEQ ID NO: 431715 - RNA, 22 nt, Homo sapiens
agcuguagcucccgagcuacuc

SEQ ID NO: 431716 - RNA, 13 nt, Homo sapiens
agcugucaggcag

SEQ ID NO: 431717 - RNA, 15 nt, Homo sapiens
agcugucaggcagua

SEQ ID NO: 431718 - RNA, 18 nt, Homo sapiens
agcugucucaaaccucca

SEQ ID NO: 431719 - RNA, 11 nt, Homo sapiens
agcugugcugc

SEQ ID NO: 431720 - RNA, 12 nt, Homo sapiens
agcuguggugag

SEQ ID NO: 431721 - RNA, 17 nt, Homo sapiens
agcuguguucacacugu

SEQ ID NO: 431722 - RNA, 16 nt, Homo sapiens
agcuguuuucccugac

SEQ ID NO: 431723 - RNA, 22 nt, Homo sapiens
agcuuaaaauaaacaguuguga

SEQ ID NO: 431724 - RNA, 14 nt, Homo sapiens
agcuuaaauugcuu

SEQ ID NO: 431725 - RNA, 20 nt, Homo sapiens
agcuuacaagccagcuggag

SEQ ID NO: 431726 - RNA, 13 nt, Homo sapiens
agcuuacugauua

SEQ ID NO: 431727 - RNA, 17 nt, Homo sapiens
agcuuagcugucucaga

SEQ ID NO: 431728 - RNA, 13 nt, Homo sapiens
agcuucaaaacag

SEQ ID NO: 431729 - RNA, 20 nt, Homo sapiens
agcuucaccagagcauuucc

SEQ ID NO: 431730 - RNA, 21 nt, Homo sapiens
agcuucagaaguuuggcaaua

SEQ ID NO: 431731 - RNA, 17 nt, Homo sapiens
agcuucauccacugaau

SEQ ID NO: 431732 - RNA, 12 nt, Homo sapiens
agcuucaugccu

SEQ ID NO: 431733 - RNA, 15 nt, Homo sapiens
agcuucaugccuuug

SEQ ID NO: 431734 - RNA, 17 nt, Homo sapiens
agcuuccuucugugaaa

SEQ ID NO: 431735 - RNA, 17 nt, Homo sapiens
agcuucucuccacugaa

SEQ ID NO: 431736 - RNA, 22 nt, Homo sapiens
agcuucuuaauauaacugccuu

SEQ ID NO: 431737 - RNA, 11 nt, Homo sapiens
agcuucuugcu

SEQ ID NO: 431738 - RNA, 15 nt, Homo sapiens
agcuugaaacauaga

SEQ ID NO: 431739 - RNA, 17 nt, Homo sapiens
agcuugacuucaugcca

SEQ ID NO: 431740 - RNA, 15 nt, Homo sapiens
agcuugguuccugcc

SEQ ID NO: 431741 - RNA, 13 nt, Homo sapiens
agcuuguaauugc

SEQ ID NO: 431742 - RNA, 18 nt, Homo sapiens
agcuuguucacacuuugc

SEQ ID NO: 431743 - RNA, 22 nt, Homo sapiens
agcuuucagagccagugaagga

SEQ ID NO: 431744 - RNA, 23 nt, Homo sapiens
agcuuucaggaaguugcugagaa

SEQ ID NO: 431745 - RNA, 22 nt, Homo sapiens
agcuuucccuggcucagggauc

SEQ ID NO: 431746 - RNA, 13 nt, Homo sapiens
agcuuucucaggg

SEQ ID NO: 431747 - RNA, 15 nt, Homo sapiens
agcuuucucuaguuc

SEQ ID NO: 431748 - RNA, 17 nt, Homo sapiens
agcuuucucuaguucaa

SEQ ID NO: 431749 - RNA, 17 nt, Homo sapiens
agcuuucugauacuuau

SEQ ID NO: 431750 - RNA, 20 nt, Homo sapiens
agcuuugaugauaaacacug

SEQ ID NO: 431751 - RNA, 19 nt, Homo sapiens
agcuuuggacacacacagc

SEQ ID NO: 431752 - RNA, 20 nt, Homo sapiens
agcuuuggacgcacacagcu

SEQ ID NO: 431753 - RNA, 13 nt, Homo sapiens
agcuuuucuugcc

SEQ ID NO: 431754 - RNA, 20 nt, Homo sapiens
agcuuuugaggggcugacuu

SEQ ID NO: 431755 - RNA, 22 nt, Homo sapiens
agcuuuuuaccguucacuuccc

SEQ ID NO: 431756 - RNA, 13 nt, Homo sapiens
agcuuuuuuacac

SEQ ID NO: 431757 - RNA, 20 nt, Homo sapiens
aggaaaacucaccauuucau

SEQ ID NO: 431758 - RNA, 15 nt, Homo sapiens
aggaaaagcuguucc

SEQ ID NO: 431759 - RNA, 20 nt, Homo sapiens
aggaaaaguuauugugauaa

SEQ ID NO: 431760 - RNA, 16 nt, Homo sapiens
aggaaacucaccugcu

SEQ ID NO: 431761 - RNA, 22 nt, Homo sapiens
aggaaacuguuguguccaaucc

SEQ ID NO: 431762 - RNA, 13 nt, Homo sapiens
aggaaagauccca

SEQ ID NO: 431763 - RNA, 18 nt, Homo sapiens
aggaaagcaccgcagcau

SEQ ID NO: 431764 - RNA, 20 nt, Homo sapiens
aggaacaaagacaaccacug

SEQ ID NO: 431765 - RNA, 23 nt, Homo sapiens
aggaacaaagacaaccacuggga

SEQ ID NO: 431766 - RNA, 22 nt, Homo sapiens
aggaacagacucgaugcaagug

SEQ ID NO: 431767 - RNA, 15 nt, Homo sapiens
aggaacuuuccagca

SEQ ID NO: 431768 - RNA, 12 nt, Homo sapiens
aggaagaaggcc

SEQ ID NO: 431769 - RNA, 23 nt, Homo sapiens
aggaagaagucuaagagugaagu

SEQ ID NO: 431770 - RNA, 22 nt, Homo sapiens
aggaagaucacuuugcucugau

SEQ ID NO: 431771 - RNA, 15 nt, Homo sapiens
aggaagcacaggcca

SEQ ID NO: 431772 - RNA, 14 nt, Homo sapiens
agugcauguggaaa

SEQ ID NO: 431773 - RNA, 13 nt, Homo sapiens
agugccagguggc

SEQ ID NO: 431774 - RNA, 13 nt, Homo sapiens
agugcccagugau

SEQ ID NO: 431775 - RNA, 14 nt, Homo sapiens
agugcccagugaug

SEQ ID NO: 431776 - RNA, 22 nt, Homo sapiens
agugccuuccgugggucauccc

SEQ ID NO: 431777 - RNA, 18 nt, Homo sapiens
agugccuugagcugccug

SEQ ID NO: 431778 - RNA, 20 nt, Homo sapiens
agugcucccuuccuccucaa

SEQ ID NO: 431779 - RNA, 15 nt, Homo sapiens
agugcugaacagugg

SEQ ID NO: 431780 - RNA, 13 nt, Homo sapiens
agugcuucuugua

SEQ ID NO: 431781 - RNA, 18 nt, Homo sapiens
agugcuucuuguaauauu

SEQ ID NO: 431782 - RNA, 13 nt, Homo sapiens
aguggaaacaaag

SEQ ID NO: 431783 - RNA, 13 nt, Homo sapiens
aguggagccugaa

SEQ ID NO: 431784 - RNA, 17 nt, Homo sapiens
aguggaguuuucuguga

SEQ ID NO: 431785 - RNA, 20 nt, Homo sapiens
aguggaguuuucugugagaa

SEQ ID NO: 431786 - RNA, 15 nt, Homo sapiens
aguggauuggcuuug

SEQ ID NO: 431787 - RNA, 21 nt, Homo sapiens
aguggauuggcuuugugcuug

SEQ ID NO: 431788 - RNA, 23 nt, Homo sapiens
aguggcauggcuccagucugcug

SEQ ID NO: 431789 - RNA, 15 nt, Homo sapiens
aguggcgugaucucg

SEQ ID NO: 431790 - RNA, 14 nt, Homo sapiens
aguggcugccaugg

SEQ ID NO: 431791 - RNA, 15 nt, Homo sapiens
agugggcagugcaug

SEQ ID NO: 431792 - RNA, 16 nt, Homo sapiens
agugggcagugcaugu

SEQ ID NO: 431793 - RNA, 18 nt, Homo sapiens
aguggggagacaccucag

SEQ ID NO: 431794 - RNA, 13 nt, Homo sapiens
aguggggauuugu

SEQ ID NO: 431795 - RNA, 15 nt, Homo sapiens
agugguacauuccau

SEQ ID NO: 431796 - RNA, 19 nt, Homo sapiens
agugguauagaguacugca

SEQ ID NO: 431797 - RNA, 16 nt, Homo sapiens
aguggugagacuguau

SEQ ID NO: 431798 - RNA, 19 nt, Homo sapiens
agugguggcagcucaaaau

SEQ ID NO: 431799 - RNA, 20 nt, Homo sapiens
aguggugugaucucggcuca

SEQ ID NO: 431800 - RNA, 21 nt, Homo sapiens
agugguguguguuaucagaua

SEQ ID NO: 431801 - RNA, 20 nt, Homo sapiens
agugguguuuagaaugucag

SEQ ID NO: 431802 - RNA, 14 nt, Homo sapiens
agugguuugugcua

SEQ ID NO: 431803 - RNA, 18 nt, Homo sapiens
aguguaccugccauaaca

SEQ ID NO: 431804 - RNA, 21 nt, Homo sapiens
aguguaugcacgugugcacac

SEQ ID NO: 431805 - RNA, 16 nt, Homo sapiens
aguguauuuucuguca

SEQ ID NO: 431806 - RNA, 23 nt, Homo sapiens
agugucugucagcuucauucucu

SEQ ID NO: 431807 - RNA, 16 nt, Homo sapiens
agugucugugugcaag

SEQ ID NO: 431808 - RNA, 13 nt, Homo sapiens
agugucuuagcag

SEQ ID NO: 431809 - RNA, 13 nt, Homo sapiens
agugugaguguga

SEQ ID NO: 431810 - RNA, 16 nt, Homo sapiens
agugugauugugaacu

SEQ ID NO: 431811 - RNA, 19 nt, Homo sapiens
agugugccccucuguaaca

SEQ ID NO: 431812 - RNA, 20 nt, Homo sapiens
agugugccugucacuacugg

SEQ ID NO: 431813 - RNA, 16 nt, Homo sapiens
agugugcucggacaca

SEQ ID NO: 431814 - RNA, 23 nt, Homo sapiens
aguguggggcgggggucuauaca

SEQ ID NO: 431815 - RNA, 14 nt, Homo sapiens
aguguguaugugcg

SEQ ID NO: 431816 - RNA, 20 nt, Homo sapiens
agugugugcaaguaugugag

SEQ ID NO: 431817 - RNA, 13 nt, Homo sapiens
agugugugcacau

SEQ ID NO: 431818 - RNA, 14 nt, Homo sapiens
agugugugucuuuc

SEQ ID NO: 431819 - RNA, 14 nt, Homo sapiens
agugugugugcaau

SEQ ID NO: 431820 - RNA, 15 nt, Homo sapiens
aguguguugacuucu

SEQ ID NO: 431821 - RNA, 21 nt, Homo sapiens
aguguugaucagaucuuacaa

SEQ ID NO: 431822 - RNA, 23 nt, Homo sapiens
aguguugcccaggcuggucucaa

SEQ ID NO: 431823 - RNA, 22 nt, Homo sapiens
aguguuuacaaggugacaaaug

SEQ ID NO: 431824 - RNA, 14 nt, Homo sapiens
aguguuucuguucu

SEQ ID NO: 431825 - RNA, 19 nt, Homo sapiens
aguuaaacauugaaguaau

SEQ ID NO: 431826 - RNA, 18 nt, Homo sapiens
aguuaaagagacaaauag

SEQ ID NO: 431827 - RNA, 13 nt, Homo sapiens
aguuaaaguauau

SEQ ID NO: 431828 - RNA, 20 nt, Homo sapiens
aguuaaagugaauaaccacu

SEQ ID NO: 431829 - RNA, 23 nt, Homo sapiens
aguuaaagugaauaaccacuuaa

SEQ ID NO: 431830 - RNA, 19 nt, Homo sapiens
aguuaaaucccccaccucc

SEQ ID NO: 431831 - RNA, 20 nt, Homo sapiens
aguuaaugaaggugugcuac

SEQ ID NO: 431832 - RNA, 19 nt, Homo sapiens
aguuaauuaugugcauauu

SEQ ID NO: 431833 - RNA, 14 nt, Homo sapiens
aguuaauucuugcc

SEQ ID NO: 431834 - RNA, 17 nt, Homo sapiens
aguuaccuuucuagguc

SEQ ID NO: 431835 - RNA, 13 nt, Homo sapiens
aguuaggggagag

SEQ ID NO: 431836 - RNA, 19 nt, Homo sapiens
aguuagguuaauaaaucaa

SEQ ID NO: 431837 - RNA, 20 nt, Homo sapiens
aguuauuuacuuuuaccacu

SEQ ID NO: 431838 - RNA, 16 nt, Homo sapiens
aguuauuuuaauaccu

SEQ ID NO: 431839 - RNA, 19 nt, Homo sapiens
aguuauuuuaauaccuuua

SEQ ID NO: 431840 - RNA, 14 nt, Homo sapiens
aguuauuuucagac

SEQ ID NO: 431841 - RNA, 21 nt, Homo sapiens
aguucaaaaaacucuugauau

SEQ ID NO: 431842 - RNA, 17 nt, Homo sapiens
aguucacacccugcaag

SEQ ID NO: 431843 - RNA, 17 nt, Homo sapiens
aguucagcuccuuccac

SEQ ID NO: 431844 - RNA, 19 nt, Homo sapiens
aguucagcuccuuccacca

SEQ ID NO: 431845 - RNA, 14 nt, Homo sapiens
aguucaucucugcu

SEQ ID NO: 431846 - RNA, 17 nt, Homo sapiens
aguucccggagcacagc

SEQ ID NO: 431847 - RNA, 16 nt, Homo sapiens
aguucccucaguguga

SEQ ID NO: 431848 - RNA, 18 nt, Homo sapiens
aguucuauuucuaucugc

SEQ ID NO: 431849 - RNA, 13 nt, Homo sapiens
aguucucacuguu

SEQ ID NO: 431850 - RNA, 12 nt, Homo sapiens
aguucucagggg

SEQ ID NO: 431851 - RNA, 17 nt, Homo sapiens
aguucucauccacagag

SEQ ID NO: 431852 - RNA, 11 nt, Homo sapiens
aguucugauga

SEQ ID NO: 431853 - RNA, 12 nt, Homo sapiens
aguucugaugag

SEQ ID NO: 431854 - RNA, 20 nt, Homo sapiens
aguucuucaucccacuccaa

SEQ ID NO: 431855 - RNA, 15 nt, Homo sapiens
aguucuugaacaguu

SEQ ID NO: 431856 - RNA, 16 nt, Homo sapiens
aguugaacagaacugc

SEQ ID NO: 431857 - RNA, 16 nt, Homo sapiens
aguugaccguuuucau

SEQ ID NO: 431858 - RNA, 13 nt, Homo sapiens
aguugagaacaaa

SEQ ID NO: 431859 - RNA, 23 nt, Homo sapiens
aguugagcacaggcaacauuaca

SEQ ID NO: 431860 - RNA, 16 nt, Homo sapiens
aguugauuacuuuuca

SEQ ID NO: 431861 - RNA, 16 nt, Homo sapiens
aguugcacauuaggaa

SEQ ID NO: 431862 - RNA, 20 nt, Homo sapiens
aguugccguggcaacugugg

SEQ ID NO: 431863 - RNA, 12 nt, Homo sapiens
aguugcuccuac

SEQ ID NO: 431864 - RNA, 17 nt, Homo sapiens
aguugcugaugaacucu

SEQ ID NO: 431865 - RNA, 16 nt, Homo sapiens
aguugcuucucaugga

SEQ ID NO: 431866 - RNA, 14 nt, Homo sapiens
aguuggacagcaaa

SEQ ID NO: 431867 - RNA, 17 nt, Homo sapiens
aguuggcaaaauggggu

SEQ ID NO: 431868 - RNA, 15 nt, Homo sapiens
aguugggaguacaua

SEQ ID NO: 431869 - RNA, 12 nt, Homo sapiens
aguuggugcugc

SEQ ID NO: 431870 - RNA, 14 nt, Homo sapiens
aguuguaccacugc

SEQ ID NO: 431871 - RNA, 22 nt, Homo sapiens
aguuguauaguuuuacacucua

SEQ ID NO: 431872 - RNA, 16 nt, Homo sapiens
aguuuacaaucagcca

SEQ ID NO: 431873 - RNA, 14 nt, Homo sapiens
aguuuagauuuuaa

SEQ ID NO: 431874 - RNA, 14 nt, Homo sapiens
aguuuaugauuuaa

SEQ ID NO: 431875 - RNA, 19 nt, Homo sapiens
aguuuaugcagugcugcuu

SEQ ID NO: 431876 - RNA, 14 nt, Homo sapiens
aguuucacugccaa

SEQ ID NO: 431877 - RNA, 14 nt, Homo sapiens
aguuucaucaguca

SEQ ID NO: 431878 - RNA, 21 nt, Homo sapiens
aguuuccaaguuuauugcccu

SEQ ID NO: 431879 - RNA, 17 nt, Homo sapiens
aguuuccauauguuaua

SEQ ID NO: 431880 - RNA, 13 nt, Homo sapiens
aguuuccaugugg

SEQ ID NO: 431881 - RNA, 17 nt, Homo sapiens
aguuuccucaggcugcu

SEQ ID NO: 431882 - RNA, 19 nt, Homo sapiens
aguuuccucaucugucaca

SEQ ID NO: 431883 - RNA, 18 nt, Homo sapiens
aguuucuugaaguccagu

SEQ ID NO: 431884 - RNA, 22 nt, Homo sapiens
aguuucuuuuuuaauagaauau

SEQ ID NO: 431885 - RNA, 20 nt, Homo sapiens
aguuugacauuguauguauc

SEQ ID NO: 431886 - RNA, 13 nt, Homo sapiens
aguuugagacagg

SEQ ID NO: 431887 - RNA, 20 nt, Homo sapiens
aguuugagacaggagaccug

SEQ ID NO: 431888 - RNA, 13 nt, Homo sapiens
aguuugauuucau

SEQ ID NO: 431889 - RNA, 22 nt, Homo sapiens
aguuugcaaucuuauguugauc

SEQ ID NO: 431890 - RNA, 19 nt, Homo sapiens
aguuugguccuggggacca

SEQ ID NO: 431891 - RNA, 19 nt, Homo sapiens
aguuuuagaccucaucucc

SEQ ID NO: 431892 - RNA, 15 nt, Homo sapiens
aguuuuccaggaaua

SEQ ID NO: 431893 - RNA, 22 nt, Homo sapiens
aguuuugaaaggcuuuccucag

SEQ ID NO: 431894 - RNA, 21 nt, Homo sapiens
aguuuuuauuacaaauuuuca

SEQ ID NO: 431895 - RNA, 17 nt, Homo sapiens
aguuuuugauagcuuua

SEQ ID NO: 431896 - RNA, 14 nt, Homo sapiens
aguuuuugcugaag

SEQ ID NO: 431897 - RNA, 15 nt, Homo sapiens
auaaaaaacauucaa

SEQ ID NO: 431898 - RNA, 20 nt, Homo sapiens
auaaaaacauaaauaauacc

SEQ ID NO: 431899 - RNA, 20 nt, Homo sapiens
auaaaaaucauucuacugaa

SEQ ID NO: 431900 - RNA, 21 nt, Homo sapiens
auaaaaaucauucuacugaac

SEQ ID NO: 431901 - RNA, 16 nt, Homo sapiens
auaaaacacugcccuc

SEQ ID NO: 431902 - RNA, 21 nt, Homo sapiens
auaaaaccaucaaaaauauuc

SEQ ID NO: 431903 - RNA, 22 nt, Homo sapiens
cacguaguagggucaggccacg

SEQ ID NO: 431904 - RNA, 19 nt, Homo sapiens
cacguggaggaaugcuccc

SEQ ID NO: 431905 - RNA, 18 nt, Homo sapiens
cacgugugcacacacacc

SEQ ID NO: 431906 - RNA, 19 nt, Homo sapiens
cacuaaacagacuauuuaa

SEQ ID NO: 431907 - RNA, 18 nt, Homo sapiens
cacuaaauccuuuccaau

SEQ ID NO: 431908 - RNA, 20 nt, Homo sapiens
cacuaagagaauacaggaaa

SEQ ID NO: 431909 - RNA, 15 nt, Homo sapiens
cacuaaguaaccucu

SEQ ID NO: 431910 - RNA, 16 nt, Homo sapiens
cacuaaguaaccucua

SEQ ID NO: 431911 - RNA, 18 nt, Homo sapiens
cacuaccauuguacccug

SEQ ID NO: 431912 - RNA, 17 nt, Homo sapiens
cacuaccguaaaugucc

SEQ ID NO: 431913 - RNA, 11 nt, Homo sapiens
cacuagacugu

SEQ ID NO: 431914 - RNA, 17 nt, Homo sapiens
cacuagaucucccuuaa

SEQ ID NO: 431915 - RNA, 12 nt, Homo sapiens
cacuagcauuuu

SEQ ID NO: 431916 - RNA, 22 nt, Homo sapiens
cacuagcauuuucuugaaccaa

SEQ ID NO: 431917 - RNA, 20 nt, Homo sapiens
cacuaggaggucaucaaccg

SEQ ID NO: 431918 - RNA, 18 nt, Homo sapiens
cacuaguagagcaaagac

SEQ ID NO: 431919 - RNA, 20 nt, Homo sapiens
cacuauaguuuaaaacacau

SEQ ID NO: 431920 - RNA, 19 nt, Homo sapiens
cacuauucuuaagcacuuu

SEQ ID NO: 431921 - RNA, 18 nt, Homo sapiens
cacucaggaauguuugcu

SEQ ID NO: 431922 - RNA, 18 nt, Homo sapiens
cacucaucagguaaacug

SEQ ID NO: 431923 - RNA, 22 nt, Homo sapiens
cacuccacaguuaggccaagaa

SEQ ID NO: 431924 - RNA, 14 nt, Homo sapiens
cacucccaguccaa

SEQ ID NO: 431925 - RNA, 16 nt, Homo sapiens
cacucccuaaagcccu

SEQ ID NO: 431926 - RNA, 14 nt, Homo sapiens
cacucgugugcaug

SEQ ID NO: 431927 - RNA, 17 nt, Homo sapiens
cacucugaauccucaug

SEQ ID NO: 431928 - RNA, 22 nt, Homo sapiens
cacucuuaucuacauaaggaug

SEQ ID NO: 431929 - RNA, 21 nt, Homo sapiens
cacucuuauuucacuaaagaa

SEQ ID NO: 431930 - RNA, 14 nt, Homo sapiens
cacugacauuucac

SEQ ID NO: 431931 - RNA, 15 nt, Homo sapiens
cacugacucaagaca

SEQ ID NO: 431932 - RNA, 13 nt, Homo sapiens
cacugacuugaga

SEQ ID NO: 431933 - RNA, 22 nt, Homo sapiens
cacugaggcauuuuuacuacua

SEQ ID NO: 431934 - RNA, 13 nt, Homo sapiens
cacugagggccac

SEQ ID NO: 431935 - RNA, 14 nt, Homo sapiens
cacugauuacuuuu

SEQ ID NO: 431936 - RNA, 17 nt, Homo sapiens
cacugcccgagcuggug

SEQ ID NO: 431937 - RNA, 9 nt, Homo sapiens
cacugccuc

SEQ ID NO: 431938 - RNA, 14 nt, Homo sapiens
cacugcucaagaag

SEQ ID NO: 431939 - RNA, 17 nt, Homo sapiens
cacuggaaaaguguaau

SEQ ID NO: 431940 - RNA, 14 nt, Homo sapiens
cacuggaugcagaa

SEQ ID NO: 431941 - RNA, 17 nt, Homo sapiens
cacuggcccucuuugaa

SEQ ID NO: 431942 - RNA, 21 nt, Homo sapiens
cacugggggaacagaugcuaa

SEQ ID NO: 431943 - RNA, 12 nt, Homo sapiens
cacuguaaaaug

SEQ ID NO: 431944 - RNA, 14 nt, Homo sapiens
cacugucacuuugc

SEQ ID NO: 431945 - RNA, 12 nt, Homo sapiens
cacuguccagua

SEQ ID NO: 431946 - RNA, 23 nt, Homo sapiens
cacuguccugggcgcccuggaag

SEQ ID NO: 431947 - RNA, 19 nt, Homo sapiens
cacugucuccuuucucuua

SEQ ID NO: 431948 - RNA, 16 nt, Homo sapiens
cacuguguaaccagca

SEQ ID NO: 431949 - RNA, 15 nt, Homo sapiens
cacuguuucuucuca

SEQ ID NO: 431950 - RNA, 20 nt, Homo sapiens
cacuuaaaaaauguccauga

SEQ ID NO: 431951 - RNA, 16 nt, Homo sapiens
cacuuaaggggccaag

SEQ ID NO: 431952 - RNA, 20 nt, Homo sapiens
cacuuaauacagauguauca

SEQ ID NO: 431953 - RNA, 15 nt, Homo sapiens
cacuuauaccaaagg

SEQ ID NO: 431954 - RNA, 21 nt, Homo sapiens
cacuuauuuuuuaaugugaga

SEQ ID NO: 431955 - RNA, 21 nt, Homo sapiens
cacuucaaaucagagcaguga

SEQ ID NO: 431956 - RNA, 21 nt, Homo sapiens
cacuucaggguucuaaccuuu

SEQ ID NO: 431957 - RNA, 17 nt, Homo sapiens
cacuucaggguucuccu

SEQ ID NO: 431958 - RNA, 16 nt, Homo sapiens
cacuucuaaaugcaua

SEQ ID NO: 431959 - RNA, 18 nt, Homo sapiens
cacuucuaaaugcauauc

SEQ ID NO: 431960 - RNA, 14 nt, Homo sapiens
cacuugacauuccu

SEQ ID NO: 431961 - RNA, 13 nt, Homo sapiens
cacuugagaggau

SEQ ID NO: 431962 - RNA, 19 nt, Homo sapiens
cacuugcaagucccaugau

SEQ ID NO: 431963 - RNA, 19 nt, Homo sapiens
cacuugcacgcccaugugu

SEQ ID NO: 431964 - RNA, 20 nt, Homo sapiens
cacuugccuucuucacccag

SEQ ID NO: 431965 - RNA, 20 nt, Homo sapiens
cacuugcucccaacccauuc

SEQ ID NO: 431966 - RNA, 13 nt, Homo sapiens
cacuuggugcugc

SEQ ID NO: 431967 - RNA, 14 nt, Homo sapiens
cacuuggugcugcg

SEQ ID NO: 431968 - RNA, 21 nt, Homo sapiens
cacuugugcaguguugacagu

SEQ ID NO: 431969 - RNA, 22 nt, Homo sapiens
cacuuguucuguacuuguaaaa

SEQ ID NO: 431970 - RNA, 17 nt, Homo sapiens
cacuuuaacugacuuaa

SEQ ID NO: 431971 - RNA, 21 nt, Homo sapiens
cacuuuccccgugggccaugg

SEQ ID NO: 431972 - RNA, 16 nt, Homo sapiens
cacuuucugaaauuca

SEQ ID NO: 431973 - RNA, 19 nt, Homo sapiens
cacuuuuuccauuucuuca

SEQ ID NO: 431974 - RNA, 18 nt, Homo sapiens
cacuuuuuuccugucaau

SEQ ID NO: 431975 - RNA, 17 nt, Homo sapiens
cagaaaagaugugcaga

SEQ ID NO: 431976 - RNA, 16 nt, Homo sapiens
cagaaaauaugauaua

SEQ ID NO: 431977 - RNA, 17 nt, Homo sapiens
cagaaacagggggaaaa

SEQ ID NO: 431978 - RNA, 23 nt, Homo sapiens
cagaaacagugggagcccugacc

SEQ ID NO: 431979 - RNA, 19 nt, Homo sapiens
cagaaacaguucaccuuga

SEQ ID NO: 431980 - RNA, 20 nt, Homo sapiens
cagaaaccaguuaugugaau

SEQ ID NO: 431981 - RNA, 22 nt, Homo sapiens
cagaaaugcugccugccugucu

SEQ ID NO: 431982 - RNA, 12 nt, Homo sapiens
cagaaaugugcu

SEQ ID NO: 431983 - RNA, 18 nt, Homo sapiens
cagaaaugugcugcaaag

SEQ ID NO: 431984 - RNA, 11 nt, Homo sapiens
cagaacaguua

SEQ ID NO: 431985 - RNA, 20 nt, Homo sapiens
cagaaccucuuccccagaaa

SEQ ID NO: 431986 - RNA, 14 nt, Homo sapiens
cagaaccuuuguca

SEQ ID NO: 431987 - RNA, 18 nt, Homo sapiens
cagaagaauauucaggac

SEQ ID NO: 431988 - RNA, 17 nt, Homo sapiens
cagaagacccgcucucc

SEQ ID NO: 431989 - RNA, 13 nt, Homo sapiens
cagaagaucugaa

SEQ ID NO: 431990 - RNA, 18 nt, Homo sapiens
cagaagauuauuuacuga

SEQ ID NO: 431991 - RNA, 15 nt, Homo sapiens
cagaagcauuucacc

SEQ ID NO: 431992 - RNA, 21 nt, Homo sapiens
cagaagcuccgugagccucag

SEQ ID NO: 431993 - RNA, 12 nt, Homo sapiens
cagaagugcucu

SEQ ID NO: 431994 - RNA, 22 nt, Homo sapiens
cagaaguuugcuucuuauggua

SEQ ID NO: 431995 - RNA, 15 nt, Homo sapiens
cagaauaaaugggua

SEQ ID NO: 431996 - RNA, 18 nt, Homo sapiens
cagaauaaauggguaaca

SEQ ID NO: 431997 - RNA, 14 nt, Homo sapiens
cagaauacaauuca

SEQ ID NO: 431998 - RNA, 18 nt, Homo sapiens
cagaauauacccauccau

SEQ ID NO: 431999 - RNA, 23 nt, Homo sapiens
cagaaucucauagguugccaaua

SEQ ID NO: 432000 - RNA, 14 nt, Homo sapiens
cagaaucuuugcaa

SEQ ID NO: 432001 - RNA, 18 nt, Homo sapiens
cagaaugcucuacuucuu

SEQ ID NO: 432002 - RNA, 19 nt, Homo sapiens
cagaaugcucuacuucuuu

SEQ ID NO: 432003 - RNA, 20 nt, Homo sapiens
cagaauuguagccaguuucu

SEQ ID NO: 432004 - RNA, 14 nt, Homo sapiens
cagaauugugcaaa

SEQ ID NO: 432005 - RNA, 16 nt, Homo sapiens
cagaauuuugcacagu

SEQ ID NO: 432006 - RNA, 12 nt, Homo sapiens
cagacaaaaaga

SEQ ID NO: 432007 - RNA, 15 nt, Homo sapiens
cagacaaaugugguu

SEQ ID NO: 432008 - RNA, 22 nt, Homo sapiens
cagacacacacacacacacaaa

SEQ ID NO: 432009 - RNA, 15 nt, Homo sapiens
cagacauccugugau

SEQ ID NO: 432010 - RNA, 16 nt, Homo sapiens
cagacaucuccucacc

SEQ ID NO: 432011 - RNA, 14 nt, Homo sapiens
cagaccaguacugg

SEQ ID NO: 432012 - RNA, 22 nt, Homo sapiens
cagaccaguuucagagaaauac

SEQ ID NO: 432013 - RNA, 20 nt, Homo sapiens
cagaccgugaccaucuuugu

SEQ ID NO: 432014 - RNA, 15 nt, Homo sapiens
cagaccuaauaucau

SEQ ID NO: 432015 - RNA, 23 nt, Homo sapiens
cagaccuaauaucauuuuauuca

SEQ ID NO: 432016 - RNA, 17 nt, Homo sapiens
cagaccugaaugcuucu

SEQ ID NO: 432017 - RNA, 16 nt, Homo sapiens
cagacucugcccaucc

SEQ ID NO: 432018 - RNA, 19 nt, Homo sapiens
cagacugaagagcagguga

SEQ ID NO: 432019 - RNA, 21 nt, Homo sapiens
cagacuggaggggacgcuggu

SEQ ID NO: 432020 - RNA, 14 nt, Homo sapiens
cagacuggugggau

SEQ ID NO: 432021 - RNA, 16 nt, Homo sapiens
cagacuucgcuauucc

SEQ ID NO: 432022 - RNA, 21 nt, Homo sapiens
cagacuuuuuaaauuccugcu

SEQ ID NO: 432023 - RNA, 13 nt, Homo sapiens
cagagaaaagagu

SEQ ID NO: 432024 - RNA, 17 nt, Homo sapiens
cagagaaauacuuucag

SEQ ID NO: 432025 - RNA, 21 nt, Homo sapiens
cagagaagaccacaccaagga

SEQ ID NO: 432026 - RNA, 22 nt, Homo sapiens
cagagaagauaauguucuuuaa

SEQ ID NO: 432027 - RNA, 19 nt, Homo sapiens
cagagaauagcaguuucac

SEQ ID NO: 432028 - RNA, 18 nt, Homo sapiens
cagagaauauauacauuc

SEQ ID NO: 432029 - RNA, 19 nt, Homo sapiens
cagagaaucucuagugaau

SEQ ID NO: 432030 - RNA, 18 nt, Homo sapiens
cagagacccccgugccaa

SEQ ID NO: 432031 - RNA, 17 nt, Homo sapiens
cagagacggucaugcaa

SEQ ID NO: 432032 - RNA, 19 nt, Homo sapiens
cagagacuuuguguuuaca

SEQ ID NO: 432033 - RNA, 23 nt, Homo sapiens
cauaauuaugggaacaaguguac

SEQ ID NO: 432034 - RNA, 15 nt, Homo sapiens
cauaauucuaaguua

SEQ ID NO: 432035 - RNA, 16 nt, Homo sapiens
cauaauugcaagggaa

SEQ ID NO: 432036 - RNA, 18 nt, Homo sapiens
cauaauuugaauggugca

SEQ ID NO: 432037 - RNA, 16 nt, Homo sapiens
cauacaguuugcacuu

SEQ ID NO: 432038 - RNA, 20 nt, Homo sapiens
cauacauacacugcauccug

SEQ ID NO: 432039 - RNA, 22 nt, Homo sapiens
cauacaucuaagucaguuucac

SEQ ID NO: 432040 - RNA, 14 nt, Homo sapiens
cauacccaucugca

SEQ ID NO: 432041 - RNA, 16 nt, Homo sapiens
cauacuccuuccauca

SEQ ID NO: 432042 - RNA, 17 nt, Homo sapiens
cauacucugcuuagaau

SEQ ID NO: 432043 - RNA, 17 nt, Homo sapiens
cauagaagaaaauccau

SEQ ID NO: 432044 - RNA, 13 nt, Homo sapiens
cauagacauuccu

SEQ ID NO: 432045 - RNA, 16 nt, Homo sapiens
cauagccauggaaccc

SEQ ID NO: 432046 - RNA, 21 nt, Homo sapiens
cauagccauggaacccugcca

SEQ ID NO: 432047 - RNA, 24 nt, Homo sapiens
cauagcugagcuggaaaggaugcu

SEQ ID NO: 432048 - RNA, 18 nt, Homo sapiens
cauagcuguauauuugaa

SEQ ID NO: 432049 - RNA, 16 nt, Homo sapiens
cauagcuugauugcuc

SEQ ID NO: 432050 - RNA, 17 nt, Homo sapiens
cauagcuugauugcuca

SEQ ID NO: 432051 - RNA, 18 nt, Homo sapiens
cauagucuuuguuuacau

SEQ ID NO: 432052 - RNA, 17 nt, Homo sapiens
cauaguuuacaauauua

SEQ ID NO: 432053 - RNA, 14 nt, Homo sapiens
cauauaaccaaaau

SEQ ID NO: 432054 - RNA, 15 nt, Homo sapiens
cauauagaggcaaga

SEQ ID NO: 432055 - RNA, 24 nt, Homo sapiens
cauauauaauuuuauugcuggaau

SEQ ID NO: 432056 - RNA, 16 nt, Homo sapiens
cauauaucuauuacac

SEQ ID NO: 432057 - RNA, 14 nt, Homo sapiens
cauaucagaccucu

SEQ ID NO: 432058 - RNA, 15 nt, Homo sapiens
cauauccugagccau

SEQ ID NO: 432059 - RNA, 20 nt, Homo sapiens
cauaucuuaaagaaacagcu

SEQ ID NO: 432060 - RNA, 22 nt, Homo sapiens
cauaugagcuuccuucugugaa

SEQ ID NO: 432061 - RNA, 14 nt, Homo sapiens
cauaugcuauguua

SEQ ID NO: 432062 - RNA, 16 nt, Homo sapiens
cauaugcuuuaagaau

SEQ ID NO: 432063 - RNA, 20 nt, Homo sapiens
cauaugucuuacuacuuuaa

SEQ ID NO: 432064 - RNA, 21 nt, Homo sapiens
cauaugugagugaaaguacuu

SEQ ID NO: 432065 - RNA, 19 nt, Homo sapiens
cauauguugcucagucucc

SEQ ID NO: 432066 - RNA, 13 nt, Homo sapiens
cauauuaaaacaa

SEQ ID NO: 432067 - RNA, 20 nt, Homo sapiens
cauauuauaucagacugcuu

SEQ ID NO: 432068 - RNA, 16 nt, Homo sapiens
cauauugugccaauau

SEQ ID NO: 432069 - RNA, 19 nt, Homo sapiens
cauauuuauuuagaugcua

SEQ ID NO: 432070 - RNA, 17 nt, Homo sapiens
caucaauaaaggggaau

SEQ ID NO: 432071 - RNA, 22 nt, Homo sapiens
caucacaggcucugcauacaca

SEQ ID NO: 432072 - RNA, 12 nt, Homo sapiens
caucagccagac

SEQ ID NO: 432073 - RNA, 20 nt, Homo sapiens
caucagcucucugcaaagau

SEQ ID NO: 432074 - RNA, 22 nt, Homo sapiens
caucagggggcaugaagcacau

SEQ ID NO: 432075 - RNA, 15 nt, Homo sapiens
caucaguauugugua

SEQ ID NO: 432076 - RNA, 14 nt, Homo sapiens
caucaguguuaaaa

SEQ ID NO: 432077 - RNA, 12 nt, Homo sapiens
caucaguucccc

SEQ ID NO: 432078 - RNA, 14 nt, Homo sapiens
caucauaauggacu

SEQ ID NO: 432079 - RNA, 12 nt, Homo sapiens
caucaugacuga

SEQ ID NO: 432080 - RNA, 19 nt, Homo sapiens
caucauuggaaaugaaacu

SEQ ID NO: 432081 - RNA, 18 nt, Homo sapiens
caucauuggaauacagga

SEQ ID NO: 432082 - RNA, 15 nt, Homo sapiens
caucauuugcauaug

SEQ ID NO: 432083 - RNA, 15 nt, Homo sapiens
caucauuuucaccuc

SEQ ID NO: 432084 - RNA, 13 nt, Homo sapiens
cauccaguaucuu

SEQ ID NO: 432085 - RNA, 15 nt, Homo sapiens
cauccauagacacag

SEQ ID NO: 432086 - RNA, 18 nt, Homo sapiens
caucccacgcuugcuuua

SEQ ID NO: 432087 - RNA, 16 nt, Homo sapiens
cauccccaacuccaug

SEQ ID NO: 432088 - RNA, 15 nt, Homo sapiens
cauccccagggccau

SEQ ID NO: 432089 - RNA, 18 nt, Homo sapiens
cauccccauccuccagcu

SEQ ID NO: 432090 - RNA, 19 nt, Homo sapiens
caucccccaaaguucacaa

SEQ ID NO: 432091 - RNA, 17 nt, Homo sapiens
caucccgaagccaucac

SEQ ID NO: 432092 - RNA, 19 nt, Homo sapiens
caucccgugcaaaacaugc

SEQ ID NO: 432093 - RNA, 22 nt, Homo sapiens
caucccugaaacauugcaugua

SEQ ID NO: 432094 - RNA, 21 nt, Homo sapiens
cauccggcaugagggcugaga

SEQ ID NO: 432095 - RNA, 12 nt, Homo sapiens
cauccuacccua

SEQ ID NO: 432096 - RNA, 13 nt, Homo sapiens
cauccuccagcuu

SEQ ID NO: 432097 - RNA, 23 nt, Homo sapiens
cauccuccccuagcuuagcuguc

SEQ ID NO: 432098 - RNA, 21 nt, Homo sapiens
caucgguucaggaggagacag

SEQ ID NO: 432099 - RNA, 18 nt, Homo sapiens
caucgucuuuaaccccaa

SEQ ID NO: 432100 - RNA, 17 nt, Homo sapiens
caucuaacaaagucaag

SEQ ID NO: 432101 - RNA, 17 nt, Homo sapiens
caucuaagacauucacc

SEQ ID NO: 432102 - RNA, 16 nt, Homo sapiens
caucuaagcuauacug

SEQ ID NO: 432103 - RNA, 20 nt, Homo sapiens
caucuaagucaguuucacau

SEQ ID NO: 432104 - RNA, 21 nt, Homo sapiens
caucuacccugcugaccuccc

SEQ ID NO: 432105 - RNA, 11 nt, Homo sapiens
caucuauguga

SEQ ID NO: 432106 - RNA, 22 nt, Homo sapiens
caucuaugugagaccauuuagc

SEQ ID NO: 432107 - RNA, 23 nt, Homo sapiens
caucuauuuggaaagcacuggaa

SEQ ID NO: 432108 - RNA, 16 nt, Homo sapiens
caucucaguccucaaa

SEQ ID NO: 432109 - RNA, 15 nt, Homo sapiens
caucucagugcagga

SEQ ID NO: 432110 - RNA, 19 nt, Homo sapiens
caucucauuaaaaggcccu

SEQ ID NO: 432111 - RNA, 22 nt, Homo sapiens
caucuccagggagcaagacaga

SEQ ID NO: 432112 - RNA, 20 nt, Homo sapiens
caucucuacuaaaaauacaa

SEQ ID NO: 432113 - RNA, 15 nt, Homo sapiens
caucucugccuggaa

SEQ ID NO: 432114 - RNA, 15 nt, Homo sapiens
caucucuguaaaaag

SEQ ID NO: 432115 - RNA, 21 nt, Homo sapiens
caucugaaaagaaaugcuaau

SEQ ID NO: 432116 - RNA, 17 nt, Homo sapiens
caucugacacugacagc

SEQ ID NO: 432117 - RNA, 16 nt, Homo sapiens
caucugacuugaacuc

SEQ ID NO: 432118 - RNA, 15 nt, Homo sapiens
caucugaggagucca

SEQ ID NO: 432119 - RNA, 13 nt, Homo sapiens
caucugcauuucu

SEQ ID NO: 432120 - RNA, 14 nt, Homo sapiens
caucugcucugaga

SEQ ID NO: 432121 - RNA, 22 nt, Homo sapiens
caucugucagcuucccaacaau

SEQ ID NO: 432122 - RNA, 20 nt, Homo sapiens
caucuuacaaaaacaagaca

SEQ ID NO: 432123 - RNA, 14 nt, Homo sapiens
caucuuacuugagc

SEQ ID NO: 432124 - RNA, 17 nt, Homo sapiens
caucuucacugcaauuu

SEQ ID NO: 432125 - RNA, 22 nt, Homo sapiens
caucuuccgcgcaggugccaac

SEQ ID NO: 432126 - RNA, 20 nt, Homo sapiens
caucuucuaggccaagcauu

SEQ ID NO: 432127 - RNA, 18 nt, Homo sapiens
caucuucuuauuuuccaa

SEQ ID NO: 432128 - RNA, 20 nt, Homo sapiens
caucuucuuauuuuccaaau

SEQ ID NO: 432129 - RNA, 23 nt, Homo sapiens
caucuuggucagauuugaacucu

SEQ ID NO: 432130 - RNA, 23 nt, Homo sapiens
caucuuuguggcgggagugcuca

SEQ ID NO: 432131 - RNA, 23 nt, Homo sapiens
caucuuuuguuaaguucaccgua

SEQ ID NO: 432132 - RNA, 19 nt, Homo sapiens
caugaaaaagaauaccaau

SEQ ID NO: 432133 - RNA, 18 nt, Homo sapiens
caugaaaauuacaacaga

SEQ ID NO: 432134 - RNA, 12 nt, Homo sapiens
caugaagcacau

SEQ ID NO: 432135 - RNA, 19 nt, Homo sapiens
caugaaggucuaccugaaa

SEQ ID NO: 432136 - RNA, 12 nt, Homo sapiens
caugaaucuucc

SEQ ID NO: 432137 - RNA, 22 nt, Homo sapiens
caugaaugaaugaaccaugaau

SEQ ID NO: 432138 - RNA, 20 nt, Homo sapiens
caugaauuaagaacugacac

SEQ ID NO: 432139 - RNA, 21 nt, Homo sapiens
caugaccacugggccugcuag

SEQ ID NO: 432140 - RNA, 20 nt, Homo sapiens
caugacucguauaugucuca

SEQ ID NO: 432141 - RNA, 23 nt, Homo sapiens
caugacugccccuugcuucucaa

SEQ ID NO: 432142 - RNA, 19 nt, Homo sapiens
caugagaccacuguuauca

SEQ ID NO: 432143 - RNA, 16 nt, Homo sapiens
caugagcacuuuguaa

SEQ ID NO: 432144 - RNA, 17 nt, Homo sapiens
caugagcaguccagagc

SEQ ID NO: 432145 - RNA, 15 nt, Homo sapiens
caugagucccagugg

SEQ ID NO: 432146 - RNA, 20 nt, Homo sapiens
caugagugucaacuccagga

SEQ ID NO: 432147 - RNA, 14 nt, Homo sapiens
caugaguucaaaua

SEQ ID NO: 432148 - RNA, 17 nt, Homo sapiens
caugaguuuaugggaau

SEQ ID NO: 432149 - RNA, 22 nt, Homo sapiens
caugaucgcuuucuacacugua

SEQ ID NO: 432150 - RNA, 18 nt, Homo sapiens
caugauguauuguugcuu

SEQ ID NO: 432151 - RNA, 12 nt, Homo sapiens
caugcaacucca

SEQ ID NO: 432152 - RNA, 13 nt, Homo sapiens
caugcaaugacau

SEQ ID NO: 432153 - RNA, 12 nt, Homo sapiens
caugcacaaagu

SEQ ID NO: 432154 - RNA, 11 nt, Homo sapiens
caugcacacac

SEQ ID NO: 432155 - RNA, 22 nt, Homo sapiens
caugcacacacacacaucucau

SEQ ID NO: 432156 - RNA, 17 nt, Homo sapiens
caugcacagaguccuua

SEQ ID NO: 432157 - RNA, 15 nt, Homo sapiens
caugcagaaauugac

SEQ ID NO: 432158 - RNA, 19 nt, Homo sapiens
caugcaugggaaagugcaa

SEQ ID NO: 432159 - RNA, 11 nt, Homo sapiens
caugcauuuga

SEQ ID NO: 432160 - RNA, 15 nt, Homo sapiens
caugccacugccagg

SEQ ID NO: 432161 - RNA, 13 nt, Homo sapiens
caugccuacagau

SEQ ID NO: 432162 - RNA, 15 nt, Homo sapiens
caugccuauuuacug

SEQ ID NO: 432163 - RNA, 20 nt, Homo sapiens
ccauagugcacuagcauuuu

SEQ ID NO: 432164 - RNA, 16 nt, Homo sapiens
ccauaucugugaaaug

SEQ ID NO: 432165 - RNA, 22 nt, Homo sapiens
ccauaucuuaaagaaacagcuu

SEQ ID NO: 432166 - RNA, 14 nt, Homo sapiens
ccauaugugggugu

SEQ ID NO: 432167 - RNA, 19 nt, Homo sapiens
ccauauuccagcagugaaa

SEQ ID NO: 432168 - RNA, 19 nt, Homo sapiens
ccaucacccucagcaguuc

SEQ ID NO: 432169 - RNA, 13 nt, Homo sapiens
ccaucaccucucu

SEQ ID NO: 432170 - RNA, 17 nt, Homo sapiens
ccaucagcucucugcaa

SEQ ID NO: 432171 - RNA, 17 nt, Homo sapiens
ccaucaucucugccuuu

SEQ ID NO: 432172 - RNA, 20 nt, Homo sapiens
ccauccaauggauugugcaa

SEQ ID NO: 432173 - RNA, 14 nt, Homo sapiens
ccauccauauacuu

SEQ ID NO: 432174 - RNA, 19 nt, Homo sapiens
ccauccuucccgcagcacc

SEQ ID NO: 432175 - RNA, 19 nt, Homo sapiens
ccaucuaaaacucauacaa

SEQ ID NO: 432176 - RNA, 19 nt, Homo sapiens
ccaucugcuuacaauuccc

SEQ ID NO: 432177 - RNA, 21 nt, Homo sapiens
ccaucuguuugauacaguauu

SEQ ID NO: 432178 - RNA, 17 nt, Homo sapiens
ccaucuuaaauuucuaa

SEQ ID NO: 432179 - RNA, 15 nt, Homo sapiens
ccaucuucuuuauac

SEQ ID NO: 432180 - RNA, 17 nt, Homo sapiens
ccaucuuuuaauaugcu

SEQ ID NO: 432181 - RNA, 15 nt, Homo sapiens
ccaugaccaggccac

SEQ ID NO: 432182 - RNA, 11 nt, Homo sapiens
ccaugagacac

SEQ ID NO: 432183 - RNA, 16 nt, Homo sapiens
ccaugagaugaugcca

SEQ ID NO: 432184 - RNA, 13 nt, Homo sapiens
ccaugauaucacu

SEQ ID NO: 432185 - RNA, 18 nt, Homo sapiens
ccaugauaucacuucuuc

SEQ ID NO: 432186 - RNA, 14 nt, Homo sapiens
ccaugccaccaccc

SEQ ID NO: 432187 - RNA, 22 nt, Homo sapiens
ccauggaagcuggcaggagaca

SEQ ID NO: 432188 - RNA, 22 nt, Homo sapiens
ccauggagacaagggcaucauc

SEQ ID NO: 432189 - RNA, 16 nt, Homo sapiens
ccauggaggcaugcca

SEQ ID NO: 432190 - RNA, 19 nt, Homo sapiens
ccauggcaccuucagacuu

SEQ ID NO: 432191 - RNA, 15 nt, Homo sapiens
ccauggcccaucacu

SEQ ID NO: 432192 - RNA, 23 nt, Homo sapiens
ccaugggcuagugugaguggcag

SEQ ID NO: 432193 - RNA, 21 nt, Homo sapiens
ccaugguagacugugacacag

SEQ ID NO: 432194 - RNA, 16 nt, Homo sapiens
ccauggucacagagaa

SEQ ID NO: 432195 - RNA, 22 nt, Homo sapiens
ccauggugcccuguuggcauua

SEQ ID NO: 432196 - RNA, 16 nt, Homo sapiens
ccauggugguuucaga

SEQ ID NO: 432197 - RNA, 18 nt, Homo sapiens
ccauguaccaguguacug

SEQ ID NO: 432198 - RNA, 16 nt, Homo sapiens
ccaugugacuguauua

SEQ ID NO: 432199 - RNA, 11 nt, Homo sapiens
ccaugugauua

SEQ ID NO: 432200 - RNA, 15 nt, Homo sapiens
ccauguggccauuaa

SEQ ID NO: 432201 - RNA, 20 nt, Homo sapiens
ccaugugugagugugugcaa

SEQ ID NO: 432202 - RNA, 22 nt, Homo sapiens
ccaugugugagugugugcaagu

SEQ ID NO: 432203 - RNA, 14 nt, Homo sapiens
ccaugugugugcaa

SEQ ID NO: 432204 - RNA, 23 nt, Homo sapiens
ccauguuauuuauaguguugcuu

SEQ ID NO: 432205 - RNA, 20 nt, Homo sapiens
ccauguucacaccgcugcac

SEQ ID NO: 432206 - RNA, 19 nt, Homo sapiens
ccauguuuuugcaaauacu

SEQ ID NO: 432207 - RNA, 22 nt, Homo sapiens
ccauuauucuauuuuagacuuu

SEQ ID NO: 432208 - RNA, 12 nt, Homo sapiens
ccauucauucaa

SEQ ID NO: 432209 - RNA, 22 nt, Homo sapiens
ccauuccaagucaacacucuuc

SEQ ID NO: 432210 - RNA, 18 nt, Homo sapiens
ccauucuccugccucagc

SEQ ID NO: 432211 - RNA, 23 nt, Homo sapiens
ccauuggaauaauaaauuugaua

SEQ ID NO: 432212 - RNA, 16 nt, Homo sapiens
ccauuguauugucuga

SEQ ID NO: 432213 - RNA, 13 nt, Homo sapiens
ccauugucuuucc

SEQ ID NO: 432214 - RNA, 18 nt, Homo sapiens
ccauuguuuugccaguga

SEQ ID NO: 432215 - RNA, 18 nt, Homo sapiens
ccauuuaaacuaaccuuu

SEQ ID NO: 432216 - RNA, 12 nt, Homo sapiens
ccauuucuucag

SEQ ID NO: 432217 - RNA, 17 nt, Homo sapiens
ccauuugaagcagugau

SEQ ID NO: 432218 - RNA, 19 nt, Homo sapiens
ccauuugccaugcugcuau

SEQ ID NO: 432219 - RNA, 20 nt, Homo sapiens
ccauuugugugugugcaagu

SEQ ID NO: 432220 - RNA, 14 nt, Homo sapiens
ccauuuugcaaaau

SEQ ID NO: 432221 - RNA, 14 nt, Homo sapiens
cccaaaacaaagua

SEQ ID NO: 432222 - RNA, 21 nt, Homo sapiens
cccaaacuugcuuuaugccuu

SEQ ID NO: 432223 - RNA, 20 nt, Homo sapiens
cccaaauuaagaaucuagga

SEQ ID NO: 432224 - RNA, 11 nt, Homo sapiens
cccaacacuuu

SEQ ID NO: 432225 - RNA, 14 nt, Homo sapiens
cccaacgaaaagca

SEQ ID NO: 432226 - RNA, 18 nt, Homo sapiens
cccaacgaaaagcacauc

SEQ ID NO: 432227 - RNA, 17 nt, Homo sapiens
cccaacuugagauguau

SEQ ID NO: 432228 - RNA, 23 nt, Homo sapiens
cccaagaggucaaggcugcagug

SEQ ID NO: 432229 - RNA, 16 nt, Homo sapiens
cccaagaugagcugca

SEQ ID NO: 432230 - RNA, 17 nt, Homo sapiens
cccaagcagcugggauu

SEQ ID NO: 432231 - RNA, 23 nt, Homo sapiens
cccaagcuggccacuaucacaua

SEQ ID NO: 432232 - RNA, 22 nt, Homo sapiens
cccaaggaaaauggacauauuc

SEQ ID NO: 432233 - RNA, 19 nt, Homo sapiens
cccaaggaagaacaaauau

SEQ ID NO: 432234 - RNA, 21 nt, Homo sapiens
cccaagggccucccaccagag

SEQ ID NO: 432235 - RNA, 18 nt, Homo sapiens
cccaauaaaagugacucu

SEQ ID NO: 432236 - RNA, 14 nt, Homo sapiens
cccaauaauucugu

SEQ ID NO: 432237 - RNA, 20 nt, Homo sapiens
cccaauuuuaaaaaauaaca

SEQ ID NO: 432238 - RNA, 15 nt, Homo sapiens
cccacagacacuuac

SEQ ID NO: 432239 - RNA, 22 nt, Homo sapiens
cccacagagguggaacuuaauu

SEQ ID NO: 432240 - RNA, 13 nt, Homo sapiens
cccacaguccuca

SEQ ID NO: 432241 - RNA, 15 nt, Homo sapiens
cccacauaccaucug

SEQ ID NO: 432242 - RNA, 14 nt, Homo sapiens
cccaccaacucugc

SEQ ID NO: 432243 - RNA, 14 nt, Homo sapiens
cccaccagugccuu

SEQ ID NO: 432244 - RNA, 15 nt, Homo sapiens
cccacccaacuaauu

SEQ ID NO: 432245 - RNA, 21 nt, Homo sapiens
cccacccccuucucugcucca

SEQ ID NO: 432246 - RNA, 20 nt, Homo sapiens
cccacccgggagcagugucc

SEQ ID NO: 432247 - RNA, 13 nt, Homo sapiens
cccaccuccagcc

SEQ ID NO: 432248 - RNA, 21 nt, Homo sapiens
cccacguggucgccugcauuu

SEQ ID NO: 432249 - RNA, 22 nt, Homo sapiens
cccacguggucgccugcauuuc

SEQ ID NO: 432250 - RNA, 14 nt, Homo sapiens
cccacucagggauc

SEQ ID NO: 432251 - RNA, 13 nt, Homo sapiens
cccacuuugccac

SEQ ID NO: 432252 - RNA, 19 nt, Homo sapiens
cccagaaccacacuguuga

SEQ ID NO: 432253 - RNA, 23 nt, Homo sapiens
cccagaaggcagagguugcagug

SEQ ID NO: 432254 - RNA, 16 nt, Homo sapiens
cccagagaacaaucac

SEQ ID NO: 432255 - RNA, 20 nt, Homo sapiens
cccagagguuaucugccugg

SEQ ID NO: 432256 - RNA, 22 nt, Homo sapiens
cccagagugcugggauuacaau

SEQ ID NO: 432257 - RNA, 22 nt, Homo sapiens
cccagaugcucuccccuccucg

SEQ ID NO: 432258 - RNA, 19 nt, Homo sapiens
cccagcagcgguaccccag

SEQ ID NO: 432259 - RNA, 17 nt, Homo sapiens
cccagcccucaguuuuc

SEQ ID NO: 432260 - RNA, 18 nt, Homo sapiens
cccagcccucaguuuuca

SEQ ID NO: 432261 - RNA, 17 nt, Homo sapiens
cccagcccucccagcug

SEQ ID NO: 432262 - RNA, 18 nt, Homo sapiens
cccagccgaaaagcuuuu

SEQ ID NO: 432263 - RNA, 17 nt, Homo sapiens
cccagcuggguggucca

SEQ ID NO: 432264 - RNA, 17 nt, Homo sapiens
cccagcuguagccaugg

SEQ ID NO: 432265 - RNA, 13 nt, Homo sapiens
cccagcuugccaa

SEQ ID NO: 432266 - RNA, 13 nt, Homo sapiens
cccaggacacgac

SEQ ID NO: 432267 - RNA, 21 nt, Homo sapiens
cccaggaccuggagacaggau

SEQ ID NO: 432268 - RNA, 21 nt, Homo sapiens
cccaggagguggcuauggcca

SEQ ID NO: 432269 - RNA, 23 nt, Homo sapiens
cccaggagguugagaaugcagug

SEQ ID NO: 432270 - RNA, 16 nt, Homo sapiens
cccaggaguguggcca

SEQ ID NO: 432271 - RNA, 19 nt, Homo sapiens
cccaggcugcacugcagug

SEQ ID NO: 432272 - RNA, 20 nt, Homo sapiens
cccaggcuggagugcaauga

SEQ ID NO: 432273 - RNA, 19 nt, Homo sapiens
cccagguucagacugagcu

SEQ ID NO: 432274 - RNA, 14 nt, Homo sapiens
cccaguucauccca

SEQ ID NO: 432275 - RNA, 19 nt, Homo sapiens
cccaguuucuugagaucug

SEQ ID NO: 432276 - RNA, 17 nt, Homo sapiens
cccauaauuuucuucau

SEQ ID NO: 432277 - RNA, 14 nt, Homo sapiens
cccauaucugugaa

SEQ ID NO: 432278 - RNA, 15 nt, Homo sapiens
cccauaucugugaaa

SEQ ID NO: 432279 - RNA, 23 nt, Homo sapiens
cccauaucugugaaaugcuggca

SEQ ID NO: 432280 - RNA, 24 nt, Homo sapiens
cccauccccuuccuaaauauccaa

SEQ ID NO: 432281 - RNA, 14 nt, Homo sapiens
cccaucugcaccga

SEQ ID NO: 432282 - RNA, 22 nt, Homo sapiens
cccaugcacagaacaagccaca

SEQ ID NO: 432283 - RNA, 19 nt, Homo sapiens
cccaugguagacugugaca

SEQ ID NO: 432284 - RNA, 14 nt, Homo sapiens
cccaugugugagug

SEQ ID NO: 432285 - RNA, 17 nt, Homo sapiens
cccauguugcaugccua

SEQ ID NO: 432286 - RNA, 18 nt, Homo sapiens
cccauuagcccacugccu

SEQ ID NO: 432287 - RNA, 16 nt, Homo sapiens
cccauugauguacuuu

SEQ ID NO: 432288 - RNA, 18 nt, Homo sapiens
cccauuucuuaaucagug

SEQ ID NO: 432289 - RNA, 22 nt, Homo sapiens
ccccaaacauuaaucaccaaag

SEQ ID NO: 432290 - RNA, 23 nt, Homo sapiens
ccccaaacauuaaucaccaaagu

SEQ ID NO: 432291 - RNA, 14 nt, Homo sapiens
ccccaagcucaguu

SEQ ID NO: 432292 - RNA, 14 nt, Homo sapiens
cugguuaccacagu

SEQ ID NO: 432293 - RNA, 19 nt, Homo sapiens
cugguucuguacaugugga

SEQ ID NO: 432294 - RNA, 17 nt, Homo sapiens
cugguugaaaaauggca

SEQ ID NO: 432295 - RNA, 22 nt, Homo sapiens
cugguugaaaaauggcaaagaa

SEQ ID NO: 432296 - RNA, 19 nt, Homo sapiens
cugguugucauuuuugcag

SEQ ID NO: 432297 - RNA, 18 nt, Homo sapiens
cugguuuuaccccagcuc

SEQ ID NO: 432298 - RNA, 21 nt, Homo sapiens
cugguuuuuaaguacucacua

SEQ ID NO: 432299 - RNA, 17 nt, Homo sapiens
cuguaaaauacuucuuu

SEQ ID NO: 432300 - RNA, 13 nt, Homo sapiens
cuguaaaauccau

SEQ ID NO: 432301 - RNA, 23 nt, Homo sapiens
cuguaaaccacuugucacuacaa

SEQ ID NO: 432302 - RNA, 20 nt, Homo sapiens
cuguaaagucuaaucucuaa

SEQ ID NO: 432303 - RNA, 17 nt, Homo sapiens
cuguaaauacaugugug

SEQ ID NO: 432304 - RNA, 16 nt, Homo sapiens
cuguaacacuguauaa

SEQ ID NO: 432305 - RNA, 18 nt, Homo sapiens
cuguaacccucacccaca

SEQ ID NO: 432306 - RNA, 15 nt, Homo sapiens
cuguaagauaauguu

SEQ ID NO: 432307 - RNA, 21 nt, Homo sapiens
cuguaagauuguccagugcaa

SEQ ID NO: 432308 - RNA, 16 nt, Homo sapiens
cuguaaucacaacuca

SEQ ID NO: 432309 - RNA, 20 nt, Homo sapiens
cuguaaucccagcacuuugg

SEQ ID NO: 432310 - RNA, 18 nt, Homo sapiens
cuguaaucccagcuacuu

SEQ ID NO: 432311 - RNA, 19 nt, Homo sapiens
cuguaauuaauaucuugcu

SEQ ID NO: 432312 - RNA, 15 nt, Homo sapiens
cuguaccauccaugg

SEQ ID NO: 432313 - RNA, 22 nt, Homo sapiens
cuguacuccagccugggugaca

SEQ ID NO: 432314 - RNA, 23 nt, Homo sapiens
cuguagaaaugaugauguggaag

SEQ ID NO: 432315 - RNA, 20 nt, Homo sapiens
cuguaguaauuguuacaauu

SEQ ID NO: 432316 - RNA, 17 nt, Homo sapiens
cuguagugagaaacuga

SEQ ID NO: 432317 - RNA, 21 nt, Homo sapiens
cuguaguuaauuucagugccu

SEQ ID NO: 432318 - RNA, 18 nt, Homo sapiens
cuguauaaacaagccuaa

SEQ ID NO: 432319 - RNA, 13 nt, Homo sapiens
cuguauaaacaca

SEQ ID NO: 432320 - RNA, 23 nt, Homo sapiens
cuguauaguuaggauagcauuuu

SEQ ID NO: 432321 - RNA, 17 nt, Homo sapiens
cuguauauagcucuaca

SEQ ID NO: 432322 - RNA, 13 nt, Homo sapiens
cuguauccaaguu

SEQ ID NO: 432323 - RNA, 21 nt, Homo sapiens
cuguauuaauuauaccagugu

SEQ ID NO: 432324 - RNA, 15 nt, Homo sapiens
cuguauucugcaaca

SEQ ID NO: 432325 - RNA, 22 nt, Homo sapiens
cuguauuuuuuuuuuccauuag

SEQ ID NO: 432326 - RNA, 18 nt, Homo sapiens
cugucacucagcugagaa

SEQ ID NO: 432327 - RNA, 12 nt, Homo sapiens
cugucacuguag

SEQ ID NO: 432328 - RNA, 19 nt, Homo sapiens
cugucagcgccucaagggu

SEQ ID NO: 432329 - RNA, 14 nt, Homo sapiens
cugucaggucugau

SEQ ID NO: 432330 - RNA, 23 nt, Homo sapiens
cugucaguaggggcaugguauaa

SEQ ID NO: 432331 - RNA, 12 nt, Homo sapiens
cugucagucaug

SEQ ID NO: 432332 - RNA, 19 nt, Homo sapiens
cugucagucguguugcuua

SEQ ID NO: 432333 - RNA, 15 nt, Homo sapiens
cugucauaugcagaa

SEQ ID NO: 432334 - RNA, 20 nt, Homo sapiens
cuguccacauguggggacag

SEQ ID NO: 432335 - RNA, 21 nt, Homo sapiens
cuguccaggccacuguggcca

SEQ ID NO: 432336 - RNA, 14 nt, Homo sapiens
cugucccaccaacu

SEQ ID NO: 432337 - RNA, 15 nt, Homo sapiens
cugucccacugggac

SEQ ID NO: 432338 - RNA, 22 nt, Homo sapiens
cugucccagagcuuauuggcca

SEQ ID NO: 432339 - RNA, 17 nt, Homo sapiens
cugucccauucuagauc

SEQ ID NO: 432340 - RNA, 15 nt, Homo sapiens
cuguccuaagcacuu

SEQ ID NO: 432341 - RNA, 18 nt, Homo sapiens
cuguccucucagaacucc

SEQ ID NO: 432342 - RNA, 16 nt, Homo sapiens
cuguccugcucacguc

SEQ ID NO: 432343 - RNA, 18 nt, Homo sapiens
cugucgccugcggacucc

SEQ ID NO: 432344 - RNA, 23 nt, Homo sapiens
cugucucagagauauacuggccc

SEQ ID NO: 432345 - RNA, 16 nt, Homo sapiens
cugucuccucugucag

SEQ ID NO: 432346 - RNA, 11 nt, Homo sapiens
cugucuucccc

SEQ ID NO: 432347 - RNA, 15 nt, Homo sapiens
cugugaaaugacugc

SEQ ID NO: 432348 - RNA, 22 nt, Homo sapiens
cugugaaaugcuggcauuugca

SEQ ID NO: 432349 - RNA, 20 nt, Homo sapiens
cugugaauaaaaacccugua

SEQ ID NO: 432350 - RNA, 16 nt, Homo sapiens
cugugaauaaagccac

SEQ ID NO: 432351 - RNA, 13 nt, Homo sapiens
cugugaccauuua

SEQ ID NO: 432352 - RNA, 20 nt, Homo sapiens
cugugagaauaaagcauuuc

SEQ ID NO: 432353 - RNA, 23 nt, Homo sapiens
cugugagacgaggcaggggcucu

SEQ ID NO: 432354 - RNA, 13 nt, Homo sapiens
cugugaugccuga

SEQ ID NO: 432355 - RNA, 20 nt, Homo sapiens
cugugauggauggacacaaa

SEQ ID NO: 432356 - RNA, 23 nt, Homo sapiens
cugugaugucaguagugccugug

SEQ ID NO: 432357 - RNA, 14 nt, Homo sapiens
cugugcaucaacca

SEQ ID NO: 432358 - RNA, 18 nt, Homo sapiens
cugugccaggacugugac

SEQ ID NO: 432359 - RNA, 21 nt, Homo sapiens
cugugccaggacugugacuca

SEQ ID NO: 432360 - RNA, 11 nt, Homo sapiens
cugugccuaac

SEQ ID NO: 432361 - RNA, 13 nt, Homo sapiens
cugugccuaauaa

SEQ ID NO: 432362 - RNA, 18 nt, Homo sapiens
cugugccucccaagcuca

SEQ ID NO: 432363 - RNA, 22 nt, Homo sapiens
cugugccuggagcuccugggaa

SEQ ID NO: 432364 - RNA, 21 nt, Homo sapiens
cugugcucacccauugucuca

SEQ ID NO: 432365 - RNA, 18 nt, Homo sapiens
cugugcugauucaauaaa

SEQ ID NO: 432366 - RNA, 19 nt, Homo sapiens
cuguggacacuguggaaag

SEQ ID NO: 432367 - RNA, 21 nt, Homo sapiens
cuguggagaacaaagaccaau

SEQ ID NO: 432368 - RNA, 13 nt, Homo sapiens
cuguggagccauc

SEQ ID NO: 432369 - RNA, 11 nt, Homo sapiens
cuguggcauga

SEQ ID NO: 432370 - RNA, 22 nt, Homo sapiens
cugugggcauggucaaaggcuc

SEQ ID NO: 432371 - RNA, 16 nt, Homo sapiens
cuguggggccugaugg

SEQ ID NO: 432372 - RNA, 16 nt, Homo sapiens
cuguggguauucacca

SEQ ID NO: 432373 - RNA, 20 nt, Homo sapiens
cugugggucagugugccacc

SEQ ID NO: 432374 - RNA, 12 nt, Homo sapiens
cuguguaaccag

SEQ ID NO: 432375 - RNA, 13 nt, Homo sapiens
cuguguaucucag

SEQ ID NO: 432376 - RNA, 16 nt, Homo sapiens
cugugucaucugucag

SEQ ID NO: 432377 - RNA, 12 nt, Homo sapiens
cugugucugucc

SEQ ID NO: 432378 - RNA, 15 nt, Homo sapiens
cugugugaaggugaa

SEQ ID NO: 432379 - RNA, 15 nt, Homo sapiens
cugugugacuuugaa

SEQ ID NO: 432380 - RNA, 19 nt, Homo sapiens
cugugugcaagugugugca

SEQ ID NO: 432381 - RNA, 22 nt, Homo sapiens
cugugugcaagugugugcacau

SEQ ID NO: 432382 - RNA, 16 nt, Homo sapiens
cuguguuccuggcaau

SEQ ID NO: 432383 - RNA, 14 nt, Homo sapiens
cuguguucugcaca

SEQ ID NO: 432384 - RNA, 21 nt, Homo sapiens
cuguguuuaauaguauaucua

SEQ ID NO: 432385 - RNA, 20 nt, Homo sapiens
cuguuaaagccuaugaaugc

SEQ ID NO: 432386 - RNA, 14 nt, Homo sapiens
cuguuaaccaaaua

SEQ ID NO: 432387 - RNA, 23 nt, Homo sapiens
cuguuauccugcuagcuguagaa

SEQ ID NO: 432388 - RNA, 22 nt, Homo sapiens
cuguuauuaccauuagcauucu

SEQ ID NO: 432389 - RNA, 13 nt, Homo sapiens
cuguucaaaaagg

SEQ ID NO: 432390 - RNA, 15 nt, Homo sapiens
cuguucccuugcagg

SEQ ID NO: 432391 - RNA, 18 nt, Homo sapiens
cuguucccuugcaggggu

SEQ ID NO: 432392 - RNA, 16 nt, Homo sapiens
cuguucuaacauguaa

SEQ ID NO: 432393 - RNA, 16 nt, Homo sapiens
cuguucucagcaucca

SEQ ID NO: 432394 - RNA, 16 nt, Homo sapiens
cuguugauucuuucaa

SEQ ID NO: 432395 - RNA, 14 nt, Homo sapiens
cuguugcagguguc

SEQ ID NO: 432396 - RNA, 17 nt, Homo sapiens
cuguugcccauugcacu

SEQ ID NO: 432397 - RNA, 18 nt, Homo sapiens
cuguugcccauugcacuu

SEQ ID NO: 432398 - RNA, 19 nt, Homo sapiens
cuguuucuaauuugcugcu

SEQ ID NO: 432399 - RNA, 22 nt, Homo sapiens
cuguuucuaauuugcugcugau

SEQ ID NO: 432400 - RNA, 17 nt, Homo sapiens
cuguuucugcagccacu

SEQ ID NO: 432401 - RNA, 16 nt, Homo sapiens
cuguuucuucuuguga

SEQ ID NO: 432402 - RNA, 18 nt, Homo sapiens
cuguuugauacaguauua

SEQ ID NO: 432403 - RNA, 14 nt, Homo sapiens
cuguuuugccuuca

SEQ ID NO: 432404 - RNA, 17 nt, Homo sapiens
cuguuuugcuaugcuau

SEQ ID NO: 432405 - RNA, 24 nt, Homo sapiens
cuguuuuugaagaagggaaauuca

SEQ ID NO: 432406 - RNA, 15 nt, Homo sapiens
cuguuuuuuccugag

SEQ ID NO: 432407 - RNA, 15 nt, Homo sapiens
cuuaaaaaaugucca

SEQ ID NO: 432408 - RNA, 18 nt, Homo sapiens
cuuaaacaaaaacuuucc

SEQ ID NO: 432409 - RNA, 14 nt, Homo sapiens
cuuaaacuuuguca

SEQ ID NO: 432410 - RNA, 20 nt, Homo sapiens
cuuaaagaaacagcuuucaa

SEQ ID NO: 432411 - RNA, 20 nt, Homo sapiens
cuuaaauccaguggggaaaa

SEQ ID NO: 432412 - RNA, 22 nt, Homo sapiens
cuuaaaugaaaaaaaugaucua

SEQ ID NO: 432413 - RNA, 12 nt, Homo sapiens
cuuaacauucau

SEQ ID NO: 432414 - RNA, 15 nt, Homo sapiens
cuuaacauucauaga

SEQ ID NO: 432415 - RNA, 15 nt, Homo sapiens
cuuaacugugugaag

SEQ ID NO: 432416 - RNA, 22 nt, Homo sapiens
cuuaagaaagcuauauaugaau

SEQ ID NO: 432417 - RNA, 22 nt, Homo sapiens
cuuaagaacugcccagccucag

SEQ ID NO: 432418 - RNA, 21 nt, Homo sapiens
cuuaagauuccauuuuggaaa

SEQ ID NO: 432419 - RNA, 21 nt, Homo sapiens
cuuaagcacacuugacaucaa

SEQ ID NO: 432420 - RNA, 13 nt, Homo sapiens
cuuaagcacuuug

SEQ ID NO: 432421 - RNA, 21 nt, Homo sapiens
cuuaagcgauucucaugccuc

SEQ ID NO: 432422 - RNA, 18 nt, Homo sapiens
gaaaaacauuccaggaaa

SEQ ID NO: 432423 - RNA, 20 nt, Homo sapiens
gaaaaagaccuaugagcaca

SEQ ID NO: 432424 - RNA, 22 nt, Homo sapiens
gaaaaauaaucuuagaacagau

SEQ ID NO: 432425 - RNA, 14 nt, Homo sapiens
gaaaaauacuuuaa

SEQ ID NO: 432426 - RNA, 18 nt, Homo sapiens
gaaaaauaguguguccau

SEQ ID NO: 432427 - RNA, 18 nt, Homo sapiens
gaaaacaaucacacucau

SEQ ID NO: 432428 - RNA, 18 nt, Homo sapiens
gaaaacacuaguaccuuc

SEQ ID NO: 432429 - RNA, 12 nt, Homo sapiens
gaaaacaggcuc

SEQ ID NO: 432430 - RNA, 21 nt, Homo sapiens
gaaaacguaucaccuuuccca

SEQ ID NO: 432431 - RNA, 13 nt, Homo sapiens
gaaaacucuucau

SEQ ID NO: 432432 - RNA, 15 nt, Homo sapiens
gaaaacugucauuua

SEQ ID NO: 432433 - RNA, 15 nt, Homo sapiens
gaaaacuuauuugag

SEQ ID NO: 432434 - RNA, 19 nt, Homo sapiens
gaaaagaccaguccaugag

SEQ ID NO: 432435 - RNA, 17 nt, Homo sapiens
gaaaagauuucugucca

SEQ ID NO: 432436 - RNA, 16 nt, Homo sapiens
gaaaaggauaugcagu

SEQ ID NO: 432437 - RNA, 22 nt, Homo sapiens
gaaaaggcacgcuggcuuguga

SEQ ID NO: 432438 - RNA, 15 nt, Homo sapiens
gaaaagggaucugcu

SEQ ID NO: 432439 - RNA, 16 nt, Homo sapiens
gaaaagguugccugaa

SEQ ID NO: 432440 - RNA, 16 nt, Homo sapiens
gaaaaguacauuuaau

SEQ ID NO: 432441 - RNA, 12 nt, Homo sapiens
gaaaagugcuuu

SEQ ID NO: 432442 - RNA, 22 nt, Homo sapiens
gaaaaguggauggaagugucug

SEQ ID NO: 432443 - RNA, 21 nt, Homo sapiens
gaaaauaaucugguguucuug

SEQ ID NO: 432444 - RNA, 19 nt, Homo sapiens
gaaaauagaaacuugcuua

SEQ ID NO: 432445 - RNA, 21 nt, Homo sapiens
gaaaauaguggcaggacuguc

SEQ ID NO: 432446 - RNA, 23 nt, Homo sapiens
gaaaauaguggcaggacuguccc

SEQ ID NO: 432447 - RNA, 16 nt, Homo sapiens
gaaaauauggguugca

SEQ ID NO: 432448 - RNA, 15 nt, Homo sapiens
gaaaauccaucucau

SEQ ID NO: 432449 - RNA, 18 nt, Homo sapiens
gaaaaucgaguuggcaaa

SEQ ID NO: 432450 - RNA, 12 nt, Homo sapiens
gaaaaucuuaca

SEQ ID NO: 432451 - RNA, 17 nt, Homo sapiens
gaaacaauaaauuggaa

SEQ ID NO: 432452 - RNA, 13 nt, Homo sapiens
gaaacacagucau

SEQ ID NO: 432453 - RNA, 23 nt, Homo sapiens
gaaacacaucuucccuagagggu

SEQ ID NO: 432454 - RNA, 16 nt, Homo sapiens
gaaacacugugcaaag

SEQ ID NO: 432455 - RNA, 17 nt, Homo sapiens
gaaacagauaacaccaa

SEQ ID NO: 432456 - RNA, 17 nt, Homo sapiens
gaaacagccauguccaa

SEQ ID NO: 432457 - RNA, 17 nt, Homo sapiens
gaaacauuaugccuuaa

SEQ ID NO: 432458 - RNA, 11 nt, Homo sapiens
gaaacauuuag

SEQ ID NO: 432459 - RNA, 15 nt, Homo sapiens
gaaacauuugccaaa

SEQ ID NO: 432460 - RNA, 19 nt, Homo sapiens
gaaacauuuggaagcccca

SEQ ID NO: 432461 - RNA, 16 nt, Homo sapiens
gaaaccacugggcaua

SEQ ID NO: 432462 - RNA, 15 nt, Homo sapiens
gaaaccccacuucca

SEQ ID NO: 432463 - RNA, 19 nt, Homo sapiens
gaaaccccacuuccauugu

SEQ ID NO: 432464 - RNA, 20 nt, Homo sapiens
gaaacccuacgaaagcacag

SEQ ID NO: 432465 - RNA, 20 nt, Homo sapiens
gaaaccuuauuguaccucuc

SEQ ID NO: 432466 - RNA, 15 nt, Homo sapiens
gaaaccuuugacacu

SEQ ID NO: 432467 - RNA, 23 nt, Homo sapiens
gaaacucuauggguaucaaacag

SEQ ID NO: 432468 - RNA, 14 nt, Homo sapiens
gaaacuuagaucau

SEQ ID NO: 432469 - RNA, 10 nt, Homo sapiens
gaaacuuccc

SEQ ID NO: 432470 - RNA, 18 nt, Homo sapiens
gaaacuucccaacuuccc

SEQ ID NO: 432471 - RNA, 16 nt, Homo sapiens
gaaagaaaaauaccau

SEQ ID NO: 432472 - RNA, 15 nt, Homo sapiens
gaaagaaaaugaauu

SEQ ID NO: 432473 - RNA, 12 nt, Homo sapiens
gaaagaacauca

SEQ ID NO: 432474 - RNA, 14 nt, Homo sapiens
gaaagaacaucagu

SEQ ID NO: 432475 - RNA, 12 nt, Homo sapiens
gaaagaagacau

SEQ ID NO: 432476 - RNA, 12 nt, Homo sapiens
gaaagacaguaa

SEQ ID NO: 432477 - RNA, 15 nt, Homo sapiens
gaaagccucagccau

SEQ ID NO: 432478 - RNA, 12 nt, Homo sapiens
gaaagcuauaua

SEQ ID NO: 432479 - RNA, 12 nt, Homo sapiens
gaaagcuuucau

SEQ ID NO: 432480 - RNA, 14 nt, Homo sapiens
gaaagcuuucauga

SEQ ID NO: 432481 - RNA, 13 nt, Homo sapiens
gaaagcuuugaac

SEQ ID NO: 432482 - RNA, 21 nt, Homo sapiens
gaaaggaaauaguaccuucaa

SEQ ID NO: 432483 - RNA, 14 nt, Homo sapiens
gaaaggagacuaga

SEQ ID NO: 432484 - RNA, 19 nt, Homo sapiens
gaaaggaggaaggagccua

SEQ ID NO: 432485 - RNA, 22 nt, Homo sapiens
gaaaggcaucuaagacauucac

SEQ ID NO: 432486 - RNA, 23 nt, Homo sapiens
gaaaggcaucuaagacauucacc

SEQ ID NO: 432487 - RNA, 19 nt, Homo sapiens
gaaaggcaugaaucuuccc

SEQ ID NO: 432488 - RNA, 15 nt, Homo sapiens
gaaaggcuucuggga

SEQ ID NO: 432489 - RNA, 22 nt, Homo sapiens
gaaaggguucagggcaugggga

SEQ ID NO: 432490 - RNA, 13 nt, Homo sapiens
gaaaggugcucaa

SEQ ID NO: 432491 - RNA, 18 nt, Homo sapiens
gaaaguaaaaagaacaac

SEQ ID NO: 432492 - RNA, 17 nt, Homo sapiens
gaaaguaagugguagcu

SEQ ID NO: 432493 - RNA, 14 nt, Homo sapiens
gaaaguaugugaua

SEQ ID NO: 432494 - RNA, 18 nt, Homo sapiens
gaaagucuccuguaucau

SEQ ID NO: 432495 - RNA, 14 nt, Homo sapiens
gaaagugauuugua

SEQ ID NO: 432496 - RNA, 19 nt, Homo sapiens
gaaaguuuccccaccagug

SEQ ID NO: 432497 - RNA, 19 nt, Homo sapiens
gaaaguuuuuaauauuuau

SEQ ID NO: 432498 - RNA, 22 nt, Homo sapiens
gaaauaaaaucuaauuaauucu

SEQ ID NO: 432499 - RNA, 16 nt, Homo sapiens
gaaauaaacugugcaa

SEQ ID NO: 432500 - RNA, 14 nt, Homo sapiens
gaaauaaagcacau

SEQ ID NO: 432501 - RNA, 16 nt, Homo sapiens
gaaauaacacugugaa

SEQ ID NO: 432502 - RNA, 14 nt, Homo sapiens
gaaauaacauugca

SEQ ID NO: 432503 - RNA, 12 nt, Homo sapiens
gaaauacauaug

SEQ ID NO: 432504 - RNA, 13 nt, Homo sapiens
gaaauacauauga

SEQ ID NO: 432505 - RNA, 17 nt, Homo sapiens
gaaauacuuaaugccaa

SEQ ID NO: 432506 - RNA, 15 nt, Homo sapiens
gaaauacuugacaac

SEQ ID NO: 432507 - RNA, 14 nt, Homo sapiens
gaaauagaagcaaa

SEQ ID NO: 432508 - RNA, 20 nt, Homo sapiens
gaaauagaagcaaaugacaa

SEQ ID NO: 432509 - RNA, 22 nt, Homo sapiens
gaaauaguaccuucaauacuua

SEQ ID NO: 432510 - RNA, 13 nt, Homo sapiens
gaaauauauuuga

SEQ ID NO: 432511 - RNA, 23 nt, Homo sapiens
gaaauauccuaacccccuaagcu

SEQ ID NO: 432512 - RNA, 15 nt, Homo sapiens
gaaaucauuguagaa

SEQ ID NO: 432513 - RNA, 12 nt, Homo sapiens
gaaauccaaacu

SEQ ID NO: 432514 - RNA, 15 nt, Homo sapiens
gaaaucccaguucau

SEQ ID NO: 432515 - RNA, 17 nt, Homo sapiens
gaaaugauaaagauguc

SEQ ID NO: 432516 - RNA, 12 nt, Homo sapiens
gaaaugcugauu

SEQ ID NO: 432517 - RNA, 17 nt, Homo sapiens
gaaauggcuuuccacau

SEQ ID NO: 432518 - RNA, 14 nt, Homo sapiens
gaaauucacaaagu

SEQ ID NO: 432519 - RNA, 23 nt, Homo sapiens
gaaauucuucccuggggguccca

SEQ ID NO: 432520 - RNA, 17 nt, Homo sapiens
gaaauuuuuaaaucauu

SEQ ID NO: 432521 - RNA, 13 nt, Homo sapiens
gaacaaacaauga

SEQ ID NO: 432522 - RNA, 16 nt, Homo sapiens
gaacaagaauugcuaa

SEQ ID NO: 432523 - RNA, 20 nt, Homo sapiens
gaacaaguguacagaagaau

SEQ ID NO: 432524 - RNA, 18 nt, Homo sapiens
gaacaaucaaagcacuug

SEQ ID NO: 432525 - RNA, 17 nt, Homo sapiens
gaacacagcaugugcca

SEQ ID NO: 432526 - RNA, 21 nt, Homo sapiens
gaacacaguuuagugcuuuac

SEQ ID NO: 432527 - RNA, 15 nt, Homo sapiens
gaacacaucucuuag

SEQ ID NO: 432528 - RNA, 23 nt, Homo sapiens
gaacaccuccucaaaccuaccac

SEQ ID NO: 432529 - RNA, 21 nt, Homo sapiens
gaacacuaaugaggaaacugc

SEQ ID NO: 432530 - RNA, 23 nt, Homo sapiens
gaacacucaugcggcccagccau

SEQ ID NO: 432531 - RNA, 16 nt, Homo sapiens
gaacagauggcuguga

SEQ ID NO: 432532 - RNA, 12 nt, Homo sapiens
gaacagccagac

SEQ ID NO: 432533 - RNA, 20 nt, Homo sapiens
gaacaggaggaacuggucca

SEQ ID NO: 432534 - RNA, 14 nt, Homo sapiens
gaacaggugguggu

SEQ ID NO: 432535 - RNA, 13 nt, Homo sapiens
gaacaguguuucc

SEQ ID NO: 432536 - RNA, 20 nt, Homo sapiens
gaacaguuaagcagccgcca

SEQ ID NO: 432537 - RNA, 15 nt, Homo sapiens
gaacauacuucaucg

SEQ ID NO: 432538 - RNA, 16 nt, Homo sapiens
gaacaugaaaugcccu

SEQ ID NO: 432539 - RNA, 15 nt, Homo sapiens
gaacauggcauguga

SEQ ID NO: 432540 - RNA, 19 nt, Homo sapiens
gaacauggggaguguuuca

SEQ ID NO: 432541 - RNA, 15 nt, Homo sapiens
gaacauucgaggugu

SEQ ID NO: 432542 - RNA, 18 nt, Homo sapiens
gaaccaacccuccaggac

SEQ ID NO: 432543 - RNA, 18 nt, Homo sapiens
gaaccaacgggucugugg

SEQ ID NO: 432544 - RNA, 12 nt, Homo sapiens
gaaccaagaacu

SEQ ID NO: 432545 - RNA, 21 nt, Homo sapiens
gaaccaaggcagccuccagag

SEQ ID NO: 432546 - RNA, 12 nt, Homo sapiens
gaaccaauaaug

SEQ ID NO: 432547 - RNA, 17 nt, Homo sapiens
gaaccaaucccgugaaa

SEQ ID NO: 432548 - RNA, 21 nt, Homo sapiens
gaaccagagaggcucugagaa

SEQ ID NO: 432549 - RNA, 21 nt, Homo sapiens
gaaccagagccauggacucua

SEQ ID NO: 432550 - RNA, 11 nt, Homo sapiens
gaacccaugag

SEQ ID NO: 432551 - RNA, 14 nt, Homo sapiens
gaaccccaggagau

SEQ ID NO: 432552 - RNA, 22 nt, Homo sapiens
gaacccuuggagccaauggaga

SEQ ID NO: 432553 - RNA, 17 nt, Homo sapiens
gaaugaaugaaccauga

SEQ ID NO: 432554 - RNA, 18 nt, Homo sapiens
gaaugaccagccugucca

SEQ ID NO: 432555 - RNA, 20 nt, Homo sapiens
gaaugaccagguaacaucau

SEQ ID NO: 432556 - RNA, 21 nt, Homo sapiens
gaaugagaagaggcugcugca

SEQ ID NO: 432557 - RNA, 21 nt, Homo sapiens
gaaugauucccucuugcuauu

SEQ ID NO: 432558 - RNA, 15 nt, Homo sapiens
gaaugcggaaccaua

SEQ ID NO: 432559 - RNA, 21 nt, Homo sapiens
gaaugcuccauucaggccuau

SEQ ID NO: 432560 - RNA, 15 nt, Homo sapiens
gaauggcaugcugaa

SEQ ID NO: 432561 - RNA, 14 nt, Homo sapiens
gaaugggagccaga

SEQ ID NO: 432562 - RNA, 10 nt, Homo sapiens
gaauggugug

SEQ ID NO: 432563 - RNA, 18 nt, Homo sapiens
gaaugguguuguaugccu

SEQ ID NO: 432564 - RNA, 14 nt, Homo sapiens
gaauguacucuguu

SEQ ID NO: 432565 - RNA, 14 nt, Homo sapiens
gaauguaugugcac

SEQ ID NO: 432566 - RNA, 13 nt, Homo sapiens
gaaugugcagugu

SEQ ID NO: 432567 - RNA, 16 nt, Homo sapiens
gaaugugcagugucuu

SEQ ID NO: 432568 - RNA, 17 nt, Homo sapiens
gaaugugguuacuuccu

SEQ ID NO: 432569 - RNA, 20 nt, Homo sapiens
gaauguguuauuugucacaa

SEQ ID NO: 432570 - RNA, 15 nt, Homo sapiens
gaauguuaagcagau

SEQ ID NO: 432571 - RNA, 20 nt, Homo sapiens
gaauguuauccaacuauuaa

SEQ ID NO: 432572 - RNA, 13 nt, Homo sapiens
gaauguucugcug

SEQ ID NO: 432573 - RNA, 14 nt, Homo sapiens
gaauuaaccuggug

SEQ ID NO: 432574 - RNA, 15 nt, Homo sapiens
gaauuaucaucccaa

SEQ ID NO: 432575 - RNA, 12 nt, Homo sapiens
gaauuaugauaa

SEQ ID NO: 432576 - RNA, 20 nt, Homo sapiens
gaauuauuuugaaugucaca

SEQ ID NO: 432577 - RNA, 22 nt, Homo sapiens
gaauucauacucuguugccucc

SEQ ID NO: 432578 - RNA, 15 nt, Homo sapiens
gaauucugaacuuuu

SEQ ID NO: 432579 - RNA, 22 nt, Homo sapiens
gaauugaagacacguucuugcc

SEQ ID NO: 432580 - RNA, 22 nt, Homo sapiens
gaauugauauugaaugauguga

SEQ ID NO: 432581 - RNA, 15 nt, Homo sapiens
gaauuguagccaguu

SEQ ID NO: 432582 - RNA, 23 nt, Homo sapiens
gaauuucuuugauuuaacugacu

SEQ ID NO: 432583 - RNA, 21 nt, Homo sapiens
gaauuugaagaauuaaugaca

SEQ ID NO: 432584 - RNA, 16 nt, Homo sapiens
gaauuugggccucuug

SEQ ID NO: 432585 - RNA, 21 nt, Homo sapiens
gaauuuuaaaaaagauggauu

SEQ ID NO: 432586 - RNA, 15 nt, Homo sapiens
gaauuuuaagugcuu

SEQ ID NO: 432587 - RNA, 21 nt, Homo sapiens
gaauuuuauauucuaagccag

SEQ ID NO: 432588 - RNA, 19 nt, Homo sapiens
gaauuuucucuaacuucaa

SEQ ID NO: 432589 - RNA, 23 nt, Homo sapiens
gacaaaaagccuuuuccagaaga

SEQ ID NO: 432590 - RNA, 17 nt, Homo sapiens
gacaaaccgagugcaau

SEQ ID NO: 432591 - RNA, 22 nt, Homo sapiens
gacaaagcgugguggacaugca

SEQ ID NO: 432592 - RNA, 20 nt, Homo sapiens
gacaaaggccuuaacaaacg

SEQ ID NO: 432593 - RNA, 14 nt, Homo sapiens
gacaaagugacauu

SEQ ID NO: 432594 - RNA, 13 nt, Homo sapiens
gacaaaugcugcg

SEQ ID NO: 432595 - RNA, 20 nt, Homo sapiens
gacaaaugggccugccaaac

SEQ ID NO: 432596 - RNA, 19 nt, Homo sapiens
gacaacacguuacuagcag

SEQ ID NO: 432597 - RNA, 20 nt, Homo sapiens
gacaacauuuuucauagaua

SEQ ID NO: 432598 - RNA, 16 nt, Homo sapiens
gacaaccgaugcucca

SEQ ID NO: 432599 - RNA, 15 nt, Homo sapiens
gacaacgaugaugcu

SEQ ID NO: 432600 - RNA, 14 nt, Homo sapiens
gacaacuguuuaau

SEQ ID NO: 432601 - RNA, 12 nt, Homo sapiens
gacaagcacuuu

SEQ ID NO: 432602 - RNA, 22 nt, Homo sapiens
gacaagccaacuuguaaauaca

SEQ ID NO: 432603 - RNA, 17 nt, Homo sapiens
gacaaggccccagagac

SEQ ID NO: 432604 - RNA, 19 nt, Homo sapiens
gacaaucaugaaauaugca

SEQ ID NO: 432605 - RNA, 23 nt, Homo sapiens
gacaaugaugugaguacccagga

SEQ ID NO: 432606 - RNA, 21 nt, Homo sapiens
gacaauuccuagauaaaaaga

SEQ ID NO: 432607 - RNA, 16 nt, Homo sapiens
gacacagcagugguau

SEQ ID NO: 432608 - RNA, 20 nt, Homo sapiens
gacacaugcuguuggccuca

SEQ ID NO: 432609 - RNA, 23 nt, Homo sapiens
gacaccccugcucuacccaugag

SEQ ID NO: 432610 - RNA, 15 nt, Homo sapiens
gacacggccaugacc

SEQ ID NO: 432611 - RNA, 17 nt, Homo sapiens
gacacguccaccccagu

SEQ ID NO: 432612 - RNA, 15 nt, Homo sapiens
gacacguucuugcca

SEQ ID NO: 432613 - RNA, 14 nt, Homo sapiens
gacacuacaaacau

SEQ ID NO: 432614 - RNA, 13 nt, Homo sapiens
gacacucaaucua

SEQ ID NO: 432615 - RNA, 20 nt, Homo sapiens
gacagaaggcaaaguuucca

SEQ ID NO: 432616 - RNA, 17 nt, Homo sapiens
gacagacacugcugaac

SEQ ID NO: 432617 - RNA, 17 nt, Homo sapiens
gacagacagagaaggca

SEQ ID NO: 432618 - RNA, 23 nt, Homo sapiens
gacagagcgagacucugucucag

SEQ ID NO: 432619 - RNA, 13 nt, Homo sapiens
gacagagugagug

SEQ ID NO: 432620 - RNA, 16 nt, Homo sapiens
gacagcagccugugag

SEQ ID NO: 432621 - RNA, 22 nt, Homo sapiens
gacagcauuacacgccacaacu

SEQ ID NO: 432622 - RNA, 13 nt, Homo sapiens
gacaggaagacug

SEQ ID NO: 432623 - RNA, 18 nt, Homo sapiens
gacaggcagacacaugcu

SEQ ID NO: 432624 - RNA, 13 nt, Homo sapiens
gacaggcucuuag

SEQ ID NO: 432625 - RNA, 17 nt, Homo sapiens
gacagggaauaguggga

SEQ ID NO: 432626 - RNA, 12 nt, Homo sapiens
gacaggugaaug

SEQ ID NO: 432627 - RNA, 15 nt, Homo sapiens
gacagugaggcugca

SEQ ID NO: 432628 - RNA, 18 nt, Homo sapiens
gacagugauaggcccaag

SEQ ID NO: 432629 - RNA, 21 nt, Homo sapiens
gacagugccugggaauguauu

SEQ ID NO: 432630 - RNA, 19 nt, Homo sapiens
gacaguuaagagaaaugag

SEQ ID NO: 432631 - RNA, 19 nt, Homo sapiens
gacauaaaucuuccaaagu

SEQ ID NO: 432632 - RNA, 22 nt, Homo sapiens
gacauacauggaauagcaccug

SEQ ID NO: 432633 - RNA, 18 nt, Homo sapiens
gacauagucucuaccuau

SEQ ID NO: 432634 - RNA, 11 nt, Homo sapiens
gacauauuuga

SEQ ID NO: 432635 - RNA, 19 nt, Homo sapiens
gacauauuugaaugacugc

SEQ ID NO: 432636 - RNA, 16 nt, Homo sapiens
gacaucgguucauauu

SEQ ID NO: 432637 - RNA, 18 nt, Homo sapiens
gacaucgguucauauuaa

SEQ ID NO: 432638 - RNA, 24 nt, Homo sapiens
gacaucgguucauauuaagacaua

SEQ ID NO: 432639 - RNA, 16 nt, Homo sapiens
gacaucuccucacccc

SEQ ID NO: 432640 - RNA, 21 nt, Homo sapiens
gacaugaaauugagucauuuu

SEQ ID NO: 432641 - RNA, 21 nt, Homo sapiens
gacauuaacaguuuuccauga

SEQ ID NO: 432642 - RNA, 23 nt, Homo sapiens
gacauuaacaguuuuccaugaaa

SEQ ID NO: 432643 - RNA, 22 nt, Homo sapiens
gacauucaaggcauuucuauca

SEQ ID NO: 432644 - RNA, 23 nt, Homo sapiens
gacauucacucagagaagaccac

SEQ ID NO: 432645 - RNA, 13 nt, Homo sapiens
gacauugaacuga

SEQ ID NO: 432646 - RNA, 16 nt, Homo sapiens
gacauuggacuuccuc

SEQ ID NO: 432647 - RNA, 22 nt, Homo sapiens
gacauuugggacugucuugaga

SEQ ID NO: 432648 - RNA, 20 nt, Homo sapiens
gacauuuggugguacuuuau

SEQ ID NO: 432649 - RNA, 16 nt, Homo sapiens
gacauuuguccugcag

SEQ ID NO: 432650 - RNA, 17 nt, Homo sapiens
gaccaaaaugacaauga

SEQ ID NO: 432651 - RNA, 18 nt, Homo sapiens
gaccaaagauacauguaa

SEQ ID NO: 432652 - RNA, 18 nt, Homo sapiens
gaccacagaagacccgcu

SEQ ID NO: 432653 - RNA, 15 nt, Homo sapiens
gaccaccuugcacua

SEQ ID NO: 432654 - RNA, 21 nt, Homo sapiens
gaccacgcuuucuagcuguug

SEQ ID NO: 432655 - RNA, 22 nt, Homo sapiens
gaccacuuuccccgugggccau

SEQ ID NO: 432656 - RNA, 23 nt, Homo sapiens
gaccacuuuccccgugggccaug

SEQ ID NO: 432657 - RNA, 16 nt, Homo sapiens
gaccagacugcacagg

SEQ ID NO: 432658 - RNA, 22 nt, Homo sapiens
gaccagagcucuggagccaccu

SEQ ID NO: 432659 - RNA, 13 nt, Homo sapiens
gaccagcuuugca

SEQ ID NO: 432660 - RNA, 18 nt, Homo sapiens
gaccagcuuugcagugac

SEQ ID NO: 432661 - RNA, 14 nt, Homo sapiens
gaccaguuucuuga

SEQ ID NO: 432662 - RNA, 16 nt, Homo sapiens
gacccacaaacugccu

SEQ ID NO: 432663 - RNA, 19 nt, Homo sapiens
gacccaccuucaagcagcu

SEQ ID NO: 432664 - RNA, 15 nt, Homo sapiens
gacccaggcccucca

SEQ ID NO: 432665 - RNA, 20 nt, Homo sapiens
gaccccaaauuaagaaucua

SEQ ID NO: 432666 - RNA, 21 nt, Homo sapiens
gaccccagagggaccagcugg

SEQ ID NO: 432667 - RNA, 12 nt, Homo sapiens
gaccccaucuca

SEQ ID NO: 432668 - RNA, 13 nt, Homo sapiens
gaccccaucucau

SEQ ID NO: 432669 - RNA, 19 nt, Homo sapiens
gacccggagcuaacacugg

SEQ ID NO: 432670 - RNA, 15 nt, Homo sapiens
gacccggggcagcug

SEQ ID NO: 432671 - RNA, 15 nt, Homo sapiens
gacccuagcucuuuc

SEQ ID NO: 432672 - RNA, 18 nt, Homo sapiens
gacccuggcaucugacac

SEQ ID NO: 432673 - RNA, 21 nt, Homo sapiens
gaccgauagcaggugaacucg

SEQ ID NO: 432674 - RNA, 14 nt, Homo sapiens
gaccguacucucac

SEQ ID NO: 432675 - RNA, 15 nt, Homo sapiens
gaccgugaccaucuu

SEQ ID NO: 432676 - RNA, 20 nt, Homo sapiens
gaccuacagggaacugggaa

SEQ ID NO: 432677 - RNA, 19 nt, Homo sapiens
gaccuacuguucggacaaa

SEQ ID NO: 432678 - RNA, 13 nt, Homo sapiens
gaccuauugccag

SEQ ID NO: 432679 - RNA, 18 nt, Homo sapiens
gaccuccguguagugucu

SEQ ID NO: 432680 - RNA, 16 nt, Homo sapiens
gaccucugaagagcug

SEQ ID NO: 432681 - RNA, 19 nt, Homo sapiens
gaccugccugugugcuccg

SEQ ID NO: 432682 - RNA, 20 nt, Homo sapiens
gaccugcuuugagauuuccu

SEQ ID NO: 432683 - RNA, 14 nt, Homo sapiens
gauuaaaaccagag

SEQ ID NO: 432684 - RNA, 20 nt, Homo sapiens
gauuaacccuauuaaucuau

SEQ ID NO: 432685 - RNA, 19 nt, Homo sapiens
gauuaagauacacuccugc

SEQ ID NO: 432686 - RNA, 20 nt, Homo sapiens
gauuaauuuguguagauugu

SEQ ID NO: 432687 - RNA, 18 nt, Homo sapiens
gauuacagacaugaacca

SEQ ID NO: 432688 - RNA, 15 nt, Homo sapiens
gauuacaggcaccca

SEQ ID NO: 432689 - RNA, 20 nt, Homo sapiens
gauuacaggcgugagccacc

SEQ ID NO: 432690 - RNA, 12 nt, Homo sapiens
gauuacaggugc

SEQ ID NO: 432691 - RNA, 19 nt, Homo sapiens
gauuacugcccaauaugca

SEQ ID NO: 432692 - RNA, 14 nt, Homo sapiens
gauuauucaucaaa

SEQ ID NO: 432693 - RNA, 16 nt, Homo sapiens
gauuauuccuauaauu

SEQ ID NO: 432694 - RNA, 21 nt, Homo sapiens
gauuauuggaaauuuguuaua

SEQ ID NO: 432695 - RNA, 14 nt, Homo sapiens
gauuauuuaucaca

SEQ ID NO: 432696 - RNA, 15 nt, Homo sapiens
gauuauuuaucacau

SEQ ID NO: 432697 - RNA, 13 nt, Homo sapiens
gauucaauuuaaa

SEQ ID NO: 432698 - RNA, 21 nt, Homo sapiens
gauucauauuuacuucuuaua

SEQ ID NO: 432699 - RNA, 23 nt, Homo sapiens
gauucauuauuuuuccacuuugu

SEQ ID NO: 432700 - RNA, 18 nt, Homo sapiens
gauuccaggcgaugugca

SEQ ID NO: 432701 - RNA, 18 nt, Homo sapiens
gauucuaaugucuucauu

SEQ ID NO: 432702 - RNA, 19 nt, Homo sapiens
gauucuagcuaccuguauu

SEQ ID NO: 432703 - RNA, 16 nt, Homo sapiens
gauucuaggauaagca

SEQ ID NO: 432704 - RNA, 22 nt, Homo sapiens
gauucuuauuuuaccuucucau

SEQ ID NO: 432705 - RNA, 14 nt, Homo sapiens
gauucuuuguuaca

SEQ ID NO: 432706 - RNA, 16 nt, Homo sapiens
gauugaaagaaccaga

SEQ ID NO: 432707 - RNA, 17 nt, Homo sapiens
gauugaaggauugugaa

SEQ ID NO: 432708 - RNA, 16 nt, Homo sapiens
gauugacacagcccau

SEQ ID NO: 432709 - RNA, 16 nt, Homo sapiens
gauugauuaaugaacu

SEQ ID NO: 432710 - RNA, 22 nt, Homo sapiens
gauugcaaggaaggaaacaaug

SEQ ID NO: 432711 - RNA, 15 nt, Homo sapiens
gauugcacuagagaa

SEQ ID NO: 432712 - RNA, 14 nt, Homo sapiens
gauugccaaauuga

SEQ ID NO: 432713 - RNA, 21 nt, Homo sapiens
gauugccuuuggcaauucuuc

SEQ ID NO: 432714 - RNA, 18 nt, Homo sapiens
gauugcuacguaaucuca

SEQ ID NO: 432715 - RNA, 13 nt, Homo sapiens
gauuggcacagac

SEQ ID NO: 432716 - RNA, 13 nt, Homo sapiens
gauugggggcccu

SEQ ID NO: 432717 - RNA, 16 nt, Homo sapiens
gauugguaagagccaa

SEQ ID NO: 432718 - RNA, 18 nt, Homo sapiens
gauugucuuacuguugca

SEQ ID NO: 432719 - RNA, 20 nt, Homo sapiens
gauugucuuagacacugugg

SEQ ID NO: 432720 - RNA, 23 nt, Homo sapiens
gauuuauaaauuugaaauccaaa

SEQ ID NO: 432721 - RNA, 13 nt, Homo sapiens
gauuucacugaca

SEQ ID NO: 432722 - RNA, 19 nt, Homo sapiens
gauuuccacacgccaagcu

SEQ ID NO: 432723 - RNA, 14 nt, Homo sapiens
gauuuccauuugca

SEQ ID NO: 432724 - RNA, 20 nt, Homo sapiens
gauuuccauuugcaacagga

SEQ ID NO: 432725 - RNA, 18 nt, Homo sapiens
gauuucucaccuguaaga

SEQ ID NO: 432726 - RNA, 11 nt, Homo sapiens
gauuucuggga

SEQ ID NO: 432727 - RNA, 15 nt, Homo sapiens
gauuucuggggcccc

SEQ ID NO: 432728 - RNA, 14 nt, Homo sapiens
gauuugccaaaaac

SEQ ID NO: 432729 - RNA, 22 nt, Homo sapiens
gauuugucccuaugcauaucag

SEQ ID NO: 432730 - RNA, 18 nt, Homo sapiens
gauuuuacaaaagaugua

SEQ ID NO: 432731 - RNA, 15 nt, Homo sapiens
gauuuuaucuguuaa

SEQ ID NO: 432732 - RNA, 19 nt, Homo sapiens
gauuuuuuucauuuugcca

SEQ ID NO: 432733 - RNA, 20 nt, Homo sapiens
gauuuuuuucauuuugccaa

SEQ ID NO: 432734 - RNA, 12 nt, Homo sapiens
gcaaaaauauca

SEQ ID NO: 432735 - RNA, 22 nt, Homo sapiens
gcaaaaccuugugacucagugu

SEQ ID NO: 432736 - RNA, 13 nt, Homo sapiens
gcaaaacugcaaa

SEQ ID NO: 432737 - RNA, 14 nt, Homo sapiens
gcaaaacugcaaau

SEQ ID NO: 432738 - RNA, 23 nt, Homo sapiens
gcaaaacugccgcaagucugcag

SEQ ID NO: 432739 - RNA, 11 nt, Homo sapiens
gcaaacauuua

SEQ ID NO: 432740 - RNA, 15 nt, Homo sapiens
gcaaagaaucaacag

SEQ ID NO: 432741 - RNA, 14 nt, Homo sapiens
gcaaagacaggagg

SEQ ID NO: 432742 - RNA, 12 nt, Homo sapiens
gcaaagacuuaa

SEQ ID NO: 432743 - RNA, 15 nt, Homo sapiens
gcaaagagugugcuc

SEQ ID NO: 432744 - RNA, 23 nt, Homo sapiens
gcaaagcgauuccuaccauacaa

SEQ ID NO: 432745 - RNA, 15 nt, Homo sapiens
gcaaaggaagacuug

SEQ ID NO: 432746 - RNA, 16 nt, Homo sapiens
gcaaagucaucaaaga

SEQ ID NO: 432747 - RNA, 21 nt, Homo sapiens
gcaaagucaucaaagauugag

SEQ ID NO: 432748 - RNA, 14 nt, Homo sapiens
gcaaagucucucau

SEQ ID NO: 432749 - RNA, 19 nt, Homo sapiens
gcaaaguucccuacuuccu

SEQ ID NO: 432750 - RNA, 14 nt, Homo sapiens
gcaaauauguuugc

SEQ ID NO: 432751 - RNA, 14 nt, Homo sapiens
gcaaaucagucuca

SEQ ID NO: 432752 - RNA, 22 nt, Homo sapiens
gcaaaucuccuuuguccauuua

SEQ ID NO: 432753 - RNA, 14 nt, Homo sapiens
gcaaaugaguauuu

SEQ ID NO: 432754 - RNA, 19 nt, Homo sapiens
gcaaauggcagaaccaaag

SEQ ID NO: 432755 - RNA, 13 nt, Homo sapiens
gcaacaaacacau

SEQ ID NO: 432756 - RNA, 15 nt, Homo sapiens
gcaacagcacuggcu

SEQ ID NO: 432757 - RNA, 16 nt, Homo sapiens
gcaaccacacaccuca

SEQ ID NO: 432758 - RNA, 17 nt, Homo sapiens
gcaacccuaacaguaag

SEQ ID NO: 432759 - RNA, 19 nt, Homo sapiens
gcaaccucccaacccagag

SEQ ID NO: 432760 - RNA, 17 nt, Homo sapiens
gcaaccucccauuuuag

SEQ ID NO: 432761 - RNA, 13 nt, Homo sapiens
gcaacgacuacuu

SEQ ID NO: 432762 - RNA, 22 nt, Homo sapiens
gcaacgccugccuucugggcaa

SEQ ID NO: 432763 - RNA, 23 nt, Homo sapiens
gcaacgccugccuucugggcaag

SEQ ID NO: 432764 - RNA, 14 nt, Homo sapiens
gcaacuacagaauu

SEQ ID NO: 432765 - RNA, 15 nt, Homo sapiens
gcaacuacagaauuu

SEQ ID NO: 432766 - RNA, 18 nt, Homo sapiens
gcaacuggugacuguccc

SEQ ID NO: 432767 - RNA, 19 nt, Homo sapiens
gcaagaagugggauucagg

SEQ ID NO: 432768 - RNA, 16 nt, Homo sapiens
gcaagacguccuggaa

SEQ ID NO: 432769 - RNA, 16 nt, Homo sapiens
gcaagagaaacugcag

SEQ ID NO: 432770 - RNA, 14 nt, Homo sapiens
gcaagccacagaaa

SEQ ID NO: 432771 - RNA, 15 nt, Homo sapiens
gcaaggacauugccc

SEQ ID NO: 432772 - RNA, 14 nt, Homo sapiens
gcaaggaucacuug

SEQ ID NO: 432773 - RNA, 17 nt, Homo sapiens
gcaaggccucugccccu

SEQ ID NO: 432774 - RNA, 20 nt, Homo sapiens
gcaaguauguuuuagcaugu

SEQ ID NO: 432775 - RNA, 15 nt, Homo sapiens
gcaagucccaucuca

SEQ ID NO: 432776 - RNA, 18 nt, Homo sapiens
gcaagucccaugauuucu

SEQ ID NO: 432777 - RNA, 13 nt, Homo sapiens
gcaagugugugca

SEQ ID NO: 432778 - RNA, 15 nt, Homo sapiens
gcaagugugugcaca

SEQ ID NO: 432779 - RNA, 18 nt, Homo sapiens
gcaagugugugcaugugu

SEQ ID NO: 432780 - RNA, 17 nt, Homo sapiens
gcaauaaauaccagaca

SEQ ID NO: 432781 - RNA, 12 nt, Homo sapiens
gcaauacaaaga

SEQ ID NO: 432782 - RNA, 13 nt, Homo sapiens
gcaauccuuccaa

SEQ ID NO: 432783 - RNA, 21 nt, Homo sapiens
gcaaugaaugaugcuuuucug

SEQ ID NO: 432784 - RNA, 16 nt, Homo sapiens
gcaaugagacuacaac

SEQ ID NO: 432785 - RNA, 23 nt, Homo sapiens
gcaaugcacugaagcguguuucu

SEQ ID NO: 432786 - RNA, 12 nt, Homo sapiens
gcaaugucacaa

SEQ ID NO: 432787 - RNA, 20 nt, Homo sapiens
gcaaugugcccccagacgca

SEQ ID NO: 432788 - RNA, 22 nt, Homo sapiens
gcaauuccgcauuuaauucaug

SEQ ID NO: 432789 - RNA, 16 nt, Homo sapiens
gcaauucuucuucuca

SEQ ID NO: 432790 - RNA, 16 nt, Homo sapiens
gcaauuuucuaagcaa

SEQ ID NO: 432791 - RNA, 15 nt, Homo sapiens
gcacaaaaagcacaa

SEQ ID NO: 432792 - RNA, 16 nt, Homo sapiens
gcacaaaagccucuca

SEQ ID NO: 432793 - RNA, 22 nt, Homo sapiens
gcacaaaagucucaauguucca

SEQ ID NO: 432794 - RNA, 14 nt, Homo sapiens
gcacaaaugcaccu

SEQ ID NO: 432795 - RNA, 14 nt, Homo sapiens
gcacagacuucaca

SEQ ID NO: 432796 - RNA, 17 nt, Homo sapiens
gcacaggccacuugcuc

SEQ ID NO: 432797 - RNA, 19 nt, Homo sapiens
gcacaguagagcaaaucua

SEQ ID NO: 432798 - RNA, 13 nt, Homo sapiens
gcacauaacaugc

SEQ ID NO: 432799 - RNA, 15 nt, Homo sapiens
gcacauaacaugcuu

SEQ ID NO: 432800 - RNA, 18 nt, Homo sapiens
gcacauagcuaucaagug

SEQ ID NO: 432801 - RNA, 21 nt, Homo sapiens
gcacauagugggccuucauua

SEQ ID NO: 432802 - RNA, 18 nt, Homo sapiens
gcacauaucuccucuugg

SEQ ID NO: 432803 - RNA, 20 nt, Homo sapiens
gcacauaucuccucuugggc

SEQ ID NO: 432804 - RNA, 12 nt, Homo sapiens
gcacaucaggag

SEQ ID NO: 432805 - RNA, 23 nt, Homo sapiens
gcacaucauggcagugggaccaa

SEQ ID NO: 432806 - RNA, 16 nt, Homo sapiens
gcacauccaggcaaug

SEQ ID NO: 432807 - RNA, 15 nt, Homo sapiens
gcacaugugugcgug

SEQ ID NO: 432808 - RNA, 19 nt, Homo sapiens
gcaccacuguguauuuaac

SEQ ID NO: 432809 - RNA, 22 nt, Homo sapiens
gcaccaucuggaaggacaucua

SEQ ID NO: 432810 - RNA, 17 nt, Homo sapiens
gcacccagcuccagggg

SEQ ID NO: 432811 - RNA, 13 nt, Homo sapiens
gcaccccaugcca

SEQ ID NO: 432812 - RNA, 17 nt, Homo sapiens
gcacccucccacccggc

SEQ ID NO: 432813 - RNA, 19 nt, Homo sapiens
gcacccuguaucacagacu

SEQ ID NO: 432814 - RNA, 17 nt, Homo sapiens
gcguaguccgcuuucuc

SEQ ID NO: 432815 - RNA, 19 nt, Homo sapiens
gcgucacaucugcagugga

SEQ ID NO: 432816 - RNA, 17 nt, Homo sapiens
gcgucuacccagacuca

SEQ ID NO: 432817 - RNA, 19 nt, Homo sapiens
gcgugauccaccacaccug

SEQ ID NO: 432818 - RNA, 12 nt, Homo sapiens
gcgugcaugugc

SEQ ID NO: 432819 - RNA, 14 nt, Homo sapiens
gcgugcaugugcac

SEQ ID NO: 432820 - RNA, 20 nt, Homo sapiens
gcgugcuugcaugugcugca

SEQ ID NO: 432821 - RNA, 13 nt, Homo sapiens
gcguuaaagucag

SEQ ID NO: 432822 - RNA, 14 nt, Homo sapiens
gcguuaacacagua

SEQ ID NO: 432823 - RNA, 15 nt, Homo sapiens
gcguuggagacauac

SEQ ID NO: 432824 - RNA, 18 nt, Homo sapiens
gcguuuggcccugugacu

SEQ ID NO: 432825 - RNA, 15 nt, Homo sapiens
gcuaaaaagaacuca

SEQ ID NO: 432826 - RNA, 20 nt, Homo sapiens
gcuaaaauuagaugaacuca

SEQ ID NO: 432827 - RNA, 21 nt, Homo sapiens
gcuaagauuuagagaugaauu

SEQ ID NO: 432828 - RNA, 23 nt, Homo sapiens
gcuaauccacaaccuguuaccac

SEQ ID NO: 432829 - RNA, 14 nt, Homo sapiens
gcuaauguaauaac

SEQ ID NO: 432830 - RNA, 18 nt, Homo sapiens
gcuaauguaggacuguau

SEQ ID NO: 432831 - RNA, 13 nt, Homo sapiens
gcuaauuacacac

SEQ ID NO: 432832 - RNA, 15 nt, Homo sapiens
gcuaauucaauuuau

SEQ ID NO: 432833 - RNA, 19 nt, Homo sapiens
gcuacagaaaauaaucugg

SEQ ID NO: 432834 - RNA, 19 nt, Homo sapiens
gcuacagagaaaaucaaag

SEQ ID NO: 432835 - RNA, 18 nt, Homo sapiens
gcuacgguucccugccua

SEQ ID NO: 432836 - RNA, 22 nt, Homo sapiens
gcuacuauaugcauaaacaaca

SEQ ID NO: 432837 - RNA, 18 nt, Homo sapiens
gcuacucaggagacugag

SEQ ID NO: 432838 - RNA, 14 nt, Homo sapiens
gcuacuccacugac

SEQ ID NO: 432839 - RNA, 15 nt, Homo sapiens
gcuagaaugguggga

SEQ ID NO: 432840 - RNA, 16 nt, Homo sapiens
gcuaggcugagaugca

SEQ ID NO: 432841 - RNA, 20 nt, Homo sapiens
gcuaggguggcccuugcagu

SEQ ID NO: 432842 - RNA, 15 nt, Homo sapiens
gcuagucacauauca

SEQ ID NO: 432843 - RNA, 16 nt, Homo sapiens
gcuaguccggacccac

SEQ ID NO: 432844 - RNA, 15 nt, Homo sapiens
gcuagucugucaggg

SEQ ID NO: 432845 - RNA, 21 nt, Homo sapiens
gcuauaauuccgaaacauaca

SEQ ID NO: 432846 - RNA, 14 nt, Homo sapiens
gcuauagcuacagg

SEQ ID NO: 432847 - RNA, 21 nt, Homo sapiens
gcuaucugcauuuauaaaugu

SEQ ID NO: 432848 - RNA, 11 nt, Homo sapiens
gcuaugcaaau

SEQ ID NO: 432849 - RNA, 16 nt, Homo sapiens
gcuaugccugccucaa

SEQ ID NO: 432850 - RNA, 15 nt, Homo sapiens
gcuaugucugugaug

SEQ ID NO: 432851 - RNA, 16 nt, Homo sapiens
gcuaugugagcacaaa

SEQ ID NO: 432852 - RNA, 16 nt, Homo sapiens
gcuauuaagaaaauca

SEQ ID NO: 432853 - RNA, 19 nt, Homo sapiens
gcuauuacuaguacuauua

SEQ ID NO: 432854 - RNA, 20 nt, Homo sapiens
gcuauuacuaguacuauuac

SEQ ID NO: 432855 - RNA, 11 nt, Homo sapiens
gcuauucccug

SEQ ID NO: 432856 - RNA, 18 nt, Homo sapiens
gcucaaagauguacugag

SEQ ID NO: 432857 - RNA, 19 nt, Homo sapiens
gcucaaaguacuacagcaa

SEQ ID NO: 432858 - RNA, 16 nt, Homo sapiens
gcucaaaucuauucag

SEQ ID NO: 432859 - RNA, 14 nt, Homo sapiens
gcucaaccauggcu

SEQ ID NO: 432860 - RNA, 23 nt, Homo sapiens
gcucaagcacuuuuccugucuca

SEQ ID NO: 432861 - RNA, 21 nt, Homo sapiens
gcucaagcagucuacccaccu

SEQ ID NO: 432862 - RNA, 18 nt, Homo sapiens
gcucaaguugaugaauca

SEQ ID NO: 432863 - RNA, 15 nt, Homo sapiens
gcucaauauuccuga

SEQ ID NO: 432864 - RNA, 23 nt, Homo sapiens
gcucaauauuccugaaugaaaua

SEQ ID NO: 432865 - RNA, 18 nt, Homo sapiens
gcucaaugugcuguugau

SEQ ID NO: 432866 - RNA, 12 nt, Homo sapiens
gcucacacagcu

SEQ ID NO: 432867 - RNA, 17 nt, Homo sapiens
gcucacaccugaccaau

SEQ ID NO: 432868 - RNA, 18 nt, Homo sapiens
gcucacccauugucucau

SEQ ID NO: 432869 - RNA, 16 nt, Homo sapiens
gcucacggcacgcuug

SEQ ID NO: 432870 - RNA, 15 nt, Homo sapiens
gcucacgucugugag

SEQ ID NO: 432871 - RNA, 19 nt, Homo sapiens
gcucacuaaaaugcuaauu

SEQ ID NO: 432872 - RNA, 14 nt, Homo sapiens
gcucagacaugaua

SEQ ID NO: 432873 - RNA, 19 nt, Homo sapiens
gcucagagcagaaccaaag

SEQ ID NO: 432874 - RNA, 18 nt, Homo sapiens
gcucagauacacaaguga

SEQ ID NO: 432875 - RNA, 12 nt, Homo sapiens
gcucagggcuga

SEQ ID NO: 432876 - RNA, 16 nt, Homo sapiens
gcucagggcugacacg

SEQ ID NO: 432877 - RNA, 15 nt, Homo sapiens
gcucaggggcgugug

SEQ ID NO: 432878 - RNA, 20 nt, Homo sapiens
gcucaggggcguguggcuca

SEQ ID NO: 432879 - RNA, 16 nt, Homo sapiens
gcucauagaucagcaa

SEQ ID NO: 432880 - RNA, 20 nt, Homo sapiens
gcucaugucuauaaucccag

SEQ ID NO: 432881 - RNA, 15 nt, Homo sapiens
gcucaugucuguuaa

SEQ ID NO: 432882 - RNA, 19 nt, Homo sapiens
gcucauucauauuccugcc

SEQ ID NO: 432883 - RNA, 22 nt, Homo sapiens
gcuccaguggaagaagaaaaca

SEQ ID NO: 432884 - RNA, 21 nt, Homo sapiens
gcuccauccuugcaucacugg

SEQ ID NO: 432885 - RNA, 18 nt, Homo sapiens
gcuccauuuucuugucaa

SEQ ID NO: 432886 - RNA, 14 nt, Homo sapiens
gcucccaacagagg

SEQ ID NO: 432887 - RNA, 11 nt, Homo sapiens
gcucccagugc

SEQ ID NO: 432888 - RNA, 23 nt, Homo sapiens
gcucccucccccgcggugccuuc

SEQ ID NO: 432889 - RNA, 14 nt, Homo sapiens
gcuccgggugcgug

SEQ ID NO: 432890 - RNA, 18 nt, Homo sapiens
gcuccuccugcccugucc

SEQ ID NO: 432891 - RNA, 20 nt, Homo sapiens
gcuccuggaggcccugguca

SEQ ID NO: 432892 - RNA, 21 nt, Homo sapiens
gcuccuuucuccagccagcaa

SEQ ID NO: 432893 - RNA, 22 nt, Homo sapiens
gcucgccauucacugauuggaa

SEQ ID NO: 432894 - RNA, 20 nt, Homo sapiens
gcucguaugaauucauucuu

SEQ ID NO: 432895 - RNA, 23 nt, Homo sapiens
gcucguucucuucucucuucaau

SEQ ID NO: 432896 - RNA, 16 nt, Homo sapiens
gcucuaccaagacaua

SEQ ID NO: 432897 - RNA, 18 nt, Homo sapiens
gcucuaccaagacauaau

SEQ ID NO: 432898 - RNA, 13 nt, Homo sapiens
gcucuacccauga

SEQ ID NO: 432899 - RNA, 14 nt, Homo sapiens
gcucucacaugcac

SEQ ID NO: 432900 - RNA, 21 nt, Homo sapiens
gcucuccccaaacuugcuuua

SEQ ID NO: 432901 - RNA, 17 nt, Homo sapiens
gcucuccugacuuuuaa

SEQ ID NO: 432902 - RNA, 15 nt, Homo sapiens
gcucuccuucacucu

SEQ ID NO: 432903 - RNA, 14 nt, Homo sapiens
gcucucgacaguau

SEQ ID NO: 432904 - RNA, 14 nt, Homo sapiens
gcucugcaugugug

SEQ ID NO: 432905 - RNA, 19 nt, Homo sapiens
gcucugccacccuaccugu

SEQ ID NO: 432906 - RNA, 15 nt, Homo sapiens
gcucuggcaccacua

SEQ ID NO: 432907 - RNA, 16 nt, Homo sapiens
gcucugguuagaaaaa

SEQ ID NO: 432908 - RNA, 20 nt, Homo sapiens
gcucuguaggucauuggcca

SEQ ID NO: 432909 - RNA, 21 nt, Homo sapiens
gcucuguauucugcaacagcc

SEQ ID NO: 432910 - RNA, 21 nt, Homo sapiens
gcucuuagcagcuuccagauu

SEQ ID NO: 432911 - RNA, 16 nt, Homo sapiens
gcucuucaccaggaag

SEQ ID NO: 432912 - RNA, 21 nt, Homo sapiens
gcucuucuacguauaaauaug

SEQ ID NO: 432913 - RNA, 12 nt, Homo sapiens
gcucuugcucaa

SEQ ID NO: 432914 - RNA, 18 nt, Homo sapiens
gcucuuucucugccagug

SEQ ID NO: 432915 - RNA, 14 nt, Homo sapiens
gcucuuuggugcca

SEQ ID NO: 432916 - RNA, 17 nt, Homo sapiens
gcucuuuugagcauuua

SEQ ID NO: 432917 - RNA, 12 nt, Homo sapiens
gcugaaaacccg

SEQ ID NO: 432918 - RNA, 15 nt, Homo sapiens
gcugaaaagugcuuu

SEQ ID NO: 432919 - RNA, 14 nt, Homo sapiens
gcugacucauucuu

SEQ ID NO: 432920 - RNA, 20 nt, Homo sapiens
gcugagaucacaccacugua

SEQ ID NO: 432921 - RNA, 13 nt, Homo sapiens
gcugagauuacag

SEQ ID NO: 432922 - RNA, 14 nt, Homo sapiens
gcugagauuccugg

SEQ ID NO: 432923 - RNA, 13 nt, Homo sapiens
gcugagccaguca

SEQ ID NO: 432924 - RNA, 14 nt, Homo sapiens
gcugagcuuuccag

SEQ ID NO: 432925 - RNA, 20 nt, Homo sapiens
gcugaggcccccagcugccu

SEQ ID NO: 432926 - RNA, 19 nt, Homo sapiens
gcugaguagggacucaggg

SEQ ID NO: 432927 - RNA, 22 nt, Homo sapiens
gcugagugggagcugucaggca

SEQ ID NO: 432928 - RNA, 18 nt, Homo sapiens
gcugaucgggcaauggga

SEQ ID NO: 432929 - RNA, 15 nt, Homo sapiens
gcugaugcccuauaa

SEQ ID NO: 432930 - RNA, 23 nt, Homo sapiens
gcugaugucaaugcuauggacug

SEQ ID NO: 432931 - RNA, 20 nt, Homo sapiens
gcugauuuccaggccccuga

SEQ ID NO: 432932 - RNA, 12 nt, Homo sapiens
gcugauuucccu

SEQ ID NO: 432933 - RNA, 15 nt, Homo sapiens
gcugcaauacauuaa

SEQ ID NO: 432934 - RNA, 17 nt, Homo sapiens
gcugcacccacccagga

SEQ ID NO: 432935 - RNA, 16 nt, Homo sapiens
gcugcaccccaugugg

SEQ ID NO: 432936 - RNA, 21 nt, Homo sapiens
gcugcacccuguauggagcua

SEQ ID NO: 432937 - RNA, 21 nt, Homo sapiens
gcugcacucaagcuuggguga

SEQ ID NO: 432938 - RNA, 14 nt, Homo sapiens
gcugcacuccauga

SEQ ID NO: 432939 - RNA, 15 nt, Homo sapiens
gcugcacuccaugag

SEQ ID NO: 432940 - RNA, 19 nt, Homo sapiens
gcugcagacaaguggacag

SEQ ID NO: 432941 - RNA, 16 nt, Homo sapiens
gcugcagcuugggaga

SEQ ID NO: 432942 - RNA, 16 nt, Homo sapiens
gcugcagucccuggaa

SEQ ID NO: 432943 - RNA, 21 nt, Homo sapiens
gcugcaucuccccucagauuc

SEQ ID NO: 432944 - RNA, 16 nt, Homo sapiens
gcugccaaaaagaaca

SEQ ID NO: 432945 - RNA, 17 nt, Homo sapiens
uacacugugaacuuggg

SEQ ID NO: 432946 - RNA, 17 nt, Homo sapiens
uacacuugggugaaaag

SEQ ID NO: 432947 - RNA, 13 nt, Homo sapiens
uacagaacaaaga

SEQ ID NO: 432948 - RNA, 14 nt, Homo sapiens
uacagaacauaucc

SEQ ID NO: 432949 - RNA, 13 nt, Homo sapiens
uacagacaacaaa

SEQ ID NO: 432950 - RNA, 14 nt, Homo sapiens
uacagacagaauau

SEQ ID NO: 432951 - RNA, 16 nt, Homo sapiens
uacagacauuaaauaa

SEQ ID NO: 432952 - RNA, 21 nt, Homo sapiens
uacagagaaaaucaaagcagu

SEQ ID NO: 432953 - RNA, 13 nt, Homo sapiens
uacagaugaacuc

SEQ ID NO: 432954 - RNA, 13 nt, Homo sapiens
uacagaugggcaa

SEQ ID NO: 432955 - RNA, 14 nt, Homo sapiens
uacagcacuacucu

SEQ ID NO: 432956 - RNA, 13 nt, Homo sapiens
uacagcacuuuga

SEQ ID NO: 432957 - RNA, 14 nt, Homo sapiens
uacagcucuuggca

SEQ ID NO: 432958 - RNA, 18 nt, Homo sapiens
uacagcucuuggcauuuu

SEQ ID NO: 432959 - RNA, 13 nt, Homo sapiens
uacaggaaguacu

SEQ ID NO: 432960 - RNA, 14 nt, Homo sapiens
uacaggaaguacug

SEQ ID NO: 432961 - RNA, 20 nt, Homo sapiens
uacaggaugguuacugagga

SEQ ID NO: 432962 - RNA, 20 nt, Homo sapiens
uacaggggcccgccaccaca

SEQ ID NO: 432963 - RNA, 17 nt, Homo sapiens
uacaguauucuguacca

SEQ ID NO: 432964 - RNA, 22 nt, Homo sapiens
uacagugaugcugugcuaugaa

SEQ ID NO: 432965 - RNA, 22 nt, Homo sapiens
uacaguuaauuaugugcauauu

SEQ ID NO: 432966 - RNA, 20 nt, Homo sapiens
uacaguuaggcaccagaaga

SEQ ID NO: 432967 - RNA, 20 nt, Homo sapiens
uacauaacaggcauugcacu

SEQ ID NO: 432968 - RNA, 13 nt, Homo sapiens
uacauaaguaauu

SEQ ID NO: 432969 - RNA, 20 nt, Homo sapiens
uacauaccaccaccaagaaa

SEQ ID NO: 432970 - RNA, 13 nt, Homo sapiens
uacauagucuuug

SEQ ID NO: 432971 - RNA, 14 nt, Homo sapiens
uacauauguagaua

SEQ ID NO: 432972 - RNA, 24 nt, Homo sapiens
uacaucaccuuuuugacuuuucca

SEQ ID NO: 432973 - RNA, 16 nt, Homo sapiens
uacaucccagccugug

SEQ ID NO: 432974 - RNA, 20 nt, Homo sapiens
uacauccugcuacacucauc

SEQ ID NO: 432975 - RNA, 10 nt, Homo sapiens
uacaugacug

SEQ ID NO: 432976 - RNA, 23 nt, Homo sapiens
uacaugugauugugauucaucau

SEQ ID NO: 432977 - RNA, 24 nt, Homo sapiens
uacauuaaaauaacuaagcaagua

SEQ ID NO: 432978 - RNA, 19 nt, Homo sapiens
uacauuccaucacagccag

SEQ ID NO: 432979 - RNA, 15 nt, Homo sapiens
uacauuccucagcug

SEQ ID NO: 432980 - RNA, 17 nt, Homo sapiens
uacauuccucagcugcc

SEQ ID NO: 432981 - RNA, 20 nt, Homo sapiens
uacauucugcaagcacaucu

SEQ ID NO: 432982 - RNA, 19 nt, Homo sapiens
uacauucuuuaucuugaca

SEQ ID NO: 432983 - RNA, 20 nt, Homo sapiens
uacauucuuuaucuugacau

SEQ ID NO: 432984 - RNA, 23 nt, Homo sapiens
uacauuguuugucugucuucaua

SEQ ID NO: 432985 - RNA, 18 nt, Homo sapiens
uacauuucaccuacuuug

SEQ ID NO: 432986 - RNA, 12 nt, Homo sapiens
uacauuugcaug

SEQ ID NO: 432987 - RNA, 18 nt, Homo sapiens
uacauuuuauaucuggau

SEQ ID NO: 432988 - RNA, 14 nt, Homo sapiens
uacauuuugcuugc

SEQ ID NO: 432989 - RNA, 22 nt, Homo sapiens
uaccaaaaauaucccuuuuuca

SEQ ID NO: 432990 - RNA, 19 nt, Homo sapiens
uaccaaauccacaagccau

SEQ ID NO: 432991 - RNA, 20 nt, Homo sapiens
uaccaaauccacaagccauu

SEQ ID NO: 432992 - RNA, 18 nt, Homo sapiens
uaccaagccccuuggccc

SEQ ID NO: 432993 - RNA, 16 nt, Homo sapiens
uaccaaggaacaggaa

SEQ ID NO: 432994 - RNA, 13 nt, Homo sapiens
uaccaagugacca

SEQ ID NO: 432995 - RNA, 13 nt, Homo sapiens
uaccaaucauuuu

SEQ ID NO: 432996 - RNA, 12 nt, Homo sapiens
uaccacaguguc

SEQ ID NO: 432997 - RNA, 17 nt, Homo sapiens
uaccacaucacaccacu

SEQ ID NO: 432998 - RNA, 18 nt, Homo sapiens
uaccacaucacaccacuu

SEQ ID NO: 432999 - RNA, 15 nt, Homo sapiens
uaccagagauuuacc

SEQ ID NO: 433000 - RNA, 15 nt, Homo sapiens
uaccagaucuaauau

SEQ ID NO: 433001 - RNA, 13 nt, Homo sapiens
uaccagaugcuac

SEQ ID NO: 433002 - RNA, 22 nt, Homo sapiens
uaccagguuaccucacuuuuaa

SEQ ID NO: 433003 - RNA, 22 nt, Homo sapiens
uaccauaagcuuuuucucugaa

SEQ ID NO: 433004 - RNA, 17 nt, Homo sapiens
uaccaucuuaaucuuua

SEQ ID NO: 433005 - RNA, 20 nt, Homo sapiens
uaccauuguacccugcugua

SEQ ID NO: 433006 - RNA, 17 nt, Homo sapiens
uacccaggaugauuucc

SEQ ID NO: 433007 - RNA, 20 nt, Homo sapiens
uacccaggcuggagugcagu

SEQ ID NO: 433008 - RNA, 15 nt, Homo sapiens
uaccccugcucccau

SEQ ID NO: 433009 - RNA, 18 nt, Homo sapiens
uacccuacaccucugggc

SEQ ID NO: 433010 - RNA, 13 nt, Homo sapiens
uaccggcaauuuc

SEQ ID NO: 433011 - RNA, 14 nt, Homo sapiens
uaccgucugugauu

SEQ ID NO: 433012 - RNA, 16 nt, Homo sapiens
uaccuaacauuauuua

SEQ ID NO: 433013 - RNA, 14 nt, Homo sapiens
uaccuagcauuuca

SEQ ID NO: 433014 - RNA, 23 nt, Homo sapiens
uaccuaugugugugcuuugccac

SEQ ID NO: 433015 - RNA, 17 nt, Homo sapiens
uaccucaagggggacug

SEQ ID NO: 433016 - RNA, 20 nt, Homo sapiens
uaccuccuccucuggacaaa

SEQ ID NO: 433017 - RNA, 16 nt, Homo sapiens
uaccucuuaacaauuu

SEQ ID NO: 433018 - RNA, 15 nt, Homo sapiens
uaccugaaaauucaa

SEQ ID NO: 433019 - RNA, 23 nt, Homo sapiens
uaccugaagucuuuguacagaca

SEQ ID NO: 433020 - RNA, 13 nt, Homo sapiens
uaccugacuucca

SEQ ID NO: 433021 - RNA, 15 nt, Homo sapiens
uaccugagauggagg

SEQ ID NO: 433022 - RNA, 14 nt, Homo sapiens
uaccugccucagcc

SEQ ID NO: 433023 - RNA, 21 nt, Homo sapiens
uaccugcuccuuggccuaguc

SEQ ID NO: 433024 - RNA, 21 nt, Homo sapiens
uaccugggcauucuuguuuca

SEQ ID NO: 433025 - RNA, 20 nt, Homo sapiens
uacggaaggcucugggaucu

SEQ ID NO: 433026 - RNA, 16 nt, Homo sapiens
uacggagggugggcuc

SEQ ID NO: 433027 - RNA, 20 nt, Homo sapiens
uacguuaugauaguguccca

SEQ ID NO: 433028 - RNA, 23 nt, Homo sapiens
uacuaagccacaagaaauuugau

SEQ ID NO: 433029 - RNA, 13 nt, Homo sapiens
uacuaaucuuucu

SEQ ID NO: 433030 - RNA, 13 nt, Homo sapiens
uacuaaugugccc

SEQ ID NO: 433031 - RNA, 22 nt, Homo sapiens
uacuaaugugccccauguccaa

SEQ ID NO: 433032 - RNA, 13 nt, Homo sapiens
uacuacaguauac

SEQ ID NO: 433033 - RNA, 15 nt, Homo sapiens
uacuaccacaaggaa

SEQ ID NO: 433034 - RNA, 15 nt, Homo sapiens
uacuauuaacucugc

SEQ ID NO: 433035 - RNA, 16 nt, Homo sapiens
uacuauuaacucugca

SEQ ID NO: 433036 - RNA, 15 nt, Homo sapiens
uacuauuacuaguac

SEQ ID NO: 433037 - RNA, 15 nt, Homo sapiens
uacuauuauggaauu

SEQ ID NO: 433038 - RNA, 12 nt, Homo sapiens
uacuauugcuag

SEQ ID NO: 433039 - RNA, 16 nt, Homo sapiens
uacuauuuucauucuc

SEQ ID NO: 433040 - RNA, 16 nt, Homo sapiens
uacuauuuuuacuaau

SEQ ID NO: 433041 - RNA, 13 nt, Homo sapiens
uacucaaccaaau

SEQ ID NO: 433042 - RNA, 17 nt, Homo sapiens
uacucauuuuauucacu

SEQ ID NO: 433043 - RNA, 13 nt, Homo sapiens
uacuccucugcag

SEQ ID NO: 433044 - RNA, 19 nt, Homo sapiens
uacucgaguuacagacaaa

SEQ ID NO: 433045 - RNA, 21 nt, Homo sapiens
uacucgaguuacagacaaagc

SEQ ID NO: 433046 - RNA, 15 nt, Homo sapiens
uacucuaagucucca

SEQ ID NO: 433047 - RNA, 20 nt, Homo sapiens
uacucuaucagagaaaaaca

SEQ ID NO: 433048 - RNA, 12 nt, Homo sapiens
uacucucuugcc

SEQ ID NO: 433049 - RNA, 21 nt, Homo sapiens
uacugaauuucuuugauuuaa

SEQ ID NO: 433050 - RNA, 13 nt, Homo sapiens
uacugacuugagg

SEQ ID NO: 433051 - RNA, 14 nt, Homo sapiens
uacugagacauuac

SEQ ID NO: 433052 - RNA, 19 nt, Homo sapiens
uacugaggaaucagcucaa

SEQ ID NO: 433053 - RNA, 23 nt, Homo sapiens
uacugcaaaugcuauauugcacu

SEQ ID NO: 433054 - RNA, 19 nt, Homo sapiens
uacugcuaguaccuguaag

SEQ ID NO: 433055 - RNA, 23 nt, Homo sapiens
uacuggaaaccuguuaugccaaa

SEQ ID NO: 433056 - RNA, 14 nt, Homo sapiens
uacuggugcaguca

SEQ ID NO: 433057 - RNA, 20 nt, Homo sapiens
uacuuaaaaauagucuucca

SEQ ID NO: 433058 - RNA, 14 nt, Homo sapiens
uacuuaaacagcuu

SEQ ID NO: 433059 - RNA, 15 nt, Homo sapiens
uacuuaaagcuucua

SEQ ID NO: 433060 - RNA, 19 nt, Homo sapiens
uacuuaacuauucaggaga

SEQ ID NO: 433061 - RNA, 20 nt, Homo sapiens
uacuuaacugugugaagaaa

SEQ ID NO: 433062 - RNA, 15 nt, Homo sapiens
uacuuaaugccaagu

SEQ ID NO: 433063 - RNA, 19 nt, Homo sapiens
uacuuaauuccuuucucau

SEQ ID NO: 433064 - RNA, 18 nt, Homo sapiens
uacuuagagaugcuacug

SEQ ID NO: 433065 - RNA, 17 nt, Homo sapiens
uacuuagcaugcacaaa

SEQ ID NO: 433066 - RNA, 19 nt, Homo sapiens
uacuuaggaaauacucagc

SEQ ID NO: 433067 - RNA, 22 nt, Homo sapiens
uacuuagugguaugucucuuua

SEQ ID NO: 433068 - RNA, 15 nt, Homo sapiens
uacuucccucaggcc

SEQ ID NO: 433069 - RNA, 15 nt, Homo sapiens
uacuucucgugacac

SEQ ID NO: 433070 - RNA, 23 nt, Homo sapiens
uacuucugugucugucaccacau

SEQ ID NO: 433071 - RNA, 21 nt, Homo sapiens
uacuucuucauccauagacac

SEQ ID NO: 433072 - RNA, 15 nt, Homo sapiens
uacuugaugcacuua

SEQ ID NO: 433073 - RNA, 14 nt, Homo sapiens
uacuuuaacuucca

SEQ ID NO: 433074 - RNA, 12 nt, Homo sapiens
uacuuuaccucc

SEQ ID NO: 433075 - RNA, 14 nt, Homo sapiens
uacuuucacacuaa

SEQ ID NO: 433076 - RNA, 16 nt, Homo sapiens
ucaccucauaugcuau

SEQ ID NO: 433077 - RNA, 16 nt, Homo sapiens
ucaccucccaaaccca

SEQ ID NO: 433078 - RNA, 18 nt, Homo sapiens
ucaccuggcuucccagga

SEQ ID NO: 433079 - RNA, 18 nt, Homo sapiens
ucaccuguaaaacuuuau

SEQ ID NO: 433080 - RNA, 20 nt, Homo sapiens
ucaccuuuuugacuuuucca

SEQ ID NO: 433081 - RNA, 19 nt, Homo sapiens
ucacgccauucuccugccu

SEQ ID NO: 433082 - RNA, 21 nt, Homo sapiens
ucacgcuuucaugaccacugg

SEQ ID NO: 433083 - RNA, 17 nt, Homo sapiens
ucacuacaaaaauacaa

SEQ ID NO: 433084 - RNA, 21 nt, Homo sapiens
ucacuauucuuaagcacuuug

SEQ ID NO: 433085 - RNA, 23 nt, Homo sapiens
ucacucaacaaaagugcuuugga

SEQ ID NO: 433086 - RNA, 14 nt, Homo sapiens
ucacucaccaucug

SEQ ID NO: 433087 - RNA, 17 nt, Homo sapiens
ucacucaccaucuggaa

SEQ ID NO: 433088 - RNA, 20 nt, Homo sapiens
ucacuccaggauauugacaa

SEQ ID NO: 433089 - RNA, 21 nt, Homo sapiens
ucacucuauuaaaucuugcaa

SEQ ID NO: 433090 - RNA, 16 nt, Homo sapiens
ucacucugcuuugcau

SEQ ID NO: 433091 - RNA, 22 nt, Homo sapiens
ucacucugggcggcuccccaua

SEQ ID NO: 433092 - RNA, 16 nt, Homo sapiens
ucacugaaacuucaag

SEQ ID NO: 433093 - RNA, 14 nt, Homo sapiens
ucacugagaagauu

SEQ ID NO: 433094 - RNA, 18 nt, Homo sapiens
ucacugcaacuucugccu

SEQ ID NO: 433095 - RNA, 16 nt, Homo sapiens
ucacugcaagcuccaa

SEQ ID NO: 433096 - RNA, 15 nt, Homo sapiens
ucacugccaacuuuu

SEQ ID NO: 433097 - RNA, 14 nt, Homo sapiens
ucacuggaacacua

SEQ ID NO: 433098 - RNA, 15 nt, Homo sapiens
ucacugucuguuguu

SEQ ID NO: 433099 - RNA, 17 nt, Homo sapiens
ucacugucuuuccuaga

SEQ ID NO: 433100 - RNA, 11 nt, Homo sapiens
ucacugugcuc

SEQ ID NO: 433101 - RNA, 16 nt, Homo sapiens
ucacuguucaugaaua

SEQ ID NO: 433102 - RNA, 20 nt, Homo sapiens
ucacuguugcuuaauuguga

SEQ ID NO: 433103 - RNA, 15 nt, Homo sapiens
ucacuucugcuguac

SEQ ID NO: 433104 - RNA, 20 nt, Homo sapiens
ucacuugugcaguguugaca

SEQ ID NO: 433105 - RNA, 17 nt, Homo sapiens
ucacuuuuacuacccca

SEQ ID NO: 433106 - RNA, 18 nt, Homo sapiens
ucagaaaccccacuucca

SEQ ID NO: 433107 - RNA, 16 nt, Homo sapiens
ucagaaacgaaaucua

SEQ ID NO: 433108 - RNA, 13 nt, Homo sapiens
ucagaacaugaaa

SEQ ID NO: 433109 - RNA, 15 nt, Homo sapiens
ucagaagcucuucua

SEQ ID NO: 433110 - RNA, 19 nt, Homo sapiens
ucagaaguuucucagcucc

SEQ ID NO: 433111 - RNA, 17 nt, Homo sapiens
ucagaauggauuuauca

SEQ ID NO: 433112 - RNA, 18 nt, Homo sapiens
ucagacaauuuauccaaa

SEQ ID NO: 433113 - RNA, 19 nt, Homo sapiens
ucagacagggucugaagga

SEQ ID NO: 433114 - RNA, 16 nt, Homo sapiens
ucagaccaacucucuc

SEQ ID NO: 433115 - RNA, 16 nt, Homo sapiens
ucagaccaguacuggg

SEQ ID NO: 433116 - RNA, 17 nt, Homo sapiens
ucagaccaguacuggga

SEQ ID NO: 433117 - RNA, 20 nt, Homo sapiens
ucagaccugucuuccaagga

SEQ ID NO: 433118 - RNA, 14 nt, Homo sapiens
ucagacucaucuac

SEQ ID NO: 433119 - RNA, 16 nt, Homo sapiens
ucagagaaaacacuuu

SEQ ID NO: 433120 - RNA, 18 nt, Homo sapiens
ucagagaaauacuuucag

SEQ ID NO: 433121 - RNA, 22 nt, Homo sapiens
ucagagaagaccacaccaagga

SEQ ID NO: 433122 - RNA, 14 nt, Homo sapiens
ucagaggaguuuaa

SEQ ID NO: 433123 - RNA, 15 nt, Homo sapiens
ucagaggccuaguca

SEQ ID NO: 433124 - RNA, 17 nt, Homo sapiens
ucagaucauauuucaca

SEQ ID NO: 433125 - RNA, 20 nt, Homo sapiens
ucagaucugaacacaguuua

SEQ ID NO: 433126 - RNA, 15 nt, Homo sapiens
ucagaugacuagaaa

SEQ ID NO: 433127 - RNA, 18 nt, Homo sapiens
ucagauggagacauugga

SEQ ID NO: 433128 - RNA, 18 nt, Homo sapiens
ucagauggagguucucag

SEQ ID NO: 433129 - RNA, 19 nt, Homo sapiens
ucagauggagguucucaga

SEQ ID NO: 433130 - RNA, 16 nt, Homo sapiens
ucagauggcacauuag

SEQ ID NO: 433131 - RNA, 12 nt, Homo sapiens
ucagauuccacc

SEQ ID NO: 433132 - RNA, 20 nt, Homo sapiens
ucagauugcuuuugugcauu

SEQ ID NO: 433133 - RNA, 20 nt, Homo sapiens
ucagauuguuaucuaucaac

SEQ ID NO: 433134 - RNA, 20 nt, Homo sapiens
ucagcaacccuacaguauau

SEQ ID NO: 433135 - RNA, 15 nt, Homo sapiens
ucagcaaguguacag

SEQ ID NO: 433136 - RNA, 19 nt, Homo sapiens
ucagcaaguguacaguauu

SEQ ID NO: 433137 - RNA, 20 nt, Homo sapiens
ucagcaguucagcuccuucc

SEQ ID NO: 433138 - RNA, 15 nt, Homo sapiens
ucagcauuauuccuc

SEQ ID NO: 433139 - RNA, 21 nt, Homo sapiens
ucagcauucaaaauaguucua

SEQ ID NO: 433140 - RNA, 23 nt, Homo sapiens
ucagccaaaugacuucauuucug

SEQ ID NO: 433141 - RNA, 18 nt, Homo sapiens
ucagccaacauugccuug

SEQ ID NO: 433142 - RNA, 20 nt, Homo sapiens
ucagccagcugcccacaagc

SEQ ID NO: 433143 - RNA, 14 nt, Homo sapiens
ucagccauucacug

SEQ ID NO: 433144 - RNA, 22 nt, Homo sapiens
ucagccauuccuguucccauga

SEQ ID NO: 433145 - RNA, 15 nt, Homo sapiens
ucagccucauucacu

SEQ ID NO: 433146 - RNA, 20 nt, Homo sapiens
ucagccucccaaagugcuga

SEQ ID NO: 433147 - RNA, 20 nt, Homo sapiens
ucagccucuuaaagcugccu

SEQ ID NO: 433148 - RNA, 21 nt, Homo sapiens
ucagccugggacaccuaggug

SEQ ID NO: 433149 - RNA, 13 nt, Homo sapiens
ucagccuuccaaa

SEQ ID NO: 433150 - RNA, 16 nt, Homo sapiens
ucagcuccuugguucc

SEQ ID NO: 433151 - RNA, 16 nt, Homo sapiens
ucagcugcacauuccu

SEQ ID NO: 433152 - RNA, 19 nt, Homo sapiens
ucagcuggcggaaccuggc

SEQ ID NO: 433153 - RNA, 15 nt, Homo sapiens
ucagcuguaccaagc

SEQ ID NO: 433154 - RNA, 17 nt, Homo sapiens
ucagcugugaacaugga

SEQ ID NO: 433155 - RNA, 19 nt, Homo sapiens
ucagcuuauuguagcauau

SEQ ID NO: 433156 - RNA, 23 nt, Homo sapiens
ucagcuuucccuggcucagggau

SEQ ID NO: 433157 - RNA, 19 nt, Homo sapiens
ucaggaauacauuuggaaa

SEQ ID NO: 433158 - RNA, 22 nt, Homo sapiens
ucaggagagagcuuccuguuuc

SEQ ID NO: 433159 - RNA, 15 nt, Homo sapiens
ucaggcacauguguu

SEQ ID NO: 433160 - RNA, 21 nt, Homo sapiens
ucaggccgggugcaguggcuc

SEQ ID NO: 433161 - RNA, 18 nt, Homo sapiens
ucaggcucugaaucucuc

SEQ ID NO: 433162 - RNA, 20 nt, Homo sapiens
ucaggcucugaaucucucaa

SEQ ID NO: 433163 - RNA, 17 nt, Homo sapiens
ucagggaaaaggaguag

SEQ ID NO: 433164 - RNA, 17 nt, Homo sapiens
ucagggcacugcugcug

SEQ ID NO: 433165 - RNA, 16 nt, Homo sapiens
ucagggccaugccugc

SEQ ID NO: 433166 - RNA, 15 nt, Homo sapiens
ucagggcucuaccaa

SEQ ID NO: 433167 - RNA, 14 nt, Homo sapiens
ucaggggacucagc

SEQ ID NO: 433168 - RNA, 15 nt, Homo sapiens
ucaggggacuugaau

SEQ ID NO: 433169 - RNA, 19 nt, Homo sapiens
ucagggugcucccuccuca

SEQ ID NO: 433170 - RNA, 12 nt, Homo sapiens
ucaggguggcug

SEQ ID NO: 433171 - RNA, 21 nt, Homo sapiens
ucaggugauccgccuaccuca

SEQ ID NO: 433172 - RNA, 19 nt, Homo sapiens
ucagguggggaguccaggg

SEQ ID NO: 433173 - RNA, 15 nt, Homo sapiens
ucaguaaauuuugga

SEQ ID NO: 433174 - RNA, 17 nt, Homo sapiens
ucaguaaauuuuggaaa

SEQ ID NO: 433175 - RNA, 15 nt, Homo sapiens
ucaguaauagcugaa

SEQ ID NO: 433176 - RNA, 23 nt, Homo sapiens
ucaguaauagcugaaccuguuca

SEQ ID NO: 433177 - RNA, 14 nt, Homo sapiens
ucaguacuuuauga

SEQ ID NO: 433178 - RNA, 16 nt, Homo sapiens
ucaguagaccuaauga

SEQ ID NO: 433179 - RNA, 15 nt, Homo sapiens
ucaguaugaagacac

SEQ ID NO: 433180 - RNA, 17 nt, Homo sapiens
ucaguaugaagacacug

SEQ ID NO: 433181 - RNA, 13 nt, Homo sapiens
ucagucauaauca

SEQ ID NO: 433182 - RNA, 16 nt, Homo sapiens
ucaguccaagucuucu

SEQ ID NO: 433183 - RNA, 23 nt, Homo sapiens
ucaguccugggagacccauguaa

SEQ ID NO: 433184 - RNA, 14 nt, Homo sapiens
ucagucuacaggcc

SEQ ID NO: 433185 - RNA, 10 nt, Homo sapiens
ucagucuuca

SEQ ID NO: 433186 - RNA, 19 nt, Homo sapiens
ucagucuucacuugcacug

SEQ ID NO: 433187 - RNA, 21 nt, Homo sapiens
ucagucuuugggggauucaaa

SEQ ID NO: 433188 - RNA, 21 nt, Homo sapiens
ucagugaagcccaggaggacc

SEQ ID NO: 433189 - RNA, 18 nt, Homo sapiens
ucaguggggccccaaagc

SEQ ID NO: 433190 - RNA, 16 nt, Homo sapiens
ucaguggugagacugu

SEQ ID NO: 433191 - RNA, 19 nt, Homo sapiens
ucaguguccucuugcucaa

SEQ ID NO: 433192 - RNA, 15 nt, Homo sapiens
ucagugugcaaagaa

SEQ ID NO: 433193 - RNA, 17 nt, Homo sapiens
ucaguguggacugggaa

SEQ ID NO: 433194 - RNA, 20 nt, Homo sapiens
ucaguguuauaaaaucugua

SEQ ID NO: 433195 - RNA, 12 nt, Homo sapiens
ucaguuccagcu

SEQ ID NO: 433196 - RNA, 14 nt, Homo sapiens
ucaguuggagaaaa

SEQ ID NO: 433197 - RNA, 20 nt, Homo sapiens
ucaguugugaagaggggcca

SEQ ID NO: 433198 - RNA, 19 nt, Homo sapiens
ucaguuucacauauuugua

SEQ ID NO: 433199 - RNA, 16 nt, Homo sapiens
ucaguuucacuuucac

SEQ ID NO: 433200 - RNA, 20 nt, Homo sapiens
ucauaaaaauaaccaaaaaa

SEQ ID NO: 433201 - RNA, 17 nt, Homo sapiens
ucauaaauguuugcugc

SEQ ID NO: 433202 - RNA, 21 nt, Homo sapiens
ucauaacaauguaugugaaag

SEQ ID NO: 433203 - RNA, 18 nt, Homo sapiens
ucauaaggcauauacaaa

SEQ ID NO: 433204 - RNA, 13 nt, Homo sapiens
ucauaauugucaa

SEQ ID NO: 433205 - RNA, 13 nt, Homo sapiens
ucauagcauuaac

SEQ ID NO: 433206 - RNA, 20 nt, Homo sapiens
uccuguuaauucuagaucag

SEQ ID NO: 433207 - RNA, 21 nt, Homo sapiens
uccuguugagaugggggacug

SEQ ID NO: 433208 - RNA, 18 nt, Homo sapiens
uccuuagaauacuguauu

SEQ ID NO: 433209 - RNA, 18 nt, Homo sapiens
uccuuauuguuaaaaaca

SEQ ID NO: 433210 - RNA, 22 nt, Homo sapiens
uccuuauuucucuuucaucaaa

SEQ ID NO: 433211 - RNA, 16 nt, Homo sapiens
uccuucaagcugcuga

SEQ ID NO: 433212 - RNA, 22 nt, Homo sapiens
uccuucacaggcagugcaugug

SEQ ID NO: 433213 - RNA, 23 nt, Homo sapiens
uccuucacaggcagugcauguga

SEQ ID NO: 433214 - RNA, 20 nt, Homo sapiens
uccuucacucugacaguauu

SEQ ID NO: 433215 - RNA, 18 nt, Homo sapiens
uccuuccacaaugacugc

SEQ ID NO: 433216 - RNA, 14 nt, Homo sapiens
uccuuccacuucag

SEQ ID NO: 433217 - RNA, 14 nt, Homo sapiens
uccuuccugcccug

SEQ ID NO: 433218 - RNA, 21 nt, Homo sapiens
uccuuccugcccuguaccucu

SEQ ID NO: 433219 - RNA, 13 nt, Homo sapiens
uccuucgcuggaa

SEQ ID NO: 433220 - RNA, 15 nt, Homo sapiens
uccuucugcuggaua

SEQ ID NO: 433221 - RNA, 13 nt, Homo sapiens
uccuucuggccuu

SEQ ID NO: 433222 - RNA, 11 nt, Homo sapiens
uccuucuugcu

SEQ ID NO: 433223 - RNA, 20 nt, Homo sapiens
uccuugaggaccuccaccug

SEQ ID NO: 433224 - RNA, 17 nt, Homo sapiens
uccuugcucagugcaaa

SEQ ID NO: 433225 - RNA, 17 nt, Homo sapiens
uccuugucuauccuucc

SEQ ID NO: 433226 - RNA, 14 nt, Homo sapiens
uccuuucccaccca

SEQ ID NO: 433227 - RNA, 15 nt, Homo sapiens
uccuuucccacccac

SEQ ID NO: 433228 - RNA, 21 nt, Homo sapiens
uccuuuccugaucacuaugca

SEQ ID NO: 433229 - RNA, 16 nt, Homo sapiens
uccuuucuccagccag

SEQ ID NO: 433230 - RNA, 18 nt, Homo sapiens
uccuuugaaagcuguaua

SEQ ID NO: 433231 - RNA, 13 nt, Homo sapiens
uccuuugauauua

SEQ ID NO: 433232 - RNA, 20 nt, Homo sapiens
uccuuuuaucucacaaauaa

SEQ ID NO: 433233 - RNA, 19 nt, Homo sapiens
uccuuuuuuauacaggaaa

SEQ ID NO: 433234 - RNA, 16 nt, Homo sapiens
ucgaaagaaaaugggc

SEQ ID NO: 433235 - RNA, 19 nt, Homo sapiens
ucgaacuccugacaucagg

SEQ ID NO: 433236 - RNA, 22 nt, Homo sapiens
ucgaauccagagagcagugugg

SEQ ID NO: 433237 - RNA, 15 nt, Homo sapiens
ucgacucuuugcaac

SEQ ID NO: 433238 - RNA, 19 nt, Homo sapiens
ucgagacuuggguguuugu

SEQ ID NO: 433239 - RNA, 13 nt, Homo sapiens
ucgaggcaggaag

SEQ ID NO: 433240 - RNA, 14 nt, Homo sapiens
ucgaugcucacugc

SEQ ID NO: 433241 - RNA, 17 nt, Homo sapiens
ucgcaaaaugaugugaa

SEQ ID NO: 433242 - RNA, 21 nt, Homo sapiens
ucgcaaaaugaugugaaagga

SEQ ID NO: 433243 - RNA, 18 nt, Homo sapiens
ucgcaccauugcacucca

SEQ ID NO: 433244 - RNA, 17 nt, Homo sapiens
ucgcaucucagugcagg

SEQ ID NO: 433245 - RNA, 21 nt, Homo sapiens
ucgccaacacuuguguugcuu

SEQ ID NO: 433246 - RNA, 23 nt, Homo sapiens
ucgccauccgucaccagaauuag

SEQ ID NO: 433247 - RNA, 20 nt, Homo sapiens
ucgcccaggcuggagugcaa

SEQ ID NO: 433248 - RNA, 16 nt, Homo sapiens
ucgccccucugggcug

SEQ ID NO: 433249 - RNA, 19 nt, Homo sapiens
ucgcgccaguacauuccaa

SEQ ID NO: 433250 - RNA, 18 nt, Homo sapiens
ucggaaauacacuacaaa

SEQ ID NO: 433251 - RNA, 20 nt, Homo sapiens
ucggauuagaaauaaagcau

SEQ ID NO: 433252 - RNA, 11 nt, Homo sapiens
ucgggacauca

SEQ ID NO: 433253 - RNA, 13 nt, Homo sapiens
ucggggugcuccu

SEQ ID NO: 433254 - RNA, 20 nt, Homo sapiens
ucgguagaggauuucuaguu

SEQ ID NO: 433255 - RNA, 16 nt, Homo sapiens
ucgguggcauuugcug

SEQ ID NO: 433256 - RNA, 17 nt, Homo sapiens
ucguauaagcauggaga

SEQ ID NO: 433257 - RNA, 16 nt, Homo sapiens
ucguccugcaguguga

SEQ ID NO: 433258 - RNA, 13 nt, Homo sapiens
ucgugcacucugc

SEQ ID NO: 433259 - RNA, 13 nt, Homo sapiens
ucgugccguccuc

SEQ ID NO: 433260 - RNA, 16 nt, Homo sapiens
ucgugguagaagccag

SEQ ID NO: 433261 - RNA, 16 nt, Homo sapiens
ucguugacaugcacag

SEQ ID NO: 433262 - RNA, 18 nt, Homo sapiens
ucguuuuuuucauuccau

SEQ ID NO: 433263 - RNA, 15 nt, Homo sapiens
ucuaaaaucugcuag

SEQ ID NO: 433264 - RNA, 12 nt, Homo sapiens
ucuaaacauuuc

SEQ ID NO: 433265 - RNA, 14 nt, Homo sapiens
ucuaaaggcuugau

SEQ ID NO: 433266 - RNA, 22 nt, Homo sapiens
ucuaaaguguuggucuuucuaa

SEQ ID NO: 433267 - RNA, 16 nt, Homo sapiens
ucuaacaggacuugaa

SEQ ID NO: 433268 - RNA, 16 nt, Homo sapiens
ucuaacccacccucac

SEQ ID NO: 433269 - RNA, 16 nt, Homo sapiens
ucuaacucauucuuca

SEQ ID NO: 433270 - RNA, 13 nt, Homo sapiens
ucuaagggaguca

SEQ ID NO: 433271 - RNA, 15 nt, Homo sapiens
ucuaagucuccaaga

SEQ ID NO: 433272 - RNA, 18 nt, Homo sapiens
ucuaagucuccaagaaua

SEQ ID NO: 433273 - RNA, 14 nt, Homo sapiens
ucuaaguguaaaaa

SEQ ID NO: 433274 - RNA, 17 nt, Homo sapiens
ucuaaguguacuucaua

SEQ ID NO: 433275 - RNA, 19 nt, Homo sapiens
ucuaauaaauauacuauga

SEQ ID NO: 433276 - RNA, 16 nt, Homo sapiens
ucuaauccaugugcug

SEQ ID NO: 433277 - RNA, 20 nt, Homo sapiens
ucuaaucccuucaaggaagu

SEQ ID NO: 433278 - RNA, 23 nt, Homo sapiens
ucuaaugaaaccugugucucuga

SEQ ID NO: 433279 - RNA, 20 nt, Homo sapiens
ucuaaugcucacgcucccaa

SEQ ID NO: 433280 - RNA, 12 nt, Homo sapiens
ucuaaugucuuc

SEQ ID NO: 433281 - RNA, 21 nt, Homo sapiens
ucuaauugcccacccaguaug

SEQ ID NO: 433282 - RNA, 16 nt, Homo sapiens
ucuacaaaugucuuca

SEQ ID NO: 433283 - RNA, 19 nt, Homo sapiens
ucuacacccaccagaguga

SEQ ID NO: 433284 - RNA, 17 nt, Homo sapiens
ucuacacuguauuacau

SEQ ID NO: 433285 - RNA, 24 nt, Homo sapiens
ucuacaguuaauuaugugcauauu

SEQ ID NO: 433286 - RNA, 17 nt, Homo sapiens
ucuacauaaguaauuca

SEQ ID NO: 433287 - RNA, 17 nt, Homo sapiens
ucuacauccaauguaug

SEQ ID NO: 433288 - RNA, 13 nt, Homo sapiens
ucuacaugugcca

SEQ ID NO: 433289 - RNA, 17 nt, Homo sapiens
ucuacauguuuuagaca

SEQ ID NO: 433290 - RNA, 15 nt, Homo sapiens
ucuaccaagacauaa

SEQ ID NO: 433291 - RNA, 15 nt, Homo sapiens
ucuaccucuuccagg

SEQ ID NO: 433292 - RNA, 20 nt, Homo sapiens
ucuacguauaaauaugaaau

SEQ ID NO: 433293 - RNA, 13 nt, Homo sapiens
ucuacgugcuccu

SEQ ID NO: 433294 - RNA, 18 nt, Homo sapiens
ucuacuauccuugcuaag

SEQ ID NO: 433295 - RNA, 22 nt, Homo sapiens
ucuacucuuaaauauacaacuu

SEQ ID NO: 433296 - RNA, 13 nt, Homo sapiens
ucuacugagccac

SEQ ID NO: 433297 - RNA, 15 nt, Homo sapiens
ucuagaacagccaga

SEQ ID NO: 433298 - RNA, 13 nt, Homo sapiens
ucuagaacuugac

SEQ ID NO: 433299 - RNA, 15 nt, Homo sapiens
ucuagaauccugcuu

SEQ ID NO: 433300 - RNA, 19 nt, Homo sapiens
ucuagaauuauaagucaca

SEQ ID NO: 433301 - RNA, 21 nt, Homo sapiens
ucuagaauuauaagucacaaa

SEQ ID NO: 433302 - RNA, 16 nt, Homo sapiens
ucuagagcagggauua

SEQ ID NO: 433303 - RNA, 21 nt, Homo sapiens
ucuagccagagcccuucacug

SEQ ID NO: 433304 - RNA, 14 nt, Homo sapiens
ucuaggauaagcac

SEQ ID NO: 433305 - RNA, 22 nt, Homo sapiens
ucuaggucaguacccaccugag

SEQ ID NO: 433306 - RNA, 21 nt, Homo sapiens
ucuagucuccuuugcacugag

SEQ ID NO: 433307 - RNA, 20 nt, Homo sapiens
ucuagugucuuuugccuuua

SEQ ID NO: 433308 - RNA, 14 nt, Homo sapiens
ucuaguuucauuau

SEQ ID NO: 433309 - RNA, 20 nt, Homo sapiens
ucuaguuucuugugggcuaa

SEQ ID NO: 433310 - RNA, 14 nt, Homo sapiens
ucuauaacuccuug

SEQ ID NO: 433311 - RNA, 14 nt, Homo sapiens
ucuauauaguguau

SEQ ID NO: 433312 - RNA, 17 nt, Homo sapiens
ucuauauggaauugcuu

SEQ ID NO: 433313 - RNA, 14 nt, Homo sapiens
ucuaucaccuguca

SEQ ID NO: 433314 - RNA, 14 nt, Homo sapiens
ucuaucucucaaaa

SEQ ID NO: 433315 - RNA, 13 nt, Homo sapiens
ucuaugccuguau

SEQ ID NO: 433316 - RNA, 18 nt, Homo sapiens
ucuauggguaucaaacag

SEQ ID NO: 433317 - RNA, 11 nt, Homo sapiens
ucuauguccaa

SEQ ID NO: 433318 - RNA, 15 nt, Homo sapiens
ucuaugucucaugau

SEQ ID NO: 433319 - RNA, 14 nt, Homo sapiens
ucuauuaaucaccu

SEQ ID NO: 433320 - RNA, 18 nt, Homo sapiens
ucuauuacucugacauaa

SEQ ID NO: 433321 - RNA, 13 nt, Homo sapiens
ucuauucauuuga

SEQ ID NO: 433322 - RNA, 14 nt, Homo sapiens
ucuauucauuugau

SEQ ID NO: 433323 - RNA, 21 nt, Homo sapiens
ucuauugagugaacagaauug

SEQ ID NO: 433324 - RNA, 14 nt, Homo sapiens
ucuauugauguaca

SEQ ID NO: 433325 - RNA, 20 nt, Homo sapiens
ucucaaaaaaaaaaauacaa

SEQ ID NO: 433326 - RNA, 17 nt, Homo sapiens
ucucaaaccuccaaaag

SEQ ID NO: 433327 - RNA, 20 nt, Homo sapiens
ucucaaacuccugaccucaa

SEQ ID NO: 433328 - RNA, 15 nt, Homo sapiens
ucucaaagcaucaaa

SEQ ID NO: 433329 - RNA, 22 nt, Homo sapiens
ucucaaaguuuuuacaguguau

SEQ ID NO: 433330 - RNA, 21 nt, Homo sapiens
ucucaagacggagaugcaugg

SEQ ID NO: 433331 - RNA, 21 nt, Homo sapiens
ucucaagcacugacacucauu

SEQ ID NO: 433332 - RNA, 21 nt, Homo sapiens
ucucaaugugaaaaauguguc

SEQ ID NO: 433333 - RNA, 17 nt, Homo sapiens
ucucaauguuccauuca

SEQ ID NO: 433334 - RNA, 17 nt, Homo sapiens
ucucacaaauaaguaau

SEQ ID NO: 433335 - RNA, 14 nt, Homo sapiens
ucucacaagaugga

SEQ ID NO: 433336 - RNA, 17 nt, Homo sapiens
ucucacacuucauccua

SEQ ID NO: 433337 - RNA, 17 nt, Homo sapiens
ugugccaccaacauaaa

SEQ ID NO: 433338 - RNA, 20 nt, Homo sapiens
ugugccaggacugugacuca

SEQ ID NO: 433339 - RNA, 23 nt, Homo sapiens
ugugccaggaggcggcagcucuu

SEQ ID NO: 433340 - RNA, 21 nt, Homo sapiens
ugugccaggcugaauuacagu

SEQ ID NO: 433341 - RNA, 14 nt, Homo sapiens
ugugcccaucaucu

SEQ ID NO: 433342 - RNA, 18 nt, Homo sapiens
ugugccccaucagcagcu

SEQ ID NO: 433343 - RNA, 14 nt, Homo sapiens
ugugccgccaccuc

SEQ ID NO: 433344 - RNA, 12 nt, Homo sapiens
ugugccugagaa

SEQ ID NO: 433345 - RNA, 16 nt, Homo sapiens
ugugccuggagcuccu

SEQ ID NO: 433346 - RNA, 23 nt, Homo sapiens
ugugccugugguuaacaucucag

SEQ ID NO: 433347 - RNA, 17 nt, Homo sapiens
ugugcgugaaacacacc

SEQ ID NO: 433348 - RNA, 17 nt, Homo sapiens
ugugcgugcaugugcac

SEQ ID NO: 433349 - RNA, 19 nt, Homo sapiens
ugugcguguguccaugugu

SEQ ID NO: 433350 - RNA, 22 nt, Homo sapiens
ugugcuguggguauucaccacc

SEQ ID NO: 433351 - RNA, 18 nt, Homo sapiens
ugugcuguugauucuuuc

SEQ ID NO: 433352 - RNA, 19 nt, Homo sapiens
ugugcuugggaucuucaau

SEQ ID NO: 433353 - RNA, 14 nt, Homo sapiens
ugugcuuguuuaca

SEQ ID NO: 433354 - RNA, 17 nt, Homo sapiens
uguggaaaacucacaga

SEQ ID NO: 433355 - RNA, 20 nt, Homo sapiens
uguggaacuauuuuaccuua

SEQ ID NO: 433356 - RNA, 16 nt, Homo sapiens
uguggagagugagaau

SEQ ID NO: 433357 - RNA, 23 nt, Homo sapiens
uguggagggauugaacacaggca

SEQ ID NO: 433358 - RNA, 14 nt, Homo sapiens
uguggauaagggag

SEQ ID NO: 433359 - RNA, 22 nt, Homo sapiens
uguggaugggaaacugcuccag

SEQ ID NO: 433360 - RNA, 15 nt, Homo sapiens
uguggauucuauauu

SEQ ID NO: 433361 - RNA, 18 nt, Homo sapiens
uguggccuguguccagca

SEQ ID NO: 433362 - RNA, 15 nt, Homo sapiens
uguggcuuaguaaua

SEQ ID NO: 433363 - RNA, 20 nt, Homo sapiens
ugugggaaugcggcaagaag

SEQ ID NO: 433364 - RNA, 13 nt, Homo sapiens
ugugggucaggga

SEQ ID NO: 433365 - RNA, 16 nt, Homo sapiens
ugugggugucagucag

SEQ ID NO: 433366 - RNA, 22 nt, Homo sapiens
uguggugagcagaaguggagcu

SEQ ID NO: 433367 - RNA, 22 nt, Homo sapiens
uguggugggagggguguuccaa

SEQ ID NO: 433368 - RNA, 17 nt, Homo sapiens
ugugguuaacaucucag

SEQ ID NO: 433369 - RNA, 20 nt, Homo sapiens
ugugguuaacaucucagaaa

SEQ ID NO: 433370 - RNA, 16 nt, Homo sapiens
ugugguuacaguuuga

SEQ ID NO: 433371 - RNA, 15 nt, Homo sapiens
ugugguuaccgagua

SEQ ID NO: 433372 - RNA, 14 nt, Homo sapiens
ugugguuacuuccu

SEQ ID NO: 433373 - RNA, 22 nt, Homo sapiens
uguguaaccagcagucacaggu

SEQ ID NO: 433374 - RNA, 21 nt, Homo sapiens
uguguaauggagauugccuca

SEQ ID NO: 433375 - RNA, 18 nt, Homo sapiens
uguguagcucucacaugc

SEQ ID NO: 433376 - RNA, 22 nt, Homo sapiens
uguguagcucucacaugcacag

SEQ ID NO: 433377 - RNA, 20 nt, Homo sapiens
uguguauaaagccauuauuc

SEQ ID NO: 433378 - RNA, 13 nt, Homo sapiens
uguguaugugcca

SEQ ID NO: 433379 - RNA, 16 nt, Homo sapiens
uguguauuagauauca

SEQ ID NO: 433380 - RNA, 16 nt, Homo sapiens
ugugucagccaugacc

SEQ ID NO: 433381 - RNA, 15 nt, Homo sapiens
ugugucaucugucag

SEQ ID NO: 433382 - RNA, 19 nt, Homo sapiens
uguguccaagugugugugc

SEQ ID NO: 433383 - RNA, 17 nt, Homo sapiens
uguguccaugugugugc

SEQ ID NO: 433384 - RNA, 20 nt, Homo sapiens
uguguccaugugugugcaag

SEQ ID NO: 433385 - RNA, 21 nt, Homo sapiens
uguguccccugaccuguccag

SEQ ID NO: 433386 - RNA, 15 nt, Homo sapiens
ugugucgcuuauguc

SEQ ID NO: 433387 - RNA, 19 nt, Homo sapiens
ugugucgcuuaugucuaua

SEQ ID NO: 433388 - RNA, 12 nt, Homo sapiens
ugugucuucaau

SEQ ID NO: 433389 - RNA, 14 nt, Homo sapiens
ugugucuucaauuu

SEQ ID NO: 433390 - RNA, 20 nt, Homo sapiens
ugugugaggcucuguccuaa

SEQ ID NO: 433391 - RNA, 21 nt, Homo sapiens
ugugugagugugugcaaguau

SEQ ID NO: 433392 - RNA, 20 nt, Homo sapiens
ugugugcaagugugugcaca

SEQ ID NO: 433393 - RNA, 23 nt, Homo sapiens
ugugugcaagugugugcaugugu

SEQ ID NO: 433394 - RNA, 14 nt, Homo sapiens
ugugugcaauguuc

SEQ ID NO: 433395 - RNA, 15 nt, Homo sapiens
ugugugcaugugugc

SEQ ID NO: 433396 - RNA, 22 nt, Homo sapiens
ugugugcuuugccacugaagua

SEQ ID NO: 433397 - RNA, 13 nt, Homo sapiens
ugugugucuucag

SEQ ID NO: 433398 - RNA, 14 nt, Homo sapiens
uguguuaucucuua

SEQ ID NO: 433399 - RNA, 16 nt, Homo sapiens
uguguucacacuguaa

SEQ ID NO: 433400 - RNA, 17 nt, Homo sapiens
uguguucacacuguaaa

SEQ ID NO: 433401 - RNA, 21 nt, Homo sapiens
uguguuuauccuaaacugaga

SEQ ID NO: 433402 - RNA, 16 nt, Homo sapiens
uguguuucaggacagc

SEQ ID NO: 433403 - RNA, 14 nt, Homo sapiens
uguuaaagcuauuu

SEQ ID NO: 433404 - RNA, 20 nt, Homo sapiens
uguuaacuauuuauucccug

SEQ ID NO: 433405 - RNA, 12 nt, Homo sapiens
uguuaacugagg

SEQ ID NO: 433406 - RNA, 22 nt, Homo sapiens
uguuacugaaaugagccucgug

SEQ ID NO: 433407 - RNA, 22 nt, Homo sapiens
uguuacugguagaaaggcaguu

SEQ ID NO: 433408 - RNA, 15 nt, Homo sapiens
uguuagaugugcaca

SEQ ID NO: 433409 - RNA, 19 nt, Homo sapiens
uguuauaacucugcacuac

SEQ ID NO: 433410 - RNA, 21 nt, Homo sapiens
uguuauaacucugcacuacuc

SEQ ID NO: 433411 - RNA, 14 nt, Homo sapiens
uguuauaucaggga

SEQ ID NO: 433412 - RNA, 13 nt, Homo sapiens
uguuaucugcuag

SEQ ID NO: 433413 - RNA, 11 nt, Homo sapiens
uguuaugccaa

SEQ ID NO: 433414 - RNA, 12 nt, Homo sapiens
uguucaaaaagg

SEQ ID NO: 433415 - RNA, 17 nt, Homo sapiens
uguucaaacuacuguac

SEQ ID NO: 433416 - RNA, 15 nt, Homo sapiens
uguucacaccacagg

SEQ ID NO: 433417 - RNA, 15 nt, Homo sapiens
uguucacacuguaaa

SEQ ID NO: 433418 - RNA, 12 nt, Homo sapiens
uguucauucaca

SEQ ID NO: 433419 - RNA, 13 nt, Homo sapiens
uguuccaaaaaga

SEQ ID NO: 433420 - RNA, 23 nt, Homo sapiens
uguucccacucccucucuugccg

SEQ ID NO: 433421 - RNA, 22 nt, Homo sapiens
uguuccuaaaaaucuguggcaa

SEQ ID NO: 433422 - RNA, 14 nt, Homo sapiens
uguuccuacuggag

SEQ ID NO: 433423 - RNA, 17 nt, Homo sapiens
uguuccugaugugccag

SEQ ID NO: 433424 - RNA, 14 nt, Homo sapiens
uguuccugccacau

SEQ ID NO: 433425 - RNA, 23 nt, Homo sapiens
uguuccuggagaaggcauuccag

SEQ ID NO: 433426 - RNA, 22 nt, Homo sapiens
uguucuaaagguggugaggcaa

SEQ ID NO: 433427 - RNA, 14 nt, Homo sapiens
uguucuauuguggg

SEQ ID NO: 433428 - RNA, 20 nt, Homo sapiens
uguucucagagcuccacaga

SEQ ID NO: 433429 - RNA, 22 nt, Homo sapiens
uguucugagcuauaacauuugc

SEQ ID NO: 433430 - RNA, 13 nt, Homo sapiens
uguucugauuaga

SEQ ID NO: 433431 - RNA, 23 nt, Homo sapiens
uguucuuagagcagauucuagca

SEQ ID NO: 433432 - RNA, 13 nt, Homo sapiens
uguugacugcugc

SEQ ID NO: 433433 - RNA, 20 nt, Homo sapiens
uguugagcaaugugcacuuc

SEQ ID NO: 433434 - RNA, 14 nt, Homo sapiens
uguugcacacucac

SEQ ID NO: 433435 - RNA, 11 nt, Homo sapiens
uguugccaaau

SEQ ID NO: 433436 - RNA, 18 nt, Homo sapiens
uguugcuaagcuguaacc

SEQ ID NO: 433437 - RNA, 19 nt, Homo sapiens
uguuggauagucagcugua

SEQ ID NO: 433438 - RNA, 20 nt, Homo sapiens
uguugguauuauauaauuca

SEQ ID NO: 433439 - RNA, 19 nt, Homo sapiens
uguuguucauagucaauca

SEQ ID NO: 433440 - RNA, 17 nt, Homo sapiens
uguuguuccguuaaccu

SEQ ID NO: 433441 - RNA, 16 nt, Homo sapiens
uguuguuuuaggggcu

SEQ ID NO: 433442 - RNA, 19 nt, Homo sapiens
uguuuaaaagcaaaacugc

SEQ ID NO: 433443 - RNA, 17 nt, Homo sapiens
uguuuacaaggugacaa

SEQ ID NO: 433444 - RNA, 15 nt, Homo sapiens
uguuuacagcacuac

SEQ ID NO: 433445 - RNA, 18 nt, Homo sapiens
uguuuaccuucagccaua

SEQ ID NO: 433446 - RNA, 17 nt, Homo sapiens
uguuuagcuuccuccag

SEQ ID NO: 433447 - RNA, 14 nt, Homo sapiens
uguuuaugagccag

SEQ ID NO: 433448 - RNA, 14 nt, Homo sapiens
uguuuauuccugau

SEQ ID NO: 433449 - RNA, 17 nt, Homo sapiens
uguuucagggggccuuu

SEQ ID NO: 433450 - RNA, 15 nt, Homo sapiens
uguuucccauuacuu

SEQ ID NO: 433451 - RNA, 18 nt, Homo sapiens
uguuucuaaaacuauggu

SEQ ID NO: 433452 - RNA, 17 nt, Homo sapiens
uguuucuaaguggccug

SEQ ID NO: 433453 - RNA, 17 nt, Homo sapiens
uguuucuaauuugcugc

SEQ ID NO: 433454 - RNA, 19 nt, Homo sapiens
uguuucucagacuggucuc

SEQ ID NO: 433455 - RNA, 22 nt, Homo sapiens
uguuucugaaccauuacuguaa

SEQ ID NO: 433456 - RNA, 23 nt, Homo sapiens
uguuucugaaccauuacuguaau

SEQ ID NO: 433457 - RNA, 12 nt, Homo sapiens
uguuucugcaga

SEQ ID NO: 433458 - RNA, 19 nt, Homo sapiens
uguuucuucuuugacuaua

SEQ ID NO: 433459 - RNA, 17 nt, Homo sapiens
uguuugagcgcagagua

SEQ ID NO: 433460 - RNA, 23 nt, Homo sapiens
uguuuggaaauaaacugugcaau

SEQ ID NO: 433461 - RNA, 15 nt, Homo sapiens
uguuuggacuuuuau

SEQ ID NO: 433462 - RNA, 19 nt, Homo sapiens
uguuuguaaauaagagauu

SEQ ID NO: 433463 - RNA, 20 nt, Homo sapiens
uguuugugaaacaaaaaagu

SEQ ID NO: 433464 - RNA, 20 nt, Homo sapiens
uguuugugcugcagacaaaa

SEQ ID NO: 433465 - RNA, 13 nt, Homo sapiens
uguuuuaaguuua

SEQ ID NO: 433466 - RNA, 19 nt, Homo sapiens
uguuuucaccucauaugcu

SEQ ID NO: 433467 - RNA, 22 nt, Homo sapiens
uuccugaagaauugaaaaacca

SEQ ID NO: 433468 - RNA, 15 nt, Homo sapiens
uuccugaaugaaaua

SEQ ID NO: 433469 - RNA, 14 nt, Homo sapiens
uuccugacugggaa

SEQ ID NO: 433470 - RNA, 22 nt, Homo sapiens
uuccugagggcuaauucuggga

SEQ ID NO: 433471 - RNA, 13 nt, Homo sapiens
uuccugaguaccu

SEQ ID NO: 433472 - RNA, 21 nt, Homo sapiens
uuccuggagaaggcauuccag

SEQ ID NO: 433473 - RNA, 22 nt, Homo sapiens
uuccuggccuucugaacuccau

SEQ ID NO: 433474 - RNA, 20 nt, Homo sapiens
uuccuggcuccaacacugcu

SEQ ID NO: 433475 - RNA, 16 nt, Homo sapiens
uuccugucaauauaua

SEQ ID NO: 433476 - RNA, 20 nt, Homo sapiens
uuccugugcccaucaucucu

SEQ ID NO: 433477 - RNA, 15 nt, Homo sapiens
uuccuuaaacugugu

SEQ ID NO: 433478 - RNA, 22 nt, Homo sapiens
uuccuuaggagaugucaugaca

SEQ ID NO: 433479 - RNA, 15 nt, Homo sapiens
uuccuuagucucaag

SEQ ID NO: 433480 - RNA, 19 nt, Homo sapiens
uuccuucagacagauucca

SEQ ID NO: 433481 - RNA, 15 nt, Homo sapiens
uuccuucagagugaa

SEQ ID NO: 433482 - RNA, 18 nt, Homo sapiens
uuccuuccaagucuuccu

SEQ ID NO: 433483 - RNA, 18 nt, Homo sapiens
uuccuucgaggguuccag

SEQ ID NO: 433484 - RNA, 24 nt, Homo sapiens
uuccuucggaauccagugcuucca

SEQ ID NO: 433485 - RNA, 23 nt, Homo sapiens
uuccuuuaaauucuccaacccaa

SEQ ID NO: 433486 - RNA, 20 nt, Homo sapiens
uuccuuuuaaaacacuucca

SEQ ID NO: 433487 - RNA, 21 nt, Homo sapiens
uuccuuuuaaaacacuuccau

SEQ ID NO: 433488 - RNA, 20 nt, Homo sapiens
uucgagaccagucuggccaa

SEQ ID NO: 433489 - RNA, 15 nt, Homo sapiens
uucgaggagugccgu

SEQ ID NO: 433490 - RNA, 23 nt, Homo sapiens
uucgauacaccgggccuggagaa

SEQ ID NO: 433491 - RNA, 20 nt, Homo sapiens
uucgcgugcccucgcugcuu

SEQ ID NO: 433492 - RNA, 20 nt, Homo sapiens
uucguccuuagaauacugua

SEQ ID NO: 433493 - RNA, 20 nt, Homo sapiens
uucuaaaacauucuuuaaca

SEQ ID NO: 433494 - RNA, 22 nt, Homo sapiens
uucuaaaggggacagaucuuga

SEQ ID NO: 433495 - RNA, 15 nt, Homo sapiens
uucuaaugugugaau

SEQ ID NO: 433496 - RNA, 16 nt, Homo sapiens
uucuaauuugcugcug

SEQ ID NO: 433497 - RNA, 19 nt, Homo sapiens
uucuaauuugcugcugaua

SEQ ID NO: 433498 - RNA, 22 nt, Homo sapiens
uucuacucgaguuacagacaaa

SEQ ID NO: 433499 - RNA, 17 nt, Homo sapiens
uucuacugaacagucca

SEQ ID NO: 433500 - RNA, 23 nt, Homo sapiens
uucuacuucuggaagucaucuca

SEQ ID NO: 433501 - RNA, 12 nt, Homo sapiens
uucuacuuuaag

SEQ ID NO: 433502 - RNA, 21 nt, Homo sapiens
uucuacuuuaagguuugcaga

SEQ ID NO: 433503 - RNA, 14 nt, Homo sapiens
uucuagcuaccugu

SEQ ID NO: 433504 - RNA, 22 nt, Homo sapiens
uucuagucuccuuugcacugag

SEQ ID NO: 433505 - RNA, 14 nt, Homo sapiens
uucuagucucugau

SEQ ID NO: 433506 - RNA, 19 nt, Homo sapiens
uucuauaaacauaugcaaa

SEQ ID NO: 433507 - RNA, 16 nt, Homo sapiens
uucuaugacaauaaau

SEQ ID NO: 433508 - RNA, 15 nt, Homo sapiens
uucuauuuauuuacu

SEQ ID NO: 433509 - RNA, 21 nt, Homo sapiens
uucucaagcgcuauccacaga

SEQ ID NO: 433510 - RNA, 20 nt, Homo sapiens
uucucacuccuaccugguaa

SEQ ID NO: 433511 - RNA, 16 nt, Homo sapiens
uucucauaaacagagu

SEQ ID NO: 433512 - RNA, 21 nt, Homo sapiens
uucucaucuucuuauuuucca

SEQ ID NO: 433513 - RNA, 23 nt, Homo sapiens
uucucaugauagauuuguaugau

SEQ ID NO: 433514 - RNA, 14 nt, Homo sapiens
uucucaugccucau

SEQ ID NO: 433515 - RNA, 18 nt, Homo sapiens
uucucauuauuucaucau

SEQ ID NO: 433516 - RNA, 14 nt, Homo sapiens
uucucauucuugcc

SEQ ID NO: 433517 - RNA, 13 nt, Homo sapiens
uucuccaggugau

SEQ ID NO: 433518 - RNA, 20 nt, Homo sapiens
uucuccauacgcacugguau

SEQ ID NO: 433519 - RNA, 22 nt, Homo sapiens
uucuccguugucauugacuuca

SEQ ID NO: 433520 - RNA, 13 nt, Homo sapiens
uucuccugccuca

SEQ ID NO: 433521 - RNA, 18 nt, Homo sapiens
uucucgugacaccaccaa

SEQ ID NO: 433522 - RNA, 21 nt, Homo sapiens
uucucuguguuuguuccuaca

SEQ ID NO: 433523 - RNA, 13 nt, Homo sapiens
uucucuugcuaau

SEQ ID NO: 433524 - RNA, 22 nt, Homo sapiens
uucugaacuggaacaugggcau

SEQ ID NO: 433525 - RNA, 23 nt, Homo sapiens
uucugaccccacuuaugcugcug

SEQ ID NO: 433526 - RNA, 20 nt, Homo sapiens
uucugacugcaacuucuguc

SEQ ID NO: 433527 - RNA, 15 nt, Homo sapiens
uucugagaaggugag

SEQ ID NO: 433528 - RNA, 16 nt, Homo sapiens
uucugaggauugcaga

SEQ ID NO: 433529 - RNA, 17 nt, Homo sapiens
uucugaguagcauauau

SEQ ID NO: 433530 - RNA, 14 nt, Homo sapiens
uucugauugucuua

SEQ ID NO: 433531 - RNA, 14 nt, Homo sapiens
uucugcauuacuau

SEQ ID NO: 433532 - RNA, 13 nt, Homo sapiens
uucugccuaagcc

SEQ ID NO: 433533 - RNA, 18 nt, Homo sapiens
uucugcuguauacuguac

SEQ ID NO: 433534 - RNA, 17 nt, Homo sapiens
uucuggaagucaucuca

SEQ ID NO: 433535 - RNA, 14 nt, Homo sapiens
uucuggaauguaau

SEQ ID NO: 433536 - RNA, 19 nt, Homo sapiens
uucugggcacccucccacc

SEQ ID NO: 433537 - RNA, 17 nt, Homo sapiens
uucugggugcagcugag

SEQ ID NO: 433538 - RNA, 15 nt, Homo sapiens
uucugucaccaaauu

SEQ ID NO: 433539 - RNA, 11 nt, Homo sapiens
uucugugagaa

SEQ ID NO: 433540 - RNA, 22 nt, Homo sapiens
uucugugggcuuggccuugugu

SEQ ID NO: 433541 - RNA, 15 nt, Homo sapiens
uucuguucaucuuaa

SEQ ID NO: 433542 - RNA, 22 nt, Homo sapiens
uucuuaaaaguugugauuccag

SEQ ID NO: 433543 - RNA, 14 nt, Homo sapiens
uucuuaacaaccga

SEQ ID NO: 433544 - RNA, 14 nt, Homo sapiens
uucuuaauaggcuu

SEQ ID NO: 433545 - RNA, 19 nt, Homo sapiens
uucuuaauauaacugccuu

SEQ ID NO: 433546 - RNA, 19 nt, Homo sapiens
uucuuacaauugcacugcu

SEQ ID NO: 433547 - RNA, 15 nt, Homo sapiens
uucuuaggaacagac

SEQ ID NO: 433548 - RNA, 14 nt, Homo sapiens
uucuuaugguauaa

SEQ ID NO: 433549 - RNA, 15 nt, Homo sapiens
uucuuauuacuauua

SEQ ID NO: 433550 - RNA, 18 nt, Homo sapiens
uucuuauuggccaaaugc

SEQ ID NO: 433551 - RNA, 13 nt, Homo sapiens
uucuuauuucccc

SEQ ID NO: 433552 - RNA, 23 nt, Homo sapiens
uucuucacugcagauuucucacc

SEQ ID NO: 433553 - RNA, 22 nt, Homo sapiens
uucuucaggagaugaugugaug

SEQ ID NO: 433554 - RNA, 19 nt, Homo sapiens
uucuucucaagcacugaca

SEQ ID NO: 433555 - RNA, 18 nt, Homo sapiens
uucuugaacaaacuggaa

SEQ ID NO: 433556 - RNA, 18 nt, Homo sapiens
uucuugacaaaaccuaac

SEQ ID NO: 433557 - RNA, 18 nt, Homo sapiens
uucuugcacuauuccaca

SEQ ID NO: 433558 - RNA, 20 nt, Homo sapiens
uucuugcuuucaauuacaaa

SEQ ID NO: 433559 - RNA, 19 nt, Homo sapiens
uucuugggguacucuugau

SEQ ID NO: 433560 - RNA, 18 nt, Homo sapiens
uucuuguaaaacugugac

SEQ ID NO: 433561 - RNA, 12 nt, Homo sapiens
uucuuguugcau

SEQ ID NO: 433562 - RNA, 17 nt, Homo sapiens
uucuuguuuaccaaaga

SEQ ID NO: 433563 - RNA, 18 nt, Homo sapiens
uucuuuaauguuguccag

SEQ ID NO: 433564 - RNA, 23 nt, Homo sapiens
uucuuuacuaaagauaucagagc

SEQ ID NO: 433565 - RNA, 16 nt, Homo sapiens
uucuuuacuacugcaa

SEQ ID NO: 433566 - RNA, 13 nt, Homo sapiens
uucuuuacuccuu

SEQ ID NO: 433567 - RNA, 14 nt, Homo sapiens
uucuuuccaugcag

SEQ ID NO: 433568 - RNA, 22 nt, Homo sapiens
uucuuucugcaugacuauugua

SEQ ID NO: 433569 - RNA, 12 nt, Homo sapiens
uucuuuggucau

SEQ ID NO: 433570 - RNA, 13 nt, Homo sapiens
uucuuuuuccacc

SEQ ID NO: 433571 - RNA, 14 nt, Homo sapiens
uugaaaaggacucu

SEQ ID NO: 433572 - RNA, 15 nt, Homo sapiens
uugaaagaacaucag

SEQ ID NO: 433573 - RNA, 21 nt, Homo sapiens
uugaaagaagucaaaugaaug

SEQ ID NO: 433574 - RNA, 14 nt, Homo sapiens
uugaaagcuguaua

SEQ ID NO: 433575 - RNA, 23 nt, Homo sapiens
uugaaaugagaaacuuugaucuc

SEQ ID NO: 433576 - RNA, 17 nt, Homo sapiens
uugaaaugccacgugcc

SEQ ID NO: 433577 - RNA, 13 nt, Homo sapiens
uugaacacaggca

SEQ ID NO: 433578 - RNA, 18 nt, Homo sapiens
uugaacacaggcaaagag

SEQ ID NO: 433579 - RNA, 19 nt, Homo sapiens
uugaacuguuagaugcuga

SEQ ID NO: 433580 - RNA, 13 nt, Homo sapiens
uugaagaacucau

SEQ ID NO: 433581 - RNA, 23 nt, Homo sapiens
uugaagagccugacaagugaagu

SEQ ID NO: 433582 - RNA, 12 nt, Homo sapiens
uugaagcauuga

SEQ ID NO: 433583 - RNA, 23 nt, Homo sapiens
uugaaggguguucacccauccca

SEQ ID NO: 433584 - RNA, 21 nt, Homo sapiens
uugaauaccauuaaaacugcu

SEQ ID NO: 433585 - RNA, 17 nt, Homo sapiens
uugaauauaauggccuc

SEQ ID NO: 433586 - RNA, 21 nt, Homo sapiens
uugaaucuugucccagccuca

SEQ ID NO: 433587 - RNA, 11 nt, Homo sapiens
uugaaugauga

SEQ ID NO: 433588 - RNA, 12 nt, Homo sapiens
uugaaugucaca

SEQ ID NO: 433589 - RNA, 21 nt, Homo sapiens
uugaaugugguuacuuccuac

SEQ ID NO: 433590 - RNA, 20 nt, Homo sapiens
uugaauuaauccacacauca

SEQ ID NO: 433591 - RNA, 19 nt, Homo sapiens
uugaauuucugccaggcau

SEQ ID NO: 433592 - RNA, 18 nt, Homo sapiens
uugaauuuugaaccaugu

SEQ ID NO: 433593 - RNA, 17 nt, Homo sapiens
uugacaaccaugagacc

SEQ ID NO: 433594 - RNA, 17 nt, Homo sapiens
uugacacggccaugacc

SEQ ID NO: 433595 - RNA, 13 nt, Homo sapiens
uugacaggauuau

SEQ ID NO: 433596 - RNA, 15 nt, Homo sapiens
uuuauauuacuuuug

SEQ ID NO: 433597 - RNA, 22 nt, Homo sapiens
uuuauauuguuuuuauauauua

SEQ ID NO: 433598 - RNA, 18 nt, Homo sapiens
uuuaucacacaaagcaga

SEQ ID NO: 433599 - RNA, 20 nt, Homo sapiens
uuuauccuaguuccauucuu

SEQ ID NO: 433600 - RNA, 14 nt, Homo sapiens
uuuaucuagaacau

SEQ ID NO: 433601 - RNA, 22 nt, Homo sapiens
uuuaucucacaaauaaguaaua

SEQ ID NO: 433602 - RNA, 19 nt, Homo sapiens
uuuaucugugaauucagau

SEQ ID NO: 433603 - RNA, 17 nt, Homo sapiens
uuuaucuugucucuggg

SEQ ID NO: 433604 - RNA, 19 nt, Homo sapiens
uuuaugagaacugguucuu

SEQ ID NO: 433605 - RNA, 11 nt, Homo sapiens
uuuaugcauuu

SEQ ID NO: 433606 - RNA, 15 nt, Homo sapiens
uuuauuaaugaacug

SEQ ID NO: 433607 - RNA, 16 nt, Homo sapiens
uuuauuaccucugaua

SEQ ID NO: 433608 - RNA, 22 nt, Homo sapiens
uuuauuaguuaauauaucccag

SEQ ID NO: 433609 - RNA, 12 nt, Homo sapiens
uuuauucaggaa

SEQ ID NO: 433610 - RNA, 16 nt, Homo sapiens
uuuauucccccaaagc

SEQ ID NO: 433611 - RNA, 15 nt, Homo sapiens
uuuauuuuccuguga

SEQ ID NO: 433612 - RNA, 14 nt, Homo sapiens
uuucaaaacuucag

SEQ ID NO: 433613 - RNA, 19 nt, Homo sapiens
uuucaaagauguguugcua

SEQ ID NO: 433614 - RNA, 17 nt, Homo sapiens
uuucaaaguguugaugg

SEQ ID NO: 433615 - RNA, 19 nt, Homo sapiens
uuucaagaaagcauugcca

SEQ ID NO: 433616 - RNA, 13 nt, Homo sapiens
uuucaauuacaaa

SEQ ID NO: 433617 - RNA, 15 nt, Homo sapiens
uuucaauuacaaagc

SEQ ID NO: 433618 - RNA, 11 nt, Homo sapiens
uuucaccucau

SEQ ID NO: 433619 - RNA, 21 nt, Homo sapiens
uuucaccuguuuuuaagcugu

SEQ ID NO: 433620 - RNA, 12 nt, Homo sapiens
uuucacugacac

SEQ ID NO: 433621 - RNA, 21 nt, Homo sapiens
uuucagaucauauuucacaau

SEQ ID NO: 433622 - RNA, 18 nt, Homo sapiens
uuucaggagguacuguga

SEQ ID NO: 433623 - RNA, 17 nt, Homo sapiens
uuucaggauacaugugc

SEQ ID NO: 433624 - RNA, 18 nt, Homo sapiens
uuucaguaucaucuccau

SEQ ID NO: 433625 - RNA, 13 nt, Homo sapiens
uuucauaguucug

SEQ ID NO: 433626 - RNA, 17 nt, Homo sapiens
uuucauauguugcucag

SEQ ID NO: 433627 - RNA, 15 nt, Homo sapiens
uuucauauucucaga

SEQ ID NO: 433628 - RNA, 23 nt, Homo sapiens
uuucauccuguuggcugcugcca

SEQ ID NO: 433629 - RNA, 11 nt, Homo sapiens
uuucauguauu

SEQ ID NO: 433630 - RNA, 18 nt, Homo sapiens
uuucauuuaggugaggaa

SEQ ID NO: 433631 - RNA, 21 nt, Homo sapiens
uuuccaaagguuucaacugua

SEQ ID NO: 433632 - RNA, 18 nt, Homo sapiens
uuuccaaauacauuccag

SEQ ID NO: 433633 - RNA, 18 nt, Homo sapiens
uuuccaacuuuucaucca

SEQ ID NO: 433634 - RNA, 10 nt, Homo sapiens
uuuccaccuu

SEQ ID NO: 433635 - RNA, 19 nt, Homo sapiens
uuuccacucccacugccag

SEQ ID NO: 433636 - RNA, 20 nt, Homo sapiens
uuuccacucccacugccagg

SEQ ID NO: 433637 - RNA, 22 nt, Homo sapiens
uuuccaguccuuggucaguuug

SEQ ID NO: 433638 - RNA, 12 nt, Homo sapiens
uuucccaaaaac

SEQ ID NO: 433639 - RNA, 23 nt, Homo sapiens
uuuccccaccccagcucaugccc

SEQ ID NO: 433640 - RNA, 18 nt, Homo sapiens
uuucccgcuccaagagaa

SEQ ID NO: 433641 - RNA, 19 nt, Homo sapiens
uuucccuccaccagugugc

SEQ ID NO: 433642 - RNA, 23 nt, Homo sapiens
uuucccuucccuuccacugccuc

SEQ ID NO: 433643 - RNA, 15 nt, Homo sapiens
uuucccuugaacugu

SEQ ID NO: 433644 - RNA, 18 nt, Homo sapiens
uuuccuaugacacucauc

SEQ ID NO: 433645 - RNA, 23 nt, Homo sapiens
uuuccuccccuuugacccuauuc

SEQ ID NO: 433646 - RNA, 18 nt, Homo sapiens
uuuccugaucacuaugca

SEQ ID NO: 433647 - RNA, 15 nt, Homo sapiens
uuuccugcggcauca

SEQ ID NO: 433648 - RNA, 14 nt, Homo sapiens
uuuccuugcucaac

SEQ ID NO: 433649 - RNA, 17 nt, Homo sapiens
uuucuaauuugcugcug

SEQ ID NO: 433650 - RNA, 18 nt, Homo sapiens
uuucuaccuugaggucuu

SEQ ID NO: 433651 - RNA, 19 nt, Homo sapiens
uuucuagacaguauugcca

SEQ ID NO: 433652 - RNA, 13 nt, Homo sapiens
uuucuagcaaaca

SEQ ID NO: 433653 - RNA, 21 nt, Homo sapiens
uuucuaguuucuugugggcua

SEQ ID NO: 433654 - RNA, 18 nt, Homo sapiens
uuucuauuaaaaguggga

SEQ ID NO: 433655 - RNA, 15 nt, Homo sapiens
uuucucaaaagcauu

SEQ ID NO: 433656 - RNA, 12 nt, Homo sapiens
uuucucacugag

SEQ ID NO: 433657 - RNA, 22 nt, Homo sapiens
uuucucaugguauuaucuagua

SEQ ID NO: 433658 - RNA, 19 nt, Homo sapiens
uuucucucuguguggcaaa

SEQ ID NO: 433659 - RNA, 16 nt, Homo sapiens
uuucucugccagugac

SEQ ID NO: 433660 - RNA, 19 nt, Homo sapiens
uuucugaaccauuacugua

SEQ ID NO: 433661 - RNA, 18 nt, Homo sapiens
uuucugagagagugccau

SEQ ID NO: 433662 - RNA, 16 nt, Homo sapiens
uuucugaggaguaaaa

SEQ ID NO: 433663 - RNA, 20 nt, Homo sapiens
uuucugaucauugguuucuu

SEQ ID NO: 433664 - RNA, 13 nt, Homo sapiens
uuucugccucaca

SEQ ID NO: 433665 - RNA, 18 nt, Homo sapiens
uuucugccucacaucagc

SEQ ID NO: 433666 - RNA, 18 nt, Homo sapiens
uuucuuccuuaaacuccu

SEQ ID NO: 433667 - RNA, 16 nt, Homo sapiens
uuucuugaaguccagu

SEQ ID NO: 433668 - RNA, 23 nt, Homo sapiens
uuucuugaaguccaguguuucca

SEQ ID NO: 433669 - RNA, 16 nt, Homo sapiens
uuucuuguugcugcau

SEQ ID NO: 433670 - RNA, 13 nt, Homo sapiens
uuucuuucugcca

SEQ ID NO: 433671 - RNA, 21 nt, Homo sapiens
uuucuuuucuauggagcaaaa

SEQ ID NO: 433672 - RNA, 12 nt, Homo sapiens
uuugaaaacacu

SEQ ID NO: 433673 - RNA, 22 nt, Homo sapiens
uuugaaaaccaacaccaucaca

SEQ ID NO: 433674 - RNA, 13 nt, Homo sapiens
uuugaaacaguug

SEQ ID NO: 433675 - RNA, 16 nt, Homo sapiens
uuugaaagcuguauaa

SEQ ID NO: 433676 - RNA, 12 nt, Homo sapiens
uuugaaccaaaa

SEQ ID NO: 433677 - RNA, 14 nt, Homo sapiens
uuugaaccaaaaca

SEQ ID NO: 433678 - RNA, 22 nt, Homo sapiens
uuugaaugucacaaauugauca

SEQ ID NO: 433679 - RNA, 13 nt, Homo sapiens
uuugacacacuca

SEQ ID NO: 433680 - RNA, 19 nt, Homo sapiens
uuugacacaguuguuucag

SEQ ID NO: 433681 - RNA, 13 nt, Homo sapiens
uuugacuuuucca

SEQ ID NO: 433682 - RNA, 14 nt, Homo sapiens
uuugagacaggaga

SEQ ID NO: 433683 - RNA, 17 nt, Homo sapiens
uuugagauucauauguc

SEQ ID NO: 433684 - RNA, 11 nt, Homo sapiens
uuugagccaug

SEQ ID NO: 433685 - RNA, 21 nt, Homo sapiens
uuugagcccacaaagccuuau

SEQ ID NO: 433686 - RNA, 18 nt, Homo sapiens
uuugagcuggaaagcagc

SEQ ID NO: 433687 - RNA, 16 nt, Homo sapiens
uuugaggggcugacuu

SEQ ID NO: 433688 - RNA, 20 nt, Homo sapiens
uuugagugugggacuccagg

SEQ ID NO: 433689 - RNA, 12 nt, Homo sapiens
uuugauaccagu

SEQ ID NO: 433690 - RNA, 10 nt, Homo sapiens
uuugaucaua

SEQ ID NO: 433691 - RNA, 14 nt, Homo sapiens
uuugcaaugucaca

SEQ ID NO: 433692 - RNA, 20 nt, Homo sapiens
uuugcacaggaaagagucac

SEQ ID NO: 433693 - RNA, 12 nt, Homo sapiens
uuugcacugagg

SEQ ID NO: 433694 - RNA, 12 nt, Homo sapiens
uuugcaggugag

SEQ ID NO: 433695 - RNA, 17 nt, Homo sapiens
uuugcauggaguauuau

SEQ ID NO: 433696 - RNA, 23 nt, Homo sapiens
uuugcauuugcucuuucaucucu

SEQ ID NO: 433697 - RNA, 17 nt, Homo sapiens
uuugccaaggcucuccc

SEQ ID NO: 433698 - RNA, 20 nt, Homo sapiens
uuugccccuuccacuuugag

SEQ ID NO: 433699 - RNA, 15 nt, Homo sapiens
uuugccuucacccau

SEQ ID NO: 433700 - RNA, 14 nt, Homo sapiens
uuugcuaagagcca

SEQ ID NO: 433701 - RNA, 17 nt, Homo sapiens
uuugcuaagagccagag

SEQ ID NO: 433702 - RNA, 15 nt, Homo sapiens
uuugcuaccugaaca

SEQ ID NO: 433703 - RNA, 17 nt, Homo sapiens
uuugcuaccugaacacu

SEQ ID NO: 433704 - RNA, 16 nt, Homo sapiens
uuugcucagaacacau

SEQ ID NO: 433705 - RNA, 18 nt, Homo sapiens
uuugcucuuuucaaugug

SEQ ID NO: 433706 - RNA, 15 nt, Homo sapiens
uuugcugcagacuca

SEQ ID NO: 433707 - RNA, 16 nt, Homo sapiens
uuugcugcagacucau

SEQ ID NO: 433708 - RNA, 16 nt, Homo sapiens
uuuggaugaaugcagu

SEQ ID NO: 433709 - RNA, 13 nt, Homo sapiens
uuuggcaacagaa

SEQ ID NO: 433710 - RNA, 11 nt, Homo sapiens
uuugggagacu

SEQ ID NO: 433711 - RNA, 21 nt, Homo sapiens
uuugggaguguucugugggcu

SEQ ID NO: 433712 - RNA, 20 nt, Homo sapiens
uuugggauguuaccuucaca

SEQ ID NO: 433713 - RNA, 14 nt, Homo sapiens
uuugggauuugccg

SEQ ID NO: 433714 - RNA, 17 nt, Homo sapiens
uuuggggacucauuuca

SEQ ID NO: 433715 - RNA, 20 nt, Homo sapiens
uuugggggauucaaaugcau

SEQ ID NO: 433716 - RNA, 11 nt, Homo sapiens
uuugggguccc

SEQ ID NO: 433717 - RNA, 16 nt, Homo sapiens
uuugguaugugacaug

SEQ ID NO: 433718 - RNA, 19 nt, Homo sapiens
uuuggucuuagcuuuacau

SEQ ID NO: 433719 - RNA, 15 nt, Homo sapiens
uuuggugaauaaccu

SEQ ID NO: 433720 - RNA, 11 nt, Homo sapiens
uuuggugccag

SEQ ID NO: 433721 - RNA, 17 nt, Homo sapiens
uuugguuacugugccau

SEQ ID NO: 433722 - RNA, 18 nt, Homo sapiens
uuugguuuaccuggggau

SEQ ID NO: 433723 - RNA, 11 nt, Homo sapiens
uuugguuuugu

SEQ ID NO: 433724 - RNA, 18 nt, Homo sapiens
uuugguuuugugugguau

SEQ ID NO: 433725 - RNA, 19 nt, Homo sapiens
uuuguaagacacacagccu

SEQ ID NO: 433726 - RNA, 19 nt, Homo sapiens
uuuguagauguauuuucaa

SEQ ID NO: 433727 - RNA, 17 nt, Homo sapiens
uccuuaugauauucuca

SEQ ID NO: 433728 - RNA, 23 nt, Homo sapiens
uccuuaugauguccaacaaggaa

SEQ ID NO: 433729 - RNA, 19 nt, Homo sapiens
uccuucaugcuuuucucau

SEQ ID NO: 433730 - RNA, 16 nt, Homo sapiens
uccuuccaucccuacc

SEQ ID NO: 433731 - RNA, 22 nt, Homo sapiens
uccuucccucuccccaagacuu

SEQ ID NO: 433732 - RNA, 22 nt, Homo sapiens
uccuuccugccaccugcugcug

SEQ ID NO: 433733 - RNA, 13 nt, Homo sapiens
uccuuccugcugu

SEQ ID NO: 433734 - RNA, 13 nt, Homo sapiens
uccuucuccggcc

SEQ ID NO: 433735 - RNA, 17 nt, Homo sapiens
uccuugagcuaagcaga

SEQ ID NO: 433736 - RNA, 19 nt, Homo sapiens
uccuugaguaguuuuuauc

SEQ ID NO: 433737 - RNA, 19 nt, Homo sapiens
uccuuggagccacugggau

SEQ ID NO: 433738 - RNA, 15 nt, Homo sapiens
uccuuggauguaguc

SEQ ID NO: 433739 - RNA, 16 nt, Homo sapiens
uccuuggcaccaaaga

SEQ ID NO: 433740 - RNA, 21 nt, Homo sapiens
uccuuggcgcugccaccugcc

SEQ ID NO: 433741 - RNA, 13 nt, Homo sapiens
uccuuggugccgu

SEQ ID NO: 433742 - RNA, 19 nt, Homo sapiens
uccuugugaagaugauaua

SEQ ID NO: 433743 - RNA, 14 nt, Homo sapiens
uccuuuaccagaug

SEQ ID NO: 433744 - RNA, 14 nt, Homo sapiens
uccuuucuccugau

SEQ ID NO: 433745 - RNA, 18 nt, Homo sapiens
uccuuucuuuaaacuaua

SEQ ID NO: 433746 - RNA, 21 nt, Homo sapiens
uccuuugcgcaaacuuuaaca

SEQ ID NO: 433747 - RNA, 17 nt, Homo sapiens
uccuuuguucucccaaa

SEQ ID NO: 433748 - RNA, 17 nt, Homo sapiens
uccuuuuaaccauuuua

SEQ ID NO: 433749 - RNA, 22 nt, Homo sapiens
uccuuuucugguguuacacaua

SEQ ID NO: 433750 - RNA, 17 nt, Homo sapiens
ucgaaauacaagccauu

SEQ ID NO: 433751 - RNA, 19 nt, Homo sapiens
ucgaacgcgugugugccug

SEQ ID NO: 433752 - RNA, 19 nt, Homo sapiens
ucgaacuccugggcucaag

SEQ ID NO: 433753 - RNA, 13 nt, Homo sapiens
ucgaagcucagcc

SEQ ID NO: 433754 - RNA, 18 nt, Homo sapiens
ucgaaugaacaaagucca

SEQ ID NO: 433755 - RNA, 11 nt, Homo sapiens
ucgaccacagu

SEQ ID NO: 433756 - RNA, 20 nt, Homo sapiens
ucgacucuuugcaacagcac

SEQ ID NO: 433757 - RNA, 15 nt, Homo sapiens
ucgaggagugccgug

SEQ ID NO: 433758 - RNA, 16 nt, Homo sapiens
ucgauguccagcugcu

SEQ ID NO: 433759 - RNA, 17 nt, Homo sapiens
ucgcaaggccugugcug

SEQ ID NO: 433760 - RNA, 14 nt, Homo sapiens
ucgcauuugucaau

SEQ ID NO: 433761 - RNA, 13 nt, Homo sapiens
ucgccaacacuug

SEQ ID NO: 433762 - RNA, 20 nt, Homo sapiens
ucgccaaccgcaucugcuca

SEQ ID NO: 433763 - RNA, 21 nt, Homo sapiens
ucgcccaggcuggagugcaau

SEQ ID NO: 433764 - RNA, 16 nt, Homo sapiens
ucgccuaggccuguga

SEQ ID NO: 433765 - RNA, 19 nt, Homo sapiens
ucgccuuuugacagcugug

SEQ ID NO: 433766 - RNA, 14 nt, Homo sapiens
ucgcgugaugcgca

SEQ ID NO: 433767 - RNA, 17 nt, Homo sapiens
ucgcuauucccaggcag

SEQ ID NO: 433768 - RNA, 17 nt, Homo sapiens
ucgcuucacggacagga

SEQ ID NO: 433769 - RNA, 15 nt, Homo sapiens
ucgcuugaaccuggg

SEQ ID NO: 433770 - RNA, 18 nt, Homo sapiens
ucggagacagugaucucc

SEQ ID NO: 433771 - RNA, 16 nt, Homo sapiens
ucggaguugggggucc

SEQ ID NO: 433772 - RNA, 21 nt, Homo sapiens
ucggauacccuggagcaagac

SEQ ID NO: 433773 - RNA, 14 nt, Homo sapiens
ucggccgucuucac

SEQ ID NO: 433774 - RNA, 11 nt, Homo sapiens
ucggcuggaag

SEQ ID NO: 433775 - RNA, 21 nt, Homo sapiens
ucgggaaggugucuggacauu

SEQ ID NO: 433776 - RNA, 23 nt, Homo sapiens
ucgggcauacuuaucuauaucca

SEQ ID NO: 433777 - RNA, 16 nt, Homo sapiens
ucggggacacaggcca

SEQ ID NO: 433778 - RNA, 15 nt, Homo sapiens
ucgguggcauuugcu

SEQ ID NO: 433779 - RNA, 18 nt, Homo sapiens
ucgucccguucuccauuc

SEQ ID NO: 433780 - RNA, 16 nt, Homo sapiens
ucguccugcugcugcu

SEQ ID NO: 433781 - RNA, 21 nt, Homo sapiens
ucgucugggguggcucugcag

SEQ ID NO: 433782 - RNA, 15 nt, Homo sapiens
ucgugaccuacaggg

SEQ ID NO: 433783 - RNA, 13 nt, Homo sapiens
ucguuaccagaga

SEQ ID NO: 433784 - RNA, 16 nt, Homo sapiens
ucguucuccacccacc

SEQ ID NO: 433785 - RNA, 20 nt, Homo sapiens
ucguucucgugacccagugg

SEQ ID NO: 433786 - RNA, 14 nt, Homo sapiens
ucuaaaaaauaacu

SEQ ID NO: 433787 - RNA, 21 nt, Homo sapiens
ucuaaaagggggcuauucccu

SEQ ID NO: 433788 - RNA, 22 nt, Homo sapiens
ucuaaacaaaaaaaggcgguga

SEQ ID NO: 433789 - RNA, 20 nt, Homo sapiens
ucuaaagguggugaggcaau

SEQ ID NO: 433790 - RNA, 22 nt, Homo sapiens
ucuaaaguuuuauugaugugaa

SEQ ID NO: 433791 - RNA, 20 nt, Homo sapiens
ucuaaauagauacuuuugau

SEQ ID NO: 433792 - RNA, 16 nt, Homo sapiens
ucuaaaucauaaucau

SEQ ID NO: 433793 - RNA, 18 nt, Homo sapiens
ucuaaaugauuaucuuga

SEQ ID NO: 433794 - RNA, 23 nt, Homo sapiens
ucuaaauuugaauguuaagcaga

SEQ ID NO: 433795 - RNA, 24 nt, Homo sapiens
ucuaaauuugaauguuaagcagau

SEQ ID NO: 433796 - RNA, 12 nt, Homo sapiens
ucuaacagauca

SEQ ID NO: 433797 - RNA, 19 nt, Homo sapiens
uccaaaauaucgagugaau

SEQ ID NO: 433798 - RNA, 15 nt, Homo sapiens
uccaaagaacuugau

SEQ ID NO: 433799 - RNA, 20 nt, Homo sapiens
uccaaagcauuuuugaucaa

SEQ ID NO: 433800 - RNA, 12 nt, Homo sapiens
uccaaagcuuuc

SEQ ID NO: 433801 - RNA, 13 nt, Homo sapiens
uccaaagucagau

SEQ ID NO: 433802 - RNA, 21 nt, Homo sapiens
uccaaaguuuuaaaccuguua

SEQ ID NO: 433803 - RNA, 15 nt, Homo sapiens
uccaaaugagccaca

SEQ ID NO: 433804 - RNA, 15 nt, Homo sapiens
uccaaauguccucca

SEQ ID NO: 433805 - RNA, 17 nt, Homo sapiens
uccaacaaacuuacugu

SEQ ID NO: 433806 - RNA, 14 nt, Homo sapiens
uccaacaccacaga

SEQ ID NO: 433807 - RNA, 16 nt, Homo sapiens
uccaacacugcugcuc

SEQ ID NO: 433808 - RNA, 21 nt, Homo sapiens
uccaaccaggaguaccuggac

SEQ ID NO: 433809 - RNA, 16 nt, Homo sapiens
uccaaccgaccagcuu

SEQ ID NO: 433810 - RNA, 20 nt, Homo sapiens
uccaaccugccugugcauga

SEQ ID NO: 433811 - RNA, 18 nt, Homo sapiens
uccaacgugccuccagca

SEQ ID NO: 433812 - RNA, 21 nt, Homo sapiens
uccaacuaacaagaaacucac

SEQ ID NO: 433813 - RNA, 20 nt, Homo sapiens
uccaacuccugaccucaggu

SEQ ID NO: 433814 - RNA, 12 nt, Homo sapiens
uccaacuuuccc

SEQ ID NO: 433815 - RNA, 16 nt, Homo sapiens
uccaacuuucccucca

SEQ ID NO: 433816 - RNA, 14 nt, Homo sapiens
uccaacuuuucauc

SEQ ID NO: 433817 - RNA, 14 nt, Homo sapiens
uccaagaagcccuc

SEQ ID NO: 433818 - RNA, 18 nt, Homo sapiens
uccaagcaaguagcuuuc

SEQ ID NO: 433819 - RNA, 21 nt, Homo sapiens
uccaaggcaaauguccaagca

SEQ ID NO: 433820 - RNA, 14 nt, Homo sapiens
uccaagucuucuca

SEQ ID NO: 433821 - RNA, 19 nt, Homo sapiens
uccaagugaaugaguuucc

SEQ ID NO: 433822 - RNA, 22 nt, Homo sapiens
uccaagugaaugaguuuccagc

SEQ ID NO: 433823 - RNA, 12 nt, Homo sapiens
uccaauaugaug

SEQ ID NO: 433824 - RNA, 14 nt, Homo sapiens
uccaaucacauuca

SEQ ID NO: 433825 - RNA, 20 nt, Homo sapiens
uccaauccuuuauagcuuug

SEQ ID NO: 433826 - RNA, 14 nt, Homo sapiens
uccaaucuccauca

SEQ ID NO: 433827 - RNA, 16 nt, Homo sapiens
uccaauuaugugacaa

SEQ ID NO: 433828 - RNA, 12 nt, Homo sapiens
uccaauugaacu

SEQ ID NO: 433829 - RNA, 22 nt, Homo sapiens
uccaauugaacuuucacauagc

SEQ ID NO: 433830 - RNA, 15 nt, Homo sapiens
uccacaaauguccuc

SEQ ID NO: 433831 - RNA, 22 nt, Homo sapiens
uccacaaccuccuccuccaguu

SEQ ID NO: 433832 - RNA, 13 nt, Homo sapiens
uccacaagccauu

SEQ ID NO: 433833 - RNA, 15 nt, Homo sapiens
uccacacaggcccau

SEQ ID NO: 433834 - RNA, 20 nt, Homo sapiens
uccacagagauuagccugua

SEQ ID NO: 433835 - RNA, 16 nt, Homo sapiens
uccacaugcucugaga

SEQ ID NO: 433836 - RNA, 15 nt, Homo sapiens
uccacauuugucaca

SEQ ID NO: 433837 - RNA, 15 nt, Homo sapiens
uccaccaucaccucu

SEQ ID NO: 433838 - RNA, 20 nt, Homo sapiens
uccacccaggcugcacugca

SEQ ID NO: 433839 - RNA, 11 nt, Homo sapiens
uccaccccagu

SEQ ID NO: 433840 - RNA, 15 nt, Homo sapiens
uccacccccaagaaa

SEQ ID NO: 433841 - RNA, 13 nt, Homo sapiens
uccacccuuggcc

SEQ ID NO: 433842 - RNA, 13 nt, Homo sapiens
uccaccugucuca

SEQ ID NO: 433843 - RNA, 16 nt, Homo sapiens
uccaccugugcugcug

SEQ ID NO: 433844 - RNA, 15 nt, Homo sapiens
uccaccuuguuacac

SEQ ID NO: 433845 - RNA, 20 nt, Homo sapiens
uccaccuuguuacacauuau

SEQ ID NO: 433846 - RNA, 20 nt, Homo sapiens
uccacgaagccuuaagccau

SEQ ID NO: 433847 - RNA, 13 nt, Homo sapiens
uccacucacucca

SEQ ID NO: 433848 - RNA, 14 nt, Homo sapiens
uccacucacuccag

SEQ ID NO: 433849 - RNA, 11 nt, Homo sapiens
uccacuggccu

SEQ ID NO: 433850 - RNA, 15 nt, Homo sapiens
uccacugucaagaaa

SEQ ID NO: 433851 - RNA, 19 nt, Homo sapiens
uccacuucuuguuccccac

SEQ ID NO: 433852 - RNA, 16 nt, Homo sapiens
uccagaacgucucuca

SEQ ID NO: 433853 - RNA, 20 nt, Homo sapiens
uccagaagaaauaauugugu

SEQ ID NO: 433854 - RNA, 11 nt, Homo sapiens
uccagaauuaa

SEQ ID NO: 433855 - RNA, 12 nt, Homo sapiens
uccagaauucac

SEQ ID NO: 433856 - RNA, 16 nt, Homo sapiens
uccagacccccagcaa

SEQ ID NO: 433857 - RNA, 16 nt, Homo sapiens
uccagaccccuacccu

SEQ ID NO: 433858 - RNA, 17 nt, Homo sapiens
uccagagagcagugugg

SEQ ID NO: 433859 - RNA, 17 nt, Homo sapiens
uccagagggaagggaac

SEQ ID NO: 433860 - RNA, 18 nt, Homo sapiens
uccagaggggugcgcaga

SEQ ID NO: 433861 - RNA, 23 nt, Homo sapiens
uccagaggugaugguaacugcac

SEQ ID NO: 433862 - RNA, 21 nt, Homo sapiens
uccagaguaggugggucuugg

SEQ ID NO: 433863 - RNA, 17 nt, Homo sapiens
uccagauagcagggcau

SEQ ID NO: 433864 - RNA, 17 nt, Homo sapiens
uccagaugaacugagaa

SEQ ID NO: 433865 - RNA, 22 nt, Homo sapiens
uccagaugugccuagacacgaa

SEQ ID NO: 433866 - RNA, 11 nt, Homo sapiens
uccagcacauc

SEQ ID NO: 433867 - RNA, 15 nt, Homo sapiens
uccagcaucccaaga

SEQ ID NO: 433868 - RNA, 16 nt, Homo sapiens
uccagcaucccaagau

SEQ ID NO: 433869 - RNA, 16 nt, Homo sapiens
uccagcaugugugugu

SEQ ID NO: 433870 - RNA, 15 nt, Homo sapiens
uccagcccaggacuc

SEQ ID NO: 433871 - RNA, 21 nt, Homo sapiens
uccagccccauagaaaacaau

SEQ ID NO: 433872 - RNA, 17 nt, Homo sapiens
uccagcuccccccaaga

SEQ ID NO: 433873 - RNA, 14 nt, Homo sapiens
uccagcucuaauaa

SEQ ID NO: 433874 - RNA, 18 nt, Homo sapiens
uccagcuucccuuugauu

SEQ ID NO: 433875 - RNA, 18 nt, Homo sapiens
uccaggaacuuuccagca

SEQ ID NO: 433876 - RNA, 17 nt, Homo sapiens
uccaggcagacacagcu

SEQ ID NO: 433877 - RNA, 16 nt, Homo sapiens
uccaggcccaaggagu

SEQ ID NO: 433878 - RNA, 14 nt, Homo sapiens
uccaggccccaaaa

SEQ ID NO: 433879 - RNA, 21 nt, Homo sapiens
uccaggccccaaaaccacagc

SEQ ID NO: 433880 - RNA, 16 nt, Homo sapiens
uccaggcgaugugcaa

SEQ ID NO: 433881 - RNA, 17 nt, Homo sapiens
uccaggcgaugugcaag

SEQ ID NO: 433882 - RNA, 20 nt, Homo sapiens
uccaggcgaugugcaagugu

SEQ ID NO: 433883 - RNA, 17 nt, Homo sapiens
uccaggcuugggcucca

SEQ ID NO: 433884 - RNA, 23 nt, Homo sapiens
uccaggcuugggcuccauuccca

SEQ ID NO: 433885 - RNA, 15 nt, Homo sapiens
uccagggaguccccu

SEQ ID NO: 433886 - RNA, 20 nt, Homo sapiens
uccaggguugaaucuugucc

SEQ ID NO: 433887 - RNA, 15 nt, Homo sapiens
uccagguuccaucca

SEQ ID NO: 433888 - RNA, 19 nt, Homo sapiens
uccaguauucuugucaaaa

SEQ ID NO: 433889 - RNA, 18 nt, Homo sapiens
uccagucuccaccaggaa

SEQ ID NO: 433890 - RNA, 14 nt, Homo sapiens
uccagucuguucuc

SEQ ID NO: 433891 - RNA, 14 nt, Homo sapiens
uccagugggacccc

SEQ ID NO: 433892 - RNA, 20 nt, Homo sapiens
uccaguguugccuccuccca

SEQ ID NO: 433893 - RNA, 14 nt, Homo sapiens
uccaguuccgggag

SEQ ID NO: 433894 - RNA, 21 nt, Homo sapiens
uccaguuuuuugccacugcaa

SEQ ID NO: 433895 - RNA, 16 nt, Homo sapiens
uccauaauugcaaggg

SEQ ID NO: 433896 - RNA, 13 nt, Homo sapiens
uccauagugcacu

SEQ ID NO: 433897 - RNA, 14 nt, Homo sapiens
uccaucagcucucu

SEQ ID NO: 433898 - RNA, 22 nt, Homo sapiens
uccaucagguuccaucccgaaa

SEQ ID NO: 433899 - RNA, 14 nt, Homo sapiens
uccaucauaugccu

SEQ ID NO: 433900 - RNA, 21 nt, Homo sapiens
uccauccccauguguuucagg

SEQ ID NO: 433901 - RNA, 14 nt, Homo sapiens
uccaucccuacccc

SEQ ID NO: 433902 - RNA, 21 nt, Homo sapiens
uccaugacaguagcauacuga

SEQ ID NO: 433903 - RNA, 23 nt, Homo sapiens
uccaugacugcauuuuacuguac

SEQ ID NO: 433904 - RNA, 11 nt, Homo sapiens
uccaugcaugu

SEQ ID NO: 433905 - RNA, 14 nt, Homo sapiens
uccaugcuccucac

SEQ ID NO: 433906 - RNA, 16 nt, Homo sapiens
uccaugcugccuccag

SEQ ID NO: 433907 - RNA, 23 nt, Homo sapiens
uccaugggggcagggcaugacuu

SEQ ID NO: 433908 - RNA, 13 nt, Homo sapiens
uccauguacugua

SEQ ID NO: 433909 - RNA, 19 nt, Homo sapiens
uccauguagaagagggaga

SEQ ID NO: 433910 - RNA, 22 nt, Homo sapiens
uccaugucgccucugcauucag

SEQ ID NO: 433911 - RNA, 20 nt, Homo sapiens
uccauguguuuugcuuuuau

SEQ ID NO: 433912 - RNA, 20 nt, Homo sapiens
uccauguuugauguaucuga

SEQ ID NO: 433913 - RNA, 16 nt, Homo sapiens
uccauguuugcaaugc

SEQ ID NO: 433914 - RNA, 20 nt, Homo sapiens
uccauuaaauggucuaaaau

SEQ ID NO: 433915 - RNA, 14 nt, Homo sapiens
uccauuccagaaua

SEQ ID NO: 433916 - RNA, 15 nt, Homo sapiens
uccauuugcuuuguc

SEQ ID NO: 433917 - RNA, 20 nt, Homo sapiens
uccauuugugugugugcaag

SEQ ID NO: 433918 - RNA, 17 nt, Homo sapiens
ucccaaacagcugccuc

SEQ ID NO: 433919 - RNA, 14 nt, Homo sapiens
ucccaaacccagcc

SEQ ID NO: 433920 - RNA, 14 nt, Homo sapiens
ucccaaacucccag

SEQ ID NO: 433921 - RNA, 15 nt, Homo sapiens
ucccaaagugcuagu

SEQ ID NO: 433922 - RNA, 20 nt, Homo sapiens
ucccaaagugcugggauuac

SEQ ID NO: 433923 - RNA, 22 nt, Homo sapiens
ucccaaaucugaaucgaauuac

SEQ ID NO: 433924 - RNA, 14 nt, Homo sapiens
ucccaacacuuugg

SEQ ID NO: 433925 - RNA, 15 nt, Homo sapiens
ucccaacagccaaga

SEQ ID NO: 433926 - RNA, 21 nt, Homo sapiens
ucccaacccauucacuacagg

SEQ ID NO: 433927 - RNA, 20 nt, Homo sapiens
ucccaagcagcugggauuac

SEQ ID NO: 433928 - RNA, 17 nt, Homo sapiens
ucccaaggaaaauggac

SEQ ID NO: 433929 - RNA, 21 nt, Homo sapiens
ucccaagggaggcccauguga

SEQ ID NO: 433930 - RNA, 18 nt, Homo sapiens
ucagcauucucacuccua

SEQ ID NO: 433931 - RNA, 23 nt, Homo sapiens
ucagccacaugggaaacuuccaa

SEQ ID NO: 433932 - RNA, 20 nt, Homo sapiens
ucagccccacuccacaguua

SEQ ID NO: 433933 - RNA, 18 nt, Homo sapiens
ucagccccucucuacugu

SEQ ID NO: 433934 - RNA, 18 nt, Homo sapiens
ucagccccuucauggaag

SEQ ID NO: 433935 - RNA, 23 nt, Homo sapiens
ucagcccugcccuucagcauccu

SEQ ID NO: 433936 - RNA, 17 nt, Homo sapiens
ucagccugcuucuuccc

SEQ ID NO: 433937 - RNA, 15 nt, Homo sapiens
ucagccuuacauuug

SEQ ID NO: 433938 - RNA, 14 nt, Homo sapiens
ucagcgcugcccac

SEQ ID NO: 433939 - RNA, 15 nt, Homo sapiens
ucagcucccaucuca

SEQ ID NO: 433940 - RNA, 16 nt, Homo sapiens
ucagcucccaucucau

SEQ ID NO: 433941 - RNA, 12 nt, Homo sapiens
ucagcuccuucc

SEQ ID NO: 433942 - RNA, 14 nt, Homo sapiens
ucagcucuuugaca

SEQ ID NO: 433943 - RNA, 12 nt, Homo sapiens
ucagcugagcuu

SEQ ID NO: 433944 - RNA, 22 nt, Homo sapiens
ucagcugccugaaacagccaug

SEQ ID NO: 433945 - RNA, 13 nt, Homo sapiens
ucagcugcuucuc

SEQ ID NO: 433946 - RNA, 15 nt, Homo sapiens
ucagcuguucagauu

SEQ ID NO: 433947 - RNA, 17 nt, Homo sapiens
ucagcuucuuaauauaa

SEQ ID NO: 433948 - RNA, 22 nt, Homo sapiens
ucagcuuuuaauaaaauugaca

SEQ ID NO: 433949 - RNA, 21 nt, Homo sapiens
ucaggaagccuccugcugagu

SEQ ID NO: 433950 - RNA, 15 nt, Homo sapiens
ucaggaauacauuug

SEQ ID NO: 433951 - RNA, 17 nt, Homo sapiens
ucaggaauacauuugga

SEQ ID NO: 433952 - RNA, 20 nt, Homo sapiens
ucaggaaugggccaagccag

SEQ ID NO: 433953 - RNA, 19 nt, Homo sapiens
ucaggaccccaucugcuga

SEQ ID NO: 433954 - RNA, 18 nt, Homo sapiens
ucaggaguuccuaaccag

SEQ ID NO: 433955 - RNA, 18 nt, Homo sapiens
ucaggaguucgagaccaa

SEQ ID NO: 433956 - RNA, 16 nt, Homo sapiens
ucaggaugaacccagg

SEQ ID NO: 433957 - RNA, 23 nt, Homo sapiens
ucaggcgauccaccugucucagc

SEQ ID NO: 433958 - RNA, 16 nt, Homo sapiens
ucaggcucugaaucuc

SEQ ID NO: 433959 - RNA, 20 nt, Homo sapiens
ucagggggauaacuaccaga

SEQ ID NO: 433960 - RNA, 15 nt, Homo sapiens
ucaggggucaccucc

SEQ ID NO: 433961 - RNA, 16 nt, Homo sapiens
ucagguagccaccacc

SEQ ID NO: 433962 - RNA, 17 nt, Homo sapiens
ucagguaguacugggaa

SEQ ID NO: 433963 - RNA, 22 nt, Homo sapiens
ucaggugaucuaccugccucag

SEQ ID NO: 433964 - RNA, 16 nt, Homo sapiens
ucagguguugccaaau

SEQ ID NO: 433965 - RNA, 19 nt, Homo sapiens
ucagguuaaauuaaaccaa

SEQ ID NO: 433966 - RNA, 21 nt, Homo sapiens
ucaguaagaccggaagcuccu

SEQ ID NO: 433967 - RNA, 22 nt, Homo sapiens
ucaguaauaaaacaucuuucca

SEQ ID NO: 433968 - RNA, 12 nt, Homo sapiens
ucaguaccaaag

SEQ ID NO: 433969 - RNA, 22 nt, Homo sapiens
ucaguaggagaggaugcacagu

SEQ ID NO: 433970 - RNA, 16 nt, Homo sapiens
ucaguagugccuguga

SEQ ID NO: 433971 - RNA, 12 nt, Homo sapiens
ucaguauccacu

SEQ ID NO: 433972 - RNA, 15 nt, Homo sapiens
ucaguauugagacac

SEQ ID NO: 433973 - RNA, 14 nt, Homo sapiens
ucagucaacauuua

SEQ ID NO: 433974 - RNA, 12 nt, Homo sapiens
ucagucagggac

SEQ ID NO: 433975 - RNA, 21 nt, Homo sapiens
ucagucaugcacucacaaaga

SEQ ID NO: 433976 - RNA, 22 nt, Homo sapiens
ucaguccacccccauugugaau

SEQ ID NO: 433977 - RNA, 17 nt, Homo sapiens
ucagugcucugcuuuua

SEQ ID NO: 433978 - RNA, 13 nt, Homo sapiens
ucagugugucuaa

SEQ ID NO: 433979 - RNA, 15 nt, Homo sapiens
ucaguguucuucuca

SEQ ID NO: 433980 - RNA, 21 nt, Homo sapiens
ucaguucccccaguaccucca

SEQ ID NO: 433981 - RNA, 20 nt, Homo sapiens
ucaguucccuuggccucaga

SEQ ID NO: 433982 - RNA, 17 nt, Homo sapiens
ucaguuccucuuugcau

SEQ ID NO: 433983 - RNA, 13 nt, Homo sapiens
ucaguuggugcug

SEQ ID NO: 433984 - RNA, 12 nt, Homo sapiens
ucaguuugcuaa

SEQ ID NO: 433985 - RNA, 15 nt, Homo sapiens
ucaguuuuugcugau

SEQ ID NO: 433986 - RNA, 14 nt, Homo sapiens
ucauaaaaauaacc

SEQ ID NO: 433987 - RNA, 17 nt, Homo sapiens
ucauaaggcauauacaa

SEQ ID NO: 433988 - RNA, 20 nt, Homo sapiens
ucauaaggcauauacaaaua

SEQ ID NO: 433989 - RNA, 13 nt, Homo sapiens
ucauaaugacuua

SEQ ID NO: 433990 - RNA, 21 nt, Homo sapiens
ucauaaugugcaaagucauca

SEQ ID NO: 433991 - RNA, 21 nt, Homo sapiens
ucauaauugucaaaaaccaga

SEQ ID NO: 433992 - RNA, 13 nt, Homo sapiens
ucauacaaugaua

SEQ ID NO: 433993 - RNA, 11 nt, Homo sapiens
ucauacuuugc

SEQ ID NO: 433994 - RNA, 14 nt, Homo sapiens
ucauagcugagauu

SEQ ID NO: 433995 - RNA, 15 nt, Homo sapiens
ucauagcugagauuc

SEQ ID NO: 433996 - RNA, 16 nt, Homo sapiens
ucauauaccagcaaua

SEQ ID NO: 433997 - RNA, 17 nt, Homo sapiens
ucauaucuguaugccuc

SEQ ID NO: 433998 - RNA, 22 nt, Homo sapiens
ucauaugaauuagccaaaagaa

SEQ ID NO: 433999 - RNA, 23 nt, Homo sapiens
ucauauugguauucacuaaucug

SEQ ID NO: 434000 - RNA, 17 nt, Homo sapiens
ucauauuuuuacaaaua

SEQ ID NO: 434001 - RNA, 20 nt, Homo sapiens
ucauauuuuuacaaauaauu

SEQ ID NO: 434002 - RNA, 18 nt, Homo sapiens
ucaucaauucucuaucau

SEQ ID NO: 434003 - RNA, 15 nt, Homo sapiens
ucaucagaaacaauu

SEQ ID NO: 434004 - RNA, 22 nt, Homo sapiens
ucaucagaagauaacuugagca

SEQ ID NO: 434005 - RNA, 16 nt, Homo sapiens
ucaucaggcuuggaau

SEQ ID NO: 434006 - RNA, 22 nt, Homo sapiens
ucaucaggcuuggaaugaauuc

SEQ ID NO: 434007 - RNA, 13 nt, Homo sapiens
ucaucaguauugu

SEQ ID NO: 434008 - RNA, 20 nt, Homo sapiens
ucauccaggcucccaaaaga

SEQ ID NO: 434009 - RNA, 18 nt, Homo sapiens
ucauccauagacacagua

SEQ ID NO: 434010 - RNA, 22 nt, Homo sapiens
ucauccuacccuaaugccaguu

SEQ ID NO: 434011 - RNA, 14 nt, Homo sapiens
ucauccuuagcaac

SEQ ID NO: 434012 - RNA, 14 nt, Homo sapiens
ucaucucugcugaa

SEQ ID NO: 434013 - RNA, 17 nt, Homo sapiens
ucaucugaggaguccaa

SEQ ID NO: 434014 - RNA, 24 nt, Homo sapiens
ucaucugaguugagcacuggucac

SEQ ID NO: 434015 - RNA, 22 nt, Homo sapiens
ucaucugcacaacugacuucca

SEQ ID NO: 434016 - RNA, 19 nt, Homo sapiens
ucaucugucugucccaguu

SEQ ID NO: 434017 - RNA, 13 nt, Homo sapiens
ucaucuguuguuu

SEQ ID NO: 434018 - RNA, 15 nt, Homo sapiens
ucaucuucacugcaa

SEQ ID NO: 434019 - RNA, 16 nt, Homo sapiens
ucaugacauguuauau

SEQ ID NO: 434020 - RNA, 14 nt, Homo sapiens
ucaugacuuuucca

SEQ ID NO: 434021 - RNA, 16 nt, Homo sapiens
ucaugaugucugcaaa

SEQ ID NO: 434022 - RNA, 22 nt, Homo sapiens
ucaugcccccuuucagaugucu

SEQ ID NO: 434023 - RNA, 19 nt, Homo sapiens
ucauggaaguggcagugaa

SEQ ID NO: 434024 - RNA, 15 nt, Homo sapiens
ucauggcagucccaa

SEQ ID NO: 434025 - RNA, 18 nt, Homo sapiens
ucauggcuuuguauccaa

SEQ ID NO: 434026 - RNA, 21 nt, Homo sapiens
ucauggguuauguguaugugc

SEQ ID NO: 434027 - RNA, 16 nt, Homo sapiens
ucauguaaaugcucaa

SEQ ID NO: 434028 - RNA, 19 nt, Homo sapiens
ucauguaaaugcucaaaga

SEQ ID NO: 434029 - RNA, 17 nt, Homo sapiens
ucaugugauuuacccuu

SEQ ID NO: 434030 - RNA, 11 nt, Homo sapiens
ucauguucuca

SEQ ID NO: 434031 - RNA, 22 nt, Homo sapiens
ucauuaccgucugugauugcca

SEQ ID NO: 434032 - RNA, 17 nt, Homo sapiens
ucauuaccucccuauca

SEQ ID NO: 434033 - RNA, 22 nt, Homo sapiens
ucauuaguaaaaaugacuucac

SEQ ID NO: 434034 - RNA, 19 nt, Homo sapiens
ucauuaguugaaagggaua

SEQ ID NO: 434035 - RNA, 15 nt, Homo sapiens
ucauuaucaccuucc

SEQ ID NO: 434036 - RNA, 13 nt, Homo sapiens
ucauuauuggaau

SEQ ID NO: 434037 - RNA, 19 nt, Homo sapiens
ucauuauuuugugguucua

SEQ ID NO: 434038 - RNA, 20 nt, Homo sapiens
ucauuauuuuuccacuuugu

SEQ ID NO: 434039 - RNA, 18 nt, Homo sapiens
ucauucaacucuccaaug

SEQ ID NO: 434040 - RNA, 16 nt, Homo sapiens
ucauucaagccuguga

SEQ ID NO: 434041 - RNA, 13 nt, Homo sapiens
ucauucaguacuu

SEQ ID NO: 434042 - RNA, 15 nt, Homo sapiens
ucauuccuaacacag

SEQ ID NO: 434043 - RNA, 20 nt, Homo sapiens
ucauucuacugaacagucca

SEQ ID NO: 434044 - RNA, 16 nt, Homo sapiens
ucauucucaguaucca

SEQ ID NO: 434045 - RNA, 17 nt, Homo sapiens
ucauucuuucugcuaua

SEQ ID NO: 434046 - RNA, 19 nt, Homo sapiens
ucauucuuuuggauugcua

SEQ ID NO: 434047 - RNA, 21 nt, Homo sapiens
ucauugagaaauaaagcacau

SEQ ID NO: 434048 - RNA, 22 nt, Homo sapiens
ucauugcccgaaaccagagccu

SEQ ID NO: 434049 - RNA, 13 nt, Homo sapiens
ucauugcuaauau

SEQ ID NO: 434050 - RNA, 16 nt, Homo sapiens
ucauugugugucuuca

SEQ ID NO: 434051 - RNA, 16 nt, Homo sapiens
ucauuucaucuaccau

SEQ ID NO: 434052 - RNA, 20 nt, Homo sapiens
ucauuucauguuagucuuac

SEQ ID NO: 434053 - RNA, 18 nt, Homo sapiens
ucauuuccagaaaggcuc

SEQ ID NO: 434054 - RNA, 11 nt, Homo sapiens
ucauuugcauc

SEQ ID NO: 434055 - RNA, 21 nt, Homo sapiens
ucauuugcauccuaucgaucu

SEQ ID NO: 434056 - RNA, 16 nt, Homo sapiens
ucauuuucaccuccau

SEQ ID NO: 434057 - RNA, 18 nt, Homo sapiens
ucauuuuuuucacuggag

SEQ ID NO: 434058 - RNA, 23 nt, Homo sapiens
ucauuuuuuucacuggaguuaca

SEQ ID NO: 434059 - RNA, 14 nt, Homo sapiens
uccaaaaacaguga

SEQ ID NO: 434060 - RNA, 20 nt, Homo sapiens
uccaaaagagacagggagaa

SEQ ID NO: 434061 - RNA, 12 nt, Homo sapiens
uccaaaagcaaa

SEQ ID NO: 434062 - RNA, 14 nt, Homo sapiens
ucccaagucaaaca

SEQ ID NO: 434063 - RNA, 19 nt, Homo sapiens
ucccaaucuuucuauauaa

SEQ ID NO: 434064 - RNA, 23 nt, Homo sapiens
ucccacacagaauauacauuguc

SEQ ID NO: 434065 - RNA, 18 nt, Homo sapiens
ucccacacccuguuuuac

SEQ ID NO: 434066 - RNA, 16 nt, Homo sapiens
ucccacaggcccuucc

SEQ ID NO: 434067 - RNA, 18 nt, Homo sapiens
ucccacuaagcuuucucc

SEQ ID NO: 434068 - RNA, 17 nt, Homo sapiens
ucccacucaggugaaaa

SEQ ID NO: 434069 - RNA, 17 nt, Homo sapiens
ucccacuucagugcacc

SEQ ID NO: 434070 - RNA, 13 nt, Homo sapiens
ucccagaaccaca

SEQ ID NO: 434071 - RNA, 14 nt, Homo sapiens
ucccagacauucau

SEQ ID NO: 434072 - RNA, 18 nt, Homo sapiens
ucccagauguuggaccaa

SEQ ID NO: 434073 - RNA, 21 nt, Homo sapiens
ucccagauguuggaccaacac

SEQ ID NO: 434074 - RNA, 15 nt, Homo sapiens
ucccagcaccugcca

SEQ ID NO: 434075 - RNA, 13 nt, Homo sapiens
ucccagcacuuug

SEQ ID NO: 434076 - RNA, 17 nt, Homo sapiens
ucccagcagcccaagcu

SEQ ID NO: 434077 - RNA, 13 nt, Homo sapiens
ucccagcuacuca

SEQ ID NO: 434078 - RNA, 17 nt, Homo sapiens
ucccaggacgcagggag

SEQ ID NO: 434079 - RNA, 21 nt, Homo sapiens
ucccaggcccgagaugugacc

SEQ ID NO: 434080 - RNA, 13 nt, Homo sapiens
ucccagggccaug

SEQ ID NO: 434081 - RNA, 15 nt, Homo sapiens
ucccaguaaaaggca

SEQ ID NO: 434082 - RNA, 22 nt, Homo sapiens
ucccagugaccccugaccucac

SEQ ID NO: 434083 - RNA, 13 nt, Homo sapiens
ucccagugaucac

SEQ ID NO: 434084 - RNA, 12 nt, Homo sapiens
ucccagugccau

SEQ ID NO: 434085 - RNA, 17 nt, Homo sapiens
ucccaguuaacuguuaa

SEQ ID NO: 434086 - RNA, 17 nt, Homo sapiens
ucccauaaagaaaguga

SEQ ID NO: 434087 - RNA, 14 nt, Homo sapiens
ucccauccaucagc

SEQ ID NO: 434088 - RNA, 19 nt, Homo sapiens
ucccauuugggcaguauag

SEQ ID NO: 434089 - RNA, 23 nt, Homo sapiens
uccccaaacauuaaucaccaaag

SEQ ID NO: 434090 - RNA, 18 nt, Homo sapiens
uccccaaacccacccaua

SEQ ID NO: 434091 - RNA, 16 nt, Homo sapiens
uccccaaccacuucau

SEQ ID NO: 434092 - RNA, 19 nt, Homo sapiens
uccccaacgaaaagcacau

SEQ ID NO: 434093 - RNA, 16 nt, Homo sapiens
uccccaagagcuguua

SEQ ID NO: 434094 - RNA, 14 nt, Homo sapiens
uccccaccuuccaa

SEQ ID NO: 434095 - RNA, 13 nt, Homo sapiens
uccccacugccug

SEQ ID NO: 434096 - RNA, 14 nt, Homo sapiens
uccccagagcacug

SEQ ID NO: 434097 - RNA, 18 nt, Homo sapiens
uccccauauuuguguuca

SEQ ID NO: 434098 - RNA, 23 nt, Homo sapiens
uccccaugcaugggaaagugcaa

SEQ ID NO: 434099 - RNA, 13 nt, Homo sapiens
uccccauggugca

SEQ ID NO: 434100 - RNA, 18 nt, Homo sapiens
ucccccaaagcaauguga

SEQ ID NO: 434101 - RNA, 14 nt, Homo sapiens
ucccccaaaguuca

SEQ ID NO: 434102 - RNA, 21 nt, Homo sapiens
ucccccacggccgucccugac

SEQ ID NO: 434103 - RNA, 12 nt, Homo sapiens
ucccccaugugc

SEQ ID NO: 434104 - RNA, 22 nt, Homo sapiens
ucccccuguagacuagugccgu

SEQ ID NO: 434105 - RNA, 23 nt, Homo sapiens
uccccgauugaaagaaccagaga

SEQ ID NO: 434106 - RNA, 22 nt, Homo sapiens
uccccgggguauuagcaccucu

SEQ ID NO: 434107 - RNA, 22 nt, Homo sapiens
uccccuagcuuuccccagacac

SEQ ID NO: 434108 - RNA, 14 nt, Homo sapiens
uccccucccagaug

SEQ ID NO: 434109 - RNA, 19 nt, Homo sapiens
uccccucccuggcucccau

SEQ ID NO: 434110 - RNA, 23 nt, Homo sapiens
uccccuccuugccuccuguguaa

SEQ ID NO: 434111 - RNA, 16 nt, Homo sapiens
uccccugcacuguaaa

SEQ ID NO: 434112 - RNA, 18 nt, Homo sapiens
uccccugcacuguaaaau

SEQ ID NO: 434113 - RNA, 21 nt, Homo sapiens
uccccugccuuccuuuaaucc

SEQ ID NO: 434114 - RNA, 15 nt, Homo sapiens
uccccuggacauauu

SEQ ID NO: 434115 - RNA, 21 nt, Homo sapiens
uccccuuuguguagaaagcca

SEQ ID NO: 434116 - RNA, 14 nt, Homo sapiens
ucccgaaacuccac

SEQ ID NO: 434117 - RNA, 19 nt, Homo sapiens
ucccgaguaacugagauua

SEQ ID NO: 434118 - RNA, 20 nt, Homo sapiens
ucccgaguaacugagauuac

SEQ ID NO: 434119 - RNA, 22 nt, Homo sapiens
ucccggcuggacuuuugcagcu

SEQ ID NO: 434120 - RNA, 19 nt, Homo sapiens
ucccggcuuugcagggaga

SEQ ID NO: 434121 - RNA, 16 nt, Homo sapiens
ucccgucuuccgguca

SEQ ID NO: 434122 - RNA, 15 nt, Homo sapiens
ucccuaaaaauucca

SEQ ID NO: 434123 - RNA, 20 nt, Homo sapiens
ucccuaagaauucccagaua

SEQ ID NO: 434124 - RNA, 22 nt, Homo sapiens
uccuccauaaauuauggcauuu

SEQ ID NO: 434125 - RNA, 13 nt, Homo sapiens
uccuccccagaaa

SEQ ID NO: 434126 - RNA, 15 nt, Homo sapiens
uccuccccucuugag

SEQ ID NO: 434127 - RNA, 15 nt, Homo sapiens
uccucccuacuucca

SEQ ID NO: 434128 - RNA, 12 nt, Homo sapiens
uccuccguccac

SEQ ID NO: 434129 - RNA, 17 nt, Homo sapiens
uccucuauuuugugaug

SEQ ID NO: 434130 - RNA, 18 nt, Homo sapiens
uccucuccucguccggcc

SEQ ID NO: 434131 - RNA, 16 nt, Homo sapiens
uccucugcaugucuca

SEQ ID NO: 434132 - RNA, 12 nt, Homo sapiens
uccucuuaccug

SEQ ID NO: 434133 - RNA, 21 nt, Homo sapiens
uccucuugccucucucaggag

SEQ ID NO: 434134 - RNA, 14 nt, Homo sapiens
uccucuugcucaaa

SEQ ID NO: 434135 - RNA, 14 nt, Homo sapiens
uccucuuguuuacg

SEQ ID NO: 434136 - RNA, 17 nt, Homo sapiens
uccucuuuaccuguuca

SEQ ID NO: 434137 - RNA, 18 nt, Homo sapiens
uccugaagccucugcccu

SEQ ID NO: 434138 - RNA, 14 nt, Homo sapiens
uccugacagcaaua

SEQ ID NO: 434139 - RNA, 14 nt, Homo sapiens
uccugacccuguga

SEQ ID NO: 434140 - RNA, 21 nt, Homo sapiens
uccugagaaagcccaccuggg

SEQ ID NO: 434141 - RNA, 20 nt, Homo sapiens
uccugaggcagaaccuggug

SEQ ID NO: 434142 - RNA, 20 nt, Homo sapiens
uccugagggauuucuaacca

SEQ ID NO: 434143 - RNA, 23 nt, Homo sapiens
uccugauaaacauuaaacacugu

SEQ ID NO: 434144 - RNA, 15 nt, Homo sapiens
uccugauguacuuua

SEQ ID NO: 434145 - RNA, 17 nt, Homo sapiens
uccugauguuuuuccca

SEQ ID NO: 434146 - RNA, 16 nt, Homo sapiens
uccugcaaaauuaccu

SEQ ID NO: 434147 - RNA, 11 nt, Homo sapiens
uccugcaaguc

SEQ ID NO: 434148 - RNA, 22 nt, Homo sapiens
uccugcaauaaaauaguagcau

SEQ ID NO: 434149 - RNA, 15 nt, Homo sapiens
uccugcaccgagaga

SEQ ID NO: 434150 - RNA, 20 nt, Homo sapiens
uccugcacgccguggagcau

SEQ ID NO: 434151 - RNA, 20 nt, Homo sapiens
uccugcagccuccuccugac

SEQ ID NO: 434152 - RNA, 21 nt, Homo sapiens
uccugcagccuccuccugacc

SEQ ID NO: 434153 - RNA, 21 nt, Homo sapiens
uccugcaucguggcacuccuc

SEQ ID NO: 434154 - RNA, 19 nt, Homo sapiens
uccugcccuuccugaagaa

SEQ ID NO: 434155 - RNA, 14 nt, Homo sapiens
uccugccuggccag

SEQ ID NO: 434156 - RNA, 20 nt, Homo sapiens
uccugccuuucuuccaucag

SEQ ID NO: 434157 - RNA, 15 nt, Homo sapiens
uccugcggcaucaga

SEQ ID NO: 434158 - RNA, 15 nt, Homo sapiens
uccugcuccaugacu

SEQ ID NO: 434159 - RNA, 22 nt, Homo sapiens
uccugcuggaugcgugcccuga

SEQ ID NO: 434160 - RNA, 16 nt, Homo sapiens
uccugcuuaaugucag

SEQ ID NO: 434161 - RNA, 15 nt, Homo sapiens
uccuggaaugaagca

SEQ ID NO: 434162 - RNA, 16 nt, Homo sapiens
uccuggaaugcauuca

SEQ ID NO: 434163 - RNA, 17 nt, Homo sapiens
uccuggagccccagaac

SEQ ID NO: 434164 - RNA, 17 nt, Homo sapiens
uccuggcaugacacucu

SEQ ID NO: 434165 - RNA, 14 nt, Homo sapiens
uccuggcugugcac

SEQ ID NO: 434166 - RNA, 14 nt, Homo sapiens
uccuggcuuuuauu

SEQ ID NO: 434167 - RNA, 23 nt, Homo sapiens
uccugggaaggagggagcugcuc

SEQ ID NO: 434168 - RNA, 13 nt, Homo sapiens
uccugggauucaa

SEQ ID NO: 434169 - RNA, 14 nt, Homo sapiens
uccugggauucaaa

SEQ ID NO: 434170 - RNA, 18 nt, Homo sapiens
uccuggguggacuuuuga

SEQ ID NO: 434171 - RNA, 16 nt, Homo sapiens
uccugguucaguggga

SEQ ID NO: 434172 - RNA, 22 nt, Homo sapiens
uccuguacauugugggauguuc

SEQ ID NO: 434173 - RNA, 13 nt, Homo sapiens
uccugucaccaag

SEQ ID NO: 434174 - RNA, 11 nt, Homo sapiens
uccugugaaag

SEQ ID NO: 434175 - RNA, 15 nt, Homo sapiens
uccugugacuguuuu

SEQ ID NO: 434176 - RNA, 23 nt, Homo sapiens
uccugugcggugucaccaugagc

SEQ ID NO: 434177 - RNA, 13 nt, Homo sapiens
uccuguuacuuaa

SEQ ID NO: 434178 - RNA, 19 nt, Homo sapiens
uccuguucgugcuuguaau

SEQ ID NO: 434179 - RNA, 22 nt, Homo sapiens
uccuguucgugcuuguaaugcu

SEQ ID NO: 434180 - RNA, 21 nt, Homo sapiens
uccuguuguuauggaaacugu

SEQ ID NO: 434181 - RNA, 23 nt, Homo sapiens
uccuuaaaaaauaaaguacgugu

SEQ ID NO: 434182 - RNA, 16 nt, Homo sapiens
uccuuaaacagggcau

SEQ ID NO: 434183 - RNA, 17 nt, Homo sapiens
uccuuaaacuccuguga

SEQ ID NO: 434184 - RNA, 17 nt, Homo sapiens
uccuuaauaacaacaga

SEQ ID NO: 434185 - RNA, 16 nt, Homo sapiens
uccuuaauaugaucug

SEQ ID NO: 434186 - RNA, 19 nt, Homo sapiens
uggcaauaaggaucuuccc

SEQ ID NO: 434187 - RNA, 17 nt, Homo sapiens
uggcaccccagcuaccc

SEQ ID NO: 434188 - RNA, 16 nt, Homo sapiens
uggcaccccuuucuag

SEQ ID NO: 434189 - RNA, 21 nt, Homo sapiens
uggcaccuguagucccagcua

SEQ ID NO: 434190 - RNA, 23 nt, Homo sapiens
uggcacuccucucgcauggugug

SEQ ID NO: 434191 - RNA, 22 nt, Homo sapiens
uggcagaaaucccaguucaugu

SEQ ID NO: 434192 - RNA, 14 nt, Homo sapiens
uggcagcgccuccc

SEQ ID NO: 434193 - RNA, 14 nt, Homo sapiens
uggcaggugccuug

SEQ ID NO: 434194 - RNA, 18 nt, Homo sapiens
uggcaucugacacugaca

SEQ ID NO: 434195 - RNA, 15 nt, Homo sapiens
uggcauuaucucuuu

SEQ ID NO: 434196 - RNA, 22 nt, Homo sapiens
uggcauucgcagugcccaguga

SEQ ID NO: 434197 - RNA, 23 nt, Homo sapiens
uggcauucgcagugcccagugau

SEQ ID NO: 434198 - RNA, 21 nt, Homo sapiens
uggcauugucccugugccuaa

SEQ ID NO: 434199 - RNA, 17 nt, Homo sapiens
uggcauuuguugugacu

SEQ ID NO: 434200 - RNA, 15 nt, Homo sapiens
uggccaaaguguaca

SEQ ID NO: 434201 - RNA, 23 nt, Homo sapiens
uggccacugggucucacuccuga

SEQ ID NO: 434202 - RNA, 17 nt, Homo sapiens
uggccagacuucagcug

SEQ ID NO: 434203 - RNA, 17 nt, Homo sapiens
uggccagagaugccagc

SEQ ID NO: 434204 - RNA, 19 nt, Homo sapiens
uggccaggcuggucucaaa

SEQ ID NO: 434205 - RNA, 22 nt, Homo sapiens
uggcccaagugguuugugcuaa

SEQ ID NO: 434206 - RNA, 23 nt, Homo sapiens
uggcccaagugguuugugcuaac

SEQ ID NO: 434207 - RNA, 20 nt, Homo sapiens
uggcccacgcccucccucuc

SEQ ID NO: 434208 - RNA, 13 nt, Homo sapiens
uggcccagccuug

SEQ ID NO: 434209 - RNA, 18 nt, Homo sapiens
uggccccgggcucuggcc

SEQ ID NO: 434210 - RNA, 17 nt, Homo sapiens
uggccccucaccugggc

SEQ ID NO: 434211 - RNA, 19 nt, Homo sapiens
uggcccucuuugaaagggc

SEQ ID NO: 434212 - RNA, 12 nt, Homo sapiens
uggcccuguuaa

SEQ ID NO: 434213 - RNA, 23 nt, Homo sapiens
uggcccuguugugggggugucac

SEQ ID NO: 434214 - RNA, 22 nt, Homo sapiens
uggccgaaccccccacucccug

SEQ ID NO: 434215 - RNA, 16 nt, Homo sapiens
uggccgggcacagcug

SEQ ID NO: 434216 - RNA, 18 nt, Homo sapiens
uggccgucacgcuuucau

SEQ ID NO: 434217 - RNA, 21 nt, Homo sapiens
uggccuauuuuggacguguga

SEQ ID NO: 434218 - RNA, 12 nt, Homo sapiens
uggccucaggag

SEQ ID NO: 434219 - RNA, 18 nt, Homo sapiens
uggccugguucaauuucu

SEQ ID NO: 434220 - RNA, 17 nt, Homo sapiens
uggccuugaaaccaccu

SEQ ID NO: 434221 - RNA, 17 nt, Homo sapiens
uggccuugguguaaaau

SEQ ID NO: 434222 - RNA, 23 nt, Homo sapiens
uggccuugugucagagcugggag

SEQ ID NO: 434223 - RNA, 14 nt, Homo sapiens
uggcgacugucaug

SEQ ID NO: 434224 - RNA, 19 nt, Homo sapiens
uggcuaauuccccuuccau

SEQ ID NO: 434225 - RNA, 18 nt, Homo sapiens
uggcuacacacaaaccag

SEQ ID NO: 434226 - RNA, 19 nt, Homo sapiens
uggcuacacacaaaccagu

SEQ ID NO: 434227 - RNA, 21 nt, Homo sapiens
uggcuacacacaaaccaguau

SEQ ID NO: 434228 - RNA, 15 nt, Homo sapiens
uggcuagacuugcca

SEQ ID NO: 434229 - RNA, 16 nt, Homo sapiens
uggcuagucacauauc

SEQ ID NO: 434230 - RNA, 15 nt, Homo sapiens
uggcuauaaauauau

SEQ ID NO: 434231 - RNA, 21 nt, Homo sapiens
uggcuauaacaugucuuucag

SEQ ID NO: 434232 - RNA, 19 nt, Homo sapiens
uggcuaucugcauuuauaa

SEQ ID NO: 434233 - RNA, 13 nt, Homo sapiens
uggcucacagcca

SEQ ID NO: 434234 - RNA, 18 nt, Homo sapiens
uggcucagugccaccuau

SEQ ID NO: 434235 - RNA, 13 nt, Homo sapiens
uggcucaucucuu

SEQ ID NO: 434236 - RNA, 15 nt, Homo sapiens
uggcucccaggacac

SEQ ID NO: 434237 - RNA, 13 nt, Homo sapiens
uggcuccuaucug

SEQ ID NO: 434238 - RNA, 19 nt, Homo sapiens
uggcucgugggcucuggcu

SEQ ID NO: 434239 - RNA, 18 nt, Homo sapiens
uggcucguuugggcucaa

SEQ ID NO: 434240 - RNA, 22 nt, Homo sapiens
uggcucuaacauuacugccuuc

SEQ ID NO: 434241 - RNA, 20 nt, Homo sapiens
uggcucugcaugacaaacac

SEQ ID NO: 434242 - RNA, 11 nt, Homo sapiens
uggcucuguca

SEQ ID NO: 434243 - RNA, 14 nt, Homo sapiens
uggcugacuguugc

SEQ ID NO: 434244 - RNA, 20 nt, Homo sapiens
uggcugauggaagcaccuaa

SEQ ID NO: 434245 - RNA, 14 nt, Homo sapiens
uggcugcacagccc

SEQ ID NO: 434246 - RNA, 18 nt, Homo sapiens
uggcuuaaaaauacuuaa

SEQ ID NO: 434247 - RNA, 17 nt, Homo sapiens
uggcuuaagccugugua

SEQ ID NO: 434248 - RNA, 20 nt, Homo sapiens
uggcuuuugccccagaaagg

SEQ ID NO: 434249 - RNA, 19 nt, Homo sapiens
uggcuuuuuaaauuuucca

SEQ ID NO: 434250 - RNA, 19 nt, Homo sapiens
uggcuuuuuuuuguagcca

SEQ ID NO: 434251 - RNA, 16 nt, Homo sapiens
ugggaaaacuguauua

SEQ ID NO: 434252 - RNA, 14 nt, Homo sapiens
ugggaaaguggagu

SEQ ID NO: 434253 - RNA, 15 nt, Homo sapiens
ugggaaauucuugca

SEQ ID NO: 434254 - RNA, 15 nt, Homo sapiens
ugggaacuccacucu

SEQ ID NO: 434255 - RNA, 15 nt, Homo sapiens
ugggaacucccaaga

SEQ ID NO: 434256 - RNA, 20 nt, Homo sapiens
ugggaagaaagauucaauua

SEQ ID NO: 434257 - RNA, 16 nt, Homo sapiens
ugggaauugugugaug

SEQ ID NO: 434258 - RNA, 14 nt, Homo sapiens
ugggacugcugcuu

SEQ ID NO: 434259 - RNA, 17 nt, Homo sapiens
ugggagaaaagccagau

SEQ ID NO: 434260 - RNA, 18 nt, Homo sapiens
ugggagaaggacuaucaa

SEQ ID NO: 434261 - RNA, 15 nt, Homo sapiens
ugggagaaggugcuu

SEQ ID NO: 434262 - RNA, 16 nt, Homo sapiens
ugggagagacugugag

SEQ ID NO: 434263 - RNA, 20 nt, Homo sapiens
ugggagccaaauguggcauu

SEQ ID NO: 434264 - RNA, 20 nt, Homo sapiens
ugggagcccugaccuuggcu

SEQ ID NO: 434265 - RNA, 15 nt, Homo sapiens
ugggaggaacaaaga

SEQ ID NO: 434266 - RNA, 17 nt, Homo sapiens
ugggaggaacaaagaca

SEQ ID NO: 434267 - RNA, 18 nt, Homo sapiens
ugggagggaagcuucugg

SEQ ID NO: 434268 - RNA, 21 nt, Homo sapiens
ugggaguaagagcaaauuuca

SEQ ID NO: 434269 - RNA, 21 nt, Homo sapiens
ugggauauuacaaauaaagcu

SEQ ID NO: 434270 - RNA, 19 nt, Homo sapiens
ugggaucgcaccuuuuaua

SEQ ID NO: 434271 - RNA, 21 nt, Homo sapiens
ugggauggggcauguggccaa

SEQ ID NO: 434272 - RNA, 15 nt, Homo sapiens
ugggauguucagcac

SEQ ID NO: 434273 - RNA, 17 nt, Homo sapiens
ugggauuaacauaaaag

SEQ ID NO: 434274 - RNA, 21 nt, Homo sapiens
ugggauuaugggucacaggaa

SEQ ID NO: 434275 - RNA, 23 nt, Homo sapiens
ugggcaacaugaugaaaucccau

SEQ ID NO: 434276 - RNA, 12 nt, Homo sapiens
ugggcaccucag

SEQ ID NO: 434277 - RNA, 16 nt, Homo sapiens
ugggcaccucagaaag

SEQ ID NO: 434278 - RNA, 21 nt, Homo sapiens
ugggcaccuggggagugggac

SEQ ID NO: 434279 - RNA, 15 nt, Homo sapiens
ugggccaaucacuga

SEQ ID NO: 434280 - RNA, 23 nt, Homo sapiens
ugggccaccccuaaucacuauug

SEQ ID NO: 434281 - RNA, 21 nt, Homo sapiens
ugggccccagccguggcguga

SEQ ID NO: 434282 - RNA, 23 nt, Homo sapiens
ugggcccugguucccccaggacc

SEQ ID NO: 434283 - RNA, 17 nt, Homo sapiens
ugggccucauucuagca

SEQ ID NO: 434284 - RNA, 13 nt, Homo sapiens
ugggccuccucua

SEQ ID NO: 434285 - RNA, 13 nt, Homo sapiens
ugggccugccaaa

SEQ ID NO: 434286 - RNA, 14 nt, Homo sapiens
ugggccuggcuccc

SEQ ID NO: 434287 - RNA, 17 nt, Homo sapiens
ugggccugucucagauu

SEQ ID NO: 434288 - RNA, 13 nt, Homo sapiens
ugggcuacuggca

SEQ ID NO: 434289 - RNA, 16 nt, Homo sapiens
ugggcugagacuggau

SEQ ID NO: 434290 - RNA, 22 nt, Homo sapiens
ugggcuuacaggcaugagccac

SEQ ID NO: 434291 - RNA, 19 nt, Homo sapiens
ugggcuuggccuuguguca

SEQ ID NO: 434292 - RNA, 16 nt, Homo sapiens
uggggaaguguuccag

SEQ ID NO: 434293 - RNA, 21 nt, Homo sapiens
uggggacgggggcugcuucuc

SEQ ID NO: 434294 - RNA, 17 nt, Homo sapiens
uggggagacaccucaga

SEQ ID NO: 434295 - RNA, 19 nt, Homo sapiens
uggggaguaggacauacca

SEQ ID NO: 434296 - RNA, 16 nt, Homo sapiens
uggggauuaucuguca

SEQ ID NO: 434297 - RNA, 14 nt, Homo sapiens
uggggcaagccuga

SEQ ID NO: 434298 - RNA, 22 nt, Homo sapiens
uggggccacacguuugccaaau

SEQ ID NO: 434299 - RNA, 10 nt, Homo sapiens
uggggcuccu

SEQ ID NO: 434300 - RNA, 18 nt, Homo sapiens
uggggcuccuuucuccag

SEQ ID NO: 434301 - RNA, 21 nt, Homo sapiens
ugggggacugggagucagagc

SEQ ID NO: 434302 - RNA, 15 nt, Homo sapiens
uggggugggccucug

SEQ ID NO: 434303 - RNA, 16 nt, Homo sapiens
uggguaacugucaagu

SEQ ID NO: 434304 - RNA, 20 nt, Homo sapiens
uggguaagacuaaaucugua

SEQ ID NO: 434305 - RNA, 18 nt, Homo sapiens
uggguagucauucuuaca

SEQ ID NO: 434306 - RNA, 12 nt, Homo sapiens
ugggucaacucc

SEQ ID NO: 434307 - RNA, 19 nt, Homo sapiens
ugggucaccuuccugggca

SEQ ID NO: 434308 - RNA, 16 nt, Homo sapiens
ugggugcccacagccc

SEQ ID NO: 434309 - RNA, 15 nt, Homo sapiens
uggguuccagacaga

SEQ ID NO: 434310 - RNA, 14 nt, Homo sapiens
ugguaaaugaucac

SEQ ID NO: 434311 - RNA, 14 nt, Homo sapiens
ugguaaaugucaca

SEQ ID NO: 434312 - RNA, 13 nt, Homo sapiens
ugguaaccgagcc

SEQ ID NO: 434313 - RNA, 12 nt, Homo sapiens
ugguaacugcac

SEQ ID NO: 434314 - RNA, 23 nt, Homo sapiens
ugguacuuuuaacauaaagaaau

SEQ ID NO: 434315 - RNA, 15 nt, Homo sapiens
ugguagacugugaca

SEQ ID NO: 434316 - RNA, 12 nt, Homo sapiens
gcucacgugugu

SEQ ID NO: 434317 - RNA, 20 nt, Homo sapiens
gcucagugcaaaacugauga

SEQ ID NO: 434318 - RNA, 20 nt, Homo sapiens
gcucaguggaucacacacau

SEQ ID NO: 434319 - RNA, 15 nt, Homo sapiens
gcucaguuggugcug

SEQ ID NO: 434320 - RNA, 18 nt, Homo sapiens
gcucaguuggugcugcuu

SEQ ID NO: 434321 - RNA, 15 nt, Homo sapiens
gcucaucuugcaaag

SEQ ID NO: 434322 - RNA, 15 nt, Homo sapiens
gcucaugagcgucug

SEQ ID NO: 434323 - RNA, 18 nt, Homo sapiens
gcucaugagcgucugugg

SEQ ID NO: 434324 - RNA, 17 nt, Homo sapiens
gcuccacaguguugcca

SEQ ID NO: 434325 - RNA, 21 nt, Homo sapiens
gcuccaccuuccaaaggaccu

SEQ ID NO: 434326 - RNA, 16 nt, Homo sapiens
gcuccacgaagccuua

SEQ ID NO: 434327 - RNA, 17 nt, Homo sapiens
gcuccacgaagccuuaa

SEQ ID NO: 434328 - RNA, 13 nt, Homo sapiens
gcuccagcaucca

SEQ ID NO: 434329 - RNA, 13 nt, Homo sapiens
gcuccagugcagg

SEQ ID NO: 434330 - RNA, 21 nt, Homo sapiens
gcuccauaauugcaagggaag

SEQ ID NO: 434331 - RNA, 21 nt, Homo sapiens
gcuccaugcagaucuagccag

SEQ ID NO: 434332 - RNA, 16 nt, Homo sapiens
gcuccauuaauccagg

SEQ ID NO: 434333 - RNA, 12 nt, Homo sapiens
gcucccaccagc

SEQ ID NO: 434334 - RNA, 15 nt, Homo sapiens
gcucccagacccagg

SEQ ID NO: 434335 - RNA, 17 nt, Homo sapiens
gcucccagggccaugaa

SEQ ID NO: 434336 - RNA, 12 nt, Homo sapiens
gcucccauuccu

SEQ ID NO: 434337 - RNA, 22 nt, Homo sapiens
gcucccccuucccaguagcucu

SEQ ID NO: 434338 - RNA, 21 nt, Homo sapiens
gcuccgagggcggccagggac

SEQ ID NO: 434339 - RNA, 15 nt, Homo sapiens
gcuccgugugucuca

SEQ ID NO: 434340 - RNA, 20 nt, Homo sapiens
gcuccuaguagcuuuccucc

SEQ ID NO: 434341 - RNA, 14 nt, Homo sapiens
gcuccuaucugugu

SEQ ID NO: 434342 - RNA, 14 nt, Homo sapiens
gcuccucuguucag

SEQ ID NO: 434343 - RNA, 23 nt, Homo sapiens
gcuccugggaaggcuacucaccu

SEQ ID NO: 434344 - RNA, 15 nt, Homo sapiens
gcuccuggggcaaug

SEQ ID NO: 434345 - RNA, 22 nt, Homo sapiens
gcuccuguauuugagacuagga

SEQ ID NO: 434346 - RNA, 13 nt, Homo sapiens
gcuccuguuucca

SEQ ID NO: 434347 - RNA, 22 nt, Homo sapiens
gcuccuuggcacccccaugcug

SEQ ID NO: 434348 - RNA, 15 nt, Homo sapiens
gcucgagcaguccug

SEQ ID NO: 434349 - RNA, 23 nt, Homo sapiens
gcucuaugggguucguuaugcca

SEQ ID NO: 434350 - RNA, 21 nt, Homo sapiens
gcucugaauuggauccagggg

SEQ ID NO: 434351 - RNA, 19 nt, Homo sapiens
gcucugagcaguuguuaua

SEQ ID NO: 434352 - RNA, 20 nt, Homo sapiens
gcucugagcaguuguuauau

SEQ ID NO: 434353 - RNA, 12 nt, Homo sapiens
gcucugcucaau

SEQ ID NO: 434354 - RNA, 16 nt, Homo sapiens
gcucugucaccgccau

SEQ ID NO: 434355 - RNA, 20 nt, Homo sapiens
gcucuguguguaccuggucc

SEQ ID NO: 434356 - RNA, 14 nt, Homo sapiens
gcucuuaugccauu

SEQ ID NO: 434357 - RNA, 13 nt, Homo sapiens
gcucuucauuuau

SEQ ID NO: 434358 - RNA, 17 nt, Homo sapiens
gcucuucccccaugugc

SEQ ID NO: 434359 - RNA, 13 nt, Homo sapiens
gcucuuucagaga

SEQ ID NO: 434360 - RNA, 15 nt, Homo sapiens
gcucuuucucugcca

SEQ ID NO: 434361 - RNA, 13 nt, Homo sapiens
gcucuuugacaac

SEQ ID NO: 434362 - RNA, 19 nt, Homo sapiens
gcucuuugucucaccagcu

SEQ ID NO: 434363 - RNA, 14 nt, Homo sapiens
gcugaaaacccgaa

SEQ ID NO: 434364 - RNA, 13 nt, Homo sapiens
gcugaaaagugau

SEQ ID NO: 434365 - RNA, 13 nt, Homo sapiens
gcugaaaaucacu

SEQ ID NO: 434366 - RNA, 20 nt, Homo sapiens
gcugaaaaucacuauaacca

SEQ ID NO: 434367 - RNA, 19 nt, Homo sapiens
gcugacagauguuccaucc

SEQ ID NO: 434368 - RNA, 16 nt, Homo sapiens
gcugaccucccaguga

SEQ ID NO: 434369 - RNA, 18 nt, Homo sapiens
gcugacuagaagggccag

SEQ ID NO: 434370 - RNA, 20 nt, Homo sapiens
gcugagaucacgccacugca

SEQ ID NO: 434371 - RNA, 13 nt, Homo sapiens
gcugaggugggca

SEQ ID NO: 434372 - RNA, 16 nt, Homo sapiens
gcugagucaccuccuc

SEQ ID NO: 434373 - RNA, 16 nt, Homo sapiens
gcugagugcaccacuu

SEQ ID NO: 434374 - RNA, 19 nt, Homo sapiens
gcugauccagagcacagau

SEQ ID NO: 434375 - RNA, 17 nt, Homo sapiens
gcugaugaugucucuug

SEQ ID NO: 434376 - RNA, 21 nt, Homo sapiens
gcugauggaccaggaagcccu

SEQ ID NO: 434377 - RNA, 15 nt, Homo sapiens
gcugauuuuaacaau

SEQ ID NO: 434378 - RNA, 13 nt, Homo sapiens
gcugcaaaggaca

SEQ ID NO: 434379 - RNA, 21 nt, Homo sapiens
gcugcaccccaaguccagguc

SEQ ID NO: 434380 - RNA, 14 nt, Homo sapiens
gcugcagucaucua

SEQ ID NO: 434381 - RNA, 22 nt, Homo sapiens
gcugcaguuuccucaucuguca

SEQ ID NO: 434382 - RNA, 17 nt, Homo sapiens
gcugcauacaguuugca

SEQ ID NO: 434383 - RNA, 12 nt, Homo sapiens
gcugcauaguau

SEQ ID NO: 434384 - RNA, 11 nt, Homo sapiens
gcugcaucucc

SEQ ID NO: 434385 - RNA, 18 nt, Homo sapiens
gcugcaucuccccucaga

SEQ ID NO: 434386 - RNA, 21 nt, Homo sapiens
gcugccaccacgucugccagg

SEQ ID NO: 434387 - RNA, 15 nt, Homo sapiens
gcugccauccucacc

SEQ ID NO: 434388 - RNA, 22 nt, Homo sapiens
gcugccccaaccugcugaaggg

SEQ ID NO: 434389 - RNA, 18 nt, Homo sapiens
gcugccggcugcacccug

SEQ ID NO: 434390 - RNA, 15 nt, Homo sapiens
gcugccuaccagggg

SEQ ID NO: 434391 - RNA, 22 nt, Homo sapiens
gcugccucaggaaucuccugac

SEQ ID NO: 434392 - RNA, 15 nt, Homo sapiens
gcugccucccugucc

SEQ ID NO: 434393 - RNA, 21 nt, Homo sapiens
gcugccuuuucucauucuguu

SEQ ID NO: 434394 - RNA, 13 nt, Homo sapiens
gcugcuccagugc

SEQ ID NO: 434395 - RNA, 16 nt, Homo sapiens
gcugcuccagugcagg

SEQ ID NO: 434396 - RNA, 14 nt, Homo sapiens
gcugcuccauggau

SEQ ID NO: 434397 - RNA, 14 nt, Homo sapiens
gcugcucuauugua

SEQ ID NO: 434398 - RNA, 13 nt, Homo sapiens
gcugcucugcuau

SEQ ID NO: 434399 - RNA, 17 nt, Homo sapiens
gcugcugaaaaccaucu

SEQ ID NO: 434400 - RNA, 20 nt, Homo sapiens
gcugcugagaaucuagccuc

SEQ ID NO: 434401 - RNA, 12 nt, Homo sapiens
gcugcugcugau

SEQ ID NO: 434402 - RNA, 15 nt, Homo sapiens
gcugcuggacaguau

SEQ ID NO: 434403 - RNA, 21 nt, Homo sapiens
gcugcuggaggaaaacugaga

SEQ ID NO: 434404 - RNA, 20 nt, Homo sapiens
gcugcuucaaacucaaacac

SEQ ID NO: 434405 - RNA, 14 nt, Homo sapiens
gcugcuucugcaaa

SEQ ID NO: 434406 - RNA, 20 nt, Homo sapiens
gcugcuuucuuguugcugca

SEQ ID NO: 434407 - RNA, 19 nt, Homo sapiens
gcugcuuugcuucuucaau

SEQ ID NO: 434408 - RNA, 23 nt, Homo sapiens
gcuggaaaaccuccuuuaccaga

SEQ ID NO: 434409 - RNA, 21 nt, Homo sapiens
gcuggaccaguggugccuugg

SEQ ID NO: 434410 - RNA, 15 nt, Homo sapiens
gcuggacgugcgcga

SEQ ID NO: 434411 - RNA, 22 nt, Homo sapiens
gcuggacgugcgcgaugccugg

SEQ ID NO: 434412 - RNA, 20 nt, Homo sapiens
gcuggagggcaguggcacga

SEQ ID NO: 434413 - RNA, 20 nt, Homo sapiens
gcuggagugcagugguguga

SEQ ID NO: 434414 - RNA, 22 nt, Homo sapiens
gcuggauugagcagaacccaga

SEQ ID NO: 434415 - RNA, 14 nt, Homo sapiens
gcuggcaccucuca

SEQ ID NO: 434416 - RNA, 23 nt, Homo sapiens
gcuggcagcuucgugugcagcua

SEQ ID NO: 434417 - RNA, 15 nt, Homo sapiens
gcuggcaggagacac

SEQ ID NO: 434418 - RNA, 9 nt, Homo sapiens
gcuggccaa

SEQ ID NO: 434419 - RNA, 14 nt, Homo sapiens
gcugggagaaccaa

SEQ ID NO: 434420 - RNA, 13 nt, Homo sapiens
gcugggagacaca

SEQ ID NO: 434421 - RNA, 16 nt, Homo sapiens
gcugggagggggcccu

SEQ ID NO: 434422 - RNA, 13 nt, Homo sapiens
gcugggauuacag

SEQ ID NO: 434423 - RNA, 15 nt, Homo sapiens
gcugggauuugaacu

SEQ ID NO: 434424 - RNA, 14 nt, Homo sapiens
gcugggcagcuguu

SEQ ID NO: 434425 - RNA, 14 nt, Homo sapiens
gcugggccccaccu

SEQ ID NO: 434426 - RNA, 16 nt, Homo sapiens
gcugggccucauucua

SEQ ID NO: 434427 - RNA, 22 nt, Homo sapiens
gcuggggcugagugaaaacauc

SEQ ID NO: 434428 - RNA, 21 nt, Homo sapiens
gcuggggcuucaccagucugu

SEQ ID NO: 434429 - RNA, 20 nt, Homo sapiens
gcuggguguguuucaggaca

SEQ ID NO: 434430 - RNA, 17 nt, Homo sapiens
gcuggguuuucaggggc

SEQ ID NO: 434431 - RNA, 19 nt, Homo sapiens
gcuggucucugcugaaggu

SEQ ID NO: 434432 - RNA, 13 nt, Homo sapiens
gcuggucuucaau

SEQ ID NO: 434433 - RNA, 17 nt, Homo sapiens
ugcccacccguguucuc

SEQ ID NO: 434434 - RNA, 20 nt, Homo sapiens
ugcccacuaccuaugcuucu

SEQ ID NO: 434435 - RNA, 15 nt, Homo sapiens
ugcccagacuacagg

SEQ ID NO: 434436 - RNA, 20 nt, Homo sapiens
ugcccagacucaaggccucc

SEQ ID NO: 434437 - RNA, 21 nt, Homo sapiens
ugcccaggccggccagccuca

SEQ ID NO: 434438 - RNA, 20 nt, Homo sapiens
ugcccaggcuggagcgcagu

SEQ ID NO: 434439 - RNA, 20 nt, Homo sapiens
ugcccaggcuggagugcaau

SEQ ID NO: 434440 - RNA, 20 nt, Homo sapiens
ugcccaggcuggagugcagu

SEQ ID NO: 434441 - RNA, 17 nt, Homo sapiens
ugcccaggcuggucuca

SEQ ID NO: 434442 - RNA, 15 nt, Homo sapiens
ugcccagggugcagu

SEQ ID NO: 434443 - RNA, 22 nt, Homo sapiens
ugccccacccaguuucuggaaa

SEQ ID NO: 434444 - RNA, 15 nt, Homo sapiens
ugccccagagcuguu

SEQ ID NO: 434445 - RNA, 17 nt, Homo sapiens
ugccccaugccugucca

SEQ ID NO: 434446 - RNA, 18 nt, Homo sapiens
ugcccccuucucccacac

SEQ ID NO: 434447 - RNA, 21 nt, Homo sapiens
ugcuggggagucccugccaca

SEQ ID NO: 434448 - RNA, 20 nt, Homo sapiens
ugcugggguacacagugaga

SEQ ID NO: 434449 - RNA, 20 nt, Homo sapiens
ugcuggguuuccacacagcc

SEQ ID NO: 434450 - RNA, 17 nt, Homo sapiens
ugcugguuguugccagg

SEQ ID NO: 434451 - RNA, 22 nt, Homo sapiens
ugcuguaacucagacauuccaa

SEQ ID NO: 434452 - RNA, 11 nt, Homo sapiens
ugcugugcaaa

SEQ ID NO: 434453 - RNA, 19 nt, Homo sapiens
ugcuguuagauguccucag

SEQ ID NO: 434454 - RNA, 14 nt, Homo sapiens
ugcuguugauucuu

SEQ ID NO: 434455 - RNA, 18 nt, Homo sapiens
ugcuguugugcagugugc

SEQ ID NO: 434456 - RNA, 13 nt, Homo sapiens
ugcuuaguauuag

SEQ ID NO: 434457 - RNA, 19 nt, Homo sapiens
ugcuuauuguuccaagaca

SEQ ID NO: 434458 - RNA, 22 nt, Homo sapiens
ugcuucaaguguugcucuugga

SEQ ID NO: 434459 - RNA, 13 nt, Homo sapiens
ugcuucaguccac

SEQ ID NO: 434460 - RNA, 13 nt, Homo sapiens
ugcuucaucugcu

SEQ ID NO: 434461 - RNA, 15 nt, Homo sapiens
ugcuuccccacggga

SEQ ID NO: 434462 - RNA, 18 nt, Homo sapiens
ugcuuccuugcuuuuaug

SEQ ID NO: 434463 - RNA, 14 nt, Homo sapiens
ugcuucuccaccuc

SEQ ID NO: 434464 - RNA, 19 nt, Homo sapiens
ugcuugaacccagaaggca

SEQ ID NO: 434465 - RNA, 16 nt, Homo sapiens
ugcuugcaugugcugc

SEQ ID NO: 434466 - RNA, 18 nt, Homo sapiens
ugcuugccaccaccagau

SEQ ID NO: 434467 - RNA, 18 nt, Homo sapiens
ugcuugcccgcucccaca

SEQ ID NO: 434468 - RNA, 15 nt, Homo sapiens
ugcuuuagcuuucca

SEQ ID NO: 434469 - RNA, 14 nt, Homo sapiens
ugcuuuaggcucac

SEQ ID NO: 434470 - RNA, 14 nt, Homo sapiens
ugcuuugaggacaa

SEQ ID NO: 434471 - RNA, 14 nt, Homo sapiens
ugcuuugcugcuau

SEQ ID NO: 434472 - RNA, 11 nt, Homo sapiens
ugcuuuggacu

SEQ ID NO: 434473 - RNA, 15 nt, Homo sapiens
ugcuuuuacuaagca

SEQ ID NO: 434474 - RNA, 19 nt, Homo sapiens
ugcuuuucccuaagccaag

SEQ ID NO: 434475 - RNA, 17 nt, Homo sapiens
ugcuuuucuaaucugca

SEQ ID NO: 434476 - RNA, 19 nt, Homo sapiens
ugcuuuuugcuuguguaca

SEQ ID NO: 434477 - RNA, 23 nt, Homo sapiens
uggaaaaaagagaaaaaccaaug

SEQ ID NO: 434478 - RNA, 16 nt, Homo sapiens
uggaaaaagucacauu

SEQ ID NO: 434479 - RNA, 16 nt, Homo sapiens
uggaaaacucaggauu

SEQ ID NO: 434480 - RNA, 17 nt, Homo sapiens
uggaaagaaucuaauag

SEQ ID NO: 434481 - RNA, 14 nt, Homo sapiens
uggaaagcugauga

SEQ ID NO: 434482 - RNA, 14 nt, Homo sapiens
uggaaauaaagcuu

SEQ ID NO: 434483 - RNA, 22 nt, Homo sapiens
uggaaaucauugugugucuuca

SEQ ID NO: 434484 - RNA, 19 nt, Homo sapiens
uggaaauccuguuacuuaa

SEQ ID NO: 434485 - RNA, 21 nt, Homo sapiens
uggaaaugaaacugcugugaa

SEQ ID NO: 434486 - RNA, 23 nt, Homo sapiens
uggaaaugaaacugcugugaaug

SEQ ID NO: 434487 - RNA, 15 nt, Homo sapiens
uggaacaccuccuca

SEQ ID NO: 434488 - RNA, 14 nt, Homo sapiens
uggaacacuaauga

SEQ ID NO: 434489 - RNA, 17 nt, Homo sapiens
uggaaccaaaacccauc

SEQ ID NO: 434490 - RNA, 21 nt, Homo sapiens
uggaaccaaucccgugaaaga

SEQ ID NO: 434491 - RNA, 13 nt, Homo sapiens
uggaagaaguaua

SEQ ID NO: 434492 - RNA, 22 nt, Homo sapiens
uggaagagcaacaacagacagg

SEQ ID NO: 434493 - RNA, 18 nt, Homo sapiens
uggaagagcuggguacca

SEQ ID NO: 434494 - RNA, 14 nt, Homo sapiens
uggaagcugauucc

SEQ ID NO: 434495 - RNA, 23 nt, Homo sapiens
uggaaggugacagcgauucccug

SEQ ID NO: 434496 - RNA, 15 nt, Homo sapiens
uggaagucaucucau

SEQ ID NO: 434497 - RNA, 15 nt, Homo sapiens
uggaagucucaaaga

SEQ ID NO: 434498 - RNA, 19 nt, Homo sapiens
uggaaguguucaagaaaua

SEQ ID NO: 434499 - RNA, 18 nt, Homo sapiens
uggaauaaaccacacuua

SEQ ID NO: 434500 - RNA, 14 nt, Homo sapiens
uggaauaaagcccu

SEQ ID NO: 434501 - RNA, 20 nt, Homo sapiens
uggaauaaagucacagaauu

SEQ ID NO: 434502 - RNA, 16 nt, Homo sapiens
uggaauacuaaaguua

SEQ ID NO: 434503 - RNA, 14 nt, Homo sapiens
uggaauaggaauaa

SEQ ID NO: 434504 - RNA, 16 nt, Homo sapiens
uggaaugguaggauau

SEQ ID NO: 434505 - RNA, 16 nt, Homo sapiens
uggaauguacucuguu

SEQ ID NO: 434506 - RNA, 18 nt, Homo sapiens
uggaauuagaaauauauc

SEQ ID NO: 434507 - RNA, 21 nt, Homo sapiens
uggaauuauuuugaaugucac

SEQ ID NO: 434508 - RNA, 13 nt, Homo sapiens
uggaauugcucaa

SEQ ID NO: 434509 - RNA, 20 nt, Homo sapiens
uggacaaaccgagugcaaug

SEQ ID NO: 434510 - RNA, 13 nt, Homo sapiens
uggacacugugga

SEQ ID NO: 434511 - RNA, 17 nt, Homo sapiens
uggacagcaaaaccauu

SEQ ID NO: 434512 - RNA, 16 nt, Homo sapiens
uggacaugcuuuggca

SEQ ID NO: 434513 - RNA, 13 nt, Homo sapiens
uggaccaaagcug

SEQ ID NO: 434514 - RNA, 14 nt, Homo sapiens
uggaccuauugcca

SEQ ID NO: 434515 - RNA, 15 nt, Homo sapiens
uggaccugccuccug

SEQ ID NO: 434516 - RNA, 15 nt, Homo sapiens
uggacgcacacagcu

SEQ ID NO: 434517 - RNA, 16 nt, Homo sapiens
uggacgcacacagcuu

SEQ ID NO: 434518 - RNA, 22 nt, Homo sapiens
uggacguacugguuuaaccucc

SEQ ID NO: 434519 - RNA, 15 nt, Homo sapiens
uggacucucagggau

SEQ ID NO: 434520 - RNA, 18 nt, Homo sapiens
uggacucuguggggccac

SEQ ID NO: 434521 - RNA, 20 nt, Homo sapiens
uggacugggaagcauuacuu

SEQ ID NO: 434522 - RNA, 20 nt, Homo sapiens
uggacuuuguuacacuguua

SEQ ID NO: 434523 - RNA, 21 nt, Homo sapiens
uggacuuuucguuaacauuga

SEQ ID NO: 434524 - RNA, 16 nt, Homo sapiens
uggacuuuugaagucc

SEQ ID NO: 434525 - RNA, 19 nt, Homo sapiens
uggacuuuugcagcuuccu

SEQ ID NO: 434526 - RNA, 15 nt, Homo sapiens
uggagaaaaugaaga

SEQ ID NO: 434527 - RNA, 22 nt, Homo sapiens
uggagacaagggcaucaucuau

SEQ ID NO: 434528 - RNA, 18 nt, Homo sapiens
uggagacaguaacauuuc

SEQ ID NO: 434529 - RNA, 16 nt, Homo sapiens
uggagacgccucccca

SEQ ID NO: 434530 - RNA, 20 nt, Homo sapiens
uggagacuggaacacaacca

SEQ ID NO: 434531 - RNA, 19 nt, Homo sapiens
uggagagacagacacgugu

SEQ ID NO: 434532 - RNA, 13 nt, Homo sapiens
uggagcacgugga

SEQ ID NO: 434533 - RNA, 19 nt, Homo sapiens
uggagcaucauaauggacu

SEQ ID NO: 434534 - RNA, 23 nt, Homo sapiens
uggagccaccugucccaccucaa

SEQ ID NO: 434535 - RNA, 15 nt, Homo sapiens
uggagcccuguaauu

SEQ ID NO: 434536 - RNA, 15 nt, Homo sapiens
uggaggaaugacaau

SEQ ID NO: 434537 - RNA, 16 nt, Homo sapiens
uggaggcacacagcug

SEQ ID NO: 434538 - RNA, 17 nt, Homo sapiens
uggaggguaaaugaugu

SEQ ID NO: 434539 - RNA, 17 nt, Homo sapiens
uggaguccuguucucag

SEQ ID NO: 434540 - RNA, 18 nt, Homo sapiens
uggagugcaacggcauga

SEQ ID NO: 434541 - RNA, 21 nt, Homo sapiens
uggagugccuguacaagcuga

SEQ ID NO: 434542 - RNA, 22 nt, Homo sapiens
uggaguggcugccauggaagga

SEQ ID NO: 434543 - RNA, 16 nt, Homo sapiens
uggagugucacaucuc

SEQ ID NO: 434544 - RNA, 18 nt, Homo sapiens
uggaguugcccugccauc

SEQ ID NO: 434545 - RNA, 18 nt, Homo sapiens
uggaguuugacauuguau

SEQ ID NO: 434546 - RNA, 18 nt, Homo sapiens
uggaguuuucugugagaa

SEQ ID NO: 434547 - RNA, 22 nt, Homo sapiens
uggauaaaaaagaaaacauucc

SEQ ID NO: 434548 - RNA, 20 nt, Homo sapiens
uggauaaaucauuucaguau

SEQ ID NO: 434549 - RNA, 20 nt, Homo sapiens
uggauaauaacuagaucucc

SEQ ID NO: 434550 - RNA, 14 nt, Homo sapiens
uggauaccugugug

SEQ ID NO: 434551 - RNA, 20 nt, Homo sapiens
uggauaccugugugucucca

SEQ ID NO: 434552 - RNA, 12 nt, Homo sapiens
uggauaugugua

SEQ ID NO: 434553 - RNA, 21 nt, Homo sapiens
uggaucagggaauccagcucc

SEQ ID NO: 434554 - RNA, 17 nt, Homo sapiens
uggaucuaccagcauaa

SEQ ID NO: 434555 - RNA, 21 nt, Homo sapiens
uggaucuaucaccugucauca

SEQ ID NO: 434556 - RNA, 19 nt, Homo sapiens
uggaugcagaaacaguuca

SEQ ID NO: 434557 - RNA, 14 nt, Homo sapiens
uggaugcaggguuu

SEQ ID NO: 434558 - RNA, 19 nt, Homo sapiens
uggaugcaugcccuaagag

SEQ ID NO: 434559 - RNA, 13 nt, Homo sapiens
uggaugugcauuu

SEQ ID NO: 434560 - RNA, 15 nt, Homo sapiens
uggaugugcauuucu

SEQ ID NO: 434561 - RNA, 23 nt, Homo sapiens
uggaugugguuaccgaguaucug

SEQ ID NO: 434562 - RNA, 21 nt, Homo sapiens
uggauguugcuuuugcaccua

SEQ ID NO: 434563 - RNA, 20 nt, Homo sapiens
uggauuaaauggcaccugua

SEQ ID NO: 434564 - RNA, 17 nt, Homo sapiens
uggauuaguuaacagac

SEQ ID NO: 434565 - RNA, 14 nt, Homo sapiens
uggauuauucauuu

SEQ ID NO: 434566 - RNA, 22 nt, Homo sapiens
uggauugcacguggccucuuga

SEQ ID NO: 434567 - RNA, 20 nt, Homo sapiens
uggauuggggauggggacaa

SEQ ID NO: 434568 - RNA, 18 nt, Homo sapiens
gucaaauuuggauuuucc

SEQ ID NO: 434569 - RNA, 21 nt, Homo sapiens
gucaacaucuuuuacauucug

SEQ ID NO: 434570 - RNA, 15 nt, Homo sapiens
gucaaggugcucaau

SEQ ID NO: 434571 - RNA, 17 nt, Homo sapiens
gucaagugauugacaac

SEQ ID NO: 434572 - RNA, 21 nt, Homo sapiens
gucaagugugccugcuaucca

SEQ ID NO: 434573 - RNA, 21 nt, Homo sapiens
gucaauauuaaauacagacac

SEQ ID NO: 434574 - RNA, 14 nt, Homo sapiens
gucaaugugcagug

SEQ ID NO: 434575 - RNA, 14 nt, Homo sapiens
gucacaauccuaac

SEQ ID NO: 434576 - RNA, 20 nt, Homo sapiens
gucacagcaguacuugcuca

SEQ ID NO: 434577 - RNA, 18 nt, Homo sapiens
gucacaggagucuuugua

SEQ ID NO: 434578 - RNA, 20 nt, Homo sapiens
gucacaggggugucuugucu

SEQ ID NO: 434579 - RNA, 18 nt, Homo sapiens
gucaccagguccugugag

SEQ ID NO: 434580 - RNA, 21 nt, Homo sapiens
gucaccaguuaaaagcauuuu

SEQ ID NO: 434581 - RNA, 23 nt, Homo sapiens
gucaccuccuccaagaagcccuc

SEQ ID NO: 434582 - RNA, 13 nt, Homo sapiens
gucaccugugcac

SEQ ID NO: 434583 - RNA, 15 nt, Homo sapiens
gucaccuuccaggac

SEQ ID NO: 434584 - RNA, 12 nt, Homo sapiens
gucacguguauu

SEQ ID NO: 434585 - RNA, 20 nt, Homo sapiens
gucacucauuuacguaaaaa

SEQ ID NO: 434586 - RNA, 11 nt, Homo sapiens
gucacuccugg

SEQ ID NO: 434587 - RNA, 14 nt, Homo sapiens
gucacuugaucucc

SEQ ID NO: 434588 - RNA, 19 nt, Homo sapiens
gucagaccaguacugggaa

SEQ ID NO: 434589 - RNA, 17 nt, Homo sapiens
gucagcaacagagcaaa

SEQ ID NO: 434590 - RNA, 21 nt, Homo sapiens
gucagcacaggccauggugca

SEQ ID NO: 434591 - RNA, 12 nt, Homo sapiens
cuaaacauuucu

SEQ ID NO: 434592 - RNA, 18 nt, Homo sapiens
cuaaacuccuuuccugca

SEQ ID NO: 434593 - RNA, 15 nt, Homo sapiens
cuaaagaacauaccu

SEQ ID NO: 434594 - RNA, 19 nt, Homo sapiens
cuaaagaagacacacagcc

SEQ ID NO: 434595 - RNA, 20 nt, Homo sapiens
cuaaagccaaggguauccaa

SEQ ID NO: 434596 - RNA, 18 nt, Homo sapiens
cuaaagugccuaccccag

SEQ ID NO: 434597 - RNA, 22 nt, Homo sapiens
cuaaaguuaaauaggauauuaa

SEQ ID NO: 434598 - RNA, 14 nt, Homo sapiens
cuaaauaggagaua

SEQ ID NO: 434599 - RNA, 19 nt, Homo sapiens
cuaaauauccaaagacugu

SEQ ID NO: 434600 - RNA, 12 nt, Homo sapiens
cuaaauaucuca

SEQ ID NO: 434601 - RNA, 22 nt, Homo sapiens
cuaaaucuccaaaaacagugau

SEQ ID NO: 434602 - RNA, 18 nt, Homo sapiens
cuaaaugaauguuuacac

SEQ ID NO: 434603 - RNA, 16 nt, Homo sapiens
cuaaaugaugccuuug

SEQ ID NO: 434604 - RNA, 11 nt, Homo sapiens
cuaaauuucca

SEQ ID NO: 434605 - RNA, 23 nt, Homo sapiens
cuaacacccagucuguuccccau

SEQ ID NO: 434606 - RNA, 17 nt, Homo sapiens
cuaacauguaauugcag

SEQ ID NO: 434607 - RNA, 20 nt, Homo sapiens
cuaacauguaauugcagaua

SEQ ID NO: 434608 - RNA, 14 nt, Homo sapiens
cuaaccacuaaugu

SEQ ID NO: 434609 - RNA, 23 nt, Homo sapiens
cuaaccacuuagcaugugugauu

SEQ ID NO: 434610 - RNA, 19 nt, Homo sapiens
cuaacuauauuugcuuuuu

SEQ ID NO: 434611 - RNA, 23 nt, Homo sapiens
cuaacucuuacggcuaucuaguu

SEQ ID NO: 434612 - RNA, 15 nt, Homo sapiens
cuaacucuugcucac

SEQ ID NO: 434613 - RNA, 21 nt, Homo sapiens
cuaagaaauggcuuuccacau

SEQ ID NO: 434614 - RNA, 14 nt, Homo sapiens
cuaagacaccugca

SEQ ID NO: 434615 - RNA, 19 nt, Homo sapiens
cuaagacccacaaacugcc

SEQ ID NO: 434616 - RNA, 21 nt, Homo sapiens
cuaagacccacaaacugccug

SEQ ID NO: 434617 - RNA, 15 nt, Homo sapiens
cuaagauaguaacaa

SEQ ID NO: 434618 - RNA, 17 nt, Homo sapiens
cuaagaugaaauugcca

SEQ ID NO: 434619 - RNA, 14 nt, Homo sapiens
cuaagcaugugucc

SEQ ID NO: 434620 - RNA, 20 nt, Homo sapiens
cuaagccaggaggcuuuaag

SEQ ID NO: 434621 - RNA, 19 nt, Homo sapiens
cuaagccguuggcaccucu

SEQ ID NO: 434622 - RNA, 21 nt, Homo sapiens
cuaagccuguugcugaaguca

SEQ ID NO: 434623 - RNA, 17 nt, Homo sapiens
cuaagccuuuccauaag

SEQ ID NO: 434624 - RNA, 15 nt, Homo sapiens
cuaagcgcacauuca

SEQ ID NO: 434625 - RNA, 14 nt, Homo sapiens
cuaaggaucucuca

SEQ ID NO: 434626 - RNA, 23 nt, Homo sapiens
cuaagggcaggcccaaauuauca

SEQ ID NO: 434627 - RNA, 23 nt, Homo sapiens
cuaagugaggaugaaaaaauaac

SEQ ID NO: 434628 - RNA, 23 nt, Homo sapiens
cuaaguguggaauuaccugauaa

SEQ ID NO: 434629 - RNA, 17 nt, Homo sapiens
cuaauaaagaaauaaua

SEQ ID NO: 434630 - RNA, 19 nt, Homo sapiens
cuaauaaauauacuaugaa

SEQ ID NO: 434631 - RNA, 17 nt, Homo sapiens
cuaauaauaaauuaaua

SEQ ID NO: 434632 - RNA, 23 nt, Homo sapiens
cuaauagagucacagcuuuccca

SEQ ID NO: 434633 - RNA, 14 nt, Homo sapiens
cuaaucaccaaagg

SEQ ID NO: 434634 - RNA, 16 nt, Homo sapiens
cuaaucagcauucuca

SEQ ID NO: 434635 - RNA, 17 nt, Homo sapiens
cuaaucagcauucucac

SEQ ID NO: 434636 - RNA, 15 nt, Homo sapiens
cuaauccuccaaguc

SEQ ID NO: 434637 - RNA, 22 nt, Homo sapiens
cuaauccugaagggaagcccau

SEQ ID NO: 434638 - RNA, 13 nt, Homo sapiens
cuaauccuuaaaa

SEQ ID NO: 434639 - RNA, 15 nt, Homo sapiens
cuaaugaaaccugug

SEQ ID NO: 434640 - RNA, 15 nt, Homo sapiens
cuaaugagauauauc

SEQ ID NO: 434641 - RNA, 19 nt, Homo sapiens
cuaaugagucgacuuugag

SEQ ID NO: 434642 - RNA, 14 nt, Homo sapiens
cuaaugcacugaug

SEQ ID NO: 434643 - RNA, 21 nt, Homo sapiens
cuaaugccaguuccagcuuca

SEQ ID NO: 434644 - RNA, 17 nt, Homo sapiens
cuaaugcucguaucucc

SEQ ID NO: 434645 - RNA, 17 nt, Homo sapiens
cuaaugucagcacaugu

SEQ ID NO: 434646 - RNA, 18 nt, Homo sapiens
cuaauguggcagcugucu

SEQ ID NO: 434647 - RNA, 23 nt, Homo sapiens
cuaauuaaaaaacacaucuggcc

SEQ ID NO: 434648 - RNA, 23 nt, Homo sapiens
cuaauuagaaaauauaguuugag

SEQ ID NO: 434649 - RNA, 17 nt, Homo sapiens
cuaauuagagcagauga

SEQ ID NO: 434650 - RNA, 16 nt, Homo sapiens
cuaauuauaaugcaaa

SEQ ID NO: 434651 - RNA, 16 nt, Homo sapiens
cuaauuccauccauaa

SEQ ID NO: 434652 - RNA, 22 nt, Homo sapiens
cuaauuucugaaaugugcagcu

SEQ ID NO: 434653 - RNA, 23 nt, Homo sapiens
cuaauuuugugcucuuuccugcc

SEQ ID NO: 434654 - RNA, 18 nt, Homo sapiens
cuaauuuuuagauauuca

SEQ ID NO: 434655 - RNA, 23 nt, Homo sapiens
cuacacaaaauacagcacuuuga

SEQ ID NO: 434656 - RNA, 16 nt, Homo sapiens
cuacacccaccagagu

SEQ ID NO: 434657 - RNA, 13 nt, Homo sapiens
cuacacuguauua

SEQ ID NO: 434658 - RNA, 13 nt, Homo sapiens
cuacagaaugaga

SEQ ID NO: 434659 - RNA, 17 nt, Homo sapiens
cuacagggcuuaggacu

SEQ ID NO: 434660 - RNA, 19 nt, Homo sapiens
cuacaggugaaggcucuca

SEQ ID NO: 434661 - RNA, 14 nt, Homo sapiens
cuacauaauuuaga

SEQ ID NO: 434662 - RNA, 17 nt, Homo sapiens
cuacauccaauguauga

SEQ ID NO: 434663 - RNA, 13 nt, Homo sapiens
cuacaugcauguu

SEQ ID NO: 434664 - RNA, 11 nt, Homo sapiens
cuacaugccuc

SEQ ID NO: 434665 - RNA, 17 nt, Homo sapiens
cuacauuugcaugccuu

SEQ ID NO: 434666 - RNA, 13 nt, Homo sapiens
cuaccagcauaaa

SEQ ID NO: 434667 - RNA, 17 nt, Homo sapiens
cuaccauuauggcuuug

SEQ ID NO: 434668 - RNA, 20 nt, Homo sapiens
cuaccccaaaguuugcucaa

SEQ ID NO: 434669 - RNA, 22 nt, Homo sapiens
cuacccucuuauuguuccucuu

SEQ ID NO: 434670 - RNA, 16 nt, Homo sapiens
cuaccgcaaggaccug

SEQ ID NO: 434671 - RNA, 13 nt, Homo sapiens
cuaccguagcuuu

SEQ ID NO: 434672 - RNA, 16 nt, Homo sapiens
cuaccucaaacuucca

SEQ ID NO: 434673 - RNA, 12 nt, Homo sapiens
cuaccucuccag

SEQ ID NO: 434674 - RNA, 12 nt, Homo sapiens
cuaccugugagc

SEQ ID NO: 434675 - RNA, 23 nt, Homo sapiens
cuaccuuuauauuugggguccuu

SEQ ID NO: 434676 - RNA, 15 nt, Homo sapiens
cuacuaaaaaugcaa

SEQ ID NO: 434677 - RNA, 15 nt, Homo sapiens
cuacuaaagugccua

SEQ ID NO: 434678 - RNA, 16 nt, Homo sapiens
cuacucaggagacuga

SEQ ID NO: 434679 - RNA, 20 nt, Homo sapiens
cuacucuuaaauauacaacu

SEQ ID NO: 434680 - RNA, 14 nt, Homo sapiens
cuacugaacuguua

SEQ ID NO: 434681 - RNA, 19 nt, Homo sapiens
cuacugucuggaagacaug

SEQ ID NO: 434682 - RNA, 16 nt, Homo sapiens
cuacuuaaacaaaaac

SEQ ID NO: 434683 - RNA, 20 nt, Homo sapiens
cuacuuaaacaaaaacuuuc

SEQ ID NO: 434684 - RNA, 13 nt, Homo sapiens
cuacuucaguaca

SEQ ID NO: 434685 - RNA, 16 nt, Homo sapiens
cuacuucuacauccaa

SEQ ID NO: 434686 - RNA, 18 nt, Homo sapiens
cuacuucugugucuguca

SEQ ID NO: 434687 - RNA, 21 nt, Homo sapiens
cuacuuuaagcacuacauaaa

SEQ ID NO: 434688 - RNA, 21 nt, Homo sapiens
cuagaaaaauguucuuuaaag

SEQ ID NO: 434689 - RNA, 18 nt, Homo sapiens
cuagaagaaaguaaaaag

SEQ ID NO: 434690 - RNA, 17 nt, Homo sapiens
cuagaauggaaaacugc

SEQ ID NO: 434691 - RNA, 19 nt, Homo sapiens
cuagacuucccaacagccu

SEQ ID NO: 434692 - RNA, 17 nt, Homo sapiens
cuagagcuagauguguc

SEQ ID NO: 434693 - RNA, 18 nt, Homo sapiens
cuagagcuagaugugucu

SEQ ID NO: 434694 - RNA, 20 nt, Homo sapiens
cuagagcuaugcacaccaaa

SEQ ID NO: 434695 - RNA, 14 nt, Homo sapiens
cuagaucaauuaau

SEQ ID NO: 434696 - RNA, 16 nt, Homo sapiens
cuagaucucccuuaau

SEQ ID NO: 434697 - RNA, 19 nt, Homo sapiens
cuagauuaguagaugcauc

SEQ ID NO: 434698 - RNA, 15 nt, Homo sapiens
cucacuggugcauuu

SEQ ID NO: 434699 - RNA, 13 nt, Homo sapiens
cucacuuaauaca

SEQ ID NO: 434700 - RNA, 20 nt, Homo sapiens
cucacuugaaugugucacua

SEQ ID NO: 434701 - RNA, 18 nt, Homo sapiens
cucacuugugcaguguug

SEQ ID NO: 434702 - RNA, 17 nt, Homo sapiens
cucacuuuuauugauaa

SEQ ID NO: 434703 - RNA, 23 nt, Homo sapiens
cucagaauauugcuuuggucaua

SEQ ID NO: 434704 - RNA, 21 nt, Homo sapiens
cucagagaagaccacaccaag

SEQ ID NO: 434705 - RNA, 13 nt, Homo sapiens
cucagagauauac

SEQ ID NO: 434706 - RNA, 18 nt, Homo sapiens
cucagagcuccacagaag

SEQ ID NO: 434707 - RNA, 19 nt, Homo sapiens
cucagaggguuguucuccu

SEQ ID NO: 434708 - RNA, 16 nt, Homo sapiens
cucagaucacuacugc

SEQ ID NO: 434709 - RNA, 17 nt, Homo sapiens
cucagcaauagggugca

SEQ ID NO: 434710 - RNA, 23 nt, Homo sapiens
cucagccuacuuucacacuaaga

SEQ ID NO: 434711 - RNA, 16 nt, Homo sapiens
cucagccuuccaaagu

SEQ ID NO: 434712 - RNA, 18 nt, Homo sapiens
cucagccuuccaaagugc

SEQ ID NO: 434713 - RNA, 20 nt, Homo sapiens
cucagcugccaagcacucga

SEQ ID NO: 434714 - RNA, 15 nt, Homo sapiens
cucaggaauguuugc

SEQ ID NO: 434715 - RNA, 13 nt, Homo sapiens
cucaggagacuga

SEQ ID NO: 434716 - RNA, 21 nt, Homo sapiens
cucaggcuguuuuugggugca

SEQ ID NO: 434717 - RNA, 13 nt, Homo sapiens
cucagggaucuca

SEQ ID NO: 434718 - RNA, 21 nt, Homo sapiens
cucagguagccaccaccgggg

SEQ ID NO: 434719 - RNA, 15 nt, Homo sapiens
cucagguguugccaa

SEQ ID NO: 434720 - RNA, 19 nt, Homo sapiens
cucagguuccaaauucagu

SEQ ID NO: 434721 - RNA, 23 nt, Homo sapiens
cucaguccugggucaacaucuua

SEQ ID NO: 434722 - RNA, 22 nt, Homo sapiens
cucagugccacuugacauuccu

SEQ ID NO: 434723 - RNA, 15 nt, Homo sapiens
cucagugucauuuau

SEQ ID NO: 434724 - RNA, 18 nt, Homo sapiens
cucaguguccucaucuau

SEQ ID NO: 434725 - RNA, 14 nt, Homo sapiens
cucaguguugacug

SEQ ID NO: 434726 - RNA, 17 nt, Homo sapiens
cucaguuccugcagcag

SEQ ID NO: 434727 - RNA, 20 nt, Homo sapiens
gucuuuguuaagacugcuga

SEQ ID NO: 434728 - RNA, 22 nt, Homo sapiens
gugaaaacagcagcaaugcaau

SEQ ID NO: 434729 - RNA, 20 nt, Homo sapiens
gugaaaacgcuuaggccaug

SEQ ID NO: 434730 - RNA, 13 nt, Homo sapiens
gugaaacaaaaaa

SEQ ID NO: 434731 - RNA, 22 nt, Homo sapiens
gugaaacccuacgaaagcacag

SEQ ID NO: 434732 - RNA, 14 nt, Homo sapiens
gugaaagcuuucau

SEQ ID NO: 434733 - RNA, 20 nt, Homo sapiens
gugaaagucuccuguaucau

SEQ ID NO: 434734 - RNA, 14 nt, Homo sapiens
gugaaaugcuggca

SEQ ID NO: 434735 - RNA, 20 nt, Homo sapiens
gugaaaugcuggcauuugca

SEQ ID NO: 434736 - RNA, 22 nt, Homo sapiens
gugaacagguucuccaggugau

SEQ ID NO: 434737 - RNA, 21 nt, Homo sapiens
gugaagaucacguuccuuccc

SEQ ID NO: 434738 - RNA, 12 nt, Homo sapiens
gugaagccuuua

SEQ ID NO: 434739 - RNA, 17 nt, Homo sapiens
gugaauaaaaauuaagg

SEQ ID NO: 434740 - RNA, 16 nt, Homo sapiens
gugaauaaccacuuaa

SEQ ID NO: 434741 - RNA, 15 nt, Homo sapiens
gugaaugaaucucaa

SEQ ID NO: 434742 - RNA, 22 nt, Homo sapiens
gugaaugcugcugagugaauga

SEQ ID NO: 434743 - RNA, 13 nt, Homo sapiens
gugacacauugua

SEQ ID NO: 434744 - RNA, 21 nt, Homo sapiens
gugacagacaggcucuuagca

SEQ ID NO: 434745 - RNA, 17 nt, Homo sapiens
gugacaggacuuucauu

SEQ ID NO: 434746 - RNA, 16 nt, Homo sapiens
gugacaggcagacaca

SEQ ID NO: 434747 - RNA, 16 nt, Homo sapiens
gugacaucaguggcau

SEQ ID NO: 434748 - RNA, 18 nt, Homo sapiens
gugacaugcggcugccca

SEQ ID NO: 434749 - RNA, 12 nt, Homo sapiens
gugacccagugg

SEQ ID NO: 434750 - RNA, 23 nt, Homo sapiens
gugaccccugaccucacugugac

SEQ ID NO: 434751 - RNA, 14 nt, Homo sapiens
gugaccgggguccu

SEQ ID NO: 434752 - RNA, 17 nt, Homo sapiens
gugaccuaaccacuuag

SEQ ID NO: 434753 - RNA, 10 nt, Homo sapiens
gugaccuucu

SEQ ID NO: 434754 - RNA, 21 nt, Homo sapiens
gugacuugaacuagauugcau

SEQ ID NO: 434755 - RNA, 13 nt, Homo sapiens
gugagaccaccuc

SEQ ID NO: 434756 - RNA, 23 nt, Homo sapiens
gugagaccaccucucaauauuca

SEQ ID NO: 434757 - RNA, 15 nt, Homo sapiens
gugaggaagcaaaag

SEQ ID NO: 434758 - RNA, 14 nt, Homo sapiens
gugaggacaaggua

SEQ ID NO: 434759 - RNA, 19 nt, Homo sapiens
gugaggcuguccuguacau

SEQ ID NO: 434760 - RNA, 21 nt, Homo sapiens
gugagggaacagagagguuaa

SEQ ID NO: 434761 - RNA, 20 nt, Homo sapiens
gugagugacaucgguucagg

SEQ ID NO: 434762 - RNA, 15 nt, Homo sapiens
gugagugugugcaag

SEQ ID NO: 434763 - RNA, 22 nt, Homo sapiens
gugaucacugagacagccacuu

SEQ ID NO: 434764 - RNA, 22 nt, Homo sapiens
gugaucagaccauaauguuaca

SEQ ID NO: 434765 - RNA, 15 nt, Homo sapiens
gugaucaucuuugcu

SEQ ID NO: 434766 - RNA, 18 nt, Homo sapiens
gugauccgccuaccucag

SEQ ID NO: 434767 - RNA, 22 nt, Homo sapiens
gugaucuauuacucugacauaa

SEQ ID NO: 434768 - RNA, 15 nt, Homo sapiens
gugaugcaugagcuc

SEQ ID NO: 434769 - RNA, 15 nt, Homo sapiens
gugaugccugacaca

SEQ ID NO: 434770 - RNA, 15 nt, Homo sapiens
gugauuaaagcaaga

SEQ ID NO: 434771 - RNA, 19 nt, Homo sapiens
gugauuugggggugcaaug

SEQ ID NO: 434772 - RNA, 23 nt, Homo sapiens
gugauuuuucugcacuaauauaa

SEQ ID NO: 434773 - RNA, 14 nt, Homo sapiens
gugauuuuugaaca

SEQ ID NO: 434774 - RNA, 19 nt, Homo sapiens
gugcaaaguucccuacuuc

SEQ ID NO: 434775 - RNA, 17 nt, Homo sapiens
gugcaaguggaugcauu

SEQ ID NO: 434776 - RNA, 19 nt, Homo sapiens
gugcaagugugugcacaug

SEQ ID NO: 434777 - RNA, 14 nt, Homo sapiens
gugcacagccaugg

SEQ ID NO: 434778 - RNA, 15 nt, Homo sapiens
gugcacuagcauuuu

SEQ ID NO: 434779 - RNA, 14 nt, Homo sapiens
gugcacucugcuaa

SEQ ID NO: 434780 - RNA, 14 nt, Homo sapiens
gugcagcucuggag

SEQ ID NO: 434781 - RNA, 20 nt, Homo sapiens
gugcaguggcaccaucucag

SEQ ID NO: 434782 - RNA, 22 nt, Homo sapiens
gugcauuaacuuaaaagauuca

SEQ ID NO: 434783 - RNA, 16 nt, Homo sapiens
gugcauuucugugaug

SEQ ID NO: 434784 - RNA, 16 nt, Homo sapiens
gugcauuugugucugc

SEQ ID NO: 434785 - RNA, 19 nt, Homo sapiens
gugccauucccacuaagcu

SEQ ID NO: 434786 - RNA, 19 nt, Homo sapiens
gugccauuguuuugccagu

SEQ ID NO: 434787 - RNA, 17 nt, Homo sapiens
gugcccagucaugacau

SEQ ID NO: 434788 - RNA, 22 nt, Homo sapiens
gugccucccacccuucucaggg

SEQ ID NO: 434789 - RNA, 23 nt, Homo sapiens
gugccucccacccuucucaggga

SEQ ID NO: 434790 - RNA, 14 nt, Homo sapiens
gugccuuccauaau

SEQ ID NO: 434791 - RNA, 15 nt, Homo sapiens
gugcgagugugugca

SEQ ID NO: 434792 - RNA, 18 nt, Homo sapiens
gugcgugcaugugcacuu

SEQ ID NO: 434793 - RNA, 20 nt, Homo sapiens
gugcgugcuugcaugugcug

SEQ ID NO: 434794 - RNA, 23 nt, Homo sapiens
gugcuaaaaaauuaaaccaagca

SEQ ID NO: 434795 - RNA, 13 nt, Homo sapiens
gugcuaaaccaca

SEQ ID NO: 434796 - RNA, 17 nt, Homo sapiens
gugcuaucgcaccacug

SEQ ID NO: 434797 - RNA, 15 nt, Homo sapiens
gugcucuccuacccc

SEQ ID NO: 434798 - RNA, 21 nt, Homo sapiens
gugcugcggguggguauccca

SEQ ID NO: 434799 - RNA, 18 nt, Homo sapiens
gugcugggauuacaggug

SEQ ID NO: 434800 - RNA, 20 nt, Homo sapiens
gugcuuaagcagaagcauua

SEQ ID NO: 434801 - RNA, 17 nt, Homo sapiens
gugcuuacacaucucag

SEQ ID NO: 434802 - RNA, 22 nt, Homo sapiens
gugcuuggaaaauguucugaca

SEQ ID NO: 434803 - RNA, 13 nt, Homo sapiens
gugcuuggcacau

SEQ ID NO: 434804 - RNA, 20 nt, Homo sapiens
gugcuugggaucuucaauga

SEQ ID NO: 434805 - RNA, 15 nt, Homo sapiens
gugcuugucauggaa

SEQ ID NO: 434806 - RNA, 23 nt, Homo sapiens
gugcuuguggucacacuguggaa

SEQ ID NO: 434807 - RNA, 14 nt, Homo sapiens
gugcuuguuuacag

SEQ ID NO: 434808 - RNA, 15 nt, Homo sapiens
guggaaaacucacag

SEQ ID NO: 434809 - RNA, 13 nt, Homo sapiens
guggaacaaaagu

SEQ ID NO: 434810 - RNA, 17 nt, Homo sapiens
guggaaggcagugaaca

SEQ ID NO: 434811 - RNA, 18 nt, Homo sapiens
guggaccucuacuuucca

SEQ ID NO: 434812 - RNA, 12 nt, Homo sapiens
guggacugugau

SEQ ID NO: 434813 - RNA, 21 nt, Homo sapiens
guggagaaauacaucauuugc

SEQ ID NO: 434814 - RNA, 12 nt, Homo sapiens
guggagaacaaa

SEQ ID NO: 434815 - RNA, 12 nt, Homo sapiens
guggaugcugcu

SEQ ID NO: 434816 - RNA, 21 nt, Homo sapiens
guggauucuucccacacagaa

SEQ ID NO: 434817 - RNA, 17 nt, Homo sapiens
guggcagcaaaggaaga

SEQ ID NO: 434818 - RNA, 23 nt, Homo sapiens
guggcagcaacaaaggauuugaa

SEQ ID NO: 434819 - RNA, 23 nt, Homo sapiens
guggcagcuggggagcagcugag

SEQ ID NO: 434820 - RNA, 21 nt, Homo sapiens
guggcaucccaguggccucaa

SEQ ID NO: 434821 - RNA, 14 nt, Homo sapiens
guggcaugugcugu

SEQ ID NO: 434822 - RNA, 17 nt, Homo sapiens
guggcauuaaacauuug

SEQ ID NO: 434823 - RNA, 14 nt, Homo sapiens
guggccacagcagg

SEQ ID NO: 434824 - RNA, 20 nt, Homo sapiens
guggccccagcugugacuga

SEQ ID NO: 434825 - RNA, 17 nt, Homo sapiens
guggccgaggacuuuga

SEQ ID NO: 434826 - RNA, 16 nt, Homo sapiens
guggccgucgaguuga

SEQ ID NO: 434827 - RNA, 16 nt, Homo sapiens
guggccuagcacuggu

SEQ ID NO: 434828 - RNA, 15 nt, Homo sapiens
cuuaccaacuuucug

SEQ ID NO: 434829 - RNA, 17 nt, Homo sapiens
cuuacccucucuuucaa

SEQ ID NO: 434830 - RNA, 16 nt, Homo sapiens
cuuaccucauuugcau

SEQ ID NO: 434831 - RNA, 18 nt, Homo sapiens
cuuacuagaccuguaacu

SEQ ID NO: 434832 - RNA, 20 nt, Homo sapiens
cuuacugcuugguccuugau

SEQ ID NO: 434833 - RNA, 14 nt, Homo sapiens
cuuacuguugcaua

SEQ ID NO: 434834 - RNA, 19 nt, Homo sapiens
cuuagagcagauucuagca

SEQ ID NO: 434835 - RNA, 14 nt, Homo sapiens
cuuagauugccacu

SEQ ID NO: 434836 - RNA, 13 nt, Homo sapiens
cuuagcacacuca

SEQ ID NO: 434837 - RNA, 17 nt, Homo sapiens
cuuagcagcuuccagau

SEQ ID NO: 434838 - RNA, 14 nt, Homo sapiens
cuuagcaugcacaa

SEQ ID NO: 434839 - RNA, 11 nt, Homo sapiens
cuuagcucaca

SEQ ID NO: 434840 - RNA, 15 nt, Homo sapiens
cuuagcuuacaggaa

SEQ ID NO: 434841 - RNA, 16 nt, Homo sapiens
cuuaggaaauugcuca

SEQ ID NO: 434842 - RNA, 19 nt, Homo sapiens
cuuaggauuuaccaaauag

SEQ ID NO: 434843 - RNA, 16 nt, Homo sapiens
cuuaguaauagaucac

SEQ ID NO: 434844 - RNA, 15 nt, Homo sapiens
cuuaguagagauuuc

SEQ ID NO: 434845 - RNA, 20 nt, Homo sapiens
cuuagugaaaggucaucuca

SEQ ID NO: 434846 - RNA, 15 nt, Homo sapiens
cuuauaccaaaggga

SEQ ID NO: 434847 - RNA, 20 nt, Homo sapiens
cuuauagacacuugcuccca

SEQ ID NO: 434848 - RNA, 13 nt, Homo sapiens
cuuauauacagac

SEQ ID NO: 434849 - RNA, 19 nt, Homo sapiens
cuuaucaaaaaugcaaauu

SEQ ID NO: 434850 - RNA, 16 nt, Homo sapiens
cuuaucauaaauucaa

SEQ ID NO: 434851 - RNA, 18 nt, Homo sapiens
cuuaucccagugaucacc

SEQ ID NO: 434852 - RNA, 20 nt, Homo sapiens
cuuaugaaaugggcuuuaac

SEQ ID NO: 434853 - RNA, 13 nt, Homo sapiens
cuuaugauacuug

SEQ ID NO: 434854 - RNA, 15 nt, Homo sapiens
cuuaugauacuugag

SEQ ID NO: 434855 - RNA, 16 nt, Homo sapiens
cuuaugauacuugagg

SEQ ID NO: 434856 - RNA, 22 nt, Homo sapiens
cuuaugcguaagugguaugcau

SEQ ID NO: 434857 - RNA, 13 nt, Homo sapiens
cuuauguguugca

SEQ ID NO: 434858 - RNA, 21 nt, Homo sapiens
cuuauucacugaaguucuccu

SEQ ID NO: 434859 - RNA, 14 nt, Homo sapiens
cuuauuuccaugga

SEQ ID NO: 434860 - RNA, 17 nt, Homo sapiens
cuuauuuuaccuucuca

SEQ ID NO: 434861 - RNA, 13 nt, Homo sapiens
cuucaaaacagaa

SEQ ID NO: 434862 - RNA, 22 nt, Homo sapiens
cuucaaaagccauaacuugaaa

SEQ ID NO: 434863 - RNA, 15 nt, Homo sapiens
cuucaaacgaaaugg

SEQ ID NO: 434864 - RNA, 15 nt, Homo sapiens
cuucaaagcugaaua

SEQ ID NO: 434865 - RNA, 19 nt, Homo sapiens
cuucaacaugguuaccucu

SEQ ID NO: 434866 - RNA, 22 nt, Homo sapiens
cuucaaccccaaggucagcucc

SEQ ID NO: 434867 - RNA, 21 nt, Homo sapiens
cuucaacugaccagccuccau

SEQ ID NO: 434868 - RNA, 21 nt, Homo sapiens
cuucaacugucuccuaccucu

SEQ ID NO: 434869 - RNA, 19 nt, Homo sapiens
cuucaaucucuugcacuca

SEQ ID NO: 434870 - RNA, 20 nt, Homo sapiens
cuucacagaaaguucuuaaa

SEQ ID NO: 434871 - RNA, 23 nt, Homo sapiens
cuucaccagucugucuacugugg

SEQ ID NO: 434872 - RNA, 18 nt, Homo sapiens
cuucacccacgcauauac

SEQ ID NO: 434873 - RNA, 20 nt, Homo sapiens
cuucacgguuucacuuuuaa

SEQ ID NO: 434874 - RNA, 18 nt, Homo sapiens
cuucacucugacaguauu

SEQ ID NO: 434875 - RNA, 16 nt, Homo sapiens
cuucacugaauaucau

SEQ ID NO: 434876 - RNA, 20 nt, Homo sapiens
cuucacugccaugauagcug

SEQ ID NO: 434877 - RNA, 17 nt, Homo sapiens
cuucagaauuguuuuua

SEQ ID NO: 434878 - RNA, 16 nt, Homo sapiens
cuucagagaagucagu

SEQ ID NO: 434879 - RNA, 21 nt, Homo sapiens
cuucagggcagggcucugaua

SEQ ID NO: 434880 - RNA, 15 nt, Homo sapiens
cuucaggggucaccu

SEQ ID NO: 434881 - RNA, 11 nt, Homo sapiens
cuucaguauua

SEQ ID NO: 434882 - RNA, 14 nt, Homo sapiens
uacugaacaguauu

SEQ ID NO: 434883 - RNA, 14 nt, Homo sapiens
uacugaacuguuac

SEQ ID NO: 434884 - RNA, 12 nt, Homo sapiens
uacugacauaua

SEQ ID NO: 434885 - RNA, 14 nt, Homo sapiens
uacugaguaugugg

SEQ ID NO: 434886 - RNA, 16 nt, Homo sapiens
uacugaguauguggaa

SEQ ID NO: 434887 - RNA, 13 nt, Homo sapiens
uacugaucuuacu

SEQ ID NO: 434888 - RNA, 14 nt, Homo sapiens
uacugaugagacaa

SEQ ID NO: 434889 - RNA, 17 nt, Homo sapiens
uacugauuuuugugauu

SEQ ID NO: 434890 - RNA, 22 nt, Homo sapiens
uacuggauaaacuugcuucaga

SEQ ID NO: 434891 - RNA, 20 nt, Homo sapiens
uacuggauuuaacuaccuuu

SEQ ID NO: 434892 - RNA, 15 nt, Homo sapiens
uacuggccaguguca

SEQ ID NO: 434893 - RNA, 18 nt, Homo sapiens
uacugguuucaguugaca

SEQ ID NO: 434894 - RNA, 14 nt, Homo sapiens
uacuguauugcugu

SEQ ID NO: 434895 - RNA, 14 nt, Homo sapiens
uacugucauauaau

SEQ ID NO: 434896 - RNA, 13 nt, Homo sapiens
uacugucuggaag

SEQ ID NO: 434897 - RNA, 15 nt, Homo sapiens
uacuguggugaucug

SEQ ID NO: 434898 - RNA, 14 nt, Homo sapiens
uacuguuaaaggaa

SEQ ID NO: 434899 - RNA, 16 nt, Homo sapiens
uacuguuccaaaaaga

SEQ ID NO: 434900 - RNA, 19 nt, Homo sapiens
uacuguugcccauugcacu

SEQ ID NO: 434901 - RNA, 16 nt, Homo sapiens
uacuuaauauacucag

SEQ ID NO: 434902 - RNA, 14 nt, Homo sapiens
uacuuagcaugcac

SEQ ID NO: 434903 - RNA, 18 nt, Homo sapiens
uacuuagcaugcacaaag

SEQ ID NO: 434904 - RNA, 22 nt, Homo sapiens
uacuuauuuaaaaaugcaugau

SEQ ID NO: 434905 - RNA, 17 nt, Homo sapiens
uacuugaucauucucag

SEQ ID NO: 434906 - RNA, 12 nt, Homo sapiens
uacuugaugcac

SEQ ID NO: 434907 - RNA, 20 nt, Homo sapiens
uacuugcagguuguugucau

SEQ ID NO: 434908 - RNA, 14 nt, Homo sapiens
uacuuguuccagau

SEQ ID NO: 434909 - RNA, 22 nt, Homo sapiens
uacuuuagguaguagaaucuca

SEQ ID NO: 434910 - RNA, 22 nt, Homo sapiens
uacuuuauuucugaucuauaca

SEQ ID NO: 434911 - RNA, 22 nt, Homo sapiens
uacuuugugucuuuuguucucu

SEQ ID NO: 434912 - RNA, 22 nt, Homo sapiens
uacuuuuuccuggcucaucucu

SEQ ID NO: 434913 - RNA, 15 nt, Homo sapiens
uacuuuuuguaaaaa

SEQ ID NO: 434914 - RNA, 13 nt, Homo sapiens
uagaaaaacuugg

SEQ ID NO: 434915 - RNA, 19 nt, Homo sapiens
uagaaaaaggacucugcuu

SEQ ID NO: 434916 - RNA, 17 nt, Homo sapiens
uagaaaacaaucugccc

SEQ ID NO: 434917 - RNA, 21 nt, Homo sapiens
uagaaacacacuuuugcacau

SEQ ID NO: 434918 - RNA, 22 nt, Homo sapiens
uagaaacacacuuuugcacaua

SEQ ID NO: 434919 - RNA, 17 nt, Homo sapiens
uagaaacugaguccugu

SEQ ID NO: 434920 - RNA, 17 nt, Homo sapiens
uagaaaguaauacaaua

SEQ ID NO: 434921 - RNA, 16 nt, Homo sapiens
uagaaauaauaugcau

SEQ ID NO: 434922 - RNA, 19 nt, Homo sapiens
uagaaauguauccugauaa

SEQ ID NO: 434923 - RNA, 13 nt, Homo sapiens
uagaaauuuuaca

SEQ ID NO: 434924 - RNA, 17 nt, Homo sapiens
uagaacaaugcuauaau

SEQ ID NO: 434925 - RNA, 12 nt, Homo sapiens
uagaacuugauu

SEQ ID NO: 434926 - RNA, 17 nt, Homo sapiens
uagaagaaaagcacugg

SEQ ID NO: 434927 - RNA, 14 nt, Homo sapiens
uagaagccaagaca

SEQ ID NO: 434928 - RNA, 18 nt, Homo sapiens
uagaagccugcagcggca

SEQ ID NO: 434929 - RNA, 15 nt, Homo sapiens
uagaaggagagccca

SEQ ID NO: 434930 - RNA, 13 nt, Homo sapiens
uagaauacuguau

SEQ ID NO: 434931 - RNA, 17 nt, Homo sapiens
uagaauauuuauuaccu

SEQ ID NO: 434932 - RNA, 18 nt, Homo sapiens
uagaaugagaacauccau

SEQ ID NO: 434933 - RNA, 17 nt, Homo sapiens
uagaauggggcuuccau

SEQ ID NO: 434934 - RNA, 19 nt, Homo sapiens
uagaauuauaagucacaaa

SEQ ID NO: 434935 - RNA, 22 nt, Homo sapiens
uagaauugugcuggucauacau

SEQ ID NO: 434936 - RNA, 13 nt, Homo sapiens
uagaauuuauuca

SEQ ID NO: 434937 - RNA, 21 nt, Homo sapiens
uagacaauccccacauaccau

SEQ ID NO: 434938 - RNA, 16 nt, Homo sapiens
uagacaauuugccuua

SEQ ID NO: 434939 - RNA, 22 nt, Homo sapiens
uagacaguaugagucaaugugc

SEQ ID NO: 434940 - RNA, 19 nt, Homo sapiens
uagacucacagccguccaa

SEQ ID NO: 434941 - RNA, 17 nt, Homo sapiens
uagacuuaaacagcaga

SEQ ID NO: 434942 - RNA, 22 nt, Homo sapiens
uagacuugccaacaccacagaa

SEQ ID NO: 434943 - RNA, 19 nt, Homo sapiens
uagacuuucuuaucacuua

SEQ ID NO: 434944 - RNA, 16 nt, Homo sapiens
uagagaaaauggaaca

SEQ ID NO: 434945 - RNA, 21 nt, Homo sapiens
uagagaaaccccuggggacca

SEQ ID NO: 434946 - RNA, 19 nt, Homo sapiens
uagagacaggguuucacca

SEQ ID NO: 434947 - RNA, 15 nt, Homo sapiens
uagagagaaacagcu

SEQ ID NO: 434948 - RNA, 13 nt, Homo sapiens
uagagaugagcuu

SEQ ID NO: 434949 - RNA, 15 nt, Homo sapiens
uagagaugcuacugu

SEQ ID NO: 434950 - RNA, 22 nt, Homo sapiens
uagagauggggucucacagugu

SEQ ID NO: 434951 - RNA, 19 nt, Homo sapiens
uagagaugugucuauggcu

SEQ ID NO: 434952 - RNA, 19 nt, Homo sapiens
uagagcacuagaagcacag

SEQ ID NO: 434953 - RNA, 14 nt, Homo sapiens
uagagcagauucua

SEQ ID NO: 434954 - RNA, 22 nt, Homo sapiens
uagagccuucugaugucucuaa

SEQ ID NO: 434955 - RNA, 15 nt, Homo sapiens
uagagcuagaugugu

SEQ ID NO: 434956 - RNA, 20 nt, Homo sapiens
uagagcuagaugugucuuac

SEQ ID NO: 434957 - RNA, 22 nt, Homo sapiens
uagagcuagaugugucuuacca

SEQ ID NO: 434958 - RNA, 18 nt, Homo sapiens
uagagcucuauuucucua

SEQ ID NO: 434959 - RNA, 18 nt, Homo sapiens
uaugugugaggagcugcu

SEQ ID NO: 434960 - RNA, 19 nt, Homo sapiens
uauguuaaagcaucagaga

SEQ ID NO: 434961 - RNA, 17 nt, Homo sapiens
uauguuaugaacaugca

SEQ ID NO: 434962 - RNA, 21 nt, Homo sapiens
uauguucuccccuacauuagu

SEQ ID NO: 434963 - RNA, 18 nt, Homo sapiens
uauguuguugcuuguaua

SEQ ID NO: 434964 - RNA, 16 nt, Homo sapiens
uauuaaacuugucaga

SEQ ID NO: 434965 - RNA, 14 nt, Homo sapiens
uauuaaauuccucc

SEQ ID NO: 434966 - RNA, 13 nt, Homo sapiens
uauuaaauuugaa

SEQ ID NO: 434967 - RNA, 16 nt, Homo sapiens
uauuaaccuaccugug

SEQ ID NO: 434968 - RNA, 18 nt, Homo sapiens
uauuaaguaugauugaca

SEQ ID NO: 434969 - RNA, 18 nt, Homo sapiens
uauuaaucuucagcugaa

SEQ ID NO: 434970 - RNA, 14 nt, Homo sapiens
uauuaauucauuaa

SEQ ID NO: 434971 - RNA, 22 nt, Homo sapiens
uauuacaaauuuucacugcugc

SEQ ID NO: 434972 - RNA, 23 nt, Homo sapiens
uauuacccccuuuccucuugggc

SEQ ID NO: 434973 - RNA, 15 nt, Homo sapiens
uauuacuccuugcca

SEQ ID NO: 434974 - RNA, 16 nt, Homo sapiens
uauuacugaugugugc

SEQ ID NO: 434975 - RNA, 12 nt, Homo sapiens
uauuacuguugc

SEQ ID NO: 434976 - RNA, 20 nt, Homo sapiens
uauuacuguugcauuuacuu

SEQ ID NO: 434977 - RNA, 14 nt, Homo sapiens
uauuauguguuucc

SEQ ID NO: 434978 - RNA, 15 nt, Homo sapiens
uauuauuucaaugug

SEQ ID NO: 434979 - RNA, 22 nt, Homo sapiens
uauuauuugcuuuucauguaga

SEQ ID NO: 434980 - RNA, 17 nt, Homo sapiens
uauucaaacacacagua

SEQ ID NO: 434981 - RNA, 20 nt, Homo sapiens
uauucaacagcucaccaacu

SEQ ID NO: 434982 - RNA, 13 nt, Homo sapiens
uauucaacuaaua

SEQ ID NO: 434983 - RNA, 17 nt, Homo sapiens
uauucaauaaagcugcu

SEQ ID NO: 434984 - RNA, 19 nt, Homo sapiens
uauucagaaucaaaccuuu

SEQ ID NO: 434985 - RNA, 14 nt, Homo sapiens
uauucagacaagca

SEQ ID NO: 434986 - RNA, 17 nt, Homo sapiens
uauucauaccuguugua

SEQ ID NO: 434987 - RNA, 16 nt, Homo sapiens
uauucauagcuguaua

SEQ ID NO: 434988 - RNA, 16 nt, Homo sapiens
uauucaucugugugua

SEQ ID NO: 434989 - RNA, 14 nt, Homo sapiens
uauuccaccuuaaa

SEQ ID NO: 434990 - RNA, 17 nt, Homo sapiens
uauuccucacauucaca

SEQ ID NO: 434991 - RNA, 21 nt, Homo sapiens
uauucgugcauuuuuggauca

SEQ ID NO: 434992 - RNA, 18 nt, Homo sapiens
uauucuaagccaguuuuc

SEQ ID NO: 434993 - RNA, 23 nt, Homo sapiens
uauucuaguuuugucaaacugua

SEQ ID NO: 434994 - RNA, 12 nt, Homo sapiens
uauugacugccu

SEQ ID NO: 434995 - RNA, 15 nt, Homo sapiens
uauugauuccucaca

SEQ ID NO: 434996 - RNA, 17 nt, Homo sapiens
uauugcaguaaugauau

SEQ ID NO: 434997 - RNA, 20 nt, Homo sapiens
uauugccaggaauguuucag

SEQ ID NO: 434998 - RNA, 18 nt, Homo sapiens
uauugccuggagugugaa

SEQ ID NO: 434999 - RNA, 21 nt, Homo sapiens
uauugccuuuagaaacugagu

SEQ ID NO: 435000 - RNA, 15 nt, Homo sapiens
uauugcugcugguaa

SEQ ID NO: 435001 - RNA, 18 nt, Homo sapiens
uauugggccauagccuau

SEQ ID NO: 435002 - RNA, 15 nt, Homo sapiens
uauuguaaacaugug

SEQ ID NO: 435003 - RNA, 23 nt, Homo sapiens
uauuguaaguggaaaaugcaaug

SEQ ID NO: 435004 - RNA, 17 nt, Homo sapiens
uauugugaaguacauau

SEQ ID NO: 435005 - RNA, 16 nt, Homo sapiens
uauugugccaauaugu

SEQ ID NO: 435006 - RNA, 22 nt, Homo sapiens
uauuguuaaaaccuuacuuaaa

SEQ ID NO: 435007 - RNA, 21 nt, Homo sapiens
uauuuaaaaaaaaacauucaa

SEQ ID NO: 435008 - RNA, 20 nt, Homo sapiens
uauuuaaauguaaagacaaa

SEQ ID NO: 435009 - RNA, 18 nt, Homo sapiens
uauuuaaggggaauuaac

SEQ ID NO: 435010 - RNA, 15 nt, Homo sapiens
uauuuacaugugauu

SEQ ID NO: 435011 - RNA, 21 nt, Homo sapiens
uauuuacugagcuucucugug

SEQ ID NO: 435012 - RNA, 20 nt, Homo sapiens
uauuuacuggaaaccuguua

SEQ ID NO: 435013 - RNA, 19 nt, Homo sapiens
uauuuaucagugacagagu

SEQ ID NO: 435014 - RNA, 16 nt, Homo sapiens
uauuuauucaucugca

SEQ ID NO: 435015 - RNA, 13 nt, Homo sapiens
uauuuauuuucag

SEQ ID NO: 435016 - RNA, 15 nt, Homo sapiens
uauuucauaaacaac

SEQ ID NO: 435017 - RNA, 15 nt, Homo sapiens
uauuuccaacaaacu

SEQ ID NO: 435018 - RNA, 16 nt, Homo sapiens
uauuuccaucauguca

SEQ ID NO: 435019 - RNA, 20 nt, Homo sapiens
uauuucggaaauacacuaca

SEQ ID NO: 435020 - RNA, 21 nt, Homo sapiens
uauuucucaacaaagcacagu

SEQ ID NO: 435021 - RNA, 15 nt, Homo sapiens
uauuucuugcuuuca

SEQ ID NO: 435022 - RNA, 15 nt, Homo sapiens
cuuugaaauaugcau

SEQ ID NO: 435023 - RNA, 14 nt, Homo sapiens
cuuugaaguggcac

SEQ ID NO: 435024 - RNA, 13 nt, Homo sapiens
cuuugacauauug

SEQ ID NO: 435025 - RNA, 20 nt, Homo sapiens
cuuugaccucaaccugugau

SEQ ID NO: 435026 - RNA, 13 nt, Homo sapiens
cuuugacugaugc

SEQ ID NO: 435027 - RNA, 17 nt, Homo sapiens
cuuugagacugggucuc

SEQ ID NO: 435028 - RNA, 23 nt, Homo sapiens
cuuugagggacugccucugccac

SEQ ID NO: 435029 - RNA, 23 nt, Homo sapiens
cuuugauauuauguggcuuuuau

SEQ ID NO: 435030 - RNA, 13 nt, Homo sapiens
cuuugcaaugcaa

SEQ ID NO: 435031 - RNA, 20 nt, Homo sapiens
cuuugcaaugcaagcccuuu

SEQ ID NO: 435032 - RNA, 13 nt, Homo sapiens
cuuugccacugaa

SEQ ID NO: 435033 - RNA, 22 nt, Homo sapiens
cuuugcuacgaagaaagacucc

SEQ ID NO: 435034 - RNA, 16 nt, Homo sapiens
cuuugcugcuaugaaa

SEQ ID NO: 435035 - RNA, 14 nt, Homo sapiens
cuuuggauacacac

SEQ ID NO: 435036 - RNA, 19 nt, Homo sapiens
cuuuggaugggucacuugu

SEQ ID NO: 435037 - RNA, 17 nt, Homo sapiens
cuuuggcugacugggaa

SEQ ID NO: 435038 - RNA, 19 nt, Homo sapiens
cuuugggaggcugagaugg

SEQ ID NO: 435039 - RNA, 19 nt, Homo sapiens
cuuuggggacaguuggcag

SEQ ID NO: 435040 - RNA, 23 nt, Homo sapiens
cuuugggggauucaaaugcauga

SEQ ID NO: 435041 - RNA, 19 nt, Homo sapiens
cuuuguaacggcucuuagc

SEQ ID NO: 435042 - RNA, 14 nt, Homo sapiens
cuuuguaagacaca

SEQ ID NO: 435043 - RNA, 14 nt, Homo sapiens
cuuuguacugauga

SEQ ID NO: 435044 - RNA, 17 nt, Homo sapiens
cuuuguaugcacuuugu

SEQ ID NO: 435045 - RNA, 22 nt, Homo sapiens
cuuugucauucaagccugugaa

SEQ ID NO: 435046 - RNA, 17 nt, Homo sapiens
cuuugucccacagcuug

SEQ ID NO: 435047 - RNA, 13 nt, Homo sapiens
cuuuguccccuca

SEQ ID NO: 435048 - RNA, 17 nt, Homo sapiens
cuuugucccggggcucc

SEQ ID NO: 435049 - RNA, 15 nt, Homo sapiens
cuuugucugugggaa

SEQ ID NO: 435050 - RNA, 15 nt, Homo sapiens
cuuuguuacugucca

SEQ ID NO: 435051 - RNA, 16 nt, Homo sapiens
cuuuguuaucuuccac

SEQ ID NO: 435052 - RNA, 21 nt, Homo sapiens
cuuuguucucccaaaucugaa

SEQ ID NO: 435053 - RNA, 14 nt, Homo sapiens
cuuuguugcugucu

SEQ ID NO: 435054 - RNA, 23 nt, Homo sapiens
cuuuguuuacaugaguucaaaua

SEQ ID NO: 435055 - RNA, 14 nt, Homo sapiens
cuuuguuuccucuu

SEQ ID NO: 435056 - RNA, 22 nt, Homo sapiens
cuuuuaaaaauucaaaugauuu

SEQ ID NO: 435057 - RNA, 19 nt, Homo sapiens
cuuuuaaaaggagcacauu

SEQ ID NO: 435058 - RNA, 17 nt, Homo sapiens
cuuuuaaauaauaucca

SEQ ID NO: 435059 - RNA, 15 nt, Homo sapiens
cuuuuaaggcuaaaa

SEQ ID NO: 435060 - RNA, 17 nt, Homo sapiens
cuuuuaaugucaucucu

SEQ ID NO: 435061 - RNA, 17 nt, Homo sapiens
cuuuuacagcucuuggc

SEQ ID NO: 435062 - RNA, 18 nt, Homo sapiens
cuuuuacauacagugaua

SEQ ID NO: 435063 - RNA, 15 nt, Homo sapiens
cuuuuacuaagcacu

SEQ ID NO: 435064 - RNA, 12 nt, Homo sapiens
cuuuuacugugg

SEQ ID NO: 435065 - RNA, 16 nt, Homo sapiens
cuuuuagaucaacaau

SEQ ID NO: 435066 - RNA, 14 nt, Homo sapiens
cuuuuaguacccac

SEQ ID NO: 435067 - RNA, 22 nt, Homo sapiens
cuuuuaucaauaaagcacuauu

SEQ ID NO: 435068 - RNA, 15 nt, Homo sapiens
cuuuuaucucacaaa

SEQ ID NO: 435069 - RNA, 13 nt, Homo sapiens
cuuuuaugcagau

SEQ ID NO: 435070 - RNA, 20 nt, Homo sapiens
cuuuuauuucauucauaucc

SEQ ID NO: 435071 - RNA, 16 nt, Homo sapiens
cuuuuauuugcaacau

SEQ ID NO: 435072 - RNA, 23 nt, Homo sapiens
cuuuuauuuuuuaagguaacaaa

SEQ ID NO: 435073 - RNA, 21 nt, Homo sapiens
cuuuuauuuuuuaaguucaau

SEQ ID NO: 435074 - RNA, 16 nt, Homo sapiens
cuuuuccauguaucua

SEQ ID NO: 435075 - RNA, 13 nt, Homo sapiens
cuuuuccccucau

SEQ ID NO: 435076 - RNA, 16 nt, Homo sapiens
cuuuucccuaagccaa

SEQ ID NO: 435077 - RNA, 20 nt, Homo sapiens
cuuuucgcuuucuuucugca

SEQ ID NO: 435078 - RNA, 23 nt, Homo sapiens
cuuuucuuugaaggaugacuaca

SEQ ID NO: 435079 - RNA, 16 nt, Homo sapiens
cuuuugaaauccagaa

SEQ ID NO: 435080 - RNA, 14 nt, Homo sapiens
cuuuugaaaugcca

SEQ ID NO: 435081 - RNA, 16 nt, Homo sapiens
cuuuugaaaugccacg

SEQ ID NO: 435082 - RNA, 20 nt, Homo sapiens
cuuuugaauaauguagugca

SEQ ID NO: 435083 - RNA, 17 nt, Homo sapiens
cuuuugaaucaaucugg

SEQ ID NO: 435084 - RNA, 18 nt, Homo sapiens
cuuuugaauuuuugguua

SEQ ID NO: 435085 - RNA, 15 nt, Homo sapiens
cuuuugagugccuua

SEQ ID NO: 435086 - RNA, 20 nt, Homo sapiens
cuuuugccccagaaagggga

SEQ ID NO: 435087 - RNA, 15 nt, Homo sapiens
cuuuuggagcugaga

SEQ ID NO: 435088 - RNA, 17 nt, Homo sapiens
cuuuuggcucugaagaa

SEQ ID NO: 435089 - RNA, 14 nt, Homo sapiens
gaacacagugccug

SEQ ID NO: 435090 - RNA, 20 nt, Homo sapiens
gaacacguuggcucaguccu

SEQ ID NO: 435091 - RNA, 22 nt, Homo sapiens
gaacacuaaacagacuauuuaa

SEQ ID NO: 435092 - RNA, 17 nt, Homo sapiens
gaacacuagacaugcca

SEQ ID NO: 435093 - RNA, 21 nt, Homo sapiens
gaacacuggccugggucuccc

SEQ ID NO: 435094 - RNA, 22 nt, Homo sapiens
gaacagauaaucagugugucua

SEQ ID NO: 435095 - RNA, 14 nt, Homo sapiens
gaacagccagaccc

SEQ ID NO: 435096 - RNA, 23 nt, Homo sapiens
gaacagcgggagaccugugcuag

SEQ ID NO: 435097 - RNA, 17 nt, Homo sapiens
gaacagcuguaaucuau

SEQ ID NO: 435098 - RNA, 17 nt, Homo sapiens
gaacaguuuaugcagug

SEQ ID NO: 435099 - RNA, 16 nt, Homo sapiens
gaacaugagugcugau

SEQ ID NO: 435100 - RNA, 17 nt, Homo sapiens
gaacauuaaauagcaaa

SEQ ID NO: 435101 - RNA, 21 nt, Homo sapiens
gaaccaagaacuuuccaggaa

SEQ ID NO: 435102 - RNA, 13 nt, Homo sapiens
gaaccacuaugaa

SEQ ID NO: 435103 - RNA, 23 nt, Homo sapiens
gaaccaucauuggaaaugaaacu

SEQ ID NO: 435104 - RNA, 16 nt, Homo sapiens
gaaccauuacuguaau

SEQ ID NO: 435105 - RNA, 15 nt, Homo sapiens
gaacccggucccagg

SEQ ID NO: 435106 - RNA, 15 nt, Homo sapiens
gaacccuagcacaaa

SEQ ID NO: 435107 - RNA, 19 nt, Homo sapiens
gaacccugccaggcugcua

SEQ ID NO: 435108 - RNA, 15 nt, Homo sapiens
gaaccucccugggcc

SEQ ID NO: 435109 - RNA, 18 nt, Homo sapiens
gaaccucguugacaugca

SEQ ID NO: 435110 - RNA, 14 nt, Homo sapiens
gaaccucugaugcc

SEQ ID NO: 435111 - RNA, 15 nt, Homo sapiens
gaaccuggcugcgaa

SEQ ID NO: 435112 - RNA, 13 nt, Homo sapiens
gaacgcucuuagc

SEQ ID NO: 435113 - RNA, 21 nt, Homo sapiens
gaacuaaguuuuuuacuucca

SEQ ID NO: 435114 - RNA, 21 nt, Homo sapiens
gaacuacaaagcuucuauccc

SEQ ID NO: 435115 - RNA, 15 nt, Homo sapiens
gaacuagagaaggac

SEQ ID NO: 435116 - RNA, 22 nt, Homo sapiens
gaacuagugguggcucugagaa

SEQ ID NO: 435117 - RNA, 15 nt, Homo sapiens
gaacucacgagccuu

SEQ ID NO: 435118 - RNA, 14 nt, Homo sapiens
gaacucaugugauu

SEQ ID NO: 435119 - RNA, 16 nt, Homo sapiens
gaacuccauacagccu

SEQ ID NO: 435120 - RNA, 15 nt, Homo sapiens
gaacucgaacuugaa

SEQ ID NO: 435121 - RNA, 14 nt, Homo sapiens
gaacucgcuucucu

SEQ ID NO: 435122 - RNA, 16 nt, Homo sapiens
gaacucugcaacugaa

SEQ ID NO: 435123 - RNA, 13 nt, Homo sapiens
gaacucuguaaaa

SEQ ID NO: 435124 - RNA, 16 nt, Homo sapiens
gaacugaaaaccaguc

SEQ ID NO: 435125 - RNA, 17 nt, Homo sapiens
gaacugcccagccucag

SEQ ID NO: 435126 - RNA, 13 nt, Homo sapiens
gaacugcugcugg

SEQ ID NO: 435127 - RNA, 12 nt, Homo sapiens
gaacugcuuuau

SEQ ID NO: 435128 - RNA, 18 nt, Homo sapiens
gaacugguccaggccagg

SEQ ID NO: 435129 - RNA, 13 nt, Homo sapiens
gaacugucccaca

SEQ ID NO: 435130 - RNA, 15 nt, Homo sapiens
gaacugugcucuccc

SEQ ID NO: 435131 - RNA, 12 nt, Homo sapiens
gaacuuaucaaa

SEQ ID NO: 435132 - RNA, 20 nt, Homo sapiens
gaacuucucguagaugcugc

SEQ ID NO: 435133 - RNA, 15 nt, Homo sapiens
gaacuuucacauagc

SEQ ID NO: 435134 - RNA, 19 nt, Homo sapiens
gaacuuugcacacuucaaa

SEQ ID NO: 435135 - RNA, 22 nt, Homo sapiens
gaagaaaagaaaaaagucuuug

SEQ ID NO: 435136 - RNA, 22 nt, Homo sapiens
gaagaaauggaaucagcuuuua

SEQ ID NO: 435137 - RNA, 22 nt, Homo sapiens
gaagaacacagcaugugccaag

SEQ ID NO: 435138 - RNA, 22 nt, Homo sapiens
gaagaacagaauugcuccugca

SEQ ID NO: 435139 - RNA, 16 nt, Homo sapiens
gaagaacuugucccuc

SEQ ID NO: 435140 - RNA, 20 nt, Homo sapiens
gaagaacuugucccucaggc

SEQ ID NO: 435141 - RNA, 12 nt, Homo sapiens
gaagaagcaaac

SEQ ID NO: 435142 - RNA, 12 nt, Homo sapiens
gaagaagcuaaa

SEQ ID NO: 435143 - RNA, 20 nt, Homo sapiens
gaagaagucuaagagugaag

SEQ ID NO: 435144 - RNA, 21 nt, Homo sapiens
gaagaagucuaagagugaagu

SEQ ID NO: 435145 - RNA, 15 nt, Homo sapiens
gaagaaugcauucaa

SEQ ID NO: 435146 - RNA, 15 nt, Homo sapiens
gaagaauggccauuu

SEQ ID NO: 435147 - RNA, 14 nt, Homo sapiens
gaagaauggugugu

SEQ ID NO: 435148 - RNA, 19 nt, Homo sapiens
gaagaauuuaucugugaau

SEQ ID NO: 435149 - RNA, 22 nt, Homo sapiens
gaagacaaauaguguggaguga

SEQ ID NO: 435150 - RNA, 18 nt, Homo sapiens
gaagacauaucaugugug

SEQ ID NO: 435151 - RNA, 23 nt, Homo sapiens
gaagacauccugagcagugccag

SEQ ID NO: 435152 - RNA, 12 nt, Homo sapiens
gaagaccaguca

SEQ ID NO: 435153 - RNA, 20 nt, Homo sapiens
gaagaccuucugaagaucuc

SEQ ID NO: 435154 - RNA, 21 nt, Homo sapiens
gaagagcaggcaccagcagca

SEQ ID NO: 435155 - RNA, 17 nt, Homo sapiens
gaagagggacagaugaa

SEQ ID NO: 435156 - RNA, 20 nt, Homo sapiens
gaagagggagaagcaugaaa

SEQ ID NO: 435157 - RNA, 19 nt, Homo sapiens
gaagaguaaaauggcuguu

SEQ ID NO: 435158 - RNA, 20 nt, Homo sapiens
gaagauaacuugagcaccgu

SEQ ID NO: 435159 - RNA, 14 nt, Homo sapiens
gaagauaauuugca

SEQ ID NO: 435160 - RNA, 21 nt, Homo sapiens
ucaccagucugucuacugugg

SEQ ID NO: 435161 - RNA, 15 nt, Homo sapiens
ucaccauugugaagc

SEQ ID NO: 435162 - RNA, 13 nt, Homo sapiens
ucacccaaaacaa

SEQ ID NO: 435163 - RNA, 14 nt, Homo sapiens
ucacccaggaggau

SEQ ID NO: 435164 - RNA, 23 nt, Homo sapiens
ucaccccggcaggcccugcagug

SEQ ID NO: 435165 - RNA, 17 nt, Homo sapiens
ucacccgacccgugcac

SEQ ID NO: 435166 - RNA, 14 nt, Homo sapiens
ucacccuacaagau

SEQ ID NO: 435167 - RNA, 15 nt, Homo sapiens
ucacccuucugggca

SEQ ID NO: 435168 - RNA, 23 nt, Homo sapiens
ucaccggccuugugacauucacu

SEQ ID NO: 435169 - RNA, 17 nt, Homo sapiens
ucaccuaauuaauuuca

SEQ ID NO: 435170 - RNA, 13 nt, Homo sapiens
ucaccuagaccuu

SEQ ID NO: 435171 - RNA, 21 nt, Homo sapiens
ucaccuccacccccuccuguc

SEQ ID NO: 435172 - RNA, 22 nt, Homo sapiens
ucaccucccaaacccagccucu

SEQ ID NO: 435173 - RNA, 20 nt, Homo sapiens
ucaccuccucccagacuuuc

SEQ ID NO: 435174 - RNA, 21 nt, Homo sapiens
ucaccucucccuccaccuccu

SEQ ID NO: 435175 - RNA, 16 nt, Homo sapiens
ucaccucugaaaacgg

SEQ ID NO: 435176 - RNA, 15 nt, Homo sapiens
ucaccugaaacacuu

SEQ ID NO: 435177 - RNA, 18 nt, Homo sapiens
ucaccugggccuuuccug

SEQ ID NO: 435178 - RNA, 14 nt, Homo sapiens
ucacgacucuuccu

SEQ ID NO: 435179 - RNA, 23 nt, Homo sapiens
ucacuaaagaaaaacuaauguca

SEQ ID NO: 435180 - RNA, 18 nt, Homo sapiens
ucacuaaauccuuuccaa

SEQ ID NO: 435181 - RNA, 15 nt, Homo sapiens
ucacuaggaggucau

SEQ ID NO: 435182 - RNA, 18 nt, Homo sapiens
ucacuaggaggucaucaa

SEQ ID NO: 435183 - RNA, 20 nt, Homo sapiens
ucacuauccaugcaccaaac

SEQ ID NO: 435184 - RNA, 21 nt, Homo sapiens
ucacucaaccauaacacuuga

SEQ ID NO: 435185 - RNA, 19 nt, Homo sapiens
ucacuccacaacccaagaa

SEQ ID NO: 435186 - RNA, 17 nt, Homo sapiens
ucacuccucugucauau

SEQ ID NO: 435187 - RNA, 23 nt, Homo sapiens
ucacucucugaagaugaucauuu

SEQ ID NO: 435188 - RNA, 16 nt, Homo sapiens
ucacucugacaguauu

SEQ ID NO: 435189 - RNA, 15 nt, Homo sapiens
ucacucuuaugaaau

SEQ ID NO: 435190 - RNA, 16 nt, Homo sapiens
ucacugaaguucuccu

SEQ ID NO: 435191 - RNA, 17 nt, Homo sapiens
ucacugacucaagacac

SEQ ID NO: 435192 - RNA, 18 nt, Homo sapiens
ucacugagaagauuguga

SEQ ID NO: 435193 - RNA, 14 nt, Homo sapiens
ucacugcucaagaa

SEQ ID NO: 435194 - RNA, 16 nt, Homo sapiens
ucacuguuucucugcu

SEQ ID NO: 435195 - RNA, 15 nt, Homo sapiens
ucacuuaagcccagg

SEQ ID NO: 435196 - RNA, 15 nt, Homo sapiens
ucacuuauaccaaag

SEQ ID NO: 435197 - RNA, 20 nt, Homo sapiens
ucacuuauaccaaagggaaa

SEQ ID NO: 435198 - RNA, 14 nt, Homo sapiens
ucacuuauuucaua

SEQ ID NO: 435199 - RNA, 12 nt, Homo sapiens
ucacuucacccu

SEQ ID NO: 435200 - RNA, 13 nt, Homo sapiens
ucacuuccuacaa

SEQ ID NO: 435201 - RNA, 17 nt, Homo sapiens
ucacuucugcuguacag

SEQ ID NO: 435202 - RNA, 15 nt, Homo sapiens
ucacuugacucuuga

SEQ ID NO: 435203 - RNA, 12 nt, Homo sapiens
ucacuugaucuc

SEQ ID NO: 435204 - RNA, 20 nt, Homo sapiens
ucacuuggaagauuuguaua

SEQ ID NO: 435205 - RNA, 12 nt, Homo sapiens
ucacuuugcaua

SEQ ID NO: 435206 - RNA, 21 nt, Homo sapiens
ucacuuuuaauuagugaugca

SEQ ID NO: 435207 - RNA, 18 nt, Homo sapiens
ucacuuuuuuccugucaa

SEQ ID NO: 435208 - RNA, 14 nt, Homo sapiens
ucagaaaagacacu

SEQ ID NO: 435209 - RNA, 23 nt, Homo sapiens
ucagaaaagaugugcagauauca

SEQ ID NO: 435210 - RNA, 19 nt, Homo sapiens
ucagaaaaucgaccacagu

SEQ ID NO: 435211 - RNA, 15 nt, Homo sapiens
ucagaaacaaagcau

SEQ ID NO: 435212 - RNA, 19 nt, Homo sapiens
ucagaaaccccacuuccau

SEQ ID NO: 435213 - RNA, 22 nt, Homo sapiens
ucagaacacccuguaccaucca

SEQ ID NO: 435214 - RNA, 19 nt, Homo sapiens
ucagaaccucuuccccaga

SEQ ID NO: 435215 - RNA, 12 nt, Homo sapiens
ucagaagauauc

SEQ ID NO: 435216 - RNA, 14 nt, Homo sapiens
ucagaauguguuau

SEQ ID NO: 435217 - RNA, 15 nt, Homo sapiens
ucagaauuguagcca

SEQ ID NO: 435218 - RNA, 22 nt, Homo sapiens
ucagacaauuuauccaaagcau

SEQ ID NO: 435219 - RNA, 16 nt, Homo sapiens
gaccccacccaagcuu

SEQ ID NO: 435220 - RNA, 19 nt, Homo sapiens
gaccccacuuaugcugcug

SEQ ID NO: 435221 - RNA, 19 nt, Homo sapiens
gaccccagcuuuucuugcc

SEQ ID NO: 435222 - RNA, 16 nt, Homo sapiens
gaccccucccaaccuc

SEQ ID NO: 435223 - RNA, 18 nt, Homo sapiens
gaccccugaauucaauga

SEQ ID NO: 435224 - RNA, 17 nt, Homo sapiens
gaccccugcuccugacu

SEQ ID NO: 435225 - RNA, 14 nt, Homo sapiens
gacccgcucuccau

SEQ ID NO: 435226 - RNA, 21 nt, Homo sapiens
gacccuccuccacuccaccuc

SEQ ID NO: 435227 - RNA, 22 nt, Homo sapiens
gacccucgcaaaaugaugugaa

SEQ ID NO: 435228 - RNA, 18 nt, Homo sapiens
gacccugaggguuuccac

SEQ ID NO: 435229 - RNA, 21 nt, Homo sapiens
gaccggaggcaaaaggcagug

SEQ ID NO: 435230 - RNA, 18 nt, Homo sapiens
gaccguuuuuacuaagua

SEQ ID NO: 435231 - RNA, 15 nt, Homo sapiens
gaccuaggauuucau

SEQ ID NO: 435232 - RNA, 22 nt, Homo sapiens
gaccucacugugaccuugacuu

SEQ ID NO: 435233 - RNA, 17 nt, Homo sapiens
gaccuccaaccaggagu

SEQ ID NO: 435234 - RNA, 23 nt, Homo sapiens
gaccuccaccugggagaugcugg

SEQ ID NO: 435235 - RNA, 14 nt, Homo sapiens
gaccucccacuuug

SEQ ID NO: 435236 - RNA, 18 nt, Homo sapiens
gaccucccccucuugguc

SEQ ID NO: 435237 - RNA, 19 nt, Homo sapiens
gaccucccugucucuacaa

SEQ ID NO: 435238 - RNA, 18 nt, Homo sapiens
gaccugcuccgccaggaa

SEQ ID NO: 435239 - RNA, 16 nt, Homo sapiens
gaccuggauguuauau

SEQ ID NO: 435240 - RNA, 16 nt, Homo sapiens
gaccuggcuggugaca

SEQ ID NO: 435241 - RNA, 19 nt, Homo sapiens
gaccuguucaaaaaggaaa

SEQ ID NO: 435242 - RNA, 18 nt, Homo sapiens
gaccuugaaugaugccau

SEQ ID NO: 435243 - RNA, 13 nt, Homo sapiens
gaccuuuauuuau

SEQ ID NO: 435244 - RNA, 15 nt, Homo sapiens
gacgagguccucaca

SEQ ID NO: 435245 - RNA, 15 nt, Homo sapiens
gacgcggcucccggg

SEQ ID NO: 435246 - RNA, 15 nt, Homo sapiens
gacggaugauuggau

SEQ ID NO: 435247 - RNA, 22 nt, Homo sapiens
gacggcaccaucuggaaggaca

SEQ ID NO: 435248 - RNA, 21 nt, Homo sapiens
gacgggaccgggccgcuagau

SEQ ID NO: 435249 - RNA, 20 nt, Homo sapiens
gacgguagagagaaacagcu

SEQ ID NO: 435250 - RNA, 15 nt, Homo sapiens
gacguaaucuccaca

SEQ ID NO: 435251 - RNA, 19 nt, Homo sapiens
gacuagaacacaaauccaa

SEQ ID NO: 435252 - RNA, 17 nt, Homo sapiens
gacuagaggcuugcaua

SEQ ID NO: 435253 - RNA, 18 nt, Homo sapiens
gacuagaggcuugcauaa

SEQ ID NO: 435254 - RNA, 15 nt, Homo sapiens
gacuaggagcacugu

SEQ ID NO: 435255 - RNA, 14 nt, Homo sapiens
gacuaggauaacag

SEQ ID NO: 435256 - RNA, 18 nt, Homo sapiens
gacuagugacacauugua

SEQ ID NO: 435257 - RNA, 16 nt, Homo sapiens
gacuauuuaacuugag

SEQ ID NO: 435258 - RNA, 18 nt, Homo sapiens
gacucaagacacugagau

SEQ ID NO: 435259 - RNA, 17 nt, Homo sapiens
gacucaggccugccaau

SEQ ID NO: 435260 - RNA, 21 nt, Homo sapiens
gacucagggccaugccugccc

SEQ ID NO: 435261 - RNA, 15 nt, Homo sapiens
gacucaguccagcca

SEQ ID NO: 435262 - RNA, 23 nt, Homo sapiens
gacuccagaaucugcuguugcca

SEQ ID NO: 435263 - RNA, 23 nt, Homo sapiens
gacucccuccccaccccaaccac

SEQ ID NO: 435264 - RNA, 21 nt, Homo sapiens
gacuccgggcacggcuuccca

SEQ ID NO: 435265 - RNA, 15 nt, Homo sapiens
gacucuauucucaaa

SEQ ID NO: 435266 - RNA, 12 nt, Homo sapiens
gacucucaggga

SEQ ID NO: 435267 - RNA, 23 nt, Homo sapiens
gacucugaaaaacauuccaggaa

SEQ ID NO: 435268 - RNA, 16 nt, Homo sapiens
gacucugucucaaaaa

SEQ ID NO: 435269 - RNA, 18 nt, Homo sapiens
gacucuucccccacuccu

SEQ ID NO: 435270 - RNA, 21 nt, Homo sapiens
gacugacccugaucagucuaa

SEQ ID NO: 435271 - RNA, 22 nt, Homo sapiens
gacugagagacaggacuagcug

SEQ ID NO: 435272 - RNA, 16 nt, Homo sapiens
gacugaugucaucuug

SEQ ID NO: 435273 - RNA, 17 nt, Homo sapiens
gacugaugucaucuuga

SEQ ID NO: 435274 - RNA, 20 nt, Homo sapiens
gacugccacccacacgcccu

SEQ ID NO: 435275 - RNA, 22 nt, Homo sapiens
gacugccucugccacacucuga

SEQ ID NO: 435276 - RNA, 17 nt, Homo sapiens
gacugggggacugggag

SEQ ID NO: 435277 - RNA, 18 nt, Homo sapiens
gacugugauuuauuugga

SEQ ID NO: 435278 - RNA, 23 nt, Homo sapiens
gacuguucuauagcagucaucau

SEQ ID NO: 435279 - RNA, 16 nt, Homo sapiens
gacuuaagaagccuua

SEQ ID NO: 435280 - RNA, 18 nt, Homo sapiens
gacuuaauuaugcuaaca

SEQ ID NO: 435281 - RNA, 19 nt, Homo sapiens
gacuuccauuugcuuuguc

SEQ ID NO: 435282 - RNA, 19 nt, Homo sapiens
gacuucccaacagccuuag

SEQ ID NO: 435283 - RNA, 15 nt, Homo sapiens
gacuucucuagacau

SEQ ID NO: 435284 - RNA, 23 nt, Homo sapiens
gacuucugaagggccccuugcaa

SEQ ID NO: 435285 - RNA, 16 nt, Homo sapiens
gacuucuggcagggaa

SEQ ID NO: 435286 - RNA, 16 nt, Homo sapiens
gacuugaaucaaguca

SEQ ID NO: 435287 - RNA, 17 nt, Homo sapiens
gacuugauuagugccuu

SEQ ID NO: 435288 - RNA, 14 nt, Homo sapiens
gacuuggaaauggg

SEQ ID NO: 435289 - RNA, 15 nt, Homo sapiens
gacuuggagcugucc

SEQ ID NO: 435290 - RNA, 16 nt, Homo sapiens
gacuuggggucaggaa

SEQ ID NO: 435291 - RNA, 21 nt, Homo sapiens
gacuuguaggaaucugccuuc

SEQ ID NO: 435292 - RNA, 20 nt, Homo sapiens
gacuuguuuuaugcucaggg

SEQ ID NO: 435293 - RNA, 16 nt, Homo sapiens
gacuuugauugcacau

SEQ ID NO: 435294 - RNA, 16 nt, Homo sapiens
gacuuugccacaucca

SEQ ID NO: 435295 - RNA, 17 nt, Homo sapiens
gacuuuguauagaaggu

SEQ ID NO: 435296 - RNA, 15 nt, Homo sapiens
gacuuuuaaugucau

SEQ ID NO: 435297 - RNA, 19 nt, Homo sapiens
gacuuuugaagaacaaaag

SEQ ID NO: 435298 - RNA, 17 nt, Homo sapiens
uccagauccuucaaaga

SEQ ID NO: 435299 - RNA, 19 nt, Homo sapiens
uccagaugugccuagacac

SEQ ID NO: 435300 - RNA, 14 nt, Homo sapiens
uccagcacuggaag

SEQ ID NO: 435301 - RNA, 15 nt, Homo sapiens
uccagccaacauuua

SEQ ID NO: 435302 - RNA, 19 nt, Homo sapiens
uccagcccucucacugugu

SEQ ID NO: 435303 - RNA, 17 nt, Homo sapiens
uccagccgccauugcca

SEQ ID NO: 435304 - RNA, 16 nt, Homo sapiens
uccagcgguugccuuu

SEQ ID NO: 435305 - RNA, 18 nt, Homo sapiens
uccagcuaagccugauga

SEQ ID NO: 435306 - RNA, 20 nt, Homo sapiens
uccagcucuuuccuccuucc

SEQ ID NO: 435307 - RNA, 23 nt, Homo sapiens
uccagcuucugguacucuccuag

SEQ ID NO: 435308 - RNA, 15 nt, Homo sapiens
uccagcuuuaagggu

SEQ ID NO: 435309 - RNA, 14 nt, Homo sapiens
uccaggaaggcagc

SEQ ID NO: 435310 - RNA, 17 nt, Homo sapiens
uccaggagaccuuccac

SEQ ID NO: 435311 - RNA, 19 nt, Homo sapiens
uccaggcacucagaaggca

SEQ ID NO: 435312 - RNA, 19 nt, Homo sapiens
uccaggcgaugugcaagug

SEQ ID NO: 435313 - RNA, 21 nt, Homo sapiens
uccaggcuuaagcgauucuca

SEQ ID NO: 435314 - RNA, 15 nt, Homo sapiens
uccagggacaaagag

SEQ ID NO: 435315 - RNA, 14 nt, Homo sapiens
uccagggaugccau

SEQ ID NO: 435316 - RNA, 22 nt, Homo sapiens
uccagguuccauccaccaccuu

SEQ ID NO: 435317 - RNA, 14 nt, Homo sapiens
uccaguauugaaaa

SEQ ID NO: 435318 - RNA, 16 nt, Homo sapiens
uccagucuguucucac

SEQ ID NO: 435319 - RNA, 13 nt, Homo sapiens
uccagugcaggag

SEQ ID NO: 435320 - RNA, 15 nt, Homo sapiens
uccagugcaggagac

SEQ ID NO: 435321 - RNA, 15 nt, Homo sapiens
uccaguucugaugag

SEQ ID NO: 435322 - RNA, 14 nt, Homo sapiens
uccaguuucccaaa

SEQ ID NO: 435323 - RNA, 14 nt, Homo sapiens
uccaguuugcccac

SEQ ID NO: 435324 - RNA, 14 nt, Homo sapiens
uccauaaaaguccu

SEQ ID NO: 435325 - RNA, 17 nt, Homo sapiens
uccauaaaaguccuguc

SEQ ID NO: 435326 - RNA, 13 nt, Homo sapiens
uccauaugcucuu

SEQ ID NO: 435327 - RNA, 18 nt, Homo sapiens
uccauauuuauuuaaaca

SEQ ID NO: 435328 - RNA, 20 nt, Homo sapiens
uccaucacagccagcccagc

SEQ ID NO: 435329 - RNA, 21 nt, Homo sapiens
uccaucagcucucugcaaaga

SEQ ID NO: 435330 - RNA, 22 nt, Homo sapiens
uccauccauaaauccaguucua

SEQ ID NO: 435331 - RNA, 15 nt, Homo sapiens
uccauccccaguugg

SEQ ID NO: 435332 - RNA, 13 nt, Homo sapiens
uccauccuugacu

SEQ ID NO: 435333 - RNA, 13 nt, Homo sapiens
uccaucuuucuac

SEQ ID NO: 435334 - RNA, 16 nt, Homo sapiens
uccaugaccaggccac

SEQ ID NO: 435335 - RNA, 23 nt, Homo sapiens
uccaugcagaucuagccaggccu

SEQ ID NO: 435336 - RNA, 21 nt, Homo sapiens
uccaugccuauuuacuggaaa

SEQ ID NO: 435337 - RNA, 22 nt, Homo sapiens
uccaugcuccucaccugucuag

SEQ ID NO: 435338 - RNA, 15 nt, Homo sapiens
uccauggaugcaugc

SEQ ID NO: 435339 - RNA, 23 nt, Homo sapiens
uccauguaggaaaguaaaaugga

SEQ ID NO: 435340 - RNA, 12 nt, Homo sapiens
uccaugugaaau

SEQ ID NO: 435341 - RNA, 15 nt, Homo sapiens
uccaugugugugcaa

SEQ ID NO: 435342 - RNA, 16 nt, Homo sapiens
uccaugugugugcaag

SEQ ID NO: 435343 - RNA, 18 nt, Homo sapiens
uccaugugugugcaagug

SEQ ID NO: 435344 - RNA, 10 nt, Homo sapiens
uccauuagua

SEQ ID NO: 435345 - RNA, 15 nt, Homo sapiens
uccauucagucugca

SEQ ID NO: 435346 - RNA, 20 nt, Homo sapiens
uccauucuuucugauaacua

SEQ ID NO: 435347 - RNA, 18 nt, Homo sapiens
uccauuuacuugaucauu

SEQ ID NO: 435348 - RNA, 17 nt, Homo sapiens
uccauuucaugugaucu

SEQ ID NO: 435349 - RNA, 14 nt, Homo sapiens
ucuuuaaucaaaag

SEQ ID NO: 435350 - RNA, 19 nt, Homo sapiens
ucuuuaauuguaucuccuu

SEQ ID NO: 435351 - RNA, 12 nt, Homo sapiens
ucuuuaccugag

SEQ ID NO: 435352 - RNA, 17 nt, Homo sapiens
ucuuuaccuucauuuca

SEQ ID NO: 435353 - RNA, 14 nt, Homo sapiens
ucuuuauaaaccau

SEQ ID NO: 435354 - RNA, 13 nt, Homo sapiens
ucuuuauaauucu

SEQ ID NO: 435355 - RNA, 12 nt, Homo sapiens
ucuuuauacuua

SEQ ID NO: 435356 - RNA, 18 nt, Homo sapiens
ucuuuauacuuaaacagc

SEQ ID NO: 435357 - RNA, 14 nt, Homo sapiens
ucuuuaugacuguu

SEQ ID NO: 435358 - RNA, 16 nt, Homo sapiens
ucuuuauucacaguau

SEQ ID NO: 435359 - RNA, 21 nt, Homo sapiens
ucuuucaauugcagaugccaa

SEQ ID NO: 435360 - RNA, 15 nt, Homo sapiens
ucuuucaucaaaaca

SEQ ID NO: 435361 - RNA, 12 nt, Homo sapiens
ucuuuccacuuu

SEQ ID NO: 435362 - RNA, 22 nt, Homo sapiens
ucuuuccaggcuucccugacuu

SEQ ID NO: 435363 - RNA, 18 nt, Homo sapiens
ucuuuccuacucugggaa

SEQ ID NO: 435364 - RNA, 23 nt, Homo sapiens
ucuuuccuguagucccauugaug

SEQ ID NO: 435365 - RNA, 21 nt, Homo sapiens
ucuuucgcacauucuccugau

SEQ ID NO: 435366 - RNA, 18 nt, Homo sapiens
ucuuucuaaugugugaau

SEQ ID NO: 435367 - RNA, 21 nt, Homo sapiens
ucuuucuauguagaacuguuc

SEQ ID NO: 435368 - RNA, 20 nt, Homo sapiens
ucuuugaacccuugcuugca

SEQ ID NO: 435369 - RNA, 16 nt, Homo sapiens
ucuuugacuauaacaa

SEQ ID NO: 435370 - RNA, 16 nt, Homo sapiens
ucuuugagucaaguca

SEQ ID NO: 435371 - RNA, 21 nt, Homo sapiens
ucuuugauuuaacugacuuaa

SEQ ID NO: 435372 - RNA, 12 nt, Homo sapiens
ucuuugcaugga

SEQ ID NO: 435373 - RNA, 20 nt, Homo sapiens
ucuuugcccaguucauccca

SEQ ID NO: 435374 - RNA, 17 nt, Homo sapiens
ucuuugccuuuaucucu

SEQ ID NO: 435375 - RNA, 16 nt, Homo sapiens
ucuuuggaacaacagc

SEQ ID NO: 435376 - RNA, 18 nt, Homo sapiens
ucuuuggcuucagaauug

SEQ ID NO: 435377 - RNA, 14 nt, Homo sapiens
ucuuugguuccuca

SEQ ID NO: 435378 - RNA, 21 nt, Homo sapiens
ucuuugguuccucauggcugu

SEQ ID NO: 435379 - RNA, 17 nt, Homo sapiens
ucuuugucaaugcucua

SEQ ID NO: 435380 - RNA, 18 nt, Homo sapiens
ucuuuguuuacaugaguu

SEQ ID NO: 435381 - RNA, 18 nt, Homo sapiens
ucuuuuaaugucaucucu

SEQ ID NO: 435382 - RNA, 16 nt, Homo sapiens
ucuuuuacauucugca

SEQ ID NO: 435383 - RNA, 14 nt, Homo sapiens
ucuuuucaaugugu

SEQ ID NO: 435384 - RNA, 15 nt, Homo sapiens
ucuuuucagcuuguu

SEQ ID NO: 435385 - RNA, 14 nt, Homo sapiens
ucuuuucauucuca

SEQ ID NO: 435386 - RNA, 10 nt, Homo sapiens
ucuuuuccau

SEQ ID NO: 435387 - RNA, 22 nt, Homo sapiens
ucuuuuccccucauugcauuua

SEQ ID NO: 435388 - RNA, 13 nt, Homo sapiens
ucuuuuuccuccc

SEQ ID NO: 435389 - RNA, 20 nt, Homo sapiens
ucuuuuuuuuuucgucuucc

SEQ ID NO: 435390 - RNA, 20 nt, Homo sapiens
ugaaaaaaaugaucuauugc

SEQ ID NO: 435391 - RNA, 14 nt, Homo sapiens
ugaaaaacauacau

SEQ ID NO: 435392 - RNA, 19 nt, Homo sapiens
ugaaaaagaacuguauuua

SEQ ID NO: 435393 - RNA, 21 nt, Homo sapiens
ugaaaaaggcaagccacagaa

SEQ ID NO: 435394 - RNA, 17 nt, Homo sapiens
ugaaaaauaaaaguaua

SEQ ID NO: 435395 - RNA, 21 nt, Homo sapiens
ugaaaaauaguguguccaugc

SEQ ID NO: 435396 - RNA, 16 nt, Homo sapiens
ugaaaaauuacagcuu

SEQ ID NO: 435397 - RNA, 12 nt, Homo sapiens
ugaaaacacugc

SEQ ID NO: 435398 - RNA, 12 nt, Homo sapiens
ugaaaacacuua

SEQ ID NO: 435399 - RNA, 16 nt, Homo sapiens
ugaaaacaucugcaca

SEQ ID NO: 435400 - RNA, 18 nt, Homo sapiens
ugaaaaccaacaccauca

SEQ ID NO: 435401 - RNA, 15 nt, Homo sapiens
ugaaaaccugcauuu

SEQ ID NO: 435402 - RNA, 13 nt, Homo sapiens
ugaaaacuucaaa

SEQ ID NO: 435403 - RNA, 14 nt, Homo sapiens
ugaaaagaguaugu

SEQ ID NO: 435404 - RNA, 16 nt, Homo sapiens
ugaaaaucacuauaac

SEQ ID NO: 435405 - RNA, 20 nt, Homo sapiens
ugaaaaugauaaaacagaau

SEQ ID NO: 435406 - RNA, 12 nt, Homo sapiens
ugaaaauguacu

SEQ ID NO: 435407 - RNA, 12 nt, Homo sapiens
ugaaaaugugac

SEQ ID NO: 435408 - RNA, 22 nt, Homo sapiens
ugaaaauuacacccaugcacag

SEQ ID NO: 435409 - RNA, 16 nt, Homo sapiens
ugaaaauucuugauaa

SEQ ID NO: 435410 - RNA, 16 nt, Homo sapiens
ugaaaauuuuacuucc

SEQ ID NO: 435411 - RNA, 14 nt, Homo sapiens
ugaaaccacuggaa

SEQ ID NO: 435412 - RNA, 14 nt, Homo sapiens
ugaaaccaugacug

SEQ ID NO: 435413 - RNA, 15 nt, Homo sapiens
ugaaaccgucccuga

SEQ ID NO: 435414 - RNA, 22 nt, Homo sapiens
ugaaacgcaaccaccaccaacc

SEQ ID NO: 435415 - RNA, 23 nt, Homo sapiens
ugaaacuaacagauaagcaagag

SEQ ID NO: 435416 - RNA, 14 nt, Homo sapiens
ugaaagaaccagag

SEQ ID NO: 435417 - RNA, 19 nt, Homo sapiens
ugaaagacaaagaaggaaa

SEQ ID NO: 435418 - RNA, 14 nt, Homo sapiens
ugaaagaccuucuc

SEQ ID NO: 435419 - RNA, 12 nt, Homo sapiens
ugaaagaugcaa

SEQ ID NO: 435420 - RNA, 19 nt, Homo sapiens
ugaaagaugcaagcaccug

SEQ ID NO: 435421 - RNA, 17 nt, Homo sapiens
ugaaaggcuuuccucag

SEQ ID NO: 435422 - RNA, 16 nt, Homo sapiens
ugaaaggucaucucau

SEQ ID NO: 435423 - RNA, 17 nt, Homo sapiens
ugaaagucaugcacaua

SEQ ID NO: 435424 - RNA, 13 nt, Homo sapiens
ugaaaguguaaaa

SEQ ID NO: 435425 - RNA, 19 nt, Homo sapiens
ugaaaguguuuuacucuuu

SEQ ID NO: 435426 - RNA, 18 nt, Homo sapiens
ugaaauaacauggccuug

SEQ ID NO: 435427 - RNA, 19 nt, Homo sapiens
ugaaauaauguacaucugg

SEQ ID NO: 435428 - RNA, 20 nt, Homo sapiens
ugaaauacgccagaacugcu

SEQ ID NO: 435429 - RNA, 22 nt, Homo sapiens
ugaaauacuuaaugccaaguaa

SEQ ID NO: 435430 - RNA, 21 nt, Homo sapiens
ugaaauagguguuaccuucuc

SEQ ID NO: 435431 - RNA, 20 nt, Homo sapiens
ugaaauauaaacugugagau

SEQ ID NO: 435432 - RNA, 19 nt, Homo sapiens
ugaaaucaccuuuucuaaa

SEQ ID NO: 435433 - RNA, 15 nt, Homo sapiens
ugaaaucucuagccu

SEQ ID NO: 435434 - RNA, 13 nt, Homo sapiens
ugaaaucuuuuaa

SEQ ID NO: 435435 - RNA, 16 nt, Homo sapiens
ugaaaugcuggcauuu

SEQ ID NO: 435436 - RNA, 18 nt, Homo sapiens
ugaaaugcuggcauuugc

SEQ ID NO: 435437 - RNA, 20 nt, Homo sapiens
ugaaauucaaguguaccugc

SEQ ID NO: 435438 - RNA, 13 nt, Homo sapiens
ugaaauugccaaa

SEQ ID NO: 435439 - RNA, 17 nt, Homo sapiens
ugaaauuuaaaauaagc

SEQ ID NO: 435440 - RNA, 19 nt, Homo sapiens
ugaaauuucccacacccca

SEQ ID NO: 435441 - RNA, 15 nt, Homo sapiens
ugaacacacucagca

SEQ ID NO: 435442 - RNA, 12 nt, Homo sapiens
ugaacacaggca

SEQ ID NO: 435443 - RNA, 18 nt, Homo sapiens
ugaacacauugugucaca

SEQ ID NO: 435444 - RNA, 20 nt, Homo sapiens
ugaacaugcaguucauuauu

SEQ ID NO: 435445 - RNA, 13 nt, Homo sapiens
ugaaccauuacug

SEQ ID NO: 435446 - RNA, 18 nt, Homo sapiens
ugaaccauuacuguaauu

SEQ ID NO: 435447 - RNA, 15 nt, Homo sapiens
ugaacccagaaggca

SEQ ID NO: 435448 - RNA, 17 nt, Homo sapiens
ugaacccauccaaugga

SEQ ID NO: 435449 - RNA, 15 nt, Homo sapiens
ugaacccuugugcuu

SEQ ID NO: 435450 - RNA, 19 nt, Homo sapiens
ugaaccugagguugcuuua

SEQ ID NO: 435451 - RNA, 21 nt, Homo sapiens
ugaacucgaagcccacaaucc

SEQ ID NO: 435452 - RNA, 15 nt, Homo sapiens
ugaacucuguaaaac

SEQ ID NO: 435453 - RNA, 17 nt, Homo sapiens
ugaacucuuucuggccu

SEQ ID NO: 435454 - RNA, 12 nt, Homo sapiens
ugaacugccaaa

SEQ ID NO: 435455 - RNA, 16 nt, Homo sapiens
ugaacuuucacauagc

SEQ ID NO: 435456 - RNA, 17 nt, Homo sapiens
ugaacuuucacauagca

SEQ ID NO: 435457 - RNA, 19 nt, Homo sapiens
ugaagaacacagcaugugc

SEQ ID NO: 435458 - RNA, 22 nt, Homo sapiens
ugaagaagaccagucacagcca

SEQ ID NO: 435459 - RNA, 17 nt, Homo sapiens
ugaagaauacacuguga

SEQ ID NO: 435460 - RNA, 16 nt, Homo sapiens
ugaagaauauuguuaa

SEQ ID NO: 435461 - RNA, 16 nt, Homo sapiens
ugaagaaugagcaaga

SEQ ID NO: 435462 - RNA, 20 nt, Homo sapiens
ugaagacccuggaguucaaa

SEQ ID NO: 435463 - RNA, 14 nt, Homo sapiens
ugaagagauuucaa

SEQ ID NO: 435464 - RNA, 15 nt, Homo sapiens
ugaagagcuauuaua

SEQ ID NO: 435465 - RNA, 23 nt, Homo sapiens
ugaagcaaacacacagacucugu

SEQ ID NO: 435466 - RNA, 16 nt, Homo sapiens
ugaagcaaaucagaaa

SEQ ID NO: 435467 - RNA, 11 nt, Homo sapiens
ugaagcacuuu

SEQ ID NO: 435468 - RNA, 15 nt, Homo sapiens
ugaagcagucuugcu

SEQ ID NO: 435469 - RNA, 16 nt, Homo sapiens
ugaagcagucuugcuc

SEQ ID NO: 435470 - RNA, 17 nt, Homo sapiens
ugaagcagucuugcucu

SEQ ID NO: 435471 - RNA, 20 nt, Homo sapiens
ugaagcaugcuuugcugcua

SEQ ID NO: 435472 - RNA, 22 nt, Homo sapiens
ugaagccucugcccugccuccc

SEQ ID NO: 435473 - RNA, 21 nt, Homo sapiens
ugaagcugggagaaccaaaaa

SEQ ID NO: 435474 - RNA, 14 nt, Homo sapiens
ugaaggcaaaucuc

SEQ ID NO: 435475 - RNA, 17 nt, Homo sapiens
ugaaggccaucaucucu

SEQ ID NO: 435476 - RNA, 14 nt, Homo sapiens
ugaaggcccaagag

SEQ ID NO: 435477 - RNA, 19 nt, Homo sapiens
ugaagggccccuugcaaag

SEQ ID NO: 435478 - RNA, 14 nt, Homo sapiens
ugaaggugaccucu

SEQ ID NO: 435479 - RNA, 13 nt, Homo sapiens
ugaaguacagucc

SEQ ID NO: 435480 - RNA, 15 nt, Homo sapiens
ugcaaauacuuccaa

SEQ ID NO: 435481 - RNA, 14 nt, Homo sapiens
ugcaacagcacuug

SEQ ID NO: 435482 - RNA, 17 nt, Homo sapiens
ugcaaccacacaccuca

SEQ ID NO: 435483 - RNA, 17 nt, Homo sapiens
ugcaaccucugccuccc

SEQ ID NO: 435484 - RNA, 21 nt, Homo sapiens
ugcaacucaaggacuuugcag

SEQ ID NO: 435485 - RNA, 16 nt, Homo sapiens
ugcaacuuagcucaca

SEQ ID NO: 435486 - RNA, 16 nt, Homo sapiens
ugcaacuucaugucaa

SEQ ID NO: 435487 - RNA, 17 nt, Homo sapiens
ugcaagagaaacugcag

SEQ ID NO: 435488 - RNA, 13 nt, Homo sapiens
ugcaagagaacaa

SEQ ID NO: 435489 - RNA, 16 nt, Homo sapiens
ugcaagggacugugug

SEQ ID NO: 435490 - RNA, 14 nt, Homo sapiens
ugcaagugagcaaa

SEQ ID NO: 435491 - RNA, 17 nt, Homo sapiens
ugcaaguggaugcauuc

SEQ ID NO: 435492 - RNA, 19 nt, Homo sapiens
ugcaagugucugugugcaa

SEQ ID NO: 435493 - RNA, 14 nt, Homo sapiens
ugcaagugugugca

SEQ ID NO: 435494 - RNA, 19 nt, Homo sapiens
ugcaagugugugcacaugu

SEQ ID NO: 435495 - RNA, 17 nt, Homo sapiens
ugcaagugugugcaugu

SEQ ID NO: 435496 - RNA, 21 nt, Homo sapiens
ugcaagugugugcaugugugc

SEQ ID NO: 435497 - RNA, 17 nt, Homo sapiens
ugcaauaucaacaacaa

SEQ ID NO: 435498 - RNA, 16 nt, Homo sapiens
ugcaauaugaauucaa

SEQ ID NO: 435499 - RNA, 16 nt, Homo sapiens
ugcaauccuuccaaau

SEQ ID NO: 435500 - RNA, 20 nt, Homo sapiens
ugcaaucugguugugauuua

SEQ ID NO: 435501 - RNA, 22 nt, Homo sapiens
ugcaaucugguugugauuuaua

SEQ ID NO: 435502 - RNA, 19 nt, Homo sapiens
ugcaaucuucuacuuuaag

SEQ ID NO: 435503 - RNA, 13 nt, Homo sapiens
ugcaaugucacaa

SEQ ID NO: 435504 - RNA, 14 nt, Homo sapiens
ugcaauuuccauuc

SEQ ID NO: 435505 - RNA, 14 nt, Homo sapiens
ugcacaagccaggg

SEQ ID NO: 435506 - RNA, 12 nt, Homo sapiens
ugcacacaccug

SEQ ID NO: 435507 - RNA, 19 nt, Homo sapiens
ugcacagcccaaccaggag

SEQ ID NO: 435508 - RNA, 11 nt, Homo sapiens
ugcacauauau

SEQ ID NO: 435509 - RNA, 24 nt, Homo sapiens
ugcacaugugugcgugugcgugca

SEQ ID NO: 435510 - RNA, 21 nt, Homo sapiens
ugcacauucucccuugauucc

SEQ ID NO: 435511 - RNA, 18 nt, Homo sapiens
ugcaccaacgagcuguac

SEQ ID NO: 435512 - RNA, 17 nt, Homo sapiens
ugcaccagugugacauc

SEQ ID NO: 435513 - RNA, 20 nt, Homo sapiens
ugcaccgugcagcccgccau

SEQ ID NO: 435514 - RNA, 17 nt, Homo sapiens
ugcaccugugcauucuc

SEQ ID NO: 435515 - RNA, 15 nt, Homo sapiens
ugcacgcccaugugu

SEQ ID NO: 435516 - RNA, 17 nt, Homo sapiens
ugcacguggccucuuga

SEQ ID NO: 435517 - RNA, 12 nt, Homo sapiens
ugcacgugugca

SEQ ID NO: 435518 - RNA, 13 nt, Homo sapiens
ugcacuacuccuc

SEQ ID NO: 435519 - RNA, 12 nt, Homo sapiens
ugcacuauagcc

SEQ ID NO: 435520 - RNA, 11 nt, Homo sapiens
ugcacuggccu

SEQ ID NO: 435521 - RNA, 16 nt, Homo sapiens
ugcacuguuugcccca

SEQ ID NO: 435522 - RNA, 15 nt, Homo sapiens
ugcacuuggccucug

SEQ ID NO: 435523 - RNA, 18 nt, Homo sapiens
ugcacuuuaaauggaaua

SEQ ID NO: 435524 - RNA, 19 nt, Homo sapiens
ugcagacaaaaagaacaaa

SEQ ID NO: 435525 - RNA, 13 nt, Homo sapiens
ugcagacacacaa

SEQ ID NO: 435526 - RNA, 17 nt, Homo sapiens
ugcagacauuuacaugu

SEQ ID NO: 435527 - RNA, 13 nt, Homo sapiens
ugcagacuggagg

SEQ ID NO: 435528 - RNA, 19 nt, Homo sapiens
ugcagagaaucuguaguca

SEQ ID NO: 435529 - RNA, 18 nt, Homo sapiens
ugcagcaaggggacaucu

SEQ ID NO: 435530 - RNA, 15 nt, Homo sapiens
ugcagcacucuuauc

SEQ ID NO: 435531 - RNA, 22 nt, Homo sapiens
ugcagcccagaacgggccuccc

SEQ ID NO: 435532 - RNA, 17 nt, Homo sapiens
ugcagccuuugccuccc

SEQ ID NO: 435533 - RNA, 23 nt, Homo sapiens
ugcagcugggccccaugcucugc

SEQ ID NO: 435534 - RNA, 16 nt, Homo sapiens
ugcaggccccagccaa

SEQ ID NO: 435535 - RNA, 22 nt, Homo sapiens
ugcagggaagccccacuugaag

SEQ ID NO: 435536 - RNA, 12 nt, Homo sapiens
ugcagggguccc

SEQ ID NO: 435537 - RNA, 17 nt, Homo sapiens
ugcagguuguugucauc

SEQ ID NO: 435538 - RNA, 17 nt, Homo sapiens
ugcaguagagagcaaag

SEQ ID NO: 435539 - RNA, 15 nt, Homo sapiens
ugcagucccuggaaa

SEQ ID NO: 435540 - RNA, 21 nt, Homo sapiens
ugcagucggugguaccugaga

SEQ ID NO: 435541 - RNA, 20 nt, Homo sapiens
ugcaguggcaccaucucagu

SEQ ID NO: 435542 - RNA, 13 nt, Homo sapiens
ugcagugucugug

SEQ ID NO: 435543 - RNA, 19 nt, Homo sapiens
ugcagugucugugauucug

SEQ ID NO: 435544 - RNA, 20 nt, Homo sapiens
ugcaguuccugaguaccuuc

SEQ ID NO: 435545 - RNA, 22 nt, Homo sapiens
ugcauaaauauuagcaaagcau

SEQ ID NO: 435546 - RNA, 21 nt, Homo sapiens
ugcaucauucuuucugcuaua

SEQ ID NO: 435547 - RNA, 21 nt, Homo sapiens
ugcauccuaucgaucuggaaa

SEQ ID NO: 435548 - RNA, 17 nt, Homo sapiens
ugcaugaaaccacugga

SEQ ID NO: 435549 - RNA, 13 nt, Homo sapiens
ugcaugaccugau

SEQ ID NO: 435550 - RNA, 16 nt, Homo sapiens
ugcaugauaagagcau

SEQ ID NO: 435551 - RNA, 16 nt, Homo sapiens
ugcaugcugucccuua

SEQ ID NO: 435552 - RNA, 14 nt, Homo sapiens
ugcauggaauuugu

SEQ ID NO: 435553 - RNA, 17 nt, Homo sapiens
ugcauguaauccuagca

SEQ ID NO: 435554 - RNA, 14 nt, Homo sapiens
ugcaugucucaggc

SEQ ID NO: 435555 - RNA, 16 nt, Homo sapiens
ugcaugugauuggcag

SEQ ID NO: 435556 - RNA, 16 nt, Homo sapiens
ugcaugugugugcuca

SEQ ID NO: 435557 - RNA, 18 nt, Homo sapiens
ugcauguuuuaugugcac

SEQ ID NO: 435558 - RNA, 15 nt, Homo sapiens
ugcauucguccuuag

SEQ ID NO: 435559 - RNA, 20 nt, Homo sapiens
ugcauuuauggucaacacuu

SEQ ID NO: 435560 - RNA, 14 nt, Homo sapiens
ugcauuucuuuauu

SEQ ID NO: 435561 - RNA, 22 nt, Homo sapiens
ugcauuugagaauaguuuuccc

SEQ ID NO: 435562 - RNA, 16 nt, Homo sapiens
ugcauuuuaucaaaug

SEQ ID NO: 435563 - RNA, 17 nt, Homo sapiens
ugccaaauccugggcau

SEQ ID NO: 435564 - RNA, 20 nt, Homo sapiens
ugccaaccggucacccagga

SEQ ID NO: 435565 - RNA, 17 nt, Homo sapiens
ugccaagacagugaagu

SEQ ID NO: 435566 - RNA, 24 nt, Homo sapiens
ugccaagcccucaauaagccagca

SEQ ID NO: 435567 - RNA, 20 nt, Homo sapiens
ugccaagggcagguugauca

SEQ ID NO: 435568 - RNA, 18 nt, Homo sapiens
ugccacaaugugauaugu

SEQ ID NO: 435569 - RNA, 14 nt, Homo sapiens
ugccacacaguggg

SEQ ID NO: 435570 - RNA, 22 nt, Homo sapiens
ugccacauggagcuugacuuca

SEQ ID NO: 435571 - RNA, 18 nt, Homo sapiens
ugccaccucucacacugg

SEQ ID NO: 435572 - RNA, 23 nt, Homo sapiens
ugccacgguccuuugagugucag

SEQ ID NO: 435573 - RNA, 19 nt, Homo sapiens
ugccacugcuuucauugaa

SEQ ID NO: 435574 - RNA, 22 nt, Homo sapiens
ugccagcauauacugaagucuu

SEQ ID NO: 435575 - RNA, 17 nt, Homo sapiens
ugccagccgugaugcuc

SEQ ID NO: 435576 - RNA, 24 nt, Homo sapiens
ugccaggaauguuucagcugcagu

SEQ ID NO: 435577 - RNA, 15 nt, Homo sapiens
ugccaggacugugac

SEQ ID NO: 435578 - RNA, 23 nt, Homo sapiens
ugccaggagcagccuccaagaaa

SEQ ID NO: 435579 - RNA, 21 nt, Homo sapiens
ugccaggagugggugggacac

SEQ ID NO: 435580 - RNA, 23 nt, Homo sapiens
ugccaggcucucccucucugcac

SEQ ID NO: 435581 - RNA, 22 nt, Homo sapiens
ugccaggcugaauuacagugaa

SEQ ID NO: 435582 - RNA, 14 nt, Homo sapiens
ugccaguccugcaa

SEQ ID NO: 435583 - RNA, 21 nt, Homo sapiens
ugccaguuccagcuucaucua

SEQ ID NO: 435584 - RNA, 21 nt, Homo sapiens
ugccauaaugacucagaauau

SEQ ID NO: 435585 - RNA, 17 nt, Homo sapiens
ugccaucgggugccaaa

SEQ ID NO: 435586 - RNA, 22 nt, Homo sapiens
ugccaucuguacauauuacugu

SEQ ID NO: 435587 - RNA, 15 nt, Homo sapiens
ugccaugcugcuaug

SEQ ID NO: 435588 - RNA, 12 nt, Homo sapiens
ugccauggauuu

SEQ ID NO: 435589 - RNA, 15 nt, Homo sapiens
ugccauguguuuauc

SEQ ID NO: 435590 - RNA, 14 nt, Homo sapiens
ugcccaaccucagc

SEQ ID NO: 435591 - RNA, 13 nt, Homo sapiens
ugcccaacuccca

SEQ ID NO: 435592 - RNA, 22 nt, Homo sapiens
ugcccaauaugcaguucugcag

SEQ ID NO: 435593 - RNA, 18 nt, Homo sapiens
ugcccaccacaacuaaca

SEQ ID NO: 435594 - RNA, 12 nt, Homo sapiens
gcuagucuuuca

SEQ ID NO: 435595 - RNA, 20 nt, Homo sapiens
gcuagugacuugugucccau

SEQ ID NO: 435596 - RNA, 18 nt, Homo sapiens
gcuaguucguagcuuucc

SEQ ID NO: 435597 - RNA, 19 nt, Homo sapiens
gcuauauaaauaaagcaaa

SEQ ID NO: 435598 - RNA, 15 nt, Homo sapiens
gcuauauccauguac

SEQ ID NO: 435599 - RNA, 18 nt, Homo sapiens
gcuauaugccuuaagcca

SEQ ID NO: 435600 - RNA, 18 nt, Homo sapiens
gcuaucccuucucagaaa

SEQ ID NO: 435601 - RNA, 17 nt, Homo sapiens
gcuauggacugcacaaa

SEQ ID NO: 435602 - RNA, 16 nt, Homo sapiens
gcuaugucugugaugu

SEQ ID NO: 435603 - RNA, 18 nt, Homo sapiens
gcuauuacuaguacuauu

SEQ ID NO: 435604 - RNA, 20 nt, Homo sapiens
gcuauuuguguguaugcuga

SEQ ID NO: 435605 - RNA, 17 nt, Homo sapiens
gcuauuuguucagagag

SEQ ID NO: 435606 - RNA, 20 nt, Homo sapiens
gcucaaaguacuacagcaaa

SEQ ID NO: 435607 - RNA, 23 nt, Homo sapiens
gcucaaguugaugaaucaugggg

SEQ ID NO: 435608 - RNA, 18 nt, Homo sapiens
gcucaauaaauguguguu

SEQ ID NO: 435609 - RNA, 19 nt, Homo sapiens
gcucacaguacaauguuuc

SEQ ID NO: 435610 - RNA, 23 nt, Homo sapiens
cucuggccaggauggaggggugg

SEQ ID NO: 435611 - RNA, 22 nt, Homo sapiens
cucuggcggcuuccuguccacu

SEQ ID NO: 435612 - RNA, 13 nt, Homo sapiens
cucuggcuucugu

SEQ ID NO: 435613 - RNA, 14 nt, Homo sapiens
cucugggagacuuu

SEQ ID NO: 435614 - RNA, 21 nt, Homo sapiens
cucuggggucuuuuuaugcau

SEQ ID NO: 435615 - RNA, 22 nt, Homo sapiens
cucuggguagguguugaaaaug

SEQ ID NO: 435616 - RNA, 18 nt, Homo sapiens
cucugguaaaugaucacu

SEQ ID NO: 435617 - RNA, 21 nt, Homo sapiens
cucugguccuucugaccccac

SEQ ID NO: 435618 - RNA, 23 nt, Homo sapiens
cucuggugggaaaauguccccca

SEQ ID NO: 435619 - RNA, 17 nt, Homo sapiens
cucugguuagaaaaagg

SEQ ID NO: 435620 - RNA, 18 nt, Homo sapiens
cucugguuagguuaggac

SEQ ID NO: 435621 - RNA, 17 nt, Homo sapiens
cucuguauaacuuguga

SEQ ID NO: 435622 - RNA, 14 nt, Homo sapiens
cucugucucaaaaa

SEQ ID NO: 435623 - RNA, 13 nt, Homo sapiens
cucugugcugcac

SEQ ID NO: 435624 - RNA, 15 nt, Homo sapiens
cucuguuguccuccc

SEQ ID NO: 435625 - RNA, 16 nt, Homo sapiens
cucuguuuucaugcua

SEQ ID NO: 435626 - RNA, 18 nt, Homo sapiens
cucuguuuucaugcuauu

SEQ ID NO: 435627 - RNA, 20 nt, Homo sapiens
cucuuaccgcgagacugaga

SEQ ID NO: 435628 - RNA, 12 nt, Homo sapiens
cucuuagcacac

SEQ ID NO: 435629 - RNA, 14 nt, Homo sapiens
cucuuaguagggac

SEQ ID NO: 435630 - RNA, 17 nt, Homo sapiens
cucuuauaaaaucaaua

SEQ ID NO: 435631 - RNA, 14 nt, Homo sapiens
cucuucaaggccaa

SEQ ID NO: 435632 - RNA, 20 nt, Homo sapiens
cucuucagagcaagcacugg

SEQ ID NO: 435633 - RNA, 13 nt, Homo sapiens
cucuucauuccca

SEQ ID NO: 435634 - RNA, 19 nt, Homo sapiens
cucuuccagaagaugcccu

SEQ ID NO: 435635 - RNA, 17 nt, Homo sapiens
cucuuccaggaagcaca

SEQ ID NO: 435636 - RNA, 14 nt, Homo sapiens
cucuucccaugacu

SEQ ID NO: 435637 - RNA, 19 nt, Homo sapiens
cucuucccccacuccucuu

SEQ ID NO: 435638 - RNA, 23 nt, Homo sapiens
cucuucuaaaaaaugauacacac

SEQ ID NO: 435639 - RNA, 13 nt, Homo sapiens
cucuucuugugaa

SEQ ID NO: 435640 - RNA, 20 nt, Homo sapiens
cucuugagggagcuuagcca

SEQ ID NO: 435641 - RNA, 22 nt, Homo sapiens
cucuugauucauaaugacuuaa

SEQ ID NO: 435642 - RNA, 13 nt, Homo sapiens
cucuugcacucaa

SEQ ID NO: 435643 - RNA, 11 nt, Homo sapiens
cucuugcuaau

SEQ ID NO: 435644 - RNA, 12 nt, Homo sapiens
cucuugcucaag

SEQ ID NO: 435645 - RNA, 14 nt, Homo sapiens
cucuuggcauuuuc

SEQ ID NO: 435646 - RNA, 13 nt, Homo sapiens
cucuuggguucaa

SEQ ID NO: 435647 - RNA, 18 nt, Homo sapiens
cucuuguauaugaugauc

SEQ ID NO: 435648 - RNA, 21 nt, Homo sapiens
cucuuguauaugaugaucugg

SEQ ID NO: 435649 - RNA, 15 nt, Homo sapiens
cucuuguccaauggg

SEQ ID NO: 435650 - RNA, 17 nt, Homo sapiens
cucuuguggugcauuga

SEQ ID NO: 435651 - RNA, 12 nt, Homo sapiens
cucuuuaacuuc

SEQ ID NO: 435652 - RNA, 12 nt, Homo sapiens
cucuuucaucaa

SEQ ID NO: 435653 - RNA, 12 nt, Homo sapiens
cucuuucaucua

SEQ ID NO: 435654 - RNA, 15 nt, Homo sapiens
cucuuuccacuuugu

SEQ ID NO: 435655 - RNA, 16 nt, Homo sapiens
cucuuuccugcccuuu

SEQ ID NO: 435656 - RNA, 15 nt, Homo sapiens
cucuuucuacucuga

SEQ ID NO: 435657 - RNA, 16 nt, Homo sapiens
cucuuucuucuuugaa

SEQ ID NO: 435658 - RNA, 18 nt, Homo sapiens
cucuuugacaauuccuag

SEQ ID NO: 435659 - RNA, 21 nt, Homo sapiens
cucuuugcccaguucauccca

SEQ ID NO: 435660 - RNA, 14 nt, Homo sapiens
cucuuuucaaugug

SEQ ID NO: 435661 - RNA, 20 nt, Homo sapiens
cucuuuuguuccuggcuuug

SEQ ID NO: 435662 - RNA, 13 nt, Homo sapiens
cugaaaaucaaua

SEQ ID NO: 435663 - RNA, 13 nt, Homo sapiens
cugaaaaucacua

SEQ ID NO: 435664 - RNA, 23 nt, Homo sapiens
cugaaaaucacuauaaccaucag

SEQ ID NO: 435665 - RNA, 13 nt, Homo sapiens
cugaaaauucaac

SEQ ID NO: 435666 - RNA, 20 nt, Homo sapiens
cugaaacauucacacagggc

SEQ ID NO: 435667 - RNA, 16 nt, Homo sapiens
cugaaacccaguaauu

SEQ ID NO: 435668 - RNA, 20 nt, Homo sapiens
auauaguaccuuugcucuug

SEQ ID NO: 435669 - RNA, 16 nt, Homo sapiens
auauauaguagcauuu

SEQ ID NO: 435670 - RNA, 13 nt, Homo sapiens
auauaucaaggau

SEQ ID NO: 435671 - RNA, 19 nt, Homo sapiens
auauauguauaauuucaca

SEQ ID NO: 435672 - RNA, 16 nt, Homo sapiens
auauauuaaauuugaa

SEQ ID NO: 435673 - RNA, 20 nt, Homo sapiens
auauauucuuuccaugcagu

SEQ ID NO: 435674 - RNA, 13 nt, Homo sapiens
auaucaacaacaa

SEQ ID NO: 435675 - RNA, 16 nt, Homo sapiens
auaucaccagucuuac

SEQ ID NO: 435676 - RNA, 14 nt, Homo sapiens
auaucagaguaugu

SEQ ID NO: 435677 - RNA, 20 nt, Homo sapiens
auaucccuuucucucuuguc

SEQ ID NO: 435678 - RNA, 20 nt, Homo sapiens
auaucuaucuauauauacau

SEQ ID NO: 435679 - RNA, 20 nt, Homo sapiens
auaucugaagagcuauuaua

SEQ ID NO: 435680 - RNA, 21 nt, Homo sapiens
auaucugacaguuacucuuca

SEQ ID NO: 435681 - RNA, 21 nt, Homo sapiens
auaucuuuaaauaaaugugag

SEQ ID NO: 435682 - RNA, 16 nt, Homo sapiens
auaucuuuauacuuaa

SEQ ID NO: 435683 - RNA, 20 nt, Homo sapiens
auaucuuugaccucaaugga

SEQ ID NO: 435684 - RNA, 13 nt, Homo sapiens
auaucuuugcacu

SEQ ID NO: 435685 - RNA, 17 nt, Homo sapiens
auaugaaaacuaaguuc

SEQ ID NO: 435686 - RNA, 19 nt, Homo sapiens
auaugagacguuuuuggaa

SEQ ID NO: 435687 - RNA, 18 nt, Homo sapiens
auaugagccuuugcacag

SEQ ID NO: 435688 - RNA, 12 nt, Homo sapiens
auaugauguuua

SEQ ID NO: 435689 - RNA, 21 nt, Homo sapiens
auaugcacaauagcaguugaa

SEQ ID NO: 435690 - RNA, 21 nt, Homo sapiens
auaugcacuuucccuagaaag

SEQ ID NO: 435691 - RNA, 16 nt, Homo sapiens
auauggagugccugua

SEQ ID NO: 435692 - RNA, 14 nt, Homo sapiens
auaugggaggaaca

SEQ ID NO: 435693 - RNA, 23 nt, Homo sapiens
auauggggggagugagcucucuc

SEQ ID NO: 435694 - RNA, 19 nt, Homo sapiens
auauguacaguuauacaua

SEQ ID NO: 435695 - RNA, 14 nt, Homo sapiens
auauguaccaugua

SEQ ID NO: 435696 - RNA, 23 nt, Homo sapiens
auauguagauugccuuuggcaau

SEQ ID NO: 435697 - RNA, 15 nt, Homo sapiens
auauguggaguucau

SEQ ID NO: 435698 - RNA, 19 nt, Homo sapiens
auaugugguuugguaguau

SEQ ID NO: 435699 - RNA, 13 nt, Homo sapiens
auauguugcugaa

SEQ ID NO: 435700 - RNA, 22 nt, Homo sapiens
auauguuugcauuaaaugcuuu

SEQ ID NO: 435701 - RNA, 22 nt, Homo sapiens
auauuaaauaaaugugcaugcu

SEQ ID NO: 435702 - RNA, 22 nt, Homo sapiens
auauuaauaaaacuuuauguac

SEQ ID NO: 435703 - RNA, 17 nt, Homo sapiens
auauuaauaugcaugcu

SEQ ID NO: 435704 - RNA, 20 nt, Homo sapiens
auauuauaucagacugcuuu

SEQ ID NO: 435705 - RNA, 18 nt, Homo sapiens
auauucaauaaagcugcu

SEQ ID NO: 435706 - RNA, 14 nt, Homo sapiens
auauuccagcagug

SEQ ID NO: 435707 - RNA, 18 nt, Homo sapiens
auauuccauccauauacu

SEQ ID NO: 435708 - RNA, 12 nt, Homo sapiens
auauucccaugg

SEQ ID NO: 435709 - RNA, 22 nt, Homo sapiens
auauucccaugguagacuguga

SEQ ID NO: 435710 - RNA, 20 nt, Homo sapiens
auauuccgggugccauuccc

SEQ ID NO: 435711 - RNA, 13 nt, Homo sapiens
auauuccuaugcu

SEQ ID NO: 435712 - RNA, 21 nt, Homo sapiens
auauuccugcauuugugaaau

SEQ ID NO: 435713 - RNA, 18 nt, Homo sapiens
auauucuauuaacuuuaa

SEQ ID NO: 435714 - RNA, 22 nt, Homo sapiens
auauugaaugaugugauacaaa

SEQ ID NO: 435715 - RNA, 22 nt, Homo sapiens
auauuuaaaaaaaaacauucaa

SEQ ID NO: 435716 - RNA, 16 nt, Homo sapiens
auauuuaagagauuaa

SEQ ID NO: 435717 - RNA, 16 nt, Homo sapiens
auauuuauaacucauc

SEQ ID NO: 435718 - RNA, 16 nt, Homo sapiens
auauuuauauugucac

SEQ ID NO: 435719 - RNA, 14 nt, Homo sapiens
auauuuauuuccag

SEQ ID NO: 435720 - RNA, 17 nt, Homo sapiens
auauuugaaagaaguca

SEQ ID NO: 435721 - RNA, 20 nt, Homo sapiens
auauuugugugaaaauguga

SEQ ID NO: 435722 - RNA, 14 nt, Homo sapiens
auauuuuagaagcu

SEQ ID NO: 435723 - RNA, 22 nt, Homo sapiens
auauuuuaucuugguaguacau

SEQ ID NO: 435724 - RNA, 23 nt, Homo sapiens
auauuuucauucacaacuaugaa

SEQ ID NO: 435725 - RNA, 22 nt, Homo sapiens
auauuuuuaguagagacagggu

SEQ ID NO: 435726 - RNA, 19 nt, Homo sapiens
auauuuuugguugucaaua

SEQ ID NO: 435727 - RNA, 21 nt, Homo sapiens
aucaaaaagguuucugcacau

SEQ ID NO: 435728 - RNA, 19 nt, Homo sapiens
aucaaaaauauuccaucca

SEQ ID NO: 435729 - RNA, 20 nt, Homo sapiens
aucaaaauaaaaagugacac

SEQ ID NO: 435730 - RNA, 13 nt, Homo sapiens
aucaaagcacuug

SEQ ID NO: 435731 - RNA, 14 nt, Homo sapiens
aucaaaucauucaa

SEQ ID NO: 435732 - RNA, 18 nt, Homo sapiens
aucaacaucuuggucaga

SEQ ID NO: 435733 - RNA, 22 nt, Homo sapiens
aucaacauguuuuugauauuug

SEQ ID NO: 435734 - RNA, 13 nt, Homo sapiens
aucaacuuuagcu

SEQ ID NO: 435735 - RNA, 24 nt, Homo sapiens
aucaacuuuagcuaguaucuucaa

SEQ ID NO: 435736 - RNA, 21 nt, Homo sapiens
aucaagaaaacagcaagggag

SEQ ID NO: 435737 - RNA, 19 nt, Homo sapiens
aucaaucuggcuucugcau

SEQ ID NO: 435738 - RNA, 11 nt, Homo sapiens
aucaaugucac

SEQ ID NO: 435739 - RNA, 13 nt, Homo sapiens
aucaaugucacuu

SEQ ID NO: 435740 - RNA, 14 nt, Homo sapiens
aucugaggcaaucu

SEQ ID NO: 435741 - RNA, 15 nt, Homo sapiens
aucugaggcaaucua

SEQ ID NO: 435742 - RNA, 15 nt, Homo sapiens
aucugauuaauccau

SEQ ID NO: 435743 - RNA, 14 nt, Homo sapiens
aucugcagcuaacu

SEQ ID NO: 435744 - RNA, 13 nt, Homo sapiens
aucugcaguggag

SEQ ID NO: 435745 - RNA, 19 nt, Homo sapiens
aucugcauuuagcacaaaa

SEQ ID NO: 435746 - RNA, 22 nt, Homo sapiens
aucugcuguuccuucgaggguu

SEQ ID NO: 435747 - RNA, 19 nt, Homo sapiens
aucugggcaaaugaaaaug

SEQ ID NO: 435748 - RNA, 17 nt, Homo sapiens
aucugguguucuugcua

SEQ ID NO: 435749 - RNA, 15 nt, Homo sapiens
aucugguugugauuu

SEQ ID NO: 435750 - RNA, 22 nt, Homo sapiens
aucuguaaauuuaacugcauau

SEQ ID NO: 435751 - RNA, 16 nt, Homo sapiens
aucuguaacccuugaa

SEQ ID NO: 435752 - RNA, 14 nt, Homo sapiens
aucugucauucaag

SEQ ID NO: 435753 - RNA, 13 nt, Homo sapiens
aucugucuguccu

SEQ ID NO: 435754 - RNA, 14 nt, Homo sapiens
aucugugaagccuu

SEQ ID NO: 435755 - RNA, 17 nt, Homo sapiens
aucugugccccaugccu

SEQ ID NO: 435756 - RNA, 18 nt, Homo sapiens
aucuguuagaugcuacua

SEQ ID NO: 435757 - RNA, 15 nt, Homo sapiens
aucuguucacuuuuc

SEQ ID NO: 435758 - RNA, 16 nt, Homo sapiens
aucuguuugaacacuu

SEQ ID NO: 435759 - RNA, 19 nt, Homo sapiens
aucuguuugauacaguauu

SEQ ID NO: 435760 - RNA, 14 nt, Homo sapiens
aucuuaaaugccag

SEQ ID NO: 435761 - RNA, 22 nt, Homo sapiens
aucuuaauuuuuuuuaauguac

SEQ ID NO: 435762 - RNA, 22 nt, Homo sapiens
aucuuaccagaugcuacuggac

SEQ ID NO: 435763 - RNA, 23 nt, Homo sapiens
aucuuaccagaugcuacuggacu

SEQ ID NO: 435764 - RNA, 15 nt, Homo sapiens
aucuuagacauuuau

SEQ ID NO: 435765 - RNA, 20 nt, Homo sapiens
aucuuagacccgguccugcc

SEQ ID NO: 435766 - RNA, 17 nt, Homo sapiens
aucuuaucauggucuca

SEQ ID NO: 435767 - RNA, 20 nt, Homo sapiens
aucuuaucauggucucaguc

SEQ ID NO: 435768 - RNA, 24 nt, Homo sapiens
aucuuauuugucaguguagaucaa

SEQ ID NO: 435769 - RNA, 15 nt, Homo sapiens
aucuucaaacuuuca

SEQ ID NO: 435770 - RNA, 19 nt, Homo sapiens
aucuucaaagcuugaagau

SEQ ID NO: 435771 - RNA, 11 nt, Homo sapiens
aucuucaauga

SEQ ID NO: 435772 - RNA, 22 nt, Homo sapiens
aucuucaaugaacugugcuuuu

SEQ ID NO: 435773 - RNA, 17 nt, Homo sapiens
aucuuccauaugcucuu

SEQ ID NO: 435774 - RNA, 20 nt, Homo sapiens
aucuucuaucaaagcacaua

SEQ ID NO: 435775 - RNA, 21 nt, Homo sapiens
aucuugaauuguaaggaauga

SEQ ID NO: 435776 - RNA, 22 nt, Homo sapiens
aucuugcaucuaccugcuccuu

SEQ ID NO: 435777 - RNA, 17 nt, Homo sapiens
aucuugcuuuuuuucac

SEQ ID NO: 435778 - RNA, 19 nt, Homo sapiens
aucuuggacugacauuuag

SEQ ID NO: 435779 - RNA, 23 nt, Homo sapiens
aucuuggccaggcuggucuugaa

SEQ ID NO: 435780 - RNA, 16 nt, Homo sapiens
aucuuggcucacuaca

SEQ ID NO: 435781 - RNA, 13 nt, Homo sapiens
aucuuuaacuuag

SEQ ID NO: 435782 - RNA, 22 nt, Homo sapiens
aucuuuaacuuaguauuuuacc

SEQ ID NO: 435783 - RNA, 19 nt, Homo sapiens
aucuuuauuuuauuauuca

SEQ ID NO: 435784 - RNA, 14 nt, Homo sapiens
aucuuuccaucuca

SEQ ID NO: 435785 - RNA, 19 nt, Homo sapiens
aucuuuccaucucauuaca

SEQ ID NO: 435786 - RNA, 17 nt, Homo sapiens
aucuuucccaaaaccca

SEQ ID NO: 435787 - RNA, 19 nt, Homo sapiens
aucuuugcaagaaagucag

SEQ ID NO: 435788 - RNA, 18 nt, Homo sapiens
aucuuugccuuuaucucu

SEQ ID NO: 435789 - RNA, 23 nt, Homo sapiens
aucuuuuaguuuuaguugcagaa

SEQ ID NO: 435790 - RNA, 15 nt, Homo sapiens
aucuuuucauucuca

SEQ ID NO: 435791 - RNA, 21 nt, Homo sapiens
augaaaaaaaucuuugcuugu

SEQ ID NO: 435792 - RNA, 17 nt, Homo sapiens
augaaaaaaaugaucua

SEQ ID NO: 435793 - RNA, 13 nt, Homo sapiens
augaaaaugucag

SEQ ID NO: 435794 - RNA, 18 nt, Homo sapiens
augaaacaaauaaucaca

SEQ ID NO: 435795 - RNA, 19 nt, Homo sapiens
augaaaugauaaagauguc

SEQ ID NO: 435796 - RNA, 20 nt, Homo sapiens
augaaauuguaaaaccuguc

SEQ ID NO: 435797 - RNA, 15 nt, Homo sapiens
augaacucuuaauca

SEQ ID NO: 435798 - RNA, 13 nt, Homo sapiens
augaacugccaaa

SEQ ID NO: 435799 - RNA, 14 nt, Homo sapiens
augaacugccaaag

SEQ ID NO: 435800 - RNA, 19 nt, Homo sapiens
augaacuuaacaugcugug

SEQ ID NO: 435801 - RNA, 22 nt, Homo sapiens
augaagaacacagcaugugcca

SEQ ID NO: 435802 - RNA, 13 nt, Homo sapiens
cugccccaucucc

SEQ ID NO: 435803 - RNA, 21 nt, Homo sapiens
cugccccccuucccaccccua

SEQ ID NO: 435804 - RNA, 18 nt, Homo sapiens
cugccccgaaagugcuga

SEQ ID NO: 435805 - RNA, 15 nt, Homo sapiens
cugccccugccccug

SEQ ID NO: 435806 - RNA, 15 nt, Homo sapiens
cugcccgagagcucu

SEQ ID NO: 435807 - RNA, 19 nt, Homo sapiens
cugccggucccccaugcca

SEQ ID NO: 435808 - RNA, 16 nt, Homo sapiens
cugccuaaaauaugau

SEQ ID NO: 435809 - RNA, 16 nt, Homo sapiens
cugccuagcacucaca

SEQ ID NO: 435810 - RNA, 20 nt, Homo sapiens
cugccuccaggagggcauca

SEQ ID NO: 435811 - RNA, 15 nt, Homo sapiens
cugccuccucuucaa

SEQ ID NO: 435812 - RNA, 18 nt, Homo sapiens
cugccucuaaggccaagg

SEQ ID NO: 435813 - RNA, 15 nt, Homo sapiens
cugccugaacaaagg

SEQ ID NO: 435814 - RNA, 15 nt, Homo sapiens
cugccugacacugag

SEQ ID NO: 435815 - RNA, 16 nt, Homo sapiens
cugccugagggccccu

SEQ ID NO: 435816 - RNA, 12 nt, Homo sapiens
cugccuguaacu

SEQ ID NO: 435817 - RNA, 14 nt, Homo sapiens
cugccugugcauga

SEQ ID NO: 435818 - RNA, 15 nt, Homo sapiens
cugccuuacagacag

SEQ ID NO: 435819 - RNA, 16 nt, Homo sapiens
cugccuucaccccacu

SEQ ID NO: 435820 - RNA, 17 nt, Homo sapiens
cugccuuguccugaugc

SEQ ID NO: 435821 - RNA, 14 nt, Homo sapiens
cugccuuguguaca

SEQ ID NO: 435822 - RNA, 14 nt, Homo sapiens
cugcgaugcaaugc

SEQ ID NO: 435823 - RNA, 22 nt, Homo sapiens
cugcgcugguugaaaaauggca

SEQ ID NO: 435824 - RNA, 20 nt, Homo sapiens
cugcggcacccuugcgcuuu

SEQ ID NO: 435825 - RNA, 20 nt, Homo sapiens
cugcguucugauagaugggg

SEQ ID NO: 435826 - RNA, 14 nt, Homo sapiens
cugcguucuuucaa

SEQ ID NO: 435827 - RNA, 15 nt, Homo sapiens
cugcuacaacuucag

SEQ ID NO: 435828 - RNA, 17 nt, Homo sapiens
cugcuacuuaauuccuu

SEQ ID NO: 435829 - RNA, 23 nt, Homo sapiens
cugcuagcaaauggcagaaccaa

SEQ ID NO: 435830 - RNA, 17 nt, Homo sapiens
cugcuaggcgcugggga

SEQ ID NO: 435831 - RNA, 23 nt, Homo sapiens
cugcuauaauucuauacuguuga

SEQ ID NO: 435832 - RNA, 18 nt, Homo sapiens
cugcucaaugaaaccuuc

SEQ ID NO: 435833 - RNA, 14 nt, Homo sapiens
cugcuccaccacau

SEQ ID NO: 435834 - RNA, 16 nt, Homo sapiens
cugcuccagugcagga

SEQ ID NO: 435835 - RNA, 22 nt, Homo sapiens
cugcuccaugcagaucuagcca

SEQ ID NO: 435836 - RNA, 19 nt, Homo sapiens
cugcuccauggaugcaugc

SEQ ID NO: 435837 - RNA, 19 nt, Homo sapiens
cugcuccgugugucucaug

SEQ ID NO: 435838 - RNA, 17 nt, Homo sapiens
cugcuccuacaagggaa

SEQ ID NO: 435839 - RNA, 20 nt, Homo sapiens
cugcucuagaggcccaagcu

SEQ ID NO: 435840 - RNA, 17 nt, Homo sapiens
cugcucuccuugcccug

SEQ ID NO: 435841 - RNA, 18 nt, Homo sapiens
cugcucugaacacgaagc

SEQ ID NO: 435842 - RNA, 14 nt, Homo sapiens
cugcucugcuauau

SEQ ID NO: 435843 - RNA, 22 nt, Homo sapiens
cugcucuguaggucauuggcca

SEQ ID NO: 435844 - RNA, 18 nt, Homo sapiens
cugcugagugcaccacuu

SEQ ID NO: 435845 - RNA, 15 nt, Homo sapiens
cugcugccccaaagg

SEQ ID NO: 435846 - RNA, 16 nt, Homo sapiens
cugcugcuccagugca

SEQ ID NO: 435847 - RNA, 20 nt, Homo sapiens
cugcuggagaggaacccaga

SEQ ID NO: 435848 - RNA, 15 nt, Homo sapiens
cugcuggaugucacc

SEQ ID NO: 435849 - RNA, 21 nt, Homo sapiens
cugcuggaugucaccaagaag

SEQ ID NO: 435850 - RNA, 20 nt, Homo sapiens
cugcugguaauuuguaucug

SEQ ID NO: 435851 - RNA, 11 nt, Homo sapiens
cugcuggugag

SEQ ID NO: 435852 - RNA, 21 nt, Homo sapiens
cugcuguggcgugagggugag

SEQ ID NO: 435853 - RNA, 12 nt, Homo sapiens
cugcuguugcca

SEQ ID NO: 435854 - RNA, 21 nt, Homo sapiens
cugcuucaguccacaguacau

SEQ ID NO: 435855 - RNA, 16 nt, Homo sapiens
cugcuucugugcauuu

SEQ ID NO: 435856 - RNA, 20 nt, Homo sapiens
cugcuugaccguacucucac

SEQ ID NO: 435857 - RNA, 20 nt, Homo sapiens
cugcuugagucagguuugag

SEQ ID NO: 435858 - RNA, 20 nt, Homo sapiens
cugcuuucuuguugcugcau

SEQ ID NO: 435859 - RNA, 21 nt, Homo sapiens
cugcuuucuuguugcugcauc

SEQ ID NO: 435860 - RNA, 21 nt, Homo sapiens
cugcuuuguuuggaugccuca

SEQ ID NO: 435861 - RNA, 16 nt, Homo sapiens
cuggaaaacucaggau

SEQ ID NO: 435862 - RNA, 22 nt, Homo sapiens
cuggaaaccacacuucuugaaa

SEQ ID NO: 435863 - RNA, 21 nt, Homo sapiens
cuggaaagcaggcaagcaugu

SEQ ID NO: 435864 - RNA, 20 nt, Homo sapiens
cuggaaaggaggaaggagcc

SEQ ID NO: 435865 - RNA, 13 nt, Homo sapiens
cuggaaauaaccu

SEQ ID NO: 435866 - RNA, 22 nt, Homo sapiens
cuggaagaucagcacccuaaga

SEQ ID NO: 435867 - RNA, 15 nt, Homo sapiens
cuggaagucaucuca

SEQ ID NO: 435868 - RNA, 15 nt, Homo sapiens
cuggaaugcauucac

SEQ ID NO: 435869 - RNA, 20 nt, Homo sapiens
cuggaauguaaucaauguuu

SEQ ID NO: 435870 - RNA, 17 nt, Homo sapiens
augauugcuagccagca

SEQ ID NO: 435871 - RNA, 16 nt, Homo sapiens
augauugugaccucca

SEQ ID NO: 435872 - RNA, 20 nt, Homo sapiens
augauuguuugaaagucugu

SEQ ID NO: 435873 - RNA, 13 nt, Homo sapiens
augauuucagaaa

SEQ ID NO: 435874 - RNA, 21 nt, Homo sapiens
augauuugggggaggcuuugg

SEQ ID NO: 435875 - RNA, 14 nt, Homo sapiens
augauuuuauuuga

SEQ ID NO: 435876 - RNA, 16 nt, Homo sapiens
augauuuuggccacuu

SEQ ID NO: 435877 - RNA, 20 nt, Homo sapiens
augcaaagaacucaccacaa

SEQ ID NO: 435878 - RNA, 17 nt, Homo sapiens
augcaagcucagggugc

SEQ ID NO: 435879 - RNA, 16 nt, Homo sapiens
augcaauccuuccaaa

SEQ ID NO: 435880 - RNA, 20 nt, Homo sapiens
augcacacacacacaucuca

SEQ ID NO: 435881 - RNA, 14 nt, Homo sapiens
augcacacaguagg

SEQ ID NO: 435882 - RNA, 19 nt, Homo sapiens
augcacagaguccuuaaaa

SEQ ID NO: 435883 - RNA, 13 nt, Homo sapiens
augcacagauuaa

SEQ ID NO: 435884 - RNA, 20 nt, Homo sapiens
augcacagauuaaacuucac

SEQ ID NO: 435885 - RNA, 18 nt, Homo sapiens
augcacagcuaacaugga

SEQ ID NO: 435886 - RNA, 18 nt, Homo sapiens
augcacaggggaaggaaa

SEQ ID NO: 435887 - RNA, 15 nt, Homo sapiens
augcacaggggccca

SEQ ID NO: 435888 - RNA, 17 nt, Homo sapiens
augcacauagcuaucaa

SEQ ID NO: 435889 - RNA, 14 nt, Homo sapiens
augcacguagcuga

SEQ ID NO: 435890 - RNA, 23 nt, Homo sapiens
augcacgugugcacacacaccac

SEQ ID NO: 435891 - RNA, 16 nt, Homo sapiens
augcagaaauguggau

SEQ ID NO: 435892 - RNA, 12 nt, Homo sapiens
augcagacacac

SEQ ID NO: 435893 - RNA, 20 nt, Homo sapiens
augcagcaaggggacaucuu

SEQ ID NO: 435894 - RNA, 15 nt, Homo sapiens
augcagcagcuugcu

SEQ ID NO: 435895 - RNA, 13 nt, Homo sapiens
augcagcauacaa

SEQ ID NO: 435896 - RNA, 16 nt, Homo sapiens
augcaguuuuccuuaa

SEQ ID NO: 435897 - RNA, 20 nt, Homo sapiens
augcauaaaagacaagcacu

SEQ ID NO: 435898 - RNA, 18 nt, Homo sapiens
augcauauccugagccau

SEQ ID NO: 435899 - RNA, 18 nt, Homo sapiens
augcauauugcccuggag

SEQ ID NO: 435900 - RNA, 22 nt, Homo sapiens
augcaugagcucccucgcugua

SEQ ID NO: 435901 - RNA, 18 nt, Homo sapiens
augcauucacaaggugac

SEQ ID NO: 435902 - RNA, 18 nt, Homo sapiens
augcauugaaagaauuag

SEQ ID NO: 435903 - RNA, 15 nt, Homo sapiens
augcauugcuaaaau

SEQ ID NO: 435904 - RNA, 23 nt, Homo sapiens
augccaaacaguuguaccacugc

SEQ ID NO: 435905 - RNA, 18 nt, Homo sapiens
augccaaccggucaccca

SEQ ID NO: 435906 - RNA, 18 nt, Homo sapiens
augccagcauauacugaa

SEQ ID NO: 435907 - RNA, 13 nt, Homo sapiens
augccagcuauaa

SEQ ID NO: 435908 - RNA, 20 nt, Homo sapiens
augccagugggcagugcaug

SEQ ID NO: 435909 - RNA, 16 nt, Homo sapiens
augccaucuguguccu

SEQ ID NO: 435910 - RNA, 20 nt, Homo sapiens
augcccucaggggacuugaa

SEQ ID NO: 435911 - RNA, 13 nt, Homo sapiens
augccguggauug

SEQ ID NO: 435912 - RNA, 21 nt, Homo sapiens
augccuagacuucccaacagc

SEQ ID NO: 435913 - RNA, 15 nt, Homo sapiens
augccuauuuacugg

SEQ ID NO: 435914 - RNA, 19 nt, Homo sapiens
augccucagccuacuuuca

SEQ ID NO: 435915 - RNA, 14 nt, Homo sapiens
augccugccucaaa

SEQ ID NO: 435916 - RNA, 18 nt, Homo sapiens
augccuguaacccuggca

SEQ ID NO: 435917 - RNA, 18 nt, Homo sapiens
augccuuuaaaucuguga

SEQ ID NO: 435918 - RNA, 23 nt, Homo sapiens
augcuaucucgcuagccauauau

SEQ ID NO: 435919 - RNA, 18 nt, Homo sapiens
augcucaguuggugcugc

SEQ ID NO: 435920 - RNA, 23 nt, Homo sapiens
augcucaguuggugcugcuuucu

SEQ ID NO: 435921 - RNA, 13 nt, Homo sapiens
augcucauaccuc

SEQ ID NO: 435922 - RNA, 16 nt, Homo sapiens
augcuccuccugauga

SEQ ID NO: 435923 - RNA, 17 nt, Homo sapiens
augcucuccaaaccacu

SEQ ID NO: 435924 - RNA, 19 nt, Homo sapiens
augcucugccccaagcccc

SEQ ID NO: 435925 - RNA, 15 nt, Homo sapiens
augcucugugccaga

SEQ ID NO: 435926 - RNA, 14 nt, Homo sapiens
augcugaccugugu

SEQ ID NO: 435927 - RNA, 16 nt, Homo sapiens
augcugcacaccaguu

SEQ ID NO: 435928 - RNA, 14 nt, Homo sapiens
augcugccuaggcu

SEQ ID NO: 435929 - RNA, 17 nt, Homo sapiens
augcugcuggacaguau

SEQ ID NO: 435930 - RNA, 20 nt, Homo sapiens
augcuggcucccagggccau

SEQ ID NO: 435931 - RNA, 17 nt, Homo sapiens
augcugguuaaggugaa

SEQ ID NO: 435932 - RNA, 15 nt, Homo sapiens
augcugugcuaugaa

SEQ ID NO: 435933 - RNA, 20 nt, Homo sapiens
augcugugcucaaucagccu

SEQ ID NO: 435934 - RNA, 18 nt, Homo sapiens
augcuguggucacagggg

SEQ ID NO: 435935 - RNA, 19 nt, Homo sapiens
augcuguuuuauauguaga

SEQ ID NO: 435936 - RNA, 14 nt, Homo sapiens
cuggguguguuuca

SEQ ID NO: 435937 - RNA, 20 nt, Homo sapiens
cuggguuaauggcuaguacu

SEQ ID NO: 435938 - RNA, 16 nt, Homo sapiens
cugguaaccuguggug

SEQ ID NO: 435939 - RNA, 19 nt, Homo sapiens
cugguaauuuguaucugaa

SEQ ID NO: 435940 - RNA, 22 nt, Homo sapiens
cugguacaucgaggcucuugcu

SEQ ID NO: 435941 - RNA, 15 nt, Homo sapiens
cugguauguguggau

SEQ ID NO: 435942 - RNA, 19 nt, Homo sapiens
cuggucaacuugagcaugu

SEQ ID NO: 435943 - RNA, 21 nt, Homo sapiens
cuggucacccccacccccggg

SEQ ID NO: 435944 - RNA, 20 nt, Homo sapiens
cugguccuucugaccccacu

SEQ ID NO: 435945 - RNA, 16 nt, Homo sapiens
cuggucucgaacuccu

SEQ ID NO: 435946 - RNA, 14 nt, Homo sapiens
cuggucugaaaaug

SEQ ID NO: 435947 - RNA, 16 nt, Homo sapiens
cuggucuuggugaaca

SEQ ID NO: 435948 - RNA, 15 nt, Homo sapiens
cuggugagaggugca

SEQ ID NO: 435949 - RNA, 19 nt, Homo sapiens
cugguggcccgacagccug

SEQ ID NO: 435950 - RNA, 13 nt, Homo sapiens
cugguuagguaga

SEQ ID NO: 435951 - RNA, 17 nt, Homo sapiens
cugguucuguacaugug

SEQ ID NO: 435952 - RNA, 13 nt, Homo sapiens
cugguucuugccu

SEQ ID NO: 435953 - RNA, 16 nt, Homo sapiens
cugguugccaaauacu

SEQ ID NO: 435954 - RNA, 22 nt, Homo sapiens
cugguugcugggccucauucua

SEQ ID NO: 435955 - RNA, 15 nt, Homo sapiens
cugguuuaauuacau

SEQ ID NO: 435956 - RNA, 15 nt, Homo sapiens
cugguuugaaagccu

SEQ ID NO: 435957 - RNA, 13 nt, Homo sapiens
cugguuugacuca

SEQ ID NO: 435958 - RNA, 12 nt, Homo sapiens
cugguuuuaaca

SEQ ID NO: 435959 - RNA, 21 nt, Homo sapiens
cugguuuugacaucagcauua

SEQ ID NO: 435960 - RNA, 15 nt, Homo sapiens
cuguaaaauggaaaa

SEQ ID NO: 435961 - RNA, 14 nt, Homo sapiens
cuguaaacauucau

SEQ ID NO: 435962 - RNA, 14 nt, Homo sapiens
cuguaaauaaccua

SEQ ID NO: 435963 - RNA, 14 nt, Homo sapiens
cuguaaaugaacac

SEQ ID NO: 435964 - RNA, 21 nt, Homo sapiens
cuguaaaugaagggucauuuc

SEQ ID NO: 435965 - RNA, 23 nt, Homo sapiens
cuguaacccuggcacuuaagggg

SEQ ID NO: 435966 - RNA, 19 nt, Homo sapiens
cuguaacucagacauucca

SEQ ID NO: 435967 - RNA, 14 nt, Homo sapiens
cuguaagauugucc

SEQ ID NO: 435968 - RNA, 20 nt, Homo sapiens
cuguaagauuuuauuuucaa

SEQ ID NO: 435969 - RNA, 13 nt, Homo sapiens
cuguaagcauucu

SEQ ID NO: 435970 - RNA, 21 nt, Homo sapiens
cuguaaucccagcacuuuggg

SEQ ID NO: 435971 - RNA, 21 nt, Homo sapiens
cuguaaucucagcacuuuggg

SEQ ID NO: 435972 - RNA, 15 nt, Homo sapiens
cuguacaagcugaug

SEQ ID NO: 435973 - RNA, 19 nt, Homo sapiens
cuguacacugacuugagac

SEQ ID NO: 435974 - RNA, 13 nt, Homo sapiens
cuguaccauuuau

SEQ ID NO: 435975 - RNA, 15 nt, Homo sapiens
cuguacuaauacagc

SEQ ID NO: 435976 - RNA, 13 nt, Homo sapiens
cuguacugaggaa

SEQ ID NO: 435977 - RNA, 11 nt, Homo sapiens
cuguagacuua

SEQ ID NO: 435978 - RNA, 17 nt, Homo sapiens
cuguagagccagccuug

SEQ ID NO: 435979 - RNA, 15 nt, Homo sapiens
cuguagagccauuua

SEQ ID NO: 435980 - RNA, 15 nt, Homo sapiens
cuguaggacuauaua

SEQ ID NO: 435981 - RNA, 17 nt, Homo sapiens
cuguaguaaauggcaau

SEQ ID NO: 435982 - RNA, 17 nt, Homo sapiens
cuguauaaaaugcaaaa

SEQ ID NO: 435983 - RNA, 16 nt, Homo sapiens
cuguauaaacacaauc

SEQ ID NO: 435984 - RNA, 13 nt, Homo sapiens
cuguauacuguac

SEQ ID NO: 435985 - RNA, 13 nt, Homo sapiens
cuguaugucuuau

SEQ ID NO: 435986 - RNA, 13 nt, Homo sapiens
cuguauuacauaa

SEQ ID NO: 435987 - RNA, 15 nt, Homo sapiens
cuguauuuauuuuag

SEQ ID NO: 435988 - RNA, 21 nt, Homo sapiens
cuguauuuucgggauucuuug

SEQ ID NO: 435989 - RNA, 20 nt, Homo sapiens
cuguauuuugccagacuuaa

SEQ ID NO: 435990 - RNA, 19 nt, Homo sapiens
cugucaaguuaacaaggaa

SEQ ID NO: 435991 - RNA, 18 nt, Homo sapiens
cugucaauaaacagcuuc

SEQ ID NO: 435992 - RNA, 12 nt, Homo sapiens
cugucacaccca

SEQ ID NO: 435993 - RNA, 13 nt, Homo sapiens
cugucaccaagga

SEQ ID NO: 435994 - RNA, 11 nt, Homo sapiens
cugucaggcag

SEQ ID NO: 435995 - RNA, 23 nt, Homo sapiens
cugucaggcaguagcagcugugu

SEQ ID NO: 435996 - RNA, 15 nt, Homo sapiens
cugucagucguguug

SEQ ID NO: 435997 - RNA, 12 nt, Homo sapiens
cugucagugucc

SEQ ID NO: 435998 - RNA, 16 nt, Homo sapiens
cugucaguguccucag

SEQ ID NO: 435999 - RNA, 19 nt, Homo sapiens
cuguccaggaacuuuccag

SEQ ID NO: 436000 - RNA, 21 nt, Homo sapiens
cugucccgccuuccuccucca

SEQ ID NO: 436001 - RNA, 20 nt, Homo sapiens
gaagacacgagcgaaugauu

SEQ ID NO: 436002 - RNA, 17 nt, Homo sapiens
gaagaccacacuuggug

SEQ ID NO: 436003 - RNA, 11 nt, Homo sapiens
gaagaccagcu

SEQ ID NO: 436004 - RNA, 21 nt, Homo sapiens
gaagaccaguccuguuugcag

SEQ ID NO: 436005 - RNA, 17 nt, Homo sapiens
gaagacccgcucuccau

SEQ ID NO: 436006 - RNA, 23 nt, Homo sapiens
gaagaccuccacauuaaguggcu

SEQ ID NO: 436007 - RNA, 17 nt, Homo sapiens
gaagagagagacccuca

SEQ ID NO: 436008 - RNA, 16 nt, Homo sapiens
gaagagaggaguucaa

SEQ ID NO: 436009 - RNA, 21 nt, Homo sapiens
gaagagaggaguucaaugauc

SEQ ID NO: 436010 - RNA, 14 nt, Homo sapiens
gaagagaugcucua

SEQ ID NO: 436011 - RNA, 22 nt, Homo sapiens
gaagagcauccggcaugagggc

SEQ ID NO: 436012 - RNA, 15 nt, Homo sapiens
gaagaggcugcugag

SEQ ID NO: 436013 - RNA, 17 nt, Homo sapiens
gaagaguuuacagacaa

SEQ ID NO: 436014 - RNA, 19 nt, Homo sapiens
gaagaguuuacagacaaua

SEQ ID NO: 436015 - RNA, 16 nt, Homo sapiens
gaagcaccuaaaugau

SEQ ID NO: 436016 - RNA, 17 nt, Homo sapiens
gaagcagagcacugugu

SEQ ID NO: 436017 - RNA, 16 nt, Homo sapiens
gaagcagccuccacuu

SEQ ID NO: 436018 - RNA, 15 nt, Homo sapiens
gaagcagugccuucc

SEQ ID NO: 436019 - RNA, 21 nt, Homo sapiens
gaagcagugucgccgucccuc

SEQ ID NO: 436020 - RNA, 23 nt, Homo sapiens
gaagcaucugucuugucauucca

SEQ ID NO: 436021 - RNA, 22 nt, Homo sapiens
gaagccaagucagcuuugccuu

SEQ ID NO: 436022 - RNA, 13 nt, Homo sapiens
gaagccauauuca

SEQ ID NO: 436023 - RNA, 20 nt, Homo sapiens
gaagccggaggguguuuaug

SEQ ID NO: 436024 - RNA, 16 nt, Homo sapiens
gaagccucuggcuaga

SEQ ID NO: 436025 - RNA, 13 nt, Homo sapiens
gaagccugcugau

SEQ ID NO: 436026 - RNA, 21 nt, Homo sapiens
gaagccuuuaucuaugggaga

SEQ ID NO: 436027 - RNA, 19 nt, Homo sapiens
gaagcgucucccuuggcca

SEQ ID NO: 436028 - RNA, 19 nt, Homo sapiens
gaagcuccgugagccucag

SEQ ID NO: 436029 - RNA, 17 nt, Homo sapiens
gaagcuucuugcuccug

SEQ ID NO: 436030 - RNA, 17 nt, Homo sapiens
gaaggacagcucuuccc

SEQ ID NO: 436031 - RNA, 23 nt, Homo sapiens
gaaggcaaauauaagcugggaaa

SEQ ID NO: 436032 - RNA, 19 nt, Homo sapiens
gaaggcagagguugcagug

SEQ ID NO: 436033 - RNA, 21 nt, Homo sapiens
gaaggcagcuagacaccaaug

SEQ ID NO: 436034 - RNA, 13 nt, Homo sapiens
gaaggcaugccua

SEQ ID NO: 436035 - RNA, 18 nt, Homo sapiens
gaaggccaccugcagguc

SEQ ID NO: 436036 - RNA, 12 nt, Homo sapiens
gaaggccagcuu

SEQ ID NO: 436037 - RNA, 15 nt, Homo sapiens
gaaggcccagccugu

SEQ ID NO: 436038 - RNA, 17 nt, Homo sapiens
gaagggacugguccagg

SEQ ID NO: 436039 - RNA, 11 nt, Homo sapiens
gaagggccaga

SEQ ID NO: 436040 - RNA, 23 nt, Homo sapiens
gaagggccuucuccacagggaca

SEQ ID NO: 436041 - RNA, 19 nt, Homo sapiens
gaaggggcucgagugcccc

SEQ ID NO: 436042 - RNA, 17 nt, Homo sapiens
gaaggucuauuggccaa

SEQ ID NO: 436043 - RNA, 12 nt, Homo sapiens
gaaggugugcua

SEQ ID NO: 436044 - RNA, 20 nt, Homo sapiens
gaaggugugcuacagaaaau

SEQ ID NO: 436045 - RNA, 23 nt, Homo sapiens
gaaggugugcuacagaaaauaau

SEQ ID NO: 436046 - RNA, 13 nt, Homo sapiens
gaaguaaccuuau

SEQ ID NO: 436047 - RNA, 14 nt, Homo sapiens
gaagucaaacuacu

SEQ ID NO: 436048 - RNA, 21 nt, Homo sapiens
gaagucaucucauuccacugu

SEQ ID NO: 436049 - RNA, 22 nt, Homo sapiens
gaagucaugggaacgcagccuc

SEQ ID NO: 436050 - RNA, 23 nt, Homo sapiens
gaagucuucauggucucuuccag

SEQ ID NO: 436051 - RNA, 18 nt, Homo sapiens
gaagucuuuguacagaca

SEQ ID NO: 436052 - RNA, 22 nt, Homo sapiens
gaagucuuuucugucaccaaau

SEQ ID NO: 436053 - RNA, 15 nt, Homo sapiens
gaaguggcaccuaau

SEQ ID NO: 436054 - RNA, 17 nt, Homo sapiens
gaaguggcaccuaauaa

SEQ ID NO: 436055 - RNA, 15 nt, Homo sapiens
gaagugucuaaugca

SEQ ID NO: 436056 - RNA, 18 nt, Homo sapiens
gaaguuaagcagccuuuc

SEQ ID NO: 436057 - RNA, 15 nt, Homo sapiens
gaauaaaagugcaca

SEQ ID NO: 436058 - RNA, 16 nt, Homo sapiens
gaauaaaccauuuuua

SEQ ID NO: 436059 - RNA, 14 nt, Homo sapiens
gaauaaagcccuug

SEQ ID NO: 436060 - RNA, 17 nt, Homo sapiens
gaauaaagcccuugaac

SEQ ID NO: 436061 - RNA, 14 nt, Homo sapiens
gaauaauaccuaag

SEQ ID NO: 436062 - RNA, 12 nt, Homo sapiens
gaauacaguaag

SEQ ID NO: 436063 - RNA, 22 nt, Homo sapiens
gaauacaguaagcugcucuauu

SEQ ID NO: 436064 - RNA, 16 nt, Homo sapiens
gaauacugcagcacuc

SEQ ID NO: 436065 - RNA, 24 nt, Homo sapiens
gaauacuguauuguuacagcugaa

SEQ ID NO: 436066 - RNA, 15 nt, Homo sapiens
gaauacuugaacucu

SEQ ID NO: 436067 - RNA, 15 nt, Homo sapiens
gaauagcaguuucac

SEQ ID NO: 436068 - RNA, 16 nt, Homo sapiens
gaauagcaugucacua

SEQ ID NO: 436069 - RNA, 18 nt, Homo sapiens
gaauauaauaugucuuca

SEQ ID NO: 436070 - RNA, 13 nt, Homo sapiens
gaauaucuguuca

SEQ ID NO: 436071 - RNA, 18 nt, Homo sapiens
gaauauggaacauaugca

SEQ ID NO: 436072 - RNA, 19 nt, Homo sapiens
gaauauggaacauaugcac

SEQ ID NO: 436073 - RNA, 20 nt, Homo sapiens
gaauauggaacauaugcaca

SEQ ID NO: 436074 - RNA, 16 nt, Homo sapiens
gaauauguauguuucu

SEQ ID NO: 436075 - RNA, 13 nt, Homo sapiens
gaauauuguuaaa

SEQ ID NO: 436076 - RNA, 21 nt, Homo sapiens
gaauauuuauuaccucugaua

SEQ ID NO: 436077 - RNA, 13 nt, Homo sapiens
gaaucaaauccaa

SEQ ID NO: 436078 - RNA, 20 nt, Homo sapiens
gaaucaagucagcaacagag

SEQ ID NO: 436079 - RNA, 16 nt, Homo sapiens
gaaucaagucugugaa

SEQ ID NO: 436080 - RNA, 13 nt, Homo sapiens
gaaucacuggaac

SEQ ID NO: 436081 - RNA, 14 nt, Homo sapiens
gaaucacuugacuu

SEQ ID NO: 436082 - RNA, 12 nt, Homo sapiens
gaaucagacuca

SEQ ID NO: 436083 - RNA, 20 nt, Homo sapiens
gaauccagaaggaagcucgc

SEQ ID NO: 436084 - RNA, 23 nt, Homo sapiens
gaauccaguccagauauuucaca

SEQ ID NO: 436085 - RNA, 16 nt, Homo sapiens
gaauccccuaaacaaa

SEQ ID NO: 436086 - RNA, 14 nt, Homo sapiens
gaaucggugcuguc

SEQ ID NO: 436087 - RNA, 19 nt, Homo sapiens
gaaucuccugaccacuugu

SEQ ID NO: 436088 - RNA, 16 nt, Homo sapiens
gaaucugaaagagcau

SEQ ID NO: 436089 - RNA, 19 nt, Homo sapiens
gaaucuguaaagaaauaua

SEQ ID NO: 436090 - RNA, 14 nt, Homo sapiens
caacgagagcacuu

SEQ ID NO: 436091 - RNA, 15 nt, Homo sapiens
caacuaauacauggu

SEQ ID NO: 436092 - RNA, 20 nt, Homo sapiens
caacuaauacaugguuuaaa

SEQ ID NO: 436093 - RNA, 21 nt, Homo sapiens
caacuacagaauuucauucau

SEQ ID NO: 436094 - RNA, 18 nt, Homo sapiens
caacucacugugcuccua

SEQ ID NO: 436095 - RNA, 14 nt, Homo sapiens
caacuccaaggcaa

SEQ ID NO: 436096 - RNA, 22 nt, Homo sapiens
caacuccaggguuaaagaaagg

SEQ ID NO: 436097 - RNA, 23 nt, Homo sapiens
caacucccagccaccaccacugu

SEQ ID NO: 436098 - RNA, 17 nt, Homo sapiens
caacucgggagcauucu

SEQ ID NO: 436099 - RNA, 10 nt, Homo sapiens
caacugacca

SEQ ID NO: 436100 - RNA, 15 nt, Homo sapiens
caacuuaauucuguu

SEQ ID NO: 436101 - RNA, 13 nt, Homo sapiens
caacuuacauaug

SEQ ID NO: 436102 - RNA, 20 nt, Homo sapiens
caacuuaggcuacagaauga

SEQ ID NO: 436103 - RNA, 15 nt, Homo sapiens
caacuuccuguugau

SEQ ID NO: 436104 - RNA, 11 nt, Homo sapiens
caacuugagau

SEQ ID NO: 436105 - RNA, 19 nt, Homo sapiens
caacuugagcauguuacug

SEQ ID NO: 436106 - RNA, 23 nt, Homo sapiens
caacuuuaauugcuuaaaagaca

SEQ ID NO: 436107 - RNA, 14 nt, Homo sapiens
caacuuuccaacuu

SEQ ID NO: 436108 - RNA, 15 nt, Homo sapiens
caacuuuguuuucca

SEQ ID NO: 436109 - RNA, 13 nt, Homo sapiens
caagaaaaauaau

SEQ ID NO: 436110 - RNA, 15 nt, Homo sapiens
caagaaaacaacuuc

SEQ ID NO: 436111 - RNA, 17 nt, Homo sapiens
caagaaaauaaaacuaa

SEQ ID NO: 436112 - RNA, 13 nt, Homo sapiens
caagaacagcagg

SEQ ID NO: 436113 - RNA, 18 nt, Homo sapiens
caagaacugcauggaccu

SEQ ID NO: 436114 - RNA, 19 nt, Homo sapiens
caagaagcccuccuugcca

SEQ ID NO: 436115 - RNA, 20 nt, Homo sapiens
caagaagugggauucaggaa

SEQ ID NO: 436116 - RNA, 20 nt, Homo sapiens
caagaauauuguauguuaaa

SEQ ID NO: 436117 - RNA, 15 nt, Homo sapiens
caagacacccagugg

SEQ ID NO: 436118 - RNA, 15 nt, Homo sapiens
caagacacugagaua

SEQ ID NO: 436119 - RNA, 13 nt, Homo sapiens
caagacagugaag

SEQ ID NO: 436120 - RNA, 15 nt, Homo sapiens
caagaccucccugga

SEQ ID NO: 436121 - RNA, 17 nt, Homo sapiens
caagacggagaugcaug

SEQ ID NO: 436122 - RNA, 19 nt, Homo sapiens
caagacucugucucaaaaa

SEQ ID NO: 436123 - RNA, 20 nt, Homo sapiens
caagacuuggcaacagaagc

SEQ ID NO: 436124 - RNA, 11 nt, Homo sapiens
caagagccaug

SEQ ID NO: 436125 - RNA, 23 nt, Homo sapiens
caagagccauguaccaguguacu

SEQ ID NO: 436126 - RNA, 18 nt, Homo sapiens
caagaguaaauauuguca

SEQ ID NO: 436127 - RNA, 13 nt, Homo sapiens
caagaguauucca

SEQ ID NO: 436128 - RNA, 21 nt, Homo sapiens
caagagugggcuuuccagggu

SEQ ID NO: 436129 - RNA, 23 nt, Homo sapiens
caagaucaaacuuccauagcuuc

SEQ ID NO: 436130 - RNA, 20 nt, Homo sapiens
caagauccgagucuacccag

SEQ ID NO: 436131 - RNA, 20 nt, Homo sapiens
caagaucgcaccauugcacu

SEQ ID NO: 436132 - RNA, 21 nt, Homo sapiens
caagaucgcaccauugcacuc

SEQ ID NO: 436133 - RNA, 14 nt, Homo sapiens
caagauucuacuug

SEQ ID NO: 436134 - RNA, 21 nt, Homo sapiens
caagcaaaaacaaaugggaaa

SEQ ID NO: 436135 - RNA, 12 nt, Homo sapiens
caagcaaaccuu

SEQ ID NO: 436136 - RNA, 15 nt, Homo sapiens
caagcaaaccuucuc

SEQ ID NO: 436137 - RNA, 15 nt, Homo sapiens
caagcaagcucucuu

SEQ ID NO: 436138 - RNA, 14 nt, Homo sapiens
caagcaccugcuca

SEQ ID NO: 436139 - RNA, 22 nt, Homo sapiens
caagcacuggacuacaagggca

SEQ ID NO: 436140 - RNA, 12 nt, Homo sapiens
caagcacuuugg

SEQ ID NO: 436141 - RNA, 12 nt, Homo sapiens
caagccacagaa

SEQ ID NO: 436142 - RNA, 15 nt, Homo sapiens
caagcccugccccuc

SEQ ID NO: 436143 - RNA, 21 nt, Homo sapiens
caagcccuggcaacauaguga

SEQ ID NO: 436144 - RNA, 14 nt, Homo sapiens
caagccggugccca

SEQ ID NO: 436145 - RNA, 18 nt, Homo sapiens
caagcucucuugccgagg

SEQ ID NO: 436146 - RNA, 21 nt, Homo sapiens
caagcuguccagagaaaagag

SEQ ID NO: 436147 - RNA, 18 nt, Homo sapiens
caagcuuaauagcccucc

SEQ ID NO: 436148 - RNA, 17 nt, Homo sapiens
caagcuuguguacuuga

SEQ ID NO: 436149 - RNA, 15 nt, Homo sapiens
caaggaaaauggaca

SEQ ID NO: 436150 - RNA, 13 nt, Homo sapiens
caaggacauugcc

SEQ ID NO: 436151 - RNA, 22 nt, Homo sapiens
caaggaccuggagauugugcuc

SEQ ID NO: 436152 - RNA, 14 nt, Homo sapiens
caaggacuuugcag

SEQ ID NO: 436153 - RNA, 15 nt, Homo sapiens
caaggagaaaggcau

SEQ ID NO: 436154 - RNA, 19 nt, Homo sapiens
caaggaguaaguacaaaua

SEQ ID NO: 436155 - RNA, 19 nt, Homo sapiens
caaggauguucuggcuuua

SEQ ID NO: 436156 - RNA, 22 nt, Homo sapiens
caaggcccauaucugugaaaug

SEQ ID NO: 436157 - RNA, 19 nt, Homo sapiens
caaggcugcagugagccau

SEQ ID NO: 436158 - RNA, 19 nt, Homo sapiens
caaggcugccggcugcacc

SEQ ID NO: 436159 - RNA, 23 nt, Homo sapiens
caaggcuuggcacacugccagug

SEQ ID NO: 436160 - RNA, 16 nt, Homo sapiens
caaggggucuguauau

SEQ ID NO: 436161 - RNA, 19 nt, Homo sapiens
caaggguaugggaagccau

SEQ ID NO: 436162 - RNA, 19 nt, Homo sapiens
caagguccccuccacaucc

SEQ ID NO: 436163 - RNA, 14 nt, Homo sapiens
caaggugacuggga

SEQ ID NO: 436164 - RNA, 15 nt, Homo sapiens
caaggugggggagcc

SEQ ID NO: 436165 - RNA, 17 nt, Homo sapiens
caagguuauuggacacc

SEQ ID NO: 436166 - RNA, 16 nt, Homo sapiens
caaguaacaauaugau

SEQ ID NO: 436167 - RNA, 19 nt, Homo sapiens
caaguacagccuucacugg

SEQ ID NO: 436168 - RNA, 15 nt, Homo sapiens
caaguagcacccugg

SEQ ID NO: 436169 - RNA, 17 nt, Homo sapiens
caaguaggagacacaga

SEQ ID NO: 436170 - RNA, 15 nt, Homo sapiens
caagucaacacucuu

SEQ ID NO: 436171 - RNA, 21 nt, Homo sapiens
caaguccugugaauuucuuca

SEQ ID NO: 436172 - RNA, 14 nt, Homo sapiens
caagucuaguggaa

SEQ ID NO: 436173 - RNA, 13 nt, Homo sapiens
caagucugugaaa

SEQ ID NO: 436174 - RNA, 20 nt, Homo sapiens
caaguguaugcacgugugca

SEQ ID NO: 436175 - RNA, 13 nt, Homo sapiens
caagugucuucca

SEQ ID NO: 436176 - RNA, 16 nt, Homo sapiens
caaguguguaugugcg

SEQ ID NO: 436177 - RNA, 20 nt, Homo sapiens
caagugugugcacaugugug

SEQ ID NO: 436178 - RNA, 23 nt, Homo sapiens
caaguucaaagaacccuagcaca

SEQ ID NO: 436179 - RNA, 12 nt, Homo sapiens
caaguucauuac

SEQ ID NO: 436180 - RNA, 18 nt, Homo sapiens
caaguugugccuuucaca

SEQ ID NO: 436181 - RNA, 20 nt, Homo sapiens
caaguuguuucaaacagcau

SEQ ID NO: 436182 - RNA, 17 nt, Homo sapiens
caaguuucaucagucaa

SEQ ID NO: 436183 - RNA, 16 nt, Homo sapiens
caaguuuuugguaaug

SEQ ID NO: 436184 - RNA, 14 nt, Homo sapiens
caauaaaacauucc

SEQ ID NO: 436185 - RNA, 19 nt, Homo sapiens
caauaaaaguuuucuccaa

SEQ ID NO: 436186 - RNA, 14 nt, Homo sapiens
caauaaacauguca

SEQ ID NO: 436187 - RNA, 18 nt, Homo sapiens
caauaaacgaaacacaga

SEQ ID NO: 436188 - RNA, 20 nt, Homo sapiens
caauaaacgaaacacagaac

SEQ ID NO: 436189 - RNA, 15 nt, Homo sapiens
caauaaacuguuaca

SEQ ID NO: 436190 - RNA, 19 nt, Homo sapiens
caauaaagaaugcaaucca

SEQ ID NO: 436191 - RNA, 19 nt, Homo sapiens
caauaaauaccagacacgu

SEQ ID NO: 436192 - RNA, 16 nt, Homo sapiens
caauaaaucuuuggaa

SEQ ID NO: 436193 - RNA, 20 nt, Homo sapiens
caauaaauuggaacaccucc

SEQ ID NO: 436194 - RNA, 23 nt, Homo sapiens
caauaaauuggaacaccuccuca

SEQ ID NO: 436195 - RNA, 15 nt, Homo sapiens
caauaacacugucuc

SEQ ID NO: 436196 - RNA, 20 nt, Homo sapiens
caauaagcagagguggaaaa

SEQ ID NO: 436197 - RNA, 12 nt, Homo sapiens
caauaagccagc

SEQ ID NO: 436198 - RNA, 16 nt, Homo sapiens
caauaauaaauccuca

SEQ ID NO: 436199 - RNA, 17 nt, Homo sapiens
caauacaauaguaugca

SEQ ID NO: 436200 - RNA, 14 nt, Homo sapiens
caauagagacugua

SEQ ID NO: 436201 - RNA, 14 nt, Homo sapiens
caauagauauuuac

SEQ ID NO: 436202 - RNA, 13 nt, Homo sapiens
caauagcauccaa

SEQ ID NO: 436203 - RNA, 19 nt, Homo sapiens
caauaguauuaacuauuag

SEQ ID NO: 436204 - RNA, 14 nt, Homo sapiens
caauauaugauaua

SEQ ID NO: 436205 - RNA, 18 nt, Homo sapiens
caauauccaaaccaaaua

SEQ ID NO: 436206 - RNA, 18 nt, Homo sapiens
caauaugaugacucccuu

SEQ ID NO: 436207 - RNA, 22 nt, Homo sapiens
caauauuuccauguuucauuaa

SEQ ID NO: 436208 - RNA, 15 nt, Homo sapiens
caaucaaagcacuug

SEQ ID NO: 436209 - RNA, 15 nt, Homo sapiens
caaucagagagcuca

SEQ ID NO: 436210 - RNA, 17 nt, Homo sapiens
caaucaucuauugagug

SEQ ID NO: 436211 - RNA, 17 nt, Homo sapiens
caaucaugaaauaugca

SEQ ID NO: 436212 - RNA, 19 nt, Homo sapiens
caauccuuuguucucccaa

SEQ ID NO: 436213 - RNA, 17 nt, Homo sapiens
caaucuuagacauuuau

SEQ ID NO: 436214 - RNA, 16 nt, Homo sapiens
caaucuucuacuuuaa

SEQ ID NO: 436215 - RNA, 14 nt, Homo sapiens
caaucuugcuguga

SEQ ID NO: 436216 - RNA, 15 nt, Homo sapiens
caaucuuugccuuua

SEQ ID NO: 436217 - RNA, 19 nt, Homo sapiens
caaugaaauauuugcuuau

SEQ ID NO: 436218 - RNA, 16 nt, Homo sapiens
caaugcacgaucucag

SEQ ID NO: 436219 - RNA, 14 nt, Homo sapiens
caaugcauugcuaa

SEQ ID NO: 436220 - RNA, 11 nt, Homo sapiens
caaugcuauaa

SEQ ID NO: 436221 - RNA, 21 nt, Homo sapiens
caaugcuauggacugcacaaa

SEQ ID NO: 436222 - RNA, 12 nt, Homo sapiens
caaugcucuccu

SEQ ID NO: 436223 - RNA, 20 nt, Homo sapiens
gaaucuucacaaaacacuuc

SEQ ID NO: 436224 - RNA, 17 nt, Homo sapiens
gaaucuuuuacugugga

SEQ ID NO: 436225 - RNA, 21 nt, Homo sapiens
gaaugaaauauaaacugugag

SEQ ID NO: 436226 - RNA, 14 nt, Homo sapiens
gaaugaauccauua

SEQ ID NO: 436227 - RNA, 23 nt, Homo sapiens
gaaugaaucucaagauucaguag

SEQ ID NO: 436228 - RNA, 19 nt, Homo sapiens
gaaugaaugucagugugac

SEQ ID NO: 436229 - RNA, 22 nt, Homo sapiens
gaaugaaugucagugugacuga

SEQ ID NO: 436230 - RNA, 15 nt, Homo sapiens
gaaugacaacagaag

SEQ ID NO: 436231 - RNA, 13 nt, Homo sapiens
gaaugacauugaa

SEQ ID NO: 436232 - RNA, 15 nt, Homo sapiens
gaaugacauugaacu

SEQ ID NO: 436233 - RNA, 13 nt, Homo sapiens
gaaugagcucucu

SEQ ID NO: 436234 - RNA, 17 nt, Homo sapiens
gaaugaguuuccagcua

SEQ ID NO: 436235 - RNA, 22 nt, Homo sapiens
gaaugaguuuccagcuaagccu

SEQ ID NO: 436236 - RNA, 21 nt, Homo sapiens
gaaugauuaauuaaaacacaa

SEQ ID NO: 436237 - RNA, 14 nt, Homo sapiens
gaaugcaagcugga

SEQ ID NO: 436238 - RNA, 20 nt, Homo sapiens
gaaugcagcaguaaauccaa

SEQ ID NO: 436239 - RNA, 12 nt, Homo sapiens
gaaugcauucaa

SEQ ID NO: 436240 - RNA, 14 nt, Homo sapiens
gaaugcauucaggg

SEQ ID NO: 436241 - RNA, 18 nt, Homo sapiens
gaaugccugucaguuuca

SEQ ID NO: 436242 - RNA, 14 nt, Homo sapiens
gaaugcggcaagaa

SEQ ID NO: 436243 - RNA, 17 nt, Homo sapiens
gaauggaaaacugccug

SEQ ID NO: 436244 - RNA, 18 nt, Homo sapiens
gaauggaaggcuuugcca

SEQ ID NO: 436245 - RNA, 13 nt, Homo sapiens
gaauggagcugua

SEQ ID NO: 436246 - RNA, 17 nt, Homo sapiens
gaauggauuuaucagaa

SEQ ID NO: 436247 - RNA, 22 nt, Homo sapiens
gaauggcccaguccucucccaa

SEQ ID NO: 436248 - RNA, 18 nt, Homo sapiens
gaauguagcaucugagaa

SEQ ID NO: 436249 - RNA, 18 nt, Homo sapiens
gaauguggauucuuccca

SEQ ID NO: 436250 - RNA, 19 nt, Homo sapiens
gaauguuauccaacuauua

SEQ ID NO: 436251 - RNA, 21 nt, Homo sapiens
gaauuauuuugaaugucacaa

SEQ ID NO: 436252 - RNA, 16 nt, Homo sapiens
gaauucagaugcaaga

SEQ ID NO: 436253 - RNA, 20 nt, Homo sapiens
gaauucauacucuguugccu

SEQ ID NO: 436254 - RNA, 15 nt, Homo sapiens
gaauucuccaaaaca

SEQ ID NO: 436255 - RNA, 19 nt, Homo sapiens
gaauucuuaaauaugugga

SEQ ID NO: 436256 - RNA, 13 nt, Homo sapiens
gaauugaagucau

SEQ ID NO: 436257 - RNA, 17 nt, Homo sapiens
gaauugcuuaccaaagg

SEQ ID NO: 436258 - RNA, 16 nt, Homo sapiens
gaauuggauccagggg

SEQ ID NO: 436259 - RNA, 23 nt, Homo sapiens
gaauuguuauacuagguuaacau

SEQ ID NO: 436260 - RNA, 15 nt, Homo sapiens
gaauuuccucuauug

SEQ ID NO: 436261 - RNA, 15 nt, Homo sapiens
gaauuugggccucuu

SEQ ID NO: 436262 - RNA, 11 nt, Homo sapiens
gacuggcuuug

SEQ ID NO: 436263 - RNA, 13 nt, Homo sapiens
gacuggcuuuguc

SEQ ID NO: 436264 - RNA, 14 nt, Homo sapiens
gacuguacuccucc

SEQ ID NO: 436265 - RNA, 15 nt, Homo sapiens
gacuguggcuucucc

SEQ ID NO: 436266 - RNA, 20 nt, Homo sapiens
gacuguguuuaauaguauau

SEQ ID NO: 436267 - RNA, 14 nt, Homo sapiens
gacuguugcucaaa

SEQ ID NO: 436268 - RNA, 22 nt, Homo sapiens
gacuguugcucaaaucuauuca

SEQ ID NO: 436269 - RNA, 16 nt, Homo sapiens
gacuguuuggcuuaua

SEQ ID NO: 436270 - RNA, 14 nt, Homo sapiens
gacuuagugcaaca

SEQ ID NO: 436271 - RNA, 17 nt, Homo sapiens
gacuuagugcaacaggu

SEQ ID NO: 436272 - RNA, 17 nt, Homo sapiens
gacuuauauauuugaaa

SEQ ID NO: 436273 - RNA, 19 nt, Homo sapiens
gacuuauugauuaaguaua

SEQ ID NO: 436274 - RNA, 19 nt, Homo sapiens
gacuucaaaaggugauuaa

SEQ ID NO: 436275 - RNA, 15 nt, Homo sapiens
gacuucaagaugccu

SEQ ID NO: 436276 - RNA, 21 nt, Homo sapiens
gacuucagacucucuccucuc

SEQ ID NO: 436277 - RNA, 22 nt, Homo sapiens
gacuucaugacaagcauuuugu

SEQ ID NO: 436278 - RNA, 20 nt, Homo sapiens
gacuucauuuuuccuaacag

SEQ ID NO: 436279 - RNA, 14 nt, Homo sapiens
gacuuccuggugag

SEQ ID NO: 436280 - RNA, 22 nt, Homo sapiens
gacuucucuuauucuuuacaaa

SEQ ID NO: 436281 - RNA, 21 nt, Homo sapiens
gacuucugcaucuuacaguca

SEQ ID NO: 436282 - RNA, 21 nt, Homo sapiens
gacuugaacuagauugcaugc

SEQ ID NO: 436283 - RNA, 18 nt, Homo sapiens
gacuugaauguacaaaga

SEQ ID NO: 436284 - RNA, 16 nt, Homo sapiens
gacuugaggauuuuga

SEQ ID NO: 436285 - RNA, 18 nt, Homo sapiens
gacuugauuagugccuuc

SEQ ID NO: 436286 - RNA, 18 nt, Homo sapiens
gacuuuagggaucugggg

SEQ ID NO: 436287 - RNA, 14 nt, Homo sapiens
gacuuucuacaccu

SEQ ID NO: 436288 - RNA, 23 nt, Homo sapiens
gacuuucuacaccuguugcaccu

SEQ ID NO: 436289 - RNA, 18 nt, Homo sapiens
gacuuucuccaaaggcac

SEQ ID NO: 436290 - RNA, 16 nt, Homo sapiens
gacuuugauguguuuu

SEQ ID NO: 436291 - RNA, 12 nt, Homo sapiens
gacuuuguuaca

SEQ ID NO: 436292 - RNA, 20 nt, Homo sapiens
gacuuuuuagccagugacuu

SEQ ID NO: 436293 - RNA, 12 nt, Homo sapiens
gagaaaacacuu

SEQ ID NO: 436294 - RNA, 23 nt, Homo sapiens
gagaaaacagauaaugauagugu

SEQ ID NO: 436295 - RNA, 20 nt, Homo sapiens
gagaaaacuuauuugaguga

SEQ ID NO: 436296 - RNA, 22 nt, Homo sapiens
gagaaaacuuauuugagugauu

SEQ ID NO: 436297 - RNA, 13 nt, Homo sapiens
gagaaaagccaga

SEQ ID NO: 436298 - RNA, 22 nt, Homo sapiens
gagaaaauaaagaccuugcuua

SEQ ID NO: 436299 - RNA, 21 nt, Homo sapiens
gagaaaaucaaagcagucaua

SEQ ID NO: 436300 - RNA, 13 nt, Homo sapiens
gagaaaccagcuu

SEQ ID NO: 436301 - RNA, 20 nt, Homo sapiens
gagaaaccuuauuguaccuc

SEQ ID NO: 436302 - RNA, 21 nt, Homo sapiens
gagaaaggauggcagccucag

SEQ ID NO: 436303 - RNA, 17 nt, Homo sapiens
gagaaaugccagugugc

SEQ ID NO: 436304 - RNA, 22 nt, Homo sapiens
gagaacaaagaccaaugugaag

SEQ ID NO: 436305 - RNA, 12 nt, Homo sapiens
gagaacaucugc

SEQ ID NO: 436306 - RNA, 16 nt, Homo sapiens
gagaacaugcauacua

SEQ ID NO: 436307 - RNA, 23 nt, Homo sapiens
gagaaccucguugacaugcacag

SEQ ID NO: 436308 - RNA, 22 nt, Homo sapiens
gagaacugguucuugccuuccc

SEQ ID NO: 436309 - RNA, 11 nt, Homo sapiens
gagaacugugc

SEQ ID NO: 436310 - RNA, 17 nt, Homo sapiens
gagaagacuucuuugca

SEQ ID NO: 436311 - RNA, 16 nt, Homo sapiens
gagaagauucaauuua

SEQ ID NO: 436312 - RNA, 17 nt, Homo sapiens
gagaagcgggaguggcu

SEQ ID NO: 436313 - RNA, 11 nt, Homo sapiens
gagaaggcauu

SEQ ID NO: 436314 - RNA, 15 nt, Homo sapiens
gagaaguaauuccuc

SEQ ID NO: 436315 - RNA, 21 nt, Homo sapiens
gagaagugccccugcugccuc

SEQ ID NO: 436316 - RNA, 18 nt, Homo sapiens
gagaauccugccucuccc

SEQ ID NO: 436317 - RNA, 15 nt, Homo sapiens
gagaaugaauucuga

SEQ ID NO: 436318 - RNA, 12 nt, Homo sapiens
gagaaugccauu

SEQ ID NO: 436319 - RNA, 22 nt, Homo sapiens
gagaauggggguggggaggcaa

SEQ ID NO: 436320 - RNA, 17 nt, Homo sapiens
gagaauguugaauacuu

SEQ ID NO: 436321 - RNA, 16 nt, Homo sapiens
gagaauguuguauuca

SEQ ID NO: 436322 - RNA, 19 nt, Homo sapiens
gagacaagggcaucaucua

SEQ ID NO: 436323 - RNA, 16 nt, Homo sapiens
gagacacagauggcac

SEQ ID NO: 436324 - RNA, 17 nt, Homo sapiens
gagacagacacguguga

SEQ ID NO: 436325 - RNA, 17 nt, Homo sapiens
gagacaguguuuugcca

SEQ ID NO: 436326 - RNA, 23 nt, Homo sapiens
gagacccccacaccucaguuccc

SEQ ID NO: 436327 - RNA, 16 nt, Homo sapiens
gagaccuggaaccaga

SEQ ID NO: 436328 - RNA, 17 nt, Homo sapiens
gagaccuggaaccagag

SEQ ID NO: 436329 - RNA, 12 nt, Homo sapiens
gagaccuuccac

SEQ ID NO: 436330 - RNA, 13 nt, Homo sapiens
gagacgggaccgg

SEQ ID NO: 436331 - RNA, 24 nt, Homo sapiens
gagacuaggauagcuucaucuuga

SEQ ID NO: 436332 - RNA, 14 nt, Homo sapiens
gagacuauguguca

SEQ ID NO: 436333 - RNA, 21 nt, Homo sapiens
gagacuaugugucaugauuuc

SEQ ID NO: 436334 - RNA, 22 nt, Homo sapiens
gagacugggagccacuucuccc

SEQ ID NO: 436335 - RNA, 13 nt, Homo sapiens
gagacugggucuc

SEQ ID NO: 436336 - RNA, 17 nt, Homo sapiens
gagacuguagauugcuu

SEQ ID NO: 436337 - RNA, 22 nt, Homo sapiens
gagagaaaacagaccuaaugcu

SEQ ID NO: 436338 - RNA, 14 nt, Homo sapiens
gagagaacagggau

SEQ ID NO: 436339 - RNA, 16 nt, Homo sapiens
gagagaacagggaugc

SEQ ID NO: 436340 - RNA, 21 nt, Homo sapiens
gagagaacagggaugcuaucu

SEQ ID NO: 436341 - RNA, 18 nt, Homo sapiens
gagagagguacccaaggu

SEQ ID NO: 436342 - RNA, 20 nt, Homo sapiens
gagagauggaauaaagcccu

SEQ ID NO: 436343 - RNA, 12 nt, Homo sapiens
gagagauguuuu

SEQ ID NO: 436344 - RNA, 20 nt, Homo sapiens
gagagcagcuggcucuccac

SEQ ID NO: 436345 - RNA, 21 nt, Homo sapiens
gagagccaaggccuaugccac

SEQ ID NO: 436346 - RNA, 16 nt, Homo sapiens
gagagcgccacccgcc

SEQ ID NO: 436347 - RNA, 20 nt, Homo sapiens
gagagcggcugcccgacuca

SEQ ID NO: 436348 - RNA, 22 nt, Homo sapiens
gagagcucaggauggcucagac

SEQ ID NO: 436349 - RNA, 16 nt, Homo sapiens
gagaggaaaagccagu

SEQ ID NO: 436350 - RNA, 17 nt, Homo sapiens
gagaggaaaaguggaug

SEQ ID NO: 436351 - RNA, 22 nt, Homo sapiens
gagaggaaagaccuacauuccc

SEQ ID NO: 436352 - RNA, 13 nt, Homo sapiens
gagaggaacccag

SEQ ID NO: 436353 - RNA, 14 nt, Homo sapiens
gagaggaagccacg

SEQ ID NO: 436354 - RNA, 14 nt, Homo sapiens
gagaggaguucaau

SEQ ID NO: 436355 - RNA, 11 nt, Homo sapiens
gagaguaccau

SEQ ID NO: 436356 - RNA, 22 nt, Homo sapiens
gagaguagaugguuugagccug

SEQ ID NO: 436357 - RNA, 17 nt, Homo sapiens
gagagucucacuccccu

SEQ ID NO: 436358 - RNA, 22 nt, Homo sapiens
gagaguuucuauggauucacuu

SEQ ID NO: 436359 - RNA, 23 nt, Homo sapiens
caccaacaacagucagccagcuu

SEQ ID NO: 436360 - RNA, 18 nt, Homo sapiens
caccaagcugcucuccuu

SEQ ID NO: 436361 - RNA, 13 nt, Homo sapiens
caccaaguacagc

SEQ ID NO: 436362 - RNA, 21 nt, Homo sapiens
caccaccgcccuccucgcugu

SEQ ID NO: 436363 - RNA, 13 nt, Homo sapiens
caccaccuugcca

SEQ ID NO: 436364 - RNA, 14 nt, Homo sapiens
caccacucuugacu

SEQ ID NO: 436365 - RNA, 17 nt, Homo sapiens
caccagccccagcaaga

SEQ ID NO: 436366 - RNA, 22 nt, Homo sapiens
caccaggacuuggggucaggaa

SEQ ID NO: 436367 - RNA, 21 nt, Homo sapiens
caccaggagacagacagagaa

SEQ ID NO: 436368 - RNA, 16 nt, Homo sapiens
caccaggcacugccug

SEQ ID NO: 436369 - RNA, 12 nt, Homo sapiens
caccagguccug

SEQ ID NO: 436370 - RNA, 14 nt, Homo sapiens
caccaucacagcuu

SEQ ID NO: 436371 - RNA, 19 nt, Homo sapiens
caccaucaucauagaggau

SEQ ID NO: 436372 - RNA, 15 nt, Homo sapiens
caccaugcaccccug

SEQ ID NO: 436373 - RNA, 16 nt, Homo sapiens
caccaugcacucaaua

SEQ ID NO: 436374 - RNA, 15 nt, Homo sapiens
caccauguuggccag

SEQ ID NO: 436375 - RNA, 23 nt, Homo sapiens
caccauucuuucuuggugcauuc

SEQ ID NO: 436376 - RNA, 12 nt, Homo sapiens
caccauugcacu

SEQ ID NO: 436377 - RNA, 22 nt, Homo sapiens
cacccaaaagaauuaucauccc

SEQ ID NO: 436378 - RNA, 16 nt, Homo sapiens
cacccaccuccaccca

SEQ ID NO: 436379 - RNA, 14 nt, Homo sapiens
cacccaccuggauu

SEQ ID NO: 436380 - RNA, 15 nt, Homo sapiens
cacccaggcugcacu

SEQ ID NO: 436381 - RNA, 18 nt, Homo sapiens
cacccaguggaaccaaaa

SEQ ID NO: 436382 - RNA, 16 nt, Homo sapiens
cacccaucuuccugcu

SEQ ID NO: 436383 - RNA, 12 nt, Homo sapiens
cacccauucaca

SEQ ID NO: 436384 - RNA, 20 nt, Homo sapiens
caccccagcgccugugcuga

SEQ ID NO: 436385 - RNA, 24 nt, Homo sapiens
caccccagugcacccacucugcuu

SEQ ID NO: 436386 - RNA, 20 nt, Homo sapiens
cacccccuucucugcuccac

SEQ ID NO: 436387 - RNA, 15 nt, Homo sapiens
caccccuaaagagau

SEQ ID NO: 436388 - RNA, 13 nt, Homo sapiens
cacccgggagcag

SEQ ID NO: 436389 - RNA, 17 nt, Homo sapiens
cacccuaacucuugcuc

SEQ ID NO: 436390 - RNA, 17 nt, Homo sapiens
cacccuccaugcuccuc

SEQ ID NO: 436391 - RNA, 20 nt, Homo sapiens
cacccuccaugcuccucacc

SEQ ID NO: 436392 - RNA, 22 nt, Homo sapiens
gaguucagagggugucguccug

SEQ ID NO: 436393 - RNA, 16 nt, Homo sapiens
gaguucaucuugaauu

SEQ ID NO: 436394 - RNA, 22 nt, Homo sapiens
gaguuccuagcaaguugacuaa

SEQ ID NO: 436395 - RNA, 15 nt, Homo sapiens
gaguucuauccccaa

SEQ ID NO: 436396 - RNA, 16 nt, Homo sapiens
gaguucugaucuguac

SEQ ID NO: 436397 - RNA, 16 nt, Homo sapiens
gaguucuuuauauuca

SEQ ID NO: 436398 - RNA, 15 nt, Homo sapiens
gaguuucuauggauu

SEQ ID NO: 436399 - RNA, 15 nt, Homo sapiens
gaguuugcuuucaaa

SEQ ID NO: 436400 - RNA, 22 nt, Homo sapiens
gauaaaaaaauauguagcaaug

SEQ ID NO: 436401 - RNA, 16 nt, Homo sapiens
gauaaaaagauggccu

SEQ ID NO: 436402 - RNA, 19 nt, Homo sapiens
gauaaacacagagguuuua

SEQ ID NO: 436403 - RNA, 16 nt, Homo sapiens
gauaaagaugcaagga

SEQ ID NO: 436404 - RNA, 19 nt, Homo sapiens
gauaaaucauuucaguauc

SEQ ID NO: 436405 - RNA, 18 nt, Homo sapiens
gauaaauuugacuguuau

SEQ ID NO: 436406 - RNA, 21 nt, Homo sapiens
gauaaauuugacuguuauuug

SEQ ID NO: 436407 - RNA, 13 nt, Homo sapiens
gauaaccacaggg

SEQ ID NO: 436408 - RNA, 17 nt, Homo sapiens
gauaacuagauggugcu

SEQ ID NO: 436409 - RNA, 20 nt, Homo sapiens
gauaacuuccuucacaucuc

SEQ ID NO: 436410 - RNA, 20 nt, Homo sapiens
gauaacuuggggaggcaaga

SEQ ID NO: 436411 - RNA, 14 nt, Homo sapiens
gauaagacuggaaa

SEQ ID NO: 436412 - RNA, 20 nt, Homo sapiens
gauaagcacuagaucucccu

SEQ ID NO: 436413 - RNA, 13 nt, Homo sapiens
gauaauaguuuac

SEQ ID NO: 436414 - RNA, 15 nt, Homo sapiens
gauaaucagccucuu

SEQ ID NO: 436415 - RNA, 21 nt, Homo sapiens
gauaaugcauaaauguuauau

SEQ ID NO: 436416 - RNA, 17 nt, Homo sapiens
gauaauuaaaugaaaua

SEQ ID NO: 436417 - RNA, 20 nt, Homo sapiens
gauacagauccgcauguguc

SEQ ID NO: 436418 - RNA, 19 nt, Homo sapiens
gauaccaagaugccaucug

SEQ ID NO: 436419 - RNA, 18 nt, Homo sapiens
gauaccugugugucucca

SEQ ID NO: 436420 - RNA, 11 nt, Homo sapiens
gauacugaaaa

SEQ ID NO: 436421 - RNA, 14 nt, Homo sapiens
gauacugaaaaaua

SEQ ID NO: 436422 - RNA, 13 nt, Homo sapiens
gauacugcugaug

SEQ ID NO: 436423 - RNA, 16 nt, Homo sapiens
gauacuuauucaaaaa

SEQ ID NO: 436424 - RNA, 20 nt, Homo sapiens
gauagaacaaugcuauaaua

SEQ ID NO: 436425 - RNA, 14 nt, Homo sapiens
gauagacuucgaaa

SEQ ID NO: 436426 - RNA, 15 nt, Homo sapiens
gauagauaaugccuu

SEQ ID NO: 436427 - RNA, 19 nt, Homo sapiens
gauagauauccuuggcaca

SEQ ID NO: 436428 - RNA, 12 nt, Homo sapiens
gauagcuuuauu

SEQ ID NO: 436429 - RNA, 15 nt, Homo sapiens
gauaguaacaaugaa

SEQ ID NO: 436430 - RNA, 16 nt, Homo sapiens
gauauaaaaaguacag

SEQ ID NO: 436431 - RNA, 20 nt, Homo sapiens
gauauacuauuuucauucuc

SEQ ID NO: 436432 - RNA, 22 nt, Homo sapiens
gauauauauaugcuuggcuaac

SEQ ID NO: 436433 - RNA, 22 nt, Homo sapiens
gauauaucuuuaauaaguaauc

SEQ ID NO: 436434 - RNA, 15 nt, Homo sapiens
gauaucaugccccug

SEQ ID NO: 436435 - RNA, 13 nt, Homo sapiens
gauaucuaugacu

SEQ ID NO: 436436 - RNA, 23 nt, Homo sapiens
gauaugcacuugaaaugauggua

SEQ ID NO: 436437 - RNA, 11 nt, Homo sapiens
gauauucucau

SEQ ID NO: 436438 - RNA, 16 nt, Homo sapiens
gauauuugauaaugaa

SEQ ID NO: 436439 - RNA, 13 nt, Homo sapiens
gauauuugaugua

SEQ ID NO: 436440 - RNA, 18 nt, Homo sapiens
gaucaauaaaaugugauu

SEQ ID NO: 436441 - RNA, 15 nt, Homo sapiens
gaucacuccagugca

SEQ ID NO: 436442 - RNA, 16 nt, Homo sapiens
gaucagaucuuacaag

SEQ ID NO: 436443 - RNA, 15 nt, Homo sapiens
gaucaguauuucacu

SEQ ID NO: 436444 - RNA, 21 nt, Homo sapiens
gaucaguggggccccaaagcc

SEQ ID NO: 436445 - RNA, 17 nt, Homo sapiens
gaucauagucgggcaua

SEQ ID NO: 436446 - RNA, 21 nt, Homo sapiens
gaucauuacauggcugugguu

SEQ ID NO: 436447 - RNA, 23 nt, Homo sapiens
gaucauuugcccuuaaggacaaa

SEQ ID NO: 436448 - RNA, 21 nt, Homo sapiens
gauccacacuuucaaagagaa

SEQ ID NO: 436449 - RNA, 14 nt, Homo sapiens
gauccagacuguaa

SEQ ID NO: 436450 - RNA, 20 nt, Homo sapiens
gauccauccaucuccaggga

SEQ ID NO: 436451 - RNA, 13 nt, Homo sapiens
gauccccagugaa

SEQ ID NO: 436452 - RNA, 22 nt, Homo sapiens
gaucccugaucaagcuucagac

SEQ ID NO: 436453 - RNA, 14 nt, Homo sapiens
gauccgagucuacc

SEQ ID NO: 436454 - RNA, 13 nt, Homo sapiens
gauccgcggggac

SEQ ID NO: 436455 - RNA, 12 nt, Homo sapiens
gauccugcacuc

SEQ ID NO: 436456 - RNA, 22 nt, Homo sapiens
gauccugcacucuaacacucga

SEQ ID NO: 436457 - RNA, 14 nt, Homo sapiens
gauccuucaaagag

SEQ ID NO: 436458 - RNA, 15 nt, Homo sapiens
gauccuucaaagagu

SEQ ID NO: 436459 - RNA, 13 nt, Homo sapiens
gaucgacugccaa

SEQ ID NO: 436460 - RNA, 12 nt, Homo sapiens
gaucgcaccuuu

SEQ ID NO: 436461 - RNA, 20 nt, Homo sapiens
gaucggagccuccucucuca

SEQ ID NO: 436462 - RNA, 17 nt, Homo sapiens
gaucgguucugugccuu

SEQ ID NO: 436463 - RNA, 16 nt, Homo sapiens
gaucuaaaccaguccu

SEQ ID NO: 436464 - RNA, 19 nt, Homo sapiens
gaucuacacccaccagagu

SEQ ID NO: 436465 - RNA, 21 nt, Homo sapiens
gaucuacuucauagcuccuug

SEQ ID NO: 436466 - RNA, 17 nt, Homo sapiens
gaucuaucaccugucau

SEQ ID NO: 436467 - RNA, 18 nt, Homo sapiens
gaucuauuacucugacau

SEQ ID NO: 436468 - RNA, 20 nt, Homo sapiens
gaucucccuuaauaaacuca

SEQ ID NO: 436469 - RNA, 14 nt, Homo sapiens
gaucugaaaucauu

SEQ ID NO: 436470 - RNA, 12 nt, Homo sapiens
gaucugcagcuc

SEQ ID NO: 436471 - RNA, 17 nt, Homo sapiens
gaucuggcuuacagggg

SEQ ID NO: 436472 - RNA, 17 nt, Homo sapiens
gaucugggcacaaucau

SEQ ID NO: 436473 - RNA, 20 nt, Homo sapiens
gaucuuaaagcauuccccaa

SEQ ID NO: 436474 - RNA, 23 nt, Homo sapiens
gaucuuaaauuuugugauaugga

SEQ ID NO: 436475 - RNA, 14 nt, Homo sapiens
gaucuucacucugg

SEQ ID NO: 436476 - RNA, 21 nt, Homo sapiens
gaucuuugcuuccuugcuuuu

SEQ ID NO: 436477 - RNA, 18 nt, Homo sapiens
gaugaaaaugaaucuuca

SEQ ID NO: 436478 - RNA, 16 nt, Homo sapiens
gaugaaagcugauuac

SEQ ID NO: 436479 - RNA, 21 nt, Homo sapiens
gaugaagauucuccugugcua

SEQ ID NO: 436480 - RNA, 12 nt, Homo sapiens
gaugaagcacau

SEQ ID NO: 436481 - RNA, 20 nt, Homo sapiens
gaugaauagaugugaucacu

SEQ ID NO: 436482 - RNA, 23 nt, Homo sapiens
gaugaccccuccccuaaugccug

SEQ ID NO: 436483 - RNA, 14 nt, Homo sapiens
gaugaggucauuuc

SEQ ID NO: 436484 - RNA, 21 nt, Homo sapiens
gaugaucuggauccaccaaga

SEQ ID NO: 436485 - RNA, 17 nt, Homo sapiens
gaugauucuaugucuca

SEQ ID NO: 436486 - RNA, 14 nt, Homo sapiens
gaugcaagcaccug

SEQ ID NO: 436487 - RNA, 16 nt, Homo sapiens
gaugcaccaaguacag

SEQ ID NO: 436488 - RNA, 13 nt, Homo sapiens
gaugcaugagcuc

SEQ ID NO: 436489 - RNA, 15 nt, Homo sapiens
gaugcaugagcuccc

SEQ ID NO: 436490 - RNA, 16 nt, Homo sapiens
gaugcauggaguguuu

SEQ ID NO: 436491 - RNA, 20 nt, Homo sapiens
gaugccaaaaaagaugccaa

SEQ ID NO: 436492 - RNA, 20 nt, Homo sapiens
gaugccacgcuuugcugcua

SEQ ID NO: 436493 - RNA, 17 nt, Homo sapiens
gaugccccagagcucua

SEQ ID NO: 436494 - RNA, 23 nt, Homo sapiens
gaugcccgcccggggaguuuccg

SEQ ID NO: 436495 - RNA, 23 nt, Homo sapiens
gaugccucccggcuuugcaggga

SEQ ID NO: 436496 - RNA, 17 nt, Homo sapiens
gaugccucccugacccu

SEQ ID NO: 436497 - RNA, 16 nt, Homo sapiens
gaugccuccucugucc

SEQ ID NO: 436498 - RNA, 14 nt, Homo sapiens
cagauaauuuacuu

SEQ ID NO: 436499 - RNA, 14 nt, Homo sapiens
cagaucaacugagu

SEQ ID NO: 436500 - RNA, 21 nt, Homo sapiens
cagaucaacugaguucaggag

SEQ ID NO: 436501 - RNA, 16 nt, Homo sapiens
cagaucacuacugcag

SEQ ID NO: 436502 - RNA, 19 nt, Homo sapiens
cagaucaguuuuccuaguc

SEQ ID NO: 436503 - RNA, 15 nt, Homo sapiens
cagaucauauuucac

SEQ ID NO: 436504 - RNA, 17 nt, Homo sapiens
cagaucauauuucacaa

SEQ ID NO: 436505 - RNA, 16 nt, Homo sapiens
cagaucugaacacagu

SEQ ID NO: 436506 - RNA, 23 nt, Homo sapiens
cagaucuggucuaguuaaccuag

SEQ ID NO: 436507 - RNA, 13 nt, Homo sapiens
cagaucugugcuc

SEQ ID NO: 436508 - RNA, 23 nt, Homo sapiens
cagaucuguuucgugcauuggaa

SEQ ID NO: 436509 - RNA, 22 nt, Homo sapiens
cagaucuuugcugccagccacu

SEQ ID NO: 436510 - RNA, 20 nt, Homo sapiens
cagaugacuagaaagugaau

SEQ ID NO: 436511 - RNA, 21 nt, Homo sapiens
cagaugagcaaggacauugcc

SEQ ID NO: 436512 - RNA, 22 nt, Homo sapiens
cagaugauucuaugucucauga

SEQ ID NO: 436513 - RNA, 21 nt, Homo sapiens
cagaugccaaaaaagaugcca

SEQ ID NO: 436514 - RNA, 19 nt, Homo sapiens
cagaugccccagagcuguu

SEQ ID NO: 436515 - RNA, 18 nt, Homo sapiens
cagaugccuccucugucc

SEQ ID NO: 436516 - RNA, 15 nt, Homo sapiens
cagauggcugugaaa

SEQ ID NO: 436517 - RNA, 23 nt, Homo sapiens
cagaugggcuguuucguguagug

SEQ ID NO: 436518 - RNA, 15 nt, Homo sapiens
cagauggggccucug

SEQ ID NO: 436519 - RNA, 18 nt, Homo sapiens
cagauguuggaccaacac

SEQ ID NO: 436520 - RNA, 17 nt, Homo sapiens
cagauguuuguuuucaa

SEQ ID NO: 436521 - RNA, 15 nt, Homo sapiens
cagauuaauagauuu

SEQ ID NO: 436522 - RNA, 13 nt, Homo sapiens
caguggcuccuau

SEQ ID NO: 436523 - RNA, 15 nt, Homo sapiens
cagugggcagugcau

SEQ ID NO: 436524 - RNA, 16 nt, Homo sapiens
cagugguuggcaauug

SEQ ID NO: 436525 - RNA, 20 nt, Homo sapiens
caguguagcccacacuugag

SEQ ID NO: 436526 - RNA, 21 nt, Homo sapiens
caguguagcccacacuugaga

SEQ ID NO: 436527 - RNA, 20 nt, Homo sapiens
caguguauuuuaaauucuca

SEQ ID NO: 436528 - RNA, 19 nt, Homo sapiens
caguguccugugcuuucug

SEQ ID NO: 436529 - RNA, 13 nt, Homo sapiens
cagugucuuccau

SEQ ID NO: 436530 - RNA, 19 nt, Homo sapiens
cagugucuuguaacaacua

SEQ ID NO: 436531 - RNA, 21 nt, Homo sapiens
cagugugagauuucucauuga

SEQ ID NO: 436532 - RNA, 15 nt, Homo sapiens
cagugugguuugcau

SEQ ID NO: 436533 - RNA, 16 nt, Homo sapiens
caguguguacuucuuc

SEQ ID NO: 436534 - RNA, 17 nt, Homo sapiens
caguguuaccuggugua

SEQ ID NO: 436535 - RNA, 17 nt, Homo sapiens
caguguuuucaccucau

SEQ ID NO: 436536 - RNA, 13 nt, Homo sapiens
caguguuuugcca

SEQ ID NO: 436537 - RNA, 20 nt, Homo sapiens
caguguuuugccauguuggc

SEQ ID NO: 436538 - RNA, 14 nt, Homo sapiens
caguuaaaggcaac

SEQ ID NO: 436539 - RNA, 19 nt, Homo sapiens
caguuaaaucccccaccuc

SEQ ID NO: 436540 - RNA, 20 nt, Homo sapiens
caguuaagacaacaggcauu

SEQ ID NO: 436541 - RNA, 18 nt, Homo sapiens
caguuaagagaaaugagc

SEQ ID NO: 436542 - RNA, 16 nt, Homo sapiens
caguuacuccaguaua

SEQ ID NO: 436543 - RNA, 17 nt, Homo sapiens
caguuauagaaaaucua

SEQ ID NO: 436544 - RNA, 17 nt, Homo sapiens
caguucagguaugugug

SEQ ID NO: 436545 - RNA, 14 nt, Homo sapiens
caguuccagcuuuu

SEQ ID NO: 436546 - RNA, 16 nt, Homo sapiens
caguuccuuaggagau

SEQ ID NO: 436547 - RNA, 13 nt, Homo sapiens
caguucucacucc

SEQ ID NO: 436548 - RNA, 16 nt, Homo sapiens
caguucucucccuucc

SEQ ID NO: 436549 - RNA, 17 nt, Homo sapiens
caguucugaacuggaac

SEQ ID NO: 436550 - RNA, 12 nt, Homo sapiens
caguucugauga

SEQ ID NO: 436551 - RNA, 19 nt, Homo sapiens
caguucugucauauguuaa

SEQ ID NO: 436552 - RNA, 21 nt, Homo sapiens
caguugaaugacaacagaagc

SEQ ID NO: 436553 - RNA, 19 nt, Homo sapiens
caguuggacucucagggau

SEQ ID NO: 436554 - RNA, 14 nt, Homo sapiens
caguuggugcugcu

SEQ ID NO: 436555 - RNA, 14 nt, Homo sapiens
caguugguuuugca

SEQ ID NO: 436556 - RNA, 24 nt, Homo sapiens
caguugucccgauuguaacucaaa

SEQ ID NO: 436557 - RNA, 20 nt, Homo sapiens
caguuuaugcagugcugcuu

SEQ ID NO: 436558 - RNA, 20 nt, Homo sapiens
caguuucagguguuuaguug

SEQ ID NO: 436559 - RNA, 17 nt, Homo sapiens
caguuugaaaagacaaa

SEQ ID NO: 436560 - RNA, 18 nt, Homo sapiens
caguuugaaggcugcaca

SEQ ID NO: 436561 - RNA, 21 nt, Homo sapiens
caguuuuaucuuuaaucuccu

SEQ ID NO: 436562 - RNA, 23 nt, Homo sapiens
caguuuuguuuugagggcuauua

SEQ ID NO: 436563 - RNA, 13 nt, Homo sapiens
caguuuuuugcca

SEQ ID NO: 436564 - RNA, 22 nt, Homo sapiens
cauaaaaagaaaugugaaguuu

SEQ ID NO: 436565 - RNA, 22 nt, Homo sapiens
cauaaaaagccugcaauuucau

SEQ ID NO: 436566 - RNA, 19 nt, Homo sapiens
cauaaaaaucccucuuccu

SEQ ID NO: 436567 - RNA, 17 nt, Homo sapiens
cauaaaacaaaaccaag

SEQ ID NO: 436568 - RNA, 19 nt, Homo sapiens
cauaaaagacaagcacuuu

SEQ ID NO: 436569 - RNA, 16 nt, Homo sapiens
cauaaaaguccuguca

SEQ ID NO: 436570 - RNA, 16 nt, Homo sapiens
cauaaaauaaacugaa

SEQ ID NO: 436571 - RNA, 14 nt, Homo sapiens
cauaaaaucuguga

SEQ ID NO: 436572 - RNA, 16 nt, Homo sapiens
cauaaagaaacacuuu

SEQ ID NO: 436573 - RNA, 15 nt, Homo sapiens
cauaaagaaagugag

SEQ ID NO: 436574 - RNA, 14 nt, Homo sapiens
cauaaauguuauau

SEQ ID NO: 436575 - RNA, 22 nt, Homo sapiens
cauaaauuacuuuuucauucuu

SEQ ID NO: 436576 - RNA, 22 nt, Homo sapiens
cauaaauuagaggucuccaaaa

SEQ ID NO: 436577 - RNA, 17 nt, Homo sapiens
cauaaauuauuucuaaa

SEQ ID NO: 436578 - RNA, 14 nt, Homo sapiens
cauaacaugcuuua

SEQ ID NO: 436579 - RNA, 19 nt, Homo sapiens
cauaaggcauauacaaaua

SEQ ID NO: 436580 - RNA, 19 nt, Homo sapiens
cauaagggacugugccaga

SEQ ID NO: 436581 - RNA, 22 nt, Homo sapiens
cauaaguauacaguucaauaaa

SEQ ID NO: 436582 - RNA, 21 nt, Homo sapiens
cauaauaaaaggaguucagau

SEQ ID NO: 436583 - RNA, 15 nt, Homo sapiens
cauaaucuaguuuac

SEQ ID NO: 436584 - RNA, 21 nt, Homo sapiens
cauaauggacucuguggugcc

SEQ ID NO: 436585 - RNA, 13 nt, Homo sapiens
cauaauguaauga

SEQ ID NO: 436586 - RNA, 23 nt, Homo sapiens
cauaauguaaugaggugguacua

SEQ ID NO: 436587 - RNA, 22 nt, Homo sapiens
cauaauguauuuaaccagucuu

SEQ ID NO: 436588 - RNA, 16 nt, Homo sapiens
cauaaugucauacgaa

SEQ ID NO: 436589 - RNA, 16 nt, Homo sapiens
cauaauguuacauuau

SEQ ID NO: 436590 - RNA, 21 nt, Homo sapiens
cauaauguuacauuauuauca

SEQ ID NO: 436591 - RNA, 19 nt, Homo sapiens
cauaauguugaacauucau

SEQ ID NO: 436592 - RNA, 19 nt, Homo sapiens
cauaauuuagaguguaugu

SEQ ID NO: 436593 - RNA, 21 nt, Homo sapiens
cauaauuuucuucaugcaaug

SEQ ID NO: 436594 - RNA, 13 nt, Homo sapiens
cauaauuuugcca

SEQ ID NO: 436595 - RNA, 16 nt, Homo sapiens
cauacagcacuacuua

SEQ ID NO: 436596 - RNA, 18 nt, Homo sapiens
cauacauuuguggucuga

SEQ ID NO: 436597 - RNA, 18 nt, Homo sapiens
cauaccccggugugccug

SEQ ID NO: 436598 - RNA, 23 nt, Homo sapiens
cauacgaaccuaaagaauaugaa

SEQ ID NO: 436599 - RNA, 15 nt, Homo sapiens
cauacgcaugguccu

SEQ ID NO: 436600 - RNA, 21 nt, Homo sapiens
cauacggcucuaacagauuag

SEQ ID NO: 436601 - RNA, 22 nt, Homo sapiens
cauacucuguguaaucucugau

SEQ ID NO: 436602 - RNA, 13 nt, Homo sapiens
cauagacugcaaa

SEQ ID NO: 436603 - RNA, 15 nt, Homo sapiens
cauagauauaucuuu

SEQ ID NO: 436604 - RNA, 16 nt, Homo sapiens
cauagauucaccugua

SEQ ID NO: 436605 - RNA, 12 nt, Homo sapiens
cauagccuauaa

SEQ ID NO: 436606 - RNA, 23 nt, Homo sapiens
cauagcgcugcucuuaugccauu

SEQ ID NO: 436607 - RNA, 14 nt, Homo sapiens
cauagcuggucuua

SEQ ID NO: 436608 - RNA, 23 nt, Homo sapiens
cauaggaaaucuuguccagagac

SEQ ID NO: 436609 - RNA, 20 nt, Homo sapiens
cauaggacuggaaguuugcc

SEQ ID NO: 436610 - RNA, 21 nt, Homo sapiens
cauagucuuuguuuacaugag

SEQ ID NO: 436611 - RNA, 13 nt, Homo sapiens
cauagugcacuag

SEQ ID NO: 436612 - RNA, 13 nt, Homo sapiens
cauauaauguugu

SEQ ID NO: 436613 - RNA, 19 nt, Homo sapiens
cauauaauguuguuauuua

SEQ ID NO: 436614 - RNA, 13 nt, Homo sapiens
cauauaccagcaa

SEQ ID NO: 436615 - RNA, 16 nt, Homo sapiens
cauauaccagcaauau

SEQ ID NO: 436616 - RNA, 21 nt, Homo sapiens
cauaucaagaaauugauugaa

SEQ ID NO: 436617 - RNA, 14 nt, Homo sapiens
cauaucagcucucu

SEQ ID NO: 436618 - RNA, 17 nt, Homo sapiens
cauaucuguaugccuca

SEQ ID NO: 436619 - RNA, 22 nt, Homo sapiens
cauaugaggacgaggaguaaug

SEQ ID NO: 436620 - RNA, 15 nt, Homo sapiens
cauaugcaaacagcc

SEQ ID NO: 436621 - RNA, 17 nt, Homo sapiens
cauaugucuuacuacuu

SEQ ID NO: 436622 - RNA, 13 nt, Homo sapiens
cauaugucuucaa

SEQ ID NO: 436623 - RNA, 22 nt, Homo sapiens
cauauuaauugguuugugccuu

SEQ ID NO: 436624 - RNA, 12 nt, Homo sapiens
cauauucacagu

SEQ ID NO: 436625 - RNA, 21 nt, Homo sapiens
cauauugaggggcaacuccag

SEQ ID NO: 436626 - RNA, 21 nt, Homo sapiens
cauauuugcuucuaauguucc

SEQ ID NO: 436627 - RNA, 20 nt, Homo sapiens
cauauuuuccuuuagaucaa

SEQ ID NO: 436628 - RNA, 16 nt, Homo sapiens
cauauuuuuacaaaua

SEQ ID NO: 436629 - RNA, 23 nt, Homo sapiens
cauauuuuuauauuauguuaaag

SEQ ID NO: 436630 - RNA, 18 nt, Homo sapiens
caucaaaacaaaacagca

SEQ ID NO: 436631 - RNA, 19 nt, Homo sapiens
caucaauaaauacuuuaac

SEQ ID NO: 436632 - RNA, 19 nt, Homo sapiens
caucaaugcugaguuaaua

SEQ ID NO: 436633 - RNA, 16 nt, Homo sapiens
caucaauucucuauca

SEQ ID NO: 436634 - RNA, 15 nt, Homo sapiens
caucagaaauaguca

SEQ ID NO: 436635 - RNA, 17 nt, Homo sapiens
gcacacaugguuuccaa

SEQ ID NO: 436636 - RNA, 15 nt, Homo sapiens
gcacacccauucaca

SEQ ID NO: 436637 - RNA, 21 nt, Homo sapiens
gcacacuugcacccaugugua

SEQ ID NO: 436638 - RNA, 12 nt, Homo sapiens
gcacagaacaag

SEQ ID NO: 436639 - RNA, 23 nt, Homo sapiens
gcacagagagggggccaccuccc

SEQ ID NO: 436640 - RNA, 19 nt, Homo sapiens
gcacagagucgaugcucaa

SEQ ID NO: 436641 - RNA, 17 nt, Homo sapiens
gcacauaugcaagccau

SEQ ID NO: 436642 - RNA, 16 nt, Homo sapiens
gcacaucauuggaaua

SEQ ID NO: 436643 - RNA, 15 nt, Homo sapiens
gcacauccaggcaau

SEQ ID NO: 436644 - RNA, 14 nt, Homo sapiens
gcacauguguucag

SEQ ID NO: 436645 - RNA, 21 nt, Homo sapiens
gcacauucucccuugauucca

SEQ ID NO: 436646 - RNA, 17 nt, Homo sapiens
gcaccagccugagccac

SEQ ID NO: 436647 - RNA, 18 nt, Homo sapiens
gcaccagugugacaucua

SEQ ID NO: 436648 - RNA, 17 nt, Homo sapiens
gcaccccaaagcuuucc

SEQ ID NO: 436649 - RNA, 21 nt, Homo sapiens
gcaccccaugugggugaccag

SEQ ID NO: 436650 - RNA, 17 nt, Homo sapiens
gcacccccacccaccuc

SEQ ID NO: 436651 - RNA, 21 nt, Homo sapiens
ggaacucccaagaacagcagg

SEQ ID NO: 436652 - RNA, 21 nt, Homo sapiens
ggaacucuucaugagcacuuu

SEQ ID NO: 436653 - RNA, 15 nt, Homo sapiens
ggaacugguccaggc

SEQ ID NO: 436654 - RNA, 21 nt, Homo sapiens
ccauaggacauacugcaugua

SEQ ID NO: 436655 - RNA, 21 nt, Homo sapiens
ccauauaggauuauagauacu

SEQ ID NO: 436656 - RNA, 12 nt, Homo sapiens
ccauauucacac

SEQ ID NO: 436657 - RNA, 21 nt, Homo sapiens
ccaucagcucucugcaaagau

SEQ ID NO: 436658 - RNA, 23 nt, Homo sapiens
ccaucagugcacaaaucauucca

SEQ ID NO: 436659 - RNA, 16 nt, Homo sapiens
ccaucaguuacugguu

SEQ ID NO: 436660 - RNA, 13 nt, Homo sapiens
ccaucaugccuga

SEQ ID NO: 436661 - RNA, 23 nt, Homo sapiens
ccaucaugggcuggacauuggac

SEQ ID NO: 436662 - RNA, 22 nt, Homo sapiens
ccauccaauggauugugcaaau

SEQ ID NO: 436663 - RNA, 24 nt, Homo sapiens
ccauccagcaugugugugucucua

SEQ ID NO: 436664 - RNA, 17 nt, Homo sapiens
ccaucccucggacccac

SEQ ID NO: 436665 - RNA, 10 nt, Homo sapiens
ccauccucac

SEQ ID NO: 436666 - RNA, 21 nt, Homo sapiens
ccaucggguaagaugcuccug

SEQ ID NO: 436667 - RNA, 23 nt, Homo sapiens
ccaucuaaaacucauacaaugau

SEQ ID NO: 436668 - RNA, 21 nt, Homo sapiens
ccaucuaaugcuuguuuauga

SEQ ID NO: 436669 - RNA, 22 nt, Homo sapiens
ccaucuccaggccccuuaccug

SEQ ID NO: 436670 - RNA, 16 nt, Homo sapiens
ccaucuccuaucuuuu

SEQ ID NO: 436671 - RNA, 17 nt, Homo sapiens
ccaucugcugccaugag

SEQ ID NO: 436672 - RNA, 13 nt, Homo sapiens
ccaucugcuuaca

SEQ ID NO: 436673 - RNA, 12 nt, Homo sapiens
ccaucuguagag

SEQ ID NO: 436674 - RNA, 16 nt, Homo sapiens
ccaucuguuugauaca

SEQ ID NO: 436675 - RNA, 16 nt, Homo sapiens
ccaucuuaaucuuuau

SEQ ID NO: 436676 - RNA, 21 nt, Homo sapiens
ccaugacugcauuuuacugua

SEQ ID NO: 436677 - RNA, 21 nt, Homo sapiens
ccaugagcaccccaaggcugc

SEQ ID NO: 436678 - RNA, 22 nt, Homo sapiens
ccaugagccugcccgcugcaau

SEQ ID NO: 436679 - RNA, 12 nt, Homo sapiens
ccaugauaucac

SEQ ID NO: 436680 - RNA, 17 nt, Homo sapiens
ccaugcagaucuagcca

SEQ ID NO: 436681 - RNA, 17 nt, Homo sapiens
ccaugccccuggaccag

SEQ ID NO: 436682 - RNA, 16 nt, Homo sapiens
ccaugcucauaccucu

SEQ ID NO: 436683 - RNA, 10 nt, Homo sapiens
ccaugcucuu

SEQ ID NO: 436684 - RNA, 16 nt, Homo sapiens
ccaugcugaccugugu

SEQ ID NO: 436685 - RNA, 17 nt, Homo sapiens
ccauggcccagcagcuu

SEQ ID NO: 436686 - RNA, 15 nt, Homo sapiens
ccauggccccagcug

SEQ ID NO: 436687 - RNA, 17 nt, Homo sapiens
ccaugggccugggccug

SEQ ID NO: 436688 - RNA, 21 nt, Homo sapiens
ccaugggggcagggcaugacu

SEQ ID NO: 436689 - RNA, 20 nt, Homo sapiens
ccaugggggcuccagacauu

SEQ ID NO: 436690 - RNA, 18 nt, Homo sapiens
ccaugguagacugugaca

SEQ ID NO: 436691 - RNA, 15 nt, Homo sapiens
ccauggugcacaaaa

SEQ ID NO: 436692 - RNA, 19 nt, Homo sapiens
ccauggugcagugaagaaa

SEQ ID NO: 436693 - RNA, 23 nt, Homo sapiens
ccauggugggagagacugugagg

SEQ ID NO: 436694 - RNA, 19 nt, Homo sapiens
ccauguaaucugacgucau

SEQ ID NO: 436695 - RNA, 16 nt, Homo sapiens
ccauguacaugaagaa

SEQ ID NO: 436696 - RNA, 17 nt, Homo sapiens
ccauguaccaguguacu

SEQ ID NO: 436697 - RNA, 19 nt, Homo sapiens
ccauguaccaguguacugc

SEQ ID NO: 436698 - RNA, 17 nt, Homo sapiens
ccauguaucuaccucac

SEQ ID NO: 436699 - RNA, 19 nt, Homo sapiens
ccaugucgccucugcauuc

SEQ ID NO: 436700 - RNA, 16 nt, Homo sapiens
ccaugucuacaaaagc

SEQ ID NO: 436701 - RNA, 18 nt, Homo sapiens
ccaugugauuaaguuccu

SEQ ID NO: 436702 - RNA, 14 nt, Homo sapiens
ccaugugcccaguu

SEQ ID NO: 436703 - RNA, 19 nt, Homo sapiens
ccaugugugagugugugca

SEQ ID NO: 436704 - RNA, 15 nt, Homo sapiens
ccaugugugugcaag

SEQ ID NO: 436705 - RNA, 16 nt, Homo sapiens
ccaugugugugcaagu

SEQ ID NO: 436706 - RNA, 12 nt, Homo sapiens
ccauguguuuca

SEQ ID NO: 436707 - RNA, 19 nt, Homo sapiens
ccauguguuuugcuuuuau

SEQ ID NO: 436708 - RNA, 15 nt, Homo sapiens
ccauguuuaaacuuu

SEQ ID NO: 436709 - RNA, 19 nt, Homo sapiens
ccauguuucauuaaucaag

SEQ ID NO: 436710 - RNA, 15 nt, Homo sapiens
ccauucacuacaggu

SEQ ID NO: 436711 - RNA, 21 nt, Homo sapiens
ccauucauacccacacaccca

SEQ ID NO: 436712 - RNA, 16 nt, Homo sapiens
ccauucccccaugugg

SEQ ID NO: 436713 - RNA, 19 nt, Homo sapiens
ccauugaccucagcugcac

SEQ ID NO: 436714 - RNA, 16 nt, Homo sapiens
ccauugagacuauuua

SEQ ID NO: 436715 - RNA, 23 nt, Homo sapiens
ccauugcaaaagguuaagccaua

SEQ ID NO: 436716 - RNA, 20 nt, Homo sapiens
ccauugcucccagugccaaa

SEQ ID NO: 436717 - RNA, 21 nt, Homo sapiens
ccauuguacccugcuguauaa

SEQ ID NO: 436718 - RNA, 20 nt, Homo sapiens
ccauuguguaugauuuugau

SEQ ID NO: 436719 - RNA, 20 nt, Homo sapiens
ccauuguuuugccagugaag

SEQ ID NO: 436720 - RNA, 14 nt, Homo sapiens
ccauuuaaucauuu

SEQ ID NO: 436721 - RNA, 21 nt, Homo sapiens
ccauuuauaauguuaguagaa

SEQ ID NO: 436722 - RNA, 16 nt, Homo sapiens
ccauuugugauacuuc

SEQ ID NO: 436723 - RNA, 17 nt, Homo sapiens
ccauuugugauacuucc

SEQ ID NO: 436724 - RNA, 18 nt, Homo sapiens
ccauuugugugugugcaa

SEQ ID NO: 436725 - RNA, 22 nt, Homo sapiens
ccauuuuaugaguucuguauaa

SEQ ID NO: 436726 - RNA, 23 nt, Homo sapiens
ccauuuuguggauuguguccuau

SEQ ID NO: 436727 - RNA, 16 nt, Homo sapiens
ccauuuuuuucacuca

SEQ ID NO: 436728 - RNA, 13 nt, Homo sapiens
cccaaacccagcc

SEQ ID NO: 436729 - RNA, 13 nt, Homo sapiens
cccaaacucccag

SEQ ID NO: 436730 - RNA, 17 nt, Homo sapiens
cccaaagcuggagccaa

SEQ ID NO: 436731 - RNA, 23 nt, Homo sapiens
cccaaccucaaugcccugccauu

SEQ ID NO: 436732 - RNA, 20 nt, Homo sapiens
cccaacuacccgggccugac

SEQ ID NO: 436733 - RNA, 21 nt, Homo sapiens
cccaagguaaacaguuugaaa

SEQ ID NO: 436734 - RNA, 16 nt, Homo sapiens
cccaagguggucuugg

SEQ ID NO: 436735 - RNA, 13 nt, Homo sapiens
cccaaugccugcu

SEQ ID NO: 436736 - RNA, 20 nt, Homo sapiens
cccacaagugccacugcccg

SEQ ID NO: 436737 - RNA, 22 nt, Homo sapiens
cccacaauggcugggagggggc

SEQ ID NO: 436738 - RNA, 22 nt, Homo sapiens
cccacacccuggaggauuucau

SEQ ID NO: 436739 - RNA, 23 nt, Homo sapiens
cccacagagucuguguguagcca

SEQ ID NO: 436740 - RNA, 13 nt, Homo sapiens
cccacagugcuca

SEQ ID NO: 436741 - RNA, 19 nt, Homo sapiens
cccacauaauacauuccau

SEQ ID NO: 436742 - RNA, 23 nt, Homo sapiens
cccacaucccacuggaucuggcu

SEQ ID NO: 436743 - RNA, 19 nt, Homo sapiens
cccaccagcaauacaaaga

SEQ ID NO: 436744 - RNA, 22 nt, Homo sapiens
cccaccaugcaccccugauguu

SEQ ID NO: 436745 - RNA, 17 nt, Homo sapiens
cccacccccuucucugc

SEQ ID NO: 436746 - RNA, 17 nt, Homo sapiens
cccaccuccugcaauaa

SEQ ID NO: 436747 - RNA, 20 nt, Homo sapiens
cccaccugggcccuaggcau

SEQ ID NO: 436748 - RNA, 22 nt, Homo sapiens
cccacguggacucugugcucac

SEQ ID NO: 436749 - RNA, 23 nt, Homo sapiens
cccacgugggccuuuugcucagu

SEQ ID NO: 436750 - RNA, 13 nt, Homo sapiens
cccacugagauuu

SEQ ID NO: 436751 - RNA, 22 nt, Homo sapiens
cccacuguccuuucuccaggcc

SEQ ID NO: 436752 - RNA, 20 nt, Homo sapiens
cccagaagcucaaggcugca

SEQ ID NO: 436753 - RNA, 23 nt, Homo sapiens
cccagaagcucaaggcugcagug

SEQ ID NO: 436754 - RNA, 16 nt, Homo sapiens
cccagacauccuguga

SEQ ID NO: 436755 - RNA, 17 nt, Homo sapiens
cccagacuuucuacacc

SEQ ID NO: 436756 - RNA, 15 nt, Homo sapiens
cccagagaagccuca

SEQ ID NO: 436757 - RNA, 22 nt, Homo sapiens
cccagaguagcccaggucacug

SEQ ID NO: 436758 - RNA, 15 nt, Homo sapiens
cccagauagguggug

SEQ ID NO: 436759 - RNA, 15 nt, Homo sapiens
cccagcaccugccag

SEQ ID NO: 436760 - RNA, 18 nt, Homo sapiens
cccagcacuuuagaucac

SEQ ID NO: 436761 - RNA, 20 nt, Homo sapiens
cccagccaaacccugucuga

SEQ ID NO: 436762 - RNA, 15 nt, Homo sapiens
cccagccucaucucu

SEQ ID NO: 436763 - RNA, 23 nt, Homo sapiens
cccagccucuagaacagccagac

SEQ ID NO: 436764 - RNA, 14 nt, Homo sapiens
cccagcuaccccuu

SEQ ID NO: 436765 - RNA, 15 nt, Homo sapiens
cccagcucagucuuc

SEQ ID NO: 436766 - RNA, 14 nt, Homo sapiens
cccagcuccacuca

SEQ ID NO: 436767 - RNA, 12 nt, Homo sapiens
cccagcucugac

SEQ ID NO: 436768 - RNA, 16 nt, Homo sapiens
cccaggacgcuucuga

SEQ ID NO: 436769 - RNA, 20 nt, Homo sapiens
cccaggcccgagaugugacc

SEQ ID NO: 436770 - RNA, 17 nt, Homo sapiens
cccaggccuccagccuc

SEQ ID NO: 436771 - RNA, 20 nt, Homo sapiens
cccaggcuggagugcaacgg

SEQ ID NO: 436772 - RNA, 19 nt, Homo sapiens
cccaggcuggagugcaaug

SEQ ID NO: 436773 - RNA, 17 nt, Homo sapiens
cccaggcuggagugcag

SEQ ID NO: 436774 - RNA, 18 nt, Homo sapiens
cccaggcuggagugcagu

SEQ ID NO: 436775 - RNA, 23 nt, Homo sapiens
cccaggcuggagugcaguagcac

SEQ ID NO: 436776 - RNA, 19 nt, Homo sapiens
cccaggcuggagugcagug

SEQ ID NO: 436777 - RNA, 16 nt, Homo sapiens
cccaggucacuguuaa

SEQ ID NO: 436778 - RNA, 19 nt, Homo sapiens
cccaguaagccacugccac

SEQ ID NO: 436779 - RNA, 11 nt, Homo sapiens
cccaguagcca

SEQ ID NO: 436780 - RNA, 20 nt, Homo sapiens
ggcuccucaccaccgagaca

SEQ ID NO: 436781 - RNA, 15 nt, Homo sapiens
ggcucuaccaagaca

SEQ ID NO: 436782 - RNA, 24 nt, Homo sapiens
ggcucugcgucccacugagucuca

SEQ ID NO: 436783 - RNA, 18 nt, Homo sapiens
ggcucuuuccuugcucaa

SEQ ID NO: 436784 - RNA, 19 nt, Homo sapiens
ggcugcaagcugcagggaa

SEQ ID NO: 436785 - RNA, 17 nt, Homo sapiens
ggcugcacccacccagg

SEQ ID NO: 436786 - RNA, 18 nt, Homo sapiens
ggcugcacccacccagga

SEQ ID NO: 436787 - RNA, 18 nt, Homo sapiens
ggcugcccacacacccca

SEQ ID NO: 436788 - RNA, 19 nt, Homo sapiens
ggcugccccaaccugcuga

SEQ ID NO: 436789 - RNA, 22 nt, Homo sapiens
ggcugccgugcacggggccagc

SEQ ID NO: 436790 - RNA, 11 nt, Homo sapiens
cccuugcccaa

SEQ ID NO: 436791 - RNA, 18 nt, Homo sapiens
cccuuggggguucaggga

SEQ ID NO: 436792 - RNA, 19 nt, Homo sapiens
cccuuggggguucagggaa

SEQ ID NO: 436793 - RNA, 21 nt, Homo sapiens
cccuugugcgugggugaagcc

SEQ ID NO: 436794 - RNA, 18 nt, Homo sapiens
cccuuuccagauauucaa

SEQ ID NO: 436795 - RNA, 20 nt, Homo sapiens
cccuuucuguaccauuuauu

SEQ ID NO: 436796 - RNA, 20 nt, Homo sapiens
cccuuucugugugaagauca

SEQ ID NO: 436797 - RNA, 21 nt, Homo sapiens
cccuuuggagaacgccagucu

SEQ ID NO: 436798 - RNA, 20 nt, Homo sapiens
ccgaaaaggauaugcaguau

SEQ ID NO: 436799 - RNA, 15 nt, Homo sapiens
ccgacccccuuucua

SEQ ID NO: 436800 - RNA, 20 nt, Homo sapiens
ccgagagagauggaauaaag

SEQ ID NO: 436801 - RNA, 15 nt, Homo sapiens
ccgagccagcagcug

SEQ ID NO: 436802 - RNA, 15 nt, Homo sapiens
ccgagucucuucucc

SEQ ID NO: 436803 - RNA, 22 nt, Homo sapiens
ccgaguggauagaugcccugcu

SEQ ID NO: 436804 - RNA, 18 nt, Homo sapiens
ccgaguggccauggcaug

SEQ ID NO: 436805 - RNA, 17 nt, Homo sapiens
ccgauguggaccucuac

SEQ ID NO: 436806 - RNA, 18 nt, Homo sapiens
ccgcagugggaagugaau

SEQ ID NO: 436807 - RNA, 14 nt, Homo sapiens
ccgcaugugucugu

SEQ ID NO: 436808 - RNA, 21 nt, Homo sapiens
ccgccauugccaccaggagaa

SEQ ID NO: 436809 - RNA, 22 nt, Homo sapiens
ccgccucugcccucauccuccc

SEQ ID NO: 436810 - RNA, 22 nt, Homo sapiens
ccgccuuccuccuccacagugc

SEQ ID NO: 436811 - RNA, 21 nt, Homo sapiens
ccgcgcucugccccuccgucc

SEQ ID NO: 436812 - RNA, 14 nt, Homo sapiens
ccgcggugcucugg

SEQ ID NO: 436813 - RNA, 15 nt, Homo sapiens
ccgcucucucaugug

SEQ ID NO: 436814 - RNA, 18 nt, Homo sapiens
ccgcucugaggcaacccc

SEQ ID NO: 436815 - RNA, 21 nt, Homo sapiens
ccgcugcauccgugagcagug

SEQ ID NO: 436816 - RNA, 18 nt, Homo sapiens
ccgcugggagaaaagcca

SEQ ID NO: 436817 - RNA, 21 nt, Homo sapiens
ccggaaguugcugugccccau

SEQ ID NO: 436818 - RNA, 14 nt, Homo sapiens
ccggcaaccuguaa

SEQ ID NO: 436819 - RNA, 23 nt, Homo sapiens
ccggcgaaauaaaaucagaguug

SEQ ID NO: 436820 - RNA, 17 nt, Homo sapiens
ccggcuuugcagggaga

SEQ ID NO: 436821 - RNA, 20 nt, Homo sapiens
ccggcuuugcagggagacca

SEQ ID NO: 436822 - RNA, 14 nt, Homo sapiens
ccgggacgcagggg

SEQ ID NO: 436823 - RNA, 22 nt, Homo sapiens
ccggggcaagagggaaggugac

SEQ ID NO: 436824 - RNA, 16 nt, Homo sapiens
ccggggcuccacugaa

SEQ ID NO: 436825 - RNA, 13 nt, Homo sapiens
ccgggugccauuc

SEQ ID NO: 436826 - RNA, 19 nt, Homo sapiens
ccggguuagccuggugaca

SEQ ID NO: 436827 - RNA, 15 nt, Homo sapiens
ccggguucuccugau

SEQ ID NO: 436828 - RNA, 12 nt, Homo sapiens
ccggugcucugg

SEQ ID NO: 436829 - RNA, 17 nt, Homo sapiens
ccgguugcuucugggaa

SEQ ID NO: 436830 - RNA, 21 nt, Homo sapiens
ccguaccucuucccaugacug

SEQ ID NO: 436831 - RNA, 22 nt, Homo sapiens
ccguaccucuucccaugacugc

SEQ ID NO: 436832 - RNA, 15 nt, Homo sapiens
ccgucaccagaauua

SEQ ID NO: 436833 - RNA, 23 nt, Homo sapiens
ccgucagccaaauguaauugaau

SEQ ID NO: 436834 - RNA, 16 nt, Homo sapiens
ccgugacccaugcgau

SEQ ID NO: 436835 - RNA, 13 nt, Homo sapiens
ccgugacccugag

SEQ ID NO: 436836 - RNA, 16 nt, Homo sapiens
ccgugcucacuaccaa

SEQ ID NO: 436837 - RNA, 23 nt, Homo sapiens
ccguggcuuugguuuaaaagaca

SEQ ID NO: 436838 - RNA, 20 nt, Homo sapiens
ccgugggaauuuuaucuuuu

SEQ ID NO: 436839 - RNA, 12 nt, Homo sapiens
ccgugggccaug

SEQ ID NO: 436840 - RNA, 15 nt, Homo sapiens
ccguuaaaaaaucaa

SEQ ID NO: 436841 - RNA, 13 nt, Homo sapiens
ccguuccagcuga

SEQ ID NO: 436842 - RNA, 11 nt, Homo sapiens
ccguugcacaa

SEQ ID NO: 436843 - RNA, 19 nt, Homo sapiens
ccguugcgggguggaguga

SEQ ID NO: 436844 - RNA, 20 nt, Homo sapiens
ccguugcugcguucuuucaa

SEQ ID NO: 436845 - RNA, 21 nt, Homo sapiens
ccguuggcaccucugugccac

SEQ ID NO: 436846 - RNA, 20 nt, Homo sapiens
ccguuuuuacuaaguaaaag

SEQ ID NO: 436847 - RNA, 14 nt, Homo sapiens
ccuaaaaaaagaga

SEQ ID NO: 436848 - RNA, 22 nt, Homo sapiens
ccuaaaacaccuggacauuccc

SEQ ID NO: 436849 - RNA, 18 nt, Homo sapiens
ccuaaaaggaaaucucac

SEQ ID NO: 436850 - RNA, 21 nt, Homo sapiens
ccuaaaaguuacuuaccacag

SEQ ID NO: 436851 - RNA, 17 nt, Homo sapiens
ccuaaaauuguaugaaa

SEQ ID NO: 436852 - RNA, 22 nt, Homo sapiens
ccuaaaugaugccuuugucugu

SEQ ID NO: 436853 - RNA, 12 nt, Homo sapiens
ccuaacaaaaga

SEQ ID NO: 436854 - RNA, 13 nt, Homo sapiens
ccuaacaaaagau

SEQ ID NO: 436855 - RNA, 11 nt, Homo sapiens
ccuaaccacua

SEQ ID NO: 436856 - RNA, 15 nt, Homo sapiens
ccuaaccacuuagca

SEQ ID NO: 436857 - RNA, 15 nt, Homo sapiens
ccuaaccucauuccc

SEQ ID NO: 436858 - RNA, 15 nt, Homo sapiens
ccuaacucuugcuca

SEQ ID NO: 436859 - RNA, 16 nt, Homo sapiens
ccuaacucuugcucac

SEQ ID NO: 436860 - RNA, 21 nt, Homo sapiens
ccuaagagaugggacuaggac

SEQ ID NO: 436861 - RNA, 12 nt, Homo sapiens
ccuaagagccac

SEQ ID NO: 436862 - RNA, 18 nt, Homo sapiens
ccuaaggaucucucagga

SEQ ID NO: 436863 - RNA, 12 nt, Homo sapiens
ccuaaugcuccu

SEQ ID NO: 436864 - RNA, 22 nt, Homo sapiens
ccuaauguggcagcugucucaa

SEQ ID NO: 436865 - RNA, 14 nt, Homo sapiens
ccuaauuaauuuca

SEQ ID NO: 436866 - RNA, 14 nt, Homo sapiens
ccuaccacaguguc

SEQ ID NO: 436867 - RNA, 16 nt, Homo sapiens
ccuacccucuucucag

SEQ ID NO: 436868 - RNA, 11 nt, Homo sapiens
ccuaccucagc

SEQ ID NO: 436869 - RNA, 15 nt, Homo sapiens
ccuacgaaagcacag

SEQ ID NO: 436870 - RNA, 19 nt, Homo sapiens
ccuacugcuuccucugaau

SEQ ID NO: 436871 - RNA, 23 nt, Homo sapiens
ccuacuguucggacaaaaaaagu

SEQ ID NO: 436872 - RNA, 21 nt, Homo sapiens
ccuagaagcccucugagcucc

SEQ ID NO: 436873 - RNA, 15 nt, Homo sapiens
ccuagaccuugccuc

SEQ ID NO: 436874 - RNA, 16 nt, Homo sapiens
ccuagaccuugccucc

SEQ ID NO: 436875 - RNA, 20 nt, Homo sapiens
ccuagacugacccugaucag

SEQ ID NO: 436876 - RNA, 17 nt, Homo sapiens
ccuagagcuagaugugu

SEQ ID NO: 436877 - RNA, 18 nt, Homo sapiens
ccuagagcuagauguguc

SEQ ID NO: 436878 - RNA, 20 nt, Homo sapiens
ccuagauguuuaacaaaucu

SEQ ID NO: 436879 - RNA, 13 nt, Homo sapiens
ccuagcauuucaa

SEQ ID NO: 436880 - RNA, 11 nt, Homo sapiens
ccuagccagag

SEQ ID NO: 436881 - RNA, 20 nt, Homo sapiens
ccuaggauuucaugauuuca

SEQ ID NO: 436882 - RNA, 22 nt, Homo sapiens
ccuaggguugcuugggccacug

SEQ ID NO: 436883 - RNA, 22 nt, Homo sapiens
ccuagugucuauucccuggaau

SEQ ID NO: 436884 - RNA, 15 nt, Homo sapiens
ccuaguucuucaucc

SEQ ID NO: 436885 - RNA, 17 nt, Homo sapiens
ccuauaccccucaucac

SEQ ID NO: 436886 - RNA, 18 nt, Homo sapiens
ccuauaccccucaucaca

SEQ ID NO: 436887 - RNA, 19 nt, Homo sapiens
ccuauagagucaaccacca

SEQ ID NO: 436888 - RNA, 18 nt, Homo sapiens
ccuauauugcauuaauuu

SEQ ID NO: 436889 - RNA, 14 nt, Homo sapiens
ccuauggaaagggu

SEQ ID NO: 436890 - RNA, 23 nt, Homo sapiens
ccuauggguugucaauaguauua

SEQ ID NO: 436891 - RNA, 14 nt, Homo sapiens
ccuaugguucuuau

SEQ ID NO: 436892 - RNA, 19 nt, Homo sapiens
ccuauguacuuaauccuuu

SEQ ID NO: 436893 - RNA, 15 nt, Homo sapiens
ccuaugucauuucua

SEQ ID NO: 436894 - RNA, 15 nt, Homo sapiens
ccuauucaugucucu

SEQ ID NO: 436895 - RNA, 16 nt, Homo sapiens
ccuauugcuguaaaua

SEQ ID NO: 436896 - RNA, 17 nt, Homo sapiens
ccuauuuucuuuuccau

SEQ ID NO: 436897 - RNA, 18 nt, Homo sapiens
ccuauuuuggacguguga

SEQ ID NO: 436898 - RNA, 21 nt, Homo sapiens
ccucaaaccuaccacucagga

SEQ ID NO: 436899 - RNA, 21 nt, Homo sapiens
ccucaacauugcauggugcua

SEQ ID NO: 436900 - RNA, 22 nt, Homo sapiens
ccucaaccuugacuucugccca

SEQ ID NO: 436901 - RNA, 13 nt, Homo sapiens
ccucaaguucaau

SEQ ID NO: 436902 - RNA, 23 nt, Homo sapiens
ccucacacacacagcugggcaaa

SEQ ID NO: 436903 - RNA, 15 nt, Homo sapiens
ccucaccuucaaaaa

SEQ ID NO: 436904 - RNA, 14 nt, Homo sapiens
ccucaccuucccua

SEQ ID NO: 436905 - RNA, 12 nt, Homo sapiens
ccucacugggug

SEQ ID NO: 436906 - RNA, 20 nt, Homo sapiens
ccucagcaccugggacccaa

SEQ ID NO: 436907 - RNA, 17 nt, Homo sapiens
ccucagccauucacugc

SEQ ID NO: 436908 - RNA, 18 nt, Homo sapiens
ccucagcugcacauuccu

SEQ ID NO: 436909 - RNA, 21 nt, Homo sapiens
ccucaggcccaauucugccac

SEQ ID NO: 436910 - RNA, 20 nt, Homo sapiens
auuccugggccuguccccca

SEQ ID NO: 436911 - RNA, 21 nt, Homo sapiens
auuccuguuucugaaccauua

SEQ ID NO: 436912 - RNA, 15 nt, Homo sapiens
auuccuuagcagcuc

SEQ ID NO: 436913 - RNA, 20 nt, Homo sapiens
auuccuuauuucucuuucau

SEQ ID NO: 436914 - RNA, 13 nt, Homo sapiens
auucuaaacagau

SEQ ID NO: 436915 - RNA, 12 nt, Homo sapiens
auucuaagccag

SEQ ID NO: 436916 - RNA, 17 nt, Homo sapiens
auucuaaguuauuuacu

SEQ ID NO: 436917 - RNA, 18 nt, Homo sapiens
auucuaaguuauuuacuu

SEQ ID NO: 436918 - RNA, 18 nt, Homo sapiens
auucuaauuagauuaacc

SEQ ID NO: 436919 - RNA, 14 nt, Homo sapiens
auucuacuagucaa

SEQ ID NO: 436920 - RNA, 20 nt, Homo sapiens
auucuagugaaugaaucuca

SEQ ID NO: 436921 - RNA, 14 nt, Homo sapiens
auucucaguaucca

SEQ ID NO: 436922 - RNA, 18 nt, Homo sapiens
auucuccacucacugcau

SEQ ID NO: 436923 - RNA, 21 nt, Homo sapiens
auucucccugguuuuacccca

SEQ ID NO: 436924 - RNA, 19 nt, Homo sapiens
auucucucuaacauaacaa

SEQ ID NO: 436925 - RNA, 17 nt, Homo sapiens
auucucugaugcacugu

SEQ ID NO: 436926 - RNA, 20 nt, Homo sapiens
auucucuuaugauacuugag

SEQ ID NO: 436927 - RNA, 18 nt, Homo sapiens
auucugaaggccuuguua

SEQ ID NO: 436928 - RNA, 23 nt, Homo sapiens
auucugcuugguuccacaaucau

SEQ ID NO: 436929 - RNA, 20 nt, Homo sapiens
auucugucccaaucuuacca

SEQ ID NO: 436930 - RNA, 15 nt, Homo sapiens
auucugugcauaaaa

SEQ ID NO: 436931 - RNA, 23 nt, Homo sapiens
auucuguggugggaacauucgag

SEQ ID NO: 436932 - RNA, 16 nt, Homo sapiens
auucuguucuacuuga

SEQ ID NO: 436933 - RNA, 13 nt, Homo sapiens
auucuuaagcacu

SEQ ID NO: 436934 - RNA, 15 nt, Homo sapiens
auucuuaagcacuuu

SEQ ID NO: 436935 - RNA, 18 nt, Homo sapiens
auucuuacaaaacauuuu

SEQ ID NO: 436936 - RNA, 22 nt, Homo sapiens
auucuuacaauugcacugcugu

SEQ ID NO: 436937 - RNA, 17 nt, Homo sapiens
auucuuacauuuuacuu

SEQ ID NO: 436938 - RNA, 18 nt, Homo sapiens
auucuuaccucauuugca

SEQ ID NO: 436939 - RNA, 19 nt, Homo sapiens
auucuuaccucauuugcau

SEQ ID NO: 436940 - RNA, 17 nt, Homo sapiens
auucuuccuugagcuaa

SEQ ID NO: 436941 - RNA, 14 nt, Homo sapiens
auucuuuaaacuac

SEQ ID NO: 436942 - RNA, 17 nt, Homo sapiens
auucuuuaaacuacuga

SEQ ID NO: 436943 - RNA, 17 nt, Homo sapiens
auucuuuggaguuguca

SEQ ID NO: 436944 - RNA, 16 nt, Homo sapiens
auugaaagaaccagag

SEQ ID NO: 436945 - RNA, 14 nt, Homo sapiens
auugaaugugauuu

SEQ ID NO: 436946 - RNA, 14 nt, Homo sapiens
auugaccucagcug

SEQ ID NO: 436947 - RNA, 23 nt, Homo sapiens
auugaccucagcugcacauuccu

SEQ ID NO: 436948 - RNA, 19 nt, Homo sapiens
auugagaaauaaagcacau

SEQ ID NO: 436949 - RNA, 23 nt, Homo sapiens
auugagaggugggggaugcugag

SEQ ID NO: 436950 - RNA, 22 nt, Homo sapiens
auugagauauaauuaacauaaa

SEQ ID NO: 436951 - RNA, 14 nt, Homo sapiens
auugaggaugaacu

SEQ ID NO: 436952 - RNA, 16 nt, Homo sapiens
auugaggaugaacuca

SEQ ID NO: 436953 - RNA, 18 nt, Homo sapiens
auugauagaguguuauca

SEQ ID NO: 436954 - RNA, 13 nt, Homo sapiens
auugaucacagau

SEQ ID NO: 436955 - RNA, 15 nt, Homo sapiens
auugaugaacugcca

SEQ ID NO: 436956 - RNA, 14 nt, Homo sapiens
auugauguacuuua

SEQ ID NO: 436957 - RNA, 22 nt, Homo sapiens
auugcaaagaaaauucucaagu

SEQ ID NO: 436958 - RNA, 15 nt, Homo sapiens
auugcacaaauacaa

SEQ ID NO: 436959 - RNA, 23 nt, Homo sapiens
auugcagcuaagcucaaauguau

SEQ ID NO: 436960 - RNA, 16 nt, Homo sapiens
auugcaucgcugucca

SEQ ID NO: 436961 - RNA, 21 nt, Homo sapiens
auugccaggaauguuucagcu

SEQ ID NO: 436962 - RNA, 24 nt, Homo sapiens
auugccaggaauguuucagcugca

SEQ ID NO: 436963 - RNA, 17 nt, Homo sapiens
auugcccgaaaccagag

SEQ ID NO: 436964 - RNA, 12 nt, Homo sapiens
auugccuucuag

SEQ ID NO: 436965 - RNA, 16 nt, Homo sapiens
auugcuacacuuacaa

SEQ ID NO: 436966 - RNA, 22 nt, Homo sapiens
auugcuauuacuaguacuauua

SEQ ID NO: 436967 - RNA, 17 nt, Homo sapiens
auugcucagagaaauau

SEQ ID NO: 436968 - RNA, 19 nt, Homo sapiens
auugcugagauguuuagua

SEQ ID NO: 436969 - RNA, 17 nt, Homo sapiens
auugcuggagacuacaa

SEQ ID NO: 436970 - RNA, 18 nt, Homo sapiens
auugcuuuuggacaagga

SEQ ID NO: 436971 - RNA, 16 nt, Homo sapiens
auuggaaaguacuccc

SEQ ID NO: 436972 - RNA, 18 nt, Homo sapiens
auuggaaauuuguuauaa

SEQ ID NO: 436973 - RNA, 16 nt, Homo sapiens
auuggaauuacuguaa

SEQ ID NO: 436974 - RNA, 21 nt, Homo sapiens
auuggaugugcauuucuguga

SEQ ID NO: 436975 - RNA, 21 nt, Homo sapiens
auuggcaaacuuuguauuaau

SEQ ID NO: 436976 - RNA, 23 nt, Homo sapiens
auuggcaccccuuucuaguucaa

SEQ ID NO: 436977 - RNA, 20 nt, Homo sapiens
auuggcagcuucaaaacaga

SEQ ID NO: 436978 - RNA, 13 nt, Homo sapiens
auuggggucuguu

SEQ ID NO: 436979 - RNA, 13 nt, Homo sapiens
auuguaacauauu

SEQ ID NO: 436980 - RNA, 20 nt, Homo sapiens
auuguacgugggagaggcag

SEQ ID NO: 436981 - RNA, 16 nt, Homo sapiens
auuguagaaacacagu

SEQ ID NO: 436982 - RNA, 13 nt, Homo sapiens
auuguaggugcaa

SEQ ID NO: 436983 - RNA, 16 nt, Homo sapiens
auuguaggugcaagau

SEQ ID NO: 436984 - RNA, 21 nt, Homo sapiens
auuguaucaaguggcaugugc

SEQ ID NO: 436985 - RNA, 20 nt, Homo sapiens
auugucccugaaugcuccau

SEQ ID NO: 436986 - RNA, 16 nt, Homo sapiens
auugucguuucauuca

SEQ ID NO: 436987 - RNA, 18 nt, Homo sapiens
auugucucaaagcaucaa

SEQ ID NO: 436988 - RNA, 14 nt, Homo sapiens
auugucuuacuguu

SEQ ID NO: 436989 - RNA, 18 nt, Homo sapiens
auugucuuacuguugcau

SEQ ID NO: 436990 - RNA, 12 nt, Homo sapiens
auuguggcugca

SEQ ID NO: 436991 - RNA, 18 nt, Homo sapiens
auuguggguaacgugaga

SEQ ID NO: 436992 - RNA, 17 nt, Homo sapiens
auuguuaauucuuccua

SEQ ID NO: 436993 - RNA, 21 nt, Homo sapiens
auuguuacagguguacuaugg

SEQ ID NO: 436994 - RNA, 16 nt, Homo sapiens
auuguuaucuaucaac

SEQ ID NO: 436995 - RNA, 13 nt, Homo sapiens
auuguucauauca

SEQ ID NO: 436996 - RNA, 13 nt, Homo sapiens
auuguuuuuggau

SEQ ID NO: 436997 - RNA, 21 nt, Homo sapiens
auuuaaaaaaauacaguauuc

SEQ ID NO: 436998 - RNA, 13 nt, Homo sapiens
auuuaaaaaucuu

SEQ ID NO: 436999 - RNA, 14 nt, Homo sapiens
auuuaaacuucuua

SEQ ID NO: 437000 - RNA, 15 nt, Homo sapiens
auuuaacuagcacuu

SEQ ID NO: 437001 - RNA, 17 nt, Homo sapiens
auuuaacugcauauaga

SEQ ID NO: 437002 - RNA, 12 nt, Homo sapiens
auuuaagcacaa

SEQ ID NO: 437003 - RNA, 21 nt, Homo sapiens
auuuaagccaucaucagcuua

SEQ ID NO: 437004 - RNA, 16 nt, Homo sapiens
auuuaagguacuuaaa

SEQ ID NO: 437005 - RNA, 16 nt, Homo sapiens
auuuaauaacuuugcu

SEQ ID NO: 437006 - RNA, 22 nt, Homo sapiens
auuuaauaggacuuccuuugaa

SEQ ID NO: 437007 - RNA, 22 nt, Homo sapiens
aagagaggaguucaaugaucua

SEQ ID NO: 437008 - RNA, 13 nt, Homo sapiens
aagagaguaccau

SEQ ID NO: 437009 - RNA, 13 nt, Homo sapiens
aagagauacccac

SEQ ID NO: 437010 - RNA, 17 nt, Homo sapiens
aagagcgucauguccuu

SEQ ID NO: 437011 - RNA, 13 nt, Homo sapiens
aagagcuaauaaa

SEQ ID NO: 437012 - RNA, 18 nt, Homo sapiens
aagaggagcacuuccaaa

SEQ ID NO: 437013 - RNA, 22 nt, Homo sapiens
aagaggagcacuuccaaaauuc

SEQ ID NO: 437014 - RNA, 15 nt, Homo sapiens
aagaggauagaauac

SEQ ID NO: 437015 - RNA, 15 nt, Homo sapiens
aagaggcugcugcag

SEQ ID NO: 437016 - RNA, 12 nt, Homo sapiens
aagaggggccag

SEQ ID NO: 437017 - RNA, 20 nt, Homo sapiens
aagagguagagaaaauggaa

SEQ ID NO: 437018 - RNA, 18 nt, Homo sapiens
aagagguuuuucagcucu

SEQ ID NO: 437019 - RNA, 23 nt, Homo sapiens
aagaguaguuauuaguucugcuu

SEQ ID NO: 437020 - RNA, 21 nt, Homo sapiens
aagagugagugaacaacuauu

SEQ ID NO: 437021 - RNA, 14 nt, Homo sapiens
aagaguggaaccaa

SEQ ID NO: 437022 - RNA, 11 nt, Homo sapiens
aagaguggucu

SEQ ID NO: 437023 - RNA, 17 nt, Homo sapiens
aagaguucugaucugua

SEQ ID NO: 437024 - RNA, 13 nt, Homo sapiens
aagaguugagcuc

SEQ ID NO: 437025 - RNA, 15 nt, Homo sapiens
aagauacaaguuuca

SEQ ID NO: 437026 - RNA, 17 nt, Homo sapiens
aagauacugcugaugcu

SEQ ID NO: 437027 - RNA, 22 nt, Homo sapiens
aagauaucuaugacuguguuua

SEQ ID NO: 437028 - RNA, 16 nt, Homo sapiens
aagauauucuuuacaa

SEQ ID NO: 437029 - RNA, 18 nt, Homo sapiens
aagauccgagucuaccca

SEQ ID NO: 437030 - RNA, 14 nt, Homo sapiens
aagaucgcaccauu

SEQ ID NO: 437031 - RNA, 20 nt, Homo sapiens
aagaucgcaccauugcacuc

SEQ ID NO: 437032 - RNA, 20 nt, Homo sapiens
aagaugaaaaauggucccuu

SEQ ID NO: 437033 - RNA, 23 nt, Homo sapiens
aagaugagauuugccagcacagg

SEQ ID NO: 437034 - RNA, 16 nt, Homo sapiens
aagauggaaagaacca

SEQ ID NO: 437035 - RNA, 11 nt, Homo sapiens
aagauggauuu

SEQ ID NO: 437036 - RNA, 20 nt, Homo sapiens
aagauggccuuugcuuauga

SEQ ID NO: 437037 - RNA, 22 nt, Homo sapiens
aagauggcuuccgugagacaca

SEQ ID NO: 437038 - RNA, 16 nt, Homo sapiens
aagaugggaacacugg

SEQ ID NO: 437039 - RNA, 16 nt, Homo sapiens
aagaugugucuucaau

SEQ ID NO: 437040 - RNA, 14 nt, Homo sapiens
auuuccaacaccac

SEQ ID NO: 437041 - RNA, 11 nt, Homo sapiens
auuuccagggg

SEQ ID NO: 437042 - RNA, 23 nt, Homo sapiens
auuuccaggggccucccaaggaa

SEQ ID NO: 437043 - RNA, 11 nt, Homo sapiens
auuuccaugga

SEQ ID NO: 437044 - RNA, 23 nt, Homo sapiens
auuuccccaccccagcucaugcc

SEQ ID NO: 437045 - RNA, 13 nt, Homo sapiens
auuucccuaaaaa

SEQ ID NO: 437046 - RNA, 15 nt, Homo sapiens
auuuccggccaacag

SEQ ID NO: 437047 - RNA, 21 nt, Homo sapiens
auuuccugacagaaggacuca

SEQ ID NO: 437048 - RNA, 23 nt, Homo sapiens
auuuccuuaaacuguguggacug

SEQ ID NO: 437049 - RNA, 10 nt, Homo sapiens
auuuccuugu

SEQ ID NO: 437050 - RNA, 17 nt, Homo sapiens
auuuccuuugcgcaaac

SEQ ID NO: 437051 - RNA, 16 nt, Homo sapiens
auuucgagcauaagaa

SEQ ID NO: 437052 - RNA, 16 nt, Homo sapiens
auuucuaucugcaaau

SEQ ID NO: 437053 - RNA, 18 nt, Homo sapiens
auuucucuucaguguguu

SEQ ID NO: 437054 - RNA, 19 nt, Homo sapiens
auuucugaaaaagaacugu

SEQ ID NO: 437055 - RNA, 23 nt, Homo sapiens
auuucugagagugaaaccaugac

SEQ ID NO: 437056 - RNA, 22 nt, Homo sapiens
auuucuucaaauccuuccaaaa

SEQ ID NO: 437057 - RNA, 19 nt, Homo sapiens
auuucuuugauuuaacuga

SEQ ID NO: 437058 - RNA, 19 nt, Homo sapiens
auuugaacucuucaaucuc

SEQ ID NO: 437059 - RNA, 19 nt, Homo sapiens
auuugauuuuuacugagga

SEQ ID NO: 437060 - RNA, 15 nt, Homo sapiens
auuugcaacauuuac

SEQ ID NO: 437061 - RNA, 12 nt, Homo sapiens
auuugccaugcu

SEQ ID NO: 437062 - RNA, 16 nt, Homo sapiens
auuugcugaauaacaa

SEQ ID NO: 437063 - RNA, 19 nt, Homo sapiens
auuugguggccuaauuuac

SEQ ID NO: 437064 - RNA, 16 nt, Homo sapiens
auuuguaacuuugcau

SEQ ID NO: 437065 - RNA, 14 nt, Homo sapiens
auuuguaagacuua

SEQ ID NO: 437066 - RNA, 21 nt, Homo sapiens
auuuguaccucuaaguacaua

SEQ ID NO: 437067 - RNA, 22 nt, Homo sapiens
auuugucacaaauaaacauaau

SEQ ID NO: 437068 - RNA, 20 nt, Homo sapiens
auuugugaaaagaguaugua

SEQ ID NO: 437069 - RNA, 17 nt, Homo sapiens
auuugugauacuuccuc

SEQ ID NO: 437070 - RNA, 19 nt, Homo sapiens
auuugugugaaaaugugac

SEQ ID NO: 437071 - RNA, 16 nt, Homo sapiens
auuuguuuaaagaaua

SEQ ID NO: 437072 - RNA, 14 nt, Homo sapiens
auuuuaaaauugca

SEQ ID NO: 437073 - RNA, 19 nt, Homo sapiens
auuuuaaaguaaaagucua

SEQ ID NO: 437074 - RNA, 15 nt, Homo sapiens
auuuuaaauucucag

SEQ ID NO: 437075 - RNA, 16 nt, Homo sapiens
auuuuaaguaucccau

SEQ ID NO: 437076 - RNA, 20 nt, Homo sapiens
auuuuaauagagaacuucua

SEQ ID NO: 437077 - RNA, 16 nt, Homo sapiens
auuuuaauguuuccuu

SEQ ID NO: 437078 - RNA, 19 nt, Homo sapiens
auuuuaccuagcauuucaa

SEQ ID NO: 437079 - RNA, 16 nt, Homo sapiens
auuuuacuuugugcaa

SEQ ID NO: 437080 - RNA, 21 nt, Homo sapiens
auuuuacuuuuuccuggcuca

SEQ ID NO: 437081 - RNA, 13 nt, Homo sapiens
auuuuagacuuuu

SEQ ID NO: 437082 - RNA, 19 nt, Homo sapiens
auuuuauugcuggaaucua

SEQ ID NO: 437083 - RNA, 23 nt, Homo sapiens
auuuucaaaggcuuccaaugugg

SEQ ID NO: 437084 - RNA, 13 nt, Homo sapiens
auuuucaccucca

SEQ ID NO: 437085 - RNA, 22 nt, Homo sapiens
auuuucacugcugcuccucuuu

SEQ ID NO: 437086 - RNA, 13 nt, Homo sapiens
auuuucagcauca

SEQ ID NO: 437087 - RNA, 16 nt, Homo sapiens
auuuucagcaucaaac

SEQ ID NO: 437088 - RNA, 20 nt, Homo sapiens
auuuucagugcuuucucaaa

SEQ ID NO: 437089 - RNA, 16 nt, Homo sapiens
auuuuccaccaaauuc

SEQ ID NO: 437090 - RNA, 16 nt, Homo sapiens
auuuuccugaauauua

SEQ ID NO: 437091 - RNA, 20 nt, Homo sapiens
auuuuccugaauauuaaucc

SEQ ID NO: 437092 - RNA, 21 nt, Homo sapiens
auuuucuagauuuucuacuuu

SEQ ID NO: 437093 - RNA, 16 nt, Homo sapiens
auuuucuauuuaugua

SEQ ID NO: 437094 - RNA, 22 nt, Homo sapiens
auuuucucuauacauagagcuc

SEQ ID NO: 437095 - RNA, 14 nt, Homo sapiens
auuuucuuuuccau

SEQ ID NO: 437096 - RNA, 23 nt, Homo sapiens
auuuugacauacaggagagcugc

SEQ ID NO: 437097 - RNA, 14 nt, Homo sapiens
auuuugaguucugu

SEQ ID NO: 437098 - RNA, 19 nt, Homo sapiens
auuuugauaccagugagca

SEQ ID NO: 437099 - RNA, 15 nt, Homo sapiens
auuuuggccaaagug

SEQ ID NO: 437100 - RNA, 14 nt, Homo sapiens
auuuuggcgcuauu

SEQ ID NO: 437101 - RNA, 19 nt, Homo sapiens
auuuuggcgcuauuacaaa

SEQ ID NO: 437102 - RNA, 15 nt, Homo sapiens
auuuuguaacugccu

SEQ ID NO: 437103 - RNA, 16 nt, Homo sapiens
auuuuguaacugccua

SEQ ID NO: 437104 - RNA, 18 nt, Homo sapiens
auuuuguauaaaugggaa

SEQ ID NO: 437105 - RNA, 15 nt, Homo sapiens
auuuuuaagacuuuu

SEQ ID NO: 437106 - RNA, 15 nt, Homo sapiens
auuuuuaaguacaaa

SEQ ID NO: 437107 - RNA, 14 nt, Homo sapiens
auuuuuaccuuuca

SEQ ID NO: 437108 - RNA, 15 nt, Homo sapiens
auuuuuaguuugcua

SEQ ID NO: 437109 - RNA, 22 nt, Homo sapiens
auuuuuccucuuucacuucuua

SEQ ID NO: 437110 - RNA, 12 nt, Homo sapiens
auuuuucugcac

SEQ ID NO: 437111 - RNA, 11 nt, Homo sapiens
auuuuuguaca

SEQ ID NO: 437112 - RNA, 20 nt, Homo sapiens
auuuuugucagucugaguca

SEQ ID NO: 437113 - RNA, 15 nt, Homo sapiens
auuuuuguuaagcuc

SEQ ID NO: 437114 - RNA, 18 nt, Homo sapiens
auuuuuguuaagcucagg

SEQ ID NO: 437115 - RNA, 14 nt, Homo sapiens
auuuuuuaagugac

SEQ ID NO: 437116 - RNA, 16 nt, Homo sapiens
auuuuuuaaguucaau

SEQ ID NO: 437117 - RNA, 21 nt, Homo sapiens
auuuuuuacagcugccugcag

SEQ ID NO: 437118 - RNA, 16 nt, Homo sapiens
auuuuuuacuacauaa

SEQ ID NO: 437119 - RNA, 18 nt, Homo sapiens
auuuuuuuauacuaccaa

SEQ ID NO: 437120 - RNA, 19 nt, Homo sapiens
auuuuuuuuaacugcauuc

SEQ ID NO: 437121 - RNA, 16 nt, Homo sapiens
auuuuuuuuugaagca

SEQ ID NO: 437122 - RNA, 22 nt, Homo sapiens
auuuuuuuuuuaaaacuaucca

SEQ ID NO: 437123 - RNA, 16 nt, Homo sapiens
caaaaaaacagaaaag

SEQ ID NO: 437124 - RNA, 19 nt, Homo sapiens
caaaaaaaggcggugagca

SEQ ID NO: 437125 - RNA, 17 nt, Homo sapiens
caaaaaacaacugacca

SEQ ID NO: 437126 - RNA, 16 nt, Homo sapiens
caaaaaacuaauguga

SEQ ID NO: 437127 - RNA, 19 nt, Homo sapiens
caaaaaaugugagcuauaa

SEQ ID NO: 437128 - RNA, 13 nt, Homo sapiens
caaaaacaagcaa

SEQ ID NO: 437129 - RNA, 22 nt, Homo sapiens
caaaaacauucuuacauuuuac

SEQ ID NO: 437130 - RNA, 21 nt, Homo sapiens
caaaaagaggcuaugugagca

SEQ ID NO: 437131 - RNA, 14 nt, Homo sapiens
caaaaaugaacuga

SEQ ID NO: 437132 - RNA, 22 nt, Homo sapiens
caaaaaugaacugaaguuucac

SEQ ID NO: 437133 - RNA, 13 nt, Homo sapiens
caaaacauaucuu

SEQ ID NO: 437134 - RNA, 12 nt, Homo sapiens
caaaacccaucg

SEQ ID NO: 437135 - RNA, 13 nt, Homo sapiens
caaaacugcaaau

SEQ ID NO: 437136 - RNA, 23 nt, Homo sapiens
caaaacuuccuguuuguggaaca

SEQ ID NO: 437137 - RNA, 15 nt, Homo sapiens
caaaagagacaggga

SEQ ID NO: 437138 - RNA, 22 nt, Homo sapiens
caaaagaucaaauguauucaga

SEQ ID NO: 437139 - RNA, 15 nt, Homo sapiens
caaaagauucuacaa

SEQ ID NO: 437140 - RNA, 20 nt, Homo sapiens
caaaagcuuauucaucuguu

SEQ ID NO: 437141 - RNA, 22 nt, Homo sapiens
aaggcuugaaguaaccuuauag

SEQ ID NO: 437142 - RNA, 15 nt, Homo sapiens
aaggcuuugccaugg

SEQ ID NO: 437143 - RNA, 23 nt, Homo sapiens
aagggaaaacaaauauuucacuu

SEQ ID NO: 437144 - RNA, 19 nt, Homo sapiens
aagggacuaggagcacugu

SEQ ID NO: 437145 - RNA, 22 nt, Homo sapiens
aagggagagaacaaaagcuaua

SEQ ID NO: 437146 - RNA, 17 nt, Homo sapiens
aagggaggcccauguga

SEQ ID NO: 437147 - RNA, 22 nt, Homo sapiens
aagggagucauuuuuuaaguga

SEQ ID NO: 437148 - RNA, 22 nt, Homo sapiens
aagggcaacucacgggugcaug

SEQ ID NO: 437149 - RNA, 19 nt, Homo sapiens
aagggccccacucagggau

SEQ ID NO: 437150 - RNA, 20 nt, Homo sapiens
aagggcuuaucuagccaaag

SEQ ID NO: 437151 - RNA, 14 nt, Homo sapiens
aaggggccuggaag

SEQ ID NO: 437152 - RNA, 11 nt, Homo sapiens
aaggguccuac

SEQ ID NO: 437153 - RNA, 18 nt, Homo sapiens
aagggucguuaccagaga

SEQ ID NO: 437154 - RNA, 17 nt, Homo sapiens
aagggugcccaccucuu

SEQ ID NO: 437155 - RNA, 16 nt, Homo sapiens
aaggguguucacccau

SEQ ID NO: 437156 - RNA, 21 nt, Homo sapiens
aaggguucuguaaaauggaaa

SEQ ID NO: 437157 - RNA, 13 nt, Homo sapiens
aagguaauacuuu

SEQ ID NO: 437158 - RNA, 14 nt, Homo sapiens
aagguagugaguaa

SEQ ID NO: 437159 - RNA, 18 nt, Homo sapiens
aagguaugugucagccau

SEQ ID NO: 437160 - RNA, 12 nt, Homo sapiens
aaggucaucuca

SEQ ID NO: 437161 - RNA, 12 nt, Homo sapiens
aagguccacucc

SEQ ID NO: 437162 - RNA, 14 nt, Homo sapiens
aaggugacugggau

SEQ ID NO: 437163 - RNA, 14 nt, Homo sapiens
aaggugauuuuccu

SEQ ID NO: 437164 - RNA, 22 nt, Homo sapiens
aaggugcuacgguagugaugaa

SEQ ID NO: 437165 - RNA, 22 nt, Homo sapiens
aaggugcucaaagauguacuga

SEQ ID NO: 437166 - RNA, 22 nt, Homo sapiens
aaggugggccuugcuaccucaa

SEQ ID NO: 437167 - RNA, 18 nt, Homo sapiens
aagguuaagccauaugac

SEQ ID NO: 437168 - RNA, 21 nt, Homo sapiens
aagguuguacauaguggucau

SEQ ID NO: 437169 - RNA, 13 nt, Homo sapiens
aagguugugauga

SEQ ID NO: 437170 - RNA, 19 nt, Homo sapiens
acaggucugggagaggcag

SEQ ID NO: 437171 - RNA, 13 nt, Homo sapiens
acaguaaaucuca

SEQ ID NO: 437172 - RNA, 20 nt, Homo sapiens
acaguagcauacugaugaga

SEQ ID NO: 437173 - RNA, 21 nt, Homo sapiens
acaguagcauacugaugagac

SEQ ID NO: 437174 - RNA, 18 nt, Homo sapiens
acaguauuaacaucaaag

SEQ ID NO: 437175 - RNA, 20 nt, Homo sapiens
acagucaaaauguuugauau

SEQ ID NO: 437176 - RNA, 18 nt, Homo sapiens
acaguccucacagccucu

SEQ ID NO: 437177 - RNA, 18 nt, Homo sapiens
acagugaauuuaagcaug

SEQ ID NO: 437178 - RNA, 22 nt, Homo sapiens
acagugaucuccauauguuaca

SEQ ID NO: 437179 - RNA, 12 nt, Homo sapiens
acagugaugcug

SEQ ID NO: 437180 - RNA, 13 nt, Homo sapiens
acagugcagacag

SEQ ID NO: 437181 - RNA, 15 nt, Homo sapiens
acaguggaugcugcu

SEQ ID NO: 437182 - RNA, 16 nt, Homo sapiens
acaguggccaaagagg

SEQ ID NO: 437183 - RNA, 15 nt, Homo sapiens
acaguggcucuccaa

SEQ ID NO: 437184 - RNA, 17 nt, Homo sapiens
acagugggugaggagau

SEQ ID NO: 437185 - RNA, 18 nt, Homo sapiens
acaguuaaacuugcaaug

SEQ ID NO: 437186 - RNA, 18 nt, Homo sapiens
acaguuaauuaugugcau

SEQ ID NO: 437187 - RNA, 16 nt, Homo sapiens
acaguuacuccaguau

SEQ ID NO: 437188 - RNA, 14 nt, Homo sapiens
acaguuacuuccuu

SEQ ID NO: 437189 - RNA, 16 nt, Homo sapiens
acaguucuuguuagaa

SEQ ID NO: 437190 - RNA, 13 nt, Homo sapiens
acaguugccaugu

SEQ ID NO: 437191 - RNA, 17 nt, Homo sapiens
acaguuggaacaguaau

SEQ ID NO: 437192 - RNA, 23 nt, Homo sapiens
acaguuguaccacugcuaauaaa

SEQ ID NO: 437193 - RNA, 23 nt, Homo sapiens
acaguuuauuuuuauacuuucag

SEQ ID NO: 437194 - RNA, 20 nt, Homo sapiens
acauaaaacaaaaccaagcc

SEQ ID NO: 437195 - RNA, 19 nt, Homo sapiens
acauaaaaccugagcagca

SEQ ID NO: 437196 - RNA, 16 nt, Homo sapiens
acauaaaauaaacacu

SEQ ID NO: 437197 - RNA, 12 nt, Homo sapiens
acauaaacugac

SEQ ID NO: 437198 - RNA, 18 nt, Homo sapiens
acauaaagaaacacuuuc

SEQ ID NO: 437199 - RNA, 21 nt, Homo sapiens
acauaaagaaaucauacuuug

SEQ ID NO: 437200 - RNA, 22 nt, Homo sapiens
acauaaaucaguuaauggcuca

SEQ ID NO: 437201 - RNA, 21 nt, Homo sapiens
acauaaauuacuuuuucauuc

SEQ ID NO: 437202 - RNA, 23 nt, Homo sapiens
acauaaauuacuuuuucauucuu

SEQ ID NO: 437203 - RNA, 18 nt, Homo sapiens
acauaacacacaucaguc

SEQ ID NO: 437204 - RNA, 18 nt, Homo sapiens
acauaacuguaacauaua

SEQ ID NO: 437205 - RNA, 17 nt, Homo sapiens
acauaaucuaguuuaca

SEQ ID NO: 437206 - RNA, 21 nt, Homo sapiens
acauaauguuaguagcacuga

SEQ ID NO: 437207 - RNA, 20 nt, Homo sapiens
acauacauuguauaggccau

SEQ ID NO: 437208 - RNA, 21 nt, Homo sapiens
acauacucugcuuagaauuug

SEQ ID NO: 437209 - RNA, 14 nt, Homo sapiens
acauagacugcaaa

SEQ ID NO: 437210 - RNA, 19 nt, Homo sapiens
acauagcuaguuaugugag

SEQ ID NO: 437211 - RNA, 22 nt, Homo sapiens
acauauagcccuuuccccacuc

SEQ ID NO: 437212 - RNA, 19 nt, Homo sapiens
acauauauaugaaugcuug

SEQ ID NO: 437213 - RNA, 20 nt, Homo sapiens
acauaucaccucauggccua

SEQ ID NO: 437214 - RNA, 23 nt, Homo sapiens
acauauuacuguugcauuuacuu

SEQ ID NO: 437215 - RNA, 22 nt, Homo sapiens
acauauuaggaaaauauggguu

SEQ ID NO: 437216 - RNA, 21 nt, Homo sapiens
acauauucacagugaacauaa

SEQ ID NO: 437217 - RNA, 23 nt, Homo sapiens
acauauucccaugguagacugug

SEQ ID NO: 437218 - RNA, 19 nt, Homo sapiens
acaucaauaaauacuuuaa

SEQ ID NO: 437219 - RNA, 12 nt, Homo sapiens
acauccacagga

SEQ ID NO: 437220 - RNA, 19 nt, Homo sapiens
acauccaggcaauggccua

SEQ ID NO: 437221 - RNA, 22 nt, Homo sapiens
acauccaugcggaguccauuau

SEQ ID NO: 437222 - RNA, 20 nt, Homo sapiens
acauccccuuuguguagaaa

SEQ ID NO: 437223 - RNA, 22 nt, Homo sapiens
acauccucugcuaccaucucau

SEQ ID NO: 437224 - RNA, 21 nt, Homo sapiens
acauccugaccuccuggacug

SEQ ID NO: 437225 - RNA, 17 nt, Homo sapiens
acaucuacaaucaggag

SEQ ID NO: 437226 - RNA, 19 nt, Homo sapiens
acaucucagaaaacucugg

SEQ ID NO: 437227 - RNA, 21 nt, Homo sapiens
acaucuccuccauacucagga

SEQ ID NO: 437228 - RNA, 16 nt, Homo sapiens
acaucucuuucaucua

SEQ ID NO: 437229 - RNA, 22 nt, Homo sapiens
acaucuggccuugaaaccaccu

SEQ ID NO: 437230 - RNA, 18 nt, Homo sapiens
acaucuuggucagauuug

SEQ ID NO: 437231 - RNA, 17 nt, Homo sapiens
acaucuuuaucauuaaa

SEQ ID NO: 437232 - RNA, 19 nt, Homo sapiens
acaucuuuuacauucugca

SEQ ID NO: 437233 - RNA, 16 nt, Homo sapiens
acaugaaaacauugau

SEQ ID NO: 437234 - RNA, 14 nt, Homo sapiens
acaugaagaagcua

SEQ ID NO: 437235 - RNA, 23 nt, Homo sapiens
acaugaaugaaugaaccaugaau

SEQ ID NO: 437236 - RNA, 17 nt, Homo sapiens
acaugacaacuuugcca

SEQ ID NO: 437237 - RNA, 10 nt, Homo sapiens
acaugacugg

SEQ ID NO: 437238 - RNA, 16 nt, Homo sapiens
acaugagucccagugg

SEQ ID NO: 437239 - RNA, 16 nt, Homo sapiens
acaugaguucaaauac

SEQ ID NO: 437240 - RNA, 22 nt, Homo sapiens
acaugauuccuuccuguucuga

SEQ ID NO: 437241 - RNA, 17 nt, Homo sapiens
acaugcacagcuaacau

SEQ ID NO: 437242 - RNA, 15 nt, Homo sapiens
acaugcacuacugaa

SEQ ID NO: 437243 - RNA, 16 nt, Homo sapiens
acaugcagcucugcag

SEQ ID NO: 437244 - RNA, 15 nt, Homo sapiens
acaugcauuuuauca

SEQ ID NO: 437245 - RNA, 18 nt, Homo sapiens
acaugcuaccugauccca

SEQ ID NO: 437246 - RNA, 20 nt, Homo sapiens
acaugcuaccugaucccacu

SEQ ID NO: 437247 - RNA, 17 nt, Homo sapiens
acauggaauagcaccug

SEQ ID NO: 437248 - RNA, 17 nt, Homo sapiens
acauggccaauagucau

SEQ ID NO: 437249 - RNA, 19 nt, Homo sapiens
acauggccuuggagggcau

SEQ ID NO: 437250 - RNA, 19 nt, Homo sapiens
acauguaguaguacuugaa

SEQ ID NO: 437251 - RNA, 23 nt, Homo sapiens
acaugugugcgugugcgugcaug

SEQ ID NO: 437252 - RNA, 18 nt, Homo sapiens
acauguuacugaccagca

SEQ ID NO: 437253 - RNA, 19 nt, Homo sapiens
acauguugcuaaugacagu

SEQ ID NO: 437254 - RNA, 23 nt, Homo sapiens
acauuaaaagaaguaaccaacug

SEQ ID NO: 437255 - RNA, 16 nt, Homo sapiens
acauuaggcuguggug

SEQ ID NO: 437256 - RNA, 22 nt, Homo sapiens
acauuaucgggagcagugucuu

SEQ ID NO: 437257 - RNA, 15 nt, Homo sapiens
acauuauuacuccuu

SEQ ID NO: 437258 - RNA, 14 nt, Homo sapiens
acauuauuccugca

SEQ ID NO: 437259 - RNA, 16 nt, Homo sapiens
acauucaguacuuuau

SEQ ID NO: 437260 - RNA, 13 nt, Homo sapiens
acauuccaggaaa

SEQ ID NO: 437261 - RNA, 17 nt, Homo sapiens
acauucccucucaucca

SEQ ID NO: 437262 - RNA, 20 nt, Homo sapiens
acauuccugagauucuggga

SEQ ID NO: 437263 - RNA, 19 nt, Homo sapiens
acauuccugauacugggua

SEQ ID NO: 437264 - RNA, 20 nt, Homo sapiens
acauucugcaagcacaucug

SEQ ID NO: 437265 - RNA, 13 nt, Homo sapiens
acauucuuccaaa

SEQ ID NO: 437266 - RNA, 20 nt, Homo sapiens
acauugaccaagaacugcau

SEQ ID NO: 437267 - RNA, 23 nt, Homo sapiens
acauugcaggaagagaugcucua

SEQ ID NO: 437268 - RNA, 14 nt, Homo sapiens
acauugcauguauu

SEQ ID NO: 437269 - RNA, 15 nt, Homo sapiens
acauuggugcaaaga

SEQ ID NO: 437270 - RNA, 13 nt, Homo sapiens
acauuguauauau

SEQ ID NO: 437271 - RNA, 20 nt, Homo sapiens
acauuguuugucugucuuca

SEQ ID NO: 437272 - RNA, 22 nt, Homo sapiens
acauuuaauacagcagugucau

SEQ ID NO: 437273 - RNA, 22 nt, Homo sapiens
acauuuaucaacuguugauaca

SEQ ID NO: 437274 - RNA, 14 nt, Homo sapiens
acauuugacacaua

SEQ ID NO: 437275 - RNA, 23 nt, Homo sapiens
acauuugcuuuuugcuuguguac

SEQ ID NO: 437276 - RNA, 15 nt, Homo sapiens
acauuugugcauaaa

SEQ ID NO: 437277 - RNA, 20 nt, Homo sapiens
acauuuuuuaaacaguuaca

SEQ ID NO: 437278 - RNA, 16 nt, Homo sapiens
acauuuuuuuguucuc

SEQ ID NO: 437279 - RNA, 20 nt, Homo sapiens
accaaaaaaauaaagcauua

SEQ ID NO: 437280 - RNA, 17 nt, Homo sapiens
accaaaaauguucuuca

SEQ ID NO: 437281 - RNA, 14 nt, Homo sapiens
accaaaacauuccg

SEQ ID NO: 437282 - RNA, 21 nt, Homo sapiens
accaaaaugacaaugaugaug

SEQ ID NO: 437283 - RNA, 20 nt, Homo sapiens
accaaagggaaaacucuuca

SEQ ID NO: 437284 - RNA, 12 nt, Homo sapiens
accaaauacuuu

SEQ ID NO: 437285 - RNA, 15 nt, Homo sapiens
accaaauauaaagag

SEQ ID NO: 437286 - RNA, 23 nt, Homo sapiens
accaaauauaaagaggacuugaa

SEQ ID NO: 437287 - RNA, 22 nt, Homo sapiens
accaaaugccuuucuagcaauu

SEQ ID NO: 437288 - RNA, 15 nt, Homo sapiens
accaacaccacaaac

SEQ ID NO: 437289 - RNA, 15 nt, Homo sapiens
accaacccucagagc

SEQ ID NO: 437290 - RNA, 14 nt, Homo sapiens
accaacccugcagg

SEQ ID NO: 437291 - RNA, 15 nt, Homo sapiens
accaacuacagaaag

SEQ ID NO: 437292 - RNA, 21 nt, Homo sapiens
accaagaaaccacugggcaua

SEQ ID NO: 437293 - RNA, 13 nt, Homo sapiens
cagauuuaccaua

SEQ ID NO: 437294 - RNA, 16 nt, Homo sapiens
cagauuuuacaaaaga

SEQ ID NO: 437295 - RNA, 22 nt, Homo sapiens
cagcaacacaauguuauucguu

SEQ ID NO: 437296 - RNA, 21 nt, Homo sapiens
cagcaaccuguaagacugaua

SEQ ID NO: 437297 - RNA, 20 nt, Homo sapiens
cagcaacggggaggccaagu

SEQ ID NO: 437298 - RNA, 20 nt, Homo sapiens
caggcacccaccaccaugcc

SEQ ID NO: 437299 - RNA, 14 nt, Homo sapiens
caggcagagcucag

SEQ ID NO: 437300 - RNA, 13 nt, Homo sapiens
caggcagccccac

SEQ ID NO: 437301 - RNA, 22 nt, Homo sapiens
caggcaggaggccauuccagga

SEQ ID NO: 437302 - RNA, 16 nt, Homo sapiens
caggcaguagcagcug

SEQ ID NO: 437303 - RNA, 14 nt, Homo sapiens
caggcaucuucccu

SEQ ID NO: 437304 - RNA, 22 nt, Homo sapiens
caggcaugugccacccacccaa

SEQ ID NO: 437305 - RNA, 11 nt, Homo sapiens
caggcauuuaa

SEQ ID NO: 437306 - RNA, 13 nt, Homo sapiens
caggccaccagcu

SEQ ID NO: 437307 - RNA, 13 nt, Homo sapiens
caggccaccugcc

SEQ ID NO: 437308 - RNA, 18 nt, Homo sapiens
caggccacuguggccaga

SEQ ID NO: 437309 - RNA, 12 nt, Homo sapiens
caggccagcugu

SEQ ID NO: 437310 - RNA, 18 nt, Homo sapiens
caggccaggagacuguua

SEQ ID NO: 437311 - RNA, 19 nt, Homo sapiens
caggccauaccaggugcua

SEQ ID NO: 437312 - RNA, 17 nt, Homo sapiens
caggccaugugagccac

SEQ ID NO: 437313 - RNA, 18 nt, Homo sapiens
caggcccaauucugccac

SEQ ID NO: 437314 - RNA, 15 nt, Homo sapiens
caggcccugcagugu

SEQ ID NO: 437315 - RNA, 16 nt, Homo sapiens
caggcccugccuucag

SEQ ID NO: 437316 - RNA, 17 nt, Homo sapiens
caggccuggagcguuug

SEQ ID NO: 437317 - RNA, 16 nt, Homo sapiens
caggccugggacccag

SEQ ID NO: 437318 - RNA, 20 nt, Homo sapiens
caggcgauccaccugucuca

SEQ ID NO: 437319 - RNA, 14 nt, Homo sapiens
caggcgaugugcaa

SEQ ID NO: 437320 - RNA, 15 nt, Homo sapiens
caggcgaugugcaag

SEQ ID NO: 437321 - RNA, 20 nt, Homo sapiens
caggcgugagccaccgcgcc

SEQ ID NO: 437322 - RNA, 21 nt, Homo sapiens
caggcugaucgggcaauggga

SEQ ID NO: 437323 - RNA, 23 nt, Homo sapiens
caggcugccccaccccuccauga

SEQ ID NO: 437324 - RNA, 20 nt, Homo sapiens
caggcuggagugcaacggca

SEQ ID NO: 437325 - RNA, 17 nt, Homo sapiens
caggcuggagugcaaug

SEQ ID NO: 437326 - RNA, 17 nt, Homo sapiens
caggcuggagugcagua

SEQ ID NO: 437327 - RNA, 18 nt, Homo sapiens
caggcuggucuugaacuc

SEQ ID NO: 437328 - RNA, 19 nt, Homo sapiens
caggcuguuuuugggugca

SEQ ID NO: 437329 - RNA, 15 nt, Homo sapiens
caggcuuaugaauau

SEQ ID NO: 437330 - RNA, 14 nt, Homo sapiens
caggcuuggcaaag

SEQ ID NO: 437331 - RNA, 15 nt, Homo sapiens
cagggacaagauaca

SEQ ID NO: 437332 - RNA, 23 nt, Homo sapiens
cagggagcaacucuccacuccau

SEQ ID NO: 437333 - RNA, 22 nt, Homo sapiens
cagggagcccugggguuuccac

SEQ ID NO: 437334 - RNA, 15 nt, Homo sapiens
cagggaucauagcug

SEQ ID NO: 437335 - RNA, 17 nt, Homo sapiens
cagggaugccaacaccu

SEQ ID NO: 437336 - RNA, 24 nt, Homo sapiens
cagggauuccuucuaaguguacuu

SEQ ID NO: 437337 - RNA, 15 nt, Homo sapiens
cagggcagggcucau

SEQ ID NO: 437338 - RNA, 19 nt, Homo sapiens
cagggcauccaacugagaa

SEQ ID NO: 437339 - RNA, 13 nt, Homo sapiens
cagggccacaacu

SEQ ID NO: 437340 - RNA, 14 nt, Homo sapiens
cagggccacugagu

SEQ ID NO: 437341 - RNA, 15 nt, Homo sapiens
cagggccuccagccc

SEQ ID NO: 437342 - RNA, 21 nt, Homo sapiens
cagggccuggccugguccagg

SEQ ID NO: 437343 - RNA, 20 nt, Homo sapiens
cagggccuugacaaguacau

SEQ ID NO: 437344 - RNA, 20 nt, Homo sapiens
cagggcucuguauucugcaa

SEQ ID NO: 437345 - RNA, 15 nt, Homo sapiens
cagggcugugggugg

SEQ ID NO: 437346 - RNA, 18 nt, Homo sapiens
cagggcuuaccuguacac

SEQ ID NO: 437347 - RNA, 22 nt, Homo sapiens
caggggacuugaaucuuuccaa

SEQ ID NO: 437348 - RNA, 18 nt, Homo sapiens
caggggaggugauagcau

SEQ ID NO: 437349 - RNA, 17 nt, Homo sapiens
caggggcugcauccuca

SEQ ID NO: 437350 - RNA, 18 nt, Homo sapiens
caggggcugcauccucag

SEQ ID NO: 437351 - RNA, 21 nt, Homo sapiens
caggggcuuuggaagcucugu

SEQ ID NO: 437352 - RNA, 19 nt, Homo sapiens
caggggucgccaacacuug

SEQ ID NO: 437353 - RNA, 22 nt, Homo sapiens
caggguauaccucuaauaaccu

SEQ ID NO: 437354 - RNA, 23 nt, Homo sapiens
cagggucugcucuuucucugcca

SEQ ID NO: 437355 - RNA, 22 nt, Homo sapiens
caggguggggggugacagugcc

SEQ ID NO: 437356 - RNA, 20 nt, Homo sapiens
caggguucuaaccuuucuaa

SEQ ID NO: 437357 - RNA, 18 nt, Homo sapiens
caggguuggggugguuuu

SEQ ID NO: 437358 - RNA, 19 nt, Homo sapiens
cagguaagggggugcagca

SEQ ID NO: 437359 - RNA, 16 nt, Homo sapiens
cagguagccaccaccg

SEQ ID NO: 437360 - RNA, 22 nt, Homo sapiens
cagguaggcccuuguccugcca

SEQ ID NO: 437361 - RNA, 19 nt, Homo sapiens
caggucacccuuugcugug

SEQ ID NO: 437362 - RNA, 19 nt, Homo sapiens
cagguccucuacuuaauga

SEQ ID NO: 437363 - RNA, 22 nt, Homo sapiens
caggucugcaggccaccagcug

SEQ ID NO: 437364 - RNA, 14 nt, Homo sapiens
caggugaaaaucca

SEQ ID NO: 437365 - RNA, 21 nt, Homo sapiens
caggugacuuuccuaugacac

SEQ ID NO: 437366 - RNA, 16 nt, Homo sapiens
caggugauccacccac

SEQ ID NO: 437367 - RNA, 11 nt, Homo sapiens
caggugcacag

SEQ ID NO: 437368 - RNA, 17 nt, Homo sapiens
caggugcgcacuaccac

SEQ ID NO: 437369 - RNA, 23 nt, Homo sapiens
cagguggauuuuguggaggugag

SEQ ID NO: 437370 - RNA, 15 nt, Homo sapiens
cagguggcucagugc

SEQ ID NO: 437371 - RNA, 17 nt, Homo sapiens
cagguggcucagugcca

SEQ ID NO: 437372 - RNA, 10 nt, Homo sapiens
caggugggag

SEQ ID NO: 437373 - RNA, 14 nt, Homo sapiens
cagguguugccaaa

SEQ ID NO: 437374 - RNA, 19 nt, Homo sapiens
cagguguugggaccugcug

SEQ ID NO: 437375 - RNA, 21 nt, Homo sapiens
cagguguugggaccugcugcu

SEQ ID NO: 437376 - RNA, 18 nt, Homo sapiens
caguaaaaacuguucucu

SEQ ID NO: 437377 - RNA, 16 nt, Homo sapiens
caguaacauuucauua

SEQ ID NO: 437378 - RNA, 15 nt, Homo sapiens
caguaacuaaagcuu

SEQ ID NO: 437379 - RNA, 17 nt, Homo sapiens
caguaacuaaagcuuua

SEQ ID NO: 437380 - RNA, 23 nt, Homo sapiens
caguaagaucaagcuccaucuua

SEQ ID NO: 437381 - RNA, 20 nt, Homo sapiens
caguaagcugcucuauugua

SEQ ID NO: 437382 - RNA, 17 nt, Homo sapiens
caguaauagcugaaccu

SEQ ID NO: 437383 - RNA, 17 nt, Homo sapiens
caguacuuccugcagua

SEQ ID NO: 437384 - RNA, 23 nt, Homo sapiens
caguagagcaaaucuaugagauu

SEQ ID NO: 437385 - RNA, 20 nt, Homo sapiens
caguagggaggucagugcuu

SEQ ID NO: 437386 - RNA, 17 nt, Homo sapiens
caguagugccugugauc

SEQ ID NO: 437387 - RNA, 19 nt, Homo sapiens
caguauaaaauguaaaaac

SEQ ID NO: 437388 - RNA, 15 nt, Homo sapiens
caguaucacaggcca

SEQ ID NO: 437389 - RNA, 14 nt, Homo sapiens
caguaugacauuuc

SEQ ID NO: 437390 - RNA, 20 nt, Homo sapiens
caguaugagucaaugugcag

SEQ ID NO: 437391 - RNA, 14 nt, Homo sapiens
caguauuaagugug

SEQ ID NO: 437392 - RNA, 12 nt, Homo sapiens
caguauucccuu

SEQ ID NO: 437393 - RNA, 16 nt, Homo sapiens
caguauugacuucuuu

SEQ ID NO: 437394 - RNA, 21 nt, Homo sapiens
cagucauaacuaaauaaagcu

SEQ ID NO: 437395 - RNA, 14 nt, Homo sapiens
cagucaucuacuuu

SEQ ID NO: 437396 - RNA, 16 nt, Homo sapiens
cagucaugcacucaca

SEQ ID NO: 437397 - RNA, 21 nt, Homo sapiens
cagucaugcguccacuuuccc

SEQ ID NO: 437398 - RNA, 17 nt, Homo sapiens
cagucauuggguuuuau

SEQ ID NO: 437399 - RNA, 13 nt, Homo sapiens
cagucccagcaca

SEQ ID NO: 437400 - RNA, 15 nt, Homo sapiens
cagucccaugaccuu

SEQ ID NO: 437401 - RNA, 14 nt, Homo sapiens
cagucccuggagcu

SEQ ID NO: 437402 - RNA, 17 nt, Homo sapiens
caguccucaaagcuuuu

SEQ ID NO: 437403 - RNA, 14 nt, Homo sapiens
caguccugguucag

SEQ ID NO: 437404 - RNA, 11 nt, Homo sapiens
cagucucaagc

SEQ ID NO: 437405 - RNA, 15 nt, Homo sapiens
cagugaaacuugugc

SEQ ID NO: 437406 - RNA, 23 nt, Homo sapiens
cagugaccccugaccucacugug

SEQ ID NO: 437407 - RNA, 17 nt, Homo sapiens
cagugagucucuucaga

SEQ ID NO: 437408 - RNA, 23 nt, Homo sapiens
cagugauggcgcgggaggcacca

SEQ ID NO: 437409 - RNA, 17 nt, Homo sapiens
cagugcaacagcacugg

SEQ ID NO: 437410 - RNA, 14 nt, Homo sapiens
cagugcaaccacac

SEQ ID NO: 437411 - RNA, 14 nt, Homo sapiens
cagugcaccucuca

SEQ ID NO: 437412 - RNA, 23 nt, Homo sapiens
cagugccaccuaugccuguggug

SEQ ID NO: 437413 - RNA, 16 nt, Homo sapiens
cagugccuggcaaggc

SEQ ID NO: 437414 - RNA, 11 nt, Homo sapiens
cagugccugua

SEQ ID NO: 437415 - RNA, 15 nt, Homo sapiens
cagugccuguaucuu

SEQ ID NO: 437416 - RNA, 16 nt, Homo sapiens
cagugccuuccauaau

SEQ ID NO: 437417 - RNA, 18 nt, Homo sapiens
cagugcuucuuacuauua

SEQ ID NO: 437418 - RNA, 14 nt, Homo sapiens
caguggaaccaaaa

SEQ ID NO: 437419 - RNA, 13 nt, Homo sapiens
caguggcccugag

SEQ ID NO: 437420 - RNA, 16 nt, Homo sapiens
cagugggagcccugac

SEQ ID NO: 437421 - RNA, 16 nt, Homo sapiens
caguggggugaucuca

SEQ ID NO: 437422 - RNA, 21 nt, Homo sapiens
caguggggugaucucaucucc

SEQ ID NO: 437423 - RNA, 19 nt, Homo sapiens
caguguaacccaagcauuu

SEQ ID NO: 437424 - RNA, 16 nt, Homo sapiens
caguguaauccagggg

SEQ ID NO: 437425 - RNA, 15 nt, Homo sapiens
caguguccucaucua

SEQ ID NO: 437426 - RNA, 15 nt, Homo sapiens
cagugucuaccuucc

SEQ ID NO: 437427 - RNA, 20 nt, Homo sapiens
cagugucugugccauggauu

SEQ ID NO: 437428 - RNA, 23 nt, Homo sapiens
accuuguuguuguuaaauaucag

SEQ ID NO: 437429 - RNA, 21 nt, Homo sapiens
accuuuauuaaugaacuguga

SEQ ID NO: 437430 - RNA, 16 nt, Homo sapiens
accuuucuaaaccucu

SEQ ID NO: 437431 - RNA, 19 nt, Homo sapiens
cagugugcauaauuuugcc

SEQ ID NO: 437432 - RNA, 11 nt, Homo sapiens
caguguugccc

SEQ ID NO: 437433 - RNA, 12 nt, Homo sapiens
caguguuuacaa

SEQ ID NO: 437434 - RNA, 12 nt, Homo sapiens
caguguuuccac

SEQ ID NO: 437435 - RNA, 19 nt, Homo sapiens
caguguuuguauaccauga

SEQ ID NO: 437436 - RNA, 16 nt, Homo sapiens
caguguuuucaccuca

SEQ ID NO: 437437 - RNA, 21 nt, Homo sapiens
caguuaaaucccccaccucca

SEQ ID NO: 437438 - RNA, 21 nt, Homo sapiens
caguuaagcccccuccucacc

SEQ ID NO: 437439 - RNA, 23 nt, Homo sapiens
caguuacugguuucaguugacaa

SEQ ID NO: 437440 - RNA, 16 nt, Homo sapiens
caguuauacauaccuc

SEQ ID NO: 437441 - RNA, 19 nt, Homo sapiens
caguucacacccugcaagg

SEQ ID NO: 437442 - RNA, 16 nt, Homo sapiens
caguucaccuugaaga

SEQ ID NO: 437443 - RNA, 16 nt, Homo sapiens
caguucauuauuuugu

SEQ ID NO: 437444 - RNA, 13 nt, Homo sapiens
caguuccagcuuu

SEQ ID NO: 437445 - RNA, 20 nt, Homo sapiens
caguugagagagaaucucaa

SEQ ID NO: 437446 - RNA, 16 nt, Homo sapiens
caguugggagcacugg

SEQ ID NO: 437447 - RNA, 22 nt, Homo sapiens
caguugggugagaacaaccaaa

SEQ ID NO: 437448 - RNA, 15 nt, Homo sapiens
caguuggugcugcuu

SEQ ID NO: 437449 - RNA, 15 nt, Homo sapiens
caguugguuuugcau

SEQ ID NO: 437450 - RNA, 22 nt, Homo sapiens
caguuguaacauucuauuucaa

SEQ ID NO: 437451 - RNA, 15 nt, Homo sapiens
caguuguuauauuca

SEQ ID NO: 437452 - RNA, 15 nt, Homo sapiens
caguuucacauauuu

SEQ ID NO: 437453 - RNA, 19 nt, Homo sapiens
caguuuccucaucugucac

SEQ ID NO: 437454 - RNA, 17 nt, Homo sapiens
caguuucuggaaaaagu

SEQ ID NO: 437455 - RNA, 21 nt, Homo sapiens
caguuucuugaaguccagugu

SEQ ID NO: 437456 - RNA, 15 nt, Homo sapiens
caguuugauaacuag

SEQ ID NO: 437457 - RNA, 15 nt, Homo sapiens
caguuugcaaucuua

SEQ ID NO: 437458 - RNA, 22 nt, Homo sapiens
caguuugcuauuugcuuuagag

SEQ ID NO: 437459 - RNA, 13 nt, Homo sapiens
caguuugugcaag

SEQ ID NO: 437460 - RNA, 14 nt, Homo sapiens
caguuuuuugccac

SEQ ID NO: 437461 - RNA, 17 nt, Homo sapiens
cauaaaaauaaccaaaa

SEQ ID NO: 437462 - RNA, 21 nt, Homo sapiens
cauaaaagacaagcacuuugg

SEQ ID NO: 437463 - RNA, 16 nt, Homo sapiens
cauaaacuucagggau

SEQ ID NO: 437464 - RNA, 22 nt, Homo sapiens
cauaacauaaaagugcuacuug

SEQ ID NO: 437465 - RNA, 21 nt, Homo sapiens
cauaagaaauaaaaucuaauu

SEQ ID NO: 437466 - RNA, 18 nt, Homo sapiens
cauaagauauucuuuaca

SEQ ID NO: 437467 - RNA, 23 nt, Homo sapiens
cauaauaaggggaagacuuuaaa

SEQ ID NO: 437468 - RNA, 15 nt, Homo sapiens
cauaauacauuccau

SEQ ID NO: 437469 - RNA, 23 nt, Homo sapiens
cauaauacauuccaucacagcca

SEQ ID NO: 437470 - RNA, 22 nt, Homo sapiens
cauaauccacgcucaucuugca

SEQ ID NO: 437471 - RNA, 18 nt, Homo sapiens
cauaaugacuuaagcaca

SEQ ID NO: 437472 - RNA, 18 nt, Homo sapiens
cauaauugcuuauguaug

SEQ ID NO: 437473 - RNA, 23 nt, Homo sapiens
cauacacccccaccuccugcaau

SEQ ID NO: 437474 - RNA, 21 nt, Homo sapiens
cauacauggaauagcaccugg

SEQ ID NO: 437475 - RNA, 20 nt, Homo sapiens
cauacauuuguggucugacu

SEQ ID NO: 437476 - RNA, 16 nt, Homo sapiens
cauaccaccaccaaga

SEQ ID NO: 437477 - RNA, 14 nt, Homo sapiens
cauaccaggugcua

SEQ ID NO: 437478 - RNA, 20 nt, Homo sapiens
cauaccucuucuuacuccaa

SEQ ID NO: 437479 - RNA, 20 nt, Homo sapiens
cauaccuguuguacacuugg

SEQ ID NO: 437480 - RNA, 16 nt, Homo sapiens
cauacguucuuuucaa

SEQ ID NO: 437481 - RNA, 19 nt, Homo sapiens
cauacucuguugccuccuc

SEQ ID NO: 437482 - RNA, 12 nt, Homo sapiens
cauacugucaua

SEQ ID NO: 437483 - RNA, 19 nt, Homo sapiens
cauacugucauauaaugca

SEQ ID NO: 437484 - RNA, 20 nt, Homo sapiens
cauagaacugucccacaaaa

SEQ ID NO: 437485 - RNA, 23 nt, Homo sapiens
cauagaauugugcuggucauaca

SEQ ID NO: 437486 - RNA, 22 nt, Homo sapiens
cauagacaaaggccuuaacaaa

SEQ ID NO: 437487 - RNA, 16 nt, Homo sapiens
cauagaguagaccuga

SEQ ID NO: 437488 - RNA, 17 nt, Homo sapiens
cauagccauaccuggua

SEQ ID NO: 437489 - RNA, 17 nt, Homo sapiens
cauagcuacuauaugca

SEQ ID NO: 437490 - RNA, 20 nt, Homo sapiens
cauagcugggauuugaacug

SEQ ID NO: 437491 - RNA, 18 nt, Homo sapiens
cauaggagacccaugugc

SEQ ID NO: 437492 - RNA, 18 nt, Homo sapiens
cauaggcucacucuuucc

SEQ ID NO: 437493 - RNA, 23 nt, Homo sapiens
cauaggcugacuuuugcagaugg

SEQ ID NO: 437494 - RNA, 20 nt, Homo sapiens
cauagguauauauaugccau

SEQ ID NO: 437495 - RNA, 15 nt, Homo sapiens
cauauaaagugcaau

SEQ ID NO: 437496 - RNA, 22 nt, Homo sapiens
cauauaauuuucacuucugucu

SEQ ID NO: 437497 - RNA, 12 nt, Homo sapiens
cauauaccagca

SEQ ID NO: 437498 - RNA, 20 nt, Homo sapiens
cauauaccauuuuaugaguu

SEQ ID NO: 437499 - RNA, 16 nt, Homo sapiens
cauauaggacacacau

SEQ ID NO: 437500 - RNA, 19 nt, Homo sapiens
cauauaggacacacauaga

SEQ ID NO: 437501 - RNA, 22 nt, Homo sapiens
cauauaggauuauagauacuua

SEQ ID NO: 437502 - RNA, 22 nt, Homo sapiens
cauauauaaauuauuacuuuaa

SEQ ID NO: 437503 - RNA, 19 nt, Homo sapiens
cauauauaaauucuaagcc

SEQ ID NO: 437504 - RNA, 13 nt, Homo sapiens
cauauaucuauua

SEQ ID NO: 437505 - RNA, 16 nt, Homo sapiens
cauaucaccagucuua

SEQ ID NO: 437506 - RNA, 18 nt, Homo sapiens
cauaucucuagucccugu

SEQ ID NO: 437507 - RNA, 11 nt, Homo sapiens
cauaugaacug

SEQ ID NO: 437508 - RNA, 15 nt, Homo sapiens
cauaugacaauuuca

SEQ ID NO: 437509 - RNA, 23 nt, Homo sapiens
cauaugacaauuucaaaaugcau

SEQ ID NO: 437510 - RNA, 15 nt, Homo sapiens
cauaugcaugccagg

SEQ ID NO: 437511 - RNA, 13 nt, Homo sapiens
cauauggaaaucc

SEQ ID NO: 437512 - RNA, 14 nt, Homo sapiens
cauauguacauaaa

SEQ ID NO: 437513 - RNA, 15 nt, Homo sapiens
cauauuaagacauaa

SEQ ID NO: 437514 - RNA, 15 nt, Homo sapiens
cauauuaaucccucg

SEQ ID NO: 437515 - RNA, 16 nt, Homo sapiens
cauauugaggcauuca

SEQ ID NO: 437516 - RNA, 19 nt, Homo sapiens
cauauuguuugaucuacuu

SEQ ID NO: 437517 - RNA, 13 nt, Homo sapiens
cauauuuacuucu

SEQ ID NO: 437518 - RNA, 21 nt, Homo sapiens
caucaaaaaaacaaguuuaga

SEQ ID NO: 437519 - RNA, 14 nt, Homo sapiens
caucaagaugugac

SEQ ID NO: 437520 - RNA, 17 nt, Homo sapiens
caucaagaugugacaug

SEQ ID NO: 437521 - RNA, 22 nt, Homo sapiens
caucaccccuuccccauuuccu

SEQ ID NO: 437522 - RNA, 22 nt, Homo sapiens
caucacucaaccauaacacuug

SEQ ID NO: 437523 - RNA, 23 nt, Homo sapiens
caucacuccucugucauaugcag

SEQ ID NO: 437524 - RNA, 19 nt, Homo sapiens
caucagaccugucuuccaa

SEQ ID NO: 437525 - RNA, 15 nt, Homo sapiens
caucagauaagacau

SEQ ID NO: 437526 - RNA, 21 nt, Homo sapiens
caucaguguccucuugcucaa

SEQ ID NO: 437527 - RNA, 12 nt, Homo sapiens
caucaucuaugg

SEQ ID NO: 437528 - RNA, 22 nt, Homo sapiens
cauccauagugcacuagcauuu

SEQ ID NO: 437529 - RNA, 12 nt, Homo sapiens
cauccaucagcu

SEQ ID NO: 437530 - RNA, 12 nt, Homo sapiens
cauccauucucc

SEQ ID NO: 437531 - RNA, 15 nt, Homo sapiens
caucccaucaucuug

SEQ ID NO: 437532 - RNA, 20 nt, Homo sapiens
caucccaugagcaguccaga

SEQ ID NO: 437533 - RNA, 14 nt, Homo sapiens
caucccggggccau

SEQ ID NO: 437534 - RNA, 18 nt, Homo sapiens
caucccuaagaauuccca

SEQ ID NO: 437535 - RNA, 18 nt, Homo sapiens
caucccugugagcaaaaa

SEQ ID NO: 437536 - RNA, 23 nt, Homo sapiens
cauccggcaugagggcugagaug

SEQ ID NO: 437537 - RNA, 12 nt, Homo sapiens
cauccucaaaag

SEQ ID NO: 437538 - RNA, 22 nt, Homo sapiens
cauccugaaaaggguguugcua

SEQ ID NO: 437539 - RNA, 23 nt, Homo sapiens
cauccugauuauugaauguuaua

SEQ ID NO: 437540 - RNA, 22 nt, Homo sapiens
cauccuucccgcagcaccagcc

SEQ ID NO: 437541 - RNA, 20 nt, Homo sapiens
cauccuuuuacuuuuugccc

SEQ ID NO: 437542 - RNA, 20 nt, Homo sapiens
caucuaaauugaucauucau

SEQ ID NO: 437543 - RNA, 14 nt, Homo sapiens
caucuaagacauuc

SEQ ID NO: 437544 - RNA, 19 nt, Homo sapiens
caucuaagucaguuucaca

SEQ ID NO: 437545 - RNA, 14 nt, Homo sapiens
caucuacccaucua

SEQ ID NO: 437546 - RNA, 17 nt, Homo sapiens
caucuacccugcugacc

SEQ ID NO: 437547 - RNA, 14 nt, Homo sapiens
caucuagcuccaua

SEQ ID NO: 437548 - RNA, 16 nt, Homo sapiens
caucuagucucagugc

SEQ ID NO: 437549 - RNA, 13 nt, Homo sapiens
caucuaugugaga

SEQ ID NO: 437550 - RNA, 14 nt, Homo sapiens
caucuauuuucuca

SEQ ID NO: 437551 - RNA, 13 nt, Homo sapiens
caucucagugcag

SEQ ID NO: 437552 - RNA, 18 nt, Homo sapiens
caucuccccucagauucc

SEQ ID NO: 437553 - RNA, 20 nt, Homo sapiens
caucuccccucagauuccac

SEQ ID NO: 437554 - RNA, 22 nt, Homo sapiens
caucucccuuccaccucacaac

SEQ ID NO: 437555 - RNA, 12 nt, Homo sapiens
caucucuacuaa

SEQ ID NO: 437556 - RNA, 14 nt, Homo sapiens
caucucuuguauau

SEQ ID NO: 437557 - RNA, 19 nt, Homo sapiens
cauuauuuuuccacuuugu

SEQ ID NO: 437558 - RNA, 18 nt, Homo sapiens
cauucaaaaacauggcca

SEQ ID NO: 437559 - RNA, 17 nt, Homo sapiens
cauucaaggaugcacag

SEQ ID NO: 437560 - RNA, 16 nt, Homo sapiens
cauucacacacagccu

SEQ ID NO: 437561 - RNA, 14 nt, Homo sapiens
cauucagauuuacc

SEQ ID NO: 437562 - RNA, 14 nt, Homo sapiens
cauucauauuugca

SEQ ID NO: 437563 - RNA, 19 nt, Homo sapiens
cauucaugugggcauuucu

SEQ ID NO: 437564 - RNA, 14 nt, Homo sapiens
cauuccaccuuccc

SEQ ID NO: 437565 - RNA, 13 nt, Homo sapiens
cauuccaggaaac

SEQ ID NO: 437566 - RNA, 14 nt, Homo sapiens
cauuccaucaauuu

SEQ ID NO: 437567 - RNA, 16 nt, Homo sapiens
acucugaauccucaug

SEQ ID NO: 437568 - RNA, 14 nt, Homo sapiens
acucugacaguauu

SEQ ID NO: 437569 - RNA, 15 nt, Homo sapiens
acucugcacuacucc

SEQ ID NO: 437570 - RNA, 20 nt, Homo sapiens
acucugcccauccccacccc

SEQ ID NO: 437571 - RNA, 19 nt, Homo sapiens
acucugcggauagcauuug

SEQ ID NO: 437572 - RNA, 14 nt, Homo sapiens
acucuuaccuacaa

SEQ ID NO: 437573 - RNA, 16 nt, Homo sapiens
acucuuaucuacauaa

SEQ ID NO: 437574 - RNA, 18 nt, Homo sapiens
acucuuccuggaaugcau

SEQ ID NO: 437575 - RNA, 20 nt, Homo sapiens
acucuugucgggagauugaa

SEQ ID NO: 437576 - RNA, 12 nt, Homo sapiens
acucuuugcaac

SEQ ID NO: 437577 - RNA, 15 nt, Homo sapiens
acugaaaacuguaaa

SEQ ID NO: 437578 - RNA, 14 nt, Homo sapiens
acugaaacuucccu

SEQ ID NO: 437579 - RNA, 13 nt, Homo sapiens
acugaacuguuac

SEQ ID NO: 437580 - RNA, 16 nt, Homo sapiens
acugaaggacacagca

SEQ ID NO: 437581 - RNA, 18 nt, Homo sapiens
acugaagugaacuaugaa

SEQ ID NO: 437582 - RNA, 13 nt, Homo sapiens
acugaauucugaa

SEQ ID NO: 437583 - RNA, 16 nt, Homo sapiens
acugaauuucuuugau

SEQ ID NO: 437584 - RNA, 15 nt, Homo sapiens
acugacaaauucugu

SEQ ID NO: 437585 - RNA, 22 nt, Homo sapiens
acugacaacaugcuagguagug

SEQ ID NO: 437586 - RNA, 20 nt, Homo sapiens
acugacauauaucuauuaca

SEQ ID NO: 437587 - RNA, 15 nt, Homo sapiens
acugaccagccucca

SEQ ID NO: 437588 - RNA, 11 nt, Homo sapiens
acugaccaguu

SEQ ID NO: 437589 - RNA, 12 nt, Homo sapiens
acugacuugagg

SEQ ID NO: 437590 - RNA, 14 nt, Homo sapiens
acugagacauuaca

SEQ ID NO: 437591 - RNA, 20 nt, Homo sapiens
acugagauuuugguauuaca

SEQ ID NO: 437592 - RNA, 18 nt, Homo sapiens
acugagccaaaaacaaua

SEQ ID NO: 437593 - RNA, 22 nt, Homo sapiens
acugaggaaugcgguucagggc

SEQ ID NO: 437594 - RNA, 22 nt, Homo sapiens
acugaggccuucucaaacuuua

SEQ ID NO: 437595 - RNA, 22 nt, Homo sapiens
acugagggccuggucaccacaa

SEQ ID NO: 437596 - RNA, 21 nt, Homo sapiens
acugagggggagcugucuugu

SEQ ID NO: 437597 - RNA, 22 nt, Homo sapiens
acugaguagcucuccugacuuu

SEQ ID NO: 437598 - RNA, 23 nt, Homo sapiens
acugaguauugauaaacuuugaa

SEQ ID NO: 437599 - RNA, 18 nt, Homo sapiens
acugagucuggcaaacau

SEQ ID NO: 437600 - RNA, 23 nt, Homo sapiens
acugagucuguggacacugugga

SEQ ID NO: 437601 - RNA, 13 nt, Homo sapiens
acugaucauuaaa

SEQ ID NO: 437602 - RNA, 19 nt, Homo sapiens
acugauccuguuucuugcu

SEQ ID NO: 437603 - RNA, 19 nt, Homo sapiens
acugaugaaggcaugccua

SEQ ID NO: 437604 - RNA, 12 nt, Homo sapiens
acugaugucauc

SEQ ID NO: 437605 - RNA, 14 nt, Homo sapiens
acugauuucacaac

SEQ ID NO: 437606 - RNA, 20 nt, Homo sapiens
acugauuucacaacagauca

SEQ ID NO: 437607 - RNA, 23 nt, Homo sapiens
acugcaaccucugccucccaggu

SEQ ID NO: 437608 - RNA, 16 nt, Homo sapiens
acugcaacuucugccu

SEQ ID NO: 437609 - RNA, 18 nt, Homo sapiens
acugcacagugcaucuca

SEQ ID NO: 437610 - RNA, 16 nt, Homo sapiens
acugcaccaacgagcu

SEQ ID NO: 437611 - RNA, 20 nt, Homo sapiens
acugcacuccagccugggug

SEQ ID NO: 437612 - RNA, 13 nt, Homo sapiens
acugcagauuucu

SEQ ID NO: 437613 - RNA, 17 nt, Homo sapiens
acugcagauuucucacc

SEQ ID NO: 437614 - RNA, 20 nt, Homo sapiens
acugcagggacugccagucc

SEQ ID NO: 437615 - RNA, 16 nt, Homo sapiens
acugcauguaagccaa

SEQ ID NO: 437616 - RNA, 22 nt, Homo sapiens
acugcauuuggggccuuuccca

SEQ ID NO: 437617 - RNA, 18 nt, Homo sapiens
acugccccuugcuucuca

SEQ ID NO: 437618 - RNA, 13 nt, Homo sapiens
acugcccugggca

SEQ ID NO: 437619 - RNA, 14 nt, Homo sapiens
acugccucugccac

SEQ ID NO: 437620 - RNA, 22 nt, Homo sapiens
acugccucugccacacucugac

SEQ ID NO: 437621 - RNA, 17 nt, Homo sapiens
acugccucugccuuaga

SEQ ID NO: 437622 - RNA, 22 nt, Homo sapiens
acugccucuggaauugcucaag

SEQ ID NO: 437623 - RNA, 19 nt, Homo sapiens
acugccuggaaagcccuuc

SEQ ID NO: 437624 - RNA, 21 nt, Homo sapiens
acugccuguuaagucugagaa

SEQ ID NO: 437625 - RNA, 19 nt, Homo sapiens
acugccuuacagacagaau

SEQ ID NO: 437626 - RNA, 19 nt, Homo sapiens
acugcugcuccagugcagg

SEQ ID NO: 437627 - RNA, 15 nt, Homo sapiens
acugcugcuucuuaa

SEQ ID NO: 437628 - RNA, 12 nt, Homo sapiens
acugcugugaau

SEQ ID NO: 437629 - RNA, 14 nt, Homo sapiens
acugcuuaguauua

SEQ ID NO: 437630 - RNA, 16 nt, Homo sapiens
acuggaaaccuguuau

SEQ ID NO: 437631 - RNA, 20 nt, Homo sapiens
acuggaaauaaccugugaau

SEQ ID NO: 437632 - RNA, 17 nt, Homo sapiens
acuggaacacuaaugag

SEQ ID NO: 437633 - RNA, 15 nt, Homo sapiens
acuggagaguggcaa

SEQ ID NO: 437634 - RNA, 15 nt, Homo sapiens
acuggaggugggcau

SEQ ID NO: 437635 - RNA, 11 nt, Homo sapiens
acuggagucag

SEQ ID NO: 437636 - RNA, 22 nt, Homo sapiens
acuggcacgcgacgaggacgca

SEQ ID NO: 437637 - RNA, 19 nt, Homo sapiens
acuggccagcucuggcuca

SEQ ID NO: 437638 - RNA, 17 nt, Homo sapiens
acuggccuagagccuca

SEQ ID NO: 437639 - RNA, 22 nt, Homo sapiens
acuggccugggucucccuggug

SEQ ID NO: 437640 - RNA, 15 nt, Homo sapiens
acuggcugugugacu

SEQ ID NO: 437641 - RNA, 17 nt, Homo sapiens
acugggaagaugcuggc

SEQ ID NO: 437642 - RNA, 21 nt, Homo sapiens
acugggccugcuagucuguca

SEQ ID NO: 437643 - RNA, 15 nt, Homo sapiens
acugggucucacucc

SEQ ID NO: 437644 - RNA, 20 nt, Homo sapiens
acuggguuccucuccaagcu

SEQ ID NO: 437645 - RNA, 16 nt, Homo sapiens
acugguauguguggau

SEQ ID NO: 437646 - RNA, 20 nt, Homo sapiens
acugguuaaaucaauucuga

SEQ ID NO: 437647 - RNA, 18 nt, Homo sapiens
acugguuauccugugcua

SEQ ID NO: 437648 - RNA, 22 nt, Homo sapiens
acugguuuguaugauguauuag

SEQ ID NO: 437649 - RNA, 17 nt, Homo sapiens
acuguacugacuugagg

SEQ ID NO: 437650 - RNA, 17 nt, Homo sapiens
acuguacugagacauua

SEQ ID NO: 437651 - RNA, 21 nt, Homo sapiens
acuguacugagacauuacagu

SEQ ID NO: 437652 - RNA, 23 nt, Homo sapiens
acuguagguauagaagaucugcc

SEQ ID NO: 437653 - RNA, 16 nt, Homo sapiens
acuguauucgugcauu

SEQ ID NO: 437654 - RNA, 15 nt, Homo sapiens
acugucagcgagcug

SEQ ID NO: 437655 - RNA, 21 nt, Homo sapiens
acugucagcugagcuugagcu

SEQ ID NO: 437656 - RNA, 16 nt, Homo sapiens
acugucauauaaugca

SEQ ID NO: 437657 - RNA, 14 nt, Homo sapiens
acugucccuugccu

SEQ ID NO: 437658 - RNA, 15 nt, Homo sapiens
acugucuccuaccuc

SEQ ID NO: 437659 - RNA, 19 nt, Homo sapiens
acugucuccuuucucuuau

SEQ ID NO: 437660 - RNA, 21 nt, Homo sapiens
acugucucguacuagaauuca

SEQ ID NO: 437661 - RNA, 20 nt, Homo sapiens
acugugaacuuggggaacaa

SEQ ID NO: 437662 - RNA, 15 nt, Homo sapiens
acugugacauuccac

SEQ ID NO: 437663 - RNA, 20 nt, Homo sapiens
acugugccauguguuuaucc

SEQ ID NO: 437664 - RNA, 20 nt, Homo sapiens
acugugcguuuuagaguaug

SEQ ID NO: 437665 - RNA, 20 nt, Homo sapiens
acuguggagguggcugguca

SEQ ID NO: 437666 - RNA, 15 nt, Homo sapiens
acuguggccucagga

SEQ ID NO: 437667 - RNA, 22 nt, Homo sapiens
acuguggucccagcuacagggg

SEQ ID NO: 437668 - RNA, 21 nt, Homo sapiens
acuguguaaccagcagucaca

SEQ ID NO: 437669 - RNA, 21 nt, Homo sapiens
acugugucccucucucuggaa

SEQ ID NO: 437670 - RNA, 16 nt, Homo sapiens
acuguguggacuguga

SEQ ID NO: 437671 - RNA, 14 nt, Homo sapiens
acuguguguugcca

SEQ ID NO: 437672 - RNA, 23 nt, Homo sapiens
acuguucucuauuagacuuuaga

SEQ ID NO: 437673 - RNA, 17 nt, Homo sapiens
acuguugcauaacuauu

SEQ ID NO: 437674 - RNA, 18 nt, Homo sapiens
acuguugcccauugcacu

SEQ ID NO: 437675 - RNA, 20 nt, Homo sapiens
acuguuggagcuacugcaaa

SEQ ID NO: 437676 - RNA, 13 nt, Homo sapiens
acuguuugcccca

SEQ ID NO: 437677 - RNA, 15 nt, Homo sapiens
acuuaaaaguauuca

SEQ ID NO: 437678 - RNA, 21 nt, Homo sapiens
acuuaaacaaaaacuuuccau

SEQ ID NO: 437679 - RNA, 21 nt, Homo sapiens
acuuaaauaauaaacagugga

SEQ ID NO: 437680 - RNA, 11 nt, Homo sapiens
acuuaacuuaa

SEQ ID NO: 437681 - RNA, 15 nt, Homo sapiens
acuuaagaagccuua

SEQ ID NO: 437682 - RNA, 19 nt, Homo sapiens
acuuaagaguggcauauaa

SEQ ID NO: 437683 - RNA, 14 nt, Homo sapiens
acuuaagcccagga

SEQ ID NO: 437684 - RNA, 15 nt, Homo sapiens
acuuaauuauaagcu

SEQ ID NO: 437685 - RNA, 18 nt, Homo sapiens
acuuaauucuguuacaca

SEQ ID NO: 437686 - RNA, 21 nt, Homo sapiens
acuuaauuuuuccugcuguau

SEQ ID NO: 437687 - RNA, 19 nt, Homo sapiens
agaaauguuguucauuauu

SEQ ID NO: 437688 - RNA, 19 nt, Homo sapiens
agaaauuauuuaauaugca

SEQ ID NO: 437689 - RNA, 19 nt, Homo sapiens
agaaauucuguuaauguua

SEQ ID NO: 437690 - RNA, 21 nt, Homo sapiens
agaaauugauugaacguucuc

SEQ ID NO: 437691 - RNA, 22 nt, Homo sapiens
agaaauugcauuuccugacaga

SEQ ID NO: 437692 - RNA, 21 nt, Homo sapiens
agaaauuuuaucucuucuucc

SEQ ID NO: 437693 - RNA, 23 nt, Homo sapiens
agaacaaaccucuauauguugcu

SEQ ID NO: 437694 - RNA, 13 nt, Homo sapiens
agaacaaccaaaa

SEQ ID NO: 437695 - RNA, 15 nt, Homo sapiens
agaacaaugcuauaa

SEQ ID NO: 437696 - RNA, 18 nt, Homo sapiens
agaacaauguuucuucag

SEQ ID NO: 437697 - RNA, 19 nt, Homo sapiens
agaaccaaaaagaggcuau

SEQ ID NO: 437698 - RNA, 12 nt, Homo sapiens
agaaccaaagca

SEQ ID NO: 437699 - RNA, 20 nt, Homo sapiens
agaaccagagaggcucugag

SEQ ID NO: 437700 - RNA, 14 nt, Homo sapiens
agaaccgagcaaag

SEQ ID NO: 437701 - RNA, 19 nt, Homo sapiens
agaaccuggauguacuuaa

SEQ ID NO: 437702 - RNA, 18 nt, Homo sapiens
agaaccuuuugagugccu

SEQ ID NO: 437703 - RNA, 19 nt, Homo sapiens
ccaauggugauccucuauu

SEQ ID NO: 437704 - RNA, 23 nt, Homo sapiens
ccaauguucuauuaaucaccucu

SEQ ID NO: 437705 - RNA, 22 nt, Homo sapiens
ccaauuaaguccuacuuuacau

SEQ ID NO: 437706 - RNA, 23 nt, Homo sapiens
ccaauucugucccaaucuuacca

SEQ ID NO: 437707 - RNA, 15 nt, Homo sapiens
ccaauuuuguugcau

SEQ ID NO: 437708 - RNA, 16 nt, Homo sapiens
ccacaaaaaauacuuu

SEQ ID NO: 437709 - RNA, 12 nt, Homo sapiens
ccacaaaugucc

SEQ ID NO: 437710 - RNA, 21 nt, Homo sapiens
ccacaauaagccacugguauc

SEQ ID NO: 437711 - RNA, 22 nt, Homo sapiens
ccacacccuggaggauuucauc

SEQ ID NO: 437712 - RNA, 17 nt, Homo sapiens
ccacacguuugauuucu

SEQ ID NO: 437713 - RNA, 15 nt, Homo sapiens
ccacacguuugccaa

SEQ ID NO: 437714 - RNA, 19 nt, Homo sapiens
ccacagaggacagugcuga

SEQ ID NO: 437715 - RNA, 19 nt, Homo sapiens
ccacagaugcuugugauuu

SEQ ID NO: 437716 - RNA, 18 nt, Homo sapiens
ccacaggaggcaagcaag

SEQ ID NO: 437717 - RNA, 13 nt, Homo sapiens
ccacaggaucuga

SEQ ID NO: 437718 - RNA, 15 nt, Homo sapiens
ccacauuuugcuuua

SEQ ID NO: 437719 - RNA, 14 nt, Homo sapiens
ccaccacaagagcu

SEQ ID NO: 437720 - RNA, 12 nt, Homo sapiens
ccaccacacccc

SEQ ID NO: 437721 - RNA, 15 nt, Homo sapiens
ccaccacucuugacu

SEQ ID NO: 437722 - RNA, 16 nt, Homo sapiens
ccaccagggcuucugg

SEQ ID NO: 437723 - RNA, 20 nt, Homo sapiens
ccaccauuuccccugugguu

SEQ ID NO: 437724 - RNA, 19 nt, Homo sapiens
ccacccaagcuuggcagcc

SEQ ID NO: 437725 - RNA, 13 nt, Homo sapiens
ccaccccacacuu

SEQ ID NO: 437726 - RNA, 18 nt, Homo sapiens
ccaccccacucacagaga

SEQ ID NO: 437727 - RNA, 20 nt, Homo sapiens
ccacccguaggcagccucuc

SEQ ID NO: 437728 - RNA, 12 nt, Homo sapiens
ccacccuaucau

SEQ ID NO: 437729 - RNA, 17 nt, Homo sapiens
ccacccuccaugcuccu

SEQ ID NO: 437730 - RNA, 13 nt, Homo sapiens
ccacccuucucag

SEQ ID NO: 437731 - RNA, 21 nt, Homo sapiens
ccaccgcauaugcaugccagg

SEQ ID NO: 437732 - RNA, 17 nt, Homo sapiens
ccaccgcuggagcuccu

SEQ ID NO: 437733 - RNA, 15 nt, Homo sapiens
ccaccuccugcaaua

SEQ ID NO: 437734 - RNA, 16 nt, Homo sapiens
ccaccugacaauggca

SEQ ID NO: 437735 - RNA, 16 nt, Homo sapiens
ccaccugccugcaucu

SEQ ID NO: 437736 - RNA, 24 nt, Homo sapiens
ccaccugccugcaucugugaaaag

SEQ ID NO: 437737 - RNA, 13 nt, Homo sapiens
ccaccugcugcug

SEQ ID NO: 437738 - RNA, 16 nt, Homo sapiens
ccaccuggauucccug

SEQ ID NO: 437739 - RNA, 17 nt, Homo sapiens
ccaccugugcugcugca

SEQ ID NO: 437740 - RNA, 16 nt, Homo sapiens
ccacgucaacagaauu

SEQ ID NO: 437741 - RNA, 22 nt, Homo sapiens
ccacguccagcuggaaggguca

SEQ ID NO: 437742 - RNA, 20 nt, Homo sapiens
ccacgugagagaaucugccu

SEQ ID NO: 437743 - RNA, 19 nt, Homo sapiens
ccacgugccauugucuuuc

SEQ ID NO: 437744 - RNA, 19 nt, Homo sapiens
ccacgugggcaaacaggca

SEQ ID NO: 437745 - RNA, 20 nt, Homo sapiens
ccacguugccucuacuuuau

SEQ ID NO: 437746 - RNA, 21 nt, Homo sapiens
ccacuaauuugucacuggaac

SEQ ID NO: 437747 - RNA, 19 nt, Homo sapiens
ccacuagguuucaccuccc

SEQ ID NO: 437748 - RNA, 12 nt, Homo sapiens
ccacucagggau

SEQ ID NO: 437749 - RNA, 15 nt, Homo sapiens
ccacucccugccaac

SEQ ID NO: 437750 - RNA, 16 nt, Homo sapiens
ccacucccugcuccac

SEQ ID NO: 437751 - RNA, 14 nt, Homo sapiens
ccacuccuguacac

SEQ ID NO: 437752 - RNA, 15 nt, Homo sapiens
ccacuccuguuccuu

SEQ ID NO: 437753 - RNA, 13 nt, Homo sapiens
ccacucuaccuga

SEQ ID NO: 437754 - RNA, 22 nt, Homo sapiens
ccacucuguuccuacuggagau

SEQ ID NO: 437755 - RNA, 16 nt, Homo sapiens
ccacugagaagucaaa

SEQ ID NO: 437756 - RNA, 20 nt, Homo sapiens
ccacugaucucuacuaccac

SEQ ID NO: 437757 - RNA, 18 nt, Homo sapiens
ccacuggaaaaguguaau

SEQ ID NO: 437758 - RNA, 17 nt, Homo sapiens
ccacuggccagcucugg

SEQ ID NO: 437759 - RNA, 19 nt, Homo sapiens
ccacuggccagcucuggcu

SEQ ID NO: 437760 - RNA, 13 nt, Homo sapiens
ccacuggucugua

SEQ ID NO: 437761 - RNA, 22 nt, Homo sapiens
ccacuggucuguagggauuuuu

SEQ ID NO: 437762 - RNA, 16 nt, Homo sapiens
ccacugucccuaccac

SEQ ID NO: 437763 - RNA, 19 nt, Homo sapiens
ccacugucuauguacaaua

SEQ ID NO: 437764 - RNA, 19 nt, Homo sapiens
ccacugugcugaauucugc

SEQ ID NO: 437765 - RNA, 15 nt, Homo sapiens
ccacuguguauuuaa

SEQ ID NO: 437766 - RNA, 15 nt, Homo sapiens
ccacuguuacauuuc

SEQ ID NO: 437767 - RNA, 23 nt, Homo sapiens
ccacuguugguauuauauaauuc

SEQ ID NO: 437768 - RNA, 22 nt, Homo sapiens
ccacuuaaucuucucucuugau

SEQ ID NO: 437769 - RNA, 16 nt, Homo sapiens
ccacuuagagaacaaa

SEQ ID NO: 437770 - RNA, 16 nt, Homo sapiens
ccacuugcacugugcu

SEQ ID NO: 437771 - RNA, 21 nt, Homo sapiens
ccacuugcacugugcuugcuc

SEQ ID NO: 437772 - RNA, 17 nt, Homo sapiens
ccacuugccccuguuac

SEQ ID NO: 437773 - RNA, 14 nt, Homo sapiens
ccacuugcucagac

SEQ ID NO: 437774 - RNA, 17 nt, Homo sapiens
ccacuugucacuacaaa

SEQ ID NO: 437775 - RNA, 14 nt, Homo sapiens
ccacuuguucugua

SEQ ID NO: 437776 - RNA, 15 nt, Homo sapiens
ccacuuugauaccau

SEQ ID NO: 437777 - RNA, 20 nt, Homo sapiens
ccacuuugucuuggugggag

SEQ ID NO: 437778 - RNA, 23 nt, Homo sapiens
ccagaaaauaugauauauaugua

SEQ ID NO: 437779 - RNA, 15 nt, Homo sapiens
ccagaacugccccca

SEQ ID NO: 437780 - RNA, 21 nt, Homo sapiens
ccagaagaacaguaggugaca

SEQ ID NO: 437781 - RNA, 20 nt, Homo sapiens
ccagaagcggccugugcguu

SEQ ID NO: 437782 - RNA, 14 nt, Homo sapiens
ccagaagugccaug

SEQ ID NO: 437783 - RNA, 17 nt, Homo sapiens
ccagaauaucugggauu

SEQ ID NO: 437784 - RNA, 14 nt, Homo sapiens
ccagaauccucuca

SEQ ID NO: 437785 - RNA, 18 nt, Homo sapiens
ccagaauuugcugcauuu

SEQ ID NO: 437786 - RNA, 11 nt, Homo sapiens
ccagaccccau

SEQ ID NO: 437787 - RNA, 18 nt, Homo sapiens
ccagacccuggcaucuga

SEQ ID NO: 437788 - RNA, 16 nt, Homo sapiens
ccagaccuguucugac

SEQ ID NO: 437789 - RNA, 23 nt, Homo sapiens
ccagacuccaccgucagcuguaa

SEQ ID NO: 437790 - RNA, 15 nt, Homo sapiens
ccagagaaaagaguc

SEQ ID NO: 437791 - RNA, 20 nt, Homo sapiens
ccagagagccuggugcugcu

SEQ ID NO: 437792 - RNA, 20 nt, Homo sapiens
ccagagcaggagacuggcaa

SEQ ID NO: 437793 - RNA, 21 nt, Homo sapiens
ccagagcauuuccaacaccac

SEQ ID NO: 437794 - RNA, 20 nt, Homo sapiens
ccagagccccccacaaugau

SEQ ID NO: 437795 - RNA, 21 nt, Homo sapiens
ccagagccccccacaaugaug

SEQ ID NO: 437796 - RNA, 18 nt, Homo sapiens
ccagagcccugaguuucu

SEQ ID NO: 437797 - RNA, 19 nt, Homo sapiens
ccagagcccuucacugcca

SEQ ID NO: 437798 - RNA, 20 nt, Homo sapiens
ccagagccuauggaaagggu

SEQ ID NO: 437799 - RNA, 14 nt, Homo sapiens
ccagagcuucaggg

SEQ ID NO: 437800 - RNA, 15 nt, Homo sapiens
ccagaggcaguaacc

SEQ ID NO: 437801 - RNA, 12 nt, Homo sapiens
ccagaggggugc

SEQ ID NO: 437802 - RNA, 21 nt, Homo sapiens
ccagagguaagaauagaauuu

SEQ ID NO: 437803 - RNA, 20 nt, Homo sapiens
ccagaguggccuggccagga

SEQ ID NO: 437804 - RNA, 12 nt, Homo sapiens
ccagauaccagc

SEQ ID NO: 437805 - RNA, 15 nt, Homo sapiens
ccagauccagacugu

SEQ ID NO: 437806 - RNA, 12 nt, Homo sapiens
ccagaucugccu

SEQ ID NO: 437807 - RNA, 18 nt, Homo sapiens
ccagauugacgacaagug

SEQ ID NO: 437808 - RNA, 20 nt, Homo sapiens
ccagcaaugauguccagaag

SEQ ID NO: 437809 - RNA, 20 nt, Homo sapiens
ccagcacacggcugccugac

SEQ ID NO: 437810 - RNA, 12 nt, Homo sapiens
ccagcacagggg

SEQ ID NO: 437811 - RNA, 20 nt, Homo sapiens
ccagcaccuggcacaccaga

SEQ ID NO: 437812 - RNA, 21 nt, Homo sapiens
ccagcaccuggcacaccagaa

SEQ ID NO: 437813 - RNA, 20 nt, Homo sapiens
ccagcacuuugggaggccaa

SEQ ID NO: 437814 - RNA, 15 nt, Homo sapiens
ccagcaugugugugu

SEQ ID NO: 437815 - RNA, 22 nt, Homo sapiens
ccagccaccccgggcucucugc

SEQ ID NO: 437816 - RNA, 15 nt, Homo sapiens
ccagcccaaccggga

SEQ ID NO: 437817 - RNA, 17 nt, Homo sapiens
agacuucagcuguuccu

SEQ ID NO: 437818 - RNA, 16 nt, Homo sapiens
agacuucuuugcaaca

SEQ ID NO: 437819 - RNA, 19 nt, Homo sapiens
agacuucuuugcaacaaua

SEQ ID NO: 437820 - RNA, 14 nt, Homo sapiens
agacuuuacaugga

SEQ ID NO: 437821 - RNA, 18 nt, Homo sapiens
agacuuucuuaucacuua

SEQ ID NO: 437822 - RNA, 15 nt, Homo sapiens
agagaaaaaccaaug

SEQ ID NO: 437823 - RNA, 22 nt, Homo sapiens
agagaaaacagaccuaaugcuc

SEQ ID NO: 437824 - RNA, 13 nt, Homo sapiens
agagaaccaagcu

SEQ ID NO: 437825 - RNA, 18 nt, Homo sapiens
agagaaccaagcuugucu

SEQ ID NO: 437826 - RNA, 17 nt, Homo sapiens
agagaacugauugugag

SEQ ID NO: 437827 - RNA, 14 nt, Homo sapiens
agagaagagaccaa

SEQ ID NO: 437828 - RNA, 20 nt, Homo sapiens
agagaagcccagacuuccuu

SEQ ID NO: 437829 - RNA, 22 nt, Homo sapiens
agagaaugagaagaggcugcug

SEQ ID NO: 437830 - RNA, 14 nt, Homo sapiens
agagaauucacuuu

SEQ ID NO: 437831 - RNA, 13 nt, Homo sapiens
agagacaaauagu

SEQ ID NO: 437832 - RNA, 14 nt, Homo sapiens
agagacaagacuuc

SEQ ID NO: 437833 - RNA, 18 nt, Homo sapiens
agagacaauaaaacauuc

SEQ ID NO: 437834 - RNA, 14 nt, Homo sapiens
agagaccaucuccu

SEQ ID NO: 437835 - RNA, 21 nt, Homo sapiens
agagacuuggggaaauugcuu

SEQ ID NO: 437836 - RNA, 18 nt, Homo sapiens
agagagaaacagcuugau

SEQ ID NO: 437837 - RNA, 22 nt, Homo sapiens
agagagacccugccaacuuucc

SEQ ID NO: 437838 - RNA, 12 nt, Homo sapiens
ccagcucuucca

SEQ ID NO: 437839 - RNA, 15 nt, Homo sapiens
ccagcugacauggaa

SEQ ID NO: 437840 - RNA, 14 nt, Homo sapiens
ccagcugcucugcc

SEQ ID NO: 437841 - RNA, 22 nt, Homo sapiens
ccagcuggugucacucugccuc

SEQ ID NO: 437842 - RNA, 19 nt, Homo sapiens
ccagcuguacuagugccau

SEQ ID NO: 437843 - RNA, 14 nt, Homo sapiens
ccagcugugacuga

SEQ ID NO: 437844 - RNA, 21 nt, Homo sapiens
ccagcuguguucacacuguaa

SEQ ID NO: 437845 - RNA, 17 nt, Homo sapiens
ccagcuuugcagugaca

SEQ ID NO: 437846 - RNA, 23 nt, Homo sapiens
ccagcuuuuguagauggcacuuu

SEQ ID NO: 437847 - RNA, 17 nt, Homo sapiens
ccaggaagaauggugug

SEQ ID NO: 437848 - RNA, 13 nt, Homo sapiens
ccaggacagcauu

SEQ ID NO: 437849 - RNA, 23 nt, Homo sapiens
ccaggaccagccagaccagcaga

SEQ ID NO: 437850 - RNA, 12 nt, Homo sapiens
ccaggacuguga

SEQ ID NO: 437851 - RNA, 21 nt, Homo sapiens
ccaggagauggaaguugcagu

SEQ ID NO: 437852 - RNA, 21 nt, Homo sapiens
ccaggagguugagaaugcagu

SEQ ID NO: 437853 - RNA, 22 nt, Homo sapiens
ccaggauccagaagggguuugg

SEQ ID NO: 437854 - RNA, 22 nt, Homo sapiens
ccaggauccccugcuacuccac

SEQ ID NO: 437855 - RNA, 14 nt, Homo sapiens
ccaggcacugcugc

SEQ ID NO: 437856 - RNA, 20 nt, Homo sapiens
ccaggcaggcugugcgcuga

SEQ ID NO: 437857 - RNA, 16 nt, Homo sapiens
ccaggcccaguccacu

SEQ ID NO: 437858 - RNA, 18 nt, Homo sapiens
ccaggccggccagccuca

SEQ ID NO: 437859 - RNA, 16 nt, Homo sapiens
ccaggccugaccucaa

SEQ ID NO: 437860 - RNA, 14 nt, Homo sapiens
ccaggccugccagc

SEQ ID NO: 437861 - RNA, 15 nt, Homo sapiens
ccaggcuccaggcug

SEQ ID NO: 437862 - RNA, 16 nt, Homo sapiens
ccaggcuggagugcaa

SEQ ID NO: 437863 - RNA, 17 nt, Homo sapiens
ccaggcuggagugcagu

SEQ ID NO: 437864 - RNA, 23 nt, Homo sapiens
ccaggcuugggcuccauucccau

SEQ ID NO: 437865 - RNA, 15 nt, Homo sapiens
ccagggagcaagaca

SEQ ID NO: 437866 - RNA, 17 nt, Homo sapiens
ccagggcagugcuagug

SEQ ID NO: 437867 - RNA, 20 nt, Homo sapiens
ccagggcaguguggugggag

SEQ ID NO: 437868 - RNA, 19 nt, Homo sapiens
ccagggcugggcacuccuc

SEQ ID NO: 437869 - RNA, 20 nt, Homo sapiens
ccagggcugggcacuccucc

SEQ ID NO: 437870 - RNA, 21 nt, Homo sapiens
ccaggggcugcgucugacauc

SEQ ID NO: 437871 - RNA, 15 nt, Homo sapiens
ccaggguuccagaca

SEQ ID NO: 437872 - RNA, 20 nt, Homo sapiens
ccaggucguccaagcaaaaa

SEQ ID NO: 437873 - RNA, 18 nt, Homo sapiens
ccaggugucuagaggcaa

SEQ ID NO: 437874 - RNA, 16 nt, Homo sapiens
ccagguuaccucacuu

SEQ ID NO: 437875 - RNA, 20 nt, Homo sapiens
ccagguuaccucacuuuuaa

SEQ ID NO: 437876 - RNA, 15 nt, Homo sapiens
ccagguuccauccac

SEQ ID NO: 437877 - RNA, 17 nt, Homo sapiens
ccagguugggggcagug

SEQ ID NO: 437878 - RNA, 18 nt, Homo sapiens
ccaguaagccacugccac

SEQ ID NO: 437879 - RNA, 16 nt, Homo sapiens
ccaguaauugguccga

SEQ ID NO: 437880 - RNA, 17 nt, Homo sapiens
ccaguacauaaggaguu

SEQ ID NO: 437881 - RNA, 16 nt, Homo sapiens
ccaguacauuccaacu

SEQ ID NO: 437882 - RNA, 12 nt, Homo sapiens
ccaguacuugag

SEQ ID NO: 437883 - RNA, 17 nt, Homo sapiens
ccaguagagagugcccu

SEQ ID NO: 437884 - RNA, 13 nt, Homo sapiens
ccaguagccauuu

SEQ ID NO: 437885 - RNA, 15 nt, Homo sapiens
ccaguagcucuugca

SEQ ID NO: 437886 - RNA, 13 nt, Homo sapiens
ccaguaucgcuca

SEQ ID NO: 437887 - RNA, 13 nt, Homo sapiens
ccaguaucuugaa

SEQ ID NO: 437888 - RNA, 17 nt, Homo sapiens
ccagucacuuugccaga

SEQ ID NO: 437889 - RNA, 20 nt, Homo sapiens
ccaguccagauauuucacau

SEQ ID NO: 437890 - RNA, 20 nt, Homo sapiens
ccaguccaguuucccaaaaa

SEQ ID NO: 437891 - RNA, 13 nt, Homo sapiens
ccagucucuggca

SEQ ID NO: 437892 - RNA, 14 nt, Homo sapiens
ccagugcaacagca

SEQ ID NO: 437893 - RNA, 11 nt, Homo sapiens
ccagugcaacc

SEQ ID NO: 437894 - RNA, 16 nt, Homo sapiens
ccagugccaaacuugg

SEQ ID NO: 437895 - RNA, 22 nt, Homo sapiens
ccagugcuacacguuggaguau

SEQ ID NO: 437896 - RNA, 17 nt, Homo sapiens
ccaguggaccugaagga

SEQ ID NO: 437897 - RNA, 9 nt, Homo sapiens
ccagugggc

SEQ ID NO: 437898 - RNA, 15 nt, Homo sapiens
ccagugggcagugca

SEQ ID NO: 437899 - RNA, 16 nt, Homo sapiens
ccagugggcuguguug

SEQ ID NO: 437900 - RNA, 14 nt, Homo sapiens
ccaguguacugcuu

SEQ ID NO: 437901 - RNA, 22 nt, Homo sapiens
ccagugucacuugacucuugaa

SEQ ID NO: 437902 - RNA, 18 nt, Homo sapiens
ccaguguuguuuguaaau

SEQ ID NO: 437903 - RNA, 13 nt, Homo sapiens
ccaguguuuacaa

SEQ ID NO: 437904 - RNA, 15 nt, Homo sapiens
ccaguuaacuguuaa

SEQ ID NO: 437905 - RNA, 23 nt, Homo sapiens
ccaguucuacuauggcugaguuc

SEQ ID NO: 437906 - RNA, 20 nt, Homo sapiens
ccaguuguagcagguuucac

SEQ ID NO: 437907 - RNA, 17 nt, Homo sapiens
ccaguuuauuacauuua

SEQ ID NO: 437908 - RNA, 21 nt, Homo sapiens
ccaguuuugcugcuauaauuc

SEQ ID NO: 437909 - RNA, 23 nt, Homo sapiens
ccauaaaauuagacauaccucuc

SEQ ID NO: 437910 - RNA, 14 nt, Homo sapiens
ccauaacuugaaaa

SEQ ID NO: 437911 - RNA, 16 nt, Homo sapiens
ccauaaggcaguggcu

SEQ ID NO: 437912 - RNA, 20 nt, Homo sapiens
ccauagaaaacaaucugccc

SEQ ID NO: 437913 - RNA, 16 nt, Homo sapiens
ccauagcuuccaugag

SEQ ID NO: 437914 - RNA, 12 nt, Homo sapiens
ccauccaaauaa

SEQ ID NO: 437915 - RNA, 13 nt, Homo sapiens
ccauccaccaccu

SEQ ID NO: 437916 - RNA, 19 nt, Homo sapiens
ccauccaucugcuuacaau

SEQ ID NO: 437917 - RNA, 13 nt, Homo sapiens
ccaucccacugau

SEQ ID NO: 437918 - RNA, 15 nt, Homo sapiens
ccauccccaccagcu

SEQ ID NO: 437919 - RNA, 15 nt, Homo sapiens
ccauccuucccgcag

SEQ ID NO: 437920 - RNA, 19 nt, Homo sapiens
ccaucgccuccaucagcca

SEQ ID NO: 437921 - RNA, 19 nt, Homo sapiens
ccaucggugaaacuaacag

SEQ ID NO: 437922 - RNA, 14 nt, Homo sapiens
ccaucuauggugug

SEQ ID NO: 437923 - RNA, 15 nt, Homo sapiens
ccaucucauucaggu

SEQ ID NO: 437924 - RNA, 18 nt, Homo sapiens
ccaucugcuuacaauucc

SEQ ID NO: 437925 - RNA, 16 nt, Homo sapiens
ccaucuguaaauaucc

SEQ ID NO: 437926 - RNA, 15 nt, Homo sapiens
ccaucuguuugauac

SEQ ID NO: 437927 - RNA, 23 nt, Homo sapiens
ccaugacuggcugucugccugua

SEQ ID NO: 437928 - RNA, 19 nt, Homo sapiens
ccaugacugugaccaccuu

SEQ ID NO: 437929 - RNA, 22 nt, Homo sapiens
ccaugacuucagaguacaucca

SEQ ID NO: 437930 - RNA, 17 nt, Homo sapiens
ccaugagaaaagggaag

SEQ ID NO: 437931 - RNA, 15 nt, Homo sapiens
ccaugcaugugcaua

SEQ ID NO: 437932 - RNA, 19 nt, Homo sapiens
ccaugccuauuuacuggaa

SEQ ID NO: 437933 - RNA, 22 nt, Homo sapiens
ccauggaaggaagaaaagcugc

SEQ ID NO: 437934 - RNA, 13 nt, Homo sapiens
ccauggaggcaca

SEQ ID NO: 437935 - RNA, 22 nt, Homo sapiens
ccauggcaccuuuugcacauaa

SEQ ID NO: 437936 - RNA, 18 nt, Homo sapiens
ccauggccaaggggccag

SEQ ID NO: 437937 - RNA, 21 nt, Homo sapiens
ccauggcccuuccuggacugg

SEQ ID NO: 437938 - RNA, 20 nt, Homo sapiens
ccauggcuccucaccaccga

SEQ ID NO: 437939 - RNA, 22 nt, Homo sapiens
ccauggcuccucaccaccgaga

SEQ ID NO: 437940 - RNA, 15 nt, Homo sapiens
ccaugguagacugug

SEQ ID NO: 437941 - RNA, 19 nt, Homo sapiens
ccauguacaguauguucaa

SEQ ID NO: 437942 - RNA, 21 nt, Homo sapiens
ccauguaccaguguacugcuu

SEQ ID NO: 437943 - RNA, 12 nt, Homo sapiens
ccauguccuccg

SEQ ID NO: 437944 - RNA, 20 nt, Homo sapiens
ccaugugccugcaccaggag

SEQ ID NO: 437945 - RNA, 16 nt, Homo sapiens
ccaugugcugcugugg

SEQ ID NO: 437946 - RNA, 21 nt, Homo sapiens
ccaugugugagugugugcaag

SEQ ID NO: 437947 - RNA, 14 nt, Homo sapiens
cggaugaggucauu

SEQ ID NO: 437948 - RNA, 15 nt, Homo sapiens
cggauggaaggagag

SEQ ID NO: 437949 - RNA, 17 nt, Homo sapiens
cggcaacggcaaccccc

SEQ ID NO: 437950 - RNA, 13 nt, Homo sapiens
cggccaaccuccc

SEQ ID NO: 437951 - RNA, 18 nt, Homo sapiens
cggccacucuaccugaac

SEQ ID NO: 437952 - RNA, 15 nt, Homo sapiens
cggcccuaagccacu

SEQ ID NO: 437953 - RNA, 14 nt, Homo sapiens
cggccucccaaagu

SEQ ID NO: 437954 - RNA, 15 nt, Homo sapiens
cggcgccuccgccca

SEQ ID NO: 437955 - RNA, 14 nt, Homo sapiens
cggcucacugcaac

SEQ ID NO: 437956 - RNA, 14 nt, Homo sapiens
cggcugccaagaca

SEQ ID NO: 437957 - RNA, 16 nt, Homo sapiens
cggcugcccgacucag

SEQ ID NO: 437958 - RNA, 13 nt, Homo sapiens
cgggaacaguguu

SEQ ID NO: 437959 - RNA, 23 nt, Homo sapiens
cgggacauccucugcuaccaucu

SEQ ID NO: 437960 - RNA, 16 nt, Homo sapiens
cgggccccuggcacgu

SEQ ID NO: 437961 - RNA, 14 nt, Homo sapiens
cgggccuccccggg

SEQ ID NO: 437962 - RNA, 21 nt, Homo sapiens
cgggccuggagaacuagagaa

SEQ ID NO: 437963 - RNA, 14 nt, Homo sapiens
cgggcuuuccccca

SEQ ID NO: 437964 - RNA, 13 nt, Homo sapiens
cggggaguuuccg

SEQ ID NO: 437965 - RNA, 20 nt, Homo sapiens
cggggcacuggcugcucugu

SEQ ID NO: 437966 - RNA, 22 nt, Homo sapiens
cgguacuaguucagacacuuug

SEQ ID NO: 437967 - RNA, 21 nt, Homo sapiens
cgguggcgccagcccuaggcu

SEQ ID NO: 437968 - RNA, 21 nt, Homo sapiens
cgguuguauuuucugaucauu

SEQ ID NO: 437969 - RNA, 20 nt, Homo sapiens
cgguuuguauuuagugucuu

SEQ ID NO: 437970 - RNA, 17 nt, Homo sapiens
cguaagugguaugcaug

SEQ ID NO: 437971 - RNA, 23 nt, Homo sapiens
cguaagugguaugcaugggaugu

SEQ ID NO: 437972 - RNA, 12 nt, Homo sapiens
cguacaguucuu

SEQ ID NO: 437973 - RNA, 15 nt, Homo sapiens
cguacuagaauucaa

SEQ ID NO: 437974 - RNA, 13 nt, Homo sapiens
cguagaugcugcc

SEQ ID NO: 437975 - RNA, 17 nt, Homo sapiens
cguagugguacauucca

SEQ ID NO: 437976 - RNA, 18 nt, Homo sapiens
cguagugguacauuccau

SEQ ID NO: 437977 - RNA, 20 nt, Homo sapiens
cguccagcuggaagggucaa

SEQ ID NO: 437978 - RNA, 12 nt, Homo sapiens
cgucccuaagca

SEQ ID NO: 437979 - RNA, 12 nt, Homo sapiens
cgucccuaccuc

SEQ ID NO: 437980 - RNA, 23 nt, Homo sapiens
cgucccuguuagcauaaugugag

SEQ ID NO: 437981 - RNA, 17 nt, Homo sapiens
cguccugcagugugaga

SEQ ID NO: 437982 - RNA, 18 nt, Homo sapiens
cguccuuagaauacugua

SEQ ID NO: 437983 - RNA, 16 nt, Homo sapiens
cgucuacccagacuca

SEQ ID NO: 437984 - RNA, 19 nt, Homo sapiens
cgucugggguggcucugca

SEQ ID NO: 437985 - RNA, 19 nt, Homo sapiens
cgucuucaagaacuucucg

SEQ ID NO: 437986 - RNA, 23 nt, Homo sapiens
cgucuuccugaguggugccaaac

SEQ ID NO: 437987 - RNA, 23 nt, Homo sapiens
cgucuuucgcacauucuccugau

SEQ ID NO: 437988 - RNA, 24 nt, Homo sapiens
cgugaguguccguugacgugacca

SEQ ID NO: 437989 - RNA, 19 nt, Homo sapiens
agggggccaggugcacaga

SEQ ID NO: 437990 - RNA, 21 nt, Homo sapiens
agggggccuuuaaagacuuaa

SEQ ID NO: 437991 - RNA, 20 nt, Homo sapiens
aggggguuacaaacugcaau

SEQ ID NO: 437992 - RNA, 17 nt, Homo sapiens
aggggguuugggggcuu

SEQ ID NO: 437993 - RNA, 13 nt, Homo sapiens
agggguauguucc

SEQ ID NO: 437994 - RNA, 22 nt, Homo sapiens
aggguaagugcuugcuguuccc

SEQ ID NO: 437995 - RNA, 14 nt, Homo sapiens
agggucagugccaa

SEQ ID NO: 437996 - RNA, 21 nt, Homo sapiens
agggucccauuucucacugag

SEQ ID NO: 437997 - RNA, 18 nt, Homo sapiens
aggguccuccuccaucuu

SEQ ID NO: 437998 - RNA, 21 nt, Homo sapiens
aggguccugggccuccugaca

SEQ ID NO: 437999 - RNA, 18 nt, Homo sapiens
agggucuucccuaccuca

SEQ ID NO: 438000 - RNA, 17 nt, Homo sapiens
agggucuuugcaagaau

SEQ ID NO: 438001 - RNA, 14 nt, Homo sapiens
aggguggaauauca

SEQ ID NO: 438002 - RNA, 16 nt, Homo sapiens
aggguggcccuugcag

SEQ ID NO: 438003 - RNA, 15 nt, Homo sapiens
agggugggcucugac

SEQ ID NO: 438004 - RNA, 21 nt, Homo sapiens
agggugggguaaggaggagaa

SEQ ID NO: 438005 - RNA, 15 nt, Homo sapiens
agggugucuguaauc

SEQ ID NO: 438006 - RNA, 19 nt, Homo sapiens
aggguuaaagaaaggcaga

SEQ ID NO: 438007 - RNA, 17 nt, Homo sapiens
aggguuccuguagaccu

SEQ ID NO: 438008 - RNA, 20 nt, Homo sapiens
aggguugggcccagaucugg

SEQ ID NO: 438009 - RNA, 20 nt, Homo sapiens
aggguuuuccaaugugacua

SEQ ID NO: 438010 - RNA, 14 nt, Homo sapiens
agguaaugugaaua

SEQ ID NO: 438011 - RNA, 19 nt, Homo sapiens
agguaccaguuguauuuaa

SEQ ID NO: 438012 - RNA, 15 nt, Homo sapiens
agguacgaaaagagg

SEQ ID NO: 438013 - RNA, 16 nt, Homo sapiens
agguaguggggaccaa

SEQ ID NO: 438014 - RNA, 12 nt, Homo sapiens
agguauacaaaa

SEQ ID NO: 438015 - RNA, 21 nt, Homo sapiens
agguauaccuguugagacuga

SEQ ID NO: 438016 - RNA, 18 nt, Homo sapiens
agguaucaaaauguuguc

SEQ ID NO: 438017 - RNA, 15 nt, Homo sapiens
agguaugcaaauauc

SEQ ID NO: 438018 - RNA, 12 nt, Homo sapiens
agguaugcagag

SEQ ID NO: 438019 - RNA, 21 nt, Homo sapiens
aggucaaagcaaguuucauca

SEQ ID NO: 438020 - RNA, 15 nt, Homo sapiens
aggucaagcccagga

SEQ ID NO: 438021 - RNA, 22 nt, Homo sapiens
aggucaaggcugcagugagcca

SEQ ID NO: 438022 - RNA, 14 nt, Homo sapiens
aggucaaguaagaa

SEQ ID NO: 438023 - RNA, 19 nt, Homo sapiens
aggucaauuuccugaugca

SEQ ID NO: 438024 - RNA, 13 nt, Homo sapiens
aggucaccaaaca

SEQ ID NO: 438025 - RNA, 15 nt, Homo sapiens
aggucaucccggggc

SEQ ID NO: 438026 - RNA, 15 nt, Homo sapiens
aggucauugguggca

SEQ ID NO: 438027 - RNA, 20 nt, Homo sapiens
aggucauugguggcagagug

SEQ ID NO: 438028 - RNA, 14 nt, Homo sapiens
aggucccagugcca

SEQ ID NO: 438029 - RNA, 16 nt, Homo sapiens
agguccugcuguggaa

SEQ ID NO: 438030 - RNA, 16 nt, Homo sapiens
aggucugaaauggagg

SEQ ID NO: 438031 - RNA, 16 nt, Homo sapiens
aggucugacacgucug

SEQ ID NO: 438032 - RNA, 17 nt, Homo sapiens
aggucugauaguccucu

SEQ ID NO: 438033 - RNA, 19 nt, Homo sapiens
aggucuucuuguguccuga

SEQ ID NO: 438034 - RNA, 18 nt, Homo sapiens
aggugaaaauccaucuca

SEQ ID NO: 438035 - RNA, 19 nt, Homo sapiens
aggugaaaauccaucucau

SEQ ID NO: 438036 - RNA, 22 nt, Homo sapiens
aggugaacuguuuccacauuca

SEQ ID NO: 438037 - RNA, 13 nt, Homo sapiens
aggugacugggaa

SEQ ID NO: 438038 - RNA, 18 nt, Homo sapiens
aggugagaaaaggggcau

SEQ ID NO: 438039 - RNA, 15 nt, Homo sapiens
aggugagaccaccuc

SEQ ID NO: 438040 - RNA, 16 nt, Homo sapiens
aggugaggaagcaaaa

SEQ ID NO: 438041 - RNA, 17 nt, Homo sapiens
aggugaggaagcaaaag

SEQ ID NO: 438042 - RNA, 21 nt, Homo sapiens
aggugagugcuugucauggaa

SEQ ID NO: 438043 - RNA, 23 nt, Homo sapiens
aggugagugugagggcagcacug

SEQ ID NO: 438044 - RNA, 14 nt, Homo sapiens
aggugaguucucac

SEQ ID NO: 438045 - RNA, 15 nt, Homo sapiens
aggugaguucucacu

SEQ ID NO: 438046 - RNA, 19 nt, Homo sapiens
aggugauccgccuaccuca

SEQ ID NO: 438047 - RNA, 15 nt, Homo sapiens
aggugaucuaccugc

SEQ ID NO: 438048 - RNA, 17 nt, Homo sapiens
aggugaucuaccugccu

SEQ ID NO: 438049 - RNA, 19 nt, Homo sapiens
aggugauguuuccagcugc

SEQ ID NO: 438050 - RNA, 23 nt, Homo sapiens
aggugccccgugguacauucaca

SEQ ID NO: 438051 - RNA, 23 nt, Homo sapiens
aggugcuguugucauugcuuuac

SEQ ID NO: 438052 - RNA, 22 nt, Homo sapiens
aggugcuuaagcagaagcauua

SEQ ID NO: 438053 - RNA, 16 nt, Homo sapiens
agguggagugucacau

SEQ ID NO: 438054 - RNA, 20 nt, Homo sapiens
agguggagugucacaucucu

SEQ ID NO: 438055 - RNA, 18 nt, Homo sapiens
aggugggauuacaggugc

SEQ ID NO: 438056 - RNA, 16 nt, Homo sapiens
aggugggcaugccacc

SEQ ID NO: 438057 - RNA, 19 nt, Homo sapiens
aggugggccuugcuaccuc

SEQ ID NO: 438058 - RNA, 16 nt, Homo sapiens
aggugggggagccugg

SEQ ID NO: 438059 - RNA, 23 nt, Homo sapiens
agguggguccaggaaggcagcug

SEQ ID NO: 438060 - RNA, 15 nt, Homo sapiens
aggugugacuugaac

SEQ ID NO: 438061 - RNA, 18 nt, Homo sapiens
aggugugugccuagugau

SEQ ID NO: 438062 - RNA, 21 nt, Homo sapiens
agguguguugcccguggaucu

SEQ ID NO: 438063 - RNA, 21 nt, Homo sapiens
agguguuaaaaaccauuauaa

SEQ ID NO: 438064 - RNA, 12 nt, Homo sapiens
agguuaccucac

SEQ ID NO: 438065 - RNA, 15 nt, Homo sapiens
agguuauacuccucc

SEQ ID NO: 438066 - RNA, 13 nt, Homo sapiens
agguucucagcaa

SEQ ID NO: 438067 - RNA, 20 nt, Homo sapiens
agguucucagguguugccaa

SEQ ID NO: 438068 - RNA, 18 nt, Homo sapiens
agguucugucugugccaa

SEQ ID NO: 438069 - RNA, 19 nt, Homo sapiens
agguucuuagugucacuua

SEQ ID NO: 438070 - RNA, 16 nt, Homo sapiens
agguugccugaaaaau

SEQ ID NO: 438071 - RNA, 19 nt, Homo sapiens
agguugcuguugugcagug

SEQ ID NO: 438072 - RNA, 16 nt, Homo sapiens
agguuggaggcccuag

SEQ ID NO: 438073 - RNA, 15 nt, Homo sapiens
agguugggagccaaa

SEQ ID NO: 438074 - RNA, 21 nt, Homo sapiens
agguuggugacugaaacauuc

SEQ ID NO: 438075 - RNA, 18 nt, Homo sapiens
agguugucugaagucacu

SEQ ID NO: 438076 - RNA, 15 nt, Homo sapiens
agguuuacauuguca

SEQ ID NO: 438077 - RNA, 19 nt, Homo sapiens
agugcagaucugugcucau

SEQ ID NO: 438078 - RNA, 21 nt, Homo sapiens
agugcaggcuggcaccgccuu

SEQ ID NO: 438079 - RNA, 16 nt, Homo sapiens
agugcaguagugucac

SEQ ID NO: 438080 - RNA, 21 nt, Homo sapiens
agugcagucacccuguggcaa

SEQ ID NO: 438081 - RNA, 21 nt, Homo sapiens
agugcaugacguuuaaggcca

SEQ ID NO: 438082 - RNA, 21 nt, Homo sapiens
agugcauggccacagccaccu

SEQ ID NO: 438083 - RNA, 21 nt, Homo sapiens
agugcauuuuuaucugugagu

SEQ ID NO: 438084 - RNA, 18 nt, Homo sapiens
agugccaaaaacaacaac

SEQ ID NO: 438085 - RNA, 14 nt, Homo sapiens
agugccaauccaag

SEQ ID NO: 438086 - RNA, 13 nt, Homo sapiens
agugccagcuuuc

SEQ ID NO: 438087 - RNA, 16 nt, Homo sapiens
agugccagguggcuca

SEQ ID NO: 438088 - RNA, 20 nt, Homo sapiens
agugccaugauugcuagcca

SEQ ID NO: 438089 - RNA, 23 nt, Homo sapiens
agugcccaaggaauuucugcucu

SEQ ID NO: 438090 - RNA, 20 nt, Homo sapiens
agugccguagggaguaccug

SEQ ID NO: 438091 - RNA, 14 nt, Homo sapiens
agugccuaccccag

SEQ ID NO: 438092 - RNA, 18 nt, Homo sapiens
agugccuggcaaggccuc

SEQ ID NO: 438093 - RNA, 16 nt, Homo sapiens
agugccuguaucuuuu

SEQ ID NO: 438094 - RNA, 13 nt, Homo sapiens
agugccugugauc

SEQ ID NO: 438095 - RNA, 14 nt, Homo sapiens
agugccuucucuau

SEQ ID NO: 438096 - RNA, 20 nt, Homo sapiens
agugccuucugcccucccug

SEQ ID NO: 438097 - RNA, 16 nt, Homo sapiens
agugccuuuuuccuua

SEQ ID NO: 438098 - RNA, 18 nt, Homo sapiens
agugcggacaaguuuuaa

SEQ ID NO: 438099 - RNA, 12 nt, Homo sapiens
agugcuacuuga

SEQ ID NO: 438100 - RNA, 16 nt, Homo sapiens
agugcuagcuagccag

SEQ ID NO: 438101 - RNA, 20 nt, Homo sapiens
agugcugggauuacaggugu

SEQ ID NO: 438102 - RNA, 18 nt, Homo sapiens
agugcuugccaccaccag

SEQ ID NO: 438103 - RNA, 15 nt, Homo sapiens
agugcuugucaugga

SEQ ID NO: 438104 - RNA, 14 nt, Homo sapiens
aguggaacagucac

SEQ ID NO: 438105 - RNA, 20 nt, Homo sapiens
aguggaagaagaaaacacua

SEQ ID NO: 438106 - RNA, 13 nt, Homo sapiens
aguggaggcauug

SEQ ID NO: 438107 - RNA, 15 nt, Homo sapiens
aguggaucacacaca

SEQ ID NO: 438108 - RNA, 20 nt, Homo sapiens
aguggcacgaucucagcuca

SEQ ID NO: 438109 - RNA, 18 nt, Homo sapiens
aguggcaugugcugugac

SEQ ID NO: 438110 - RNA, 22 nt, Homo sapiens
aguggcauguggguugugauau

SEQ ID NO: 438111 - RNA, 14 nt, Homo sapiens
aguggccugagaag

SEQ ID NO: 438112 - RNA, 20 nt, Homo sapiens
aguggcgugaucucggcuca

SEQ ID NO: 438113 - RNA, 14 nt, Homo sapiens
agugggacccauag

SEQ ID NO: 438114 - RNA, 16 nt, Homo sapiens
agugggagccaaugaa

SEQ ID NO: 438115 - RNA, 18 nt, Homo sapiens
agugggagcugucaggca

SEQ ID NO: 438116 - RNA, 19 nt, Homo sapiens
agugggaggugagaccacc

SEQ ID NO: 438117 - RNA, 22 nt, Homo sapiens
agugggcaggauaaacugaaaa

SEQ ID NO: 438118 - RNA, 13 nt, Homo sapiens
agugggcauguau

SEQ ID NO: 438119 - RNA, 20 nt, Homo sapiens
aguggggccuccuuguccag

SEQ ID NO: 438120 - RNA, 14 nt, Homo sapiens
aguggggugaucuc

SEQ ID NO: 438121 - RNA, 13 nt, Homo sapiens
agugguacaggaa

SEQ ID NO: 438122 - RNA, 22 nt, Homo sapiens
agugguagaggugugugccuag

SEQ ID NO: 438123 - RNA, 21 nt, Homo sapiens
aguggugaggggccacugggc

SEQ ID NO: 438124 - RNA, 12 nt, Homo sapiens
cuacuggcugua

SEQ ID NO: 438125 - RNA, 18 nt, Homo sapiens
cuacugggggcaacccug

SEQ ID NO: 438126 - RNA, 19 nt, Homo sapiens
cuacuuccugugacuucag

SEQ ID NO: 438127 - RNA, 15 nt, Homo sapiens
cuacuuuaaauccua

SEQ ID NO: 438128 - RNA, 13 nt, Homo sapiens
cuacuuugccaca

SEQ ID NO: 438129 - RNA, 14 nt, Homo sapiens
cuagaaaguaauac

SEQ ID NO: 438130 - RNA, 17 nt, Homo sapiens
cuagaacacaaauccaa

SEQ ID NO: 438131 - RNA, 13 nt, Homo sapiens
cuagaacagccag

SEQ ID NO: 438132 - RNA, 12 nt, Homo sapiens
cuagaagcacag

SEQ ID NO: 438133 - RNA, 16 nt, Homo sapiens
cuagaagcugaucuga

SEQ ID NO: 438134 - RNA, 18 nt, Homo sapiens
cuagaagcugaucugauu

SEQ ID NO: 438135 - RNA, 19 nt, Homo sapiens
cuagaauccugcuuuacag

SEQ ID NO: 438136 - RNA, 19 nt, Homo sapiens
cuagacaagguugcuguug

SEQ ID NO: 438137 - RNA, 13 nt, Homo sapiens
cuagacaguauug

SEQ ID NO: 438138 - RNA, 16 nt, Homo sapiens
cuagacaguauugcca

SEQ ID NO: 438139 - RNA, 19 nt, Homo sapiens
cuagacucuucacuguuag

SEQ ID NO: 438140 - RNA, 23 nt, Homo sapiens
cuagacugacccugaucagucua

SEQ ID NO: 438141 - RNA, 22 nt, Homo sapiens
cuagacuucccaacagccuuag

SEQ ID NO: 438142 - RNA, 12 nt, Homo sapiens
cuagacuugaaa

SEQ ID NO: 438143 - RNA, 12 nt, Homo sapiens
cuagacuuucug

SEQ ID NO: 438144 - RNA, 19 nt, Homo sapiens
cuagagaaggacccggagg

SEQ ID NO: 438145 - RNA, 16 nt, Homo sapiens
cuagaggacauauuca

SEQ ID NO: 438146 - RNA, 20 nt, Homo sapiens
cuagaggcuauuccuaggcc

SEQ ID NO: 438147 - RNA, 11 nt, Homo sapiens
cuagaguagag

SEQ ID NO: 438148 - RNA, 15 nt, Homo sapiens
cuagauagcuauuaa

SEQ ID NO: 438149 - RNA, 24 nt, Homo sapiens
cuagaucucccuuaauaaacucac

SEQ ID NO: 438150 - RNA, 17 nt, Homo sapiens
cuagaugagaauucagc

SEQ ID NO: 438151 - RNA, 17 nt, Homo sapiens
cuagaugugucuuacca

SEQ ID NO: 438152 - RNA, 14 nt, Homo sapiens
cuagcaacaacuua

SEQ ID NO: 438153 - RNA, 18 nt, Homo sapiens
cuagccugggccagagaa

SEQ ID NO: 438154 - RNA, 16 nt, Homo sapiens
cuagcuaauguaauaa

SEQ ID NO: 438155 - RNA, 17 nt, Homo sapiens
cuagcuagaaauaugau

SEQ ID NO: 438156 - RNA, 16 nt, Homo sapiens
cuagcugugugcaguc

SEQ ID NO: 438157 - RNA, 19 nt, Homo sapiens
cuaggagaacugcuguguu

SEQ ID NO: 438158 - RNA, 13 nt, Homo sapiens
cuaggagcacugu

SEQ ID NO: 438159 - RNA, 18 nt, Homo sapiens
cuaggaggucaucaaccg

SEQ ID NO: 438160 - RNA, 20 nt, Homo sapiens
cuaggaguuaacuacccuac

SEQ ID NO: 438161 - RNA, 22 nt, Homo sapiens
cuaggauaggaacugggccuug

SEQ ID NO: 438162 - RNA, 21 nt, Homo sapiens
cuaggauuuucucauccucau

SEQ ID NO: 438163 - RNA, 14 nt, Homo sapiens
cuaggcacaugugg

SEQ ID NO: 438164 - RNA, 18 nt, Homo sapiens
cuaggcuccgucaguauc

SEQ ID NO: 438165 - RNA, 22 nt, Homo sapiens
cuaggcugggugcccacagccc

SEQ ID NO: 438166 - RNA, 19 nt, Homo sapiens
cuagggauucaggcugcuu

SEQ ID NO: 438167 - RNA, 18 nt, Homo sapiens
cuaggggucaggcuccau

SEQ ID NO: 438168 - RNA, 16 nt, Homo sapiens
cuagguagugaccuaa

SEQ ID NO: 438169 - RNA, 13 nt, Homo sapiens
cuagguaucauuc

SEQ ID NO: 438170 - RNA, 18 nt, Homo sapiens
cuaggugcccagucuuga

SEQ ID NO: 438171 - RNA, 23 nt, Homo sapiens
cuaggugggucaacuccaaggca

SEQ ID NO: 438172 - RNA, 19 nt, Homo sapiens
cuagguuuaacucagauca

SEQ ID NO: 438173 - RNA, 16 nt, Homo sapiens
cuagguuucaccuccc

SEQ ID NO: 438174 - RNA, 22 nt, Homo sapiens
cuaguacuauugcuauuacuag

SEQ ID NO: 438175 - RNA, 12 nt, Homo sapiens
cuaguagcuuuc

SEQ ID NO: 438176 - RNA, 22 nt, Homo sapiens
cuaguagcuuuccucccaaagg

SEQ ID NO: 438177 - RNA, 23 nt, Homo sapiens
cuaguagcuuuccucccaaaggc

SEQ ID NO: 438178 - RNA, 22 nt, Homo sapiens
cuaguaggucugcacacauaac

SEQ ID NO: 438179 - RNA, 23 nt, Homo sapiens
cuaguaggucugcacacauaaca

SEQ ID NO: 438180 - RNA, 15 nt, Homo sapiens
cuagucagauggaug

SEQ ID NO: 438181 - RNA, 12 nt, Homo sapiens
cuagucuuucac

SEQ ID NO: 438182 - RNA, 12 nt, Homo sapiens
cuagugcuggua

SEQ ID NO: 438183 - RNA, 22 nt, Homo sapiens
cuagugugaguggcagccaugc

SEQ ID NO: 438184 - RNA, 18 nt, Homo sapiens
cuaguuaggccacgcucc

SEQ ID NO: 438185 - RNA, 19 nt, Homo sapiens
cuaguucccucagugugaa

SEQ ID NO: 438186 - RNA, 12 nt, Homo sapiens
cuaguucuuaag

SEQ ID NO: 438187 - RNA, 17 nt, Homo sapiens
cuaguucuucaucccac

SEQ ID NO: 438188 - RNA, 21 nt, Homo sapiens
cuaguuugcuuugcugaccaa

SEQ ID NO: 438189 - RNA, 17 nt, Homo sapiens
cuauaaacauaugcaaa

SEQ ID NO: 438190 - RNA, 18 nt, Homo sapiens
cuauaaacauaugcaaac

SEQ ID NO: 438191 - RNA, 14 nt, Homo sapiens
cuauaaauggacuu

SEQ ID NO: 438192 - RNA, 17 nt, Homo sapiens
cuauaacaugucuuuca

SEQ ID NO: 438193 - RNA, 18 nt, Homo sapiens
cuauaacaugucuuucag

SEQ ID NO: 438194 - RNA, 16 nt, Homo sapiens
cuauaagcccacuguu

SEQ ID NO: 438195 - RNA, 18 nt, Homo sapiens
cuauaauucuauacuguu

SEQ ID NO: 438196 - RNA, 17 nt, Homo sapiens
cuauaauuuuaaaguau

SEQ ID NO: 438197 - RNA, 20 nt, Homo sapiens
cuauacauagagcucuauuu

SEQ ID NO: 438198 - RNA, 14 nt, Homo sapiens
cuauacaugaauca

SEQ ID NO: 438199 - RNA, 14 nt, Homo sapiens
cuauaccaacaucu

SEQ ID NO: 438200 - RNA, 15 nt, Homo sapiens
cuauaccaacaucug

SEQ ID NO: 438201 - RNA, 14 nt, Homo sapiens
cuauacuacauuau

SEQ ID NO: 438202 - RNA, 18 nt, Homo sapiens
cuauacugguuauaguug

SEQ ID NO: 438203 - RNA, 19 nt, Homo sapiens
cuauagaaaacgauuuuga

SEQ ID NO: 438204 - RNA, 14 nt, Homo sapiens
cuauagcagucauc

SEQ ID NO: 438205 - RNA, 19 nt, Homo sapiens
cuauauaauaaagcuacug

SEQ ID NO: 438206 - RNA, 23 nt, Homo sapiens
cuauauguuauggcuuauugugu

SEQ ID NO: 438207 - RNA, 20 nt, Homo sapiens
acgcucccccgcagucccca

SEQ ID NO: 438208 - RNA, 14 nt, Homo sapiens
acggaaaaugccaa

SEQ ID NO: 438209 - RNA, 14 nt, Homo sapiens
acggcccugcaaug

SEQ ID NO: 438210 - RNA, 16 nt, Homo sapiens
acggccgucccugacu

SEQ ID NO: 438211 - RNA, 14 nt, Homo sapiens
acggcucuuagcac

SEQ ID NO: 438212 - RNA, 22 nt, Homo sapiens
acggcuguguauuucuguagaa

SEQ ID NO: 438213 - RNA, 14 nt, Homo sapiens
acgggaagcaagau

SEQ ID NO: 438214 - RNA, 14 nt, Homo sapiens
acgguggccagaga

SEQ ID NO: 438215 - RNA, 20 nt, Homo sapiens
acgguggcucacgccuguaa

SEQ ID NO: 438216 - RNA, 14 nt, Homo sapiens
acggugggcauuug

SEQ ID NO: 438217 - RNA, 15 nt, Homo sapiens
acgguguccaugccu

SEQ ID NO: 438218 - RNA, 21 nt, Homo sapiens
acguacaaaauccagcuauga

SEQ ID NO: 438219 - RNA, 13 nt, Homo sapiens
acguacugguuua

SEQ ID NO: 438220 - RNA, 15 nt, Homo sapiens
acguagcugcaaagg

SEQ ID NO: 438221 - RNA, 15 nt, Homo sapiens
acguaugaaugauau

SEQ ID NO: 438222 - RNA, 18 nt, Homo sapiens
acguccagcucguucucu

SEQ ID NO: 438223 - RNA, 14 nt, Homo sapiens
acguccauguucua

SEQ ID NO: 438224 - RNA, 16 nt, Homo sapiens
acguccuccaccggug

SEQ ID NO: 438225 - RNA, 12 nt, Homo sapiens
acgucugugagu

SEQ ID NO: 438226 - RNA, 17 nt, Homo sapiens
acguggacucugugcuc

SEQ ID NO: 438227 - RNA, 16 nt, Homo sapiens
acguggagagggauga

SEQ ID NO: 438228 - RNA, 14 nt, Homo sapiens
acguguuuaauuaa

SEQ ID NO: 438229 - RNA, 14 nt, Homo sapiens
acguuaacagcgug

SEQ ID NO: 438230 - RNA, 15 nt, Homo sapiens
acguuaagugaugaa

SEQ ID NO: 438231 - RNA, 18 nt, Homo sapiens
acguucuggacugucuuc

SEQ ID NO: 438232 - RNA, 17 nt, Homo sapiens
acuaaacagacuauuua

SEQ ID NO: 438233 - RNA, 14 nt, Homo sapiens
acuaaacauuuugu

SEQ ID NO: 438234 - RNA, 22 nt, Homo sapiens
acuaaauacuguaacacuguau

SEQ ID NO: 438235 - RNA, 23 nt, Homo sapiens
acuaagaagugguguuccaugac

SEQ ID NO: 438236 - RNA, 19 nt, Homo sapiens
acuaagaugaaauugccaa

SEQ ID NO: 438237 - RNA, 15 nt, Homo sapiens
acuaagauguauuaa

SEQ ID NO: 438238 - RNA, 12 nt, Homo sapiens
acuaagcucuuu

SEQ ID NO: 438239 - RNA, 16 nt, Homo sapiens
acuaaugauguuuucc

SEQ ID NO: 438240 - RNA, 20 nt, Homo sapiens
acuaauuuuuagauauucau

SEQ ID NO: 438241 - RNA, 14 nt, Homo sapiens
acuacagaauuuca

SEQ ID NO: 438242 - RNA, 20 nt, Homo sapiens
acuacaugcaaggcacugua

SEQ ID NO: 438243 - RNA, 22 nt, Homo sapiens
acuaccacuuauuucuaaaucc

SEQ ID NO: 438244 - RNA, 20 nt, Homo sapiens
acuaccuaacauuauuuauu

SEQ ID NO: 438245 - RNA, 22 nt, Homo sapiens
acuacuccucugcagugccuug

SEQ ID NO: 438246 - RNA, 21 nt, Homo sapiens
acuacugacauguggggccag

SEQ ID NO: 438247 - RNA, 19 nt, Homo sapiens
acuacuguagaacugcaau

SEQ ID NO: 438248 - RNA, 22 nt, Homo sapiens
acuagaaccuucuaauccaugu

SEQ ID NO: 438249 - RNA, 14 nt, Homo sapiens
acuagaagcacagg

SEQ ID NO: 438250 - RNA, 18 nt, Homo sapiens
acuagaccuguaacuuuu

SEQ ID NO: 438251 - RNA, 23 nt, Homo sapiens
acuagagacgcaccuugcugcag

SEQ ID NO: 438252 - RNA, 19 nt, Homo sapiens
acuagagucugaacagcug

SEQ ID NO: 438253 - RNA, 12 nt, Homo sapiens
acuagaucuccc

SEQ ID NO: 438254 - RNA, 18 nt, Homo sapiens
acuagcccucuuucucuc

SEQ ID NO: 438255 - RNA, 17 nt, Homo sapiens
acuaggcauuuguaaau

SEQ ID NO: 438256 - RNA, 17 nt, Homo sapiens
acuagguuucaccuccc

SEQ ID NO: 438257 - RNA, 19 nt, Homo sapiens
acuagguuucaccucccaa

SEQ ID NO: 438258 - RNA, 13 nt, Homo sapiens
acuaguacuauua

SEQ ID NO: 438259 - RNA, 19 nt, Homo sapiens
acuaguauuguccauauca

SEQ ID NO: 438260 - RNA, 19 nt, Homo sapiens
acuagugacacauuguaca

SEQ ID NO: 438261 - RNA, 21 nt, Homo sapiens
acuaguucagacacuuuggaa

SEQ ID NO: 438262 - RNA, 22 nt, Homo sapiens
acuaguuugcuuugcugaccaa

SEQ ID NO: 438263 - RNA, 21 nt, Homo sapiens
acuauaagcagaagcacauau

SEQ ID NO: 438264 - RNA, 17 nt, Homo sapiens
acuauaagcccacuguu

SEQ ID NO: 438265 - RNA, 18 nt, Homo sapiens
acuauagccauuugcccc

SEQ ID NO: 438266 - RNA, 23 nt, Homo sapiens
acuauauaaaguacuacuguaga

SEQ ID NO: 438267 - RNA, 19 nt, Homo sapiens
acuauaucuguuuuacugc

SEQ ID NO: 438268 - RNA, 22 nt, Homo sapiens
acuauauugcuguaugguauau

SEQ ID NO: 438269 - RNA, 21 nt, Homo sapiens
acuauccaaaagagacaggga

SEQ ID NO: 438270 - RNA, 19 nt, Homo sapiens
acuaucgguucaaguugau

SEQ ID NO: 438271 - RNA, 17 nt, Homo sapiens
acuaucuacucuccuca

SEQ ID NO: 438272 - RNA, 23 nt, Homo sapiens
acuaugaaaucgcugcucaaaaa

SEQ ID NO: 438273 - RNA, 15 nt, Homo sapiens
acuauuaagcaguaa

SEQ ID NO: 438274 - RNA, 16 nt, Homo sapiens
acuauucagaggaaaa

SEQ ID NO: 438275 - RNA, 20 nt, Homo sapiens
acuauucccacuuucauuca

SEQ ID NO: 438276 - RNA, 20 nt, Homo sapiens
acuauugcuaguacuaguac

SEQ ID NO: 438277 - RNA, 18 nt, Homo sapiens
acuauuuagauauaacac

SEQ ID NO: 438278 - RNA, 21 nt, Homo sapiens
acuauuuucauucucuuguua

SEQ ID NO: 438279 - RNA, 10 nt, Homo sapiens
acucaaacau

SEQ ID NO: 438280 - RNA, 17 nt, Homo sapiens
acucaaaggacugaccu

SEQ ID NO: 438281 - RNA, 23 nt, Homo sapiens
acucaacauguuacugaccagca

SEQ ID NO: 438282 - RNA, 15 nt, Homo sapiens
acucacagucucuuu

SEQ ID NO: 438283 - RNA, 15 nt, Homo sapiens
acucacauugccuug

SEQ ID NO: 438284 - RNA, 21 nt, Homo sapiens
acucaccgcucacccuccuga

SEQ ID NO: 438285 - RNA, 21 nt, Homo sapiens
acucacuccagcccaacagaa

SEQ ID NO: 438286 - RNA, 17 nt, Homo sapiens
acucacugugcuccuaa

SEQ ID NO: 438287 - RNA, 19 nt, Homo sapiens
acucagaucacuacugcag

SEQ ID NO: 438288 - RNA, 23 nt, Homo sapiens
acucagcaacuguuagcugggaa

SEQ ID NO: 438289 - RNA, 16 nt, Homo sapiens
acucagcaguugacau

SEQ ID NO: 438290 - RNA, 13 nt, Homo sapiens
acucagcugagaa

SEQ ID NO: 438291 - RNA, 14 nt, Homo sapiens
acucagggaucuca

SEQ ID NO: 438292 - RNA, 23 nt, Homo sapiens
acucagggaucucagaccuagug

SEQ ID NO: 438293 - RNA, 22 nt, Homo sapiens
acucaguuugucagacuuuaaa

SEQ ID NO: 438294 - RNA, 17 nt, Homo sapiens
acucaucuuagugccug

SEQ ID NO: 438295 - RNA, 16 nt, Homo sapiens
acucaugugauuuacc

SEQ ID NO: 438296 - RNA, 21 nt, Homo sapiens
acuccagauuuuuuacagcug

SEQ ID NO: 438297 - RNA, 21 nt, Homo sapiens
acuccaguuugcccaccacaa

SEQ ID NO: 438298 - RNA, 13 nt, Homo sapiens
acuccauucucag

SEQ ID NO: 438299 - RNA, 12 nt, Homo sapiens
acucccaaagag

SEQ ID NO: 438300 - RNA, 20 nt, Homo sapiens
acucccuccucaccucugga

SEQ ID NO: 438301 - RNA, 13 nt, Homo sapiens
acucccugccaac

SEQ ID NO: 438302 - RNA, 16 nt, Homo sapiens
acuccuccaaggcaca

SEQ ID NO: 438303 - RNA, 16 nt, Homo sapiens
acuccugccaguugaa

SEQ ID NO: 438304 - RNA, 12 nt, Homo sapiens
acuccuguuacu

SEQ ID NO: 438305 - RNA, 22 nt, Homo sapiens
acuccuuaauaugaucugugga

SEQ ID NO: 438306 - RNA, 11 nt, Homo sapiens
acuccuuccau

SEQ ID NO: 438307 - RNA, 20 nt, Homo sapiens
acuccuuccugccaccugcu

SEQ ID NO: 438308 - RNA, 15 nt, Homo sapiens
acuccuucuccccaa

SEQ ID NO: 438309 - RNA, 16 nt, Homo sapiens
acuccuuggccuagcc

SEQ ID NO: 438310 - RNA, 19 nt, Homo sapiens
acuccuuucuugcacuauu

SEQ ID NO: 438311 - RNA, 14 nt, Homo sapiens
acuccuuugcagaa

SEQ ID NO: 438312 - RNA, 19 nt, Homo sapiens
acucgagaccauccuggcc

SEQ ID NO: 438313 - RNA, 20 nt, Homo sapiens
acucgcaauccgagccagcu

SEQ ID NO: 438314 - RNA, 13 nt, Homo sapiens
acucgcacugcaa

SEQ ID NO: 438315 - RNA, 18 nt, Homo sapiens
acucggucugagaagauu

SEQ ID NO: 438316 - RNA, 13 nt, Homo sapiens
acucgucugaugu

SEQ ID NO: 438317 - RNA, 18 nt, Homo sapiens
acucgugugcaugagaau

SEQ ID NO: 438318 - RNA, 23 nt, Homo sapiens
acucgugugcaugagaaugucau

SEQ ID NO: 438319 - RNA, 23 nt, Homo sapiens
acucuauaaauaaaaccugacag

SEQ ID NO: 438320 - RNA, 22 nt, Homo sapiens
acucuauggguaucaaacagcu

SEQ ID NO: 438321 - RNA, 20 nt, Homo sapiens
acucuauuaaaucuugcaac

SEQ ID NO: 438322 - RNA, 17 nt, Homo sapiens
acucucaccauuuggau

SEQ ID NO: 438323 - RNA, 20 nt, Homo sapiens
acucuccaauguucuauuaa

SEQ ID NO: 438324 - RNA, 12 nt, Homo sapiens
acucucuacugg

SEQ ID NO: 438325 - RNA, 13 nt, Homo sapiens
acucucugcucua

SEQ ID NO: 438326 - RNA, 20 nt, Homo sapiens
acucucugucuucucuccac

SEQ ID NO: 438327 - RNA, 17 nt, Homo sapiens
acucugaauccucauga

SEQ ID NO: 438328 - RNA, 15 nt, Homo sapiens
acucugaauuuccag

SEQ ID NO: 438329 - RNA, 18 nt, Homo sapiens
acucugacauaaacccau

SEQ ID NO: 438330 - RNA, 14 nt, Homo sapiens
acucugcacuccau

SEQ ID NO: 438331 - RNA, 22 nt, Homo sapiens
acucugcccagaccacacguag

SEQ ID NO: 438332 - RNA, 17 nt, Homo sapiens
acucugcuucaguccac

SEQ ID NO: 438333 - RNA, 20 nt, Homo sapiens
acucuggaccucucuuguga

SEQ ID NO: 438334 - RNA, 15 nt, Homo sapiens
acucugucucaaaaa

SEQ ID NO: 438335 - RNA, 12 nt, Homo sapiens
acucugugcuca

SEQ ID NO: 438336 - RNA, 22 nt, Homo sapiens
acucugugugagcguguccaca

SEQ ID NO: 438337 - RNA, 15 nt, Homo sapiens
acucuguuccuggcu

SEQ ID NO: 438338 - RNA, 14 nt, Homo sapiens
acucuuaucuacau

SEQ ID NO: 438339 - RNA, 14 nt, Homo sapiens
acucuuaugaaaug

SEQ ID NO: 438340 - RNA, 14 nt, Homo sapiens
acucuucaaggcca

SEQ ID NO: 438341 - RNA, 18 nt, Homo sapiens
acucuucaugagcacuuu

SEQ ID NO: 438342 - RNA, 21 nt, Homo sapiens
acucuucccccucucccaguu

SEQ ID NO: 438343 - RNA, 14 nt, Homo sapiens
acucuuccuggaau

SEQ ID NO: 438344 - RNA, 19 nt, Homo sapiens
acucuuccuggaaugcauu

SEQ ID NO: 438345 - RNA, 10 nt, Homo sapiens
acucuugacu

SEQ ID NO: 438346 - RNA, 10 nt, Homo sapiens
acucuugagc

SEQ ID NO: 438347 - RNA, 18 nt, Homo sapiens
acucuuguugaguucugu

SEQ ID NO: 438348 - RNA, 19 nt, Homo sapiens
acucuuuggaacaacagcu

SEQ ID NO: 438349 - RNA, 17 nt, Homo sapiens
acugaaaaccagucuuc

SEQ ID NO: 438350 - RNA, 13 nt, Homo sapiens
acugaaaaugcau

SEQ ID NO: 438351 - RNA, 19 nt, Homo sapiens
acugaacgacaaagcaugg

SEQ ID NO: 438352 - RNA, 13 nt, Homo sapiens
acugaagaccucc

SEQ ID NO: 438353 - RNA, 20 nt, Homo sapiens
acugaagcaaauaccaaagc

SEQ ID NO: 438354 - RNA, 19 nt, Homo sapiens
acugaagcgaacaucuuca

SEQ ID NO: 438355 - RNA, 16 nt, Homo sapiens
acugaaggugauggag

SEQ ID NO: 438356 - RNA, 16 nt, Homo sapiens
acugaaucuaccugcc

SEQ ID NO: 438357 - RNA, 20 nt, Homo sapiens
acugaauuuuuugucuguua

SEQ ID NO: 438358 - RNA, 22 nt, Homo sapiens
agaagaaaauccauucauucaa

SEQ ID NO: 438359 - RNA, 21 nt, Homo sapiens
agaagaaguuugaccaucacc

SEQ ID NO: 438360 - RNA, 21 nt, Homo sapiens
agaagaauauguauguuucua

SEQ ID NO: 438361 - RNA, 18 nt, Homo sapiens
agaagaccucccugugag

SEQ ID NO: 438362 - RNA, 12 nt, Homo sapiens
agaagacuguau

SEQ ID NO: 438363 - RNA, 13 nt, Homo sapiens
agaagaggcugcu

SEQ ID NO: 438364 - RNA, 18 nt, Homo sapiens
agaagauggcccagcucc

SEQ ID NO: 438365 - RNA, 20 nt, Homo sapiens
agaagcacccaggacuucca

SEQ ID NO: 438366 - RNA, 15 nt, Homo sapiens
agaagccaagacagu

SEQ ID NO: 438367 - RNA, 23 nt, Homo sapiens
agaagcccuucuaccuuccugca

SEQ ID NO: 438368 - RNA, 15 nt, Homo sapiens
agaagcugagacaca

SEQ ID NO: 438369 - RNA, 18 nt, Homo sapiens
agaagcuucuugcuccug

SEQ ID NO: 438370 - RNA, 20 nt, Homo sapiens
agaaggaaaugugggguaga

SEQ ID NO: 438371 - RNA, 19 nt, Homo sapiens
agaaggacagcucuucccc

SEQ ID NO: 438372 - RNA, 18 nt, Homo sapiens
agaaggcaaaguuuccau

SEQ ID NO: 438373 - RNA, 14 nt, Homo sapiens
agaaggccagcccu

SEQ ID NO: 438374 - RNA, 19 nt, Homo sapiens
agaaggccuugaagaauuu

SEQ ID NO: 438375 - RNA, 13 nt, Homo sapiens
agaagggggccau

SEQ ID NO: 438376 - RNA, 16 nt, Homo sapiens
agaagguugugaugaa

SEQ ID NO: 438377 - RNA, 19 nt, Homo sapiens
agaagguugugaugaagaa

SEQ ID NO: 438378 - RNA, 22 nt, Homo sapiens
agaaguauccaauuaugugaca

SEQ ID NO: 438379 - RNA, 17 nt, Homo sapiens
agaaguuaagcagccuu

SEQ ID NO: 438380 - RNA, 19 nt, Homo sapiens
agaaguuggucuuacuuug

SEQ ID NO: 438381 - RNA, 20 nt, Homo sapiens
agaaguuggucuuacuuugu

SEQ ID NO: 438382 - RNA, 18 nt, Homo sapiens
agaaguuugggcuaacau

SEQ ID NO: 438383 - RNA, 16 nt, Homo sapiens
agaauaaagcauuuca

SEQ ID NO: 438384 - RNA, 17 nt, Homo sapiens
agaauaaagcauuucac

SEQ ID NO: 438385 - RNA, 13 nt, Homo sapiens
agaauaacuucag

SEQ ID NO: 438386 - RNA, 12 nt, Homo sapiens
agaauaaugugu

SEQ ID NO: 438387 - RNA, 15 nt, Homo sapiens
agaauacaagccacu

SEQ ID NO: 438388 - RNA, 12 nt, Homo sapiens
agaauacuguau

SEQ ID NO: 438389 - RNA, 15 nt, Homo sapiens
agaauagggagacaa

SEQ ID NO: 438390 - RNA, 18 nt, Homo sapiens
agaauagggagacaaucu

SEQ ID NO: 438391 - RNA, 14 nt, Homo sapiens
agaauagugccuca

SEQ ID NO: 438392 - RNA, 16 nt, Homo sapiens
agaauagugccucagc

SEQ ID NO: 438393 - RNA, 19 nt, Homo sapiens
agcaaaauugauguguuua

SEQ ID NO: 438394 - RNA, 22 nt, Homo sapiens
agcaaagacuuaaucauaucaa

SEQ ID NO: 438395 - RNA, 22 nt, Homo sapiens
agcaaaguuuucagauuguaaa

SEQ ID NO: 438396 - RNA, 14 nt, Homo sapiens
agcaaaucuaugag

SEQ ID NO: 438397 - RNA, 12 nt, Homo sapiens
agcaaaugacaa

SEQ ID NO: 438398 - RNA, 20 nt, Homo sapiens
agcaaaugcuauuugauaac

SEQ ID NO: 438399 - RNA, 18 nt, Homo sapiens
agcaaauggcagaaccaa

SEQ ID NO: 438400 - RNA, 13 nt, Homo sapiens
agcaacaacaaca

SEQ ID NO: 438401 - RNA, 14 nt, Homo sapiens
agcaacaccaaaaa

SEQ ID NO: 438402 - RNA, 16 nt, Homo sapiens
agcaacagccagugga

SEQ ID NO: 438403 - RNA, 22 nt, Homo sapiens
agcaacaucuuuuuaaccugca

SEQ ID NO: 438404 - RNA, 15 nt, Homo sapiens
agcaacccauuaauc

SEQ ID NO: 438405 - RNA, 20 nt, Homo sapiens
agcaacccuacaguauauaa

SEQ ID NO: 438406 - RNA, 14 nt, Homo sapiens
agcaagaccuggag

SEQ ID NO: 438407 - RNA, 15 nt, Homo sapiens
agcaagcucacuugc

SEQ ID NO: 438408 - RNA, 21 nt, Homo sapiens
agcaaggcuggguaaugugaa

SEQ ID NO: 438409 - RNA, 18 nt, Homo sapiens
agcaaguguacaguauuu

SEQ ID NO: 438410 - RNA, 16 nt, Homo sapiens
agcaagugugcacucc

SEQ ID NO: 438411 - RNA, 19 nt, Homo sapiens
agcaaguuucaucagucaa

SEQ ID NO: 438412 - RNA, 17 nt, Homo sapiens
agcaauagggugcaguu

SEQ ID NO: 438413 - RNA, 22 nt, Homo sapiens
agcaauauaucugaagagcuau

SEQ ID NO: 438414 - RNA, 15 nt, Homo sapiens
agcaauggaguggcu

SEQ ID NO: 438415 - RNA, 16 nt, Homo sapiens
agcaauucuccugccu

SEQ ID NO: 438416 - RNA, 17 nt, Homo sapiens
agcacaaaagccucuca

SEQ ID NO: 438417 - RNA, 22 nt, Homo sapiens
agcacaaacuuuaggguaaaaa

SEQ ID NO: 438418 - RNA, 16 nt, Homo sapiens
agcacaagaaguggga

SEQ ID NO: 438419 - RNA, 13 nt, Homo sapiens
agcacagccucac

SEQ ID NO: 438420 - RNA, 23 nt, Homo sapiens
agcacaggcaacauuacaaacaa

SEQ ID NO: 438421 - RNA, 20 nt, Homo sapiens
agcacaucauggcaguggga

SEQ ID NO: 438422 - RNA, 18 nt, Homo sapiens
agcacaugcacuacugaa

SEQ ID NO: 438423 - RNA, 14 nt, Homo sapiens
agcaccagccugag

SEQ ID NO: 438424 - RNA, 15 nt, Homo sapiens
agcaccagguguuaa

SEQ ID NO: 438425 - RNA, 20 nt, Homo sapiens
agcaccuaaaugaugccuuu

SEQ ID NO: 438426 - RNA, 15 nt, Homo sapiens
agcacuagaucuccc

SEQ ID NO: 438427 - RNA, 23 nt, Homo sapiens
agcacuccugauuuuuaucuaga

SEQ ID NO: 438428 - RNA, 16 nt, Homo sapiens
agcacucgagaccauc

SEQ ID NO: 438429 - RNA, 15 nt, Homo sapiens
agcacugaaauaucc

SEQ ID NO: 438430 - RNA, 20 nt, Homo sapiens
agcacugccauuagacugaa

SEQ ID NO: 438431 - RNA, 18 nt, Homo sapiens
agcacugucccuugccuc

SEQ ID NO: 438432 - RNA, 13 nt, Homo sapiens
agcacuugaaaau

SEQ ID NO: 438433 - RNA, 19 nt, Homo sapiens
agcacuuuagaucacuuga

SEQ ID NO: 438434 - RNA, 19 nt, Homo sapiens
agcagaaacccccaggagg

SEQ ID NO: 438435 - RNA, 12 nt, Homo sapiens
agcagaacccag

SEQ ID NO: 438436 - RNA, 15 nt, Homo sapiens
agccucugugcugca

SEQ ID NO: 438437 - RNA, 17 nt, Homo sapiens
agccugagcagagacau

SEQ ID NO: 438438 - RNA, 21 nt, Homo sapiens
agccugagcagagacaugacu

SEQ ID NO: 438439 - RNA, 15 nt, Homo sapiens
agccugagucagggc

SEQ ID NO: 438440 - RNA, 18 nt, Homo sapiens
agccugcaaacucacugc

SEQ ID NO: 438441 - RNA, 23 nt, Homo sapiens
agccugcggcugcuggcacagac

SEQ ID NO: 438442 - RNA, 14 nt, Homo sapiens
agccugcugcaugg

SEQ ID NO: 438443 - RNA, 15 nt, Homo sapiens
agccugcuucuuccc

SEQ ID NO: 438444 - RNA, 20 nt, Homo sapiens
agccuggagccccuguguug

SEQ ID NO: 438445 - RNA, 23 nt, Homo sapiens
agccuggcaccuuuaugucaaca

SEQ ID NO: 438446 - RNA, 15 nt, Homo sapiens
agccuggugcugcug

SEQ ID NO: 438447 - RNA, 16 nt, Homo sapiens
agccuggugcugcugc

SEQ ID NO: 438448 - RNA, 22 nt, Homo sapiens
agccugguuuuuaaguacucac

SEQ ID NO: 438449 - RNA, 22 nt, Homo sapiens
agccugucagccaacauugccu

SEQ ID NO: 438450 - RNA, 20 nt, Homo sapiens
agccugugaauaaaaacccu

SEQ ID NO: 438451 - RNA, 21 nt, Homo sapiens
agccugugguuacagugcaga

SEQ ID NO: 438452 - RNA, 15 nt, Homo sapiens
agccuguugcugaag

SEQ ID NO: 438453 - RNA, 20 nt, Homo sapiens
agccuuagcauccccuguga

SEQ ID NO: 438454 - RNA, 17 nt, Homo sapiens
agccuucugaugucucu

SEQ ID NO: 438455 - RNA, 21 nt, Homo sapiens
agccuuucuguaucaagcccc

SEQ ID NO: 438456 - RNA, 12 nt, Homo sapiens
agccuuugcacu

SEQ ID NO: 438457 - RNA, 19 nt, Homo sapiens
agccuuuuauuaacauaua

SEQ ID NO: 438458 - RNA, 18 nt, Homo sapiens
agcgaauucccugagaua

SEQ ID NO: 438459 - RNA, 17 nt, Homo sapiens
agcgaggcgaggcugcc

SEQ ID NO: 438460 - RNA, 14 nt, Homo sapiens
agcgaguaccccag

SEQ ID NO: 438461 - RNA, 22 nt, Homo sapiens
agcggcugucacacccaugagc

SEQ ID NO: 438462 - RNA, 17 nt, Homo sapiens
agcgggucuaguggaaa

SEQ ID NO: 438463 - RNA, 13 nt, Homo sapiens
agcgguaccccag

SEQ ID NO: 438464 - RNA, 15 nt, Homo sapiens
agcguagcuaaguga

SEQ ID NO: 438465 - RNA, 15 nt, Homo sapiens
agcuaaagaggcuga

SEQ ID NO: 438466 - RNA, 15 nt, Homo sapiens
agcuaaauggcaaca

SEQ ID NO: 438467 - RNA, 19 nt, Homo sapiens
agcuaaauggcaacaaaca

SEQ ID NO: 438468 - RNA, 22 nt, Homo sapiens
agcuaaauuuucugaaacugca

SEQ ID NO: 438469 - RNA, 16 nt, Homo sapiens
agcuaagccugaugau

SEQ ID NO: 438470 - RNA, 20 nt, Homo sapiens
agcuaaggaggccguucagc

SEQ ID NO: 438471 - RNA, 19 nt, Homo sapiens
agcuaauguaggacuguau

SEQ ID NO: 438472 - RNA, 22 nt, Homo sapiens
agcuaauguuuaaaagcaaaac

SEQ ID NO: 438473 - RNA, 18 nt, Homo sapiens
agcuacauuccucagcug

SEQ ID NO: 438474 - RNA, 14 nt, Homo sapiens
agcuaccagguguu

SEQ ID NO: 438475 - RNA, 16 nt, Homo sapiens
agcuaccucaaacuuc

SEQ ID NO: 438476 - RNA, 20 nt, Homo sapiens
agcuacucaggagguugagg

SEQ ID NO: 438477 - RNA, 17 nt, Homo sapiens
agcuacucucuugccag

SEQ ID NO: 438478 - RNA, 16 nt, Homo sapiens
agcuagaaaguggcag

SEQ ID NO: 438479 - RNA, 14 nt, Homo sapiens
agcuagccagcugu

SEQ ID NO: 438480 - RNA, 15 nt, Homo sapiens
agcuagugagcaaaa

SEQ ID NO: 438481 - RNA, 15 nt, Homo sapiens
agcuauaacauuugc

SEQ ID NO: 438482 - RNA, 16 nt, Homo sapiens
agcuauacucaugguc

SEQ ID NO: 438483 - RNA, 14 nt, Homo sapiens
agcuauauccaugu

SEQ ID NO: 438484 - RNA, 19 nt, Homo sapiens
agcuauauuauacaaauac

SEQ ID NO: 438485 - RNA, 14 nt, Homo sapiens
agcuauuaagauac

SEQ ID NO: 438486 - RNA, 15 nt, Homo sapiens
agcuauuucucauca

SEQ ID NO: 438487 - RNA, 13 nt, Homo sapiens
agcucaaacuggc

SEQ ID NO: 438488 - RNA, 20 nt, Homo sapiens
agcucagcaacaaggcugca

SEQ ID NO: 438489 - RNA, 15 nt, Homo sapiens
agcucagcccacccc

SEQ ID NO: 438490 - RNA, 17 nt, Homo sapiens
agcucaggggcagcuca

SEQ ID NO: 438491 - RNA, 19 nt, Homo sapiens
agcucaguauacuaaugcc

SEQ ID NO: 438492 - RNA, 21 nt, Homo sapiens
agcucaguauacuaaugcccu

SEQ ID NO: 438493 - RNA, 12 nt, Homo sapiens
agcucaguuuau

SEQ ID NO: 438494 - RNA, 14 nt, Homo sapiens
agcuccaguggaag

SEQ ID NO: 438495 - RNA, 18 nt, Homo sapiens
agcuccucuccuugggcu

SEQ ID NO: 438496 - RNA, 12 nt, Homo sapiens
agcuccuuccac

SEQ ID NO: 438497 - RNA, 21 nt, Homo sapiens
agcuccuuggagcaggcaaaa

SEQ ID NO: 438498 - RNA, 23 nt, Homo sapiens
agcucguucucugggccuucuca

SEQ ID NO: 438499 - RNA, 21 nt, Homo sapiens
agcucuaauagagucacagcu

SEQ ID NO: 438500 - RNA, 23 nt, Homo sapiens
agcucucggaacugcaugcugcu

SEQ ID NO: 438501 - RNA, 22 nt, Homo sapiens
agcucucugagccagucccuca

SEQ ID NO: 438502 - RNA, 19 nt, Homo sapiens
agcucugacccugaugcuu

SEQ ID NO: 438503 - RNA, 23 nt, Homo sapiens
agcucugcagcacucuuaucuac

SEQ ID NO: 438504 - RNA, 12 nt, Homo sapiens
agcucuggccac

SEQ ID NO: 438505 - RNA, 14 nt, Homo sapiens
agcucuguuuucau

SEQ ID NO: 438506 - RNA, 17 nt, Homo sapiens
agcucuucaggccuccc

SEQ ID NO: 438507 - RNA, 16 nt, Homo sapiens
agcugaaagauugauu

SEQ ID NO: 438508 - RNA, 18 nt, Homo sapiens
agcugaaccuguucaaaa

SEQ ID NO: 438509 - RNA, 14 nt, Homo sapiens
agcugacaucucag

SEQ ID NO: 438510 - RNA, 15 nt, Homo sapiens
agcugacaucuugca

SEQ ID NO: 438511 - RNA, 20 nt, Homo sapiens
agcugacccccugcugccau

SEQ ID NO: 438512 - RNA, 21 nt, Homo sapiens
agcugagaucacgccacugca

SEQ ID NO: 438513 - RNA, 15 nt, Homo sapiens
agcugagauguggac

SEQ ID NO: 438514 - RNA, 15 nt, Homo sapiens
agcugagauuccugg

SEQ ID NO: 438515 - RNA, 15 nt, Homo sapiens
agcugaggacacacc

SEQ ID NO: 438516 - RNA, 17 nt, Homo sapiens
agcugaguucauggcuu

SEQ ID NO: 438517 - RNA, 10 nt, Homo sapiens
agcugccauu

SEQ ID NO: 438518 - RNA, 16 nt, Homo sapiens
agcugccucacuuccu

SEQ ID NO: 438519 - RNA, 13 nt, Homo sapiens
agcugcuguccag

SEQ ID NO: 438520 - RNA, 14 nt, Homo sapiens
agcugcugugaaca

SEQ ID NO: 438521 - RNA, 22 nt, Homo sapiens
agcuggaagggucaacaucuuu

SEQ ID NO: 438522 - RNA, 17 nt, Homo sapiens
agcuggaccaguggugc

SEQ ID NO: 438523 - RNA, 15 nt, Homo sapiens
agcuggagaucuuaa

SEQ ID NO: 438524 - RNA, 15 nt, Homo sapiens
agcuggagugcagug

SEQ ID NO: 438525 - RNA, 16 nt, Homo sapiens
agcuggagugcugcuu

SEQ ID NO: 438526 - RNA, 13 nt, Homo sapiens
agcuggauuuccu

SEQ ID NO: 438527 - RNA, 15 nt, Homo sapiens
agcuggcaggagggu

SEQ ID NO: 438528 - RNA, 15 nt, Homo sapiens
agcugggaguagcau

SEQ ID NO: 438529 - RNA, 17 nt, Homo sapiens
agucuggcaaacaugug

SEQ ID NO: 438530 - RNA, 15 nt, Homo sapiens
agucuggccugccag

SEQ ID NO: 438531 - RNA, 20 nt, Homo sapiens
agucuggcuaggggccgagu

SEQ ID NO: 438532 - RNA, 16 nt, Homo sapiens
agucugucuacugugg

SEQ ID NO: 438533 - RNA, 11 nt, Homo sapiens
agucuguucuc

SEQ ID NO: 438534 - RNA, 14 nt, Homo sapiens
agucuguucucaca

SEQ ID NO: 438535 - RNA, 23 nt, Homo sapiens
agucuuaacaacagcuucuugcu

SEQ ID NO: 438536 - RNA, 13 nt, Homo sapiens
agucuucacauuu

SEQ ID NO: 438537 - RNA, 20 nt, Homo sapiens
agucuucacuugcacugggg

SEQ ID NO: 438538 - RNA, 23 nt, Homo sapiens
agucuuccuccucagucuucuca

SEQ ID NO: 438539 - RNA, 19 nt, Homo sapiens
agucuucucauagcauuaa

SEQ ID NO: 438540 - RNA, 21 nt, Homo sapiens
agucuucucauagcauuaacu

SEQ ID NO: 438541 - RNA, 14 nt, Homo sapiens
agucuucuuagcau

SEQ ID NO: 438542 - RNA, 19 nt, Homo sapiens
agucuugcauugaauuuag

SEQ ID NO: 438543 - RNA, 20 nt, Homo sapiens
agucuuugagcgagcccauu

SEQ ID NO: 438544 - RNA, 22 nt, Homo sapiens
agucuuuguaaguaaacugccc

SEQ ID NO: 438545 - RNA, 18 nt, Homo sapiens
agugaaaggucaucucau

SEQ ID NO: 438546 - RNA, 23 nt, Homo sapiens
agugaacagguucuccaggugau

SEQ ID NO: 438547 - RNA, 21 nt, Homo sapiens
agugaacauauccaucauccc

SEQ ID NO: 438548 - RNA, 16 nt, Homo sapiens
agugaagacacuggcu

SEQ ID NO: 438549 - RNA, 18 nt, Homo sapiens
agugaauaguaacaauaa

SEQ ID NO: 438550 - RNA, 17 nt, Homo sapiens
agugacaagaugcucug

SEQ ID NO: 438551 - RNA, 15 nt, Homo sapiens
agugacacagcagcu

SEQ ID NO: 438552 - RNA, 21 nt, Homo sapiens
agugaccaggcucacaacugu

SEQ ID NO: 438553 - RNA, 21 nt, Homo sapiens
agugaccauaaaggcauggca

SEQ ID NO: 438554 - RNA, 20 nt, Homo sapiens
agugaccccugaccucacug

SEQ ID NO: 438555 - RNA, 16 nt, Homo sapiens
agugaccggcugcuuu

SEQ ID NO: 438556 - RNA, 17 nt, Homo sapiens
agugacugugcauuuga

SEQ ID NO: 438557 - RNA, 16 nt, Homo sapiens
agugacuuccugguga

SEQ ID NO: 438558 - RNA, 14 nt, Homo sapiens
agugagagcuuccu

SEQ ID NO: 438559 - RNA, 16 nt, Homo sapiens
agugauaacacuggag

SEQ ID NO: 438560 - RNA, 15 nt, Homo sapiens
agugauaggcccaag

SEQ ID NO: 438561 - RNA, 18 nt, Homo sapiens
agugauauuauaguauuc

SEQ ID NO: 438562 - RNA, 20 nt, Homo sapiens
agugauucucucuucucucc

SEQ ID NO: 438563 - RNA, 22 nt, Homo sapiens
agugauugauagaguguuauca

SEQ ID NO: 438564 - RNA, 23 nt, Homo sapiens
agugauugugucugcauuguuau

SEQ ID NO: 438565 - RNA, 17 nt, Homo sapiens
agugauuucauucugcc

SEQ ID NO: 438566 - RNA, 16 nt, Homo sapiens
agugcaacagcacugg

SEQ ID NO: 438567 - RNA, 17 nt, Homo sapiens
agugcaaugcacgaucu

SEQ ID NO: 438568 - RNA, 20 nt, Homo sapiens
agugcaaugcacgaucucag

SEQ ID NO: 438569 - RNA, 22 nt, Homo sapiens
agugcaauuucuucuguagcua

SEQ ID NO: 438570 - RNA, 19 nt, Homo sapiens
agugccacuugacauuccu

SEQ ID NO: 438571 - RNA, 20 nt, Homo sapiens
agugccacuugacauuccuu

SEQ ID NO: 438572 - RNA, 19 nt, Homo sapiens
agugccagguggcucagug

SEQ ID NO: 438573 - RNA, 19 nt, Homo sapiens
agugccucuggucugggug

SEQ ID NO: 438574 - RNA, 14 nt, Homo sapiens
agugccuggcaagg

SEQ ID NO: 438575 - RNA, 14 nt, Homo sapiens
agugccugggaaug

SEQ ID NO: 438576 - RNA, 14 nt, Homo sapiens
agugcuaguauuau

SEQ ID NO: 438577 - RNA, 14 nt, Homo sapiens
agugcugaccccag

SEQ ID NO: 438578 - RNA, 12 nt, Homo sapiens
agugcugagauu

SEQ ID NO: 438579 - RNA, 11 nt, Homo sapiens
agugcugccau

SEQ ID NO: 438580 - RNA, 22 nt, Homo sapiens
agugcuugccaccaccagauga

SEQ ID NO: 438581 - RNA, 14 nt, Homo sapiens
aguggaaagugauu

SEQ ID NO: 438582 - RNA, 21 nt, Homo sapiens
aguggaaggacacucuuggcu

SEQ ID NO: 438583 - RNA, 23 nt, Homo sapiens
aguggaaggucuauuggccaaca

SEQ ID NO: 438584 - RNA, 14 nt, Homo sapiens
aguggaauacuaaa

SEQ ID NO: 438585 - RNA, 17 nt, Homo sapiens
aguggaugcauuccuga

SEQ ID NO: 438586 - RNA, 20 nt, Homo sapiens
aguggauuuuccugaauauu

SEQ ID NO: 438587 - RNA, 19 nt, Homo sapiens
aguggcacgaucucagcuc

SEQ ID NO: 438588 - RNA, 14 nt, Homo sapiens
aguggcagccaugc

SEQ ID NO: 438589 - RNA, 16 nt, Homo sapiens
aguggcuucuuuugaa

SEQ ID NO: 438590 - RNA, 14 nt, Homo sapiens
agugggcaccucag

SEQ ID NO: 438591 - RNA, 21 nt, Homo sapiens
aguggggauuuguaagacuua

SEQ ID NO: 438592 - RNA, 15 nt, Homo sapiens
aguggggugaucuca

SEQ ID NO: 438593 - RNA, 19 nt, Homo sapiens
agugggugggacacagaga

SEQ ID NO: 438594 - RNA, 20 nt, Homo sapiens
aguggucaggcaucuucccu

SEQ ID NO: 438595 - RNA, 13 nt, Homo sapiens
aguggugccaaac

SEQ ID NO: 438596 - RNA, 14 nt, Homo sapiens
agugguuguugcca

SEQ ID NO: 438597 - RNA, 22 nt, Homo sapiens
agugguuuuucuuuucuuggac

SEQ ID NO: 438598 - RNA, 17 nt, Homo sapiens
aguguacuggauuuaac

SEQ ID NO: 438599 - RNA, 17 nt, Homo sapiens
aguguagaucaacucau

SEQ ID NO: 438600 - RNA, 16 nt, Homo sapiens
aguguagauguagcau

SEQ ID NO: 438601 - RNA, 18 nt, Homo sapiens
aguguagauguagcauug

SEQ ID NO: 438602 - RNA, 12 nt, Homo sapiens
agugucacuuac

SEQ ID NO: 438603 - RNA, 14 nt, Homo sapiens
agugucuaccuucc

SEQ ID NO: 438604 - RNA, 19 nt, Homo sapiens
agugucugugccauggauu

SEQ ID NO: 438605 - RNA, 23 nt, Homo sapiens
agugugaguggcagccaugccuc

SEQ ID NO: 438606 - RNA, 14 nt, Homo sapiens
agugugauugugaa

SEQ ID NO: 438607 - RNA, 22 nt, Homo sapiens
agugugcaaagaaaagaacugc

SEQ ID NO: 438608 - RNA, 11 nt, Homo sapiens
agugugcuugg

SEQ ID NO: 438609 - RNA, 15 nt, Homo sapiens
aguguguacuucuuc

SEQ ID NO: 438610 - RNA, 16 nt, Homo sapiens
aguguguccaagugug

SEQ ID NO: 438611 - RNA, 13 nt, Homo sapiens
agugugugucuuu

SEQ ID NO: 438612 - RNA, 23 nt, Homo sapiens
agugugugucuuuccucccugaa

SEQ ID NO: 438613 - RNA, 17 nt, Homo sapiens
aguguuaucagucauaa

SEQ ID NO: 438614 - RNA, 20 nt, Homo sapiens
aguuaaacuugaugccagug

SEQ ID NO: 438615 - RNA, 16 nt, Homo sapiens
aguuaaaguauauuau

SEQ ID NO: 438616 - RNA, 20 nt, Homo sapiens
aguuaagaaugucgauuaaa

SEQ ID NO: 438617 - RNA, 22 nt, Homo sapiens
aguuaagcagccuuucugugga

SEQ ID NO: 438618 - RNA, 14 nt, Homo sapiens
aguuaagugucauu

SEQ ID NO: 438619 - RNA, 18 nt, Homo sapiens
aguuacaaauucaaggag

SEQ ID NO: 438620 - RNA, 22 nt, Homo sapiens
aguuacugaaggugauggaggu

SEQ ID NO: 438621 - RNA, 12 nt, Homo sapiens
aguuacuugaau

SEQ ID NO: 438622 - RNA, 22 nt, Homo sapiens
aguuagaaaggguucagggcau

SEQ ID NO: 438623 - RNA, 18 nt, Homo sapiens
aguuaugcaagggacugu

SEQ ID NO: 438624 - RNA, 23 nt, Homo sapiens
aguucaaagaacccuagcacaaa

SEQ ID NO: 438625 - RNA, 20 nt, Homo sapiens
aguucaaucucccgcugcug

SEQ ID NO: 438626 - RNA, 22 nt, Homo sapiens
aguucacaaacaguaaaggcca

SEQ ID NO: 438627 - RNA, 17 nt, Homo sapiens
aguucaccagacucuau

SEQ ID NO: 438628 - RNA, 14 nt, Homo sapiens
aguucagcuccuuc

SEQ ID NO: 438629 - RNA, 16 nt, Homo sapiens
aguucauauguaccau

SEQ ID NO: 438630 - RNA, 17 nt, Homo sapiens
aguucauauguaccaug

SEQ ID NO: 438631 - RNA, 15 nt, Homo sapiens
aguucaucuugaauu

SEQ ID NO: 438632 - RNA, 22 nt, Homo sapiens
aguucaugggcaccucauggac

SEQ ID NO: 438633 - RNA, 13 nt, Homo sapiens
aguuccagcuuuu

SEQ ID NO: 438634 - RNA, 23 nt, Homo sapiens
aguuccugcuacaacuucagcag

SEQ ID NO: 438635 - RNA, 13 nt, Homo sapiens
aguucuaucagga

SEQ ID NO: 438636 - RNA, 21 nt, Homo sapiens
auaucugggauucuacuuuaa

SEQ ID NO: 438637 - RNA, 20 nt, Homo sapiens
auaucuguuuuacugcuuuu

SEQ ID NO: 438638 - RNA, 19 nt, Homo sapiens
auaucuuaaagaaacagcu

SEQ ID NO: 438639 - RNA, 15 nt, Homo sapiens
auaugaauucaagaa

SEQ ID NO: 438640 - RNA, 22 nt, Homo sapiens
auaugagcuuccuucugugaaa

SEQ ID NO: 438641 - RNA, 15 nt, Homo sapiens
auaugaguuacugaa

SEQ ID NO: 438642 - RNA, 14 nt, Homo sapiens
auaugauaaaacac

SEQ ID NO: 438643 - RNA, 20 nt, Homo sapiens
augcugcugggccucugccu

SEQ ID NO: 438644 - RNA, 22 nt, Homo sapiens
augcuguauauccuuucuaaca

SEQ ID NO: 438645 - RNA, 13 nt, Homo sapiens
augcugugcucaa

SEQ ID NO: 438646 - RNA, 14 nt, Homo sapiens
augcugugcucaau

SEQ ID NO: 438647 - RNA, 17 nt, Homo sapiens
augcuuaaucugaggau

SEQ ID NO: 438648 - RNA, 19 nt, Homo sapiens
augucugagaucagugccu

SEQ ID NO: 438649 - RNA, 17 nt, Homo sapiens
augucugcauggcagaa

SEQ ID NO: 438650 - RNA, 15 nt, Homo sapiens
augucuuacuacuuu

SEQ ID NO: 438651 - RNA, 22 nt, Homo sapiens
augucuuuguuaagacugcuga

SEQ ID NO: 438652 - RNA, 14 nt, Homo sapiens
augugauaucugaa

SEQ ID NO: 438653 - RNA, 19 nt, Homo sapiens
augugauuggcagcuucaa

SEQ ID NO: 438654 - RNA, 16 nt, Homo sapiens
augugauuuuucugca

SEQ ID NO: 438655 - RNA, 12 nt, Homo sapiens
augugcacugaa

SEQ ID NO: 438656 - RNA, 17 nt, Homo sapiens
augugcacuucacugga

SEQ ID NO: 438657 - RNA, 18 nt, Homo sapiens
caaguuucuagcuagaaa

SEQ ID NO: 438658 - RNA, 16 nt, Homo sapiens
caauaaaaaaaaaccu

SEQ ID NO: 438659 - RNA, 22 nt, Homo sapiens
caauaaaaucagugugcuugcc

SEQ ID NO: 438660 - RNA, 15 nt, Homo sapiens
caauaaaaugcacug

SEQ ID NO: 438661 - RNA, 19 nt, Homo sapiens
caauaaaaugcacugacca

SEQ ID NO: 438662 - RNA, 14 nt, Homo sapiens
caauaacacugucu

SEQ ID NO: 438663 - RNA, 16 nt, Homo sapiens
caauaacacugucucc

SEQ ID NO: 438664 - RNA, 17 nt, Homo sapiens
caauaacuucagagaag

SEQ ID NO: 438665 - RNA, 22 nt, Homo sapiens
caauaacuucagagaagucagu

SEQ ID NO: 438666 - RNA, 15 nt, Homo sapiens
caauaaguucauuaa

SEQ ID NO: 438667 - RNA, 21 nt, Homo sapiens
caauaauaaauauuuuugcca

SEQ ID NO: 438668 - RNA, 21 nt, Homo sapiens
caauaauagacuuauaugcag

SEQ ID NO: 438669 - RNA, 15 nt, Homo sapiens
caauaauuguggaga

SEQ ID NO: 438670 - RNA, 18 nt, Homo sapiens
caauacccuuggcacuga

SEQ ID NO: 438671 - RNA, 15 nt, Homo sapiens
caauagagacuguag

SEQ ID NO: 438672 - RNA, 23 nt, Homo sapiens
caauagcgugagcuaacugagag

SEQ ID NO: 438673 - RNA, 12 nt, Homo sapiens
caauaguauuaa

SEQ ID NO: 438674 - RNA, 22 nt, Homo sapiens
caauaugaggggacugcaugca

SEQ ID NO: 438675 - RNA, 15 nt, Homo sapiens
caauaugcuuuacac

SEQ ID NO: 438676 - RNA, 17 nt, Homo sapiens
caaucaaccugcacuuc

SEQ ID NO: 438677 - RNA, 17 nt, Homo sapiens
caaucagagagcucacu

SEQ ID NO: 438678 - RNA, 19 nt, Homo sapiens
caaucaguauguauucuuu

SEQ ID NO: 438679 - RNA, 19 nt, Homo sapiens
caauccuaugucauuucua

SEQ ID NO: 438680 - RNA, 13 nt, Homo sapiens
caaucuccaucac

SEQ ID NO: 438681 - RNA, 20 nt, Homo sapiens
caaucuuugccuuuaucucu

SEQ ID NO: 438682 - RNA, 15 nt, Homo sapiens
caaugaaaccuuccu

SEQ ID NO: 438683 - RNA, 14 nt, Homo sapiens
caaugaacugugcu

SEQ ID NO: 438684 - RNA, 18 nt, Homo sapiens
caaugaccacauccugaa

SEQ ID NO: 438685 - RNA, 19 nt, Homo sapiens
caaugaccacauccugaaa

SEQ ID NO: 438686 - RNA, 22 nt, Homo sapiens
caaugaccuguauuuugccaga

SEQ ID NO: 438687 - RNA, 13 nt, Homo sapiens
caaugaucuaggu

SEQ ID NO: 438688 - RNA, 21 nt, Homo sapiens
caaugaucuagguuuaacuca

SEQ ID NO: 438689 - RNA, 10 nt, Homo sapiens
caaugauuca

SEQ ID NO: 438690 - RNA, 16 nt, Homo sapiens
caaugauucauaacaa

SEQ ID NO: 438691 - RNA, 11 nt, Homo sapiens
caaugccagua

SEQ ID NO: 438692 - RNA, 23 nt, Homo sapiens
caaugccccuggaucuaccagca

SEQ ID NO: 438693 - RNA, 18 nt, Homo sapiens
caaugccugccugaacaa

SEQ ID NO: 438694 - RNA, 16 nt, Homo sapiens
caaugccuuguuguau

SEQ ID NO: 438695 - RNA, 20 nt, Homo sapiens
caaugcugacuggacugugu

SEQ ID NO: 438696 - RNA, 21 nt, Homo sapiens
caaugcuuugggaggccaagg

SEQ ID NO: 438697 - RNA, 16 nt, Homo sapiens
caauggagacugucuc

SEQ ID NO: 438698 - RNA, 19 nt, Homo sapiens
caauggcaccuucauucuc

SEQ ID NO: 438699 - RNA, 20 nt, Homo sapiens
caauggcaccuucauucucc

SEQ ID NO: 438700 - RNA, 21 nt, Homo sapiens
caauggcaccuucauucuccg

SEQ ID NO: 438701 - RNA, 14 nt, Homo sapiens
caaugguguagcug

SEQ ID NO: 438702 - RNA, 16 nt, Homo sapiens
caauguacuauaugua

SEQ ID NO: 438703 - RNA, 13 nt, Homo sapiens
caaugucacuuaa

SEQ ID NO: 438704 - RNA, 20 nt, Homo sapiens
caauguucaggagaguaaaa

SEQ ID NO: 438705 - RNA, 19 nt, Homo sapiens
caauguuuuaaacauucuu

SEQ ID NO: 438706 - RNA, 23 nt, Homo sapiens
caauuaauucuuaauaggcuuua

SEQ ID NO: 438707 - RNA, 18 nt, Homo sapiens
caauuauuacauuuauac

SEQ ID NO: 438708 - RNA, 17 nt, Homo sapiens
caauucauaauauguuc

SEQ ID NO: 438709 - RNA, 14 nt, Homo sapiens
caauuccgcauuua

SEQ ID NO: 438710 - RNA, 13 nt, Homo sapiens
caauuccucuggg

SEQ ID NO: 438711 - RNA, 15 nt, Homo sapiens
caauucuucuucuca

SEQ ID NO: 438712 - RNA, 12 nt, Homo sapiens
caauugucugcc

SEQ ID NO: 438713 - RNA, 21 nt, Homo sapiens
caauuuauccaaagcauugca

SEQ ID NO: 438714 - RNA, 16 nt, Homo sapiens
caauuucaaaaugcau

SEQ ID NO: 438715 - RNA, 18 nt, Homo sapiens
caauuucaaaaugcaugu

SEQ ID NO: 438716 - RNA, 21 nt, Homo sapiens
caauuucaaaaugcaugugau

SEQ ID NO: 438717 - RNA, 15 nt, Homo sapiens
caauuuuguugcauc

SEQ ID NO: 438718 - RNA, 17 nt, Homo sapiens
cacaaaagucucaaugu

SEQ ID NO: 438719 - RNA, 18 nt, Homo sapiens
cacaaaauacagcacuuu

SEQ ID NO: 438720 - RNA, 16 nt, Homo sapiens
cacaaaaucuguccaa

SEQ ID NO: 438721 - RNA, 12 nt, Homo sapiens
cacaaagccuua

SEQ ID NO: 438722 - RNA, 23 nt, Homo sapiens
cacaaaggguugggagcugauga

SEQ ID NO: 438723 - RNA, 14 nt, Homo sapiens
cacaaaugcagaca

SEQ ID NO: 438724 - RNA, 14 nt, Homo sapiens
cacaacacccagcc

SEQ ID NO: 438725 - RNA, 12 nt, Homo sapiens
cacaacacugaa

SEQ ID NO: 438726 - RNA, 14 nt, Homo sapiens
cacaacccaagaau

SEQ ID NO: 438727 - RNA, 14 nt, Homo sapiens
cacaacuccuucca

SEQ ID NO: 438728 - RNA, 15 nt, Homo sapiens
cacaagcguguuucu

SEQ ID NO: 438729 - RNA, 23 nt, Homo sapiens
cacaagguugcuggcauuugcug

SEQ ID NO: 438730 - RNA, 20 nt, Homo sapiens
cacaaucauuggaauuccuu

SEQ ID NO: 438731 - RNA, 23 nt, Homo sapiens
cacaauccuguggaucugggcaa

SEQ ID NO: 438732 - RNA, 21 nt, Homo sapiens
cacaauuaacuccguuuccaa

SEQ ID NO: 438733 - RNA, 14 nt, Homo sapiens
cacaauucuguccc

SEQ ID NO: 438734 - RNA, 13 nt, Homo sapiens
cacacaaaccagu

SEQ ID NO: 438735 - RNA, 18 nt, Homo sapiens
cacacaaaugcagacaca

SEQ ID NO: 438736 - RNA, 12 nt, Homo sapiens
cacacaacugug

SEQ ID NO: 438737 - RNA, 15 nt, Homo sapiens
cacacacaccacaca

SEQ ID NO: 438738 - RNA, 12 nt, Homo sapiens
cacacacagcca

SEQ ID NO: 438739 - RNA, 13 nt, Homo sapiens
cacacacauggaa

SEQ ID NO: 438740 - RNA, 15 nt, Homo sapiens
cacacaccacacaua

SEQ ID NO: 438741 - RNA, 13 nt, Homo sapiens
cacacacccagcu

SEQ ID NO: 438742 - RNA, 15 nt, Homo sapiens
cacacaccucucaag

SEQ ID NO: 438743 - RNA, 19 nt, Homo sapiens
cacacaccugccugcagag

SEQ ID NO: 438744 - RNA, 14 nt, Homo sapiens
cacacacgcagaca

SEQ ID NO: 438745 - RNA, 21 nt, Homo sapiens
cacacaggccuggcccagcca

SEQ ID NO: 438746 - RNA, 12 nt, Homo sapiens
cacacagugggc

SEQ ID NO: 438747 - RNA, 23 nt, Homo sapiens
cacacauacacacacacaagcuu

SEQ ID NO: 438748 - RNA, 20 nt, Homo sapiens
cacacaucaguaauguauuc

SEQ ID NO: 438749 - RNA, 22 nt, Homo sapiens
cacacauccacgcacaugcgac

SEQ ID NO: 438750 - RNA, 22 nt, Homo sapiens
cacacauccccuuuguguagaa

SEQ ID NO: 438751 - RNA, 20 nt, Homo sapiens
cacacccuggaggauuucau

SEQ ID NO: 438752 - RNA, 20 nt, Homo sapiens
cacacguuugauuucuuccu

SEQ ID NO: 438753 - RNA, 22 nt, Homo sapiens
cacacucgcccgcccacugucc

SEQ ID NO: 438754 - RNA, 12 nt, Homo sapiens
cacacucugugu

SEQ ID NO: 438755 - RNA, 18 nt, Homo sapiens
cacacugugcguuuuaga

SEQ ID NO: 438756 - RNA, 14 nt, Homo sapiens
cacacuuggaugca

SEQ ID NO: 438757 - RNA, 18 nt, Homo sapiens
cacacuugggagcaaaag

SEQ ID NO: 438758 - RNA, 18 nt, Homo sapiens
cacacuuucugacugcaa

SEQ ID NO: 438759 - RNA, 19 nt, Homo sapiens
cacacuuuugcacauauau

SEQ ID NO: 438760 - RNA, 14 nt, Homo sapiens
cacagaacucagcc

SEQ ID NO: 438761 - RNA, 22 nt, Homo sapiens
cacagacuuccaccaugugcau

SEQ ID NO: 438762 - RNA, 18 nt, Homo sapiens
cacagaggacagugcuga

SEQ ID NO: 438763 - RNA, 13 nt, Homo sapiens
cacagaggcagug

SEQ ID NO: 438764 - RNA, 20 nt, Homo sapiens
cacagaugggcaaggccuuu

SEQ ID NO: 438765 - RNA, 12 nt, Homo sapiens
auucagcugccc

SEQ ID NO: 438766 - RNA, 16 nt, Homo sapiens
auucaggauuacaugc

SEQ ID NO: 438767 - RNA, 21 nt, Homo sapiens
auucaggcaugcgaaugagcu

SEQ ID NO: 438768 - RNA, 16 nt, Homo sapiens
auucaguaaauuuugg

SEQ ID NO: 438769 - RNA, 13 nt, Homo sapiens
auucaguauuaaa

SEQ ID NO: 438770 - RNA, 23 nt, Homo sapiens
auucagugagggucuucuuacau

SEQ ID NO: 438771 - RNA, 22 nt, Homo sapiens
auucauaaaaauaaccaaaaaa

SEQ ID NO: 438772 - RNA, 16 nt, Homo sapiens
auucauaaugacuuaa

SEQ ID NO: 438773 - RNA, 13 nt, Homo sapiens
auucauaccuguu

SEQ ID NO: 438774 - RNA, 17 nt, Homo sapiens
auucauauuuacuucuu

SEQ ID NO: 438775 - RNA, 21 nt, Homo sapiens
auucaucuuuccuuugcucug

SEQ ID NO: 438776 - RNA, 22 nt, Homo sapiens
auucaugcugcuuagaugacau

SEQ ID NO: 438777 - RNA, 23 nt, Homo sapiens
auucauuaaagaaaaaccacaga

SEQ ID NO: 438778 - RNA, 22 nt, Homo sapiens
auuccaaucauuguuaaaguaa

SEQ ID NO: 438779 - RNA, 18 nt, Homo sapiens
auuccacacuaccacauu

SEQ ID NO: 438780 - RNA, 15 nt, Homo sapiens
auuccaccuagagcu

SEQ ID NO: 438781 - RNA, 19 nt, Homo sapiens
auuccaccuagagcuagau

SEQ ID NO: 438782 - RNA, 14 nt, Homo sapiens
auuccagaccaaaa

SEQ ID NO: 438783 - RNA, 15 nt, Homo sapiens
auuccaggagcugcg

SEQ ID NO: 438784 - RNA, 16 nt, Homo sapiens
auuccaggcgaugugc

SEQ ID NO: 438785 - RNA, 18 nt, Homo sapiens
auuccaucacagccagcc

SEQ ID NO: 438786 - RNA, 11 nt, Homo sapiens
auuccaucucc

SEQ ID NO: 438787 - RNA, 17 nt, Homo sapiens
auucccacuuucauuca

SEQ ID NO: 438788 - RNA, 18 nt, Homo sapiens
auucccguuuuacagaua

SEQ ID NO: 438789 - RNA, 16 nt, Homo sapiens
auuccgaaacauacaa

SEQ ID NO: 438790 - RNA, 21 nt, Homo sapiens
auuccguuaggaauaacacug

SEQ ID NO: 438791 - RNA, 15 nt, Homo sapiens
auuccuaaugcauua

SEQ ID NO: 438792 - RNA, 20 nt, Homo sapiens
auuccuaggcaacuauuaau

SEQ ID NO: 438793 - RNA, 17 nt, Homo sapiens
auuccucuguagaauuu

SEQ ID NO: 438794 - RNA, 15 nt, Homo sapiens
auuccuggcaugaca

SEQ ID NO: 438795 - RNA, 19 nt, Homo sapiens
auuccuguucccaugagau

SEQ ID NO: 438796 - RNA, 14 nt, Homo sapiens
auucuaaaacauuc

SEQ ID NO: 438797 - RNA, 13 nt, Homo sapiens
auucuaagugaaa

SEQ ID NO: 438798 - RNA, 21 nt, Homo sapiens
auucuacuuuaagcacuacau

SEQ ID NO: 438799 - RNA, 16 nt, Homo sapiens
auucuagucucugauu

SEQ ID NO: 438800 - RNA, 14 nt, Homo sapiens
auucuauaaauuca

SEQ ID NO: 438801 - RNA, 15 nt, Homo sapiens
auucuauacuguuga

SEQ ID NO: 438802 - RNA, 21 nt, Homo sapiens
auucuauuucaacuucaggaa

SEQ ID NO: 438803 - RNA, 16 nt, Homo sapiens
auucucaaagcaggaa

SEQ ID NO: 438804 - RNA, 14 nt, Homo sapiens
auucucacuccuac

SEQ ID NO: 438805 - RNA, 23 nt, Homo sapiens
auucucaugccucauccucccaa

SEQ ID NO: 438806 - RNA, 17 nt, Homo sapiens
auucucauuauuucauc

SEQ ID NO: 438807 - RNA, 15 nt, Homo sapiens
auucuccugccucag

SEQ ID NO: 438808 - RNA, 20 nt, Homo sapiens
auucugaaggccuuguuaaa

SEQ ID NO: 438809 - RNA, 18 nt, Homo sapiens
auucugccacuccugaca

SEQ ID NO: 438810 - RNA, 20 nt, Homo sapiens
auucugggaaaggugcucaa

SEQ ID NO: 438811 - RNA, 23 nt, Homo sapiens
auucugggcuccuggaaccaauc

SEQ ID NO: 438812 - RNA, 18 nt, Homo sapiens
auucugguuuugacauca

SEQ ID NO: 438813 - RNA, 18 nt, Homo sapiens
auucuguggauucuauau

SEQ ID NO: 438814 - RNA, 23 nt, Homo sapiens
auucuuaaauauguggaguucau

SEQ ID NO: 438815 - RNA, 16 nt, Homo sapiens
auucuuaagcacuuug

SEQ ID NO: 438816 - RNA, 18 nt, Homo sapiens
auucuuaauaggcuuuau

SEQ ID NO: 438817 - RNA, 20 nt, Homo sapiens
auucuuccuugagcuaagca

SEQ ID NO: 438818 - RNA, 14 nt, Homo sapiens
auucuucuacuugu

SEQ ID NO: 438819 - RNA, 23 nt, Homo sapiens
auucuucuucucaagcacugaca

SEQ ID NO: 438820 - RNA, 21 nt, Homo sapiens
auucuuguccacauucuacuu

SEQ ID NO: 438821 - RNA, 18 nt, Homo sapiens
auucuuuccaugcaguua

SEQ ID NO: 438822 - RNA, 15 nt, Homo sapiens
auucuuuccccagag

SEQ ID NO: 438823 - RNA, 22 nt, Homo sapiens
auucuuugaccucaaccuguga

SEQ ID NO: 438824 - RNA, 14 nt, Homo sapiens
auugaaagaaccag

SEQ ID NO: 438825 - RNA, 23 nt, Homo sapiens
auugaaauuuuuaaaucauuuca

SEQ ID NO: 438826 - RNA, 14 nt, Homo sapiens
auugaacacaggca

SEQ ID NO: 438827 - RNA, 12 nt, Homo sapiens
auugaaccacua

SEQ ID NO: 438828 - RNA, 17 nt, Homo sapiens
auugaaggauugugaac

SEQ ID NO: 438829 - RNA, 16 nt, Homo sapiens
auugaaugaugugaua

SEQ ID NO: 438830 - RNA, 12 nt, Homo sapiens
auugaaugcgcu

SEQ ID NO: 438831 - RNA, 15 nt, Homo sapiens
auugaaugcgcuuua

SEQ ID NO: 438832 - RNA, 23 nt, Homo sapiens
auugaauuauuuuguuacugucu

SEQ ID NO: 438833 - RNA, 22 nt, Homo sapiens
auugaccaagaacugcauggac

SEQ ID NO: 438834 - RNA, 17 nt, Homo sapiens
auugacccuagccagag

SEQ ID NO: 438835 - RNA, 18 nt, Homo sapiens
auugacgacaagugcuga

SEQ ID NO: 438836 - RNA, 12 nt, Homo sapiens
auugacuucuuu

SEQ ID NO: 438837 - RNA, 19 nt, Homo sapiens
auugagacacugucaagau

SEQ ID NO: 438838 - RNA, 14 nt, Homo sapiens
auugagacuauuua

SEQ ID NO: 438839 - RNA, 12 nt, Homo sapiens
auugagcacaua

SEQ ID NO: 438840 - RNA, 23 nt, Homo sapiens
auugagccuuuuauuaacauaua

SEQ ID NO: 438841 - RNA, 18 nt, Homo sapiens
auugaggcauucaaggau

SEQ ID NO: 438842 - RNA, 15 nt, Homo sapiens
auugauaagaaccuu

SEQ ID NO: 438843 - RNA, 17 nt, Homo sapiens
auugaugaacugccaaa

SEQ ID NO: 438844 - RNA, 16 nt, Homo sapiens
auugauguaacugugu

SEQ ID NO: 438845 - RNA, 15 nt, Homo sapiens
auugauuaaugaacu

SEQ ID NO: 438846 - RNA, 16 nt, Homo sapiens
auugauuaaugaacua

SEQ ID NO: 438847 - RNA, 19 nt, Homo sapiens
auugauugaacguucucaa

SEQ ID NO: 438848 - RNA, 19 nt, Homo sapiens
auugauuuuuaaaguuuaa

SEQ ID NO: 438849 - RNA, 16 nt, Homo sapiens
auugcacaaauacaag

SEQ ID NO: 438850 - RNA, 21 nt, Homo sapiens
auugcacuagagaaacuugaa

SEQ ID NO: 438851 - RNA, 17 nt, Homo sapiens
auugcagcuaagcucaa

SEQ ID NO: 438852 - RNA, 20 nt, Homo sapiens
auugccaccaggagaaccac

SEQ ID NO: 438853 - RNA, 16 nt, Homo sapiens
auugccagcucuucca

SEQ ID NO: 438854 - RNA, 20 nt, Homo sapiens
auugcccaaauaauauuuua

SEQ ID NO: 438855 - RNA, 19 nt, Homo sapiens
auugcccauccaucugcuu

SEQ ID NO: 438856 - RNA, 18 nt, Homo sapiens
auugcuaaucaccaaagg

SEQ ID NO: 438857 - RNA, 22 nt, Homo sapiens
auugcuacguaaucucacuuaa

SEQ ID NO: 438858 - RNA, 17 nt, Homo sapiens
auugcucagagaaggaa

SEQ ID NO: 438859 - RNA, 13 nt, Homo sapiens
auugcucaucuca

SEQ ID NO: 438860 - RNA, 20 nt, Homo sapiens
auugcuccauuuucuuguca

SEQ ID NO: 438861 - RNA, 16 nt, Homo sapiens
auugcugaauuaagga

SEQ ID NO: 438862 - RNA, 22 nt, Homo sapiens
auugcugccuaaagaaacucag

SEQ ID NO: 438863 - RNA, 18 nt, Homo sapiens
auugcuuggacuaccuau

SEQ ID NO: 438864 - RNA, 20 nt, Homo sapiens
auugcuuuuguugugacuuu

SEQ ID NO: 438865 - RNA, 22 nt, Homo sapiens
auuggcaccccuuucuaguuca

SEQ ID NO: 438866 - RNA, 15 nt, Homo sapiens
auuggcucugugaaa

SEQ ID NO: 438867 - RNA, 22 nt, Homo sapiens
auugggcacagccuagggucuu

SEQ ID NO: 438868 - RNA, 18 nt, Homo sapiens
auugggcugacaccuacc

SEQ ID NO: 438869 - RNA, 19 nt, Homo sapiens
auugggcuugugauuucca

SEQ ID NO: 438870 - RNA, 21 nt, Homo sapiens
auugggcuugugauuuccauu

SEQ ID NO: 438871 - RNA, 14 nt, Homo sapiens
auuguaaacuagua

SEQ ID NO: 438872 - RNA, 22 nt, Homo sapiens
auuguaacucaaaggguggaau

SEQ ID NO: 438873 - RNA, 14 nt, Homo sapiens
auuguacagaauca

SEQ ID NO: 438874 - RNA, 15 nt, Homo sapiens
auuguaguuaaugau

SEQ ID NO: 438875 - RNA, 18 nt, Homo sapiens
auuguauaauuaugaagc

SEQ ID NO: 438876 - RNA, 14 nt, Homo sapiens
auuguauuuaguua

SEQ ID NO: 438877 - RNA, 19 nt, Homo sapiens
auugugaagcaccuacuau

SEQ ID NO: 438878 - RNA, 18 nt, Homo sapiens
auugugaucagaccauaa

SEQ ID NO: 438879 - RNA, 20 nt, Homo sapiens
auugugugaguguaccauaa

SEQ ID NO: 438880 - RNA, 23 nt, Homo sapiens
auugugugugugaagaugcucug

SEQ ID NO: 438881 - RNA, 20 nt, Homo sapiens
auuguguuuugagguuuccu

SEQ ID NO: 438882 - RNA, 14 nt, Homo sapiens
auuguuagucucuu

SEQ ID NO: 438883 - RNA, 11 nt, Homo sapiens
auuuugcccag

SEQ ID NO: 438884 - RNA, 18 nt, Homo sapiens
auuuugcuccccagugaa

SEQ ID NO: 438885 - RNA, 21 nt, Homo sapiens
auuuuggaaagauuauccugu

SEQ ID NO: 438886 - RNA, 16 nt, Homo sapiens
auuuuggacgugugag

SEQ ID NO: 438887 - RNA, 20 nt, Homo sapiens
auuuuggauaaaucauuuca

SEQ ID NO: 438888 - RNA, 23 nt, Homo sapiens
auuuuggaucuaucaccugucau

SEQ ID NO: 438889 - RNA, 17 nt, Homo sapiens
auuuugugaugaugcug

SEQ ID NO: 438890 - RNA, 15 nt, Homo sapiens
auuuuguugcaucau

SEQ ID NO: 438891 - RNA, 17 nt, Homo sapiens
auuuuuaaaggacaaac

SEQ ID NO: 438892 - RNA, 17 nt, Homo sapiens
auuuuuaauauuacugu

SEQ ID NO: 438893 - RNA, 19 nt, Homo sapiens
auuuuuacuaaagcagugu

SEQ ID NO: 438894 - RNA, 16 nt, Homo sapiens
auuuuuauacuuucag

SEQ ID NO: 438895 - RNA, 12 nt, Homo sapiens
auuuuugcaaug

SEQ ID NO: 438896 - RNA, 14 nt, Homo sapiens
auuuuugucuuaua

SEQ ID NO: 438897 - RNA, 22 nt, Homo sapiens
auuuuuguguauccaguaugca

SEQ ID NO: 438898 - RNA, 20 nt, Homo sapiens
auuuuuguuucuuccaaagc

SEQ ID NO: 438899 - RNA, 17 nt, Homo sapiens
auuuuuuaaguuuauuu

SEQ ID NO: 438900 - RNA, 22 nt, Homo sapiens
auuuuuuauuucuaaguauuua

SEQ ID NO: 438901 - RNA, 19 nt, Homo sapiens
auuuuuugcugcagacuca

SEQ ID NO: 438902 - RNA, 17 nt, Homo sapiens
auuuuuuuaaauuugca

SEQ ID NO: 438903 - RNA, 20 nt, Homo sapiens
auuuuuuuuaacauuccaau

SEQ ID NO: 438904 - RNA, 14 nt, Homo sapiens
caaaaaaaguaauu

SEQ ID NO: 438905 - RNA, 20 nt, Homo sapiens
caaaaaaauccuagagauuc

SEQ ID NO: 438906 - RNA, 12 nt, Homo sapiens
caaaaaacaacu

SEQ ID NO: 438907 - RNA, 21 nt, Homo sapiens
caaaaacagcagaacuucuga

SEQ ID NO: 438908 - RNA, 14 nt, Homo sapiens
caaaaaccccagug

SEQ ID NO: 438909 - RNA, 16 nt, Homo sapiens
caaaaagaaucugcau

SEQ ID NO: 438910 - RNA, 18 nt, Homo sapiens
caaaaagaggcuauguga

SEQ ID NO: 438911 - RNA, 21 nt, Homo sapiens
caaaaagccuuuuccagaaga

SEQ ID NO: 438912 - RNA, 14 nt, Homo sapiens
caaaaauauuccau

SEQ ID NO: 438913 - RNA, 12 nt, Homo sapiens
caaaaaugaacu

SEQ ID NO: 438914 - RNA, 21 nt, Homo sapiens
caaaacaacagcaacaacaac

SEQ ID NO: 438915 - RNA, 12 nt, Homo sapiens
caaaacauuccg

SEQ ID NO: 438916 - RNA, 12 nt, Homo sapiens
caaaacccacuu

SEQ ID NO: 438917 - RNA, 12 nt, Homo sapiens
caaaacugcaaa

SEQ ID NO: 438918 - RNA, 14 nt, Homo sapiens
caaaacugcaaauu

SEQ ID NO: 438919 - RNA, 18 nt, Homo sapiens
caaaacuucagaugacaa

SEQ ID NO: 438920 - RNA, 12 nt, Homo sapiens
caaaacuuucag

SEQ ID NO: 438921 - RNA, 22 nt, Homo sapiens
caaaagaggagcacuuccaaaa

SEQ ID NO: 438922 - RNA, 18 nt, Homo sapiens
caaaagaggauguucacc

SEQ ID NO: 438923 - RNA, 18 nt, Homo sapiens
caaaagcaauuguauuac

SEQ ID NO: 438924 - RNA, 18 nt, Homo sapiens
caaaagguuaauggaugg

SEQ ID NO: 438925 - RNA, 20 nt, Homo sapiens
caaaauaaaaagugacacag

SEQ ID NO: 438926 - RNA, 18 nt, Homo sapiens
caaaauacagcacuuuga

SEQ ID NO: 438927 - RNA, 13 nt, Homo sapiens
caaaauacuucuu

SEQ ID NO: 438928 - RNA, 19 nt, Homo sapiens
caaaauccagaaguuuaaa

SEQ ID NO: 438929 - RNA, 20 nt, Homo sapiens
caaaaugaaugccaguccag

SEQ ID NO: 438930 - RNA, 16 nt, Homo sapiens
caaaaugucuguuuua

SEQ ID NO: 438931 - RNA, 14 nt, Homo sapiens
caaaaugugugcuu

SEQ ID NO: 438932 - RNA, 14 nt, Homo sapiens
caaaauguuaauaa

SEQ ID NO: 438933 - RNA, 21 nt, Homo sapiens
caaaauguuuucuucaucugu

SEQ ID NO: 438934 - RNA, 16 nt, Homo sapiens
caaaauuacacaguua

SEQ ID NO: 438935 - RNA, 17 nt, Homo sapiens
caaaauuacacaguuaa

SEQ ID NO: 438936 - RNA, 18 nt, Homo sapiens
caaaauuacacaguuaau

SEQ ID NO: 438937 - RNA, 15 nt, Homo sapiens
caaaauuccaucccu

SEQ ID NO: 438938 - RNA, 18 nt, Homo sapiens
caaaauucuuaaguaugu

SEQ ID NO: 438939 - RNA, 15 nt, Homo sapiens
caaaauuuccaguac

SEQ ID NO: 438940 - RNA, 14 nt, Homo sapiens
caaacacauuguga

SEQ ID NO: 438941 - RNA, 23 nt, Homo sapiens
caaacaccuccuagcaagaccug

SEQ ID NO: 438942 - RNA, 15 nt, Homo sapiens
caaacaccuuauuug

SEQ ID NO: 438943 - RNA, 17 nt, Homo sapiens
caaacagaacugcaguc

SEQ ID NO: 438944 - RNA, 23 nt, Homo sapiens
caaacagaugaaaaaaguuaaca

SEQ ID NO: 438945 - RNA, 22 nt, Homo sapiens
caaacaguaaaggccaugugaa

SEQ ID NO: 438946 - RNA, 11 nt, Homo sapiens
caaacagugaa

SEQ ID NO: 438947 - RNA, 21 nt, Homo sapiens
caaaccaaaccccguagcucc

SEQ ID NO: 438948 - RNA, 22 nt, Homo sapiens
caaaccaggagcauuuuguguc

SEQ ID NO: 438949 - RNA, 17 nt, Homo sapiens
caaacccagccucuaga

SEQ ID NO: 438950 - RNA, 16 nt, Homo sapiens
caaaccgagugcaaug

SEQ ID NO: 438951 - RNA, 17 nt, Homo sapiens
caaaccuccaaaagccc

SEQ ID NO: 438952 - RNA, 16 nt, Homo sapiens
caaaccugaccacaga

SEQ ID NO: 438953 - RNA, 17 nt, Homo sapiens
caaaccugauacaauuu

SEQ ID NO: 438954 - RNA, 19 nt, Homo sapiens
caaacguaauuuguuauau

SEQ ID NO: 438955 - RNA, 13 nt, Homo sapiens
caaacuaaaagac

SEQ ID NO: 438956 - RNA, 16 nt, Homo sapiens
caaacuacaaagcuga

SEQ ID NO: 438957 - RNA, 13 nt, Homo sapiens
caaacuccugacc

SEQ ID NO: 438958 - RNA, 15 nt, Homo sapiens
caaacuccugaccuc

SEQ ID NO: 438959 - RNA, 12 nt, Homo sapiens
caaacugcaaua

SEQ ID NO: 438960 - RNA, 20 nt, Homo sapiens
caaacugccuauauugauaa

SEQ ID NO: 438961 - RNA, 21 nt, Homo sapiens
caaacuggggccucccugguc

SEQ ID NO: 438962 - RNA, 20 nt, Homo sapiens
caaacuguagaaaugaugau

SEQ ID NO: 438963 - RNA, 19 nt, Homo sapiens
caaacuguguaacugccca

SEQ ID NO: 438964 - RNA, 23 nt, Homo sapiens
caaacuucuggcuucaugcaauc

SEQ ID NO: 438965 - RNA, 14 nt, Homo sapiens
caaacuugcuuuau

SEQ ID NO: 438966 - RNA, 14 nt, Homo sapiens
caaagaaacaccac

SEQ ID NO: 438967 - RNA, 16 nt, Homo sapiens
caaagaaacaccacuu

SEQ ID NO: 438968 - RNA, 14 nt, Homo sapiens
caaagaagaaccau

SEQ ID NO: 438969 - RNA, 18 nt, Homo sapiens
caaagaaucaacagugaa

SEQ ID NO: 438970 - RNA, 21 nt, Homo sapiens
caaagaccugccugugugcuc

SEQ ID NO: 438971 - RNA, 12 nt, Homo sapiens
caaagacuguac

SEQ ID NO: 438972 - RNA, 18 nt, Homo sapiens
caaagaguuauaugacuu

SEQ ID NO: 438973 - RNA, 16 nt, Homo sapiens
caaagauaacaugcuu

SEQ ID NO: 438974 - RNA, 17 nt, Homo sapiens
caaagauacuugaugca

SEQ ID NO: 438975 - RNA, 15 nt, Homo sapiens
caaagauauuauuua

SEQ ID NO: 438976 - RNA, 17 nt, Homo sapiens
caaagauguacugagag

SEQ ID NO: 438977 - RNA, 13 nt, Homo sapiens
caaagcagugcau

SEQ ID NO: 438978 - RNA, 14 nt, Homo sapiens
caaagcaugcucag

SEQ ID NO: 438979 - RNA, 17 nt, Homo sapiens
caaagccuuauccagca

SEQ ID NO: 438980 - RNA, 21 nt, Homo sapiens
caaagcgugguggacaugcac

SEQ ID NO: 438981 - RNA, 23 nt, Homo sapiens
caaagcucuuuugagcauuuaga

SEQ ID NO: 438982 - RNA, 15 nt, Homo sapiens
caaaggaaacccaau

SEQ ID NO: 438983 - RNA, 18 nt, Homo sapiens
caaaggacugaccugccc

SEQ ID NO: 438984 - RNA, 16 nt, Homo sapiens
caaaggagacaaagca

SEQ ID NO: 438985 - RNA, 15 nt, Homo sapiens
caaaggugauuuucc

SEQ ID NO: 438986 - RNA, 22 nt, Homo sapiens
caaaguaaaaauaaacuguuau

SEQ ID NO: 438987 - RNA, 15 nt, Homo sapiens
caaagucaucaaaga

SEQ ID NO: 438988 - RNA, 20 nt, Homo sapiens
caaagugacuguuuggcuua

SEQ ID NO: 438989 - RNA, 19 nt, Homo sapiens
caaaguguacaauuuucau

SEQ ID NO: 438990 - RNA, 16 nt, Homo sapiens
caaaguguugauggua

SEQ ID NO: 438991 - RNA, 16 nt, Homo sapiens
caaaguuaaacgugau

SEQ ID NO: 438992 - RNA, 23 nt, Homo sapiens
caaaguuaaacgugaugugcuca

SEQ ID NO: 438993 - RNA, 15 nt, Homo sapiens
caaauaaaguucaaa

SEQ ID NO: 438994 - RNA, 14 nt, Homo sapiens
caaauaaauggagu

SEQ ID NO: 438995 - RNA, 17 nt, Homo sapiens
caaauaaguaauaucuu

SEQ ID NO: 438996 - RNA, 15 nt, Homo sapiens
caaauaauacaucuu

SEQ ID NO: 438997 - RNA, 22 nt, Homo sapiens
caaauagggcaaagaaucaaca

SEQ ID NO: 438998 - RNA, 15 nt, Homo sapiens
caaauaucucagagg

SEQ ID NO: 438999 - RNA, 19 nt, Homo sapiens
caaauauuggguugggcac

SEQ ID NO: 439000 - RNA, 18 nt, Homo sapiens
caaaucagacacaauuag

SEQ ID NO: 439001 - RNA, 13 nt, Homo sapiens
caaaucagucuca

SEQ ID NO: 439002 - RNA, 15 nt, Homo sapiens
caaauccuuccaaaa

SEQ ID NO: 439003 - RNA, 14 nt, Homo sapiens
caaaucgcccccuu

SEQ ID NO: 439004 - RNA, 19 nt, Homo sapiens
caaaugacuucauuucuga

SEQ ID NO: 439005 - RNA, 11 nt, Homo sapiens
caaaugagauc

SEQ ID NO: 439006 - RNA, 14 nt, Homo sapiens
caaaugagccacaa

SEQ ID NO: 439007 - RNA, 17 nt, Homo sapiens
caaaugauuuacacuga

SEQ ID NO: 439008 - RNA, 22 nt, Homo sapiens
caaaugauuuacacugacuguu

SEQ ID NO: 439009 - RNA, 20 nt, Homo sapiens
caaaugccaaaauucauuca

SEQ ID NO: 439010 - RNA, 19 nt, Homo sapiens
caaaugccugguaccagag

SEQ ID NO: 439011 - RNA, 20 nt, Homo sapiens
caaaugcuuuggacuuuuga

SEQ ID NO: 439012 - RNA, 16 nt, Homo sapiens
caaauggcagaaccaa

SEQ ID NO: 439013 - RNA, 15 nt, Homo sapiens
caaauguguaaugga

SEQ ID NO: 439014 - RNA, 15 nt, Homo sapiens
caacauaggccugcu

SEQ ID NO: 439015 - RNA, 20 nt, Homo sapiens
caacaucuuuuuccucccuu

SEQ ID NO: 439016 - RNA, 18 nt, Homo sapiens
caacauucaaaagcacaa

SEQ ID NO: 439017 - RNA, 22 nt, Homo sapiens
caaccccuguacccagcuccuu

SEQ ID NO: 439018 - RNA, 17 nt, Homo sapiens
caaccccuuugcugguu

SEQ ID NO: 439019 - RNA, 16 nt, Homo sapiens
caacccuguugaguau

SEQ ID NO: 439020 - RNA, 18 nt, Homo sapiens
caaccggucacccaggag

SEQ ID NO: 439021 - RNA, 13 nt, Homo sapiens
caaccgguuauca

SEQ ID NO: 439022 - RNA, 17 nt, Homo sapiens
caaccucagcccugaaa

SEQ ID NO: 439023 - RNA, 22 nt, Homo sapiens
caaccugaugccccuuccccaa

SEQ ID NO: 439024 - RNA, 20 nt, Homo sapiens
caaccugcucuccucuugcc

SEQ ID NO: 439025 - RNA, 23 nt, Homo sapiens
caaccuggucacaggacucugcc

SEQ ID NO: 439026 - RNA, 14 nt, Homo sapiens
caaccuuuguguaa

SEQ ID NO: 439027 - RNA, 20 nt, Homo sapiens
caacgaacauggcaugugaa

SEQ ID NO: 439028 - RNA, 15 nt, Homo sapiens
caacgagagcacuug

SEQ ID NO: 439029 - RNA, 16 nt, Homo sapiens
caacggcuuagacuuc

SEQ ID NO: 439030 - RNA, 14 nt, Homo sapiens
caacgggucugugg

SEQ ID NO: 439031 - RNA, 17 nt, Homo sapiens
caacgugcgugucucug

SEQ ID NO: 439032 - RNA, 14 nt, Homo sapiens
caacuaauacaugg

SEQ ID NO: 439033 - RNA, 20 nt, Homo sapiens
caacuacccgggccugaccc

SEQ ID NO: 439034 - RNA, 17 nt, Homo sapiens
caacuauuaagauaucu

SEQ ID NO: 439035 - RNA, 20 nt, Homo sapiens
caacuauuuuuccaaaauaa

SEQ ID NO: 439036 - RNA, 18 nt, Homo sapiens
caacucacgggugcauga

SEQ ID NO: 439037 - RNA, 11 nt, Homo sapiens
caacucagguu

SEQ ID NO: 439038 - RNA, 16 nt, Homo sapiens
caacucuccaauguuc

SEQ ID NO: 439039 - RNA, 18 nt, Homo sapiens
caacucuccaauguucua

SEQ ID NO: 439040 - RNA, 13 nt, Homo sapiens
caacugaccaguu

SEQ ID NO: 439041 - RNA, 15 nt, Homo sapiens
caacugaguucagga

SEQ ID NO: 439042 - RNA, 17 nt, Homo sapiens
caacugaucauuugcag

SEQ ID NO: 439043 - RNA, 20 nt, Homo sapiens
caacugauccucgcaucuca

SEQ ID NO: 439044 - RNA, 10 nt, Homo sapiens
caacugauga

SEQ ID NO: 439045 - RNA, 13 nt, Homo sapiens
caacugccaagaa

SEQ ID NO: 439046 - RNA, 21 nt, Homo sapiens
caacugcccccgccacaaccc

SEQ ID NO: 439047 - RNA, 22 nt, Homo sapiens
caacuuaaaucacugaggcauu

SEQ ID NO: 439048 - RNA, 13 nt, Homo sapiens
caacuuagcucac

SEQ ID NO: 439049 - RNA, 19 nt, Homo sapiens
caacuugguucugcuucaa

SEQ ID NO: 439050 - RNA, 20 nt, Homo sapiens
caacuuuguggaugucuucc

SEQ ID NO: 439051 - RNA, 21 nt, Homo sapiens
caacuuuguggaugucuuccu

SEQ ID NO: 439052 - RNA, 11 nt, Homo sapiens
caacuuuucaa

SEQ ID NO: 439053 - RNA, 23 nt, Homo sapiens
caagaaaacaacuucaauaucca

SEQ ID NO: 439054 - RNA, 12 nt, Homo sapiens
caagaaaccacu

SEQ ID NO: 439055 - RNA, 19 nt, Homo sapiens
caagaaauaaaaaucaacu

SEQ ID NO: 439056 - RNA, 15 nt, Homo sapiens
caagaaauucauuaa

SEQ ID NO: 439057 - RNA, 17 nt, Homo sapiens
caagaaauugccuccuu

SEQ ID NO: 439058 - RNA, 12 nt, Homo sapiens
caagaagcccuc

SEQ ID NO: 439059 - RNA, 14 nt, Homo sapiens
caagaaggggcucg

SEQ ID NO: 439060 - RNA, 20 nt, Homo sapiens
caagaagugggagugggaga

SEQ ID NO: 439061 - RNA, 18 nt, Homo sapiens
caagaaugggagguugau

SEQ ID NO: 439062 - RNA, 14 nt, Homo sapiens
caagaccccaaagg

SEQ ID NO: 439063 - RNA, 18 nt, Homo sapiens
caagacggagaugcaugg

SEQ ID NO: 439064 - RNA, 14 nt, Homo sapiens
caagacuuccucau

SEQ ID NO: 439065 - RNA, 19 nt, Homo sapiens
caagacuuccucaugaauc

SEQ ID NO: 439066 - RNA, 16 nt, Homo sapiens
caagacuugguguccu

SEQ ID NO: 439067 - RNA, 16 nt, Homo sapiens
caagagguuaggugaa

SEQ ID NO: 439068 - RNA, 22 nt, Homo sapiens
caagaguacagaagcuuuagca

SEQ ID NO: 439069 - RNA, 21 nt, Homo sapiens
caagaguuuauuuccaaauaa

SEQ ID NO: 439070 - RNA, 15 nt, Homo sapiens
caagaguuuucuucc

SEQ ID NO: 439071 - RNA, 14 nt, Homo sapiens
caagauacacuugu

SEQ ID NO: 439072 - RNA, 14 nt, Homo sapiens
caagauaccuuugc

SEQ ID NO: 439073 - RNA, 20 nt, Homo sapiens
caagauaccuuugcguggau

SEQ ID NO: 439074 - RNA, 12 nt, Homo sapiens
caagauagcucc

SEQ ID NO: 439075 - RNA, 16 nt, Homo sapiens
caagaucaaacuucca

SEQ ID NO: 439076 - RNA, 19 nt, Homo sapiens
caagaucgcaccauugcac

SEQ ID NO: 439077 - RNA, 13 nt, Homo sapiens
caagaucuuuaca

SEQ ID NO: 439078 - RNA, 21 nt, Homo sapiens
caagauggaggggcugacuca

SEQ ID NO: 439079 - RNA, 14 nt, Homo sapiens
caagaugugacaug

SEQ ID NO: 439080 - RNA, 21 nt, Homo sapiens
caagauucccggcuggacuuu

SEQ ID NO: 439081 - RNA, 16 nt, Homo sapiens
caagcaaaccuucuca

SEQ ID NO: 439082 - RNA, 19 nt, Homo sapiens
caagcaaaucccaacauuu

SEQ ID NO: 439083 - RNA, 12 nt, Homo sapiens
caagcacugaca

SEQ ID NO: 439084 - RNA, 17 nt, Homo sapiens
caagcagcugggauuac

SEQ ID NO: 439085 - RNA, 17 nt, Homo sapiens
caagcauucugugcaua

SEQ ID NO: 439086 - RNA, 15 nt, Homo sapiens
caagcauuuguggac

SEQ ID NO: 439087 - RNA, 23 nt, Homo sapiens
caagcauuuugugaacuagggaa

SEQ ID NO: 439088 - RNA, 18 nt, Homo sapiens
caagccaggguuccagac

SEQ ID NO: 439089 - RNA, 17 nt, Homo sapiens
caagcccaguaacugca

SEQ ID NO: 439090 - RNA, 17 nt, Homo sapiens
caagccccucagcccuu

SEQ ID NO: 439091 - RNA, 13 nt, Homo sapiens
caagccugagucc

SEQ ID NO: 439092 - RNA, 19 nt, Homo sapiens
caagcuaauaaaauaucau

SEQ ID NO: 439093 - RNA, 19 nt, Homo sapiens
caagcuccuggucuugaga

SEQ ID NO: 439094 - RNA, 14 nt, Homo sapiens
caaggaaaauggac

SEQ ID NO: 439095 - RNA, 19 nt, Homo sapiens
caaggaaggcauuuggacc

SEQ ID NO: 439096 - RNA, 15 nt, Homo sapiens
caaggagaauaugau

SEQ ID NO: 439097 - RNA, 22 nt, Homo sapiens
caaggagaccaaguccuggcua

SEQ ID NO: 439098 - RNA, 23 nt, Homo sapiens
caaggaguaaguacaaauauucc

SEQ ID NO: 439099 - RNA, 17 nt, Homo sapiens
caaggaucacuugagcc

SEQ ID NO: 439100 - RNA, 13 nt, Homo sapiens
caaggaugaucca

SEQ ID NO: 439101 - RNA, 21 nt, Homo sapiens
caaggcaggaggaucacuuga

SEQ ID NO: 439102 - RNA, 19 nt, Homo sapiens
caaggcaguguuccucacc

SEQ ID NO: 439103 - RNA, 21 nt, Homo sapiens
caaggccaucugcuuaccaca

SEQ ID NO: 439104 - RNA, 21 nt, Homo sapiens
caaggccuaugccaccugcag

SEQ ID NO: 439105 - RNA, 14 nt, Homo sapiens
caaggccugugcug

SEQ ID NO: 439106 - RNA, 16 nt, Homo sapiens
caaggccugugcugca

SEQ ID NO: 439107 - RNA, 16 nt, Homo sapiens
caaggccuugguguuu

SEQ ID NO: 439108 - RNA, 17 nt, Homo sapiens
caaggcugcacagcuca

SEQ ID NO: 439109 - RNA, 17 nt, Homo sapiens
caaggcugcagugagcc

SEQ ID NO: 439110 - RNA, 23 nt, Homo sapiens
caaggcugcgggagaagaaguuu

SEQ ID NO: 439111 - RNA, 18 nt, Homo sapiens
caaggcuggguaauguga

SEQ ID NO: 439112 - RNA, 20 nt, Homo sapiens
caagggaggcccaugugacu

SEQ ID NO: 439113 - RNA, 15 nt, Homo sapiens
caagggcuccagggc

SEQ ID NO: 439114 - RNA, 18 nt, Homo sapiens
caagggggcugcucugca

SEQ ID NO: 439115 - RNA, 22 nt, Homo sapiens
caagguccucucaguucucucc

SEQ ID NO: 439116 - RNA, 12 nt, Homo sapiens
caaggugacaaa

SEQ ID NO: 439117 - RNA, 13 nt, Homo sapiens
caaggugcucaau

SEQ ID NO: 439118 - RNA, 19 nt, Homo sapiens
caaggugggccuugcuacc

SEQ ID NO: 439119 - RNA, 14 nt, Homo sapiens
caaguaauugugaa

SEQ ID NO: 439120 - RNA, 13 nt, Homo sapiens
caaguacagccuu

SEQ ID NO: 439121 - RNA, 18 nt, Homo sapiens
caaguaggugggauuaca

SEQ ID NO: 439122 - RNA, 14 nt, Homo sapiens
caaguauuuugcca

SEQ ID NO: 439123 - RNA, 15 nt, Homo sapiens
caaguauuuugccac

SEQ ID NO: 439124 - RNA, 17 nt, Homo sapiens
caagucaacacucuucu

SEQ ID NO: 439125 - RNA, 14 nt, Homo sapiens
caagucccaucuca

SEQ ID NO: 439126 - RNA, 13 nt, Homo sapiens
caagucccaugau

SEQ ID NO: 439127 - RNA, 13 nt, Homo sapiens
cacauacuagaaa

SEQ ID NO: 439128 - RNA, 16 nt, Homo sapiens
cacauagauaccuuca

SEQ ID NO: 439129 - RNA, 21 nt, Homo sapiens
cacauagauucaccuguaaaa

SEQ ID NO: 439130 - RNA, 15 nt, Homo sapiens
cacauccaacauuuc

SEQ ID NO: 439131 - RNA, 22 nt, Homo sapiens
cacaucugcaguggagccugaa

SEQ ID NO: 439132 - RNA, 13 nt, Homo sapiens
cacaucugcauuu

SEQ ID NO: 439133 - RNA, 16 nt, Homo sapiens
cacaugaauuucugcc

SEQ ID NO: 439134 - RNA, 19 nt, Homo sapiens
cacaugacaacuuugccag

SEQ ID NO: 439135 - RNA, 11 nt, Homo sapiens
cacaugcacag

SEQ ID NO: 439136 - RNA, 23 nt, Homo sapiens
cacauguagaauuauaacuaauu

SEQ ID NO: 439137 - RNA, 17 nt, Homo sapiens
cacauguugcuaaugac

SEQ ID NO: 439138 - RNA, 23 nt, Homo sapiens
cacauuagggugggcgugcugcg

SEQ ID NO: 439139 - RNA, 20 nt, Homo sapiens
cacauuaucgggagcagugu

SEQ ID NO: 439140 - RNA, 23 nt, Homo sapiens
cacauuaucgggagcagugucuu

SEQ ID NO: 439141 - RNA, 17 nt, Homo sapiens
cacauucccaucuguca

SEQ ID NO: 439142 - RNA, 18 nt, Homo sapiens
cacauugaaugcgcuuua

SEQ ID NO: 439143 - RNA, 23 nt, Homo sapiens
cacauuugugcauaaauuuccac

SEQ ID NO: 439144 - RNA, 21 nt, Homo sapiens
cacauuuuuuaaacaguuaca

SEQ ID NO: 439145 - RNA, 21 nt, Homo sapiens
caccaaaugccucugccuuga

SEQ ID NO: 439146 - RNA, 20 nt, Homo sapiens
caccaagcugcucuccuuca

SEQ ID NO: 439147 - RNA, 14 nt, Homo sapiens
caccaaguacagcc

SEQ ID NO: 439148 - RNA, 14 nt, Homo sapiens
caccaaguucucau

SEQ ID NO: 439149 - RNA, 20 nt, Homo sapiens
caccacacugaccacacugu

SEQ ID NO: 439150 - RNA, 14 nt, Homo sapiens
caccaccaaccacu

SEQ ID NO: 439151 - RNA, 13 nt, Homo sapiens
caccacugagucc

SEQ ID NO: 439152 - RNA, 15 nt, Homo sapiens
caccagccugagcca

SEQ ID NO: 439153 - RNA, 16 nt, Homo sapiens
caccagcuccacuggc

SEQ ID NO: 439154 - RNA, 18 nt, Homo sapiens
caccaggacucagaggau

SEQ ID NO: 439155 - RNA, 14 nt, Homo sapiens
caccaucaccucuc

SEQ ID NO: 439156 - RNA, 18 nt, Homo sapiens
caccauuaacaggucuuu

SEQ ID NO: 439157 - RNA, 13 nt, Homo sapiens
caccauuccuuua

SEQ ID NO: 439158 - RNA, 18 nt, Homo sapiens
caccauucgucaucacuc

SEQ ID NO: 439159 - RNA, 12 nt, Homo sapiens
cacccaccaggg

SEQ ID NO: 439160 - RNA, 13 nt, Homo sapiens
cacccaccuccac

SEQ ID NO: 439161 - RNA, 15 nt, Homo sapiens
cacccacgcauauac

SEQ ID NO: 439162 - RNA, 18 nt, Homo sapiens
cacccaggccacugaccu

SEQ ID NO: 439163 - RNA, 15 nt, Homo sapiens
cacccauaccagcua

SEQ ID NO: 439164 - RNA, 16 nt, Homo sapiens
cacccauugucucauu

SEQ ID NO: 439165 - RNA, 13 nt, Homo sapiens
caccccugcaguu

SEQ ID NO: 439166 - RNA, 13 nt, Homo sapiens
cacccguguucuc

SEQ ID NO: 439167 - RNA, 15 nt, Homo sapiens
cacccuacacaaaau

SEQ ID NO: 439168 - RNA, 20 nt, Homo sapiens
cacccugggcaacaugauga

SEQ ID NO: 439169 - RNA, 21 nt, Homo sapiens
cacccugucuaggcacaugug

SEQ ID NO: 439170 - RNA, 21 nt, Homo sapiens
cacccuuccccuccuucuccc

SEQ ID NO: 439171 - RNA, 16 nt, Homo sapiens
cacccuucucagggac

SEQ ID NO: 439172 - RNA, 16 nt, Homo sapiens
cacccuucucauucca

SEQ ID NO: 439173 - RNA, 18 nt, Homo sapiens
caccguacaucugcaaua

SEQ ID NO: 439174 - RNA, 18 nt, Homo sapiens
caccuaauaaagaaauaa

SEQ ID NO: 439175 - RNA, 19 nt, Homo sapiens
caccuaugacauacaugga

SEQ ID NO: 439176 - RNA, 23 nt, Homo sapiens
caccucacacuccuccaaggcac

SEQ ID NO: 439177 - RNA, 13 nt, Homo sapiens
caccucaccagaa

SEQ ID NO: 439178 - RNA, 20 nt, Homo sapiens
caccucauggacuccaggau

SEQ ID NO: 439179 - RNA, 22 nt, Homo sapiens
caccuccguugcggcugugcuc

SEQ ID NO: 439180 - RNA, 21 nt, Homo sapiens
caccuccuccaagaagcccuc

SEQ ID NO: 439181 - RNA, 14 nt, Homo sapiens
caccuccuggagaa

SEQ ID NO: 439182 - RNA, 15 nt, Homo sapiens
caccucuuaugcaca

SEQ ID NO: 439183 - RNA, 13 nt, Homo sapiens
caccucuuuguca

SEQ ID NO: 439184 - RNA, 21 nt, Homo sapiens
caccugaauuucuguuugaau

SEQ ID NO: 439185 - RNA, 17 nt, Homo sapiens
caccugagcuuuggaca

SEQ ID NO: 439186 - RNA, 21 nt, Homo sapiens
caccugcgugguccauuccau

SEQ ID NO: 439187 - RNA, 12 nt, Homo sapiens
caccugcugcug

SEQ ID NO: 439188 - RNA, 15 nt, Homo sapiens
caccuggauucccug

SEQ ID NO: 439189 - RNA, 15 nt, Homo sapiens
caccuggcacaccag

SEQ ID NO: 439190 - RNA, 16 nt, Homo sapiens
cauuaggucaccugug

SEQ ID NO: 439191 - RNA, 16 nt, Homo sapiens
cauuagucacuuugaa

SEQ ID NO: 439192 - RNA, 22 nt, Homo sapiens
cauuauccuuuuaucucacaaa

SEQ ID NO: 439193 - RNA, 16 nt, Homo sapiens
cauuaugcugugguca

SEQ ID NO: 439194 - RNA, 12 nt, Homo sapiens
cauuauuccucc

SEQ ID NO: 439195 - RNA, 16 nt, Homo sapiens
cauuauuccuccagga

SEQ ID NO: 439196 - RNA, 22 nt, Homo sapiens
cauuauucucugaugcacuguu

SEQ ID NO: 439197 - RNA, 17 nt, Homo sapiens
cauuauuucaucaugac

SEQ ID NO: 439198 - RNA, 19 nt, Homo sapiens
cauuauuuuuuacaauggc

SEQ ID NO: 439199 - RNA, 23 nt, Homo sapiens
cauucaaucaaccugcacuucau

SEQ ID NO: 439200 - RNA, 17 nt, Homo sapiens
cauucacuacaggugaa

SEQ ID NO: 439201 - RNA, 16 nt, Homo sapiens
cauucacugauuggaa

SEQ ID NO: 439202 - RNA, 19 nt, Homo sapiens
cauucaguuaaaaauccag

SEQ ID NO: 439203 - RNA, 23 nt, Homo sapiens
cauucaucaagcuguacauuugg

SEQ ID NO: 439204 - RNA, 14 nt, Homo sapiens
cauuccagcucugc

SEQ ID NO: 439205 - RNA, 15 nt, Homo sapiens
cauucccaucuguca

SEQ ID NO: 439206 - RNA, 17 nt, Homo sapiens
cauucccucucauccag

SEQ ID NO: 439207 - RNA, 16 nt, Homo sapiens
cauucccucuccugcc

SEQ ID NO: 439208 - RNA, 20 nt, Homo sapiens
cauuccguuaggaauaacac

SEQ ID NO: 439209 - RNA, 20 nt, Homo sapiens
cauuccugaaagaaacaguu

SEQ ID NO: 439210 - RNA, 20 nt, Homo sapiens
cauuccugagauucugggaa

SEQ ID NO: 439211 - RNA, 14 nt, Homo sapiens
cauuccuugucacc

SEQ ID NO: 439212 - RNA, 20 nt, Homo sapiens
cauucgcagugcccagugau

SEQ ID NO: 439213 - RNA, 22 nt, Homo sapiens
cauucguccuuagaauacugua

SEQ ID NO: 439214 - RNA, 14 nt, Homo sapiens
cauucuacugaaca

SEQ ID NO: 439215 - RNA, 17 nt, Homo sapiens
cauucuacuucagcuuu

SEQ ID NO: 439216 - RNA, 15 nt, Homo sapiens
cauucuagauccugc

SEQ ID NO: 439217 - RNA, 13 nt, Homo sapiens
cauucuagguagg

SEQ ID NO: 439218 - RNA, 17 nt, Homo sapiens
cauucuaguacuuggga

SEQ ID NO: 439219 - RNA, 13 nt, Homo sapiens
cauucuaugacaa

SEQ ID NO: 439220 - RNA, 18 nt, Homo sapiens
cauucucaguauccacug

SEQ ID NO: 439221 - RNA, 22 nt, Homo sapiens
cauucuccguugucauugacuu

SEQ ID NO: 439222 - RNA, 21 nt, Homo sapiens
cauucugcuuucuugccacac

SEQ ID NO: 439223 - RNA, 13 nt, Homo sapiens
cauucuuccaaaa

SEQ ID NO: 439224 - RNA, 18 nt, Homo sapiens
cauugaaguaaugaauuu

SEQ ID NO: 439225 - RNA, 17 nt, Homo sapiens
cauugacuucaagaugc

SEQ ID NO: 439226 - RNA, 13 nt, Homo sapiens
cauugaugacccu

SEQ ID NO: 439227 - RNA, 17 nt, Homo sapiens
cauugcacuaaaaguga

SEQ ID NO: 439228 - RNA, 22 nt, Homo sapiens
cauugcacuaaaagugauguga

SEQ ID NO: 439229 - RNA, 16 nt, Homo sapiens
cauugcacuccagcug

SEQ ID NO: 439230 - RNA, 21 nt, Homo sapiens
cauugccuaacuacuaguuuu

SEQ ID NO: 439231 - RNA, 20 nt, Homo sapiens
cauuggcccugacaaaaagg

SEQ ID NO: 439232 - RNA, 14 nt, Homo sapiens
cauugguaucugau

SEQ ID NO: 439233 - RNA, 15 nt, Homo sapiens
cauuguagaaacaca

SEQ ID NO: 439234 - RNA, 22 nt, Homo sapiens
cauuguauuuuacuuugugcaa

SEQ ID NO: 439235 - RNA, 14 nt, Homo sapiens
cauugugugucuuc

SEQ ID NO: 439236 - RNA, 20 nt, Homo sapiens
cauuguuacagguguacuau

SEQ ID NO: 439237 - RNA, 16 nt, Homo sapiens
cauuguuuugccagug

SEQ ID NO: 439238 - RNA, 22 nt, Homo sapiens
cauuuaacugccuuacagacag

SEQ ID NO: 439239 - RNA, 17 nt, Homo sapiens
cauuuaauaacuuugcu

SEQ ID NO: 439240 - RNA, 13 nt, Homo sapiens
cauuuaccuggaa

SEQ ID NO: 439241 - RNA, 21 nt, Homo sapiens
cauuuacuugaucauucucag

SEQ ID NO: 439242 - RNA, 14 nt, Homo sapiens
cauuuacuuguuga

SEQ ID NO: 439243 - RNA, 23 nt, Homo sapiens
cauuuagauuuugauaccaguga

SEQ ID NO: 439244 - RNA, 14 nt, Homo sapiens
cauuuagcacaaaa

SEQ ID NO: 439245 - RNA, 21 nt, Homo sapiens
cauuuaggugaggaagcaaaa

SEQ ID NO: 439246 - RNA, 15 nt, Homo sapiens
cauuuauaaaaccau

SEQ ID NO: 439247 - RNA, 22 nt, Homo sapiens
cauuuauaaccccagccugacc

SEQ ID NO: 439248 - RNA, 15 nt, Homo sapiens
cauuuaugcaugaga

SEQ ID NO: 439249 - RNA, 20 nt, Homo sapiens
cauuuauuauuucaauguga

SEQ ID NO: 439250 - RNA, 17 nt, Homo sapiens
cauuuauuuuaagcacu

SEQ ID NO: 439251 - RNA, 14 nt, Homo sapiens
cauuucaaaaccca

SEQ ID NO: 439252 - RNA, 22 nt, Homo sapiens
cauuucaaaacccaaauggcua

SEQ ID NO: 439253 - RNA, 17 nt, Homo sapiens
cauuucaagugauuugg

SEQ ID NO: 439254 - RNA, 16 nt, Homo sapiens
cauuucacuauucugu

SEQ ID NO: 439255 - RNA, 20 nt, Homo sapiens
cauuucauugagggaaaaca

SEQ ID NO: 439256 - RNA, 22 nt, Homo sapiens
cauuucauuguaugauguguug

SEQ ID NO: 439257 - RNA, 20 nt, Homo sapiens
cauuuccaacaccacagaca

SEQ ID NO: 439258 - RNA, 13 nt, Homo sapiens
cauuucccaaaau

SEQ ID NO: 439259 - RNA, 15 nt, Homo sapiens
cauuuccucaggcaa

SEQ ID NO: 439260 - RNA, 19 nt, Homo sapiens
cauuuccugacagaaggac

SEQ ID NO: 439261 - RNA, 13 nt, Homo sapiens
cauuucuaaggug

SEQ ID NO: 439262 - RNA, 15 nt, Homo sapiens
cauuucuagcaguga

SEQ ID NO: 439263 - RNA, 18 nt, Homo sapiens
cauuucuagcagugauga

SEQ ID NO: 439264 - RNA, 17 nt, Homo sapiens
cauuucuugauguugcu

SEQ ID NO: 439265 - RNA, 19 nt, Homo sapiens
cauuucuuuauuucugucu

SEQ ID NO: 439266 - RNA, 19 nt, Homo sapiens
cauuugcacagguuuucag

SEQ ID NO: 439267 - RNA, 13 nt, Homo sapiens
cauuugcaccuac

SEQ ID NO: 439268 - RNA, 13 nt, Homo sapiens
cauuugccaaacu

SEQ ID NO: 439269 - RNA, 24 nt, Homo sapiens
cauuugccaaacuaaauacuguaa

SEQ ID NO: 439270 - RNA, 19 nt, Homo sapiens
cauuugcucuuucaucucu

SEQ ID NO: 439271 - RNA, 11 nt, Homo sapiens
cauuugcugaa

SEQ ID NO: 439272 - RNA, 11 nt, Homo sapiens
cauuugcugca

SEQ ID NO: 439273 - RNA, 20 nt, Homo sapiens
cauuugggauuuucuuugcc

SEQ ID NO: 439274 - RNA, 21 nt, Homo sapiens
cauuuguggucugacuccuug

SEQ ID NO: 439275 - RNA, 15 nt, Homo sapiens
cauuugugucaaugg

SEQ ID NO: 439276 - RNA, 13 nt, Homo sapiens
cauuugugucugc

SEQ ID NO: 439277 - RNA, 17 nt, Homo sapiens
cauuugugugugugcaa

SEQ ID NO: 439278 - RNA, 19 nt, Homo sapiens
cauuuuauucacauauguc

SEQ ID NO: 439279 - RNA, 13 nt, Homo sapiens
cauuuucaccucc

SEQ ID NO: 439280 - RNA, 19 nt, Homo sapiens
cauuuucagcaucaaacau

SEQ ID NO: 439281 - RNA, 18 nt, Homo sapiens
cauuuucucccuuaggaa

SEQ ID NO: 439282 - RNA, 15 nt, Homo sapiens
cauuuuggucucuau

SEQ ID NO: 439283 - RNA, 23 nt, Homo sapiens
cauuuuguaccagggcucuguau

SEQ ID NO: 439284 - RNA, 14 nt, Homo sapiens
cauuuuucugggag

SEQ ID NO: 439285 - RNA, 11 nt, Homo sapiens
cauuuuugcuu

SEQ ID NO: 439286 - RNA, 19 nt, Homo sapiens
cauuuuuuaaaacaagaaa

SEQ ID NO: 439287 - RNA, 23 nt, Homo sapiens
cauuuuuuucacuggaguuacau

SEQ ID NO: 439288 - RNA, 14 nt, Homo sapiens
ccaaaaacagugau

SEQ ID NO: 439289 - RNA, 16 nt, Homo sapiens
ccaaaaaccccagugu

SEQ ID NO: 439290 - RNA, 13 nt, Homo sapiens
ccaaaaacuaaau

SEQ ID NO: 439291 - RNA, 13 nt, Homo sapiens
ccaaaacauuccg

SEQ ID NO: 439292 - RNA, 13 nt, Homo sapiens
ccaaaagcacuua

SEQ ID NO: 439293 - RNA, 18 nt, Homo sapiens
ccaaaaucggaucugggg

SEQ ID NO: 439294 - RNA, 17 nt, Homo sapiens
ccaaacccuugucagug

SEQ ID NO: 439295 - RNA, 18 nt, Homo sapiens
ccaaacggaacucuucau

SEQ ID NO: 439296 - RNA, 15 nt, Homo sapiens
ccaaagcaaugugag

SEQ ID NO: 439297 - RNA, 18 nt, Homo sapiens
ccaaagcagcacuuauaa

SEQ ID NO: 439298 - RNA, 18 nt, Homo sapiens
ccaaaggucauccuuaau

SEQ ID NO: 439299 - RNA, 14 nt, Homo sapiens
ccaaagguuuugca

SEQ ID NO: 439300 - RNA, 20 nt, Homo sapiens
ccaaaguucucccugccauc

SEQ ID NO: 439301 - RNA, 14 nt, Homo sapiens
ccaaauaugcacuu

SEQ ID NO: 439302 - RNA, 18 nt, Homo sapiens
ccaaauccacaagccauu

SEQ ID NO: 439303 - RNA, 16 nt, Homo sapiens
ccaaaucccagggaag

SEQ ID NO: 439304 - RNA, 19 nt, Homo sapiens
ccaaauccccucccuguga

SEQ ID NO: 439305 - RNA, 20 nt, Homo sapiens
ccaaaucuaaauagauacuu

SEQ ID NO: 439306 - RNA, 14 nt, Homo sapiens
ccaaaugcagggag

SEQ ID NO: 439307 - RNA, 18 nt, Homo sapiens
ccaaaugcuauacugugu

SEQ ID NO: 439308 - RNA, 17 nt, Homo sapiens
ccaaauugacauguugu

SEQ ID NO: 439309 - RNA, 21 nt, Homo sapiens
ccaacuucauuugaugcuaaa

SEQ ID NO: 439310 - RNA, 21 nt, Homo sapiens
ccaacuuccuguugauguuca

SEQ ID NO: 439311 - RNA, 14 nt, Homo sapiens
ccaacuugagaugu

SEQ ID NO: 439312 - RNA, 22 nt, Homo sapiens
ccaacuugguucugcuucaaua

SEQ ID NO: 439313 - RNA, 16 nt, Homo sapiens
ccaacuuuguuuucca

SEQ ID NO: 439314 - RNA, 13 nt, Homo sapiens
ccaacuuuugcau

SEQ ID NO: 439315 - RNA, 18 nt, Homo sapiens
ccaagaacagcaggccca

SEQ ID NO: 439316 - RNA, 13 nt, Homo sapiens
ccaagaacugcau

SEQ ID NO: 439317 - RNA, 20 nt, Homo sapiens
ccaagaagcccuccuugcca

SEQ ID NO: 439318 - RNA, 18 nt, Homo sapiens
ccaagaaggugagugcuu

SEQ ID NO: 439319 - RNA, 17 nt, Homo sapiens
ccaagaguuugagacca

SEQ ID NO: 439320 - RNA, 21 nt, Homo sapiens
ccaagcaaaaacaaaugggaa

SEQ ID NO: 439321 - RNA, 20 nt, Homo sapiens
ccaaggaauuucugcucugg

SEQ ID NO: 439322 - RNA, 13 nt, Homo sapiens
ccaaggagaccaa

SEQ ID NO: 439323 - RNA, 22 nt, Homo sapiens
ccaaggauccucuccacuccau

SEQ ID NO: 439324 - RNA, 18 nt, Homo sapiens
ccaaggggguggacgcaa

SEQ ID NO: 439325 - RNA, 16 nt, Homo sapiens
ccaaggguaugggaag

SEQ ID NO: 439326 - RNA, 19 nt, Homo sapiens
ccaagguaaacaguuugaa

SEQ ID NO: 439327 - RNA, 21 nt, Homo sapiens
ccaaggucagcucccaucuca

SEQ ID NO: 439328 - RNA, 19 nt, Homo sapiens
ccaaggugcacauuuucca

SEQ ID NO: 439329 - RNA, 15 nt, Homo sapiens
ccaagucuuccugac

SEQ ID NO: 439330 - RNA, 16 nt, Homo sapiens
ccaagugaaugaguuu

SEQ ID NO: 439331 - RNA, 23 nt, Homo sapiens
ccaagugaaugaguuuccagcua

SEQ ID NO: 439332 - RNA, 14 nt, Homo sapiens
ccaauaaaacaaga

SEQ ID NO: 439333 - RNA, 17 nt, Homo sapiens
ccaauaaaagcucuucu

SEQ ID NO: 439334 - RNA, 18 nt, Homo sapiens
ccaauaaaagugacucuc

SEQ ID NO: 439335 - RNA, 21 nt, Homo sapiens
ccaauaaagcgaauggaccau

SEQ ID NO: 439336 - RNA, 16 nt, Homo sapiens
ccaauacugagugccu

SEQ ID NO: 439337 - RNA, 13 nt, Homo sapiens
ccaauagucauau

SEQ ID NO: 439338 - RNA, 15 nt, Homo sapiens
ccaaucaacagcaug

SEQ ID NO: 439339 - RNA, 14 nt, Homo sapiens
ccaaucauuuuaau

SEQ ID NO: 439340 - RNA, 17 nt, Homo sapiens
ccaauccacacauauug

SEQ ID NO: 439341 - RNA, 19 nt, Homo sapiens
ccaauccuuuauagcuuug

SEQ ID NO: 439342 - RNA, 16 nt, Homo sapiens
ccaaugcacacaguag

SEQ ID NO: 439343 - RNA, 17 nt, Homo sapiens
ccaaugccuuuccagca

SEQ ID NO: 439344 - RNA, 11 nt, Homo sapiens
ccaaugcuuug

SEQ ID NO: 439345 - RNA, 19 nt, Homo sapiens
ccaaugguguagcuguccu

SEQ ID NO: 439346 - RNA, 16 nt, Homo sapiens
ccaauuaacugaagca

SEQ ID NO: 439347 - RNA, 11 nt, Homo sapiens
ccaauuccuca

SEQ ID NO: 439348 - RNA, 12 nt, Homo sapiens
ccaauuccucau

SEQ ID NO: 439349 - RNA, 12 nt, Homo sapiens
ccaauugaugua

SEQ ID NO: 439350 - RNA, 14 nt, Homo sapiens
ccaauuucucuuaa

SEQ ID NO: 439351 - RNA, 13 nt, Homo sapiens
ccacaaaacugac

SEQ ID NO: 439352 - RNA, 12 nt, Homo sapiens
ccacaacaugaa

SEQ ID NO: 439353 - RNA, 21 nt, Homo sapiens
ccacaauagcagacaguguuu

SEQ ID NO: 439354 - RNA, 16 nt, Homo sapiens
ccacaauggcugggag

SEQ ID NO: 439355 - RNA, 11 nt, Homo sapiens
ccacacaagcg

SEQ ID NO: 439356 - RNA, 14 nt, Homo sapiens
ccacaccacaggau

SEQ ID NO: 439357 - RNA, 13 nt, Homo sapiens
ccacacccaggaa

SEQ ID NO: 439358 - RNA, 17 nt, Homo sapiens
ccacacgcucacuccag

SEQ ID NO: 439359 - RNA, 12 nt, Homo sapiens
ccacacugggac

SEQ ID NO: 439360 - RNA, 21 nt, Homo sapiens
ccacacuuccuguccagagag

SEQ ID NO: 439361 - RNA, 14 nt, Homo sapiens
ccacacuucuugaa

SEQ ID NO: 439362 - RNA, 21 nt, Homo sapiens
ccacacuuguuccagcucuuu

SEQ ID NO: 439363 - RNA, 15 nt, Homo sapiens
ccacagacaagguag

SEQ ID NO: 439364 - RNA, 22 nt, Homo sapiens
ccacagggugggaugagccucu

SEQ ID NO: 439365 - RNA, 21 nt, Homo sapiens
ccacauaauacauuccaucac

SEQ ID NO: 439366 - RNA, 15 nt, Homo sapiens
ccacaucuaacaaag

SEQ ID NO: 439367 - RNA, 13 nt, Homo sapiens
ccaccaaauucug

SEQ ID NO: 439368 - RNA, 23 nt, Homo sapiens
ccaccaaauucugaauuuguaga

SEQ ID NO: 439369 - RNA, 20 nt, Homo sapiens
ccaccagggcucagcuccuu

SEQ ID NO: 439370 - RNA, 11 nt, Homo sapiens
ccaccagugaa

SEQ ID NO: 439371 - RNA, 14 nt, Homo sapiens
ccaccccacuggcu

SEQ ID NO: 439372 - RNA, 14 nt, Homo sapiens
ccacccccaagaaa

SEQ ID NO: 439373 - RNA, 17 nt, Homo sapiens
ccaccccuaaagagaua

SEQ ID NO: 439374 - RNA, 15 nt, Homo sapiens
ccacccuaauuugcc

SEQ ID NO: 439375 - RNA, 15 nt, Homo sapiens
ccaccuagagcuaga

SEQ ID NO: 439376 - RNA, 15 nt, Homo sapiens
ccaccuccaaggacu

SEQ ID NO: 439377 - RNA, 19 nt, Homo sapiens
ccaccuccacccccaagaa

SEQ ID NO: 439378 - RNA, 20 nt, Homo sapiens
ccaccugacaauggcagcua

SEQ ID NO: 439379 - RNA, 17 nt, Homo sapiens
ccaccugagcuuuggac

SEQ ID NO: 439380 - RNA, 16 nt, Homo sapiens
ccaccugcagccuguu

SEQ ID NO: 439381 - RNA, 13 nt, Homo sapiens
ccaccugccugac

SEQ ID NO: 439382 - RNA, 21 nt, Homo sapiens
ccaccuugaucccaauccuua

SEQ ID NO: 439383 - RNA, 16 nt, Homo sapiens
ccacgaccuuugaaga

SEQ ID NO: 439384 - RNA, 17 nt, Homo sapiens
ccacgcccuggggagug

SEQ ID NO: 439385 - RNA, 17 nt, Homo sapiens
ccacgcucaucuugcaa

SEQ ID NO: 439386 - RNA, 14 nt, Homo sapiens
ccacggccacugca

SEQ ID NO: 439387 - RNA, 15 nt, Homo sapiens
ccacggccacugcag

SEQ ID NO: 439388 - RNA, 24 nt, Homo sapiens
ccacgucuggccaggcacugccuu

SEQ ID NO: 439389 - RNA, 15 nt, Homo sapiens
ccacguggacucugu

SEQ ID NO: 439390 - RNA, 20 nt, Homo sapiens
ccacgugggcaaacaggcag

SEQ ID NO: 439391 - RNA, 19 nt, Homo sapiens
ccacguugccucuacuuua

SEQ ID NO: 439392 - RNA, 15 nt, Homo sapiens
ccacuaaccaucccc

SEQ ID NO: 439393 - RNA, 12 nt, Homo sapiens
ccacuaauacug

SEQ ID NO: 439394 - RNA, 18 nt, Homo sapiens
ccacuaccuucugaccuc

SEQ ID NO: 439395 - RNA, 22 nt, Homo sapiens
ccacucacaaccccugcuccag

SEQ ID NO: 439396 - RNA, 14 nt, Homo sapiens
ccacucccugccaa

SEQ ID NO: 439397 - RNA, 14 nt, Homo sapiens
ccacugaagaguau

SEQ ID NO: 439398 - RNA, 20 nt, Homo sapiens
ccacugaccggaggcaaaag

SEQ ID NO: 439399 - RNA, 20 nt, Homo sapiens
ccacugcccugggcagccau

SEQ ID NO: 439400 - RNA, 15 nt, Homo sapiens
ccacugcgaccacaa

SEQ ID NO: 439401 - RNA, 12 nt, Homo sapiens
ccacugcuccau

SEQ ID NO: 439402 - RNA, 19 nt, Homo sapiens
ccacuuaaaaaauguccau

SEQ ID NO: 439403 - RNA, 19 nt, Homo sapiens
ccacuuagaaauugcauuu

SEQ ID NO: 439404 - RNA, 14 nt, Homo sapiens
ccacuuaugcugcu

SEQ ID NO: 439405 - RNA, 13 nt, Homo sapiens
ccacuucacaguu

SEQ ID NO: 439406 - RNA, 15 nt, Homo sapiens
ccacuucauccccuc

SEQ ID NO: 439407 - RNA, 21 nt, Homo sapiens
ccacuugacauuccuugucac

SEQ ID NO: 439408 - RNA, 16 nt, Homo sapiens
ccacuugccagggugg

SEQ ID NO: 439409 - RNA, 13 nt, Homo sapiens
ccacuuucauuca

SEQ ID NO: 439410 - RNA, 21 nt, Homo sapiens
ccacuuuccccgugggccaug

SEQ ID NO: 439411 - RNA, 15 nt, Homo sapiens
ccacuuuuugcagcu

SEQ ID NO: 439412 - RNA, 23 nt, Homo sapiens
ccagaaaagauggaaaagaaauu

SEQ ID NO: 439413 - RNA, 15 nt, Homo sapiens
ccagaaaauaugaua

SEQ ID NO: 439414 - RNA, 22 nt, Homo sapiens
ccagaacaaaccucuauauguu

SEQ ID NO: 439415 - RNA, 18 nt, Homo sapiens
ccagaaccccaacuccca

SEQ ID NO: 439416 - RNA, 22 nt, Homo sapiens
ccagaagcucaaggcugcagug

SEQ ID NO: 439417 - RNA, 16 nt, Homo sapiens
ccagaagcuccgugag

SEQ ID NO: 439418 - RNA, 15 nt, Homo sapiens
ccagaagcugggaaa

SEQ ID NO: 439419 - RNA, 23 nt, Homo sapiens
ccagaaggagggcagagccaugg

SEQ ID NO: 439420 - RNA, 17 nt, Homo sapiens
ccagaagggggccauga

SEQ ID NO: 439421 - RNA, 23 nt, Homo sapiens
ccagaaguuuuaacuuccagugg

SEQ ID NO: 439422 - RNA, 12 nt, Homo sapiens
ccagaauuuccc

SEQ ID NO: 439423 - RNA, 13 nt, Homo sapiens
ccagacaaaugga

SEQ ID NO: 439424 - RNA, 23 nt, Homo sapiens
ccagacagcaacggggaggccaa

SEQ ID NO: 439425 - RNA, 17 nt, Homo sapiens
ccauggcuaaggcacca

SEQ ID NO: 439426 - RNA, 22 nt, Homo sapiens
ccaugggauuuuaucuguggau

SEQ ID NO: 439427 - RNA, 15 nt, Homo sapiens
ccaugguaauguaac

SEQ ID NO: 439428 - RNA, 13 nt, Homo sapiens
ccauggugcagug

SEQ ID NO: 439429 - RNA, 21 nt, Homo sapiens
ccaugucuuuggacaaccaug

SEQ ID NO: 439430 - RNA, 23 nt, Homo sapiens
ccauguggcugaagacauuccaa

SEQ ID NO: 439431 - RNA, 16 nt, Homo sapiens
ccaugugugagugugu

SEQ ID NO: 439432 - RNA, 20 nt, Homo sapiens
ccaugugugugcaagugugu

SEQ ID NO: 439433 - RNA, 23 nt, Homo sapiens
ccaugugugugcaagugugugca

SEQ ID NO: 439434 - RNA, 22 nt, Homo sapiens
ccauguuauuuauaguguugcu

SEQ ID NO: 439435 - RNA, 21 nt, Homo sapiens
ccauguuuaaguguacuggau

SEQ ID NO: 439436 - RNA, 19 nt, Homo sapiens
ccauuaacaaugaccuuua

SEQ ID NO: 439437 - RNA, 20 nt, Homo sapiens
ccauuaaccagggcaccaag

SEQ ID NO: 439438 - RNA, 13 nt, Homo sapiens
ccauuacuguaau

SEQ ID NO: 439439 - RNA, 17 nt, Homo sapiens
ccauuagcccacugccu

SEQ ID NO: 439440 - RNA, 15 nt, Homo sapiens
ccauuauaaaaucuu

SEQ ID NO: 439441 - RNA, 11 nt, Homo sapiens
ccauucugcuu

SEQ ID NO: 439442 - RNA, 13 nt, Homo sapiens
ccauugagacuau

SEQ ID NO: 439443 - RNA, 22 nt, Homo sapiens
ccauugcaaaagguuaagccau

SEQ ID NO: 439444 - RNA, 22 nt, Homo sapiens
ccauuggaauaauaaauuugau

SEQ ID NO: 439445 - RNA, 13 nt, Homo sapiens
ccauuggugcaca

SEQ ID NO: 439446 - RNA, 14 nt, Homo sapiens
ccauuuaccuggaa

SEQ ID NO: 439447 - RNA, 22 nt, Homo sapiens
ccauuuauaauguuaguagaaa

SEQ ID NO: 439448 - RNA, 12 nt, Homo sapiens
ccauuugaagca

SEQ ID NO: 439449 - RNA, 13 nt, Homo sapiens
ccauuuguaauaa

SEQ ID NO: 439450 - RNA, 13 nt, Homo sapiens
ccauuuguaaugu

SEQ ID NO: 439451 - RNA, 14 nt, Homo sapiens
ccauuugugauacu

SEQ ID NO: 439452 - RNA, 13 nt, Homo sapiens
ccauuuugaaaua

SEQ ID NO: 439453 - RNA, 14 nt, Homo sapiens
cccaaaggcaucca

SEQ ID NO: 439454 - RNA, 15 nt, Homo sapiens
cccaaaggcauccau

SEQ ID NO: 439455 - RNA, 18 nt, Homo sapiens
cccaacacaaggugggca

SEQ ID NO: 439456 - RNA, 13 nt, Homo sapiens
cccaacccauuca

SEQ ID NO: 439457 - RNA, 11 nt, Homo sapiens
cccaaccuccc

SEQ ID NO: 439458 - RNA, 21 nt, Homo sapiens
cccaaggaaaauggacauauu

SEQ ID NO: 439459 - RNA, 17 nt, Homo sapiens
cccaaggcaguguuccu

SEQ ID NO: 439460 - RNA, 21 nt, Homo sapiens
cccaauaaaguccucuucccu

SEQ ID NO: 439461 - RNA, 22 nt, Homo sapiens
cccacacgcccuccccagacuc

SEQ ID NO: 439462 - RNA, 15 nt, Homo sapiens
cccacagugcucagu

SEQ ID NO: 439463 - RNA, 15 nt, Homo sapiens
cccacauccaguggg

SEQ ID NO: 439464 - RNA, 21 nt, Homo sapiens
cccaccaacucugcacuccau

SEQ ID NO: 439465 - RNA, 14 nt, Homo sapiens
cccaccaccugucc

SEQ ID NO: 439466 - RNA, 18 nt, Homo sapiens
cccaccagagugaugugu

SEQ ID NO: 439467 - RNA, 12 nt, Homo sapiens
cccaccagucuc

SEQ ID NO: 439468 - RNA, 17 nt, Homo sapiens
cccacccgggagcagug

SEQ ID NO: 439469 - RNA, 15 nt, Homo sapiens
cccacccgucuucaa

SEQ ID NO: 439470 - RNA, 18 nt, Homo sapiens
cccacccuccucaagaag

SEQ ID NO: 439471 - RNA, 21 nt, Homo sapiens
cccacccugggaucucaggag

SEQ ID NO: 439472 - RNA, 23 nt, Homo sapiens
cccaccucccgguguaugcagug

SEQ ID NO: 439473 - RNA, 23 nt, Homo sapiens
cccacuaagcuuucuccuuugag

SEQ ID NO: 439474 - RNA, 10 nt, Homo sapiens
cccacugcac

SEQ ID NO: 439475 - RNA, 20 nt, Homo sapiens
cccacuggcugguuccagaa

SEQ ID NO: 439476 - RNA, 19 nt, Homo sapiens
cccacuuaugcugcuguga

SEQ ID NO: 439477 - RNA, 12 nt, Homo sapiens
cccacuucaggg

SEQ ID NO: 439478 - RNA, 11 nt, Homo sapiens
cccacuugaag

SEQ ID NO: 439479 - RNA, 18 nt, Homo sapiens
cccagaaccccaacuccc

SEQ ID NO: 439480 - RNA, 22 nt, Homo sapiens
cccagaaccuuuuuauagguug

SEQ ID NO: 439481 - RNA, 15 nt, Homo sapiens
cccagaaggaccucc

SEQ ID NO: 439482 - RNA, 14 nt, Homo sapiens
cccagaagguugug

SEQ ID NO: 439483 - RNA, 16 nt, Homo sapiens
cccagaauuugcugca

SEQ ID NO: 439484 - RNA, 14 nt, Homo sapiens
cccagacaaggaga

SEQ ID NO: 439485 - RNA, 16 nt, Homo sapiens
cccagaccugagcucc

SEQ ID NO: 439486 - RNA, 21 nt, Homo sapiens
cccagaggaugucacaaagau

SEQ ID NO: 439487 - RNA, 19 nt, Homo sapiens
cccagaggcagagguugug

SEQ ID NO: 439488 - RNA, 19 nt, Homo sapiens
cccagaguuuucagggagu

SEQ ID NO: 439489 - RNA, 15 nt, Homo sapiens
cccagaucugguccc

SEQ ID NO: 439490 - RNA, 13 nt, Homo sapiens
cccagaugcucuc

SEQ ID NO: 439491 - RNA, 14 nt, Homo sapiens
cccagcacacggcu

SEQ ID NO: 439492 - RNA, 12 nt, Homo sapiens
cccagcacccag

SEQ ID NO: 439493 - RNA, 15 nt, Homo sapiens
cccagcagacuugag

SEQ ID NO: 439494 - RNA, 14 nt, Homo sapiens
cccagcauguugag

SEQ ID NO: 439495 - RNA, 24 nt, Homo sapiens
cccagccacaguggccaaagaggc

SEQ ID NO: 439496 - RNA, 15 nt, Homo sapiens
cccagccacgugucu

SEQ ID NO: 439497 - RNA, 23 nt, Homo sapiens
cccagcccaaccgggaaaggcau

SEQ ID NO: 439498 - RNA, 13 nt, Homo sapiens
cccagcccaauaa

SEQ ID NO: 439499 - RNA, 18 nt, Homo sapiens
cccagccucccaaagugc

SEQ ID NO: 439500 - RNA, 19 nt, Homo sapiens
cccagccucccccaggcug

SEQ ID NO: 439501 - RNA, 21 nt, Homo sapiens
cccagcuaucuauauggaauu

SEQ ID NO: 439502 - RNA, 20 nt, Homo sapiens
cccagcucaggggcagcuca

SEQ ID NO: 439503 - RNA, 17 nt, Homo sapiens
cccagcuccccaagaaa

SEQ ID NO: 439504 - RNA, 18 nt, Homo sapiens
cccagcugggcucugcca

SEQ ID NO: 439505 - RNA, 22 nt, Homo sapiens
cccagcugugacugagggccug

SEQ ID NO: 439506 - RNA, 14 nt, Homo sapiens
cccaggaggaccug

SEQ ID NO: 439507 - RNA, 23 nt, Homo sapiens
cccaggaggucgaccccaaagcc

SEQ ID NO: 439508 - RNA, 14 nt, Homo sapiens
cccaggcagcaccu

SEQ ID NO: 439509 - RNA, 21 nt, Homo sapiens
cccaggcccuaggauuccucc

SEQ ID NO: 439510 - RNA, 19 nt, Homo sapiens
cccaggccgggguggagca

SEQ ID NO: 439511 - RNA, 14 nt, Homo sapiens
cccaggcugcacug

SEQ ID NO: 439512 - RNA, 20 nt, Homo sapiens
cccaggcuggagcgcagugg

SEQ ID NO: 439513 - RNA, 18 nt, Homo sapiens
cccaggcuggagggcagu

SEQ ID NO: 439514 - RNA, 19 nt, Homo sapiens
cccaggcuggagugcagua

SEQ ID NO: 439515 - RNA, 22 nt, Homo sapiens
cccaggcuucacccugaauggu

SEQ ID NO: 439516 - RNA, 18 nt, Homo sapiens
cccagggagaggccauga

SEQ ID NO: 439517 - RNA, 20 nt, Homo sapiens
cccagggccugggggcagug

SEQ ID NO: 439518 - RNA, 13 nt, Homo sapiens
cccagggcuaccc

SEQ ID NO: 439519 - RNA, 19 nt, Homo sapiens
cccagggcugugaaggcag

SEQ ID NO: 439520 - RNA, 15 nt, Homo sapiens
cccagguaccacccu

SEQ ID NO: 439521 - RNA, 18 nt, Homo sapiens
cccaggucagcuguuacu

SEQ ID NO: 439522 - RNA, 20 nt, Homo sapiens
cccaggugggaccugacaua

SEQ ID NO: 439523 - RNA, 18 nt, Homo sapiens
cccaguaacugcaccaac

SEQ ID NO: 439524 - RNA, 13 nt, Homo sapiens
cccaguagccauu

SEQ ID NO: 439525 - RNA, 23 nt, Homo sapiens
cccaguauucuagguagugcccu

SEQ ID NO: 439526 - RNA, 13 nt, Homo sapiens
cccaguauucuca

SEQ ID NO: 439527 - RNA, 16 nt, Homo sapiens
cccagucucccaccuu

SEQ ID NO: 439528 - RNA, 22 nt, Homo sapiens
cccaguucugaauaacuugaag

SEQ ID NO: 439529 - RNA, 20 nt, Homo sapiens
cccaguuguugguuuggcca

SEQ ID NO: 439530 - RNA, 17 nt, Homo sapiens
cccauaucugugaaaug

SEQ ID NO: 439531 - RNA, 12 nt, Homo sapiens
cccaucaucucu

SEQ ID NO: 439532 - RNA, 21 nt, Homo sapiens
cccauccaauggauugugcaa

SEQ ID NO: 439533 - RNA, 15 nt, Homo sapiens
cccauccccaccagc

SEQ ID NO: 439534 - RNA, 16 nt, Homo sapiens
cccauccccaccagcu

SEQ ID NO: 439535 - RNA, 15 nt, Homo sapiens
cccaucgcuggaaaa

SEQ ID NO: 439536 - RNA, 22 nt, Homo sapiens
cccaugaccuugacgugugugg

SEQ ID NO: 439537 - RNA, 21 nt, Homo sapiens
cccaugguagacugugacaca

SEQ ID NO: 439538 - RNA, 21 nt, Homo sapiens
cccauuacuuuaauacucacc

SEQ ID NO: 439539 - RNA, 18 nt, Homo sapiens
cccauuccucccuccggc

SEQ ID NO: 439540 - RNA, 12 nt, Homo sapiens
cccauucuugca

SEQ ID NO: 439541 - RNA, 13 nt, Homo sapiens
cccauugucucau

SEQ ID NO: 439542 - RNA, 9 nt, Homo sapiens
cccauuucu

SEQ ID NO: 439543 - RNA, 20 nt, Homo sapiens
cccauuugcacagguuuuca

SEQ ID NO: 439544 - RNA, 16 nt, Homo sapiens
ccccaaagcaauguga

SEQ ID NO: 439545 - RNA, 19 nt, Homo sapiens
ccccaaaucuacugagcca

SEQ ID NO: 439546 - RNA, 12 nt, Homo sapiens
ccccaaccugcu

SEQ ID NO: 439547 - RNA, 12 nt, Homo sapiens
ccccaacuugag

SEQ ID NO: 439548 - RNA, 20 nt, Homo sapiens
ccccacacaggccuggccca

SEQ ID NO: 439549 - RNA, 20 nt, Homo sapiens
ccccacccaguuucuggaaa

SEQ ID NO: 439550 - RNA, 22 nt, Homo sapiens
cugcuuuagcuuuccaauaugc

SEQ ID NO: 439551 - RNA, 14 nt, Homo sapiens
cugcuuucuuguug

SEQ ID NO: 439552 - RNA, 17 nt, Homo sapiens
cugcuuucuuguugcug

SEQ ID NO: 439553 - RNA, 18 nt, Homo sapiens
cugcuuugagaaaucuca

SEQ ID NO: 439554 - RNA, 21 nt, Homo sapiens
cugcuuugccaaauaaaguua

SEQ ID NO: 439555 - RNA, 21 nt, Homo sapiens
cugcuuuuuuuuuuccagcaa

SEQ ID NO: 439556 - RNA, 20 nt, Homo sapiens
cuggaaaccacacuucuuga

SEQ ID NO: 439557 - RNA, 14 nt, Homo sapiens
cuggaaaccagaau

SEQ ID NO: 439558 - RNA, 17 nt, Homo sapiens
gaagcccuccuugccac

SEQ ID NO: 439559 - RNA, 18 nt, Homo sapiens
gaagcccuccuugccacc

SEQ ID NO: 439560 - RNA, 21 nt, Homo sapiens
gaagcccucugagcuccagag

SEQ ID NO: 439561 - RNA, 14 nt, Homo sapiens
gaagccugcugauu

SEQ ID NO: 439562 - RNA, 12 nt, Homo sapiens
gaagccuguccu

SEQ ID NO: 439563 - RNA, 16 nt, Homo sapiens
gaagccuguccucacc

SEQ ID NO: 439564 - RNA, 22 nt, Homo sapiens
gaagccuguccucaccgucucg

SEQ ID NO: 439565 - RNA, 15 nt, Homo sapiens
gaagccuuaagccau

SEQ ID NO: 439566 - RNA, 18 nt, Homo sapiens
gaagccuugcugaacuaa

SEQ ID NO: 439567 - RNA, 21 nt, Homo sapiens
gaagcuaauguaggacuguau

SEQ ID NO: 439568 - RNA, 22 nt, Homo sapiens
gaagcuccugggggaugcucua

SEQ ID NO: 439569 - RNA, 15 nt, Homo sapiens
gaagcucugugugua

SEQ ID NO: 439570 - RNA, 13 nt, Homo sapiens
gaagcugaucuga

SEQ ID NO: 439571 - RNA, 17 nt, Homo sapiens
gaagcuggagugcugcu

SEQ ID NO: 439572 - RNA, 18 nt, Homo sapiens
gaagcuggagugcugcuu

SEQ ID NO: 439573 - RNA, 11 nt, Homo sapiens
gaagcugugcg

SEQ ID NO: 439574 - RNA, 15 nt, Homo sapiens
gaagcuuccauucca

SEQ ID NO: 439575 - RNA, 13 nt, Homo sapiens
gaagcuucuugcu

SEQ ID NO: 439576 - RNA, 21 nt, Homo sapiens
gaaggagaguccccugaaggu

SEQ ID NO: 439577 - RNA, 12 nt, Homo sapiens
gaaggagccugc

SEQ ID NO: 439578 - RNA, 13 nt, Homo sapiens
gaaggagugugca

SEQ ID NO: 439579 - RNA, 12 nt, Homo sapiens
gaaggcaaauga

SEQ ID NO: 439580 - RNA, 16 nt, Homo sapiens
gaaggcagcuagacac

SEQ ID NO: 439581 - RNA, 11 nt, Homo sapiens
gaaggcagcug

SEQ ID NO: 439582 - RNA, 22 nt, Homo sapiens
gaaggccuugcugucaugugaa

SEQ ID NO: 439583 - RNA, 12 nt, Homo sapiens
gaaggcuuucag

SEQ ID NO: 439584 - RNA, 15 nt, Homo sapiens
gaagggaauugcuca

SEQ ID NO: 439585 - RNA, 10 nt, Homo sapiens
gaagggccag

SEQ ID NO: 439586 - RNA, 18 nt, Homo sapiens
gaagggccccacucaggg

SEQ ID NO: 439587 - RNA, 16 nt, Homo sapiens
gaagggccccuugcaa

SEQ ID NO: 439588 - RNA, 22 nt, Homo sapiens
gaagggccuucuccacagggac

SEQ ID NO: 439589 - RNA, 17 nt, Homo sapiens
gaaggggcgugucccuc

SEQ ID NO: 439590 - RNA, 22 nt, Homo sapiens
gaaggucaucaauaaaggggaa

SEQ ID NO: 439591 - RNA, 15 nt, Homo sapiens
gaaggucccucagac

SEQ ID NO: 439592 - RNA, 19 nt, Homo sapiens
gaaggugaaagugcaguuc

SEQ ID NO: 439593 - RNA, 18 nt, Homo sapiens
gaaggugacucugaccuu

SEQ ID NO: 439594 - RNA, 18 nt, Homo sapiens
gaagguggggauugccca

SEQ ID NO: 439595 - RNA, 13 nt, Homo sapiens
gaagguucuggua

SEQ ID NO: 439596 - RNA, 21 nt, Homo sapiens
gaagguuggaacugcugccau

SEQ ID NO: 439597 - RNA, 13 nt, Homo sapiens
gaaguacuucccu

SEQ ID NO: 439598 - RNA, 16 nt, Homo sapiens
gaaguccaguguuucc

SEQ ID NO: 439599 - RNA, 17 nt, Homo sapiens
gaagucuaagagugaag

SEQ ID NO: 439600 - RNA, 20 nt, Homo sapiens
gaagucugcuuaccaaaaca

SEQ ID NO: 439601 - RNA, 22 nt, Homo sapiens
gaagucuucauggucucuucca

SEQ ID NO: 439602 - RNA, 16 nt, Homo sapiens
gaagugacaagaugcu

SEQ ID NO: 439603 - RNA, 13 nt, Homo sapiens
gaagugacaggac

SEQ ID NO: 439604 - RNA, 16 nt, Homo sapiens
gaagugccaugcucag

SEQ ID NO: 439605 - RNA, 15 nt, Homo sapiens
gaaguggcagugaaa

SEQ ID NO: 439606 - RNA, 23 nt, Homo sapiens
gaagugguguuuagaaugucagu

SEQ ID NO: 439607 - RNA, 19 nt, Homo sapiens
gaagugguuuaaaccaaac

SEQ ID NO: 439608 - RNA, 18 nt, Homo sapiens
gaaguuaacagucucauu

SEQ ID NO: 439609 - RNA, 19 nt, Homo sapiens
gaaguuccaguguucucuc

SEQ ID NO: 439610 - RNA, 15 nt, Homo sapiens
gaaguugcugagaaa

SEQ ID NO: 439611 - RNA, 21 nt, Homo sapiens
gaaguuuagauuuuaaucaaa

SEQ ID NO: 439612 - RNA, 12 nt, Homo sapiens
gaauaaagccac

SEQ ID NO: 439613 - RNA, 16 nt, Homo sapiens
gaauaaagcccuugaa

SEQ ID NO: 439614 - RNA, 12 nt, Homo sapiens
gaauaaagccuc

SEQ ID NO: 439615 - RNA, 16 nt, Homo sapiens
gaauaaaguccaaagu

SEQ ID NO: 439616 - RNA, 17 nt, Homo sapiens
gaauaaauugcuccuug

SEQ ID NO: 439617 - RNA, 12 nt, Homo sapiens
gaauaaccacuu

SEQ ID NO: 439618 - RNA, 13 nt, Homo sapiens
gaauaacuugaag

SEQ ID NO: 439619 - RNA, 23 nt, Homo sapiens
gaauaagcucuaguucuuaacaa

SEQ ID NO: 439620 - RNA, 12 nt, Homo sapiens
gaauaaugcugu

SEQ ID NO: 439621 - RNA, 15 nt, Homo sapiens
gaauaaugcuguuuu

SEQ ID NO: 439622 - RNA, 15 nt, Homo sapiens
gaauaauuguguaca

SEQ ID NO: 439623 - RNA, 19 nt, Homo sapiens
gaauacugaguauguggaa

SEQ ID NO: 439624 - RNA, 21 nt, Homo sapiens
gaauaugauaaaacacugccc

SEQ ID NO: 439625 - RNA, 21 nt, Homo sapiens
gaauauggaacauaugcacag

SEQ ID NO: 439626 - RNA, 21 nt, Homo sapiens
gaauauugcuuuggucauaug

SEQ ID NO: 439627 - RNA, 18 nt, Homo sapiens
gaauauuuauuaccucug

SEQ ID NO: 439628 - RNA, 19 nt, Homo sapiens
gaaucacuugacuuugcca

SEQ ID NO: 439629 - RNA, 22 nt, Homo sapiens
gaauccaguccagauauuucac

SEQ ID NO: 439630 - RNA, 19 nt, Homo sapiens
gaaucggcauguauacuua

SEQ ID NO: 439631 - RNA, 13 nt, Homo sapiens
gaaucuacagaac

SEQ ID NO: 439632 - RNA, 14 nt, Homo sapiens
gaaucuacagaaca

SEQ ID NO: 439633 - RNA, 14 nt, Homo sapiens
gaaucucagcacuu

SEQ ID NO: 439634 - RNA, 23 nt, Homo sapiens
gaaucucccagacuuguuuccug

SEQ ID NO: 439635 - RNA, 12 nt, Homo sapiens
gacacaguauug

SEQ ID NO: 439636 - RNA, 16 nt, Homo sapiens
gacacaguauugacuu

SEQ ID NO: 439637 - RNA, 13 nt, Homo sapiens
gacaccaccaagg

SEQ ID NO: 439638 - RNA, 19 nt, Homo sapiens
gacaccagcccugcugcuu

SEQ ID NO: 439639 - RNA, 18 nt, Homo sapiens
gacaccccugcucuaccc

SEQ ID NO: 439640 - RNA, 20 nt, Homo sapiens
gacacucuagugacuuccug

SEQ ID NO: 439641 - RNA, 16 nt, Homo sapiens
gacacugaaccuuguu

SEQ ID NO: 439642 - RNA, 20 nt, Homo sapiens
gacacugcgaacucucagga

SEQ ID NO: 439643 - RNA, 18 nt, Homo sapiens
gacacugcugaaccuuuc

SEQ ID NO: 439644 - RNA, 20 nt, Homo sapiens
gacacuguggaaagcuuuga

SEQ ID NO: 439645 - RNA, 22 nt, Homo sapiens
gacacugugguugcaaaaccca

SEQ ID NO: 439646 - RNA, 23 nt, Homo sapiens
gacacuucaaugggagugaacau

SEQ ID NO: 439647 - RNA, 19 nt, Homo sapiens
gacacuuuggaaguuugug

SEQ ID NO: 439648 - RNA, 14 nt, Homo sapiens
gacagaaaaccuca

SEQ ID NO: 439649 - RNA, 18 nt, Homo sapiens
gacagaaaaccucaaggg

SEQ ID NO: 439650 - RNA, 15 nt, Homo sapiens
gacagaaauaugauu

SEQ ID NO: 439651 - RNA, 15 nt, Homo sapiens
gacagacacguguga

SEQ ID NO: 439652 - RNA, 22 nt, Homo sapiens
gacagaucccauccaucagcuc

SEQ ID NO: 439653 - RNA, 17 nt, Homo sapiens
gacagaugaaugccgug

SEQ ID NO: 439654 - RNA, 14 nt, Homo sapiens
gacagcagccuccc

SEQ ID NO: 439655 - RNA, 20 nt, Homo sapiens
gacagcugcuucugugcauu

SEQ ID NO: 439656 - RNA, 18 nt, Homo sapiens
gacagcuguuccacaggg

SEQ ID NO: 439657 - RNA, 21 nt, Homo sapiens
gacaggacagcauggugcaug

SEQ ID NO: 439658 - RNA, 20 nt, Homo sapiens
gacagucucaagcacuaaaa

SEQ ID NO: 439659 - RNA, 14 nt, Homo sapiens
gacagugccuggga

SEQ ID NO: 439660 - RNA, 16 nt, Homo sapiens
gacaguggaugcugcu

SEQ ID NO: 439661 - RNA, 15 nt, Homo sapiens
gacaguguuuugcca

SEQ ID NO: 439662 - RNA, 21 nt, Homo sapiens
gacaguuaagagaaaugagcu

SEQ ID NO: 439663 - RNA, 21 nt, Homo sapiens
gacaguuacucuucaguuuua

SEQ ID NO: 439664 - RNA, 21 nt, Homo sapiens
gacauacugcauguaagccaa

SEQ ID NO: 439665 - RNA, 16 nt, Homo sapiens
gacauagacugcaaaa

SEQ ID NO: 439666 - RNA, 19 nt, Homo sapiens
gacaucccccuccuugccg

SEQ ID NO: 439667 - RNA, 20 nt, Homo sapiens
gacaucccccuccuugccgc

SEQ ID NO: 439668 - RNA, 14 nt, Homo sapiens
gacauccucaaaag

SEQ ID NO: 439669 - RNA, 23 nt, Homo sapiens
gacauccucugcuaccaucucau

SEQ ID NO: 439670 - RNA, 20 nt, Homo sapiens
gacauccugagcagugccag

SEQ ID NO: 439671 - RNA, 20 nt, Homo sapiens
gacaucgcuggaaaugaaua

SEQ ID NO: 439672 - RNA, 16 nt, Homo sapiens
gacaucuagucucagu

SEQ ID NO: 439673 - RNA, 24 nt, Homo sapiens
gacaugaucgcuuucuacacugua

SEQ ID NO: 439674 - RNA, 21 nt, Homo sapiens
gacaugcgggcugggcagcug

SEQ ID NO: 439675 - RNA, 16 nt, Homo sapiens
gacauucaaggcauuu

SEQ ID NO: 439676 - RNA, 22 nt, Homo sapiens
gacauucaccaacaacagucag

SEQ ID NO: 439677 - RNA, 11 nt, Homo sapiens
gacauucacuc

SEQ ID NO: 439678 - RNA, 21 nt, Homo sapiens
gacauuggauguggagcuccu

SEQ ID NO: 439679 - RNA, 22 nt, Homo sapiens
gacauuuauccaagaccugaaa

SEQ ID NO: 439680 - RNA, 20 nt, Homo sapiens
gacauuugggacugucuuga

SEQ ID NO: 439681 - RNA, 19 nt, Homo sapiens
gaccaaaauaauacaacaa

SEQ ID NO: 439682 - RNA, 15 nt, Homo sapiens
gaccaacugggccca

SEQ ID NO: 439683 - RNA, 16 nt, Homo sapiens
gaccaauccuauguca

SEQ ID NO: 439684 - RNA, 13 nt, Homo sapiens
gaccaaugugaag

SEQ ID NO: 439685 - RNA, 14 nt, Homo sapiens
gaccacaccaagga

SEQ ID NO: 439686 - RNA, 12 nt, Homo sapiens
gaccacaccacu

SEQ ID NO: 439687 - RNA, 22 nt, Homo sapiens
gaccaccucucaauauucaaua

SEQ ID NO: 439688 - RNA, 17 nt, Homo sapiens
gaccacuguuaucaaaa

SEQ ID NO: 439689 - RNA, 15 nt, Homo sapiens
gaccaguacugggaa

SEQ ID NO: 439690 - RNA, 22 nt, Homo sapiens
gaccaguccuguuugcagggaa

SEQ ID NO: 439691 - RNA, 19 nt, Homo sapiens
gaccaguuguugauaacca

SEQ ID NO: 439692 - RNA, 23 nt, Homo sapiens
gaccauaaaggcauggcauuugu

SEQ ID NO: 439693 - RNA, 19 nt, Homo sapiens
gacccacaaacugccuguu

SEQ ID NO: 439694 - RNA, 14 nt, Homo sapiens
gacccaccccaacu

SEQ ID NO: 439695 - RNA, 15 nt, Homo sapiens
gacccagcucuucuc

SEQ ID NO: 439696 - RNA, 20 nt, Homo sapiens
gaccccagcuuuucuugcca

SEQ ID NO: 439697 - RNA, 20 nt, Homo sapiens
gaccccucaccuugcaacac

SEQ ID NO: 439698 - RNA, 15 nt, Homo sapiens
gaccccugaccucac

SEQ ID NO: 439699 - RNA, 16 nt, Homo sapiens
gacccuagccagagaa

SEQ ID NO: 439700 - RNA, 18 nt, Homo sapiens
gacccucggggcaggaag

SEQ ID NO: 439701 - RNA, 20 nt, Homo sapiens
gacccucugacccuagcucu

SEQ ID NO: 439702 - RNA, 21 nt, Homo sapiens
gacccugggagagugagguca

SEQ ID NO: 439703 - RNA, 23 nt, Homo sapiens
gacuuacuaugggauggggucca

SEQ ID NO: 439704 - RNA, 17 nt, Homo sapiens
gacuuaguugcguuaca

SEQ ID NO: 439705 - RNA, 19 nt, Homo sapiens
gacuucagaguacauccau

SEQ ID NO: 439706 - RNA, 20 nt, Homo sapiens
gacuucaugacaagcauuuu

SEQ ID NO: 439707 - RNA, 17 nt, Homo sapiens
gacuucauuuuuccuaa

SEQ ID NO: 439708 - RNA, 13 nt, Homo sapiens
gacuucgaaaaca

SEQ ID NO: 439709 - RNA, 14 nt, Homo sapiens
gacuucuagcagaa

SEQ ID NO: 439710 - RNA, 23 nt, Homo sapiens
gacuucuccuccaguggaccuga

SEQ ID NO: 439711 - RNA, 14 nt, Homo sapiens
gacuucugcaucuu

SEQ ID NO: 439712 - RNA, 17 nt, Homo sapiens
gacuucugcaucuuaca

SEQ ID NO: 439713 - RNA, 12 nt, Homo sapiens
gacuugaugaau

SEQ ID NO: 439714 - RNA, 23 nt, Homo sapiens
gacuugaugaauaaacacuuuuu

SEQ ID NO: 439715 - RNA, 12 nt, Homo sapiens
gacuuggcagua

SEQ ID NO: 439716 - RNA, 22 nt, Homo sapiens
gacuuguuucuuucugucucuc

SEQ ID NO: 439717 - RNA, 14 nt, Homo sapiens
gacuuuaaaguaua

SEQ ID NO: 439718 - RNA, 15 nt, Homo sapiens
gacuuuagaaauaaa

SEQ ID NO: 439719 - RNA, 23 nt, Homo sapiens
gacuuuagaaauaaauguaccug

SEQ ID NO: 439720 - RNA, 16 nt, Homo sapiens
gacuuucuccaaaggc

SEQ ID NO: 439721 - RNA, 15 nt, Homo sapiens
gacuuugaagaccag

SEQ ID NO: 439722 - RNA, 16 nt, Homo sapiens
gacuuuuauuaugggu

SEQ ID NO: 439723 - RNA, 19 nt, Homo sapiens
gagaaaacaggcucacaga

SEQ ID NO: 439724 - RNA, 22 nt, Homo sapiens
gagaaaccuuauuguaccucuc

SEQ ID NO: 439725 - RNA, 21 nt, Homo sapiens
gagaaacuuugaucucugcuu

SEQ ID NO: 439726 - RNA, 14 nt, Homo sapiens
gagaaaggauggca

SEQ ID NO: 439727 - RNA, 16 nt, Homo sapiens
gagaaauaaagcacau

SEQ ID NO: 439728 - RNA, 15 nt, Homo sapiens
gagaaauacuuucag

SEQ ID NO: 439729 - RNA, 12 nt, Homo sapiens
gagaaaugagcu

SEQ ID NO: 439730 - RNA, 14 nt, Homo sapiens
gagaacaaccaaaa

SEQ ID NO: 439731 - RNA, 14 nt, Homo sapiens
gagaacacuagaca

SEQ ID NO: 439732 - RNA, 16 nt, Homo sapiens
gagaacagggaugcua

SEQ ID NO: 439733 - RNA, 14 nt, Homo sapiens
gagaacaugcauac

SEQ ID NO: 439734 - RNA, 19 nt, Homo sapiens
gagaagaacacaucaggca

SEQ ID NO: 439735 - RNA, 19 nt, Homo sapiens
gagaagaaggaagaucuug

SEQ ID NO: 439736 - RNA, 20 nt, Homo sapiens
gagaagcauauagaggcaag

SEQ ID NO: 439737 - RNA, 16 nt, Homo sapiens
gagaagccucauggga

SEQ ID NO: 439738 - RNA, 17 nt, Homo sapiens
gagaagcucucgaggga

SEQ ID NO: 439739 - RNA, 20 nt, Homo sapiens
gagaaggacagcucuucccc

SEQ ID NO: 439740 - RNA, 20 nt, Homo sapiens
gagaaguuggucuuacuuug

SEQ ID NO: 439741 - RNA, 19 nt, Homo sapiens
gagaaugccagcccaaagc

SEQ ID NO: 439742 - RNA, 12 nt, Homo sapiens
gagaaugugcag

SEQ ID NO: 439743 - RNA, 21 nt, Homo sapiens
gagacaaaaucuuaaaugcca

SEQ ID NO: 439744 - RNA, 13 nt, Homo sapiens
gagacaaagcagg

SEQ ID NO: 439745 - RNA, 14 nt, Homo sapiens
gagacacaucuccu

SEQ ID NO: 439746 - RNA, 22 nt, Homo sapiens
gagacacccuaacucuugcuca

SEQ ID NO: 439747 - RNA, 13 nt, Homo sapiens
gagacagaagcag

SEQ ID NO: 439748 - RNA, 12 nt, Homo sapiens
gagacagucuca

SEQ ID NO: 439749 - RNA, 18 nt, Homo sapiens
gagacaguugguuuugca

SEQ ID NO: 439750 - RNA, 21 nt, Homo sapiens
gagaccaacuacgacuggcau

SEQ ID NO: 439751 - RNA, 18 nt, Homo sapiens
gagacccccgugccaaau

SEQ ID NO: 439752 - RNA, 11 nt, Homo sapiens
gagacuaggau

SEQ ID NO: 439753 - RNA, 18 nt, Homo sapiens
gagacuccugauugcucu

SEQ ID NO: 439754 - RNA, 15 nt, Homo sapiens
gagacucugucucag

SEQ ID NO: 439755 - RNA, 17 nt, Homo sapiens
gagacuggauacugccc

SEQ ID NO: 439756 - RNA, 17 nt, Homo sapiens
gagacuuuacauggaug

SEQ ID NO: 439757 - RNA, 14 nt, Homo sapiens
gagagaaucucaag

SEQ ID NO: 439758 - RNA, 17 nt, Homo sapiens
gagagacucacacugga

SEQ ID NO: 439759 - RNA, 14 nt, Homo sapiens
gagagagaugcugc

SEQ ID NO: 439760 - RNA, 18 nt, Homo sapiens
gagagagccuuggccuga

SEQ ID NO: 439761 - RNA, 14 nt, Homo sapiens
gagagagugccaug

SEQ ID NO: 439762 - RNA, 14 nt, Homo sapiens
gagagauggaauaa

SEQ ID NO: 439763 - RNA, 20 nt, Homo sapiens
gagagauguauggucuugcc

SEQ ID NO: 439764 - RNA, 22 nt, Homo sapiens
gagagcaaucuugcugugaaac

SEQ ID NO: 439765 - RNA, 17 nt, Homo sapiens
gagagcaucugcucuga

SEQ ID NO: 439766 - RNA, 22 nt, Homo sapiens
gagagcccccaccuugauccca

SEQ ID NO: 439767 - RNA, 22 nt, Homo sapiens
gagagcccggcgccccugccac

SEQ ID NO: 439768 - RNA, 14 nt, Homo sapiens
gauagcugacucau

SEQ ID NO: 439769 - RNA, 14 nt, Homo sapiens
gauaggagcuucca

SEQ ID NO: 439770 - RNA, 23 nt, Homo sapiens
gauagucagcuguaccaagcccc

SEQ ID NO: 439771 - RNA, 20 nt, Homo sapiens
gauauaacacuauguuuauu

SEQ ID NO: 439772 - RNA, 18 nt, Homo sapiens
gauauaucuuuauacuua

SEQ ID NO: 439773 - RNA, 22 nt, Homo sapiens
gauaucacagaggccuauaacu

SEQ ID NO: 439774 - RNA, 17 nt, Homo sapiens
gauaucccuaugcugcc

SEQ ID NO: 439775 - RNA, 20 nt, Homo sapiens
gauaucuguuagaugcuacu

SEQ ID NO: 439776 - RNA, 12 nt, Homo sapiens
gauaucuuggcu

SEQ ID NO: 439777 - RNA, 23 nt, Homo sapiens
gauaugucuuggccacuauggac

SEQ ID NO: 439778 - RNA, 14 nt, Homo sapiens
gauauucuuuacaa

SEQ ID NO: 439779 - RNA, 21 nt, Homo sapiens
gauauuguggguaacgugaga

SEQ ID NO: 439780 - RNA, 15 nt, Homo sapiens
gauauuuuaugcaaa

SEQ ID NO: 439781 - RNA, 21 nt, Homo sapiens
gaucaaaauaaaaagugacac

SEQ ID NO: 439782 - RNA, 15 nt, Homo sapiens
gaucaacucauguua

SEQ ID NO: 439783 - RNA, 14 nt, Homo sapiens
gaucaagcuccauc

SEQ ID NO: 439784 - RNA, 18 nt, Homo sapiens
gaucacuuuaugucucac

SEQ ID NO: 439785 - RNA, 15 nt, Homo sapiens
gaucagaucuuacaa

SEQ ID NO: 439786 - RNA, 12 nt, Homo sapiens
gaucagcuggug

SEQ ID NO: 439787 - RNA, 19 nt, Homo sapiens
gaucaugaaucacugcacc

SEQ ID NO: 439788 - RNA, 22 nt, Homo sapiens
gaucauuaaagccugaguuugc

SEQ ID NO: 439789 - RNA, 18 nt, Homo sapiens
gaucauucucaguaucca

SEQ ID NO: 439790 - RNA, 19 nt, Homo sapiens
gauccagauccagacugua

SEQ ID NO: 439791 - RNA, 14 nt, Homo sapiens
gauccaguggacac

SEQ ID NO: 439792 - RNA, 12 nt, Homo sapiens
gauccucacccg

SEQ ID NO: 439793 - RNA, 20 nt, Homo sapiens
gauccucacccgaaucuccu

SEQ ID NO: 439794 - RNA, 16 nt, Homo sapiens
gauccucccucauggc

SEQ ID NO: 439795 - RNA, 13 nt, Homo sapiens
gauccugcacucu

SEQ ID NO: 439796 - RNA, 20 nt, Homo sapiens
gauccuucaaagagucauau

SEQ ID NO: 439797 - RNA, 19 nt, Homo sapiens
gaucuaagccuuuccauaa

SEQ ID NO: 439798 - RNA, 20 nt, Homo sapiens
gaucuaagccuuuccauaag

SEQ ID NO: 439799 - RNA, 20 nt, Homo sapiens
gaucuaauauugacugccuc

SEQ ID NO: 439800 - RNA, 13 nt, Homo sapiens
gaucuaguucuca

SEQ ID NO: 439801 - RNA, 22 nt, Homo sapiens
gaucuaguucucaaucacugcu

SEQ ID NO: 439802 - RNA, 21 nt, Homo sapiens
gaucuauuacucugacauaaa

SEQ ID NO: 439803 - RNA, 21 nt, Homo sapiens
gaucucaauuugcaguauuca

SEQ ID NO: 439804 - RNA, 17 nt, Homo sapiens
gaucuccauauguuaca

SEQ ID NO: 439805 - RNA, 21 nt, Homo sapiens
gaucuccugguagcaugaccu

SEQ ID NO: 439806 - RNA, 19 nt, Homo sapiens
gaucuggggaaggaccaac

SEQ ID NO: 439807 - RNA, 16 nt, Homo sapiens
gaucuuaaagcauucc

SEQ ID NO: 439808 - RNA, 17 nt, Homo sapiens
gaucuuggggugcagca

SEQ ID NO: 439809 - RNA, 19 nt, Homo sapiens
gaucuuggggugcagcacu

SEQ ID NO: 439810 - RNA, 20 nt, Homo sapiens
gaucuuggggugcagcacuu

SEQ ID NO: 439811 - RNA, 15 nt, Homo sapiens
gaucuuugacucuuu

SEQ ID NO: 439812 - RNA, 17 nt, Homo sapiens
gaucuuugcccauggaa

SEQ ID NO: 439813 - RNA, 19 nt, Homo sapiens
gaugaaaaaauaacacugu

SEQ ID NO: 439814 - RNA, 16 nt, Homo sapiens
gaugaaaaaugguccc

SEQ ID NO: 439815 - RNA, 23 nt, Homo sapiens
gaugaaauaacuccuucuuguag

SEQ ID NO: 439816 - RNA, 16 nt, Homo sapiens
gaugaaauugccaaaa

SEQ ID NO: 439817 - RNA, 20 nt, Homo sapiens
gaugaaauuuucuagacuuu

SEQ ID NO: 439818 - RNA, 16 nt, Homo sapiens
gaugaacaucuuuuaa

SEQ ID NO: 439819 - RNA, 12 nt, Homo sapiens
gaugacaaagaa

SEQ ID NO: 439820 - RNA, 16 nt, Homo sapiens
gaugacagaaauauga

SEQ ID NO: 439821 - RNA, 20 nt, Homo sapiens
gauuguccagugcaaccaca

SEQ ID NO: 439822 - RNA, 15 nt, Homo sapiens
gauuguuucugguga

SEQ ID NO: 439823 - RNA, 14 nt, Homo sapiens
gauuuaagguuuca

SEQ ID NO: 439824 - RNA, 14 nt, Homo sapiens
gauuuacucauuau

SEQ ID NO: 439825 - RNA, 21 nt, Homo sapiens
gauuuagaaaaaaguuuacaa

SEQ ID NO: 439826 - RNA, 23 nt, Homo sapiens
gauuuauauuuuaaagcuuggug

SEQ ID NO: 439827 - RNA, 21 nt, Homo sapiens
gauuuaucacacaaagcagaa

SEQ ID NO: 439828 - RNA, 15 nt, Homo sapiens
gauuucacugacacu

SEQ ID NO: 439829 - RNA, 15 nt, Homo sapiens
gauuucaugauuuca

SEQ ID NO: 439830 - RNA, 16 nt, Homo sapiens
gauuucuuccugcaga

SEQ ID NO: 439831 - RNA, 18 nt, Homo sapiens
gauuucuucgcugcucua

SEQ ID NO: 439832 - RNA, 23 nt, Homo sapiens
gauuugagggacgaggucaagga

SEQ ID NO: 439833 - RNA, 20 nt, Homo sapiens
gauuuguaguuugucccauu

SEQ ID NO: 439834 - RNA, 15 nt, Homo sapiens
gauuuuaacaauaac

SEQ ID NO: 439835 - RNA, 16 nt, Homo sapiens
gauuuuaucugugaau

SEQ ID NO: 439836 - RNA, 21 nt, Homo sapiens
gauuuuuauuuucuucuuugg

SEQ ID NO: 439837 - RNA, 23 nt, Homo sapiens
gauuuuuuuuuuaaaacuaucca

SEQ ID NO: 439838 - RNA, 15 nt, Homo sapiens
gcaaaacugcaaauu

SEQ ID NO: 439839 - RNA, 19 nt, Homo sapiens
gcaaaagaggauguucacc

SEQ ID NO: 439840 - RNA, 19 nt, Homo sapiens
gcaaaauuuuuuuaaucuu

SEQ ID NO: 439841 - RNA, 23 nt, Homo sapiens
gcaaacagcccuaaauaaaucua

SEQ ID NO: 439842 - RNA, 17 nt, Homo sapiens
gcaaacaguucuuggac

SEQ ID NO: 439843 - RNA, 17 nt, Homo sapiens
gcaaacuuuguauuaau

SEQ ID NO: 439844 - RNA, 17 nt, Homo sapiens
gcaaagaaaacacacaa

SEQ ID NO: 439845 - RNA, 16 nt, Homo sapiens
gcaaagagaaaagcca

SEQ ID NO: 439846 - RNA, 20 nt, Homo sapiens
gcaaagcaacgacuacuuug

SEQ ID NO: 439847 - RNA, 22 nt, Homo sapiens
gcaaagccuagccugcauauca

SEQ ID NO: 439848 - RNA, 12 nt, Homo sapiens
gcaaagucuaaa

SEQ ID NO: 439849 - RNA, 22 nt, Homo sapiens
gcaaagucuaaaguuuacagua

SEQ ID NO: 439850 - RNA, 22 nt, Homo sapiens
gcaaagugaagacacuggcuca

SEQ ID NO: 439851 - RNA, 19 nt, Homo sapiens
gcaaaucuaugagauuuug

SEQ ID NO: 439852 - RNA, 16 nt, Homo sapiens
gcaaaugacaaaaagc

SEQ ID NO: 439853 - RNA, 12 nt, Homo sapiens
gcaaaugaugcc

SEQ ID NO: 439854 - RNA, 23 nt, Homo sapiens
gcaaauuuuagcguuaaagucag

SEQ ID NO: 439855 - RNA, 16 nt, Homo sapiens
gcaacaggaacuguga

SEQ ID NO: 439856 - RNA, 21 nt, Homo sapiens
gcaacguguaacuugugcuuu

SEQ ID NO: 439857 - RNA, 15 nt, Homo sapiens
gcaacuuagcucaca

SEQ ID NO: 439858 - RNA, 18 nt, Homo sapiens
gcaagaaccaguguuuag

SEQ ID NO: 439859 - RNA, 21 nt, Homo sapiens
gcaagaccaaaaugacaauga

SEQ ID NO: 439860 - RNA, 18 nt, Homo sapiens
gcaagacuguugcucaaa

SEQ ID NO: 439861 - RNA, 22 nt, Homo sapiens
gcaagauccccgccacccgggg

SEQ ID NO: 439862 - RNA, 15 nt, Homo sapiens
gcaagcacaucugca

SEQ ID NO: 439863 - RNA, 15 nt, Homo sapiens
gcaagcguuauuuug

SEQ ID NO: 439864 - RNA, 16 nt, Homo sapiens
gcaaggccugugcugc

SEQ ID NO: 439865 - RNA, 18 nt, Homo sapiens
gcaagggaaugaauccau

SEQ ID NO: 439866 - RNA, 19 nt, Homo sapiens
gcaagguggguuccaggga

SEQ ID NO: 439867 - RNA, 19 nt, Homo sapiens
gcaagucccaugauuucuu

SEQ ID NO: 439868 - RNA, 22 nt, Homo sapiens
gcaagugauugaaaauaguaaa

SEQ ID NO: 439869 - RNA, 23 nt, Homo sapiens
gcaaguguaugcacgugugcaca

SEQ ID NO: 439870 - RNA, 19 nt, Homo sapiens
gugccccaugccuguccag

SEQ ID NO: 439871 - RNA, 23 nt, Homo sapiens
gugccuccucuggggaagggaac

SEQ ID NO: 439872 - RNA, 16 nt, Homo sapiens
gugccucuuauuacag

SEQ ID NO: 439873 - RNA, 16 nt, Homo sapiens
gugccucuugggagac

SEQ ID NO: 439874 - RNA, 18 nt, Homo sapiens
gugccuguacaagcugau

SEQ ID NO: 439875 - RNA, 17 nt, Homo sapiens
gugccugucacuacugg

SEQ ID NO: 439876 - RNA, 12 nt, Homo sapiens
gugccugugauc

SEQ ID NO: 439877 - RNA, 20 nt, Homo sapiens
gugccuucucacaucugucc

SEQ ID NO: 439878 - RNA, 12 nt, Homo sapiens
gugccuucugcc

SEQ ID NO: 439879 - RNA, 13 nt, Homo sapiens
gugcgugucucug

SEQ ID NO: 439880 - RNA, 16 nt, Homo sapiens
gugcgugugugcaagu

SEQ ID NO: 439881 - RNA, 15 nt, Homo sapiens
gugcuaaaaggaaua

SEQ ID NO: 439882 - RNA, 21 nt, Homo sapiens
gugcuaugaauuuucaaguaa

SEQ ID NO: 439883 - RNA, 15 nt, Homo sapiens
gugcuggucauacau

SEQ ID NO: 439884 - RNA, 21 nt, Homo sapiens
gugcuuaagcagaagcauuaa

SEQ ID NO: 439885 - RNA, 14 nt, Homo sapiens
gugcuuguucuucc

SEQ ID NO: 439886 - RNA, 12 nt, Homo sapiens
guggacaccugc

SEQ ID NO: 439887 - RNA, 14 nt, Homo sapiens
guggaccaugggga

SEQ ID NO: 439888 - RNA, 18 nt, Homo sapiens
guggagaauguacacagu

SEQ ID NO: 439889 - RNA, 16 nt, Homo sapiens
guggagcugcuuccag

SEQ ID NO: 439890 - RNA, 15 nt, Homo sapiens
guggaucaagcuugu

SEQ ID NO: 439891 - RNA, 23 nt, Homo sapiens
guggauuauaaauuucuuucaua

SEQ ID NO: 439892 - RNA, 15 nt, Homo sapiens
guggauucaugucca

SEQ ID NO: 439893 - RNA, 15 nt, Homo sapiens
guggcagcucaaaau

SEQ ID NO: 439894 - RNA, 21 nt, Homo sapiens
guggcagcuggggagcagcug

SEQ ID NO: 439895 - RNA, 21 nt, Homo sapiens
guggccuaauuuacaagcacg

SEQ ID NO: 439896 - RNA, 16 nt, Homo sapiens
guggccuguuucugca

SEQ ID NO: 439897 - RNA, 18 nt, Homo sapiens
guggcuaauucaauuuau

SEQ ID NO: 439898 - RNA, 17 nt, Homo sapiens
guggcuccuaucugugu

SEQ ID NO: 439899 - RNA, 20 nt, Homo sapiens
guggcuugguuuggucaugc

SEQ ID NO: 439900 - RNA, 23 nt, Homo sapiens
gugggacuccaggccagcuccuu

SEQ ID NO: 439901 - RNA, 15 nt, Homo sapiens
gugggagaaggacua

SEQ ID NO: 439902 - RNA, 15 nt, Homo sapiens
gugggagaucuucac

SEQ ID NO: 439903 - RNA, 22 nt, Homo sapiens
gugggagcuuuugguaugugac

SEQ ID NO: 439904 - RNA, 23 nt, Homo sapiens
guucuuucaaugcugacuggacu

SEQ ID NO: 439905 - RNA, 19 nt, Homo sapiens
guucuuuugauacauuuau

SEQ ID NO: 439906 - RNA, 14 nt, Homo sapiens
guugaagacuuugu

SEQ ID NO: 439907 - RNA, 19 nt, Homo sapiens
guugacuggcuuuccucuc

SEQ ID NO: 439908 - RNA, 18 nt, Homo sapiens
guugaugucgaugcucac

SEQ ID NO: 439909 - RNA, 19 nt, Homo sapiens
guugcaguuaauucuugcc

SEQ ID NO: 439910 - RNA, 15 nt, Homo sapiens
guugccacacuuuca

SEQ ID NO: 439911 - RNA, 14 nt, Homo sapiens
guugccacaggaca

SEQ ID NO: 439912 - RNA, 18 nt, Homo sapiens
guugccagguugcagcug

SEQ ID NO: 439913 - RNA, 13 nt, Homo sapiens
guugcccugccau

SEQ ID NO: 439914 - RNA, 20 nt, Homo sapiens
guugcuaaugccaggccagu

SEQ ID NO: 439915 - RNA, 16 nt, Homo sapiens
guugcuuauugggagu

SEQ ID NO: 439916 - RNA, 16 nt, Homo sapiens
guuggccccucugcug

SEQ ID NO: 439917 - RNA, 15 nt, Homo sapiens
guuggcgacugucau

SEQ ID NO: 439918 - RNA, 19 nt, Homo sapiens
guugguuaccuauugcugu

SEQ ID NO: 439919 - RNA, 22 nt, Homo sapiens
guugguuuggccacucuugacc

SEQ ID NO: 439920 - RNA, 20 nt, Homo sapiens
guuguagcagguuucacuau

SEQ ID NO: 439921 - RNA, 19 nt, Homo sapiens
guugucucuagagcaggga

SEQ ID NO: 439922 - RNA, 17 nt, Homo sapiens
guugugucuugcuauac

SEQ ID NO: 439923 - RNA, 19 nt, Homo sapiens
guuguuaaugaaaauguca

SEQ ID NO: 439924 - RNA, 20 nt, Homo sapiens
guuuaauuguaggucaauga

SEQ ID NO: 439925 - RNA, 15 nt, Homo sapiens
guuuacagcacuacu

SEQ ID NO: 439926 - RNA, 21 nt, Homo sapiens
guuuaccucacuggugcauuu

SEQ ID NO: 439927 - RNA, 18 nt, Homo sapiens
guuuagaaucaagucugu

SEQ ID NO: 439928 - RNA, 20 nt, Homo sapiens
guuuagaaucaagucuguga

SEQ ID NO: 439929 - RNA, 18 nt, Homo sapiens
guuuagccaaaggauaag

SEQ ID NO: 439930 - RNA, 18 nt, Homo sapiens
guuuagcuuccuccagag

SEQ ID NO: 439931 - RNA, 17 nt, Homo sapiens
guuuagugugauuguga

SEQ ID NO: 439932 - RNA, 17 nt, Homo sapiens
guuuaguugcagacuca

SEQ ID NO: 439933 - RNA, 20 nt, Homo sapiens
guuuauccaaaucuugaauu

SEQ ID NO: 439934 - RNA, 20 nt, Homo sapiens
guuuauguaagagcaccuuc

SEQ ID NO: 439935 - RNA, 19 nt, Homo sapiens
guuuauuuaucagugacag

SEQ ID NO: 439936 - RNA, 18 nt, Homo sapiens
guuucaaaauguuaacaa

SEQ ID NO: 439937 - RNA, 22 nt, Homo sapiens
guuucaacuguaaaauacuucu

SEQ ID NO: 439938 - RNA, 18 nt, Homo sapiens
guuucacaaacuacaaag

SEQ ID NO: 439939 - RNA, 13 nt, Homo sapiens
guuucacauauuu

SEQ ID NO: 439940 - RNA, 19 nt, Homo sapiens
guuucaccauguuggccag

SEQ ID NO: 439941 - RNA, 14 nt, Homo sapiens
guuucacuguucau

SEQ ID NO: 439942 - RNA, 16 nt, Homo sapiens
guuucagaaguacugg

SEQ ID NO: 439943 - RNA, 21 nt, Homo sapiens
guuucauaggagacacaucca

SEQ ID NO: 439944 - RNA, 20 nt, Homo sapiens
guuucauggguuauguguau

SEQ ID NO: 439945 - RNA, 24 nt, Homo sapiens
guuuccauaggaaucauguuggau

SEQ ID NO: 439946 - RNA, 19 nt, Homo sapiens
guuuccaucagguuccauc

SEQ ID NO: 439947 - RNA, 17 nt, Homo sapiens
guuucccauaauuuucu

SEQ ID NO: 439948 - RNA, 16 nt, Homo sapiens
guuuccucauuccuga

SEQ ID NO: 439949 - RNA, 16 nt, Homo sapiens
guuucuacauucucua

SEQ ID NO: 439950 - RNA, 20 nt, Homo sapiens
guuucuagcuagaaauauga

SEQ ID NO: 439951 - RNA, 23 nt, Homo sapiens
guuucugaaaaauaaaaguauaa

SEQ ID NO: 439952 - RNA, 19 nt, Homo sapiens
guuucuugaaguccagugu

SEQ ID NO: 439953 - RNA, 10 nt, Homo sapiens
guuucuugcc

SEQ ID NO: 439954 - RNA, 23 nt, Homo sapiens
guuucuuguaacuggguucaaaa

SEQ ID NO: 439955 - RNA, 14 nt, Homo sapiens
guuucuuuggccag

SEQ ID NO: 439956 - RNA, 16 nt, Homo sapiens
guuucuuuuauguggu

SEQ ID NO: 439957 - RNA, 15 nt, Homo sapiens
guuugaacucuguaa

SEQ ID NO: 439958 - RNA, 14 nt, Homo sapiens
guuugaccaucacc

SEQ ID NO: 439959 - RNA, 14 nt, Homo sapiens
guuugcgcuaaaaa

SEQ ID NO: 439960 - RNA, 21 nt, Homo sapiens
guuuggacuuuuauuuuggca

SEQ ID NO: 439961 - RNA, 14 nt, Homo sapiens
guuugucaaaaagu

SEQ ID NO: 439962 - RNA, 16 nt, Homo sapiens
guuugucagacuuuaa

SEQ ID NO: 439963 - RNA, 17 nt, Homo sapiens
guuuguuauaucaggga

SEQ ID NO: 439964 - RNA, 16 nt, Homo sapiens
guuuguucugcagaga

SEQ ID NO: 439965 - RNA, 22 nt, Homo sapiens
guuuguugaugugaaacauuau

SEQ ID NO: 439966 - RNA, 15 nt, Homo sapiens
guuuuaaacauucuu

SEQ ID NO: 439967 - RNA, 14 nt, Homo sapiens
guuuuaauuccaau

SEQ ID NO: 439968 - RNA, 20 nt, Homo sapiens
guuuuacagagcuaauuguc

SEQ ID NO: 439969 - RNA, 18 nt, Homo sapiens
guuuuaguuuugggauau

SEQ ID NO: 439970 - RNA, 17 nt, Homo sapiens
guuuuauaaaagccuug

SEQ ID NO: 439971 - RNA, 17 nt, Homo sapiens
guuuucauggugaaaau

SEQ ID NO: 439972 - RNA, 21 nt, Homo sapiens
guuuucccugaccucccucua

SEQ ID NO: 439973 - RNA, 19 nt, Homo sapiens
guuuuccuaaaugcaguga

SEQ ID NO: 439974 - RNA, 15 nt, Homo sapiens
guuuucuagaauuua

SEQ ID NO: 439975 - RNA, 20 nt, Homo sapiens
guuuucuguaaauaaccuau

SEQ ID NO: 439976 - RNA, 17 nt, Homo sapiens
guuuucugugagaauaa

SEQ ID NO: 439977 - RNA, 14 nt, Homo sapiens
guuuucugugcacu

SEQ ID NO: 439978 - RNA, 23 nt, Homo sapiens
guuuucugugcacuguagccuua

SEQ ID NO: 439979 - RNA, 16 nt, Homo sapiens
guuuucuugccaauga

SEQ ID NO: 439980 - RNA, 18 nt, Homo sapiens
guuuucuuuucugugguu

SEQ ID NO: 439981 - RNA, 19 nt, Homo sapiens
guuuuggggacucauuuca

SEQ ID NO: 439982 - RNA, 14 nt, Homo sapiens
guuuugugugguau

SEQ ID NO: 439983 - RNA, 16 nt, Homo sapiens
guuuuguuugaaaaag

SEQ ID NO: 439984 - RNA, 15 nt, Homo sapiens
guuuuuaagcuguuu

SEQ ID NO: 439985 - RNA, 16 nt, Homo sapiens
guuuuuaaguacucac

SEQ ID NO: 439986 - RNA, 17 nt, Homo sapiens
guuuuuacuaaguaaaa

SEQ ID NO: 439987 - RNA, 15 nt, Homo sapiens
guuuuuggauggcuu

SEQ ID NO: 439988 - RNA, 21 nt, Homo sapiens
guuuuuggcucuuucagagag

SEQ ID NO: 439989 - RNA, 20 nt, Homo sapiens
uaaaaaacuccugucuugcu

SEQ ID NO: 439990 - RNA, 19 nt, Homo sapiens
uaaaaaagaaaacauucca

SEQ ID NO: 439991 - RNA, 17 nt, Homo sapiens
uaaaaacacuaccucuu

SEQ ID NO: 439992 - RNA, 23 nt, Homo sapiens
uaaaaacccuguauggcacuuau

SEQ ID NO: 439993 - RNA, 13 nt, Homo sapiens
uaaaaaggccuuu

SEQ ID NO: 439994 - RNA, 14 nt, Homo sapiens
uaaaaaggccuuug

SEQ ID NO: 439995 - RNA, 19 nt, Homo sapiens
uaaaaagugacacagcagc

SEQ ID NO: 439996 - RNA, 21 nt, Homo sapiens
uaaaaauauaaacaauguuca

SEQ ID NO: 439997 - RNA, 16 nt, Homo sapiens
uaaaaauaugugagca

SEQ ID NO: 439998 - RNA, 19 nt, Homo sapiens
uaaaaaucauugauuguca

SEQ ID NO: 439999 - RNA, 17 nt, Homo sapiens
uaaaaauguccugccuu

SEQ ID NO: 440000 - RNA, 23 nt, Homo sapiens
uaaaaauugugaucagaccauaa

SEQ ID NO: 440001 - RNA, 23 nt, Homo sapiens
uaaaacaaaaucugaacucucaa

SEQ ID NO: 440002 - RNA, 22 nt, Homo sapiens
uaaaacaaucuguaauugcuua

SEQ ID NO: 440003 - RNA, 14 nt, Homo sapiens
uaaaacacaacauc

SEQ ID NO: 440004 - RNA, 15 nt, Homo sapiens
aaaaaauacaguauu

SEQ ID NO: 440005 - RNA, 17 nt, Homo sapiens
aaaaaauuaauacugaa

SEQ ID NO: 440006 - RNA, 14 nt, Homo sapiens
aaaaacaaauggga

SEQ ID NO: 440007 - RNA, 16 nt, Homo sapiens
aaaaacaccuaaguga

SEQ ID NO: 440008 - RNA, 22 nt, Homo sapiens
aaaaacagcaggggcauuaguu

SEQ ID NO: 440009 - RNA, 13 nt, Homo sapiens
aaaaacauuugua

SEQ ID NO: 440010 - RNA, 14 nt, Homo sapiens
aaaaaccacagaua

SEQ ID NO: 440011 - RNA, 17 nt, Homo sapiens
aaaaaccccaaacuguu

SEQ ID NO: 440012 - RNA, 12 nt, Homo sapiens
aaaaacuauucu

SEQ ID NO: 440013 - RNA, 17 nt, Homo sapiens
aaaaagaagagguucau

SEQ ID NO: 440014 - RNA, 15 nt, Homo sapiens
aaaaagaaucugcau

SEQ ID NO: 440015 - RNA, 19 nt, Homo sapiens
aaaaagaccuaugagcaca

SEQ ID NO: 440016 - RNA, 18 nt, Homo sapiens
aaaaaggccuuugggauu

SEQ ID NO: 440017 - RNA, 12 nt, Homo sapiens
aaaaaguuuaca

SEQ ID NO: 440018 - RNA, 15 nt, Homo sapiens
aaaaauaaacucugc

SEQ ID NO: 440019 - RNA, 15 nt, Homo sapiens
aaaaauaaaguacgu

SEQ ID NO: 440020 - RNA, 18 nt, Homo sapiens
aaaaauaauaaccauggc

SEQ ID NO: 440021 - RNA, 16 nt, Homo sapiens
aaaaauaguggccaga

SEQ ID NO: 440022 - RNA, 20 nt, Homo sapiens
aaaaauaguguguccaugca

SEQ ID NO: 440023 - RNA, 23 nt, Homo sapiens
aaaaauauauuuaaugauaagua

SEQ ID NO: 440024 - RNA, 17 nt, Homo sapiens
aaaaauauguagcaaug

SEQ ID NO: 440025 - RNA, 12 nt, Homo sapiens
aaaaauauguga

SEQ ID NO: 440026 - RNA, 13 nt, Homo sapiens
aaaaaucuagaca

SEQ ID NO: 440027 - RNA, 22 nt, Homo sapiens
aaaaaucuugugcuagaauacu

SEQ ID NO: 440028 - RNA, 18 nt, Homo sapiens
aaaaaugaagacacucaa

SEQ ID NO: 440029 - RNA, 12 nt, Homo sapiens
aaaaaugacaga

SEQ ID NO: 440030 - RNA, 15 nt, Homo sapiens
aaaaaugcaugauaa

SEQ ID NO: 440031 - RNA, 18 nt, Homo sapiens
aaaaaugcccauuugccu

SEQ ID NO: 440032 - RNA, 22 nt, Homo sapiens
aaaaaugcuugcuucaacccca

SEQ ID NO: 440033 - RNA, 14 nt, Homo sapiens
aaaaauuagcugug

SEQ ID NO: 440034 - RNA, 18 nt, Homo sapiens
aaaaauuuaagcauuguu

SEQ ID NO: 440035 - RNA, 20 nt, Homo sapiens
aaaacaaagaaauaaugguc

SEQ ID NO: 440036 - RNA, 20 nt, Homo sapiens
aaaacaaaugggaaaauguc

SEQ ID NO: 440037 - RNA, 20 nt, Homo sapiens
aaaacaacuucaauauccaa

SEQ ID NO: 440038 - RNA, 22 nt, Homo sapiens
aaaacaauuugcauaauacuaa

SEQ ID NO: 440039 - RNA, 18 nt, Homo sapiens
aaaacacugcccucuugu

SEQ ID NO: 440040 - RNA, 15 nt, Homo sapiens
aaaacagucgaucaa

SEQ ID NO: 440041 - RNA, 14 nt, Homo sapiens
aaaacauacauuau

SEQ ID NO: 440042 - RNA, 20 nt, Homo sapiens
aaaacauagaguagaccuga

SEQ ID NO: 440043 - RNA, 20 nt, Homo sapiens
aaaacaucuuuccaguccuu

SEQ ID NO: 440044 - RNA, 11 nt, Homo sapiens
aaaacauucac

SEQ ID NO: 440045 - RNA, 19 nt, Homo sapiens
aaaacauucuuuaacauac

SEQ ID NO: 440046 - RNA, 23 nt, Homo sapiens
aaaaccacuaugcaaagaacuca

SEQ ID NO: 440047 - RNA, 19 nt, Homo sapiens
aaaaccagaaguuucuaca

SEQ ID NO: 440048 - RNA, 23 nt, Homo sapiens
aaaaccauuauaaaaucuuucca

SEQ ID NO: 440049 - RNA, 21 nt, Homo sapiens
aaaaccucaagggcuuuccca

SEQ ID NO: 440050 - RNA, 21 nt, Homo sapiens
aaaaccuugaaaccuuugaca

SEQ ID NO: 440051 - RNA, 20 nt, Homo sapiens
aaaacgcuuaggccaugaug

SEQ ID NO: 440052 - RNA, 15 nt, Homo sapiens
aaaacuccugucuug

SEQ ID NO: 440053 - RNA, 11 nt, Homo sapiens
aaaacugccug

SEQ ID NO: 440054 - RNA, 13 nt, Homo sapiens
aaaacugccuguu

SEQ ID NO: 440055 - RNA, 21 nt, Homo sapiens
aaaacuuccacuaccuuuaaa

SEQ ID NO: 440056 - RNA, 17 nt, Homo sapiens
aaaagaaaggguucugu

SEQ ID NO: 440057 - RNA, 16 nt, Homo sapiens
aaaagaaauucuguua

SEQ ID NO: 440058 - RNA, 17 nt, Homo sapiens
aaaagaacaacugccaa

SEQ ID NO: 440059 - RNA, 13 nt, Homo sapiens
aaaagaacuguau

SEQ ID NO: 440060 - RNA, 16 nt, Homo sapiens
aaaagacauucuucca

SEQ ID NO: 440061 - RNA, 13 nt, Homo sapiens
aaaagaccuauga

SEQ ID NO: 440062 - RNA, 12 nt, Homo sapiens
aaaagaguaugu

SEQ ID NO: 440063 - RNA, 15 nt, Homo sapiens
aaaagaguauguagu

SEQ ID NO: 440064 - RNA, 14 nt, Homo sapiens
aaaagcaacuuucc

SEQ ID NO: 440065 - RNA, 11 nt, Homo sapiens
aaaagcacuua

SEQ ID NO: 440066 - RNA, 19 nt, Homo sapiens
aaaagccuuacggucauga

SEQ ID NO: 440067 - RNA, 16 nt, Homo sapiens
aaaagccuuuuccaga

SEQ ID NO: 440068 - RNA, 23 nt, Homo sapiens
aaaagcuucauucucacucugcu

SEQ ID NO: 440069 - RNA, 20 nt, Homo sapiens
aaaaggacucugcuucaguc

SEQ ID NO: 440070 - RNA, 22 nt, Homo sapiens
aaaaggacucugcuucagucca

SEQ ID NO: 440071 - RNA, 23 nt, Homo sapiens
aaaaggauaugcaguaugcuuaa

SEQ ID NO: 440072 - RNA, 19 nt, Homo sapiens
aaaagggaaaaaagcaacu

SEQ ID NO: 440073 - RNA, 20 nt, Homo sapiens
aaaagggagaacauggccaa

SEQ ID NO: 440074 - RNA, 20 nt, Homo sapiens
aaaagggcagggcaucuccu

SEQ ID NO: 440075 - RNA, 24 nt, Homo sapiens
aaaagguauuuugaauaccauuaa

SEQ ID NO: 440076 - RNA, 15 nt, Homo sapiens
aaaaguccugucacc

SEQ ID NO: 440077 - RNA, 15 nt, Homo sapiens
aaaagucuaccaccg

SEQ ID NO: 440078 - RNA, 21 nt, Homo sapiens
aaaagucugcauuacauuccu

SEQ ID NO: 440079 - RNA, 21 nt, Homo sapiens
aaaaguggcuaauucaauuua

SEQ ID NO: 440080 - RNA, 12 nt, Homo sapiens
aaaagugggcca

SEQ ID NO: 440081 - RNA, 20 nt, Homo sapiens
aaaaguuaagugucauuucu

SEQ ID NO: 440082 - RNA, 15 nt, Homo sapiens
aaaaguuaugguacu

SEQ ID NO: 440083 - RNA, 16 nt, Homo sapiens
aaaaguuuacagauca

SEQ ID NO: 440084 - RNA, 16 nt, Homo sapiens
aaaaguuuugaugaaa

SEQ ID NO: 440085 - RNA, 15 nt, Homo sapiens
aaaauaaccaguuaa

SEQ ID NO: 440086 - RNA, 12 nt, Homo sapiens
aaaauaaggaac

SEQ ID NO: 440087 - RNA, 13 nt, Homo sapiens
aaaauacaauuca

SEQ ID NO: 440088 - RNA, 18 nt, Homo sapiens
aaaauacagcacuuugac

SEQ ID NO: 440089 - RNA, 21 nt, Homo sapiens
aaaauacaguauucuguacca

SEQ ID NO: 440090 - RNA, 21 nt, Homo sapiens
aaaauaccaaggaacaggaaa

SEQ ID NO: 440091 - RNA, 20 nt, Homo sapiens
aaaauaccuuuguaacggcu

SEQ ID NO: 440092 - RNA, 17 nt, Homo sapiens
aaaauacuauuggacag

SEQ ID NO: 440093 - RNA, 18 nt, Homo sapiens
aaaauaguaagccucccu

SEQ ID NO: 440094 - RNA, 14 nt, Homo sapiens
aaaauagucuucca

SEQ ID NO: 440095 - RNA, 18 nt, Homo sapiens
aaaauaguuuuacauuaa

SEQ ID NO: 440096 - RNA, 13 nt, Homo sapiens
aaaauauuuuaca

SEQ ID NO: 440097 - RNA, 14 nt, Homo sapiens
aaaaucaauauuuc

SEQ ID NO: 440098 - RNA, 22 nt, Homo sapiens
aaaaucaucuuggccacuuuaa

SEQ ID NO: 440099 - RNA, 21 nt, Homo sapiens
aaaaucauguuuuuaaaugca

SEQ ID NO: 440100 - RNA, 16 nt, Homo sapiens
aaaaugaagacacuca

SEQ ID NO: 440101 - RNA, 14 nt, Homo sapiens
aaaaugaagcccua

SEQ ID NO: 440102 - RNA, 14 nt, Homo sapiens
aaagccacaaggcu

SEQ ID NO: 440103 - RNA, 12 nt, Homo sapiens
aaagccagugac

SEQ ID NO: 440104 - RNA, 15 nt, Homo sapiens
aaagccauaucacca

SEQ ID NO: 440105 - RNA, 23 nt, Homo sapiens
aaagccauauuccagcagugaaa

SEQ ID NO: 440106 - RNA, 19 nt, Homo sapiens
aaagccccucaccucagga

SEQ ID NO: 440107 - RNA, 21 nt, Homo sapiens
aaagccucauuuguguggaaa

SEQ ID NO: 440108 - RNA, 16 nt, Homo sapiens
aaagccucgggccaca

SEQ ID NO: 440109 - RNA, 22 nt, Homo sapiens
aaagccucuggaaaacucagga

SEQ ID NO: 440110 - RNA, 16 nt, Homo sapiens
aaagccuuacggucau

SEQ ID NO: 440111 - RNA, 15 nt, Homo sapiens
aaagccuucaagaug

SEQ ID NO: 440112 - RNA, 19 nt, Homo sapiens
aaagccuugugaucacuuu

SEQ ID NO: 440113 - RNA, 19 nt, Homo sapiens
aaagcgugguggacaugca

SEQ ID NO: 440114 - RNA, 21 nt, Homo sapiens
aaagcgugguggacaugcaca

SEQ ID NO: 440115 - RNA, 16 nt, Homo sapiens
aaagcguuuggaaaac

SEQ ID NO: 440116 - RNA, 23 nt, Homo sapiens
aaagcuaagugaauuuuugcaca

SEQ ID NO: 440117 - RNA, 18 nt, Homo sapiens
aaagcuauauaugaauaa

SEQ ID NO: 440118 - RNA, 18 nt, Homo sapiens
aaagcugauuacugucaa

SEQ ID NO: 440119 - RNA, 22 nt, Homo sapiens
aaagcugauuacugucaauaaa

SEQ ID NO: 440120 - RNA, 11 nt, Homo sapiens
aaagcugccau

SEQ ID NO: 440121 - RNA, 13 nt, Homo sapiens
aaagcugccauuu

SEQ ID NO: 440122 - RNA, 12 nt, Homo sapiens
aaagcugugaaa

SEQ ID NO: 440123 - RNA, 13 nt, Homo sapiens
aaagcuguuccca

SEQ ID NO: 440124 - RNA, 22 nt, Homo sapiens
aaagcuguuucuaaacaguuga

SEQ ID NO: 440125 - RNA, 19 nt, Homo sapiens
aaaggaaaauaguaauguu

SEQ ID NO: 440126 - RNA, 16 nt, Homo sapiens
aaaggacaaaaauaua

SEQ ID NO: 440127 - RNA, 17 nt, Homo sapiens
aaaggacaaacagugaa

SEQ ID NO: 440128 - RNA, 21 nt, Homo sapiens
aaaggacaccuuuuaacucac

SEQ ID NO: 440129 - RNA, 19 nt, Homo sapiens
aaaggacucuugagcccuc

SEQ ID NO: 440130 - RNA, 13 nt, Homo sapiens
aaaggauuugaaa

SEQ ID NO: 440131 - RNA, 22 nt, Homo sapiens
aaaggcagauuaaaagcacaag

SEQ ID NO: 440132 - RNA, 20 nt, Homo sapiens
aaaggcauuucaaagucuca

SEQ ID NO: 440133 - RNA, 14 nt, Homo sapiens
aaaggccuuuggga

SEQ ID NO: 440134 - RNA, 16 nt, Homo sapiens
aaagggccauguuuca

SEQ ID NO: 440135 - RNA, 22 nt, Homo sapiens
aaaggguugggagcugaugaaa

SEQ ID NO: 440136 - RNA, 13 nt, Homo sapiens
aaagguaggugca

SEQ ID NO: 440137 - RNA, 14 nt, Homo sapiens
aaagguauuuucac

SEQ ID NO: 440138 - RNA, 20 nt, Homo sapiens
acaaaggugauuuuccugug

SEQ ID NO: 440139 - RNA, 12 nt, Homo sapiens
acaaauaugcaa

SEQ ID NO: 440140 - RNA, 12 nt, Homo sapiens
acaaaugaacaa

SEQ ID NO: 440141 - RNA, 17 nt, Homo sapiens
acaaauguuagagccau

SEQ ID NO: 440142 - RNA, 16 nt, Homo sapiens
acaacaaacacuguga

SEQ ID NO: 440143 - RNA, 21 nt, Homo sapiens
acaacaaaccuguuucugcag

SEQ ID NO: 440144 - RNA, 13 nt, Homo sapiens
acaacaaagagaa

SEQ ID NO: 440145 - RNA, 22 nt, Homo sapiens
acaacauaaucuaguuuacaga

SEQ ID NO: 440146 - RNA, 19 nt, Homo sapiens
acaaccaauuccaaguuuu

SEQ ID NO: 440147 - RNA, 20 nt, Homo sapiens
acaacgaacauggcauguga

SEQ ID NO: 440148 - RNA, 16 nt, Homo sapiens
acaacuauuuuuccaa

SEQ ID NO: 440149 - RNA, 21 nt, Homo sapiens
acaacuccuuccauccuugac

SEQ ID NO: 440150 - RNA, 18 nt, Homo sapiens
acaacucuagucagcaca

SEQ ID NO: 440151 - RNA, 17 nt, Homo sapiens
acaacugacuaaccauu

SEQ ID NO: 440152 - RNA, 14 nt, Homo sapiens
acaacugacuucca

SEQ ID NO: 440153 - RNA, 16 nt, Homo sapiens
acaacuucaauaucca

SEQ ID NO: 440154 - RNA, 16 nt, Homo sapiens
acaacuucagcaguac

SEQ ID NO: 440155 - RNA, 14 nt, Homo sapiens
acaagaauugcuaa

SEQ ID NO: 440156 - RNA, 18 nt, Homo sapiens
acaagaccccgucucaaa

SEQ ID NO: 440157 - RNA, 22 nt, Homo sapiens
acaagagccauguaccagugua

SEQ ID NO: 440158 - RNA, 13 nt, Homo sapiens
acaagagcuccuu

SEQ ID NO: 440159 - RNA, 14 nt, Homo sapiens
acaagcauuccuua

SEQ ID NO: 440160 - RNA, 16 nt, Homo sapiens
acaagccugaguccag

SEQ ID NO: 440161 - RNA, 16 nt, Homo sapiens
acaagcugccucugac

SEQ ID NO: 440162 - RNA, 13 nt, Homo sapiens
acaaggugacaaa

SEQ ID NO: 440163 - RNA, 19 nt, Homo sapiens
acaagguuggcaccccagc

SEQ ID NO: 440164 - RNA, 16 nt, Homo sapiens
acaaguagauugaucu

SEQ ID NO: 440165 - RNA, 18 nt, Homo sapiens
acaaguagcacacugagu

SEQ ID NO: 440166 - RNA, 13 nt, Homo sapiens
acaauaagccacu

SEQ ID NO: 440167 - RNA, 13 nt, Homo sapiens
acaauacaucuaa

SEQ ID NO: 440168 - RNA, 23 nt, Homo sapiens
acaauacgugaaagaugcaagca

SEQ ID NO: 440169 - RNA, 21 nt, Homo sapiens
acaauaggugcuuauucucaa

SEQ ID NO: 440170 - RNA, 20 nt, Homo sapiens
acaauaucauuuuccuggga

SEQ ID NO: 440171 - RNA, 15 nt, Homo sapiens
acaaucagcugcuuu

SEQ ID NO: 440172 - RNA, 18 nt, Homo sapiens
acaaucaugaaauaugca

SEQ ID NO: 440173 - RNA, 22 nt, Homo sapiens
acaauccuccccaccagucuca

SEQ ID NO: 440174 - RNA, 22 nt, Homo sapiens
acaaugacugcuuuguuuggau

SEQ ID NO: 440175 - RNA, 23 nt, Homo sapiens
acaauggcuggguuugggcagug

SEQ ID NO: 440176 - RNA, 22 nt, Homo sapiens
acaauguggaauuacauaacag

SEQ ID NO: 440177 - RNA, 17 nt, Homo sapiens
acaauguugcacugaaa

SEQ ID NO: 440178 - RNA, 20 nt, Homo sapiens
acaauguuuuaaacauucuu

SEQ ID NO: 440179 - RNA, 13 nt, Homo sapiens
acaauucagucuu

SEQ ID NO: 440180 - RNA, 19 nt, Homo sapiens
acaauuucaaaaugcaugu

SEQ ID NO: 440181 - RNA, 14 nt, Homo sapiens
acaauuugcccaag

SEQ ID NO: 440182 - RNA, 23 nt, Homo sapiens
acaauuuggucuuagcuuuacau

SEQ ID NO: 440183 - RNA, 14 nt, Homo sapiens
acaauuuucauccc

SEQ ID NO: 440184 - RNA, 11 nt, Homo sapiens
acacacacagg

SEQ ID NO: 440185 - RNA, 17 nt, Homo sapiens
acacacagccugugcuu

SEQ ID NO: 440186 - RNA, 13 nt, Homo sapiens
acacacagccuuu

SEQ ID NO: 440187 - RNA, 14 nt, Homo sapiens
acacacagcuucua

SEQ ID NO: 440188 - RNA, 13 nt, Homo sapiens
acacacauccagc

SEQ ID NO: 440189 - RNA, 13 nt, Homo sapiens
acacacucugcau

SEQ ID NO: 440190 - RNA, 17 nt, Homo sapiens
acacagcaugugccaag

SEQ ID NO: 440191 - RNA, 13 nt, Homo sapiens
acacagcuaacaa

SEQ ID NO: 440192 - RNA, 21 nt, Homo sapiens
acacagggcauccaacugaga

SEQ ID NO: 440193 - RNA, 15 nt, Homo sapiens
acacagggcucuuug

SEQ ID NO: 440194 - RNA, 22 nt, Homo sapiens
acacaggggcaaagaacugccc

SEQ ID NO: 440195 - RNA, 20 nt, Homo sapiens
acacagugagaguacucacu

SEQ ID NO: 440196 - RNA, 16 nt, Homo sapiens
acacauaaaucugucu

SEQ ID NO: 440197 - RNA, 18 nt, Homo sapiens
acacauacacacucauac

SEQ ID NO: 440198 - RNA, 14 nt, Homo sapiens
acacauagauucac

SEQ ID NO: 440199 - RNA, 11 nt, Homo sapiens
acacaucucuu

SEQ ID NO: 440200 - RNA, 15 nt, Homo sapiens
acacaugguuuccaa

SEQ ID NO: 440201 - RNA, 17 nt, Homo sapiens
acacauguccaguggga

SEQ ID NO: 440202 - RNA, 21 nt, Homo sapiens
acacauugaaugcgcuuuauu

SEQ ID NO: 440203 - RNA, 16 nt, Homo sapiens
acacauuguacauggu

SEQ ID NO: 440204 - RNA, 14 nt, Homo sapiens
acaccacagaagcu

SEQ ID NO: 440205 - RNA, 18 nt, Homo sapiens
acaccacaggaucugaac

SEQ ID NO: 440206 - RNA, 20 nt, Homo sapiens
acaccacuaaccauccccaa

SEQ ID NO: 440207 - RNA, 17 nt, Homo sapiens
acaccagaagugccaug

SEQ ID NO: 440208 - RNA, 13 nt, Homo sapiens
acaccaggcugug

SEQ ID NO: 440209 - RNA, 13 nt, Homo sapiens
acacccaccucag

SEQ ID NO: 440210 - RNA, 20 nt, Homo sapiens
acacccuaaagcaggcugau

SEQ ID NO: 440211 - RNA, 23 nt, Homo sapiens
acacccuauauuuugcauaguac

SEQ ID NO: 440212 - RNA, 12 nt, Homo sapiens
acacccugcaag

SEQ ID NO: 440213 - RNA, 17 nt, Homo sapiens
acacccuguaccaucca

SEQ ID NO: 440214 - RNA, 13 nt, Homo sapiens
acacccuucccca

SEQ ID NO: 440215 - RNA, 17 nt, Homo sapiens
acaccgauaaccacagg

SEQ ID NO: 440216 - RNA, 20 nt, Homo sapiens
aaugugugggccgcaugcau

SEQ ID NO: 440217 - RNA, 16 nt, Homo sapiens
aauguuaaagaacugc

SEQ ID NO: 440218 - RNA, 18 nt, Homo sapiens
aauguuaauggucaaugc

SEQ ID NO: 440219 - RNA, 18 nt, Homo sapiens
aauguuacauuauuauca

SEQ ID NO: 440220 - RNA, 18 nt, Homo sapiens
aauguuacugaucaugca

SEQ ID NO: 440221 - RNA, 20 nt, Homo sapiens
aauguuagucccuaaccacu

SEQ ID NO: 440222 - RNA, 19 nt, Homo sapiens
aauguuauccaacuauuaa

SEQ ID NO: 440223 - RNA, 20 nt, Homo sapiens
aauguuauccucuugcuaua

SEQ ID NO: 440224 - RNA, 19 nt, Homo sapiens
aauguuauuggaagcugau

SEQ ID NO: 440225 - RNA, 20 nt, Homo sapiens
aauguucauucuaugacaau

SEQ ID NO: 440226 - RNA, 21 nt, Homo sapiens
aauguucauuguaauguuacu

SEQ ID NO: 440227 - RNA, 21 nt, Homo sapiens
aauguuccauucagucugcag

SEQ ID NO: 440228 - RNA, 22 nt, Homo sapiens
aauguugaagaacucaugugau

SEQ ID NO: 440229 - RNA, 20 nt, Homo sapiens
aauguugguuacaugaauga

SEQ ID NO: 440230 - RNA, 15 nt, Homo sapiens
aauguuguccaggaa

SEQ ID NO: 440231 - RNA, 16 nt, Homo sapiens
aauguuguccaggaaa

SEQ ID NO: 440232 - RNA, 14 nt, Homo sapiens
aauguuuacacucu

SEQ ID NO: 440233 - RNA, 22 nt, Homo sapiens
aauguuucccucaagaacaaac

SEQ ID NO: 440234 - RNA, 19 nt, Homo sapiens
aauguuugcccuguucaaa

SEQ ID NO: 440235 - RNA, 18 nt, Homo sapiens
aauuaaaacacuuucaaa

SEQ ID NO: 440236 - RNA, 14 nt, Homo sapiens
aauuaaacaauuua

SEQ ID NO: 440237 - RNA, 13 nt, Homo sapiens
aauuaaacuaaaa

SEQ ID NO: 440238 - RNA, 22 nt, Homo sapiens
aauuaaauucuuauuggccaaa

SEQ ID NO: 440239 - RNA, 22 nt, Homo sapiens
aauuaacuccguuuccaaauac

SEQ ID NO: 440240 - RNA, 15 nt, Homo sapiens
aauuaaggcagcuga

SEQ ID NO: 440241 - RNA, 18 nt, Homo sapiens
aauuaaguccuacuuuac

SEQ ID NO: 440242 - RNA, 15 nt, Homo sapiens
aauuaaugacaacaa

SEQ ID NO: 440243 - RNA, 18 nt, Homo sapiens
aauuacaaccgguuauca

SEQ ID NO: 440244 - RNA, 22 nt, Homo sapiens
aauuacaauacaucuaagcuau

SEQ ID NO: 440245 - RNA, 16 nt, Homo sapiens
aauuacaggaaguacu

SEQ ID NO: 440246 - RNA, 20 nt, Homo sapiens
aauuacuauauucuuacccu

SEQ ID NO: 440247 - RNA, 20 nt, Homo sapiens
aauuacuccaccaucaccuc

SEQ ID NO: 440248 - RNA, 17 nt, Homo sapiens
aauuacuuuuucauucu

SEQ ID NO: 440249 - RNA, 17 nt, Homo sapiens
aauuagaagaaaaugga

SEQ ID NO: 440250 - RNA, 17 nt, Homo sapiens
aauuagacauaccucuc

SEQ ID NO: 440251 - RNA, 19 nt, Homo sapiens
aauuagacauaccucucaa

SEQ ID NO: 440252 - RNA, 17 nt, Homo sapiens
aauuagaggauugcacu

SEQ ID NO: 440253 - RNA, 23 nt, Homo sapiens
aauuagaucgguucugugccuuu

SEQ ID NO: 440254 - RNA, 21 nt, Homo sapiens
aauuagcuuguuacaauucua

SEQ ID NO: 440255 - RNA, 18 nt, Homo sapiens
aauuagggcuacauugua

SEQ ID NO: 440256 - RNA, 14 nt, Homo sapiens
aauuauaagcuaug

SEQ ID NO: 440257 - RNA, 22 nt, Homo sapiens
aauuauacagaccuaauaucau

SEQ ID NO: 440258 - RNA, 22 nt, Homo sapiens
aauuauacuguagcugaugaaa

SEQ ID NO: 440259 - RNA, 17 nt, Homo sapiens
aauuaucaagcuaauaa

SEQ ID NO: 440260 - RNA, 14 nt, Homo sapiens
aauuaucugggcau

SEQ ID NO: 440261 - RNA, 18 nt, Homo sapiens
aauuaugucaaauggaug

SEQ ID NO: 440262 - RNA, 17 nt, Homo sapiens
aauuauuacaucuuuau

SEQ ID NO: 440263 - RNA, 21 nt, Homo sapiens
aauuauuauuuauauauguau

SEQ ID NO: 440264 - RNA, 22 nt, Homo sapiens
aauucaaugaaucaaauccaau

SEQ ID NO: 440265 - RNA, 13 nt, Homo sapiens
aauucagcacuga

SEQ ID NO: 440266 - RNA, 12 nt, Homo sapiens
aauucaguucug

SEQ ID NO: 440267 - RNA, 18 nt, Homo sapiens
aauuccaucccaucaucu

SEQ ID NO: 440268 - RNA, 22 nt, Homo sapiens
aauuccaucccuaagaauuccc

SEQ ID NO: 440269 - RNA, 22 nt, Homo sapiens
aauucuaagagcagcagcauau

SEQ ID NO: 440270 - RNA, 19 nt, Homo sapiens
aauucuaaguuauuuacuu

SEQ ID NO: 440271 - RNA, 13 nt, Homo sapiens
aauucuacuuuga

SEQ ID NO: 440272 - RNA, 14 nt, Homo sapiens
aauucuacuuugag

SEQ ID NO: 440273 - RNA, 17 nt, Homo sapiens
aauucuauacuguugau

SEQ ID NO: 440274 - RNA, 23 nt, Homo sapiens
aauucucuaucauguugaaguca

SEQ ID NO: 440275 - RNA, 21 nt, Homo sapiens
aauucucuuauccaacaucaa

SEQ ID NO: 440276 - RNA, 18 nt, Homo sapiens
aauucucuucgcugugau

SEQ ID NO: 440277 - RNA, 14 nt, Homo sapiens
aauucucuuucaaa

SEQ ID NO: 440278 - RNA, 23 nt, Homo sapiens
aauucucuuuccuguagucccau

SEQ ID NO: 440279 - RNA, 22 nt, Homo sapiens
aauucuguauuaaggugucaua

SEQ ID NO: 440280 - RNA, 16 nt, Homo sapiens
aauucuguggcaguuu

SEQ ID NO: 440281 - RNA, 18 nt, Homo sapiens
aauucuuaccucauuugc

SEQ ID NO: 440282 - RNA, 20 nt, Homo sapiens
aauucuuaccucauuugcau

SEQ ID NO: 440283 - RNA, 21 nt, Homo sapiens
aauucuuauuggccaaaugcc

SEQ ID NO: 440284 - RNA, 18 nt, Homo sapiens
aauucuucuucucaagca

SEQ ID NO: 440285 - RNA, 14 nt, Homo sapiens
aauugaaaaaccau

SEQ ID NO: 440286 - RNA, 17 nt, Homo sapiens
aauccccucccugugac

SEQ ID NO: 440287 - RNA, 23 nt, Homo sapiens
aauccucagguaguacugggaau

SEQ ID NO: 440288 - RNA, 18 nt, Homo sapiens
aauccucccuacuuccaa

SEQ ID NO: 440289 - RNA, 21 nt, Homo sapiens
aauccugaggggauaucccua

SEQ ID NO: 440290 - RNA, 16 nt, Homo sapiens
aauccuguccucagcu

SEQ ID NO: 440291 - RNA, 11 nt, Homo sapiens
aauccuuccaa

SEQ ID NO: 440292 - RNA, 18 nt, Homo sapiens
aauccuuuacuguuaguc

SEQ ID NO: 440293 - RNA, 17 nt, Homo sapiens
aauccuuuauagcuuug

SEQ ID NO: 440294 - RNA, 15 nt, Homo sapiens
aauccuuucugccca

SEQ ID NO: 440295 - RNA, 14 nt, Homo sapiens
aaucgaacuaugaa

SEQ ID NO: 440296 - RNA, 17 nt, Homo sapiens
aaucgaccucacuguca

SEQ ID NO: 440297 - RNA, 21 nt, Homo sapiens
aaucuacucuuaaauauacaa

SEQ ID NO: 440298 - RNA, 22 nt, Homo sapiens
aaucuagguucaggaagaccac

SEQ ID NO: 440299 - RNA, 20 nt, Homo sapiens
aaucuauuuugucugauauu

SEQ ID NO: 440300 - RNA, 18 nt, Homo sapiens
aaucucacacuucauccu

SEQ ID NO: 440301 - RNA, 20 nt, Homo sapiens
aaucucacacuucauccuau

SEQ ID NO: 440302 - RNA, 15 nt, Homo sapiens
aaucugaacucucaa

SEQ ID NO: 440303 - RNA, 15 nt, Homo sapiens
aaucugcaguggcuc

SEQ ID NO: 440304 - RNA, 13 nt, Homo sapiens
aaucugccuucca

SEQ ID NO: 440305 - RNA, 14 nt, Homo sapiens
aaucugccuuccag

SEQ ID NO: 440306 - RNA, 22 nt, Homo sapiens
aaucuguagcauaggcuagugg

SEQ ID NO: 440307 - RNA, 16 nt, Homo sapiens
aaucuuacaacaggcu

SEQ ID NO: 440308 - RNA, 22 nt, Homo sapiens
aaucuuaccagaugcuacugga

SEQ ID NO: 440309 - RNA, 18 nt, Homo sapiens
aaucuucagggcacugcu

SEQ ID NO: 440310 - RNA, 21 nt, Homo sapiens
aaucuucagggcacugcugcu

SEQ ID NO: 440311 - RNA, 12 nt, Homo sapiens
aaucuucuacuu

SEQ ID NO: 440312 - RNA, 13 nt, Homo sapiens
aaucuugcaacug

SEQ ID NO: 440313 - RNA, 23 nt, Homo sapiens
aaucuugcugugaaacagugugg

SEQ ID NO: 440314 - RNA, 19 nt, Homo sapiens
aaucuuugccuuuaucucu

SEQ ID NO: 440315 - RNA, 19 nt, Homo sapiens
aaucuuuuaaaaauucaaa

SEQ ID NO: 440316 - RNA, 13 nt, Homo sapiens
aaucuuuuacugu

SEQ ID NO: 440317 - RNA, 24 nt, Homo sapiens
aaugaaagcauguggcauguucau

SEQ ID NO: 440318 - RNA, 17 nt, Homo sapiens
aaugaaagguagugagu

SEQ ID NO: 440319 - RNA, 16 nt, Homo sapiens
aaugaaauacuugaca

SEQ ID NO: 440320 - RNA, 12 nt, Homo sapiens
aaugaacuguga

SEQ ID NO: 440321 - RNA, 16 nt, Homo sapiens
aaugaagaauggccau

SEQ ID NO: 440322 - RNA, 21 nt, Homo sapiens
aaugaagguuaggauuuaaca

SEQ ID NO: 440323 - RNA, 20 nt, Homo sapiens
aaugaauauucaacagcuca

SEQ ID NO: 440324 - RNA, 12 nt, Homo sapiens
aaugaaucuuca

SEQ ID NO: 440325 - RNA, 23 nt, Homo sapiens
aaugaaugaaauauaaacuguga

SEQ ID NO: 440326 - RNA, 23 nt, Homo sapiens
aaugacaacaaaagggaaaaaag

SEQ ID NO: 440327 - RNA, 12 nt, Homo sapiens
aaugacaaugau

SEQ ID NO: 440328 - RNA, 14 nt, Homo sapiens
aaugacagauacaa

SEQ ID NO: 440329 - RNA, 17 nt, Homo sapiens
aaugacaucuccuccau

SEQ ID NO: 440330 - RNA, 14 nt, Homo sapiens
aaugacauguguca

SEQ ID NO: 440331 - RNA, 18 nt, Homo sapiens
aaugacauugaacugaau

SEQ ID NO: 440332 - RNA, 20 nt, Homo sapiens
aaugaccagguaacaucauc

SEQ ID NO: 440333 - RNA, 21 nt, Homo sapiens
aaugaccgcacguucucugcc

SEQ ID NO: 440334 - RNA, 23 nt, Homo sapiens
aaugacugaaagaagaacagcug

SEQ ID NO: 440335 - RNA, 23 nt, Homo sapiens
aaugagaaacuuugaucucugcu

SEQ ID NO: 440336 - RNA, 18 nt, Homo sapiens
aaugagagaguguggaaa

SEQ ID NO: 440337 - RNA, 16 nt, Homo sapiens
aaugaggaaacugcac

SEQ ID NO: 440338 - RNA, 15 nt, Homo sapiens
aaugaggacauguuu

SEQ ID NO: 440339 - RNA, 13 nt, Homo sapiens
aaugaucacucca

SEQ ID NO: 440340 - RNA, 16 nt, Homo sapiens
aaugaugaagcuuccu

SEQ ID NO: 440341 - RNA, 12 nt, Homo sapiens
aaugaugaugac

SEQ ID NO: 440342 - RNA, 16 nt, Homo sapiens
aaugaugguaaguuaa

SEQ ID NO: 440343 - RNA, 20 nt, Homo sapiens
aaugaugugaguacccagga

SEQ ID NO: 440344 - RNA, 11 nt, Homo sapiens
aaugauuagaa

SEQ ID NO: 440345 - RNA, 19 nt, Homo sapiens
aaugauucauaacaaugua

SEQ ID NO: 440346 - RNA, 18 nt, Homo sapiens
aaugauuucaagguuugu

SEQ ID NO: 440347 - RNA, 20 nt, Homo sapiens
aaugauuuguguccauuuca

SEQ ID NO: 440348 - RNA, 21 nt, Homo sapiens
aaugcaaaauacaugaugauu

SEQ ID NO: 440349 - RNA, 14 nt, Homo sapiens
aaugcaaauucuca

SEQ ID NO: 440350 - RNA, 23 nt, Homo sapiens
aaugcauuagauuaucaaaaagu

SEQ ID NO: 440351 - RNA, 20 nt, Homo sapiens
aaugcauuuaaacucauuug

SEQ ID NO: 440352 - RNA, 16 nt, Homo sapiens
aauaaaaaucauucua

SEQ ID NO: 440353 - RNA, 13 nt, Homo sapiens
aauaaaaugaugu

SEQ ID NO: 440354 - RNA, 13 nt, Homo sapiens
aauaaaaugcacu

SEQ ID NO: 440355 - RNA, 20 nt, Homo sapiens
aauaaacaaucuuagacauu

SEQ ID NO: 440356 - RNA, 12 nt, Homo sapiens
aauaaaccuccu

SEQ ID NO: 440357 - RNA, 18 nt, Homo sapiens
aauaaacgaaacauuuag

SEQ ID NO: 440358 - RNA, 18 nt, Homo sapiens
aauaaacgcagcgacgug

SEQ ID NO: 440359 - RNA, 16 nt, Homo sapiens
aauaaacucacaacuc

SEQ ID NO: 440360 - RNA, 13 nt, Homo sapiens
aauaaacuuucag

SEQ ID NO: 440361 - RNA, 20 nt, Homo sapiens
aauaaagcccuugaaccagc

SEQ ID NO: 440362 - RNA, 21 nt, Homo sapiens
aauaaagcugcugagaaucua

SEQ ID NO: 440363 - RNA, 15 nt, Homo sapiens
aauaaaggcauuuca

SEQ ID NO: 440364 - RNA, 16 nt, Homo sapiens
aauaaaguuacuugaa

SEQ ID NO: 440365 - RNA, 14 nt, Homo sapiens
aauaaauaaucuca

SEQ ID NO: 440366 - RNA, 15 nt, Homo sapiens
aauaaauguauucaa

SEQ ID NO: 440367 - RNA, 23 nt, Homo sapiens
aauaaaugugagaacuguucuca

SEQ ID NO: 440368 - RNA, 18 nt, Homo sapiens
aauaaauuggaacaccuc

SEQ ID NO: 440369 - RNA, 14 nt, Homo sapiens
aauaacacagagag

SEQ ID NO: 440370 - RNA, 23 nt, Homo sapiens
aauaacaucucuuucaucuagcu

SEQ ID NO: 440371 - RNA, 19 nt, Homo sapiens
aauaacuagaucuccugua

SEQ ID NO: 440372 - RNA, 13 nt, Homo sapiens
aauaacugacccu

SEQ ID NO: 440373 - RNA, 13 nt, Homo sapiens
aauaacugugaag

SEQ ID NO: 440374 - RNA, 12 nt, Homo sapiens
aauaacuugaag

SEQ ID NO: 440375 - RNA, 17 nt, Homo sapiens
aauaagccagcaaacca

SEQ ID NO: 440376 - RNA, 19 nt, Homo sapiens
aauaaggccucauccucca

SEQ ID NO: 440377 - RNA, 14 nt, Homo sapiens
aauaaguucauuaa

SEQ ID NO: 440378 - RNA, 23 nt, Homo sapiens
aauaaguuuuuuuaaaguguuau

SEQ ID NO: 440379 - RNA, 18 nt, Homo sapiens
aauaauaagcuacuugcc

SEQ ID NO: 440380 - RNA, 13 nt, Homo sapiens
aauaauacaacaa

SEQ ID NO: 440381 - RNA, 14 nt, Homo sapiens
aauaauacacuaau

SEQ ID NO: 440382 - RNA, 14 nt, Homo sapiens
aauaauaccuaagc

SEQ ID NO: 440383 - RNA, 17 nt, Homo sapiens
aauaauauaaaugaaug

SEQ ID NO: 440384 - RNA, 12 nt, Homo sapiens
aauaauaugcau

SEQ ID NO: 440385 - RNA, 13 nt, Homo sapiens
aauaauuaucaca

SEQ ID NO: 440386 - RNA, 15 nt, Homo sapiens
aauaauuauguuuac

SEQ ID NO: 440387 - RNA, 23 nt, Homo sapiens
aauacaccgauaaccacagggga

SEQ ID NO: 440388 - RNA, 13 nt, Homo sapiens
aauacagcacuuu

SEQ ID NO: 440389 - RNA, 17 nt, Homo sapiens
aauacagggcaugcauu

SEQ ID NO: 440390 - RNA, 14 nt, Homo sapiens
aauacagugcuuua

SEQ ID NO: 440391 - RNA, 23 nt, Homo sapiens
aauacauuaaaauaacuaagcaa

SEQ ID NO: 440392 - RNA, 20 nt, Homo sapiens
aauacauuuuauaucuggau

SEQ ID NO: 440393 - RNA, 24 nt, Homo sapiens
aauaccacuuuuaauuguuacuca

SEQ ID NO: 440394 - RNA, 18 nt, Homo sapiens
aauacgguaaggauacuu

SEQ ID NO: 440395 - RNA, 22 nt, Homo sapiens
aauacuauuggacagacacaga

SEQ ID NO: 440396 - RNA, 23 nt, Homo sapiens
aauacugaaggacacagcagugg

SEQ ID NO: 440397 - RNA, 16 nt, Homo sapiens
aauacugcagcacucu

SEQ ID NO: 440398 - RNA, 15 nt, Homo sapiens
aauacugcuuuugca

SEQ ID NO: 440399 - RNA, 19 nt, Homo sapiens
aauacuguaacacuguaua

SEQ ID NO: 440400 - RNA, 15 nt, Homo sapiens
aauacuuaaugccaa

SEQ ID NO: 440401 - RNA, 21 nt, Homo sapiens
aauagaagcuucuugcuccug

SEQ ID NO: 440402 - RNA, 13 nt, Homo sapiens
aauagaguacuua

SEQ ID NO: 440403 - RNA, 18 nt, Homo sapiens
aauagauuuaacccuuca

SEQ ID NO: 440404 - RNA, 15 nt, Homo sapiens
aauagcgccucuuuu

SEQ ID NO: 440405 - RNA, 18 nt, Homo sapiens
aauagcuauauccaugua

SEQ ID NO: 440406 - RNA, 20 nt, Homo sapiens
aauaggcuuuuaaaagcauu

SEQ ID NO: 440407 - RNA, 23 nt, Homo sapiens
aauaguaaaggaaagcaguguug

SEQ ID NO: 440408 - RNA, 15 nt, Homo sapiens
aauaguacuauuacu

SEQ ID NO: 440409 - RNA, 19 nt, Homo sapiens
aauaguaggaccaauguug

SEQ ID NO: 440410 - RNA, 13 nt, Homo sapiens
aauagucaauuuc

SEQ ID NO: 440411 - RNA, 15 nt, Homo sapiens
aauagucauauguga

SEQ ID NO: 440412 - RNA, 22 nt, Homo sapiens
aauaguuaaugaaggugugcua

SEQ ID NO: 440413 - RNA, 14 nt, Homo sapiens
aauaguuuacaugu

SEQ ID NO: 440414 - RNA, 19 nt, Homo sapiens
ccacuaauuugucacugga

SEQ ID NO: 440415 - RNA, 19 nt, Homo sapiens
ccacuaccguaaaugucca

SEQ ID NO: 440416 - RNA, 17 nt, Homo sapiens
ccacuauuuaaguuauc

SEQ ID NO: 440417 - RNA, 13 nt, Homo sapiens
ccacucacuccag

SEQ ID NO: 440418 - RNA, 13 nt, Homo sapiens
ccacucacugcau

SEQ ID NO: 440419 - RNA, 16 nt, Homo sapiens
ccacucuucacaggcu

SEQ ID NO: 440420 - RNA, 15 nt, Homo sapiens
ccacugacaggcuuu

SEQ ID NO: 440421 - RNA, 17 nt, Homo sapiens
ccacugagcccuugcac

SEQ ID NO: 440422 - RNA, 18 nt, Homo sapiens
ccacugggucucacuccu

SEQ ID NO: 440423 - RNA, 16 nt, Homo sapiens
ccacugucuccacuca

SEQ ID NO: 440424 - RNA, 15 nt, Homo sapiens
ccacuuagcaugugu

SEQ ID NO: 440425 - RNA, 20 nt, Homo sapiens
ccacuuaucaaaucauucaa

SEQ ID NO: 440426 - RNA, 13 nt, Homo sapiens
ccacuuaugcaua

SEQ ID NO: 440427 - RNA, 17 nt, Homo sapiens
ccacuuauuuccaugga

SEQ ID NO: 440428 - RNA, 13 nt, Homo sapiens
ccacuucaccccc

SEQ ID NO: 440429 - RNA, 21 nt, Homo sapiens
ccagaagaauauucaggacuu

SEQ ID NO: 440430 - RNA, 22 nt, Homo sapiens
ccagaaggcagagguugcagug

SEQ ID NO: 440431 - RNA, 18 nt, Homo sapiens
ccagaauguagcaucuga

SEQ ID NO: 440432 - RNA, 21 nt, Homo sapiens
ccagacacacagccugugcuu

SEQ ID NO: 440433 - RNA, 10 nt, Homo sapiens
ccagacuguu

SEQ ID NO: 440434 - RNA, 14 nt, Homo sapiens
ccagacuuucuaca

SEQ ID NO: 440435 - RNA, 15 nt, Homo sapiens
ccagagaguggcucc

SEQ ID NO: 440436 - RNA, 12 nt, Homo sapiens
ccagagcacugg

SEQ ID NO: 440437 - RNA, 23 nt, Homo sapiens
ccagagccccccacaaugaugau

SEQ ID NO: 440438 - RNA, 20 nt, Homo sapiens
ccagagcccuucacugccau

SEQ ID NO: 440439 - RNA, 22 nt, Homo sapiens
ccagagcuggaaggcagggcag

SEQ ID NO: 440440 - RNA, 18 nt, Homo sapiens
ccagaggaugucacaaag

SEQ ID NO: 440441 - RNA, 10 nt, Homo sapiens
ccagaggcag

SEQ ID NO: 440442 - RNA, 17 nt, Homo sapiens
ccagaggggcggggcca

SEQ ID NO: 440443 - RNA, 15 nt, Homo sapiens
ccagaggggugcgca

SEQ ID NO: 440444 - RNA, 22 nt, Homo sapiens
ccagaggggugcgcagagcuga

SEQ ID NO: 440445 - RNA, 23 nt, Homo sapiens
ccagaggggugcgcagagcugac

SEQ ID NO: 440446 - RNA, 15 nt, Homo sapiens
ccagaguccggaggc

SEQ ID NO: 440447 - RNA, 20 nt, Homo sapiens
ccagauagguggugccagug

SEQ ID NO: 440448 - RNA, 14 nt, Homo sapiens
ccagaugacacaua

SEQ ID NO: 440449 - RNA, 16 nt, Homo sapiens
ccagcaaaagugcagu

SEQ ID NO: 440450 - RNA, 13 nt, Homo sapiens
ccagcaacuccaa

SEQ ID NO: 440451 - RNA, 12 nt, Homo sapiens
ccagcacuuugg

SEQ ID NO: 440452 - RNA, 21 nt, Homo sapiens
ccagcaucugauugagucagu

SEQ ID NO: 440453 - RNA, 16 nt, Homo sapiens
ccagcaugacgguguc

SEQ ID NO: 440454 - RNA, 15 nt, Homo sapiens
ccagccaccaccacu

SEQ ID NO: 440455 - RNA, 12 nt, Homo sapiens
ccagccaccacu

SEQ ID NO: 440456 - RNA, 23 nt, Homo sapiens
ccagccaccuuccugacugggaa

SEQ ID NO: 440457 - RNA, 23 nt, Homo sapiens
ccagcccuguucugggugcagcu

SEQ ID NO: 440458 - RNA, 16 nt, Homo sapiens
ccagccgcaaauccau

SEQ ID NO: 440459 - RNA, 14 nt, Homo sapiens
ccagccuccaugcu

SEQ ID NO: 440460 - RNA, 15 nt, Homo sapiens
ccagccuccugcuaa

SEQ ID NO: 440461 - RNA, 21 nt, Homo sapiens
ccagccugggacucccaguga

SEQ ID NO: 440462 - RNA, 20 nt, Homo sapiens
ccagccugggcaacagagca

SEQ ID NO: 440463 - RNA, 23 nt, Homo sapiens
ccagccugugguuacagugcaga

SEQ ID NO: 440464 - RNA, 19 nt, Homo sapiens
ccagcgagucuggagacca

SEQ ID NO: 440465 - RNA, 20 nt, Homo sapiens
ccagcgggcccucugccgac

SEQ ID NO: 440466 - RNA, 22 nt, Homo sapiens
ccagcuccacagggugggauga

SEQ ID NO: 440467 - RNA, 14 nt, Homo sapiens
ccagcucugacuga

SEQ ID NO: 440468 - RNA, 15 nt, Homo sapiens
ccagcugccuuggac

SEQ ID NO: 440469 - RNA, 16 nt, Homo sapiens
ccagcuguagccaugg

SEQ ID NO: 440470 - RNA, 17 nt, Homo sapiens
ccagcugugacugaggg

SEQ ID NO: 440471 - RNA, 18 nt, Homo sapiens
ccagcuuaugagcucaaa

SEQ ID NO: 440472 - RNA, 21 nt, Homo sapiens
ccagcuuaugagcucaaagua

SEQ ID NO: 440473 - RNA, 19 nt, Homo sapiens
ccagcuugggcccagcugg

SEQ ID NO: 440474 - RNA, 22 nt, Homo sapiens
ccagcuuggugguuauguccca

SEQ ID NO: 440475 - RNA, 11 nt, Homo sapiens
ccagcuuuaag

SEQ ID NO: 440476 - RNA, 15 nt, Homo sapiens
ccagcuuugcaguga

SEQ ID NO: 440477 - RNA, 18 nt, Homo sapiens
ccagcuuuucuugccagc

SEQ ID NO: 440478 - RNA, 12 nt, Homo sapiens
ccaggaaggcag

SEQ ID NO: 440479 - RNA, 15 nt, Homo sapiens
ccaggaaggcagcug

SEQ ID NO: 440480 - RNA, 15 nt, Homo sapiens
ccaggaaucaugaag

SEQ ID NO: 440481 - RNA, 22 nt, Homo sapiens
ccaggaauguuucagcugcagu

SEQ ID NO: 440482 - RNA, 18 nt, Homo sapiens
ccaggacacgacuuguaa

SEQ ID NO: 440483 - RNA, 19 nt, Homo sapiens
ccaggacgcagggagaccc

SEQ ID NO: 440484 - RNA, 17 nt, Homo sapiens
ccaggagaaagaaggcu

SEQ ID NO: 440485 - RNA, 23 nt, Homo sapiens
ccaggagacagacagagaaggca

SEQ ID NO: 440486 - RNA, 15 nt, Homo sapiens
ccaggagaccuucca

SEQ ID NO: 440487 - RNA, 18 nt, Homo sapiens
ccaggaggggucugccuc

SEQ ID NO: 440488 - RNA, 13 nt, Homo sapiens
ccaggaguaccug

SEQ ID NO: 440489 - RNA, 15 nt, Homo sapiens
ccaggaguaccugga

SEQ ID NO: 440490 - RNA, 23 nt, Homo sapiens
ccaggauauugacaagaauacac

SEQ ID NO: 440491 - RNA, 17 nt, Homo sapiens
ccaggauccugcaggaa

SEQ ID NO: 440492 - RNA, 12 nt, Homo sapiens
ccaggcaauggc

SEQ ID NO: 440493 - RNA, 16 nt, Homo sapiens
ccaggcacugccugga

SEQ ID NO: 440494 - RNA, 16 nt, Homo sapiens
ccaggcagaaaacugg

SEQ ID NO: 440495 - RNA, 14 nt, Homo sapiens
ccaggccacccacu

SEQ ID NO: 440496 - RNA, 18 nt, Homo sapiens
ccaggcccgagaugugac

SEQ ID NO: 440497 - RNA, 18 nt, Homo sapiens
ccaggcgaugugcaagug

SEQ ID NO: 440498 - RNA, 23 nt, Homo sapiens
ccaggcuagaauggaaaacugcc

SEQ ID NO: 440499 - RNA, 21 nt, Homo sapiens
ccaggcucucccucucugcac

SEQ ID NO: 440500 - RNA, 17 nt, Homo sapiens
ccaggcugcacugcagu

SEQ ID NO: 440501 - RNA, 17 nt, Homo sapiens
ccaggcuggagugcaau

SEQ ID NO: 440502 - RNA, 19 nt, Homo sapiens
ccaggcuggagugcaaugc

SEQ ID NO: 440503 - RNA, 16 nt, Homo sapiens
ccaggcuggucucaaa

SEQ ID NO: 440504 - RNA, 19 nt, Homo sapiens
ccaggcugucagcgccuca

SEQ ID NO: 440505 - RNA, 20 nt, Homo sapiens
ccagggaggaauugggguuu

SEQ ID NO: 440506 - RNA, 13 nt, Homo sapiens
ccagggcaucaca

SEQ ID NO: 440507 - RNA, 16 nt, Homo sapiens
ccagggcucccggaga

SEQ ID NO: 440508 - RNA, 22 nt, Homo sapiens
ccaggggcccuugggacagcca

SEQ ID NO: 440509 - RNA, 22 nt, Homo sapiens
ccagggggcagcccaguggaau

SEQ ID NO: 440510 - RNA, 22 nt, Homo sapiens
ccaggguagagcaaaggagaca

SEQ ID NO: 440511 - RNA, 22 nt, Homo sapiens
ccagggucuugggcuacuggca

SEQ ID NO: 440512 - RNA, 19 nt, Homo sapiens
ccagggucuuuacugggaa

SEQ ID NO: 440513 - RNA, 19 nt, Homo sapiens
ccaggguuccagacagggu

SEQ ID NO: 440514 - RNA, 21 nt, Homo sapiens
ccaggguuccagacagggugg

SEQ ID NO: 440515 - RNA, 15 nt, Homo sapiens
ccagguaccacccuu

SEQ ID NO: 440516 - RNA, 19 nt, Homo sapiens
ccagguguucuacacucau

SEQ ID NO: 440517 - RNA, 21 nt, Homo sapiens
ccagguucugguuagcucagc

SEQ ID NO: 440518 - RNA, 21 nt, Homo sapiens
ccagguuggaggcccuaggcg

SEQ ID NO: 440519 - RNA, 19 nt, Homo sapiens
ccagguugggggcaguguu

SEQ ID NO: 440520 - RNA, 22 nt, Homo sapiens
ccagguugggggcaguguugug

SEQ ID NO: 440521 - RNA, 22 nt, Homo sapiens
ccagguuuaaccguugcgucac

SEQ ID NO: 440522 - RNA, 16 nt, Homo sapiens
ccaguacgugcuaaca

SEQ ID NO: 440523 - RNA, 20 nt, Homo sapiens
ccaguauugaaaacuucaaa

SEQ ID NO: 440524 - RNA, 12 nt, Homo sapiens
ccagucaaagac

SEQ ID NO: 440525 - RNA, 12 nt, Homo sapiens
ccaguccaugag

SEQ ID NO: 440526 - RNA, 16 nt, Homo sapiens
ccagucccucagccac

SEQ ID NO: 440527 - RNA, 19 nt, Homo sapiens
ccagucucaaaaauacaaa

SEQ ID NO: 440528 - RNA, 13 nt, Homo sapiens
ccagugacacuuc

SEQ ID NO: 440529 - RNA, 19 nt, Homo sapiens
ccagugagauuacagagga

SEQ ID NO: 440530 - RNA, 15 nt, Homo sapiens
ccagugcaacagcac

SEQ ID NO: 440531 - RNA, 22 nt, Homo sapiens
ccaguggaacagcgggagaccu

SEQ ID NO: 440532 - RNA, 21 nt, Homo sapiens
ccaguggaagaagaaaacacu

SEQ ID NO: 440533 - RNA, 16 nt, Homo sapiens
ccagugggcagugcau

SEQ ID NO: 440534 - RNA, 14 nt, Homo sapiens
ccagugucacuuga

SEQ ID NO: 440535 - RNA, 16 nt, Homo sapiens
ccaguguuagugggaa

SEQ ID NO: 440536 - RNA, 14 nt, Homo sapiens
ccaguucuuuauaa

SEQ ID NO: 440537 - RNA, 16 nt, Homo sapiens
ccaguuuugcugcuau

SEQ ID NO: 440538 - RNA, 14 nt, Homo sapiens
ccaguuuuuugcca

SEQ ID NO: 440539 - RNA, 19 nt, Homo sapiens
ccauaaacaccagauucca

SEQ ID NO: 440540 - RNA, 14 nt, Homo sapiens
ccauaauguuacau

SEQ ID NO: 440541 - RNA, 23 nt, Homo sapiens
ccauaauucuaaguuauuuacuu

SEQ ID NO: 440542 - RNA, 11 nt, Homo sapiens
ccauaccagcu

SEQ ID NO: 440543 - RNA, 19 nt, Homo sapiens
ccauagcuacuauaugcau

SEQ ID NO: 440544 - RNA, 15 nt, Homo sapiens
agaauuuugcacagu

SEQ ID NO: 440545 - RNA, 17 nt, Homo sapiens
agacaaaguaauuccuc

SEQ ID NO: 440546 - RNA, 21 nt, Homo sapiens
agacaaauagucggauuagaa

SEQ ID NO: 440547 - RNA, 13 nt, Homo sapiens
agacaacacacac

SEQ ID NO: 440548 - RNA, 22 nt, Homo sapiens
agacaagaaauccuaguggccu

SEQ ID NO: 440549 - RNA, 13 nt, Homo sapiens
agacaagcacuuu

SEQ ID NO: 440550 - RNA, 23 nt, Homo sapiens
agacaaucuaaaaaauaucuuag

SEQ ID NO: 440551 - RNA, 21 nt, Homo sapiens
agacacccaguggaaccaaaa

SEQ ID NO: 440552 - RNA, 19 nt, Homo sapiens
agacacgugugagugguca

SEQ ID NO: 440553 - RNA, 16 nt, Homo sapiens
agacacugucaagauu

SEQ ID NO: 440554 - RNA, 17 nt, Homo sapiens
agacacuguucccaaag

SEQ ID NO: 440555 - RNA, 16 nt, Homo sapiens
agacagacacguguga

SEQ ID NO: 440556 - RNA, 12 nt, Homo sapiens
uaaaacuaucca

SEQ ID NO: 440557 - RNA, 19 nt, Homo sapiens
uaaaacuaugguucccaau

SEQ ID NO: 440558 - RNA, 19 nt, Homo sapiens
uaaaacugcacagugcugu

SEQ ID NO: 440559 - RNA, 19 nt, Homo sapiens
uaaaacuggcaucugacac

SEQ ID NO: 440560 - RNA, 17 nt, Homo sapiens
uaaaacuuacuauggua

SEQ ID NO: 440561 - RNA, 18 nt, Homo sapiens
uaaaagaaacagauuuga

SEQ ID NO: 440562 - RNA, 10 nt, Homo sapiens
uaaaagaagc

SEQ ID NO: 440563 - RNA, 15 nt, Homo sapiens
uaaaagaagcugcuc

SEQ ID NO: 440564 - RNA, 19 nt, Homo sapiens
uaaaagacaagcacuuugg

SEQ ID NO: 440565 - RNA, 19 nt, Homo sapiens
uaaaagagccaaguucaaa

SEQ ID NO: 440566 - RNA, 15 nt, Homo sapiens
uaaaagauucacuaa

SEQ ID NO: 440567 - RNA, 21 nt, Homo sapiens
uaaaagggucguuaccagaga

SEQ ID NO: 440568 - RNA, 16 nt, Homo sapiens
uaaaagugcuacuuga

SEQ ID NO: 440569 - RNA, 18 nt, Homo sapiens
uaaaaguuucaaugugau

SEQ ID NO: 440570 - RNA, 20 nt, Homo sapiens
uaaaaguuuuaaccucaggu

SEQ ID NO: 440571 - RNA, 17 nt, Homo sapiens
uaaaauaaaaauucuga

SEQ ID NO: 440572 - RNA, 21 nt, Homo sapiens
uaaaauaaacacuagacugua

SEQ ID NO: 440573 - RNA, 23 nt, Homo sapiens
uaaaauaaaguauauauagaauc

SEQ ID NO: 440574 - RNA, 18 nt, Homo sapiens
uaaaauaacuaagcaagu

SEQ ID NO: 440575 - RNA, 18 nt, Homo sapiens
uaaaauaaggcuccuuca

SEQ ID NO: 440576 - RNA, 21 nt, Homo sapiens
uaaaauagaaauaagugguua

SEQ ID NO: 440577 - RNA, 14 nt, Homo sapiens
uaaaauauggcuau

SEQ ID NO: 440578 - RNA, 17 nt, Homo sapiens
uaaaaucagacucuuua

SEQ ID NO: 440579 - RNA, 21 nt, Homo sapiens
uaaaaugauuuuaucugugaa

SEQ ID NO: 440580 - RNA, 21 nt, Homo sapiens
uaaaaugguguuuucauguaa

SEQ ID NO: 440581 - RNA, 17 nt, Homo sapiens
uaaaauguacucagcua

SEQ ID NO: 440582 - RNA, 18 nt, Homo sapiens
uaaaaugugaagugaaug

SEQ ID NO: 440583 - RNA, 12 nt, Homo sapiens
uaaaauucaccc

SEQ ID NO: 440584 - RNA, 20 nt, Homo sapiens
uaaaauugggcuugugauuu

SEQ ID NO: 440585 - RNA, 17 nt, Homo sapiens
uaaacaauaaaugggcc

SEQ ID NO: 440586 - RNA, 18 nt, Homo sapiens
uaaacaaucuuagacauu

SEQ ID NO: 440587 - RNA, 19 nt, Homo sapiens
uaaacaaucuuagacauuu

SEQ ID NO: 440588 - RNA, 21 nt, Homo sapiens
uaaacacacaaguagauugau

SEQ ID NO: 440589 - RNA, 18 nt, Homo sapiens
uaaacacggggcuugcaa

SEQ ID NO: 440590 - RNA, 17 nt, Homo sapiens
uaaacaguggaauauaa

SEQ ID NO: 440591 - RNA, 19 nt, Homo sapiens
uaaacauuuuuaaguauuu

SEQ ID NO: 440592 - RNA, 10 nt, Homo sapiens
uaaaccaaac

SEQ ID NO: 440593 - RNA, 21 nt, Homo sapiens
uaaaccacuugucacuacaaa

SEQ ID NO: 440594 - RNA, 20 nt, Homo sapiens
cugaaagaugggcaaaagac

SEQ ID NO: 440595 - RNA, 20 nt, Homo sapiens
cugaaagauugauuaaugaa

SEQ ID NO: 440596 - RNA, 17 nt, Homo sapiens
cugaaagcaacuacaga

SEQ ID NO: 440597 - RNA, 16 nt, Homo sapiens
cugaaauaacauggcc

SEQ ID NO: 440598 - RNA, 21 nt, Homo sapiens
cugaaauagugguucuuggaa

SEQ ID NO: 440599 - RNA, 14 nt, Homo sapiens
cugaaauuccucug

SEQ ID NO: 440600 - RNA, 19 nt, Homo sapiens
cugaacaaucaaagcacuu

SEQ ID NO: 440601 - RNA, 20 nt, Homo sapiens
cugaacaaucaaagcacuug

SEQ ID NO: 440602 - RNA, 22 nt, Homo sapiens
cugaacacgaagcuuaguauaa

SEQ ID NO: 440603 - RNA, 12 nt, Homo sapiens
cugaacagugga

SEQ ID NO: 440604 - RNA, 14 nt, Homo sapiens
cugaacauugcacu

SEQ ID NO: 440605 - RNA, 12 nt, Homo sapiens
cugaaccagaga

SEQ ID NO: 440606 - RNA, 13 nt, Homo sapiens
cugaacucugcaa

SEQ ID NO: 440607 - RNA, 21 nt, Homo sapiens
cugaagaagaucccagaggau

SEQ ID NO: 440608 - RNA, 17 nt, Homo sapiens
cugaagauaaugaaaua

SEQ ID NO: 440609 - RNA, 21 nt, Homo sapiens
cugaagcuuauuaaugcuaag

SEQ ID NO: 440610 - RNA, 18 nt, Homo sapiens
cugaaggggcacaccacu

SEQ ID NO: 440611 - RNA, 19 nt, Homo sapiens
cugaagggugacaucccag

SEQ ID NO: 440612 - RNA, 18 nt, Homo sapiens
cugaagguaauacuauaa

SEQ ID NO: 440613 - RNA, 12 nt, Homo sapiens
cugaaggugccc

SEQ ID NO: 440614 - RNA, 17 nt, Homo sapiens
cugaaguccauuuuccc

SEQ ID NO: 440615 - RNA, 18 nt, Homo sapiens
cugaagucuuuguacaga

SEQ ID NO: 440616 - RNA, 17 nt, Homo sapiens
cugaagugaacuaugaa

SEQ ID NO: 440617 - RNA, 20 nt, Homo sapiens
cugaaguucagcugcauaca

SEQ ID NO: 440618 - RNA, 22 nt, Homo sapiens
cugaaguuucauuuaugauaca

SEQ ID NO: 440619 - RNA, 16 nt, Homo sapiens
cugaauaacuugaaga

SEQ ID NO: 440620 - RNA, 19 nt, Homo sapiens
cugaauaacuugaagaaca

SEQ ID NO: 440621 - RNA, 16 nt, Homo sapiens
cugaaucaguuauuau

SEQ ID NO: 440622 - RNA, 23 nt, Homo sapiens
cugaaucauccgaggcaaagaga

SEQ ID NO: 440623 - RNA, 12 nt, Homo sapiens
cugaauccucau

SEQ ID NO: 440624 - RNA, 15 nt, Homo sapiens
cugaauuacagugaa

SEQ ID NO: 440625 - RNA, 17 nt, Homo sapiens
cugaauuugcuaauaaa

SEQ ID NO: 440626 - RNA, 19 nt, Homo sapiens
cugaauuuguagacauacu

SEQ ID NO: 440627 - RNA, 16 nt, Homo sapiens
cugacaaauauuuuag

SEQ ID NO: 440628 - RNA, 17 nt, Homo sapiens
cugacaaauauuuuaga

SEQ ID NO: 440629 - RNA, 16 nt, Homo sapiens
cugacacaggggacac

SEQ ID NO: 440630 - RNA, 12 nt, Homo sapiens
cugacaccuacc

SEQ ID NO: 440631 - RNA, 22 nt, Homo sapiens
cugacacugcgaacucucagga

SEQ ID NO: 440632 - RNA, 15 nt, Homo sapiens
cugacagcagccugu

SEQ ID NO: 440633 - RNA, 17 nt, Homo sapiens
cugacauauaucuauua

SEQ ID NO: 440634 - RNA, 23 nt, Homo sapiens
cugaccaacauucaaaagcacaa

SEQ ID NO: 440635 - RNA, 13 nt, Homo sapiens
cugaccaccugca

SEQ ID NO: 440636 - RNA, 14 nt, Homo sapiens
cugaccccaggaag

SEQ ID NO: 440637 - RNA, 15 nt, Homo sapiens
cugaccucacuguga

SEQ ID NO: 440638 - RNA, 17 nt, Homo sapiens
cugaccucgugauccac

SEQ ID NO: 440639 - RNA, 23 nt, Homo sapiens
cugacuaauuuuuguauuuuuag

SEQ ID NO: 440640 - RNA, 18 nt, Homo sapiens
cugacuauucuugaugua

SEQ ID NO: 440641 - RNA, 15 nt, Homo sapiens
cugacugaaggggcu

SEQ ID NO: 440642 - RNA, 20 nt, Homo sapiens
cugacugaagugaacuauga

SEQ ID NO: 440643 - RNA, 14 nt, Homo sapiens
cugacugugugugg

SEQ ID NO: 440644 - RNA, 17 nt, Homo sapiens
cugacuguugcuguaaa

SEQ ID NO: 440645 - RNA, 12 nt, Homo sapiens
cugagaaagccc

SEQ ID NO: 440646 - RNA, 17 nt, Homo sapiens
cugagaaggcccugugc

SEQ ID NO: 440647 - RNA, 20 nt, Homo sapiens
cugagaagucaaacauuuca

SEQ ID NO: 440648 - RNA, 13 nt, Homo sapiens
cugagacagcagu

SEQ ID NO: 440649 - RNA, 22 nt, Homo sapiens
cugagacgcaaggaucacuuga

SEQ ID NO: 440650 - RNA, 20 nt, Homo sapiens
cugagacuugaaucaaguca

SEQ ID NO: 440651 - RNA, 22 nt, Homo sapiens
cugagagaaguacuaagaccca

SEQ ID NO: 440652 - RNA, 12 nt, Homo sapiens
cugagauuacag

SEQ ID NO: 440653 - RNA, 13 nt, Homo sapiens
cugagcagugggg

SEQ ID NO: 440654 - RNA, 21 nt, Homo sapiens
cugagccaaagagaaugccau

SEQ ID NO: 440655 - RNA, 23 nt, Homo sapiens
cugagccaaagagaaugccauuc

SEQ ID NO: 440656 - RNA, 21 nt, Homo sapiens
cugagccacucgcagucgcag

SEQ ID NO: 440657 - RNA, 15 nt, Homo sapiens
cugagccagucccag

SEQ ID NO: 440658 - RNA, 20 nt, Homo sapiens
cugagcccccugcacccacc

SEQ ID NO: 440659 - RNA, 15 nt, Homo sapiens
cugagccccuacccc

SEQ ID NO: 440660 - RNA, 15 nt, Homo sapiens
cugagcccuugcaca

SEQ ID NO: 440661 - RNA, 19 nt, Homo sapiens
cugagcgggcuugugauau

SEQ ID NO: 440662 - RNA, 15 nt, Homo sapiens
cugagcuugagcucc

SEQ ID NO: 440663 - RNA, 13 nt, Homo sapiens
cugagcuuuccag

SEQ ID NO: 440664 - RNA, 22 nt, Homo sapiens
cugaggaagcacagcagcaucu

SEQ ID NO: 440665 - RNA, 15 nt, Homo sapiens
cugaggacucaaggg

SEQ ID NO: 440666 - RNA, 23 nt, Homo sapiens
cugaggagaagcgggaguggcug

SEQ ID NO: 440667 - RNA, 22 nt, Homo sapiens
cugaggccuccagcuucaggca

SEQ ID NO: 440668 - RNA, 13 nt, Homo sapiens
cugagggcacucu

SEQ ID NO: 440669 - RNA, 16 nt, Homo sapiens
cugaggggcaucugcc

SEQ ID NO: 440670 - RNA, 14 nt, Homo sapiens
cugaggguuuccac

SEQ ID NO: 440671 - RNA, 19 nt, Homo sapiens
cugaggucaugcauuguaa

SEQ ID NO: 440672 - RNA, 16 nt, Homo sapiens
cugaggucucuugagg

SEQ ID NO: 440673 - RNA, 14 nt, Homo sapiens
cugaggugggcaga

SEQ ID NO: 440674 - RNA, 19 nt, Homo sapiens
cugaguagcuggauuacag

SEQ ID NO: 440675 - RNA, 20 nt, Homo sapiens
cugaguagucauuuugccca

SEQ ID NO: 440676 - RNA, 22 nt, Homo sapiens
cugaguauugauaaacuuugaa

SEQ ID NO: 440677 - RNA, 23 nt, Homo sapiens
cugaguccagcuccccccaagau

SEQ ID NO: 440678 - RNA, 19 nt, Homo sapiens
cugagugagaagauaaaaa

SEQ ID NO: 440679 - RNA, 22 nt, Homo sapiens
cugagugcaccacuucaaguga

SEQ ID NO: 440680 - RNA, 13 nt, Homo sapiens
cugaguggggcca

SEQ ID NO: 440681 - RNA, 14 nt, Homo sapiens
cugagugguccaca

SEQ ID NO: 440682 - RNA, 13 nt, Homo sapiens
cugaguuaggaga

SEQ ID NO: 440683 - RNA, 14 nt, Homo sapiens
cugaguuucuuggc

SEQ ID NO: 440684 - RNA, 15 nt, Homo sapiens
cugaguuugcuuuca

SEQ ID NO: 440685 - RNA, 20 nt, Homo sapiens
cugauaaacauuaaacacug

SEQ ID NO: 440686 - RNA, 19 nt, Homo sapiens
uaaucugaaacacagucau

SEQ ID NO: 440687 - RNA, 22 nt, Homo sapiens
uaaucuggacuccucuguccag

SEQ ID NO: 440688 - RNA, 23 nt, Homo sapiens
uaaucuucagggcacugcugcug

SEQ ID NO: 440689 - RNA, 18 nt, Homo sapiens
uaaugaauuuuuaugaua

SEQ ID NO: 440690 - RNA, 13 nt, Homo sapiens
uaaugacauuccc

SEQ ID NO: 440691 - RNA, 21 nt, Homo sapiens
uaaugacuuaagcacacuuga

SEQ ID NO: 440692 - RNA, 11 nt, Homo sapiens
uaaugauacug

SEQ ID NO: 440693 - RNA, 23 nt, Homo sapiens
uaaugccaaguaacaaugcaugc

SEQ ID NO: 440694 - RNA, 18 nt, Homo sapiens
uaaugcuugccaagaaau

SEQ ID NO: 440695 - RNA, 18 nt, Homo sapiens
uaauggucaaugcuagca

SEQ ID NO: 440696 - RNA, 17 nt, Homo sapiens
uaauguaggacuguaua

SEQ ID NO: 440697 - RNA, 16 nt, Homo sapiens
uaaugucagcacaugu

SEQ ID NO: 440698 - RNA, 23 nt, Homo sapiens
uaaugugagacagcaaguuuaua

SEQ ID NO: 440699 - RNA, 20 nt, Homo sapiens
uaauguggcagcugucucaa

SEQ ID NO: 440700 - RNA, 14 nt, Homo sapiens
uaauguuacugauc

SEQ ID NO: 440701 - RNA, 22 nt, Homo sapiens
uaauguugcuuucuuaucccag

SEQ ID NO: 440702 - RNA, 18 nt, Homo sapiens
uaauguuuaauauugaga

SEQ ID NO: 440703 - RNA, 19 nt, Homo sapiens
uaauguuuuauacuguuua

SEQ ID NO: 440704 - RNA, 15 nt, Homo sapiens
uaauuaaauuucaca

SEQ ID NO: 440705 - RNA, 13 nt, Homo sapiens
uaauuagauuaac

SEQ ID NO: 440706 - RNA, 20 nt, Homo sapiens
uaauuaggcaaagacaggag

SEQ ID NO: 440707 - RNA, 17 nt, Homo sapiens
uaauuagggguugcuaa

SEQ ID NO: 440708 - RNA, 16 nt, Homo sapiens
uaauuaguaagugagu

SEQ ID NO: 440709 - RNA, 16 nt, Homo sapiens
uaauuaucugugaugg

SEQ ID NO: 440710 - RNA, 22 nt, Homo sapiens
uaauucggaagggaaaacaguc

SEQ ID NO: 440711 - RNA, 20 nt, Homo sapiens
uaauucucuucgcugugaug

SEQ ID NO: 440712 - RNA, 20 nt, Homo sapiens
uaauucuuaccucauuugca

SEQ ID NO: 440713 - RNA, 19 nt, Homo sapiens
uaauugaucaaauucauuu

SEQ ID NO: 440714 - RNA, 15 nt, Homo sapiens
uaauugcaagggaag

SEQ ID NO: 440715 - RNA, 16 nt, Homo sapiens
uaauugcuuacauuuu

SEQ ID NO: 440716 - RNA, 12 nt, Homo sapiens
uaauugguucuu

SEQ ID NO: 440717 - RNA, 17 nt, Homo sapiens
uaauuguaaacuaguac

SEQ ID NO: 440718 - RNA, 19 nt, Homo sapiens
uaauuguaaacuaguacua

SEQ ID NO: 440719 - RNA, 21 nt, Homo sapiens
uaauuuaucuugucucugggc

SEQ ID NO: 440720 - RNA, 17 nt, Homo sapiens
uaauuucuuacuaaaca

SEQ ID NO: 440721 - RNA, 16 nt, Homo sapiens
uaauuugaauggugca

SEQ ID NO: 440722 - RNA, 23 nt, Homo sapiens
uaauuugaaugugguuacuuccu

SEQ ID NO: 440723 - RNA, 13 nt, Homo sapiens
uaauuugaugaaa

SEQ ID NO: 440724 - RNA, 19 nt, Homo sapiens
uaauuuucuagauuuucua

SEQ ID NO: 440725 - RNA, 19 nt, Homo sapiens
uaauuuuggguggggagaa

SEQ ID NO: 440726 - RNA, 13 nt, Homo sapiens
uaauuuuguagua

SEQ ID NO: 440727 - RNA, 20 nt, Homo sapiens
uaauuuuuaaaagacuuuga

SEQ ID NO: 440728 - RNA, 22 nt, Homo sapiens
uaauuuuuccuauauugcauua

SEQ ID NO: 440729 - RNA, 23 nt, Homo sapiens
uacaaaacauuuuuuuguucucu

SEQ ID NO: 440730 - RNA, 13 nt, Homo sapiens
uacaaaaugacua

SEQ ID NO: 440731 - RNA, 22 nt, Homo sapiens
uacaaacaggugcuaacacugu

SEQ ID NO: 440732 - RNA, 23 nt, Homo sapiens
cuggcuuuacauggguucaauug

SEQ ID NO: 440733 - RNA, 23 nt, Homo sapiens
cuggcuuugcccaaccucagcaa

SEQ ID NO: 440734 - RNA, 20 nt, Homo sapiens
cuggcuuuucuggcugggga

SEQ ID NO: 440735 - RNA, 23 nt, Homo sapiens
cugggaaaaaaguuuugaugaaa

SEQ ID NO: 440736 - RNA, 16 nt, Homo sapiens
cugggaaaacagugaa

SEQ ID NO: 440737 - RNA, 15 nt, Homo sapiens
cugggaaaggugcuc

SEQ ID NO: 440738 - RNA, 20 nt, Homo sapiens
cugggaaaggugcucaaaga

SEQ ID NO: 440739 - RNA, 17 nt, Homo sapiens
cugggaacucccaagaa

SEQ ID NO: 440740 - RNA, 23 nt, Homo sapiens
cugggaaggagggagcugcucag

SEQ ID NO: 440741 - RNA, 17 nt, Homo sapiens
cugggacacaaccacua

SEQ ID NO: 440742 - RNA, 16 nt, Homo sapiens
cugggagaaaagccag

SEQ ID NO: 440743 - RNA, 15 nt, Homo sapiens
cugggagacuuugaa

SEQ ID NO: 440744 - RNA, 20 nt, Homo sapiens
cugggaggcaucaguugcua

SEQ ID NO: 440745 - RNA, 23 nt, Homo sapiens
cugggauuacaggcgugagccac

SEQ ID NO: 440746 - RNA, 22 nt, Homo sapiens
cugggauuacagggaugagcca

SEQ ID NO: 440747 - RNA, 13 nt, Homo sapiens
cugggcacaauca

SEQ ID NO: 440748 - RNA, 13 nt, Homo sapiens
cugggcacuccuc

SEQ ID NO: 440749 - RNA, 14 nt, Homo sapiens
cugggcacuccucc

SEQ ID NO: 440750 - RNA, 15 nt, Homo sapiens
cugggcauacuuucu

SEQ ID NO: 440751 - RNA, 19 nt, Homo sapiens
cugggcauucucaauacuu

SEQ ID NO: 440752 - RNA, 18 nt, Homo sapiens
cugggccaccaugcacuc

SEQ ID NO: 440753 - RNA, 14 nt, Homo sapiens
cugggccacuggca

SEQ ID NO: 440754 - RNA, 16 nt, Homo sapiens
cugggcccaagacaga

SEQ ID NO: 440755 - RNA, 15 nt, Homo sapiens
cugggcccuaggcau

SEQ ID NO: 440756 - RNA, 16 nt, Homo sapiens
cugggcccuaggcaua

SEQ ID NO: 440757 - RNA, 18 nt, Homo sapiens
cugggccucauucuagca

SEQ ID NO: 440758 - RNA, 14 nt, Homo sapiens
cugggccuucucac

SEQ ID NO: 440759 - RNA, 13 nt, Homo sapiens
cugggcuagggga

SEQ ID NO: 440760 - RNA, 15 nt, Homo sapiens
cuggggaaggaccaa

SEQ ID NO: 440761 - RNA, 20 nt, Homo sapiens
cuggggaggacaaaggugau

SEQ ID NO: 440762 - RNA, 21 nt, Homo sapiens
cuggggccgaaagaacagucc

SEQ ID NO: 440763 - RNA, 22 nt, Homo sapiens
cuggguacaagagccauguacc

SEQ ID NO: 440764 - RNA, 18 nt, Homo sapiens
cugggugagaauccugcc

SEQ ID NO: 440765 - RNA, 16 nt, Homo sapiens
cuggguggaucggccu

SEQ ID NO: 440766 - RNA, 16 nt, Homo sapiens
cuggguuuucaggggc

SEQ ID NO: 440767 - RNA, 14 nt, Homo sapiens
cugguaagggccaa

SEQ ID NO: 440768 - RNA, 20 nt, Homo sapiens
cugguaauuuaagauuccag

SEQ ID NO: 440769 - RNA, 20 nt, Homo sapiens
cugguagaaaggcaguucag

SEQ ID NO: 440770 - RNA, 18 nt, Homo sapiens
cugguagcaugaccuuuu

SEQ ID NO: 440771 - RNA, 16 nt, Homo sapiens
cuggucagcagagccg

SEQ ID NO: 440772 - RNA, 19 nt, Homo sapiens
cugguccagggcuagugac

SEQ ID NO: 440773 - RNA, 20 nt, Homo sapiens
cuggugacaggcagacacau

SEQ ID NO: 440774 - RNA, 22 nt, Homo sapiens
cuggugacaggcagacacaugc

SEQ ID NO: 440775 - RNA, 22 nt, Homo sapiens
cuggugagauacccagagagaa

SEQ ID NO: 440776 - RNA, 17 nt, Homo sapiens
cuggugccguugcugcg

SEQ ID NO: 440777 - RNA, 12 nt, Homo sapiens
cugguucaauuu

SEQ ID NO: 440778 - RNA, 14 nt, Homo sapiens
cugguucaguggga

SEQ ID NO: 440779 - RNA, 21 nt, Homo sapiens
cugguucccccaggacccuga

SEQ ID NO: 440780 - RNA, 17 nt, Homo sapiens
cugguuccuuaaguggc

SEQ ID NO: 440781 - RNA, 20 nt, Homo sapiens
cugguucuguacauguggaa

SEQ ID NO: 440782 - RNA, 20 nt, Homo sapiens
cugguugagaucaugucauu

SEQ ID NO: 440783 - RNA, 23 nt, Homo sapiens
cugguugcugggccucauucuag

SEQ ID NO: 440784 - RNA, 15 nt, Homo sapiens
cuguaaaauacaugg

SEQ ID NO: 440785 - RNA, 13 nt, Homo sapiens
cuguaaacauuca

SEQ ID NO: 440786 - RNA, 13 nt, Homo sapiens
cuguaaacuacca

SEQ ID NO: 440787 - RNA, 15 nt, Homo sapiens
cuguaaauaaccuau

SEQ ID NO: 440788 - RNA, 12 nt, Homo sapiens
cuguaaauaucc

SEQ ID NO: 440789 - RNA, 14 nt, Homo sapiens
cuguaaccaccucu

SEQ ID NO: 440790 - RNA, 18 nt, Homo sapiens
cuguaacucagacauucc

SEQ ID NO: 440791 - RNA, 19 nt, Homo sapiens
cuguaagauaauguugcuu

SEQ ID NO: 440792 - RNA, 12 nt, Homo sapiens
cuguaagcauuc

SEQ ID NO: 440793 - RNA, 16 nt, Homo sapiens
cuguaagcucuuugaa

SEQ ID NO: 440794 - RNA, 22 nt, Homo sapiens
cuguaauagccucaccuucccu

SEQ ID NO: 440795 - RNA, 20 nt, Homo sapiens
cuguaaucccaacacuuugg

SEQ ID NO: 440796 - RNA, 17 nt, Homo sapiens
cuguaaucccagcacuu

SEQ ID NO: 440797 - RNA, 17 nt, Homo sapiens
cuguaaucccaguacuu

SEQ ID NO: 440798 - RNA, 16 nt, Homo sapiens
cuguaauuuuguagua

SEQ ID NO: 440799 - RNA, 18 nt, Homo sapiens
cuguacacugacuugaga

SEQ ID NO: 440800 - RNA, 23 nt, Homo sapiens
cuguacaguuucuuccccaagag

SEQ ID NO: 440801 - RNA, 12 nt, Homo sapiens
cuguacauacau

SEQ ID NO: 440802 - RNA, 16 nt, Homo sapiens
cuguaccauccaugga

SEQ ID NO: 440803 - RNA, 21 nt, Homo sapiens
cuguaccuguaggaaacagaa

SEQ ID NO: 440804 - RNA, 14 nt, Homo sapiens
cuguaccuuucuaa

SEQ ID NO: 440805 - RNA, 16 nt, Homo sapiens
cuguacuagugccauu

SEQ ID NO: 440806 - RNA, 17 nt, Homo sapiens
cuguacugagacauuac

SEQ ID NO: 440807 - RNA, 16 nt, Homo sapiens
cuguagaaauguaucc

SEQ ID NO: 440808 - RNA, 14 nt, Homo sapiens
cuguagaacugcaa

SEQ ID NO: 440809 - RNA, 15 nt, Homo sapiens
cuguagaacugcaau

SEQ ID NO: 440810 - RNA, 17 nt, Homo sapiens
cuguagacuagugccgu

SEQ ID NO: 440811 - RNA, 23 nt, Homo sapiens
cuguagcuuauauuugacauucu

SEQ ID NO: 440812 - RNA, 15 nt, Homo sapiens
cuguaguagcccuuu

SEQ ID NO: 440813 - RNA, 20 nt, Homo sapiens
cuguauaaccccaccuugcc

SEQ ID NO: 440814 - RNA, 22 nt, Homo sapiens
cuguauauuugaaacugcuaau

SEQ ID NO: 440815 - RNA, 14 nt, Homo sapiens
gaggcccaugugac

SEQ ID NO: 440816 - RNA, 17 nt, Homo sapiens
gaggccuggacuuuccu

SEQ ID NO: 440817 - RNA, 21 nt, Homo sapiens
gaggccuucagaaaagacacu

SEQ ID NO: 440818 - RNA, 17 nt, Homo sapiens
gaggcgaugccacgcuu

SEQ ID NO: 440819 - RNA, 19 nt, Homo sapiens
gaggcgggggagccuggag

SEQ ID NO: 440820 - RNA, 19 nt, Homo sapiens
gaggcgggggauccuggag

SEQ ID NO: 440821 - RNA, 12 nt, Homo sapiens
gaggcuauuaaa

SEQ ID NO: 440822 - RNA, 15 nt, Homo sapiens
gaggcucuguccuaa

SEQ ID NO: 440823 - RNA, 16 nt, Homo sapiens
gaggcucuugcucaag

SEQ ID NO: 440824 - RNA, 12 nt, Homo sapiens
gaggcugagacu

SEQ ID NO: 440825 - RNA, 20 nt, Homo sapiens
gaggcugcacccacccagga

SEQ ID NO: 440826 - RNA, 15 nt, Homo sapiens
gaggcuugggaccgc

SEQ ID NO: 440827 - RNA, 18 nt, Homo sapiens
gagggaccaggugucuag

SEQ ID NO: 440828 - RNA, 17 nt, Homo sapiens
gagggacuucccuagaa

SEQ ID NO: 440829 - RNA, 20 nt, Homo sapiens
gagggagggcugacccagau

SEQ ID NO: 440830 - RNA, 13 nt, Homo sapiens
gagggagguguuu

SEQ ID NO: 440831 - RNA, 23 nt, Homo sapiens
gagggauaagccagcugcagcug

SEQ ID NO: 440832 - RNA, 16 nt, Homo sapiens
gagggaugcagugccu

SEQ ID NO: 440833 - RNA, 15 nt, Homo sapiens
gagggauguggagca

SEQ ID NO: 440834 - RNA, 20 nt, Homo sapiens
gagggcaaucuuugccuuua

SEQ ID NO: 440835 - RNA, 15 nt, Homo sapiens
gaggggaagggccag

SEQ ID NO: 440836 - RNA, 20 nt, Homo sapiens
gaggggagaggaagcacaag

SEQ ID NO: 440837 - RNA, 15 nt, Homo sapiens
gaggggcaacgaaga

SEQ ID NO: 440838 - RNA, 16 nt, Homo sapiens
gaggggcggggccagg

SEQ ID NO: 440839 - RNA, 18 nt, Homo sapiens
gaggggucaaguuauuaa

SEQ ID NO: 440840 - RNA, 23 nt, Homo sapiens
gagggugguuccuguucucagca

SEQ ID NO: 440841 - RNA, 22 nt, Homo sapiens
gagguagaggggaaggaaaucu

SEQ ID NO: 440842 - RNA, 22 nt, Homo sapiens
gagguauuugguaacuugcugu

SEQ ID NO: 440843 - RNA, 14 nt, Homo sapiens
gaggucaugcauug

SEQ ID NO: 440844 - RNA, 21 nt, Homo sapiens
gaggucuguacguuaccucuu

SEQ ID NO: 440845 - RNA, 16 nt, Homo sapiens
gaggugagaccaccuc

SEQ ID NO: 440846 - RNA, 18 nt, Homo sapiens
gagguggccccaccugag

SEQ ID NO: 440847 - RNA, 15 nt, Homo sapiens
gaggugggauccucc

SEQ ID NO: 440848 - RNA, 17 nt, Homo sapiens
gaguaaacuauucuaua

SEQ ID NO: 440849 - RNA, 12 nt, Homo sapiens
gaguagcuggau

SEQ ID NO: 440850 - RNA, 17 nt, Homo sapiens
gaguagggacucagggc

SEQ ID NO: 440851 - RNA, 23 nt, Homo sapiens
gaguaguaaucucacacuucauc

SEQ ID NO: 440852 - RNA, 21 nt, Homo sapiens
gaguaucugggaacugugccu

SEQ ID NO: 440853 - RNA, 16 nt, Homo sapiens
gagucacgagcugcug

SEQ ID NO: 440854 - RNA, 18 nt, Homo sapiens
gagucaggcuucucuugc

SEQ ID NO: 440855 - RNA, 19 nt, Homo sapiens
gagucaggcuucucuugcu

SEQ ID NO: 440856 - RNA, 14 nt, Homo sapiens
gagucauugaaggg

SEQ ID NO: 440857 - RNA, 14 nt, Homo sapiens
gagucauuguuaca

SEQ ID NO: 440858 - RNA, 15 nt, Homo sapiens
gaguccaaaaucauu

SEQ ID NO: 440859 - RNA, 16 nt, Homo sapiens
gaguccacugcuccau

SEQ ID NO: 440860 - RNA, 15 nt, Homo sapiens
gaguccucacuccca

SEQ ID NO: 440861 - RNA, 15 nt, Homo sapiens
gagucgaugcucaau

SEQ ID NO: 440862 - RNA, 18 nt, Homo sapiens
gagucgggagcacagcug

SEQ ID NO: 440863 - RNA, 12 nt, Homo sapiens
gagucucugaac

SEQ ID NO: 440864 - RNA, 16 nt, Homo sapiens
gagucuuuguaaugcu

SEQ ID NO: 440865 - RNA, 19 nt, Homo sapiens
gagugaaaacaucugcaca

SEQ ID NO: 440866 - RNA, 15 nt, Homo sapiens
gagugagcacucacg

SEQ ID NO: 440867 - RNA, 15 nt, Homo sapiens
gagugcaaugaauga

SEQ ID NO: 440868 - RNA, 20 nt, Homo sapiens
gagugcagaucugugcucau

SEQ ID NO: 440869 - RNA, 16 nt, Homo sapiens
gagugcucaccgccuc

SEQ ID NO: 440870 - RNA, 14 nt, Homo sapiens
gaguggaaggucua

SEQ ID NO: 440871 - RNA, 14 nt, Homo sapiens
gaguggaaggugag

SEQ ID NO: 440872 - RNA, 13 nt, Homo sapiens
gagugggaccaac

SEQ ID NO: 440873 - RNA, 18 nt, Homo sapiens
gagugggguggggagcau

SEQ ID NO: 440874 - RNA, 21 nt, Homo sapiens
gaguggucaggcaucuucccu

SEQ ID NO: 440875 - RNA, 19 nt, Homo sapiens
gagugucacugagcugugu

SEQ ID NO: 440876 - RNA, 14 nt, Homo sapiens
gagugugugcaagu

SEQ ID NO: 440877 - RNA, 14 nt, Homo sapiens
gagugugugcaugu

SEQ ID NO: 440878 - RNA, 22 nt, Homo sapiens
gaguguucauuuuagugacugu

SEQ ID NO: 440879 - RNA, 16 nt, Homo sapiens
gaguucaaugaucuag

SEQ ID NO: 440880 - RNA, 12 nt, Homo sapiens
gaguucagggag

SEQ ID NO: 440881 - RNA, 17 nt, Homo sapiens
gaguuccuaacaggaug

SEQ ID NO: 440882 - RNA, 14 nt, Homo sapiens
gaguucuguucauc

SEQ ID NO: 440883 - RNA, 14 nt, Homo sapiens
gaguuggcaaaaug

SEQ ID NO: 440884 - RNA, 18 nt, Homo sapiens
gaguuggcguugugggca

SEQ ID NO: 440885 - RNA, 17 nt, Homo sapiens
gaguugucaagucucug

SEQ ID NO: 440886 - RNA, 20 nt, Homo sapiens
gaguuuccagcuaagccuga

SEQ ID NO: 440887 - RNA, 23 nt, Homo sapiens
gaguuuccagcuaagccugauga

SEQ ID NO: 440888 - RNA, 17 nt, Homo sapiens
gaguuucuucuaaagag

SEQ ID NO: 440889 - RNA, 17 nt, Homo sapiens
gaguuugcaaugucaca

SEQ ID NO: 440890 - RNA, 23 nt, Homo sapiens
gaguuuuaaagaagucucuuaau

SEQ ID NO: 440891 - RNA, 18 nt, Homo sapiens
gaguuuuuaauggccauu

SEQ ID NO: 440892 - RNA, 21 nt, Homo sapiens
gauaaaaaauuuauuaugucc

SEQ ID NO: 440893 - RNA, 13 nt, Homo sapiens
gauaaacuuugaa

SEQ ID NO: 440894 - RNA, 12 nt, Homo sapiens
gauaaagcaccc

SEQ ID NO: 440895 - RNA, 14 nt, Homo sapiens
gauaaauagcuaaa

SEQ ID NO: 440896 - RNA, 14 nt, Homo sapiens
gauaaaucauuuca

SEQ ID NO: 440897 - RNA, 22 nt, Homo sapiens
gauaacaugcuuuggguggaau

SEQ ID NO: 440898 - RNA, 12 nt, Homo sapiens
gauaaccacagg

SEQ ID NO: 440899 - RNA, 21 nt, Homo sapiens
gauaagcuugucuaugguaca

SEQ ID NO: 440900 - RNA, 19 nt, Homo sapiens
gauaauaaaggcauuucaa

SEQ ID NO: 440901 - RNA, 11 nt, Homo sapiens
gauaaugccuu

SEQ ID NO: 440902 - RNA, 22 nt, Homo sapiens
gauacaaauguuagucccuaac

SEQ ID NO: 440903 - RNA, 14 nt, Homo sapiens
uccuugauuacaua

SEQ ID NO: 440904 - RNA, 20 nt, Homo sapiens
uccuugcccagacuacaggg

SEQ ID NO: 440905 - RNA, 17 nt, Homo sapiens
uccuugccgcugggaga

SEQ ID NO: 440906 - RNA, 23 nt, Homo sapiens
uccuugcuuuuauguuuguacac

SEQ ID NO: 440907 - RNA, 14 nt, Homo sapiens
uccuugucacuuua

SEQ ID NO: 440908 - RNA, 13 nt, Homo sapiens
uccuugugguuuu

SEQ ID NO: 440909 - RNA, 13 nt, Homo sapiens
uccuuguuccuag

SEQ ID NO: 440910 - RNA, 15 nt, Homo sapiens
uccuuucauccucag

SEQ ID NO: 440911 - RNA, 21 nt, Homo sapiens
uccuuuccccggaguaccuau

SEQ ID NO: 440912 - RNA, 23 nt, Homo sapiens
uccuuucccugggguacuacucu

SEQ ID NO: 440913 - RNA, 22 nt, Homo sapiens
uccuuucuugcacuauuccaca

SEQ ID NO: 440914 - RNA, 20 nt, Homo sapiens
uccuuugaagaaaaagacac

SEQ ID NO: 440915 - RNA, 16 nt, Homo sapiens
uccuuuguacugauga

SEQ ID NO: 440916 - RNA, 23 nt, Homo sapiens
uccuuuguuuuuuuuuccugucc

SEQ ID NO: 440917 - RNA, 17 nt, Homo sapiens
uccuuuuuuauugaaua

SEQ ID NO: 440918 - RNA, 20 nt, Homo sapiens
ucgaaccaaggcagccucca

SEQ ID NO: 440919 - RNA, 14 nt, Homo sapiens
ucgaagcuccguga

SEQ ID NO: 440920 - RNA, 19 nt, Homo sapiens
ucgaagcuccgugagugaa

SEQ ID NO: 440921 - RNA, 19 nt, Homo sapiens
ucgaauaucuuaauuccuu

SEQ ID NO: 440922 - RNA, 23 nt, Homo sapiens
ucgacucuuugcaacagcacuug

SEQ ID NO: 440923 - RNA, 19 nt, Homo sapiens
ucgacuguauucgugcauu

SEQ ID NO: 440924 - RNA, 17 nt, Homo sapiens
ucgaggcucuugcucaa

SEQ ID NO: 440925 - RNA, 16 nt, Homo sapiens
ucgaguccaaaaucau

SEQ ID NO: 440926 - RNA, 19 nt, Homo sapiens
ucgaugcucacugcuucug

SEQ ID NO: 440927 - RNA, 19 nt, Homo sapiens
ucgcaaaaugaugugaaag

SEQ ID NO: 440928 - RNA, 22 nt, Homo sapiens
ucgcaacaggaaggaaccagaa

SEQ ID NO: 440929 - RNA, 16 nt, Homo sapiens
ucgcaaggccugugcu

SEQ ID NO: 440930 - RNA, 14 nt, Homo sapiens
ucgcaggagucucu

SEQ ID NO: 440931 - RNA, 16 nt, Homo sapiens
ucgcaucucagugcag

SEQ ID NO: 440932 - RNA, 22 nt, Homo sapiens
ucgccccuccaguguugccucc

SEQ ID NO: 440933 - RNA, 23 nt, Homo sapiens
ucgcggcgcagccccuggagcuc

SEQ ID NO: 440934 - RNA, 22 nt, Homo sapiens
ucgcucagcaauagggugcagu

SEQ ID NO: 440935 - RNA, 13 nt, Homo sapiens
ucgcugggcucaa

SEQ ID NO: 440936 - RNA, 18 nt, Homo sapiens
ucgcuggugaagacccag

SEQ ID NO: 440937 - RNA, 16 nt, Homo sapiens
ucgcugugccaccacc

SEQ ID NO: 440938 - RNA, 16 nt, Homo sapiens
ucgcuuuguugcccag

SEQ ID NO: 440939 - RNA, 17 nt, Homo sapiens
ucggaucuagccauggc

SEQ ID NO: 440940 - RNA, 14 nt, Homo sapiens
ucgggaacaguguu

SEQ ID NO: 440941 - RNA, 23 nt, Homo sapiens
ucgggaagagaggaguucaauga

SEQ ID NO: 440942 - RNA, 16 nt, Homo sapiens
ucggucaccugugcua

SEQ ID NO: 440943 - RNA, 17 nt, Homo sapiens
ucggugcagaaacuacc

SEQ ID NO: 440944 - RNA, 15 nt, Homo sapiens
ucggugguaccugag

SEQ ID NO: 440945 - RNA, 18 nt, Homo sapiens
ucuccugaagaggaacug

SEQ ID NO: 440946 - RNA, 16 nt, Homo sapiens
ucuccuguauaaucuc

SEQ ID NO: 440947 - RNA, 13 nt, Homo sapiens
ucuccugugccca

SEQ ID NO: 440948 - RNA, 16 nt, Homo sapiens
ucuccuucccauuucu

SEQ ID NO: 440949 - RNA, 21 nt, Homo sapiens
ucuccuuguaaaagccuaugu

SEQ ID NO: 440950 - RNA, 14 nt, Homo sapiens
ucuccuuuguccau

SEQ ID NO: 440951 - RNA, 17 nt, Homo sapiens
ucucgcuagccauauau

SEQ ID NO: 440952 - RNA, 22 nt, Homo sapiens
ucucggaguaucugggaacugu

SEQ ID NO: 440953 - RNA, 15 nt, Homo sapiens
ucucggucacaggga

SEQ ID NO: 440954 - RNA, 18 nt, Homo sapiens
ucucuaaaacagcacuau

SEQ ID NO: 440955 - RNA, 17 nt, Homo sapiens
ucucuaaaauucuaguc

SEQ ID NO: 440956 - RNA, 23 nt, Homo sapiens
ucucuaaaauucuagucucugau

SEQ ID NO: 440957 - RNA, 16 nt, Homo sapiens
ucucuaaaucaaguau

SEQ ID NO: 440958 - RNA, 22 nt, Homo sapiens
ucucuaacagcucaggaucucu

SEQ ID NO: 440959 - RNA, 20 nt, Homo sapiens
ucucuaauagaaguccauga

SEQ ID NO: 440960 - RNA, 17 nt, Homo sapiens
ucucuacccacuaugca

SEQ ID NO: 440961 - RNA, 21 nt, Homo sapiens
ucucuaucauguugaagucaa

SEQ ID NO: 440962 - RNA, 21 nt, Homo sapiens
ucucucccugccucacaucuc

SEQ ID NO: 440963 - RNA, 23 nt, Homo sapiens
ucucuccuaagacaccugcaaua

SEQ ID NO: 440964 - RNA, 19 nt, Homo sapiens
ucucuccuuauagacacuu

SEQ ID NO: 440965 - RNA, 13 nt, Homo sapiens
ucucucucucaaa

SEQ ID NO: 440966 - RNA, 19 nt, Homo sapiens
ucucugaagcauguuucau

SEQ ID NO: 440967 - RNA, 15 nt, Homo sapiens
ucucugagcuccagu

SEQ ID NO: 440968 - RNA, 13 nt, Homo sapiens
ucucugcaaaaaa

SEQ ID NO: 440969 - RNA, 18 nt, Homo sapiens
ucucugccaagcccucaa

SEQ ID NO: 440970 - RNA, 12 nt, Homo sapiens
ucucugccagug

SEQ ID NO: 440971 - RNA, 17 nt, Homo sapiens
ucucugccauguggcag

SEQ ID NO: 440972 - RNA, 17 nt, Homo sapiens
ucucugcccacuaccua

SEQ ID NO: 440973 - RNA, 18 nt, Homo sapiens
ucucugcuccaccacauc

SEQ ID NO: 440974 - RNA, 16 nt, Homo sapiens
ucucugggcccagaga

SEQ ID NO: 440975 - RNA, 19 nt, Homo sapiens
ucucuguauaacuugugau

SEQ ID NO: 440976 - RNA, 21 nt, Homo sapiens
ucucuguggccauuugugaua

SEQ ID NO: 440977 - RNA, 19 nt, Homo sapiens
ucucuucuacaauuguggu

SEQ ID NO: 440978 - RNA, 13 nt, Homo sapiens
ucucuucuuccuu

SEQ ID NO: 440979 - RNA, 21 nt, Homo sapiens
ucucuugccagcauuuucaca

SEQ ID NO: 440980 - RNA, 15 nt, Homo sapiens
ucucuugcugccaca

SEQ ID NO: 440981 - RNA, 20 nt, Homo sapiens
ucucuuuaaguuuugauuaa

SEQ ID NO: 440982 - RNA, 19 nt, Homo sapiens
ucucuuugagucaagucaa

SEQ ID NO: 440983 - RNA, 17 nt, Homo sapiens
ucucuuuuccacugaca

SEQ ID NO: 440984 - RNA, 22 nt, Homo sapiens
ucucuuuuguuccuggcuuuga

SEQ ID NO: 440985 - RNA, 23 nt, Homo sapiens
ucucuuuuucuuguaaaccugga

SEQ ID NO: 440986 - RNA, 22 nt, Homo sapiens
ucucuuuuuggaggugcuuaag

SEQ ID NO: 440987 - RNA, 20 nt, Homo sapiens
ucugaaaaaguauccugcuu

SEQ ID NO: 440988 - RNA, 22 nt, Homo sapiens
ucugaaagucaugcacauaccu

SEQ ID NO: 440989 - RNA, 14 nt, Homo sapiens
ucugaaauuuccca

SEQ ID NO: 440990 - RNA, 13 nt, Homo sapiens
ucugaaccauuac

SEQ ID NO: 440991 - RNA, 17 nt, Homo sapiens
ucugaaccauuacugua

SEQ ID NO: 440992 - RNA, 13 nt, Homo sapiens
ucugaagaucuca

SEQ ID NO: 440993 - RNA, 20 nt, Homo sapiens
ucugaagggccccuugcaaa

SEQ ID NO: 440994 - RNA, 18 nt, Homo sapiens
ucugaagguaauacuaua

SEQ ID NO: 440995 - RNA, 13 nt, Homo sapiens
ucugaauccucau

SEQ ID NO: 440996 - RNA, 18 nt, Homo sapiens
ucugacaugauuccuucc

SEQ ID NO: 440997 - RNA, 12 nt, Homo sapiens
ucugaccucagc

SEQ ID NO: 440998 - RNA, 21 nt, Homo sapiens
ucugaccucaugagugucaaa

SEQ ID NO: 440999 - RNA, 15 nt, Homo sapiens
ucugacucccaaaga

SEQ ID NO: 441000 - RNA, 23 nt, Homo sapiens
ucugacuguaaaauacaugguau

SEQ ID NO: 441001 - RNA, 22 nt, Homo sapiens
ucugagaacaaauacaauucag

SEQ ID NO: 441002 - RNA, 22 nt, Homo sapiens
ucugagagugaaaccaugacug

SEQ ID NO: 441003 - RNA, 13 nt, Homo sapiens
ucugagauacuaa

SEQ ID NO: 441004 - RNA, 15 nt, Homo sapiens
ucugagccaaagaga

SEQ ID NO: 441005 - RNA, 21 nt, Homo sapiens
ucugagccagucccucagcca

SEQ ID NO: 441006 - RNA, 22 nt, Homo sapiens
ucugagccccugggacugcugc

SEQ ID NO: 441007 - RNA, 15 nt, Homo sapiens
ucugaggaguccaaa

SEQ ID NO: 441008 - RNA, 23 nt, Homo sapiens
ucugaggggaugcaacaaaauga

SEQ ID NO: 441009 - RNA, 14 nt, Homo sapiens
ucugagucaucaaa

SEQ ID NO: 441010 - RNA, 23 nt, Homo sapiens
ucugaguugagcacuggucacau

SEQ ID NO: 441011 - RNA, 17 nt, Homo sapiens
ucugaucaaagcaccuu

SEQ ID NO: 441012 - RNA, 14 nt, Homo sapiens
ucugaucaguauug

SEQ ID NO: 441013 - RNA, 22 nt, Homo sapiens
ucugaucugcaguuuuugccug

SEQ ID NO: 441014 - RNA, 20 nt, Homo sapiens
ucugauguuuugaugccauu

SEQ ID NO: 441015 - RNA, 19 nt, Homo sapiens
ucugcaaaggcaccugaau

SEQ ID NO: 441016 - RNA, 21 nt, Homo sapiens
ucugcacaacugggcacugga

SEQ ID NO: 441017 - RNA, 19 nt, Homo sapiens
ucugcagcacucuuaucua

SEQ ID NO: 441018 - RNA, 16 nt, Homo sapiens
ucugcauuuucugggu

SEQ ID NO: 441019 - RNA, 19 nt, Homo sapiens
ucugccacccacucaggau

SEQ ID NO: 441020 - RNA, 21 nt, Homo sapiens
ucugccacccacucaggauug

SEQ ID NO: 441021 - RNA, 17 nt, Homo sapiens
ucugccacuugcacugu

SEQ ID NO: 441022 - RNA, 23 nt, Homo sapiens
ucugccagggcagugcuagugag

SEQ ID NO: 441023 - RNA, 15 nt, Homo sapiens
ucugccauguggcag

SEQ ID NO: 441024 - RNA, 14 nt, Homo sapiens
ucugcccaccgacc

SEQ ID NO: 441025 - RNA, 18 nt, Homo sapiens
ucugccccguuucuugcc

SEQ ID NO: 441026 - RNA, 22 nt, Homo sapiens
ucugccugggcuuaugcccuca

SEQ ID NO: 441027 - RNA, 23 nt, Homo sapiens
ucugccuguggccuugcccgcca

SEQ ID NO: 441028 - RNA, 18 nt, Homo sapiens
ucugccuuguccugaugc

SEQ ID NO: 441029 - RNA, 20 nt, Homo sapiens
ucugcuagguagaggcauuu

SEQ ID NO: 441030 - RNA, 14 nt, Homo sapiens
ucugcuccaugcag

SEQ ID NO: 441031 - RNA, 21 nt, Homo sapiens
ucugcucugguuagaaaaagg

SEQ ID NO: 441032 - RNA, 14 nt, Homo sapiens
ucugcugaacauuu

SEQ ID NO: 441033 - RNA, 23 nt, Homo sapiens
ucugcuguauacuguacugagac

SEQ ID NO: 441034 - RNA, 22 nt, Homo sapiens
ucugcuuacaauucccugcugu

SEQ ID NO: 441035 - RNA, 12 nt, Homo sapiens
ucugcuuaccaa

SEQ ID NO: 441036 - RNA, 17 nt, Homo sapiens
ucugcuuaccaaaacau

SEQ ID NO: 441037 - RNA, 22 nt, Homo sapiens
ucugcuugccgacuggcuguga

SEQ ID NO: 441038 - RNA, 20 nt, Homo sapiens
gauugcacguggccucuuga

SEQ ID NO: 441039 - RNA, 19 nt, Homo sapiens
gauuggcuauaacaugucu

SEQ ID NO: 441040 - RNA, 18 nt, Homo sapiens
gauuggguaucaaaauga

SEQ ID NO: 441041 - RNA, 19 nt, Homo sapiens
gauugugaccuccagaggu

SEQ ID NO: 441042 - RNA, 19 nt, Homo sapiens
gauugugcgugcaugugug

SEQ ID NO: 441043 - RNA, 19 nt, Homo sapiens
gauuuaaauagaacuugau

SEQ ID NO: 441044 - RNA, 14 nt, Homo sapiens
gauuuaagcauuuu

SEQ ID NO: 441045 - RNA, 12 nt, Homo sapiens
gauuuaugcauu

SEQ ID NO: 441046 - RNA, 14 nt, Homo sapiens
gauuucaaaugcug

SEQ ID NO: 441047 - RNA, 14 nt, Homo sapiens
gauuucacugacac

SEQ ID NO: 441048 - RNA, 19 nt, Homo sapiens
gauuucagcacaugcacua

SEQ ID NO: 441049 - RNA, 23 nt, Homo sapiens
gauuucuccaaccacucaucccu

SEQ ID NO: 441050 - RNA, 14 nt, Homo sapiens
gauuucuugcuaag

SEQ ID NO: 441051 - RNA, 22 nt, Homo sapiens
gauuugguuaagcucacacagc

SEQ ID NO: 441052 - RNA, 23 nt, Homo sapiens
gauuuguauuuauauuagagugc

SEQ ID NO: 441053 - RNA, 18 nt, Homo sapiens
gauuuuaaaaagucuuca

SEQ ID NO: 441054 - RNA, 19 nt, Homo sapiens
gauuuuaaaaagucuucac

SEQ ID NO: 441055 - RNA, 20 nt, Homo sapiens
gauuuuaaaaagucuucacu

SEQ ID NO: 441056 - RNA, 21 nt, Homo sapiens
gauuuuaucuguuaaccaaau

SEQ ID NO: 441057 - RNA, 17 nt, Homo sapiens
gauuuuauuuaaacuau

SEQ ID NO: 441058 - RNA, 16 nt, Homo sapiens
gauuuuauuugacaaa

SEQ ID NO: 441059 - RNA, 20 nt, Homo sapiens
gauuuuauuuucaagcaaau

SEQ ID NO: 441060 - RNA, 13 nt, Homo sapiens
gauuuuccuuccu

SEQ ID NO: 441061 - RNA, 15 nt, Homo sapiens
gauuuucuauuuaug

SEQ ID NO: 441062 - RNA, 15 nt, Homo sapiens
gauuuugaacauacu

SEQ ID NO: 441063 - RNA, 21 nt, Homo sapiens
gauuuugcuuuucccuagugc

SEQ ID NO: 441064 - RNA, 17 nt, Homo sapiens
gauuuuucugcacuaau

SEQ ID NO: 441065 - RNA, 17 nt, Homo sapiens
gauuuuuguauguuaug

SEQ ID NO: 441066 - RNA, 15 nt, Homo sapiens
gcaaaaaaugaaugu

SEQ ID NO: 441067 - RNA, 23 nt, Homo sapiens
gcaaaaacaaaugggaaaauguc

SEQ ID NO: 441068 - RNA, 16 nt, Homo sapiens
gcaaaaccuuaccuug

SEQ ID NO: 441069 - RNA, 18 nt, Homo sapiens
gcaaaagcaucuauguga

SEQ ID NO: 441070 - RNA, 18 nt, Homo sapiens
gcaaaagguuaagccaua

SEQ ID NO: 441071 - RNA, 22 nt, Homo sapiens
gcaaaagugcaguagugucacu

SEQ ID NO: 441072 - RNA, 18 nt, Homo sapiens
gcaaaaucuguucuaaca

SEQ ID NO: 441073 - RNA, 15 nt, Homo sapiens
ugugugccaucaugc

SEQ ID NO: 441074 - RNA, 17 nt, Homo sapiens
ugugugcgugugcgugc

SEQ ID NO: 441075 - RNA, 15 nt, Homo sapiens
uguguggccugccuu

SEQ ID NO: 441076 - RNA, 22 nt, Homo sapiens
uguguguauauaguaugaaugc

SEQ ID NO: 441077 - RNA, 18 nt, Homo sapiens
uguguguauguuugcaca

SEQ ID NO: 441078 - RNA, 21 nt, Homo sapiens
ggaauggaaagcggaguuccu

SEQ ID NO: 441079 - RNA, 23 nt, Homo sapiens
ggaauugaagacacguucuugcc

SEQ ID NO: 441080 - RNA, 20 nt, Homo sapiens
ggaauuuccucuauugaugu

SEQ ID NO: 441081 - RNA, 21 nt, Homo sapiens
ggacaaaccgagugcaaugaa

SEQ ID NO: 441082 - RNA, 17 nt, Homo sapiens
ggacaaagaaauagcaa

SEQ ID NO: 441083 - RNA, 22 nt, Homo sapiens
ggacaacagagaugccaugaua

SEQ ID NO: 441084 - RNA, 12 nt, Homo sapiens
ggacaccucuca

SEQ ID NO: 441085 - RNA, 17 nt, Homo sapiens
ggacaggugaauggagg

SEQ ID NO: 441086 - RNA, 11 nt, Homo sapiens
ggacauguguu

SEQ ID NO: 441087 - RNA, 22 nt, Homo sapiens
ggaccaauuagcauuccaucaa

SEQ ID NO: 441088 - RNA, 14 nt, Homo sapiens
ggaccacaguaaca

SEQ ID NO: 441089 - RNA, 15 nt, Homo sapiens
ggaccaguggugccu

SEQ ID NO: 441090 - RNA, 16 nt, Homo sapiens
ggaccaguuucuugaa

SEQ ID NO: 441091 - RNA, 17 nt, Homo sapiens
ggaccauucauacccac

SEQ ID NO: 441092 - RNA, 22 nt, Homo sapiens
ggacccacacugcuacacuucu

SEQ ID NO: 441093 - RNA, 14 nt, Homo sapiens
ggacccggauguga

SEQ ID NO: 441094 - RNA, 14 nt, Homo sapiens
ggaccuauguuugc

SEQ ID NO: 441095 - RNA, 20 nt, Homo sapiens
ggaccugcuuugagauuucc

SEQ ID NO: 441096 - RNA, 18 nt, Homo sapiens
ggacgcaauugugggaug

SEQ ID NO: 441097 - RNA, 16 nt, Homo sapiens
ggacgcacacagcuuu

SEQ ID NO: 441098 - RNA, 16 nt, Homo sapiens
ggacgggguccaggag

SEQ ID NO: 441099 - RNA, 12 nt, Homo sapiens
ggacuacuccaa

SEQ ID NO: 441100 - RNA, 23 nt, Homo sapiens
ggacuaucaacaccacuaggaau

SEQ ID NO: 441101 - RNA, 23 nt, Homo sapiens
ggacucagguugucugaagucac

SEQ ID NO: 441102 - RNA, 17 nt, Homo sapiens
ggacucccgggccacgc

SEQ ID NO: 441103 - RNA, 16 nt, Homo sapiens
ggacucuacacuguga

SEQ ID NO: 441104 - RNA, 14 nt, Homo sapiens
ggacucuugcucuu

SEQ ID NO: 441105 - RNA, 15 nt, Homo sapiens
ggacugaagccaaag

SEQ ID NO: 441106 - RNA, 15 nt, Homo sapiens
ggacugcuggcaugc

SEQ ID NO: 441107 - RNA, 17 nt, Homo sapiens
ggacugucagcugagcu

SEQ ID NO: 441108 - RNA, 13 nt, Homo sapiens
ggacugugacuca

SEQ ID NO: 441109 - RNA, 11 nt, Homo sapiens
ggacugugucc

SEQ ID NO: 441110 - RNA, 22 nt, Homo sapiens
ggacuucuccuccaguggaccu

SEQ ID NO: 441111 - RNA, 14 nt, Homo sapiens
ggacuuggguccuc

SEQ ID NO: 441112 - RNA, 13 nt, Homo sapiens
ggacuuguaggga

SEQ ID NO: 441113 - RNA, 13 nt, Homo sapiens
ggacuuuauuuaa

SEQ ID NO: 441114 - RNA, 17 nt, Homo sapiens
ggacuuuuauuuuggca

SEQ ID NO: 441115 - RNA, 13 nt, Homo sapiens
ggagaaaauggac

SEQ ID NO: 441116 - RNA, 14 nt, Homo sapiens
ggagaacuagagaa

SEQ ID NO: 441117 - RNA, 21 nt, Homo sapiens
ggagaacugugcucucccaaa

SEQ ID NO: 441118 - RNA, 21 nt, Homo sapiens
ggagaacuugcucaagugcag

SEQ ID NO: 441119 - RNA, 18 nt, Homo sapiens
ggagacacuggucucaga

SEQ ID NO: 441120 - RNA, 23 nt, Homo sapiens
ggagacccaugugcuuccuugcu

SEQ ID NO: 441121 - RNA, 14 nt, Homo sapiens
ggagaccuggcacu

SEQ ID NO: 441122 - RNA, 14 nt, Homo sapiens
ggagacgggggcag

SEQ ID NO: 441123 - RNA, 12 nt, Homo sapiens
ggagacuguccc

SEQ ID NO: 441124 - RNA, 16 nt, Homo sapiens
ggagacuuuacaugga

SEQ ID NO: 441125 - RNA, 18 nt, Homo sapiens
ggagagcaucugcucuga

SEQ ID NO: 441126 - RNA, 22 nt, Homo sapiens
ggagagccaaggccuaugccac

SEQ ID NO: 441127 - RNA, 13 nt, Homo sapiens
ggagaggccauga

SEQ ID NO: 441128 - RNA, 22 nt, Homo sapiens
ggagaguaacccugucuaauga

SEQ ID NO: 441129 - RNA, 14 nt, Homo sapiens
ggagauagugccag

SEQ ID NO: 441130 - RNA, 14 nt, Homo sapiens
ggagaucuucacuc

SEQ ID NO: 441131 - RNA, 20 nt, Homo sapiens
ggagaucuuggggugcagca

SEQ ID NO: 441132 - RNA, 12 nt, Homo sapiens
ggagcacgugga

SEQ ID NO: 441133 - RNA, 18 nt, Homo sapiens
ggagcaggaccuacuagg

SEQ ID NO: 441134 - RNA, 16 nt, Homo sapiens
ggagccaauacugagu

SEQ ID NO: 441135 - RNA, 16 nt, Homo sapiens
ggagccaccuguccca

SEQ ID NO: 441136 - RNA, 19 nt, Homo sapiens
ggagcccugggguuuccac

SEQ ID NO: 441137 - RNA, 22 nt, Homo sapiens
ggagccuguguuagugucuguc

SEQ ID NO: 441138 - RNA, 14 nt, Homo sapiens
ggagcugcucagaa

SEQ ID NO: 441139 - RNA, 12 nt, Homo sapiens
ggagcuggugac

SEQ ID NO: 441140 - RNA, 15 nt, Homo sapiens
ggagcugucuuguca

SEQ ID NO: 441141 - RNA, 23 nt, Homo sapiens
ggagcuuuagcuucucugccaag

SEQ ID NO: 441142 - RNA, 20 nt, Homo sapiens
ggagcuuuugguaugugaca

SEQ ID NO: 441143 - RNA, 18 nt, Homo sapiens
ggaggacuccgggaccau

SEQ ID NO: 441144 - RNA, 18 nt, Homo sapiens
ggaggccauuuguguuua

SEQ ID NO: 441145 - RNA, 22 nt, Homo sapiens
ggaggcucugaagagauaccca

SEQ ID NO: 441146 - RNA, 20 nt, Homo sapiens
ggaggcugcagugagccaag

SEQ ID NO: 441147 - RNA, 14 nt, Homo sapiens
ggagguauuugaaa

SEQ ID NO: 441148 - RNA, 22 nt, Homo sapiens
ggaggugcuuaagcagaagcau

SEQ ID NO: 441149 - RNA, 19 nt, Homo sapiens
ggagguugagaaugcagug

SEQ ID NO: 441150 - RNA, 21 nt, Homo sapiens
ggaguaccuggaccuguccau

SEQ ID NO: 441151 - RNA, 23 nt, Homo sapiens
ggagucagucuucacuugcacug

SEQ ID NO: 441152 - RNA, 15 nt, Homo sapiens
ggaguccaggccaug

SEQ ID NO: 441153 - RNA, 15 nt, Homo sapiens
ggaguccuguucuca

SEQ ID NO: 441154 - RNA, 14 nt, Homo sapiens
ggagucucugccac

SEQ ID NO: 441155 - RNA, 22 nt, Homo sapiens
ggagugcaguggcgugaucucg

SEQ ID NO: 441156 - RNA, 19 nt, Homo sapiens
ggauaagcacuagaucucc

SEQ ID NO: 441157 - RNA, 18 nt, Homo sapiens
ggauaauaacuagaucuc

SEQ ID NO: 441158 - RNA, 12 nt, Homo sapiens
ggauacagucau

SEQ ID NO: 441159 - RNA, 19 nt, Homo sapiens
ggauaccuuaauucuuugu

SEQ ID NO: 441160 - RNA, 12 nt, Homo sapiens
ggauagccuuug

SEQ ID NO: 441161 - RNA, 20 nt, Homo sapiens
ggauaugagccuuugcacag

SEQ ID NO: 441162 - RNA, 13 nt, Homo sapiens
ggauauugacaag

SEQ ID NO: 441163 - RNA, 16 nt, Homo sapiens
ggaucagaagauaucu

SEQ ID NO: 441164 - RNA, 21 nt, Homo sapiens
ggaucagccuccgccauucca

SEQ ID NO: 441165 - RNA, 22 nt, Homo sapiens
ggaucauguaaaugcucaaaga

SEQ ID NO: 441166 - RNA, 17 nt, Homo sapiens
ggaucccguguugccau

SEQ ID NO: 441167 - RNA, 14 nt, Homo sapiens
ggaucgcaccuuuu

SEQ ID NO: 441168 - RNA, 14 nt, Homo sapiens
ggaucuacacccac

SEQ ID NO: 441169 - RNA, 14 nt, Homo sapiens
ggaucuaguccagc

SEQ ID NO: 441170 - RNA, 19 nt, Homo sapiens
ggaucuucccacuuugcca

SEQ ID NO: 441171 - RNA, 20 nt, Homo sapiens
ggaucuucccacuuugccac

SEQ ID NO: 441172 - RNA, 21 nt, Homo sapiens
ggaugcaacaaaaugauccuu

SEQ ID NO: 441173 - RNA, 15 nt, Homo sapiens
ggaugcagugccuuu

SEQ ID NO: 441174 - RNA, 23 nt, Homo sapiens
ggaugccaaccggucacccagga

SEQ ID NO: 441175 - RNA, 18 nt, Homo sapiens
ggaugcugugccucccaa

SEQ ID NO: 441176 - RNA, 11 nt, Homo sapiens
ggaugucauag

SEQ ID NO: 441177 - RNA, 15 nt, Homo sapiens
ggaugucuuccuugg

SEQ ID NO: 441178 - RNA, 18 nt, Homo sapiens
ggauguugcuuuugcacc

SEQ ID NO: 441179 - RNA, 23 nt, Homo sapiens
ggauuagaaauaaagcaucucau

SEQ ID NO: 441180 - RNA, 19 nt, Homo sapiens
ggauuaugggucacaggaa

SEQ ID NO: 441181 - RNA, 20 nt, Homo sapiens
ggauucucgacucuuugcaa

SEQ ID NO: 441182 - RNA, 15 nt, Homo sapiens
ggauuggcuuugugc

SEQ ID NO: 441183 - RNA, 22 nt, Homo sapiens
ggauugucuuacuguugcauaa

SEQ ID NO: 441184 - RNA, 18 nt, Homo sapiens
ggauuuaacagucauuua

SEQ ID NO: 441185 - RNA, 14 nt, Homo sapiens
ggcaaacaggcagu

SEQ ID NO: 441186 - RNA, 14 nt, Homo sapiens
ggcaaagugcugua

SEQ ID NO: 441187 - RNA, 20 nt, Homo sapiens
ggcaacaguacuucaaacag

SEQ ID NO: 441188 - RNA, 21 nt, Homo sapiens
ggcaaggaugaaagacaaaga

SEQ ID NO: 441189 - RNA, 22 nt, Homo sapiens
ggcaaggcagcucccagguuua

SEQ ID NO: 441190 - RNA, 15 nt, Homo sapiens
ggcaagggguuucca

SEQ ID NO: 441191 - RNA, 19 nt, Homo sapiens
ggcaaguugccacuuguca

SEQ ID NO: 441192 - RNA, 22 nt, Homo sapiens
ggcaauauaaggggaugaggaa

SEQ ID NO: 441193 - RNA, 19 nt, Homo sapiens
ggcaaugggaggggaugcu

SEQ ID NO: 441194 - RNA, 23 nt, Homo sapiens
ggcaauuuuuacacaaaccugaa

SEQ ID NO: 441195 - RNA, 16 nt, Homo sapiens
ggcacaaaugcaccuc

SEQ ID NO: 441196 - RNA, 23 nt, Homo sapiens
ggcacaaaugcaccucccaguuu

SEQ ID NO: 441197 - RNA, 21 nt, Homo sapiens
ggcacaauuuuaauucaaaag

SEQ ID NO: 441198 - RNA, 16 nt, Homo sapiens
ggcacacugccagugu

SEQ ID NO: 441199 - RNA, 20 nt, Homo sapiens
ggcacagggucugcucuuuc

SEQ ID NO: 441200 - RNA, 22 nt, Homo sapiens
ggcaccucauggacuccaggau

SEQ ID NO: 441201 - RNA, 22 nt, Homo sapiens
ggcacuggcauugucccugugc

SEQ ID NO: 441202 - RNA, 16 nt, Homo sapiens
ggcagaauggugggcu

SEQ ID NO: 441203 - RNA, 17 nt, Homo sapiens
ggcuucgcgcuggaauc

SEQ ID NO: 441204 - RNA, 23 nt, Homo sapiens
ggcuucuccgucacuccauucuc

SEQ ID NO: 441205 - RNA, 13 nt, Homo sapiens
ggcuucuccugac

SEQ ID NO: 441206 - RNA, 10 nt, Homo sapiens
ggcuugacuc

SEQ ID NO: 441207 - RNA, 18 nt, Homo sapiens
ggcuuuccucagcaccug

SEQ ID NO: 441208 - RNA, 19 nt, Homo sapiens
ggcuuugcagggagaccag

SEQ ID NO: 441209 - RNA, 23 nt, Homo sapiens
ggcuuuggacuccuuguuugccu

SEQ ID NO: 441210 - RNA, 14 nt, Homo sapiens
ggcuuuuccaaaag

SEQ ID NO: 441211 - RNA, 13 nt, Homo sapiens
ggcuuuuucccag

SEQ ID NO: 441212 - RNA, 19 nt, Homo sapiens
gggaaagcagaguggugga

SEQ ID NO: 441213 - RNA, 21 nt, Homo sapiens
gggaaaggcaucuaagacauu

SEQ ID NO: 441214 - RNA, 22 nt, Homo sapiens
gggaacgaggggaaaguucuca

SEQ ID NO: 441215 - RNA, 18 nt, Homo sapiens
uuaaauuuuauaugggcu

SEQ ID NO: 441216 - RNA, 18 nt, Homo sapiens
uuaacaacuugaauuaca

SEQ ID NO: 441217 - RNA, 17 nt, Homo sapiens
uuaacaauaacuacugu

SEQ ID NO: 441218 - RNA, 14 nt, Homo sapiens
uuaacaccuaccuc

SEQ ID NO: 441219 - RNA, 18 nt, Homo sapiens
uuaaccagucugaaguuu

SEQ ID NO: 441220 - RNA, 13 nt, Homo sapiens
uuaaccugcaaaa

SEQ ID NO: 441221 - RNA, 21 nt, Homo sapiens
uuaacuaguguuucugcagag

SEQ ID NO: 441222 - RNA, 19 nt, Homo sapiens
uuaacucaccucucaaggu

SEQ ID NO: 441223 - RNA, 12 nt, Homo sapiens
uuaacucagauc

SEQ ID NO: 441224 - RNA, 17 nt, Homo sapiens
uuaacugugaaccugga

SEQ ID NO: 441225 - RNA, 18 nt, Homo sapiens
uuaacuuccaauuuacau

SEQ ID NO: 441226 - RNA, 15 nt, Homo sapiens
uuaacuugaggguaa

SEQ ID NO: 441227 - RNA, 17 nt, Homo sapiens
uuaagaaaaacauguca

SEQ ID NO: 441228 - RNA, 15 nt, Homo sapiens
uuaagaaacacaggg

SEQ ID NO: 441229 - RNA, 22 nt, Homo sapiens
uuaagaaacacaggguuuugua

SEQ ID NO: 441230 - RNA, 21 nt, Homo sapiens
uuaagaaagcuauauaugaau

SEQ ID NO: 441231 - RNA, 14 nt, Homo sapiens
uuaagaaguacaau

SEQ ID NO: 441232 - RNA, 16 nt, Homo sapiens
uuaagacagagucuca

SEQ ID NO: 441233 - RNA, 15 nt, Homo sapiens
uuaagacaugcacua

SEQ ID NO: 441234 - RNA, 17 nt, Homo sapiens
uuaagagaaaugagcuu

SEQ ID NO: 441235 - RNA, 21 nt, Homo sapiens
uuaagauuccauuuuggaaaa

SEQ ID NO: 441236 - RNA, 20 nt, Homo sapiens
uuaagcagauggaaugcugu

SEQ ID NO: 441237 - RNA, 12 nt, Homo sapiens
uuaagcauuguu

SEQ ID NO: 441238 - RNA, 12 nt, Homo sapiens
uuaagcauuugc

SEQ ID NO: 441239 - RNA, 22 nt, Homo sapiens
uuaaggaacaagaauugcuaaa

SEQ ID NO: 441240 - RNA, 18 nt, Homo sapiens
uuaaguccuacuuuacau

SEQ ID NO: 441241 - RNA, 12 nt, Homo sapiens
uuaaguuuugau

SEQ ID NO: 441242 - RNA, 22 nt, Homo sapiens
uuaauaaacucacaacucucug

SEQ ID NO: 441243 - RNA, 13 nt, Homo sapiens
uuaauagccauuu

SEQ ID NO: 441244 - RNA, 16 nt, Homo sapiens
uuaauaguauaucuaa

SEQ ID NO: 441245 - RNA, 21 nt, Homo sapiens
uuaauaguuucugauucacua

SEQ ID NO: 441246 - RNA, 14 nt, Homo sapiens
uuaauauaacugcc

SEQ ID NO: 441247 - RNA, 19 nt, Homo sapiens
uuaauauacugcauauccu

SEQ ID NO: 441248 - RNA, 14 nt, Homo sapiens
uuaauccagggaag

SEQ ID NO: 441249 - RNA, 13 nt, Homo sapiens
uuaauccuagcug

SEQ ID NO: 441250 - RNA, 16 nt, Homo sapiens
uuaaucuugcuuucuu

SEQ ID NO: 441251 - RNA, 20 nt, Homo sapiens
uuaaucuuucuuuaccugag

SEQ ID NO: 441252 - RNA, 19 nt, Homo sapiens
uuaaugaaggugugcuaca

SEQ ID NO: 441253 - RNA, 12 nt, Homo sapiens
uuaaugagauag

SEQ ID NO: 441254 - RNA, 22 nt, Homo sapiens
uuaaugcagagcuagaggacuu

SEQ ID NO: 441255 - RNA, 19 nt, Homo sapiens
uuaaugccacaaaacugac

SEQ ID NO: 441256 - RNA, 16 nt, Homo sapiens
uuaauggcuaguacug

SEQ ID NO: 441257 - RNA, 21 nt, Homo sapiens
uuaauggcucaucaacaauca

SEQ ID NO: 441258 - RNA, 22 nt, Homo sapiens
uuaauggcucaucaacaaucac

SEQ ID NO: 441259 - RNA, 19 nt, Homo sapiens
uuaaugucagucuacaggc

SEQ ID NO: 441260 - RNA, 20 nt, Homo sapiens
uuaauuaagucaccuguaua

SEQ ID NO: 441261 - RNA, 12 nt, Homo sapiens
uuaauuacaaca

SEQ ID NO: 441262 - RNA, 12 nt, Homo sapiens
uuaauuacauaa

SEQ ID NO: 441263 - RNA, 18 nt, Homo sapiens
uuaauuagggguugcuaa

SEQ ID NO: 441264 - RNA, 15 nt, Homo sapiens
uuaauucugaugcua

SEQ ID NO: 441265 - RNA, 17 nt, Homo sapiens
uuaauuggaauucugga

SEQ ID NO: 441266 - RNA, 23 nt, Homo sapiens
uuaauugguuugugccuuacauu

SEQ ID NO: 441267 - RNA, 18 nt, Homo sapiens
uuaauuguuuugcacuuu

SEQ ID NO: 441268 - RNA, 14 nt, Homo sapiens
uuaauuucuaaaga

SEQ ID NO: 441269 - RNA, 16 nt, Homo sapiens
uuacaaaaacauggcc

SEQ ID NO: 441270 - RNA, 15 nt, Homo sapiens
uuacaaagcauguga

SEQ ID NO: 441271 - RNA, 18 nt, Homo sapiens
uuacaaauaauuaucaca

SEQ ID NO: 441272 - RNA, 22 nt, Homo sapiens
uuacaaauagaagcuucuugcu

SEQ ID NO: 441273 - RNA, 14 nt, Homo sapiens
uuacaacuccugca

SEQ ID NO: 441274 - RNA, 13 nt, Homo sapiens
uuacaauugugag

SEQ ID NO: 441275 - RNA, 22 nt, Homo sapiens
uuacaccguuguuguuuuacau

SEQ ID NO: 441276 - RNA, 21 nt, Homo sapiens
uuacagacagaauauacauau

SEQ ID NO: 441277 - RNA, 18 nt, Homo sapiens
uuacagacaugagccucc

SEQ ID NO: 441278 - RNA, 15 nt, Homo sapiens
uuacagcacuacucu

SEQ ID NO: 441279 - RNA, 21 nt, Homo sapiens
uuacagccacaggcacugugu

SEQ ID NO: 441280 - RNA, 11 nt, Homo sapiens
uuacagcugcc

SEQ ID NO: 441281 - RNA, 17 nt, Homo sapiens
uuacaggaagccucuca

SEQ ID NO: 441282 - RNA, 17 nt, Homo sapiens
uuacaggauuaauauau

SEQ ID NO: 441283 - RNA, 21 nt, Homo sapiens
uuacaggugcccgccaccacg

SEQ ID NO: 441284 - RNA, 22 nt, Homo sapiens
uuacaggugcccgccaccacgc

SEQ ID NO: 441285 - RNA, 22 nt, Homo sapiens
uuacagguguacuauggcugua

SEQ ID NO: 441286 - RNA, 13 nt, Homo sapiens
uuacaggugugag

SEQ ID NO: 441287 - RNA, 21 nt, Homo sapiens
uuacaggugugagccaccacg

SEQ ID NO: 441288 - RNA, 13 nt, Homo sapiens
uuacaggugugug

SEQ ID NO: 441289 - RNA, 21 nt, Homo sapiens
uuacauaacaggcauugcacu

SEQ ID NO: 441290 - RNA, 14 nt, Homo sapiens
uuacauacagugau

SEQ ID NO: 441291 - RNA, 15 nt, Homo sapiens
uuacauacagugaua

SEQ ID NO: 441292 - RNA, 20 nt, Homo sapiens
uuacaucaugaguggacuuu

SEQ ID NO: 441293 - RNA, 22 nt, Homo sapiens
uuacaugaaugaaugaaccaug

SEQ ID NO: 441294 - RNA, 14 nt, Homo sapiens
uuacaugaguucaa

SEQ ID NO: 441295 - RNA, 22 nt, Homo sapiens
uuacauguaguaguacuugaaa

SEQ ID NO: 441296 - RNA, 16 nt, Homo sapiens
uuacauuuuggucucu

SEQ ID NO: 441297 - RNA, 15 nt, Homo sapiens
uuaccaaaacauaag

SEQ ID NO: 441298 - RNA, 22 nt, Homo sapiens
uuaccaggaagcagauacauau

SEQ ID NO: 441299 - RNA, 22 nt, Homo sapiens
uuaccauuuguaauaaaguaua

SEQ ID NO: 441300 - RNA, 22 nt, Homo sapiens
uuacccagagaauauauacauu

SEQ ID NO: 441301 - RNA, 15 nt, Homo sapiens
uuaccuauugcugua

SEQ ID NO: 441302 - RNA, 13 nt, Homo sapiens
uuaccuggcugcu

SEQ ID NO: 441303 - RNA, 14 nt, Homo sapiens
uuaccuggggaucc

SEQ ID NO: 441304 - RNA, 23 nt, Homo sapiens
uuaccuuuauuaaugaacuguga

SEQ ID NO: 441305 - RNA, 22 nt, Homo sapiens
uuaccuuuuauuuuaauguuuc

SEQ ID NO: 441306 - RNA, 13 nt, Homo sapiens
uuacuaaacauuu

SEQ ID NO: 441307 - RNA, 16 nt, Homo sapiens
uuacuaaaucuacucu

SEQ ID NO: 441308 - RNA, 20 nt, Homo sapiens
uuacuacaugugggagcuuu

SEQ ID NO: 441309 - RNA, 12 nt, Homo sapiens
uuacuacuuuaa

SEQ ID NO: 441310 - RNA, 15 nt, Homo sapiens
uuacucaaccaaauu

SEQ ID NO: 441311 - RNA, 21 nt, Homo sapiens
uuacugaaagaaaaagaccua

SEQ ID NO: 441312 - RNA, 23 nt, Homo sapiens
uuacugaacaaucaaagcacuug

SEQ ID NO: 441313 - RNA, 17 nt, Homo sapiens
uuacugaucuuacucac

SEQ ID NO: 441314 - RNA, 21 nt, Homo sapiens
uuacugguuucaguugacaaa

SEQ ID NO: 441315 - RNA, 18 nt, Homo sapiens
uuacuuagcaugcacaaa

SEQ ID NO: 441316 - RNA, 17 nt, Homo sapiens
uuacuuuuaccacuauu

SEQ ID NO: 441317 - RNA, 15 nt, Homo sapiens
uuacuuuuauuugca

SEQ ID NO: 441318 - RNA, 14 nt, Homo sapiens
uuacuuuucacagu

SEQ ID NO: 441319 - RNA, 19 nt, Homo sapiens
uuacuuuuuccuggcucau

SEQ ID NO: 441320 - RNA, 17 nt, Homo sapiens
uuagaaaaaaguuuaca

SEQ ID NO: 441321 - RNA, 21 nt, Homo sapiens
uuagaaacacacuuuugcaca

SEQ ID NO: 441322 - RNA, 15 nt, Homo sapiens
uuagaaauugcauuu

SEQ ID NO: 441323 - RNA, 17 nt, Homo sapiens
uuagaagaaaacauaua

SEQ ID NO: 441324 - RNA, 18 nt, Homo sapiens
uuagaagaaaauggauga

SEQ ID NO: 441325 - RNA, 19 nt, Homo sapiens
uuagaagcagaucauuucc

SEQ ID NO: 441326 - RNA, 20 nt, Homo sapiens
uuagaaugucaguugaucag

SEQ ID NO: 441327 - RNA, 20 nt, Homo sapiens
uuagacaaccauagaacugu

SEQ ID NO: 441328 - RNA, 19 nt, Homo sapiens
uuagacaagucuaguggaa

SEQ ID NO: 441329 - RNA, 17 nt, Homo sapiens
uuagagauugccccaga

SEQ ID NO: 441330 - RNA, 14 nt, Homo sapiens
uuagaggcaaagaa

SEQ ID NO: 441331 - RNA, 23 nt, Homo sapiens
uuagagggacagccaaaaguaag

SEQ ID NO: 441332 - RNA, 12 nt, Homo sapiens
uuagaguuuaau

SEQ ID NO: 441333 - RNA, 20 nt, Homo sapiens
uagaaaggcaguucagguau

SEQ ID NO: 441334 - RNA, 23 nt, Homo sapiens
uagaaaggcuuccagaugucuaa

SEQ ID NO: 441335 - RNA, 13 nt, Homo sapiens
uagaaaguagcca

SEQ ID NO: 441336 - RNA, 18 nt, Homo sapiens
uagaaaugaccaauauua

SEQ ID NO: 441337 - RNA, 22 nt, Homo sapiens
uagaaauguauuuugaaaacac

SEQ ID NO: 441338 - RNA, 17 nt, Homo sapiens
uagaacagauaaucagu

SEQ ID NO: 441339 - RNA, 14 nt, Homo sapiens
uagaacagccagac

SEQ ID NO: 441340 - RNA, 20 nt, Homo sapiens
uagaacagccagacccugca

SEQ ID NO: 441341 - RNA, 23 nt, Homo sapiens
uagaacucugggcugccauguga

SEQ ID NO: 441342 - RNA, 19 nt, Homo sapiens
uagaacugucccacaaaau

SEQ ID NO: 441343 - RNA, 22 nt, Homo sapiens
uagaagcagaucauuucccaaa

SEQ ID NO: 441344 - RNA, 17 nt, Homo sapiens
uagaagcuucuugcucc

SEQ ID NO: 441345 - RNA, 22 nt, Homo sapiens
uagaagggccaguccugccugg

SEQ ID NO: 441346 - RNA, 18 nt, Homo sapiens
uagaauauacugucuugu

SEQ ID NO: 441347 - RNA, 14 nt, Homo sapiens
uagaaugauucccu

SEQ ID NO: 441348 - RNA, 14 nt, Homo sapiens
uagaaugcauguaa

SEQ ID NO: 441349 - RNA, 17 nt, Homo sapiens
uagaauggaaaacugcc

SEQ ID NO: 441350 - RNA, 23 nt, Homo sapiens
uagaauggggcuuccaugguggu

SEQ ID NO: 441351 - RNA, 15 nt, Homo sapiens
uagaauuuagcuuau

SEQ ID NO: 441352 - RNA, 20 nt, Homo sapiens
uagaauuugggggaaaauuu

SEQ ID NO: 441353 - RNA, 22 nt, Homo sapiens
uagacaaaugaacaagcaauua

SEQ ID NO: 441354 - RNA, 22 nt, Homo sapiens
uagacacaucuauaauuuuaca

SEQ ID NO: 441355 - RNA, 14 nt, Homo sapiens
uagacagagacaau

SEQ ID NO: 441356 - RNA, 16 nt, Homo sapiens
uagacagagacaauuu

SEQ ID NO: 441357 - RNA, 20 nt, Homo sapiens
uagacaucccccuccuugcc

SEQ ID NO: 441358 - RNA, 20 nt, Homo sapiens
uagaccaggauuucuaauca

SEQ ID NO: 441359 - RNA, 23 nt, Homo sapiens
uagacuauaagcagaagcacaua

SEQ ID NO: 441360 - RNA, 19 nt, Homo sapiens
uagacucuguaaccaccuc

SEQ ID NO: 441361 - RNA, 12 nt, Homo sapiens
uagacugccugg

SEQ ID NO: 441362 - RNA, 17 nt, Homo sapiens
uagacuuagccccauga

SEQ ID NO: 441363 - RNA, 16 nt, Homo sapiens
uagacuucgaaaacag

SEQ ID NO: 441364 - RNA, 21 nt, Homo sapiens
uagacuuuuaacuucaccuua

SEQ ID NO: 441365 - RNA, 19 nt, Homo sapiens
uagagagggugguuuuccu

SEQ ID NO: 441366 - RNA, 14 nt, Homo sapiens
uagagauaugcaga

SEQ ID NO: 441367 - RNA, 18 nt, Homo sapiens
uagagauaugcagaagga

SEQ ID NO: 441368 - RNA, 17 nt, Homo sapiens
uagagaugagcuuucuu

SEQ ID NO: 441369 - RNA, 22 nt, Homo sapiens
uagagauggggaaagaauuccu

SEQ ID NO: 441370 - RNA, 16 nt, Homo sapiens
uagagcaaagacuuaa

SEQ ID NO: 441371 - RNA, 19 nt, Homo sapiens
uagagcaaagacuuaauca

SEQ ID NO: 441372 - RNA, 15 nt, Homo sapiens
uagagcagaauucau

SEQ ID NO: 441373 - RNA, 17 nt, Homo sapiens
uagagccuuugaucuuc

SEQ ID NO: 441374 - RNA, 17 nt, Homo sapiens
uagaggaugauguaauu

SEQ ID NO: 441375 - RNA, 14 nt, Homo sapiens
uagaggcuauuccu

SEQ ID NO: 441376 - RNA, 18 nt, Homo sapiens
uagaggggcaacugauga

SEQ ID NO: 441377 - RNA, 20 nt, Homo sapiens
uagaguaaacuauucuauaa

SEQ ID NO: 441378 - RNA, 20 nt, Homo sapiens
uagagucuagaacacaauuu

SEQ ID NO: 441379 - RNA, 18 nt, Homo sapiens
uagagucugaacagcugu

SEQ ID NO: 441380 - RNA, 14 nt, Homo sapiens
uuccaauuuacaua

SEQ ID NO: 441381 - RNA, 20 nt, Homo sapiens
uuccacagaauacaagccac

SEQ ID NO: 441382 - RNA, 20 nt, Homo sapiens
uuccacagggauaccuuaau

SEQ ID NO: 441383 - RNA, 18 nt, Homo sapiens
uuccacccacucuucaca

SEQ ID NO: 441384 - RNA, 21 nt, Homo sapiens
uuccacucagcaucagcgugg

SEQ ID NO: 441385 - RNA, 16 nt, Homo sapiens
uuccacucccacugcc

SEQ ID NO: 441386 - RNA, 20 nt, Homo sapiens
uuccacuggaaaaguguaau

SEQ ID NO: 441387 - RNA, 18 nt, Homo sapiens
uuccacuuagagaacaaa

SEQ ID NO: 441388 - RNA, 23 nt, Homo sapiens
uuccacuuugaguaccaaaucca

SEQ ID NO: 441389 - RNA, 14 nt, Homo sapiens
uuccagaagaucug

SEQ ID NO: 441390 - RNA, 15 nt, Homo sapiens
uuccagcaaaauaua

SEQ ID NO: 441391 - RNA, 20 nt, Homo sapiens
uuccagcugacaucuugcac

SEQ ID NO: 441392 - RNA, 18 nt, Homo sapiens
uuccagcugccaagugcu

SEQ ID NO: 441393 - RNA, 16 nt, Homo sapiens
uuccaggcgaugugca

SEQ ID NO: 441394 - RNA, 23 nt, Homo sapiens
uuccaguacuuccugcaguacaa

SEQ ID NO: 441395 - RNA, 16 nt, Homo sapiens
uuccaguuuuuugcca

SEQ ID NO: 441396 - RNA, 19 nt, Homo sapiens
uuccauaaucuggacuccu

SEQ ID NO: 441397 - RNA, 14 nt, Homo sapiens
uuccauaugcucuu

SEQ ID NO: 441398 - RNA, 14 nt, Homo sapiens
uuccaucaauuuua

SEQ ID NO: 441399 - RNA, 14 nt, Homo sapiens
uuccaucacagcca

SEQ ID NO: 441400 - RNA, 19 nt, Homo sapiens
uuccaucccuaagaauucc

SEQ ID NO: 441401 - RNA, 19 nt, Homo sapiens
uuccaucuguuugauacag

SEQ ID NO: 441402 - RNA, 16 nt, Homo sapiens
uuccauucuuucuucc

SEQ ID NO: 441403 - RNA, 23 nt, Homo sapiens
uuccauuuccguuccagagggaa

SEQ ID NO: 441404 - RNA, 14 nt, Homo sapiens
uuccauuugcaaca

SEQ ID NO: 441405 - RNA, 19 nt, Homo sapiens
uuccauuugugugugugca

SEQ ID NO: 441406 - RNA, 20 nt, Homo sapiens
uuccauuugugugugugcaa

SEQ ID NO: 441407 - RNA, 15 nt, Homo sapiens
uuccauuuuggaaaa

SEQ ID NO: 441408 - RNA, 19 nt, Homo sapiens
uucccacauaauacauucc

SEQ ID NO: 441409 - RNA, 13 nt, Homo sapiens
uucccaucgcugg

SEQ ID NO: 441410 - RNA, 14 nt, Homo sapiens
uucccaugccuguc

SEQ ID NO: 441411 - RNA, 20 nt, Homo sapiens
uucccauuguggcuccuauc

SEQ ID NO: 441412 - RNA, 17 nt, Homo sapiens
ugagcaugccccaaaaa

SEQ ID NO: 441413 - RNA, 17 nt, Homo sapiens
ugagcauuuuuaaggga

SEQ ID NO: 441414 - RNA, 21 nt, Homo sapiens
ugagccacugcgcccgggcaa

SEQ ID NO: 441415 - RNA, 19 nt, Homo sapiens
ugagccagucccucagcca

SEQ ID NO: 441416 - RNA, 22 nt, Homo sapiens
ugagccccugaggacaggggca

SEQ ID NO: 441417 - RNA, 18 nt, Homo sapiens
ugagccguugcuaaugcc

SEQ ID NO: 441418 - RNA, 17 nt, Homo sapiens
ugagccugagccuuaga

SEQ ID NO: 441419 - RNA, 21 nt, Homo sapiens
ugagcggccgccuguccuugg

SEQ ID NO: 441420 - RNA, 14 nt, Homo sapiens
ugagcuaacugaga

SEQ ID NO: 441421 - RNA, 16 nt, Homo sapiens
ugagcuccaguggaag

SEQ ID NO: 441422 - RNA, 12 nt, Homo sapiens
ugagcuuuccag

SEQ ID NO: 441423 - RNA, 19 nt, Homo sapiens
ugagcuuuggacacacaca

SEQ ID NO: 441424 - RNA, 22 nt, Homo sapiens
ugagcuuuggacgcacacagcu

SEQ ID NO: 441425 - RNA, 19 nt, Homo sapiens
ugaggaacaaucacaaaag

SEQ ID NO: 441426 - RNA, 14 nt, Homo sapiens
ugaggcaaaggcca

SEQ ID NO: 441427 - RNA, 22 nt, Homo sapiens
ugaggccaagaguuugagacca

SEQ ID NO: 441428 - RNA, 17 nt, Homo sapiens
ugaggccaggaguucaa

SEQ ID NO: 441429 - RNA, 18 nt, Homo sapiens
ugaggccuggacuuuccu

SEQ ID NO: 441430 - RNA, 20 nt, Homo sapiens
ugaggcggggagcaugaaga

SEQ ID NO: 441431 - RNA, 19 nt, Homo sapiens
ugaggcuaaaacaaaucuc

SEQ ID NO: 441432 - RNA, 15 nt, Homo sapiens
ugaggcuucucagcc

SEQ ID NO: 441433 - RNA, 17 nt, Homo sapiens
ugaggcuucuccuucuc

SEQ ID NO: 441434 - RNA, 17 nt, Homo sapiens
ugagggaaaacauaaua

SEQ ID NO: 441435 - RNA, 13 nt, Homo sapiens
ugagggacugccu

SEQ ID NO: 441436 - RNA, 13 nt, Homo sapiens
ugaggggacugca

SEQ ID NO: 441437 - RNA, 18 nt, Homo sapiens
ugaggggcugacuucaau

SEQ ID NO: 441438 - RNA, 22 nt, Homo sapiens
ugaggggguaauaaaccuccuu

SEQ ID NO: 441439 - RNA, 19 nt, Homo sapiens
ugaggucaucccggggcca

SEQ ID NO: 441440 - RNA, 18 nt, Homo sapiens
ugaggugguacuaugauu

SEQ ID NO: 441441 - RNA, 21 nt, Homo sapiens
ugagguuaaaauauaaauuaa

SEQ ID NO: 441442 - RNA, 16 nt, Homo sapiens
ugagguuaugagaaaa

SEQ ID NO: 441443 - RNA, 20 nt, Homo sapiens
ugaguagcuggauuacaggc

SEQ ID NO: 441444 - RNA, 22 nt, Homo sapiens
ugaguagcuggauuacaggcau

SEQ ID NO: 441445 - RNA, 18 nt, Homo sapiens
ugaguagggacucagggc

SEQ ID NO: 441446 - RNA, 16 nt, Homo sapiens
ugaguaguaaucucac

SEQ ID NO: 441447 - RNA, 21 nt, Homo sapiens
ugaguaguaaucucacacuuc

SEQ ID NO: 441448 - RNA, 16 nt, Homo sapiens
ugagucaaaagccugg

SEQ ID NO: 441449 - RNA, 15 nt, Homo sapiens
ugagucaaugugcag

SEQ ID NO: 441450 - RNA, 17 nt, Homo sapiens
ugagucauugucagaau

SEQ ID NO: 441451 - RNA, 15 nt, Homo sapiens
ugagucuccugugcc

SEQ ID NO: 441452 - RNA, 20 nt, Homo sapiens
ugagugaaaacaucugcaca

SEQ ID NO: 441453 - RNA, 14 nt, Homo sapiens
ugagugaacaacua

SEQ ID NO: 441454 - RNA, 21 nt, Homo sapiens
ugagugagaggguuugaguca

SEQ ID NO: 441455 - RNA, 14 nt, Homo sapiens
ugagugccacaaaa

SEQ ID NO: 441456 - RNA, 15 nt, Homo sapiens
ugagugccacaaaag

SEQ ID NO: 441457 - RNA, 12 nt, Homo sapiens
ugagugucuguc

SEQ ID NO: 441458 - RNA, 15 nt, Homo sapiens
ugagugugugcaagu

SEQ ID NO: 441459 - RNA, 13 nt, Homo sapiens
ugaguuacccugg

SEQ ID NO: 441460 - RNA, 16 nt, Homo sapiens
ugaguuauuuugcuaa

SEQ ID NO: 441461 - RNA, 15 nt, Homo sapiens
ugaguugcccaucau

SEQ ID NO: 441462 - RNA, 21 nt, Homo sapiens
ugaguuuaaaaaaauaacauc

SEQ ID NO: 441463 - RNA, 22 nt, Homo sapiens
ugaguuuaguuuuucacuuuag

SEQ ID NO: 441464 - RNA, 17 nt, Homo sapiens
ugaguuucuuggcugca

SEQ ID NO: 441465 - RNA, 22 nt, Homo sapiens
ugauaaaauaaguaacauauaa

SEQ ID NO: 441466 - RNA, 13 nt, Homo sapiens
ugauaaacauuaa

SEQ ID NO: 441467 - RNA, 14 nt, Homo sapiens
ugauaaacuuugaa

SEQ ID NO: 441468 - RNA, 14 nt, Homo sapiens
ugauaaccacuaag

SEQ ID NO: 441469 - RNA, 20 nt, Homo sapiens
ugauaacuagauggugcuga

SEQ ID NO: 441470 - RNA, 19 nt, Homo sapiens
ugauacgcaacauaauuaa

SEQ ID NO: 441471 - RNA, 16 nt, Homo sapiens
ugauagcuaagugagu

SEQ ID NO: 441472 - RNA, 18 nt, Homo sapiens
ugauagucaccugcuggu

SEQ ID NO: 441473 - RNA, 16 nt, Homo sapiens
ugauauauauguauaa

SEQ ID NO: 441474 - RNA, 21 nt, Homo sapiens
ugauauuuccuucaccaccuc

SEQ ID NO: 441475 - RNA, 16 nt, Homo sapiens
ugauauuuuaugcaaa

SEQ ID NO: 441476 - RNA, 14 nt, Homo sapiens
ugaucagaucuuac

SEQ ID NO: 441477 - RNA, 12 nt, Homo sapiens
ugaucauagaau

SEQ ID NO: 441478 - RNA, 18 nt, Homo sapiens
ugauccagagcacagauc

SEQ ID NO: 441479 - RNA, 15 nt, Homo sapiens
ugaucccaauccuua

SEQ ID NO: 441480 - RNA, 10 nt, Homo sapiens
ugauccucac

SEQ ID NO: 441481 - RNA, 15 nt, Homo sapiens
ugaucgugccuauaa

SEQ ID NO: 441482 - RNA, 19 nt, Homo sapiens
ugaucgugggguugaccaa

SEQ ID NO: 441483 - RNA, 19 nt, Homo sapiens
ugaauaaagggaacaugca

SEQ ID NO: 441484 - RNA, 14 nt, Homo sapiens
ugaauagaaacaga

SEQ ID NO: 441485 - RNA, 23 nt, Homo sapiens
ugaauagccaggccugaccucaa

SEQ ID NO: 441486 - RNA, 15 nt, Homo sapiens
ugaauauuauacuuc

SEQ ID NO: 441487 - RNA, 17 nt, Homo sapiens
ugaauauuauacuucuu

SEQ ID NO: 441488 - RNA, 23 nt, Homo sapiens
ugaaucaaucuggcuucugcauu

SEQ ID NO: 441489 - RNA, 14 nt, Homo sapiens
ugaaucauccagac

SEQ ID NO: 441490 - RNA, 15 nt, Homo sapiens
ugaaucaugaaguaa

SEQ ID NO: 441491 - RNA, 17 nt, Homo sapiens
ugaaucauuaacagugc

SEQ ID NO: 441492 - RNA, 14 nt, Homo sapiens
ugaauccucucuuc

SEQ ID NO: 441493 - RNA, 21 nt, Homo sapiens
ugaaucuugucccagccucag

SEQ ID NO: 441494 - RNA, 22 nt, Homo sapiens
ugaaugaaauauaaacugugag

SEQ ID NO: 441495 - RNA, 12 nt, Homo sapiens
ugaaugaugcuu

SEQ ID NO: 441496 - RNA, 16 nt, Homo sapiens
ugaaugcauucagggg

SEQ ID NO: 441497 - RNA, 14 nt, Homo sapiens
ugaaugccagucca

SEQ ID NO: 441498 - RNA, 12 nt, Homo sapiens
ugaaugcuuccu

SEQ ID NO: 441499 - RNA, 23 nt, Homo sapiens
ugaaugggagccagaauucacua

SEQ ID NO: 441500 - RNA, 15 nt, Homo sapiens
ugaauguaugugcac

SEQ ID NO: 441501 - RNA, 15 nt, Homo sapiens
ugaaugucaguguga

SEQ ID NO: 441502 - RNA, 17 nt, Homo sapiens
ugaaugugguuacuucc

SEQ ID NO: 441503 - RNA, 13 nt, Homo sapiens
ugaaugugucacu

SEQ ID NO: 441504 - RNA, 22 nt, Homo sapiens
ugaauguuaaacuacucuugaa

SEQ ID NO: 441505 - RNA, 16 nt, Homo sapiens
ugaauuaaauauugaa

SEQ ID NO: 441506 - RNA, 14 nt, Homo sapiens
ugaauuacagugaa

SEQ ID NO: 441507 - RNA, 19 nt, Homo sapiens
ugaauucaaagcaugucaa

SEQ ID NO: 441508 - RNA, 18 nt, Homo sapiens
ugaauugaagucaucaua

SEQ ID NO: 441509 - RNA, 23 nt, Homo sapiens
ugaauuucuagacaguauugcca

SEQ ID NO: 441510 - RNA, 11 nt, Homo sapiens
ugaauuugacu

SEQ ID NO: 441511 - RNA, 13 nt, Homo sapiens
ugaauuugcuaau

SEQ ID NO: 441512 - RNA, 21 nt, Homo sapiens
ugaauuuuggugauguaaaac

SEQ ID NO: 441513 - RNA, 16 nt, Homo sapiens
ugaauuuuuaugauau

SEQ ID NO: 441514 - RNA, 15 nt, Homo sapiens
ugaauuuuugcacau

SEQ ID NO: 441515 - RNA, 23 nt, Homo sapiens
ugacaaaaguaagagagcacagu

SEQ ID NO: 441516 - RNA, 14 nt, Homo sapiens
ugacaacaaaaggg

SEQ ID NO: 441517 - RNA, 13 nt, Homo sapiens
ugacaacaugcua

SEQ ID NO: 441518 - RNA, 19 nt, Homo sapiens
ugacaacgccaacugccca

SEQ ID NO: 441519 - RNA, 17 nt, Homo sapiens
ugacaaggccccagaga

SEQ ID NO: 441520 - RNA, 15 nt, Homo sapiens
ugacacaggggacac

SEQ ID NO: 441521 - RNA, 18 nt, Homo sapiens
ugacacaggggacacuga

SEQ ID NO: 441522 - RNA, 16 nt, Homo sapiens
ugacacaugcucucaa

SEQ ID NO: 441523 - RNA, 10 nt, Homo sapiens
ugacacugaa

SEQ ID NO: 441524 - RNA, 16 nt, Homo sapiens
ugacacugacauuuca

SEQ ID NO: 441525 - RNA, 17 nt, Homo sapiens
ugacacugacauuucac

SEQ ID NO: 441526 - RNA, 11 nt, Homo sapiens
ugacagcaaua

SEQ ID NO: 441527 - RNA, 14 nt, Homo sapiens
ugacaggaagccca

SEQ ID NO: 441528 - RNA, 19 nt, Homo sapiens
ugacaggcagacacaugcu

SEQ ID NO: 441529 - RNA, 18 nt, Homo sapiens
ugacaggcccaguggaac

SEQ ID NO: 441530 - RNA, 17 nt, Homo sapiens
ugacaggcgugcaccug

SEQ ID NO: 441531 - RNA, 14 nt, Homo sapiens
ugacagggaaaaga

SEQ ID NO: 441532 - RNA, 18 nt, Homo sapiens
ugacauauaucuauuaca

SEQ ID NO: 441533 - RNA, 14 nt, Homo sapiens
ugacaucaggugau

SEQ ID NO: 441534 - RNA, 18 nt, Homo sapiens
ugacauccaagcuuccuu

SEQ ID NO: 441535 - RNA, 18 nt, Homo sapiens
ugacaucucaguucacug

SEQ ID NO: 441536 - RNA, 16 nt, Homo sapiens
ugacaucuugcacggu

SEQ ID NO: 441537 - RNA, 23 nt, Homo sapiens
ugacaugaaaauuacaacagaua

SEQ ID NO: 441538 - RNA, 15 nt, Homo sapiens
ugacauguggggcca

SEQ ID NO: 441539 - RNA, 21 nt, Homo sapiens
ugaccaaacuguggguauugu

SEQ ID NO: 441540 - RNA, 16 nt, Homo sapiens
ugaccaagaacugcau

SEQ ID NO: 441541 - RNA, 24 nt, Homo sapiens
ugaccaaguuauaaaucaauguca

SEQ ID NO: 441542 - RNA, 22 nt, Homo sapiens
ugaccaauauuauacuaagaaa

SEQ ID NO: 441543 - RNA, 17 nt, Homo sapiens
ugaccaaugcauuaccu

SEQ ID NO: 441544 - RNA, 22 nt, Homo sapiens
ugaccaggcauccuccacaaua

SEQ ID NO: 441545 - RNA, 11 nt, Homo sapiens
ugacccagugg

SEQ ID NO: 441546 - RNA, 23 nt, Homo sapiens
ugacccggccccuaccagccacg

SEQ ID NO: 441547 - RNA, 20 nt, Homo sapiens
ugacccucugacccuagcuc

SEQ ID NO: 441548 - RNA, 19 nt, Homo sapiens
ugacccuggagcccggcag

SEQ ID NO: 441549 - RNA, 21 nt, Homo sapiens
ugaccuacagggaacugggaa

SEQ ID NO: 441550 - RNA, 14 nt, Homo sapiens
ugaccucaacaaag

SEQ ID NO: 441551 - RNA, 17 nt, Homo sapiens
ugaccuccaaccaggag

SEQ ID NO: 441552 - RNA, 17 nt, Homo sapiens
ugaccuccuggacugua

SEQ ID NO: 441553 - RNA, 20 nt, Homo sapiens
ugaccugaacucugcaacug

SEQ ID NO: 441554 - RNA, 23 nt, Homo sapiens
ucaagucagcaacagagcaaaau

SEQ ID NO: 441555 - RNA, 17 nt, Homo sapiens
ucaagucggaucuaguc

SEQ ID NO: 441556 - RNA, 20 nt, Homo sapiens
ucaaguggcaugugcuguga

SEQ ID NO: 441557 - RNA, 16 nt, Homo sapiens
ucaaguuaacaaggaa

SEQ ID NO: 441558 - RNA, 13 nt, Homo sapiens
ucaaguucauuga

SEQ ID NO: 441559 - RNA, 19 nt, Homo sapiens
ucaaguugagaacaaaaau

SEQ ID NO: 441560 - RNA, 20 nt, Homo sapiens
ucaaguugugcuuguuuaca

SEQ ID NO: 441561 - RNA, 21 nt, Homo sapiens
ucaaguuuuucucucaaauga

SEQ ID NO: 441562 - RNA, 13 nt, Homo sapiens
ucaauaagccagc

SEQ ID NO: 441563 - RNA, 17 nt, Homo sapiens
ucaauaccaccaagagg

SEQ ID NO: 441564 - RNA, 13 nt, Homo sapiens
ucaauaguauuaa

SEQ ID NO: 441565 - RNA, 17 nt, Homo sapiens
ucaauauuaaauacaga

SEQ ID NO: 441566 - RNA, 19 nt, Homo sapiens
ucaaucaucugugugaaaa

SEQ ID NO: 441567 - RNA, 13 nt, Homo sapiens
ucaaucucuaguu

SEQ ID NO: 441568 - RNA, 17 nt, Homo sapiens
ucaaucucuguucugcu

SEQ ID NO: 441569 - RNA, 18 nt, Homo sapiens
ucaaugacaucuccucca

SEQ ID NO: 441570 - RNA, 22 nt, Homo sapiens
ucaaugaucuagguuuaacuca

SEQ ID NO: 441571 - RNA, 12 nt, Homo sapiens
ucaaugccagua

SEQ ID NO: 441572 - RNA, 23 nt, Homo sapiens
ucaaugccucacgagauuugcca

SEQ ID NO: 441573 - RNA, 16 nt, Homo sapiens
ucaaugcuagcacaau

SEQ ID NO: 441574 - RNA, 20 nt, Homo sapiens
ucaaugcugacuggacugug

SEQ ID NO: 441575 - RNA, 15 nt, Homo sapiens
ucaaugucacuuaaa

SEQ ID NO: 441576 - RNA, 13 nt, Homo sapiens
ucaaugugcagug

SEQ ID NO: 441577 - RNA, 17 nt, Homo sapiens
ucaauugcagaugccaa

SEQ ID NO: 441578 - RNA, 17 nt, Homo sapiens
ucaauuuccugaugcau

SEQ ID NO: 441579 - RNA, 14 nt, Homo sapiens
ucaauuucuacuuc

SEQ ID NO: 441580 - RNA, 18 nt, Homo sapiens
ucaauuuguaauugcuua

SEQ ID NO: 441581 - RNA, 23 nt, Homo sapiens
ucacaaauaaguaauaucuuuca

SEQ ID NO: 441582 - RNA, 23 nt, Homo sapiens
ucacaaaugaucgcuaucuagca

SEQ ID NO: 441583 - RNA, 16 nt, Homo sapiens
ucacaaauugaucaag

SEQ ID NO: 441584 - RNA, 13 nt, Homo sapiens
ucacaacucucug

SEQ ID NO: 441585 - RNA, 12 nt, Homo sapiens
ucacacauucca

SEQ ID NO: 441586 - RNA, 12 nt, Homo sapiens
ucacaccacagg

SEQ ID NO: 441587 - RNA, 20 nt, Homo sapiens
ucacacccugcaaggcccac

SEQ ID NO: 441588 - RNA, 15 nt, Homo sapiens
ucacacgggguauuu

SEQ ID NO: 441589 - RNA, 16 nt, Homo sapiens
ucacagagugcauugu

SEQ ID NO: 441590 - RNA, 18 nt, Homo sapiens
ucacagagugcauuguga

SEQ ID NO: 441591 - RNA, 14 nt, Homo sapiens
ucacagcugcagcu

SEQ ID NO: 441592 - RNA, 22 nt, Homo sapiens
ucacaggacgauuucacugaca

SEQ ID NO: 441593 - RNA, 18 nt, Homo sapiens
ucacauccuggggcucag

SEQ ID NO: 441594 - RNA, 13 nt, Homo sapiens
ucacaucucugcc

SEQ ID NO: 441595 - RNA, 12 nt, Homo sapiens
ucacaugcacag

SEQ ID NO: 441596 - RNA, 20 nt, Homo sapiens
ucacauuuuacgacaaggau

SEQ ID NO: 441597 - RNA, 16 nt, Homo sapiens
ucaccaaaaagcuuua

SEQ ID NO: 441598 - RNA, 21 nt, Homo sapiens
ucaccaacaacagucagccag

SEQ ID NO: 441599 - RNA, 16 nt, Homo sapiens
ucaccaauaacuucag

SEQ ID NO: 441600 - RNA, 15 nt, Homo sapiens
ucaccagagcauuuc

SEQ ID NO: 441601 - RNA, 22 nt, Homo sapiens
ucaccaggaagaaggcccggga

SEQ ID NO: 441602 - RNA, 19 nt, Homo sapiens
ucaccauugugaagcaccu

SEQ ID NO: 441603 - RNA, 20 nt, Homo sapiens
ucaccauugugaagcaccua

SEQ ID NO: 441604 - RNA, 18 nt, Homo sapiens
ucaccccacucagcucac

SEQ ID NO: 441605 - RNA, 15 nt, Homo sapiens
ucaccccagugccug

SEQ ID NO: 441606 - RNA, 15 nt, Homo sapiens
ucacccccacacugg

SEQ ID NO: 441607 - RNA, 13 nt, Homo sapiens
ucacccuccucau

SEQ ID NO: 441608 - RNA, 14 nt, Homo sapiens
ucaccgaaguguga

SEQ ID NO: 441609 - RNA, 21 nt, Homo sapiens
ucaccggccuugugacauuca

SEQ ID NO: 441610 - RNA, 13 nt, Homo sapiens
ucaccuaucugga

SEQ ID NO: 441611 - RNA, 14 nt, Homo sapiens
ucaccucucaaggu

SEQ ID NO: 441612 - RNA, 17 nt, Homo sapiens
ucaccucuuaugcacac

SEQ ID NO: 441613 - RNA, 21 nt, Homo sapiens
ucaccugcgugguccauucca

SEQ ID NO: 441614 - RNA, 16 nt, Homo sapiens
ucaccuggcuucccag

SEQ ID NO: 441615 - RNA, 13 nt, Homo sapiens
ucaccuguaaaac

SEQ ID NO: 441616 - RNA, 17 nt, Homo sapiens
ucaccuugcucugccau

SEQ ID NO: 441617 - RNA, 20 nt, Homo sapiens
ucaccuugguuuaugagaac

SEQ ID NO: 441618 - RNA, 22 nt, Homo sapiens
ucacgacucuaccauguccaau

SEQ ID NO: 441619 - RNA, 18 nt, Homo sapiens
ucacgaggugucucucac

SEQ ID NO: 441620 - RNA, 22 nt, Homo sapiens
ucacuagagacaaaucuuuaag

SEQ ID NO: 441621 - RNA, 15 nt, Homo sapiens
ucacuauccaugcac

SEQ ID NO: 441622 - RNA, 13 nt, Homo sapiens
ucacucagaggaa

SEQ ID NO: 441623 - RNA, 12 nt, Homo sapiens
uauaaacuguga

SEQ ID NO: 441624 - RNA, 16 nt, Homo sapiens
uauaaauggacuugcu

SEQ ID NO: 441625 - RNA, 22 nt, Homo sapiens
uauaaauguacuacauuugcau

SEQ ID NO: 441626 - RNA, 19 nt, Homo sapiens
uauaaauguuugucuggau

SEQ ID NO: 441627 - RNA, 22 nt, Homo sapiens
uauaacacagacgagccccaga

SEQ ID NO: 441628 - RNA, 15 nt, Homo sapiens
uauaagacuacuaua

SEQ ID NO: 441629 - RNA, 17 nt, Homo sapiens
uauaagcagaagcacau

SEQ ID NO: 441630 - RNA, 13 nt, Homo sapiens
uauaagccaaaaa

SEQ ID NO: 441631 - RNA, 22 nt, Homo sapiens
uauaagcuuuuuucucaauaaa

SEQ ID NO: 441632 - RNA, 18 nt, Homo sapiens
uauacauguauagugagu

SEQ ID NO: 441633 - RNA, 14 nt, Homo sapiens
uauaccacaauuca

SEQ ID NO: 441634 - RNA, 13 nt, Homo sapiens
uauaccauuuuau

SEQ ID NO: 441635 - RNA, 14 nt, Homo sapiens
uauacuaaccauuu

SEQ ID NO: 441636 - RNA, 12 nt, Homo sapiens
uauacuaugaaa

SEQ ID NO: 441637 - RNA, 15 nt, Homo sapiens
uauacuugguugauu

SEQ ID NO: 441638 - RNA, 18 nt, Homo sapiens
uauagaaaacgauuuuga

SEQ ID NO: 441639 - RNA, 14 nt, Homo sapiens
uauagagauaugca

SEQ ID NO: 441640 - RNA, 21 nt, Homo sapiens
uauagagggcuuaugauucag

SEQ ID NO: 441641 - RNA, 17 nt, Homo sapiens
uauagcagauuguguaa

SEQ ID NO: 441642 - RNA, 15 nt, Homo sapiens
uauagcauguaauau

SEQ ID NO: 441643 - RNA, 14 nt, Homo sapiens
uauaguagcauuuc

SEQ ID NO: 441644 - RNA, 19 nt, Homo sapiens
uauaguaugaaugcagugg

SEQ ID NO: 441645 - RNA, 13 nt, Homo sapiens
uauauaaaaaugg

SEQ ID NO: 441646 - RNA, 19 nt, Homo sapiens
uauauaauaaagcuacuga

SEQ ID NO: 441647 - RNA, 17 nt, Homo sapiens
uauauagguugugcaaa

SEQ ID NO: 441648 - RNA, 17 nt, Homo sapiens
uauauaugaaaacuaag

SEQ ID NO: 441649 - RNA, 16 nt, Homo sapiens
uauauaugugugugua

SEQ ID NO: 441650 - RNA, 14 nt, Homo sapiens
uauaucgaucucuu

SEQ ID NO: 441651 - RNA, 19 nt, Homo sapiens
uauaucucacaggaguugg

SEQ ID NO: 441652 - RNA, 16 nt, Homo sapiens
uauaugcaccccugga

SEQ ID NO: 441653 - RNA, 14 nt, Homo sapiens
uauauggggggcca

SEQ ID NO: 441654 - RNA, 22 nt, Homo sapiens
uauauuugugugaaaaugugac

SEQ ID NO: 441655 - RNA, 15 nt, Homo sapiens
uauauuugugugagg

SEQ ID NO: 441656 - RNA, 19 nt, Homo sapiens
uaucaaaaaguacaauaau

SEQ ID NO: 441657 - RNA, 13 nt, Homo sapiens
uaucaaacagcuc

SEQ ID NO: 441658 - RNA, 14 nt, Homo sapiens
uaucaaaugcauuu

SEQ ID NO: 441659 - RNA, 21 nt, Homo sapiens
uaucaagccaguacgugcuaa

SEQ ID NO: 441660 - RNA, 23 nt, Homo sapiens
uaucaaggauguucuggcuuuac

SEQ ID NO: 441661 - RNA, 16 nt, Homo sapiens
uaucaagugucuucca

SEQ ID NO: 441662 - RNA, 16 nt, Homo sapiens
uaucacauauuugaua

SEQ ID NO: 441663 - RNA, 18 nt, Homo sapiens
uaucaccucuuaugcaca

SEQ ID NO: 441664 - RNA, 20 nt, Homo sapiens
uaucacuuuggucuccauuu

SEQ ID NO: 441665 - RNA, 14 nt, Homo sapiens
uaucagucauaacu

SEQ ID NO: 441666 - RNA, 22 nt, Homo sapiens
uaucauuaaccuuaucauaaau

SEQ ID NO: 441667 - RNA, 23 nt, Homo sapiens
uaucauugcuaaacugaugacuu

SEQ ID NO: 441668 - RNA, 19 nt, Homo sapiens
uauccaaaagagacaggga

SEQ ID NO: 441669 - RNA, 16 nt, Homo sapiens
uauccaaagcauugca

SEQ ID NO: 441670 - RNA, 22 nt, Homo sapiens
uauccaagaccuuacaaccaca

SEQ ID NO: 441671 - RNA, 23 nt, Homo sapiens
uauccacaacuuuucaaguauug

SEQ ID NO: 441672 - RNA, 19 nt, Homo sapiens
uauccacagaaccuuuguc

SEQ ID NO: 441673 - RNA, 21 nt, Homo sapiens
uauccaugcaccaaacuaaua

SEQ ID NO: 441674 - RNA, 13 nt, Homo sapiens
uaucccacggaaa

SEQ ID NO: 441675 - RNA, 15 nt, Homo sapiens
uaucccagugaucac

SEQ ID NO: 441676 - RNA, 13 nt, Homo sapiens
uaucccaucucac

SEQ ID NO: 441677 - RNA, 21 nt, Homo sapiens
uaucccuagauagcuauuaag

SEQ ID NO: 441678 - RNA, 14 nt, Homo sapiens
uaucccuaugcugc

SEQ ID NO: 441679 - RNA, 15 nt, Homo sapiens
uaucccuaugcugcc

SEQ ID NO: 441680 - RNA, 20 nt, Homo sapiens
uauccugagccaucggugaa

SEQ ID NO: 441681 - RNA, 22 nt, Homo sapiens
uauccugauaaacauuaaacac

SEQ ID NO: 441682 - RNA, 15 nt, Homo sapiens
uauccuguuacugaa

SEQ ID NO: 441683 - RNA, 15 nt, Homo sapiens
uaucgccuuuugaca

SEQ ID NO: 441684 - RNA, 20 nt, Homo sapiens
uaucuaguaggucugcacac

SEQ ID NO: 441685 - RNA, 12 nt, Homo sapiens
uaucucaaugug

SEQ ID NO: 441686 - RNA, 20 nt, Homo sapiens
uaucucacaaauaaguaaua

SEQ ID NO: 441687 - RNA, 21 nt, Homo sapiens
uaucugaacacauacuagaaa

SEQ ID NO: 441688 - RNA, 15 nt, Homo sapiens
uaucugacugaaauu

SEQ ID NO: 441689 - RNA, 19 nt, Homo sapiens
uaucugguaucugcaugua

SEQ ID NO: 441690 - RNA, 18 nt, Homo sapiens
uaucugugaauucagauu

SEQ ID NO: 441691 - RNA, 22 nt, Homo sapiens
uaucuugaagacuuuucuuuca

SEQ ID NO: 441692 - RNA, 14 nt, Homo sapiens
uaucuugcaucuac

SEQ ID NO: 441693 - RNA, 15 nt, Homo sapiens
uaucuuggcuuugcc

SEQ ID NO: 441694 - RNA, 15 nt, Homo sapiens
uaucuuguguaugga

SEQ ID NO: 441695 - RNA, 15 nt, Homo sapiens
uaucuuuaaauauaa

SEQ ID NO: 441696 - RNA, 16 nt, Homo sapiens
uaugaaaugggcuuua

SEQ ID NO: 441697 - RNA, 14 nt, Homo sapiens
uaugaacuacaaag

SEQ ID NO: 441698 - RNA, 13 nt, Homo sapiens
uaugaacuugagg

SEQ ID NO: 441699 - RNA, 12 nt, Homo sapiens
uaugaaguacuu

SEQ ID NO: 441700 - RNA, 16 nt, Homo sapiens
aaggccaucugcuuac

SEQ ID NO: 441701 - RNA, 22 nt, Homo sapiens
aaggcccagccuguaacugucc

SEQ ID NO: 441702 - RNA, 19 nt, Homo sapiens
aaggccucuugcuggugca

SEQ ID NO: 441703 - RNA, 17 nt, Homo sapiens
aaggccugcccucccau

SEQ ID NO: 441704 - RNA, 23 nt, Homo sapiens
aaggccugucccuggccaucucu

SEQ ID NO: 441705 - RNA, 13 nt, Homo sapiens
aaggccuuuggga

SEQ ID NO: 441706 - RNA, 20 nt, Homo sapiens
aaggccuuugggauuugccg

SEQ ID NO: 441707 - RNA, 18 nt, Homo sapiens
aaggcgauguggugaccc

SEQ ID NO: 441708 - RNA, 21 nt, Homo sapiens
aaggcucauaccuggcuugca

SEQ ID NO: 441709 - RNA, 12 nt, Homo sapiens
aaggcugcagga

SEQ ID NO: 441710 - RNA, 22 nt, Homo sapiens
aaggcuggcugaaaaucacuau

SEQ ID NO: 441711 - RNA, 21 nt, Homo sapiens
aaggcuuggcacacugccagu

SEQ ID NO: 441712 - RNA, 20 nt, Homo sapiens
aagggaagccgccuuugcaa

SEQ ID NO: 441713 - RNA, 15 nt, Homo sapiens
aagggaauugcucag

SEQ ID NO: 441714 - RNA, 18 nt, Homo sapiens
aagggaauugcucagaga

SEQ ID NO: 441715 - RNA, 20 nt, Homo sapiens
aagggaguggccucauuuca

SEQ ID NO: 441716 - RNA, 23 nt, Homo sapiens
aagggcacgagagagucuuccag

SEQ ID NO: 441717 - RNA, 14 nt, Homo sapiens
aagggcaucaucua

SEQ ID NO: 441718 - RNA, 22 nt, Homo sapiens
aagggcgcugagggcaggguuc

SEQ ID NO: 441719 - RNA, 21 nt, Homo sapiens
aagggcuuaucuagccaaaga

SEQ ID NO: 441720 - RNA, 16 nt, Homo sapiens
aaggggacgcuuugaa

SEQ ID NO: 441721 - RNA, 20 nt, Homo sapiens
aaggggcugucucccaauga

SEQ ID NO: 441722 - RNA, 12 nt, Homo sapiens
aaggggucugua

SEQ ID NO: 441723 - RNA, 19 nt, Homo sapiens
aaggguaauagaaaugcau

SEQ ID NO: 441724 - RNA, 14 nt, Homo sapiens
aagggucuugacuc

SEQ ID NO: 441725 - RNA, 15 nt, Homo sapiens
aagggugacauccca

SEQ ID NO: 441726 - RNA, 21 nt, Homo sapiens
aagggugcccuuugggguccc

SEQ ID NO: 441727 - RNA, 23 nt, Homo sapiens
aaggguguugcuaagcuguaacc

SEQ ID NO: 441728 - RNA, 16 nt, Homo sapiens
aaggguucagggcaug

SEQ ID NO: 441729 - RNA, 14 nt, Homo sapiens
aaggguugugagcc

SEQ ID NO: 441730 - RNA, 13 nt, Homo sapiens
aagguauguguca

SEQ ID NO: 441731 - RNA, 19 nt, Homo sapiens
aagguauuuugaauaccau

SEQ ID NO: 441732 - RNA, 20 nt, Homo sapiens
aaggucagcucccaucucau

SEQ ID NO: 441733 - RNA, 21 nt, Homo sapiens
aagguccacucccugcuccac

SEQ ID NO: 441734 - RNA, 18 nt, Homo sapiens
aagguccugcuguggaaa

SEQ ID NO: 441735 - RNA, 22 nt, Homo sapiens
aaggucuuugacggcaccaucu

SEQ ID NO: 441736 - RNA, 16 nt, Homo sapiens
aaggugaaagugcagu

SEQ ID NO: 441737 - RNA, 18 nt, Homo sapiens
aaggugcuaaaaggaaua

SEQ ID NO: 441738 - RNA, 15 nt, Homo sapiens
aaggugcucaaagau

SEQ ID NO: 441739 - RNA, 21 nt, Homo sapiens
aagguggauuuuaaaaauugg

SEQ ID NO: 441740 - RNA, 21 nt, Homo sapiens
aaggugggaaggaugguccag

SEQ ID NO: 441741 - RNA, 18 nt, Homo sapiens
aagguggggauugcccau

SEQ ID NO: 441742 - RNA, 15 nt, Homo sapiens
aagguuaagccauau

SEQ ID NO: 441743 - RNA, 15 nt, Homo sapiens
aagguucuugcugcc

SEQ ID NO: 441744 - RNA, 18 nt, Homo sapiens
aagguuucacuguucaug

SEQ ID NO: 441745 - RNA, 16 nt, Homo sapiens
aagguuuuaacauuga

SEQ ID NO: 441746 - RNA, 23 nt, Homo sapiens
aaguaacaaugcaugcuuuggaa

SEQ ID NO: 441747 - RNA, 15 nt, Homo sapiens
aaguaaggcaugguu

SEQ ID NO: 441748 - RNA, 17 nt, Homo sapiens
aaguaaguuugauuuca

SEQ ID NO: 441749 - RNA, 19 nt, Homo sapiens
aaguaauagggcuucugcc

SEQ ID NO: 441750 - RNA, 15 nt, Homo sapiens
aaguaauaucuuuca

SEQ ID NO: 441751 - RNA, 17 nt, Homo sapiens
aaguaauguuaauucuu

SEQ ID NO: 441752 - RNA, 23 nt, Homo sapiens
aaguaauuaucgggaacaguguu

SEQ ID NO: 441753 - RNA, 13 nt, Homo sapiens
aaguaauuccucu

SEQ ID NO: 441754 - RNA, 20 nt, Homo sapiens
aaguaauuccucucacuaaa

SEQ ID NO: 441755 - RNA, 21 nt, Homo sapiens
aaguacaaauauuccuguuuc

SEQ ID NO: 441756 - RNA, 22 nt, Homo sapiens
aaguacuacuguagaacugcaa

SEQ ID NO: 441757 - RNA, 16 nt, Homo sapiens
aaguagcacacugagu

SEQ ID NO: 441758 - RNA, 22 nt, Homo sapiens
aaguagcguuggagacauacac

SEQ ID NO: 441759 - RNA, 21 nt, Homo sapiens
aaguaggugugacuugaacua

SEQ ID NO: 441760 - RNA, 20 nt, Homo sapiens
aaguauaucuaucuauauau

SEQ ID NO: 441761 - RNA, 14 nt, Homo sapiens
aaguauuaauguac

SEQ ID NO: 441762 - RNA, 13 nt, Homo sapiens
aaguauugcuaau

SEQ ID NO: 441763 - RNA, 12 nt, Homo sapiens
aaguauuuugcc

SEQ ID NO: 441764 - RNA, 18 nt, Homo sapiens
aagucaaacaguguggcu

SEQ ID NO: 441765 - RNA, 23 nt, Homo sapiens
aagucaaacuuucaccucagauu

SEQ ID NO: 441766 - RNA, 15 nt, Homo sapiens
aagucaccuguauaa

SEQ ID NO: 441767 - RNA, 17 nt, Homo sapiens
aagucacguagcacaga

SEQ ID NO: 441768 - RNA, 23 nt, Homo sapiens
aagucacugcacagugcaucuca

SEQ ID NO: 441769 - RNA, 16 nt, Homo sapiens
aagucagaucuggucu

SEQ ID NO: 441770 - RNA, 13 nt, Homo sapiens
aagucagcuuuca

SEQ ID NO: 441771 - RNA, 15 nt, Homo sapiens
aagucaucauaaaag

SEQ ID NO: 441772 - RNA, 17 nt, Homo sapiens
aagucaugaagcucagu

SEQ ID NO: 441773 - RNA, 18 nt, Homo sapiens
aagucauuuuaacuuuau

SEQ ID NO: 441774 - RNA, 14 nt, Homo sapiens
aaguccagcucucc

SEQ ID NO: 441775 - RNA, 11 nt, Homo sapiens
aaguccagugu

SEQ ID NO: 441776 - RNA, 19 nt, Homo sapiens
aagucccuugaccuuucca

SEQ ID NO: 441777 - RNA, 15 nt, Homo sapiens
aaguccuaaagugaa

SEQ ID NO: 441778 - RNA, 16 nt, Homo sapiens
aagucggaucuagucc

SEQ ID NO: 441779 - RNA, 20 nt, Homo sapiens
aagucucacuuuuauugaua

SEQ ID NO: 441780 - RNA, 16 nt, Homo sapiens
aagucuccuguaucau

SEQ ID NO: 441781 - RNA, 21 nt, Homo sapiens
aagucucuuaauucugaugcu

SEQ ID NO: 441782 - RNA, 13 nt, Homo sapiens
aagucucuucucu

SEQ ID NO: 441783 - RNA, 19 nt, Homo sapiens
aagucugcauuacauuccu

SEQ ID NO: 441784 - RNA, 14 nt, Homo sapiens
aagucuugcauuga

SEQ ID NO: 441785 - RNA, 14 nt, Homo sapiens
aagugaaaaugcca

SEQ ID NO: 441786 - RNA, 14 nt, Homo sapiens
aagugaacuaugaa

SEQ ID NO: 441787 - RNA, 22 nt, Homo sapiens
aagugaagagugacuaguacaa

SEQ ID NO: 441788 - RNA, 13 nt, Homo sapiens
aagugacuugaau

SEQ ID NO: 441789 - RNA, 22 nt, Homo sapiens
aagugacuugaauguacaaaga

SEQ ID NO: 441790 - RNA, 22 nt, Homo sapiens
aagugauaucccccagccucaa

SEQ ID NO: 441791 - RNA, 12 nt, Homo sapiens
aagugaugugau

SEQ ID NO: 441792 - RNA, 15 nt, Homo sapiens
aagugaugugauuua

SEQ ID NO: 441793 - RNA, 15 nt, Homo sapiens
aagugccuaccccag

SEQ ID NO: 441794 - RNA, 22 nt, Homo sapiens
aagugcugggauuacaggugug

SEQ ID NO: 441795 - RNA, 16 nt, Homo sapiens
aaguggccccucguga

SEQ ID NO: 441796 - RNA, 17 nt, Homo sapiens
aagugggagugggagag

SEQ ID NO: 441797 - RNA, 19 nt, Homo sapiens
aagugguagcucuuguugc

SEQ ID NO: 441798 - RNA, 13 nt, Homo sapiens
aaguguacaguau

SEQ ID NO: 441799 - RNA, 14 nt, Homo sapiens
aagugucuaaugca

SEQ ID NO: 441800 - RNA, 21 nt, Homo sapiens
aagugucugugugcaagugug

SEQ ID NO: 441801 - RNA, 12 nt, Homo sapiens
aagugucuucca

SEQ ID NO: 441802 - RNA, 22 nt, Homo sapiens
aaguuaacauucaguacuuuau

SEQ ID NO: 441803 - RNA, 15 nt, Homo sapiens
aaguuaagcagccuu

SEQ ID NO: 441804 - RNA, 14 nt, Homo sapiens
aaguuaauucucag

SEQ ID NO: 441805 - RNA, 19 nt, Homo sapiens
aaguuacaaauucaaggag

SEQ ID NO: 441806 - RNA, 14 nt, Homo sapiens
aaguuauugauguu

SEQ ID NO: 441807 - RNA, 15 nt, Homo sapiens
aaguuauugugauaa

SEQ ID NO: 441808 - RNA, 23 nt, Homo sapiens
aaguuauuuacuuuuaccacuau

SEQ ID NO: 441809 - RNA, 22 nt, Homo sapiens
aaguucaccguaguaacacaua

SEQ ID NO: 441810 - RNA, 13 nt, Homo sapiens
aaguucaugggca

SEQ ID NO: 441811 - RNA, 18 nt, Homo sapiens
aaguuccaguguucucuc

SEQ ID NO: 441812 - RNA, 20 nt, Homo sapiens
aaguucugggcagcuaaaag

SEQ ID NO: 441813 - RNA, 20 nt, Homo sapiens
aaguugaagcuaagauuuag

SEQ ID NO: 441814 - RNA, 17 nt, Homo sapiens
aaguugcugaugaacuc

SEQ ID NO: 441815 - RNA, 20 nt, Homo sapiens
aaguugcugaugaacucuua

SEQ ID NO: 441816 - RNA, 16 nt, Homo sapiens
aaguuuagaaauuaca

SEQ ID NO: 441817 - RNA, 19 nt, Homo sapiens
aaguuucuuaaagcaacac

SEQ ID NO: 441818 - RNA, 14 nt, Homo sapiens
aaguuuuacuugag

SEQ ID NO: 441819 - RNA, 22 nt, Homo sapiens
aaguuuucuuuuacuaucuuuu

SEQ ID NO: 441820 - RNA, 21 nt, Homo sapiens
aauaaaacaucuuuccagucc

SEQ ID NO: 441821 - RNA, 14 nt, Homo sapiens
aauaaaauguuccg

SEQ ID NO: 441822 - RNA, 22 nt, Homo sapiens
aauaaacaguugugaaccaaga

SEQ ID NO: 441823 - RNA, 17 nt, Homo sapiens
aauaaacgaaacacaga

SEQ ID NO: 441824 - RNA, 17 nt, Homo sapiens
aauaaacuagacucuga

SEQ ID NO: 441825 - RNA, 13 nt, Homo sapiens
aauaaagcccuug

SEQ ID NO: 441826 - RNA, 20 nt, Homo sapiens
aauaaagcugauagcauaua

SEQ ID NO: 441827 - RNA, 20 nt, Homo sapiens
aauaaaguacccugugcuca

SEQ ID NO: 441828 - RNA, 15 nt, Homo sapiens
aauaaaguauuccac

SEQ ID NO: 441829 - RNA, 14 nt, Homo sapiens
agaugagacugccc

SEQ ID NO: 441830 - RNA, 21 nt, Homo sapiens
agaugagccccacguggagcu

SEQ ID NO: 441831 - RNA, 22 nt, Homo sapiens
agaugaugccaugggcccucuc

SEQ ID NO: 441832 - RNA, 20 nt, Homo sapiens
agaugccaaaaaagaugcca

SEQ ID NO: 441833 - RNA, 16 nt, Homo sapiens
agaugcccuuuggaaa

SEQ ID NO: 441834 - RNA, 18 nt, Homo sapiens
agaugccucccugacccu

SEQ ID NO: 441835 - RNA, 20 nt, Homo sapiens
agaugccucuucuaccucuu

SEQ ID NO: 441836 - RNA, 14 nt, Homo sapiens
agaugcgcaaagag

SEQ ID NO: 441837 - RNA, 21 nt, Homo sapiens
agaugcgcaaagagugugcuc

SEQ ID NO: 441838 - RNA, 19 nt, Homo sapiens
agaugcgcugugccaaagc

SEQ ID NO: 441839 - RNA, 20 nt, Homo sapiens
agaugcguuguuacaggaag

SEQ ID NO: 441840 - RNA, 12 nt, Homo sapiens
agaugggacugg

SEQ ID NO: 441841 - RNA, 18 nt, Homo sapiens
agaugggaggaucacuug

SEQ ID NO: 441842 - RNA, 16 nt, Homo sapiens
agauggggacagguga

SEQ ID NO: 441843 - RNA, 17 nt, Homo sapiens
agaugggggaacuguga

SEQ ID NO: 441844 - RNA, 21 nt, Homo sapiens
agauggggucucacaguguug

SEQ ID NO: 441845 - RNA, 13 nt, Homo sapiens
agauggugcugag

SEQ ID NO: 441846 - RNA, 21 nt, Homo sapiens
agauguaauuguuugucuuua

SEQ ID NO: 441847 - RNA, 19 nt, Homo sapiens
agaugucaugacaacacua

SEQ ID NO: 441848 - RNA, 20 nt, Homo sapiens
agaugucccccaggggccca

SEQ ID NO: 441849 - RNA, 12 nt, Homo sapiens
agauguccucag

SEQ ID NO: 441850 - RNA, 21 nt, Homo sapiens
agaugucuucguacaguucuu

SEQ ID NO: 441851 - RNA, 21 nt, Homo sapiens
agaugugacccaccagugccu

SEQ ID NO: 441852 - RNA, 20 nt, Homo sapiens
agaugugcaggcuccuccuc

SEQ ID NO: 441853 - RNA, 16 nt, Homo sapiens
agaugugccuagacac

SEQ ID NO: 441854 - RNA, 20 nt, Homo sapiens
agauguggcaaagugcugua

SEQ ID NO: 441855 - RNA, 15 nt, Homo sapiens
agaugugucuuacca

SEQ ID NO: 441856 - RNA, 11 nt, Homo sapiens
agauguuuaca

SEQ ID NO: 441857 - RNA, 19 nt, Homo sapiens
agauguuugaggcuuucag

SEQ ID NO: 441858 - RNA, 20 nt, Homo sapiens
agauguuugcuuuuguuaaa

SEQ ID NO: 441859 - RNA, 23 nt, Homo sapiens
agauguuuguuuucaaaauacuu

SEQ ID NO: 441860 - RNA, 18 nt, Homo sapiens
agauuagccuguagcuua

SEQ ID NO: 441861 - RNA, 19 nt, Homo sapiens
agauuagggcggggagaag

SEQ ID NO: 441862 - RNA, 12 nt, Homo sapiens
agauuaucccac

SEQ ID NO: 441863 - RNA, 22 nt, Homo sapiens
agauucaauuaaguuauuaaca

SEQ ID NO: 441864 - RNA, 12 nt, Homo sapiens
agauuccaccua

SEQ ID NO: 441865 - RNA, 17 nt, Homo sapiens
agauuccaccuagagcu

SEQ ID NO: 441866 - RNA, 22 nt, Homo sapiens
agauuccaggcgaugugcaagu

SEQ ID NO: 441867 - RNA, 21 nt, Homo sapiens
agauucccuuccggugcgugu

SEQ ID NO: 441868 - RNA, 18 nt, Homo sapiens
agauucuccaaaugauuu

SEQ ID NO: 441869 - RNA, 15 nt, Homo sapiens
agauucuuagcucuu

SEQ ID NO: 441870 - RNA, 20 nt, Homo sapiens
agauugacuauuuauacaaa

SEQ ID NO: 441871 - RNA, 11 nt, Homo sapiens
agauugccacu

SEQ ID NO: 441872 - RNA, 18 nt, Homo sapiens
agauuggcauggcuuuau

SEQ ID NO: 441873 - RNA, 17 nt, Homo sapiens
agauugugaauauuucc

SEQ ID NO: 441874 - RNA, 19 nt, Homo sapiens
agauuucucaccuguaaga

SEQ ID NO: 441875 - RNA, 17 nt, Homo sapiens
agauuuuaaaacuucau

SEQ ID NO: 441876 - RNA, 15 nt, Homo sapiens
agauuuuacaaaaga

SEQ ID NO: 441877 - RNA, 17 nt, Homo sapiens
agauuuuucucaucucc

SEQ ID NO: 441878 - RNA, 14 nt, Homo sapiens
agcaaaagauucua

SEQ ID NO: 441879 - RNA, 21 nt, Homo sapiens
agcaaaaggcagcucaccccu

SEQ ID NO: 441880 - RNA, 21 nt, Homo sapiens
agcaaaagugcaguaguguca

SEQ ID NO: 441881 - RNA, 19 nt, Homo sapiens
aggaacaagaauugcuaaa

SEQ ID NO: 441882 - RNA, 20 nt, Homo sapiens
aggaaccuccuccacaccag

SEQ ID NO: 441883 - RNA, 15 nt, Homo sapiens
aggaacgugguucag

SEQ ID NO: 441884 - RNA, 15 nt, Homo sapiens
aggaacuccuuggcc

SEQ ID NO: 441885 - RNA, 23 nt, Homo sapiens
aggaacucuucaugagcacuuug

SEQ ID NO: 441886 - RNA, 18 nt, Homo sapiens
aggaagaaaagcugccau

SEQ ID NO: 441887 - RNA, 15 nt, Homo sapiens
aggaagaauggugug

SEQ ID NO: 441888 - RNA, 15 nt, Homo sapiens
aggaagaucuugaga

SEQ ID NO: 441889 - RNA, 16 nt, Homo sapiens
aggaagcaaggccagc

SEQ ID NO: 441890 - RNA, 17 nt, Homo sapiens
aggaagcagccuccacu

SEQ ID NO: 441891 - RNA, 15 nt, Homo sapiens
aggaagccacgugcu

SEQ ID NO: 441892 - RNA, 17 nt, Homo sapiens
aggaagggacuggucca

SEQ ID NO: 441893 - RNA, 21 nt, Homo sapiens
aggaagggacugguccaggca

SEQ ID NO: 441894 - RNA, 22 nt, Homo sapiens
aggaagguggugcuuacauccu

SEQ ID NO: 441895 - RNA, 15 nt, Homo sapiens
aggaagugacuugaa

SEQ ID NO: 441896 - RNA, 15 nt, Homo sapiens
aggaauaaugauacc

SEQ ID NO: 441897 - RNA, 15 nt, Homo sapiens
aggaauagcauguca

SEQ ID NO: 441898 - RNA, 19 nt, Homo sapiens
aggaaucuaaacaaacagg

SEQ ID NO: 441899 - RNA, 13 nt, Homo sapiens
aggaaugacaaua

SEQ ID NO: 441900 - RNA, 14 nt, Homo sapiens
aggaaugacaauaa

SEQ ID NO: 441901 - RNA, 18 nt, Homo sapiens
aggaauugggaccugguu

SEQ ID NO: 441902 - RNA, 23 nt, Homo sapiens
aggacacacauagauaccuucaa

SEQ ID NO: 441903 - RNA, 22 nt, Homo sapiens
aggacaccuuuuaacucaccuc

SEQ ID NO: 441904 - RNA, 17 nt, Homo sapiens
aggacagcauggugcau

SEQ ID NO: 441905 - RNA, 22 nt, Homo sapiens
aggacaguacacacuuggguaa

SEQ ID NO: 441906 - RNA, 14 nt, Homo sapiens
aggacagugcugac

SEQ ID NO: 441907 - RNA, 15 nt, Homo sapiens
aggacagugcugacc

SEQ ID NO: 441908 - RNA, 19 nt, Homo sapiens
aggacaguggaugcugcug

SEQ ID NO: 441909 - RNA, 19 nt, Homo sapiens
aggaccaaagauacaugua

SEQ ID NO: 441910 - RNA, 19 nt, Homo sapiens
aggaccaauguugugauua

SEQ ID NO: 441911 - RNA, 17 nt, Homo sapiens
aggaccugagucugcua

SEQ ID NO: 441912 - RNA, 22 nt, Homo sapiens
aggaccuggagauugugcucug

SEQ ID NO: 441913 - RNA, 13 nt, Homo sapiens
aggacgauuucac

SEQ ID NO: 441914 - RNA, 15 nt, Homo sapiens
aggacucugcuucag

SEQ ID NO: 441915 - RNA, 17 nt, Homo sapiens
aggacuggaaguuugcc

SEQ ID NO: 441916 - RNA, 20 nt, Homo sapiens
aggacuuaacggcuccagga

SEQ ID NO: 441917 - RNA, 21 nt, Homo sapiens
aggacuuccauuugcuuuguc

SEQ ID NO: 441918 - RNA, 13 nt, Homo sapiens
aggacuucuggca

SEQ ID NO: 441919 - RNA, 15 nt, Homo sapiens
aggacuugaacaaaa

SEQ ID NO: 441920 - RNA, 14 nt, Homo sapiens
aggagaacugugcu

SEQ ID NO: 441921 - RNA, 21 nt, Homo sapiens
aggagaagcgggaguggcuga

SEQ ID NO: 441922 - RNA, 15 nt, Homo sapiens
aggagaauaugauaa

SEQ ID NO: 441923 - RNA, 17 nt, Homo sapiens
aggagaaucacuggaac

SEQ ID NO: 441924 - RNA, 14 nt, Homo sapiens
aggagacauuggua

SEQ ID NO: 441925 - RNA, 13 nt, Homo sapiens
aggagaccuucca

SEQ ID NO: 441926 - RNA, 16 nt, Homo sapiens
aggagagaacagggau

SEQ ID NO: 441927 - RNA, 21 nt, Homo sapiens
aggagagcaucugcucugaga

SEQ ID NO: 441928 - RNA, 17 nt, Homo sapiens
aggagaggaugcacagu

SEQ ID NO: 441929 - RNA, 13 nt, Homo sapiens
aggagagucccag

SEQ ID NO: 441930 - RNA, 13 nt, Homo sapiens
aggagaguguuua

SEQ ID NO: 441931 - RNA, 20 nt, Homo sapiens
aggagauggaaguugcagug

SEQ ID NO: 441932 - RNA, 15 nt, Homo sapiens
aggagccaccugggc

SEQ ID NO: 441933 - RNA, 15 nt, Homo sapiens
aggagccggcugccu

SEQ ID NO: 441934 - RNA, 22 nt, Homo sapiens
aggagccggugcucuggaagac

SEQ ID NO: 441935 - RNA, 18 nt, Homo sapiens
aggagcgggaccuguggc

SEQ ID NO: 441936 - RNA, 16 nt, Homo sapiens
aggaggaacuggucca

SEQ ID NO: 441937 - RNA, 20 nt, Homo sapiens
aggaggaacugguccaggcc

SEQ ID NO: 441938 - RNA, 23 nt, Homo sapiens
aggaggaaggagccuauggcauc

SEQ ID NO: 441939 - RNA, 13 nt, Homo sapiens
aggaggacaggga

SEQ ID NO: 441940 - RNA, 21 nt, Homo sapiens
aggaggagcauuguccaggca

SEQ ID NO: 441941 - RNA, 21 nt, Homo sapiens
aggaggccacaugauacuuau

SEQ ID NO: 441942 - RNA, 14 nt, Homo sapiens
aggaggccauucca

SEQ ID NO: 441943 - RNA, 22 nt, Homo sapiens
aggaggugcuaucgcaccacug

SEQ ID NO: 441944 - RNA, 23 nt, Homo sapiens
aggaggugcuaucgcaccacugu

SEQ ID NO: 441945 - RNA, 20 nt, Homo sapiens
aggagguugagaaugcagug

SEQ ID NO: 441946 - RNA, 14 nt, Homo sapiens
aggaguaauggcau

SEQ ID NO: 441947 - RNA, 14 nt, Homo sapiens
aggagucgggagca

SEQ ID NO: 441948 - RNA, 14 nt, Homo sapiens
aggagucucugcca

SEQ ID NO: 441949 - RNA, 22 nt, Homo sapiens
aggagucucugccacccacuca

SEQ ID NO: 441950 - RNA, 21 nt, Homo sapiens
aggaguucgagaccaaccuag

SEQ ID NO: 441951 - RNA, 19 nt, Homo sapiens
aggauaagcacuagaucuc

SEQ ID NO: 441952 - RNA, 21 nt, Homo sapiens
aggauauaguuaucaaucucu

SEQ ID NO: 441953 - RNA, 23 nt, Homo sapiens
aggauauaguuaucaaucucuag

SEQ ID NO: 441954 - RNA, 14 nt, Homo sapiens
aggauaucuuggcu

SEQ ID NO: 441955 - RNA, 19 nt, Homo sapiens
aggauauuaacaacaauaa

SEQ ID NO: 441956 - RNA, 12 nt, Homo sapiens
aggaucacuuga

SEQ ID NO: 441957 - RNA, 19 nt, Homo sapiens
aggauccucuccacuccau

SEQ ID NO: 441958 - RNA, 14 nt, Homo sapiens
aggaugaauguaug

SEQ ID NO: 441959 - RNA, 12 nt, Homo sapiens
aggaugagcugg

SEQ ID NO: 441960 - RNA, 22 nt, Homo sapiens
aggaugcacgguuucuguucug

SEQ ID NO: 441961 - RNA, 13 nt, Homo sapiens
aggaugcugugcc

SEQ ID NO: 441962 - RNA, 18 nt, Homo sapiens
aggauggcaaagagaguc

SEQ ID NO: 441963 - RNA, 21 nt, Homo sapiens
aggauggcguguccccugccu

SEQ ID NO: 441964 - RNA, 21 nt, Homo sapiens
aggauggucuccagacaccuu

SEQ ID NO: 441965 - RNA, 16 nt, Homo sapiens
aggauuuaccaaauag

SEQ ID NO: 441966 - RNA, 22 nt, Homo sapiens
aggauuuacuuuuuguaaaaag

SEQ ID NO: 441967 - RNA, 15 nt, Homo sapiens
aggauuucaugauuu

SEQ ID NO: 441968 - RNA, 15 nt, Homo sapiens
aggcaaagaacaauu

SEQ ID NO: 441969 - RNA, 16 nt, Homo sapiens
aggcaaauauaagcug

SEQ ID NO: 441970 - RNA, 14 nt, Homo sapiens
aggcaagccacaga

SEQ ID NO: 441971 - RNA, 16 nt, Homo sapiens
aggcaagcuggcagga

SEQ ID NO: 441972 - RNA, 22 nt, Homo sapiens
aggcaagguuggcgacugucau

SEQ ID NO: 441973 - RNA, 16 nt, Homo sapiens
aggcaaugacugugag

SEQ ID NO: 441974 - RNA, 22 nt, Homo sapiens
aggcaauggugaacugucauua

SEQ ID NO: 441975 - RNA, 14 nt, Homo sapiens
aggcacaggcuccu

SEQ ID NO: 441976 - RNA, 19 nt, Homo sapiens
aggcacccaccaccaugcc

SEQ ID NO: 441977 - RNA, 23 nt, Homo sapiens
aggcacccgcccuuuccuugccu

SEQ ID NO: 441978 - RNA, 22 nt, Homo sapiens
aggcaccgcagccugucagcca

SEQ ID NO: 441979 - RNA, 17 nt, Homo sapiens
aggguggucuugaucuc

SEQ ID NO: 441980 - RNA, 17 nt, Homo sapiens
aggguuccagacagggu

SEQ ID NO: 441981 - RNA, 16 nt, Homo sapiens
aggguucuaaguggga

SEQ ID NO: 441982 - RNA, 23 nt, Homo sapiens
aggguugcuucugagugguguuu

SEQ ID NO: 441983 - RNA, 15 nt, Homo sapiens
agguaaacuagcaaa

SEQ ID NO: 441984 - RNA, 15 nt, Homo sapiens
agguaacacauuaua

SEQ ID NO: 441985 - RNA, 13 nt, Homo sapiens
agguaaggccuuu

SEQ ID NO: 441986 - RNA, 15 nt, Homo sapiens
agguacaaguggcug

SEQ ID NO: 441987 - RNA, 21 nt, Homo sapiens
agguaccaagaucacaaauag

SEQ ID NO: 441988 - RNA, 20 nt, Homo sapiens
agguacgaaaagaggggaag

SEQ ID NO: 441989 - RNA, 19 nt, Homo sapiens
agguaggggcccacuucac

SEQ ID NO: 441990 - RNA, 15 nt, Homo sapiens
agguaguacugggaa

SEQ ID NO: 441991 - RNA, 21 nt, Homo sapiens
agguaucugguaucugcaugu

SEQ ID NO: 441992 - RNA, 20 nt, Homo sapiens
agguaucuuuuuuaaaugaa

SEQ ID NO: 441993 - RNA, 22 nt, Homo sapiens
agguaugggaccugcuaagugu

SEQ ID NO: 441994 - RNA, 16 nt, Homo sapiens
agguaugugucagcca

SEQ ID NO: 441995 - RNA, 14 nt, Homo sapiens
agguauuuuggaau

SEQ ID NO: 441996 - RNA, 16 nt, Homo sapiens
aggucaaggcugcagu

SEQ ID NO: 441997 - RNA, 16 nt, Homo sapiens
aggucaauuuccugau

SEQ ID NO: 441998 - RNA, 17 nt, Homo sapiens
aggucacauagcuggga

SEQ ID NO: 441999 - RNA, 12 nt, Homo sapiens
aggucacuccug

SEQ ID NO: 442000 - RNA, 17 nt, Homo sapiens
aggucacugaaacuuca

SEQ ID NO: 442001 - RNA, 22 nt, Homo sapiens
aggucagugcuucgugccucga

SEQ ID NO: 442002 - RNA, 17 nt, Homo sapiens
agguccgaggccaaagu

SEQ ID NO: 442003 - RNA, 20 nt, Homo sapiens
agguccucuacuuaaugaga

SEQ ID NO: 442004 - RNA, 21 nt, Homo sapiens
aggucgaccccaaagccccuu

SEQ ID NO: 442005 - RNA, 13 nt, Homo sapiens
aggucuccaaaau

SEQ ID NO: 442006 - RNA, 20 nt, Homo sapiens
aggucuguacguuaccucuu

SEQ ID NO: 442007 - RNA, 23 nt, Homo sapiens
cacagauuaucuuguacagccuu

SEQ ID NO: 442008 - RNA, 19 nt, Homo sapiens
cacagcaggagggacaaug

SEQ ID NO: 442009 - RNA, 18 nt, Homo sapiens
cacagcauguguauuucc

SEQ ID NO: 442010 - RNA, 11 nt, Homo sapiens
cacagccaaac

SEQ ID NO: 442011 - RNA, 14 nt, Homo sapiens
cacagcccagccac

SEQ ID NO: 442012 - RNA, 21 nt, Homo sapiens
cacagcugcagagacagagag

SEQ ID NO: 442013 - RNA, 16 nt, Homo sapiens
cacagcugcuggagaa

SEQ ID NO: 442014 - RNA, 14 nt, Homo sapiens
cacagcugugguga

SEQ ID NO: 442015 - RNA, 15 nt, Homo sapiens
cacagggacacaaag

SEQ ID NO: 442016 - RNA, 17 nt, Homo sapiens
cacagggaggaaggcag

SEQ ID NO: 442017 - RNA, 22 nt, Homo sapiens
cacagggcgagacuccgucuca

SEQ ID NO: 442018 - RNA, 13 nt, Homo sapiens
cacaggggcccca

SEQ ID NO: 442019 - RNA, 23 nt, Homo sapiens
cacaggguuuuguauucuuuacu

SEQ ID NO: 442020 - RNA, 16 nt, Homo sapiens
cacagguucaugccac

SEQ ID NO: 442021 - RNA, 13 nt, Homo sapiens
cacagguuuucag

SEQ ID NO: 442022 - RNA, 16 nt, Homo sapiens
cacagguuuucagcaa

SEQ ID NO: 442023 - RNA, 18 nt, Homo sapiens
cacagugggugaggagau

SEQ ID NO: 442024 - RNA, 11 nt, Homo sapiens
cacagugucug

SEQ ID NO: 442025 - RNA, 15 nt, Homo sapiens
cacaguugccaugua

SEQ ID NO: 442026 - RNA, 12 nt, Homo sapiens
cacaguuugcaa

SEQ ID NO: 442027 - RNA, 16 nt, Homo sapiens
cacauaacaugcuuua

SEQ ID NO: 442028 - RNA, 19 nt, Homo sapiens
cacauaauacauuccauca

SEQ ID NO: 442029 - RNA, 20 nt, Homo sapiens
cacauaauuugaauggugca

SEQ ID NO: 442030 - RNA, 16 nt, Homo sapiens
cacauacacacucaua

SEQ ID NO: 442031 - RNA, 20 nt, Homo sapiens
cacauacgugagggggagcu

SEQ ID NO: 442032 - RNA, 16 nt, Homo sapiens
ggcgggcagggguucc

SEQ ID NO: 442033 - RNA, 15 nt, Homo sapiens
ggcgggggucuauac

SEQ ID NO: 442034 - RNA, 19 nt, Homo sapiens
ggcggucaauaauugugga

SEQ ID NO: 442035 - RNA, 14 nt, Homo sapiens
ggcgucccuaccuc

SEQ ID NO: 442036 - RNA, 14 nt, Homo sapiens
ggcguugugggcag

SEQ ID NO: 442037 - RNA, 16 nt, Homo sapiens
ggcuaaaaacauuuua

SEQ ID NO: 442038 - RNA, 22 nt, Homo sapiens
ggcuaaggccucuugcuggugc

SEQ ID NO: 442039 - RNA, 16 nt, Homo sapiens
ggcuagguaucauuca

SEQ ID NO: 442040 - RNA, 16 nt, Homo sapiens
ggcuaucugcauuuau

SEQ ID NO: 442041 - RNA, 23 nt, Homo sapiens
gaggugcugcuuugcuucuucaa

SEQ ID NO: 442042 - RNA, 18 nt, Homo sapiens
gagguggauucaugucca

SEQ ID NO: 442043 - RNA, 17 nt, Homo sapiens
gagguggggugaagcug

SEQ ID NO: 442044 - RNA, 17 nt, Homo sapiens
gagguggugccuucuca

SEQ ID NO: 442045 - RNA, 15 nt, Homo sapiens
gagguuauaggucac

SEQ ID NO: 442046 - RNA, 18 nt, Homo sapiens
gagguuuguuugugugaa

SEQ ID NO: 442047 - RNA, 22 nt, Homo sapiens
gaguaccaugaggguugcuauu

SEQ ID NO: 442048 - RNA, 16 nt, Homo sapiens
gaguacucacuuuuca

SEQ ID NO: 442049 - RNA, 20 nt, Homo sapiens
gaguagggacucagggccau

SEQ ID NO: 442050 - RNA, 23 nt, Homo sapiens
gaguaucuuuaaauauaaucccu

SEQ ID NO: 442051 - RNA, 18 nt, Homo sapiens
gagucaaaacacuuguaa

SEQ ID NO: 442052 - RNA, 23 nt, Homo sapiens
gagucaccuccuccacucacucc

SEQ ID NO: 442053 - RNA, 14 nt, Homo sapiens
gagucaccuuccag

SEQ ID NO: 442054 - RNA, 18 nt, Homo sapiens
gagucagucuucacuugc

SEQ ID NO: 442055 - RNA, 12 nt, Homo sapiens
gagucaucaugg

SEQ ID NO: 442056 - RNA, 14 nt, Homo sapiens
gaguccucacuccc

SEQ ID NO: 442057 - RNA, 14 nt, Homo sapiens
gagucgacuuugag

SEQ ID NO: 442058 - RNA, 20 nt, Homo sapiens
gagucucacuuuguugccca

SEQ ID NO: 442059 - RNA, 17 nt, Homo sapiens
gagucucugaacauccu

SEQ ID NO: 442060 - RNA, 17 nt, Homo sapiens
gagucucuucuccacug

SEQ ID NO: 442061 - RNA, 18 nt, Homo sapiens
gagucucuucuccacugg

SEQ ID NO: 442062 - RNA, 15 nt, Homo sapiens
gagucugaacagcug

SEQ ID NO: 442063 - RNA, 18 nt, Homo sapiens
gagucugaacagcuguaa

SEQ ID NO: 442064 - RNA, 14 nt, Homo sapiens
gagucugacaggaa

SEQ ID NO: 442065 - RNA, 16 nt, Homo sapiens
gagugaaaccaugacu

SEQ ID NO: 442066 - RNA, 18 nt, Homo sapiens
gagugaaaccaugacugu

SEQ ID NO: 442067 - RNA, 15 nt, Homo sapiens
gagugaaccuaccuu

SEQ ID NO: 442068 - RNA, 16 nt, Homo sapiens
gagugacuaguacaaa

SEQ ID NO: 442069 - RNA, 16 nt, Homo sapiens
gagugcaguggcacca

SEQ ID NO: 442070 - RNA, 19 nt, Homo sapiens
gagugcauugugaggguua

SEQ ID NO: 442071 - RNA, 21 nt, Homo sapiens
gagugggcugggcccucuguc

SEQ ID NO: 442072 - RNA, 11 nt, Homo sapiens
gaguggugcca

SEQ ID NO: 442073 - RNA, 18 nt, Homo sapiens
gagugguggcagcucaaa

SEQ ID NO: 442074 - RNA, 15 nt, Homo sapiens
gagugguuguugcca

SEQ ID NO: 442075 - RNA, 20 nt, Homo sapiens
gaguguggcuuaguaauaga

SEQ ID NO: 442076 - RNA, 20 nt, Homo sapiens
gaguuaaacuugaugccagu

SEQ ID NO: 442077 - RNA, 17 nt, Homo sapiens
gaguuacuuccuaucaa

SEQ ID NO: 442078 - RNA, 15 nt, Homo sapiens
gaguucaaugaucua

SEQ ID NO: 442079 - RNA, 11 nt, Homo sapiens
gaguucucacu

SEQ ID NO: 442080 - RNA, 23 nt, Homo sapiens
gaguucucacuauguuucucaga

SEQ ID NO: 442081 - RNA, 18 nt, Homo sapiens
gaguugaccuucugaaca

SEQ ID NO: 442082 - RNA, 18 nt, Homo sapiens
gaguuggaacugcauucu

SEQ ID NO: 442083 - RNA, 19 nt, Homo sapiens
gaguuguuuaaacagucaa

SEQ ID NO: 442084 - RNA, 19 nt, Homo sapiens
gaguuuaugggaaugccuu

SEQ ID NO: 442085 - RNA, 19 nt, Homo sapiens
gaguuucuauggauucacu

SEQ ID NO: 442086 - RNA, 19 nt, Homo sapiens
gaguuuuacucuuguugcc

SEQ ID NO: 442087 - RNA, 21 nt, Homo sapiens
gaguuuuacucuuguugccca

SEQ ID NO: 442088 - RNA, 20 nt, Homo sapiens
gauaaaaaaauauguagcaa

SEQ ID NO: 442089 - RNA, 19 nt, Homo sapiens
gauaaagaugucaaauauc

SEQ ID NO: 442090 - RNA, 17 nt, Homo sapiens
gauaaauuugacuguua

SEQ ID NO: 442091 - RNA, 18 nt, Homo sapiens
gauaacaguuacuccagu

SEQ ID NO: 442092 - RNA, 17 nt, Homo sapiens
gauaacuugagcaccgu

SEQ ID NO: 442093 - RNA, 16 nt, Homo sapiens
gauaagcacuagaucu

SEQ ID NO: 442094 - RNA, 22 nt, Homo sapiens
gauaagcacuagaucucccuua

SEQ ID NO: 442095 - RNA, 20 nt, Homo sapiens
gauaaguaaguuugauuuca

SEQ ID NO: 442096 - RNA, 18 nt, Homo sapiens
gauaaucuuagcugccaa

SEQ ID NO: 442097 - RNA, 19 nt, Homo sapiens
gauaaugaguuuuacauua

SEQ ID NO: 442098 - RNA, 20 nt, Homo sapiens
gauaauuuuuagacuaacuu

SEQ ID NO: 442099 - RNA, 17 nt, Homo sapiens
gauacacaccuuucaca

SEQ ID NO: 442100 - RNA, 12 nt, Homo sapiens
gauacacuguau

SEQ ID NO: 442101 - RNA, 11 nt, Homo sapiens
gauacaguauu

SEQ ID NO: 442102 - RNA, 12 nt, Homo sapiens
gauacagucucc

SEQ ID NO: 442103 - RNA, 21 nt, Homo sapiens
gauacaugugccgaaugugca

SEQ ID NO: 442104 - RNA, 23 nt, Homo sapiens
gauacuaauaggugugugaggcu

SEQ ID NO: 442105 - RNA, 13 nt, Homo sapiens
gauacucuuuaau

SEQ ID NO: 442106 - RNA, 19 nt, Homo sapiens
gauacugaguaaauccaug

SEQ ID NO: 442107 - RNA, 16 nt, Homo sapiens
gauagaagauguuugc

SEQ ID NO: 442108 - RNA, 22 nt, Homo sapiens
gauagaauaaagccuugugauc

SEQ ID NO: 442109 - RNA, 13 nt, Homo sapiens
gauagcaggugaa

SEQ ID NO: 442110 - RNA, 15 nt, Homo sapiens
gauagcauauauuca

SEQ ID NO: 442111 - RNA, 14 nt, Homo sapiens
ggauccucccucau

SEQ ID NO: 442112 - RNA, 13 nt, Homo sapiens
ggauccugcacuc

SEQ ID NO: 442113 - RNA, 13 nt, Homo sapiens
ggaucuaccagca

SEQ ID NO: 442114 - RNA, 18 nt, Homo sapiens
ggaucuaucaccugucau

SEQ ID NO: 442115 - RNA, 19 nt, Homo sapiens
gcuacugcaaaugcuauau

SEQ ID NO: 442116 - RNA, 17 nt, Homo sapiens
gcuagaaaaaacauaaa

SEQ ID NO: 442117 - RNA, 14 nt, Homo sapiens
gcuagaguccucac

SEQ ID NO: 442118 - RNA, 12 nt, Homo sapiens
gcuagaugggca

SEQ ID NO: 442119 - RNA, 14 nt, Homo sapiens
gcuagaugugucuu

SEQ ID NO: 442120 - RNA, 19 nt, Homo sapiens
gcuagaugugucuuaccag

SEQ ID NO: 442121 - RNA, 18 nt, Homo sapiens
gcuaggccggccagcucc

SEQ ID NO: 442122 - RNA, 19 nt, Homo sapiens
gcuaggguggcccuugcag

SEQ ID NO: 442123 - RNA, 16 nt, Homo sapiens
gcuagguaucauucaa

SEQ ID NO: 442124 - RNA, 20 nt, Homo sapiens
gcuauaugccuuaagccaau

SEQ ID NO: 442125 - RNA, 13 nt, Homo sapiens
gcuauauugcacu

SEQ ID NO: 442126 - RNA, 15 nt, Homo sapiens
gcuaucugcauuuau

SEQ ID NO: 442127 - RNA, 12 nt, Homo sapiens
gcuaugcaaauc

SEQ ID NO: 442128 - RNA, 18 nt, Homo sapiens
gcuauuaagaaaaucaca

SEQ ID NO: 442129 - RNA, 14 nt, Homo sapiens
gcuauuacugucug

SEQ ID NO: 442130 - RNA, 15 nt, Homo sapiens
gcuauuuccauucca

SEQ ID NO: 442131 - RNA, 22 nt, Homo sapiens
gcucaaaguacuacagcaaagc

SEQ ID NO: 442132 - RNA, 17 nt, Homo sapiens
gcucaagaggccacuua

SEQ ID NO: 442133 - RNA, 16 nt, Homo sapiens
gcucaaugaaaccuuc

SEQ ID NO: 442134 - RNA, 15 nt, Homo sapiens
gcucaaugugcuguu

SEQ ID NO: 442135 - RNA, 14 nt, Homo sapiens
gcucacagccacca

SEQ ID NO: 442136 - RNA, 21 nt, Homo sapiens
gcucacccaaggucaccaaac

SEQ ID NO: 442137 - RNA, 13 nt, Homo sapiens
gcucacucuucca

SEQ ID NO: 442138 - RNA, 22 nt, Homo sapiens
gcucagaaauguugguuacaug

SEQ ID NO: 442139 - RNA, 20 nt, Homo sapiens
gcucagcccaccccccucau

SEQ ID NO: 442140 - RNA, 13 nt, Homo sapiens
gcucagggugcuc

SEQ ID NO: 442141 - RNA, 17 nt, Homo sapiens
gcucaguuggugcugcu

SEQ ID NO: 442142 - RNA, 17 nt, Homo sapiens
gcucauagaucagcaaa

SEQ ID NO: 442143 - RNA, 14 nt, Homo sapiens
gcucaucacuggau

SEQ ID NO: 442144 - RNA, 10 nt, Homo sapiens
gcucaugccc

SEQ ID NO: 442145 - RNA, 20 nt, Homo sapiens
gcucauuucacuauucuguu

SEQ ID NO: 442146 - RNA, 17 nt, Homo sapiens
gcucauuuuuucuuaca

SEQ ID NO: 442147 - RNA, 14 nt, Homo sapiens
gcuccaagagaauu

SEQ ID NO: 442148 - RNA, 21 nt, Homo sapiens
gcuccaagagaauucacuuua

SEQ ID NO: 442149 - RNA, 12 nt, Homo sapiens
gcuccacucuga

SEQ ID NO: 442150 - RNA, 11 nt, Homo sapiens
gcuccacugaa

SEQ ID NO: 442151 - RNA, 13 nt, Homo sapiens
gcuccacugaaca

SEQ ID NO: 442152 - RNA, 12 nt, Homo sapiens
gcuccagaauua

SEQ ID NO: 442153 - RNA, 16 nt, Homo sapiens
gcuccagacacacagc

SEQ ID NO: 442154 - RNA, 16 nt, Homo sapiens
gcuccaggcuccaggc

SEQ ID NO: 442155 - RNA, 17 nt, Homo sapiens
gcuccagugcaggagac

SEQ ID NO: 442156 - RNA, 14 nt, Homo sapiens
gcucccagggccau

SEQ ID NO: 442157 - RNA, 17 nt, Homo sapiens
gcucccaugcucauacc

SEQ ID NO: 442158 - RNA, 20 nt, Homo sapiens
gcucccaugcucauaccucu

SEQ ID NO: 442159 - RNA, 13 nt, Homo sapiens
gcuccccaagaaa

SEQ ID NO: 442160 - RNA, 13 nt, Homo sapiens
gcuccccagugaa

SEQ ID NO: 442161 - RNA, 22 nt, Homo sapiens
gcucccgagcuacucucuugcc

SEQ ID NO: 442162 - RNA, 11 nt, Homo sapiens
gcucccggggc

SEQ ID NO: 442163 - RNA, 22 nt, Homo sapiens
gcuccgaaaaacuuuguuauau

SEQ ID NO: 442164 - RNA, 21 nt, Homo sapiens
gcuccgccuggcacccacucc

SEQ ID NO: 442165 - RNA, 16 nt, Homo sapiens
gcuccuaguagcuuuc

SEQ ID NO: 442166 - RNA, 16 nt, Homo sapiens
gcuccuccccucuuga

SEQ ID NO: 442167 - RNA, 14 nt, Homo sapiens
gcuccuggaaccaa

SEQ ID NO: 442168 - RNA, 18 nt, Homo sapiens
gcuccugggggaugcucu

SEQ ID NO: 442169 - RNA, 13 nt, Homo sapiens
gcucgaugccuuu

SEQ ID NO: 442170 - RNA, 12 nt, Homo sapiens
gcucgggacugu

SEQ ID NO: 442171 - RNA, 17 nt, Homo sapiens
gcucuaacauuacugcc

SEQ ID NO: 442172 - RNA, 15 nt, Homo sapiens
gcucuaccaagacau

SEQ ID NO: 442173 - RNA, 18 nt, Homo sapiens
gcucuacguuacaggugg

SEQ ID NO: 442174 - RNA, 23 nt, Homo sapiens
gcucuauaagagcuggaugcaca

SEQ ID NO: 442175 - RNA, 14 nt, Homo sapiens
gcucuaucugcaau

SEQ ID NO: 442176 - RNA, 15 nt, Homo sapiens
gcucuccaucuucca

SEQ ID NO: 442177 - RNA, 19 nt, Homo sapiens
gcucuccuucacucugaca

SEQ ID NO: 442178 - RNA, 16 nt, Homo sapiens
gcucuccuugcccugg

SEQ ID NO: 442179 - RNA, 13 nt, Homo sapiens
gcucucgacagua

SEQ ID NO: 442180 - RNA, 22 nt, Homo sapiens
gcucugaagagauacccacaga

SEQ ID NO: 442181 - RNA, 20 nt, Homo sapiens
gcucugagaaaccucgggaa

SEQ ID NO: 442182 - RNA, 23 nt, Homo sapiens
gcucugcagcgagccccccaugu

SEQ ID NO: 442183 - RNA, 17 nt, Homo sapiens
gcucugcuggucuucaa

SEQ ID NO: 442184 - RNA, 12 nt, Homo sapiens
gcucuggaagac

SEQ ID NO: 442185 - RNA, 20 nt, Homo sapiens
gcucuggauccugcacucua

SEQ ID NO: 442186 - RNA, 22 nt, Homo sapiens
gcucuggcaccacuaggguccu

SEQ ID NO: 442187 - RNA, 17 nt, Homo sapiens
gcucugggauagcugac

SEQ ID NO: 442188 - RNA, 21 nt, Homo sapiens
gcucuguccuaaauaucucaa

SEQ ID NO: 442189 - RNA, 19 nt, Homo sapiens
gcucuuacagccacaggca

SEQ ID NO: 442190 - RNA, 14 nt, Homo sapiens
gcucuucagcacca

SEQ ID NO: 442191 - RNA, 19 nt, Homo sapiens
gcucuugggaagaccagcu

SEQ ID NO: 442192 - RNA, 21 nt, Homo sapiens
gcucuuucaucucugcuugga

SEQ ID NO: 442193 - RNA, 16 nt, Homo sapiens
gcucuuucucugccag

SEQ ID NO: 442194 - RNA, 17 nt, Homo sapiens
gcucuuugucucaccag

SEQ ID NO: 442195 - RNA, 19 nt, Homo sapiens
gcugaaaaccaucuggccu

SEQ ID NO: 442196 - RNA, 23 nt, Homo sapiens
gcugaaacguggguaaggauuua

SEQ ID NO: 442197 - RNA, 18 nt, Homo sapiens
gcugaaauuaugucaaau

SEQ ID NO: 442198 - RNA, 21 nt, Homo sapiens
gcugaacacaagcaaaccuuc

SEQ ID NO: 442199 - RNA, 21 nt, Homo sapiens
gcugaaggaaaccagugcaac

SEQ ID NO: 442200 - RNA, 13 nt, Homo sapiens
gcugaagucauug

SEQ ID NO: 442201 - RNA, 16 nt, Homo sapiens
gcugaauuccuuuaca

SEQ ID NO: 442202 - RNA, 19 nt, Homo sapiens
gcugagugcaccacuucaa

SEQ ID NO: 442203 - RNA, 21 nt, Homo sapiens
gcugaugaacucuuaaucaaa

SEQ ID NO: 442204 - RNA, 22 nt, Homo sapiens
gcugauucaauaaaaugcacug

SEQ ID NO: 442205 - RNA, 22 nt, Homo sapiens
gcugauuucccuuuuuucuucc

SEQ ID NO: 442206 - RNA, 13 nt, Homo sapiens
gcugcacauuccu

SEQ ID NO: 442207 - RNA, 16 nt, Homo sapiens
gcugcacccacccagg

SEQ ID NO: 442208 - RNA, 16 nt, Homo sapiens
gcugcaccccaagucc

SEQ ID NO: 442209 - RNA, 20 nt, Homo sapiens
gcugcagcugggccccaugc

SEQ ID NO: 442210 - RNA, 15 nt, Homo sapiens
gcugcagucaucuac

SEQ ID NO: 442211 - RNA, 19 nt, Homo sapiens
gcugcaucuccccucagau

SEQ ID NO: 442212 - RNA, 13 nt, Homo sapiens
gcugcaugaaggu

SEQ ID NO: 442213 - RNA, 16 nt, Homo sapiens
gcugccaagcacucga

SEQ ID NO: 442214 - RNA, 21 nt, Homo sapiens
gcugccaaguaaauagcaaca

SEQ ID NO: 442215 - RNA, 20 nt, Homo sapiens
gcugccaauaaacuguuaca

SEQ ID NO: 442216 - RNA, 19 nt, Homo sapiens
gcugccaccaaaucugucu

SEQ ID NO: 442217 - RNA, 16 nt, Homo sapiens
gcugccagccacuuca

SEQ ID NO: 442218 - RNA, 14 nt, Homo sapiens
gcugccaucuccag

SEQ ID NO: 442219 - RNA, 16 nt, Homo sapiens
gcugcccacaccaccg

SEQ ID NO: 442220 - RNA, 19 nt, Homo sapiens
gcugccccuggugcacugg

SEQ ID NO: 442221 - RNA, 12 nt, Homo sapiens
uccccugcugaa

SEQ ID NO: 442222 - RNA, 16 nt, Homo sapiens
uccugugcuuucugca

SEQ ID NO: 442223 - RNA, 18 nt, Homo sapiens
uccugugggagaucuuca

SEQ ID NO: 442224 - RNA, 13 nt, Homo sapiens
uccuguuacugaa

SEQ ID NO: 442225 - RNA, 16 nt, Homo sapiens
uccuguucgugcuugu

SEQ ID NO: 442226 - RNA, 11 nt, Homo sapiens
uccuguucuca

SEQ ID NO: 442227 - RNA, 20 nt, Homo sapiens
ucucaagcgcuauccacaga

SEQ ID NO: 442228 - RNA, 19 nt, Homo sapiens
ucucaauguuccauucagu

SEQ ID NO: 442229 - RNA, 16 nt, Homo sapiens
ucucacagcacaugcu

SEQ ID NO: 442230 - RNA, 14 nt, Homo sapiens
ucucacaugcacag

SEQ ID NO: 442231 - RNA, 23 nt, Homo sapiens
ucucacuuaauacagauguauca

SEQ ID NO: 442232 - RNA, 20 nt, Homo sapiens
ucucacuuauaccaaaggga

SEQ ID NO: 442233 - RNA, 18 nt, Homo sapiens
ucucacuuuuauugauaa

SEQ ID NO: 442234 - RNA, 22 nt, Homo sapiens
ucuguaauauauugccaguaua

SEQ ID NO: 442235 - RNA, 18 nt, Homo sapiens
ucuguagaggagccugga

SEQ ID NO: 442236 - RNA, 15 nt, Homo sapiens
ucuguagggaacucu

SEQ ID NO: 442237 - RNA, 20 nt, Homo sapiens
ucuguauauagcucuacaca

SEQ ID NO: 442238 - RNA, 22 nt, Homo sapiens
ucuguauugcagcuaagcucaa

SEQ ID NO: 442239 - RNA, 13 nt, Homo sapiens
ucugucaaugaca

SEQ ID NO: 442240 - RNA, 19 nt, Homo sapiens
ucugucaccacaucuuguc

SEQ ID NO: 442241 - RNA, 16 nt, Homo sapiens
ucugucccaaucuuac

SEQ ID NO: 442242 - RNA, 14 nt, Homo sapiens
ucugucuacugugg

SEQ ID NO: 442243 - RNA, 12 nt, Homo sapiens
ucugucucaaaa

SEQ ID NO: 442244 - RNA, 12 nt, Homo sapiens
ucugucuguccu

SEQ ID NO: 442245 - RNA, 18 nt, Homo sapiens
ucugucuugucauuccag

SEQ ID NO: 442246 - RNA, 20 nt, Homo sapiens
ucugucuuuaagaacuaauu

SEQ ID NO: 442247 - RNA, 23 nt, Homo sapiens
ucugugaaagucuccuguaucau

SEQ ID NO: 442248 - RNA, 14 nt, Homo sapiens
ucugugauugccau

SEQ ID NO: 442249 - RNA, 16 nt, Homo sapiens
ucugugccccaugccu

SEQ ID NO: 442250 - RNA, 22 nt, Homo sapiens
ucugugccugggaucagugggg

SEQ ID NO: 442251 - RNA, 17 nt, Homo sapiens
ucuguguaaucucugau

SEQ ID NO: 442252 - RNA, 21 nt, Homo sapiens
ucuguguuggcccaagcucuu

SEQ ID NO: 442253 - RNA, 22 nt, Homo sapiens
ucuguguuuugaaugguguugu

SEQ ID NO: 442254 - RNA, 18 nt, Homo sapiens
ucuguuaaaugaacuuga

SEQ ID NO: 442255 - RNA, 19 nt, Homo sapiens
ucuguuaccaugucacugu

SEQ ID NO: 442256 - RNA, 15 nt, Homo sapiens
ucuguucugauauua

SEQ ID NO: 442257 - RNA, 20 nt, Homo sapiens
ucuguuuugcauggaguauu

SEQ ID NO: 442258 - RNA, 13 nt, Homo sapiens
ucuguuuugccug

SEQ ID NO: 442259 - RNA, 17 nt, Homo sapiens
ucuuaaauauacaacuu

SEQ ID NO: 442260 - RNA, 14 nt, Homo sapiens
ucuuaaaucuguga

SEQ ID NO: 442261 - RNA, 15 nt, Homo sapiens
ucuuaaaucugugaa

SEQ ID NO: 442262 - RNA, 22 nt, Homo sapiens
ucuuaacaacagcuucuugcuu

SEQ ID NO: 442263 - RNA, 13 nt, Homo sapiens
ucuuaaccccagu

SEQ ID NO: 442264 - RNA, 15 nt, Homo sapiens
ucuuaauaggcuuua

SEQ ID NO: 442265 - RNA, 19 nt, Homo sapiens
ucuuacagucagcacagaa

SEQ ID NO: 442266 - RNA, 13 nt, Homo sapiens
ucuuacaugcauu

SEQ ID NO: 442267 - RNA, 15 nt, Homo sapiens
ucuuacauuagcagu

SEQ ID NO: 442268 - RNA, 15 nt, Homo sapiens
ucuuaccuacaaaau

SEQ ID NO: 442269 - RNA, 12 nt, Homo sapiens
ucuuacuguugc

SEQ ID NO: 442270 - RNA, 17 nt, Homo sapiens
ucuuacuguugcauaac

SEQ ID NO: 442271 - RNA, 16 nt, Homo sapiens
ucuuacuuugugcaaa

SEQ ID NO: 442272 - RNA, 20 nt, Homo sapiens
ucuuagaacagauggcugug

SEQ ID NO: 442273 - RNA, 15 nt, Homo sapiens
ucuuagacacugugg

SEQ ID NO: 442274 - RNA, 14 nt, Homo sapiens
ucuuagcugccaag

SEQ ID NO: 442275 - RNA, 15 nt, Homo sapiens
ucuuagugucacuua

SEQ ID NO: 442276 - RNA, 13 nt, Homo sapiens
ucuuaguucucac

SEQ ID NO: 442277 - RNA, 16 nt, Homo sapiens
ucuuaugaaaugggcu

SEQ ID NO: 442278 - RNA, 12 nt, Homo sapiens
ucuuaugccauu

SEQ ID NO: 442279 - RNA, 13 nt, Homo sapiens
ucuuaugccauuu

SEQ ID NO: 442280 - RNA, 16 nt, Homo sapiens
ucuuauuuauauauga

SEQ ID NO: 442281 - RNA, 15 nt, Homo sapiens
ucuucacaccuaccc

SEQ ID NO: 442282 - RNA, 22 nt, Homo sapiens
ucuucacgguuucacuuuuaag

SEQ ID NO: 442283 - RNA, 21 nt, Homo sapiens
ucuucacuauucagaacuugu

SEQ ID NO: 442284 - RNA, 12 nt, Homo sapiens
ucuucacucuga

SEQ ID NO: 442285 - RNA, 18 nt, Homo sapiens
ucuucacuucuaaaugca

SEQ ID NO: 442286 - RNA, 17 nt, Homo sapiens
ucuucaguuuuaggcuu

SEQ ID NO: 442287 - RNA, 17 nt, Homo sapiens
ucuucaucccacuccaa

SEQ ID NO: 442288 - RNA, 14 nt, Homo sapiens
ucuucaucugugac

SEQ ID NO: 442289 - RNA, 16 nt, Homo sapiens
ucuucaugagcacuuu

SEQ ID NO: 442290 - RNA, 17 nt, Homo sapiens
ucuuccagcccagacau

SEQ ID NO: 442291 - RNA, 13 nt, Homo sapiens
ucuucccaugacu

SEQ ID NO: 442292 - RNA, 16 nt, Homo sapiens
ucuucccccucuccca

SEQ ID NO: 442293 - RNA, 11 nt, Homo sapiens
ucuucccuacc

SEQ ID NO: 442294 - RNA, 22 nt, Homo sapiens
ucuucccugguccccccaaauc

SEQ ID NO: 442295 - RNA, 23 nt, Homo sapiens
ucuucccuguaugauuccuugau

SEQ ID NO: 442296 - RNA, 20 nt, Homo sapiens
ucuuccuccagucuguucuc

SEQ ID NO: 442297 - RNA, 21 nt, Homo sapiens
ucuuccucccucauuccaccu

SEQ ID NO: 442298 - RNA, 22 nt, Homo sapiens
ucuuccucugcuguagagccau

SEQ ID NO: 442299 - RNA, 21 nt, Homo sapiens
ucuuccugaccaccuugcacu

SEQ ID NO: 442300 - RNA, 17 nt, Homo sapiens
ucuuccuggaaugcauu

SEQ ID NO: 442301 - RNA, 21 nt, Homo sapiens
ucuuccuggaaugcauucacu

SEQ ID NO: 442302 - RNA, 16 nt, Homo sapiens
ucuucggagguggcag

SEQ ID NO: 442303 - RNA, 21 nt, Homo sapiens
ucuucguagguugugaugaua

SEQ ID NO: 442304 - RNA, 15 nt, Homo sapiens
ucuucuacaaccaga

SEQ ID NO: 442305 - RNA, 23 nt, Homo sapiens
ucuucuauauuccgggugccauu

SEQ ID NO: 442306 - RNA, 20 nt, Homo sapiens
ucuucucagcuccacucuga

SEQ ID NO: 442307 - RNA, 22 nt, Homo sapiens
ucuucucagcuccacucugaag

SEQ ID NO: 442308 - RNA, 17 nt, Homo sapiens
ucuucucauagcauuaa

SEQ ID NO: 442309 - RNA, 13 nt, Homo sapiens
ucuucuccacugg

SEQ ID NO: 442310 - RNA, 14 nt, Homo sapiens
ucuucuccacugga

SEQ ID NO: 442311 - RNA, 19 nt, Homo sapiens
ucuucuuacaugcauuuga

SEQ ID NO: 442312 - RNA, 12 nt, Homo sapiens
ucuucuuccaau

SEQ ID NO: 442313 - RNA, 23 nt, Homo sapiens
ucuugaaaaaugcccauuugccu

SEQ ID NO: 442314 - RNA, 14 nt, Homo sapiens
ucuugagagcugcu

SEQ ID NO: 442315 - RNA, 20 nt, Homo sapiens
ucuugagauguauuaugcaa

SEQ ID NO: 442316 - RNA, 22 nt, Homo sapiens
ucuugagauguauuaugcaaag

SEQ ID NO: 442317 - RNA, 19 nt, Homo sapiens
ucuugagcccaggaguuca

SEQ ID NO: 442318 - RNA, 13 nt, Homo sapiens
ucuugaucuccug

SEQ ID NO: 442319 - RNA, 14 nt, Homo sapiens
ucuugauguaaaau

SEQ ID NO: 442320 - RNA, 15 nt, Homo sapiens
ucuugcacuauucca

SEQ ID NO: 442321 - RNA, 15 nt, Homo sapiens
ucuugcuaccuguga

SEQ ID NO: 442322 - RNA, 17 nt, Homo sapiens
ucuugcucuaucucuca

SEQ ID NO: 442323 - RNA, 14 nt, Homo sapiens
ucuugcugccaggc

SEQ ID NO: 442324 - RNA, 22 nt, Homo sapiens
ucuugcugccaggcccacacau

SEQ ID NO: 442325 - RNA, 13 nt, Homo sapiens
ucuuggaaaucau

SEQ ID NO: 442326 - RNA, 13 nt, Homo sapiens
ucuuggagacaau

SEQ ID NO: 442327 - RNA, 23 nt, Homo sapiens
ucuuggagaggagguguggagug

SEQ ID NO: 442328 - RNA, 16 nt, Homo sapiens
ucuuggccguggcauu

SEQ ID NO: 442329 - RNA, 19 nt, Homo sapiens
ucuuggccucaaguucaau

SEQ ID NO: 442330 - RNA, 16 nt, Homo sapiens
ucuuggcuuugccaca

SEQ ID NO: 442331 - RNA, 15 nt, Homo sapiens
ucuugggaaaauauc

SEQ ID NO: 442332 - RNA, 15 nt, Homo sapiens
ucuugguacuacuag

SEQ ID NO: 442333 - RNA, 22 nt, Homo sapiens
ucuuguaaaacugugacauucc

SEQ ID NO: 442334 - RNA, 23 nt, Homo sapiens
ucuuguaaaacugugacauucca

SEQ ID NO: 442335 - RNA, 15 nt, Homo sapiens
ucuuguauugcucca

SEQ ID NO: 442336 - RNA, 22 nt, Homo sapiens
ucuugucgggagauugaaccac

SEQ ID NO: 442337 - RNA, 21 nt, Homo sapiens
ucuugucugagaacaaauaca

SEQ ID NO: 442338 - RNA, 19 nt, Homo sapiens
ucuugugagggacugagau

SEQ ID NO: 442339 - RNA, 15 nt, Homo sapiens
ucuugugccucuaau

SEQ ID NO: 442340 - RNA, 15 nt, Homo sapiens
ucuuguugcugcauc

SEQ ID NO: 442341 - RNA, 15 nt, Homo sapiens
ucuuguuuaccaaag

SEQ ID NO: 442342 - RNA, 20 nt, Homo sapiens
ucuuuaaaguuacugaucac

SEQ ID NO: 442343 - RNA, 18 nt, Homo sapiens
ucuuuaaguuuugauuaa

SEQ ID NO: 442344 - RNA, 21 nt, Homo sapiens
ucuuuaauguuguccaggaaa

SEQ ID NO: 442345 - RNA, 14 nt, Homo sapiens
ucuuuaccuugcau

SEQ ID NO: 442346 - RNA, 24 nt, Homo sapiens
ucuuuaccuugcauuuuagcuaau

SEQ ID NO: 442347 - RNA, 14 nt, Homo sapiens
ucuuuauacuuaaa

SEQ ID NO: 442348 - RNA, 16 nt, Homo sapiens
ucuuuaucauugcuaa

SEQ ID NO: 442349 - RNA, 17 nt, Homo sapiens
ucuuucaaacuuggggu

SEQ ID NO: 442350 - RNA, 20 nt, Homo sapiens
ucuuucaauccacaguauug

SEQ ID NO: 442351 - RNA, 20 nt, Homo sapiens
ucuuucaauugcagaugcca

SEQ ID NO: 442352 - RNA, 12 nt, Homo sapiens
ucuuuccaaucc

SEQ ID NO: 442353 - RNA, 18 nt, Homo sapiens
uguacaguauguucaaag

SEQ ID NO: 442354 - RNA, 19 nt, Homo sapiens
uguacauuccugauacugg

SEQ ID NO: 442355 - RNA, 22 nt, Homo sapiens
uguacauuccugauacugggua

SEQ ID NO: 442356 - RNA, 19 nt, Homo sapiens
uguaccagggcucuguauu

SEQ ID NO: 442357 - RNA, 13 nt, Homo sapiens
uguaccauguaca

SEQ ID NO: 442358 - RNA, 14 nt, Homo sapiens
uguacccugcugua

SEQ ID NO: 442359 - RNA, 14 nt, Homo sapiens
uguaccugccauaa

SEQ ID NO: 442360 - RNA, 16 nt, Homo sapiens
uguacuacaguauacu

SEQ ID NO: 442361 - RNA, 23 nt, Homo sapiens
uguacuggauuuaacuaccuuug

SEQ ID NO: 442362 - RNA, 15 nt, Homo sapiens
uguacugugcugauu

SEQ ID NO: 442363 - RNA, 15 nt, Homo sapiens
uguacuuaauccuuu

SEQ ID NO: 442364 - RNA, 15 nt, Homo sapiens
uguagaagauggacu

SEQ ID NO: 442365 - RNA, 17 nt, Homo sapiens
uguagacccuaacccgg

SEQ ID NO: 442366 - RNA, 12 nt, Homo sapiens
uguagauauugu

SEQ ID NO: 442367 - RNA, 20 nt, Homo sapiens
uguagaugggggaacuguga

SEQ ID NO: 442368 - RNA, 17 nt, Homo sapiens
uguagauguauuuucaa

SEQ ID NO: 442369 - RNA, 13 nt, Homo sapiens
uguagauugccuu

SEQ ID NO: 442370 - RNA, 15 nt, Homo sapiens
uguagcauuucuuga

SEQ ID NO: 442371 - RNA, 17 nt, Homo sapiens
uguagcuccucaacuca

SEQ ID NO: 442372 - RNA, 23 nt, Homo sapiens
uguaggauucucaccguggggcu

SEQ ID NO: 442373 - RNA, 16 nt, Homo sapiens
uguaguguuuugugga

SEQ ID NO: 442374 - RNA, 13 nt, Homo sapiens
uguauaacaagcc

SEQ ID NO: 442375 - RNA, 13 nt, Homo sapiens
uguauaacauuua

SEQ ID NO: 442376 - RNA, 19 nt, Homo sapiens
uguauaauaaacaaucuua

SEQ ID NO: 442377 - RNA, 12 nt, Homo sapiens
uguauagcauau

SEQ ID NO: 442378 - RNA, 17 nt, Homo sapiens
uguauauacauuucaua

SEQ ID NO: 442379 - RNA, 18 nt, Homo sapiens
uguauaucuuugcacuga

SEQ ID NO: 442380 - RNA, 17 nt, Homo sapiens
uguauauuuucucuaua

SEQ ID NO: 442381 - RNA, 16 nt, Homo sapiens
uguaucccuucucaca

SEQ ID NO: 442382 - RNA, 11 nt, Homo sapiens
uguauccucca

SEQ ID NO: 442383 - RNA, 18 nt, Homo sapiens
uguaucuuuaaagacuug

SEQ ID NO: 442384 - RNA, 16 nt, Homo sapiens
uguaugaaaauccuuu

SEQ ID NO: 442385 - RNA, 14 nt, Homo sapiens
uguaugauguguug

SEQ ID NO: 442386 - RNA, 18 nt, Homo sapiens
uguaugcacgugugcaca

SEQ ID NO: 442387 - RNA, 22 nt, Homo sapiens
uguaugcacgugugcacacaca

SEQ ID NO: 442388 - RNA, 13 nt, Homo sapiens
uguaugccuauuc

SEQ ID NO: 442389 - RNA, 15 nt, Homo sapiens
uguauggcacuggca

SEQ ID NO: 442390 - RNA, 15 nt, Homo sapiens
uguaugugaaagugu

SEQ ID NO: 442391 - RNA, 16 nt, Homo sapiens
uguaugugcgugugug

SEQ ID NO: 442392 - RNA, 20 nt, Homo sapiens
uguaugugcgugugugcaag

SEQ ID NO: 442393 - RNA, 22 nt, Homo sapiens
uguauguuuacauaucaccuca

SEQ ID NO: 442394 - RNA, 23 nt, Homo sapiens
uguauguuuacauaucaccucau

SEQ ID NO: 442395 - RNA, 17 nt, Homo sapiens
uguauuaauuauaccag

SEQ ID NO: 442396 - RNA, 14 nt, Homo sapiens
uguauuaccuauuc

SEQ ID NO: 442397 - RNA, 21 nt, Homo sapiens
uguauuagccagucauuguaa

SEQ ID NO: 442398 - RNA, 16 nt, Homo sapiens
uguauucggcaccuuc

SEQ ID NO: 442399 - RNA, 14 nt, Homo sapiens
uguauucgugcauu

SEQ ID NO: 442400 - RNA, 16 nt, Homo sapiens
uguauucugcaacagc

SEQ ID NO: 442401 - RNA, 16 nt, Homo sapiens
uguauuguucccagug

SEQ ID NO: 442402 - RNA, 15 nt, Homo sapiens
uguauuuaacugccu

SEQ ID NO: 442403 - RNA, 16 nt, Homo sapiens
uguauuuucugaucau

SEQ ID NO: 442404 - RNA, 15 nt, Homo sapiens
ugucaaaaaccagaa

SEQ ID NO: 442405 - RNA, 14 nt, Homo sapiens
ugucaaauaucuca

SEQ ID NO: 442406 - RNA, 22 nt, Homo sapiens
ugucaaugcuauggacugcaca

SEQ ID NO: 442407 - RNA, 12 nt, Homo sapiens
ugucacaaagau

SEQ ID NO: 442408 - RNA, 21 nt, Homo sapiens
ugucacaaauaaacauaauaa

SEQ ID NO: 442409 - RNA, 16 nt, Homo sapiens
ugucacaaauugauca

SEQ ID NO: 442410 - RNA, 13 nt, Homo sapiens
ugucacacucugu

SEQ ID NO: 442411 - RNA, 24 nt, Homo sapiens
ugucacuuuccucuuccacuuuga

SEQ ID NO: 442412 - RNA, 21 nt, Homo sapiens
ugucagagcugggaguagcau

SEQ ID NO: 442413 - RNA, 20 nt, Homo sapiens
ugucagcuacuaaugauguu

SEQ ID NO: 442414 - RNA, 18 nt, Homo sapiens
ugucagcuguagaaaggu

SEQ ID NO: 442415 - RNA, 15 nt, Homo sapiens
ugucaggcaguagca

SEQ ID NO: 442416 - RNA, 11 nt, Homo sapiens
ugucagucaug

SEQ ID NO: 442417 - RNA, 17 nt, Homo sapiens
ugucagucguguugcuu

SEQ ID NO: 442418 - RNA, 17 nt, Homo sapiens
ugucaguguagaucaac

SEQ ID NO: 442419 - RNA, 16 nt, Homo sapiens
ugucaguuucauggag

SEQ ID NO: 442420 - RNA, 20 nt, Homo sapiens
ugucauagaagaaaauccau

SEQ ID NO: 442421 - RNA, 14 nt, Homo sapiens
ugucauaugcugcu

SEQ ID NO: 442422 - RNA, 14 nt, Homo sapiens
uguccaaacuaauu

SEQ ID NO: 442423 - RNA, 17 nt, Homo sapiens
uguccaacaacuccagg

SEQ ID NO: 442424 - RNA, 15 nt, Homo sapiens
uguccaaguccaacc

SEQ ID NO: 442425 - RNA, 19 nt, Homo sapiens
uguccacaaauguccucag

SEQ ID NO: 442426 - RNA, 22 nt, Homo sapiens
uguccacauaauccacgcucau

SEQ ID NO: 442427 - RNA, 19 nt, Homo sapiens
uguccacauucuacuucag

SEQ ID NO: 442428 - RNA, 21 nt, Homo sapiens
uguccacccacuuaguccacu

SEQ ID NO: 442429 - RNA, 18 nt, Homo sapiens
uguccaccugugcugcug

SEQ ID NO: 442430 - RNA, 18 nt, Homo sapiens
uguccagugcaaccacac

SEQ ID NO: 442431 - RNA, 15 nt, Homo sapiens
uguccaugccuucca

SEQ ID NO: 442432 - RNA, 16 nt, Homo sapiens
uguccaugccuuccau

SEQ ID NO: 442433 - RNA, 16 nt, Homo sapiens
uguccauuuauaucau

SEQ ID NO: 442434 - RNA, 15 nt, Homo sapiens
ugucccauucuagau

SEQ ID NO: 442435 - RNA, 14 nt, Homo sapiens
ugucccccuaccca

SEQ ID NO: 442436 - RNA, 15 nt, Homo sapiens
ugucccccuacccac

SEQ ID NO: 442437 - RNA, 17 nt, Homo sapiens
uguccgcuauccaccaa

SEQ ID NO: 442438 - RNA, 15 nt, Homo sapiens
uguccuaagcacuuu

SEQ ID NO: 442439 - RNA, 20 nt, Homo sapiens
uguccuggcugugcacauuc

SEQ ID NO: 442440 - RNA, 22 nt, Homo sapiens
uguccuggcugugcacauucuc

SEQ ID NO: 442441 - RNA, 15 nt, Homo sapiens
uguccuggcuuuuau

SEQ ID NO: 442442 - RNA, 19 nt, Homo sapiens
ugucgccgucccucugccu

SEQ ID NO: 442443 - RNA, 19 nt, Homo sapiens
ugucuaaaaauaaaaugca

SEQ ID NO: 442444 - RNA, 16 nt, Homo sapiens
ugucuaaagagcuuua

SEQ ID NO: 442445 - RNA, 16 nt, Homo sapiens
ugucuacugcuuggau

SEQ ID NO: 442446 - RNA, 16 nt, Homo sapiens
ugucuaguagaacaau

SEQ ID NO: 442447 - RNA, 18 nt, Homo sapiens
ugucuaguuugcauacuu

SEQ ID NO: 442448 - RNA, 16 nt, Homo sapiens
ugucuccucugucagu

SEQ ID NO: 442449 - RNA, 15 nt, Homo sapiens
ugucuccuuccacaa

SEQ ID NO: 442450 - RNA, 21 nt, Homo sapiens
ugucucggagggauuccccua

SEQ ID NO: 442451 - RNA, 14 nt, Homo sapiens
ugucucugccaugu

SEQ ID NO: 442452 - RNA, 16 nt, Homo sapiens
ugucuggacauucaga

SEQ ID NO: 442453 - RNA, 10 nt, Homo sapiens
ugucugguaa

SEQ ID NO: 442454 - RNA, 14 nt, Homo sapiens
ugucugucccaaag

SEQ ID NO: 442455 - RNA, 15 nt, Homo sapiens
ugucugugaugucag

SEQ ID NO: 442456 - RNA, 18 nt, Homo sapiens
ugucuuaaggucauaaaa

SEQ ID NO: 442457 - RNA, 18 nt, Homo sapiens
ugucuucauagcagauuu

SEQ ID NO: 442458 - RNA, 10 nt, Homo sapiens
ugucuucccc

SEQ ID NO: 442459 - RNA, 19 nt, Homo sapiens
ugucuucguacaguucuuc

SEQ ID NO: 442460 - RNA, 23 nt, Homo sapiens
ugucuugucauuccaggugccag

SEQ ID NO: 442461 - RNA, 16 nt, Homo sapiens
ugucuuuaucaaagga

SEQ ID NO: 442462 - RNA, 13 nt, Homo sapiens
ugucuuuccuaga

SEQ ID NO: 442463 - RNA, 18 nt, Homo sapiens
ugucuuuucaaaaggauu

SEQ ID NO: 442464 - RNA, 14 nt, Homo sapiens
ugugaaaacagcag

SEQ ID NO: 442465 - RNA, 18 nt, Homo sapiens
ugugaaaagcuacccuga

SEQ ID NO: 442466 - RNA, 16 nt, Homo sapiens
ugugaaagcaccauca

SEQ ID NO: 442467 - RNA, 21 nt, Homo sapiens
ugugaaaugacugcaucaugc

SEQ ID NO: 442468 - RNA, 14 nt, Homo sapiens
ugugaaauuuacau

SEQ ID NO: 442469 - RNA, 16 nt, Homo sapiens
ugugaaauuuacauca

SEQ ID NO: 442470 - RNA, 17 nt, Homo sapiens
ugugaauauuagauugc

SEQ ID NO: 442471 - RNA, 14 nt, Homo sapiens
ugugacauucacuc

SEQ ID NO: 442472 - RNA, 13 nt, Homo sapiens
ugugaccuugacu

SEQ ID NO: 442473 - RNA, 13 nt, Homo sapiens
ugugacugaucuc

SEQ ID NO: 442474 - RNA, 17 nt, Homo sapiens
ugugagaauaaacuaga

SEQ ID NO: 442475 - RNA, 15 nt, Homo sapiens
ugugagagaaagugu

SEQ ID NO: 442476 - RNA, 13 nt, Homo sapiens
ugugagcaaaaau

SEQ ID NO: 442477 - RNA, 15 nt, Homo sapiens
ugugagguaacuggg

SEQ ID NO: 442478 - RNA, 19 nt, Homo sapiens
ugugaguaagagcuggugu

SEQ ID NO: 442479 - RNA, 17 nt, Homo sapiens
ugugaguguaaguguga

SEQ ID NO: 442480 - RNA, 19 nt, Homo sapiens
ugugagugugugcaaguau

SEQ ID NO: 442481 - RNA, 13 nt, Homo sapiens
ugugauauggagc

SEQ ID NO: 442482 - RNA, 14 nt, Homo sapiens
ugugaucugggaac

SEQ ID NO: 442483 - RNA, 20 nt, Homo sapiens
ugugaugccugacacagggg

SEQ ID NO: 442484 - RNA, 20 nt, Homo sapiens
ugugauguuaugaauacauu

SEQ ID NO: 442485 - RNA, 22 nt, Homo sapiens
ugugauuuuucugcacuaauau

SEQ ID NO: 442486 - RNA, 18 nt, Homo sapiens
ugugcacacacaccacac

SEQ ID NO: 442487 - RNA, 14 nt, Homo sapiens
ugugcacauucucc

SEQ ID NO: 442488 - RNA, 14 nt, Homo sapiens
ugugcacucauaug

SEQ ID NO: 442489 - RNA, 18 nt, Homo sapiens
ugugcacugucacuuugc

SEQ ID NO: 442490 - RNA, 13 nt, Homo sapiens
ugugcagauauca

SEQ ID NO: 442491 - RNA, 14 nt, Homo sapiens
ugugcagauaucac

SEQ ID NO: 442492 - RNA, 18 nt, Homo sapiens
ugugcagcucccauuugg

SEQ ID NO: 442493 - RNA, 16 nt, Homo sapiens
ugugcaucaaccagga

SEQ ID NO: 442494 - RNA, 12 nt, Homo sapiens
ugugcaugaccu

SEQ ID NO: 442495 - RNA, 19 nt, Homo sapiens
ugugcaugcaaccagauaa

SEQ ID NO: 442496 - RNA, 13 nt, Homo sapiens
ugugcauuggaua

SEQ ID NO: 442497 - RNA, 19 nt, Homo sapiens
ugugcauuucugugauguu

SEQ ID NO: 442498 - RNA, 13 nt, Homo sapiens
ugugccaccaccc

SEQ ID NO: 442499 - RNA, 20 nt, Homo sapiens
ugugccauggaugauucuuu

SEQ ID NO: 442500 - RNA, 13 nt, Homo sapiens
ugugcccagagau

SEQ ID NO: 442501 - RNA, 22 nt, Homo sapiens
ugugcccaucaucucugccuuu

SEQ ID NO: 442502 - RNA, 10 nt, Homo sapiens
ugugccuaac

SEQ ID NO: 442503 - RNA, 16 nt, Homo sapiens
ugugccuuacauuauu

SEQ ID NO: 442504 - RNA, 22 nt, Homo sapiens
ugugcgcugacaaccaccgcuc

SEQ ID NO: 442505 - RNA, 12 nt, Homo sapiens
ugugcuaccucu

SEQ ID NO: 442506 - RNA, 17 nt, Homo sapiens
ugugcucggacacaguu

SEQ ID NO: 442507 - RNA, 18 nt, Homo sapiens
ugugcugaucgccuuauu

SEQ ID NO: 442508 - RNA, 14 nt, Homo sapiens
uguggacacugugg

SEQ ID NO: 442509 - RNA, 16 nt, Homo sapiens
uguggacacuguggaa

SEQ ID NO: 442510 - RNA, 17 nt, Homo sapiens
uguggacacuguggaaa

SEQ ID NO: 442511 - RNA, 18 nt, Homo sapiens
uguggaggccugaugcug

SEQ ID NO: 442512 - RNA, 19 nt, Homo sapiens
uguggagugugugucuuuc

SEQ ID NO: 442513 - RNA, 19 nt, Homo sapiens
uguggauacagucauuauu

SEQ ID NO: 442514 - RNA, 21 nt, Homo sapiens
uguggauucuucccacacaga

SEQ ID NO: 442515 - RNA, 12 nt, Homo sapiens
uguggcacucca

SEQ ID NO: 442516 - RNA, 16 nt, Homo sapiens
uguggccugccuucac

SEQ ID NO: 442517 - RNA, 19 nt, Homo sapiens
uguggcuaucugcauuuau

SEQ ID NO: 442518 - RNA, 16 nt, Homo sapiens
uguggcucacgugugu

SEQ ID NO: 442519 - RNA, 21 nt, Homo sapiens
ugugguuugcuccagaauuaa

SEQ ID NO: 442520 - RNA, 21 nt, Homo sapiens
ugugguuuucuuuugccauga

SEQ ID NO: 442521 - RNA, 15 nt, Homo sapiens
uguguaaauuucuca

SEQ ID NO: 442522 - RNA, 15 nt, Homo sapiens
uguguaacugcccaa

SEQ ID NO: 442523 - RNA, 21 nt, Homo sapiens
uguguaacugcccaaagcagc

SEQ ID NO: 442524 - RNA, 20 nt, Homo sapiens
uguguacugaguauugauaa

SEQ ID NO: 442525 - RNA, 20 nt, Homo sapiens
uguguacuucuucauccaua

SEQ ID NO: 442526 - RNA, 21 nt, Homo sapiens
uguguagcucucacaugcaca

SEQ ID NO: 442527 - RNA, 16 nt, Homo sapiens
uguguauauaguauga

SEQ ID NO: 442528 - RNA, 19 nt, Homo sapiens
uguguaugcugaugaucaa

SEQ ID NO: 442529 - RNA, 16 nt, Homo sapiens
uguguaugucugguaa

SEQ ID NO: 442530 - RNA, 21 nt, Homo sapiens
uguguauucuguggauucuau

SEQ ID NO: 442531 - RNA, 16 nt, Homo sapiens
ugugucaucugucagc

SEQ ID NO: 442532 - RNA, 18 nt, Homo sapiens
uguguccuaugcgcucau

SEQ ID NO: 442533 - RNA, 12 nt, Homo sapiens
ugugucuacugu

SEQ ID NO: 442534 - RNA, 12 nt, Homo sapiens
ugugucugcaac

SEQ ID NO: 442535 - RNA, 13 nt, Homo sapiens
ugugucugcaaca

SEQ ID NO: 442536 - RNA, 18 nt, Homo sapiens
ugugucugucaccacauc

SEQ ID NO: 442537 - RNA, 15 nt, Homo sapiens
ugugugaagcaaauu

SEQ ID NO: 442538 - RNA, 17 nt, Homo sapiens
ugugugagaauaaacua

SEQ ID NO: 442539 - RNA, 18 nt, Homo sapiens
ugugugaggacuucugca

SEQ ID NO: 442540 - RNA, 21 nt, Homo sapiens
ugugugaggacuucugcaucu

SEQ ID NO: 442541 - RNA, 17 nt, Homo sapiens
ugugugagugugugcaa

SEQ ID NO: 442542 - RNA, 17 nt, Homo sapiens
ugugugcaagugugugc

SEQ ID NO: 442543 - RNA, 21 nt, Homo sapiens
ugugugggauaaugucauuaa

SEQ ID NO: 442544 - RNA, 19 nt, Homo sapiens
uguguggggcccaagcaug

SEQ ID NO: 442545 - RNA, 13 nt, Homo sapiens
ugugugucucuga

SEQ ID NO: 442546 - RNA, 15 nt, Homo sapiens
ugugugugcaauguu

SEQ ID NO: 442547 - RNA, 16 nt, Homo sapiens
ugugugugcguguguc

SEQ ID NO: 442548 - RNA, 13 nt, Homo sapiens
ugugugugugcaa

SEQ ID NO: 442549 - RNA, 14 nt, Homo sapiens
ugugugugugcaag

SEQ ID NO: 442550 - RNA, 18 nt, Homo sapiens
uguguuaguaaacugugc

SEQ ID NO: 442551 - RNA, 15 nt, Homo sapiens
uguguucaugcacac

SEQ ID NO: 442552 - RNA, 20 nt, Homo sapiens
uguguucaugcacacuugca

SEQ ID NO: 442553 - RNA, 13 nt, Homo sapiens
uguguugccaaag

SEQ ID NO: 442554 - RNA, 11 nt, Homo sapiens
uguguuuacuu

SEQ ID NO: 442555 - RNA, 18 nt, Homo sapiens
uguguuuauaauuguuau

SEQ ID NO: 442556 - RNA, 22 nt, Homo sapiens
uguguuuugaaugguguuguau

SEQ ID NO: 442557 - RNA, 16 nt, Homo sapiens
uguuaaacaugcuaaa

SEQ ID NO: 442558 - RNA, 21 nt, Homo sapiens
uguuaacauggacaugaucuu

SEQ ID NO: 442559 - RNA, 19 nt, Homo sapiens
uguuaacuguuaguauuaa

SEQ ID NO: 442560 - RNA, 15 nt, Homo sapiens
uguuaauugauuaaa

SEQ ID NO: 442561 - RNA, 20 nt, Homo sapiens
uguuaccuuaaaacuaggca

SEQ ID NO: 442562 - RNA, 13 nt, Homo sapiens
uguuaccuucaca

SEQ ID NO: 442563 - RNA, 20 nt, Homo sapiens
uguuacgcacacguacuuaa

SEQ ID NO: 442564 - RNA, 16 nt, Homo sapiens
uguuacugaucaugca

SEQ ID NO: 442565 - RNA, 18 nt, Homo sapiens
uguuagauguccucagaa

SEQ ID NO: 442566 - RNA, 14 nt, Homo sapiens
uguuagauuccucu

SEQ ID NO: 442567 - RNA, 12 nt, Homo sapiens
uguuagugauuu

SEQ ID NO: 442568 - RNA, 14 nt, Homo sapiens
uguuauaacuucau

SEQ ID NO: 442569 - RNA, 15 nt, Homo sapiens
uguuauaucagggaa

SEQ ID NO: 442570 - RNA, 19 nt, Homo sapiens
uguuauaucaucaauacuu

SEQ ID NO: 442571 - RNA, 14 nt, Homo sapiens
uguuaucagucaua

SEQ ID NO: 442572 - RNA, 16 nt, Homo sapiens
uguuauccaacuauua

SEQ ID NO: 442573 - RNA, 18 nt, Homo sapiens
uguuaucuaucaacuaua

SEQ ID NO: 442574 - RNA, 20 nt, Homo sapiens
uguuaugccaaacaguugua

SEQ ID NO: 442575 - RNA, 18 nt, Homo sapiens
uguuauggaaacuguugc

SEQ ID NO: 442576 - RNA, 22 nt, Homo sapiens
uguuauuaauccacaaauaugc

SEQ ID NO: 442577 - RNA, 16 nt, Homo sapiens
uguuauuuauaguguu

SEQ ID NO: 442578 - RNA, 16 nt, Homo sapiens
uguuauuuguacaguu

SEQ ID NO: 442579 - RNA, 20 nt, Homo sapiens
uguuauuuuauugccuuuag

SEQ ID NO: 442580 - RNA, 21 nt, Homo sapiens
uguucacacuguaaacauuca

SEQ ID NO: 442581 - RNA, 14 nt, Homo sapiens
uguucacacuuugc

SEQ ID NO: 442582 - RNA, 17 nt, Homo sapiens
uguucaugcacacuugc

SEQ ID NO: 442583 - RNA, 14 nt, Homo sapiens
uguucauuccgaaa

SEQ ID NO: 442584 - RNA, 16 nt, Homo sapiens
uguucauuccgaaaaa

SEQ ID NO: 442585 - RNA, 13 nt, Homo sapiens
uguucccaugaga

SEQ ID NO: 442586 - RNA, 22 nt, Homo sapiens
uguucccucucucccuccaggg

SEQ ID NO: 442587 - RNA, 23 nt, Homo sapiens
uguuccucuuacgcucugcucaa

SEQ ID NO: 442588 - RNA, 17 nt, Homo sapiens
uguucuaaugcugcaca

SEQ ID NO: 442589 - RNA, 13 nt, Homo sapiens
uguucuacacuca

SEQ ID NO: 442590 - RNA, 14 nt, Homo sapiens
uguucucuucuaua

SEQ ID NO: 442591 - RNA, 20 nt, Homo sapiens
uguucuggccucagaccaac

SEQ ID NO: 442592 - RNA, 18 nt, Homo sapiens
uguucuuccucuuaccug

SEQ ID NO: 442593 - RNA, 14 nt, Homo sapiens
uguugaauaaugcu

SEQ ID NO: 442594 - RNA, 21 nt, Homo sapiens
uguugacuuuuuaaaauauaa

SEQ ID NO: 442595 - RNA, 14 nt, Homo sapiens
uguugagacgccuu

SEQ ID NO: 442596 - RNA, 15 nt, Homo sapiens
uguugaguauuugcu

SEQ ID NO: 442597 - RNA, 17 nt, Homo sapiens
uguugaugaagcacauu

SEQ ID NO: 442598 - RNA, 21 nt, Homo sapiens
uguugcauuuacuuuuaauaa

SEQ ID NO: 442599 - RNA, 21 nt, Homo sapiens
uguugcccaggcuggucucaa

SEQ ID NO: 442600 - RNA, 17 nt, Homo sapiens
uguugccuucaucuuca

SEQ ID NO: 442601 - RNA, 14 nt, Homo sapiens
uguugcugcaucuc

SEQ ID NO: 442602 - RNA, 23 nt, Homo sapiens
uguugcugcaucuccccucagau

SEQ ID NO: 442603 - RNA, 16 nt, Homo sapiens
uguuggaaggggguca

SEQ ID NO: 442604 - RNA, 14 nt, Homo sapiens
uguuggagccugca

SEQ ID NO: 442605 - RNA, 17 nt, Homo sapiens
uguuggcaaaucagaug

SEQ ID NO: 442606 - RNA, 15 nt, Homo sapiens
uguuggcaguguuug

SEQ ID NO: 442607 - RNA, 15 nt, Homo sapiens
uguuggcccuuccag

SEQ ID NO: 442608 - RNA, 17 nt, Homo sapiens
uguugguauuauauaau

SEQ ID NO: 442609 - RNA, 19 nt, Homo sapiens
uguugguuacaugaaugaa

SEQ ID NO: 442610 - RNA, 20 nt, Homo sapiens
uguugguuaguagacacuaa

SEQ ID NO: 442611 - RNA, 22 nt, Homo sapiens
uguuguagcuaauuaggaagcu

SEQ ID NO: 442612 - RNA, 15 nt, Homo sapiens
uguugucauguguau

SEQ ID NO: 442613 - RNA, 19 nt, Homo sapiens
uguuguggucugagccaaa

SEQ ID NO: 442614 - RNA, 20 nt, Homo sapiens
uguuguguauagaugcaaga

SEQ ID NO: 442615 - RNA, 16 nt, Homo sapiens
uguuguguuugucaaa

SEQ ID NO: 442616 - RNA, 14 nt, Homo sapiens
uguuguuauggcaa

SEQ ID NO: 442617 - RNA, 17 nt, Homo sapiens
uguuuacagcacuacuc

SEQ ID NO: 442618 - RNA, 23 nt, Homo sapiens
uguuuacauaucaccucauggcc

SEQ ID NO: 442619 - RNA, 17 nt, Homo sapiens
uguuuacaugaguucaa

SEQ ID NO: 442620 - RNA, 12 nt, Homo sapiens
uguuuacuuaag

SEQ ID NO: 442621 - RNA, 12 nt, Homo sapiens
uguuuaguugca

SEQ ID NO: 442622 - RNA, 21 nt, Homo sapiens
uguuucagaaagagcucucca

SEQ ID NO: 442623 - RNA, 18 nt, Homo sapiens
uguuucagcugcaguuga

SEQ ID NO: 442624 - RNA, 15 nt, Homo sapiens
uguuucauuaaucaa

SEQ ID NO: 442625 - RNA, 14 nt, Homo sapiens
uguuuccacauuca

SEQ ID NO: 442626 - RNA, 16 nt, Homo sapiens
uguuuccacgggucuc

SEQ ID NO: 442627 - RNA, 23 nt, Homo sapiens
uguuuccaugggucaaagccggu

SEQ ID NO: 442628 - RNA, 19 nt, Homo sapiens
uguuucccuucccuuccac

SEQ ID NO: 442629 - RNA, 19 nt, Homo sapiens
uguuucugcagccacuauu

SEQ ID NO: 442630 - RNA, 20 nt, Homo sapiens
uguuucugcagccacuauug

SEQ ID NO: 442631 - RNA, 22 nt, Homo sapiens
uguuucuggaauugauauugaa

SEQ ID NO: 442632 - RNA, 13 nt, Homo sapiens
uguuucuuccaaa

SEQ ID NO: 442633 - RNA, 20 nt, Homo sapiens
uguuucuucuuugacuauaa

SEQ ID NO: 442634 - RNA, 16 nt, Homo sapiens
uguuucuuuugcuuag

SEQ ID NO: 442635 - RNA, 18 nt, Homo sapiens
uguuugcugcucuauauu

SEQ ID NO: 442636 - RNA, 23 nt, Homo sapiens
uguuuggcuuauaaacacauuga

SEQ ID NO: 442637 - RNA, 23 nt, Homo sapiens
uguuugguaguuagccaucuaau

SEQ ID NO: 442638 - RNA, 20 nt, Homo sapiens
uguuuguacacaacaccuaa

SEQ ID NO: 442639 - RNA, 19 nt, Homo sapiens
uguuugucaaaaagucauu

SEQ ID NO: 442640 - RNA, 23 nt, Homo sapiens
uguuugucauagggcaguuggaa

SEQ ID NO: 442641 - RNA, 14 nt, Homo sapiens
uguuuuaguucuug

SEQ ID NO: 442642 - RNA, 15 nt, Homo sapiens
uguuuuccugcuggu

SEQ ID NO: 442643 - RNA, 18 nt, Homo sapiens
uguuuucuacuuugccac

SEQ ID NO: 442644 - RNA, 20 nt, Homo sapiens
uguuuucuugccaaugaggu

SEQ ID NO: 442645 - RNA, 16 nt, Homo sapiens
uguuuugcaagggaau

SEQ ID NO: 442646 - RNA, 15 nt, Homo sapiens
uguuuugcuaaagga

SEQ ID NO: 442647 - RNA, 20 nt, Homo sapiens
uguuuuucuuuuuccacaag

SEQ ID NO: 442648 - RNA, 14 nt, Homo sapiens
uuaaaaaaguggug

SEQ ID NO: 442649 - RNA, 17 nt, Homo sapiens
uuaaaaagucuucacuc

SEQ ID NO: 442650 - RNA, 17 nt, Homo sapiens
uuaaaaauaaacucugc

SEQ ID NO: 442651 - RNA, 16 nt, Homo sapiens
uuaaaaaugcaugaua

SEQ ID NO: 442652 - RNA, 14 nt, Homo sapiens
uuaaaacacuuuca

SEQ ID NO: 442653 - RNA, 16 nt, Homo sapiens
uuaaaacuuacuaugg

SEQ ID NO: 442654 - RNA, 17 nt, Homo sapiens
uuaaaagaagacuggaa

SEQ ID NO: 442655 - RNA, 17 nt, Homo sapiens
uuaaaagacacacuugu

SEQ ID NO: 442656 - RNA, 13 nt, Homo sapiens
uuaaaagcuuuau

SEQ ID NO: 442657 - RNA, 16 nt, Homo sapiens
uuaaaaggagcacauu

SEQ ID NO: 442658 - RNA, 19 nt, Homo sapiens
uuaaaaguugugauuccag

SEQ ID NO: 442659 - RNA, 15 nt, Homo sapiens
uuaaaauaacuaagc

SEQ ID NO: 442660 - RNA, 16 nt, Homo sapiens
uuaaaaucauucaaua

SEQ ID NO: 442661 - RNA, 12 nt, Homo sapiens
uuaaaaugauug

SEQ ID NO: 442662 - RNA, 21 nt, Homo sapiens
uuaaaauggacuuuuguucau

SEQ ID NO: 442663 - RNA, 20 nt, Homo sapiens
uuaaaauucucagaggacuu

SEQ ID NO: 442664 - RNA, 13 nt, Homo sapiens
uuaaacagcagau

SEQ ID NO: 442665 - RNA, 13 nt, Homo sapiens
uuaaacagggcau

SEQ ID NO: 442666 - RNA, 13 nt, Homo sapiens
uuaaacagugcca

SEQ ID NO: 442667 - RNA, 16 nt, Homo sapiens
uuaaaccaagcagcuu

SEQ ID NO: 442668 - RNA, 22 nt, Homo sapiens
uuaaacgaggcaaugacuguga

SEQ ID NO: 442669 - RNA, 22 nt, Homo sapiens
uuaaacuacucuugaauuccug

SEQ ID NO: 442670 - RNA, 18 nt, Homo sapiens
uuaaacuuaccugggcau

SEQ ID NO: 442671 - RNA, 17 nt, Homo sapiens
uuaaacuucaccuacaa

SEQ ID NO: 442672 - RNA, 14 nt, Homo sapiens
uuaaacuuugucac

SEQ ID NO: 442673 - RNA, 13 nt, Homo sapiens
uuaaagagacaaa

SEQ ID NO: 442674 - RNA, 17 nt, Homo sapiens
uuaaagcuuggugcuaa

SEQ ID NO: 442675 - RNA, 18 nt, Homo sapiens
uuaaaggacaaacaguga

SEQ ID NO: 442676 - RNA, 22 nt, Homo sapiens
uuaaaggcugugguaguacucc

SEQ ID NO: 442677 - RNA, 20 nt, Homo sapiens
uuaaaguuacugaucacagg

SEQ ID NO: 442678 - RNA, 17 nt, Homo sapiens
uuaaauaaaaaaguuua

SEQ ID NO: 442679 - RNA, 17 nt, Homo sapiens
uuaaauaaaugugagaa

SEQ ID NO: 442680 - RNA, 22 nt, Homo sapiens
uuaaauaauuuuacaugucuca

SEQ ID NO: 442681 - RNA, 18 nt, Homo sapiens
uuaaauauuuauaucuca

SEQ ID NO: 442682 - RNA, 19 nt, Homo sapiens
uuaaauauuuauaucucac

SEQ ID NO: 442683 - RNA, 12 nt, Homo sapiens
uuaaaucuguga

SEQ ID NO: 442684 - RNA, 15 nt, Homo sapiens
uuaaaucuugcaacu

SEQ ID NO: 442685 - RNA, 18 nt, Homo sapiens
uuaaauggcauaccaaaa

SEQ ID NO: 442686 - RNA, 14 nt, Homo sapiens
uuaaauuucuggau

SEQ ID NO: 442687 - RNA, 15 nt, Homo sapiens
uuaacaacaauaaca

SEQ ID NO: 442688 - RNA, 16 nt, Homo sapiens
uuaacaacccuguuga

SEQ ID NO: 442689 - RNA, 14 nt, Homo sapiens
uuaacaauugccag

SEQ ID NO: 442690 - RNA, 14 nt, Homo sapiens
uuaacagcuuucuc

SEQ ID NO: 442691 - RNA, 21 nt, Homo sapiens
uuaacauaaaauaaacugaac

SEQ ID NO: 442692 - RNA, 15 nt, Homo sapiens
uuaaccugcaugcag

SEQ ID NO: 442693 - RNA, 14 nt, Homo sapiens
uuaacucagaucac

SEQ ID NO: 442694 - RNA, 21 nt, Homo sapiens
uuaacucagaucacuacugca

SEQ ID NO: 442695 - RNA, 20 nt, Homo sapiens
uuaacuccguuuccaaauac

SEQ ID NO: 442696 - RNA, 21 nt, Homo sapiens
uuaacugccuuacagacagaa

SEQ ID NO: 442697 - RNA, 13 nt, Homo sapiens
uuaagaaaauaca

SEQ ID NO: 442698 - RNA, 21 nt, Homo sapiens
uuaagaacugcccagccucag

SEQ ID NO: 442699 - RNA, 17 nt, Homo sapiens
uuaagaaugacaggcuu

SEQ ID NO: 442700 - RNA, 22 nt, Homo sapiens
uuaagaaugucgauuaaaauca

SEQ ID NO: 442701 - RNA, 19 nt, Homo sapiens
uuaagacaacaggcauuuu

SEQ ID NO: 442702 - RNA, 14 nt, Homo sapiens
uuaagagaaaugag

SEQ ID NO: 442703 - RNA, 17 nt, Homo sapiens
uuaagagaaaugagcug

SEQ ID NO: 442704 - RNA, 19 nt, Homo sapiens
uuaagagagugaacauauc

SEQ ID NO: 442705 - RNA, 20 nt, Homo sapiens
uuaagagagugaacauaucc

SEQ ID NO: 442706 - RNA, 12 nt, Homo sapiens
uuaagauugcaa

SEQ ID NO: 442707 - RNA, 14 nt, Homo sapiens
uuaagcacuacaua

SEQ ID NO: 442708 - RNA, 16 nt, Homo sapiens
uuaagccauaugacaa

SEQ ID NO: 442709 - RNA, 13 nt, Homo sapiens
uuaagguacuuaa

SEQ ID NO: 442710 - RNA, 20 nt, Homo sapiens
uuaaguacugaaauacauau

SEQ ID NO: 442711 - RNA, 23 nt, Homo sapiens
uuaaguaucuuuuuucaaaaaca

SEQ ID NO: 442712 - RNA, 16 nt, Homo sapiens
uuaagucaccuguaua

SEQ ID NO: 442713 - RNA, 21 nt, Homo sapiens
uuaauaaaacugcacagugcu

SEQ ID NO: 442714 - RNA, 21 nt, Homo sapiens
uuaauaaaacuuuauguacug

SEQ ID NO: 442715 - RNA, 13 nt, Homo sapiens
uuaauaaacucac

SEQ ID NO: 442716 - RNA, 17 nt, Homo sapiens
uuaauaaacucacaacu

SEQ ID NO: 442717 - RNA, 16 nt, Homo sapiens
uuaauaaagacagggu

SEQ ID NO: 442718 - RNA, 15 nt, Homo sapiens
uuaauacucaccucc

SEQ ID NO: 442719 - RNA, 15 nt, Homo sapiens
uuaauaguacuauua

SEQ ID NO: 442720 - RNA, 17 nt, Homo sapiens
uuaauagucauuccaaa

SEQ ID NO: 442721 - RNA, 13 nt, Homo sapiens
uuaauaugaucug

SEQ ID NO: 442722 - RNA, 23 nt, Homo sapiens
uuaauaugcuguggggcauagaa

SEQ ID NO: 442723 - RNA, 15 nt, Homo sapiens
uuaauaugguuguac

SEQ ID NO: 442724 - RNA, 23 nt, Homo sapiens
uuaauauguuaaccucaguguca

SEQ ID NO: 442725 - RNA, 13 nt, Homo sapiens
uuaaucaguguga

SEQ ID NO: 442726 - RNA, 15 nt, Homo sapiens
uuaaucccacuugcc

SEQ ID NO: 442727 - RNA, 14 nt, Homo sapiens
uuaauccuucuaac

SEQ ID NO: 442728 - RNA, 22 nt, Homo sapiens
uuaaucucuaaaauucuagucu

SEQ ID NO: 442729 - RNA, 18 nt, Homo sapiens
uuaaucuucucucuugau

SEQ ID NO: 442730 - RNA, 13 nt, Homo sapiens
uuaauguacaagu

SEQ ID NO: 442731 - RNA, 19 nt, Homo sapiens
uuaauguguuaagugcagg

SEQ ID NO: 442732 - RNA, 16 nt, Homo sapiens
uuaauuaugcuaacaa

SEQ ID NO: 442733 - RNA, 19 nt, Homo sapiens
uuaauuccaauaugaugac

SEQ ID NO: 442734 - RNA, 21 nt, Homo sapiens
uuaauugguuugugccuuaca

SEQ ID NO: 442735 - RNA, 15 nt, Homo sapiens
uuaauuuugauucag

SEQ ID NO: 442736 - RNA, 19 nt, Homo sapiens
uuaauuuuuguacuuugcu

SEQ ID NO: 442737 - RNA, 16 nt, Homo sapiens
uuacaaaaacaagaca

SEQ ID NO: 442738 - RNA, 23 nt, Homo sapiens
uuacaaaacaugauuguuuacag

SEQ ID NO: 442739 - RNA, 12 nt, Homo sapiens
uuacaaacugca

SEQ ID NO: 442740 - RNA, 15 nt, Homo sapiens
uuacaaacugcaaua

SEQ ID NO: 442741 - RNA, 13 nt, Homo sapiens
uuacaaauucaag

SEQ ID NO: 442742 - RNA, 21 nt, Homo sapiens
uuacaagacggggagugagac

SEQ ID NO: 442743 - RNA, 14 nt, Homo sapiens
uuacaaggugacaa

SEQ ID NO: 442744 - RNA, 18 nt, Homo sapiens
uuacaaguuucaguaaua

SEQ ID NO: 442745 - RNA, 16 nt, Homo sapiens
uuacaaugugcacuga

SEQ ID NO: 442746 - RNA, 19 nt, Homo sapiens
uuacaauuguaaaacugag

SEQ ID NO: 442747 - RNA, 15 nt, Homo sapiens
uuacacacgugugau

SEQ ID NO: 442748 - RNA, 13 nt, Homo sapiens
uuacacaucucag

SEQ ID NO: 442749 - RNA, 18 nt, Homo sapiens
uuacacccuuucuugaca

SEQ ID NO: 442750 - RNA, 20 nt, Homo sapiens
uuacacccuuucuugacaaa

SEQ ID NO: 442751 - RNA, 17 nt, Homo sapiens
uuacacucuagugccau

SEQ ID NO: 442752 - RNA, 20 nt, Homo sapiens
uuacacucuagugccauaua

SEQ ID NO: 442753 - RNA, 21 nt, Homo sapiens
uuacacuugggauugucuuac

SEQ ID NO: 442754 - RNA, 22 nt, Homo sapiens
uuacagacaugaaccaccacgc

SEQ ID NO: 442755 - RNA, 20 nt, Homo sapiens
uuacagagaggagaaacaca

SEQ ID NO: 442756 - RNA, 19 nt, Homo sapiens
uuacaggaagccucucaua

SEQ ID NO: 442757 - RNA, 20 nt, Homo sapiens
uuacaggaagucccuugcca

SEQ ID NO: 442758 - RNA, 14 nt, Homo sapiens
uuacaggaucaugu

SEQ ID NO: 442759 - RNA, 17 nt, Homo sapiens
uuacaggcgugauccac

SEQ ID NO: 442760 - RNA, 20 nt, Homo sapiens
uuacaugaguucaaauacuu

SEQ ID NO: 442761 - RNA, 13 nt, Homo sapiens
uuaccaaaacaua

SEQ ID NO: 442762 - RNA, 19 nt, Homo sapiens
uuaccaaagaagaguuuac

SEQ ID NO: 442763 - RNA, 22 nt, Homo sapiens
uuaccagaugcugacuggcacu

SEQ ID NO: 442764 - RNA, 19 nt, Homo sapiens
uuacccaggcuggagugca

SEQ ID NO: 442765 - RNA, 17 nt, Homo sapiens
uuaccgaguaucuguaa

SEQ ID NO: 442766 - RNA, 23 nt, Homo sapiens
uuaccguucacuuccccuuccaa

SEQ ID NO: 442767 - RNA, 21 nt, Homo sapiens
uuaccuagauuuacagccuca

SEQ ID NO: 442768 - RNA, 18 nt, Homo sapiens
uuaccucacuggugcauu

SEQ ID NO: 442769 - RNA, 14 nt, Homo sapiens
uuaccucauuugca

SEQ ID NO: 442770 - RNA, 15 nt, Homo sapiens
uuaccucauuugcau

SEQ ID NO: 442771 - RNA, 14 nt, Homo sapiens
uuaccuccuaucag

SEQ ID NO: 442772 - RNA, 12 nt, Homo sapiens
uuaccucugaua

SEQ ID NO: 442773 - RNA, 20 nt, Homo sapiens
uuaccuguacacugacuuga

SEQ ID NO: 442774 - RNA, 13 nt, Homo sapiens
uuaccuguucaaa

SEQ ID NO: 442775 - RNA, 23 nt, Homo sapiens
uuaccuuaaaacuaggcauuugu

SEQ ID NO: 442776 - RNA, 17 nt, Homo sapiens
uuacggucaugaugucu

SEQ ID NO: 442777 - RNA, 21 nt, Homo sapiens
uuacuaagaugaaauugccaa

SEQ ID NO: 442778 - RNA, 11 nt, Homo sapiens
uuacuacuauu

SEQ ID NO: 442779 - RNA, 19 nt, Homo sapiens
uuacuauauucuuacccua

SEQ ID NO: 442780 - RNA, 16 nt, Homo sapiens
uuacuaucauggcaua

SEQ ID NO: 442781 - RNA, 22 nt, Homo sapiens
uuacucauaaggcauauacaaa

SEQ ID NO: 442782 - RNA, 19 nt, Homo sapiens
uuacuccaccaucaccucu

SEQ ID NO: 442783 - RNA, 19 nt, Homo sapiens
uuacuccuuuggcuucaaa

SEQ ID NO: 442784 - RNA, 14 nt, Homo sapiens
uuacugaaagggag

SEQ ID NO: 442785 - RNA, 15 nt, Homo sapiens
uuacugaauuugcua

SEQ ID NO: 442786 - RNA, 15 nt, Homo sapiens
cugaguauugauaaa

SEQ ID NO: 442787 - RNA, 19 nt, Homo sapiens
cugagucaucaaaaagagu

SEQ ID NO: 442788 - RNA, 22 nt, Homo sapiens
cugagucugugaauaaagccac

SEQ ID NO: 442789 - RNA, 14 nt, Homo sapiens
cugagugaaugagu

SEQ ID NO: 442790 - RNA, 15 nt, Homo sapiens
cugagugcaccacuu

SEQ ID NO: 442791 - RNA, 19 nt, Homo sapiens
cugaguuauuuugcuaaac

SEQ ID NO: 442792 - RNA, 18 nt, Homo sapiens
cugaguucuggucaaaga

SEQ ID NO: 442793 - RNA, 22 nt, Homo sapiens
cugaguuucuuggcugcaugaa

SEQ ID NO: 442794 - RNA, 11 nt, Homo sapiens
cugaguuugcu

SEQ ID NO: 442795 - RNA, 22 nt, Homo sapiens
cugauaauauguuugagguuaa

SEQ ID NO: 442796 - RNA, 22 nt, Homo sapiens
cugauagauauccuuggcacau

SEQ ID NO: 442797 - RNA, 21 nt, Homo sapiens
cugaucagucuaagaugggug

SEQ ID NO: 442798 - RNA, 14 nt, Homo sapiens
auccuaccaaccuc

SEQ ID NO: 442799 - RNA, 16 nt, Homo sapiens
auccucccuacuucca

SEQ ID NO: 442800 - RNA, 14 nt, Homo sapiens
aaaacugucccuuu

SEQ ID NO: 442801 - RNA, 22 nt, Homo sapiens
aaaacuugauguguuaucucuu

SEQ ID NO: 442802 - RNA, 18 nt, Homo sapiens
aaaacuuuaaucccacuu

SEQ ID NO: 442803 - RNA, 22 nt, Homo sapiens
aaaagaaauucccuggaccaga

SEQ ID NO: 442804 - RNA, 23 nt, Homo sapiens
aaaagaaucccuguucauuguaa

SEQ ID NO: 442805 - RNA, 20 nt, Homo sapiens
aaaagacauuuuuauuuagu

SEQ ID NO: 442806 - RNA, 20 nt, Homo sapiens
aaaagacugaaucuaccugc

SEQ ID NO: 442807 - RNA, 23 nt, Homo sapiens
aaaagaguaguuauuaguucugc

SEQ ID NO: 442808 - RNA, 22 nt, Homo sapiens
aaaagcaagacuguugcucaaa

SEQ ID NO: 442809 - RNA, 16 nt, Homo sapiens
aaaagcacagcucuca

SEQ ID NO: 442810 - RNA, 19 nt, Homo sapiens
aaaagcaucuaugugagac

SEQ ID NO: 442811 - RNA, 23 nt, Homo sapiens
aaaagcauuauccuuuuaucuca

SEQ ID NO: 442812 - RNA, 13 nt, Homo sapiens
aaaagcauucugu

SEQ ID NO: 442813 - RNA, 20 nt, Homo sapiens
aaaagcuuauucaucuguuu

SEQ ID NO: 442814 - RNA, 16 nt, Homo sapiens
aaaagcuucauucuca

SEQ ID NO: 442815 - RNA, 21 nt, Homo sapiens
aaaaggacucugcuucagucc

SEQ ID NO: 442816 - RNA, 20 nt, Homo sapiens
aaaaggaguagggaguucau

SEQ ID NO: 442817 - RNA, 14 nt, Homo sapiens
aaaagggagaacau

SEQ ID NO: 442818 - RNA, 12 nt, Homo sapiens
aaaaggugauua

SEQ ID NO: 442819 - RNA, 22 nt, Homo sapiens
aaaagguuaaacccacagccaa

SEQ ID NO: 442820 - RNA, 17 nt, Homo sapiens
aaaaguaaaacagauuu

SEQ ID NO: 442821 - RNA, 15 nt, Homo sapiens
aaaaguaaacaacau

SEQ ID NO: 442822 - RNA, 17 nt, Homo sapiens
aaaaguaaggugcaguu

SEQ ID NO: 442823 - RNA, 18 nt, Homo sapiens
aaaaguauccugcuucug

SEQ ID NO: 442824 - RNA, 22 nt, Homo sapiens
aaaagucaaacuuucaccucag

SEQ ID NO: 442825 - RNA, 20 nt, Homo sapiens
aaaagucugcauuacauucc

SEQ ID NO: 442826 - RNA, 13 nt, Homo sapiens
aaaagucuucacu

SEQ ID NO: 442827 - RNA, 10 nt, Homo sapiens
aaaagugaug

SEQ ID NO: 442828 - RNA, 18 nt, Homo sapiens
aaaaguggauggaagugu

SEQ ID NO: 442829 - RNA, 13 nt, Homo sapiens
aaaagugggccag

SEQ ID NO: 442830 - RNA, 11 nt, Homo sapiens
aaaaguuauua

SEQ ID NO: 442831 - RNA, 17 nt, Homo sapiens
aaaauaaauauacuaau

SEQ ID NO: 442832 - RNA, 22 nt, Homo sapiens
aaaauaagcuauauuauacaaa

SEQ ID NO: 442833 - RNA, 18 nt, Homo sapiens
aaaauacaguauucugua

SEQ ID NO: 442834 - RNA, 12 nt, Homo sapiens
aaaauacaugau

SEQ ID NO: 442835 - RNA, 17 nt, Homo sapiens
aaaauacaugcaucuca

SEQ ID NO: 442836 - RNA, 16 nt, Homo sapiens
aaaauagaaacuugcu

SEQ ID NO: 442837 - RNA, 14 nt, Homo sapiens
aaaauagcuauaaa

SEQ ID NO: 442838 - RNA, 20 nt, Homo sapiens
aaaauagcuuugcagugaaa

SEQ ID NO: 442839 - RNA, 13 nt, Homo sapiens
aaaauaguaaugu

SEQ ID NO: 442840 - RNA, 12 nt, Homo sapiens
aaaauaguagca

SEQ ID NO: 442841 - RNA, 21 nt, Homo sapiens
aaaauaguuuuacauuaacau

SEQ ID NO: 442842 - RNA, 15 nt, Homo sapiens
aaaauauacauucaa

SEQ ID NO: 442843 - RNA, 16 nt, Homo sapiens
aaaauaucacuuugua

SEQ ID NO: 442844 - RNA, 19 nt, Homo sapiens
aaaaucacucucagugcuu

SEQ ID NO: 442845 - RNA, 19 nt, Homo sapiens
aaaaucaguguuuaaauaa

SEQ ID NO: 442846 - RNA, 14 nt, Homo sapiens
aaaaucuguucuaa

SEQ ID NO: 442847 - RNA, 15 nt, Homo sapiens
aaaaucuucagcugg

SEQ ID NO: 442848 - RNA, 16 nt, Homo sapiens
aaaaucuucagcuggu

SEQ ID NO: 442849 - RNA, 22 nt, Homo sapiens
aaaaucuucagcugguggaugg

SEQ ID NO: 442850 - RNA, 17 nt, Homo sapiens
aaaaucuugugcuagaa

SEQ ID NO: 442851 - RNA, 18 nt, Homo sapiens
aaaaucuuuccaucucau

SEQ ID NO: 442852 - RNA, 22 nt, Homo sapiens
aaaaugaaaauuaggauuucau

SEQ ID NO: 442853 - RNA, 13 nt, Homo sapiens
aaaaugaacugaa

SEQ ID NO: 442854 - RNA, 12 nt, Homo sapiens
aaaaugagacaa

SEQ ID NO: 442855 - RNA, 21 nt, Homo sapiens
aaaaugauuuuaucugugaau

SEQ ID NO: 442856 - RNA, 14 nt, Homo sapiens
aaaaugcaugauaa

SEQ ID NO: 442857 - RNA, 14 nt, Homo sapiens
aaaauggacauauu

SEQ ID NO: 442858 - RNA, 13 nt, Homo sapiens
aaaauguacucag

SEQ ID NO: 442859 - RNA, 17 nt, Homo sapiens
aaaaugugucuguaaga

SEQ ID NO: 442860 - RNA, 13 nt, Homo sapiens
aaaauguuaacaa

SEQ ID NO: 442861 - RNA, 12 nt, Homo sapiens
aaaauguucauu

SEQ ID NO: 442862 - RNA, 14 nt, Homo sapiens
aaaauguucauucu

SEQ ID NO: 442863 - RNA, 14 nt, Homo sapiens
aaaauguuguccuu

SEQ ID NO: 442864 - RNA, 18 nt, Homo sapiens
aaaauuaaggucugggag

SEQ ID NO: 442865 - RNA, 16 nt, Homo sapiens
aaaauuacaacagaua

SEQ ID NO: 442866 - RNA, 19 nt, Homo sapiens
aaaauucucagaggacuug

SEQ ID NO: 442867 - RNA, 18 nt, Homo sapiens
aaaauuugaaauuuagcu

SEQ ID NO: 442868 - RNA, 15 nt, Homo sapiens
aaaauuuuacuucca

SEQ ID NO: 442869 - RNA, 16 nt, Homo sapiens
aaacaaaaaggaaaug

SEQ ID NO: 442870 - RNA, 11 nt, Homo sapiens
aaacaaaaaua

SEQ ID NO: 442871 - RNA, 22 nt, Homo sapiens
aaacaaacauacccaucugcac

SEQ ID NO: 442872 - RNA, 20 nt, Homo sapiens
aaacaaagccuuauccagca

SEQ ID NO: 442873 - RNA, 21 nt, Homo sapiens
aaacaaauaaucacauugacu

SEQ ID NO: 442874 - RNA, 13 nt, Homo sapiens
aaacaaauaugca

SEQ ID NO: 442875 - RNA, 18 nt, Homo sapiens
aaacaaauauuucacuua

SEQ ID NO: 442876 - RNA, 21 nt, Homo sapiens
aaacaaccauuuuuuguucug

SEQ ID NO: 442877 - RNA, 20 nt, Homo sapiens
aaacaagaaaccaagugggc

SEQ ID NO: 442878 - RNA, 12 nt, Homo sapiens
aaacaaucuuag

SEQ ID NO: 442879 - RNA, 19 nt, Homo sapiens
aaacaaucuuagacauuua

SEQ ID NO: 442880 - RNA, 22 nt, Homo sapiens
aaacacaauccuuuguucuccc

SEQ ID NO: 442881 - RNA, 17 nt, Homo sapiens
aaacaccgcuucugccu

SEQ ID NO: 442882 - RNA, 13 nt, Homo sapiens
aaacacuaccucu

SEQ ID NO: 442883 - RNA, 16 nt, Homo sapiens
aaacacuuauuuuaca

SEQ ID NO: 442884 - RNA, 22 nt, Homo sapiens
aaacacuuauuuuacacagcaa

SEQ ID NO: 442885 - RNA, 17 nt, Homo sapiens
aaacagaacugcaguca

SEQ ID NO: 442886 - RNA, 13 nt, Homo sapiens
aaacagaauauuc

SEQ ID NO: 442887 - RNA, 15 nt, Homo sapiens
aaacagacuauuuaa

SEQ ID NO: 442888 - RNA, 19 nt, Homo sapiens
aaacagauguuuguuuuca

SEQ ID NO: 442889 - RNA, 21 nt, Homo sapiens
aaacagcagauuucagaucau

SEQ ID NO: 442890 - RNA, 12 nt, Homo sapiens
aaacagcagcug

SEQ ID NO: 442891 - RNA, 14 nt, Homo sapiens
aaacagcuugaugc

SEQ ID NO: 442892 - RNA, 15 nt, Homo sapiens
aaacaggugcuaaca

SEQ ID NO: 442893 - RNA, 14 nt, Homo sapiens
aaacauacccagug

SEQ ID NO: 442894 - RNA, 14 nt, Homo sapiens
aaacauaucuugag

SEQ ID NO: 442895 - RNA, 15 nt, Homo sapiens
aaacaucauuggaua

SEQ ID NO: 442896 - RNA, 17 nt, Homo sapiens
aaacaugaaaacauuga

SEQ ID NO: 442897 - RNA, 17 nt, Homo sapiens
aaacaugcuaaauaguu

SEQ ID NO: 442898 - RNA, 19 nt, Homo sapiens
aaacaugcuaaauaguucu

SEQ ID NO: 442899 - RNA, 23 nt, Homo sapiens
aaacaugggguuggcugggccca

SEQ ID NO: 442900 - RNA, 18 nt, Homo sapiens
aaacaugugcaacucuug

SEQ ID NO: 442901 - RNA, 21 nt, Homo sapiens
aaacauuaaaagaagacugga

SEQ ID NO: 442902 - RNA, 19 nt, Homo sapiens
aaacauucacacagggcuc

SEQ ID NO: 442903 - RNA, 19 nt, Homo sapiens
aaaccacuugucacuacaa

SEQ ID NO: 442904 - RNA, 14 nt, Homo sapiens
aaaccacuuuccuu

SEQ ID NO: 442905 - RNA, 14 nt, Homo sapiens
aaaccagacucacu

SEQ ID NO: 442906 - RNA, 24 nt, Homo sapiens
aaaccaggguagaauuguuuggca

SEQ ID NO: 442907 - RNA, 18 nt, Homo sapiens
aaaccaucaaaaauauuc

SEQ ID NO: 442908 - RNA, 20 nt, Homo sapiens
aaaccaucaaaaauauucca

SEQ ID NO: 442909 - RNA, 23 nt, Homo sapiens
aaaccauuauaaaaucuuuccau

SEQ ID NO: 442910 - RNA, 16 nt, Homo sapiens
aaacccaacuccucuc

SEQ ID NO: 442911 - RNA, 16 nt, Homo sapiens
aaacccagccucuaga

SEQ ID NO: 442912 - RNA, 22 nt, Homo sapiens
aaaccccuuuucaguuugaacu

SEQ ID NO: 442913 - RNA, 21 nt, Homo sapiens
aaacccuuccacguguaugca

SEQ ID NO: 442914 - RNA, 15 nt, Homo sapiens
aaaccgaauuuucac

SEQ ID NO: 442915 - RNA, 18 nt, Homo sapiens
aaaccuagcaucuuacaa

SEQ ID NO: 442916 - RNA, 13 nt, Homo sapiens
aaaccugaccaca

SEQ ID NO: 442917 - RNA, 15 nt, Homo sapiens
aaaccuggaugucac

SEQ ID NO: 442918 - RNA, 13 nt, Homo sapiens
aaaccugugccag

SEQ ID NO: 442919 - RNA, 14 nt, Homo sapiens
aaaccuuacuuaaa

SEQ ID NO: 442920 - RNA, 14 nt, Homo sapiens
aaaccuucucagga

SEQ ID NO: 442921 - RNA, 19 nt, Homo sapiens
aaaccuugugacucagugu

SEQ ID NO: 442922 - RNA, 20 nt, Homo sapiens
aaacggaacucuucaucuua

SEQ ID NO: 442923 - RNA, 15 nt, Homo sapiens
aaacguccacagagu

SEQ ID NO: 442924 - RNA, 20 nt, Homo sapiens
aaacgugcccucuguuugau

SEQ ID NO: 442925 - RNA, 17 nt, Homo sapiens
aaacuaaaucucuaaua

SEQ ID NO: 442926 - RNA, 16 nt, Homo sapiens
aaacuaacacccaguc

SEQ ID NO: 442927 - RNA, 13 nt, Homo sapiens
aaacuaggcauuu

SEQ ID NO: 442928 - RNA, 20 nt, Homo sapiens
aaacuauuuaaaauuggcac

SEQ ID NO: 442929 - RNA, 13 nt, Homo sapiens
aaacucacaacuc

SEQ ID NO: 442930 - RNA, 16 nt, Homo sapiens
aaacucacaacucucu

SEQ ID NO: 442931 - RNA, 19 nt, Homo sapiens
aaacucacaacucucuggu

SEQ ID NO: 442932 - RNA, 15 nt, Homo sapiens
aaacucacugcucaa

SEQ ID NO: 442933 - RNA, 19 nt, Homo sapiens
aaaaaagaacaacugccaa

SEQ ID NO: 442934 - RNA, 12 nt, Homo sapiens
aaaaaaugcaca

SEQ ID NO: 442935 - RNA, 22 nt, Homo sapiens
aaaaaauguucauucuaugaca

SEQ ID NO: 442936 - RNA, 15 nt, Homo sapiens
aaaaacaagacugcc

SEQ ID NO: 442937 - RNA, 22 nt, Homo sapiens
aaaaacauggccuuugcuugaa

SEQ ID NO: 442938 - RNA, 11 nt, Homo sapiens
aaaaaccaaug

SEQ ID NO: 442939 - RNA, 15 nt, Homo sapiens
aaaaacccugcuaaa

SEQ ID NO: 442940 - RNA, 14 nt, Homo sapiens
aaaaacuauaugua

SEQ ID NO: 442941 - RNA, 11 nt, Homo sapiens
aaaaacuucca

SEQ ID NO: 442942 - RNA, 13 nt, Homo sapiens
aaaaagaacugua

SEQ ID NO: 442943 - RNA, 18 nt, Homo sapiens
aaaaagacauucuuccaa

SEQ ID NO: 442944 - RNA, 21 nt, Homo sapiens
aaaaaggaaaacucaccauuu

SEQ ID NO: 442945 - RNA, 23 nt, Homo sapiens
aaaaaggccuuugggauuugccg

SEQ ID NO: 442946 - RNA, 14 nt, Homo sapiens
aaaaauaacaucug

SEQ ID NO: 442947 - RNA, 16 nt, Homo sapiens
aaaaauagcaaugccu

SEQ ID NO: 442948 - RNA, 15 nt, Homo sapiens
aaaaauauguagcaa

SEQ ID NO: 442949 - RNA, 17 nt, Homo sapiens
aaaaaucauaguacucu

SEQ ID NO: 442950 - RNA, 13 nt, Homo sapiens
aaaaaugagcucg

SEQ ID NO: 442951 - RNA, 16 nt, Homo sapiens
aaaaaugcaugauaau

SEQ ID NO: 442952 - RNA, 16 nt, Homo sapiens
aaaaauucugaaugua

SEQ ID NO: 442953 - RNA, 21 nt, Homo sapiens
aaaacaaagccuuauccagca

SEQ ID NO: 442954 - RNA, 19 nt, Homo sapiens
aaaacaagaaaccaagugg

SEQ ID NO: 442955 - RNA, 15 nt, Homo sapiens
aaaacaagaugagau

SEQ ID NO: 442956 - RNA, 12 nt, Homo sapiens
aaaacacaacau

SEQ ID NO: 442957 - RNA, 13 nt, Homo sapiens
aaaacacuuccau

SEQ ID NO: 442958 - RNA, 17 nt, Homo sapiens
aaaacagacccucccac

SEQ ID NO: 442959 - RNA, 21 nt, Homo sapiens
aaaacagacccucccacuggu

SEQ ID NO: 442960 - RNA, 16 nt, Homo sapiens
aaaacagccacugaau

SEQ ID NO: 442961 - RNA, 14 nt, Homo sapiens
aaaacagugauuaa

SEQ ID NO: 442962 - RNA, 11 nt, Homo sapiens
aaaacauaucu

SEQ ID NO: 442963 - RNA, 18 nt, Homo sapiens
aaaacaugauuguuuaca

SEQ ID NO: 442964 - RNA, 16 nt, Homo sapiens
aaaacauguaaagggg

SEQ ID NO: 442965 - RNA, 17 nt, Homo sapiens
aaaacauugcugccuaa

SEQ ID NO: 442966 - RNA, 10 nt, Homo sapiens
aaaaccaaug

SEQ ID NO: 442967 - RNA, 14 nt, Homo sapiens
aaaaccacuuuccu

SEQ ID NO: 442968 - RNA, 16 nt, Homo sapiens
aaaacccucugaacuc

SEQ ID NO: 442969 - RNA, 22 nt, Homo sapiens
aaaacccuugauuauacucugu

SEQ ID NO: 442970 - RNA, 22 nt, Homo sapiens
aaaaccucaagggcuuucccac

SEQ ID NO: 442971 - RNA, 18 nt, Homo sapiens
aaaaccugagcagcaacu

SEQ ID NO: 442972 - RNA, 14 nt, Homo sapiens
aaaaccugugccag

SEQ ID NO: 442973 - RNA, 23 nt, Homo sapiens
aaaaccuuauuuuuucuuucuug

SEQ ID NO: 442974 - RNA, 20 nt, Homo sapiens
aaaacguaucaccuuuccca

SEQ ID NO: 442975 - RNA, 16 nt, Homo sapiens
aaaacuaguucuuagg

SEQ ID NO: 442976 - RNA, 20 nt, Homo sapiens
aaaacucuugauaugaccug

SEQ ID NO: 442977 - RNA, 17 nt, Homo sapiens
aaaacuggcaucugaca

SEQ ID NO: 442978 - RNA, 18 nt, Homo sapiens
aaccaucgcgugcaauga

SEQ ID NO: 442979 - RNA, 13 nt, Homo sapiens
aaccaugaacuca

SEQ ID NO: 442980 - RNA, 11 nt, Homo sapiens
aacccaaagug

SEQ ID NO: 442981 - RNA, 18 nt, Homo sapiens
aacccagacccugagucc

SEQ ID NO: 442982 - RNA, 15 nt, Homo sapiens
aacccagauugaagc

SEQ ID NO: 442983 - RNA, 16 nt, Homo sapiens
aacccagccucuagaa

SEQ ID NO: 442984 - RNA, 22 nt, Homo sapiens
aaccccagccugaccugagacu

SEQ ID NO: 442985 - RNA, 17 nt, Homo sapiens
aaccccgggcaagacuu

SEQ ID NO: 442986 - RNA, 14 nt, Homo sapiens
aaccccugcuccag

SEQ ID NO: 442987 - RNA, 16 nt, Homo sapiens
aaccccuggggaccau

SEQ ID NO: 442988 - RNA, 14 nt, Homo sapiens
aacccuaaaccucu

SEQ ID NO: 442989 - RNA, 13 nt, Homo sapiens
aacccugcuucug

SEQ ID NO: 442990 - RNA, 12 nt, Homo sapiens
aaccgucccuga

SEQ ID NO: 442991 - RNA, 14 nt, Homo sapiens
aaccgugugucaug

SEQ ID NO: 442992 - RNA, 12 nt, Homo sapiens
aaccuaccugug

SEQ ID NO: 442993 - RNA, 13 nt, Homo sapiens
aaccuacuagaca

SEQ ID NO: 442994 - RNA, 21 nt, Homo sapiens
aaccuagaaguauuuuugucu

SEQ ID NO: 442995 - RNA, 22 nt, Homo sapiens
aaccuauuugacugcuucacgg

SEQ ID NO: 442996 - RNA, 20 nt, Homo sapiens
aaccuccccaacagcacuua

SEQ ID NO: 442997 - RNA, 14 nt, Homo sapiens
aaccucccuagguc

SEQ ID NO: 442998 - RNA, 17 nt, Homo sapiens
aaccuccuccuccaguu

SEQ ID NO: 442999 - RNA, 15 nt, Homo sapiens
aaccucugcacuacu

SEQ ID NO: 443000 - RNA, 20 nt, Homo sapiens
aaccugaugccccuucccca

SEQ ID NO: 443001 - RNA, 17 nt, Homo sapiens
aaccugccugugcauga

SEQ ID NO: 443002 - RNA, 20 nt, Homo sapiens
aaccuggcugcgaacugugc

SEQ ID NO: 443003 - RNA, 18 nt, Homo sapiens
aaccuguuaugccaaaca

SEQ ID NO: 443004 - RNA, 22 nt, Homo sapiens
aaccuguuaugccaaacaguug

SEQ ID NO: 443005 - RNA, 17 nt, Homo sapiens
aaccuucuaauccaugu

SEQ ID NO: 443006 - RNA, 16 nt, Homo sapiens
aaccuuucaaauuuca

SEQ ID NO: 443007 - RNA, 22 nt, Homo sapiens
aaccuuucagcuggcagaguua

SEQ ID NO: 443008 - RNA, 21 nt, Homo sapiens
aaccuuuugagugccuuacac

SEQ ID NO: 443009 - RNA, 17 nt, Homo sapiens
aacgaaaaccacaaaaa

SEQ ID NO: 443010 - RNA, 21 nt, Homo sapiens
aacgaaacacagaacucagcc

SEQ ID NO: 443011 - RNA, 18 nt, Homo sapiens
aacgccgcugacugccac

SEQ ID NO: 443012 - RNA, 18 nt, Homo sapiens
aacggaugaggucauuuc

SEQ ID NO: 443013 - RNA, 13 nt, Homo sapiens
aacggcacugugg

SEQ ID NO: 443014 - RNA, 21 nt, Homo sapiens
aacgggucugugggacuggcc

SEQ ID NO: 443015 - RNA, 14 nt, Homo sapiens
aacguacccaaggu

SEQ ID NO: 443016 - RNA, 18 nt, Homo sapiens
aacguccacagaguauaa

SEQ ID NO: 443017 - RNA, 23 nt, Homo sapiens
aacguccuuccacuucaggguuc

SEQ ID NO: 443018 - RNA, 21 nt, Homo sapiens
aacguggggcagcacagagag

SEQ ID NO: 443019 - RNA, 22 nt, Homo sapiens
aacuaaaauagauuaaaggaau

SEQ ID NO: 443020 - RNA, 14 nt, Homo sapiens
aacuaaauaaagcu

SEQ ID NO: 443021 - RNA, 22 nt, Homo sapiens
aacuaagguacggugagacucu

SEQ ID NO: 443022 - RNA, 20 nt, Homo sapiens
aacuaaugucagcacauguu

SEQ ID NO: 443023 - RNA, 22 nt, Homo sapiens
aacuaaugucagcacauguugc

SEQ ID NO: 443024 - RNA, 20 nt, Homo sapiens
aacuacagaaagagcgucau

SEQ ID NO: 443025 - RNA, 21 nt, Homo sapiens
aacuacagaguuuaugauuua

SEQ ID NO: 443026 - RNA, 20 nt, Homo sapiens
aacuaccagugggcauguau

SEQ ID NO: 443027 - RNA, 22 nt, Homo sapiens
aacuaccagugggcauguauua

SEQ ID NO: 443028 - RNA, 18 nt, Homo sapiens
aacuaccauguggccauu

SEQ ID NO: 443029 - RNA, 23 nt, Homo sapiens
aacuacuaaagugccuaccccag

SEQ ID NO: 443030 - RNA, 14 nt, Homo sapiens
aacuacugaacugu

SEQ ID NO: 443031 - RNA, 11 nt, Homo sapiens
aacuacuguac

SEQ ID NO: 443032 - RNA, 21 nt, Homo sapiens
aacuacuguguuccuggcaau

SEQ ID NO: 443033 - RNA, 21 nt, Homo sapiens
aacuaguauuguccauaucag

SEQ ID NO: 443034 - RNA, 17 nt, Homo sapiens
aacuaguuaaaagccuu

SEQ ID NO: 443035 - RNA, 16 nt, Homo sapiens
aacuauccuaacaagc

SEQ ID NO: 443036 - RNA, 13 nt, Homo sapiens
aacuauccugacu

SEQ ID NO: 443037 - RNA, 19 nt, Homo sapiens
aacuaugguucccaauaaa

SEQ ID NO: 443038 - RNA, 16 nt, Homo sapiens
aacuauguaaugcuua

SEQ ID NO: 443039 - RNA, 18 nt, Homo sapiens
aacuauguuuagugugau

SEQ ID NO: 443040 - RNA, 16 nt, Homo sapiens
aacuauuguuaauucu

SEQ ID NO: 443041 - RNA, 22 nt, Homo sapiens
aacucaaaaggagaacugugcu

SEQ ID NO: 443042 - RNA, 18 nt, Homo sapiens
aacucaaggacuuugcag

SEQ ID NO: 443043 - RNA, 14 nt, Homo sapiens
aacucacugugcuc

SEQ ID NO: 443044 - RNA, 12 nt, Homo sapiens
aacucagaucac

SEQ ID NO: 443045 - RNA, 18 nt, Homo sapiens
aacucagaucacuacugc

SEQ ID NO: 443046 - RNA, 23 nt, Homo sapiens
aacucagccuuaagaaagcuaua

SEQ ID NO: 443047 - RNA, 14 nt, Homo sapiens
aacucaucuguuau

SEQ ID NO: 443048 - RNA, 22 nt, Homo sapiens
aacucaugacugagucuggcaa

SEQ ID NO: 443049 - RNA, 21 nt, Homo sapiens
aacucauggaccacaguaaca

SEQ ID NO: 443050 - RNA, 20 nt, Homo sapiens
aacucccagccaccaccacu

SEQ ID NO: 443051 - RNA, 17 nt, Homo sapiens
aacuccuagcugacuca

SEQ ID NO: 443052 - RNA, 19 nt, Homo sapiens
aacuccugacaucagguga

SEQ ID NO: 443053 - RNA, 14 nt, Homo sapiens
aacuccugaccuca

SEQ ID NO: 443054 - RNA, 19 nt, Homo sapiens
aacuccugaccucagguga

SEQ ID NO: 443055 - RNA, 19 nt, Homo sapiens
aacuccuuaauaugaucug

SEQ ID NO: 443056 - RNA, 15 nt, Homo sapiens
aacucuccacuccau

SEQ ID NO: 443057 - RNA, 16 nt, Homo sapiens
aaauuauaaguagauu

SEQ ID NO: 443058 - RNA, 16 nt, Homo sapiens
aaauuaucugauccuu

SEQ ID NO: 443059 - RNA, 18 nt, Homo sapiens
aaauuauucuagucaacu

SEQ ID NO: 443060 - RNA, 14 nt, Homo sapiens
aaauucaaacugcc

SEQ ID NO: 443061 - RNA, 12 nt, Homo sapiens
aaauucaccccc

SEQ ID NO: 443062 - RNA, 14 nt, Homo sapiens
aaauucaugcugcu

SEQ ID NO: 443063 - RNA, 19 nt, Homo sapiens
aaauuccacacuaccacau

SEQ ID NO: 443064 - RNA, 19 nt, Homo sapiens
aaauucucagucaugcacu

SEQ ID NO: 443065 - RNA, 18 nt, Homo sapiens
aaauucuguggcaguuuu

SEQ ID NO: 443066 - RNA, 17 nt, Homo sapiens
aaauugaaagcuuccau

SEQ ID NO: 443067 - RNA, 19 nt, Homo sapiens
aaauugauuaaaggggcug

SEQ ID NO: 443068 - RNA, 12 nt, Homo sapiens
aaauugccuccu

SEQ ID NO: 443069 - RNA, 23 nt, Homo sapiens
aaauuguagcccaguuggucaaa

SEQ ID NO: 443070 - RNA, 22 nt, Homo sapiens
aaauuguauacauuuuguuaua

SEQ ID NO: 443071 - RNA, 13 nt, Homo sapiens
aaauuguauagag

SEQ ID NO: 443072 - RNA, 14 nt, Homo sapiens
aaauuuaaccuacu

SEQ ID NO: 443073 - RNA, 18 nt, Homo sapiens
aaauuucgagcauaagaa

SEQ ID NO: 443074 - RNA, 14 nt, Homo sapiens
aaauuugacuguua

SEQ ID NO: 443075 - RNA, 22 nt, Homo sapiens
aaauuugcaaaucucaggauaa

SEQ ID NO: 443076 - RNA, 16 nt, Homo sapiens
aaauuugcaggggaua

SEQ ID NO: 443077 - RNA, 13 nt, Homo sapiens
aaauuuggaagau

SEQ ID NO: 443078 - RNA, 12 nt, Homo sapiens
aaauuuuacuuc

SEQ ID NO: 443079 - RNA, 21 nt, Homo sapiens
aaauuuugaguucuacauaag

SEQ ID NO: 443080 - RNA, 23 nt, Homo sapiens
aaauuuugucuuuaacucauaaa

SEQ ID NO: 443081 - RNA, 17 nt, Homo sapiens
aaauuuuuuaaaaagca

SEQ ID NO: 443082 - RNA, 14 nt, Homo sapiens
aaauuuuuuuccag

SEQ ID NO: 443083 - RNA, 18 nt, Homo sapiens
aacaaaaagaacaauaga

SEQ ID NO: 443084 - RNA, 13 nt, Homo sapiens
aacaaaaggcuuu

SEQ ID NO: 443085 - RNA, 12 nt, Homo sapiens
aacaaaagggag

SEQ ID NO: 443086 - RNA, 17 nt, Homo sapiens
aacaaaagugcuuugga

SEQ ID NO: 443087 - RNA, 13 nt, Homo sapiens
aacaaacugugua

SEQ ID NO: 443088 - RNA, 15 nt, Homo sapiens
aacaaagcaugcuca

SEQ ID NO: 443089 - RNA, 16 nt, Homo sapiens
aacaaagcaugcucag

SEQ ID NO: 443090 - RNA, 22 nt, Homo sapiens
aacaaagugacuguuuggcuua

SEQ ID NO: 443091 - RNA, 14 nt, Homo sapiens
aacaaauaugcaaa

SEQ ID NO: 443092 - RNA, 13 nt, Homo sapiens
aacaacaacuauc

SEQ ID NO: 443093 - RNA, 21 nt, Homo sapiens
aacaacccuguugaguauuug

SEQ ID NO: 443094 - RNA, 22 nt, Homo sapiens
aacaacccuguugaguauuugc

SEQ ID NO: 443095 - RNA, 21 nt, Homo sapiens
aacaacguguauagugccuaa

SEQ ID NO: 443096 - RNA, 21 nt, Homo sapiens
aacaacuauccugacuucuaa

SEQ ID NO: 443097 - RNA, 16 nt, Homo sapiens
aacaacugauauacuu

SEQ ID NO: 443098 - RNA, 16 nt, Homo sapiens
aacaaguugugccuuu

SEQ ID NO: 443099 - RNA, 15 nt, Homo sapiens
aacaaucuuagacau

SEQ ID NO: 443100 - RNA, 23 nt, Homo sapiens
aacaauguuucuucaguggcaaa

SEQ ID NO: 443101 - RNA, 16 nt, Homo sapiens
aacaauuucugugucc

SEQ ID NO: 443102 - RNA, 17 nt, Homo sapiens
aacaauuuuuuccccaa

SEQ ID NO: 443103 - RNA, 14 nt, Homo sapiens
aacacaauaugaau

SEQ ID NO: 443104 - RNA, 19 nt, Homo sapiens
aacacacuuaucugucucu

SEQ ID NO: 443105 - RNA, 22 nt, Homo sapiens
aacacacuuggaugcaggguuu

SEQ ID NO: 443106 - RNA, 21 nt, Homo sapiens
aacacauaauugcuuauguau

SEQ ID NO: 443107 - RNA, 15 nt, Homo sapiens
aacacauacuagaaa

SEQ ID NO: 443108 - RNA, 14 nt, Homo sapiens
aacacauuguguca

SEQ ID NO: 443109 - RNA, 14 nt, Homo sapiens
aacaccaagacuug

SEQ ID NO: 443110 - RNA, 15 nt, Homo sapiens
aacaccauuauucca

SEQ ID NO: 443111 - RNA, 18 nt, Homo sapiens
aacaccgcuucugccuuu

SEQ ID NO: 443112 - RNA, 19 nt, Homo sapiens
aacaccgcuucugccuuuu

SEQ ID NO: 443113 - RNA, 13 nt, Homo sapiens
aacaccuccucaa

SEQ ID NO: 443114 - RNA, 16 nt, Homo sapiens
aacaccuucaugcuua

SEQ ID NO: 443115 - RNA, 20 nt, Homo sapiens
aacacggggcuugcaacuua

SEQ ID NO: 443116 - RNA, 19 nt, Homo sapiens
aacacuaguuuugugccag

SEQ ID NO: 443117 - RNA, 17 nt, Homo sapiens
aacacucaguuguucaa

SEQ ID NO: 443118 - RNA, 14 nt, Homo sapiens
aacacucucugaga

SEQ ID NO: 443119 - RNA, 20 nt, Homo sapiens
aacacugcagcccucuccac

SEQ ID NO: 443120 - RNA, 19 nt, Homo sapiens
aacacuguauaacauuuaa

SEQ ID NO: 443121 - RNA, 13 nt, Homo sapiens
aacacugugcaaa

SEQ ID NO: 443122 - RNA, 14 nt, Homo sapiens
aacacugugcaaag

SEQ ID NO: 443123 - RNA, 14 nt, Homo sapiens
aacagaagcuucca

SEQ ID NO: 443124 - RNA, 18 nt, Homo sapiens
aacagagaugccaugaua

SEQ ID NO: 443125 - RNA, 14 nt, Homo sapiens
aacagaguccaauu

SEQ ID NO: 443126 - RNA, 14 nt, Homo sapiens
aacagauaacacca

SEQ ID NO: 443127 - RNA, 19 nt, Homo sapiens
aacagcagauuucagauca

SEQ ID NO: 443128 - RNA, 16 nt, Homo sapiens
aacagcuaugcaggga

SEQ ID NO: 443129 - RNA, 15 nt, Homo sapiens
aacagcucaccaacu

SEQ ID NO: 443130 - RNA, 17 nt, Homo sapiens
aacagcuguuccugugu

SEQ ID NO: 443131 - RNA, 19 nt, Homo sapiens
aacagcuguuccuguguuc

SEQ ID NO: 443132 - RNA, 17 nt, Homo sapiens
aacaggaaacugaucau

SEQ ID NO: 443133 - RNA, 17 nt, Homo sapiens
aacaggcucacagagau

SEQ ID NO: 443134 - RNA, 19 nt, Homo sapiens
aacagggcaucuccaggaa

SEQ ID NO: 443135 - RNA, 19 nt, Homo sapiens
aacagguuuuccugaagaa

SEQ ID NO: 443136 - RNA, 19 nt, Homo sapiens
aacaguaaaggccauguga

SEQ ID NO: 443137 - RNA, 15 nt, Homo sapiens
aacaguccauugaaa

SEQ ID NO: 443138 - RNA, 16 nt, Homo sapiens
aacaguguuggcuuuc

SEQ ID NO: 443139 - RNA, 15 nt, Homo sapiens
aacaguuugaaaaga

SEQ ID NO: 443140 - RNA, 20 nt, Homo sapiens
aacaguuugaugcugaguca

SEQ ID NO: 443141 - RNA, 22 nt, Homo sapiens
aacauaaaacaaaaccaagccu

SEQ ID NO: 443142 - RNA, 20 nt, Homo sapiens
aacauaaaaucugugaauua

SEQ ID NO: 443143 - RNA, 16 nt, Homo sapiens
aaauaacgccccagau

SEQ ID NO: 443144 - RNA, 14 nt, Homo sapiens
aaauaagcuauauu

SEQ ID NO: 443145 - RNA, 18 nt, Homo sapiens
aaauaagcucuccccaaa

SEQ ID NO: 443146 - RNA, 23 nt, Homo sapiens
aaauaaguaauaucuuucaguua

SEQ ID NO: 443147 - RNA, 16 nt, Homo sapiens
aaauaauacaacaauc

SEQ ID NO: 443148 - RNA, 19 nt, Homo sapiens
aaauaauuaucacaaugua

SEQ ID NO: 443149 - RNA, 14 nt, Homo sapiens
aaauacacauagca

SEQ ID NO: 443150 - RNA, 20 nt, Homo sapiens
aaauacaguauucuguacca

SEQ ID NO: 443151 - RNA, 17 nt, Homo sapiens
aaauacuguaacacugu

SEQ ID NO: 443152 - RNA, 15 nt, Homo sapiens
aaauacuucuugaag

SEQ ID NO: 443153 - RNA, 16 nt, Homo sapiens
aaauacuuuaacuucc

SEQ ID NO: 443154 - RNA, 15 nt, Homo sapiens
aaauagaaacuugcu

SEQ ID NO: 443155 - RNA, 14 nt, Homo sapiens
aaauagaacuugau

SEQ ID NO: 443156 - RNA, 18 nt, Homo sapiens
aaauagacagucaggcua

SEQ ID NO: 443157 - RNA, 15 nt, Homo sapiens
aaauagcugccuuuu

SEQ ID NO: 443158 - RNA, 16 nt, Homo sapiens
aaauagucuuccacaa

SEQ ID NO: 443159 - RNA, 15 nt, Homo sapiens
aaauaguguguccau

SEQ ID NO: 443160 - RNA, 15 nt, Homo sapiens
aaauauaaacuguga

SEQ ID NO: 443161 - RNA, 23 nt, Homo sapiens
aaauauauaaugguuuacugcug

SEQ ID NO: 443162 - RNA, 14 nt, Homo sapiens
aaauauauaugugu

SEQ ID NO: 443163 - RNA, 22 nt, Homo sapiens
aaauaugauucuccucucccaa

SEQ ID NO: 443164 - RNA, 21 nt, Homo sapiens
aaauaugauuuuauuugacaa

SEQ ID NO: 443165 - RNA, 18 nt, Homo sapiens
aaauaugguagcucgcca

SEQ ID NO: 443166 - RNA, 19 nt, Homo sapiens
aaauauguugaguguucau

SEQ ID NO: 443167 - RNA, 16 nt, Homo sapiens
aaauauuuauaucuca

SEQ ID NO: 443168 - RNA, 20 nt, Homo sapiens
aaauauuuccuuaaacugug

SEQ ID NO: 443169 - RNA, 18 nt, Homo sapiens
aaauauuuuaaacuacug

SEQ ID NO: 443170 - RNA, 16 nt, Homo sapiens
aaauauuuuucccucc

SEQ ID NO: 443171 - RNA, 15 nt, Homo sapiens
aaauauuuuugccau

SEQ ID NO: 443172 - RNA, 16 nt, Homo sapiens
aaaucaaugucacuua

SEQ ID NO: 443173 - RNA, 17 nt, Homo sapiens
aaaucaguuuuguguac

SEQ ID NO: 443174 - RNA, 19 nt, Homo sapiens
aaaucauuaauacucuucu

SEQ ID NO: 443175 - RNA, 12 nt, Homo sapiens
aaaucauuccau

SEQ ID NO: 443176 - RNA, 16 nt, Homo sapiens
aaaucauuuauuuaca

SEQ ID NO: 443177 - RNA, 18 nt, Homo sapiens
aaaucauuucaguaucau

SEQ ID NO: 443178 - RNA, 13 nt, Homo sapiens
aaauccaguucua

SEQ ID NO: 443179 - RNA, 19 nt, Homo sapiens
aaauccccucccugugacc

SEQ ID NO: 443180 - RNA, 21 nt, Homo sapiens
aaauccccucccugugacccg

SEQ ID NO: 443181 - RNA, 15 nt, Homo sapiens
aaauccuaccaaagu

SEQ ID NO: 443182 - RNA, 19 nt, Homo sapiens
aaauccuaccaaccucuga

SEQ ID NO: 443183 - RNA, 16 nt, Homo sapiens
aaauccuguuacuuaa

SEQ ID NO: 443184 - RNA, 14 nt, Homo sapiens
aaaucgaccacagu

SEQ ID NO: 443185 - RNA, 23 nt, Homo sapiens
aaaucggaucuggggcucuggga

SEQ ID NO: 443186 - RNA, 22 nt, Homo sapiens
aaaucuaaaugauuaucuugaa

SEQ ID NO: 443187 - RNA, 15 nt, Homo sapiens
aaaucuaggauuauu

SEQ ID NO: 443188 - RNA, 13 nt, Homo sapiens
aaaucucacaaau

SEQ ID NO: 443189 - RNA, 23 nt, Homo sapiens
aaaucucacuuuucuccaugagu

SEQ ID NO: 443190 - RNA, 13 nt, Homo sapiens
aaaucucuaauau

SEQ ID NO: 443191 - RNA, 19 nt, Homo sapiens
aaaucuggguaucuuucca

SEQ ID NO: 443192 - RNA, 16 nt, Homo sapiens
aaaucuguaagcucuu

SEQ ID NO: 443193 - RNA, 16 nt, Homo sapiens
aaaucuucagcaugau

SEQ ID NO: 443194 - RNA, 19 nt, Homo sapiens
aaaucuuguuggcaaauca

SEQ ID NO: 443195 - RNA, 19 nt, Homo sapiens
aaaugaaaaaaaugaucua

SEQ ID NO: 443196 - RNA, 16 nt, Homo sapiens
aaaugaaagucaguuu

SEQ ID NO: 443197 - RNA, 14 nt, Homo sapiens
aaaugaauacgaac

SEQ ID NO: 443198 - RNA, 16 nt, Homo sapiens
aaaugacugucccauu

SEQ ID NO: 443199 - RNA, 22 nt, Homo sapiens
aaaugagaauuuuauauucuaa

SEQ ID NO: 443200 - RNA, 13 nt, Homo sapiens
aaaugaguauuuc

SEQ ID NO: 443201 - RNA, 14 nt, Homo sapiens
aaaugauacaguca

SEQ ID NO: 443202 - RNA, 18 nt, Homo sapiens
aaaugauccuuaugaugu

SEQ ID NO: 443203 - RNA, 12 nt, Homo sapiens
aaaugauggaau

SEQ ID NO: 443204 - RNA, 13 nt, Homo sapiens
aaaugaugugaaa

SEQ ID NO: 443205 - RNA, 14 nt, Homo sapiens
aaaugcaugauaau

SEQ ID NO: 443206 - RNA, 16 nt, Homo sapiens
aaaugcccauuugccu

SEQ ID NO: 443207 - RNA, 16 nt, Homo sapiens
aaaugcugcuuucugc

SEQ ID NO: 443208 - RNA, 23 nt, Homo sapiens
aaaugcuuugauuguucauauca

SEQ ID NO: 443209 - RNA, 13 nt, Homo sapiens
aaauggaacauua

SEQ ID NO: 443210 - RNA, 13 nt, Homo sapiens
aaauggaugacaa

SEQ ID NO: 443211 - RNA, 14 nt, Homo sapiens
aaaugggugaaaaa

SEQ ID NO: 443212 - RNA, 19 nt, Homo sapiens
aaauguacuacauuugcau

SEQ ID NO: 443213 - RNA, 12 nt, Homo sapiens
aaaugucccaaa

SEQ ID NO: 443214 - RNA, 16 nt, Homo sapiens
aaauguccguguaaaa

SEQ ID NO: 443215 - RNA, 10 nt, Homo sapiens
aaaugucucc

SEQ ID NO: 443216 - RNA, 21 nt, Homo sapiens
aaaugucuguuucaaugaccu

SEQ ID NO: 443217 - RNA, 19 nt, Homo sapiens
aaaugugguuacacacuuu

SEQ ID NO: 443218 - RNA, 18 nt, Homo sapiens
aaauguuaaagaacugcu

SEQ ID NO: 443219 - RNA, 21 nt, Homo sapiens
aaauguuagugaucaccacuu

SEQ ID NO: 443220 - RNA, 17 nt, Homo sapiens
aaauguuauuguccuca

SEQ ID NO: 443221 - RNA, 23 nt, Homo sapiens
aaauguuuaauaucugacugaaa

SEQ ID NO: 443222 - RNA, 21 nt, Homo sapiens
aaauuaaaauccagcauccca

SEQ ID NO: 443223 - RNA, 15 nt, Homo sapiens
aaauuacaauuguca

SEQ ID NO: 443224 - RNA, 19 nt, Homo sapiens
aaauuagcuugagcaaccu

SEQ ID NO: 443225 - RNA, 23 nt, Homo sapiens
aaauuauacuguagcugaugaaa

SEQ ID NO: 443226 - RNA, 17 nt, Homo sapiens
aaauuauguauguuuac

SEQ ID NO: 443227 - RNA, 18 nt, Homo sapiens
aaauuauguauguuuaca

SEQ ID NO: 443228 - RNA, 22 nt, Homo sapiens
aaauuaugucaaauggauguaa

SEQ ID NO: 443229 - RNA, 17 nt, Homo sapiens
aaauucaaccacuguaa

SEQ ID NO: 443230 - RNA, 12 nt, Homo sapiens
aaauucuugaua

SEQ ID NO: 443231 - RNA, 16 nt, Homo sapiens
aaauucuuuauucuuc

SEQ ID NO: 443232 - RNA, 22 nt, Homo sapiens
aaauugaaagcaggacauauga

SEQ ID NO: 443233 - RNA, 16 nt, Homo sapiens
aaauugcagcaguugc

SEQ ID NO: 443234 - RNA, 20 nt, Homo sapiens
aaauugcaugcugcuuuaau

SEQ ID NO: 443235 - RNA, 17 nt, Homo sapiens
aaauuggaacaccuccu

SEQ ID NO: 443236 - RNA, 13 nt, Homo sapiens
aaauuggcuccuu

SEQ ID NO: 443237 - RNA, 19 nt, Homo sapiens
aaauuuaauauacugcaua

SEQ ID NO: 443238 - RNA, 20 nt, Homo sapiens
aaauuuacaguuacugccua

SEQ ID NO: 443239 - RNA, 14 nt, Homo sapiens
aaauuuuacaauag

SEQ ID NO: 443240 - RNA, 14 nt, Homo sapiens
aacaaaaaugacag

SEQ ID NO: 443241 - RNA, 12 nt, Homo sapiens
aacaaaaccaag

SEQ ID NO: 443242 - RNA, 13 nt, Homo sapiens
aacaaaaucuggg

SEQ ID NO: 443243 - RNA, 17 nt, Homo sapiens
aacaaacacauugugaa

SEQ ID NO: 443244 - RNA, 15 nt, Homo sapiens
aacaaacuuacuguc

SEQ ID NO: 443245 - RNA, 15 nt, Homo sapiens
aacaaagcauuugac

SEQ ID NO: 443246 - RNA, 13 nt, Homo sapiens
aacaaaguccaca

SEQ ID NO: 443247 - RNA, 16 nt, Homo sapiens
aacaaauauuucacuu

SEQ ID NO: 443248 - RNA, 23 nt, Homo sapiens
aacaacauuggaugugcauuucu

SEQ ID NO: 443249 - RNA, 15 nt, Homo sapiens
aacaaccuggucaca

SEQ ID NO: 443250 - RNA, 22 nt, Homo sapiens
aacaaccuggucacaggacucu

SEQ ID NO: 443251 - RNA, 19 nt, Homo sapiens
aacaacuuaauguucugaa

SEQ ID NO: 443252 - RNA, 16 nt, Homo sapiens
aacaagacacccaagu

SEQ ID NO: 443253 - RNA, 21 nt, Homo sapiens
aacaagaguaaauauugucac

SEQ ID NO: 443254 - RNA, 20 nt, Homo sapiens
aacaauacgugaaagaugca

SEQ ID NO: 443255 - RNA, 17 nt, Homo sapiens
aacaauccaaaugcauu

SEQ ID NO: 443256 - RNA, 14 nt, Homo sapiens
aacaaugaccuuua

SEQ ID NO: 443257 - RNA, 22 nt, Homo sapiens
aacaauguaugugaaaguguaa

SEQ ID NO: 443258 - RNA, 22 nt, Homo sapiens
aacaauguuucuucaguggcaa

SEQ ID NO: 443259 - RNA, 16 nt, Homo sapiens
aacacaagagacuuaa

SEQ ID NO: 443260 - RNA, 20 nt, Homo sapiens
aacacacacacacacaaaac

SEQ ID NO: 443261 - RNA, 14 nt, Homo sapiens
aacacacaugcaca

SEQ ID NO: 443262 - RNA, 16 nt, Homo sapiens
aacacagaacucagcc

SEQ ID NO: 443263 - RNA, 21 nt, Homo sapiens
aacacagcauguguauuucca

SEQ ID NO: 443264 - RNA, 17 nt, Homo sapiens
aacacaguaaaauauuc

SEQ ID NO: 443265 - RNA, 20 nt, Homo sapiens
aacacauugccuaacuacua

SEQ ID NO: 443266 - RNA, 12 nt, Homo sapiens
aacacauuguga

SEQ ID NO: 443267 - RNA, 14 nt, Homo sapiens
aacaccacagacac

SEQ ID NO: 443268 - RNA, 16 nt, Homo sapiens
aacaccaccaaaugac

SEQ ID NO: 443269 - RNA, 14 nt, Homo sapiens
aacaccccacagga

SEQ ID NO: 443270 - RNA, 22 nt, Homo sapiens
aacaccuguggauaaaacauua

SEQ ID NO: 443271 - RNA, 22 nt, Homo sapiens
aacaccuucuuggcuucuggga

SEQ ID NO: 443272 - RNA, 18 nt, Homo sapiens
aacacguggguauuuaau

SEQ ID NO: 443273 - RNA, 19 nt, Homo sapiens
aacacgugggugagcgugu

SEQ ID NO: 443274 - RNA, 21 nt, Homo sapiens
aagagcgcuccucugccuugg

SEQ ID NO: 443275 - RNA, 15 nt, Homo sapiens
aagagcuccuugaug

SEQ ID NO: 443276 - RNA, 13 nt, Homo sapiens
aagagcucuccag

SEQ ID NO: 443277 - RNA, 15 nt, Homo sapiens
aagaggaagugcacu

SEQ ID NO: 443278 - RNA, 20 nt, Homo sapiens
aagaggcauucccagaauuu

SEQ ID NO: 443279 - RNA, 23 nt, Homo sapiens
aagaggcccugucuguaccuaac

SEQ ID NO: 443280 - RNA, 17 nt, Homo sapiens
aagaggcugcugagaaa

SEQ ID NO: 443281 - RNA, 23 nt, Homo sapiens
aagagggagccgguuugggagag

SEQ ID NO: 443282 - RNA, 18 nt, Homo sapiens
aagagggccugugggagc

SEQ ID NO: 443283 - RNA, 15 nt, Homo sapiens
aagagugauguuuca

SEQ ID NO: 443284 - RNA, 15 nt, Homo sapiens
aagagugggcuuucc

SEQ ID NO: 443285 - RNA, 21 nt, Homo sapiens
aagagugggggagagcaggcu

SEQ ID NO: 443286 - RNA, 21 nt, Homo sapiens
aagagugucacugagcugugu

SEQ ID NO: 443287 - RNA, 15 nt, Homo sapiens
aagaguuauaugacu

SEQ ID NO: 443288 - RNA, 21 nt, Homo sapiens
aagaguucaagaccagccugg

SEQ ID NO: 443289 - RNA, 12 nt, Homo sapiens
aagauacuaaua

SEQ ID NO: 443290 - RNA, 21 nt, Homo sapiens
aagauacuaauagaguacuua

SEQ ID NO: 443291 - RNA, 23 nt, Homo sapiens
aagauacuaauagaguacuuaau

SEQ ID NO: 443292 - RNA, 20 nt, Homo sapiens
aagaucacgccacugcacuc

SEQ ID NO: 443293 - RNA, 14 nt, Homo sapiens
aagaugcucuguga

SEQ ID NO: 443294 - RNA, 17 nt, Homo sapiens
aagauggaaaucacauu

SEQ ID NO: 443295 - RNA, 22 nt, Homo sapiens
aagaugguauauuugguacugu

SEQ ID NO: 443296 - RNA, 22 nt, Homo sapiens
aagaugguuuuauucuuugaga

SEQ ID NO: 443297 - RNA, 20 nt, Homo sapiens
aagauuauuuacugacauau

SEQ ID NO: 443298 - RNA, 13 nt, Homo sapiens
aagauucaauuaa

SEQ ID NO: 443299 - RNA, 21 nt, Homo sapiens
aagauucauauuuacuucuua

SEQ ID NO: 443300 - RNA, 17 nt, Homo sapiens
aagauucuccugugcua

SEQ ID NO: 443301 - RNA, 17 nt, Homo sapiens
aagauugauuaaugaac

SEQ ID NO: 443302 - RNA, 21 nt, Homo sapiens
aagauuucucuuuuucauuca

SEQ ID NO: 443303 - RNA, 15 nt, Homo sapiens
aagauuuucagaaaa

SEQ ID NO: 443304 - RNA, 17 nt, Homo sapiens
aagcaaacaucaaauaa

SEQ ID NO: 443305 - RNA, 22 nt, Homo sapiens
aagcaaauauuuaugaccucaa

SEQ ID NO: 443306 - RNA, 18 nt, Homo sapiens
aagcaacgacuacuuugc

SEQ ID NO: 443307 - RNA, 15 nt, Homo sapiens
aagcaaggcuuuaaa

SEQ ID NO: 443308 - RNA, 13 nt, Homo sapiens
aagcaauugucug

SEQ ID NO: 443309 - RNA, 13 nt, Homo sapiens
aagcacaucugca

SEQ ID NO: 443310 - RNA, 17 nt, Homo sapiens
aagcaccuaaaugaugc

SEQ ID NO: 443311 - RNA, 19 nt, Homo sapiens
aagcaccuaaaugaugccu

SEQ ID NO: 443312 - RNA, 19 nt, Homo sapiens
aagcacuacauaaacugac

SEQ ID NO: 443313 - RNA, 12 nt, Homo sapiens
aagcacuggaau

SEQ ID NO: 443314 - RNA, 19 nt, Homo sapiens
aagcacuggacuacaaggg

SEQ ID NO: 443315 - RNA, 18 nt, Homo sapiens
aagcacuuggacucuugc

SEQ ID NO: 443316 - RNA, 19 nt, Homo sapiens
aagcacuuuuccugucuca

SEQ ID NO: 443317 - RNA, 18 nt, Homo sapiens
aagcagaucauuucccaa

SEQ ID NO: 443318 - RNA, 19 nt, Homo sapiens
aagcagccuuacuauucau

SEQ ID NO: 443319 - RNA, 16 nt, Homo sapiens
aagcagucuugcucug

SEQ ID NO: 443320 - RNA, 22 nt, Homo sapiens
aagcagugcaugcugucccuua

SEQ ID NO: 443321 - RNA, 21 nt, Homo sapiens
aagcaguguuuucaccucaua

SEQ ID NO: 443322 - RNA, 20 nt, Homo sapiens
aagcaguuacuaauaugccu

SEQ ID NO: 443323 - RNA, 21 nt, Homo sapiens
aagcaucacacaguggcacua

SEQ ID NO: 443324 - RNA, 23 nt, Homo sapiens
aagcaucucagccuaccaugaga

SEQ ID NO: 443325 - RNA, 17 nt, Homo sapiens
aagcaugucaaguggau

SEQ ID NO: 443326 - RNA, 18 nt, Homo sapiens
aagcaugucucugcuucc

SEQ ID NO: 443327 - RNA, 21 nt, Homo sapiens
aagcauuauccuuuuaucuca

SEQ ID NO: 443328 - RNA, 23 nt, Homo sapiens
aagcauuauccuuuuaucucaca

SEQ ID NO: 443329 - RNA, 15 nt, Homo sapiens
aagcauucugugcau

SEQ ID NO: 443330 - RNA, 16 nt, Homo sapiens
aagccaagacaguggc

SEQ ID NO: 443331 - RNA, 22 nt, Homo sapiens
aagccaccagggcuucuggaac

SEQ ID NO: 443332 - RNA, 21 nt, Homo sapiens
aagccacggaccguugcacaa

SEQ ID NO: 443333 - RNA, 16 nt, Homo sapiens
aagccagcugcagcug

SEQ ID NO: 443334 - RNA, 12 nt, Homo sapiens
aagccaggguuc

SEQ ID NO: 443335 - RNA, 15 nt, Homo sapiens
aagccagugacucca

SEQ ID NO: 443336 - RNA, 13 nt, Homo sapiens
aagccaguuuuca

SEQ ID NO: 443337 - RNA, 13 nt, Homo sapiens
aagccauaugaca

SEQ ID NO: 443338 - RNA, 23 nt, Homo sapiens
aagccccuuggcccucucccaug

SEQ ID NO: 443339 - RNA, 18 nt, Homo sapiens
aagcccgucaucuucccu

SEQ ID NO: 443340 - RNA, 16 nt, Homo sapiens
aagcccuccaaaagca

SEQ ID NO: 443341 - RNA, 20 nt, Homo sapiens
aagcccuccaaaagcacuua

SEQ ID NO: 443342 - RNA, 12 nt, Homo sapiens
aagcccuugaac

SEQ ID NO: 443343 - RNA, 14 nt, Homo sapiens
aagccgccguuuuc

SEQ ID NO: 443344 - RNA, 19 nt, Homo sapiens
aagccgccuagugcagaga

SEQ ID NO: 443345 - RNA, 20 nt, Homo sapiens
aagccgguugcagagaaucu

SEQ ID NO: 443346 - RNA, 21 nt, Homo sapiens
aagccucagcaacagccagug

SEQ ID NO: 443347 - RNA, 18 nt, Homo sapiens
aagccucucaucccccau

SEQ ID NO: 443348 - RNA, 22 nt, Homo sapiens
aagccucuggaaaacucaggau

SEQ ID NO: 443349 - RNA, 14 nt, Homo sapiens
aagccugaguccag

SEQ ID NO: 443350 - RNA, 18 nt, Homo sapiens
aagccugucucuuuccac

SEQ ID NO: 443351 - RNA, 22 nt, Homo sapiens
aagccuuaucaagugucuucca

SEQ ID NO: 443352 - RNA, 17 nt, Homo sapiens
aagcgcacauucaugug

SEQ ID NO: 443353 - RNA, 18 nt, Homo sapiens
aagcgugguggacaugca

SEQ ID NO: 443354 - RNA, 22 nt, Homo sapiens
aagcgugguggacaugcacagc

SEQ ID NO: 443355 - RNA, 23 nt, Homo sapiens
aagcuaaaaugaaaaauagugug

SEQ ID NO: 443356 - RNA, 18 nt, Homo sapiens
aagcuaaaaugauuuuau

SEQ ID NO: 443357 - RNA, 22 nt, Homo sapiens
aagcuaaaauuagaugaacuca

SEQ ID NO: 443358 - RNA, 13 nt, Homo sapiens
aagcucuaauaga

SEQ ID NO: 443359 - RNA, 19 nt, Homo sapiens
aagcucuuuaugacuguuu

SEQ ID NO: 443360 - RNA, 20 nt, Homo sapiens
aagcugaagaaaaugaagcc

SEQ ID NO: 443361 - RNA, 19 nt, Homo sapiens
aagcugauuacugucaaua

SEQ ID NO: 443362 - RNA, 19 nt, Homo sapiens
aagcugcagcuugggagag

SEQ ID NO: 443363 - RNA, 13 nt, Homo sapiens
aagcugcuuuaaa

SEQ ID NO: 443364 - RNA, 12 nt, Homo sapiens
aagcugggagaa

SEQ ID NO: 443365 - RNA, 21 nt, Homo sapiens
aagcugggagaaccaaaaaga

SEQ ID NO: 443366 - RNA, 22 nt, Homo sapiens
aagcugguaaacuauuugucuu

SEQ ID NO: 443367 - RNA, 21 nt, Homo sapiens
aagcuguaagauaauguugcu

SEQ ID NO: 443368 - RNA, 12 nt, Homo sapiens
aagcuucuaucc

SEQ ID NO: 443369 - RNA, 12 nt, Homo sapiens
aagcuucuugcu

SEQ ID NO: 443370 - RNA, 13 nt, Homo sapiens
aagcuuggcugcu

SEQ ID NO: 443371 - RNA, 20 nt, Homo sapiens
aagcuuggggaacccaugag

SEQ ID NO: 443372 - RNA, 18 nt, Homo sapiens
aagcuuucaaauccuccc

SEQ ID NO: 443373 - RNA, 18 nt, Homo sapiens
aagcuuuuuagugcauua

SEQ ID NO: 443374 - RNA, 15 nt, Homo sapiens
aaggaaaaaaccauc

SEQ ID NO: 443375 - RNA, 18 nt, Homo sapiens
aaggaaaaaaccauccag

SEQ ID NO: 443376 - RNA, 14 nt, Homo sapiens
aaggaaacuccuga

SEQ ID NO: 443377 - RNA, 17 nt, Homo sapiens
aaggaaagaggcucugg

SEQ ID NO: 443378 - RNA, 21 nt, Homo sapiens
aaggaaauaguaccuucaaua

SEQ ID NO: 443379 - RNA, 19 nt, Homo sapiens
aaggaacaagaauugcuaa

SEQ ID NO: 443380 - RNA, 12 nt, Homo sapiens
aaggaaccagaa

SEQ ID NO: 443381 - RNA, 23 nt, Homo sapiens
aaggaagaaaagcugccauuucc

SEQ ID NO: 443382 - RNA, 19 nt, Homo sapiens
aaggaagauguaagaagcu

SEQ ID NO: 443383 - RNA, 18 nt, Homo sapiens
aaggaauauccagucaaa

SEQ ID NO: 443384 - RNA, 15 nt, Homo sapiens
aaggaaugcuuggaa

SEQ ID NO: 443385 - RNA, 20 nt, Homo sapiens
aaggacaccuuuuaacucac

SEQ ID NO: 443386 - RNA, 12 nt, Homo sapiens
aaggacugaccu

SEQ ID NO: 443387 - RNA, 15 nt, Homo sapiens
aaggagaacugugcu

SEQ ID NO: 443388 - RNA, 18 nt, Homo sapiens
aaggagagggaguacaaa

SEQ ID NO: 443389 - RNA, 23 nt, Homo sapiens
aaggagaugucugaauacugcag

SEQ ID NO: 443390 - RNA, 17 nt, Homo sapiens
aaggagggccucagaga

SEQ ID NO: 443391 - RNA, 15 nt, Homo sapiens
aaggaucucucagga

SEQ ID NO: 443392 - RNA, 18 nt, Homo sapiens
aaggauuagaacacucau

SEQ ID NO: 443393 - RNA, 17 nt, Homo sapiens
aaggauuugaaaacacc

SEQ ID NO: 443394 - RNA, 12 nt, Homo sapiens
aaggcaaaaaua

SEQ ID NO: 443395 - RNA, 15 nt, Homo sapiens
aaggcaaaaaugugc

SEQ ID NO: 443396 - RNA, 23 nt, Homo sapiens
aaggcaaaucuccuuuguccauu

SEQ ID NO: 443397 - RNA, 21 nt, Homo sapiens
aaggcacccgcccuuuccuug

SEQ ID NO: 443398 - RNA, 13 nt, Homo sapiens
aaggcagcaacaa

SEQ ID NO: 443399 - RNA, 15 nt, Homo sapiens
aaggcagcuagacac

SEQ ID NO: 443400 - RNA, 18 nt, Homo sapiens
aaggcagcucccagguuu

SEQ ID NO: 443401 - RNA, 16 nt, Homo sapiens
aaggcaggcauaucaa

SEQ ID NO: 443402 - RNA, 20 nt, Homo sapiens
aaggcagugaacacacucag

SEQ ID NO: 443403 - RNA, 22 nt, Homo sapiens
aauguuuaaaagcaaaacugca

SEQ ID NO: 443404 - RNA, 17 nt, Homo sapiens
aauguuucccucaagaa

SEQ ID NO: 443405 - RNA, 20 nt, Homo sapiens
aauuaaaaaaaaaacuucau

SEQ ID NO: 443406 - RNA, 18 nt, Homo sapiens
aauuaaaaaauaguugca

SEQ ID NO: 443407 - RNA, 13 nt, Homo sapiens
aauuaaaauccag

SEQ ID NO: 443408 - RNA, 12 nt, Homo sapiens
aauuaaagcaaa

SEQ ID NO: 443409 - RNA, 19 nt, Homo sapiens
aauuaaagggcagauauuc

SEQ ID NO: 443410 - RNA, 22 nt, Homo sapiens
aauuaaauauauguauguaaaa

SEQ ID NO: 443411 - RNA, 17 nt, Homo sapiens
aauuaaccuggugcugg

SEQ ID NO: 443412 - RNA, 12 nt, Homo sapiens
aauuaacugaag

SEQ ID NO: 443413 - RNA, 20 nt, Homo sapiens
aauuaaugaguuuuauccaa

SEQ ID NO: 443414 - RNA, 18 nt, Homo sapiens
aauuacaauaacucacuc

SEQ ID NO: 443415 - RNA, 14 nt, Homo sapiens
aauuagacuaagug

SEQ ID NO: 443416 - RNA, 17 nt, Homo sapiens
aauuaguggcacuugcu

SEQ ID NO: 443417 - RNA, 19 nt, Homo sapiens
aauuauacagaccuaauau

SEQ ID NO: 443418 - RNA, 21 nt, Homo sapiens
aauuaucacaauguacuauau

SEQ ID NO: 443419 - RNA, 19 nt, Homo sapiens
aauuaucuuuuuucuuccu

SEQ ID NO: 443420 - RNA, 14 nt, Homo sapiens
aauuauggcauuuu

SEQ ID NO: 443421 - RNA, 16 nt, Homo sapiens
aauuauuguaaacuuu

SEQ ID NO: 443422 - RNA, 18 nt, Homo sapiens
aauuauuuaacuaauuaa

SEQ ID NO: 443423 - RNA, 22 nt, Homo sapiens
aauuauuucagucaucaucuca

SEQ ID NO: 443424 - RNA, 12 nt, Homo sapiens
aauucacccucu

SEQ ID NO: 443425 - RNA, 13 nt, Homo sapiens
aauucagaguggu

SEQ ID NO: 443426 - RNA, 23 nt, Homo sapiens
aauucagagugguuucauugccu

SEQ ID NO: 443427 - RNA, 16 nt, Homo sapiens
aauucagaugcaagag

SEQ ID NO: 443428 - RNA, 19 nt, Homo sapiens
aauucagcacugauuucac

SEQ ID NO: 443429 - RNA, 13 nt, Homo sapiens
aauucaguucugu

SEQ ID NO: 443430 - RNA, 21 nt, Homo sapiens
aauucauaaaaauaaccaaaa

SEQ ID NO: 443431 - RNA, 22 nt, Homo sapiens
aauucauaaaaauaaccaaaaa

SEQ ID NO: 443432 - RNA, 15 nt, Homo sapiens
aauucauaccucccu

SEQ ID NO: 443433 - RNA, 21 nt, Homo sapiens
aauucuaaguuauuuacuuuu

SEQ ID NO: 443434 - RNA, 20 nt, Homo sapiens
aauucucagucaugcacuca

SEQ ID NO: 443435 - RNA, 13 nt, Homo sapiens
aauucucuaucau

SEQ ID NO: 443436 - RNA, 16 nt, Homo sapiens
aauucugaacuuuuca

SEQ ID NO: 443437 - RNA, 22 nt, Homo sapiens
aauucuuauuggccaaaugccu

SEQ ID NO: 443438 - RNA, 14 nt, Homo sapiens
aauucuucuucuca

SEQ ID NO: 443439 - RNA, 20 nt, Homo sapiens
aauugaaaaccucuuuccaa

SEQ ID NO: 443440 - RNA, 13 nt, Homo sapiens
aauugacaggauu

SEQ ID NO: 443441 - RNA, 13 nt, Homo sapiens
aauugauagucaa

SEQ ID NO: 443442 - RNA, 15 nt, Homo sapiens
aauugaucauucaua

SEQ ID NO: 443443 - RNA, 17 nt, Homo sapiens
aauugauuaaacuguau

SEQ ID NO: 443444 - RNA, 14 nt, Homo sapiens
aauuggacaauuau

SEQ ID NO: 443445 - RNA, 16 nt, Homo sapiens
aauugucaaaugucau

SEQ ID NO: 443446 - RNA, 21 nt, Homo sapiens
aauugucauuuauaaaaccau

SEQ ID NO: 443447 - RNA, 22 nt, Homo sapiens
aauugugguuuauugaauguga

SEQ ID NO: 443448 - RNA, 15 nt, Homo sapiens
aauuguugcuuuuac

SEQ ID NO: 443449 - RNA, 16 nt, Homo sapiens
aauuuaaaaaaauaca

SEQ ID NO: 443450 - RNA, 15 nt, Homo sapiens
aauuuaaaaucauuc

SEQ ID NO: 443451 - RNA, 12 nt, Homo sapiens
aauuuaaccuac

SEQ ID NO: 443452 - RNA, 19 nt, Homo sapiens
aauuuaauauacugcauau

SEQ ID NO: 443453 - RNA, 14 nt, Homo sapiens
aauuuaauuccucu

SEQ ID NO: 443454 - RNA, 19 nt, Homo sapiens
aauuuagaaauauaauuga

SEQ ID NO: 443455 - RNA, 14 nt, Homo sapiens
aauuuagggagaaa

SEQ ID NO: 443456 - RNA, 18 nt, Homo sapiens
aauuuauaaauauauuca

SEQ ID NO: 443457 - RNA, 20 nt, Homo sapiens
aauuuaucuugucucugggc

SEQ ID NO: 443458 - RNA, 18 nt, Homo sapiens
aauuuauuaaaaugauug

SEQ ID NO: 443459 - RNA, 20 nt, Homo sapiens
aauuucaaaaauauaacuua

SEQ ID NO: 443460 - RNA, 21 nt, Homo sapiens
aauuuccuuaaagcaagcuca

SEQ ID NO: 443461 - RNA, 14 nt, Homo sapiens
aauuucgcucugga

SEQ ID NO: 443462 - RNA, 16 nt, Homo sapiens
aauuucucacaauaga

SEQ ID NO: 443463 - RNA, 17 nt, Homo sapiens
aauuucuguccagaaaa

SEQ ID NO: 443464 - RNA, 21 nt, Homo sapiens
aauuucuuccacguaauucaa

SEQ ID NO: 443465 - RNA, 13 nt, Homo sapiens
aauuugaaaucca

SEQ ID NO: 443466 - RNA, 14 nt, Homo sapiens
aauuugaaauuuag

SEQ ID NO: 443467 - RNA, 17 nt, Homo sapiens
aauuugaauggugcaga

SEQ ID NO: 443468 - RNA, 22 nt, Homo sapiens
aauuugaccagaaaauaugaua

SEQ ID NO: 443469 - RNA, 18 nt, Homo sapiens
aauuugacuccucuucaa

SEQ ID NO: 443470 - RNA, 13 nt, Homo sapiens
aauuugagacaaa

SEQ ID NO: 443471 - RNA, 19 nt, Homo sapiens
aauuuguaauugcuuacau

SEQ ID NO: 443472 - RNA, 23 nt, Homo sapiens
aauuuuaucuuuuuuaggcuucu

SEQ ID NO: 443473 - RNA, 17 nt, Homo sapiens
aauuuucacuucugucu

SEQ ID NO: 443474 - RNA, 13 nt, Homo sapiens
aauuuucauucau

SEQ ID NO: 443475 - RNA, 18 nt, Homo sapiens
aauuuucauucauucacu

SEQ ID NO: 443476 - RNA, 17 nt, Homo sapiens
aauuuucauuggaugca

SEQ ID NO: 443477 - RNA, 13 nt, Homo sapiens
aauuuuuugcucu

SEQ ID NO: 443478 - RNA, 23 nt, Homo sapiens
acaaaaaaauauauuuaaugaua

SEQ ID NO: 443479 - RNA, 23 nt, Homo sapiens
acaaaaaaguguucccuuuucaa

SEQ ID NO: 443480 - RNA, 17 nt, Homo sapiens
acaaaaacauggccuuu

SEQ ID NO: 443481 - RNA, 13 nt, Homo sapiens
acaaaaagcacaa

SEQ ID NO: 443482 - RNA, 16 nt, Homo sapiens
acaaaaauauauuaaa

SEQ ID NO: 443483 - RNA, 15 nt, Homo sapiens
acaaacaaugcaaac

SEQ ID NO: 443484 - RNA, 17 nt, Homo sapiens
acaaacaccuuauuugu

SEQ ID NO: 443485 - RNA, 17 nt, Homo sapiens
acaaacaggugcuaaca

SEQ ID NO: 443486 - RNA, 12 nt, Homo sapiens
acaaacagugaa

SEQ ID NO: 443487 - RNA, 16 nt, Homo sapiens
acaaaccgagugcaau

SEQ ID NO: 443488 - RNA, 16 nt, Homo sapiens
acaaagaagaaccauc

SEQ ID NO: 443489 - RNA, 23 nt, Homo sapiens
acaaagaaggaaaagaguaucaa

SEQ ID NO: 443490 - RNA, 17 nt, Homo sapiens
acaaagaggagcugcug

SEQ ID NO: 443491 - RNA, 15 nt, Homo sapiens
acaaagauacuugau

SEQ ID NO: 443492 - RNA, 13 nt, Homo sapiens
acaaagcauguga

SEQ ID NO: 443493 - RNA, 12 nt, Homo sapiens
acaaagccuuau

SEQ ID NO: 443494 - RNA, 23 nt, Homo sapiens
acaaagcgugguggacaugcaca

SEQ ID NO: 443495 - RNA, 24 nt, Homo sapiens
acaaagcgugguggacaugcacag

SEQ ID NO: 443496 - RNA, 20 nt, Homo sapiens
acaaagcugugaaaugugca

SEQ ID NO: 443497 - RNA, 15 nt, Homo sapiens
acaaagggugggcau

SEQ ID NO: 443498 - RNA, 18 nt, Homo sapiens
acaaauaaguuacccuca

SEQ ID NO: 443499 - RNA, 17 nt, Homo sapiens
acaaauaaucacauuga

SEQ ID NO: 443500 - RNA, 13 nt, Homo sapiens
acaaauauuccug

SEQ ID NO: 443501 - RNA, 12 nt, Homo sapiens
acaaauauugcu

SEQ ID NO: 443502 - RNA, 21 nt, Homo sapiens
acaaaugaucgcuaucuagca

SEQ ID NO: 443503 - RNA, 15 nt, Homo sapiens
acaaaugcagacaca

SEQ ID NO: 443504 - RNA, 18 nt, Homo sapiens
acaaaugggccugccaaa

SEQ ID NO: 443505 - RNA, 15 nt, Homo sapiens
acaaaugguagcaua

SEQ ID NO: 443506 - RNA, 22 nt, Homo sapiens
acaaauugauagucaauaucaa

SEQ ID NO: 443507 - RNA, 15 nt, Homo sapiens
acaacaaacacugug

SEQ ID NO: 443508 - RNA, 17 nt, Homo sapiens
acaacaaacacugugau

SEQ ID NO: 443509 - RNA, 19 nt, Homo sapiens
acaacaaagcaugcucagu

SEQ ID NO: 443510 - RNA, 17 nt, Homo sapiens
acaacaaccuggucaca

SEQ ID NO: 443511 - RNA, 20 nt, Homo sapiens
acaacacccagccagucaca

SEQ ID NO: 443512 - RNA, 17 nt, Homo sapiens
acaacauguauguggau

SEQ ID NO: 443513 - RNA, 20 nt, Homo sapiens
acaacauguauguggauaca

SEQ ID NO: 443514 - RNA, 19 nt, Homo sapiens
acaaccugccacaauguga

SEQ ID NO: 443515 - RNA, 14 nt, Homo sapiens
acaacuccuuccau

SEQ ID NO: 443516 - RNA, 17 nt, Homo sapiens
acaacuguuuuugaaga

SEQ ID NO: 443517 - RNA, 19 nt, Homo sapiens
acaacuucuaauugccaug

SEQ ID NO: 443518 - RNA, 18 nt, Homo sapiens
acaacuuucucuuguaaa

SEQ ID NO: 443519 - RNA, 18 nt, Homo sapiens
acaacuuuggaauuugaa

SEQ ID NO: 443520 - RNA, 14 nt, Homo sapiens
acaagaaccucucc

SEQ ID NO: 443521 - RNA, 12 nt, Homo sapiens
acaagaagccac

SEQ ID NO: 443522 - RNA, 22 nt, Homo sapiens
acaagaagccacagaccuagga

SEQ ID NO: 443523 - RNA, 23 nt, Homo sapiens
acaagaccccugcuccugacuua

SEQ ID NO: 443524 - RNA, 19 nt, Homo sapiens
acaagauccuuaaugcaga

SEQ ID NO: 443525 - RNA, 15 nt, Homo sapiens
acaagcaaaccuucu

SEQ ID NO: 443526 - RNA, 15 nt, Homo sapiens
acaagcaauuacaau

SEQ ID NO: 443527 - RNA, 13 nt, Homo sapiens
acaagcacuuugg

SEQ ID NO: 443528 - RNA, 20 nt, Homo sapiens
acaagcauuccuuagcagcu

SEQ ID NO: 443529 - RNA, 17 nt, Homo sapiens
acaagccaacuuguaaa

SEQ ID NO: 443530 - RNA, 18 nt, Homo sapiens
acaagccugaguccaguu

SEQ ID NO: 443531 - RNA, 16 nt, Homo sapiens
acaagccuuggaccaa

SEQ ID NO: 443532 - RNA, 16 nt, Homo sapiens
acaaggaugacaagaa

SEQ ID NO: 443533 - RNA, 23 nt, Homo sapiens
aucucccuuaauaaacucacaac

SEQ ID NO: 443534 - RNA, 18 nt, Homo sapiens
aucucgaagucuuccauc

SEQ ID NO: 443535 - RNA, 17 nt, Homo sapiens
aucucggcucacugcaa

SEQ ID NO: 443536 - RNA, 19 nt, Homo sapiens
aucucuaaaauucuagucu

SEQ ID NO: 443537 - RNA, 20 nt, Homo sapiens
aucucuaauuccauccauaa

SEQ ID NO: 443538 - RNA, 18 nt, Homo sapiens
aucucuccccauauauaa

SEQ ID NO: 443539 - RNA, 14 nt, Homo sapiens
aucucucuccugua

SEQ ID NO: 443540 - RNA, 20 nt, Homo sapiens
aucucugaagcauguuucau

SEQ ID NO: 443541 - RNA, 15 nt, Homo sapiens
aucucugccuuugag

SEQ ID NO: 443542 - RNA, 20 nt, Homo sapiens
aucucugcugcuucugggcc

SEQ ID NO: 443543 - RNA, 16 nt, Homo sapiens
aucucugcuuacuaau

SEQ ID NO: 443544 - RNA, 15 nt, Homo sapiens
aucucugcuugaguc

SEQ ID NO: 443545 - RNA, 19 nt, Homo sapiens
aucucuugcacucaaagcu

SEQ ID NO: 443546 - RNA, 23 nt, Homo sapiens
aucucuuguauaugaugaucugg

SEQ ID NO: 443547 - RNA, 17 nt, Homo sapiens
aucugaaacacagucau

SEQ ID NO: 443548 - RNA, 15 nt, Homo sapiens
aucugaaacuuccca

SEQ ID NO: 443549 - RNA, 16 nt, Homo sapiens
aucugaggaguccaaa

SEQ ID NO: 443550 - RNA, 16 nt, Homo sapiens
aucugaggcaaucuaa

SEQ ID NO: 443551 - RNA, 18 nt, Homo sapiens
aucugcaguggagccuga

SEQ ID NO: 443552 - RNA, 22 nt, Homo sapiens
aucugcauccagccuccugcua

SEQ ID NO: 443553 - RNA, 17 nt, Homo sapiens
aucugcauuuagcacaa

SEQ ID NO: 443554 - RNA, 20 nt, Homo sapiens
aucugcuagggaauaucaau

SEQ ID NO: 443555 - RNA, 20 nt, Homo sapiens
aucuggaagaagaugggcug

SEQ ID NO: 443556 - RNA, 18 nt, Homo sapiens
aucuggccuaauguucca

SEQ ID NO: 443557 - RNA, 15 nt, Homo sapiens
aucugggcuggcaga

SEQ ID NO: 443558 - RNA, 18 nt, Homo sapiens
aucugguguucuugcuaa

SEQ ID NO: 443559 - RNA, 14 nt, Homo sapiens
aucuguaaauuuaa

SEQ ID NO: 443560 - RNA, 22 nt, Homo sapiens
aucuguccagaggcugcaagga

SEQ ID NO: 443561 - RNA, 15 nt, Homo sapiens
aucugucccacuggg

SEQ ID NO: 443562 - RNA, 16 nt, Homo sapiens
aucugucucuucuaca

SEQ ID NO: 443563 - RNA, 18 nt, Homo sapiens
aucugucuguccuacccg

SEQ ID NO: 443564 - RNA, 19 nt, Homo sapiens
aucugucuugucauuccag

SEQ ID NO: 443565 - RNA, 17 nt, Homo sapiens
aucugucuuuaugauuu

SEQ ID NO: 443566 - RNA, 16 nt, Homo sapiens
aucuguuauccugcua

SEQ ID NO: 443567 - RNA, 18 nt, Homo sapiens
aucuguuugauacaguau

SEQ ID NO: 443568 - RNA, 21 nt, Homo sapiens
aucuguuugaucccuguuacc

SEQ ID NO: 443569 - RNA, 15 nt, Homo sapiens
aucuuaaagcauucc

SEQ ID NO: 443570 - RNA, 17 nt, Homo sapiens
aucuuaagccaagaagu

SEQ ID NO: 443571 - RNA, 19 nt, Homo sapiens
aucuuacagucagcacaga

SEQ ID NO: 443572 - RNA, 16 nt, Homo sapiens
aucuuagcugccaagu

SEQ ID NO: 443573 - RNA, 17 nt, Homo sapiens
aucuuaggauuuaccaa

SEQ ID NO: 443574 - RNA, 21 nt, Homo sapiens
aucuuaggauuuaccaaauag

SEQ ID NO: 443575 - RNA, 14 nt, Homo sapiens
aucuuagugccuga

SEQ ID NO: 443576 - RNA, 13 nt, Homo sapiens
aucuuauguugau

SEQ ID NO: 443577 - RNA, 22 nt, Homo sapiens
aucuucaaacauguacaaaauc

SEQ ID NO: 443578 - RNA, 19 nt, Homo sapiens
aucuucaaacuuucacuuu

SEQ ID NO: 443579 - RNA, 21 nt, Homo sapiens
aucuucaaacuuucacuuuga

SEQ ID NO: 443580 - RNA, 21 nt, Homo sapiens
aucuucaaugaacugugcuuu

SEQ ID NO: 443581 - RNA, 16 nt, Homo sapiens
aucuucacugaauauc

SEQ ID NO: 443582 - RNA, 13 nt, Homo sapiens
aucuucacugcaa

SEQ ID NO: 443583 - RNA, 21 nt, Homo sapiens
aucuucagggcacugcugcug

SEQ ID NO: 443584 - RNA, 15 nt, Homo sapiens
aucuuccccggaugu

SEQ ID NO: 443585 - RNA, 16 nt, Homo sapiens
aucuucucucuugauu

SEQ ID NO: 443586 - RNA, 22 nt, Homo sapiens
aucuucuuuauaauucuacuuu

SEQ ID NO: 443587 - RNA, 15 nt, Homo sapiens
aucuugagagcugcu

SEQ ID NO: 443588 - RNA, 14 nt, Homo sapiens
aucuugcaccccaa

SEQ ID NO: 443589 - RNA, 13 nt, Homo sapiens
aucuugugcucag

SEQ ID NO: 443590 - RNA, 19 nt, Homo sapiens
aucuuugagaauauuauaa

SEQ ID NO: 443591 - RNA, 13 nt, Homo sapiens
aucuuugcuuguu

SEQ ID NO: 443592 - RNA, 22 nt, Homo sapiens
aucuuuuauuucauucauaucc

SEQ ID NO: 443593 - RNA, 15 nt, Homo sapiens
aucuuuucauuuagg

SEQ ID NO: 443594 - RNA, 18 nt, Homo sapiens
augaaaaaauaacacugu

SEQ ID NO: 443595 - RNA, 17 nt, Homo sapiens
augaaacaaauaaucac

SEQ ID NO: 443596 - RNA, 15 nt, Homo sapiens
augaaaccacuggaa

SEQ ID NO: 443597 - RNA, 21 nt, Homo sapiens
augaaaccugugucucugaga

SEQ ID NO: 443598 - RNA, 23 nt, Homo sapiens
augaaacucuuuggaacaacagc

SEQ ID NO: 443599 - RNA, 20 nt, Homo sapiens
augaaauugagucauuuuau

SEQ ID NO: 443600 - RNA, 20 nt, Homo sapiens
augaacccauccaauggauu

SEQ ID NO: 443601 - RNA, 13 nt, Homo sapiens
augaacugugaca

SEQ ID NO: 443602 - RNA, 12 nt, Homo sapiens
augaacuuucuc

SEQ ID NO: 443603 - RNA, 14 nt, Homo sapiens
augaagacaaauag

SEQ ID NO: 443604 - RNA, 14 nt, Homo sapiens
augaagacacucaa

SEQ ID NO: 443605 - RNA, 16 nt, Homo sapiens
augaaggcagagccau

SEQ ID NO: 443606 - RNA, 15 nt, Homo sapiens
augaaggucuaccug

SEQ ID NO: 443607 - RNA, 19 nt, Homo sapiens
augaaggucuaccugaaaa

SEQ ID NO: 443608 - RNA, 22 nt, Homo sapiens
augaaucaaucaauucauaucu

SEQ ID NO: 443609 - RNA, 22 nt, Homo sapiens
augaaucucaagauucaguaga

SEQ ID NO: 443610 - RNA, 17 nt, Homo sapiens
augaaugauguuuuaga

SEQ ID NO: 443611 - RNA, 12 nt, Homo sapiens
augaaugcagug

SEQ ID NO: 443612 - RNA, 15 nt, Homo sapiens
augaauguaugugca

SEQ ID NO: 443613 - RNA, 16 nt, Homo sapiens
augaauguaugugcac

SEQ ID NO: 443614 - RNA, 18 nt, Homo sapiens
augaauucaagaaaggaa

SEQ ID NO: 443615 - RNA, 13 nt, Homo sapiens
augaauuucugcc

SEQ ID NO: 443616 - RNA, 15 nt, Homo sapiens
augaauuugacuggu

SEQ ID NO: 443617 - RNA, 20 nt, Homo sapiens
augacaacuucuaauugcca

SEQ ID NO: 443618 - RNA, 19 nt, Homo sapiens
augacaaugaugaugauaa

SEQ ID NO: 443619 - RNA, 12 nt, Homo sapiens
augacacagucu

SEQ ID NO: 443620 - RNA, 20 nt, Homo sapiens
augaccagguaacaucauca

SEQ ID NO: 443621 - RNA, 14 nt, Homo sapiens
augaccccacaggu

SEQ ID NO: 443622 - RNA, 22 nt, Homo sapiens
augaccccuccccuaaugccug

SEQ ID NO: 443623 - RNA, 21 nt, Homo sapiens
augaccuugaaugaugccaug

SEQ ID NO: 443624 - RNA, 22 nt, Homo sapiens
augaccuuggacaaucaugaaa

SEQ ID NO: 443625 - RNA, 19 nt, Homo sapiens
augaccuugggguacaauu

SEQ ID NO: 443626 - RNA, 23 nt, Homo sapiens
augacgguguccaugccuuccau

SEQ ID NO: 443627 - RNA, 12 nt, Homo sapiens
augacuaaagag

SEQ ID NO: 443628 - RNA, 13 nt, Homo sapiens
augacucacauga

SEQ ID NO: 443629 - RNA, 21 nt, Homo sapiens
augacugagucuggcaaacau

SEQ ID NO: 443630 - RNA, 19 nt, Homo sapiens
augacugcuguacugcaau

SEQ ID NO: 443631 - RNA, 15 nt, Homo sapiens
augagaaaugaugaa

SEQ ID NO: 443632 - RNA, 19 nt, Homo sapiens
augagaacugguucuugcc

SEQ ID NO: 443633 - RNA, 18 nt, Homo sapiens
augagcaaggacaaccug

SEQ ID NO: 443634 - RNA, 20 nt, Homo sapiens
augagcaaggacaaccugcc

SEQ ID NO: 443635 - RNA, 14 nt, Homo sapiens
augagcaccuccag

SEQ ID NO: 443636 - RNA, 24 nt, Homo sapiens
augagcauccucucucacauggaa

SEQ ID NO: 443637 - RNA, 17 nt, Homo sapiens
augagcguuaacacagu

SEQ ID NO: 443638 - RNA, 14 nt, Homo sapiens
augagcuauuucca

SEQ ID NO: 443639 - RNA, 10 nt, Homo sapiens
augagcucug

SEQ ID NO: 443640 - RNA, 17 nt, Homo sapiens
augagcugacaucucag

SEQ ID NO: 443641 - RNA, 16 nt, Homo sapiens
augagggcaugugaua

SEQ ID NO: 443642 - RNA, 17 nt, Homo sapiens
augagggugacugucaa

SEQ ID NO: 443643 - RNA, 22 nt, Homo sapiens
augaggucaauuuccugaugca

SEQ ID NO: 443644 - RNA, 18 nt, Homo sapiens
augagucaaugugcagug

SEQ ID NO: 443645 - RNA, 16 nt, Homo sapiens
augagugaggacuugg

SEQ ID NO: 443646 - RNA, 13 nt, Homo sapiens
augaguggaauac

SEQ ID NO: 443647 - RNA, 17 nt, Homo sapiens
augagugucaacuccag

SEQ ID NO: 443648 - RNA, 21 nt, Homo sapiens
augaguuugccauguugagca

SEQ ID NO: 443649 - RNA, 19 nt, Homo sapiens
augaguuuuacauuacaaa

SEQ ID NO: 443650 - RNA, 15 nt, Homo sapiens
augauaaauuugacu

SEQ ID NO: 443651 - RNA, 17 nt, Homo sapiens
augauauuuuaugcaaa

SEQ ID NO: 443652 - RNA, 17 nt, Homo sapiens
augaucagcuguuuguc

SEQ ID NO: 443653 - RNA, 14 nt, Homo sapiens
augaucauuugccc

SEQ ID NO: 443654 - RNA, 18 nt, Homo sapiens
augauccagggauugggc

SEQ ID NO: 443655 - RNA, 22 nt, Homo sapiens
augaucgcuuucuacacuguau

SEQ ID NO: 443656 - RNA, 21 nt, Homo sapiens
augaucuguggagaauguaca

SEQ ID NO: 443657 - RNA, 12 nt, Homo sapiens
augaucuuggcu

SEQ ID NO: 443658 - RNA, 16 nt, Homo sapiens
augaugauaaugauga

SEQ ID NO: 443659 - RNA, 23 nt, Homo sapiens
augauguacaggcagaugaaacc

SEQ ID NO: 443660 - RNA, 16 nt, Homo sapiens
augauuguaacauauu

SEQ ID NO: 443661 - RNA, 14 nt, Homo sapiens
augauuuaggcuuc

SEQ ID NO: 443662 - RNA, 21 nt, Homo sapiens
augauuucaaaugcuguaacu

SEQ ID NO: 443663 - RNA, 19 nt, Homo sapiens
auuaggggguuuguugcac

SEQ ID NO: 443664 - RNA, 19 nt, Homo sapiens
auuauaagcuaugucacua

SEQ ID NO: 443665 - RNA, 14 nt, Homo sapiens
auuauaaguugacc

SEQ ID NO: 443666 - RNA, 17 nt, Homo sapiens
auuauaauauacuauau

SEQ ID NO: 443667 - RNA, 20 nt, Homo sapiens
auuauauauuccgcacucaa

SEQ ID NO: 443668 - RNA, 23 nt, Homo sapiens
auuauauuugugugaaaauguga

SEQ ID NO: 443669 - RNA, 17 nt, Homo sapiens
auuaucgggaacagugu

SEQ ID NO: 443670 - RNA, 18 nt, Homo sapiens
auuaucgggaacaguguu

SEQ ID NO: 443671 - RNA, 16 nt, Homo sapiens
auuaucugucauucaa

SEQ ID NO: 443672 - RNA, 13 nt, Homo sapiens
auuaugaaccgca

SEQ ID NO: 443673 - RNA, 22 nt, Homo sapiens
auuaugaagugacucucacaag

SEQ ID NO: 443674 - RNA, 14 nt, Homo sapiens
auuaugacaguuau

SEQ ID NO: 443675 - RNA, 16 nt, Homo sapiens
auuaugcaccaccucc

SEQ ID NO: 443676 - RNA, 20 nt, Homo sapiens
auuaugggcgugaaccacca

SEQ ID NO: 443677 - RNA, 13 nt, Homo sapiens
auuauuacuguuc

SEQ ID NO: 443678 - RNA, 18 nt, Homo sapiens
auuauuauucuucauaac

SEQ ID NO: 443679 - RNA, 16 nt, Homo sapiens
auuauuccugcacuca

SEQ ID NO: 443680 - RNA, 15 nt, Homo sapiens
auuauuuacugacau

SEQ ID NO: 443681 - RNA, 15 nt, Homo sapiens
auuauuuuggaucua

SEQ ID NO: 443682 - RNA, 18 nt, Homo sapiens
auuauuuuuccacuuugu

SEQ ID NO: 443683 - RNA, 15 nt, Homo sapiens
auucaaaaaaauccu

SEQ ID NO: 443684 - RNA, 14 nt, Homo sapiens
auucaaaagaucaa

SEQ ID NO: 443685 - RNA, 16 nt, Homo sapiens
auucaaaagcacaaac

SEQ ID NO: 443686 - RNA, 22 nt, Homo sapiens
auucaaagaaucaccuaauuaa

SEQ ID NO: 443687 - RNA, 14 nt, Homo sapiens
auucaaaugcaaaa

SEQ ID NO: 443688 - RNA, 17 nt, Homo sapiens
auucaagcaaacaucaa

SEQ ID NO: 443689 - RNA, 21 nt, Homo sapiens
auucaaggagaauaugauaaa

SEQ ID NO: 443690 - RNA, 21 nt, Homo sapiens
auucaaggaggaaagaagaag

SEQ ID NO: 443691 - RNA, 19 nt, Homo sapiens
auucaagucaccuccuuaa

SEQ ID NO: 443692 - RNA, 15 nt, Homo sapiens
auucaaguguaccug

SEQ ID NO: 443693 - RNA, 21 nt, Homo sapiens
auucaaguugcuucucaugga

SEQ ID NO: 443694 - RNA, 22 nt, Homo sapiens
auucaaguugcuucucauggau

SEQ ID NO: 443695 - RNA, 17 nt, Homo sapiens
auucacaaaauuuccac

SEQ ID NO: 443696 - RNA, 20 nt, Homo sapiens
auucaccuguaaaacuuuau

SEQ ID NO: 443697 - RNA, 20 nt, Homo sapiens
auucacgugcagcagcaaca

SEQ ID NO: 443698 - RNA, 20 nt, Homo sapiens
auucagaaaagaugugcaga

SEQ ID NO: 443699 - RNA, 14 nt, Homo sapiens
auucagaacuugua

SEQ ID NO: 443700 - RNA, 17 nt, Homo sapiens
auucagaauaaaugggu

SEQ ID NO: 443701 - RNA, 18 nt, Homo sapiens
auucagagaauagcaguu

SEQ ID NO: 443702 - RNA, 20 nt, Homo sapiens
auucagauggcaauuucacu

SEQ ID NO: 443703 - RNA, 19 nt, Homo sapiens
auucagcauuauuccucca

SEQ ID NO: 443704 - RNA, 16 nt, Homo sapiens
auucaggcacaugugu

SEQ ID NO: 443705 - RNA, 15 nt, Homo sapiens
auucauaaaaauaac

SEQ ID NO: 443706 - RNA, 13 nt, Homo sapiens
auucauaauaugu

SEQ ID NO: 443707 - RNA, 19 nt, Homo sapiens
auucauaaugacuuaagca

SEQ ID NO: 443708 - RNA, 22 nt, Homo sapiens
auucauaccuguuguacacuug

SEQ ID NO: 443709 - RNA, 13 nt, Homo sapiens
auucauauuccug

SEQ ID NO: 443710 - RNA, 19 nt, Homo sapiens
auucaucaaacucuuugcc

SEQ ID NO: 443711 - RNA, 13 nt, Homo sapiens
auucaugcugcuu

SEQ ID NO: 443712 - RNA, 23 nt, Homo sapiens
auucaugucucuacccacuaugc

SEQ ID NO: 443713 - RNA, 22 nt, Homo sapiens
auucaugugggcauuucuugcg

SEQ ID NO: 443714 - RNA, 22 nt, Homo sapiens
auucauuauuuuuccacuuugu

SEQ ID NO: 443715 - RNA, 20 nt, Homo sapiens
auucauuuuuuucacuggag

SEQ ID NO: 443716 - RNA, 16 nt, Homo sapiens
auuccaccuucccaug

SEQ ID NO: 443717 - RNA, 16 nt, Homo sapiens
auuccagaugcaugau

SEQ ID NO: 443718 - RNA, 22 nt, Homo sapiens
auuccaggguugaaucuugucc

SEQ ID NO: 443719 - RNA, 17 nt, Homo sapiens
auuccauuuacuugauc

SEQ ID NO: 443720 - RNA, 19 nt, Homo sapiens
auucccaagccaaaaaccu

SEQ ID NO: 443721 - RNA, 20 nt, Homo sapiens
auucccaugguagacuguga

SEQ ID NO: 443722 - RNA, 17 nt, Homo sapiens
auucccggcuggacuuu

SEQ ID NO: 443723 - RNA, 21 nt, Homo sapiens
auucccuuuuuaaaugagcuu

SEQ ID NO: 443724 - RNA, 22 nt, Homo sapiens
auuccgaaaaaaaaauguucau

SEQ ID NO: 443725 - RNA, 20 nt, Homo sapiens
auuccuaagcagugcuugua

SEQ ID NO: 443726 - RNA, 22 nt, Homo sapiens
auuccucuugccucucucagga

SEQ ID NO: 443727 - RNA, 17 nt, Homo sapiens
auuccugcuuaauguca

SEQ ID NO: 443728 - RNA, 22 nt, Homo sapiens
auuccuguuucugaaccauuac

SEQ ID NO: 443729 - RNA, 15 nt, Homo sapiens
auuccuuagucucaa

SEQ ID NO: 443730 - RNA, 17 nt, Homo sapiens
auuccuucuaaguguac

SEQ ID NO: 443731 - RNA, 23 nt, Homo sapiens
auuccuugucaccagcaacaucu

SEQ ID NO: 443732 - RNA, 22 nt, Homo sapiens
auucguccuuagaauacuguau

SEQ ID NO: 443733 - RNA, 20 nt, Homo sapiens
auucgugcauuuuuggauca

SEQ ID NO: 443734 - RNA, 16 nt, Homo sapiens
auucuaaaggcuugau

SEQ ID NO: 443735 - RNA, 14 nt, Homo sapiens
auucuaaaggggac

SEQ ID NO: 443736 - RNA, 16 nt, Homo sapiens
auucuaagauuguaca

SEQ ID NO: 443737 - RNA, 22 nt, Homo sapiens
auucuaauaaauauacuaugaa

SEQ ID NO: 443738 - RNA, 20 nt, Homo sapiens
auucuaaugucuucauuuca

SEQ ID NO: 443739 - RNA, 13 nt, Homo sapiens
auucuacacacag

SEQ ID NO: 443740 - RNA, 14 nt, Homo sapiens
auucuacccugaaa

SEQ ID NO: 443741 - RNA, 20 nt, Homo sapiens
auucuaccgugguacacagu

SEQ ID NO: 443742 - RNA, 18 nt, Homo sapiens
auucuaccugaggccagg

SEQ ID NO: 443743 - RNA, 20 nt, Homo sapiens
auucuagucucugauuugca

SEQ ID NO: 443744 - RNA, 16 nt, Homo sapiens
auucuaguuuugucaa

SEQ ID NO: 443745 - RNA, 20 nt, Homo sapiens
auucuaugccuguauuucca

SEQ ID NO: 443746 - RNA, 13 nt, Homo sapiens
auucucaauacuu

SEQ ID NO: 443747 - RNA, 17 nt, Homo sapiens
auucucaguauccacug

SEQ ID NO: 443748 - RNA, 17 nt, Homo sapiens
auucucagugcucuccu

SEQ ID NO: 443749 - RNA, 15 nt, Homo sapiens
auucuccaacccaaa

SEQ ID NO: 443750 - RNA, 15 nt, Homo sapiens
auucucugcaauuug

SEQ ID NO: 443751 - RNA, 18 nt, Homo sapiens
auucucuucgcugugaug

SEQ ID NO: 443752 - RNA, 19 nt, Homo sapiens
auucucuuguuauugcauc

SEQ ID NO: 443753 - RNA, 17 nt, Homo sapiens
auucugcuuucuugcca

SEQ ID NO: 443754 - RNA, 22 nt, Homo sapiens
auucugcuuucuugccacacag

SEQ ID NO: 443755 - RNA, 21 nt, Homo sapiens
auucugggaaaggugcucaaa

SEQ ID NO: 443756 - RNA, 21 nt, Homo sapiens
auucugggcuccuggaaccaa

SEQ ID NO: 443757 - RNA, 16 nt, Homo sapiens
auucuguuacacaaua

SEQ ID NO: 443758 - RNA, 19 nt, Homo sapiens
auucuuaugauuacuauca

SEQ ID NO: 443759 - RNA, 14 nt, Homo sapiens
auucuucaauuuga

SEQ ID NO: 443760 - RNA, 19 nt, Homo sapiens
auucuucuucuuuuaugua

SEQ ID NO: 443761 - RNA, 16 nt, Homo sapiens
auucuugaaguucaug

SEQ ID NO: 443762 - RNA, 15 nt, Homo sapiens
auucuugucacaaua

SEQ ID NO: 443763 - RNA, 19 nt, Homo sapiens
auucuuuacaaacugaaga

SEQ ID NO: 443764 - RNA, 13 nt, Homo sapiens
auucuuuccccag

SEQ ID NO: 443765 - RNA, 14 nt, Homo sapiens
auucuuuguuacag

SEQ ID NO: 443766 - RNA, 20 nt, Homo sapiens
auugaaaaaaauuggcauua

SEQ ID NO: 443767 - RNA, 13 nt, Homo sapiens
auugaaaaaccau

SEQ ID NO: 443768 - RNA, 18 nt, Homo sapiens
auugaaaaccucuuucca

SEQ ID NO: 443769 - RNA, 17 nt, Homo sapiens
auugaaagaaccagaga

SEQ ID NO: 443770 - RNA, 19 nt, Homo sapiens
auugaaagggaguauuaca

SEQ ID NO: 443771 - RNA, 18 nt, Homo sapiens
auugaacuuucacauagc

SEQ ID NO: 443772 - RNA, 22 nt, Homo sapiens
auugaacuuucacauagcacag

SEQ ID NO: 443773 - RNA, 15 nt, Homo sapiens
auugaagacccucaa

SEQ ID NO: 443774 - RNA, 20 nt, Homo sapiens
auugaagacccucaaugcca

SEQ ID NO: 443775 - RNA, 15 nt, Homo sapiens
auugaagcccuccaa

SEQ ID NO: 443776 - RNA, 23 nt, Homo sapiens
auugaagcccuccaaaagcacuu

SEQ ID NO: 443777 - RNA, 12 nt, Homo sapiens
auugaaguaaug

SEQ ID NO: 443778 - RNA, 19 nt, Homo sapiens
auugaaucugauuggacau

SEQ ID NO: 443779 - RNA, 22 nt, Homo sapiens
auugaaugaugugauacaaauu

SEQ ID NO: 443780 - RNA, 13 nt, Homo sapiens
auugaauguggua

SEQ ID NO: 443781 - RNA, 19 nt, Homo sapiens
auugacgacaagugcugaa

SEQ ID NO: 443782 - RNA, 15 nt, Homo sapiens
auugagacacuguca

SEQ ID NO: 443783 - RNA, 18 nt, Homo sapiens
auugagaucagcauucaa

SEQ ID NO: 443784 - RNA, 16 nt, Homo sapiens
auugagucauugucag

SEQ ID NO: 443785 - RNA, 20 nt, Homo sapiens
auugauauugaaugauguga

SEQ ID NO: 443786 - RNA, 22 nt, Homo sapiens
auugaugaaugaggaacaauca

SEQ ID NO: 443787 - RNA, 19 nt, Homo sapiens
auugauugaaucauugccu

SEQ ID NO: 443788 - RNA, 17 nt, Homo sapiens
auugauuuucuuucuaa

SEQ ID NO: 443789 - RNA, 13 nt, Homo sapiens
auugcacuagaga

SEQ ID NO: 443790 - RNA, 14 nt, Homo sapiens
auugcagaacauga

SEQ ID NO: 443791 - RNA, 17 nt, Homo sapiens
auugcaugaaagacaga

SEQ ID NO: 443792 - RNA, 12 nt, Homo sapiens
ccuguagacugu

SEQ ID NO: 443793 - RNA, 13 nt, Homo sapiens
ccuguagucccag

SEQ ID NO: 443794 - RNA, 15 nt, Homo sapiens
ccuguauggcacugg

SEQ ID NO: 443795 - RNA, 16 nt, Homo sapiens
ccuguccuaagcacuu

SEQ ID NO: 443796 - RNA, 19 nt, Homo sapiens
ccuguccuaagcacuuuau

SEQ ID NO: 443797 - RNA, 15 nt, Homo sapiens
ccugucucuacaaaa

SEQ ID NO: 443798 - RNA, 14 nt, Homo sapiens
ccugugaccagcac

SEQ ID NO: 443799 - RNA, 13 nt, Homo sapiens
ccugugagggagu

SEQ ID NO: 443800 - RNA, 11 nt, Homo sapiens
ccugugcagca

SEQ ID NO: 443801 - RNA, 21 nt, Homo sapiens
ccugugcccacccgucuucaa

SEQ ID NO: 443802 - RNA, 22 nt, Homo sapiens
ccugugcccacccgucuucaau

SEQ ID NO: 443803 - RNA, 15 nt, Homo sapiens
ccugugcuaccucua

SEQ ID NO: 443804 - RNA, 19 nt, Homo sapiens
ccuguggauaacauugcua

SEQ ID NO: 443805 - RNA, 22 nt, Homo sapiens
ccuguggcccucgcucugccuc

SEQ ID NO: 443806 - RNA, 15 nt, Homo sapiens
ccuguggccuugccc

SEQ ID NO: 443807 - RNA, 15 nt, Homo sapiens
ccuguggugaagugu

SEQ ID NO: 443808 - RNA, 23 nt, Homo sapiens
ccuguggugaugugccuguaauc

SEQ ID NO: 443809 - RNA, 19 nt, Homo sapiens
ccugugguuacagugcaga

SEQ ID NO: 443810 - RNA, 17 nt, Homo sapiens
ccuguguauucuaguga

SEQ ID NO: 443811 - RNA, 13 nt, Homo sapiens
ccugugucagggc

SEQ ID NO: 443812 - RNA, 16 nt, Homo sapiens
ccugugucagggcaca

SEQ ID NO: 443813 - RNA, 17 nt, Homo sapiens
ccuguguccagcagcug

SEQ ID NO: 443814 - RNA, 22 nt, Homo sapiens
ccuguuacugaauuugcuaaua

SEQ ID NO: 443815 - RNA, 22 nt, Homo sapiens
ccuguucauuguaagcacuuuu

SEQ ID NO: 443816 - RNA, 13 nt, Homo sapiens
ccuguucccauga

SEQ ID NO: 443817 - RNA, 14 nt, Homo sapiens
ccuguuccugccac

SEQ ID NO: 443818 - RNA, 15 nt, Homo sapiens
ccuguuccugccaca

SEQ ID NO: 443819 - RNA, 10 nt, Homo sapiens
ccuguucuca

SEQ ID NO: 443820 - RNA, 18 nt, Homo sapiens
ccuguucucagcauccac

SEQ ID NO: 443821 - RNA, 22 nt, Homo sapiens
ccuguucugggugcagcugaga

SEQ ID NO: 443822 - RNA, 19 nt, Homo sapiens
ccuguucugugucugcugu

SEQ ID NO: 443823 - RNA, 21 nt, Homo sapiens
ccuguucuguuuugccugaag

SEQ ID NO: 443824 - RNA, 23 nt, Homo sapiens
ccuguucuuguuacggcagucac

SEQ ID NO: 443825 - RNA, 12 nt, Homo sapiens
ccuguugcccuu

SEQ ID NO: 443826 - RNA, 22 nt, Homo sapiens
ccuguuucugaaccauuacugu

SEQ ID NO: 443827 - RNA, 23 nt, Homo sapiens
ccuuaaaugaaaaaaaugaucua

SEQ ID NO: 443828 - RNA, 20 nt, Homo sapiens
ccuuaacucaucuguuaucc

SEQ ID NO: 443829 - RNA, 15 nt, Homo sapiens
ccuuaagaaagcuau

SEQ ID NO: 443830 - RNA, 15 nt, Homo sapiens
ccuuaauaaacucac

SEQ ID NO: 443831 - RNA, 18 nt, Homo sapiens
ccuuaauucuuaccucau

SEQ ID NO: 443832 - RNA, 23 nt, Homo sapiens
ccuuacauuauuacuccuugcca

SEQ ID NO: 443833 - RNA, 16 nt, Homo sapiens
ccuuagaauacuguau

SEQ ID NO: 443834 - RNA, 21 nt, Homo sapiens
ccuuauaaacagauaaugcuu

SEQ ID NO: 443835 - RNA, 17 nt, Homo sapiens
ccuuaugguacacucca

SEQ ID NO: 443836 - RNA, 16 nt, Homo sapiens
ccuuauucuacauuuc

SEQ ID NO: 443837 - RNA, 14 nt, Homo sapiens
ccuuauuguaccuc

SEQ ID NO: 443838 - RNA, 16 nt, Homo sapiens
ccuuauuguaccucuc

SEQ ID NO: 443839 - RNA, 21 nt, Homo sapiens
ccuuauuguaccucucuuaua

SEQ ID NO: 443840 - RNA, 15 nt, Homo sapiens
ccuucaauacuuaaa

SEQ ID NO: 443841 - RNA, 23 nt, Homo sapiens
ccuucaaugcaaaauacaugaug

SEQ ID NO: 443842 - RNA, 18 nt, Homo sapiens
ccuucacgcuggcuucca

SEQ ID NO: 443843 - RNA, 18 nt, Homo sapiens
ccuucagaaaagacacuu

SEQ ID NO: 443844 - RNA, 22 nt, Homo sapiens
ccuucagugccaaaaacaacaa

SEQ ID NO: 443845 - RNA, 12 nt, Homo sapiens
ccuucccagugg

SEQ ID NO: 443846 - RNA, 23 nt, Homo sapiens
ccuuccccucacacuccuaaaau

SEQ ID NO: 443847 - RNA, 23 nt, Homo sapiens
ccuuccggugcgugugaagccac

SEQ ID NO: 443848 - RNA, 19 nt, Homo sapiens
ccuuccugcuguccuucuc

SEQ ID NO: 443849 - RNA, 21 nt, Homo sapiens
ccuuccugcuguccuucuccg

SEQ ID NO: 443850 - RNA, 22 nt, Homo sapiens
ccuuccugggcagcccagagag

SEQ ID NO: 443851 - RNA, 15 nt, Homo sapiens
ccuuccugucuggcc

SEQ ID NO: 443852 - RNA, 20 nt, Homo sapiens
ccuuccuucuugcuucucau

SEQ ID NO: 443853 - RNA, 14 nt, Homo sapiens
ccuucgguuuguau

SEQ ID NO: 443854 - RNA, 16 nt, Homo sapiens
ccuucuaauccaugug

SEQ ID NO: 443855 - RNA, 16 nt, Homo sapiens
ccuucuccacagggac

SEQ ID NO: 443856 - RNA, 16 nt, Homo sapiens
ccuucucccacacugc

SEQ ID NO: 443857 - RNA, 15 nt, Homo sapiens
ccuucucugcuccac

SEQ ID NO: 443858 - RNA, 19 nt, Homo sapiens
ccuucugacggcccugcaa

SEQ ID NO: 443859 - RNA, 19 nt, Homo sapiens
ccuucugauaagacuggaa

SEQ ID NO: 443860 - RNA, 14 nt, Homo sapiens
ccuucuguggcuca

SEQ ID NO: 443861 - RNA, 15 nt, Homo sapiens
ccuucuugcuucuca

SEQ ID NO: 443862 - RNA, 11 nt, Homo sapiens
ccuugaaccag

SEQ ID NO: 443863 - RNA, 19 nt, Homo sapiens
ccuugaagacauaucaugu

SEQ ID NO: 443864 - RNA, 23 nt, Homo sapiens
ccuugacugaagcgaacaucuuc

SEQ ID NO: 443865 - RNA, 11 nt, Homo sapiens
ccuugagaaac

SEQ ID NO: 443866 - RNA, 17 nt, Homo sapiens
ccuugaucccaauccuu

SEQ ID NO: 443867 - RNA, 22 nt, Homo sapiens
ccuugauuuaucacacaaagca

SEQ ID NO: 443868 - RNA, 21 nt, Homo sapiens
ccuugcauuuuagcuaauuua

SEQ ID NO: 443869 - RNA, 14 nt, Homo sapiens
ccuugcccaacucc

SEQ ID NO: 443870 - RNA, 20 nt, Homo sapiens
ccuugcccagacuacagggc

SEQ ID NO: 443871 - RNA, 15 nt, Homo sapiens
ccuugccuccucacc

SEQ ID NO: 443872 - RNA, 16 nt, Homo sapiens
ccuugcucagugccuc

SEQ ID NO: 443873 - RNA, 23 nt, Homo sapiens
ccuugcuuucucuucuaauggaa

SEQ ID NO: 443874 - RNA, 23 nt, Homo sapiens
ccuuggaauuggaauuacuguaa

SEQ ID NO: 443875 - RNA, 23 nt, Homo sapiens
ccuuggccucccaaagugcuagu

SEQ ID NO: 443876 - RNA, 16 nt, Homo sapiens
ccuugggaugggcaca

SEQ ID NO: 443877 - RNA, 16 nt, Homo sapiens
ccuugggcaguucuca

SEQ ID NO: 443878 - RNA, 21 nt, Homo sapiens
ccuugggccuuucagucccaa

SEQ ID NO: 443879 - RNA, 16 nt, Homo sapiens
ccuugggcugcuccuc

SEQ ID NO: 443880 - RNA, 17 nt, Homo sapiens
ccuugguuuuaccugua

SEQ ID NO: 443881 - RNA, 20 nt, Homo sapiens
ccuugucucuuccucugcag

SEQ ID NO: 443882 - RNA, 21 nt, Homo sapiens
ccuuguguacaguuauuuaug

SEQ ID NO: 443883 - RNA, 18 nt, Homo sapiens
ccuuguguccacugugac

SEQ ID NO: 443884 - RNA, 21 nt, Homo sapiens
ccuuguucuauugcacaggcu

SEQ ID NO: 443885 - RNA, 23 nt, Homo sapiens
ccuuuaucaaaaaaagacucagc

SEQ ID NO: 443886 - RNA, 22 nt, Homo sapiens
ccuuucacuuuagaggcuugau

SEQ ID NO: 443887 - RNA, 20 nt, Homo sapiens
ccuuuccccggaguaccuau

SEQ ID NO: 443888 - RNA, 13 nt, Homo sapiens
ccuuuccugcaaa

SEQ ID NO: 443889 - RNA, 19 nt, Homo sapiens
ccuuuccuuccaucccuac

SEQ ID NO: 443890 - RNA, 17 nt, Homo sapiens
ccuuucgagcucugcag

SEQ ID NO: 443891 - RNA, 14 nt, Homo sapiens
ccuuucuaguucaa

SEQ ID NO: 443892 - RNA, 21 nt, Homo sapiens
ccuuugagcccacaaagccuu

SEQ ID NO: 443893 - RNA, 22 nt, Homo sapiens
ccuuuggagggagggcugaccc

SEQ ID NO: 443894 - RNA, 14 nt, Homo sapiens
ccuuugucaucauu

SEQ ID NO: 443895 - RNA, 23 nt, Homo sapiens
ccuuuguuucggugcccuguguc

SEQ ID NO: 443896 - RNA, 14 nt, Homo sapiens
ccuuuuaaaacacu

SEQ ID NO: 443897 - RNA, 14 nt, Homo sapiens
ccuuuuauguguug

SEQ ID NO: 443898 - RNA, 23 nt, Homo sapiens
ccuuuuauuuuuuaagguaacaa

SEQ ID NO: 443899 - RNA, 16 nt, Homo sapiens
ccuuuucucauucugu

SEQ ID NO: 443900 - RNA, 14 nt, Homo sapiens
ccuuuugugugaug

SEQ ID NO: 443901 - RNA, 19 nt, Homo sapiens
ccuuuuuuuaaaauucacc

SEQ ID NO: 443902 - RNA, 15 nt, Homo sapiens
cgaaaaggauaugca

SEQ ID NO: 443903 - RNA, 19 nt, Homo sapiens
cgaaacacagaacucagcc

SEQ ID NO: 443904 - RNA, 18 nt, Homo sapiens
cgaacauggcaugugaaa

SEQ ID NO: 443905 - RNA, 14 nt, Homo sapiens
cgaacugugcaguu

SEQ ID NO: 443906 - RNA, 23 nt, Homo sapiens
cgaauuuucacagccaugauucu

SEQ ID NO: 443907 - RNA, 13 nt, Homo sapiens
cgaccccaucuca

SEQ ID NO: 443908 - RNA, 14 nt, Homo sapiens
cgaccccaucucau

SEQ ID NO: 443909 - RNA, 15 nt, Homo sapiens
cgacuggcugugaga

SEQ ID NO: 443910 - RNA, 12 nt, Homo sapiens
cgagacuccauc

SEQ ID NO: 443911 - RNA, 19 nt, Homo sapiens
cgagauagcaccauugcac

SEQ ID NO: 443912 - RNA, 15 nt, Homo sapiens
cgagauuccgucuca

SEQ ID NO: 443913 - RNA, 14 nt, Homo sapiens
cgagcauguuguuu

SEQ ID NO: 443914 - RNA, 21 nt, Homo sapiens
cgagccagcucugggggcucc

SEQ ID NO: 443915 - RNA, 21 nt, Homo sapiens
cgagcccuuagccuugcugua

SEQ ID NO: 443916 - RNA, 19 nt, Homo sapiens
cgagcugggggccaugagc

SEQ ID NO: 443917 - RNA, 14 nt, Homo sapiens
cgaggaaaagaaca

SEQ ID NO: 443918 - RNA, 21 nt, Homo sapiens
cgaggcaaagagaaaagccac

SEQ ID NO: 443919 - RNA, 18 nt, Homo sapiens
cgaggcaaugacugugag

SEQ ID NO: 443920 - RNA, 18 nt, Homo sapiens
cgaggcaggggcucugcu

SEQ ID NO: 443921 - RNA, 19 nt, Homo sapiens
cucaucuguuauccugcua

SEQ ID NO: 443922 - RNA, 21 nt, Homo sapiens
cucaugugcuuuguagcuuaa

SEQ ID NO: 443923 - RNA, 17 nt, Homo sapiens
cucauguucuuaacuuu

SEQ ID NO: 443924 - RNA, 13 nt, Homo sapiens
cucauguuugugc

SEQ ID NO: 443925 - RNA, 13 nt, Homo sapiens
cuccaaaugagau

SEQ ID NO: 443926 - RNA, 18 nt, Homo sapiens
cuccaagccugccuccca

SEQ ID NO: 443927 - RNA, 19 nt, Homo sapiens
cuccaaggcaaauguccaa

SEQ ID NO: 443928 - RNA, 13 nt, Homo sapiens
cuccacaguguug

SEQ ID NO: 443929 - RNA, 14 nt, Homo sapiens
cuccaccacauccu

SEQ ID NO: 443930 - RNA, 17 nt, Homo sapiens
cuccaccagugugcuug

SEQ ID NO: 443931 - RNA, 21 nt, Homo sapiens
cuccacgaagccuuaagccau

SEQ ID NO: 443932 - RNA, 11 nt, Homo sapiens
cuccacuaaua

SEQ ID NO: 443933 - RNA, 16 nt, Homo sapiens
cuccacuccaccucca

SEQ ID NO: 443934 - RNA, 20 nt, Homo sapiens
cuccacugaaagaaguggga

SEQ ID NO: 443935 - RNA, 17 nt, Homo sapiens
cuccagaggaugacugg

SEQ ID NO: 443936 - RNA, 22 nt, Homo sapiens
cuccagccagcaaugaugucca

SEQ ID NO: 443937 - RNA, 22 nt, Homo sapiens
cuccagccugggcaacagagca

SEQ ID NO: 443938 - RNA, 16 nt, Homo sapiens
cuccagggcaucacau

SEQ ID NO: 443939 - RNA, 17 nt, Homo sapiens
cuccaguauucuuguca

SEQ ID NO: 443940 - RNA, 17 nt, Homo sapiens
cuccagucuguucucac

SEQ ID NO: 443941 - RNA, 16 nt, Homo sapiens
cuccaguucugaugag

SEQ ID NO: 443942 - RNA, 20 nt, Homo sapiens
cuccauaauugcaagggaag

SEQ ID NO: 443943 - RNA, 21 nt, Homo sapiens
cuccaugcuccucaccugucu

SEQ ID NO: 443944 - RNA, 16 nt, Homo sapiens
cuccauguuugaugua

SEQ ID NO: 443945 - RNA, 22 nt, Homo sapiens
cuccauuuucuugucaauggaa

SEQ ID NO: 443946 - RNA, 16 nt, Homo sapiens
cucccaacccauucac

SEQ ID NO: 443947 - RNA, 14 nt, Homo sapiens
cucccaagguccuc

SEQ ID NO: 443948 - RNA, 20 nt, Homo sapiens
cucccaaguaggugggauua

SEQ ID NO: 443949 - RNA, 18 nt, Homo sapiens
cucccaaguccaguguga

SEQ ID NO: 443950 - RNA, 18 nt, Homo sapiens
cucccaaguuuugaaagg

SEQ ID NO: 443951 - RNA, 18 nt, Homo sapiens
cucccaccagagacuggg

SEQ ID NO: 443952 - RNA, 13 nt, Homo sapiens
cucccagacugca

SEQ ID NO: 443953 - RNA, 13 nt, Homo sapiens
cucccagggccau

SEQ ID NO: 443954 - RNA, 16 nt, Homo sapiens
cuccccacacuaaccu

SEQ ID NO: 443955 - RNA, 18 nt, Homo sapiens
cuccccacaguccucaca

SEQ ID NO: 443956 - RNA, 20 nt, Homo sapiens
cuccccagacuccaccguca

SEQ ID NO: 443957 - RNA, 17 nt, Homo sapiens
cuccccugcccuggucc

SEQ ID NO: 443958 - RNA, 18 nt, Homo sapiens
cuccccugcccuggucca

SEQ ID NO: 443959 - RNA, 15 nt, Homo sapiens
cucccuccaccuccu

SEQ ID NO: 443960 - RNA, 17 nt, Homo sapiens
cucccuccucagucuuu

SEQ ID NO: 443961 - RNA, 20 nt, Homo sapiens
cucccucucugcaccugucu

SEQ ID NO: 443962 - RNA, 12 nt, Homo sapiens
cucccugccaac

SEQ ID NO: 443963 - RNA, 12 nt, Homo sapiens
cucccugccacc

SEQ ID NO: 443964 - RNA, 15 nt, Homo sapiens
cucccugccaccagg

SEQ ID NO: 443965 - RNA, 22 nt, Homo sapiens
cucccuggacucuguggggcca

SEQ ID NO: 443966 - RNA, 21 nt, Homo sapiens
cucccuggccuguucuguuuu

SEQ ID NO: 443967 - RNA, 16 nt, Homo sapiens
cucccugggccugucu

SEQ ID NO: 443968 - RNA, 22 nt, Homo sapiens
cucccugguuuuaccccagcuc

SEQ ID NO: 443969 - RNA, 15 nt, Homo sapiens
cucccuuggauuuuu

SEQ ID NO: 443970 - RNA, 17 nt, Homo sapiens
cucccuuggguucugau

SEQ ID NO: 443971 - RNA, 22 nt, Homo sapiens
cucccuuuuaaaaggagcacau

SEQ ID NO: 443972 - RNA, 23 nt, Homo sapiens
cuccgaugcccgcccggggaguu

SEQ ID NO: 443973 - RNA, 15 nt, Homo sapiens
cuccguguagugucu

SEQ ID NO: 443974 - RNA, 20 nt, Homo sapiens
cuccguucccaccucugagg

SEQ ID NO: 443975 - RNA, 22 nt, Homo sapiens
cuccuaccccuguccuggggcu

SEQ ID NO: 443976 - RNA, 14 nt, Homo sapiens
cuccuaccugguca

SEQ ID NO: 443977 - RNA, 20 nt, Homo sapiens
cuccuagaggugggcagcug

SEQ ID NO: 443978 - RNA, 22 nt, Homo sapiens
cuccuaucuuuuauuucauuca

SEQ ID NO: 443979 - RNA, 19 nt, Homo sapiens
cuccucccaacucuagccu

SEQ ID NO: 443980 - RNA, 22 nt, Homo sapiens
cuccuccccuccccucacuucu

SEQ ID NO: 443981 - RNA, 18 nt, Homo sapiens
cuccucucugggccuuug

SEQ ID NO: 443982 - RNA, 13 nt, Homo sapiens
cuccucugagcag

SEQ ID NO: 443983 - RNA, 19 nt, Homo sapiens
cuccucuggggaagggaac

SEQ ID NO: 443984 - RNA, 22 nt, Homo sapiens
cuccucuucagaggagaaagaa

SEQ ID NO: 443985 - RNA, 14 nt, Homo sapiens
cuccucuuccugua

SEQ ID NO: 443986 - RNA, 14 nt, Homo sapiens
cuccucuugccacu

SEQ ID NO: 443987 - RNA, 20 nt, Homo sapiens
cuccucuuuuuuuaaaaaua

SEQ ID NO: 443988 - RNA, 13 nt, Homo sapiens
cuccugacagcaa

SEQ ID NO: 443989 - RNA, 16 nt, Homo sapiens
cuccugacccugugau

SEQ ID NO: 443990 - RNA, 20 nt, Homo sapiens
cuccugaccucaaguaaucc

SEQ ID NO: 443991 - RNA, 18 nt, Homo sapiens
cuccugagcgaugacuca

SEQ ID NO: 443992 - RNA, 17 nt, Homo sapiens
cuccugaggucuggauu

SEQ ID NO: 443993 - RNA, 16 nt, Homo sapiens
cuccuggacuguagga

SEQ ID NO: 443994 - RNA, 19 nt, Homo sapiens
cuccuggaggcccugguca

SEQ ID NO: 443995 - RNA, 21 nt, Homo sapiens
cuccugggcucaagcagucua

SEQ ID NO: 443996 - RNA, 22 nt, Homo sapiens
cuccuguguggaguuauucacu

SEQ ID NO: 443997 - RNA, 13 nt, Homo sapiens
cuccugugugugg

SEQ ID NO: 443998 - RNA, 23 nt, Homo sapiens
cuccuguugccacacuuucacug

SEQ ID NO: 443999 - RNA, 16 nt, Homo sapiens
cuccuuaauaugaucu

SEQ ID NO: 444000 - RNA, 16 nt, Homo sapiens
cuccuuccaccucccu

SEQ ID NO: 444001 - RNA, 15 nt, Homo sapiens
cuccuucccauuucu

SEQ ID NO: 444002 - RNA, 22 nt, Homo sapiens
cuccuucccauuucucuacacu

SEQ ID NO: 444003 - RNA, 23 nt, Homo sapiens
cuccuugaguuuuccugcugcga

SEQ ID NO: 444004 - RNA, 21 nt, Homo sapiens
cuccuugcccagacuacaggg

SEQ ID NO: 444005 - RNA, 22 nt, Homo sapiens
cuccuuggauguagucaguuag

SEQ ID NO: 444006 - RNA, 24 nt, Homo sapiens
cuccuuuugcuguuuggauguuuc

SEQ ID NO: 444007 - RNA, 22 nt, Homo sapiens
cuccuuuuugccauuucacuua

SEQ ID NO: 444008 - RNA, 22 nt, Homo sapiens
cucgaacccacacugcaacagg

SEQ ID NO: 444009 - RNA, 16 nt, Homo sapiens
cucgagcaguccugcc

SEQ ID NO: 444010 - RNA, 16 nt, Homo sapiens
cucgaguuacagacaa

SEQ ID NO: 444011 - RNA, 13 nt, Homo sapiens
cucgcacucuggu

SEQ ID NO: 444012 - RNA, 14 nt, Homo sapiens
cucgcacucuggug

SEQ ID NO: 444013 - RNA, 17 nt, Homo sapiens
cucgccuaggccuguga

SEQ ID NO: 444014 - RNA, 18 nt, Homo sapiens
cucgcugugccaccaccc

SEQ ID NO: 444015 - RNA, 17 nt, Homo sapiens
cucgcuucauaggcaga

SEQ ID NO: 444016 - RNA, 17 nt, Homo sapiens
cucgcuuuguugcccag

SEQ ID NO: 444017 - RNA, 21 nt, Homo sapiens
cucgggaaacuuagaucauca

SEQ ID NO: 444018 - RNA, 18 nt, Homo sapiens
cucgucuuucgcacauuc

SEQ ID NO: 444019 - RNA, 18 nt, Homo sapiens
cucuaaaacagcacuauc

SEQ ID NO: 444020 - RNA, 16 nt, Homo sapiens
cucuaaaauucuaguc

SEQ ID NO: 444021 - RNA, 20 nt, Homo sapiens
cucuaauagaaguccaugag

SEQ ID NO: 444022 - RNA, 16 nt, Homo sapiens
cucuaccaagacauaa

SEQ ID NO: 444023 - RNA, 13 nt, Homo sapiens
cucuacgccaaag

SEQ ID NO: 444024 - RNA, 20 nt, Homo sapiens
cucuacuaaaaauacaaaaa

SEQ ID NO: 444025 - RNA, 13 nt, Homo sapiens
cucuagaacagcc

SEQ ID NO: 444026 - RNA, 20 nt, Homo sapiens
cucuagccugggccagagaa

SEQ ID NO: 444027 - RNA, 19 nt, Homo sapiens
cucuaggccuguugccucg

SEQ ID NO: 444028 - RNA, 20 nt, Homo sapiens
cucuaucauguugaagucaa

SEQ ID NO: 444029 - RNA, 21 nt, Homo sapiens
cucuauuuguaauugaacuua

SEQ ID NO: 444030 - RNA, 22 nt, Homo sapiens
cucuauuuugugaugaugcugu

SEQ ID NO: 444031 - RNA, 17 nt, Homo sapiens
cucuauuuuuuacuaca

SEQ ID NO: 444032 - RNA, 22 nt, Homo sapiens
cucucaagacggagaugcaugg

SEQ ID NO: 444033 - RNA, 14 nt, Homo sapiens
cucucaccuccuaa

SEQ ID NO: 444034 - RNA, 13 nt, Homo sapiens
cucuccacugaaa

SEQ ID NO: 444035 - RNA, 11 nt, Homo sapiens
cucuccagaag

SEQ ID NO: 444036 - RNA, 13 nt, Homo sapiens
cucuccaucauag

SEQ ID NO: 444037 - RNA, 18 nt, Homo sapiens
cucucccaaguccagugu

SEQ ID NO: 444038 - RNA, 20 nt, Homo sapiens
cucucccaccccggccucca

SEQ ID NO: 444039 - RNA, 14 nt, Homo sapiens
cucuccucuugcca

SEQ ID NO: 444040 - RNA, 11 nt, Homo sapiens
cucucucaugu

SEQ ID NO: 444041 - RNA, 12 nt, Homo sapiens
cucucuccuuau

SEQ ID NO: 444042 - RNA, 18 nt, Homo sapiens
cucucuggacuuucucca

SEQ ID NO: 444043 - RNA, 22 nt, Homo sapiens
cucucuuuuuggaggugcuuaa

SEQ ID NO: 444044 - RNA, 20 nt, Homo sapiens
cucugaacaggacaccuguu

SEQ ID NO: 444045 - RNA, 16 nt, Homo sapiens
cucugaaccagagaaa

SEQ ID NO: 444046 - RNA, 16 nt, Homo sapiens
cucugaagcauguuuc

SEQ ID NO: 444047 - RNA, 18 nt, Homo sapiens
cucugacgcaaaaccacu

SEQ ID NO: 444048 - RNA, 16 nt, Homo sapiens
cucugacucccaaaga

SEQ ID NO: 444049 - RNA, 17 nt, Homo sapiens
cucugaggcuauggagg

SEQ ID NO: 444050 - RNA, 16 nt, Homo sapiens
cucugauauacaauua

SEQ ID NO: 444051 - RNA, 15 nt, Homo sapiens
cugagggcauuaaaa

SEQ ID NO: 444052 - RNA, 20 nt, Homo sapiens
cugaggggauaucccuaugu

SEQ ID NO: 444053 - RNA, 16 nt, Homo sapiens
cugaguaguaaucuca

SEQ ID NO: 444054 - RNA, 21 nt, Homo sapiens
cugaguagucauuuugcccau

SEQ ID NO: 444055 - RNA, 14 nt, Homo sapiens
cugagucaccuccu

SEQ ID NO: 444056 - RNA, 18 nt, Homo sapiens
cugagucccagcaauucu

SEQ ID NO: 444057 - RNA, 20 nt, Homo sapiens
cugaguggaaugcagggaag

SEQ ID NO: 444058 - RNA, 15 nt, Homo sapiens
cugaguggugccaaa

SEQ ID NO: 444059 - RNA, 16 nt, Homo sapiens
cugaguggugccaaac

SEQ ID NO: 444060 - RNA, 18 nt, Homo sapiens
cugaguucucauccacag

SEQ ID NO: 444061 - RNA, 12 nt, Homo sapiens
cugaguuugugg

SEQ ID NO: 444062 - RNA, 21 nt, Homo sapiens
cugauaaacauuaaacacugu

SEQ ID NO: 444063 - RNA, 20 nt, Homo sapiens
cugauacaauuugcccaagg

SEQ ID NO: 444064 - RNA, 23 nt, Homo sapiens
cugauacaauuugcccaagguaa

SEQ ID NO: 444065 - RNA, 24 nt, Homo sapiens
cugauacagccuuacaauacaaua

SEQ ID NO: 444066 - RNA, 16 nt, Homo sapiens
cugauagucaccugcu

SEQ ID NO: 444067 - RNA, 20 nt, Homo sapiens
cugauauacuugagugugca

SEQ ID NO: 444068 - RNA, 22 nt, Homo sapiens
cugauauacuugagugugcaag

SEQ ID NO: 444069 - RNA, 15 nt, Homo sapiens
cugaucaaagcaccu

SEQ ID NO: 444070 - RNA, 17 nt, Homo sapiens
cugauccagagcacaga

SEQ ID NO: 444071 - RNA, 15 nt, Homo sapiens
cugauccuuguggca

SEQ ID NO: 444072 - RNA, 20 nt, Homo sapiens
cugaucgugcuaaauuuuca

SEQ ID NO: 444073 - RNA, 13 nt, Homo sapiens
cugaucuauacaa

SEQ ID NO: 444074 - RNA, 18 nt, Homo sapiens
cugaugaaggcaugccua

SEQ ID NO: 444075 - RNA, 16 nt, Homo sapiens
cugaugagaauacuga

SEQ ID NO: 444076 - RNA, 14 nt, Homo sapiens
cugauggaccagga

SEQ ID NO: 444077 - RNA, 13 nt, Homo sapiens
cugauggccaagg

SEQ ID NO: 444078 - RNA, 15 nt, Homo sapiens
cugauguacuuuaaa

SEQ ID NO: 444079 - RNA, 17 nt, Homo sapiens
cugauguuaaaauucca

SEQ ID NO: 444080 - RNA, 18 nt, Homo sapiens
cugauguuaaaauuccau

SEQ ID NO: 444081 - RNA, 20 nt, Homo sapiens
cugauuagaaaugaccaaua

SEQ ID NO: 444082 - RNA, 18 nt, Homo sapiens
cugauuauuuaucacaua

SEQ ID NO: 444083 - RNA, 13 nt, Homo sapiens
cugauugucuuag

SEQ ID NO: 444084 - RNA, 18 nt, Homo sapiens
cugauuuaaacuucuuaa

SEQ ID NO: 444085 - RNA, 17 nt, Homo sapiens
cugauuucuacaacuga

SEQ ID NO: 444086 - RNA, 13 nt, Homo sapiens
cugauuucuugcu

SEQ ID NO: 444087 - RNA, 21 nt, Homo sapiens
cugcaaaaccggcaaccugua

SEQ ID NO: 444088 - RNA, 19 nt, Homo sapiens
cugcaaauacuuccaaaga

SEQ ID NO: 444089 - RNA, 19 nt, Homo sapiens
cugcaaggauucagcauua

SEQ ID NO: 444090 - RNA, 22 nt, Homo sapiens
cugcaauacauuaaaauaacua

SEQ ID NO: 444091 - RNA, 21 nt, Homo sapiens
cugcacaaagcccuuccaugu

SEQ ID NO: 444092 - RNA, 11 nt, Homo sapiens
cugcacaggga

SEQ ID NO: 444093 - RNA, 12 nt, Homo sapiens
cugcacauuccu

SEQ ID NO: 444094 - RNA, 13 nt, Homo sapiens
cugcacauuccug

SEQ ID NO: 444095 - RNA, 20 nt, Homo sapiens
cugcaccagugugacaucua

SEQ ID NO: 444096 - RNA, 17 nt, Homo sapiens
cugcacccacccaggag

SEQ ID NO: 444097 - RNA, 19 nt, Homo sapiens
cugcaccccauguggguga

SEQ ID NO: 444098 - RNA, 13 nt, Homo sapiens
cugcaccgagaga

SEQ ID NO: 444099 - RNA, 24 nt, Homo sapiens
cugcaccgagagagauggaauaaa

SEQ ID NO: 444100 - RNA, 11 nt, Homo sapiens
cugcaccugcg

SEQ ID NO: 444101 - RNA, 13 nt, Homo sapiens
cugcacuccauga

SEQ ID NO: 444102 - RNA, 15 nt, Homo sapiens
cugcacuccaugagu

SEQ ID NO: 444103 - RNA, 21 nt, Homo sapiens
cugcacuccaugagugcagcu

SEQ ID NO: 444104 - RNA, 16 nt, Homo sapiens
cugcacuccauggcca

SEQ ID NO: 444105 - RNA, 14 nt, Homo sapiens
cugcacuguaaaau

SEQ ID NO: 444106 - RNA, 13 nt, Homo sapiens
cugcagaauccag

SEQ ID NO: 444107 - RNA, 16 nt, Homo sapiens
cugcagacucauccuu

SEQ ID NO: 444108 - RNA, 15 nt, Homo sapiens
cugcagagacuucua

SEQ ID NO: 444109 - RNA, 15 nt, Homo sapiens
cugcagagcaggaaa

SEQ ID NO: 444110 - RNA, 18 nt, Homo sapiens
cugcagcagagccuggaa

SEQ ID NO: 444111 - RNA, 21 nt, Homo sapiens
cugcagccccuccuccucggg

SEQ ID NO: 444112 - RNA, 21 nt, Homo sapiens
cugcagcgagccccccaugua

SEQ ID NO: 444113 - RNA, 22 nt, Homo sapiens
cugcagcgccacccaguggaag

SEQ ID NO: 444114 - RNA, 19 nt, Homo sapiens
cugcagcggcacaaaugca

SEQ ID NO: 444115 - RNA, 16 nt, Homo sapiens
cugcaggccaccagcu

SEQ ID NO: 444116 - RNA, 17 nt, Homo sapiens
cugcagucaucuacuuu

SEQ ID NO: 444117 - RNA, 15 nt, Homo sapiens
cugcaucaagaugug

SEQ ID NO: 444118 - RNA, 18 nt, Homo sapiens
cugcaucaagaugugaca

SEQ ID NO: 444119 - RNA, 23 nt, Homo sapiens
cugcaucuccccucagauuccac

SEQ ID NO: 444120 - RNA, 15 nt, Homo sapiens
cugcaucugugaaaa

SEQ ID NO: 444121 - RNA, 23 nt, Homo sapiens
cugcaugaagguuuucuuuagaa

SEQ ID NO: 444122 - RNA, 21 nt, Homo sapiens
cugcauggacgccuggcucca

SEQ ID NO: 444123 - RNA, 15 nt, Homo sapiens
cugcauuacauuccu

SEQ ID NO: 444124 - RNA, 14 nt, Homo sapiens
cugcauuacuauua

SEQ ID NO: 444125 - RNA, 15 nt, Homo sapiens
cugcauuuucugggu

SEQ ID NO: 444126 - RNA, 15 nt, Homo sapiens
cugccaaaaagaaca

SEQ ID NO: 444127 - RNA, 20 nt, Homo sapiens
cugccaaaaagaacacccau

SEQ ID NO: 444128 - RNA, 22 nt, Homo sapiens
cugccaaccagcuuguccaaca

SEQ ID NO: 444129 - RNA, 22 nt, Homo sapiens
cugccaacuccaugaccaggcc

SEQ ID NO: 444130 - RNA, 18 nt, Homo sapiens
cugccaaguccugccuuu

SEQ ID NO: 444131 - RNA, 14 nt, Homo sapiens
cugccacaauguga

SEQ ID NO: 444132 - RNA, 20 nt, Homo sapiens
cugccaccaggcacugccug

SEQ ID NO: 444133 - RNA, 14 nt, Homo sapiens
cugccagacugaag

SEQ ID NO: 444134 - RNA, 13 nt, Homo sapiens
cugccagggagcu

SEQ ID NO: 444135 - RNA, 15 nt, Homo sapiens
cugccagugucuuag

SEQ ID NO: 444136 - RNA, 13 nt, Homo sapiens
cugccauaacaua

SEQ ID NO: 444137 - RNA, 14 nt, Homo sapiens
cugccauccucacc

SEQ ID NO: 444138 - RNA, 14 nt, Homo sapiens
cugcccaauaugca

SEQ ID NO: 444139 - RNA, 22 nt, Homo sapiens
cugcccacaagccauaaaccaa

SEQ ID NO: 444140 - RNA, 14 nt, Homo sapiens
cugcccacaccacc

SEQ ID NO: 444141 - RNA, 21 nt, Homo sapiens
cugcccagaccccucuggcca

SEQ ID NO: 444142 - RNA, 19 nt, Homo sapiens
cugcccagagcugggugag

SEQ ID NO: 444143 - RNA, 18 nt, Homo sapiens
cugcccagccucagcuga

SEQ ID NO: 444144 - RNA, 21 nt, Homo sapiens
cugccccaaacaaauaugcaa

SEQ ID NO: 444145 - RNA, 19 nt, Homo sapiens
cugccccacggcccuguca

SEQ ID NO: 444146 - RNA, 21 nt, Homo sapiens
cugcccccguuccagcugaca

SEQ ID NO: 444147 - RNA, 19 nt, Homo sapiens
cugcccgaccccaucucau

SEQ ID NO: 444148 - RNA, 15 nt, Homo sapiens
cugcccgacucaggu

SEQ ID NO: 444149 - RNA, 23 nt, Homo sapiens
cugcccgaggagcccugccugcc

SEQ ID NO: 444150 - RNA, 18 nt, Homo sapiens
cugcccgggagggcuucc

SEQ ID NO: 444151 - RNA, 21 nt, Homo sapiens
cugcccuccccagagcacugg

SEQ ID NO: 444152 - RNA, 18 nt, Homo sapiens
cugcccugguccagggaa

SEQ ID NO: 444153 - RNA, 21 nt, Homo sapiens
cugccggcucuuuccuugcuc

SEQ ID NO: 444154 - RNA, 19 nt, Homo sapiens
cugccuaaaauaugauguu

SEQ ID NO: 444155 - RNA, 15 nt, Homo sapiens
cugccucacaucucc

SEQ ID NO: 444156 - RNA, 14 nt, Homo sapiens
cugccucagccucc

SEQ ID NO: 444157 - RNA, 17 nt, Homo sapiens
cugccuccaccgagcca

SEQ ID NO: 444158 - RNA, 23 nt, Homo sapiens
cugccuccagaauggucuuucua

SEQ ID NO: 444159 - RNA, 21 nt, Homo sapiens
cugccucugccacugacugca

SEQ ID NO: 444160 - RNA, 20 nt, Homo sapiens
cugccucuggaauugcucaa

SEQ ID NO: 444161 - RNA, 13 nt, Homo sapiens
cugccucugggag

SEQ ID NO: 444162 - RNA, 14 nt, Homo sapiens
cugccugagcccag

SEQ ID NO: 444163 - RNA, 20 nt, Homo sapiens
cugccuggauuucuuccuau

SEQ ID NO: 444164 - RNA, 22 nt, Homo sapiens
cugccugguaugaguugcccau

SEQ ID NO: 444165 - RNA, 22 nt, Homo sapiens
cugccugugcaugaccugauca

SEQ ID NO: 444166 - RNA, 18 nt, Homo sapiens
cugccuuaucuugcaccc

SEQ ID NO: 444167 - RNA, 16 nt, Homo sapiens
cugccuuggacugugu

SEQ ID NO: 444168 - RNA, 15 nt, Homo sapiens
cugccuuucuuccau

SEQ ID NO: 444169 - RNA, 17 nt, Homo sapiens
cugcggcuccccugugu

SEQ ID NO: 444170 - RNA, 21 nt, Homo sapiens
cugcggugaggcaggggaguc

SEQ ID NO: 444171 - RNA, 16 nt, Homo sapiens
cugcgucugacauccu

SEQ ID NO: 444172 - RNA, 12 nt, Homo sapiens
cugcgugccauc

SEQ ID NO: 444173 - RNA, 14 nt, Homo sapiens
cugcuagucuguca

SEQ ID NO: 444174 - RNA, 16 nt, Homo sapiens
cugcucaagaagacau

SEQ ID NO: 444175 - RNA, 16 nt, Homo sapiens
cugcucacauucccuc

SEQ ID NO: 444176 - RNA, 18 nt, Homo sapiens
cugcuccacgaagccuua

SEQ ID NO: 444177 - RNA, 18 nt, Homo sapiens
cugcuccauuuuucauca

SEQ ID NO: 444178 - RNA, 19 nt, Homo sapiens
cugcuccuuggccuaguca

SEQ ID NO: 444179 - RNA, 24 nt, Homo sapiens
cugcucuauauuacaaguugugca

SEQ ID NO: 444180 - RNA, 18 nt, Homo sapiens
cugcucugcaagcccacu

SEQ ID NO: 444181 - RNA, 21 nt, Homo sapiens
ggcuuaccuguacacugacuu

SEQ ID NO: 444182 - RNA, 13 nt, Homo sapiens
ggcuuaucuagcc

SEQ ID NO: 444183 - RNA, 20 nt, Homo sapiens
ggcuuccgagggcacuaccg

SEQ ID NO: 444184 - RNA, 21 nt, Homo sapiens
ggcuugggguagagaggacag

SEQ ID NO: 444185 - RNA, 13 nt, Homo sapiens
ggcuuugcaggga

SEQ ID NO: 444186 - RNA, 19 nt, Homo sapiens
ggcuuugucccacagcuug

SEQ ID NO: 444187 - RNA, 16 nt, Homo sapiens
ggcuuuucccuugcuu

SEQ ID NO: 444188 - RNA, 22 nt, Homo sapiens
gggaaacuuagaucaucaguca

SEQ ID NO: 444189 - RNA, 14 nt, Homo sapiens
gggaaagaaaggga

SEQ ID NO: 444190 - RNA, 23 nt, Homo sapiens
gggaaauggcuugaagccaaguc

SEQ ID NO: 444191 - RNA, 17 nt, Homo sapiens
gggaaauucacacugug

SEQ ID NO: 444192 - RNA, 21 nt, Homo sapiens
gggaaauucugcugcuugaaa

SEQ ID NO: 444193 - RNA, 12 nt, Homo sapiens
gggaaauugcuu

SEQ ID NO: 444194 - RNA, 14 nt, Homo sapiens
gggaaccauccccg

SEQ ID NO: 444195 - RNA, 20 nt, Homo sapiens
gggaacugggaagaugcugg

SEQ ID NO: 444196 - RNA, 21 nt, Homo sapiens
gggaagaccagcuuugcagug

SEQ ID NO: 444197 - RNA, 23 nt, Homo sapiens
gggaagcaguguguacuucuuca

SEQ ID NO: 444198 - RNA, 17 nt, Homo sapiens
gggaagccccacuugaa

SEQ ID NO: 444199 - RNA, 23 nt, Homo sapiens
gggaagcuggcuuucuggcugcu

SEQ ID NO: 444200 - RNA, 16 nt, Homo sapiens
gggaaggagugugcaa

SEQ ID NO: 444201 - RNA, 16 nt, Homo sapiens
gggaaggccugaggga

SEQ ID NO: 444202 - RNA, 19 nt, Homo sapiens
gggaaggggugggagccaa

SEQ ID NO: 444203 - RNA, 16 nt, Homo sapiens
gggacagaucugauuu

SEQ ID NO: 444204 - RNA, 14 nt, Homo sapiens
gggacagcccacug

SEQ ID NO: 444205 - RNA, 22 nt, Homo sapiens
gggaccaauauuaccaucuuaa

SEQ ID NO: 444206 - RNA, 16 nt, Homo sapiens
gggacugagagacagg

SEQ ID NO: 444207 - RNA, 15 nt, Homo sapiens
gggacugaugucauc

SEQ ID NO: 444208 - RNA, 15 nt, Homo sapiens
gggacugcaugcaag

SEQ ID NO: 444209 - RNA, 14 nt, Homo sapiens
gggacuuggcagua

SEQ ID NO: 444210 - RNA, 20 nt, Homo sapiens
gggagaaacgaaaaccacaa

SEQ ID NO: 444211 - RNA, 22 nt, Homo sapiens
gggagaaccucguugacaugca

SEQ ID NO: 444212 - RNA, 17 nt, Homo sapiens
gggagacccugggagag

SEQ ID NO: 444213 - RNA, 23 nt, Homo sapiens
gggagaccgaguguggagcugcu

SEQ ID NO: 444214 - RNA, 18 nt, Homo sapiens
gggagauuaaaaccagag

SEQ ID NO: 444215 - RNA, 20 nt, Homo sapiens
gggagauuggcuuugccuuu

SEQ ID NO: 444216 - RNA, 22 nt, Homo sapiens
gggagcaugggacugugccuuu

SEQ ID NO: 444217 - RNA, 13 nt, Homo sapiens
gggaggaacaaag

SEQ ID NO: 444218 - RNA, 13 nt, Homo sapiens
gggaggagccuug

SEQ ID NO: 444219 - RNA, 17 nt, Homo sapiens
gggaggccaagugcagg

SEQ ID NO: 444220 - RNA, 16 nt, Homo sapiens
gggagucagagcccug

SEQ ID NO: 444221 - RNA, 14 nt, Homo sapiens
gggauaagccagcu

SEQ ID NO: 444222 - RNA, 22 nt, Homo sapiens
gggauguucagcacugucccuu

SEQ ID NO: 444223 - RNA, 23 nt, Homo sapiens
gggauuacagacaugaaccacca

SEQ ID NO: 444224 - RNA, 15 nt, Homo sapiens
gggauucaggcugcu

SEQ ID NO: 444225 - RNA, 18 nt, Homo sapiens
gggauugaagcccuccaa

SEQ ID NO: 444226 - RNA, 15 nt, Homo sapiens
gggauuugaaccagg

SEQ ID NO: 444227 - RNA, 23 nt, Homo sapiens
gggauuuuuggcuacacacaaac

SEQ ID NO: 444228 - RNA, 17 nt, Homo sapiens
gggcaacgacgguuuca

SEQ ID NO: 444229 - RNA, 19 nt, Homo sapiens
gggcaagagggaaggugac

SEQ ID NO: 444230 - RNA, 21 nt, Homo sapiens
gggcaccaagaccccaaaggg

SEQ ID NO: 444231 - RNA, 23 nt, Homo sapiens
gggcacgagagagucuuccaggu

SEQ ID NO: 444232 - RNA, 21 nt, Homo sapiens
gggcacggcuucccaggggaa

SEQ ID NO: 444233 - RNA, 18 nt, Homo sapiens
gggcacugaggaccagcc

SEQ ID NO: 444234 - RNA, 15 nt, Homo sapiens
gggcagggguuccca

SEQ ID NO: 444235 - RNA, 13 nt, Homo sapiens
gggcagucaccug

SEQ ID NO: 444236 - RNA, 20 nt, Homo sapiens
gggcaguuguugcuucuuaa

SEQ ID NO: 444237 - RNA, 14 nt, Homo sapiens
gggcauuguaguua

SEQ ID NO: 444238 - RNA, 23 nt, Homo sapiens
gggccaagccaggguuccagaca

SEQ ID NO: 444239 - RNA, 21 nt, Homo sapiens
gggccacugcuugaagaagaa

SEQ ID NO: 444240 - RNA, 13 nt, Homo sapiens
gggccacuggcau

SEQ ID NO: 444241 - RNA, 16 nt, Homo sapiens
gggccccaaagcccag

SEQ ID NO: 444242 - RNA, 19 nt, Homo sapiens
gggccccacucagggaucu

SEQ ID NO: 444243 - RNA, 19 nt, Homo sapiens
gggccgccuccuccagacu

SEQ ID NO: 444244 - RNA, 18 nt, Homo sapiens
gggccgcucgaugccuuu

SEQ ID NO: 444245 - RNA, 16 nt, Homo sapiens
gggccucccaccagag

SEQ ID NO: 444246 - RNA, 17 nt, Homo sapiens
gggccugauggugcuca

SEQ ID NO: 444247 - RNA, 20 nt, Homo sapiens
gggccugcaggccccagcca

SEQ ID NO: 444248 - RNA, 21 nt, Homo sapiens
gggccuggggauguaaccaag

SEQ ID NO: 444249 - RNA, 15 nt, Homo sapiens
gggccuggggcuccu

SEQ ID NO: 444250 - RNA, 23 nt, Homo sapiens
gggccuugucucuuccucugcag

SEQ ID NO: 444251 - RNA, 21 nt, Homo sapiens
gggcgugaaccaccaugccca

SEQ ID NO: 444252 - RNA, 18 nt, Homo sapiens
gggcuaggggacaucaga

SEQ ID NO: 444253 - RNA, 16 nt, Homo sapiens
gggcuagugacuugug

SEQ ID NO: 444254 - RNA, 20 nt, Homo sapiens
gggcuuuuccaaaagcaaac

SEQ ID NO: 444255 - RNA, 16 nt, Homo sapiens
ggggacugcaugcaag

SEQ ID NO: 444256 - RNA, 13 nt, Homo sapiens
ggggagaauggcu

SEQ ID NO: 444257 - RNA, 21 nt, Homo sapiens
ggggcaaggugggggagccug

SEQ ID NO: 444258 - RNA, 17 nt, Homo sapiens
ggggcagcgcagccucc

SEQ ID NO: 444259 - RNA, 16 nt, Homo sapiens
ggggcauguggccaag

SEQ ID NO: 444260 - RNA, 11 nt, Homo sapiens
ggggcucagaa

SEQ ID NO: 444261 - RNA, 10 nt, Homo sapiens
ggggcuuccu

SEQ ID NO: 444262 - RNA, 13 nt, Homo sapiens
gggggcaagagcu

SEQ ID NO: 444263 - RNA, 14 nt, Homo sapiens
gggggccgugccuc

SEQ ID NO: 444264 - RNA, 16 nt, Homo sapiens
gggguacuacucucca

SEQ ID NO: 444265 - RNA, 18 nt, Homo sapiens
gggguauaaaacuuuccu

SEQ ID NO: 444266 - RNA, 21 nt, Homo sapiens
gggguauuuuaggcagggauu

SEQ ID NO: 444267 - RNA, 16 nt, Homo sapiens
ggggucugcucugugc

SEQ ID NO: 444268 - RNA, 14 nt, Homo sapiens
ggggugcagcagug

SEQ ID NO: 444269 - RNA, 14 nt, Homo sapiens
ggguagacuuggag

SEQ ID NO: 444270 - RNA, 21 nt, Homo sapiens
ggguaugucuuuaucaaagga

SEQ ID NO: 444271 - RNA, 15 nt, Homo sapiens
ggguauguguugcca

SEQ ID NO: 444272 - RNA, 21 nt, Homo sapiens
gggucaaagccgguugcagag

SEQ ID NO: 444273 - RNA, 15 nt, Homo sapiens
gggucgugguggaga

SEQ ID NO: 444274 - RNA, 20 nt, Homo sapiens
gggucucaccauguugccca

SEQ ID NO: 444275 - RNA, 16 nt, Homo sapiens
gggucuuugaacccuu

SEQ ID NO: 444276 - RNA, 16 nt, Homo sapiens
gggugaagcuggggac

SEQ ID NO: 444277 - RNA, 20 nt, Homo sapiens
gggugaggggccaggccaug

SEQ ID NO: 444278 - RNA, 18 nt, Homo sapiens
gggugcgcucaccugcag

SEQ ID NO: 444279 - RNA, 20 nt, Homo sapiens
ggguggacgagggagugucu

SEQ ID NO: 444280 - RNA, 11 nt, Homo sapiens
gggugugcugu

SEQ ID NO: 444281 - RNA, 14 nt, Homo sapiens
ggguuacuuucaca

SEQ ID NO: 444282 - RNA, 18 nt, Homo sapiens
ggguuucaccauguuggc

SEQ ID NO: 444283 - RNA, 12 nt, Homo sapiens
ggguuuugcucu

SEQ ID NO: 444284 - RNA, 15 nt, Homo sapiens
gguaagggggugcag

SEQ ID NO: 444285 - RNA, 20 nt, Homo sapiens
gguaaugaugauucaaucau

SEQ ID NO: 444286 - RNA, 21 nt, Homo sapiens
gguaauggaggccaagccugc

SEQ ID NO: 444287 - RNA, 13 nt, Homo sapiens
gguacagcagggu

SEQ ID NO: 444288 - RNA, 20 nt, Homo sapiens
gguacuauuuagauauaaca

SEQ ID NO: 444289 - RNA, 18 nt, Homo sapiens
gguagagagaaacagcuu

SEQ ID NO: 444290 - RNA, 24 nt, Homo sapiens
gguagaggugugugccuagugaug

SEQ ID NO: 444291 - RNA, 17 nt, Homo sapiens
gguagaguccuaggaca

SEQ ID NO: 444292 - RNA, 20 nt, Homo sapiens
gguagcuauacucaugguca

SEQ ID NO: 444293 - RNA, 19 nt, Homo sapiens
gguaguacuccugcaaaau

SEQ ID NO: 444294 - RNA, 20 nt, Homo sapiens
gguaguacuccugcaaaauu

SEQ ID NO: 444295 - RNA, 13 nt, Homo sapiens
gguaguacuggga

SEQ ID NO: 444296 - RNA, 14 nt, Homo sapiens
gguauaaaaccuaa

SEQ ID NO: 444297 - RNA, 23 nt, Homo sapiens
gguaugcuugaaaguagcaauua

SEQ ID NO: 444298 - RNA, 18 nt, Homo sapiens
gguauuucuuauuugaaa

SEQ ID NO: 444299 - RNA, 14 nt, Homo sapiens
ggucaagcccagga

SEQ ID NO: 444300 - RNA, 18 nt, Homo sapiens
ggucacauagcugggauu

SEQ ID NO: 444301 - RNA, 23 nt, Homo sapiens
ggucaccuuccugggcagcccag

SEQ ID NO: 444302 - RNA, 16 nt, Homo sapiens
ggucaucccggggcca

SEQ ID NO: 444303 - RNA, 15 nt, Homo sapiens
gguccaggaaggcag

SEQ ID NO: 444304 - RNA, 15 nt, Homo sapiens
ggucguccaagcaaa

SEQ ID NO: 444305 - RNA, 16 nt, Homo sapiens
ggucucaaacuccuga

SEQ ID NO: 444306 - RNA, 22 nt, Homo sapiens
ggucuccaccccucaagccagg

SEQ ID NO: 444307 - RNA, 18 nt, Homo sapiens
ggucuccauuuuucccag

SEQ ID NO: 444308 - RNA, 23 nt, Homo sapiens
ggucuguuuucugugcacuguag

SEQ ID NO: 444309 - RNA, 16 nt, Homo sapiens
ggucuuauuuguaaag

SEQ ID NO: 444310 - RNA, 14 nt, Homo sapiens
guagcacacugagu

SEQ ID NO: 444311 - RNA, 18 nt, Homo sapiens
guagccacucucugccca

SEQ ID NO: 444312 - RNA, 20 nt, Homo sapiens
guagcuaagugaaaagguca

SEQ ID NO: 444313 - RNA, 19 nt, Homo sapiens
guagcugggauuacaggug

SEQ ID NO: 444314 - RNA, 22 nt, Homo sapiens
guagcuuuuuaccguucacuuc

SEQ ID NO: 444315 - RNA, 13 nt, Homo sapiens
guagggaugccuu

SEQ ID NO: 444316 - RNA, 17 nt, Homo sapiens
guagggcuuggugaaug

SEQ ID NO: 444317 - RNA, 13 nt, Homo sapiens
guagguaagggcc

SEQ ID NO: 444318 - RNA, 14 nt, Homo sapiens
guaggugauguuuc

SEQ ID NO: 444319 - RNA, 16 nt, Homo sapiens
guaggugggucuugga

SEQ ID NO: 444320 - RNA, 17 nt, Homo sapiens
guaggugugacuugaac

SEQ ID NO: 444321 - RNA, 23 nt, Homo sapiens
guagguuuuuuauagcuauuaaa

SEQ ID NO: 444322 - RNA, 21 nt, Homo sapiens
guaguagaaucucagcacuuu

SEQ ID NO: 444323 - RNA, 21 nt, Homo sapiens
guagucacuuuggagcuuuag

SEQ ID NO: 444324 - RNA, 16 nt, Homo sapiens
guagucauucuuacaa

SEQ ID NO: 444325 - RNA, 15 nt, Homo sapiens
guauaaacuaucagu

SEQ ID NO: 444326 - RNA, 14 nt, Homo sapiens
guauaaagccauua

SEQ ID NO: 444327 - RNA, 13 nt, Homo sapiens
guauaaaugaagu

SEQ ID NO: 444328 - RNA, 15 nt, Homo sapiens
guauaacuuauucac

SEQ ID NO: 444329 - RNA, 18 nt, Homo sapiens
guauaaggaaauaucaua

SEQ ID NO: 444330 - RNA, 15 nt, Homo sapiens
guauacccacugcau

SEQ ID NO: 444331 - RNA, 13 nt, Homo sapiens
guauacuaaugcc

SEQ ID NO: 444332 - RNA, 22 nt, Homo sapiens
guauaggccaucuguaaauauc

SEQ ID NO: 444333 - RNA, 17 nt, Homo sapiens
guauauaguaugaaugc

SEQ ID NO: 444334 - RNA, 19 nt, Homo sapiens
guauauauaguagcauuuc

SEQ ID NO: 444335 - RNA, 19 nt, Homo sapiens
guauauauuuacaugucuu

SEQ ID NO: 444336 - RNA, 15 nt, Homo sapiens
guauaucuuugcacu

SEQ ID NO: 444337 - RNA, 20 nt, Homo sapiens
guauauugauguaacugugu

SEQ ID NO: 444338 - RNA, 19 nt, Homo sapiens
guauauuuauuucuagcaa

SEQ ID NO: 444339 - RNA, 17 nt, Homo sapiens
guauauuugguacugua

SEQ ID NO: 444340 - RNA, 24 nt, Homo sapiens
guaucacagacuggcaacaagaag

SEQ ID NO: 444341 - RNA, 18 nt, Homo sapiens
guaucucggaccuuucag

SEQ ID NO: 444342 - RNA, 15 nt, Homo sapiens
guaugaaugcagugg

SEQ ID NO: 444343 - RNA, 14 nt, Homo sapiens
guaugacuaaagag

SEQ ID NO: 444344 - RNA, 23 nt, Homo sapiens
guaugccucauuuuauucuguca

SEQ ID NO: 444345 - RNA, 21 nt, Homo sapiens
guaugcugauuuacuacuuau

SEQ ID NO: 444346 - RNA, 11 nt, Homo sapiens
guauggaagaa

SEQ ID NO: 444347 - RNA, 19 nt, Homo sapiens
guauuaagauggucauauu

SEQ ID NO: 444348 - RNA, 14 nt, Homo sapiens
guauuacacuguau

SEQ ID NO: 444349 - RNA, 20 nt, Homo sapiens
guauuaccuggucauuucaa

SEQ ID NO: 444350 - RNA, 17 nt, Homo sapiens
guauuacuaauuuccau

SEQ ID NO: 444351 - RNA, 20 nt, Homo sapiens
guauuaggugucauuuccau

SEQ ID NO: 444352 - RNA, 20 nt, Homo sapiens
guauucacgugcagcagcaa

SEQ ID NO: 444353 - RNA, 12 nt, Homo sapiens
guauucuaugua

SEQ ID NO: 444354 - RNA, 16 nt, Homo sapiens
guauugaaaacuucaa

SEQ ID NO: 444355 - RNA, 18 nt, Homo sapiens
guauugagacacugucaa

SEQ ID NO: 444356 - RNA, 17 nt, Homo sapiens
guauugauugaaaaaag

SEQ ID NO: 444357 - RNA, 20 nt, Homo sapiens
guauuguuuuccagugucac

SEQ ID NO: 444358 - RNA, 14 nt, Homo sapiens
guauuuagugucuu

SEQ ID NO: 444359 - RNA, 16 nt, Homo sapiens
guauuuagugucuuga

SEQ ID NO: 444360 - RNA, 21 nt, Homo sapiens
guauuucauugcugugucaca

SEQ ID NO: 444361 - RNA, 13 nt, Homo sapiens
guauuugggauau

SEQ ID NO: 444362 - RNA, 22 nt, Homo sapiens
guauuuuaggcagggauuugag

SEQ ID NO: 444363 - RNA, 15 nt, Homo sapiens
guauuuuaugaucuu

SEQ ID NO: 444364 - RNA, 19 nt, Homo sapiens
guauuuucugucacuguag

SEQ ID NO: 444365 - RNA, 14 nt, Homo sapiens
guauuuugccagac

SEQ ID NO: 444366 - RNA, 18 nt, Homo sapiens
guauuuuuccucuuucac

SEQ ID NO: 444367 - RNA, 16 nt, Homo sapiens
gucaaacuuucaccuc

SEQ ID NO: 444368 - RNA, 23 nt, Homo sapiens
gucaacuucuggcuccucaaaca

SEQ ID NO: 444369 - RNA, 21 nt, Homo sapiens
gucaauaguauuaacuauuag

SEQ ID NO: 444370 - RNA, 12 nt, Homo sapiens
gucaaugacauc

SEQ ID NO: 444371 - RNA, 19 nt, Homo sapiens
gucaaugagguuaugagaa

SEQ ID NO: 444372 - RNA, 12 nt, Homo sapiens
gucaaugugcag

SEQ ID NO: 444373 - RNA, 12 nt, Homo sapiens
gucacacucugu

SEQ ID NO: 444374 - RNA, 20 nt, Homo sapiens
gucacauagcugggauuuga

SEQ ID NO: 444375 - RNA, 21 nt, Homo sapiens
gucaccagaauauuucuuuca

SEQ ID NO: 444376 - RNA, 19 nt, Homo sapiens
gucaccagcaacaucucga

SEQ ID NO: 444377 - RNA, 15 nt, Homo sapiens
gucaccaucucaggc

SEQ ID NO: 444378 - RNA, 13 nt, Homo sapiens
gucaccugugcua

SEQ ID NO: 444379 - RNA, 14 nt, Homo sapiens
gucacuuuccucuu

SEQ ID NO: 444380 - RNA, 20 nt, Homo sapiens
gucagauaaucggugcagcg

SEQ ID NO: 444381 - RNA, 14 nt, Homo sapiens
gucagauuagggcg

SEQ ID NO: 444382 - RNA, 16 nt, Homo sapiens
gucagcacagaacaca

SEQ ID NO: 444383 - RNA, 23 nt, Homo sapiens
gucagcacagaacacacugagac

SEQ ID NO: 444384 - RNA, 23 nt, Homo sapiens
gucagcagggggguuggguucca

SEQ ID NO: 444385 - RNA, 11 nt, Homo sapiens
gucagccagcu

SEQ ID NO: 444386 - RNA, 13 nt, Homo sapiens
gucagcuguuacu

SEQ ID NO: 444387 - RNA, 14 nt, Homo sapiens
gucaggagagugca

SEQ ID NO: 444388 - RNA, 15 nt, Homo sapiens
gucagggacagcagc

SEQ ID NO: 444389 - RNA, 16 nt, Homo sapiens
gucaguagugccagaa

SEQ ID NO: 444390 - RNA, 15 nt, Homo sapiens
gucaguuagcaucau

SEQ ID NO: 444391 - RNA, 19 nt, Homo sapiens
gucauacucuuuuucccaa

SEQ ID NO: 444392 - RNA, 17 nt, Homo sapiens
gucauaugugaagacag

SEQ ID NO: 444393 - RNA, 16 nt, Homo sapiens
gucaucccggggccau

SEQ ID NO: 444394 - RNA, 18 nt, Homo sapiens
gucauggcauucgcagug

SEQ ID NO: 444395 - RNA, 21 nt, Homo sapiens
gucaugucucugguggugcug

SEQ ID NO: 444396 - RNA, 19 nt, Homo sapiens
gucauuccaggugccagaa

SEQ ID NO: 444397 - RNA, 21 nt, Homo sapiens
gucauugaugaacugccaaag

SEQ ID NO: 444398 - RNA, 17 nt, Homo sapiens
gucauuguccaugccua

SEQ ID NO: 444399 - RNA, 16 nt, Homo sapiens
gucauuguccucugag

SEQ ID NO: 444400 - RNA, 21 nt, Homo sapiens
guccaagugugugugcgugug

SEQ ID NO: 444401 - RNA, 20 nt, Homo sapiens
guccaaucacauucaggcau

SEQ ID NO: 444402 - RNA, 14 nt, Homo sapiens
guccaccaccaccu

SEQ ID NO: 444403 - RNA, 15 nt, Homo sapiens
guccaccaccaccug

SEQ ID NO: 444404 - RNA, 19 nt, Homo sapiens
guccacccaggcugcacug

SEQ ID NO: 444405 - RNA, 21 nt, Homo sapiens
guccacccaggcugcacugca

SEQ ID NO: 444406 - RNA, 22 nt, Homo sapiens
guccacccccauugugaauguu

SEQ ID NO: 444407 - RNA, 21 nt, Homo sapiens
guccacccucauuucugccag

SEQ ID NO: 444408 - RNA, 15 nt, Homo sapiens
guccagaauucacuu

SEQ ID NO: 444409 - RNA, 16 nt, Homo sapiens
guccagagcuucaggg

SEQ ID NO: 444410 - RNA, 23 nt, Homo sapiens
guccagccgccauugccaccagg

SEQ ID NO: 444411 - RNA, 18 nt, Homo sapiens
guccagggcuagugacuu

SEQ ID NO: 444412 - RNA, 23 nt, Homo sapiens
guccaucuucuuuauacaaugac

SEQ ID NO: 444413 - RNA, 12 nt, Homo sapiens
guccauuauuca

SEQ ID NO: 444414 - RNA, 13 nt, Homo sapiens
gucccacugggac

SEQ ID NO: 444415 - RNA, 17 nt, Homo sapiens
guccccagcccacugga

SEQ ID NO: 444416 - RNA, 18 nt, Homo sapiens
guccccauccccaccagc

SEQ ID NO: 444417 - RNA, 21 nt, Homo sapiens
guccccuccccggcccuacca

SEQ ID NO: 444418 - RNA, 17 nt, Homo sapiens
guccccugccucaagaa

SEQ ID NO: 444419 - RNA, 20 nt, Homo sapiens
gucccggggcuccacugaac

SEQ ID NO: 444420 - RNA, 20 nt, Homo sapiens
gucccuacuagagaccucuc

SEQ ID NO: 444421 - RNA, 23 nt, Homo sapiens
gucccucuccuauguggcagcug

SEQ ID NO: 444422 - RNA, 17 nt, Homo sapiens
gucccugaagucuugca

SEQ ID NO: 444423 - RNA, 18 nt, Homo sapiens
gucccugccacacucagu

SEQ ID NO: 444424 - RNA, 16 nt, Homo sapiens
gucccuuccaggccau

SEQ ID NO: 444425 - RNA, 17 nt, Homo sapiens
gucccuuucccuaccuu

SEQ ID NO: 444426 - RNA, 15 nt, Homo sapiens
guccgaucuuugacu

SEQ ID NO: 444427 - RNA, 20 nt, Homo sapiens
guccgcgcgccagcacagaa

SEQ ID NO: 444428 - RNA, 18 nt, Homo sapiens
guccgcgcugcucugcag

SEQ ID NO: 444429 - RNA, 18 nt, Homo sapiens
guccuaaggacacacuaa

SEQ ID NO: 444430 - RNA, 22 nt, Homo sapiens
guccuacggagggaccaggugu

SEQ ID NO: 444431 - RNA, 16 nt, Homo sapiens
guccuagugucuauuc

SEQ ID NO: 444432 - RNA, 18 nt, Homo sapiens
guccuauaauucuauuga

SEQ ID NO: 444433 - RNA, 13 nt, Homo sapiens
guccuaugcgcuc

SEQ ID NO: 444434 - RNA, 14 nt, Homo sapiens
guccucacaugccc

SEQ ID NO: 444435 - RNA, 18 nt, Homo sapiens
guccucaccuucaaaaau

SEQ ID NO: 444436 - RNA, 18 nt, Homo sapiens
guccuccagaccaccagc

SEQ ID NO: 444437 - RNA, 19 nt, Homo sapiens
guccuccagaccaccagcc

SEQ ID NO: 444438 - RNA, 15 nt, Homo sapiens
guccucgaauucuca

SEQ ID NO: 444439 - RNA, 20 nt, Homo sapiens
guccugaugcugugcucaau

SEQ ID NO: 444440 - RNA, 13 nt, Homo sapiens
guuaaauuuagca

SEQ ID NO: 444441 - RNA, 15 nt, Homo sapiens
guuaacaacuugaau

SEQ ID NO: 444442 - RNA, 19 nt, Homo sapiens
guuaacuauuuauucccug

SEQ ID NO: 444443 - RNA, 18 nt, Homo sapiens
guuaagagaaaugagcuu

SEQ ID NO: 444444 - RNA, 15 nt, Homo sapiens
guuaagauucuuggu

SEQ ID NO: 444445 - RNA, 18 nt, Homo sapiens
guuaaggguuaguuuaca

SEQ ID NO: 444446 - RNA, 17 nt, Homo sapiens
guuaagugucauuucuu

SEQ ID NO: 444447 - RNA, 13 nt, Homo sapiens
guuaauacuauau

SEQ ID NO: 444448 - RNA, 15 nt, Homo sapiens
guuaauaguacuauu

SEQ ID NO: 444449 - RNA, 22 nt, Homo sapiens
guuaauauuaauuuauauuugu

SEQ ID NO: 444450 - RNA, 20 nt, Homo sapiens
guuaaugaaggugugcuaca

SEQ ID NO: 444451 - RNA, 15 nt, Homo sapiens
guuaauggucaaugc

SEQ ID NO: 444452 - RNA, 17 nt, Homo sapiens
guuaauggucaaugcua

SEQ ID NO: 444453 - RNA, 11 nt, Homo sapiens
guuacaaagac

SEQ ID NO: 444454 - RNA, 20 nt, Homo sapiens
guuacagacaaagcguggug

SEQ ID NO: 444455 - RNA, 17 nt, Homo sapiens
guuacaugaaugaauga

SEQ ID NO: 444456 - RNA, 11 nt, Homo sapiens
guuaccacagu

SEQ ID NO: 444457 - RNA, 17 nt, Homo sapiens
guuaccagagauuuacc

SEQ ID NO: 444458 - RNA, 17 nt, Homo sapiens
guuaccaugucacugug

SEQ ID NO: 444459 - RNA, 22 nt, Homo sapiens
guuacuaagaugaaauugccaa

SEQ ID NO: 444460 - RNA, 24 nt, Homo sapiens
guuacuggcuucucuugagucaca

SEQ ID NO: 444461 - RNA, 17 nt, Homo sapiens
guuacuuccuuccugcc

SEQ ID NO: 444462 - RNA, 13 nt, Homo sapiens
guuagaccacuuu

SEQ ID NO: 444463 - RNA, 15 nt, Homo sapiens
guuagcagagcugga

SEQ ID NO: 444464 - RNA, 15 nt, Homo sapiens
guuaggauagcauuu

SEQ ID NO: 444465 - RNA, 20 nt, Homo sapiens
guuagguaucaaaauguugu

SEQ ID NO: 444466 - RNA, 14 nt, Homo sapiens
guuaguguuuagaa

SEQ ID NO: 444467 - RNA, 21 nt, Homo sapiens
guuauaacucugcacuacucc

SEQ ID NO: 444468 - RNA, 21 nt, Homo sapiens
guuauaugacuucuuguucau

SEQ ID NO: 444469 - RNA, 16 nt, Homo sapiens
guuauccugugcuaca

SEQ ID NO: 444470 - RNA, 18 nt, Homo sapiens
guuaugucccaugaccuu

SEQ ID NO: 444471 - RNA, 13 nt, Homo sapiens
guuaugugaauga

SEQ ID NO: 444472 - RNA, 15 nt, Homo sapiens
guuauuuauaguguu

SEQ ID NO: 444473 - RNA, 21 nt, Homo sapiens
guuauuucucccuuguguuag

SEQ ID NO: 444474 - RNA, 14 nt, Homo sapiens
guuauuuuauugcc

SEQ ID NO: 444475 - RNA, 14 nt, Homo sapiens
guuauuuuccauuu

SEQ ID NO: 444476 - RNA, 22 nt, Homo sapiens
guucaaagaaccccccucccca

SEQ ID NO: 444477 - RNA, 19 nt, Homo sapiens
guucaaauuuugcauugug

SEQ ID NO: 444478 - RNA, 14 nt, Homo sapiens
guucaagacugaaa

SEQ ID NO: 444479 - RNA, 20 nt, Homo sapiens
guucaagcgauucuugugcc

SEQ ID NO: 444480 - RNA, 20 nt, Homo sapiens
guucaaucucccgcugcugc

SEQ ID NO: 444481 - RNA, 13 nt, Homo sapiens
guucaccuugccg

SEQ ID NO: 444482 - RNA, 16 nt, Homo sapiens
guucacucccaaccug

SEQ ID NO: 444483 - RNA, 24 nt, Homo sapiens
guucagcacugucccuugccucaa

SEQ ID NO: 444484 - RNA, 20 nt, Homo sapiens
guucagcuccuuccaccaca

SEQ ID NO: 444485 - RNA, 18 nt, Homo sapiens
guucaguuccacuaucua

SEQ ID NO: 444486 - RNA, 14 nt, Homo sapiens
guucaucucugcug

SEQ ID NO: 444487 - RNA, 16 nt, Homo sapiens
guucaugcacacuugc

SEQ ID NO: 444488 - RNA, 16 nt, Homo sapiens
guucauuaaguucuga

SEQ ID NO: 444489 - RNA, 18 nt, Homo sapiens
guucauuauuuugugguu

SEQ ID NO: 444490 - RNA, 12 nt, Homo sapiens
guuccagacuca

SEQ ID NO: 444491 - RNA, 16 nt, Homo sapiens
guuccauccaccaccu

SEQ ID NO: 444492 - RNA, 14 nt, Homo sapiens
guuccaugucugaa

SEQ ID NO: 444493 - RNA, 22 nt, Homo sapiens
guucccacucccucucuugccg

SEQ ID NO: 444494 - RNA, 12 nt, Homo sapiens
guucccauuugc

SEQ ID NO: 444495 - RNA, 16 nt, Homo sapiens
guucccuuggccucag

SEQ ID NO: 444496 - RNA, 13 nt, Homo sapiens
guuccuacuggag

SEQ ID NO: 444497 - RNA, 18 nt, Homo sapiens
guuccugauagcuaccca

SEQ ID NO: 444498 - RNA, 19 nt, Homo sapiens
guuccuggcucagccucaa

SEQ ID NO: 444499 - RNA, 19 nt, Homo sapiens
guuccuguucucagcaucc

SEQ ID NO: 444500 - RNA, 12 nt, Homo sapiens
guuccuugcuag

SEQ ID NO: 444501 - RNA, 16 nt, Homo sapiens
guucgauuuaagccau

SEQ ID NO: 444502 - RNA, 16 nt, Homo sapiens
guucuaacauguaauu

SEQ ID NO: 444503 - RNA, 14 nt, Homo sapiens
guucuaaugcugca

SEQ ID NO: 444504 - RNA, 22 nt, Homo sapiens
guucuaggagaacugucaugag

SEQ ID NO: 444505 - RNA, 17 nt, Homo sapiens
guucuauuuguauauau

SEQ ID NO: 444506 - RNA, 20 nt, Homo sapiens
guucucacuauguuucucag

SEQ ID NO: 444507 - RNA, 19 nt, Homo sapiens
guucucagguguugccaaa

SEQ ID NO: 444508 - RNA, 21 nt, Homo sapiens
guucucauuuuuaucccauug

SEQ ID NO: 444509 - RNA, 14 nt, Homo sapiens
guucuccaggugau

SEQ ID NO: 444510 - RNA, 13 nt, Homo sapiens
guucucugccuca

SEQ ID NO: 444511 - RNA, 14 nt, Homo sapiens
guucugaacuggaa

SEQ ID NO: 444512 - RNA, 23 nt, Homo sapiens
guucugacauuaacaguuuucca

SEQ ID NO: 444513 - RNA, 22 nt, Homo sapiens
guucugauauuaauuuaucaga

SEQ ID NO: 444514 - RNA, 17 nt, Homo sapiens
guucuugaaauaggugu

SEQ ID NO: 444515 - RNA, 21 nt, Homo sapiens
guucuuguaaauccaacacaa

SEQ ID NO: 444516 - RNA, 20 nt, Homo sapiens
guucuuugagggacugccuc

SEQ ID NO: 444517 - RNA, 22 nt, Homo sapiens
guugaacauucauucaacagcu

SEQ ID NO: 444518 - RNA, 16 nt, Homo sapiens
guugaauaaugcuguu

SEQ ID NO: 444519 - RNA, 17 nt, Homo sapiens
guugacguugaucuccu

SEQ ID NO: 444520 - RNA, 12 nt, Homo sapiens
guugacugcugc

SEQ ID NO: 444521 - RNA, 16 nt, Homo sapiens
guugaggaugcacugg

SEQ ID NO: 444522 - RNA, 19 nt, Homo sapiens
guugagucgucaucacuuu

SEQ ID NO: 444523 - RNA, 12 nt, Homo sapiens
guugaguguuca

SEQ ID NO: 444524 - RNA, 16 nt, Homo sapiens
guugaguuugcuguau

SEQ ID NO: 444525 - RNA, 15 nt, Homo sapiens
guugaugaagcacau

SEQ ID NO: 444526 - RNA, 15 nt, Homo sapiens
guugaugucgaugcu

SEQ ID NO: 444527 - RNA, 12 nt, Homo sapiens
guugcaggugac

SEQ ID NO: 444528 - RNA, 11 nt, Homo sapiens
guugcagugag

SEQ ID NO: 444529 - RNA, 13 nt, Homo sapiens
guugcaucauguu

SEQ ID NO: 444530 - RNA, 16 nt, Homo sapiens
guugcaucauguugaa

SEQ ID NO: 444531 - RNA, 19 nt, Homo sapiens
guugccuuugcucuuauaa

SEQ ID NO: 444532 - RNA, 14 nt, Homo sapiens
guugcugcaucucc

SEQ ID NO: 444533 - RNA, 15 nt, Homo sapiens
guugcuuucuuaucc

SEQ ID NO: 444534 - RNA, 16 nt, Homo sapiens
guuggaaccacggaga

SEQ ID NO: 444535 - RNA, 21 nt, Homo sapiens
guuggaacugcauucuuuuaa

SEQ ID NO: 444536 - RNA, 16 nt, Homo sapiens
guuggagcuacugcaa

SEQ ID NO: 444537 - RNA, 18 nt, Homo sapiens
guuggaugggagugggca

SEQ ID NO: 444538 - RNA, 15 nt, Homo sapiens
guugggagcacugga

SEQ ID NO: 444539 - RNA, 13 nt, Homo sapiens
guuggggggcaag

SEQ ID NO: 444540 - RNA, 10 nt, Homo sapiens
guuggugcaa

SEQ ID NO: 444541 - RNA, 13 nt, Homo sapiens
guuggugcugcuu

SEQ ID NO: 444542 - RNA, 19 nt, Homo sapiens
guugguuaguagacacuaa

SEQ ID NO: 444543 - RNA, 16 nt, Homo sapiens
guugucacauucucau

SEQ ID NO: 444544 - RNA, 21 nt, Homo sapiens
guugucugaagucacugcaca

SEQ ID NO: 444545 - RNA, 14 nt, Homo sapiens
guuguuuaccuguu

SEQ ID NO: 444546 - RNA, 13 nt, Homo sapiens
guuuaacucagau

SEQ ID NO: 444547 - RNA, 21 nt, Homo sapiens
guuuaacucagaucacuacug

SEQ ID NO: 444548 - RNA, 18 nt, Homo sapiens
guuuaacugaguuagaau

SEQ ID NO: 444549 - RNA, 16 nt, Homo sapiens
guuuaagguucuugcu

SEQ ID NO: 444550 - RNA, 15 nt, Homo sapiens
guuuaauaguauauc

SEQ ID NO: 444551 - RNA, 23 nt, Homo sapiens
guuuacauuguaaauaguauuug

SEQ ID NO: 444552 - RNA, 21 nt, Homo sapiens
guuuaccuucagccauagcuu

SEQ ID NO: 444553 - RNA, 21 nt, Homo sapiens
guuuagaaucaagucugugaa

SEQ ID NO: 444554 - RNA, 16 nt, Homo sapiens
guuuauaauuguuaua

SEQ ID NO: 444555 - RNA, 19 nt, Homo sapiens
guuuaugauauuucuugcu

SEQ ID NO: 444556 - RNA, 17 nt, Homo sapiens
guuuaugcagugcugcu

SEQ ID NO: 444557 - RNA, 14 nt, Homo sapiens
guuucaaaccagga

SEQ ID NO: 444558 - RNA, 15 nt, Homo sapiens
guuucacugccaacu

SEQ ID NO: 444559 - RNA, 19 nt, Homo sapiens
guuucacuguguuagccag

SEQ ID NO: 444560 - RNA, 13 nt, Homo sapiens
guuucacuuuuaa

SEQ ID NO: 444561 - RNA, 23 nt, Homo sapiens
guuucagaugauucuaugucuca

SEQ ID NO: 444562 - RNA, 18 nt, Homo sapiens
guuucaguaauagcugaa

SEQ ID NO: 444563 - RNA, 18 nt, Homo sapiens
guuucaguugacaaaaua

SEQ ID NO: 444564 - RNA, 15 nt, Homo sapiens
guuucauauucucag

SEQ ID NO: 444565 - RNA, 14 nt, Homo sapiens
guuuccacacagcc

SEQ ID NO: 444566 - RNA, 22 nt, Homo sapiens
guuuccagcuaagccugaugau

SEQ ID NO: 444567 - RNA, 15 nt, Homo sapiens
guuuccagcugccaa

SEQ ID NO: 444568 - RNA, 14 nt, Homo sapiens
guuuccccucagaa

SEQ ID NO: 444569 - RNA, 16 nt, Homo sapiens
guuuccgugagcucaa

SEQ ID NO: 444570 - RNA, 19 nt, Homo sapiens
guuuccucaucugucacau

SEQ ID NO: 444571 - RNA, 21 nt, Homo sapiens
ugcccagcccggaccuuggca

SEQ ID NO: 444572 - RNA, 18 nt, Homo sapiens
ugcccaggcagucuuugc

SEQ ID NO: 444573 - RNA, 21 nt, Homo sapiens
ugcccaggcuggagugcaaug

SEQ ID NO: 444574 - RNA, 17 nt, Homo sapiens
ugcccagugauggcauu

SEQ ID NO: 444575 - RNA, 20 nt, Homo sapiens
ugcccaucaucucugccuuu

SEQ ID NO: 444576 - RNA, 22 nt, Homo sapiens
ugcccauuguaacuuauuucag

SEQ ID NO: 444577 - RNA, 20 nt, Homo sapiens
ugccccaaacaaauaugcaa

SEQ ID NO: 444578 - RNA, 12 nt, Homo sapiens
ugccccaccugc

SEQ ID NO: 444579 - RNA, 18 nt, Homo sapiens
ugccccagaaaaauaacu

SEQ ID NO: 444580 - RNA, 18 nt, Homo sapiens
ugccccaggccugaaaga

SEQ ID NO: 444581 - RNA, 14 nt, Homo sapiens
ugccccagugcuac

SEQ ID NO: 444582 - RNA, 20 nt, Homo sapiens
ugccccguccacggcucuag

SEQ ID NO: 444583 - RNA, 16 nt, Homo sapiens
ugcccgagcuggugca

SEQ ID NO: 444584 - RNA, 16 nt, Homo sapiens
ugcccgcacacccuca

SEQ ID NO: 444585 - RNA, 13 nt, Homo sapiens
ugcccuccacugc

SEQ ID NO: 444586 - RNA, 21 nt, Homo sapiens
ugcccuccccagagcacuggg

SEQ ID NO: 444587 - RNA, 16 nt, Homo sapiens
ugcccucgugguggaa

SEQ ID NO: 444588 - RNA, 20 nt, Homo sapiens
ugcccucuuguggugcauug

SEQ ID NO: 444589 - RNA, 22 nt, Homo sapiens
ugcccugaugcgucuacccaga

SEQ ID NO: 444590 - RNA, 19 nt, Homo sapiens
ugcccuuaaaauaaugauu

SEQ ID NO: 444591 - RNA, 19 nt, Homo sapiens
ugcccuuucuguaccauuu

SEQ ID NO: 444592 - RNA, 20 nt, Homo sapiens
ugcccuuuggaaagccauug

SEQ ID NO: 444593 - RNA, 18 nt, Homo sapiens
ugcccuuuuguaucuuaa

SEQ ID NO: 444594 - RNA, 20 nt, Homo sapiens
ugccgaagaugagacugccc

SEQ ID NO: 444595 - RNA, 23 nt, Homo sapiens
ugccggucccccaugccaccacc

SEQ ID NO: 444596 - RNA, 17 nt, Homo sapiens
ugccguggcaacugugg

SEQ ID NO: 444597 - RNA, 17 nt, Homo sapiens
ugccuaaaauuguauga

SEQ ID NO: 444598 - RNA, 13 nt, Homo sapiens
ugccuaccccagc

SEQ ID NO: 444599 - RNA, 15 nt, Homo sapiens
ugccucaaugccagu

SEQ ID NO: 444600 - RNA, 20 nt, Homo sapiens
ugccucacaucucccuucca

SEQ ID NO: 444601 - RNA, 21 nt, Homo sapiens
ugccucagccuuccaaagugc

SEQ ID NO: 444602 - RNA, 22 nt, Homo sapiens
ugccucccaagguccucucagu

SEQ ID NO: 444603 - RNA, 16 nt, Homo sapiens
ugccucccagguucca

SEQ ID NO: 444604 - RNA, 19 nt, Homo sapiens
ugccucccagguuccagca

SEQ ID NO: 444605 - RNA, 21 nt, Homo sapiens
ugccucugacagcagccugug

SEQ ID NO: 444606 - RNA, 23 nt, Homo sapiens
ugccucugacagcagccugugag

SEQ ID NO: 444607 - RNA, 15 nt, Homo sapiens
ugccucuuauuacag

SEQ ID NO: 444608 - RNA, 16 nt, Homo sapiens
ugccucuucuaccucu

SEQ ID NO: 444609 - RNA, 22 nt, Homo sapiens
ugccucuuuuaaugucaucucu

SEQ ID NO: 444610 - RNA, 23 nt, Homo sapiens
ugccugaaagcaacuacagaauu

SEQ ID NO: 444611 - RNA, 20 nt, Homo sapiens
ugccugaccaucccaugagc

SEQ ID NO: 444612 - RNA, 20 nt, Homo sapiens
ugccuggagcuccugggaag

SEQ ID NO: 444613 - RNA, 21 nt, Homo sapiens
ugccuggcuucuuucucucag

SEQ ID NO: 444614 - RNA, 16 nt, Homo sapiens
ugccugucacuacugg

SEQ ID NO: 444615 - RNA, 21 nt, Homo sapiens
ugccugugcaugaccugauca

SEQ ID NO: 444616 - RNA, 14 nt, Homo sapiens
ugccuuaauucuua

SEQ ID NO: 444617 - RNA, 19 nt, Homo sapiens
ugccuuacagacagaauau

SEQ ID NO: 444618 - RNA, 13 nt, Homo sapiens
ugccuucacccau

SEQ ID NO: 444619 - RNA, 22 nt, Homo sapiens
ugccuucagcccuaacauagug

SEQ ID NO: 444620 - RNA, 15 nt, Homo sapiens
ugccuuccaccugua

SEQ ID NO: 444621 - RNA, 20 nt, Homo sapiens
ugccuucgguuuguauuuag

SEQ ID NO: 444622 - RNA, 21 nt, Homo sapiens
ugccuucucacaucuguccag

SEQ ID NO: 444623 - RNA, 12 nt, Homo sapiens
ugccuucugacg

SEQ ID NO: 444624 - RNA, 16 nt, Homo sapiens
ugccuucuuauugcuu

SEQ ID NO: 444625 - RNA, 21 nt, Homo sapiens
ugccuucuuauugcuuuuaug

SEQ ID NO: 444626 - RNA, 14 nt, Homo sapiens
ugccuugcacaaaa

SEQ ID NO: 444627 - RNA, 14 nt, Homo sapiens
ugccuuggggacaa

SEQ ID NO: 444628 - RNA, 19 nt, Homo sapiens
ugccuuuccagcaccuucc

SEQ ID NO: 444629 - RNA, 16 nt, Homo sapiens
ugccuuugaccaucuc

SEQ ID NO: 444630 - RNA, 16 nt, Homo sapiens
ugccuuugcucuuaua

SEQ ID NO: 444631 - RNA, 17 nt, Homo sapiens
ugccuuuguaaguuauu

SEQ ID NO: 444632 - RNA, 17 nt, Homo sapiens
ugccuuuuccuauguaa

SEQ ID NO: 444633 - RNA, 18 nt, Homo sapiens
ugccuuuuccuauguaaa

SEQ ID NO: 444634 - RNA, 23 nt, Homo sapiens
ugccuuuuccuauguaaauauua

SEQ ID NO: 444635 - RNA, 16 nt, Homo sapiens
ugcgagcaacagugcc

SEQ ID NO: 444636 - RNA, 23 nt, Homo sapiens
ugcgcaaggccucgcucuugaca

SEQ ID NO: 444637 - RNA, 20 nt, Homo sapiens
ugcgcggaagugaccacaga

SEQ ID NO: 444638 - RNA, 18 nt, Homo sapiens
ugcggguggguaucccac

SEQ ID NO: 444639 - RNA, 14 nt, Homo sapiens
ugcgguaggugcug

SEQ ID NO: 444640 - RNA, 21 nt, Homo sapiens
ugcguaggagagaacagggau

SEQ ID NO: 444641 - RNA, 23 nt, Homo sapiens
ugcguuacacccuuucuugacaa

SEQ ID NO: 444642 - RNA, 22 nt, Homo sapiens
ugcguucccuucaguacugcag

SEQ ID NO: 444643 - RNA, 22 nt, Homo sapiens
ugcuaaauaguucuaucaggaa

SEQ ID NO: 444644 - RNA, 12 nt, Homo sapiens
ugcuaacaaugc

SEQ ID NO: 444645 - RNA, 13 nt, Homo sapiens
ugcuaagagccag

SEQ ID NO: 444646 - RNA, 17 nt, Homo sapiens
ugcuaaggcuccuccuu

SEQ ID NO: 444647 - RNA, 19 nt, Homo sapiens
ugcuaauaaaugaccaguu

SEQ ID NO: 444648 - RNA, 19 nt, Homo sapiens
ugcuaauccaggacagcau

SEQ ID NO: 444649 - RNA, 20 nt, Homo sapiens
ugcuaauuucuguccagaaa

SEQ ID NO: 444650 - RNA, 14 nt, Homo sapiens
ugcuaccugugagc

SEQ ID NO: 444651 - RNA, 17 nt, Homo sapiens
ugcuaccugugagcauc

SEQ ID NO: 444652 - RNA, 16 nt, Homo sapiens
ugcuacgaagaaagac

SEQ ID NO: 444653 - RNA, 18 nt, Homo sapiens
ugcuagaaaaauguucuu

SEQ ID NO: 444654 - RNA, 20 nt, Homo sapiens
ugcuagaugugcaaaugcaa

SEQ ID NO: 444655 - RNA, 20 nt, Homo sapiens
ugcuaucucgcuagccauau

SEQ ID NO: 444656 - RNA, 17 nt, Homo sapiens
ugcuauuacuaguacua

SEQ ID NO: 444657 - RNA, 15 nt, Homo sapiens
ugcuauuucacucua

SEQ ID NO: 444658 - RNA, 11 nt, Homo sapiens
ugcucaaagau

SEQ ID NO: 444659 - RNA, 20 nt, Homo sapiens
ugcucaaagauguacugaga

SEQ ID NO: 444660 - RNA, 20 nt, Homo sapiens
ugcucaauaaaggucauauu

SEQ ID NO: 444661 - RNA, 18 nt, Homo sapiens
ugcucaguuggugcugcu

SEQ ID NO: 444662 - RNA, 15 nt, Homo sapiens
ugcucauguaugugc

SEQ ID NO: 444663 - RNA, 19 nt, Homo sapiens
ugcuccaaccaguccucag

SEQ ID NO: 444664 - RNA, 22 nt, Homo sapiens
ugcuccaugacuggcugucugc

SEQ ID NO: 444665 - RNA, 18 nt, Homo sapiens
ugcuccauggaugcaugc

SEQ ID NO: 444666 - RNA, 18 nt, Homo sapiens
ugcuccgugugucucaug

SEQ ID NO: 444667 - RNA, 13 nt, Homo sapiens
ugcuccucagggg

SEQ ID NO: 444668 - RNA, 17 nt, Homo sapiens
ugcucggccgucuucac

SEQ ID NO: 444669 - RNA, 17 nt, Homo sapiens
ugcucucccaaagccau

SEQ ID NO: 444670 - RNA, 18 nt, Homo sapiens
ugcucuccuucacucuga

SEQ ID NO: 444671 - RNA, 21 nt, Homo sapiens
ugcucugcagcccacagagga

SEQ ID NO: 444672 - RNA, 14 nt, Homo sapiens
ugcucuguuaccca

SEQ ID NO: 444673 - RNA, 15 nt, Homo sapiens
ugcucuuaugccauu

SEQ ID NO: 444674 - RNA, 20 nt, Homo sapiens
ugcucuugcaucugggccag

SEQ ID NO: 444675 - RNA, 18 nt, Homo sapiens
ugcucuugggaagaccag

SEQ ID NO: 444676 - RNA, 14 nt, Homo sapiens
ugcucuuuaccuug

SEQ ID NO: 444677 - RNA, 18 nt, Homo sapiens
ugcucuuucaucucugcu

SEQ ID NO: 444678 - RNA, 15 nt, Homo sapiens
ugcucuuuguggcag

SEQ ID NO: 444679 - RNA, 14 nt, Homo sapiens
ugcucuuuuacuaa

SEQ ID NO: 444680 - RNA, 22 nt, Homo sapiens
ugcugaaggagggucaccgcau

SEQ ID NO: 444681 - RNA, 13 nt, Homo sapiens
ugcugaagggcag

SEQ ID NO: 444682 - RNA, 20 nt, Homo sapiens
ugcugaaugucauuauuuga

SEQ ID NO: 444683 - RNA, 19 nt, Homo sapiens
ugcugaccucccagugacc

SEQ ID NO: 444684 - RNA, 18 nt, Homo sapiens
ugcugagccuccuugucu

SEQ ID NO: 444685 - RNA, 23 nt, Homo sapiens
ugcugagugcaccacuucaagug

SEQ ID NO: 444686 - RNA, 14 nt, Homo sapiens
ugcugaugaucaaa

SEQ ID NO: 444687 - RNA, 22 nt, Homo sapiens
ugcugauucaauaaaaugcacu

SEQ ID NO: 444688 - RNA, 19 nt, Homo sapiens
ugcugauuucuacaacuga

SEQ ID NO: 444689 - RNA, 13 nt, Homo sapiens
ugcugcaccugug

SEQ ID NO: 444690 - RNA, 14 nt, Homo sapiens
ugcugccauccuca

SEQ ID NO: 444691 - RNA, 15 nt, Homo sapiens
ugcugccauccucac

SEQ ID NO: 444692 - RNA, 14 nt, Homo sapiens
ugcugccugccugg

SEQ ID NO: 444693 - RNA, 21 nt, Homo sapiens
ugcugcggguggguaucccac

SEQ ID NO: 444694 - RNA, 17 nt, Homo sapiens
ugcugcguucuuucaau

SEQ ID NO: 444695 - RNA, 15 nt, Homo sapiens
ugcuggaaaaucugu

SEQ ID NO: 444696 - RNA, 19 nt, Homo sapiens
ugcuggacaguaucacugu

SEQ ID NO: 444697 - RNA, 19 nt, Homo sapiens
ugcuggagaggaacccaga

SEQ ID NO: 444698 - RNA, 22 nt, Homo sapiens
ugcuggagagguuaaggugcaa

SEQ ID NO: 444699 - RNA, 15 nt, Homo sapiens
ugcuggcauuugcac

SEQ ID NO: 444700 - RNA, 15 nt, Homo sapiens
ugggucaaagccggu

SEQ ID NO: 444701 - RNA, 22 nt, Homo sapiens
ugggucaaagugguacaggaag

SEQ ID NO: 444702 - RNA, 15 nt, Homo sapiens
ugggucaagggggcu

SEQ ID NO: 444703 - RNA, 22 nt, Homo sapiens
ugggucaucccagcaccugcca

SEQ ID NO: 444704 - RNA, 21 nt, Homo sapiens
uggguccucggucuuaccccc

SEQ ID NO: 444705 - RNA, 22 nt, Homo sapiens
ugggucgcgugaugcgcauguc

SEQ ID NO: 444706 - RNA, 15 nt, Homo sapiens
ugggucuucccugua

SEQ ID NO: 444707 - RNA, 19 nt, Homo sapiens
ugggugagaacaaccaaaa

SEQ ID NO: 444708 - RNA, 15 nt, Homo sapiens
ugggugggacacaga

SEQ ID NO: 444709 - RNA, 20 nt, Homo sapiens
uggguuauguguaugugcca

SEQ ID NO: 444710 - RNA, 17 nt, Homo sapiens
uggguuccagacagagu

SEQ ID NO: 444711 - RNA, 20 nt, Homo sapiens
uggguuuugggucuuugaac

SEQ ID NO: 444712 - RNA, 23 nt, Homo sapiens
ugguaaauauauuucaaaacuuc

SEQ ID NO: 444713 - RNA, 18 nt, Homo sapiens
ugguaaucugaggcaauc

SEQ ID NO: 444714 - RNA, 16 nt, Homo sapiens
ugguaauuuguaucug

SEQ ID NO: 444715 - RNA, 19 nt, Homo sapiens
ugguacaacacuugcacaa

SEQ ID NO: 444716 - RNA, 14 nt, Homo sapiens
ugguacagcacugu

SEQ ID NO: 444717 - RNA, 13 nt, Homo sapiens
ugguacauuccau

SEQ ID NO: 444718 - RNA, 18 nt, Homo sapiens
ugguacuuuauucuugcu

SEQ ID NO: 444719 - RNA, 15 nt, Homo sapiens
ugguagaaaggcagu

SEQ ID NO: 444720 - RNA, 19 nt, Homo sapiens
ugguagaaaggcaguucag

SEQ ID NO: 444721 - RNA, 13 nt, Homo sapiens
ugguagagauuca

SEQ ID NO: 444722 - RNA, 17 nt, Homo sapiens
ugguaucuacuucuaca

SEQ ID NO: 444723 - RNA, 20 nt, Homo sapiens
ugguaugaacuugaggacac

SEQ ID NO: 444724 - RNA, 15 nt, Homo sapiens
ugguaugcacugguu

SEQ ID NO: 444725 - RNA, 17 nt, Homo sapiens
ugguaugucucuuuaag

SEQ ID NO: 444726 - RNA, 21 nt, Homo sapiens
uggucaaguuuuucucucaaa

SEQ ID NO: 444727 - RNA, 17 nt, Homo sapiens
uggucaggcaucuuccc

SEQ ID NO: 444728 - RNA, 23 nt, Homo sapiens
ugguccacacaccacagaagcuu

SEQ ID NO: 444729 - RNA, 12 nt, Homo sapiens
ugguccaugccu

SEQ ID NO: 444730 - RNA, 18 nt, Homo sapiens
ugguccccuguggugaug

SEQ ID NO: 444731 - RNA, 22 nt, Homo sapiens
uggucuccgcucugaauuggau

SEQ ID NO: 444732 - RNA, 16 nt, Homo sapiens
uggucucuauacuaca

SEQ ID NO: 444733 - RNA, 21 nt, Homo sapiens
uggucucuuuccaaagcauuu

SEQ ID NO: 444734 - RNA, 14 nt, Homo sapiens
uggucugacuccuu

SEQ ID NO: 444735 - RNA, 21 nt, Homo sapiens
uggugacagccuugggccuuu

SEQ ID NO: 444736 - RNA, 13 nt, Homo sapiens
uggugaggcaaua

SEQ ID NO: 444737 - RNA, 20 nt, Homo sapiens
uggugaugggguuuagcaac

SEQ ID NO: 444738 - RNA, 14 nt, Homo sapiens
uggugauguaaaac

SEQ ID NO: 444739 - RNA, 15 nt, Homo sapiens
uggugaugugccugu

SEQ ID NO: 444740 - RNA, 17 nt, Homo sapiens
uggugauuucuugcuaa

SEQ ID NO: 444741 - RNA, 17 nt, Homo sapiens
uggugcaguaaccauuu

SEQ ID NO: 444742 - RNA, 12 nt, Homo sapiens
uggugcagugaa

SEQ ID NO: 444743 - RNA, 16 nt, Homo sapiens
uggugccccacagcua

SEQ ID NO: 444744 - RNA, 13 nt, Homo sapiens
uggugcuggauau

SEQ ID NO: 444745 - RNA, 12 nt, Homo sapiens
ugguggccucug

SEQ ID NO: 444746 - RNA, 19 nt, Homo sapiens
uggugggagagacugugag

SEQ ID NO: 444747 - RNA, 20 nt, Homo sapiens
ugguguggagggcgccaucu

SEQ ID NO: 444748 - RNA, 21 nt, Homo sapiens
ugguguucaaaaaaacacuag

SEQ ID NO: 444749 - RNA, 17 nt, Homo sapiens
ugguguuccaugacuuc

SEQ ID NO: 444750 - RNA, 14 nt, Homo sapiens
ugguguucccaaga

SEQ ID NO: 444751 - RNA, 15 nt, Homo sapiens
ugguuacaugaauga

SEQ ID NO: 444752 - RNA, 13 nt, Homo sapiens
ugguuaccacagu

SEQ ID NO: 444753 - RNA, 19 nt, Homo sapiens
ugguuauccugugcuacag

SEQ ID NO: 444754 - RNA, 15 nt, Homo sapiens
ugguuaugucccaug

SEQ ID NO: 444755 - RNA, 17 nt, Homo sapiens
ugguuaugucccaugac

SEQ ID NO: 444756 - RNA, 15 nt, Homo sapiens
ugguuccuaagccug

SEQ ID NO: 444757 - RNA, 17 nt, Homo sapiens
ugguucuuaguucucac

SEQ ID NO: 444758 - RNA, 23 nt, Homo sapiens
ugguucuucugacacuuguggua

SEQ ID NO: 444759 - RNA, 22 nt, Homo sapiens
ugguucuuuuaccccacgaaga

SEQ ID NO: 444760 - RNA, 17 nt, Homo sapiens
ugguuggaccuauugcc

SEQ ID NO: 444761 - RNA, 14 nt, Homo sapiens
ugguuuacuguguu

SEQ ID NO: 444762 - RNA, 17 nt, Homo sapiens
ugguuucuauacaugaa

SEQ ID NO: 444763 - RNA, 17 nt, Homo sapiens
ugguuugccaugucgcu

SEQ ID NO: 444764 - RNA, 20 nt, Homo sapiens
ugguuuguuauaucagggaa

SEQ ID NO: 444765 - RNA, 13 nt, Homo sapiens
ugguuuuaccugu

SEQ ID NO: 444766 - RNA, 19 nt, Homo sapiens
ugguuuugcaugucugcau

SEQ ID NO: 444767 - RNA, 19 nt, Homo sapiens
ugguuuuuggcucuuucag

SEQ ID NO: 444768 - RNA, 18 nt, Homo sapiens
uguaaaaacccugcuaaa

SEQ ID NO: 444769 - RNA, 21 nt, Homo sapiens
uguaaaacugugacauuccac

SEQ ID NO: 444770 - RNA, 16 nt, Homo sapiens
uguaaaagcaacauca

SEQ ID NO: 444771 - RNA, 19 nt, Homo sapiens
uguaaaauagaauguuacu

SEQ ID NO: 444772 - RNA, 22 nt, Homo sapiens
uguaaaaugugaagugaaugaa

SEQ ID NO: 444773 - RNA, 22 nt, Homo sapiens
uguaaacauucaucaagcugua

SEQ ID NO: 444774 - RNA, 22 nt, Homo sapiens
uguaaaccaucgcgugcaauga

SEQ ID NO: 444775 - RNA, 21 nt, Homo sapiens
uguaaaccuagaguuuuauca

SEQ ID NO: 444776 - RNA, 18 nt, Homo sapiens
uguaaacuaguacuauua

SEQ ID NO: 444777 - RNA, 18 nt, Homo sapiens
uguaaauauucuugucca

SEQ ID NO: 444778 - RNA, 21 nt, Homo sapiens
uguaaauccuagacuugaaag

SEQ ID NO: 444779 - RNA, 19 nt, Homo sapiens
uguaaaugaagggucauuu

SEQ ID NO: 444780 - RNA, 14 nt, Homo sapiens
uguaaaugcucaaa

SEQ ID NO: 444781 - RNA, 16 nt, Homo sapiens
uguaaauuuaacugca

SEQ ID NO: 444782 - RNA, 18 nt, Homo sapiens
uguaacacuguauaacau

SEQ ID NO: 444783 - RNA, 16 nt, Homo sapiens
uguaaccaccucucug

SEQ ID NO: 444784 - RNA, 21 nt, Homo sapiens
uguaaccagcagucacagguc

SEQ ID NO: 444785 - RNA, 17 nt, Homo sapiens
uguaacccucacccaca

SEQ ID NO: 444786 - RNA, 14 nt, Homo sapiens
uguaacugccuacc

SEQ ID NO: 444787 - RNA, 20 nt, Homo sapiens
uguaacuggguucaaaaaga

SEQ ID NO: 444788 - RNA, 17 nt, Homo sapiens
uguaagauaauguugcu

SEQ ID NO: 444789 - RNA, 23 nt, Homo sapiens
uguaagaucguucucugccucac

SEQ ID NO: 444790 - RNA, 15 nt, Homo sapiens
uguaagaugaagaua

SEQ ID NO: 444791 - RNA, 18 nt, Homo sapiens
uguaagcauucugagcug

SEQ ID NO: 444792 - RNA, 14 nt, Homo sapiens
uguaaggugcuaca

SEQ ID NO: 444793 - RNA, 18 nt, Homo sapiens
uguaagugagagagacaa

SEQ ID NO: 444794 - RNA, 18 nt, Homo sapiens
uguaaguuuaugucuaaa

SEQ ID NO: 444795 - RNA, 15 nt, Homo sapiens
uguaauagcauacau

SEQ ID NO: 444796 - RNA, 14 nt, Homo sapiens
uguaaucauauaau

SEQ ID NO: 444797 - RNA, 19 nt, Homo sapiens
uguaaucccaacacuuugg

SEQ ID NO: 444798 - RNA, 19 nt, Homo sapiens
uguaaucccagcuacuugg

SEQ ID NO: 444799 - RNA, 15 nt, Homo sapiens
uguaauggucucuga

SEQ ID NO: 444800 - RNA, 13 nt, Homo sapiens
uguacaaagauac

SEQ ID NO: 444801 - RNA, 17 nt, Homo sapiens
uguacaauuuucauccc

SEQ ID NO: 444802 - RNA, 13 nt, Homo sapiens
uguacacaguuua

SEQ ID NO: 444803 - RNA, 12 nt, Homo sapiens
uguacagccuuu

SEQ ID NO: 444804 - RNA, 19 nt, Homo sapiens
uguacaguuauacauaccu

SEQ ID NO: 444805 - RNA, 17 nt, Homo sapiens
uguacauuccugauacu

SEQ ID NO: 444806 - RNA, 17 nt, Homo sapiens
uguacccugcuguauaa

SEQ ID NO: 444807 - RNA, 15 nt, Homo sapiens
uguaccugacuucca

SEQ ID NO: 444808 - RNA, 19 nt, Homo sapiens
uguaccuuucugacaauaa

SEQ ID NO: 444809 - RNA, 19 nt, Homo sapiens
uguacuggagaguggcaaa

SEQ ID NO: 444810 - RNA, 16 nt, Homo sapiens
uguagaaaaauacuga

SEQ ID NO: 444811 - RNA, 21 nt, Homo sapiens
uguagaaagauacacugacuu

SEQ ID NO: 444812 - RNA, 21 nt, Homo sapiens
uguagaacucagcaguugaca

SEQ ID NO: 444813 - RNA, 19 nt, Homo sapiens
uguagaacugcaauuucca

SEQ ID NO: 444814 - RNA, 17 nt, Homo sapiens
uguagauggcggugaug

SEQ ID NO: 444815 - RNA, 20 nt, Homo sapiens
uguagcauuucuugauguug

SEQ ID NO: 444816 - RNA, 22 nt, Homo sapiens
uguagcauuucuugauguugcu

SEQ ID NO: 444817 - RNA, 18 nt, Homo sapiens
uguagcugaaacaaaaau

SEQ ID NO: 444818 - RNA, 20 nt, Homo sapiens
uguaggaaucugccuuccag

SEQ ID NO: 444819 - RNA, 13 nt, Homo sapiens
uguaggagcugga

SEQ ID NO: 444820 - RNA, 13 nt, Homo sapiens
uguagggaacucu

SEQ ID NO: 444821 - RNA, 15 nt, Homo sapiens
uguagggcauaauga

SEQ ID NO: 444822 - RNA, 19 nt, Homo sapiens
uguagguaauauuguucua

SEQ ID NO: 444823 - RNA, 13 nt, Homo sapiens
uguaguacuccuu

SEQ ID NO: 444824 - RNA, 13 nt, Homo sapiens
uguaguagucuca

SEQ ID NO: 444825 - RNA, 15 nt, Homo sapiens
uguaguuaaugaugg

SEQ ID NO: 444826 - RNA, 20 nt, Homo sapiens
uguaguuugucccauuuauu

SEQ ID NO: 444827 - RNA, 21 nt, Homo sapiens
uguaguuuuucuucaacauca

SEQ ID NO: 444828 - RNA, 21 nt, Homo sapiens
uguauaaccccaccuugccaa

SEQ ID NO: 444829 - RNA, 14 nt, Homo sapiens
uguauauaguauga

SEQ ID NO: 444830 - RNA, 23 nt, Homo sapiens
uauuguuccaagacauugucaau

SEQ ID NO: 444831 - RNA, 21 nt, Homo sapiens
uauuguugcuuuuuuuccaau

SEQ ID NO: 444832 - RNA, 20 nt, Homo sapiens
uauuuaaaaaugcaugauaa

SEQ ID NO: 444833 - RNA, 22 nt, Homo sapiens
uauuuaaagaaaaaaaaggcag

SEQ ID NO: 444834 - RNA, 16 nt, Homo sapiens
uauuuaagcaacaucu

SEQ ID NO: 444835 - RNA, 20 nt, Homo sapiens
uauuuagauauaacacuaug

SEQ ID NO: 444836 - RNA, 14 nt, Homo sapiens
uauuuauaacauug

SEQ ID NO: 444837 - RNA, 14 nt, Homo sapiens
uauuuauaucucac

SEQ ID NO: 444838 - RNA, 19 nt, Homo sapiens
uauuuauuaaaaacccaua

SEQ ID NO: 444839 - RNA, 14 nt, Homo sapiens
uauuuauucccugu

SEQ ID NO: 444840 - RNA, 20 nt, Homo sapiens
uauuucaaaauauacauuca

SEQ ID NO: 444841 - RNA, 18 nt, Homo sapiens
uauuucaggcacaucauu

SEQ ID NO: 444842 - RNA, 14 nt, Homo sapiens
uauuucauaaacaa

SEQ ID NO: 444843 - RNA, 23 nt, Homo sapiens
uauuucuaaaacauuaauugagg

SEQ ID NO: 444844 - RNA, 20 nt, Homo sapiens
uauuucuaagcuuauuucua

SEQ ID NO: 444845 - RNA, 23 nt, Homo sapiens
uauuucuauguaaauuauuguaa

SEQ ID NO: 444846 - RNA, 17 nt, Homo sapiens
uauuugaaaaacauaca

SEQ ID NO: 444847 - RNA, 18 nt, Homo sapiens
uauuugaccggaucuaca

SEQ ID NO: 444848 - RNA, 15 nt, Homo sapiens
uauuugagacuagga

SEQ ID NO: 444849 - RNA, 24 nt, Homo sapiens
uauuugcuuuuugcuaacaaugcu

SEQ ID NO: 444850 - RNA, 12 nt, Homo sapiens
uauuugucacaa

SEQ ID NO: 444851 - RNA, 20 nt, Homo sapiens
uauuuuaaaguaaaagucua

SEQ ID NO: 444852 - RNA, 15 nt, Homo sapiens
uauuuucaagcaaau

SEQ ID NO: 444853 - RNA, 14 nt, Homo sapiens
uauuuucuuuauca

SEQ ID NO: 444854 - RNA, 16 nt, Homo sapiens
uauuuugaaaacacuu

SEQ ID NO: 444855 - RNA, 16 nt, Homo sapiens
uauuuugagauucaua

SEQ ID NO: 444856 - RNA, 11 nt, Homo sapiens
uauuuugauca

SEQ ID NO: 444857 - RNA, 18 nt, Homo sapiens
uauuuugcauaguaccaa

SEQ ID NO: 444858 - RNA, 16 nt, Homo sapiens
uauuuugccagacuua

SEQ ID NO: 444859 - RNA, 16 nt, Homo sapiens
uauuuuggaucuauca

SEQ ID NO: 444860 - RNA, 17 nt, Homo sapiens
uauuuuuccucuuucac

SEQ ID NO: 444861 - RNA, 17 nt, Homo sapiens
uauuuuuuaaguucaau

SEQ ID NO: 444862 - RNA, 19 nt, Homo sapiens
uauuuuuuacuacauaauu

SEQ ID NO: 444863 - RNA, 21 nt, Homo sapiens
uauuuuuuuaagcuguaaaaa

SEQ ID NO: 444864 - RNA, 14 nt, Homo sapiens
ucaaaaacagcaga

SEQ ID NO: 444865 - RNA, 13 nt, Homo sapiens
ucaaaaacauucu

SEQ ID NO: 444866 - RNA, 13 nt, Homo sapiens
ucaaaaauacaaa

SEQ ID NO: 444867 - RNA, 17 nt, Homo sapiens
ucaaaaccugugccagg

SEQ ID NO: 444868 - RNA, 20 nt, Homo sapiens
ucaaaagccauaacuugaaa

SEQ ID NO: 444869 - RNA, 20 nt, Homo sapiens
ucaaaagccugggugagaau

SEQ ID NO: 444870 - RNA, 15 nt, Homo sapiens
ucaaaaggaaaccaa

SEQ ID NO: 444871 - RNA, 18 nt, Homo sapiens
ucaaaauaaaaagugaca

SEQ ID NO: 444872 - RNA, 14 nt, Homo sapiens
ucaaaauacuucuu

SEQ ID NO: 444873 - RNA, 14 nt, Homo sapiens
ucaaaauaguucua

SEQ ID NO: 444874 - RNA, 16 nt, Homo sapiens
ucaaaauauacauuca

SEQ ID NO: 444875 - RNA, 18 nt, Homo sapiens
ucaaaauauacauucaaa

SEQ ID NO: 444876 - RNA, 19 nt, Homo sapiens
ucaaaauccuuccaaagaa

SEQ ID NO: 444877 - RNA, 20 nt, Homo sapiens
ucaaaauggacguacugguu

SEQ ID NO: 444878 - RNA, 21 nt, Homo sapiens
ucaaaauuugauggugaauau

SEQ ID NO: 444879 - RNA, 23 nt, Homo sapiens
ucaaacaaaaauauuuugaucau

SEQ ID NO: 444880 - RNA, 15 nt, Homo sapiens
ucaaacagaaaagaa

SEQ ID NO: 444881 - RNA, 20 nt, Homo sapiens
ucaaacaugaaaacauugau

SEQ ID NO: 444882 - RNA, 17 nt, Homo sapiens
ucaaacauuauucucaa

SEQ ID NO: 444883 - RNA, 18 nt, Homo sapiens
ucaaaccccgaccaccug

SEQ ID NO: 444884 - RNA, 20 nt, Homo sapiens
ucaaaccuaccacucaggaa

SEQ ID NO: 444885 - RNA, 21 nt, Homo sapiens
ucaaaccugcauauugugauu

SEQ ID NO: 444886 - RNA, 17 nt, Homo sapiens
ucaaacuagugcaugaa

SEQ ID NO: 444887 - RNA, 14 nt, Homo sapiens
ucaaacucaaacac

SEQ ID NO: 444888 - RNA, 18 nt, Homo sapiens
ucaaagaaucaccuaauu

SEQ ID NO: 444889 - RNA, 16 nt, Homo sapiens
ucaaagauguacugag

SEQ ID NO: 444890 - RNA, 21 nt, Homo sapiens
ucaaagauguacugagaggag

SEQ ID NO: 444891 - RNA, 22 nt, Homo sapiens
ucaaagcaggaauugguggcag

SEQ ID NO: 444892 - RNA, 17 nt, Homo sapiens
ucaaagugguacaggaa

SEQ ID NO: 444893 - RNA, 21 nt, Homo sapiens
ucaaauaaaucuaaaucuuca

SEQ ID NO: 444894 - RNA, 19 nt, Homo sapiens
ucaaaucagagcagugauu

SEQ ID NO: 444895 - RNA, 14 nt, Homo sapiens
ucaaaugcaugaua

SEQ ID NO: 444896 - RNA, 16 nt, Homo sapiens
ucaaaugcauuuucua

SEQ ID NO: 444897 - RNA, 17 nt, Homo sapiens
ucaaauuggacuuucaa

SEQ ID NO: 444898 - RNA, 16 nt, Homo sapiens
ucaacaccacuaggaa

SEQ ID NO: 444899 - RNA, 20 nt, Homo sapiens
ucaacaccaggagagcuucu

SEQ ID NO: 444900 - RNA, 17 nt, Homo sapiens
ucaacagugaacagcuu

SEQ ID NO: 444901 - RNA, 20 nt, Homo sapiens
ucaacauguuuuugauauuu

SEQ ID NO: 444902 - RNA, 12 nt, Homo sapiens
ucaacauugcau

SEQ ID NO: 444903 - RNA, 18 nt, Homo sapiens
ucaacccaauaauucugu

SEQ ID NO: 444904 - RNA, 21 nt, Homo sapiens
ucaacccaauaauucuguauu

SEQ ID NO: 444905 - RNA, 21 nt, Homo sapiens
ucaaccugcacuucauaucua

SEQ ID NO: 444906 - RNA, 15 nt, Homo sapiens
ucaaccugugaugag

SEQ ID NO: 444907 - RNA, 19 nt, Homo sapiens
ucaacugaugauagacuuc

SEQ ID NO: 444908 - RNA, 15 nt, Homo sapiens
ucaacuuacauaugu

SEQ ID NO: 444909 - RNA, 22 nt, Homo sapiens
ucaacuuuagcuaguaucuuca

SEQ ID NO: 444910 - RNA, 20 nt, Homo sapiens
ucaagacauaaguaaaugag

SEQ ID NO: 444911 - RNA, 20 nt, Homo sapiens
ucaagacggagaugcauggc

SEQ ID NO: 444912 - RNA, 19 nt, Homo sapiens
ucaagagaaguacagaaug

SEQ ID NO: 444913 - RNA, 11 nt, Homo sapiens
ucaagagccag

SEQ ID NO: 444914 - RNA, 15 nt, Homo sapiens
ucaagaugugacaug

SEQ ID NO: 444915 - RNA, 17 nt, Homo sapiens
ucaagauuaaacugagu

SEQ ID NO: 444916 - RNA, 16 nt, Homo sapiens
ucaagcaaacaucaaa

SEQ ID NO: 444917 - RNA, 17 nt, Homo sapiens
ucaagcaauccuccuga

SEQ ID NO: 444918 - RNA, 21 nt, Homo sapiens
ucaagcaauccuccugaguga

SEQ ID NO: 444919 - RNA, 12 nt, Homo sapiens
ucaagccaggag

SEQ ID NO: 444920 - RNA, 19 nt, Homo sapiens
ucaaggaagugauaacacu

SEQ ID NO: 444921 - RNA, 14 nt, Homo sapiens
ucaaggagauauga

SEQ ID NO: 444922 - RNA, 22 nt, Homo sapiens
ucaaguagcguuggagacauac

SEQ ID NO: 444923 - RNA, 19 nt, Homo sapiens
ucaaguccuacaagcuaaa

SEQ ID NO: 444924 - RNA, 15 nt, Homo sapiens
ucaagugauagucuu

SEQ ID NO: 444925 - RNA, 19 nt, Homo sapiens
ucaagugauucuccugccu

SEQ ID NO: 444926 - RNA, 21 nt, Homo sapiens
ucaagugauucuccugccuca

SEQ ID NO: 444927 - RNA, 14 nt, Homo sapiens
ucaagugucuucca

SEQ ID NO: 444928 - RNA, 17 nt, Homo sapiens
ucaaguuaacaaggaau

SEQ ID NO: 444929 - RNA, 16 nt, Homo sapiens
ucaaguugugcuuguu

SEQ ID NO: 444930 - RNA, 22 nt, Homo sapiens
ucaauaaacagcuucaugccuu

SEQ ID NO: 444931 - RNA, 21 nt, Homo sapiens
ucaauaaacugugucuguccc

SEQ ID NO: 444932 - RNA, 22 nt, Homo sapiens
ucaauaaauacuuuaacuucca

SEQ ID NO: 444933 - RNA, 22 nt, Homo sapiens
ucaauaaauagaugaguccugu

SEQ ID NO: 444934 - RNA, 16 nt, Homo sapiens
ucaauaacuauugcug

SEQ ID NO: 444935 - RNA, 20 nt, Homo sapiens
ucaauacccuuggcacugau

SEQ ID NO: 444936 - RNA, 12 nt, Homo sapiens
ucaauaguauua

SEQ ID NO: 444937 - RNA, 15 nt, Homo sapiens
ucaaucaaacaggga

SEQ ID NO: 444938 - RNA, 15 nt, Homo sapiens
ucaaucauuaauuca

SEQ ID NO: 444939 - RNA, 20 nt, Homo sapiens
ucaaucuggcuucugcauua

SEQ ID NO: 444940 - RNA, 15 nt, Homo sapiens
ucaaugcuagcacaa

SEQ ID NO: 444941 - RNA, 14 nt, Homo sapiens
ucaaugcuauggac

SEQ ID NO: 444942 - RNA, 15 nt, Homo sapiens
ucaaugcucuaacaa

SEQ ID NO: 444943 - RNA, 21 nt, Homo sapiens
ucaaugcugacuggacugugu

SEQ ID NO: 444944 - RNA, 18 nt, Homo sapiens
ucaauuacaggaaguacu

SEQ ID NO: 444945 - RNA, 16 nt, Homo sapiens
ucaauuauuacauuua

SEQ ID NO: 444946 - RNA, 22 nt, Homo sapiens
ucaauucccacguagacucuua

SEQ ID NO: 444947 - RNA, 15 nt, Homo sapiens
ucaauuuccugaugc

SEQ ID NO: 444948 - RNA, 16 nt, Homo sapiens
ucaauuuuauaucuag

SEQ ID NO: 444949 - RNA, 14 nt, Homo sapiens
ucacaaacuacaaa

SEQ ID NO: 444950 - RNA, 22 nt, Homo sapiens
ucacaaauaaguaauaucuuuc

SEQ ID NO: 444951 - RNA, 20 nt, Homo sapiens
ucagggggcaugaagcacau

SEQ ID NO: 444952 - RNA, 12 nt, Homo sapiens
ucagguagccac

SEQ ID NO: 444953 - RNA, 14 nt, Homo sapiens
ucagguaguacugg

SEQ ID NO: 444954 - RNA, 19 nt, Homo sapiens
ucaggugaaaauccaucuc

SEQ ID NO: 444955 - RNA, 14 nt, Homo sapiens
ucuuuggccagaag

SEQ ID NO: 444956 - RNA, 21 nt, Homo sapiens
ucuuuguaagaguggaaccaa

SEQ ID NO: 444957 - RNA, 21 nt, Homo sapiens
ucuuugucaaugcucuaacaa

SEQ ID NO: 444958 - RNA, 12 nt, Homo sapiens
ucuuuguggcag

SEQ ID NO: 444959 - RNA, 21 nt, Homo sapiens
ucuuuuaaauaauauccaccu

SEQ ID NO: 444960 - RNA, 15 nt, Homo sapiens
ucuuuuaaaugggug

SEQ ID NO: 444961 - RNA, 22 nt, Homo sapiens
ucuuuuacuguggagguggcug

SEQ ID NO: 444962 - RNA, 15 nt, Homo sapiens
ucuuuucuccuccuc

SEQ ID NO: 444963 - RNA, 22 nt, Homo sapiens
ucuuuucuucuccgccaguaug

SEQ ID NO: 444964 - RNA, 15 nt, Homo sapiens
ucuuuugaaaugcca

SEQ ID NO: 444965 - RNA, 18 nt, Homo sapiens
ucuuuugaaggacuccuu

SEQ ID NO: 444966 - RNA, 18 nt, Homo sapiens
ucuuuuucaaaacuaguu

SEQ ID NO: 444967 - RNA, 19 nt, Homo sapiens
ucuuuuuucuuccuauuuc

SEQ ID NO: 444968 - RNA, 18 nt, Homo sapiens
ucuuuuuugucucaagau

SEQ ID NO: 444969 - RNA, 20 nt, Homo sapiens
ugaaaaaaaucuuugcuugu

SEQ ID NO: 444970 - RNA, 15 nt, Homo sapiens
ugaaaaagaacugua

SEQ ID NO: 444971 - RNA, 14 nt, Homo sapiens
ugaaaaaguauugu

SEQ ID NO: 444972 - RNA, 14 nt, Homo sapiens
ugaaaaauguauau

SEQ ID NO: 444973 - RNA, 19 nt, Homo sapiens
ugaaaacaccaagaguaca

SEQ ID NO: 444974 - RNA, 13 nt, Homo sapiens
ugaaaacaucugc

SEQ ID NO: 444975 - RNA, 20 nt, Homo sapiens
ugaaaaccacccuaucauca

SEQ ID NO: 444976 - RNA, 17 nt, Homo sapiens
ugaaaaccucuuuccaa

SEQ ID NO: 444977 - RNA, 21 nt, Homo sapiens
ugaaaacuuagagagguacaa

SEQ ID NO: 444978 - RNA, 12 nt, Homo sapiens
ugaaaacuucaa

SEQ ID NO: 444979 - RNA, 14 nt, Homo sapiens
ugaaaacuucaaag

SEQ ID NO: 444980 - RNA, 19 nt, Homo sapiens
ugaaaagaaaaugugccau

SEQ ID NO: 444981 - RNA, 19 nt, Homo sapiens
ugaaaaggguguugcuaag

SEQ ID NO: 444982 - RNA, 15 nt, Homo sapiens
ugaaaagguugccug

SEQ ID NO: 444983 - RNA, 22 nt, Homo sapiens
ugaaaauacaacuuaaauaaua

SEQ ID NO: 444984 - RNA, 19 nt, Homo sapiens
ugaaaauauuuuguugccu

SEQ ID NO: 444985 - RNA, 16 nt, Homo sapiens
ugaaaauccaucucau

SEQ ID NO: 444986 - RNA, 14 nt, Homo sapiens
ugaaaaucuaauau

SEQ ID NO: 444987 - RNA, 16 nt, Homo sapiens
ugaaaaugaaucuuca

SEQ ID NO: 444988 - RNA, 14 nt, Homo sapiens
ugaaaauguacuga

SEQ ID NO: 444989 - RNA, 12 nt, Homo sapiens
ugaaaaugugug

SEQ ID NO: 444990 - RNA, 20 nt, Homo sapiens
ugaaaauguuguuaugcuau

SEQ ID NO: 444991 - RNA, 13 nt, Homo sapiens
ugaaaauucuuga

SEQ ID NO: 444992 - RNA, 15 nt, Homo sapiens
ugaaaauucuugaua

SEQ ID NO: 444993 - RNA, 15 nt, Homo sapiens
ugaaaauuguagggu

SEQ ID NO: 444994 - RNA, 17 nt, Homo sapiens
ugaaacaaauaaucaca

SEQ ID NO: 444995 - RNA, 15 nt, Homo sapiens
ugaaacaacccaaag

SEQ ID NO: 444996 - RNA, 14 nt, Homo sapiens
ugaaacacagucau

SEQ ID NO: 444997 - RNA, 21 nt, Homo sapiens
ugaaacacucaguuguucaau

SEQ ID NO: 444998 - RNA, 20 nt, Homo sapiens
ugaaacauuugacacauaaa

SEQ ID NO: 444999 - RNA, 14 nt, Homo sapiens
ugaaacauuuggaa

SEQ ID NO: 445000 - RNA, 16 nt, Homo sapiens
ugaaaccuuccucuug

SEQ ID NO: 445001 - RNA, 21 nt, Homo sapiens
ugaaacugacuugcugugacu

SEQ ID NO: 445002 - RNA, 15 nt, Homo sapiens
ugaaacugcugugaa

SEQ ID NO: 445003 - RNA, 23 nt, Homo sapiens
ugaaagaaaaauaccaugucucu

SEQ ID NO: 445004 - RNA, 14 nt, Homo sapiens
ugaaagaacaucag

SEQ ID NO: 445005 - RNA, 15 nt, Homo sapiens
ugaaagaaccagaga

SEQ ID NO: 445006 - RNA, 20 nt, Homo sapiens
ugaaagauugauuaaugaac

SEQ ID NO: 445007 - RNA, 20 nt, Homo sapiens
ugaaaggaaaaacagaacau

SEQ ID NO: 445008 - RNA, 15 nt, Homo sapiens
ugaaaggucaucuca

SEQ ID NO: 445009 - RNA, 19 nt, Homo sapiens
ugaaaguccagcacuggaa

SEQ ID NO: 445010 - RNA, 22 nt, Homo sapiens
ugaaaguuuguucugcagagac

SEQ ID NO: 445011 - RNA, 14 nt, Homo sapiens
ugaaauacauauga

SEQ ID NO: 445012 - RNA, 17 nt, Homo sapiens
ugaaauauaaacuguga

SEQ ID NO: 445013 - RNA, 18 nt, Homo sapiens
ugaaauauaaacugugag

SEQ ID NO: 445014 - RNA, 14 nt, Homo sapiens
ugaaauaugcaucu

SEQ ID NO: 445015 - RNA, 17 nt, Homo sapiens
ugaaauauuuuugaaug

SEQ ID NO: 445016 - RNA, 19 nt, Homo sapiens
ugaaaucgcugcucaaaaa

SEQ ID NO: 445017 - RNA, 15 nt, Homo sapiens
ugaaaugacugucua

SEQ ID NO: 445018 - RNA, 13 nt, Homo sapiens
ugaaaugucuguu

SEQ ID NO: 445019 - RNA, 18 nt, Homo sapiens
ugaaauguuuccaggcau

SEQ ID NO: 445020 - RNA, 13 nt, Homo sapiens
ugaaauugaguca

SEQ ID NO: 445021 - RNA, 14 nt, Homo sapiens
ugaaauuuacaguu

SEQ ID NO: 445022 - RNA, 21 nt, Homo sapiens
ugaaauuuuuaaaucauuuca

SEQ ID NO: 445023 - RNA, 19 nt, Homo sapiens
ugaacaaucaaagcacuug

SEQ ID NO: 445024 - RNA, 20 nt, Homo sapiens
ugaacaaucaaagcacuugg

SEQ ID NO: 445025 - RNA, 16 nt, Homo sapiens
ugaacacaggcaaaga

SEQ ID NO: 445026 - RNA, 23 nt, Homo sapiens
ugaacaccacgcuugacaggaca

SEQ ID NO: 445027 - RNA, 13 nt, Homo sapiens
ugaacagaacaaa

SEQ ID NO: 445028 - RNA, 15 nt, Homo sapiens
ugaacagaacaaaag

SEQ ID NO: 445029 - RNA, 14 nt, Homo sapiens
ugaacauaaaucag

SEQ ID NO: 445030 - RNA, 23 nt, Homo sapiens
ugaacauaggaaaauagaaacuu

SEQ ID NO: 445031 - RNA, 18 nt, Homo sapiens
ugaacauauccaucaucc

SEQ ID NO: 445032 - RNA, 22 nt, Homo sapiens
ugaacauauuuaaaguguacua

SEQ ID NO: 445033 - RNA, 17 nt, Homo sapiens
ugaaccaaaacauuccg

SEQ ID NO: 445034 - RNA, 14 nt, Homo sapiens
ugaaccuuugucca

SEQ ID NO: 445035 - RNA, 14 nt, Homo sapiens
ugaacucagcuauu

SEQ ID NO: 445036 - RNA, 18 nt, Homo sapiens
ugaacuccugggcucaag

SEQ ID NO: 445037 - RNA, 15 nt, Homo sapiens
ugaacucgaagccca

SEQ ID NO: 445038 - RNA, 18 nt, Homo sapiens
ugaacucuucaaucucuu

SEQ ID NO: 445039 - RNA, 18 nt, Homo sapiens
ugaacugaaguuucacau

SEQ ID NO: 445040 - RNA, 18 nt, Homo sapiens
ugaacuguggggugugca

SEQ ID NO: 445041 - RNA, 20 nt, Homo sapiens
ugaacuguggggugugcaca

SEQ ID NO: 445042 - RNA, 20 nt, Homo sapiens
ugaacuuaacaugcugugua

SEQ ID NO: 445043 - RNA, 16 nt, Homo sapiens
ugaacuucagcuagag

SEQ ID NO: 445044 - RNA, 17 nt, Homo sapiens
ugaagaacucaugugau

SEQ ID NO: 445045 - RNA, 20 nt, Homo sapiens
ugaagaacucaugugauuua

SEQ ID NO: 445046 - RNA, 19 nt, Homo sapiens
ugaagaauacacugugacu

SEQ ID NO: 445047 - RNA, 20 nt, Homo sapiens
ugaagacagauacuccucca

SEQ ID NO: 445048 - RNA, 22 nt, Homo sapiens
ugaagacuucuagcagaaaaau

SEQ ID NO: 445049 - RNA, 12 nt, Homo sapiens
ugaagaucucag

SEQ ID NO: 445050 - RNA, 13 nt, Homo sapiens
ugaagaugaucau

SEQ ID NO: 445051 - RNA, 23 nt, Homo sapiens
ugaagcaaaucagaaacuuguga

SEQ ID NO: 445052 - RNA, 19 nt, Homo sapiens
ugaagcaaauuucuagaua

SEQ ID NO: 445053 - RNA, 21 nt, Homo sapiens
ugaagcccuccaaaagcacuu

SEQ ID NO: 445054 - RNA, 18 nt, Homo sapiens
ugaagcccuuugccugua

SEQ ID NO: 445055 - RNA, 21 nt, Homo sapiens
ugaaggaccugggcucuuggc

SEQ ID NO: 445056 - RNA, 15 nt, Homo sapiens
ugaaggacuacaggu

SEQ ID NO: 445057 - RNA, 18 nt, Homo sapiens
ugaaggcaaccuggaagg

SEQ ID NO: 445058 - RNA, 19 nt, Homo sapiens
ugaagggggauaugaaugg

SEQ ID NO: 445059 - RNA, 23 nt, Homo sapiens
ugaaggguguucacccaucccac

SEQ ID NO: 445060 - RNA, 14 nt, Homo sapiens
ugaaggucugcaag

SEQ ID NO: 445061 - RNA, 12 nt, Homo sapiens
ugaaggugaccu

SEQ ID NO: 445062 - RNA, 14 nt, Homo sapiens
ugaaguacauauua

SEQ ID NO: 445063 - RNA, 14 nt, Homo sapiens
ugaaguacuuuuaa

SEQ ID NO: 445064 - RNA, 23 nt, Homo sapiens
ugaagucucuuuuucuuccucuc

SEQ ID NO: 445065 - RNA, 18 nt, Homo sapiens
ugaagugaugauggauga

SEQ ID NO: 445066 - RNA, 16 nt, Homo sapiens
ugaaguucaaaugccc

SEQ ID NO: 445067 - RNA, 17 nt, Homo sapiens
ugaaguugggaaauuca

SEQ ID NO: 445068 - RNA, 20 nt, Homo sapiens
ugaaguuugccccagugcua

SEQ ID NO: 445069 - RNA, 18 nt, Homo sapiens
ugaauaaagccacauaac

SEQ ID NO: 445070 - RNA, 19 nt, Homo sapiens
ugaauaaaguugaagcuaa

SEQ ID NO: 445071 - RNA, 16 nt, Homo sapiens
ugaauaaccacuuaaa

SEQ ID NO: 445072 - RNA, 16 nt, Homo sapiens
ugcacaaaaagcacaa

SEQ ID NO: 445073 - RNA, 15 nt, Homo sapiens
ugcacaaagcccuuc

SEQ ID NO: 445074 - RNA, 16 nt, Homo sapiens
ugcacaaagcccuucc

SEQ ID NO: 445075 - RNA, 18 nt, Homo sapiens
ugcacacaaacaccuccu

SEQ ID NO: 445076 - RNA, 20 nt, Homo sapiens
ugcacacacacacaucucau

SEQ ID NO: 445077 - RNA, 14 nt, Homo sapiens
ugcacacauaacac

SEQ ID NO: 445078 - RNA, 20 nt, Homo sapiens
ugcacagccauggcuggaau

SEQ ID NO: 445079 - RNA, 18 nt, Homo sapiens
ugcacagcucaacggaag

SEQ ID NO: 445080 - RNA, 20 nt, Homo sapiens
ugcacaggccacuugcucag

SEQ ID NO: 445081 - RNA, 22 nt, Homo sapiens
ugcacagguuuucagcaacuca

SEQ ID NO: 445082 - RNA, 24 nt, Homo sapiens
ugcacauuagagggacagccaaaa

SEQ ID NO: 445083 - RNA, 15 nt, Homo sapiens
ugcaccaacgagcug

SEQ ID NO: 445084 - RNA, 15 nt, Homo sapiens
ugcaccaaguacagc

SEQ ID NO: 445085 - RNA, 18 nt, Homo sapiens
ugcaccaaguacagccuu

SEQ ID NO: 445086 - RNA, 17 nt, Homo sapiens
ugcaccaggagacagac

SEQ ID NO: 445087 - RNA, 14 nt, Homo sapiens
ugcacccacucugc

SEQ ID NO: 445088 - RNA, 13 nt, Homo sapiens
ugcacccaugugu

SEQ ID NO: 445089 - RNA, 20 nt, Homo sapiens
ugcaccgagagagauggaau

SEQ ID NO: 445090 - RNA, 21 nt, Homo sapiens
ugcaccuacgggggcaucuga

SEQ ID NO: 445091 - RNA, 14 nt, Homo sapiens
ugcacgaucucagu

SEQ ID NO: 445092 - RNA, 23 nt, Homo sapiens
ugcacuacuccucugcagugccu

SEQ ID NO: 445093 - RNA, 13 nt, Homo sapiens
ugcacuacugaca

SEQ ID NO: 445094 - RNA, 16 nt, Homo sapiens
ugcacuagccaaccca

SEQ ID NO: 445095 - RNA, 10 nt, Homo sapiens
ugcacuccau

SEQ ID NO: 445096 - RNA, 23 nt, Homo sapiens
ugcacuguagccuuagugucacc

SEQ ID NO: 445097 - RNA, 20 nt, Homo sapiens
ugcacuuuuuuauaagagcu

SEQ ID NO: 445098 - RNA, 18 nt, Homo sapiens
ugcagaaggcaggaucaa

SEQ ID NO: 445099 - RNA, 18 nt, Homo sapiens
ugcagaccccuuggccag

SEQ ID NO: 445100 - RNA, 15 nt, Homo sapiens
ugcagaccugggacu

SEQ ID NO: 445101 - RNA, 16 nt, Homo sapiens
ugcagagagguuguga

SEQ ID NO: 445102 - RNA, 16 nt, Homo sapiens
ugcagaggcugagcag

SEQ ID NO: 445103 - RNA, 15 nt, Homo sapiens
ugcagauaacagcug

SEQ ID NO: 445104 - RNA, 16 nt, Homo sapiens
ugcagauaacagcugg

SEQ ID NO: 445105 - RNA, 14 nt, Homo sapiens
ugcagcagagccug

SEQ ID NO: 445106 - RNA, 21 nt, Homo sapiens
ugcagcagcaacacaauguua

SEQ ID NO: 445107 - RNA, 22 nt, Homo sapiens
ugcagcagugagucucuucaga

SEQ ID NO: 445108 - RNA, 21 nt, Homo sapiens
ugcagcaucuacuacucuguc

SEQ ID NO: 445109 - RNA, 19 nt, Homo sapiens
ugcagccacgucagccaaa

SEQ ID NO: 445110 - RNA, 18 nt, Homo sapiens
ugcagccacugugcugaa

SEQ ID NO: 445111 - RNA, 22 nt, Homo sapiens
ugcagcccacagaggacagugc

SEQ ID NO: 445112 - RNA, 21 nt, Homo sapiens
ugcagccgccgaaaaacagga

SEQ ID NO: 445113 - RNA, 14 nt, Homo sapiens
ugcagcucccagaa

SEQ ID NO: 445114 - RNA, 23 nt, Homo sapiens
ugcagcucuggagguacgaaaag

SEQ ID NO: 445115 - RNA, 13 nt, Homo sapiens
ugcaggaagggaa

SEQ ID NO: 445116 - RNA, 17 nt, Homo sapiens
ugcaggagagacaguga

SEQ ID NO: 445117 - RNA, 19 nt, Homo sapiens
ugcagggaagagggcagua

SEQ ID NO: 445118 - RNA, 16 nt, Homo sapiens
ugcagggaauuuucau

SEQ ID NO: 445119 - RNA, 13 nt, Homo sapiens
ugcaggggucccc

SEQ ID NO: 445120 - RNA, 17 nt, Homo sapiens
ugcaggguccccaagga

SEQ ID NO: 445121 - RNA, 17 nt, Homo sapiens
ugcagguacuuccucag

SEQ ID NO: 445122 - RNA, 15 nt, Homo sapiens
ugcagguuguuguca

SEQ ID NO: 445123 - RNA, 14 nt, Homo sapiens
ugcaguaaccauuu

SEQ ID NO: 445124 - RNA, 11 nt, Homo sapiens
ugcaguagcac

SEQ ID NO: 445125 - RNA, 23 nt, Homo sapiens
ugcagucaaaggaacgccuuccc

SEQ ID NO: 445126 - RNA, 14 nt, Homo sapiens
ugcagugcugcuuu

SEQ ID NO: 445127 - RNA, 18 nt, Homo sapiens
ugcaguggcgugaucucg

SEQ ID NO: 445128 - RNA, 12 nt, Homo sapiens
ugcagugggugg

SEQ ID NO: 445129 - RNA, 17 nt, Homo sapiens
ugcaguggugaugccua

SEQ ID NO: 445130 - RNA, 17 nt, Homo sapiens
ugcaguggugugaucuc

SEQ ID NO: 445131 - RNA, 18 nt, Homo sapiens
ugcaguggugugaucucg

SEQ ID NO: 445132 - RNA, 15 nt, Homo sapiens
ugcagugucuuguaa

SEQ ID NO: 445133 - RNA, 23 nt, Homo sapiens
ugcauaaaagacaagcacuuugg

SEQ ID NO: 445134 - RNA, 21 nt, Homo sapiens
ugcauaaaguaaguaaggugc

SEQ ID NO: 445135 - RNA, 22 nt, Homo sapiens
ugcauaagugaaaaucuuacaa

SEQ ID NO: 445136 - RNA, 18 nt, Homo sapiens
ugcauaauaagcuaaaga

SEQ ID NO: 445137 - RNA, 14 nt, Homo sapiens
ugcauacccgggca

SEQ ID NO: 445138 - RNA, 14 nt, Homo sapiens
ugcauaguauucca

SEQ ID NO: 445139 - RNA, 21 nt, Homo sapiens
ugcaucaagggcuuuaucaaa

SEQ ID NO: 445140 - RNA, 19 nt, Homo sapiens
ugcaucaugcaugcacucu

SEQ ID NO: 445141 - RNA, 16 nt, Homo sapiens
ugcaucauguugaaua

SEQ ID NO: 445142 - RNA, 13 nt, Homo sapiens
ugcauccuacucc

SEQ ID NO: 445143 - RNA, 21 nt, Homo sapiens
ugcaucuccccucagauucca

SEQ ID NO: 445144 - RNA, 21 nt, Homo sapiens
ugcaugacaaacacacaucca

SEQ ID NO: 445145 - RNA, 19 nt, Homo sapiens
ugcaugauccagcugugug

SEQ ID NO: 445146 - RNA, 19 nt, Homo sapiens
ugcaugccaggcugggcac

SEQ ID NO: 445147 - RNA, 21 nt, Homo sapiens
ugcaugcccuaagagugucac

SEQ ID NO: 445148 - RNA, 15 nt, Homo sapiens
ugcauggaguauuau

SEQ ID NO: 445149 - RNA, 18 nt, Homo sapiens
ugcaugugcauauagaca

SEQ ID NO: 445150 - RNA, 17 nt, Homo sapiens
ugcaugugugugcucag

SEQ ID NO: 445151 - RNA, 21 nt, Homo sapiens
ugcauguuuuaugugcacuca

SEQ ID NO: 445152 - RNA, 16 nt, Homo sapiens
ugcauugugaggguua

SEQ ID NO: 445153 - RNA, 15 nt, Homo sapiens
ugcauuuacuuuuaa

SEQ ID NO: 445154 - RNA, 23 nt, Homo sapiens
ugcauuuauaaauguguggugcu

SEQ ID NO: 445155 - RNA, 15 nt, Homo sapiens
ugcauuucuccgugc

SEQ ID NO: 445156 - RNA, 17 nt, Homo sapiens
ugcauuuuuaaagacag

SEQ ID NO: 445157 - RNA, 16 nt, Homo sapiens
ugcauuuuugugaaau

SEQ ID NO: 445158 - RNA, 17 nt, Homo sapiens
ugcauuuuuuauuuagu

SEQ ID NO: 445159 - RNA, 20 nt, Homo sapiens
ugccaaaaacuaaaauucaa

SEQ ID NO: 445160 - RNA, 21 nt, Homo sapiens
ugccaaaaacuaaaauucaac

SEQ ID NO: 445161 - RNA, 18 nt, Homo sapiens
ugccaaagggaaauauca

SEQ ID NO: 445162 - RNA, 20 nt, Homo sapiens
ugccaacagacacuacauua

SEQ ID NO: 445163 - RNA, 23 nt, Homo sapiens
ugccaagccuggagccccugugu

SEQ ID NO: 445164 - RNA, 16 nt, Homo sapiens
ugccacaaugugauau

SEQ ID NO: 445165 - RNA, 18 nt, Homo sapiens
ugccacacgucugacccu

SEQ ID NO: 445166 - RNA, 14 nt, Homo sapiens
ugccaccacccacc

SEQ ID NO: 445167 - RNA, 19 nt, Homo sapiens
ugccaccaggcacugccug

SEQ ID NO: 445168 - RNA, 11 nt, Homo sapiens
ugccacuggau

SEQ ID NO: 445169 - RNA, 13 nt, Homo sapiens
ugccagacugaag

SEQ ID NO: 445170 - RNA, 21 nt, Homo sapiens
ugccaggauuuuguauugcca

SEQ ID NO: 445171 - RNA, 20 nt, Homo sapiens
ugccaggcagaaaacuggca

SEQ ID NO: 445172 - RNA, 21 nt, Homo sapiens
ugccaggcguuggugccacuu

SEQ ID NO: 445173 - RNA, 22 nt, Homo sapiens
ugccaggcucucccucucugca

SEQ ID NO: 445174 - RNA, 13 nt, Homo sapiens
ugccagugacaug

SEQ ID NO: 445175 - RNA, 20 nt, Homo sapiens
ugccaucagccccugcugcu

SEQ ID NO: 445176 - RNA, 16 nt, Homo sapiens
ugccauggccugugcu

SEQ ID NO: 445177 - RNA, 13 nt, Homo sapiens
ugccaugugaaga

SEQ ID NO: 445178 - RNA, 21 nt, Homo sapiens
ugccauuagacugaauuuaac

SEQ ID NO: 445179 - RNA, 18 nt, Homo sapiens
ugccauucccacuaagcu

SEQ ID NO: 445180 - RNA, 16 nt, Homo sapiens
ugccauuccgaccuuc

SEQ ID NO: 445181 - RNA, 17 nt, Homo sapiens
ugccauugucuuuccuc

SEQ ID NO: 445182 - RNA, 17 nt, Homo sapiens
ugcccaaccucagcaac

SEQ ID NO: 445183 - RNA, 15 nt, Homo sapiens
ugcccaauaugcagu

SEQ ID NO: 445184 - RNA, 13 nt, Homo sapiens
ugcccacacuugg

SEQ ID NO: 445185 - RNA, 22 nt, Homo sapiens
ugcccagagaugggacugggag

SEQ ID NO: 445186 - RNA, 15 nt, Homo sapiens
ugcccaucauacgca

SEQ ID NO: 445187 - RNA, 12 nt, Homo sapiens
ugcccaucaucu

SEQ ID NO: 445188 - RNA, 21 nt, Homo sapiens
ugcccauggaagucucaaaga

SEQ ID NO: 445189 - RNA, 17 nt, Homo sapiens
ugccccacaggccacac

SEQ ID NO: 445190 - RNA, 19 nt, Homo sapiens
ugccccagagaagccucag

SEQ ID NO: 445191 - RNA, 21 nt, Homo sapiens
ugccccaguaacucacuuuaa

SEQ ID NO: 445192 - RNA, 20 nt, Homo sapiens
ugcccccgcggguucuagac

SEQ ID NO: 445193 - RNA, 15 nt, Homo sapiens
ugccccgacacccag

SEQ ID NO: 445194 - RNA, 18 nt, Homo sapiens
ugccccgugguacauuca

SEQ ID NO: 445195 - RNA, 16 nt, Homo sapiens
ugccccucuguaacaa

SEQ ID NO: 445196 - RNA, 15 nt, Homo sapiens
ugcccgagagcucuu

SEQ ID NO: 445197 - RNA, 12 nt, Homo sapiens
ugcccgccagcc

SEQ ID NO: 445198 - RNA, 22 nt, Homo sapiens
ugcccggggcagcugccagaga

SEQ ID NO: 445199 - RNA, 23 nt, Homo sapiens
ugcccggggcagcugccagagaa

SEQ ID NO: 445200 - RNA, 21 nt, Homo sapiens
ugcccuagcgcucucuuccag

SEQ ID NO: 445201 - RNA, 21 nt, Homo sapiens
ugcccucuuaagugugcacag

SEQ ID NO: 445202 - RNA, 17 nt, Homo sapiens
ugcccuggauccaucag

SEQ ID NO: 445203 - RNA, 16 nt, Homo sapiens
ugcccugguccaggga

SEQ ID NO: 445204 - RNA, 14 nt, Homo sapiens
uuauuacucugaua

SEQ ID NO: 445205 - RNA, 17 nt, Homo sapiens
uuauucaccaucaugua

SEQ ID NO: 445206 - RNA, 14 nt, Homo sapiens
uuauuccuccagga

SEQ ID NO: 445207 - RNA, 21 nt, Homo sapiens
uuauuccugcacucacaggcu

SEQ ID NO: 445208 - RNA, 14 nt, Homo sapiens
uuauugaaugugau

SEQ ID NO: 445209 - RNA, 13 nt, Homo sapiens
uuauugcuauuaa

SEQ ID NO: 445210 - RNA, 20 nt, Homo sapiens
uuauuuacaugugauuguga

SEQ ID NO: 445211 - RNA, 20 nt, Homo sapiens
uuauuuacugacauauaucu

SEQ ID NO: 445212 - RNA, 19 nt, Homo sapiens
uuauuugaaaaacauacau

SEQ ID NO: 445213 - RNA, 15 nt, Homo sapiens
uuauuuuauugccuu

SEQ ID NO: 445214 - RNA, 14 nt, Homo sapiens
uuauuuuggaucua

SEQ ID NO: 445215 - RNA, 15 nt, Homo sapiens
uucaaaagcacaaac

SEQ ID NO: 445216 - RNA, 18 nt, Homo sapiens
uucaaaauaaacaauaaa

SEQ ID NO: 445217 - RNA, 12 nt, Homo sapiens
uucaaaaugcau

SEQ ID NO: 445218 - RNA, 14 nt, Homo sapiens
uucaaaauuccauu

SEQ ID NO: 445219 - RNA, 19 nt, Homo sapiens
uucaaacauuauucucaac

SEQ ID NO: 445220 - RNA, 13 nt, Homo sapiens
uucaaaccaggau

SEQ ID NO: 445221 - RNA, 14 nt, Homo sapiens
uucaaacuacugua

SEQ ID NO: 445222 - RNA, 21 nt, Homo sapiens
uucaaagaacccuagcacaaa

SEQ ID NO: 445223 - RNA, 21 nt, Homo sapiens
uucaaaggcuuccaauguggu

SEQ ID NO: 445224 - RNA, 11 nt, Homo sapiens
uucaaaugcau

SEQ ID NO: 445225 - RNA, 13 nt, Homo sapiens
uucaaaugcauga

SEQ ID NO: 445226 - RNA, 15 nt, Homo sapiens
uucaaauuccugcaa

SEQ ID NO: 445227 - RNA, 14 nt, Homo sapiens
uucaaccaguuuga

SEQ ID NO: 445228 - RNA, 16 nt, Homo sapiens
uucaaccuugagacag

SEQ ID NO: 445229 - RNA, 18 nt, Homo sapiens
uucaagaaagcauugcca

SEQ ID NO: 445230 - RNA, 17 nt, Homo sapiens
uucaaggaagugauaac

SEQ ID NO: 445231 - RNA, 13 nt, Homo sapiens
uucaaggaggaaa

SEQ ID NO: 445232 - RNA, 19 nt, Homo sapiens
uucaaggaugcacagcuca

SEQ ID NO: 445233 - RNA, 11 nt, Homo sapiens
uucaagugauu

SEQ ID NO: 445234 - RNA, 16 nt, Homo sapiens
uucaaguuaaagugaa

SEQ ID NO: 445235 - RNA, 18 nt, Homo sapiens
uucaaguuaauucucaga

SEQ ID NO: 445236 - RNA, 10 nt, Homo sapiens
uucaaugauc

SEQ ID NO: 445237 - RNA, 20 nt, Homo sapiens
uucacacagggcucuuugau

SEQ ID NO: 445238 - RNA, 13 nt, Homo sapiens
uucacaccacagg

SEQ ID NO: 445239 - RNA, 15 nt, Homo sapiens
uucacaccuaugaca

SEQ ID NO: 445240 - RNA, 16 nt, Homo sapiens
uucacaccuaugacau

SEQ ID NO: 445241 - RNA, 23 nt, Homo sapiens
uucacaccucacgcucuggacau

SEQ ID NO: 445242 - RNA, 14 nt, Homo sapiens
uucacacuaagaaa

SEQ ID NO: 445243 - RNA, 15 nt, Homo sapiens
uucacagccaugauu

SEQ ID NO: 445244 - RNA, 15 nt, Homo sapiens
uuccugauacugggu

SEQ ID NO: 445245 - RNA, 11 nt, Homo sapiens
uuccugccacc

SEQ ID NO: 445246 - RNA, 12 nt, Homo sapiens
uuccugcccuac

SEQ ID NO: 445247 - RNA, 16 nt, Homo sapiens
uuccugcuccaugacu

SEQ ID NO: 445248 - RNA, 19 nt, Homo sapiens
uuccugcugccauccucac

SEQ ID NO: 445249 - RNA, 23 nt, Homo sapiens
uuccuggacuggcccuugcccaa

SEQ ID NO: 445250 - RNA, 20 nt, Homo sapiens
uuccuggagaaggcauucca

SEQ ID NO: 445251 - RNA, 19 nt, Homo sapiens
uuccugggcagcccagaga

SEQ ID NO: 445252 - RNA, 14 nt, Homo sapiens
uuccuguccagaga

SEQ ID NO: 445253 - RNA, 15 nt, Homo sapiens
uuccuguccagagag

SEQ ID NO: 445254 - RNA, 11 nt, Homo sapiens
uuccugugaaa

SEQ ID NO: 445255 - RNA, 21 nt, Homo sapiens
uuccuguguggccugccuuca

SEQ ID NO: 445256 - RNA, 23 nt, Homo sapiens
uuccuguugauguucagaaugga

SEQ ID NO: 445257 - RNA, 16 nt, Homo sapiens
uuccuuaaacugugug

SEQ ID NO: 445258 - RNA, 15 nt, Homo sapiens
uuccuucaccaccuc

SEQ ID NO: 445259 - RNA, 14 nt, Homo sapiens
uuccuuccugagaa

SEQ ID NO: 445260 - RNA, 13 nt, Homo sapiens
uuccuucuggccu

SEQ ID NO: 445261 - RNA, 15 nt, Homo sapiens
uuccuugaccuuccu

SEQ ID NO: 445262 - RNA, 12 nt, Homo sapiens
uuccuugcucuc

SEQ ID NO: 445263 - RNA, 15 nt, Homo sapiens
uuccuuggcccagca

SEQ ID NO: 445264 - RNA, 17 nt, Homo sapiens
uuccuuuccugaucacu

SEQ ID NO: 445265 - RNA, 20 nt, Homo sapiens
uucgacccuuucucugagag

SEQ ID NO: 445266 - RNA, 22 nt, Homo sapiens
uucuaaaaacaguuaagacaac

SEQ ID NO: 445267 - RNA, 23 nt, Homo sapiens
uucuaaagauggaaaaaccaccc

SEQ ID NO: 445268 - RNA, 21 nt, Homo sapiens
uucuaaaucauaaucauccuu

SEQ ID NO: 445269 - RNA, 20 nt, Homo sapiens
uucuaauaaauauacuauga

SEQ ID NO: 445270 - RNA, 15 nt, Homo sapiens
uucuaauccaugugc

SEQ ID NO: 445271 - RNA, 14 nt, Homo sapiens
uucuaaugucuuca

SEQ ID NO: 445272 - RNA, 17 nt, Homo sapiens
uucuaauuuuuaagcaa

SEQ ID NO: 445273 - RNA, 11 nt, Homo sapiens
uucuacccuga

SEQ ID NO: 445274 - RNA, 19 nt, Homo sapiens
uucuacuauccuugcuaag

SEQ ID NO: 445275 - RNA, 15 nt, Homo sapiens
uucuacuuugccaca

SEQ ID NO: 445276 - RNA, 22 nt, Homo sapiens
uucuagagagcuuaguguauac

SEQ ID NO: 445277 - RNA, 12 nt, Homo sapiens
uucuagcuauaa

SEQ ID NO: 445278 - RNA, 18 nt, Homo sapiens
uucuaggauaagcacuag

SEQ ID NO: 445279 - RNA, 22 nt, Homo sapiens
uucuaggggcuuccugccuuau

SEQ ID NO: 445280 - RNA, 17 nt, Homo sapiens
uucuauaggaacauaug

SEQ ID NO: 445281 - RNA, 21 nt, Homo sapiens
uucuauaugaauuuaaauaua

SEQ ID NO: 445282 - RNA, 15 nt, Homo sapiens
uucuaucuaauccuu

SEQ ID NO: 445283 - RNA, 22 nt, Homo sapiens
uucuaugguugacauuguauau

SEQ ID NO: 445284 - RNA, 21 nt, Homo sapiens
uucuaugugaccagacugcac

SEQ ID NO: 445285 - RNA, 21 nt, Homo sapiens
uucuauuuuuaguuugcuaag

SEQ ID NO: 445286 - RNA, 23 nt, Homo sapiens
uucucaaauaaaguucaaagcaa

SEQ ID NO: 445287 - RNA, 16 nt, Homo sapiens
uucucaagugccuuaa

SEQ ID NO: 445288 - RNA, 18 nt, Homo sapiens
uucucacauaacagagua

SEQ ID NO: 445289 - RNA, 15 nt, Homo sapiens
uucucaccacagagc

SEQ ID NO: 445290 - RNA, 12 nt, Homo sapiens
uucucagacuuu

SEQ ID NO: 445291 - RNA, 17 nt, Homo sapiens
uucucagguguugccaa

SEQ ID NO: 445292 - RNA, 19 nt, Homo sapiens
uucucagguguugccaaau

SEQ ID NO: 445293 - RNA, 19 nt, Homo sapiens
uucucauguuugugcaugu

SEQ ID NO: 445294 - RNA, 22 nt, Homo sapiens
uucuccaaaacaauuuucugca

SEQ ID NO: 445295 - RNA, 16 nt, Homo sapiens
uucuccaaccacucau

SEQ ID NO: 445296 - RNA, 17 nt, Homo sapiens
uucucccagcacacggc

SEQ ID NO: 445297 - RNA, 16 nt, Homo sapiens
uucucccuugauucca

SEQ ID NO: 445298 - RNA, 15 nt, Homo sapiens
uucuccgucacucca

SEQ ID NO: 445299 - RNA, 19 nt, Homo sapiens
uucucgacucuuugcaaca

SEQ ID NO: 445300 - RNA, 15 nt, Homo sapiens
uucucgugacccagu

SEQ ID NO: 445301 - RNA, 21 nt, Homo sapiens
uucucuagacaucuagucuca

SEQ ID NO: 445302 - RNA, 16 nt, Homo sapiens
uucucuaggaaagugc

SEQ ID NO: 445303 - RNA, 20 nt, Homo sapiens
uucucuauuagacuuuagaa

SEQ ID NO: 445304 - RNA, 20 nt, Homo sapiens
uucucucaccuccuaaagua

SEQ ID NO: 445305 - RNA, 12 nt, Homo sapiens
uucucucugugu

SEQ ID NO: 445306 - RNA, 18 nt, Homo sapiens
uucucucuuauuccacuu

SEQ ID NO: 445307 - RNA, 15 nt, Homo sapiens
uucucugccagugac

SEQ ID NO: 445308 - RNA, 22 nt, Homo sapiens
uucucugcgagcaacagugccc

SEQ ID NO: 445309 - RNA, 22 nt, Homo sapiens
uucucugggccuucucaccaca

SEQ ID NO: 445310 - RNA, 17 nt, Homo sapiens
uucucuggguagguguu

SEQ ID NO: 445311 - RNA, 16 nt, Homo sapiens
uucucuuucucuccuu

SEQ ID NO: 445312 - RNA, 11 nt, Homo sapiens
uucucuuugcu

SEQ ID NO: 445313 - RNA, 22 nt, Homo sapiens
uucucuuugcugcuggugcuaa

SEQ ID NO: 445314 - RNA, 22 nt, Homo sapiens
uucucuuuguggggcuuggcgu

SEQ ID NO: 445315 - RNA, 21 nt, Homo sapiens
uucugaaagaaucauuugcau

SEQ ID NO: 445316 - RNA, 14 nt, Homo sapiens
uucugaaaugugca

SEQ ID NO: 445317 - RNA, 15 nt, Homo sapiens
uucugaaauucacaa

SEQ ID NO: 445318 - RNA, 14 nt, Homo sapiens
uucugaaugcugcu

SEQ ID NO: 445319 - RNA, 18 nt, Homo sapiens
uucugaauguuaaacuac

SEQ ID NO: 445320 - RNA, 13 nt, Homo sapiens
uucugaauucaua

SEQ ID NO: 445321 - RNA, 21 nt, Homo sapiens
uucugaauuuguagacauacu

SEQ ID NO: 445322 - RNA, 16 nt, Homo sapiens
uucugacggcccugca

SEQ ID NO: 445323 - RNA, 23 nt, Homo sapiens
uucugacugauccugaacaagaa

SEQ ID NO: 445324 - RNA, 13 nt, Homo sapiens
uucugaguagcau

SEQ ID NO: 445325 - RNA, 17 nt, Homo sapiens
uucugauaagacuggaa

SEQ ID NO: 445326 - RNA, 15 nt, Homo sapiens
uucugauucuucaaa

SEQ ID NO: 445327 - RNA, 16 nt, Homo sapiens
uucugauuucucuuca

SEQ ID NO: 445328 - RNA, 18 nt, Homo sapiens
uucugcaucaucuguaga

SEQ ID NO: 445329 - RNA, 17 nt, Homo sapiens
uucuggagugagcacuc

SEQ ID NO: 445330 - RNA, 18 nt, Homo sapiens
uucuggccucagaccaac

SEQ ID NO: 445331 - RNA, 16 nt, Homo sapiens
uucugggaaaggugcu

SEQ ID NO: 445332 - RNA, 22 nt, Homo sapiens
uucugggaaaggugcucaaaga

SEQ ID NO: 445333 - RNA, 23 nt, Homo sapiens
uugcuaaauauaaaaacauaaau

SEQ ID NO: 445334 - RNA, 12 nt, Homo sapiens
uugcuaacauau

SEQ ID NO: 445335 - RNA, 23 nt, Homo sapiens
uugcuaacauauuuaaagucuug

SEQ ID NO: 445336 - RNA, 13 nt, Homo sapiens
uugcuaagagcca

SEQ ID NO: 445337 - RNA, 22 nt, Homo sapiens
uugcuacgaagaaagacuccuu

SEQ ID NO: 445338 - RNA, 19 nt, Homo sapiens
uugcuagagcuaacagaca

SEQ ID NO: 445339 - RNA, 23 nt, Homo sapiens
uugcucagugcaaaacugaugau

SEQ ID NO: 445340 - RNA, 14 nt, Homo sapiens
uugcucaguuccau

SEQ ID NO: 445341 - RNA, 19 nt, Homo sapiens
uugcucucgacaguaucca

SEQ ID NO: 445342 - RNA, 18 nt, Homo sapiens
uugcugaauaacaacaau

SEQ ID NO: 445343 - RNA, 19 nt, Homo sapiens
uugcugaauuaaggaucau

SEQ ID NO: 445344 - RNA, 21 nt, Homo sapiens
uugcugcaucuccccucagau

SEQ ID NO: 445345 - RNA, 12 nt, Homo sapiens
uugcugccacau

SEQ ID NO: 445346 - RNA, 18 nt, Homo sapiens
uugcuguaacucagacau

SEQ ID NO: 445347 - RNA, 16 nt, Homo sapiens
uugcugucccuuuucc

SEQ ID NO: 445348 - RNA, 22 nt, Homo sapiens
uugcuuaggaaauugcucauaa

SEQ ID NO: 445349 - RNA, 15 nt, Homo sapiens
uugcuuauucacuga

SEQ ID NO: 445350 - RNA, 23 nt, Homo sapiens
uugcuucccggcgucccuaccuc

SEQ ID NO: 445351 - RNA, 23 nt, Homo sapiens
uugcuucccguucagcgucacau

SEQ ID NO: 445352 - RNA, 19 nt, Homo sapiens
uugcuucuuuuucuuaccc

SEQ ID NO: 445353 - RNA, 14 nt, Homo sapiens
uugcuuuaaaguac

SEQ ID NO: 445354 - RNA, 23 nt, Homo sapiens
uugcuuucucuucuaauggaaua

SEQ ID NO: 445355 - RNA, 21 nt, Homo sapiens
uugcuuuugugcauuggauaa

SEQ ID NO: 445356 - RNA, 23 nt, Homo sapiens
uuggaaagauuuaagguuucaca

SEQ ID NO: 445357 - RNA, 14 nt, Homo sapiens
uuggaaaguacucc

SEQ ID NO: 445358 - RNA, 15 nt, Homo sapiens
uuggaagccccauaa

SEQ ID NO: 445359 - RNA, 20 nt, Homo sapiens
uuggaagguuuuaacauuga

SEQ ID NO: 445360 - RNA, 15 nt, Homo sapiens
uuggaaugaauucuc

SEQ ID NO: 445361 - RNA, 22 nt, Homo sapiens
uuggacaaaccgagugcaauga

SEQ ID NO: 445362 - RNA, 21 nt, Homo sapiens
uuggacaacuagccucaucuc

SEQ ID NO: 445363 - RNA, 16 nt, Homo sapiens
uuggacauccccagaa

SEQ ID NO: 445364 - RNA, 13 nt, Homo sapiens
uuggaccaaaugg

SEQ ID NO: 445365 - RNA, 16 nt, Homo sapiens
uuggacucuugcucuu

SEQ ID NO: 445366 - RNA, 20 nt, Homo sapiens
uuggagaggagguguggagu

SEQ ID NO: 445367 - RNA, 16 nt, Homo sapiens
uuggagccacuccugu

SEQ ID NO: 445368 - RNA, 21 nt, Homo sapiens
uuggagucagacaagccugag

SEQ ID NO: 445369 - RNA, 22 nt, Homo sapiens
uuggauaacaccaccauucaca

SEQ ID NO: 445370 - RNA, 21 nt, Homo sapiens
uuggauaauaacuagaucucc

SEQ ID NO: 445371 - RNA, 19 nt, Homo sapiens
uuggaucuucaauggcuuu

SEQ ID NO: 445372 - RNA, 16 nt, Homo sapiens
uuggauggaguuaaac

SEQ ID NO: 445373 - RNA, 22 nt, Homo sapiens
uuggaugugcauuucugugaug

SEQ ID NO: 445374 - RNA, 21 nt, Homo sapiens
uuggauuaugaagugacucuc

SEQ ID NO: 445375 - RNA, 13 nt, Homo sapiens
uuggcaccuguag

SEQ ID NO: 445376 - RNA, 15 nt, Homo sapiens
uuggcauggcuuuau

SEQ ID NO: 445377 - RNA, 19 nt, Homo sapiens
uuggcauuagcacuaccau

SEQ ID NO: 445378 - RNA, 17 nt, Homo sapiens
uuggcauuaucucuuuc

SEQ ID NO: 445379 - RNA, 22 nt, Homo sapiens
uuuguaaugggaacugccucuu

SEQ ID NO: 445380 - RNA, 18 nt, Homo sapiens
uuuguacaauuacuaaau

SEQ ID NO: 445381 - RNA, 21 nt, Homo sapiens
uuuguaucuuaaaucugugaa

SEQ ID NO: 445382 - RNA, 16 nt, Homo sapiens
uuuguaugaaguacuu

SEQ ID NO: 445383 - RNA, 18 nt, Homo sapiens
uuugucacaaauaaacau

SEQ ID NO: 445384 - RNA, 22 nt, Homo sapiens
uuugucacaaauaaacauaaua

SEQ ID NO: 445385 - RNA, 13 nt, Homo sapiens
uuugucacuucug

SEQ ID NO: 445386 - RNA, 18 nt, Homo sapiens
uuugucauucaagccugu

SEQ ID NO: 445387 - RNA, 21 nt, Homo sapiens
uuuguccaccauuccuuuaaa

SEQ ID NO: 445388 - RNA, 22 nt, Homo sapiens
uuugucucuuagaaauacuugu

SEQ ID NO: 445389 - RNA, 16 nt, Homo sapiens
uuugugaagugauuga

SEQ ID NO: 445390 - RNA, 13 nt, Homo sapiens
uuuguggccucag

SEQ ID NO: 445391 - RNA, 14 nt, Homo sapiens
uuugugugugugca

SEQ ID NO: 445392 - RNA, 16 nt, Homo sapiens
uuugugugugugcaag

SEQ ID NO: 445393 - RNA, 20 nt, Homo sapiens
uuuguuauagagaucucagc

SEQ ID NO: 445394 - RNA, 13 nt, Homo sapiens
uuuguucagagag

SEQ ID NO: 445395 - RNA, 17 nt, Homo sapiens
uuuguugagacuaucaa

SEQ ID NO: 445396 - RNA, 14 nt, Homo sapiens
uuuguuuuaaauac

SEQ ID NO: 445397 - RNA, 22 nt, Homo sapiens
uuuguuuugauguuuguggccu

SEQ ID NO: 445398 - RNA, 17 nt, Homo sapiens
uuuuaaaaaguugcaca

SEQ ID NO: 445399 - RNA, 14 nt, Homo sapiens
uuuuaaaacauuca

SEQ ID NO: 445400 - RNA, 21 nt, Homo sapiens
uuuuaaaaguuucaaugugau

SEQ ID NO: 445401 - RNA, 14 nt, Homo sapiens
uuuuaaacauucuu

SEQ ID NO: 445402 - RNA, 21 nt, Homo sapiens
uuuuaaagaaaaugugucugc

SEQ ID NO: 445403 - RNA, 17 nt, Homo sapiens
uuuuaaauggcaugaca

SEQ ID NO: 445404 - RNA, 13 nt, Homo sapiens
uuuuaacauucca

SEQ ID NO: 445405 - RNA, 14 nt, Homo sapiens
uuuuaagcuguaaa

SEQ ID NO: 445406 - RNA, 12 nt, Homo sapiens
uuuuaaguauuu

SEQ ID NO: 445407 - RNA, 21 nt, Homo sapiens
uuuuaaugauacugucuaaga

SEQ ID NO: 445408 - RNA, 12 nt, Homo sapiens
uuuuaauggugu

SEQ ID NO: 445409 - RNA, 16 nt, Homo sapiens
uuuuaaugucaucucu

SEQ ID NO: 445410 - RNA, 18 nt, Homo sapiens
uuuuaauuagaaauaucu

SEQ ID NO: 445411 - RNA, 17 nt, Homo sapiens
uuuuacacaccaccagc

SEQ ID NO: 445412 - RNA, 14 nt, Homo sapiens
uuuuacuacccaaa

SEQ ID NO: 445413 - RNA, 18 nt, Homo sapiens
uuuuagcaguucugcaaa

SEQ ID NO: 445414 - RNA, 18 nt, Homo sapiens
uuuuagcguuaaagucag

SEQ ID NO: 445415 - RNA, 19 nt, Homo sapiens
uuuuauauucuaagccagu

SEQ ID NO: 445416 - RNA, 18 nt, Homo sapiens
uuuuaucuguuaaccaaa

SEQ ID NO: 445417 - RNA, 22 nt, Homo sapiens
uuuuauggcgauucccauugaa

SEQ ID NO: 445418 - RNA, 12 nt, Homo sapiens
uuuuauucacau

SEQ ID NO: 445419 - RNA, 18 nt, Homo sapiens
uuuuauuuuuuaaguuca

SEQ ID NO: 445420 - RNA, 21 nt, Homo sapiens
uuuucaagaaagcauugccag

SEQ ID NO: 445421 - RNA, 15 nt, Homo sapiens
uuuucaagacuuccu

SEQ ID NO: 445422 - RNA, 12 nt, Homo sapiens
uuuucaccucau

SEQ ID NO: 445423 - RNA, 16 nt, Homo sapiens
uuuucacuguuuccua

SEQ ID NO: 445424 - RNA, 23 nt, Homo sapiens
uuuucauccaggcucccaaaaga

SEQ ID NO: 445425 - RNA, 12 nt, Homo sapiens
uuuucauuccau

SEQ ID NO: 445426 - RNA, 17 nt, Homo sapiens
uuuucauuggaugcagu

SEQ ID NO: 445427 - RNA, 13 nt, Homo sapiens
uuuuccacuuaga

SEQ ID NO: 445428 - RNA, 12 nt, Homo sapiens
uuuuccuauaau

SEQ ID NO: 445429 - RNA, 21 nt, Homo sapiens
uuuucgugcuuccuccugaca

SEQ ID NO: 445430 - RNA, 23 nt, Homo sapiens
uuuucucuccuaagacaccugca

SEQ ID NO: 445431 - RNA, 15 nt, Homo sapiens
uuuucucugugcuuc

SEQ ID NO: 445432 - RNA, 16 nt, Homo sapiens
uuuucucugugcuuca

SEQ ID NO: 445433 - RNA, 15 nt, Homo sapiens
uuuucugaauucaua

SEQ ID NO: 445434 - RNA, 19 nt, Homo sapiens
uuuucuguaaauaaccuau

SEQ ID NO: 445435 - RNA, 20 nt, Homo sapiens
uuuucuguaaauaaccuauu

SEQ ID NO: 445436 - RNA, 20 nt, Homo sapiens
uuuugagaugggggucucac

SEQ ID NO: 445437 - RNA, 13 nt, Homo sapiens
uuuugagauucau

SEQ ID NO: 445438 - RNA, 16 nt, Homo sapiens
uuuugaugugguguca

SEQ ID NO: 445439 - RNA, 15 nt, Homo sapiens
uuuugccaaucucaa

SEQ ID NO: 445440 - RNA, 17 nt, Homo sapiens
uuuugccauaaugacuc

SEQ ID NO: 445441 - RNA, 18 nt, Homo sapiens
uuuugcccacacuuggga

SEQ ID NO: 445442 - RNA, 17 nt, Homo sapiens
uuuugcucaguuccaug

SEQ ID NO: 445443 - RNA, 18 nt, Homo sapiens
uuuuggaauugguguaua

SEQ ID NO: 445444 - RNA, 13 nt, Homo sapiens
uuuuggcuugacu

SEQ ID NO: 445445 - RNA, 20 nt, Homo sapiens
uuuugguuuaaaaaguuuca

SEQ ID NO: 445446 - RNA, 15 nt, Homo sapiens
uuuuguaaacuguau

SEQ ID NO: 445447 - RNA, 23 nt, Homo sapiens
uuuuguagaugaacucuucucaa

SEQ ID NO: 445448 - RNA, 12 nt, Homo sapiens
uuuugucaucaa

SEQ ID NO: 445449 - RNA, 19 nt, Homo sapiens
uuuuguguacaguaugugu

SEQ ID NO: 445450 - RNA, 16 nt, Homo sapiens
uuuuuaaagcuuuuga

SEQ ID NO: 445451 - RNA, 20 nt, Homo sapiens
uuuuuagcugguggcaauaa

SEQ ID NO: 445452 - RNA, 20 nt, Homo sapiens
uuuuuccaauuuuguugcau

SEQ ID NO: 445453 - RNA, 22 nt, Homo sapiens
uuuuucccccaaccucccccuc

SEQ ID NO: 445454 - RNA, 22 nt, Homo sapiens
uuuuuccucccuuucccugaga

SEQ ID NO: 445455 - RNA, 16 nt, Homo sapiens
uuuuuccuuccugaga

SEQ ID NO: 445456 - RNA, 12 nt, Homo sapiens
uccaccaagaaa

SEQ ID NO: 445457 - RNA, 20 nt, Homo sapiens
acagccuggccccugugcac

SEQ ID NO: 445458 - RNA, 18 nt, Homo sapiens
acagcgacagaaaaccuc

SEQ ID NO: 445459 - RNA, 12 nt, Homo sapiens
acagcgauuccc

SEQ ID NO: 445460 - RNA, 14 nt, Homo sapiens
acagcuaacaugga

SEQ ID NO: 445461 - RNA, 14 nt, Homo sapiens
acagcucaaagagu

SEQ ID NO: 445462 - RNA, 21 nt, Homo sapiens
acagcucuuggcauuuuccuc

SEQ ID NO: 445463 - RNA, 13 nt, Homo sapiens
acagcucuuguuu

SEQ ID NO: 445464 - RNA, 18 nt, Homo sapiens
acagcugcugcuggaaau

SEQ ID NO: 445465 - RNA, 20 nt, Homo sapiens
acagcugcuucugugcauuu

SEQ ID NO: 445466 - RNA, 17 nt, Homo sapiens
acagcuggagcucucaa

SEQ ID NO: 445467 - RNA, 20 nt, Homo sapiens
acagcugggcaaagccacaa

SEQ ID NO: 445468 - RNA, 15 nt, Homo sapiens
acagcuucaugccuu

SEQ ID NO: 445469 - RNA, 14 nt, Homo sapiens
acagcuucuaguga

SEQ ID NO: 445470 - RNA, 21 nt, Homo sapiens
acagcuugaguggguucucug

SEQ ID NO: 445471 - RNA, 18 nt, Homo sapiens
acaggaaaaaaacuuuua

SEQ ID NO: 445472 - RNA, 15 nt, Homo sapiens
acaggaagacuggag

SEQ ID NO: 445473 - RNA, 18 nt, Homo sapiens
acaggaagucccuugcca

SEQ ID NO: 445474 - RNA, 20 nt, Homo sapiens
acaggaauggaacacacuug

SEQ ID NO: 445475 - RNA, 14 nt, Homo sapiens
acaggacacaguca

SEQ ID NO: 445476 - RNA, 22 nt, Homo sapiens
acaggacacagucagauuucca

SEQ ID NO: 445477 - RNA, 13 nt, Homo sapiens
acaggacucugcc

SEQ ID NO: 445478 - RNA, 16 nt, Homo sapiens
acaggagccacaggga

SEQ ID NO: 445479 - RNA, 16 nt, Homo sapiens
acaggagucuuuguaa

SEQ ID NO: 445480 - RNA, 21 nt, Homo sapiens
acaggaugaaaguucccccau

SEQ ID NO: 445481 - RNA, 17 nt, Homo sapiens
acaggccacacgcugcc

SEQ ID NO: 445482 - RNA, 21 nt, Homo sapiens
acaggcccuuccucuccacug

SEQ ID NO: 445483 - RNA, 21 nt, Homo sapiens
acaggcucuuagcagcuucca

SEQ ID NO: 445484 - RNA, 19 nt, Homo sapiens
acagggcaugcauuuugca

SEQ ID NO: 445485 - RNA, 15 nt, Homo sapiens
acagggcauggccag

SEQ ID NO: 445486 - RNA, 17 nt, Homo sapiens
acagggccacaacugcc

SEQ ID NO: 445487 - RNA, 20 nt, Homo sapiens
acagggcgagacuccgucuc

SEQ ID NO: 445488 - RNA, 17 nt, Homo sapiens
acagggcugguguggcu

SEQ ID NO: 445489 - RNA, 22 nt, Homo sapiens
acaggggccccuccucuaauga

SEQ ID NO: 445490 - RNA, 20 nt, Homo sapiens
acaggggcuggugggcacca

SEQ ID NO: 445491 - RNA, 20 nt, Homo sapiens
acaggggucgccaacacuug

SEQ ID NO: 445492 - RNA, 20 nt, Homo sapiens
acaggugcugaacugugcau

SEQ ID NO: 445493 - RNA, 18 nt, Homo sapiens
acagguucuaugauuugu

SEQ ID NO: 445494 - RNA, 23 nt, Homo sapiens
acaguaaauaaauuguuugacca

SEQ ID NO: 445495 - RNA, 16 nt, Homo sapiens
acaguaugagucaaug

SEQ ID NO: 445496 - RNA, 23 nt, Homo sapiens
acaguaugagucaaugugcagug

SEQ ID NO: 445497 - RNA, 16 nt, Homo sapiens
acaguauuuugguucu

SEQ ID NO: 445498 - RNA, 19 nt, Homo sapiens
acagucacugacucaagac

SEQ ID NO: 445499 - RNA, 20 nt, Homo sapiens
acagucaggaagccuccugc

SEQ ID NO: 445500 - RNA, 14 nt, Homo sapiens
acagucauguguca

SEQ ID NO: 445501 - RNA, 20 nt, Homo sapiens
acagugccuggcaaggccuc

SEQ ID NO: 445502 - RNA, 15 nt, Homo sapiens
acagugccugggaau

SEQ ID NO: 445503 - RNA, 22 nt, Homo sapiens
acaguggaggaagagggacaga

SEQ ID NO: 445504 - RNA, 14 nt, Homo sapiens
acaguguaagcuua

SEQ ID NO: 445505 - RNA, 14 nt, Homo sapiens
acaguguugcccag

SEQ ID NO: 445506 - RNA, 16 nt, Homo sapiens
acaguuaagacaacag

SEQ ID NO: 445507 - RNA, 23 nt, Homo sapiens
acaguuaauuaugugcauauuaa

SEQ ID NO: 445508 - RNA, 16 nt, Homo sapiens
acaguucugucauaug

SEQ ID NO: 445509 - RNA, 16 nt, Homo sapiens
acaguugguuuugcau

SEQ ID NO: 445510 - RNA, 23 nt, Homo sapiens
acaguugguuuugcaugucugca

SEQ ID NO: 445511 - RNA, 21 nt, Homo sapiens
acaguuugcuauuugcuuuag

SEQ ID NO: 445512 - RNA, 20 nt, Homo sapiens
acaguuuggauguccucaaa

SEQ ID NO: 445513 - RNA, 22 nt, Homo sapiens
acauaaaauaaacugaacauau

SEQ ID NO: 445514 - RNA, 16 nt, Homo sapiens
acauaaacccaucugu

SEQ ID NO: 445515 - RNA, 13 nt, Homo sapiens
acauaacacacau

SEQ ID NO: 445516 - RNA, 13 nt, Homo sapiens
acauaaggaugaa

SEQ ID NO: 445517 - RNA, 23 nt, Homo sapiens
acauaauccacgcucaucuugca

SEQ ID NO: 445518 - RNA, 12 nt, Homo sapiens
acauacagugau

SEQ ID NO: 445519 - RNA, 19 nt, Homo sapiens
acauacuccuuccaucaaa

SEQ ID NO: 445520 - RNA, 18 nt, Homo sapiens
acauagaugucccuuucu

SEQ ID NO: 445521 - RNA, 19 nt, Homo sapiens
acauagcugggauuugaac

SEQ ID NO: 445522 - RNA, 16 nt, Homo sapiens
acauaggaacauguag

SEQ ID NO: 445523 - RNA, 19 nt, Homo sapiens
acauagucuuuguuuacau

SEQ ID NO: 445524 - RNA, 21 nt, Homo sapiens
acauagucuuuguuuacauga

SEQ ID NO: 445525 - RNA, 20 nt, Homo sapiens
acauauaaauuaauacauaa

SEQ ID NO: 445526 - RNA, 23 nt, Homo sapiens
acauaugauaaaaaaguguccua

SEQ ID NO: 445527 - RNA, 14 nt, Homo sapiens
acauauuaagaaua

SEQ ID NO: 445528 - RNA, 14 nt, Homo sapiens
acauauuacuguug

SEQ ID NO: 445529 - RNA, 23 nt, Homo sapiens
acauauucacagugaacauaacu

SEQ ID NO: 445530 - RNA, 17 nt, Homo sapiens
acaucaagauacacuug

SEQ ID NO: 445531 - RNA, 14 nt, Homo sapiens
acaucaauguucau

SEQ ID NO: 445532 - RNA, 17 nt, Homo sapiens
acaucaggugauccacc

SEQ ID NO: 445533 - RNA, 23 nt, Homo sapiens
acaucaguccacccccauuguga

SEQ ID NO: 445534 - RNA, 20 nt, Homo sapiens
acaucauuggaauacaggaa

SEQ ID NO: 445535 - RNA, 14 nt, Homo sapiens
acauccagcccagg

SEQ ID NO: 445536 - RNA, 16 nt, Homo sapiens
acauccccaccuucca

SEQ ID NO: 445537 - RNA, 17 nt, Homo sapiens
acauccccaccuuccaa

SEQ ID NO: 445538 - RNA, 13 nt, Homo sapiens
acauccugugaug

SEQ ID NO: 445539 - RNA, 17 nt, Homo sapiens
acauccugugaugucau

SEQ ID NO: 445540 - RNA, 21 nt, Homo sapiens
acaucgaggcucuugcucaag

SEQ ID NO: 445541 - RNA, 13 nt, Homo sapiens
acaucuaacaaag

SEQ ID NO: 445542 - RNA, 22 nt, Homo sapiens
acaucucagacccuuuagccaa

SEQ ID NO: 445543 - RNA, 18 nt, Homo sapiens
acaucucccuuccaccuc

SEQ ID NO: 445544 - RNA, 12 nt, Homo sapiens
acaucugcaaua

SEQ ID NO: 445545 - RNA, 20 nt, Homo sapiens
acaucugcaauaugaauuca

SEQ ID NO: 445546 - RNA, 16 nt, Homo sapiens
acaucugcauuucuac

SEQ ID NO: 445547 - RNA, 23 nt, Homo sapiens
acaucuuggucagauuugaacuc

SEQ ID NO: 445548 - RNA, 17 nt, Homo sapiens
acaucuuuccaguccuu

SEQ ID NO: 445549 - RNA, 23 nt, Homo sapiens
acaucuuuuaggggaagugacaa

SEQ ID NO: 445550 - RNA, 23 nt, Homo sapiens
acaugaauugcauuuuacuuuaa

SEQ ID NO: 445551 - RNA, 16 nt, Homo sapiens
acaugagcuauuucca

SEQ ID NO: 445552 - RNA, 24 nt, Homo sapiens
acaugcccauauuuuacuuggaaa

SEQ ID NO: 445553 - RNA, 23 nt, Homo sapiens
acaugccgcgggcggccaggcaa

SEQ ID NO: 445554 - RNA, 15 nt, Homo sapiens
acaugcggcugccca

SEQ ID NO: 445555 - RNA, 15 nt, Homo sapiens
acaugcugugcucuu

SEQ ID NO: 445556 - RNA, 22 nt, Homo sapiens
acaugcuguuggccucaagcaa

SEQ ID NO: 445557 - RNA, 16 nt, Homo sapiens
acauggaacgcuuuca

SEQ ID NO: 445558 - RNA, 17 nt, Homo sapiens
acauggaacgcuuucau

SEQ ID NO: 445559 - RNA, 21 nt, Homo sapiens
acauggaguucccgugcaccu

SEQ ID NO: 445560 - RNA, 15 nt, Homo sapiens
acauggaugccaacc

SEQ ID NO: 445561 - RNA, 18 nt, Homo sapiens
acaugguaucucuuucuc

SEQ ID NO: 445562 - RNA, 22 nt, Homo sapiens
acauggucuccucugauuauca

SEQ ID NO: 445563 - RNA, 15 nt, Homo sapiens
acauggugugccaca

SEQ ID NO: 445564 - RNA, 15 nt, Homo sapiens
acauguccuauuacu

SEQ ID NO: 445565 - RNA, 17 nt, Homo sapiens
acauguggggccagguc

SEQ ID NO: 445566 - RNA, 22 nt, Homo sapiens
acauguguuuuaauuccaauau

SEQ ID NO: 445567 - RNA, 18 nt, Homo sapiens
acauguugucacauucuc

SEQ ID NO: 445568 - RNA, 22 nt, Homo sapiens
acauguuuuagacagagacaau

SEQ ID NO: 445569 - RNA, 15 nt, Homo sapiens
acauguuuuugauau

SEQ ID NO: 445570 - RNA, 16 nt, Homo sapiens
acauuaaacacuguaa

SEQ ID NO: 445571 - RNA, 18 nt, Homo sapiens
acauuaagagauuuucaa

SEQ ID NO: 445572 - RNA, 19 nt, Homo sapiens
acauuaauugaggcuuaca

SEQ ID NO: 445573 - RNA, 20 nt, Homo sapiens
acauuagaagaaaacauaua

SEQ ID NO: 445574 - RNA, 13 nt, Homo sapiens
acauuaggcugug

SEQ ID NO: 445575 - RNA, 14 nt, Homo sapiens
acauuaugccuuaa

SEQ ID NO: 445576 - RNA, 19 nt, Homo sapiens
acauuauuccugcacucac

SEQ ID NO: 445577 - RNA, 19 nt, Homo sapiens
acauucacacagggcucuu

SEQ ID NO: 445578 - RNA, 17 nt, Homo sapiens
acauucaccaacaacag

SEQ ID NO: 445579 - RNA, 15 nt, Homo sapiens
acauucacucagaga

SEQ ID NO: 445580 - RNA, 17 nt, Homo sapiens
acauucaggcaugcgaa

SEQ ID NO: 445581 - RNA, 17 nt, Homo sapiens
acauuccagaugcauga

SEQ ID NO: 445582 - RNA, 15 nt, Homo sapiens
acauuccguuuacau

SEQ ID NO: 445583 - RNA, 12 nt, Homo sapiens
acauugcacuuu

SEQ ID NO: 445584 - RNA, 18 nt, Homo sapiens
acauuuagacaauggcua

SEQ ID NO: 445585 - RNA, 18 nt, Homo sapiens
acauuuagcuuguucaca

SEQ ID NO: 445586 - RNA, 14 nt, Homo sapiens
acucugaguccacu

SEQ ID NO: 445587 - RNA, 16 nt, Homo sapiens
acucugcacuacuccu

SEQ ID NO: 445588 - RNA, 22 nt, Homo sapiens
acucugccccuucuguuuccau

SEQ ID NO: 445589 - RNA, 19 nt, Homo sapiens
acucugggcugccauguga

SEQ ID NO: 445590 - RNA, 14 nt, Homo sapiens
acucuggguuucau

SEQ ID NO: 445591 - RNA, 22 nt, Homo sapiens
acucuggguuucauauccagcu

SEQ ID NO: 445592 - RNA, 19 nt, Homo sapiens
acucugucuucacuauuca

SEQ ID NO: 445593 - RNA, 20 nt, Homo sapiens
acucuguguaaucucugauu

SEQ ID NO: 445594 - RNA, 22 nt, Homo sapiens
acucuguuccuacuggagauac

SEQ ID NO: 445595 - RNA, 20 nt, Homo sapiens
acucuuacuaaccaccauuu

SEQ ID NO: 445596 - RNA, 16 nt, Homo sapiens
acucuuaugaaauggg

SEQ ID NO: 445597 - RNA, 21 nt, Homo sapiens
acucuuauucccaaacuacag

SEQ ID NO: 445598 - RNA, 16 nt, Homo sapiens
acucuuauuucacuaa

SEQ ID NO: 445599 - RNA, 12 nt, Homo sapiens
acucuugcucac

SEQ ID NO: 445600 - RNA, 18 nt, Homo sapiens
acucuuuaguugauuuaa

SEQ ID NO: 445601 - RNA, 23 nt, Homo sapiens
acucuuugcccaguucaucccaa

SEQ ID NO: 445602 - RNA, 18 nt, Homo sapiens
acucuuuggaacaacagc

SEQ ID NO: 445603 - RNA, 13 nt, Homo sapiens
acucuuuguauga

SEQ ID NO: 445604 - RNA, 14 nt, Homo sapiens
acugaaggcuuuca

SEQ ID NO: 445605 - RNA, 23 nt, Homo sapiens
acugaaggcuuucagggccucca

SEQ ID NO: 445606 - RNA, 19 nt, Homo sapiens
acugaagucuuuucuguca

SEQ ID NO: 445607 - RNA, 14 nt, Homo sapiens
acugaaguuucaca

SEQ ID NO: 445608 - RNA, 17 nt, Homo sapiens
acugaaguuucacauga

SEQ ID NO: 445609 - RNA, 14 nt, Homo sapiens
acugaauauuauca

SEQ ID NO: 445610 - RNA, 19 nt, Homo sapiens
acugaauuugggccucuug

SEQ ID NO: 445611 - RNA, 13 nt, Homo sapiens
acugacacucauu

SEQ ID NO: 445612 - RNA, 12 nt, Homo sapiens
acugacuuucuc

SEQ ID NO: 445613 - RNA, 17 nt, Homo sapiens
acugagcagacugguga

SEQ ID NO: 445614 - RNA, 16 nt, Homo sapiens
acugagccagucccag

SEQ ID NO: 445615 - RNA, 12 nt, Homo sapiens
acugagggccac

SEQ ID NO: 445616 - RNA, 11 nt, Homo sapiens
acugaguccac

SEQ ID NO: 445617 - RNA, 17 nt, Homo sapiens
acugaguccacucggag

SEQ ID NO: 445618 - RNA, 20 nt, Homo sapiens
acugaguccuguucuuguua

SEQ ID NO: 445619 - RNA, 18 nt, Homo sapiens
acugaguuagaauguuga

SEQ ID NO: 445620 - RNA, 13 nt, Homo sapiens
acugaugagacaa

SEQ ID NO: 445621 - RNA, 14 nt, Homo sapiens
acugaugugugcaa

SEQ ID NO: 445622 - RNA, 22 nt, Homo sapiens
acugauuuaugaucacuuggaa

SEQ ID NO: 445623 - RNA, 20 nt, Homo sapiens
acugcaaauuguagcccagu

SEQ ID NO: 445624 - RNA, 15 nt, Homo sapiens
acugcaaccucugcc

SEQ ID NO: 445625 - RNA, 16 nt, Homo sapiens
acugcaaccucugccu

SEQ ID NO: 445626 - RNA, 13 nt, Homo sapiens
acugcaagcucca

SEQ ID NO: 445627 - RNA, 16 nt, Homo sapiens
acugcaccaagucuca

SEQ ID NO: 445628 - RNA, 15 nt, Homo sapiens
acugcagcuuuacau

SEQ ID NO: 445629 - RNA, 22 nt, Homo sapiens
acugcagucagcaugaauccag

SEQ ID NO: 445630 - RNA, 20 nt, Homo sapiens
acugcaucaagaugugacau

SEQ ID NO: 445631 - RNA, 19 nt, Homo sapiens
acugcccgcacacccucac

SEQ ID NO: 445632 - RNA, 17 nt, Homo sapiens
acugcccugucuagguc

SEQ ID NO: 445633 - RNA, 20 nt, Homo sapiens
acugcccuuuuaaauggcau

SEQ ID NO: 445634 - RNA, 23 nt, Homo sapiens
acugccuggagggcagggagugg

SEQ ID NO: 445635 - RNA, 14 nt, Homo sapiens
acugcuaccaugaa

SEQ ID NO: 445636 - RNA, 19 nt, Homo sapiens
acugcugcccagccuccaa

SEQ ID NO: 445637 - RNA, 22 nt, Homo sapiens
acugcugcccagccuccaagcu

SEQ ID NO: 445638 - RNA, 17 nt, Homo sapiens
acugcugcuccagugca

SEQ ID NO: 445639 - RNA, 15 nt, Homo sapiens
acugcugcuccccac

SEQ ID NO: 445640 - RNA, 15 nt, Homo sapiens
acugcugugaaugug

SEQ ID NO: 445641 - RNA, 18 nt, Homo sapiens
acuggaaaaguguaauag

SEQ ID NO: 445642 - RNA, 21 nt, Homo sapiens
acuggaacacuaaugaggaaa

SEQ ID NO: 445643 - RNA, 14 nt, Homo sapiens
acuggaggugggca

SEQ ID NO: 445644 - RNA, 15 nt, Homo sapiens
acuggauuaguuaac

SEQ ID NO: 445645 - RNA, 19 nt, Homo sapiens
acuggcauuuuuagcuccu

SEQ ID NO: 445646 - RNA, 15 nt, Homo sapiens
acuggccaugcaagu

SEQ ID NO: 445647 - RNA, 14 nt, Homo sapiens
acuggcccaagugg

SEQ ID NO: 445648 - RNA, 15 nt, Homo sapiens
acuggcucucuccag

SEQ ID NO: 445649 - RNA, 17 nt, Homo sapiens
acuggcugucaguauga

SEQ ID NO: 445650 - RNA, 13 nt, Homo sapiens
acuggcugugaga

SEQ ID NO: 445651 - RNA, 15 nt, Homo sapiens
acuggcugugagacg

SEQ ID NO: 445652 - RNA, 21 nt, Homo sapiens
acuggcuucucuugagucaca

SEQ ID NO: 445653 - RNA, 16 nt, Homo sapiens
acugggaagaugcugg

SEQ ID NO: 445654 - RNA, 12 nt, Homo sapiens
acugggggcaac

SEQ ID NO: 445655 - RNA, 13 nt, Homo sapiens
acugguccaggca

SEQ ID NO: 445656 - RNA, 23 nt, Homo sapiens
acuggucucuuuccaaagcauuu

SEQ ID NO: 445657 - RNA, 19 nt, Homo sapiens
acugguuauccugugcuac

SEQ ID NO: 445658 - RNA, 14 nt, Homo sapiens
acuguaaaauacau

SEQ ID NO: 445659 - RNA, 13 nt, Homo sapiens
acuguaaagaauu

SEQ ID NO: 445660 - RNA, 15 nt, Homo sapiens
acuguaacacuguau

SEQ ID NO: 445661 - RNA, 21 nt, Homo sapiens
acuguacaguuucuuccccaa

SEQ ID NO: 445662 - RNA, 13 nt, Homo sapiens
acuguacuccucc

SEQ ID NO: 445663 - RNA, 12 nt, Homo sapiens
acuguacuggcc

SEQ ID NO: 445664 - RNA, 23 nt, Homo sapiens
acuguagaaaugaugauguggaa

SEQ ID NO: 445665 - RNA, 16 nt, Homo sapiens
acuguagaacugcaau

SEQ ID NO: 445666 - RNA, 20 nt, Homo sapiens
acuguaguaauuguuacaau

SEQ ID NO: 445667 - RNA, 14 nt, Homo sapiens
acuguaucuaaaaa

SEQ ID NO: 445668 - RNA, 22 nt, Homo sapiens
acuguauugcuguaugguauau

SEQ ID NO: 445669 - RNA, 19 nt, Homo sapiens
acuguauuuagugauuauu

SEQ ID NO: 445670 - RNA, 12 nt, Homo sapiens
acugucaaguca

SEQ ID NO: 445671 - RNA, 18 nt, Homo sapiens
acuguccaccaccaccug

SEQ ID NO: 445672 - RNA, 12 nt, Homo sapiens
acugucucaaga

SEQ ID NO: 445673 - RNA, 21 nt, Homo sapiens
acugucuuucagauacauggu

SEQ ID NO: 445674 - RNA, 15 nt, Homo sapiens
acugugaauguucca

SEQ ID NO: 445675 - RNA, 12 nt, Homo sapiens
acugugacuuaa

SEQ ID NO: 445676 - RNA, 13 nt, Homo sapiens
acugugcauuuga

SEQ ID NO: 445677 - RNA, 17 nt, Homo sapiens
acugugcuugcuccuaa

SEQ ID NO: 445678 - RNA, 14 nt, Homo sapiens
acuguggcucugca

SEQ ID NO: 445679 - RNA, 15 nt, Homo sapiens
acuguguaaccagca

SEQ ID NO: 445680 - RNA, 19 nt, Homo sapiens
acugugugaagaaauggaa

SEQ ID NO: 445681 - RNA, 18 nt, Homo sapiens
acuguguguugccacagg

SEQ ID NO: 445682 - RNA, 19 nt, Homo sapiens
acuguuaauaguacuauua

SEQ ID NO: 445683 - RNA, 16 nt, Homo sapiens
acuguuagcugggaag

SEQ ID NO: 445684 - RNA, 13 nt, Homo sapiens
acuguucaugaau

SEQ ID NO: 445685 - RNA, 13 nt, Homo sapiens
acuguuccaaaaa

SEQ ID NO: 445686 - RNA, 10 nt, Homo sapiens
acuguugcau

SEQ ID NO: 445687 - RNA, 16 nt, Homo sapiens
acuguuuuguuuguua

SEQ ID NO: 445688 - RNA, 14 nt, Homo sapiens
acuuaaaagauuca

SEQ ID NO: 445689 - RNA, 15 nt, Homo sapiens
acuuaagacugugua

SEQ ID NO: 445690 - RNA, 19 nt, Homo sapiens
acuuaaggauggagccagc

SEQ ID NO: 445691 - RNA, 16 nt, Homo sapiens
acuuaaguggcauuaa

SEQ ID NO: 445692 - RNA, 17 nt, Homo sapiens
acuuaaguggcauuaaa

SEQ ID NO: 445693 - RNA, 13 nt, Homo sapiens
acuuaauuaccua

SEQ ID NO: 445694 - RNA, 22 nt, Homo sapiens
acuuagaaauugcauuuccuga

SEQ ID NO: 445695 - RNA, 18 nt, Homo sapiens
acuuagagaugcuacugu

SEQ ID NO: 445696 - RNA, 15 nt, Homo sapiens
acuuaguccugaugu

SEQ ID NO: 445697 - RNA, 19 nt, Homo sapiens
acuuagugguaugucucuu

SEQ ID NO: 445698 - RNA, 12 nt, Homo sapiens
acuuauuacaau

SEQ ID NO: 445699 - RNA, 21 nt, Homo sapiens
acuuauuucagguuaaauuaa

SEQ ID NO: 445700 - RNA, 16 nt, Homo sapiens
acuuauuuccauggau

SEQ ID NO: 445701 - RNA, 19 nt, Homo sapiens
acuucaauccauguaggaa

SEQ ID NO: 445702 - RNA, 16 nt, Homo sapiens
acuucacacagcaccu

SEQ ID NO: 445703 - RNA, 22 nt, Homo sapiens
acuucagaugacaaggauuaga

SEQ ID NO: 445704 - RNA, 15 nt, Homo sapiens
acuucagcaggggug

SEQ ID NO: 445705 - RNA, 18 nt, Homo sapiens
acuucauuugaugcuaaa

SEQ ID NO: 445706 - RNA, 14 nt, Homo sapiens
acuuccauuugcuu

SEQ ID NO: 445707 - RNA, 16 nt, Homo sapiens
acuuccgguuucuuca

SEQ ID NO: 445708 - RNA, 16 nt, Homo sapiens
acuuccucaugaaucu

SEQ ID NO: 445709 - RNA, 16 nt, Homo sapiens
acuuccuugcucuccc

SEQ ID NO: 445710 - RNA, 15 nt, Homo sapiens
acuucuaaaugcaua

SEQ ID NO: 445711 - RNA, 21 nt, Homo sapiens
acuucuacauccaauguauga

SEQ ID NO: 445712 - RNA, 15 nt, Homo sapiens
acuucuauccuguua

SEQ ID NO: 445713 - RNA, 14 nt, Homo sapiens
acuucucuagacau

SEQ ID NO: 445714 - RNA, 22 nt, Homo sapiens
acuucugagcaguuuuccagga

SEQ ID NO: 445715 - RNA, 20 nt, Homo sapiens
acuucugcaucuuacaguca

SEQ ID NO: 445716 - RNA, 14 nt, Homo sapiens
acuucugcccaaau

SEQ ID NO: 445717 - RNA, 14 nt, Homo sapiens
agccacuguuacau

SEQ ID NO: 445718 - RNA, 22 nt, Homo sapiens
agccagauggaguaccaugagg

SEQ ID NO: 445719 - RNA, 16 nt, Homo sapiens
agccagcaaugauguc

SEQ ID NO: 445720 - RNA, 23 nt, Homo sapiens
agccagcagggcgggccaggaga

SEQ ID NO: 445721 - RNA, 15 nt, Homo sapiens
agccagcuguguuca

SEQ ID NO: 445722 - RNA, 17 nt, Homo sapiens
agccagcuuggugguua

SEQ ID NO: 445723 - RNA, 13 nt, Homo sapiens
agccaggacaucu

SEQ ID NO: 445724 - RNA, 21 nt, Homo sapiens
agccaggguggucuugaucuc

SEQ ID NO: 445725 - RNA, 15 nt, Homo sapiens
agccagguaauguga

SEQ ID NO: 445726 - RNA, 16 nt, Homo sapiens
agccagguaaugugaa

SEQ ID NO: 445727 - RNA, 15 nt, Homo sapiens
agccaguacagagaa

SEQ ID NO: 445728 - RNA, 20 nt, Homo sapiens
agccaguacagagaaauucu

SEQ ID NO: 445729 - RNA, 14 nt, Homo sapiens
agccauaaaccaau

SEQ ID NO: 445730 - RNA, 20 nt, Homo sapiens
agccauaccugguaagcaaa

SEQ ID NO: 445731 - RNA, 18 nt, Homo sapiens
agccauaggcccaggaua

SEQ ID NO: 445732 - RNA, 15 nt, Homo sapiens
agccaucuacuggau

SEQ ID NO: 445733 - RNA, 18 nt, Homo sapiens
agccaugccucaugccac

SEQ ID NO: 445734 - RNA, 20 nt, Homo sapiens
agccauggacucuacacugu

SEQ ID NO: 445735 - RNA, 16 nt, Homo sapiens
agccauggcuggcaga

SEQ ID NO: 445736 - RNA, 11 nt, Homo sapiens
agccaugggcc

SEQ ID NO: 445737 - RNA, 19 nt, Homo sapiens
agccauguaccaguguacu

SEQ ID NO: 445738 - RNA, 21 nt, Homo sapiens
agccauguccugcugcuucug

SEQ ID NO: 445739 - RNA, 14 nt, Homo sapiens
agcccaaccgggaa

SEQ ID NO: 445740 - RNA, 13 nt, Homo sapiens
agcccacaaagcc

SEQ ID NO: 445741 - RNA, 19 nt, Homo sapiens
agcccacugccuggaaagc

SEQ ID NO: 445742 - RNA, 16 nt, Homo sapiens
agcccacuguuaauau

SEQ ID NO: 445743 - RNA, 18 nt, Homo sapiens
agcccagcccggcaggga

SEQ ID NO: 445744 - RNA, 17 nt, Homo sapiens
agcccagcuacauuccu

SEQ ID NO: 445745 - RNA, 17 nt, Homo sapiens
agcccagcuugccaaug

SEQ ID NO: 445746 - RNA, 18 nt, Homo sapiens
agcccagcuugccaaugg

SEQ ID NO: 445747 - RNA, 23 nt, Homo sapiens
agcccaguaacugcaccaacgag

SEQ ID NO: 445748 - RNA, 18 nt, Homo sapiens
agcccauccagucuccca

SEQ ID NO: 445749 - RNA, 14 nt, Homo sapiens
agccccacuugaag

SEQ ID NO: 445750 - RNA, 22 nt, Homo sapiens
agccccagggcccugcucaggc

SEQ ID NO: 445751 - RNA, 19 nt, Homo sapiens
agcccccaccuucccucca

SEQ ID NO: 445752 - RNA, 21 nt, Homo sapiens
agccccgcccuccacaccucc

SEQ ID NO: 445753 - RNA, 20 nt, Homo sapiens
agccccggaaugcuuccagu

SEQ ID NO: 445754 - RNA, 17 nt, Homo sapiens
agccccuccucugagca

SEQ ID NO: 445755 - RNA, 21 nt, Homo sapiens
agccccuggagcuccugcugg

SEQ ID NO: 445756 - RNA, 18 nt, Homo sapiens
agcccgcaugcagcagcu

SEQ ID NO: 445757 - RNA, 23 nt, Homo sapiens
agcccgcuuuuguucuuccccac

SEQ ID NO: 445758 - RNA, 22 nt, Homo sapiens
agcccuaacauagugucugcug

SEQ ID NO: 445759 - RNA, 18 nt, Homo sapiens
agcccucaauaagccagc

SEQ ID NO: 445760 - RNA, 18 nt, Homo sapiens
agcccucccucuucccag

SEQ ID NO: 445761 - RNA, 20 nt, Homo sapiens
agcccuccuggaauggagcu

SEQ ID NO: 445762 - RNA, 20 nt, Homo sapiens
agcccucgaaccaaggcagc

SEQ ID NO: 445763 - RNA, 17 nt, Homo sapiens
agcccucuuucucucug

SEQ ID NO: 445764 - RNA, 22 nt, Homo sapiens
agcccucuuucucucugugugg

SEQ ID NO: 445765 - RNA, 15 nt, Homo sapiens
agcccugcugucaga

SEQ ID NO: 445766 - RNA, 21 nt, Homo sapiens
agcccuggcccagagcuggaa

SEQ ID NO: 445767 - RNA, 18 nt, Homo sapiens
agcccugucgagacacuu

SEQ ID NO: 445768 - RNA, 20 nt, Homo sapiens
agcccuguguauaaagccau

SEQ ID NO: 445769 - RNA, 15 nt, Homo sapiens
agcccuugaaccagc

SEQ ID NO: 445770 - RNA, 15 nt, Homo sapiens
agcccuuuacuugac

SEQ ID NO: 445771 - RNA, 14 nt, Homo sapiens
agcccuuuccccac

SEQ ID NO: 445772 - RNA, 15 nt, Homo sapiens
agccgaaaagcuuuu

SEQ ID NO: 445773 - RNA, 14 nt, Homo sapiens
agccgcaaauccau

SEQ ID NO: 445774 - RNA, 18 nt, Homo sapiens
agccggcuaauuuagaua

SEQ ID NO: 445775 - RNA, 21 nt, Homo sapiens
agccgggauggucuugaucuc

SEQ ID NO: 445776 - RNA, 14 nt, Homo sapiens
agccgugaugcuca

SEQ ID NO: 445777 - RNA, 17 nt, Homo sapiens
agccgugaugcucaggc

SEQ ID NO: 445778 - RNA, 16 nt, Homo sapiens
agccguuggcaccucu

SEQ ID NO: 445779 - RNA, 13 nt, Homo sapiens
agccuaacauugg

SEQ ID NO: 445780 - RNA, 16 nt, Homo sapiens
agccucaagaugaagg

SEQ ID NO: 445781 - RNA, 12 nt, Homo sapiens
agccucaagucu

SEQ ID NO: 445782 - RNA, 13 nt, Homo sapiens
agccucagccacc

SEQ ID NO: 445783 - RNA, 19 nt, Homo sapiens
agccucagccauucacugc

SEQ ID NO: 445784 - RNA, 12 nt, Homo sapiens
agccucaucucu

SEQ ID NO: 445785 - RNA, 14 nt, Homo sapiens
agccucaucucuuu

SEQ ID NO: 445786 - RNA, 20 nt, Homo sapiens
agccucaugggagucaggga

SEQ ID NO: 445787 - RNA, 13 nt, Homo sapiens
agccuccaagaaa

SEQ ID NO: 445788 - RNA, 23 nt, Homo sapiens
agccuccacuuuggaucaggaaa

SEQ ID NO: 445789 - RNA, 23 nt, Homo sapiens
agccuccagcaccuucccucuca

SEQ ID NO: 445790 - RNA, 14 nt, Homo sapiens
agccuccaguugua

SEQ ID NO: 445791 - RNA, 22 nt, Homo sapiens
agccucccaaagugcugagauu

SEQ ID NO: 445792 - RNA, 23 nt, Homo sapiens
agccuccguucccaccucugagg

SEQ ID NO: 445793 - RNA, 19 nt, Homo sapiens
agccucgaacuccugggcu

SEQ ID NO: 445794 - RNA, 17 nt, Homo sapiens
agccucuagaacagcca

SEQ ID NO: 445795 - RNA, 19 nt, Homo sapiens
agccucuccccgcucugga

SEQ ID NO: 445796 - RNA, 21 nt, Homo sapiens
agccucucucggucaacagca

SEQ ID NO: 445797 - RNA, 12 nt, Homo sapiens
agccucugccag

SEQ ID NO: 445798 - RNA, 19 nt, Homo sapiens
agccucugcccugccuccc

SEQ ID NO: 445799 - RNA, 21 nt, Homo sapiens
agccucuguccuggcugugca

SEQ ID NO: 445800 - RNA, 24 nt, Homo sapiens
agccucuguccuggcugugcacau

SEQ ID NO: 445801 - RNA, 15 nt, Homo sapiens
agccugaguccaguu

SEQ ID NO: 445802 - RNA, 14 nt, Homo sapiens
agccugagugguga

SEQ ID NO: 445803 - RNA, 15 nt, Homo sapiens
agccugaguuugcuu

SEQ ID NO: 445804 - RNA, 23 nt, Homo sapiens
agccugcaaacucacugcucaag

SEQ ID NO: 445805 - RNA, 19 nt, Homo sapiens
agccugcacacaccugccu

SEQ ID NO: 445806 - RNA, 15 nt, Homo sapiens
agccugcagaaucca

SEQ ID NO: 445807 - RNA, 23 nt, Homo sapiens
agccugccucccaagguccucuc

SEQ ID NO: 445808 - RNA, 16 nt, Homo sapiens
agccuggccccugugc

SEQ ID NO: 445809 - RNA, 14 nt, Homo sapiens
agccugggccacug

SEQ ID NO: 445810 - RNA, 16 nt, Homo sapiens
agccugggccacuggc

SEQ ID NO: 445811 - RNA, 17 nt, Homo sapiens
agccugggccagagaag

SEQ ID NO: 445812 - RNA, 16 nt, Homo sapiens
agccuggugacaggca

SEQ ID NO: 445813 - RNA, 22 nt, Homo sapiens
agccuggugacaggcagacaca

SEQ ID NO: 445814 - RNA, 20 nt, Homo sapiens
agccuguccucaccgucucg

SEQ ID NO: 445815 - RNA, 22 nt, Homo sapiens
agccugucucuuuccacuuugu

SEQ ID NO: 445816 - RNA, 22 nt, Homo sapiens
agccuguguuagugucugucca

SEQ ID NO: 445817 - RNA, 12 nt, Homo sapiens
agccuucaagau

SEQ ID NO: 445818 - RNA, 22 nt, Homo sapiens
agccuucacuggagaccggaau

SEQ ID NO: 445819 - RNA, 18 nt, Homo sapiens
agccuugcaucaagggcu

SEQ ID NO: 445820 - RNA, 18 nt, Homo sapiens
agccuuggaccaaaugga

SEQ ID NO: 445821 - RNA, 19 nt, Homo sapiens
agccuugguacuaggcagu

SEQ ID NO: 445822 - RNA, 23 nt, Homo sapiens
agccuugguuggaccuauugcca

SEQ ID NO: 445823 - RNA, 15 nt, Homo sapiens
agccuuguaaauaac

SEQ ID NO: 445824 - RNA, 13 nt, Homo sapiens
agccuuuccauaa

SEQ ID NO: 445825 - RNA, 13 nt, Homo sapiens
agcgacuucugaa

SEQ ID NO: 445826 - RNA, 16 nt, Homo sapiens
agcgagcugcucugcu

SEQ ID NO: 445827 - RNA, 16 nt, Homo sapiens
agcgauucuugugccu

SEQ ID NO: 445828 - RNA, 19 nt, Homo sapiens
agcgcagguuuaguuuacu

SEQ ID NO: 445829 - RNA, 21 nt, Homo sapiens
agcgcaguggggugaucucau

SEQ ID NO: 445830 - RNA, 22 nt, Homo sapiens
agcgcaguggggugaucucauc

SEQ ID NO: 445831 - RNA, 20 nt, Homo sapiens
agcgcugcccacaccaccgc

SEQ ID NO: 445832 - RNA, 21 nt, Homo sapiens
agcggacuggugaggagcaca

SEQ ID NO: 445833 - RNA, 23 nt, Homo sapiens
agcggagaucgcaucauugcacu

SEQ ID NO: 445834 - RNA, 14 nt, Homo sapiens
agcgguaccccagg

SEQ ID NO: 445835 - RNA, 13 nt, Homo sapiens
agcguggggcuaa

SEQ ID NO: 445836 - RNA, 20 nt, Homo sapiens
agcuaaaagcaucccuguga

SEQ ID NO: 445837 - RNA, 16 nt, Homo sapiens
agcuaaacaugcugcc

SEQ ID NO: 445838 - RNA, 14 nt, Homo sapiens
agcuaaauggcaac

SEQ ID NO: 445839 - RNA, 16 nt, Homo sapiens
agcuaaauggcaacaa

SEQ ID NO: 445840 - RNA, 15 nt, Homo sapiens
agcuaacaaguagca

SEQ ID NO: 445841 - RNA, 17 nt, Homo sapiens
agcuaauaaaauaucau

SEQ ID NO: 445842 - RNA, 22 nt, Homo sapiens
agcuaauguaauaacugugaag

SEQ ID NO: 445843 - RNA, 15 nt, Homo sapiens
agcuaauuuuugcau

SEQ ID NO: 445844 - RNA, 19 nt, Homo sapiens
agcuacacaaggaaggcau

SEQ ID NO: 445845 - RNA, 13 nt, Homo sapiens
agcuacauuccuc

SEQ ID NO: 445846 - RNA, 18 nt, Homo sapiens
aggaagcaccccaugcca

SEQ ID NO: 445847 - RNA, 20 nt, Homo sapiens
aggaagggaagagcauguaa

SEQ ID NO: 445848 - RNA, 19 nt, Homo sapiens
aggaagggucaaaacauuu

SEQ ID NO: 445849 - RNA, 15 nt, Homo sapiens
aggaagugauaacac

SEQ ID NO: 445850 - RNA, 14 nt, Homo sapiens
aggaauacauuugg

SEQ ID NO: 445851 - RNA, 16 nt, Homo sapiens
aggaauauacauaguc

SEQ ID NO: 445852 - RNA, 22 nt, Homo sapiens
aggaauccacauugccagugac

SEQ ID NO: 445853 - RNA, 15 nt, Homo sapiens
aggaaucugccuucc

SEQ ID NO: 445854 - RNA, 12 nt, Homo sapiens
aggaaugcaaga

SEQ ID NO: 445855 - RNA, 22 nt, Homo sapiens
aggaauugacuucagcaggggu

SEQ ID NO: 445856 - RNA, 17 nt, Homo sapiens
aggacaaacagugaauu

SEQ ID NO: 445857 - RNA, 15 nt, Homo sapiens
aggacaaaggugauu

SEQ ID NO: 445858 - RNA, 18 nt, Homo sapiens
aggacagagcugacaaaa

SEQ ID NO: 445859 - RNA, 20 nt, Homo sapiens
aggacaggauggcugugugu

SEQ ID NO: 445860 - RNA, 15 nt, Homo sapiens
aggacauacugcaug

SEQ ID NO: 445861 - RNA, 23 nt, Homo sapiens
aggacaucucugcccucuucuca

SEQ ID NO: 445862 - RNA, 13 nt, Homo sapiens
aggaccagagcua

SEQ ID NO: 445863 - RNA, 15 nt, Homo sapiens
aggacccacacugcu

SEQ ID NO: 445864 - RNA, 21 nt, Homo sapiens
aggaccccagcuuuucuugcc

SEQ ID NO: 445865 - RNA, 22 nt, Homo sapiens
aggaccuuucugaggaguaaaa

SEQ ID NO: 445866 - RNA, 15 nt, Homo sapiens
aggacucccugcuua

SEQ ID NO: 445867 - RNA, 23 nt, Homo sapiens
aggacugccccgugcagacugga

SEQ ID NO: 445868 - RNA, 15 nt, Homo sapiens
aggacuggcuuuguc

SEQ ID NO: 445869 - RNA, 11 nt, Homo sapiens
aggacugugac

SEQ ID NO: 445870 - RNA, 17 nt, Homo sapiens
aggacuguugacaucca

SEQ ID NO: 445871 - RNA, 12 nt, Homo sapiens
aggacuuucauu

SEQ ID NO: 445872 - RNA, 21 nt, Homo sapiens
aggacuuucauuguucuuggc

SEQ ID NO: 445873 - RNA, 15 nt, Homo sapiens
aggagaaacacaucu

SEQ ID NO: 445874 - RNA, 17 nt, Homo sapiens
aggagaaacacaucuuc

SEQ ID NO: 445875 - RNA, 14 nt, Homo sapiens
aggagaaaggcaug

SEQ ID NO: 445876 - RNA, 19 nt, Homo sapiens
aggagaagcgggaguggcu

SEQ ID NO: 445877 - RNA, 16 nt, Homo sapiens
aggagaaggagaggga

SEQ ID NO: 445878 - RNA, 18 nt, Homo sapiens
aggagacaaagcaggagu

SEQ ID NO: 445879 - RNA, 14 nt, Homo sapiens
aggagacacaucca

SEQ ID NO: 445880 - RNA, 14 nt, Homo sapiens
aggagacacuguuc

SEQ ID NO: 445881 - RNA, 14 nt, Homo sapiens
aggagaccuuccac

SEQ ID NO: 445882 - RNA, 14 nt, Homo sapiens
aggagacuuguaca

SEQ ID NO: 445883 - RNA, 16 nt, Homo sapiens
aggagagccaaccucg

SEQ ID NO: 445884 - RNA, 21 nt, Homo sapiens
aggagagggaguacaaagaca

SEQ ID NO: 445885 - RNA, 19 nt, Homo sapiens
aggagaggggaagggccag

SEQ ID NO: 445886 - RNA, 14 nt, Homo sapiens
aggagauuacaauu

SEQ ID NO: 445887 - RNA, 14 nt, Homo sapiens
aggagcaaaacgcc

SEQ ID NO: 445888 - RNA, 12 nt, Homo sapiens
aggagcacauua

SEQ ID NO: 445889 - RNA, 13 nt, Homo sapiens
aggagcagcuuca

SEQ ID NO: 445890 - RNA, 21 nt, Homo sapiens
aggagcauuuugugucuuaag

SEQ ID NO: 445891 - RNA, 19 nt, Homo sapiens
aggagcugauuuccaggcc

SEQ ID NO: 445892 - RNA, 15 nt, Homo sapiens
aggaggagauggcca

SEQ ID NO: 445893 - RNA, 21 nt, Homo sapiens
aggaggcagaggguugcagug

SEQ ID NO: 445894 - RNA, 20 nt, Homo sapiens
aggaggcuuuaagcuccagc

SEQ ID NO: 445895 - RNA, 14 nt, Homo sapiens
aggagggagcugcu

SEQ ID NO: 445896 - RNA, 17 nt, Homo sapiens
aggagggagcugcucag

SEQ ID NO: 445897 - RNA, 15 nt, Homo sapiens
aggaggggcugucca

SEQ ID NO: 445898 - RNA, 14 nt, Homo sapiens
aggaggguggcacu

SEQ ID NO: 445899 - RNA, 16 nt, Homo sapiens
aggagucugauugcag

SEQ ID NO: 445900 - RNA, 23 nt, Homo sapiens
aggagucugccuccaugcugcag

SEQ ID NO: 445901 - RNA, 21 nt, Homo sapiens
aggaguuggaauguuguaguu

SEQ ID NO: 445902 - RNA, 13 nt, Homo sapiens
aggauagcuucau

SEQ ID NO: 445903 - RNA, 15 nt, Homo sapiens
aggauauuaacaaca

SEQ ID NO: 445904 - RNA, 22 nt, Homo sapiens
aggaugaaagacaaagaaggaa

SEQ ID NO: 445905 - RNA, 20 nt, Homo sapiens
aggaugaauguaugugcacu

SEQ ID NO: 445906 - RNA, 13 nt, Homo sapiens
aggaugacuguau

SEQ ID NO: 445907 - RNA, 15 nt, Homo sapiens
aggaugauggccaca

SEQ ID NO: 445908 - RNA, 14 nt, Homo sapiens
aggauggcucagac

SEQ ID NO: 445909 - RNA, 19 nt, Homo sapiens
aggaugguccagaauucac

SEQ ID NO: 445910 - RNA, 15 nt, Homo sapiens
aggauuuaccaaaua

SEQ ID NO: 445911 - RNA, 16 nt, Homo sapiens
aggcaaaaaugugccc

SEQ ID NO: 445912 - RNA, 13 nt, Homo sapiens
aggcaaaugaugc

SEQ ID NO: 445913 - RNA, 14 nt, Homo sapiens
aggcaaaugaugcc

SEQ ID NO: 445914 - RNA, 16 nt, Homo sapiens
aggcaacugaacaaaa

SEQ ID NO: 445915 - RNA, 19 nt, Homo sapiens
aggcaagaaccaguguuua

SEQ ID NO: 445916 - RNA, 17 nt, Homo sapiens
aggcaagcuaacugcuu

SEQ ID NO: 445917 - RNA, 14 nt, Homo sapiens
aggcaagcuggcag

SEQ ID NO: 445918 - RNA, 21 nt, Homo sapiens
aggcaaggggugccugggaac

SEQ ID NO: 445919 - RNA, 15 nt, Homo sapiens
aggcaauggccuaaa

SEQ ID NO: 445920 - RNA, 20 nt, Homo sapiens
aggcaauggugaacugucau

SEQ ID NO: 445921 - RNA, 14 nt, Homo sapiens
aggcaccagcagca

SEQ ID NO: 445922 - RNA, 21 nt, Homo sapiens
aggcacccgcccuuuccuugc

SEQ ID NO: 445923 - RNA, 16 nt, Homo sapiens
aggcacugguggcauc

SEQ ID NO: 445924 - RNA, 18 nt, Homo sapiens
aggcacuguggcucugca

SEQ ID NO: 445925 - RNA, 15 nt, Homo sapiens
aggcagaaugguggg

SEQ ID NO: 445926 - RNA, 15 nt, Homo sapiens
aggcagagacaauaa

SEQ ID NO: 445927 - RNA, 13 nt, Homo sapiens
aggcagagcucag

SEQ ID NO: 445928 - RNA, 20 nt, Homo sapiens
aggcagagggucacuuuaca

SEQ ID NO: 445929 - RNA, 13 nt, Homo sapiens
aggcagagucuca

SEQ ID NO: 445930 - RNA, 15 nt, Homo sapiens
aggcagccagggcuu

SEQ ID NO: 445931 - RNA, 16 nt, Homo sapiens
aggcagcccccuccac

SEQ ID NO: 445932 - RNA, 21 nt, Homo sapiens
aggcagcccccugcacaggga

SEQ ID NO: 445933 - RNA, 16 nt, Homo sapiens
aggcagccuugaccac

SEQ ID NO: 445934 - RNA, 19 nt, Homo sapiens
aggcagcucaccccugggc

SEQ ID NO: 445935 - RNA, 20 nt, Homo sapiens
aggcaggagaaucacuggaa

SEQ ID NO: 445936 - RNA, 21 nt, Homo sapiens
aggcagggaagcucuaccgca

SEQ ID NO: 445937 - RNA, 18 nt, Homo sapiens
aggcagggagugucugca

SEQ ID NO: 445938 - RNA, 14 nt, Homo sapiens
aggcaguaaccaug

SEQ ID NO: 445939 - RNA, 23 nt, Homo sapiens
aggcaguuaaauaauaauaguua

SEQ ID NO: 445940 - RNA, 14 nt, Homo sapiens
aggcauauacaaau

SEQ ID NO: 445941 - RNA, 16 nt, Homo sapiens
aggcauauacaaauaa

SEQ ID NO: 445942 - RNA, 14 nt, Homo sapiens
aggcauuucuauca

SEQ ID NO: 445943 - RNA, 12 nt, Homo sapiens
aggccaagcccc

SEQ ID NO: 445944 - RNA, 17 nt, Homo sapiens
aggccaaggccucagga

SEQ ID NO: 445945 - RNA, 17 nt, Homo sapiens
aggccaguaaaaguaua

SEQ ID NO: 445946 - RNA, 18 nt, Homo sapiens
aggccauaccaggugcua

SEQ ID NO: 445947 - RNA, 13 nt, Homo sapiens
aggccaucuguaa

SEQ ID NO: 445948 - RNA, 22 nt, Homo sapiens
aggccaucuguaaauaucccag

SEQ ID NO: 445949 - RNA, 16 nt, Homo sapiens
aggccauggugcacaa

SEQ ID NO: 445950 - RNA, 16 nt, Homo sapiens
aggcccaagcugccug

SEQ ID NO: 445951 - RNA, 18 nt, Homo sapiens
aggcccagcagagccguu

SEQ ID NO: 445952 - RNA, 14 nt, Homo sapiens
aggccccagccaag

SEQ ID NO: 445953 - RNA, 17 nt, Homo sapiens
aggcccuggaacucuau

SEQ ID NO: 445954 - RNA, 21 nt, Homo sapiens
aggccgccccagccucugagc

SEQ ID NO: 445955 - RNA, 20 nt, Homo sapiens
aggccgggcgcaguggcuca

SEQ ID NO: 445956 - RNA, 14 nt, Homo sapiens
aggccgggugcuca

SEQ ID NO: 445957 - RNA, 23 nt, Homo sapiens
aggccuauaacuuuugguaucua

SEQ ID NO: 445958 - RNA, 21 nt, Homo sapiens
aggccucaguguccucaucua

SEQ ID NO: 445959 - RNA, 15 nt, Homo sapiens
aggccugaggaugag

SEQ ID NO: 445960 - RNA, 16 nt, Homo sapiens
aggccugccaaugcca

SEQ ID NO: 445961 - RNA, 14 nt, Homo sapiens
aggccuggacuuuc

SEQ ID NO: 445962 - RNA, 20 nt, Homo sapiens
aggccuggacuuuccugcaa

SEQ ID NO: 445963 - RNA, 17 nt, Homo sapiens
aggccuggccucggggc

SEQ ID NO: 445964 - RNA, 21 nt, Homo sapiens
aggccuucagaaaagacacuu

SEQ ID NO: 445965 - RNA, 18 nt, Homo sapiens
aggccuuugggauuugcc

SEQ ID NO: 445966 - RNA, 22 nt, Homo sapiens
aggcgauccaccugucucagcc

SEQ ID NO: 445967 - RNA, 13 nt, Homo sapiens
aggcgaugugcaa

SEQ ID NO: 445968 - RNA, 14 nt, Homo sapiens
aggcgaugugcaag

SEQ ID NO: 445969 - RNA, 20 nt, Homo sapiens
aggcgccugccaucaugccu

SEQ ID NO: 445970 - RNA, 20 nt, Homo sapiens
aggcgggaugggacacccaa

SEQ ID NO: 445971 - RNA, 15 nt, Homo sapiens
aggcguagggccagg

SEQ ID NO: 445972 - RNA, 21 nt, Homo sapiens
aggcgugccccccuccuccag

SEQ ID NO: 445973 - RNA, 17 nt, Homo sapiens
aggcgugggacgugguc

SEQ ID NO: 445974 - RNA, 14 nt, Homo sapiens
aggcguucuccugc

SEQ ID NO: 445975 - RNA, 17 nt, Homo sapiens
aggcuacagaaugagac

SEQ ID NO: 445976 - RNA, 22 nt, Homo sapiens
aggcuagaauggaaaacugccu

SEQ ID NO: 445977 - RNA, 12 nt, Homo sapiens
auuuucauccca

SEQ ID NO: 445978 - RNA, 15 nt, Homo sapiens
auuuucauucauuca

SEQ ID NO: 445979 - RNA, 22 nt, Homo sapiens
auuuuccccccacucuccccac

SEQ ID NO: 445980 - RNA, 18 nt, Homo sapiens
auuuuccccuagcuuucc

SEQ ID NO: 445981 - RNA, 19 nt, Homo sapiens
auuuuccgccagaccucaa

SEQ ID NO: 445982 - RNA, 19 nt, Homo sapiens
auuuuccuuccuacacccu

SEQ ID NO: 445983 - RNA, 19 nt, Homo sapiens
auuuucucuggcagcauaa

SEQ ID NO: 445984 - RNA, 19 nt, Homo sapiens
auuuucugcccaacuuuca

SEQ ID NO: 445985 - RNA, 17 nt, Homo sapiens
auuuucuuuuuauacua

SEQ ID NO: 445986 - RNA, 17 nt, Homo sapiens
auuuugaaaacacuuau

SEQ ID NO: 445987 - RNA, 20 nt, Homo sapiens
auuuugaguucuacauaagu

SEQ ID NO: 445988 - RNA, 12 nt, Homo sapiens
auuuugcacagu

SEQ ID NO: 445989 - RNA, 20 nt, Homo sapiens
auuuugcugcacacaaucua

SEQ ID NO: 445990 - RNA, 18 nt, Homo sapiens
auuuuggaaaaugauuag

SEQ ID NO: 445991 - RNA, 23 nt, Homo sapiens
auuuugggggguaaucagcauua

SEQ ID NO: 445992 - RNA, 19 nt, Homo sapiens
auuuuggguggccaaagug

SEQ ID NO: 445993 - RNA, 21 nt, Homo sapiens
auuuuguugccuucaucuuca

SEQ ID NO: 445994 - RNA, 16 nt, Homo sapiens
auuuuuaacaccaugg

SEQ ID NO: 445995 - RNA, 15 nt, Homo sapiens
auuuuucucaucucc

SEQ ID NO: 445996 - RNA, 19 nt, Homo sapiens
auuuuuguuuuauccacaa

SEQ ID NO: 445997 - RNA, 20 nt, Homo sapiens
auuuuuuaagguaacaaaua

SEQ ID NO: 445998 - RNA, 19 nt, Homo sapiens
auuuuuucgugcacucugc

SEQ ID NO: 445999 - RNA, 14 nt, Homo sapiens
auuuuuugcuacuu

SEQ ID NO: 446000 - RNA, 23 nt, Homo sapiens
auuuuuuuaagacagagucucac

SEQ ID NO: 446001 - RNA, 19 nt, Homo sapiens
caaaaaaaaaaaaaugcac

SEQ ID NO: 446002 - RNA, 12 nt, Homo sapiens
caaaaaaaccuu

SEQ ID NO: 446003 - RNA, 21 nt, Homo sapiens
caaaaaaaguugaaggccuua

SEQ ID NO: 446004 - RNA, 13 nt, Homo sapiens
caaaaacaacaac

SEQ ID NO: 446005 - RNA, 14 nt, Homo sapiens
caaaaacauggccu

SEQ ID NO: 446006 - RNA, 18 nt, Homo sapiens
caaaaagaacacccaucg

SEQ ID NO: 446007 - RNA, 22 nt, Homo sapiens
caaaaagaauuccaaccgacca

SEQ ID NO: 446008 - RNA, 13 nt, Homo sapiens
caaaaaugacaga

SEQ ID NO: 446009 - RNA, 11 nt, Homo sapiens
caaaacaaagc

SEQ ID NO: 446010 - RNA, 12 nt, Homo sapiens
caaaacauaucu

SEQ ID NO: 446011 - RNA, 14 nt, Homo sapiens
caaaacuaguucuu

SEQ ID NO: 446012 - RNA, 16 nt, Homo sapiens
caaaacugacaguaaa

SEQ ID NO: 446013 - RNA, 20 nt, Homo sapiens
caaaagaggagcacuuccaa

SEQ ID NO: 446014 - RNA, 18 nt, Homo sapiens
caaaagauaaaacuaauu

SEQ ID NO: 446015 - RNA, 12 nt, Homo sapiens
caaaagauguau

SEQ ID NO: 446016 - RNA, 15 nt, Homo sapiens
caaaagcaaagugaa

SEQ ID NO: 446017 - RNA, 12 nt, Homo sapiens
caaaagcacuua

SEQ ID NO: 446018 - RNA, 19 nt, Homo sapiens
caaaagccauaacuugaaa

SEQ ID NO: 446019 - RNA, 17 nt, Homo sapiens
caaaaggaaaccaagug

SEQ ID NO: 446020 - RNA, 14 nt, Homo sapiens
caaaaggaccccaa

SEQ ID NO: 446021 - RNA, 16 nt, Homo sapiens
caaaaggcagcucacc

SEQ ID NO: 446022 - RNA, 12 nt, Homo sapiens
caaaagguuaag

SEQ ID NO: 446023 - RNA, 18 nt, Homo sapiens
caaaagguuaagccauau

SEQ ID NO: 446024 - RNA, 11 nt, Homo sapiens
caaaaguggau

SEQ ID NO: 446025 - RNA, 19 nt, Homo sapiens
caaaauacagcacuuugac

SEQ ID NO: 446026 - RNA, 11 nt, Homo sapiens
caaaauacuuc

SEQ ID NO: 446027 - RNA, 19 nt, Homo sapiens
caaaauagagaaucccacu

SEQ ID NO: 446028 - RNA, 18 nt, Homo sapiens
caaaaugaaugcauuggc

SEQ ID NO: 446029 - RNA, 20 nt, Homo sapiens
caaaaugauauguuugagua

SEQ ID NO: 446030 - RNA, 19 nt, Homo sapiens
caaaaugucuaagauagua

SEQ ID NO: 446031 - RNA, 12 nt, Homo sapiens
caaaauguuaau

SEQ ID NO: 446032 - RNA, 18 nt, Homo sapiens
caaaauguuaguggcaua

SEQ ID NO: 446033 - RNA, 13 nt, Homo sapiens
caaaauucauuca

SEQ ID NO: 446034 - RNA, 13 nt, Homo sapiens
caaaauugaugug

SEQ ID NO: 446035 - RNA, 19 nt, Homo sapiens
caaaauuguguccacauaa

SEQ ID NO: 446036 - RNA, 20 nt, Homo sapiens
caaacaaccccccaucacaa

SEQ ID NO: 446037 - RNA, 21 nt, Homo sapiens
caaacaguguggcuuaaacau

SEQ ID NO: 446038 - RNA, 20 nt, Homo sapiens
caaacccauuuccagcuccu

SEQ ID NO: 446039 - RNA, 18 nt, Homo sapiens
caaacccuaaaccucuuc

SEQ ID NO: 446040 - RNA, 17 nt, Homo sapiens
caaaccugaccacagaa

SEQ ID NO: 446041 - RNA, 18 nt, Homo sapiens
caaaccuuuccuguaaca

SEQ ID NO: 446042 - RNA, 21 nt, Homo sapiens
caaacuacuuucuuaauauca

SEQ ID NO: 446043 - RNA, 18 nt, Homo sapiens
caaacucacugcucaaga

SEQ ID NO: 446044 - RNA, 21 nt, Homo sapiens
caaacucacugcucaagaaga

SEQ ID NO: 446045 - RNA, 15 nt, Homo sapiens
caaacucccaggacc

SEQ ID NO: 446046 - RNA, 22 nt, Homo sapiens
caaacugccuauauugauaaaa

SEQ ID NO: 446047 - RNA, 22 nt, Homo sapiens
caaacuguacaguuucuucccc

SEQ ID NO: 446048 - RNA, 20 nt, Homo sapiens
caaacuguggguauuguuaa

SEQ ID NO: 446049 - RNA, 16 nt, Homo sapiens
caaacuucuuguucaa

SEQ ID NO: 446050 - RNA, 21 nt, Homo sapiens
caaagaaaauucucaagugau

SEQ ID NO: 446051 - RNA, 20 nt, Homo sapiens
caaagaacugccccaucucc

SEQ ID NO: 446052 - RNA, 21 nt, Homo sapiens
caaagaacugccccaucuccu

SEQ ID NO: 446053 - RNA, 16 nt, Homo sapiens
caaagaagaaccaucu

SEQ ID NO: 446054 - RNA, 23 nt, Homo sapiens
caaagacgguagagagaaacagc

SEQ ID NO: 446055 - RNA, 15 nt, Homo sapiens
caaagagaaaagcca

SEQ ID NO: 446056 - RNA, 19 nt, Homo sapiens
caaagagaauaaagacuuc

SEQ ID NO: 446057 - RNA, 15 nt, Homo sapiens
caaagagaaugccau

SEQ ID NO: 446058 - RNA, 21 nt, Homo sapiens
caaagaugagaagccaaagcc

SEQ ID NO: 446059 - RNA, 15 nt, Homo sapiens
caaagcaacuggaua

SEQ ID NO: 446060 - RNA, 21 nt, Homo sapiens
caaagcaaguuucaucaguca

SEQ ID NO: 446061 - RNA, 16 nt, Homo sapiens
caaagcaggaguggaa

SEQ ID NO: 446062 - RNA, 14 nt, Homo sapiens
caaagcaugugaau

SEQ ID NO: 446063 - RNA, 23 nt, Homo sapiens
caaagccuuaucaagugucuucc

SEQ ID NO: 446064 - RNA, 18 nt, Homo sapiens
caaagcgugguggacaug

SEQ ID NO: 446065 - RNA, 22 nt, Homo sapiens
caaagcugaugacaacuuccca

SEQ ID NO: 446066 - RNA, 20 nt, Homo sapiens
caaagcugugaaaugugcaa

SEQ ID NO: 446067 - RNA, 15 nt, Homo sapiens
caaagcuuuccugcc

SEQ ID NO: 446068 - RNA, 15 nt, Homo sapiens
caaaggacagaucca

SEQ ID NO: 446069 - RNA, 16 nt, Homo sapiens
caaaggacagauccag

SEQ ID NO: 446070 - RNA, 22 nt, Homo sapiens
caaaggacagauccagggacug

SEQ ID NO: 446071 - RNA, 23 nt, Homo sapiens
caaagggaacugaagaccuccac

SEQ ID NO: 446072 - RNA, 21 nt, Homo sapiens
caaaguauaaauuuguguaau

SEQ ID NO: 446073 - RNA, 16 nt, Homo sapiens
caaagucaaaaauagc

SEQ ID NO: 446074 - RNA, 18 nt, Homo sapiens
caaagucugugugaugaa

SEQ ID NO: 446075 - RNA, 20 nt, Homo sapiens
caaagugacauuccugaguc

SEQ ID NO: 446076 - RNA, 17 nt, Homo sapiens
caaagugcugagauuac

SEQ ID NO: 446077 - RNA, 19 nt, Homo sapiens
caaagugcugagauuacag

SEQ ID NO: 446078 - RNA, 17 nt, Homo sapiens
caaagugcugggauuac

SEQ ID NO: 446079 - RNA, 13 nt, Homo sapiens
caaaguuaugcaa

SEQ ID NO: 446080 - RNA, 23 nt, Homo sapiens
caaaguuaugcaagggacugugu

SEQ ID NO: 446081 - RNA, 19 nt, Homo sapiens
caaaguuuggauuguauca

SEQ ID NO: 446082 - RNA, 17 nt, Homo sapiens
caaauaaacucuaaaca

SEQ ID NO: 446083 - RNA, 15 nt, Homo sapiens
caaauaaguuacccu

SEQ ID NO: 446084 - RNA, 18 nt, Homo sapiens
caaauaaguuacccucaa

SEQ ID NO: 446085 - RNA, 20 nt, Homo sapiens
caaauaauauuuuagauuac

SEQ ID NO: 446086 - RNA, 22 nt, Homo sapiens
caaauacaauucagucuucucu

SEQ ID NO: 446087 - RNA, 22 nt, Homo sapiens
caaauagaaccacuaugaagcu

SEQ ID NO: 446088 - RNA, 19 nt, Homo sapiens
caaauagaagcuucuugcu

SEQ ID NO: 446089 - RNA, 23 nt, Homo sapiens
caaauagaagcuucuugcuccug

SEQ ID NO: 446090 - RNA, 19 nt, Homo sapiens
caaauaguaggcuaaaaac

SEQ ID NO: 446091 - RNA, 11 nt, Homo sapiens
caaauauugcu

SEQ ID NO: 446092 - RNA, 17 nt, Homo sapiens
caaaucaagaaauauga

SEQ ID NO: 446093 - RNA, 13 nt, Homo sapiens
caaaucauuccau

SEQ ID NO: 446094 - RNA, 23 nt, Homo sapiens
caaauccauacccccugccccag

SEQ ID NO: 446095 - RNA, 22 nt, Homo sapiens
caaaucuccaguauucuuguca

SEQ ID NO: 446096 - RNA, 20 nt, Homo sapiens
caaaucuugaauuucugcca

SEQ ID NO: 446097 - RNA, 20 nt, Homo sapiens
caaaugagauguaugcccaa

SEQ ID NO: 446098 - RNA, 12 nt, Homo sapiens
caaaugagccac

SEQ ID NO: 446099 - RNA, 13 nt, Homo sapiens
caaaugagccaca

SEQ ID NO: 446100 - RNA, 11 nt, Homo sapiens
caaaugaugcc

SEQ ID NO: 446101 - RNA, 20 nt, Homo sapiens
caaaugccugguaccagagg

SEQ ID NO: 446102 - RNA, 17 nt, Homo sapiens
caaaugcuacucaguau

SEQ ID NO: 446103 - RNA, 14 nt, Homo sapiens
caaaugcugugcaa

SEQ ID NO: 446104 - RNA, 15 nt, Homo sapiens
caaauggauguaaua

SEQ ID NO: 446105 - RNA, 13 nt, Homo sapiens
caaauguccaagc

SEQ ID NO: 446106 - RNA, 16 nt, Homo sapiens
caaauguuagagccau

SEQ ID NO: 446107 - RNA, 19 nt, Homo sapiens
cacagaaaaaaauggugcc

SEQ ID NO: 446108 - RNA, 22 nt, Homo sapiens
cacagacuggagacaaugcaga

SEQ ID NO: 446109 - RNA, 15 nt, Homo sapiens
cacagacuucacaca

SEQ ID NO: 446110 - RNA, 21 nt, Homo sapiens
cacagagacaaggagggcaca

SEQ ID NO: 446111 - RNA, 23 nt, Homo sapiens
cacagagauuagccuguagcuua

SEQ ID NO: 446112 - RNA, 15 nt, Homo sapiens
cacagagcaagugau

SEQ ID NO: 446113 - RNA, 14 nt, Homo sapiens
cacagagugcauug

SEQ ID NO: 446114 - RNA, 17 nt, Homo sapiens
cacagaguuacugccac

SEQ ID NO: 446115 - RNA, 14 nt, Homo sapiens
cacagauaauuuac

SEQ ID NO: 446116 - RNA, 22 nt, Homo sapiens
cacagauguuugaggcuuucag

SEQ ID NO: 446117 - RNA, 16 nt, Homo sapiens
cacagcaaaugagaug

SEQ ID NO: 446118 - RNA, 21 nt, Homo sapiens
cacagcagccccugcacaaag

SEQ ID NO: 446119 - RNA, 22 nt, Homo sapiens
cacagcaguacuugcucaauaa

SEQ ID NO: 446120 - RNA, 19 nt, Homo sapiens
cacagccaacguucaugca

SEQ ID NO: 446121 - RNA, 18 nt, Homo sapiens
cacagccauggcuggaau

SEQ ID NO: 446122 - RNA, 14 nt, Homo sapiens
cacagccauuucaa

SEQ ID NO: 446123 - RNA, 15 nt, Homo sapiens
cacagccuggccccu

SEQ ID NO: 446124 - RNA, 15 nt, Homo sapiens
cacagccugucuuca

SEQ ID NO: 446125 - RNA, 21 nt, Homo sapiens
cacagcugcagcugggcccca

SEQ ID NO: 446126 - RNA, 19 nt, Homo sapiens
cacagcugcugcuggaaau

SEQ ID NO: 446127 - RNA, 18 nt, Homo sapiens
cacaggacaacuuuacaa

SEQ ID NO: 446128 - RNA, 12 nt, Homo sapiens
cacaggacacag

SEQ ID NO: 446129 - RNA, 15 nt, Homo sapiens
cacaggacacaguca

SEQ ID NO: 446130 - RNA, 17 nt, Homo sapiens
cacaggaggugugauag

SEQ ID NO: 446131 - RNA, 15 nt, Homo sapiens
cacaggaucugaacu

SEQ ID NO: 446132 - RNA, 14 nt, Homo sapiens
cacaggcuauucua

SEQ ID NO: 446133 - RNA, 20 nt, Homo sapiens
cacaggcuccuguauuugag

SEQ ID NO: 446134 - RNA, 18 nt, Homo sapiens
cacaggggcccauggacu

SEQ ID NO: 446135 - RNA, 18 nt, Homo sapiens
cacaggggugucuugucu

SEQ ID NO: 446136 - RNA, 21 nt, Homo sapiens
cacaguacaauguuucagaag

SEQ ID NO: 446137 - RNA, 21 nt, Homo sapiens
cacaguagggcuuggugaaug

SEQ ID NO: 446138 - RNA, 23 nt, Homo sapiens
cacagucgcucacaccuguaauc

SEQ ID NO: 446139 - RNA, 15 nt, Homo sapiens
cacagucuuggcuca

SEQ ID NO: 446140 - RNA, 15 nt, Homo sapiens
cacagugcaucucag

SEQ ID NO: 446141 - RNA, 15 nt, Homo sapiens
cacaguggccaaaga

SEQ ID NO: 446142 - RNA, 20 nt, Homo sapiens
cacaguuuaaacacaucaau

SEQ ID NO: 446143 - RNA, 17 nt, Homo sapiens
cacauauauuuuuuaca

SEQ ID NO: 446144 - RNA, 20 nt, Homo sapiens
cacauauauuuuuuacaaac

SEQ ID NO: 446145 - RNA, 21 nt, Homo sapiens
cacauauauuuuuuacaaaca

SEQ ID NO: 446146 - RNA, 20 nt, Homo sapiens
cacaucagcccuguguauaa

SEQ ID NO: 446147 - RNA, 19 nt, Homo sapiens
cacauccaaacauguaucu

SEQ ID NO: 446148 - RNA, 15 nt, Homo sapiens
cacauccccaccuuc

SEQ ID NO: 446149 - RNA, 20 nt, Homo sapiens
cacauccugaaaaggguguu

SEQ ID NO: 446150 - RNA, 19 nt, Homo sapiens
cacaucuaacaaagucaag

SEQ ID NO: 446151 - RNA, 19 nt, Homo sapiens
cacaucucugcuugaguca

SEQ ID NO: 446152 - RNA, 17 nt, Homo sapiens
cacaucugccaccggaa

SEQ ID NO: 446153 - RNA, 22 nt, Homo sapiens
cacaucuuaauuaagcuccuuc

SEQ ID NO: 446154 - RNA, 18 nt, Homo sapiens
cacauggaacgcuuucau

SEQ ID NO: 446155 - RNA, 17 nt, Homo sapiens
cacauggaaggugaugg

SEQ ID NO: 446156 - RNA, 16 nt, Homo sapiens
cacaugguuuccaagg

SEQ ID NO: 446157 - RNA, 14 nt, Homo sapiens
cacaugugugcgug

SEQ ID NO: 446158 - RNA, 12 nt, Homo sapiens
cacauuacagga

SEQ ID NO: 446159 - RNA, 11 nt, Homo sapiens
cacauucccuc

SEQ ID NO: 446160 - RNA, 14 nt, Homo sapiens
cacauucuacuuca

SEQ ID NO: 446161 - RNA, 14 nt, Homo sapiens
caccaaauucugaa

SEQ ID NO: 446162 - RNA, 15 nt, Homo sapiens
caccaaccacugcga

SEQ ID NO: 446163 - RNA, 21 nt, Homo sapiens
caccaacgagcuguacaugau

SEQ ID NO: 446164 - RNA, 16 nt, Homo sapiens
caccaagaaaccacug

SEQ ID NO: 446165 - RNA, 19 nt, Homo sapiens
caccaagcuuagaagccac

SEQ ID NO: 446166 - RNA, 22 nt, Homo sapiens
caccacaauuagagcuugaugc

SEQ ID NO: 446167 - RNA, 13 nt, Homo sapiens
caccacacauaca

SEQ ID NO: 446168 - RNA, 16 nt, Homo sapiens
caccacaccuggcuaa

SEQ ID NO: 446169 - RNA, 15 nt, Homo sapiens
caccacccacuugau

SEQ ID NO: 446170 - RNA, 14 nt, Homo sapiens
caccacuuaaucuu

SEQ ID NO: 446171 - RNA, 20 nt, Homo sapiens
caccagaagugccaugcuca

SEQ ID NO: 446172 - RNA, 17 nt, Homo sapiens
caccagucucacccacu

SEQ ID NO: 446173 - RNA, 18 nt, Homo sapiens
caccauccugcagccucc

SEQ ID NO: 446174 - RNA, 23 nt, Homo sapiens
caccauggcaccuuuugcacaua

SEQ ID NO: 446175 - RNA, 14 nt, Homo sapiens
caccauguaugugg

SEQ ID NO: 446176 - RNA, 17 nt, Homo sapiens
caccauucgucaucacu

SEQ ID NO: 446177 - RNA, 14 nt, Homo sapiens
cacccaauguuuga

SEQ ID NO: 446178 - RNA, 13 nt, Homo sapiens
cacccaccagagu

SEQ ID NO: 446179 - RNA, 14 nt, Homo sapiens
cacccacccaggag

SEQ ID NO: 446180 - RNA, 13 nt, Homo sapiens
cacccacucagga

SEQ ID NO: 446181 - RNA, 13 nt, Homo sapiens
cacccaugacugc

SEQ ID NO: 446182 - RNA, 14 nt, Homo sapiens
cacccauugucuca

SEQ ID NO: 446183 - RNA, 13 nt, Homo sapiens
cacccccagucuc

SEQ ID NO: 446184 - RNA, 12 nt, Homo sapiens
caccccgugcca

SEQ ID NO: 446185 - RNA, 15 nt, Homo sapiens
cacccuaucaucagu

SEQ ID NO: 446186 - RNA, 22 nt, Homo sapiens
cacccucacacacacagcuggg

SEQ ID NO: 446187 - RNA, 21 nt, Homo sapiens
cacccuccgguuauguugcuc

SEQ ID NO: 446188 - RNA, 23 nt, Homo sapiens
cacccucugcuaugucugugaug

SEQ ID NO: 446189 - RNA, 16 nt, Homo sapiens
cacccuggaggauuuc

SEQ ID NO: 446190 - RNA, 16 nt, Homo sapiens
cacccugggaucucag

SEQ ID NO: 446191 - RNA, 18 nt, Homo sapiens
cacccugucuaggcacau

SEQ ID NO: 446192 - RNA, 17 nt, Homo sapiens
cacccuucugcuguaua

SEQ ID NO: 446193 - RNA, 15 nt, Homo sapiens
cacccuuucuugaca

SEQ ID NO: 446194 - RNA, 20 nt, Homo sapiens
caccgagaauguuguauuca

SEQ ID NO: 446195 - RNA, 16 nt, Homo sapiens
caccgauaaccacagg

SEQ ID NO: 446196 - RNA, 18 nt, Homo sapiens
caccgcugccagcacaga

SEQ ID NO: 446197 - RNA, 23 nt, Homo sapiens
caccgguguccuguuccugccac

SEQ ID NO: 446198 - RNA, 22 nt, Homo sapiens
caccguacaucugcaauaugaa

SEQ ID NO: 446199 - RNA, 21 nt, Homo sapiens
caccuaauguuuaugagccag

SEQ ID NO: 446200 - RNA, 22 nt, Homo sapiens
caccuaauguuuaugagccaga

SEQ ID NO: 446201 - RNA, 16 nt, Homo sapiens
caccuagagcuccagu

SEQ ID NO: 446202 - RNA, 13 nt, Homo sapiens
caccucacaacuc

SEQ ID NO: 446203 - RNA, 22 nt, Homo sapiens
caccucacgcucuggacaugau

SEQ ID NO: 446204 - RNA, 16 nt, Homo sapiens
caccucaugucauuuc

SEQ ID NO: 446205 - RNA, 16 nt, Homo sapiens
caccuccugcaauaaa

SEQ ID NO: 446206 - RNA, 22 nt, Homo sapiens
caccucucuccuuugcugaggc

SEQ ID NO: 446207 - RNA, 18 nt, Homo sapiens
caccucugugccaccucu

SEQ ID NO: 446208 - RNA, 14 nt, Homo sapiens
caccucuuugucac

SEQ ID NO: 446209 - RNA, 16 nt, Homo sapiens
caccugaaagccuguc

SEQ ID NO: 446210 - RNA, 15 nt, Homo sapiens
caccugaccaaucag

SEQ ID NO: 446211 - RNA, 22 nt, Homo sapiens
caccugagcuuuggacgcacac

SEQ ID NO: 446212 - RNA, 22 nt, Homo sapiens
caccugccugcaucugugaaaa

SEQ ID NO: 446213 - RNA, 22 nt, Homo sapiens
caccugcuggaaaccacacuuc

SEQ ID NO: 446214 - RNA, 20 nt, Homo sapiens
caccugcugguuguugccag

SEQ ID NO: 446215 - RNA, 17 nt, Homo sapiens
caccuggcccuugcaau

SEQ ID NO: 446216 - RNA, 21 nt, Homo sapiens
caccuggcggcccuaagccac

SEQ ID NO: 446217 - RNA, 20 nt, Homo sapiens
caccugggcugaggaggcag

SEQ ID NO: 446218 - RNA, 21 nt, Homo sapiens
caccuguauaauguuuuguaa

SEQ ID NO: 446219 - RNA, 17 nt, Homo sapiens
caccuguguacugagua

SEQ ID NO: 446220 - RNA, 16 nt, Homo sapiens
caccuucaagcagcug

SEQ ID NO: 446221 - RNA, 14 nt, Homo sapiens
caccuucauucucc

SEQ ID NO: 446222 - RNA, 14 nt, Homo sapiens
caccuuccaaagga

SEQ ID NO: 446223 - RNA, 21 nt, Homo sapiens
caccuucccuaguucuuugca

SEQ ID NO: 446224 - RNA, 17 nt, Homo sapiens
caccuugccaagcuuuc

SEQ ID NO: 446225 - RNA, 16 nt, Homo sapiens
caccuugucauguacc

SEQ ID NO: 446226 - RNA, 18 nt, Homo sapiens
caccuuguuacacauuau

SEQ ID NO: 446227 - RNA, 14 nt, Homo sapiens
caccuuuuaacuca

SEQ ID NO: 446228 - RNA, 17 nt, Homo sapiens
cacgaagcuuaguauaa

SEQ ID NO: 446229 - RNA, 21 nt, Homo sapiens
cacgaucucggcucacugcac

SEQ ID NO: 446230 - RNA, 21 nt, Homo sapiens
cacgauuccgaucgacugcca

SEQ ID NO: 446231 - RNA, 19 nt, Homo sapiens
cacgccacaacuccagugu

SEQ ID NO: 446232 - RNA, 22 nt, Homo sapiens
cacgccugguucuguacaugug

SEQ ID NO: 446233 - RNA, 17 nt, Homo sapiens
cacgcucuggugcaguc

SEQ ID NO: 446234 - RNA, 20 nt, Homo sapiens
cacggccucuggggagaccg

SEQ ID NO: 446235 - RNA, 23 nt, Homo sapiens
cacgguggugcaugccuguaauc

SEQ ID NO: 446236 - RNA, 15 nt, Homo sapiens
caggugaacucgaag

SEQ ID NO: 446237 - RNA, 13 nt, Homo sapiens
caggugaguguga

SEQ ID NO: 446238 - RNA, 22 nt, Homo sapiens
caggugauccacccaccuuggc

SEQ ID NO: 446239 - RNA, 18 nt, Homo sapiens
caggugauccgccuaccu

SEQ ID NO: 446240 - RNA, 19 nt, Homo sapiens
caggugaucuaccugccuc

SEQ ID NO: 446241 - RNA, 17 nt, Homo sapiens
caggugcccauuagcaa

SEQ ID NO: 446242 - RNA, 23 nt, Homo sapiens
caggugccuuguccucagggcua

SEQ ID NO: 446243 - RNA, 19 nt, Homo sapiens
cagguggccagggcuccac

SEQ ID NO: 446244 - RNA, 17 nt, Homo sapiens
cagguggccccaguuca

SEQ ID NO: 446245 - RNA, 17 nt, Homo sapiens
cagguguuaaaaaccau

SEQ ID NO: 446246 - RNA, 15 nt, Homo sapiens
cagguuaccucacuu

SEQ ID NO: 446247 - RNA, 22 nt, Homo sapiens
cagguucaugccaccauggcca

SEQ ID NO: 446248 - RNA, 21 nt, Homo sapiens
caguaaagaccauuuaguccu

SEQ ID NO: 446249 - RNA, 22 nt, Homo sapiens
caguaaagaccauuuaguccuc

SEQ ID NO: 446250 - RNA, 22 nt, Homo sapiens
caguaaagcaggaagccuccaa

SEQ ID NO: 446251 - RNA, 17 nt, Homo sapiens
caguaaaucucacaaau

SEQ ID NO: 446252 - RNA, 14 nt, Homo sapiens
caguaacauuucau

SEQ ID NO: 446253 - RNA, 17 nt, Homo sapiens
caguaacgcgucuuccu

SEQ ID NO: 446254 - RNA, 17 nt, Homo sapiens
caguaacugcaccaacg

SEQ ID NO: 446255 - RNA, 21 nt, Homo sapiens
caguaauaaaacaucuuucca

SEQ ID NO: 446256 - RNA, 15 nt, Homo sapiens
caguaccugugccug

SEQ ID NO: 446257 - RNA, 15 nt, Homo sapiens
caguacuuuaugaaa

SEQ ID NO: 446258 - RNA, 18 nt, Homo sapiens
caguagaaauaauaugca

SEQ ID NO: 446259 - RNA, 16 nt, Homo sapiens
caguagagucaucucc

SEQ ID NO: 446260 - RNA, 16 nt, Homo sapiens
caguagcuccaacacu

SEQ ID NO: 446261 - RNA, 14 nt, Homo sapiens
caguaggagaggau

SEQ ID NO: 446262 - RNA, 22 nt, Homo sapiens
caguauauuuguccagauaauu

SEQ ID NO: 446263 - RNA, 14 nt, Homo sapiens
caguaucaucucca

SEQ ID NO: 446264 - RNA, 20 nt, Homo sapiens
caguauccacaauagcugac

SEQ ID NO: 446265 - RNA, 15 nt, Homo sapiens
caguaugaagacacu

SEQ ID NO: 446266 - RNA, 15 nt, Homo sapiens
caguaugaaugaugu

SEQ ID NO: 446267 - RNA, 17 nt, Homo sapiens
caguaugagucaaugug

SEQ ID NO: 446268 - RNA, 21 nt, Homo sapiens
caguaugagucaaugugcagu

SEQ ID NO: 446269 - RNA, 18 nt, Homo sapiens
caguauuaacaucaaaga

SEQ ID NO: 446270 - RNA, 13 nt, Homo sapiens
caguauucucaga

SEQ ID NO: 446271 - RNA, 17 nt, Homo sapiens
caguauugagacacugu

SEQ ID NO: 446272 - RNA, 23 nt, Homo sapiens
caguauuguucuuguaaaacugu

SEQ ID NO: 446273 - RNA, 19 nt, Homo sapiens
cagucaaaauguuugauau

SEQ ID NO: 446274 - RNA, 18 nt, Homo sapiens
cagucaaggaguggcuua

SEQ ID NO: 446275 - RNA, 19 nt, Homo sapiens
cagucaaugaggaagauuu

SEQ ID NO: 446276 - RNA, 18 nt, Homo sapiens
cagucacacugcugggaa

SEQ ID NO: 446277 - RNA, 16 nt, Homo sapiens
cagucacuugaucucc

SEQ ID NO: 446278 - RNA, 14 nt, Homo sapiens
cagucaucaucuca

SEQ ID NO: 446279 - RNA, 15 nt, Homo sapiens
cagucccaguauucu

SEQ ID NO: 446280 - RNA, 15 nt, Homo sapiens
caguccccagcccuu

SEQ ID NO: 446281 - RNA, 14 nt, Homo sapiens
cagucccucagcca

SEQ ID NO: 446282 - RNA, 22 nt, Homo sapiens
cagucccuggagcuguccuuca

SEQ ID NO: 446283 - RNA, 19 nt, Homo sapiens
caguccugccucagccucc

SEQ ID NO: 446284 - RNA, 14 nt, Homo sapiens
caguccuguuugca

SEQ ID NO: 446285 - RNA, 18 nt, Homo sapiens
cagucucacccacuagga

SEQ ID NO: 446286 - RNA, 19 nt, Homo sapiens
cagucucacccacuaggau

SEQ ID NO: 446287 - RNA, 14 nt, Homo sapiens
cagucuuugcucag

SEQ ID NO: 446288 - RNA, 15 nt, Homo sapiens
cagugaaauaugaua

SEQ ID NO: 446289 - RNA, 15 nt, Homo sapiens
cagugaccccugacc

SEQ ID NO: 446290 - RNA, 19 nt, Homo sapiens
cagugaccccugaccucac

SEQ ID NO: 446291 - RNA, 12 nt, Homo sapiens
cagugacuggca

SEQ ID NO: 446292 - RNA, 13 nt, Homo sapiens
cagugacuucuuu

SEQ ID NO: 446293 - RNA, 19 nt, Homo sapiens
cagugagagucucccucca

SEQ ID NO: 446294 - RNA, 18 nt, Homo sapiens
cagugaggcugcacccac

SEQ ID NO: 446295 - RNA, 13 nt, Homo sapiens
cagugaucuccau

SEQ ID NO: 446296 - RNA, 19 nt, Homo sapiens
cagugauucucucuucucu

SEQ ID NO: 446297 - RNA, 17 nt, Homo sapiens
cagugcaaccacacacc

SEQ ID NO: 446298 - RNA, 15 nt, Homo sapiens
cagugcauguggaaa

SEQ ID NO: 446299 - RNA, 13 nt, Homo sapiens
cagugccucuggu

SEQ ID NO: 446300 - RNA, 14 nt, Homo sapiens
caguggagccugaa

SEQ ID NO: 446301 - RNA, 13 nt, Homo sapiens
caguggaugcugc

SEQ ID NO: 446302 - RNA, 17 nt, Homo sapiens
caguggauugcauuucu

SEQ ID NO: 446303 - RNA, 14 nt, Homo sapiens
caguggauugcuca

SEQ ID NO: 446304 - RNA, 18 nt, Homo sapiens
caguggauuuuuuuuuaa

SEQ ID NO: 446305 - RNA, 21 nt, Homo sapiens
caguggcaaauguagcccugc

SEQ ID NO: 446306 - RNA, 16 nt, Homo sapiens
caguggcgugaucucg

SEQ ID NO: 446307 - RNA, 15 nt, Homo sapiens
caguggcuuuugccc

SEQ ID NO: 446308 - RNA, 17 nt, Homo sapiens
caguggggccccaaagc

SEQ ID NO: 446309 - RNA, 17 nt, Homo sapiens
caguggggugaucucau

SEQ ID NO: 446310 - RNA, 16 nt, Homo sapiens
caguggugagacugua

SEQ ID NO: 446311 - RNA, 21 nt, Homo sapiens
cagugguuggcaauuguuuca

SEQ ID NO: 446312 - RNA, 13 nt, Homo sapiens
caguguacugcuu

SEQ ID NO: 446313 - RNA, 19 nt, Homo sapiens
caguguagcccacacuuga

SEQ ID NO: 446314 - RNA, 12 nt, Homo sapiens
cagugucauuua

SEQ ID NO: 446315 - RNA, 14 nt, Homo sapiens
cagugugacaucua

SEQ ID NO: 446316 - RNA, 21 nt, Homo sapiens
cagugugcuugggaucuucaa

SEQ ID NO: 446317 - RNA, 13 nt, Homo sapiens
caguguugccaga

SEQ ID NO: 446318 - RNA, 15 nt, Homo sapiens
caguguugccuccuc

SEQ ID NO: 446319 - RNA, 20 nt, Homo sapiens
caguguuugggguguuucaa

SEQ ID NO: 446320 - RNA, 19 nt, Homo sapiens
caguuaaaccagcuacuca

SEQ ID NO: 446321 - RNA, 17 nt, Homo sapiens
caguuaaugccacaaaa

SEQ ID NO: 446322 - RNA, 14 nt, Homo sapiens
caguuaauggcuca

SEQ ID NO: 446323 - RNA, 22 nt, Homo sapiens
caguuacagagugaacacucua

SEQ ID NO: 446324 - RNA, 20 nt, Homo sapiens
caguuaugugaaugaucucu

SEQ ID NO: 446325 - RNA, 20 nt, Homo sapiens
caguuauuaaaauguuaaaa

SEQ ID NO: 446326 - RNA, 14 nt, Homo sapiens
caguucagcuccuu

SEQ ID NO: 446327 - RNA, 16 nt, Homo sapiens
caguucaguuccucuu

SEQ ID NO: 446328 - RNA, 17 nt, Homo sapiens
caguucauguugcucag

SEQ ID NO: 446329 - RNA, 20 nt, Homo sapiens
caguucauuauuuugugguu

SEQ ID NO: 446330 - RNA, 18 nt, Homo sapiens
caguucccccaguaccuc

SEQ ID NO: 446331 - RNA, 18 nt, Homo sapiens
caguuccugaguaccuuc

SEQ ID NO: 446332 - RNA, 19 nt, Homo sapiens
caguucucacuccuaggag

SEQ ID NO: 446333 - RNA, 18 nt, Homo sapiens
caguucucugccacccau

SEQ ID NO: 446334 - RNA, 20 nt, Homo sapiens
caguucugaauaacuugaag

SEQ ID NO: 446335 - RNA, 14 nt, Homo sapiens
caguucugucauau

SEQ ID NO: 446336 - RNA, 21 nt, Homo sapiens
caguugaauaaaagugcacac

SEQ ID NO: 446337 - RNA, 18 nt, Homo sapiens
caguugugucagcuacug

SEQ ID NO: 446338 - RNA, 22 nt, Homo sapiens
caguuguugauaaccacuaaga

SEQ ID NO: 446339 - RNA, 19 nt, Homo sapiens
caguuuaugcagugcugcu

SEQ ID NO: 446340 - RNA, 18 nt, Homo sapiens
caguuucuuuggccagaa

SEQ ID NO: 446341 - RNA, 12 nt, Homo sapiens
caguuugaacuc

SEQ ID NO: 446342 - RNA, 14 nt, Homo sapiens
caguuugcacuuau

SEQ ID NO: 446343 - RNA, 20 nt, Homo sapiens
caguuugcuuuguaugcacu

SEQ ID NO: 446344 - RNA, 13 nt, Homo sapiens
caguuuuccagga

SEQ ID NO: 446345 - RNA, 16 nt, Homo sapiens
caguuuuuaacauaau

SEQ ID NO: 446346 - RNA, 15 nt, Homo sapiens
caguuuuuccuaguc

SEQ ID NO: 446347 - RNA, 12 nt, Homo sapiens
caguuuuugccu

SEQ ID NO: 446348 - RNA, 21 nt, Homo sapiens
cauaaaaagccugcaauuuca

SEQ ID NO: 446349 - RNA, 14 nt, Homo sapiens
cauaaaacuucuga

SEQ ID NO: 446350 - RNA, 16 nt, Homo sapiens
cauaaaaucugugaau

SEQ ID NO: 446351 - RNA, 21 nt, Homo sapiens
cauaaacaacuuaauguucug

SEQ ID NO: 446352 - RNA, 13 nt, Homo sapiens
cauaaaucugucu

SEQ ID NO: 446353 - RNA, 17 nt, Homo sapiens
cauaaaucugucugauu

SEQ ID NO: 446354 - RNA, 13 nt, Homo sapiens
cauaaauuacuuu

SEQ ID NO: 446355 - RNA, 18 nt, Homo sapiens
cauaaauuauuucuaaaa

SEQ ID NO: 446356 - RNA, 17 nt, Homo sapiens
cauaacucauugucugu

SEQ ID NO: 446357 - RNA, 20 nt, Homo sapiens
cauaacucauugucugugga

SEQ ID NO: 446358 - RNA, 20 nt, Homo sapiens
cauaagagagccuugguuca

SEQ ID NO: 446359 - RNA, 20 nt, Homo sapiens
cauaagccuccauuuaguuc

SEQ ID NO: 446360 - RNA, 21 nt, Homo sapiens
cauaagugaaaaucuuacaac

SEQ ID NO: 446361 - RNA, 15 nt, Homo sapiens
cauaauagucaauuu

SEQ ID NO: 446362 - RNA, 22 nt, Homo sapiens
cauaauagucaauuucuacuuc

SEQ ID NO: 446363 - RNA, 19 nt, Homo sapiens
cauaaugacuuaagcacac

SEQ ID NO: 446364 - RNA, 24 nt, Homo sapiens
cauaaugugcaaagucaucaaaga

SEQ ID NO: 446365 - RNA, 14 nt, Homo sapiens
cauaauguuccuua

SEQ ID NO: 446366 - RNA, 12 nt, Homo sapiens
ccaccuugccaa

SEQ ID NO: 446367 - RNA, 20 nt, Homo sapiens
ccacggaccguugcacaaaa

SEQ ID NO: 446368 - RNA, 19 nt, Homo sapiens
ccacuaagagaauacagga

SEQ ID NO: 446369 - RNA, 14 nt, Homo sapiens
ccacuacauucuga

SEQ ID NO: 446370 - RNA, 20 nt, Homo sapiens
ccacuaggaucccacuggcg

SEQ ID NO: 446371 - RNA, 17 nt, Homo sapiens
ccacuagguuucaccuc

SEQ ID NO: 446372 - RNA, 15 nt, Homo sapiens
ccacuaugcacagau

SEQ ID NO: 446373 - RNA, 22 nt, Homo sapiens
ccacuaugcacagauuaaacuu

SEQ ID NO: 446374 - RNA, 16 nt, Homo sapiens
ccacucagcucaccuc

SEQ ID NO: 446375 - RNA, 17 nt, Homo sapiens
ccacucagcucaccucu

SEQ ID NO: 446376 - RNA, 18 nt, Homo sapiens
ccacucaggauugggaau

SEQ ID NO: 446377 - RNA, 11 nt, Homo sapiens
ccacucaggga

SEQ ID NO: 446378 - RNA, 13 nt, Homo sapiens
ccacuccacaguu

SEQ ID NO: 446379 - RNA, 15 nt, Homo sapiens
ccacuccaccuccac

SEQ ID NO: 446380 - RNA, 18 nt, Homo sapiens
ccacucucugggacucuc

SEQ ID NO: 446381 - RNA, 10 nt, Homo sapiens
ccacucuguu

SEQ ID NO: 446382 - RNA, 18 nt, Homo sapiens
ccacugagcccuugcaca

SEQ ID NO: 446383 - RNA, 14 nt, Homo sapiens
ccacugagucucau

SEQ ID NO: 446384 - RNA, 14 nt, Homo sapiens
ccacuuaaucuucu

SEQ ID NO: 446385 - RNA, 19 nt, Homo sapiens
ccacuuaucaaaucauuca

SEQ ID NO: 446386 - RNA, 19 nt, Homo sapiens
ccacuuaugcugcugugaa

SEQ ID NO: 446387 - RNA, 19 nt, Homo sapiens
ccacuucuccccucaagaa

SEQ ID NO: 446388 - RNA, 23 nt, Homo sapiens
ccacuuuccccgugggccauggc

SEQ ID NO: 446389 - RNA, 16 nt, Homo sapiens
ccacuuugaguaccaa

SEQ ID NO: 446390 - RNA, 19 nt, Homo sapiens
ccagaaaauaggguggaca

SEQ ID NO: 446391 - RNA, 16 nt, Homo sapiens
ccagaagaauauucag

SEQ ID NO: 446392 - RNA, 15 nt, Homo sapiens
ccagaauugugcaaa

SEQ ID NO: 446393 - RNA, 11 nt, Homo sapiens
ccagaccucaa

SEQ ID NO: 446394 - RNA, 19 nt, Homo sapiens
ccagaccuguucugaccuc

SEQ ID NO: 446395 - RNA, 20 nt, Homo sapiens
ccagaccuguucugaccuca

SEQ ID NO: 446396 - RNA, 22 nt, Homo sapiens
ccagacucagguuccagaacag

SEQ ID NO: 446397 - RNA, 22 nt, Homo sapiens
ccagacugcagguuggacccca

SEQ ID NO: 446398 - RNA, 18 nt, Homo sapiens
ccagagaccugaggcaga

SEQ ID NO: 446399 - RNA, 14 nt, Homo sapiens
ccagagcaggagac

SEQ ID NO: 446400 - RNA, 15 nt, Homo sapiens
ccagagcauuuccaa

SEQ ID NO: 446401 - RNA, 15 nt, Homo sapiens
ccagagccauggacu

SEQ ID NO: 446402 - RNA, 16 nt, Homo sapiens
ccagagcuacugacua

SEQ ID NO: 446403 - RNA, 17 nt, Homo sapiens
ccagagcugggugagug

SEQ ID NO: 446404 - RNA, 17 nt, Homo sapiens
ccagaggcagcuaaggg

SEQ ID NO: 446405 - RNA, 13 nt, Homo sapiens
ccagauaccagcc

SEQ ID NO: 446406 - RNA, 19 nt, Homo sapiens
ccagauagcagggcaugaa

SEQ ID NO: 446407 - RNA, 19 nt, Homo sapiens
ccagauauucaagucaccu

SEQ ID NO: 446408 - RNA, 16 nt, Homo sapiens
ccagauccagacugua

SEQ ID NO: 446409 - RNA, 15 nt, Homo sapiens
ccagaugaacugaga

SEQ ID NO: 446410 - RNA, 16 nt, Homo sapiens
ccagaugaacugagaa

SEQ ID NO: 446411 - RNA, 22 nt, Homo sapiens
ccagaugcccuuuggaaagcca

SEQ ID NO: 446412 - RNA, 15 nt, Homo sapiens
ccagauguuggacca

SEQ ID NO: 446413 - RNA, 13 nt, Homo sapiens
ccagcaacgcuca

SEQ ID NO: 446414 - RNA, 14 nt, Homo sapiens
ccagcaagucccag

SEQ ID NO: 446415 - RNA, 21 nt, Homo sapiens
ccagcacuuuagaucacuuga

SEQ ID NO: 446416 - RNA, 16 nt, Homo sapiens
ccagcacuuugggagg

SEQ ID NO: 446417 - RNA, 13 nt, Homo sapiens
ccagcagucacag

SEQ ID NO: 446418 - RNA, 15 nt, Homo sapiens
ccagcauauacugaa

SEQ ID NO: 446419 - RNA, 18 nt, Homo sapiens
ccagcaugugugugucuc

SEQ ID NO: 446420 - RNA, 13 nt, Homo sapiens
ccagcccacugga

SEQ ID NO: 446421 - RNA, 15 nt, Homo sapiens
ccagccgugagugca

SEQ ID NO: 446422 - RNA, 22 nt, Homo sapiens
ccagccucuagaacagccagac

SEQ ID NO: 446423 - RNA, 22 nt, Homo sapiens
ccagccugggacucccagugaa

SEQ ID NO: 446424 - RNA, 20 nt, Homo sapiens
ccagccugggcagccaggcu

SEQ ID NO: 446425 - RNA, 17 nt, Homo sapiens
ccagccuuccucugcag

SEQ ID NO: 446426 - RNA, 16 nt, Homo sapiens
ccagcgugaaggaccu

SEQ ID NO: 446427 - RNA, 16 nt, Homo sapiens
ccagcguggcgcagug

SEQ ID NO: 446428 - RNA, 13 nt, Homo sapiens
ccagcuacauucc

SEQ ID NO: 446429 - RNA, 23 nt, Homo sapiens
ccagcuccacaguguugccagag

SEQ ID NO: 446430 - RNA, 16 nt, Homo sapiens
ccagcuccccaagaaa

SEQ ID NO: 446431 - RNA, 22 nt, Homo sapiens
ccagcugagucuauguagguga

SEQ ID NO: 446432 - RNA, 20 nt, Homo sapiens
ccagcugccuuggacugugu

SEQ ID NO: 446433 - RNA, 20 nt, Homo sapiens
ccagcuguacugaguucuca

SEQ ID NO: 446434 - RNA, 13 nt, Homo sapiens
ccagcuguuucau

SEQ ID NO: 446435 - RNA, 14 nt, Homo sapiens
ccagcuucaggcag

SEQ ID NO: 446436 - RNA, 19 nt, Homo sapiens
ccagcuuuucuugccagcu

SEQ ID NO: 446437 - RNA, 13 nt, Homo sapiens
ccaggacaucucu

SEQ ID NO: 446438 - RNA, 18 nt, Homo sapiens
ccaggaccaagcuuaagg

SEQ ID NO: 446439 - RNA, 22 nt, Homo sapiens
ccaggacgcuucugaaugcugc

SEQ ID NO: 446440 - RNA, 13 nt, Homo sapiens
ccaggacugugac

SEQ ID NO: 446441 - RNA, 15 nt, Homo sapiens
ccaggacugugacuc

SEQ ID NO: 446442 - RNA, 23 nt, Homo sapiens
ccaggagcaggaccuacuaggag

SEQ ID NO: 446443 - RNA, 11 nt, Homo sapiens
ccaggagcuca

SEQ ID NO: 446444 - RNA, 17 nt, Homo sapiens
ccaggaggcuggcagua

SEQ ID NO: 446445 - RNA, 22 nt, Homo sapiens
ccaggaguaccuggaccugucc

SEQ ID NO: 446446 - RNA, 16 nt, Homo sapiens
ccaggcaacgugcgug

SEQ ID NO: 446447 - RNA, 15 nt, Homo sapiens
ccaggcagcuggcua

SEQ ID NO: 446448 - RNA, 20 nt, Homo sapiens
ccaggccauaccaggugcua

SEQ ID NO: 446449 - RNA, 17 nt, Homo sapiens
ccaggcccaaggaguaa

SEQ ID NO: 446450 - RNA, 18 nt, Homo sapiens
ccaggccgggguggagca

SEQ ID NO: 446451 - RNA, 16 nt, Homo sapiens
ccaggcgaugugcaag

SEQ ID NO: 446452 - RNA, 17 nt, Homo sapiens
ccaggcucaagcacuuu

SEQ ID NO: 446453 - RNA, 20 nt, Homo sapiens
ccaggcugaauuacagugaa

SEQ ID NO: 446454 - RNA, 18 nt, Homo sapiens
ccaggcugcacugcagug

SEQ ID NO: 446455 - RNA, 17 nt, Homo sapiens
ccaggcugcggugggca

SEQ ID NO: 446456 - RNA, 15 nt, Homo sapiens
ccaggcuggagugca

SEQ ID NO: 446457 - RNA, 18 nt, Homo sapiens
ccaggcuggagugcaacg

SEQ ID NO: 446458 - RNA, 18 nt, Homo sapiens
ccaggcuggagugcaaug

SEQ ID NO: 446459 - RNA, 18 nt, Homo sapiens
ccaggcuggagugcagua

SEQ ID NO: 446460 - RNA, 21 nt, Homo sapiens
ccaggcuucacccugaauggu

SEQ ID NO: 446461 - RNA, 11 nt, Homo sapiens
ccagggccaug

SEQ ID NO: 446462 - RNA, 19 nt, Homo sapiens
ccagggccugggggcagug

SEQ ID NO: 446463 - RNA, 21 nt, Homo sapiens
ccagggccugggggcagugac

SEQ ID NO: 446464 - RNA, 24 nt, Homo sapiens
ccagggcucuggcagguggccagg

SEQ ID NO: 446465 - RNA, 15 nt, Homo sapiens
ccagggguguagaug

SEQ ID NO: 446466 - RNA, 20 nt, Homo sapiens
ccagggugcaggcgcgcacc

SEQ ID NO: 446467 - RNA, 14 nt, Homo sapiens
ccaggguuccagac

SEQ ID NO: 446468 - RNA, 20 nt, Homo sapiens
ccagguaagggggugcagca

SEQ ID NO: 446469 - RNA, 20 nt, Homo sapiens
ccaggucacggggcaccaaa

SEQ ID NO: 446470 - RNA, 22 nt, Homo sapiens
ccaggucagcuguuacuuucuu

SEQ ID NO: 446471 - RNA, 12 nt, Homo sapiens
ccaggugcacag

SEQ ID NO: 446472 - RNA, 21 nt, Homo sapiens
ccaggugccagaauccucuca

SEQ ID NO: 446473 - RNA, 19 nt, Homo sapiens
ccaguaaggcagcucuguc

SEQ ID NO: 446474 - RNA, 18 nt, Homo sapiens
ccaguacuuccugcagua

SEQ ID NO: 446475 - RNA, 20 nt, Homo sapiens
ccaguauaaaauuacagugg

SEQ ID NO: 446476 - RNA, 19 nt, Homo sapiens
ccaguccagauauuucaca

SEQ ID NO: 446477 - RNA, 18 nt, Homo sapiens
ccagucugucuacugugg

SEQ ID NO: 446478 - RNA, 18 nt, Homo sapiens
ccagugcaacagcacugg

SEQ ID NO: 446479 - RNA, 19 nt, Homo sapiens
ccaguggccuggcuccgcu

SEQ ID NO: 446480 - RNA, 9 nt, Homo sapiens
ccaguggga

SEQ ID NO: 446481 - RNA, 18 nt, Homo sapiens
ccaguguacugcuuucaa

SEQ ID NO: 446482 - RNA, 20 nt, Homo sapiens
ccaguguccccaggggcaca

SEQ ID NO: 446483 - RNA, 15 nt, Homo sapiens
ccaguguuaguggga

SEQ ID NO: 446484 - RNA, 20 nt, Homo sapiens
ccaguguuuacaaggugaca

SEQ ID NO: 446485 - RNA, 14 nt, Homo sapiens
ccaguucugaugag

SEQ ID NO: 446486 - RNA, 13 nt, Homo sapiens
ccauaaaggcaua

SEQ ID NO: 446487 - RNA, 20 nt, Homo sapiens
ccauaaccucuauaucuuua

SEQ ID NO: 446488 - RNA, 22 nt, Homo sapiens
ccauaagccccucgcacucugg

SEQ ID NO: 446489 - RNA, 13 nt, Homo sapiens
ccauaauguuaca

SEQ ID NO: 446490 - RNA, 15 nt, Homo sapiens
ccauaauguuccuua

SEQ ID NO: 446491 - RNA, 14 nt, Homo sapiens
ccauaauugcaagg

SEQ ID NO: 446492 - RNA, 18 nt, Homo sapiens
ccauacaaauuaucuuuu

SEQ ID NO: 446493 - RNA, 16 nt, Homo sapiens
ccauagacacaguauu

SEQ ID NO: 446494 - RNA, 19 nt, Homo sapiens
ccauaggcacuugggaugu

SEQ ID NO: 446495 - RNA, 22 nt, Homo sapiens
ccauagucgugccuguuugcuu

SEQ ID NO: 446496 - RNA, 17 nt, Homo sapiens
ccuccgcgccuugccuc

SEQ ID NO: 446497 - RNA, 16 nt, Homo sapiens
ccuccguguagugucu

SEQ ID NO: 446498 - RNA, 15 nt, Homo sapiens
ccuccuaaauuucca

SEQ ID NO: 446499 - RNA, 21 nt, Homo sapiens
ccuccuagaggugggcagcug

SEQ ID NO: 446500 - RNA, 20 nt, Homo sapiens
ccuccuaguucuucauccca

SEQ ID NO: 446501 - RNA, 19 nt, Homo sapiens
ccuccugauaguaguaaaa

SEQ ID NO: 446502 - RNA, 22 nt, Homo sapiens
ccuccugcuaacuccuagcuga

SEQ ID NO: 446503 - RNA, 18 nt, Homo sapiens
ccuccuggcucacagcca

SEQ ID NO: 446504 - RNA, 21 nt, Homo sapiens
ccuccugguugauacuuguuc

SEQ ID NO: 446505 - RNA, 14 nt, Homo sapiens
ccuccuguugccac

SEQ ID NO: 446506 - RNA, 12 nt, Homo sapiens
ccuccuugccac

SEQ ID NO: 446507 - RNA, 20 nt, Homo sapiens
ccuccuuucccaacacuuca

SEQ ID NO: 446508 - RNA, 21 nt, Homo sapiens
ccucgaacuccugggcucaag

SEQ ID NO: 446509 - RNA, 12 nt, Homo sapiens
ccucggcuaccc

SEQ ID NO: 446510 - RNA, 14 nt, Homo sapiens
ccucuacaggcauu

SEQ ID NO: 446511 - RNA, 17 nt, Homo sapiens
ccucuacaggcauuuaa

SEQ ID NO: 446512 - RNA, 18 nt, Homo sapiens
ccucuacuuaaugagaua

SEQ ID NO: 446513 - RNA, 13 nt, Homo sapiens
ccucucacacugg

SEQ ID NO: 446514 - RNA, 22 nt, Homo sapiens
ccucucucacauggaacgcuuu

SEQ ID NO: 446515 - RNA, 12 nt, Homo sapiens
ccucucucuaua

SEQ ID NO: 446516 - RNA, 19 nt, Homo sapiens
ccucucucuucugcuccac

SEQ ID NO: 446517 - RNA, 17 nt, Homo sapiens
ccucucuguuuacccuc

SEQ ID NO: 446518 - RNA, 14 nt, Homo sapiens
ccucucuugccgac

SEQ ID NO: 446519 - RNA, 19 nt, Homo sapiens
ccucugacccuagcucuuu

SEQ ID NO: 446520 - RNA, 19 nt, Homo sapiens
ccucugaucaaagcaccuu

SEQ ID NO: 446521 - RNA, 23 nt, Homo sapiens
ccucugaucaaagcaccuugaau

SEQ ID NO: 446522 - RNA, 17 nt, Homo sapiens
ccucugcauaaauauua

SEQ ID NO: 446523 - RNA, 20 nt, Homo sapiens
ccucugccuuguccugaugc

SEQ ID NO: 446524 - RNA, 17 nt, Homo sapiens
ccucugcuaccaucuca

SEQ ID NO: 446525 - RNA, 18 nt, Homo sapiens
ccucugcuaccaucucau

SEQ ID NO: 446526 - RNA, 14 nt, Homo sapiens
ccucugcugcccac

SEQ ID NO: 446527 - RNA, 17 nt, Homo sapiens
ccucugcugcuuuccaa

SEQ ID NO: 446528 - RNA, 15 nt, Homo sapiens
ccucugguucuucau

SEQ ID NO: 446529 - RNA, 20 nt, Homo sapiens
ccucugucauaugcagaauu

SEQ ID NO: 446530 - RNA, 14 nt, Homo sapiens
ccucuguccaggca

SEQ ID NO: 446531 - RNA, 22 nt, Homo sapiens
ccucuguucaguaacagggccu

SEQ ID NO: 446532 - RNA, 13 nt, Homo sapiens
ccucuucccauga

SEQ ID NO: 446533 - RNA, 17 nt, Homo sapiens
ccucuucuugcggcacc

SEQ ID NO: 446534 - RNA, 13 nt, Homo sapiens
ccucuugcucaaa

SEQ ID NO: 446535 - RNA, 18 nt, Homo sapiens
ccucuugcucagagcuag

SEQ ID NO: 446536 - RNA, 21 nt, Homo sapiens
ccucuuuugagacuuugccca

SEQ ID NO: 446537 - RNA, 17 nt, Homo sapiens
ccucuuuuuagggcuaa

SEQ ID NO: 446538 - RNA, 15 nt, Homo sapiens
ccugaaacauugcau

SEQ ID NO: 446539 - RNA, 19 nt, Homo sapiens
ccugaaacccaguaauucu

SEQ ID NO: 446540 - RNA, 12 nt, Homo sapiens
ccugaacaagaa

SEQ ID NO: 446541 - RNA, 14 nt, Homo sapiens
ccugaaccccaugg

SEQ ID NO: 446542 - RNA, 16 nt, Homo sapiens
ccugaaccucugaugc

SEQ ID NO: 446543 - RNA, 20 nt, Homo sapiens
ccugaagggugacaucccag

SEQ ID NO: 446544 - RNA, 12 nt, Homo sapiens
ccugaagugaug

SEQ ID NO: 446545 - RNA, 18 nt, Homo sapiens
ccugaaguuggagugagu

SEQ ID NO: 446546 - RNA, 16 nt, Homo sapiens
ccugacaagugaaguu

SEQ ID NO: 446547 - RNA, 14 nt, Homo sapiens
ccugacaauggcag

SEQ ID NO: 446548 - RNA, 18 nt, Homo sapiens
ccugacagaaggacucag

SEQ ID NO: 446549 - RNA, 18 nt, Homo sapiens
ccugaccucugaagagcu

SEQ ID NO: 446550 - RNA, 17 nt, Homo sapiens
ccugacucgucugacug

SEQ ID NO: 446551 - RNA, 12 nt, Homo sapiens
ccugacuuccac

SEQ ID NO: 446552 - RNA, 15 nt, Homo sapiens
ccugagaagagucga

SEQ ID NO: 446553 - RNA, 13 nt, Homo sapiens
ccugagaccaguu

SEQ ID NO: 446554 - RNA, 16 nt, Homo sapiens
ccugagccugucucuc

SEQ ID NO: 446555 - RNA, 19 nt, Homo sapiens
ccugaggucaugcauugua

SEQ ID NO: 446556 - RNA, 21 nt, Homo sapiens
ccugaguagcugggaugacag

SEQ ID NO: 446557 - RNA, 24 nt, Homo sapiens
ccugauaaacauuaaacacuguaa

SEQ ID NO: 446558 - RNA, 14 nt, Homo sapiens
ccugauacugggua

SEQ ID NO: 446559 - RNA, 16 nt, Homo sapiens
ccugauacuggguaca

SEQ ID NO: 446560 - RNA, 17 nt, Homo sapiens
ccugaugaaaaauaugu

SEQ ID NO: 446561 - RNA, 13 nt, Homo sapiens
ccugaugcaaggg

SEQ ID NO: 446562 - RNA, 20 nt, Homo sapiens
ccugauuuccauuugcaaca

SEQ ID NO: 446563 - RNA, 13 nt, Homo sapiens
ccugcaaaaucug

SEQ ID NO: 446564 - RNA, 18 nt, Homo sapiens
ccugcacucacaggcuac

SEQ ID NO: 446565 - RNA, 15 nt, Homo sapiens
ccugcacuguaaaau

SEQ ID NO: 446566 - RNA, 17 nt, Homo sapiens
ccugcaggccccagcca

SEQ ID NO: 446567 - RNA, 19 nt, Homo sapiens
ccugcaucagccucuggcc

SEQ ID NO: 446568 - RNA, 15 nt, Homo sapiens
ccugcaucugucugu

SEQ ID NO: 446569 - RNA, 13 nt, Homo sapiens
ccugccaaugcca

SEQ ID NO: 446570 - RNA, 20 nt, Homo sapiens
ccugccaaugccacagccaa

SEQ ID NO: 446571 - RNA, 20 nt, Homo sapiens
ccugccaccuggggcaguca

SEQ ID NO: 446572 - RNA, 14 nt, Homo sapiens
ccugccauaacaua

SEQ ID NO: 446573 - RNA, 19 nt, Homo sapiens
ccugcccagaucccagaag

SEQ ID NO: 446574 - RNA, 20 nt, Homo sapiens
ccugcccccacucagcauuu

SEQ ID NO: 446575 - RNA, 17 nt, Homo sapiens
ccugcccccgcucugcc

SEQ ID NO: 446576 - RNA, 17 nt, Homo sapiens
ccugcccgagagcucuu

SEQ ID NO: 446577 - RNA, 22 nt, Homo sapiens
ccugcccuacagaggucucugc

SEQ ID NO: 446578 - RNA, 23 nt, Homo sapiens
ccugcccuacagaggucucugcc

SEQ ID NO: 446579 - RNA, 15 nt, Homo sapiens
ccugccuagcacuca

SEQ ID NO: 446580 - RNA, 22 nt, Homo sapiens
ccugccuuuuaacguagauaua

SEQ ID NO: 446581 - RNA, 18 nt, Homo sapiens
ccugccuuuucauugccc

SEQ ID NO: 446582 - RNA, 17 nt, Homo sapiens
ccugcuaaaugacuuau

SEQ ID NO: 446583 - RNA, 16 nt, Homo sapiens
ccugcucacucuucca

SEQ ID NO: 446584 - RNA, 19 nt, Homo sapiens
ccugcucccagcagcccua

SEQ ID NO: 446585 - RNA, 17 nt, Homo sapiens
ccugcucuacccaugag

SEQ ID NO: 446586 - RNA, 19 nt, Homo sapiens
ccugcugcgucagaccagu

SEQ ID NO: 446587 - RNA, 23 nt, Homo sapiens
ccugcugucgucuuagcaagaag

SEQ ID NO: 446588 - RNA, 18 nt, Homo sapiens
ccugcuucacaccccuca

SEQ ID NO: 446589 - RNA, 14 nt, Homo sapiens
ccugcuucauaucu

SEQ ID NO: 446590 - RNA, 17 nt, Homo sapiens
ccuggaaagaggcaguc

SEQ ID NO: 446591 - RNA, 23 nt, Homo sapiens
ccuggaaagaggcagucuucuua

SEQ ID NO: 446592 - RNA, 15 nt, Homo sapiens
ccuggacaccucuca

SEQ ID NO: 446593 - RNA, 19 nt, Homo sapiens
ccuggagaaaggauggcag

SEQ ID NO: 446594 - RNA, 19 nt, Homo sapiens
ccuggagaaggcauuccag

SEQ ID NO: 446595 - RNA, 17 nt, Homo sapiens
ccuggagauugugcucu

SEQ ID NO: 446596 - RNA, 14 nt, Homo sapiens
ccuggagccuuuga

SEQ ID NO: 446597 - RNA, 20 nt, Homo sapiens
ccuggaggccgggugcucag

SEQ ID NO: 446598 - RNA, 16 nt, Homo sapiens
ccuggaucuaccagca

SEQ ID NO: 446599 - RNA, 21 nt, Homo sapiens
ccuggauuuucuuucuaugua

SEQ ID NO: 446600 - RNA, 23 nt, Homo sapiens
ccuggcacaccagaagugccaug

SEQ ID NO: 446601 - RNA, 16 nt, Homo sapiens
ccuggcacguccucca

SEQ ID NO: 446602 - RNA, 22 nt, Homo sapiens
ccuggcacguccuccaccggug

SEQ ID NO: 446603 - RNA, 19 nt, Homo sapiens
ccuggcagaacugagcucc

SEQ ID NO: 446604 - RNA, 14 nt, Homo sapiens
ccuggccaggagcu

SEQ ID NO: 446605 - RNA, 18 nt, Homo sapiens
ccuggccauccaugugau

SEQ ID NO: 446606 - RNA, 21 nt, Homo sapiens
ccuggccaucucugaacuuca

SEQ ID NO: 446607 - RNA, 20 nt, Homo sapiens
ccuggccgggucacccugug

SEQ ID NO: 446608 - RNA, 14 nt, Homo sapiens
ccuggccucacugg

SEQ ID NO: 446609 - RNA, 16 nt, Homo sapiens
ccuggcgcuuccagcu

SEQ ID NO: 446610 - RNA, 20 nt, Homo sapiens
ccuggcguggggggagcucu

SEQ ID NO: 446611 - RNA, 23 nt, Homo sapiens
ccuggcuuagcguucuguuucac

SEQ ID NO: 446612 - RNA, 17 nt, Homo sapiens
ccugggaaaggacccac

SEQ ID NO: 446613 - RNA, 18 nt, Homo sapiens
ccugggcaacagagugag

SEQ ID NO: 446614 - RNA, 16 nt, Homo sapiens
ccugggccuccugaca

SEQ ID NO: 446615 - RNA, 16 nt, Homo sapiens
ccugggcuuaugcccu

SEQ ID NO: 446616 - RNA, 21 nt, Homo sapiens
ccuggggccuggaccugccuc

SEQ ID NO: 446617 - RNA, 18 nt, Homo sapiens
ccuggguaacaaagugag

SEQ ID NO: 446618 - RNA, 16 nt, Homo sapiens
ccugggugacagagug

SEQ ID NO: 446619 - RNA, 13 nt, Homo sapiens
ccuggugcugcug

SEQ ID NO: 446620 - RNA, 15 nt, Homo sapiens
ccuggugcugcugcu

SEQ ID NO: 446621 - RNA, 15 nt, Homo sapiens
ccuguaaaacuuuau

SEQ ID NO: 446622 - RNA, 18 nt, Homo sapiens
ccuguaaacacucagcug

SEQ ID NO: 446623 - RNA, 16 nt, Homo sapiens
ccuguaaagucuaauc

SEQ ID NO: 446624 - RNA, 15 nt, Homo sapiens
ccuguaaucccagcu

SEQ ID NO: 446625 - RNA, 20 nt, Homo sapiens
ccuguaaucccagcuacuug

SEQ ID NO: 446626 - RNA, 15 nt, Homo sapiens
cuuuaacucauaaaa

SEQ ID NO: 446627 - RNA, 19 nt, Homo sapiens
cuuuaaguaaaauguuuca

SEQ ID NO: 446628 - RNA, 18 nt, Homo sapiens
cuuuaaucuguuguuuga

SEQ ID NO: 446629 - RNA, 23 nt, Homo sapiens
cuuuaauuguaucuccuucagaa

SEQ ID NO: 446630 - RNA, 20 nt, Homo sapiens
cuuuacaaucugcacuuuaa

SEQ ID NO: 446631 - RNA, 15 nt, Homo sapiens
cuuuacauaugcuuu

SEQ ID NO: 446632 - RNA, 16 nt, Homo sapiens
cuuuacauggaugcca

SEQ ID NO: 446633 - RNA, 22 nt, Homo sapiens
cuuuacauuuucaguaccaaag

SEQ ID NO: 446634 - RNA, 18 nt, Homo sapiens
cuuuaccugagaccaguu

SEQ ID NO: 446635 - RNA, 16 nt, Homo sapiens
cuuuaccuucauuuca

SEQ ID NO: 446636 - RNA, 21 nt, Homo sapiens
cuuuacuccuuuggcuucaaa

SEQ ID NO: 446637 - RNA, 15 nt, Homo sapiens
cuuuagaaacugagu

SEQ ID NO: 446638 - RNA, 18 nt, Homo sapiens
cuuuagcaagugugcacu

SEQ ID NO: 446639 - RNA, 20 nt, Homo sapiens
cuuuaguugauuuaaacucu

SEQ ID NO: 446640 - RNA, 15 nt, Homo sapiens
cuuuauaaauaucaa

SEQ ID NO: 446641 - RNA, 13 nt, Homo sapiens
cuuuauagcuuug

SEQ ID NO: 446642 - RNA, 14 nt, Homo sapiens
cuuuaucagugaug

SEQ ID NO: 446643 - RNA, 14 nt, Homo sapiens
cuuuaucauugcua

SEQ ID NO: 446644 - RNA, 19 nt, Homo sapiens
cuuuaugaaguuaacaguc

SEQ ID NO: 446645 - RNA, 13 nt, Homo sapiens
cuuuaugauuuca

SEQ ID NO: 446646 - RNA, 18 nt, Homo sapiens
cuuuauguauggagcucu

SEQ ID NO: 446647 - RNA, 18 nt, Homo sapiens
cuuuaugucucacaggga

SEQ ID NO: 446648 - RNA, 16 nt, Homo sapiens
cuuuauuaaauauuca

SEQ ID NO: 446649 - RNA, 16 nt, Homo sapiens
cuuuauucacaguauc

SEQ ID NO: 446650 - RNA, 17 nt, Homo sapiens
cuuuauuccuucauuuc

SEQ ID NO: 446651 - RNA, 12 nt, Homo sapiens
cuuuauuuuaga

SEQ ID NO: 446652 - RNA, 14 nt, Homo sapiens
cuuucaauccacag

SEQ ID NO: 446653 - RNA, 12 nt, Homo sapiens
cuuucacuuuga

SEQ ID NO: 446654 - RNA, 16 nt, Homo sapiens
cuuucagcugugaaca

SEQ ID NO: 446655 - RNA, 13 nt, Homo sapiens
cuuucagucccaa

SEQ ID NO: 446656 - RNA, 17 nt, Homo sapiens
cuuuccaccaagcguuu

SEQ ID NO: 446657 - RNA, 13 nt, Homo sapiens
cuuuccacuuugu

SEQ ID NO: 446658 - RNA, 18 nt, Homo sapiens
cuuuccagcaguauccuc

SEQ ID NO: 446659 - RNA, 12 nt, Homo sapiens
cuuuccagccua

SEQ ID NO: 446660 - RNA, 14 nt, Homo sapiens
cuuuccuagauggc

SEQ ID NO: 446661 - RNA, 15 nt, Homo sapiens
cuuuccugcaacuca

SEQ ID NO: 446662 - RNA, 19 nt, Homo sapiens
cuuucuaaggauagccuuu

SEQ ID NO: 446663 - RNA, 22 nt, Homo sapiens
cuuucuaaggauagccuuugua

SEQ ID NO: 446664 - RNA, 15 nt, Homo sapiens
cuuucuacaccuguu

SEQ ID NO: 446665 - RNA, 21 nt, Homo sapiens
cuuucuacaccuguugcaccu

SEQ ID NO: 446666 - RNA, 18 nt, Homo sapiens
cuuucucccuaaccacua

SEQ ID NO: 446667 - RNA, 22 nt, Homo sapiens
cuuucuccugugguuugcucca

SEQ ID NO: 446668 - RNA, 23 nt, Homo sapiens
cuuucucgugguagaagccagua

SEQ ID NO: 446669 - RNA, 11 nt, Homo sapiens
cuuucucucag

SEQ ID NO: 446670 - RNA, 15 nt, Homo sapiens
cuuucucucuuucca

SEQ ID NO: 446671 - RNA, 20 nt, Homo sapiens
cuuucucugccagugacaga

SEQ ID NO: 446672 - RNA, 22 nt, Homo sapiens
cuuucucuuguaaacguuucag

SEQ ID NO: 446673 - RNA, 16 nt, Homo sapiens
cuuucugacaaaaagu

SEQ ID NO: 446674 - RNA, 20 nt, Homo sapiens
cuuucugcaaaggcaccuga

SEQ ID NO: 446675 - RNA, 14 nt, Homo sapiens
cuuucugcaugcuu

SEQ ID NO: 446676 - RNA, 22 nt, Homo sapiens
cuuucuuacauuagcaguuugc

SEQ ID NO: 446677 - RNA, 14 nt, Homo sapiens
cuuucuuaucccag

SEQ ID NO: 446678 - RNA, 22 nt, Homo sapiens
cuuucuucccucauguucucau

SEQ ID NO: 446679 - RNA, 14 nt, Homo sapiens
cuuucuucugaaua

SEQ ID NO: 446680 - RNA, 18 nt, Homo sapiens
cuuucuugcacuauucca

SEQ ID NO: 446681 - RNA, 16 nt, Homo sapiens
cuuugaacacaucucu

SEQ ID NO: 446682 - RNA, 15 nt, Homo sapiens
cuuugaagaaaaaga

SEQ ID NO: 446683 - RNA, 17 nt, Homo sapiens
cuuugaagaccaguccu

SEQ ID NO: 446684 - RNA, 21 nt, Homo sapiens
cuuugaaguggcaccuaauaa

SEQ ID NO: 446685 - RNA, 21 nt, Homo sapiens
cuuugacccuauucaugucuc

SEQ ID NO: 446686 - RNA, 17 nt, Homo sapiens
cuuugagggacugccuc

SEQ ID NO: 446687 - RNA, 12 nt, Homo sapiens
cuuugagugaag

SEQ ID NO: 446688 - RNA, 16 nt, Homo sapiens
cuuugauugaguucau

SEQ ID NO: 446689 - RNA, 22 nt, Homo sapiens
cuuugcagugaaagcuuucaug

SEQ ID NO: 446690 - RNA, 14 nt, Homo sapiens
cuuugccacagauu

SEQ ID NO: 446691 - RNA, 19 nt, Homo sapiens
cuuugccacauccauugac

SEQ ID NO: 446692 - RNA, 22 nt, Homo sapiens
cuuugcccauggaagucucaaa

SEQ ID NO: 446693 - RNA, 18 nt, Homo sapiens
cuuugcuggaguccuguu

SEQ ID NO: 446694 - RNA, 23 nt, Homo sapiens
cuuugcugugaggcuguccugua

SEQ ID NO: 446695 - RNA, 20 nt, Homo sapiens
cuuuggacgcacacagcuuu

SEQ ID NO: 446696 - RNA, 19 nt, Homo sapiens
cuuuggauacacacauagu

SEQ ID NO: 446697 - RNA, 14 nt, Homo sapiens
cuuuggcaacagaa

SEQ ID NO: 446698 - RNA, 16 nt, Homo sapiens
cuuuggcuuaauucca

SEQ ID NO: 446699 - RNA, 21 nt, Homo sapiens
cuuuggcuuaauuccaaucau

SEQ ID NO: 446700 - RNA, 21 nt, Homo sapiens
cuuugggggauucaaaugcau

SEQ ID NO: 446701 - RNA, 18 nt, Homo sapiens
cuuuggucauaugagcuu

SEQ ID NO: 446702 - RNA, 14 nt, Homo sapiens
cuuuggucuccauu

SEQ ID NO: 446703 - RNA, 17 nt, Homo sapiens
cuuuguaaguaaacugc

SEQ ID NO: 446704 - RNA, 14 nt, Homo sapiens
cuuuguacagacaa

SEQ ID NO: 446705 - RNA, 11 nt, Homo sapiens
cuuugucacaa

SEQ ID NO: 446706 - RNA, 23 nt, Homo sapiens
cuuugucccggggcuccacugaa

SEQ ID NO: 446707 - RNA, 21 nt, Homo sapiens
cuuugucugugggaaggcaaa

SEQ ID NO: 446708 - RNA, 17 nt, Homo sapiens
cuuuguggcaguggcca

SEQ ID NO: 446709 - RNA, 18 nt, Homo sapiens
cuuuguguagaaagccaa

SEQ ID NO: 446710 - RNA, 19 nt, Homo sapiens
cuuuguguagaaagccaaa

SEQ ID NO: 446711 - RNA, 21 nt, Homo sapiens
cuuuguguagaaagccaaaua

SEQ ID NO: 446712 - RNA, 16 nt, Homo sapiens
cuuugugugauugaau

SEQ ID NO: 446713 - RNA, 11 nt, Homo sapiens
cuuuguugccc

SEQ ID NO: 446714 - RNA, 16 nt, Homo sapiens
cuuuguugcucagcaa

SEQ ID NO: 446715 - RNA, 21 nt, Homo sapiens
cuuuguuucauauucucagau

SEQ ID NO: 446716 - RNA, 17 nt, Homo sapiens
cuuuuaacuucaccuua

SEQ ID NO: 446717 - RNA, 19 nt, Homo sapiens
cuuuuaagaaacacagggu

SEQ ID NO: 446718 - RNA, 22 nt, Homo sapiens
cuuuuaaggcuaaaacuuaaca

SEQ ID NO: 446719 - RNA, 13 nt, Homo sapiens
cuuuuaaguugcu

SEQ ID NO: 446720 - RNA, 23 nt, Homo sapiens
cuuuuaaguugcugaugaacucu

SEQ ID NO: 446721 - RNA, 18 nt, Homo sapiens
cuuuuacuuguucauuuc

SEQ ID NO: 446722 - RNA, 21 nt, Homo sapiens
cuuuuagucaggagagugcag

SEQ ID NO: 446723 - RNA, 14 nt, Homo sapiens
cuuuuaguggguga

SEQ ID NO: 446724 - RNA, 14 nt, Homo sapiens
cuuuuaucucacaa

SEQ ID NO: 446725 - RNA, 21 nt, Homo sapiens
cuuuuaugauauauauaugcu

SEQ ID NO: 446726 - RNA, 14 nt, Homo sapiens
cuuuuauuucauuc

SEQ ID NO: 446727 - RNA, 15 nt, Homo sapiens
cuuuuauuucauuca

SEQ ID NO: 446728 - RNA, 14 nt, Homo sapiens
cuuuucaagcugcu

SEQ ID NO: 446729 - RNA, 17 nt, Homo sapiens
cuuuuccauugcuuauu

SEQ ID NO: 446730 - RNA, 21 nt, Homo sapiens
cuuuucuaaaaagucaauuca

SEQ ID NO: 446731 - RNA, 14 nt, Homo sapiens
cuuuucuccaugag

SEQ ID NO: 446732 - RNA, 19 nt, Homo sapiens
cuuuucuggaauguaauca

SEQ ID NO: 446733 - RNA, 17 nt, Homo sapiens
cuuuucugugaagcccu

SEQ ID NO: 446734 - RNA, 23 nt, Homo sapiens
cuuuucuuucucccuaaccacua

SEQ ID NO: 446735 - RNA, 19 nt, Homo sapiens
cuuuucuuuuuuuguccac

SEQ ID NO: 446736 - RNA, 23 nt, Homo sapiens
cuuuugaaaugccacgugccauu

SEQ ID NO: 446737 - RNA, 23 nt, Homo sapiens
cuuuugaauaauguagugcaguc

SEQ ID NO: 446738 - RNA, 15 nt, Homo sapiens
cuuuugcacauauau

SEQ ID NO: 446739 - RNA, 14 nt, Homo sapiens
cuuuugccuccuuu

SEQ ID NO: 446740 - RNA, 18 nt, Homo sapiens
cuuuuggagcugagauca

SEQ ID NO: 446741 - RNA, 15 nt, Homo sapiens
cuuuuggccuugugg

SEQ ID NO: 446742 - RNA, 16 nt, Homo sapiens
cuuuugguaugugaca

SEQ ID NO: 446743 - RNA, 21 nt, Homo sapiens
cuuuugguuuaaaaaguuuca

SEQ ID NO: 446744 - RNA, 24 nt, Homo sapiens
cuuuuguaaauauucuuguccaca

SEQ ID NO: 446745 - RNA, 15 nt, Homo sapiens
cuuuuguucauggga

SEQ ID NO: 446746 - RNA, 12 nt, Homo sapiens
cuuuuguuucag

SEQ ID NO: 446747 - RNA, 20 nt, Homo sapiens
cuuuuuaguguuuugcaagg

SEQ ID NO: 446748 - RNA, 15 nt, Homo sapiens
cuuuuuauacuauua

SEQ ID NO: 446749 - RNA, 17 nt, Homo sapiens
cuuuuucauauguugcu

SEQ ID NO: 446750 - RNA, 14 nt, Homo sapiens
cuuuuucuaccuuu

SEQ ID NO: 446751 - RNA, 16 nt, Homo sapiens
cuuuuucugagcuuuu

SEQ ID NO: 446752 - RNA, 12 nt, Homo sapiens
cuuuuuuacaca

SEQ ID NO: 446753 - RNA, 16 nt, Homo sapiens
cuuuuuuccugucaau

SEQ ID NO: 446754 - RNA, 22 nt, Homo sapiens
gaaaaaaaaaaaaaagaacaac

SEQ ID NO: 446755 - RNA, 16 nt, Homo sapiens
gaaaaacaaaugccau

SEQ ID NO: 446756 - RNA, 19 nt, Homo sapiens
gagcaaagggaaggacuga

SEQ ID NO: 446757 - RNA, 18 nt, Homo sapiens
gagcaaauguggcuccug

SEQ ID NO: 446758 - RNA, 22 nt, Homo sapiens
gagcaagacucugucucaaaaa

SEQ ID NO: 446759 - RNA, 17 nt, Homo sapiens
gagcaagucccaucuca

SEQ ID NO: 446760 - RNA, 22 nt, Homo sapiens
gagcaauggaguggcugccaug

SEQ ID NO: 446761 - RNA, 16 nt, Homo sapiens
gagcacaaaaugauaa

SEQ ID NO: 446762 - RNA, 19 nt, Homo sapiens
gagcacaaaaugauaauca

SEQ ID NO: 446763 - RNA, 20 nt, Homo sapiens
gagcacgaggccuucagaaa

SEQ ID NO: 446764 - RNA, 21 nt, Homo sapiens
gagcacguggagauagugcca

SEQ ID NO: 446765 - RNA, 17 nt, Homo sapiens
gagcacuagaagcacag

SEQ ID NO: 446766 - RNA, 17 nt, Homo sapiens
gagcacuggagugcagg

SEQ ID NO: 446767 - RNA, 18 nt, Homo sapiens
gagcacuugcguccugca

SEQ ID NO: 446768 - RNA, 13 nt, Homo sapiens
gagcagcugagau

SEQ ID NO: 446769 - RNA, 19 nt, Homo sapiens
gagcagggagccacuugcc

SEQ ID NO: 446770 - RNA, 11 nt, Homo sapiens
gagcagugggg

SEQ ID NO: 446771 - RNA, 22 nt, Homo sapiens
gagcauccucucucacauggaa

SEQ ID NO: 446772 - RNA, 21 nt, Homo sapiens
gagcauccuuaccuccaaaag

SEQ ID NO: 446773 - RNA, 20 nt, Homo sapiens
gagcaucugucccacuggga

SEQ ID NO: 446774 - RNA, 21 nt, Homo sapiens
gagcaucugucccacugggac

SEQ ID NO: 446775 - RNA, 16 nt, Homo sapiens
gagcaugaagauaaau

SEQ ID NO: 446776 - RNA, 20 nt, Homo sapiens
gagcaugaagauaaauccaa

SEQ ID NO: 446777 - RNA, 20 nt, Homo sapiens
gagcaugcucaguuggugcu

SEQ ID NO: 446778 - RNA, 21 nt, Homo sapiens
gagcaugcucaguuggugcug

SEQ ID NO: 446779 - RNA, 20 nt, Homo sapiens
gagcauuauuccuggucaaa

SEQ ID NO: 446780 - RNA, 22 nt, Homo sapiens
gagcauuuccaacaccacagac

SEQ ID NO: 446781 - RNA, 23 nt, Homo sapiens
gagccaagggguagaaguggcau

SEQ ID NO: 446782 - RNA, 22 nt, Homo sapiens
gagccaagucauuaaaauggaa

SEQ ID NO: 446783 - RNA, 17 nt, Homo sapiens
gagccaccccuaaagag

SEQ ID NO: 446784 - RNA, 16 nt, Homo sapiens
gagccacucuguuccu

SEQ ID NO: 446785 - RNA, 22 nt, Homo sapiens
gagccaggagccuccugacccu

SEQ ID NO: 446786 - RNA, 18 nt, Homo sapiens
gagcccagcuacauuccu

SEQ ID NO: 446787 - RNA, 20 nt, Homo sapiens
gagcccaggccguuccccuu

SEQ ID NO: 446788 - RNA, 22 nt, Homo sapiens
gagcccaucaccgccucuugca

SEQ ID NO: 446789 - RNA, 17 nt, Homo sapiens
gagccccccacaaugau

SEQ ID NO: 446790 - RNA, 14 nt, Homo sapiens
gagcccccuguccu

SEQ ID NO: 446791 - RNA, 16 nt, Homo sapiens
gagcccccugugccca

SEQ ID NO: 446792 - RNA, 21 nt, Homo sapiens
gagccccugggacugcugcuu

SEQ ID NO: 446793 - RNA, 16 nt, Homo sapiens
gagcccggcagugcac

SEQ ID NO: 446794 - RNA, 20 nt, Homo sapiens
gagcccuuagccuugcugua

SEQ ID NO: 446795 - RNA, 13 nt, Homo sapiens
gagcccuugcaca

SEQ ID NO: 446796 - RNA, 21 nt, Homo sapiens
gagccgggccgcagacuugac

SEQ ID NO: 446797 - RNA, 13 nt, Homo sapiens
gagccuacugucu

SEQ ID NO: 446798 - RNA, 16 nt, Homo sapiens
gagccuccacugccuc

SEQ ID NO: 446799 - RNA, 21 nt, Homo sapiens
gagccucgccccuccaguguu

SEQ ID NO: 446800 - RNA, 16 nt, Homo sapiens
gagccugcugcauggg

SEQ ID NO: 446801 - RNA, 20 nt, Homo sapiens
gagccuggaagacacccuaa

SEQ ID NO: 446802 - RNA, 18 nt, Homo sapiens
gagcggcugcccgacuca

SEQ ID NO: 446803 - RNA, 14 nt, Homo sapiens
gagcuagucuuuca

SEQ ID NO: 446804 - RNA, 19 nt, Homo sapiens
gagcucuaagcccauucag

SEQ ID NO: 446805 - RNA, 13 nt, Homo sapiens
gagcucuccagaa

SEQ ID NO: 446806 - RNA, 22 nt, Homo sapiens
gagcucuggugggaaaaugucc

SEQ ID NO: 446807 - RNA, 21 nt, Homo sapiens
gagcucuguuuucaugcuauu

SEQ ID NO: 446808 - RNA, 13 nt, Homo sapiens
gagcugcucugcu

SEQ ID NO: 446809 - RNA, 23 nt, Homo sapiens
gagcugggaguagcauggacucu

SEQ ID NO: 446810 - RNA, 16 nt, Homo sapiens
gagcugggggccauga

SEQ ID NO: 446811 - RNA, 20 nt, Homo sapiens
gagcuguuuucccugaccuc

SEQ ID NO: 446812 - RNA, 19 nt, Homo sapiens
gagcuuagccuugugcccu

SEQ ID NO: 446813 - RNA, 18 nt, Homo sapiens
gagcuugacuucaugcca

SEQ ID NO: 446814 - RNA, 12 nt, Homo sapiens
gagcuugagcuc

SEQ ID NO: 446815 - RNA, 18 nt, Homo sapiens
gagcuugauuagaagcca

SEQ ID NO: 446816 - RNA, 18 nt, Homo sapiens
gagcuugggcaauuuauc

SEQ ID NO: 446817 - RNA, 18 nt, Homo sapiens
gagcuuguaauugcacca

SEQ ID NO: 446818 - RNA, 20 nt, Homo sapiens
gagcuuuggacacacacagc

SEQ ID NO: 446819 - RNA, 21 nt, Homo sapiens
gaggaaaaguaaggugcaguu

SEQ ID NO: 446820 - RNA, 22 nt, Homo sapiens
gaggaaaaguaaggugcaguuc

SEQ ID NO: 446821 - RNA, 17 nt, Homo sapiens
gaggaaaauaguggcag

SEQ ID NO: 446822 - RNA, 16 nt, Homo sapiens
gaggaaacugcacugu

SEQ ID NO: 446823 - RNA, 16 nt, Homo sapiens
gaggaacugguccagg

SEQ ID NO: 446824 - RNA, 13 nt, Homo sapiens
gaggacucaaggg

SEQ ID NO: 446825 - RNA, 19 nt, Homo sapiens
gaggacuguugacauccaa

SEQ ID NO: 446826 - RNA, 12 nt, Homo sapiens
gaggaugaccag

SEQ ID NO: 446827 - RNA, 15 nt, Homo sapiens
gaggaugggcagcug

SEQ ID NO: 446828 - RNA, 21 nt, Homo sapiens
gaggauuccgucuucucucau

SEQ ID NO: 446829 - RNA, 13 nt, Homo sapiens
gaggauugcacua

SEQ ID NO: 446830 - RNA, 15 nt, Homo sapiens
gaggcaaaggccagc

SEQ ID NO: 446831 - RNA, 14 nt, Homo sapiens
gaggcaagaaccag

SEQ ID NO: 446832 - RNA, 15 nt, Homo sapiens
gaggcaagaaccagu

SEQ ID NO: 446833 - RNA, 13 nt, Homo sapiens
gaggcacacagcu

SEQ ID NO: 446834 - RNA, 20 nt, Homo sapiens
gaggcacgagaauugcuuga

SEQ ID NO: 446835 - RNA, 15 nt, Homo sapiens
gaggcagaauggugg

SEQ ID NO: 446836 - RNA, 14 nt, Homo sapiens
gaggcagaucuuug

SEQ ID NO: 446837 - RNA, 20 nt, Homo sapiens
gaggcagcagaauugcuuga

SEQ ID NO: 446838 - RNA, 15 nt, Homo sapiens
gaggcaguggcagca

SEQ ID NO: 446839 - RNA, 16 nt, Homo sapiens
gaggcaguggcagcaa

SEQ ID NO: 446840 - RNA, 23 nt, Homo sapiens
gaggccugaaauguuuccaggca

SEQ ID NO: 446841 - RNA, 18 nt, Homo sapiens
gaggcuagccccagggug

SEQ ID NO: 446842 - RNA, 22 nt, Homo sapiens
gaggcuauggaggguccuccuc

SEQ ID NO: 446843 - RNA, 15 nt, Homo sapiens
gaggcucuaauucuc

SEQ ID NO: 446844 - RNA, 21 nt, Homo sapiens
gaggcugagccuacagaugaa

SEQ ID NO: 446845 - RNA, 23 nt, Homo sapiens
gaggcuggaggccggaaucucag

SEQ ID NO: 446846 - RNA, 14 nt, Homo sapiens
gagggaccuuggag

SEQ ID NO: 446847 - RNA, 12 nt, Homo sapiens
gagggagcugcu

SEQ ID NO: 446848 - RNA, 17 nt, Homo sapiens
gagggccccgcccagug

SEQ ID NO: 446849 - RNA, 18 nt, Homo sapiens
gagggccccgcccagugc

SEQ ID NO: 446850 - RNA, 17 nt, Homo sapiens
gagggccccucugccca

SEQ ID NO: 446851 - RNA, 17 nt, Homo sapiens
gagggcgaggcggggga

SEQ ID NO: 446852 - RNA, 18 nt, Homo sapiens
gagggcgcauguguguau

SEQ ID NO: 446853 - RNA, 15 nt, Homo sapiens
gagggucuucuuaca

SEQ ID NO: 446854 - RNA, 20 nt, Homo sapiens
gaggguuguucuccuagacu

SEQ ID NO: 446855 - RNA, 22 nt, Homo sapiens
gaggucagugcuucgugccucg

SEQ ID NO: 446856 - RNA, 20 nt, Homo sapiens
gagguccgacaaaccuggcg

SEQ ID NO: 446857 - RNA, 21 nt, Homo sapiens
gaggugggcagaucaacugag

SEQ ID NO: 446858 - RNA, 17 nt, Homo sapiens
gagguguggauaaggcu

SEQ ID NO: 446859 - RNA, 19 nt, Homo sapiens
gaguaaaaauucauauaaa

SEQ ID NO: 446860 - RNA, 22 nt, Homo sapiens
gaguaaauauugucacaacacu

SEQ ID NO: 446861 - RNA, 23 nt, Homo sapiens
gaguaccaaauccacaagccauu

SEQ ID NO: 446862 - RNA, 21 nt, Homo sapiens
gaguaccccccugagagcaug

SEQ ID NO: 446863 - RNA, 13 nt, Homo sapiens
gaguaccuggacc

SEQ ID NO: 446864 - RNA, 15 nt, Homo sapiens
gaguaguaaucucac

SEQ ID NO: 446865 - RNA, 23 nt, Homo sapiens
gaguauggauugaaggauuguga

SEQ ID NO: 446866 - RNA, 19 nt, Homo sapiens
gaguauguuaagcucuuua

SEQ ID NO: 446867 - RNA, 16 nt, Homo sapiens
gagucaaugugcagug

SEQ ID NO: 446868 - RNA, 18 nt, Homo sapiens
gagucaaugugcagugua

SEQ ID NO: 446869 - RNA, 15 nt, Homo sapiens
gagucagccccacuc

SEQ ID NO: 446870 - RNA, 13 nt, Homo sapiens
gagucagucuuca

SEQ ID NO: 446871 - RNA, 21 nt, Homo sapiens
gagucauauugaggcauucaa

SEQ ID NO: 446872 - RNA, 13 nt, Homo sapiens
gagucauugucag

SEQ ID NO: 446873 - RNA, 16 nt, Homo sapiens
gaguccuuaaaaaaua

SEQ ID NO: 446874 - RNA, 20 nt, Homo sapiens
gagucgcaucucagugcagg

SEQ ID NO: 446875 - RNA, 20 nt, Homo sapiens
gagucucacucuguugccca

SEQ ID NO: 446876 - RNA, 14 nt, Homo sapiens
gagucugugcucuu

SEQ ID NO: 446877 - RNA, 20 nt, Homo sapiens
gagucuugcucuguugccca

SEQ ID NO: 446878 - RNA, 18 nt, Homo sapiens
gagugaaaacaucugcac

SEQ ID NO: 446879 - RNA, 15 nt, Homo sapiens
gagugaaucauccag

SEQ ID NO: 446880 - RNA, 22 nt, Homo sapiens
gagugagaauaauuguguacaa

SEQ ID NO: 446881 - RNA, 15 nt, Homo sapiens
gagugagagcacaaa

SEQ ID NO: 446882 - RNA, 20 nt, Homo sapiens
gagugcaccacuucaaguga

SEQ ID NO: 446883 - RNA, 19 nt, Homo sapiens
gagugcaguggugugaucu

SEQ ID NO: 446884 - RNA, 13 nt, Homo sapiens
gaguggaucugga

SEQ ID NO: 446885 - RNA, 21 nt, Homo sapiens
gcacccuguaucacagacugg

SEQ ID NO: 446886 - RNA, 14 nt, Homo sapiens
gcacccuugcgcuu

SEQ ID NO: 446887 - RNA, 18 nt, Homo sapiens
gcaccgagagagauggaa

SEQ ID NO: 446888 - RNA, 20 nt, Homo sapiens
gcaccgaguggccauggcau

SEQ ID NO: 446889 - RNA, 13 nt, Homo sapiens
gcaccguggucag

SEQ ID NO: 446890 - RNA, 12 nt, Homo sapiens
gcaccuaccuca

SEQ ID NO: 446891 - RNA, 13 nt, Homo sapiens
gcaccuaccucac

SEQ ID NO: 446892 - RNA, 23 nt, Homo sapiens
gcaccuaugagauggccaugcuc

SEQ ID NO: 446893 - RNA, 13 nt, Homo sapiens
gcaccugcucaac

SEQ ID NO: 446894 - RNA, 18 nt, Homo sapiens
gcaccuuaccaacuuucu

SEQ ID NO: 446895 - RNA, 14 nt, Homo sapiens
gcaccuucauucuc

SEQ ID NO: 446896 - RNA, 15 nt, Homo sapiens
gcaccuucauucucc

SEQ ID NO: 446897 - RNA, 19 nt, Homo sapiens
gcaccuucccucucaccau

SEQ ID NO: 446898 - RNA, 19 nt, Homo sapiens
gcaccuugggcacgggaga

SEQ ID NO: 446899 - RNA, 19 nt, Homo sapiens
gcaccuuuuauaccagaga

SEQ ID NO: 446900 - RNA, 14 nt, Homo sapiens
gcacgcccaugugu

SEQ ID NO: 446901 - RNA, 14 nt, Homo sapiens
gcacgguggcucac

SEQ ID NO: 446902 - RNA, 23 nt, Homo sapiens
gcacuaaaaaguggcuaauucaa

SEQ ID NO: 446903 - RNA, 18 nt, Homo sapiens
gcacuagaucucccuuaa

SEQ ID NO: 446904 - RNA, 21 nt, Homo sapiens
gcacuagaucucccuuaauaa

SEQ ID NO: 446905 - RNA, 19 nt, Homo sapiens
gcacuccaugagugcagcu

SEQ ID NO: 446906 - RNA, 22 nt, Homo sapiens
gcacucugaguuuaccauuugu

SEQ ID NO: 446907 - RNA, 16 nt, Homo sapiens
gcacucugguggcagg

SEQ ID NO: 446908 - RNA, 13 nt, Homo sapiens
gcacugacacuca

SEQ ID NO: 446909 - RNA, 17 nt, Homo sapiens
gcacugaggaccagcca

SEQ ID NO: 446910 - RNA, 22 nt, Homo sapiens
gcacugagggucuggugccaau

SEQ ID NO: 446911 - RNA, 21 nt, Homo sapiens
gcacugcaaaugccgcucuca

SEQ ID NO: 446912 - RNA, 23 nt, Homo sapiens
gcacuggcugcucugucuugguc

SEQ ID NO: 446913 - RNA, 15 nt, Homo sapiens
gcacugucacuuugc

SEQ ID NO: 446914 - RNA, 21 nt, Homo sapiens
gcacuguggcucugcaugaca

SEQ ID NO: 446915 - RNA, 16 nt, Homo sapiens
gcacuguuagugacag

SEQ ID NO: 446916 - RNA, 13 nt, Homo sapiens
gcacuucacugga

SEQ ID NO: 446917 - RNA, 13 nt, Homo sapiens
gcacuucauaucu

SEQ ID NO: 446918 - RNA, 18 nt, Homo sapiens
gcacuuuucugugucaua

SEQ ID NO: 446919 - RNA, 12 nt, Homo sapiens
gcagaaccaaag

SEQ ID NO: 446920 - RNA, 16 nt, Homo sapiens
gcagaagcacauauga

SEQ ID NO: 446921 - RNA, 15 nt, Homo sapiens
gcagacauccucauc

SEQ ID NO: 446922 - RNA, 15 nt, Homo sapiens
gcagagagguuguga

SEQ ID NO: 446923 - RNA, 14 nt, Homo sapiens
gcagagcucagagg

SEQ ID NO: 446924 - RNA, 18 nt, Homo sapiens
gcagagguggaaaaugau

SEQ ID NO: 446925 - RNA, 14 nt, Homo sapiens
gcagaucaacugag

SEQ ID NO: 446926 - RNA, 14 nt, Homo sapiens
gcagauucuagcac

SEQ ID NO: 446927 - RNA, 12 nt, Homo sapiens
gcagcagaauug

SEQ ID NO: 446928 - RNA, 13 nt, Homo sapiens
gcagcagaauugc

SEQ ID NO: 446929 - RNA, 21 nt, Homo sapiens
gcagcccacagaggacagugc

SEQ ID NO: 446930 - RNA, 13 nt, Homo sapiens
gcagcccaugccc

SEQ ID NO: 446931 - RNA, 23 nt, Homo sapiens
gcagcccaugcccaccugcccau

SEQ ID NO: 446932 - RNA, 21 nt, Homo sapiens
gcagccccuccccauggugca

SEQ ID NO: 446933 - RNA, 15 nt, Homo sapiens
gcagcgguaccccag

SEQ ID NO: 446934 - RNA, 16 nt, Homo sapiens
gcagcgguaccccagg

SEQ ID NO: 446935 - RNA, 23 nt, Homo sapiens
gcagcuaugcuggaaaacugagc

SEQ ID NO: 446936 - RNA, 19 nt, Homo sapiens
gcagcugagaaaaugagug

SEQ ID NO: 446937 - RNA, 15 nt, Homo sapiens
gcagcugccagagaa

SEQ ID NO: 446938 - RNA, 21 nt, Homo sapiens
gcagcuggggagcagcugaga

SEQ ID NO: 446939 - RNA, 19 nt, Homo sapiens
gcagcuguuuuaguuaaau

SEQ ID NO: 446940 - RNA, 18 nt, Homo sapiens
gcagcuucucuccacuga

SEQ ID NO: 446941 - RNA, 14 nt, Homo sapiens
gcagcuuuccaguu

SEQ ID NO: 446942 - RNA, 17 nt, Homo sapiens
gcaggagcagcugugcu

SEQ ID NO: 446943 - RNA, 20 nt, Homo sapiens
gcaggaggccauuccaggag

SEQ ID NO: 446944 - RNA, 16 nt, Homo sapiens
gcaggaguauaugagc

SEQ ID NO: 446945 - RNA, 18 nt, Homo sapiens
gcaggauccuugccucca

SEQ ID NO: 446946 - RNA, 14 nt, Homo sapiens
gcaggaugugccug

SEQ ID NO: 446947 - RNA, 15 nt, Homo sapiens
gcaggcagccuugac

SEQ ID NO: 446948 - RNA, 16 nt, Homo sapiens
gcaggccccagccaag

SEQ ID NO: 446949 - RNA, 18 nt, Homo sapiens
gcaggcgguauccagagg

SEQ ID NO: 446950 - RNA, 19 nt, Homo sapiens
gcaggcugaucgggcaaug

SEQ ID NO: 446951 - RNA, 19 nt, Homo sapiens
gcagggaagcucuaccgca

SEQ ID NO: 446952 - RNA, 23 nt, Homo sapiens
gcagggccaagugcccaugagca

SEQ ID NO: 446953 - RNA, 17 nt, Homo sapiens
gcagguuggaccccaga

SEQ ID NO: 446954 - RNA, 20 nt, Homo sapiens
gcaguaaaguuccaugaaga

SEQ ID NO: 446955 - RNA, 14 nt, Homo sapiens
gcaguacuugcuca

SEQ ID NO: 446956 - RNA, 19 nt, Homo sapiens
gcaguagaaauaauaugca

SEQ ID NO: 446957 - RNA, 20 nt, Homo sapiens
gcaguagaaauaauaugcau

SEQ ID NO: 446958 - RNA, 23 nt, Homo sapiens
gcaguagaaggugccgugagcag

SEQ ID NO: 446959 - RNA, 20 nt, Homo sapiens
gcaguagacuauaagcagaa

SEQ ID NO: 446960 - RNA, 16 nt, Homo sapiens
gcagucaccaccccag

SEQ ID NO: 446961 - RNA, 13 nt, Homo sapiens
gcagucacuugau

SEQ ID NO: 446962 - RNA, 21 nt, Homo sapiens
gcagucggugguaccugagau

SEQ ID NO: 446963 - RNA, 16 nt, Homo sapiens
gcagugaacacacuca

SEQ ID NO: 446964 - RNA, 15 nt, Homo sapiens
gcagugcaugugaag

SEQ ID NO: 446965 - RNA, 24 nt, Homo sapiens
gcaguggagaggggacuuggauag

SEQ ID NO: 446966 - RNA, 19 nt, Homo sapiens
gcaguggcagcaacaaagg

SEQ ID NO: 446967 - RNA, 17 nt, Homo sapiens
gcaguggcgugaucucg

SEQ ID NO: 446968 - RNA, 22 nt, Homo sapiens
gcaguguguacuucuucaucca

SEQ ID NO: 446969 - RNA, 17 nt, Homo sapiens
gcaguuccugucccuuc

SEQ ID NO: 446970 - RNA, 20 nt, Homo sapiens
gcaguucugcagcuguuuua

SEQ ID NO: 446971 - RNA, 22 nt, Homo sapiens
gcaguugaaacaagaagccaca

SEQ ID NO: 446972 - RNA, 14 nt, Homo sapiens
gcaguugaucucca

SEQ ID NO: 446973 - RNA, 21 nt, Homo sapiens
gcaguuugcuuuguaugcacu

SEQ ID NO: 446974 - RNA, 21 nt, Homo sapiens
gcaguuugguccuggggacca

SEQ ID NO: 446975 - RNA, 18 nt, Homo sapiens
gcauaaguuaacuuccaa

SEQ ID NO: 446976 - RNA, 16 nt, Homo sapiens
gcauaaguuucuggga

SEQ ID NO: 446977 - RNA, 14 nt, Homo sapiens
gcauaauagucaau

SEQ ID NO: 446978 - RNA, 16 nt, Homo sapiens
gcauagcucuauuuua

SEQ ID NO: 446979 - RNA, 16 nt, Homo sapiens
gcauaguauuccauug

SEQ ID NO: 446980 - RNA, 15 nt, Homo sapiens
gcauaucaacuugag

SEQ ID NO: 446981 - RNA, 20 nt, Homo sapiens
gcauaucaacuugaggccag

SEQ ID NO: 446982 - RNA, 23 nt, Homo sapiens
gcauauuuucuccgaaaggcaaa

SEQ ID NO: 446983 - RNA, 13 nt, Homo sapiens
gcaucaaacauga

SEQ ID NO: 446984 - RNA, 14 nt, Homo sapiens
gcaucagaugaauu

SEQ ID NO: 446985 - RNA, 20 nt, Homo sapiens
gcauccacccagugcugcca

SEQ ID NO: 446986 - RNA, 18 nt, Homo sapiens
gcauccagccuguguguu

SEQ ID NO: 446987 - RNA, 18 nt, Homo sapiens
gcaucccugugagcaaaa

SEQ ID NO: 446988 - RNA, 20 nt, Homo sapiens
gcaucguggccuugaccucc

SEQ ID NO: 446989 - RNA, 23 nt, Homo sapiens
gcaucuaagacauucaccaacaa

SEQ ID NO: 446990 - RNA, 15 nt, Homo sapiens
gcaucuacacaauuu

SEQ ID NO: 446991 - RNA, 22 nt, Homo sapiens
gcaucuacuacucugucuucac

SEQ ID NO: 446992 - RNA, 14 nt, Homo sapiens
gcaucuccccucag

SEQ ID NO: 446993 - RNA, 17 nt, Homo sapiens
gcaucuggcuaaggcau

SEQ ID NO: 446994 - RNA, 22 nt, Homo sapiens
gcaucugucccacugggacaca

SEQ ID NO: 446995 - RNA, 17 nt, Homo sapiens
gcaugaauccaguccag

SEQ ID NO: 446996 - RNA, 14 nt, Homo sapiens
gcaugaccugugac

SEQ ID NO: 446997 - RNA, 20 nt, Homo sapiens
gcaugaccuuuuggccuuug

SEQ ID NO: 446998 - RNA, 13 nt, Homo sapiens
gcaugcaagcuca

SEQ ID NO: 446999 - RNA, 19 nt, Homo sapiens
gcaugcaggucuccaugaa

SEQ ID NO: 447000 - RNA, 18 nt, Homo sapiens
gcaugccacccucacaca

SEQ ID NO: 447001 - RNA, 14 nt, Homo sapiens
gcaugccuauguac

SEQ ID NO: 447002 - RNA, 17 nt, Homo sapiens
gcauggagagccucuua

SEQ ID NO: 447003 - RNA, 14 nt, Homo sapiens
gcauggaguauuau

SEQ ID NO: 447004 - RNA, 19 nt, Homo sapiens
gcauguaaaaucuucagcu

SEQ ID NO: 447005 - RNA, 22 nt, Homo sapiens
gcauguacuuuauauuuucuau

SEQ ID NO: 447006 - RNA, 23 nt, Homo sapiens
gcauguauauuacugauuuacaa

SEQ ID NO: 447007 - RNA, 22 nt, Homo sapiens
gcaugugccaagauucuacucu

SEQ ID NO: 447008 - RNA, 15 nt, Homo sapiens
gcaugugugauuuca

SEQ ID NO: 447009 - RNA, 21 nt, Homo sapiens
gcauguuuuaugugcacucau

SEQ ID NO: 447010 - RNA, 15 nt, Homo sapiens
gcauuaaacauuuga

SEQ ID NO: 447011 - RNA, 16 nt, Homo sapiens
gcauuacucugcacua

SEQ ID NO: 447012 - RNA, 17 nt, Homo sapiens
gcauucaaguguacagu

SEQ ID NO: 447013 - RNA, 16 nt, Homo sapiens
gcauuuaaaauggacu

SEQ ID NO: 447014 - RNA, 19 nt, Homo sapiens
gcauuuaaacucauuugag

SEQ ID NO: 447015 - RNA, 16 nt, Homo sapiens
gcugccaucuccaggc

SEQ ID NO: 447016 - RNA, 20 nt, Homo sapiens
gcugccaugccacugccagg

SEQ ID NO: 447017 - RNA, 20 nt, Homo sapiens
gcugccccaaccugcugaag

SEQ ID NO: 447018 - RNA, 21 nt, Homo sapiens
gcugccccaccccuccaugau

SEQ ID NO: 447019 - RNA, 20 nt, Homo sapiens
gcugcggggggcaccagagg

SEQ ID NO: 447020 - RNA, 12 nt, Homo sapiens
gcugcuccaugg

SEQ ID NO: 447021 - RNA, 17 nt, Homo sapiens
gcugcucuuaugccauu

SEQ ID NO: 447022 - RNA, 21 nt, Homo sapiens
gcugcugaaugcauucagggg

SEQ ID NO: 447023 - RNA, 10 nt, Homo sapiens
gcugcugaga

SEQ ID NO: 447024 - RNA, 11 nt, Homo sapiens
gcugcugcuaa

SEQ ID NO: 447025 - RNA, 14 nt, Homo sapiens
gcugcugcugcuaa

SEQ ID NO: 447026 - RNA, 19 nt, Homo sapiens
gcugcuguagcaacagagc

SEQ ID NO: 447027 - RNA, 19 nt, Homo sapiens
gcugcuucugcaaaaaacu

SEQ ID NO: 447028 - RNA, 23 nt, Homo sapiens
gcugcuuucuuguugcugcaucu

SEQ ID NO: 447029 - RNA, 20 nt, Homo sapiens
gcugcuuuucccuaagccaa

SEQ ID NO: 447030 - RNA, 14 nt, Homo sapiens
gcuggaaaugcuga

SEQ ID NO: 447031 - RNA, 16 nt, Homo sapiens
gcuggagaggaaccca

SEQ ID NO: 447032 - RNA, 23 nt, Homo sapiens
gcuggagagguuaaggugcaaua

SEQ ID NO: 447033 - RNA, 21 nt, Homo sapiens
gcuggagucaaaacacuugua

SEQ ID NO: 447034 - RNA, 19 nt, Homo sapiens
gcuggagugcaaugcacga

SEQ ID NO: 447035 - RNA, 20 nt, Homo sapiens
gcuggagugcaguggcacca

SEQ ID NO: 447036 - RNA, 16 nt, Homo sapiens
gcuggcaagcagggaa

SEQ ID NO: 447037 - RNA, 19 nt, Homo sapiens
gcuggcaccgccuucucua

SEQ ID NO: 447038 - RNA, 16 nt, Homo sapiens
gcuggcagaguuagca

SEQ ID NO: 447039 - RNA, 15 nt, Homo sapiens
gcuggcccagccaaa

SEQ ID NO: 447040 - RNA, 23 nt, Homo sapiens
gcugggaaaaaaguuuugaugaa

SEQ ID NO: 447041 - RNA, 17 nt, Homo sapiens
gcugggagaaaagccag

SEQ ID NO: 447042 - RNA, 15 nt, Homo sapiens
gcugggagagccaag

SEQ ID NO: 447043 - RNA, 17 nt, Homo sapiens
gcugggauuacaggugc

SEQ ID NO: 447044 - RNA, 15 nt, Homo sapiens
gcugggauuugaacc

SEQ ID NO: 447045 - RNA, 14 nt, Homo sapiens
gcugggcucugcca

SEQ ID NO: 447046 - RNA, 21 nt, Homo sapiens
gcugggguacacagugagagu

SEQ ID NO: 447047 - RNA, 15 nt, Homo sapiens
gcuggggugagagua

SEQ ID NO: 447048 - RNA, 15 nt, Homo sapiens
gcugguaagggccaa

SEQ ID NO: 447049 - RNA, 18 nt, Homo sapiens
gcuggugucacucugccu

SEQ ID NO: 447050 - RNA, 15 nt, Homo sapiens
gcuguaaauacaugu

SEQ ID NO: 447051 - RNA, 22 nt, Homo sapiens
gcuguaaauccuagacuugaaa

SEQ ID NO: 447052 - RNA, 20 nt, Homo sapiens
gcuguaaccgauaugcacuu

SEQ ID NO: 447053 - RNA, 14 nt, Homo sapiens
gcuguaagcaccug

SEQ ID NO: 447054 - RNA, 15 nt, Homo sapiens
gcuguauacaaacag

SEQ ID NO: 447055 - RNA, 23 nt, Homo sapiens
gcuguaugauauuaauguggaag

SEQ ID NO: 447056 - RNA, 19 nt, Homo sapiens
gcuguccaggaacuuucca

SEQ ID NO: 447057 - RNA, 20 nt, Homo sapiens
gcuguccaggaacuuuccag

SEQ ID NO: 447058 - RNA, 21 nt, Homo sapiens
gcuguccucucagaacuccug

SEQ ID NO: 447059 - RNA, 16 nt, Homo sapiens
gcugucgacuucauga

SEQ ID NO: 447060 - RNA, 14 nt, Homo sapiens
gcugucuugucauc

SEQ ID NO: 447061 - RNA, 13 nt, Homo sapiens
gcugugaggacag

SEQ ID NO: 447062 - RNA, 19 nt, Homo sapiens
gcugugaucacuccagugc

SEQ ID NO: 447063 - RNA, 15 nt, Homo sapiens
gcugugaugcaugag

SEQ ID NO: 447064 - RNA, 18 nt, Homo sapiens
gcugugaugcaugagcuc

SEQ ID NO: 447065 - RNA, 21 nt, Homo sapiens
gcugugcauagugguuggcac

SEQ ID NO: 447066 - RNA, 15 nt, Homo sapiens
gcugugccaccaccc

SEQ ID NO: 447067 - RNA, 21 nt, Homo sapiens
gcuguggguauucaccacccu

SEQ ID NO: 447068 - RNA, 16 nt, Homo sapiens
gcugugugacuuugaa

SEQ ID NO: 447069 - RNA, 20 nt, Homo sapiens
gcuguuuccauagggugaca

SEQ ID NO: 447070 - RNA, 18 nt, Homo sapiens
gcuuaaugucagucuaca

SEQ ID NO: 447071 - RNA, 18 nt, Homo sapiens
gcuuacauuuuuacaaua

SEQ ID NO: 447072 - RNA, 14 nt, Homo sapiens
gcuuacuaaugugc

SEQ ID NO: 447073 - RNA, 12 nt, Homo sapiens
gcuuagcauucc

SEQ ID NO: 447074 - RNA, 20 nt, Homo sapiens
gcuuaggaaauugcucauaa

SEQ ID NO: 447075 - RNA, 21 nt, Homo sapiens
gcuuauaccagguuaccucac

SEQ ID NO: 447076 - RNA, 19 nt, Homo sapiens
gcuucaaguguugcucuug

SEQ ID NO: 447077 - RNA, 21 nt, Homo sapiens
gcuucaccagagcauuuccaa

SEQ ID NO: 447078 - RNA, 12 nt, Homo sapiens
gcuucaccaguc

SEQ ID NO: 447079 - RNA, 12 nt, Homo sapiens
gcuucacuuaaa

SEQ ID NO: 447080 - RNA, 22 nt, Homo sapiens
gcuucagucucugcagugucca

SEQ ID NO: 447081 - RNA, 11 nt, Homo sapiens
gcuucauaucu

SEQ ID NO: 447082 - RNA, 18 nt, Homo sapiens
gcuucaucuugagccuga

SEQ ID NO: 447083 - RNA, 22 nt, Homo sapiens
gcuuccauuugugugugugcaa

SEQ ID NO: 447084 - RNA, 23 nt, Homo sapiens
gcuuccccuuuugccaaucucaa

SEQ ID NO: 447085 - RNA, 17 nt, Homo sapiens
gcuucccuuugauuuuu

SEQ ID NO: 447086 - RNA, 19 nt, Homo sapiens
gcuuccgagggcacuaccg

SEQ ID NO: 447087 - RNA, 13 nt, Homo sapiens
gcuucuagcagcu

SEQ ID NO: 447088 - RNA, 19 nt, Homo sapiens
gcuucucauggauggcacu

SEQ ID NO: 447089 - RNA, 23 nt, Homo sapiens
gcuucuccuucuccuucccauuu

SEQ ID NO: 447090 - RNA, 19 nt, Homo sapiens
gcuucucuugagucacacu

SEQ ID NO: 447091 - RNA, 20 nt, Homo sapiens
gcuucugaaugcugcuacuu

SEQ ID NO: 447092 - RNA, 14 nt, Homo sapiens
gcuucugauaugca

SEQ ID NO: 447093 - RNA, 20 nt, Homo sapiens
gcuucuucaauggcaccuuc

SEQ ID NO: 447094 - RNA, 16 nt, Homo sapiens
gcuucuuucacuuugc

SEQ ID NO: 447095 - RNA, 21 nt, Homo sapiens
gcuugagcaaccuggcuaaga

SEQ ID NO: 447096 - RNA, 10 nt, Homo sapiens
gcuugcucua

SEQ ID NO: 447097 - RNA, 16 nt, Homo sapiens
gcuuggcacacugcca

SEQ ID NO: 447098 - RNA, 20 nt, Homo sapiens
gcuuggcacacugccagugu

SEQ ID NO: 447099 - RNA, 17 nt, Homo sapiens
gcuugugauaugcacgu

SEQ ID NO: 447100 - RNA, 22 nt, Homo sapiens
gcuugugauuuuugaacaauac

SEQ ID NO: 447101 - RNA, 18 nt, Homo sapiens
gcuuguggucacacugug

SEQ ID NO: 447102 - RNA, 19 nt, Homo sapiens
gcuuguguacaaacccaga

SEQ ID NO: 447103 - RNA, 22 nt, Homo sapiens
gcuuguucuuccucuuaccugu

SEQ ID NO: 447104 - RNA, 16 nt, Homo sapiens
gcuuguuuacagcacu

SEQ ID NO: 447105 - RNA, 18 nt, Homo sapiens
gcuuuaacaaaacaagaa

SEQ ID NO: 447106 - RNA, 17 nt, Homo sapiens
gcuuuauaauuucuacc

SEQ ID NO: 447107 - RNA, 22 nt, Homo sapiens
gcuuuaucaaaaaguacaauaa

SEQ ID NO: 447108 - RNA, 20 nt, Homo sapiens
gcuuuauuuuuuaaguauuu

SEQ ID NO: 447109 - RNA, 16 nt, Homo sapiens
gcuuucauccuguguc

SEQ ID NO: 447110 - RNA, 20 nt, Homo sapiens
gcuuucguaguuuucauuua

SEQ ID NO: 447111 - RNA, 18 nt, Homo sapiens
gcuuucuuucugcaugac

SEQ ID NO: 447112 - RNA, 22 nt, Homo sapiens
gcuuugagagcaacgucacugg

SEQ ID NO: 447113 - RNA, 17 nt, Homo sapiens
gcuuugauuguucauau

SEQ ID NO: 447114 - RNA, 12 nt, Homo sapiens
gcuuugcaguga

SEQ ID NO: 447115 - RNA, 17 nt, Homo sapiens
gcuuugccacugaagua

SEQ ID NO: 447116 - RNA, 20 nt, Homo sapiens
gcuuuggacacacacagcuu

SEQ ID NO: 447117 - RNA, 15 nt, Homo sapiens
gcuuuggcaacagaa

SEQ ID NO: 447118 - RNA, 21 nt, Homo sapiens
gcuuuguaaacuccacaggga

SEQ ID NO: 447119 - RNA, 18 nt, Homo sapiens
gcuuuguuaaugaaaaug

SEQ ID NO: 447120 - RNA, 23 nt, Homo sapiens
gcuuuguugaaugaagcagagaa

SEQ ID NO: 447121 - RNA, 17 nt, Homo sapiens
gcuuuucucaugguauu

SEQ ID NO: 447122 - RNA, 23 nt, Homo sapiens
gcuuuugaaauccagaaguuuua

SEQ ID NO: 447123 - RNA, 19 nt, Homo sapiens
ggaaaaacaaaugccauau

SEQ ID NO: 447124 - RNA, 13 nt, Homo sapiens
ggaaaaacuggcu

SEQ ID NO: 447125 - RNA, 18 nt, Homo sapiens
ggaaaaaggcuucuccac

SEQ ID NO: 447126 - RNA, 20 nt, Homo sapiens
ggaaaacaaauauuucacuu

SEQ ID NO: 447127 - RNA, 13 nt, Homo sapiens
ggaaaagauuucu

SEQ ID NO: 447128 - RNA, 22 nt, Homo sapiens
ggaaaaguguaauagcauacau

SEQ ID NO: 447129 - RNA, 18 nt, Homo sapiens
ggaaaauguccuguggug

SEQ ID NO: 447130 - RNA, 23 nt, Homo sapiens
ggaaaauguucugacagcauuuc

SEQ ID NO: 447131 - RNA, 18 nt, Homo sapiens
ggaaaccugcccugccug

SEQ ID NO: 447132 - RNA, 22 nt, Homo sapiens
ggaaaccuguuaugccaaacag

SEQ ID NO: 447133 - RNA, 22 nt, Homo sapiens
ggaaacugaucauuaaagccug

SEQ ID NO: 447134 - RNA, 19 nt, Homo sapiens
ggaaacuguuguguccaau

SEQ ID NO: 447135 - RNA, 22 nt, Homo sapiens
ggaaagaguugagcacaggcaa

SEQ ID NO: 447136 - RNA, 16 nt, Homo sapiens
ggaaagauugugucug

SEQ ID NO: 447137 - RNA, 22 nt, Homo sapiens
ggaaagggugcugcuucccucu

SEQ ID NO: 447138 - RNA, 21 nt, Homo sapiens
ggaaagguagcccccgaggga

SEQ ID NO: 447139 - RNA, 16 nt, Homo sapiens
ggaaagguccuguggg

SEQ ID NO: 447140 - RNA, 21 nt, Homo sapiens
ggaaagugauuuguaauauga

SEQ ID NO: 447141 - RNA, 16 nt, Homo sapiens
ggaaaguucuuaggca

SEQ ID NO: 447142 - RNA, 15 nt, Homo sapiens
ggaaauaacauugca

SEQ ID NO: 447143 - RNA, 16 nt, Homo sapiens
ggaaauacacuacaaa

SEQ ID NO: 447144 - RNA, 16 nt, Homo sapiens
uaagcaacaugaauua

SEQ ID NO: 447145 - RNA, 20 nt, Homo sapiens
uaagcacacuugacaucaac

SEQ ID NO: 447146 - RNA, 20 nt, Homo sapiens
uaagcacuagaucucccuua

SEQ ID NO: 447147 - RNA, 15 nt, Homo sapiens
uaagcagaagcacau

SEQ ID NO: 447148 - RNA, 18 nt, Homo sapiens
uaagcaugugucccagga

SEQ ID NO: 447149 - RNA, 22 nt, Homo sapiens
uaagccaacuuuaauugcuuaa

SEQ ID NO: 447150 - RNA, 22 nt, Homo sapiens
uaagccauaugacaauuucaaa

SEQ ID NO: 447151 - RNA, 18 nt, Homo sapiens
uaagcccccucuugagag

SEQ ID NO: 447152 - RNA, 18 nt, Homo sapiens
uaagcuauauuauacaaa

SEQ ID NO: 447153 - RNA, 19 nt, Homo sapiens
uaagcuaugucacuacccu

SEQ ID NO: 447154 - RNA, 21 nt, Homo sapiens
uaagcucagagaaaguuccau

SEQ ID NO: 447155 - RNA, 18 nt, Homo sapiens
uaagcucuaucugcaaug

SEQ ID NO: 447156 - RNA, 14 nt, Homo sapiens
uaaggaucucucag

SEQ ID NO: 447157 - RNA, 15 nt, Homo sapiens
uaaggcauauacaaa

SEQ ID NO: 447158 - RNA, 15 nt, Homo sapiens
uaaggccuuggugcc

SEQ ID NO: 447159 - RNA, 16 nt, Homo sapiens
uaagggagcugagcca

SEQ ID NO: 447160 - RNA, 20 nt, Homo sapiens
uaagggggugcagcagugag

SEQ ID NO: 447161 - RNA, 18 nt, Homo sapiens
uaagguaccaagaucaca

SEQ ID NO: 447162 - RNA, 13 nt, Homo sapiens
uaagguacuuaaa

SEQ ID NO: 447163 - RNA, 23 nt, Homo sapiens
uaagguuuguuuuccauccauuc

SEQ ID NO: 447164 - RNA, 17 nt, Homo sapiens
uaaguaaaugagccuuu

SEQ ID NO: 447165 - RNA, 14 nt, Homo sapiens
uaaguagauuugua

SEQ ID NO: 447166 - RNA, 20 nt, Homo sapiens
uaaguaguugguuuccuuca

SEQ ID NO: 447167 - RNA, 16 nt, Homo sapiens
uaaguauuccuuggcc

SEQ ID NO: 447168 - RNA, 16 nt, Homo sapiens
uaagucugagaaggcu

SEQ ID NO: 447169 - RNA, 21 nt, Homo sapiens
uaaguguggaauuaccugaua

SEQ ID NO: 447170 - RNA, 20 nt, Homo sapiens
uaaguuauuuacuuuuacca

SEQ ID NO: 447171 - RNA, 13 nt, Homo sapiens
uaaguucagucca

SEQ ID NO: 447172 - RNA, 14 nt, Homo sapiens
uaaguuucugggac

SEQ ID NO: 447173 - RNA, 15 nt, Homo sapiens
uaaguuugauuucau

SEQ ID NO: 447174 - RNA, 18 nt, Homo sapiens
uaaguuuuguguguauau

SEQ ID NO: 447175 - RNA, 16 nt, Homo sapiens
uaauaaaaagguuuaa

SEQ ID NO: 447176 - RNA, 21 nt, Homo sapiens
uaauaaaacagcugucucuaa

SEQ ID NO: 447177 - RNA, 14 nt, Homo sapiens
uaauaaacucacaa

SEQ ID NO: 447178 - RNA, 17 nt, Homo sapiens
uaauaaacucacaacuc

SEQ ID NO: 447179 - RNA, 15 nt, Homo sapiens
uaauaaaguauauaa

SEQ ID NO: 447180 - RNA, 18 nt, Homo sapiens
uaauaaauauuuuugcca

SEQ ID NO: 447181 - RNA, 12 nt, Homo sapiens
uaauaacuaaua

SEQ ID NO: 447182 - RNA, 21 nt, Homo sapiens
uaauaacugugaaguuuacau

SEQ ID NO: 447183 - RNA, 13 nt, Homo sapiens
uaauacaacaauc

SEQ ID NO: 447184 - RNA, 15 nt, Homo sapiens
uaauacagggcauuu

SEQ ID NO: 447185 - RNA, 15 nt, Homo sapiens
uaauacccacauuac

SEQ ID NO: 447186 - RNA, 17 nt, Homo sapiens
uaauaguacuauuacua

SEQ ID NO: 447187 - RNA, 21 nt, Homo sapiens
uaauauaaaccgugugucaug

SEQ ID NO: 447188 - RNA, 15 nt, Homo sapiens
uaauauaacaauaua

SEQ ID NO: 447189 - RNA, 15 nt, Homo sapiens
uaauauauugcugcu

SEQ ID NO: 447190 - RNA, 13 nt, Homo sapiens
uaauauccaccuc

SEQ ID NO: 447191 - RNA, 17 nt, Homo sapiens
uaauaugccuagcacaa

SEQ ID NO: 447192 - RNA, 13 nt, Homo sapiens
uaauaugcuuuac

SEQ ID NO: 447193 - RNA, 14 nt, Homo sapiens
uaauauuauauugu

SEQ ID NO: 447194 - RNA, 12 nt, Homo sapiens
uaaucacuauug

SEQ ID NO: 447195 - RNA, 13 nt, Homo sapiens
uaaucaucuucuc

SEQ ID NO: 447196 - RNA, 21 nt, Homo sapiens
uaaucauuucugauauuugcu

SEQ ID NO: 447197 - RNA, 13 nt, Homo sapiens
uaauccacgcuca

SEQ ID NO: 447198 - RNA, 18 nt, Homo sapiens
uaauccaggacagcauua

SEQ ID NO: 447199 - RNA, 13 nt, Homo sapiens
uaaucccagcacu

SEQ ID NO: 447200 - RNA, 14 nt, Homo sapiens
uaaucuaugaauuc

SEQ ID NO: 447201 - RNA, 15 nt, Homo sapiens
uaaugaaaaugucag

SEQ ID NO: 447202 - RNA, 15 nt, Homo sapiens
uaaugaacugugaca

SEQ ID NO: 447203 - RNA, 13 nt, Homo sapiens
uaaugaaugacau

SEQ ID NO: 447204 - RNA, 18 nt, Homo sapiens
uaaugacguauugugaaa

SEQ ID NO: 447205 - RNA, 21 nt, Homo sapiens
uaaugagaggcacacugcuaa

SEQ ID NO: 447206 - RNA, 19 nt, Homo sapiens
uaaugaguuuuacauuaca

SEQ ID NO: 447207 - RNA, 13 nt, Homo sapiens
uaaugcuguguuu

SEQ ID NO: 447208 - RNA, 15 nt, Homo sapiens
uaaugcuuuuacuaa

SEQ ID NO: 447209 - RNA, 16 nt, Homo sapiens
uaauggcuaguacugu

SEQ ID NO: 447210 - RNA, 14 nt, Homo sapiens
uaauguacaucugg

SEQ ID NO: 447211 - RNA, 13 nt, Homo sapiens
uaaugucaucucu

SEQ ID NO: 447212 - RNA, 11 nt, Homo sapiens
uaaugugaagg

SEQ ID NO: 447213 - RNA, 22 nt, Homo sapiens
uaauguguauuuacuguacuaa

SEQ ID NO: 447214 - RNA, 18 nt, Homo sapiens
uaauguguuaagugcagg

SEQ ID NO: 447215 - RNA, 15 nt, Homo sapiens
uaauguuaauucagc

SEQ ID NO: 447216 - RNA, 12 nt, Homo sapiens
uaauguugcuuu

SEQ ID NO: 447217 - RNA, 15 nt, Homo sapiens
uaauguugugguuug

SEQ ID NO: 447218 - RNA, 22 nt, Homo sapiens
uaauuaaaaaaaaaacuucauu

SEQ ID NO: 447219 - RNA, 15 nt, Homo sapiens
uaauuacaacagcac

SEQ ID NO: 447220 - RNA, 19 nt, Homo sapiens
uaauuaggguccacgccca

SEQ ID NO: 447221 - RNA, 22 nt, Homo sapiens
uaauuauaagcuaugucacuac

SEQ ID NO: 447222 - RNA, 19 nt, Homo sapiens
uaauuccaauuauaugaga

SEQ ID NO: 447223 - RNA, 15 nt, Homo sapiens
uaauucuacccugaa

SEQ ID NO: 447224 - RNA, 22 nt, Homo sapiens
uaauucucccgcauugguggcu

SEQ ID NO: 447225 - RNA, 14 nt, Homo sapiens
uaauucucuuucaa

SEQ ID NO: 447226 - RNA, 21 nt, Homo sapiens
uaauucuuaccucauuugcau

SEQ ID NO: 447227 - RNA, 19 nt, Homo sapiens
uaauucuuaggguacucau

SEQ ID NO: 447228 - RNA, 20 nt, Homo sapiens
uaauucuuauuuaaguuauu

SEQ ID NO: 447229 - RNA, 20 nt, Homo sapiens
uaauugccuuugagguuauu

SEQ ID NO: 447230 - RNA, 12 nt, Homo sapiens
uaauuguguaca

SEQ ID NO: 447231 - RNA, 19 nt, Homo sapiens
uaauuguuacaauuuucua

SEQ ID NO: 447232 - RNA, 17 nt, Homo sapiens
uaauuuacaagcacgau

SEQ ID NO: 447233 - RNA, 23 nt, Homo sapiens
uaauuuagagauaagccaugcau

SEQ ID NO: 447234 - RNA, 18 nt, Homo sapiens
uaauuuaucagauugcuu

SEQ ID NO: 447235 - RNA, 13 nt, Homo sapiens
uaauuugcugcug

SEQ ID NO: 447236 - RNA, 18 nt, Homo sapiens
uaauuuuuagauauucau

SEQ ID NO: 447237 - RNA, 19 nt, Homo sapiens
uaauuuuuccuauauugca

SEQ ID NO: 447238 - RNA, 17 nt, Homo sapiens
uacaaaaauuagcugug

SEQ ID NO: 447239 - RNA, 15 nt, Homo sapiens
uacaaaauccagcua

SEQ ID NO: 447240 - RNA, 20 nt, Homo sapiens
uacaaaauccagcuaugaau

SEQ ID NO: 447241 - RNA, 18 nt, Homo sapiens
uacaaaguagagaaguau

SEQ ID NO: 447242 - RNA, 23 nt, Homo sapiens
uacaaaugucuucaugaccuacu

SEQ ID NO: 447243 - RNA, 21 nt, Homo sapiens
uacaaauuuucacugcugcuc

SEQ ID NO: 447244 - RNA, 11 nt, Homo sapiens
uacaaccagag

SEQ ID NO: 447245 - RNA, 21 nt, Homo sapiens
uacaacugaguccuuaaacag

SEQ ID NO: 447246 - RNA, 16 nt, Homo sapiens
uacaacuucagcagua

SEQ ID NO: 447247 - RNA, 17 nt, Homo sapiens
uacaaguaaagcuagac

SEQ ID NO: 447248 - RNA, 16 nt, Homo sapiens
uacaaguaauuuugca

SEQ ID NO: 447249 - RNA, 16 nt, Homo sapiens
uacaaguugugcaugc

SEQ ID NO: 447250 - RNA, 22 nt, Homo sapiens
uacaaguuuauguggcacacaa

SEQ ID NO: 447251 - RNA, 13 nt, Homo sapiens
uacaaguuucaga

SEQ ID NO: 447252 - RNA, 21 nt, Homo sapiens
uacaauaaaacuuugcugcca

SEQ ID NO: 447253 - RNA, 23 nt, Homo sapiens
uacaauaggugcuuauucucaaa

SEQ ID NO: 447254 - RNA, 20 nt, Homo sapiens
uacaaucagccacauucuag

SEQ ID NO: 447255 - RNA, 15 nt, Homo sapiens
uacaaucagcugcuu

SEQ ID NO: 447256 - RNA, 16 nt, Homo sapiens
uacaaucagcugcuuu

SEQ ID NO: 447257 - RNA, 22 nt, Homo sapiens
uacaaugauaggaaaaauccau

SEQ ID NO: 447258 - RNA, 12 nt, Homo sapiens
uacaauguauca

SEQ ID NO: 447259 - RNA, 19 nt, Homo sapiens
uacaauuguaaaacugagg

SEQ ID NO: 447260 - RNA, 13 nt, Homo sapiens
uacaauugucauu

SEQ ID NO: 447261 - RNA, 13 nt, Homo sapiens
uacaauugugagc

SEQ ID NO: 447262 - RNA, 14 nt, Homo sapiens
uacaauuugcccaa

SEQ ID NO: 447263 - RNA, 14 nt, Homo sapiens
uacacaagacuuuc

SEQ ID NO: 447264 - RNA, 21 nt, Homo sapiens
uacacacucauacgugugugu

SEQ ID NO: 447265 - RNA, 23 nt, Homo sapiens
uacaccauaguuuacaauauuau

SEQ ID NO: 447266 - RNA, 14 nt, Homo sapiens
uacacccaccagag

SEQ ID NO: 447267 - RNA, 13 nt, Homo sapiens
uacacccaugcac

SEQ ID NO: 447268 - RNA, 18 nt, Homo sapiens
uacacccuuucuugacaa

SEQ ID NO: 447269 - RNA, 13 nt, Homo sapiens
uacaccugaguca

SEQ ID NO: 447270 - RNA, 21 nt, Homo sapiens
uacacguuggaguauaccuau

SEQ ID NO: 447271 - RNA, 21 nt, Homo sapiens
uacacuaaaaccacaugugca

SEQ ID NO: 447272 - RNA, 16 nt, Homo sapiens
uacacucuagugccau

SEQ ID NO: 447273 - RNA, 17 nt, Homo sapiens
uacacucuagugccaua

SEQ ID NO: 447274 - RNA, 15 nt, Homo sapiens
uacacuguauuacau

SEQ ID NO: 447275 - RNA, 22 nt, Homo sapiens
uaguacuauuauggaauuacuc

SEQ ID NO: 447276 - RNA, 14 nt, Homo sapiens
uaguacuauugcua

SEQ ID NO: 447277 - RNA, 18 nt, Homo sapiens
uaguagcagagucauugu

SEQ ID NO: 447278 - RNA, 22 nt, Homo sapiens
uagucaacugcuguuuuauguc

SEQ ID NO: 447279 - RNA, 20 nt, Homo sapiens
uagucauaugugaagacaga

SEQ ID NO: 447280 - RNA, 22 nt, Homo sapiens
uagucccauugauguacuuuac

SEQ ID NO: 447281 - RNA, 15 nt, Homo sapiens
uaguccuccaaaaca

SEQ ID NO: 447282 - RNA, 18 nt, Homo sapiens
uaguccugauguacuuua

SEQ ID NO: 447283 - RNA, 19 nt, Homo sapiens
uaguccugauguacuuuaa

SEQ ID NO: 447284 - RNA, 18 nt, Homo sapiens
uagugaaaggucaucuca

SEQ ID NO: 447285 - RNA, 19 nt, Homo sapiens
uagugaacagguucuccag

SEQ ID NO: 447286 - RNA, 21 nt, Homo sapiens
uagugacuugugucccaugau

SEQ ID NO: 447287 - RNA, 19 nt, Homo sapiens
uagugagaaacugauuuau

SEQ ID NO: 447288 - RNA, 16 nt, Homo sapiens
uagugcagaaucucau

SEQ ID NO: 447289 - RNA, 20 nt, Homo sapiens
uagugcauuaguggggagga

SEQ ID NO: 447290 - RNA, 20 nt, Homo sapiens
uagugcuuuaccuuuauuaa

SEQ ID NO: 447291 - RNA, 21 nt, Homo sapiens
uaguguauuuucugucacugu

SEQ ID NO: 447292 - RNA, 12 nt, Homo sapiens
uagugucacuua

SEQ ID NO: 447293 - RNA, 14 nt, Homo sapiens
uaguuagaaagggu

SEQ ID NO: 447294 - RNA, 14 nt, Homo sapiens
uaguucuauuucua

SEQ ID NO: 447295 - RNA, 14 nt, Homo sapiens
uaguugaacaagau

SEQ ID NO: 447296 - RNA, 18 nt, Homo sapiens
uaguugauuacuuuucag

SEQ ID NO: 447297 - RNA, 11 nt, Homo sapiens
uaguugcaaag

SEQ ID NO: 447298 - RNA, 21 nt, Homo sapiens
uaguugucacuuuccucuucc

SEQ ID NO: 447299 - RNA, 19 nt, Homo sapiens
uaguuuaggagaaaccagc

SEQ ID NO: 447300 - RNA, 22 nt, Homo sapiens
uaguuuguaugccaagugagaa

SEQ ID NO: 447301 - RNA, 16 nt, Homo sapiens
uaguuuuacacucuag

SEQ ID NO: 447302 - RNA, 20 nt, Homo sapiens
uaguuuugucaaacuguaga

SEQ ID NO: 447303 - RNA, 18 nt, Homo sapiens
uaguuuuuaaaaaggccu

SEQ ID NO: 447304 - RNA, 22 nt, Homo sapiens
uaguuuuuaccuaccacagugu

SEQ ID NO: 447305 - RNA, 13 nt, Homo sapiens
uauaaaaucuuuc

SEQ ID NO: 447306 - RNA, 12 nt, Homo sapiens
uauaaacacaua

SEQ ID NO: 447307 - RNA, 16 nt, Homo sapiens
uauaaaucaaugucac

SEQ ID NO: 447308 - RNA, 15 nt, Homo sapiens
uauaaaucagccuaa

SEQ ID NO: 447309 - RNA, 19 nt, Homo sapiens
uauaaaugagcaaauggaa

SEQ ID NO: 447310 - RNA, 18 nt, Homo sapiens
uauaaauguguggugcua

SEQ ID NO: 447311 - RNA, 13 nt, Homo sapiens
uauaaauguuugu

SEQ ID NO: 447312 - RNA, 18 nt, Homo sapiens
uauaaccccagccugacc

SEQ ID NO: 447313 - RNA, 22 nt, Homo sapiens
uauaacuuuugguaucuacuuc

SEQ ID NO: 447314 - RNA, 13 nt, Homo sapiens
uauaagacuacua

SEQ ID NO: 447315 - RNA, 22 nt, Homo sapiens
uauaagcccacuguuaauauuc

SEQ ID NO: 447316 - RNA, 15 nt, Homo sapiens
uauaauaugucuuca

SEQ ID NO: 447317 - RNA, 19 nt, Homo sapiens
uauaaugaacacgugggua

SEQ ID NO: 447318 - RNA, 15 nt, Homo sapiens
uauaaugguuuacug

SEQ ID NO: 447319 - RNA, 19 nt, Homo sapiens
uauaauuccgaaacauaca

SEQ ID NO: 447320 - RNA, 15 nt, Homo sapiens
uauaauuucuguuca

SEQ ID NO: 447321 - RNA, 19 nt, Homo sapiens
uauaauuuuaaaauugcag

SEQ ID NO: 447322 - RNA, 23 nt, Homo sapiens
uauacacuuacacuuuaugcaca

SEQ ID NO: 447323 - RNA, 19 nt, Homo sapiens
uauacagaccuaauaucau

SEQ ID NO: 447324 - RNA, 17 nt, Homo sapiens
uauacauguauagugag

SEQ ID NO: 447325 - RNA, 11 nt, Homo sapiens
uauacauuccu

SEQ ID NO: 447326 - RNA, 12 nt, Homo sapiens
uauacauuugau

SEQ ID NO: 447327 - RNA, 19 nt, Homo sapiens
uauacuguagcugaugaaa

SEQ ID NO: 447328 - RNA, 19 nt, Homo sapiens
uauacuguuauuucacuuu

SEQ ID NO: 447329 - RNA, 18 nt, Homo sapiens
uauacuucaaaagccaua

SEQ ID NO: 447330 - RNA, 14 nt, Homo sapiens
uauagacucuagga

SEQ ID NO: 447331 - RNA, 21 nt, Homo sapiens
uauagagucaaccaccacaga

SEQ ID NO: 447332 - RNA, 17 nt, Homo sapiens
uauagcggggccuuguc

SEQ ID NO: 447333 - RNA, 14 nt, Homo sapiens
uauauaaauaaagc

SEQ ID NO: 447334 - RNA, 20 nt, Homo sapiens
uauauaauaaagcuacugau

SEQ ID NO: 447335 - RNA, 12 nt, Homo sapiens
uauauacauuuc

SEQ ID NO: 447336 - RNA, 22 nt, Homo sapiens
uauauaccuggcuuuuacuuua

SEQ ID NO: 447337 - RNA, 12 nt, Homo sapiens
uauauacuaaua

SEQ ID NO: 447338 - RNA, 11 nt, Homo sapiens
uauauacuguu

SEQ ID NO: 447339 - RNA, 20 nt, Homo sapiens
uauauagcucuacacaacau

SEQ ID NO: 447340 - RNA, 22 nt, Homo sapiens
uauauagcucuacacaacaugu

SEQ ID NO: 447341 - RNA, 17 nt, Homo sapiens
uauauaguagcauuuca

SEQ ID NO: 447342 - RNA, 15 nt, Homo sapiens
uauauaucaaggaug

SEQ ID NO: 447343 - RNA, 22 nt, Homo sapiens
uauauaugcuuggcuaacuaua

SEQ ID NO: 447344 - RNA, 13 nt, Homo sapiens
uauauauuuacau

SEQ ID NO: 447345 - RNA, 16 nt, Homo sapiens
uauaucugaagagcua

SEQ ID NO: 447346 - RNA, 22 nt, Homo sapiens
uauaucuguaaauuuaacugca

SEQ ID NO: 447347 - RNA, 23 nt, Homo sapiens
uauauggggggagugagcucucu

SEQ ID NO: 447348 - RNA, 15 nt, Homo sapiens
uauauggggggccaa

SEQ ID NO: 447349 - RNA, 16 nt, Homo sapiens
uauauguacaguuaua

SEQ ID NO: 447350 - RNA, 16 nt, Homo sapiens
uauauguuuggcugaa

SEQ ID NO: 447351 - RNA, 16 nt, Homo sapiens
uauauucaggaguugg

SEQ ID NO: 447352 - RNA, 15 nt, Homo sapiens
uauauucuuacccua

SEQ ID NO: 447353 - RNA, 15 nt, Homo sapiens
uauauugcugcuggu

SEQ ID NO: 447354 - RNA, 15 nt, Homo sapiens
uauauuuuauacugc

SEQ ID NO: 447355 - RNA, 23 nt, Homo sapiens
uauauuuuaucuugguaguacau

SEQ ID NO: 447356 - RNA, 21 nt, Homo sapiens
uauauuuucugaguagcauau

SEQ ID NO: 447357 - RNA, 14 nt, Homo sapiens
uaucaaaucauuca

SEQ ID NO: 447358 - RNA, 15 nt, Homo sapiens
uaucaaaucauucaa

SEQ ID NO: 447359 - RNA, 13 nt, Homo sapiens
uaucaacuguuga

SEQ ID NO: 447360 - RNA, 23 nt, Homo sapiens
uaucaacuuaauucuguuacaca

SEQ ID NO: 447361 - RNA, 12 nt, Homo sapiens
uaucaacuuuag

SEQ ID NO: 447362 - RNA, 15 nt, Homo sapiens
uaucagaguauguca

SEQ ID NO: 447363 - RNA, 22 nt, Homo sapiens
uaucagcagacacuccaguuug

SEQ ID NO: 447364 - RNA, 17 nt, Homo sapiens
uaucaguagaaacucua

SEQ ID NO: 447365 - RNA, 16 nt, Homo sapiens
uaucauggcauauaac

SEQ ID NO: 447366 - RNA, 15 nt, Homo sapiens
uaucauuaaccuuau

SEQ ID NO: 447367 - RNA, 14 nt, Homo sapiens
uaucauucagcaac

SEQ ID NO: 447368 - RNA, 13 nt, Homo sapiens
uaucauugcuaaa

SEQ ID NO: 447369 - RNA, 15 nt, Homo sapiens
uauccaaaccaaaua

SEQ ID NO: 447370 - RNA, 17 nt, Homo sapiens
uauccaaagacuguacu

SEQ ID NO: 447371 - RNA, 19 nt, Homo sapiens
uauccaauuaugugacaac

SEQ ID NO: 447372 - RNA, 18 nt, Homo sapiens
uauccacuacauucugaa

SEQ ID NO: 447373 - RNA, 18 nt, Homo sapiens
uauccagaugaacugaga

SEQ ID NO: 447374 - RNA, 19 nt, Homo sapiens
uauccagaugaacugagaa

SEQ ID NO: 447375 - RNA, 21 nt, Homo sapiens
uauccauuuaaacuaaccuuu

SEQ ID NO: 447376 - RNA, 15 nt, Homo sapiens
uaucccagaccccuc

SEQ ID NO: 447377 - RNA, 16 nt, Homo sapiens
uauccuaguuccauuc

SEQ ID NO: 447378 - RNA, 15 nt, Homo sapiens
uauccucgcugguga

SEQ ID NO: 447379 - RNA, 22 nt, Homo sapiens
uauccuggugucuaguuugcau

SEQ ID NO: 447380 - RNA, 20 nt, Homo sapiens
uauccuguuacugaauuugc

SEQ ID NO: 447381 - RNA, 19 nt, Homo sapiens
uauccuuggcaccaaagau

SEQ ID NO: 447382 - RNA, 15 nt, Homo sapiens
uaucgcugggcucaa

SEQ ID NO: 447383 - RNA, 17 nt, Homo sapiens
uaucgggagcagugucu

SEQ ID NO: 447384 - RNA, 15 nt, Homo sapiens
uaucuacuucuacau

SEQ ID NO: 447385 - RNA, 15 nt, Homo sapiens
uaucuauauccauaa

SEQ ID NO: 447386 - RNA, 23 nt, Homo sapiens
uaucuauuugagauugaugacaa

SEQ ID NO: 447387 - RNA, 13 nt, Homo sapiens
uaucucagcauuu

SEQ ID NO: 447388 - RNA, 16 nt, Homo sapiens
uaucucggaccuuuca

SEQ ID NO: 447389 - RNA, 20 nt, Homo sapiens
uaucuggggaaaucaaaaca

SEQ ID NO: 447390 - RNA, 17 nt, Homo sapiens
uaucuguuaaccaaaua

SEQ ID NO: 447391 - RNA, 11 nt, Homo sapiens
uaucuuaccug

SEQ ID NO: 447392 - RNA, 17 nt, Homo sapiens
uaucuucaaacuuucac

SEQ ID NO: 447393 - RNA, 22 nt, Homo sapiens
uaucuuuaaagacuugaugaau

SEQ ID NO: 447394 - RNA, 17 nt, Homo sapiens
uaucuuuuggcucugaa

SEQ ID NO: 447395 - RNA, 14 nt, Homo sapiens
uaugaacaugcagu

SEQ ID NO: 447396 - RNA, 19 nt, Homo sapiens
uaugaaccgcaauauggga

SEQ ID NO: 447397 - RNA, 14 nt, Homo sapiens
uaugaacuugagga

SEQ ID NO: 447398 - RNA, 20 nt, Homo sapiens
uaugaagaaagauacuaaua

SEQ ID NO: 447399 - RNA, 13 nt, Homo sapiens
uaugaaguacuuu

SEQ ID NO: 447400 - RNA, 22 nt, Homo sapiens
uaugaauauuuauaacagcauu

SEQ ID NO: 447401 - RNA, 13 nt, Homo sapiens
uaugaaugcagug

SEQ ID NO: 447402 - RNA, 23 nt, Homo sapiens
uaugaccauaaaauuagacauac

SEQ ID NO: 447403 - RNA, 17 nt, Homo sapiens
uaugaccuaaauccauu

SEQ ID NO: 447404 - RNA, 22 nt, Homo sapiens
uaugacuaaagagagaauguag

SEQ ID NO: 447405 - RNA, 13 nt, Homo sapiens
ucauagccaaaaa

SEQ ID NO: 447406 - RNA, 19 nt, Homo sapiens
ucauaggagacccaugugc

SEQ ID NO: 447407 - RNA, 17 nt, Homo sapiens
ucauaggcugacaccaa

SEQ ID NO: 447408 - RNA, 20 nt, Homo sapiens
ucauauaccagcaauauauc

SEQ ID NO: 447409 - RNA, 12 nt, Homo sapiens
ucauaugcagaa

SEQ ID NO: 447410 - RNA, 15 nt, Homo sapiens
ucauauguugcucag

SEQ ID NO: 447411 - RNA, 16 nt, Homo sapiens
ucauauuucauuucca

SEQ ID NO: 447412 - RNA, 20 nt, Homo sapiens
ucauauuuuguauauaucug

SEQ ID NO: 447413 - RNA, 15 nt, Homo sapiens
ucaucaacaauuuga

SEQ ID NO: 447414 - RNA, 16 nt, Homo sapiens
ucaucaccagacuuug

SEQ ID NO: 447415 - RNA, 20 nt, Homo sapiens
ucaucaggcuuggaaugaau

SEQ ID NO: 447416 - RNA, 23 nt, Homo sapiens
ucaucagggggcaugaagcacau

SEQ ID NO: 447417 - RNA, 21 nt, Homo sapiens
ucaucauaaaauaaaguauau

SEQ ID NO: 447418 - RNA, 18 nt, Homo sapiens
ucauccccucccagaugu

SEQ ID NO: 447419 - RNA, 23 nt, Homo sapiens
ucauccuguuggcugcugccacc

SEQ ID NO: 447420 - RNA, 14 nt, Homo sapiens
ucaucuagcuccau

SEQ ID NO: 447421 - RNA, 23 nt, Homo sapiens
ucaucuuagugccugagaguauu

SEQ ID NO: 447422 - RNA, 14 nt, Homo sapiens
ucaucuucacugca

SEQ ID NO: 447423 - RNA, 20 nt, Homo sapiens
ucaucuuuuagaguaaacua

SEQ ID NO: 447424 - RNA, 20 nt, Homo sapiens
ucaugacugagucuggcaaa

SEQ ID NO: 447425 - RNA, 16 nt, Homo sapiens
ucaugagcacuuugua

SEQ ID NO: 447426 - RNA, 11 nt, Homo sapiens
ucaugauuuca

SEQ ID NO: 447427 - RNA, 23 nt, Homo sapiens
ucaugauuucaaugauuguuuaa

SEQ ID NO: 447428 - RNA, 16 nt, Homo sapiens
ucaugcaauccuucca

SEQ ID NO: 447429 - RNA, 18 nt, Homo sapiens
ucaugccagcagcacguc

SEQ ID NO: 447430 - RNA, 23 nt, Homo sapiens
ucaugcccugccuugucccucuc

SEQ ID NO: 447431 - RNA, 14 nt, Homo sapiens
ucaugcucucuaua

SEQ ID NO: 447432 - RNA, 20 nt, Homo sapiens
ucaugcugcuuagaugacau

SEQ ID NO: 447433 - RNA, 20 nt, Homo sapiens
ucauggacuccaggauccuc

SEQ ID NO: 447434 - RNA, 15 nt, Homo sapiens
ucauggagaagacuu

SEQ ID NO: 447435 - RNA, 19 nt, Homo sapiens
ucauggauucauuacagcu

SEQ ID NO: 447436 - RNA, 15 nt, Homo sapiens
ucauggccaccucca

SEQ ID NO: 447437 - RNA, 18 nt, Homo sapiens
ucaugguggguucagggg

SEQ ID NO: 447438 - RNA, 13 nt, Homo sapiens
ucauguaaccaag

SEQ ID NO: 447439 - RNA, 14 nt, Homo sapiens
ucauguaagggaag

SEQ ID NO: 447440 - RNA, 14 nt, Homo sapiens
ucauguaccaucaa

SEQ ID NO: 447441 - RNA, 20 nt, Homo sapiens
ucauguagaacucagcaguu

SEQ ID NO: 447442 - RNA, 16 nt, Homo sapiens
ucauguagguugucua

SEQ ID NO: 447443 - RNA, 18 nt, Homo sapiens
ucaugucuaauugcuuaa

SEQ ID NO: 447444 - RNA, 23 nt, Homo sapiens
ucaugucuauaaucccagcacuu

SEQ ID NO: 447445 - RNA, 16 nt, Homo sapiens
ucauguuggauaguca

SEQ ID NO: 447446 - RNA, 17 nt, Homo sapiens
ucauuauuggaauuaac

SEQ ID NO: 447447 - RNA, 20 nt, Homo sapiens
ucauuauuucaucaugacug

SEQ ID NO: 447448 - RNA, 23 nt, Homo sapiens
ucauucaacucuccaauguucua

SEQ ID NO: 447449 - RNA, 16 nt, Homo sapiens
ucauucacaacuauga

SEQ ID NO: 447450 - RNA, 14 nt, Homo sapiens
ucauucauucacuc

SEQ ID NO: 447451 - RNA, 13 nt, Homo sapiens
ucauuccaccuuc

SEQ ID NO: 447452 - RNA, 21 nt, Homo sapiens
ucauuccugaaagaaacaguu

SEQ ID NO: 447453 - RNA, 15 nt, Homo sapiens
ucauucuaaaccaaa

SEQ ID NO: 447454 - RNA, 21 nt, Homo sapiens
ucauucuacugaacaguccau

SEQ ID NO: 447455 - RNA, 11 nt, Homo sapiens
ucauucuugcc

SEQ ID NO: 447456 - RNA, 22 nt, Homo sapiens
ucauugaaggguguucacccau

SEQ ID NO: 447457 - RNA, 19 nt, Homo sapiens
ucauugcccgaaaccagag

SEQ ID NO: 447458 - RNA, 17 nt, Homo sapiens
ucauugcuuugaagcag

SEQ ID NO: 447459 - RNA, 22 nt, Homo sapiens
ucauuggaccuguucaaaaagg

SEQ ID NO: 447460 - RNA, 22 nt, Homo sapiens
ucauuguaaacaaacuguguaa

SEQ ID NO: 447461 - RNA, 14 nt, Homo sapiens
ucauugucugugga

SEQ ID NO: 447462 - RNA, 17 nt, Homo sapiens
ucauuuauaaaaccauc

SEQ ID NO: 447463 - RNA, 20 nt, Homo sapiens
ucauuuauuuacaugugauu

SEQ ID NO: 447464 - RNA, 16 nt, Homo sapiens
ucauuucuacuuugac

SEQ ID NO: 447465 - RNA, 17 nt, Homo sapiens
ucauuucuuucaagaca

SEQ ID NO: 447466 - RNA, 14 nt, Homo sapiens
ucauuugaugcuaa

SEQ ID NO: 447467 - RNA, 15 nt, Homo sapiens
ucauuugcauccuau

SEQ ID NO: 447468 - RNA, 16 nt, Homo sapiens
ucauuugugugcucau

SEQ ID NO: 447469 - RNA, 13 nt, Homo sapiens
ucauuuucaccuc

SEQ ID NO: 447470 - RNA, 23 nt, Homo sapiens
ucauuuuugcuuuucaaaugaca

SEQ ID NO: 447471 - RNA, 17 nt, Homo sapiens
ucauuuuuuucacugga

SEQ ID NO: 447472 - RNA, 15 nt, Homo sapiens
uccaaaagcaaacaa

SEQ ID NO: 447473 - RNA, 13 nt, Homo sapiens
uccaaaagcacuu

SEQ ID NO: 447474 - RNA, 14 nt, Homo sapiens
uccaaaagcacuua

SEQ ID NO: 447475 - RNA, 22 nt, Homo sapiens
uccaaaagcacuuacggauucu

SEQ ID NO: 447476 - RNA, 23 nt, Homo sapiens
uccaaacauguaucucuaaugaa

SEQ ID NO: 447477 - RNA, 14 nt, Homo sapiens
uccaaagacuguac

SEQ ID NO: 447478 - RNA, 15 nt, Homo sapiens
uccaaagcauugcag

SEQ ID NO: 447479 - RNA, 19 nt, Homo sapiens
uccaaagguuucaacugua

SEQ ID NO: 447480 - RNA, 19 nt, Homo sapiens
uccaaaugauuuucaucaa

SEQ ID NO: 447481 - RNA, 19 nt, Homo sapiens
uccaacaguuaaacuugca

SEQ ID NO: 447482 - RNA, 14 nt, Homo sapiens
uccaacaguuugau

SEQ ID NO: 447483 - RNA, 17 nt, Homo sapiens
uccaacuccugaccuca

SEQ ID NO: 447484 - RNA, 19 nt, Homo sapiens
uccaacuccugaccucagg

SEQ ID NO: 447485 - RNA, 18 nt, Homo sapiens
uccaacucugacuguaaa

SEQ ID NO: 447486 - RNA, 21 nt, Homo sapiens
uccaacugcugccccaaagga

SEQ ID NO: 447487 - RNA, 17 nt, Homo sapiens
uccaacuguacuuuuaa

SEQ ID NO: 447488 - RNA, 16 nt, Homo sapiens
uccaacuuuucaucca

SEQ ID NO: 447489 - RNA, 16 nt, Homo sapiens
uccaagaauacagaaa

SEQ ID NO: 447490 - RNA, 12 nt, Homo sapiens
uccaagcccuuu

SEQ ID NO: 447491 - RNA, 19 nt, Homo sapiens
uccaagcugcucauuucac

SEQ ID NO: 447492 - RNA, 15 nt, Homo sapiens
uccaaggcaaauguc

SEQ ID NO: 447493 - RNA, 15 nt, Homo sapiens
uccaaguauuuugcc

SEQ ID NO: 447494 - RNA, 12 nt, Homo sapiens
uccaagucuuca

SEQ ID NO: 447495 - RNA, 22 nt, Homo sapiens
uccaagucuuccugaccaccuu

SEQ ID NO: 447496 - RNA, 16 nt, Homo sapiens
uccaaucuccaucacc

SEQ ID NO: 447497 - RNA, 13 nt, Homo sapiens
uccaaugugacua

SEQ ID NO: 447498 - RNA, 22 nt, Homo sapiens
uccaauuaugugacaaccuuug

SEQ ID NO: 447499 - RNA, 18 nt, Homo sapiens
uccacaaauguccucaga

SEQ ID NO: 447500 - RNA, 14 nt, Homo sapiens
uccacacgccaagc

SEQ ID NO: 447501 - RNA, 19 nt, Homo sapiens
uccacaguuaggccaagaa

SEQ ID NO: 447502 - RNA, 14 nt, Homo sapiens
uccaccaccaccug

SEQ ID NO: 447503 - RNA, 13 nt, Homo sapiens
uccaccagugugc

SEQ ID NO: 447504 - RNA, 15 nt, Homo sapiens
uccacccacucuuca

SEQ ID NO: 447505 - RNA, 21 nt, Homo sapiens
uccacccuuggccugucucau

SEQ ID NO: 447506 - RNA, 16 nt, Homo sapiens
uccaccgucagcugua

SEQ ID NO: 447507 - RNA, 20 nt, Homo sapiens
uccaccuagagcuagaugug

SEQ ID NO: 447508 - RNA, 21 nt, Homo sapiens
uccaccuagagcuagaugugu

SEQ ID NO: 447509 - RNA, 18 nt, Homo sapiens
uccaccugugcugcugca

SEQ ID NO: 447510 - RNA, 16 nt, Homo sapiens
uccaccuuccaaagga

SEQ ID NO: 447511 - RNA, 22 nt, Homo sapiens
uccaccuuuaaacacggggcuu

SEQ ID NO: 447512 - RNA, 17 nt, Homo sapiens
uccacgucaacagaauu

SEQ ID NO: 447513 - RNA, 18 nt, Homo sapiens
uccacguguaugcaagug

SEQ ID NO: 447514 - RNA, 15 nt, Homo sapiens
uccacucacuccagc

SEQ ID NO: 447515 - RNA, 12 nt, Homo sapiens
uccacucagcuu

SEQ ID NO: 447516 - RNA, 21 nt, Homo sapiens
uccacuccagauuuuuuacag

SEQ ID NO: 447517 - RNA, 17 nt, Homo sapiens
uccacucggagugcccu

SEQ ID NO: 447518 - RNA, 14 nt, Homo sapiens
uccacucugagucg

SEQ ID NO: 447519 - RNA, 11 nt, Homo sapiens
uccacugccuc

SEQ ID NO: 447520 - RNA, 18 nt, Homo sapiens
uccacugucuauguacaa

SEQ ID NO: 447521 - RNA, 22 nt, Homo sapiens
uccagaaaauaggguggacaga

SEQ ID NO: 447522 - RNA, 18 nt, Homo sapiens
uccagaacguagugagcc

SEQ ID NO: 447523 - RNA, 18 nt, Homo sapiens
uccagaaggccacaggcc

SEQ ID NO: 447524 - RNA, 23 nt, Homo sapiens
uccagaccaaaauaauacaacaa

SEQ ID NO: 447525 - RNA, 19 nt, Homo sapiens
uccagacgucaaccaggaa

SEQ ID NO: 447526 - RNA, 12 nt, Homo sapiens
uccagacuguaa

SEQ ID NO: 447527 - RNA, 14 nt, Homo sapiens
uccagagaaaagag

SEQ ID NO: 447528 - RNA, 14 nt, Homo sapiens
uccagagagaagca

SEQ ID NO: 447529 - RNA, 15 nt, Homo sapiens
uccagagaguggcuc

SEQ ID NO: 447530 - RNA, 19 nt, Homo sapiens
uccagauccuucaaagagu

SEQ ID NO: 447531 - RNA, 12 nt, Homo sapiens
uccagauggcaa

SEQ ID NO: 447532 - RNA, 13 nt, Homo sapiens
uccagcagcugcg

SEQ ID NO: 447533 - RNA, 15 nt, Homo sapiens
uccagcaggcagcug

SEQ ID NO: 447534 - RNA, 12 nt, Homo sapiens
uccagcaugugu

SEQ ID NO: 447535 - RNA, 16 nt, Homo sapiens
uccagccaacauuuaa

SEQ ID NO: 447536 - RNA, 15 nt, Homo sapiens
ucucacccacuagga

SEQ ID NO: 447537 - RNA, 11 nt, Homo sapiens
ucucacugugu

SEQ ID NO: 447538 - RNA, 11 nt, Homo sapiens
ucucacuuugg

SEQ ID NO: 447539 - RNA, 19 nt, Homo sapiens
ucucagacccuuuagccaa

SEQ ID NO: 447540 - RNA, 17 nt, Homo sapiens
ucucagagucauugaag

SEQ ID NO: 447541 - RNA, 16 nt, Homo sapiens
ucucagcaaguguaca

SEQ ID NO: 447542 - RNA, 13 nt, Homo sapiens
ucucagcacuugg

SEQ ID NO: 447543 - RNA, 15 nt, Homo sapiens
ucucagccagccucc

SEQ ID NO: 447544 - RNA, 16 nt, Homo sapiens
ucucagccuaccauga

SEQ ID NO: 447545 - RNA, 21 nt, Homo sapiens
ucucagccuaccaugagaaua

SEQ ID NO: 447546 - RNA, 18 nt, Homo sapiens
ucucagcuaccuaagaaa

SEQ ID NO: 447547 - RNA, 9 nt, Homo sapiens
ucucagcuu

SEQ ID NO: 447548 - RNA, 23 nt, Homo sapiens
ucucaggaggagggcgcaugugu

SEQ ID NO: 447549 - RNA, 15 nt, Homo sapiens
ucucagguguugcca

SEQ ID NO: 447550 - RNA, 18 nt, Homo sapiens
ucucagguguugccaaau

SEQ ID NO: 447551 - RNA, 23 nt, Homo sapiens
ucucagucaugcacucacaaaga

SEQ ID NO: 447552 - RNA, 17 nt, Homo sapiens
ucucagugcuagcuuau

SEQ ID NO: 447553 - RNA, 21 nt, Homo sapiens
ucucauaauugucaaaaacca

SEQ ID NO: 447554 - RNA, 17 nt, Homo sapiens
ucucauagguugccaau

SEQ ID NO: 447555 - RNA, 10 nt, Homo sapiens
ucucaucucc

SEQ ID NO: 447556 - RNA, 20 nt, Homo sapiens
ucucauguuugugcauguau

SEQ ID NO: 447557 - RNA, 13 nt, Homo sapiens
ucucauucuugcc

SEQ ID NO: 447558 - RNA, 12 nt, Homo sapiens
ucucauuuggag

SEQ ID NO: 447559 - RNA, 17 nt, Homo sapiens
ucucauuuuguauguau

SEQ ID NO: 447560 - RNA, 22 nt, Homo sapiens
ucuccaaggguggugaccaaug

SEQ ID NO: 447561 - RNA, 18 nt, Homo sapiens
ucuccaaguaaagccacg

SEQ ID NO: 447562 - RNA, 20 nt, Homo sapiens
ucuccaccccucaagccagg

SEQ ID NO: 447563 - RNA, 17 nt, Homo sapiens
ucuccacucacugcauu

SEQ ID NO: 447564 - RNA, 12 nt, Homo sapiens
ucuccacuccau

SEQ ID NO: 447565 - RNA, 24 nt, Homo sapiens
ucuccagccagcaaugauguccag

SEQ ID NO: 447566 - RNA, 13 nt, Homo sapiens
ucuccaucuucca

SEQ ID NO: 447567 - RNA, 18 nt, Homo sapiens
ucuccauggcccugccau

SEQ ID NO: 447568 - RNA, 22 nt, Homo sapiens
ucuccauguuugauguaucuga

SEQ ID NO: 447569 - RNA, 12 nt, Homo sapiens
ucucccaugcac

SEQ ID NO: 447570 - RNA, 21 nt, Homo sapiens
ucuccccacucuaggggucag

SEQ ID NO: 447571 - RNA, 16 nt, Homo sapiens
ucuccccaggccucca

SEQ ID NO: 447572 - RNA, 19 nt, Homo sapiens
ucuccccagugccugccac

SEQ ID NO: 447573 - RNA, 17 nt, Homo sapiens
ucucccuuaauaaacuc

SEQ ID NO: 447574 - RNA, 14 nt, Homo sapiens
ucucccuucauccu

SEQ ID NO: 447575 - RNA, 20 nt, Homo sapiens
ucucccuugauuccacuugu

SEQ ID NO: 447576 - RNA, 20 nt, Homo sapiens
ucuccgucacuccauucuca

SEQ ID NO: 447577 - RNA, 16 nt, Homo sapiens
ucuccugauuauuuau

SEQ ID NO: 447578 - RNA, 18 nt, Homo sapiens
ucuccuguauaaucucuc

SEQ ID NO: 447579 - RNA, 13 nt, Homo sapiens
ucuccuugcccua

SEQ ID NO: 447580 - RNA, 21 nt, Homo sapiens
ucuccuuucucuuaugcuuaa

SEQ ID NO: 447581 - RNA, 17 nt, Homo sapiens
ucuccuuugcacugagg

SEQ ID NO: 447582 - RNA, 18 nt, Homo sapiens
ucuccuuugcacugaggg

SEQ ID NO: 447583 - RNA, 20 nt, Homo sapiens
ucucgaacuccuggccucaa

SEQ ID NO: 447584 - RNA, 12 nt, Homo sapiens
ucucgcuuuguu

SEQ ID NO: 447585 - RNA, 15 nt, Homo sapiens
ucucgguagcugugc

SEQ ID NO: 447586 - RNA, 14 nt, Homo sapiens
ucucuacugaucaa

SEQ ID NO: 447587 - RNA, 13 nt, Homo sapiens
ucucuacugguag

SEQ ID NO: 447588 - RNA, 13 nt, Homo sapiens
ucucuacugucag

SEQ ID NO: 447589 - RNA, 14 nt, Homo sapiens
ucucuacugucagc

SEQ ID NO: 447590 - RNA, 12 nt, Homo sapiens
ucucuaucuuag

SEQ ID NO: 447591 - RNA, 18 nt, Homo sapiens
ucucuauucucugcaauu

SEQ ID NO: 447592 - RNA, 12 nt, Homo sapiens
ucucuccacuga

SEQ ID NO: 447593 - RNA, 16 nt, Homo sapiens
ucucuccccauauaua

SEQ ID NO: 447594 - RNA, 14 nt, Homo sapiens
ucucucccuacccu

SEQ ID NO: 447595 - RNA, 16 nt, Homo sapiens
ucucucuacugaucaa

SEQ ID NO: 447596 - RNA, 12 nt, Homo sapiens
ucucucucaccu

SEQ ID NO: 447597 - RNA, 16 nt, Homo sapiens
ucucucucucuuuuuc

SEQ ID NO: 447598 - RNA, 16 nt, Homo sapiens
ucucugaaccagagaa

SEQ ID NO: 447599 - RNA, 23 nt, Homo sapiens
ucucugaagaugaucauuugccc

SEQ ID NO: 447600 - RNA, 17 nt, Homo sapiens
ucucugaagcauguuuc

SEQ ID NO: 447601 - RNA, 14 nt, Homo sapiens
ucucugagcuuugu

SEQ ID NO: 447602 - RNA, 21 nt, Homo sapiens
ucucugccccguuucuugccc

SEQ ID NO: 447603 - RNA, 17 nt, Homo sapiens
ucucuggaaagggggga

SEQ ID NO: 447604 - RNA, 20 nt, Homo sapiens
ucucuggacuuucuccaaag

SEQ ID NO: 447605 - RNA, 21 nt, Homo sapiens
ucucuuaccgcgagacugaga

SEQ ID NO: 447606 - RNA, 14 nt, Homo sapiens
ucucuucaaucucu

SEQ ID NO: 447607 - RNA, 18 nt, Homo sapiens
ucucuucagaaaacccuu

SEQ ID NO: 447608 - RNA, 15 nt, Homo sapiens
ucucuuccucugcag

SEQ ID NO: 447609 - RNA, 12 nt, Homo sapiens
ucucuucuaaug

SEQ ID NO: 447610 - RNA, 13 nt, Homo sapiens
ucucuucuauccu

SEQ ID NO: 447611 - RNA, 23 nt, Homo sapiens
ucucuugauucauaaugacuuaa

SEQ ID NO: 447612 - RNA, 19 nt, Homo sapiens
ucucuugccgacaagggca

SEQ ID NO: 447613 - RNA, 12 nt, Homo sapiens
ucucuugcuaau

SEQ ID NO: 447614 - RNA, 17 nt, Homo sapiens
ucucuugcuugugggac

SEQ ID NO: 447615 - RNA, 15 nt, Homo sapiens
ucucuuucuuuccaa

SEQ ID NO: 447616 - RNA, 14 nt, Homo sapiens
ucugaaaauuccag

SEQ ID NO: 447617 - RNA, 13 nt, Homo sapiens
ucugaaacacagu

SEQ ID NO: 447618 - RNA, 16 nt, Homo sapiens
ucugaaacugcauaag

SEQ ID NO: 447619 - RNA, 15 nt, Homo sapiens
ucugaaacuucccaa

SEQ ID NO: 447620 - RNA, 15 nt, Homo sapiens
ucugaaccauuacug

SEQ ID NO: 447621 - RNA, 15 nt, Homo sapiens
ucugaacucucaaaa

SEQ ID NO: 447622 - RNA, 14 nt, Homo sapiens
ucugaaggagauuu

SEQ ID NO: 447623 - RNA, 15 nt, Homo sapiens
ucugaaggcugaguc

SEQ ID NO: 447624 - RNA, 18 nt, Homo sapiens
ucugaaugggagccagaa

SEQ ID NO: 447625 - RNA, 12 nt, Homo sapiens
ucugacacugaa

SEQ ID NO: 447626 - RNA, 15 nt, Homo sapiens
ucugacacuuguggu

SEQ ID NO: 447627 - RNA, 19 nt, Homo sapiens
ucugacagcagccugugag

SEQ ID NO: 447628 - RNA, 22 nt, Homo sapiens
ucugacauaaacccaucuguaa

SEQ ID NO: 447629 - RNA, 14 nt, Homo sapiens
ucugacccugaugc

SEQ ID NO: 447630 - RNA, 19 nt, Homo sapiens
ucugaccucaugaguguca

SEQ ID NO: 447631 - RNA, 12 nt, Homo sapiens
ucugacucccaa

SEQ ID NO: 447632 - RNA, 16 nt, Homo sapiens
ucugacucccaaagag

SEQ ID NO: 447633 - RNA, 19 nt, Homo sapiens
ucugacucccaaagagcug

SEQ ID NO: 447634 - RNA, 17 nt, Homo sapiens
ucugagaaggugagaua

SEQ ID NO: 447635 - RNA, 23 nt, Homo sapiens
ucugagagugaaaccaugacugu

SEQ ID NO: 447636 - RNA, 19 nt, Homo sapiens
ucugagcaacugugcagca

SEQ ID NO: 447637 - RNA, 12 nt, Homo sapiens
ucugagccaaag

SEQ ID NO: 447638 - RNA, 22 nt, Homo sapiens
ucugagccaaagagaaugccau

SEQ ID NO: 447639 - RNA, 17 nt, Homo sapiens
ucugaguugagcacugg

SEQ ID NO: 447640 - RNA, 16 nt, Homo sapiens
ucugauucuucaaaga

SEQ ID NO: 447641 - RNA, 21 nt, Homo sapiens
ucugauugguccaacaguuug

SEQ ID NO: 447642 - RNA, 21 nt, Homo sapiens
ucugcaaaggcaccugaaugu

SEQ ID NO: 447643 - RNA, 23 nt, Homo sapiens
ucugcaauaugaauucaagaaag

SEQ ID NO: 447644 - RNA, 19 nt, Homo sapiens
ucugcacaacugacuucca

SEQ ID NO: 447645 - RNA, 16 nt, Homo sapiens
ucugcacuauagccau

SEQ ID NO: 447646 - RNA, 16 nt, Homo sapiens
ucugcagcccacagag

SEQ ID NO: 447647 - RNA, 18 nt, Homo sapiens
ucugcaggccaccagcug

SEQ ID NO: 447648 - RNA, 14 nt, Homo sapiens
ucugcaguggagcc

SEQ ID NO: 447649 - RNA, 23 nt, Homo sapiens
ucugcauaaauauuagcaaagca

SEQ ID NO: 447650 - RNA, 18 nt, Homo sapiens
ucugcaucuuacagucag

SEQ ID NO: 447651 - RNA, 13 nt, Homo sapiens
ucugcaugucuca

SEQ ID NO: 447652 - RNA, 17 nt, Homo sapiens
ucugcauuuagcacaaa

SEQ ID NO: 447653 - RNA, 19 nt, Homo sapiens
ucugcauuuagcacaaaaa

SEQ ID NO: 447654 - RNA, 15 nt, Homo sapiens
ucugccacacucuga

SEQ ID NO: 447655 - RNA, 19 nt, Homo sapiens
ucugccacuugcacugugc

SEQ ID NO: 447656 - RNA, 21 nt, Homo sapiens
ucugccacuugcacugugcuu

SEQ ID NO: 447657 - RNA, 16 nt, Homo sapiens
ucugccccacccucaa

SEQ ID NO: 447658 - RNA, 16 nt, Homo sapiens
ucugccccuccguccc

SEQ ID NO: 447659 - RNA, 14 nt, Homo sapiens
ucugcccugccucc

SEQ ID NO: 447660 - RNA, 15 nt, Homo sapiens
ucugccgguccccca

SEQ ID NO: 447661 - RNA, 13 nt, Homo sapiens
ucugccuccagga

SEQ ID NO: 447662 - RNA, 13 nt, Homo sapiens
ucugccugggcuu

SEQ ID NO: 447663 - RNA, 19 nt, Homo sapiens
ucugccuguuauaacucug

SEQ ID NO: 447664 - RNA, 19 nt, Homo sapiens
ucugcggugaggcagggga

SEQ ID NO: 447665 - RNA, 22 nt, Homo sapiens
ucugcgucccacugagucucau

SEQ ID NO: 447666 - RNA, 12 nt, Homo sapiens
ucugcuagggaa

SEQ ID NO: 447667 - RNA, 12 nt, Homo sapiens
ucugcucugaga

SEQ ID NO: 447668 - RNA, 17 nt, Homo sapiens
uguuuuccugcugguaa

SEQ ID NO: 447669 - RNA, 19 nt, Homo sapiens
uguuuucucagaacagcug

SEQ ID NO: 447670 - RNA, 23 nt, Homo sapiens
uguuuucucuguauaacuuguga

SEQ ID NO: 447671 - RNA, 14 nt, Homo sapiens
uguuuugcacuuuu

SEQ ID NO: 447672 - RNA, 16 nt, Homo sapiens
uguuuugccagugaag

SEQ ID NO: 447673 - RNA, 21 nt, Homo sapiens
uguuuuggaugaaugcaguau

SEQ ID NO: 447674 - RNA, 13 nt, Homo sapiens
uguuuuuaagcug

SEQ ID NO: 447675 - RNA, 14 nt, Homo sapiens
uguuuuuaaguccu

SEQ ID NO: 447676 - RNA, 17 nt, Homo sapiens
uguuuuucuuuaaucaa

SEQ ID NO: 447677 - RNA, 16 nt, Homo sapiens
uguuuuuuuuaagggc

SEQ ID NO: 447678 - RNA, 14 nt, Homo sapiens
uuaaaaaaauaaca

SEQ ID NO: 447679 - RNA, 13 nt, Homo sapiens
uuaaaaaucuuuc

SEQ ID NO: 447680 - RNA, 21 nt, Homo sapiens
uuaaaaauuguuaauuuuucc

SEQ ID NO: 447681 - RNA, 17 nt, Homo sapiens
uuaaaauuugacuccuc

SEQ ID NO: 447682 - RNA, 19 nt, Homo sapiens
uuaaacaaaaacuuuccau

SEQ ID NO: 447683 - RNA, 21 nt, Homo sapiens
uuaaacaaaauagaagcugua

SEQ ID NO: 447684 - RNA, 21 nt, Homo sapiens
uuaaacacggggcuugcaacu

SEQ ID NO: 447685 - RNA, 22 nt, Homo sapiens
uuaaacaguaaaacaaaaauuc

SEQ ID NO: 447686 - RNA, 24 nt, Homo sapiens
uuaaacauuugagagcuaacuaua

SEQ ID NO: 447687 - RNA, 11 nt, Homo sapiens
uuaaacuaaaa

SEQ ID NO: 447688 - RNA, 15 nt, Homo sapiens
uuaaacuacugauug

SEQ ID NO: 447689 - RNA, 18 nt, Homo sapiens
uuaaacuugaugccagug

SEQ ID NO: 447690 - RNA, 20 nt, Homo sapiens
uuaaagaaagucgaauuaau

SEQ ID NO: 447691 - RNA, 16 nt, Homo sapiens
uuaaagguagucaaga

SEQ ID NO: 447692 - RNA, 13 nt, Homo sapiens
uuaaaguaccugu

SEQ ID NO: 447693 - RNA, 17 nt, Homo sapiens
uuaaagucaggauuuau

SEQ ID NO: 447694 - RNA, 18 nt, Homo sapiens
uuaaauaaaguuacuuga

SEQ ID NO: 447695 - RNA, 17 nt, Homo sapiens
uuaaauaaaucauaaaa

SEQ ID NO: 447696 - RNA, 17 nt, Homo sapiens
uuaaauaaaucuuucag

SEQ ID NO: 447697 - RNA, 14 nt, Homo sapiens
uuaaauacuacaaa

SEQ ID NO: 447698 - RNA, 14 nt, Homo sapiens
uuaaaucaaaaggg

SEQ ID NO: 447699 - RNA, 16 nt, Homo sapiens
uuaaaucaaaagggag

SEQ ID NO: 447700 - RNA, 14 nt, Homo sapiens
uuaaaucauuucau

SEQ ID NO: 447701 - RNA, 16 nt, Homo sapiens
uuaaauccuaccaaag

SEQ ID NO: 447702 - RNA, 16 nt, Homo sapiens
uuaaaugaacuugaua

SEQ ID NO: 447703 - RNA, 22 nt, Homo sapiens
uuaaauggaauuuucuaauaua

SEQ ID NO: 447704 - RNA, 19 nt, Homo sapiens
uuaaauuacacaguucaca

SEQ ID NO: 447705 - RNA, 20 nt, Homo sapiens
uuaacaaaucuaaucucuua

SEQ ID NO: 447706 - RNA, 19 nt, Homo sapiens
uuaacaauugccagggaaa

SEQ ID NO: 447707 - RNA, 22 nt, Homo sapiens
uuaacagcgugucaacuuucau

SEQ ID NO: 447708 - RNA, 15 nt, Homo sapiens
uuaacaguuuuccau

SEQ ID NO: 447709 - RNA, 16 nt, Homo sapiens
uuaacaucaucaggcu

SEQ ID NO: 447710 - RNA, 11 nt, Homo sapiens
uuaacaucuca

SEQ ID NO: 447711 - RNA, 13 nt, Homo sapiens
uuaacaucucaga

SEQ ID NO: 447712 - RNA, 15 nt, Homo sapiens
uuaacaugcugugua

SEQ ID NO: 447713 - RNA, 18 nt, Homo sapiens
uuaacauggacaugaucu

SEQ ID NO: 447714 - RNA, 14 nt, Homo sapiens
uuaacauuccucau

SEQ ID NO: 447715 - RNA, 17 nt, Homo sapiens
uuaacauuccucaugaa

SEQ ID NO: 447716 - RNA, 17 nt, Homo sapiens
uuaacauugcaucauga

SEQ ID NO: 447717 - RNA, 21 nt, Homo sapiens
uuaaccaccgcauaugcaugc

SEQ ID NO: 447718 - RNA, 14 nt, Homo sapiens
uuaacccuucacaa

SEQ ID NO: 447719 - RNA, 16 nt, Homo sapiens
uuaaccuacuagacaa

SEQ ID NO: 447720 - RNA, 22 nt, Homo sapiens
uuaacguaacucuuucuaugcc

SEQ ID NO: 447721 - RNA, 20 nt, Homo sapiens
uuaacuaguguuucugcaga

SEQ ID NO: 447722 - RNA, 13 nt, Homo sapiens
uuaacucugcaua

SEQ ID NO: 447723 - RNA, 18 nt, Homo sapiens
uuaacugaggaaugcggu

SEQ ID NO: 447724 - RNA, 21 nt, Homo sapiens
uuaacuuccaauuuacauacu

SEQ ID NO: 447725 - RNA, 19 nt, Homo sapiens
uuaagaaaaacaugucaug

SEQ ID NO: 447726 - RNA, 14 nt, Homo sapiens
uuaagaaacacagg

SEQ ID NO: 447727 - RNA, 17 nt, Homo sapiens
uuaagacagagucucac

SEQ ID NO: 447728 - RNA, 23 nt, Homo sapiens
uuaagauaugugagaacuuuuca

SEQ ID NO: 447729 - RNA, 19 nt, Homo sapiens
uuaagauuuuacaaaagag

SEQ ID NO: 447730 - RNA, 17 nt, Homo sapiens
uuaagcacacuugacau

SEQ ID NO: 447731 - RNA, 20 nt, Homo sapiens
uuaagcacacuugacaucaa

SEQ ID NO: 447732 - RNA, 19 nt, Homo sapiens
uuaagccauaugacaauuu

SEQ ID NO: 447733 - RNA, 16 nt, Homo sapiens
uuaagcgugucuguau

SEQ ID NO: 447734 - RNA, 19 nt, Homo sapiens
uuaagcuccuucaguuuga

SEQ ID NO: 447735 - RNA, 22 nt, Homo sapiens
uuaaguauguuauuuucuguug

SEQ ID NO: 447736 - RNA, 20 nt, Homo sapiens
uuaaguuauugauguuuuaa

SEQ ID NO: 447737 - RNA, 15 nt, Homo sapiens
uuaaguuuaccaaau

SEQ ID NO: 447738 - RNA, 15 nt, Homo sapiens
uuaaguuuaucuuuc

SEQ ID NO: 447739 - RNA, 14 nt, Homo sapiens
uuaauaaacucaca

SEQ ID NO: 447740 - RNA, 19 nt, Homo sapiens
uuaauaaacucacaacucu

SEQ ID NO: 447741 - RNA, 21 nt, Homo sapiens
uuaauaagaaacaugauguga

SEQ ID NO: 447742 - RNA, 13 nt, Homo sapiens
uuaauacaaagaa

SEQ ID NO: 447743 - RNA, 20 nt, Homo sapiens
uuaauacagggcauuuuggu

SEQ ID NO: 447744 - RNA, 14 nt, Homo sapiens
uuaauaguauaucu

SEQ ID NO: 447745 - RNA, 22 nt, Homo sapiens
uuaaucagaaaccccacuucca

SEQ ID NO: 447746 - RNA, 13 nt, Homo sapiens
uuaaucauaucaa

SEQ ID NO: 447747 - RNA, 18 nt, Homo sapiens
uuaaucucuaaaauucua

SEQ ID NO: 447748 - RNA, 17 nt, Homo sapiens
uuaaugaacugugacag

SEQ ID NO: 447749 - RNA, 18 nt, Homo sapiens
uuaauggcucaucaacaa

SEQ ID NO: 447750 - RNA, 23 nt, Homo sapiens
uuaauggguuuuguguacuguaa

SEQ ID NO: 447751 - RNA, 18 nt, Homo sapiens
uuaauguagacauuaucu

SEQ ID NO: 447752 - RNA, 14 nt, Homo sapiens
uuaaugucaucucu

SEQ ID NO: 447753 - RNA, 22 nt, Homo sapiens
uuaauuaagcuccuucaguuug

SEQ ID NO: 447754 - RNA, 17 nt, Homo sapiens
uuaauugaggcuuacag

SEQ ID NO: 447755 - RNA, 22 nt, Homo sapiens
uuaauuugaccagaaaauauga

SEQ ID NO: 447756 - RNA, 12 nt, Homo sapiens
uuacaaacaaag

SEQ ID NO: 447757 - RNA, 13 nt, Homo sapiens
uuacaaacugcaa

SEQ ID NO: 447758 - RNA, 13 nt, Homo sapiens
uuacaacaaacac

SEQ ID NO: 447759 - RNA, 22 nt, Homo sapiens
uuacaaggcaggccuuuccuac

SEQ ID NO: 447760 - RNA, 19 nt, Homo sapiens
uuacaaucagccacauucu

SEQ ID NO: 447761 - RNA, 19 nt, Homo sapiens
uuacaauguaucaacauau

SEQ ID NO: 447762 - RNA, 12 nt, Homo sapiens
uuacacaauggu

SEQ ID NO: 447763 - RNA, 20 nt, Homo sapiens
uuacacacgugugauguaug

SEQ ID NO: 447764 - RNA, 14 nt, Homo sapiens
uuacacccaugcac

SEQ ID NO: 447765 - RNA, 19 nt, Homo sapiens
uuacacccuuucuugacaa

SEQ ID NO: 447766 - RNA, 15 nt, Homo sapiens
uuacacguaccucuc

SEQ ID NO: 447767 - RNA, 16 nt, Homo sapiens
uuacagacaugagccu

SEQ ID NO: 447768 - RNA, 23 nt, Homo sapiens
uuacagagaggagaaacacaucu

SEQ ID NO: 447769 - RNA, 15 nt, Homo sapiens
uuacagcaagagcca

SEQ ID NO: 447770 - RNA, 11 nt, Homo sapiens
uuacagccaca

SEQ ID NO: 447771 - RNA, 24 nt, Homo sapiens
uuacagcugccugcaguacuuuac

SEQ ID NO: 447772 - RNA, 17 nt, Homo sapiens
uuacagcuuuucucuuu

SEQ ID NO: 447773 - RNA, 17 nt, Homo sapiens
uuacaggcgugagccac

SEQ ID NO: 447774 - RNA, 18 nt, Homo sapiens
uuacaggugcccaccacc

SEQ ID NO: 447775 - RNA, 16 nt, Homo sapiens
uuacagugcagacagg

SEQ ID NO: 447776 - RNA, 16 nt, Homo sapiens
uuacaguuugagacuu

SEQ ID NO: 447777 - RNA, 18 nt, Homo sapiens
uuacauagguauauauau

SEQ ID NO: 447778 - RNA, 14 nt, Homo sapiens
uuacauaucaccuc

SEQ ID NO: 447779 - RNA, 18 nt, Homo sapiens
uuacauuuucaguaccaa

SEQ ID NO: 447780 - RNA, 19 nt, Homo sapiens
uuaccaacuuucuguaaac

SEQ ID NO: 447781 - RNA, 20 nt, Homo sapiens
uuaccagaugcuacuggacu

SEQ ID NO: 447782 - RNA, 17 nt, Homo sapiens
uuaccaugucacugugg

SEQ ID NO: 447783 - RNA, 22 nt, Homo sapiens
uuaccugggcauucuuguuuca

SEQ ID NO: 447784 - RNA, 22 nt, Homo sapiens
uuaccuguaauagccucaccuu

SEQ ID NO: 447785 - RNA, 17 nt, Homo sapiens
uuaccuuggucaugcuu

SEQ ID NO: 447786 - RNA, 14 nt, Homo sapiens
uuacuaagcacugu

SEQ ID NO: 447787 - RNA, 22 nt, Homo sapiens
uuacuaaugugccccaugucca

SEQ ID NO: 447788 - RNA, 20 nt, Homo sapiens
uuacuacuauucuguuaaaa

SEQ ID NO: 447789 - RNA, 19 nt, Homo sapiens
uuacuagcagucacuugau

SEQ ID NO: 447790 - RNA, 18 nt, Homo sapiens
uuacuaguacuauuacua

SEQ ID NO: 447791 - RNA, 16 nt, Homo sapiens
uuacuauucccacuuu

SEQ ID NO: 447792 - RNA, 22 nt, Homo sapiens
uuacuccuuuggcuucaaagga

SEQ ID NO: 447793 - RNA, 18 nt, Homo sapiens
uuacugaauuugcuaaua

SEQ ID NO: 447794 - RNA, 20 nt, Homo sapiens
uuacugagcuucucugugaa

SEQ ID NO: 447795 - RNA, 16 nt, Homo sapiens
uuacugaugugugcaa

SEQ ID NO: 447796 - RNA, 14 nt, Homo sapiens
uuacuuccacagaa

SEQ ID NO: 447797 - RNA, 20 nt, Homo sapiens
uuacuuccuaucaagccagu

SEQ ID NO: 447798 - RNA, 15 nt, Homo sapiens
uugacaucagcauua

SEQ ID NO: 447799 - RNA, 18 nt, Homo sapiens
uugaccggaucuacaccc

SEQ ID NO: 447800 - RNA, 18 nt, Homo sapiens
uugaccucaaccugugau

SEQ ID NO: 447801 - RNA, 15 nt, Homo sapiens
uugaccucagcugca

SEQ ID NO: 447802 - RNA, 18 nt, Homo sapiens
uugaccugaacucugcaa

SEQ ID NO: 447803 - RNA, 13 nt, Homo sapiens
uugaccuuuccag

SEQ ID NO: 447804 - RNA, 17 nt, Homo sapiens
uugacucuaaaugcagu

SEQ ID NO: 447805 - RNA, 11 nt, Homo sapiens
uugacugcugc

SEQ ID NO: 447806 - RNA, 13 nt, Homo sapiens
uugacugcugcuc

SEQ ID NO: 447807 - RNA, 15 nt, Homo sapiens
uugacuggcuuuccu

SEQ ID NO: 447808 - RNA, 15 nt, Homo sapiens
uugacugugauuuau

SEQ ID NO: 447809 - RNA, 14 nt, Homo sapiens
uugacuucaugcca

SEQ ID NO: 447810 - RNA, 17 nt, Homo sapiens
uugacuucgacugugac

SEQ ID NO: 447811 - RNA, 14 nt, Homo sapiens
uugagaaacccaag

SEQ ID NO: 447812 - RNA, 18 nt, Homo sapiens
uugagaaauaaagcacau

SEQ ID NO: 447813 - RNA, 15 nt, Homo sapiens
uugagacugauucag

SEQ ID NO: 447814 - RNA, 20 nt, Homo sapiens
uugagcaguggcugguccag

SEQ ID NO: 447815 - RNA, 18 nt, Homo sapiens
uugagcccaggaguucaa

SEQ ID NO: 447816 - RNA, 21 nt, Homo sapiens
uugagccccugaggacagggg

SEQ ID NO: 447817 - RNA, 15 nt, Homo sapiens
uugagcgagcccauu

SEQ ID NO: 447818 - RNA, 20 nt, Homo sapiens
uugagcugccugcucugcag

SEQ ID NO: 447819 - RNA, 21 nt, Homo sapiens
uugaggcagagucucauucug

SEQ ID NO: 447820 - RNA, 15 nt, Homo sapiens
uugagggacugccuc

SEQ ID NO: 447821 - RNA, 11 nt, Homo sapiens
uugaguaccaa

SEQ ID NO: 447822 - RNA, 23 nt, Homo sapiens
uugauaaaaaauuuauuaugucc

SEQ ID NO: 447823 - RNA, 22 nt, Homo sapiens
uugauaaaauaaaaaucauucu

SEQ ID NO: 447824 - RNA, 11 nt, Homo sapiens
uugauaccagu

SEQ ID NO: 447825 - RNA, 13 nt, Homo sapiens
uugauauugucac

SEQ ID NO: 447826 - RNA, 14 nt, Homo sapiens
uugaucucugcuua

SEQ ID NO: 447827 - RNA, 22 nt, Homo sapiens
uugaugaugaaguauugcuaau

SEQ ID NO: 447828 - RNA, 17 nt, Homo sapiens
uugaugccagcuguacu

SEQ ID NO: 447829 - RNA, 21 nt, Homo sapiens
uugaugcucguaugaauucau

SEQ ID NO: 447830 - RNA, 15 nt, Homo sapiens
uugauguaacugugu

SEQ ID NO: 447831 - RNA, 15 nt, Homo sapiens
uugauguucuuucac

SEQ ID NO: 447832 - RNA, 18 nt, Homo sapiens
uugauguuuguggccuca

SEQ ID NO: 447833 - RNA, 19 nt, Homo sapiens
uugauugucagcuacuaau

SEQ ID NO: 447834 - RNA, 14 nt, Homo sapiens
uugcaaagccuuua

SEQ ID NO: 447835 - RNA, 14 nt, Homo sapiens
uugcaacuuagcuc

SEQ ID NO: 447836 - RNA, 18 nt, Homo sapiens
uugcaaucuuauguugau

SEQ ID NO: 447837 - RNA, 20 nt, Homo sapiens
uugcacaggccacuugcuca

SEQ ID NO: 447838 - RNA, 22 nt, Homo sapiens
uugcaccccaaagcuuuccugc

SEQ ID NO: 447839 - RNA, 16 nt, Homo sapiens
uugcacgcccaugugu

SEQ ID NO: 447840 - RNA, 15 nt, Homo sapiens
uugcacuauuccaca

SEQ ID NO: 447841 - RNA, 19 nt, Homo sapiens
uugcacucuggaacugcau

SEQ ID NO: 447842 - RNA, 20 nt, Homo sapiens
uugcagcagugagucucuuc

SEQ ID NO: 447843 - RNA, 17 nt, Homo sapiens
uugcagcugcucuugca

SEQ ID NO: 447844 - RNA, 15 nt, Homo sapiens
uugcaucuuuucuac

SEQ ID NO: 447845 - RNA, 16 nt, Homo sapiens
uugcauuuauugcagu

SEQ ID NO: 447846 - RNA, 23 nt, Homo sapiens
uugccaaaaagggguaugucuuu

SEQ ID NO: 447847 - RNA, 14 nt, Homo sapiens
uugccaaacuaaau

SEQ ID NO: 447848 - RNA, 20 nt, Homo sapiens
uugccagguugcagcugcuc

SEQ ID NO: 447849 - RNA, 19 nt, Homo sapiens
uugccauuaaacuuaccug

SEQ ID NO: 447850 - RNA, 19 nt, Homo sapiens
uugcccaaccaaugcacac

SEQ ID NO: 447851 - RNA, 21 nt, Homo sapiens
uugcccacacuugggagcaaa

SEQ ID NO: 447852 - RNA, 20 nt, Homo sapiens
uugcccaggcuggagugcaa

SEQ ID NO: 447853 - RNA, 17 nt, Homo sapiens
uugcccaguucauccca

SEQ ID NO: 447854 - RNA, 22 nt, Homo sapiens
uugcccauggaagucucaaaga

SEQ ID NO: 447855 - RNA, 17 nt, Homo sapiens
uugccuccucacccacc

SEQ ID NO: 447856 - RNA, 16 nt, Homo sapiens
uugccuucacccauaa

SEQ ID NO: 447857 - RNA, 19 nt, Homo sapiens
uugccuucuagacacugaa

SEQ ID NO: 447858 - RNA, 18 nt, Homo sapiens
uugccuucucuguucccu

SEQ ID NO: 447859 - RNA, 17 nt, Homo sapiens
uugcuaacaaugcucug

SEQ ID NO: 447860 - RNA, 20 nt, Homo sapiens
uugcuacgaagaaagacucc

SEQ ID NO: 447861 - RNA, 14 nt, Homo sapiens
uugcuagccagcau

SEQ ID NO: 447862 - RNA, 15 nt, Homo sapiens
uugcuaguacuagua

SEQ ID NO: 447863 - RNA, 14 nt, Homo sapiens
uugcucaagugcag

SEQ ID NO: 447864 - RNA, 21 nt, Homo sapiens
uugcucacucccuaaagcccu

SEQ ID NO: 447865 - RNA, 22 nt, Homo sapiens
uugcucaguggaucacacacau

SEQ ID NO: 447866 - RNA, 14 nt, Homo sapiens
uugcuccuugacau

SEQ ID NO: 447867 - RNA, 21 nt, Homo sapiens
uugcucuggaagccugcugau

SEQ ID NO: 447868 - RNA, 17 nt, Homo sapiens
uugcucuuuucaaugug

SEQ ID NO: 447869 - RNA, 14 nt, Homo sapiens
uugcugaauaacaa

SEQ ID NO: 447870 - RNA, 17 nt, Homo sapiens
uugcuggucacugccau

SEQ ID NO: 447871 - RNA, 15 nt, Homo sapiens
uugcuguaugguaua

SEQ ID NO: 447872 - RNA, 21 nt, Homo sapiens
uugcugugaaaugacugcauc

SEQ ID NO: 447873 - RNA, 20 nt, Homo sapiens
uugcuucuucaauggcaccu

SEQ ID NO: 447874 - RNA, 21 nt, Homo sapiens
uugcuuguguacaaacccaga

SEQ ID NO: 447875 - RNA, 20 nt, Homo sapiens
uugcuuuggauacacacaua

SEQ ID NO: 447876 - RNA, 22 nt, Homo sapiens
uugcuuuuguuuuccugcuggu

SEQ ID NO: 447877 - RNA, 14 nt, Homo sapiens
uuggaauucuggau

SEQ ID NO: 447878 - RNA, 13 nt, Homo sapiens
uuggaauuuguaa

SEQ ID NO: 447879 - RNA, 23 nt, Homo sapiens
uuggacaaucaugaaauaugcau

SEQ ID NO: 447880 - RNA, 16 nt, Homo sapiens
uuggacacacacagcu

SEQ ID NO: 447881 - RNA, 23 nt, Homo sapiens
uuggacauguccaugaccagaag

SEQ ID NO: 447882 - RNA, 22 nt, Homo sapiens
uuggagagcagcuggcucucca

SEQ ID NO: 447883 - RNA, 14 nt, Homo sapiens
uuggaggaaugaca

SEQ ID NO: 447884 - RNA, 17 nt, Homo sapiens
uuggagggaucauuuuc

SEQ ID NO: 447885 - RNA, 18 nt, Homo sapiens
uuggaguuagguccucac

SEQ ID NO: 447886 - RNA, 21 nt, Homo sapiens
uuggaugggagugggcaccuc

SEQ ID NO: 447887 - RNA, 15 nt, Homo sapiens
uuggcaaacuuugua

SEQ ID NO: 447888 - RNA, 13 nt, Homo sapiens
uuggcaacagaag

SEQ ID NO: 447889 - RNA, 15 nt, Homo sapiens
uuggcaaugcacuga

SEQ ID NO: 447890 - RNA, 15 nt, Homo sapiens
uuggcacugagauau

SEQ ID NO: 447891 - RNA, 13 nt, Homo sapiens
uuggcagcuucaa

SEQ ID NO: 447892 - RNA, 13 nt, Homo sapiens
uuggccaaaaaga

SEQ ID NO: 447893 - RNA, 22 nt, Homo sapiens
uuggccaaacaucagaccuguc

SEQ ID NO: 447894 - RNA, 19 nt, Homo sapiens
uuggccauguucauucaca

SEQ ID NO: 447895 - RNA, 20 nt, Homo sapiens
uuggccuagcccacccugcu

SEQ ID NO: 447896 - RNA, 21 nt, Homo sapiens
uuggccuuguggauaagggag

SEQ ID NO: 447897 - RNA, 14 nt, Homo sapiens
uuggcgacugucau

SEQ ID NO: 447898 - RNA, 14 nt, Homo sapiens
uuggcgggccaagg

SEQ ID NO: 447899 - RNA, 12 nt, Homo sapiens
uugggaagacca

SEQ ID NO: 447900 - RNA, 13 nt, Homo sapiens
uugggaagaccag

SEQ ID NO: 447901 - RNA, 13 nt, Homo sapiens
uugggagcacugg

SEQ ID NO: 447902 - RNA, 20 nt, Homo sapiens
uugggaggcuggaguggaaa

SEQ ID NO: 447903 - RNA, 12 nt, Homo sapiens
uugggauguacc

SEQ ID NO: 447904 - RNA, 11 nt, Homo sapiens
uugggauuugc

SEQ ID NO: 447905 - RNA, 15 nt, Homo sapiens
uugggccauggcuuu

SEQ ID NO: 447906 - RNA, 15 nt, Homo sapiens
uugggccucuuguac

SEQ ID NO: 447907 - RNA, 10 nt, Homo sapiens
uugggcuccu

SEQ ID NO: 447908 - RNA, 20 nt, Homo sapiens
uugggcuuguuuucuacuuu

SEQ ID NO: 447909 - RNA, 16 nt, Homo sapiens
uuggggacaugugauu

SEQ ID NO: 447910 - RNA, 10 nt, Homo sapiens
uuggggacuc

SEQ ID NO: 447911 - RNA, 12 nt, Homo sapiens
uuggguuccuuu

SEQ ID NO: 447912 - RNA, 21 nt, Homo sapiens
uugguacuacuagaugucuuu

SEQ ID NO: 447913 - RNA, 22 nt, Homo sapiens
uugguagaggaaggaugcaaag

SEQ ID NO: 447914 - RNA, 16 nt, Homo sapiens
uugguccuggggacca

SEQ ID NO: 447915 - RNA, 17 nt, Homo sapiens
uuggucugggacuuccu

SEQ ID NO: 447916 - RNA, 11 nt, Homo sapiens
uuggugcacag

SEQ ID NO: 447917 - RNA, 16 nt, Homo sapiens
uuggugcuaaaccaca

SEQ ID NO: 447918 - RNA, 19 nt, Homo sapiens
uugguggccuaauuuacaa

SEQ ID NO: 447919 - RNA, 22 nt, Homo sapiens
uuggugguuaugucccaugacc

SEQ ID NO: 447920 - RNA, 16 nt, Homo sapiens
uugguuagcuggacau

SEQ ID NO: 447921 - RNA, 15 nt, Homo sapiens
uugguuuuuacucaa

SEQ ID NO: 447922 - RNA, 23 nt, Homo sapiens
uuguaaaacugugacauuccaca

SEQ ID NO: 447923 - RNA, 13 nt, Homo sapiens
uuguaaaccugga

SEQ ID NO: 447924 - RNA, 20 nt, Homo sapiens
uuguaaauacacauagcaug

SEQ ID NO: 447925 - RNA, 15 nt, Homo sapiens
uuguaaauuuuggaa

SEQ ID NO: 447926 - RNA, 21 nt, Homo sapiens
uuguaagaaauauauuugaua

SEQ ID NO: 447927 - RNA, 15 nt, Homo sapiens
uuguaagguacugaa

SEQ ID NO: 447928 - RNA, 19 nt, Homo sapiens
uuguaauuuugcaaaacau

SEQ ID NO: 447929 - RNA, 19 nt, Homo sapiens
uuuguauaccaugaugcau

SEQ ID NO: 447930 - RNA, 22 nt, Homo sapiens
uuuguauccaacugcauccagg

SEQ ID NO: 447931 - RNA, 14 nt, Homo sapiens
uuugucaacuucag

SEQ ID NO: 447932 - RNA, 12 nt, Homo sapiens
uuugucacugaa

SEQ ID NO: 447933 - RNA, 12 nt, Homo sapiens
uuugucacuucu

SEQ ID NO: 447934 - RNA, 21 nt, Homo sapiens
uuugucauauaagauucauau

SEQ ID NO: 447935 - RNA, 15 nt, Homo sapiens
uuugucuuauauaua

SEQ ID NO: 447936 - RNA, 13 nt, Homo sapiens
uuuguguuuacau

SEQ ID NO: 447937 - RNA, 17 nt, Homo sapiens
uuuguuaagacugcuga

SEQ ID NO: 447938 - RNA, 18 nt, Homo sapiens
uuuguuaaguucaccgua

SEQ ID NO: 447939 - RNA, 15 nt, Homo sapiens
uuuguuggagccacu

SEQ ID NO: 447940 - RNA, 19 nt, Homo sapiens
uuuguugugucuugcuaua

SEQ ID NO: 447941 - RNA, 22 nt, Homo sapiens
uuuuaaaaaggccuuugggauu

SEQ ID NO: 447942 - RNA, 17 nt, Homo sapiens
uuuuaaaacauucacac

SEQ ID NO: 447943 - RNA, 15 nt, Homo sapiens
uuuuaaaaguuucaa

SEQ ID NO: 447944 - RNA, 14 nt, Homo sapiens
uuuuaaacuacuga

SEQ ID NO: 447945 - RNA, 23 nt, Homo sapiens
uuuuaaauaaaaauaaguguaca

SEQ ID NO: 447946 - RNA, 15 nt, Homo sapiens
uuuuaaauggcauga

SEQ ID NO: 447947 - RNA, 13 nt, Homo sapiens
uuuuaaauguguu

SEQ ID NO: 447948 - RNA, 23 nt, Homo sapiens
uuuuaaauguguugcuuuggaua

SEQ ID NO: 447949 - RNA, 18 nt, Homo sapiens
uuuuaaauuuuccauuaa

SEQ ID NO: 447950 - RNA, 15 nt, Homo sapiens
uuuuaacauuccuca

SEQ ID NO: 447951 - RNA, 17 nt, Homo sapiens
uuuuaacucaccucuca

SEQ ID NO: 447952 - RNA, 18 nt, Homo sapiens
uuuuaacuucaccuuaaa

SEQ ID NO: 447953 - RNA, 12 nt, Homo sapiens
uuuuaagggcau

SEQ ID NO: 447954 - RNA, 19 nt, Homo sapiens
uuuuaaguaucccaucuaa

SEQ ID NO: 447955 - RNA, 13 nt, Homo sapiens
uuuuaauguacaa

SEQ ID NO: 447956 - RNA, 16 nt, Homo sapiens
uuuuacuaagcacugu

SEQ ID NO: 447957 - RNA, 16 nt, Homo sapiens
uuuuagugacuguaau

SEQ ID NO: 447958 - RNA, 20 nt, Homo sapiens
uuuuauaaaauuaagcaaug

SEQ ID NO: 447959 - RNA, 20 nt, Homo sapiens
uuuuauaagacuacuauaca

SEQ ID NO: 447960 - RNA, 21 nt, Homo sapiens
uuuuauaccgcugcauaguau

SEQ ID NO: 447961 - RNA, 15 nt, Homo sapiens
uuuuauacuaccaag

SEQ ID NO: 447962 - RNA, 17 nt, Homo sapiens
uuuuaucaauaaagcac

SEQ ID NO: 447963 - RNA, 21 nt, Homo sapiens
uuuuaucuuuaaucuccucuu

SEQ ID NO: 447964 - RNA, 23 nt, Homo sapiens
uuuuaugagaaaugccagugugc

SEQ ID NO: 447965 - RNA, 15 nt, Homo sapiens
uuuuaugaucuuggc

SEQ ID NO: 447966 - RNA, 19 nt, Homo sapiens
uuuuauguguugaugacuc

SEQ ID NO: 447967 - RNA, 12 nt, Homo sapiens
uuuuauuaucaa

SEQ ID NO: 447968 - RNA, 22 nt, Homo sapiens
uuuucaaugugugugagguguu

SEQ ID NO: 447969 - RNA, 13 nt, Homo sapiens
uuuucaccccacc

SEQ ID NO: 447970 - RNA, 19 nt, Homo sapiens
uuuucaccugaaacacuuu

SEQ ID NO: 447971 - RNA, 10 nt, Homo sapiens
uuuucacugc

SEQ ID NO: 447972 - RNA, 21 nt, Homo sapiens
uuuucacugcuggcugccuua

SEQ ID NO: 447973 - RNA, 17 nt, Homo sapiens
uuuucaguauacugugu

SEQ ID NO: 447974 - RNA, 22 nt, Homo sapiens
uuuucaugaccaauccuauguc

SEQ ID NO: 447975 - RNA, 19 nt, Homo sapiens
uuuucauguagaacucagc

SEQ ID NO: 447976 - RNA, 23 nt, Homo sapiens
uuuuccauuuuuauuucaaaaua

SEQ ID NO: 447977 - RNA, 22 nt, Homo sapiens
uuuuccauuuuugucagucuga

SEQ ID NO: 447978 - RNA, 19 nt, Homo sapiens
uuuucccgagcaaagucua

SEQ ID NO: 447979 - RNA, 12 nt, Homo sapiens
uuuuccuagucu

SEQ ID NO: 447980 - RNA, 22 nt, Homo sapiens
uuuuccuccccuuugacccuau

SEQ ID NO: 447981 - RNA, 18 nt, Homo sapiens
uuuuccuggcucaucucu

SEQ ID NO: 447982 - RNA, 16 nt, Homo sapiens
uuuuccuuuagaucaa

SEQ ID NO: 447983 - RNA, 20 nt, Homo sapiens
uuuucgucuucccugcuuca

SEQ ID NO: 447984 - RNA, 19 nt, Homo sapiens
uuuucuaauaccguggaug

SEQ ID NO: 447985 - RNA, 21 nt, Homo sapiens
uuuucugagcuuuucauggaa

SEQ ID NO: 447986 - RNA, 16 nt, Homo sapiens
uuuucugucacuguag

SEQ ID NO: 447987 - RNA, 13 nt, Homo sapiens
uuuucuucaucug

SEQ ID NO: 447988 - RNA, 14 nt, Homo sapiens
uuuucuuccuugua

SEQ ID NO: 447989 - RNA, 13 nt, Homo sapiens
uuuugaaaacacu

SEQ ID NO: 447990 - RNA, 16 nt, Homo sapiens
uuuugaaaacacuuau

SEQ ID NO: 447991 - RNA, 21 nt, Homo sapiens
uuuugaaaaggcgguacuagu

SEQ ID NO: 447992 - RNA, 17 nt, Homo sapiens
uuuugaaagaacaucag

SEQ ID NO: 447993 - RNA, 15 nt, Homo sapiens
uuuugauauuugaua

SEQ ID NO: 447994 - RNA, 11 nt, Homo sapiens
uuuugaugaaa

SEQ ID NO: 447995 - RNA, 13 nt, Homo sapiens
uuuugauggcuau

SEQ ID NO: 447996 - RNA, 13 nt, Homo sapiens
uuuugcacauucu

SEQ ID NO: 447997 - RNA, 18 nt, Homo sapiens
uuuugcugcacacaaucu

SEQ ID NO: 447998 - RNA, 19 nt, Homo sapiens
uuuugcuggucacugccau

SEQ ID NO: 447999 - RNA, 22 nt, Homo sapiens
uuuuggaucuaucaccugucau

SEQ ID NO: 448000 - RNA, 13 nt, Homo sapiens
uuuuggccaaagu

SEQ ID NO: 448001 - RNA, 23 nt, Homo sapiens
uuuuggccuuuguaagacacaca

SEQ ID NO: 448002 - RNA, 19 nt, Homo sapiens
uuuugguauuacacuguau

SEQ ID NO: 448003 - RNA, 21 nt, Homo sapiens
uuuuguaaauauucuugucca

SEQ ID NO: 448004 - RNA, 14 nt, Homo sapiens
uuuuguacugugcu

SEQ ID NO: 448005 - RNA, 16 nt, Homo sapiens
uuuuguauguaugugu

SEQ ID NO: 448006 - RNA, 13 nt, Homo sapiens
uuuuguguacugu

SEQ ID NO: 448007 - RNA, 14 nt, Homo sapiens
uuuuguugccuuca

SEQ ID NO: 448008 - RNA, 20 nt, Homo sapiens
uuuuuaaaagcccuuuccaa

SEQ ID NO: 448009 - RNA, 19 nt, Homo sapiens
uuuuuaaaauguuggugca

SEQ ID NO: 448010 - RNA, 15 nt, Homo sapiens
uuuuuaaauggaauu

SEQ ID NO: 448011 - RNA, 23 nt, Homo sapiens
uuuuuaaauuugcaaaucucagg

SEQ ID NO: 448012 - RNA, 15 nt, Homo sapiens
uuuuuaacugauucu

SEQ ID NO: 448013 - RNA, 15 nt, Homo sapiens
uuuuuacuuccacag

SEQ ID NO: 448014 - RNA, 19 nt, Homo sapiens
uuuuuaguagagauggggu

SEQ ID NO: 448015 - RNA, 21 nt, Homo sapiens
uuuuuauauuuuauacugcac

SEQ ID NO: 448016 - RNA, 15 nt, Homo sapiens
uuuuuccuaacagga

SEQ ID NO: 448017 - RNA, 16 nt, Homo sapiens
uuuuuccuccuugucu

SEQ ID NO: 448018 - RNA, 20 nt, Homo sapiens
uuuuucuuuaaucaaaaguc

SEQ ID NO: 448019 - RNA, 15 nt, Homo sapiens
uuuuucuuuuuccac

SEQ ID NO: 448020 - RNA, 21 nt, Homo sapiens
uuuuuguuucuuccaaagcac

SEQ ID NO: 448021 - RNA, 13 nt, Homo sapiens
uuuuuuauuggaa

SEQ ID NO: 448022 - RNA, 13 nt, Homo sapiens
aacuauugcugcu

SEQ ID NO: 448023 - RNA, 16 nt, Homo sapiens
aacucaccacaagcca

SEQ ID NO: 448024 - RNA, 21 nt, Homo sapiens
aacucagaaugcucuacuucu

SEQ ID NO: 448025 - RNA, 15 nt, Homo sapiens
aacucagacauucca

SEQ ID NO: 448026 - RNA, 18 nt, Homo sapiens
aacuccaggaaaacuguu

SEQ ID NO: 448027 - RNA, 20 nt, Homo sapiens
aacuccaugaccaggccacc

SEQ ID NO: 448028 - RNA, 14 nt, Homo sapiens
aacuccaugccuau

SEQ ID NO: 448029 - RNA, 16 nt, Homo sapiens
aacuccuauaauuccc

SEQ ID NO: 448030 - RNA, 21 nt, Homo sapiens
aacuccugacaucaggugauc

SEQ ID NO: 448031 - RNA, 22 nt, Homo sapiens
aacuccugauuuuguaguuaau

SEQ ID NO: 448032 - RNA, 14 nt, Homo sapiens
aacucgaugcacug

SEQ ID NO: 448033 - RNA, 18 nt, Homo sapiens
aacucgccccccuacccc

SEQ ID NO: 448034 - RNA, 21 nt, Homo sapiens
aacucuccaauguucuauuaa

SEQ ID NO: 448035 - RNA, 14 nt, Homo sapiens
aacucugacuguaa

SEQ ID NO: 448036 - RNA, 15 nt, Homo sapiens
aacucugcacuacuc

SEQ ID NO: 448037 - RNA, 16 nt, Homo sapiens
aacucugcacuacucc

SEQ ID NO: 448038 - RNA, 15 nt, Homo sapiens
aacucugcacuccau

SEQ ID NO: 448039 - RNA, 16 nt, Homo sapiens
aacucuguaaaaccuc

SEQ ID NO: 448040 - RNA, 22 nt, Homo sapiens
aacucuuacggcuaucuaguug

SEQ ID NO: 448041 - RNA, 18 nt, Homo sapiens
aacugaacgacaaagcau

SEQ ID NO: 448042 - RNA, 19 nt, Homo sapiens
aacugacaguaaaucucac

SEQ ID NO: 448043 - RNA, 20 nt, Homo sapiens
aacugaccagccuccaugcu

SEQ ID NO: 448044 - RNA, 12 nt, Homo sapiens
aacugacuucca

SEQ ID NO: 448045 - RNA, 23 nt, Homo sapiens
aacugagauuacaggcacccacc

SEQ ID NO: 448046 - RNA, 14 nt, Homo sapiens
aacugaguccuguu

SEQ ID NO: 448047 - RNA, 18 nt, Homo sapiens
aacugauuuaugaucacu

SEQ ID NO: 448048 - RNA, 17 nt, Homo sapiens
aacugcaccaacgagcu

SEQ ID NO: 448049 - RNA, 23 nt, Homo sapiens
aacugcauaagugaaaaucuuac

SEQ ID NO: 448050 - RNA, 14 nt, Homo sapiens
aacugcaugcugcu

SEQ ID NO: 448051 - RNA, 15 nt, Homo sapiens
aacugcauggaccua

SEQ ID NO: 448052 - RNA, 21 nt, Homo sapiens
aacugcccaaagcagcacuua

SEQ ID NO: 448053 - RNA, 15 nt, Homo sapiens
aacugccccaucucc

SEQ ID NO: 448054 - RNA, 16 nt, Homo sapiens
aacugcccccacuguc

SEQ ID NO: 448055 - RNA, 21 nt, Homo sapiens
aacugcuaccaugaagugaaa

SEQ ID NO: 448056 - RNA, 14 nt, Homo sapiens
aacugcuccagcuc

SEQ ID NO: 448057 - RNA, 14 nt, Homo sapiens
aacuggcaucugac

SEQ ID NO: 448058 - RNA, 14 nt, Homo sapiens
aacugggcacugga

SEQ ID NO: 448059 - RNA, 14 nt, Homo sapiens
aacuguaacauaua

SEQ ID NO: 448060 - RNA, 14 nt, Homo sapiens
aacuguacaguuuc

SEQ ID NO: 448061 - RNA, 16 nt, Homo sapiens
aacugugacauuccac

SEQ ID NO: 448062 - RNA, 22 nt, Homo sapiens
aacugugacauuccacagaguu

SEQ ID NO: 448063 - RNA, 21 nt, Homo sapiens
aacugugcagcacccuuucac

SEQ ID NO: 448064 - RNA, 14 nt, Homo sapiens
aacuguguuuacuc

SEQ ID NO: 448065 - RNA, 20 nt, Homo sapiens
aacuguugauacaaauguua

SEQ ID NO: 448066 - RNA, 19 nt, Homo sapiens
aacuguuguguccaauccc

SEQ ID NO: 448067 - RNA, 14 nt, Homo sapiens
aacuuaaaagauuc

SEQ ID NO: 448068 - RNA, 16 nt, Homo sapiens
aacuuaaaucacugag

SEQ ID NO: 448069 - RNA, 15 nt, Homo sapiens
aacuuaacauugcau

SEQ ID NO: 448070 - RNA, 17 nt, Homo sapiens
aacuuaauucuguuaca

SEQ ID NO: 448071 - RNA, 13 nt, Homo sapiens
aacuuacauaugu

SEQ ID NO: 448072 - RNA, 19 nt, Homo sapiens
aacuucauugcuacacuua

SEQ ID NO: 448073 - RNA, 22 nt, Homo sapiens
aacuuccagguuccauccacca

SEQ ID NO: 448074 - RNA, 12 nt, Homo sapiens
aacuuccaguca

SEQ ID NO: 448075 - RNA, 20 nt, Homo sapiens
aacuuccauagcuucaucca

SEQ ID NO: 448076 - RNA, 15 nt, Homo sapiens
aacuucccuguucuu

SEQ ID NO: 448077 - RNA, 19 nt, Homo sapiens
aacuucugauuucucuuca

SEQ ID NO: 448078 - RNA, 14 nt, Homo sapiens
aacuugacccccuu

SEQ ID NO: 448079 - RNA, 15 nt, Homo sapiens
aacuugaugccagug

SEQ ID NO: 448080 - RNA, 20 nt, Homo sapiens
aacuugauguguuaucucuu

SEQ ID NO: 448081 - RNA, 17 nt, Homo sapiens
aacuugcucaagugcag

SEQ ID NO: 448082 - RNA, 15 nt, Homo sapiens
aacuugcugcugagu

SEQ ID NO: 448083 - RNA, 18 nt, Homo sapiens
aacuugcugcugugccug

SEQ ID NO: 448084 - RNA, 19 nt, Homo sapiens
aacuugcugcugugccugc

SEQ ID NO: 448085 - RNA, 14 nt, Homo sapiens
aacuuggugccuaa

SEQ ID NO: 448086 - RNA, 22 nt, Homo sapiens
aacuuguuugguaguuagccau

SEQ ID NO: 448087 - RNA, 14 nt, Homo sapiens
aacuuucacuuuga

SEQ ID NO: 448088 - RNA, 19 nt, Homo sapiens
aacuuucccuccaccagug

SEQ ID NO: 448089 - RNA, 14 nt, Homo sapiens
aacuuugacuuucu

SEQ ID NO: 448090 - RNA, 13 nt, Homo sapiens
aacuuugucacuu

SEQ ID NO: 448091 - RNA, 15 nt, Homo sapiens
aacuuugucacuucu

SEQ ID NO: 448092 - RNA, 23 nt, Homo sapiens
aacuuugugccuuugaccaucuc

SEQ ID NO: 448093 - RNA, 13 nt, Homo sapiens
aacuuuucaucca

SEQ ID NO: 448094 - RNA, 13 nt, Homo sapiens
aacuuuucuauua

SEQ ID NO: 448095 - RNA, 16 nt, Homo sapiens
aagaaaaaaguacaga

SEQ ID NO: 448096 - RNA, 16 nt, Homo sapiens
aagaaaaaauaucuug

SEQ ID NO: 448097 - RNA, 23 nt, Homo sapiens
aagaaaaagaccuaugagcacau

SEQ ID NO: 448098 - RNA, 14 nt, Homo sapiens
aagaaaacauguaa

SEQ ID NO: 448099 - RNA, 15 nt, Homo sapiens
aagaaaacccaacuc

SEQ ID NO: 448100 - RNA, 15 nt, Homo sapiens
aagaaaagcugccau

SEQ ID NO: 448101 - RNA, 19 nt, Homo sapiens
aagaaaagugggccagugu

SEQ ID NO: 448102 - RNA, 17 nt, Homo sapiens
aagaaaauaccaaggaa

SEQ ID NO: 448103 - RNA, 14 nt, Homo sapiens
aagaaaaucaucuu

SEQ ID NO: 448104 - RNA, 12 nt, Homo sapiens
aagaaaauccau

SEQ ID NO: 448105 - RNA, 16 nt, Homo sapiens
aagaaacagcuuucaa

SEQ ID NO: 448106 - RNA, 12 nt, Homo sapiens
aagaaacaugau

SEQ ID NO: 448107 - RNA, 17 nt, Homo sapiens
aagaaagacuccuuucc

SEQ ID NO: 448108 - RNA, 15 nt, Homo sapiens
aagaaagcauugcca

SEQ ID NO: 448109 - RNA, 21 nt, Homo sapiens
aagaaagcuauauaugaauaa

SEQ ID NO: 448110 - RNA, 23 nt, Homo sapiens
aagaaaguuuccccaccagugaa

SEQ ID NO: 448111 - RNA, 16 nt, Homo sapiens
aagaaauaaaccucau

SEQ ID NO: 448112 - RNA, 13 nt, Homo sapiens
aagaaaucaaaga

SEQ ID NO: 448113 - RNA, 23 nt, Homo sapiens
aagaaauugauugaacguucuca

SEQ ID NO: 448114 - RNA, 15 nt, Homo sapiens
aagaacaucaguuca

SEQ ID NO: 448115 - RNA, 12 nt, Homo sapiens
aagaaccagaga

SEQ ID NO: 448116 - RNA, 16 nt, Homo sapiens
aagaacgugaucuccu

SEQ ID NO: 448117 - RNA, 15 nt, Homo sapiens
aagaacucaugugau

SEQ ID NO: 448118 - RNA, 16 nt, Homo sapiens
aagaacugcuugcauu

SEQ ID NO: 448119 - RNA, 18 nt, Homo sapiens
aagaacugcuugcauuuc

SEQ ID NO: 448120 - RNA, 16 nt, Homo sapiens
aagaacuugucccuca

SEQ ID NO: 448121 - RNA, 15 nt, Homo sapiens
aagaagacacacagc

SEQ ID NO: 448122 - RNA, 18 nt, Homo sapiens
aagaagagacucuuugca

SEQ ID NO: 448123 - RNA, 15 nt, Homo sapiens
aagaagagacuggga

SEQ ID NO: 448124 - RNA, 17 nt, Homo sapiens
aagaaggguaagugcuu

SEQ ID NO: 448125 - RNA, 15 nt, Homo sapiens
aagaaguuugaccau

SEQ ID NO: 448126 - RNA, 22 nt, Homo sapiens
aagaauacacugugacuuaaga

SEQ ID NO: 448127 - RNA, 12 nt, Homo sapiens
aagaauaccaau

SEQ ID NO: 448128 - RNA, 13 nt, Homo sapiens
aagaauauuguau

SEQ ID NO: 448129 - RNA, 16 nt, Homo sapiens
aagaaugacaggcuuu

SEQ ID NO: 448130 - RNA, 16 nt, Homo sapiens
aagaauguacauuacc

SEQ ID NO: 448131 - RNA, 13 nt, Homo sapiens
aagaauguauucg

SEQ ID NO: 448132 - RNA, 23 nt, Homo sapiens
aagaauuagaucgguucugugcc

SEQ ID NO: 448133 - RNA, 19 nt, Homo sapiens
aagaauugaaaaaccauuu

SEQ ID NO: 448134 - RNA, 16 nt, Homo sapiens
aagacacacagccuuu

SEQ ID NO: 448135 - RNA, 20 nt, Homo sapiens
aagacauaaauuacuuuuuc

SEQ ID NO: 448136 - RNA, 18 nt, Homo sapiens
aagacauagucucuaccu

SEQ ID NO: 448137 - RNA, 14 nt, Homo sapiens
aagacauaucucua

SEQ ID NO: 448138 - RNA, 16 nt, Homo sapiens
aagacauccugagcag

SEQ ID NO: 448139 - RNA, 15 nt, Homo sapiens
aagaccagcuuugca

SEQ ID NO: 448140 - RNA, 19 nt, Homo sapiens
aagaccagcuuugcaguga

SEQ ID NO: 448141 - RNA, 21 nt, Homo sapiens
aagaccagcuuugcagugaca

SEQ ID NO: 448142 - RNA, 23 nt, Homo sapiens
aagaccagucacagccauuucaa

SEQ ID NO: 448143 - RNA, 19 nt, Homo sapiens
aagacccaacaggugcuga

SEQ ID NO: 448144 - RNA, 17 nt, Homo sapiens
aagaccucccugugaga

SEQ ID NO: 448145 - RNA, 17 nt, Homo sapiens
aagacuaucaaagacaa

SEQ ID NO: 448146 - RNA, 14 nt, Homo sapiens
aagacugagucaag

SEQ ID NO: 448147 - RNA, 20 nt, Homo sapiens
aagacuuccucaugaaucuc

SEQ ID NO: 448148 - RNA, 12 nt, Homo sapiens
aagagaaggcaa

SEQ ID NO: 448149 - RNA, 14 nt, Homo sapiens
aagagacugggaag

SEQ ID NO: 448150 - RNA, 22 nt, Homo sapiens
aagagacuuggaaaugggagac

SEQ ID NO: 448151 - RNA, 15 nt, Homo sapiens
aagagaggaguucaa

SEQ ID NO: 448152 - RNA, 14 nt, Homo sapiens
aagagccauguacc

SEQ ID NO: 448153 - RNA, 20 nt, Homo sapiens
aauccacaguauuguucuug

SEQ ID NO: 448154 - RNA, 17 nt, Homo sapiens
aauccaggacagcauua

SEQ ID NO: 448155 - RNA, 14 nt, Homo sapiens
aauccauucauuca

SEQ ID NO: 448156 - RNA, 21 nt, Homo sapiens
aauccauuuaaucaauauuua

SEQ ID NO: 448157 - RNA, 17 nt, Homo sapiens
aaucccaauucuguccc

SEQ ID NO: 448158 - RNA, 17 nt, Homo sapiens
aaucccagcccuacccu

SEQ ID NO: 448159 - RNA, 14 nt, Homo sapiens
aaucccaguacuug

SEQ ID NO: 448160 - RNA, 15 nt, Homo sapiens
aaucccaguucaugu

SEQ ID NO: 448161 - RNA, 19 nt, Homo sapiens
aauccuaugucauuucuac

SEQ ID NO: 448162 - RNA, 20 nt, Homo sapiens
aauccuccccaccagucuca

SEQ ID NO: 448163 - RNA, 14 nt, Homo sapiens
aauccucucuuccu

SEQ ID NO: 448164 - RNA, 18 nt, Homo sapiens
aauccugccucuccccaa

SEQ ID NO: 448165 - RNA, 20 nt, Homo sapiens
aauccuguccucagcuucuu

SEQ ID NO: 448166 - RNA, 22 nt, Homo sapiens
aauccuguccucagcuucuuaa

SEQ ID NO: 448167 - RNA, 19 nt, Homo sapiens
aauccuuuacuguuaguca

SEQ ID NO: 448168 - RNA, 12 nt, Homo sapiens
aauccuuuccac

SEQ ID NO: 448169 - RNA, 19 nt, Homo sapiens
aaucgcaaggccugugcug

SEQ ID NO: 448170 - RNA, 14 nt, Homo sapiens
aaucuaaaaauccu

SEQ ID NO: 448171 - RNA, 22 nt, Homo sapiens
aaucuaaauagauacuuuugau

SEQ ID NO: 448172 - RNA, 15 nt, Homo sapiens
aaucuaaaucuucag

SEQ ID NO: 448173 - RNA, 19 nt, Homo sapiens
aaucuagagcuaugcacac

SEQ ID NO: 448174 - RNA, 17 nt, Homo sapiens
aaucuaggaagcucaga

SEQ ID NO: 448175 - RNA, 14 nt, Homo sapiens
aaucuaguuuacag

SEQ ID NO: 448176 - RNA, 18 nt, Homo sapiens
aaucucaagauucuacuu

SEQ ID NO: 448177 - RNA, 18 nt, Homo sapiens
aaucucaccccaucccac

SEQ ID NO: 448178 - RNA, 15 nt, Homo sapiens
aaucucagccagccu

SEQ ID NO: 448179 - RNA, 16 nt, Homo sapiens
aaucucuaguugucac

SEQ ID NO: 448180 - RNA, 23 nt, Homo sapiens
aaucucuuaugggauuacauguu

SEQ ID NO: 448181 - RNA, 19 nt, Homo sapiens
aaucugcuuuguuaaugaa

SEQ ID NO: 448182 - RNA, 20 nt, Homo sapiens
aaucuggcuccuguuuccau

SEQ ID NO: 448183 - RNA, 23 nt, Homo sapiens
aaucugucccugagagugucucu

SEQ ID NO: 448184 - RNA, 16 nt, Homo sapiens
aaucuuagacauuuau

SEQ ID NO: 448185 - RNA, 22 nt, Homo sapiens
aaucuuagcugccaaguaaaua

SEQ ID NO: 448186 - RNA, 18 nt, Homo sapiens
aaucuuuagaauaguuaa

SEQ ID NO: 448187 - RNA, 20 nt, Homo sapiens
aaucuuucagccugcuucuu

SEQ ID NO: 448188 - RNA, 15 nt, Homo sapiens
aaucuuuccaucuca

SEQ ID NO: 448189 - RNA, 19 nt, Homo sapiens
aaucuuucuuuaccugaga

SEQ ID NO: 448190 - RNA, 15 nt, Homo sapiens
aaucuuuuucuccac

SEQ ID NO: 448191 - RNA, 16 nt, Homo sapiens
aaugaaaccuuccucu

SEQ ID NO: 448192 - RNA, 17 nt, Homo sapiens
aaugaaacugcugugaa

SEQ ID NO: 448193 - RNA, 19 nt, Homo sapiens
aaugaaauauaaacuguga

SEQ ID NO: 448194 - RNA, 15 nt, Homo sapiens
aaugaacugugacag

SEQ ID NO: 448195 - RNA, 17 nt, Homo sapiens
aaugaagcccuauuacu

SEQ ID NO: 448196 - RNA, 15 nt, Homo sapiens
aaugaaggugugcua

SEQ ID NO: 448197 - RNA, 14 nt, Homo sapiens
aaugaaucuucaca

SEQ ID NO: 448198 - RNA, 17 nt, Homo sapiens
aaugaaugucaguguga

SEQ ID NO: 448199 - RNA, 22 nt, Homo sapiens
aaugaauuuuaaaagcauauau

SEQ ID NO: 448200 - RNA, 15 nt, Homo sapiens
aaugacacagucuug

SEQ ID NO: 448201 - RNA, 20 nt, Homo sapiens
aaugacacagucuuggcuca

SEQ ID NO: 448202 - RNA, 14 nt, Homo sapiens
aaugacaucuucaa

SEQ ID NO: 448203 - RNA, 23 nt, Homo sapiens
aaugacaucuucaaagcuugaag

SEQ ID NO: 448204 - RNA, 12 nt, Homo sapiens
aaugaccuguau

SEQ ID NO: 448205 - RNA, 20 nt, Homo sapiens
aaugacuuaagcacacuuga

SEQ ID NO: 448206 - RNA, 21 nt, Homo sapiens
aaugagaaauuuuguugauau

SEQ ID NO: 448207 - RNA, 22 nt, Homo sapiens
aaugagaagucaacagugaaau

SEQ ID NO: 448208 - RNA, 16 nt, Homo sapiens
aaugagacuugcucuc

SEQ ID NO: 448209 - RNA, 16 nt, Homo sapiens
aaugagccuuucugcc

SEQ ID NO: 448210 - RNA, 20 nt, Homo sapiens
aaugaggugguacuaugauu

SEQ ID NO: 448211 - RNA, 13 nt, Homo sapiens
aaugaguaaugca

SEQ ID NO: 448212 - RNA, 19 nt, Homo sapiens
aaugauaaagaugucaaau

SEQ ID NO: 448213 - RNA, 19 nt, Homo sapiens
aaugauaggaaaaauccau

SEQ ID NO: 448214 - RNA, 16 nt, Homo sapiens
aaugaucgggauauaa

SEQ ID NO: 448215 - RNA, 16 nt, Homo sapiens
aaugaucuagguuuaa

SEQ ID NO: 448216 - RNA, 21 nt, Homo sapiens
aaugaucuagguuuaacucag

SEQ ID NO: 448217 - RNA, 14 nt, Homo sapiens
aaugaugugauaca

SEQ ID NO: 448218 - RNA, 21 nt, Homo sapiens
aaugauguuuuagaaugauuc

SEQ ID NO: 448219 - RNA, 13 nt, Homo sapiens
aaugcagacacac

SEQ ID NO: 448220 - RNA, 16 nt, Homo sapiens
aaugcagacauuuaca

SEQ ID NO: 448221 - RNA, 23 nt, Homo sapiens
aaugcauaaaagacaagcacuuu

SEQ ID NO: 448222 - RNA, 18 nt, Homo sapiens
aaugccaaaauucauuca

SEQ ID NO: 448223 - RNA, 15 nt, Homo sapiens
aaugccaaauugcag

SEQ ID NO: 448224 - RNA, 23 nt, Homo sapiens
aaugccacaaaacugacaguaaa

SEQ ID NO: 448225 - RNA, 20 nt, Homo sapiens
aaugccaggcagaaaacugg

SEQ ID NO: 448226 - RNA, 13 nt, Homo sapiens
aaugccagugugc

SEQ ID NO: 448227 - RNA, 14 nt, Homo sapiens
aaugccugugccaa

SEQ ID NO: 448228 - RNA, 23 nt, Homo sapiens
aaugcguggcacaucuaaauuga

SEQ ID NO: 448229 - RNA, 17 nt, Homo sapiens
aaugcuaauuaggcaaa

SEQ ID NO: 448230 - RNA, 23 nt, Homo sapiens
aaugcuauggacugcacaaaagu

SEQ ID NO: 448231 - RNA, 15 nt, Homo sapiens
aaugcucacuuaugu

SEQ ID NO: 448232 - RNA, 16 nt, Homo sapiens
aaugcugacuggacug

SEQ ID NO: 448233 - RNA, 19 nt, Homo sapiens
aaugcugugcaaacagugu

SEQ ID NO: 448234 - RNA, 19 nt, Homo sapiens
aaugcuuguaauagucugu

SEQ ID NO: 448235 - RNA, 23 nt, Homo sapiens
aaugcuuugauuguucauaucaa

SEQ ID NO: 448236 - RNA, 19 nt, Homo sapiens
aaugcuuuuugaauguuau

SEQ ID NO: 448237 - RNA, 13 nt, Homo sapiens
aauggaaaacugc

SEQ ID NO: 448238 - RNA, 16 nt, Homo sapiens
aauggaaagguccugc

SEQ ID NO: 448239 - RNA, 23 nt, Homo sapiens
aauggaauuuuuuacccauacaa

SEQ ID NO: 448240 - RNA, 14 nt, Homo sapiens
aauggcaccuguau

SEQ ID NO: 448241 - RNA, 18 nt, Homo sapiens
aauggcaccuucauucuc

SEQ ID NO: 448242 - RNA, 15 nt, Homo sapiens
aauggcaugcugaaa

SEQ ID NO: 448243 - RNA, 16 nt, Homo sapiens
aauggcuaguacugua

SEQ ID NO: 448244 - RNA, 22 nt, Homo sapiens
aaugggacugaugucaucuuga

SEQ ID NO: 448245 - RNA, 17 nt, Homo sapiens
aaugggagugaacauuu

SEQ ID NO: 448246 - RNA, 14 nt, Homo sapiens
aauggggcuuccau

SEQ ID NO: 448247 - RNA, 21 nt, Homo sapiens
aauggguuuuguguacuguaa

SEQ ID NO: 448248 - RNA, 18 nt, Homo sapiens
aaugguagcaacugaaag

SEQ ID NO: 448249 - RNA, 17 nt, Homo sapiens
aauggugauuucuugcu

SEQ ID NO: 448250 - RNA, 21 nt, Homo sapiens
aaugguguagcuguccucuca

SEQ ID NO: 448251 - RNA, 18 nt, Homo sapiens
aaugguugggacaauggc

SEQ ID NO: 448252 - RNA, 14 nt, Homo sapiens
aaugguuuacugcu

SEQ ID NO: 448253 - RNA, 16 nt, Homo sapiens
aaugguuuacugcugu

SEQ ID NO: 448254 - RNA, 16 nt, Homo sapiens
aauguaaaacagagcc

SEQ ID NO: 448255 - RNA, 14 nt, Homo sapiens
aauguaaagacaaa

SEQ ID NO: 448256 - RNA, 13 nt, Homo sapiens
aauguacauuacc

SEQ ID NO: 448257 - RNA, 14 nt, Homo sapiens
aauguacuauaugu

SEQ ID NO: 448258 - RNA, 19 nt, Homo sapiens
aauguagacauuaucuuuu

SEQ ID NO: 448259 - RNA, 15 nt, Homo sapiens
aauguagaccuguga

SEQ ID NO: 448260 - RNA, 14 nt, Homo sapiens
aauguaggacugua

SEQ ID NO: 448261 - RNA, 18 nt, Homo sapiens
aauguauucaaauaccaa

SEQ ID NO: 448262 - RNA, 20 nt, Homo sapiens
aaugucaauaugagauauua

SEQ ID NO: 448263 - RNA, 19 nt, Homo sapiens
aaugucacaaccucucuga

SEQ ID NO: 448264 - RNA, 14 nt, Homo sapiens
aaugucacuuaaag

SEQ ID NO: 448265 - RNA, 22 nt, Homo sapiens
aaugucgauuaaaaucacucuc

SEQ ID NO: 448266 - RNA, 15 nt, Homo sapiens
aaugucuccugccac

SEQ ID NO: 448267 - RNA, 16 nt, Homo sapiens
aaugucuucaugaccu

SEQ ID NO: 448268 - RNA, 18 nt, Homo sapiens
aaugucuuguaagcaaaa

SEQ ID NO: 448269 - RNA, 16 nt, Homo sapiens
aaugugaaggcccaag

SEQ ID NO: 448270 - RNA, 18 nt, Homo sapiens
aaugugcagcucccauuu

SEQ ID NO: 448271 - RNA, 21 nt, Homo sapiens
aaugugcagcucccauuuggc

SEQ ID NO: 448272 - RNA, 19 nt, Homo sapiens
aaugugcagugucuuguaa

SEQ ID NO: 448273 - RNA, 16 nt, Homo sapiens
aaugugguuacuuccu

SEQ ID NO: 448274 - RNA, 19 nt, Homo sapiens
aaugugucugcaacaugga

SEQ ID NO: 448275 - RNA, 16 nt, Homo sapiens
aauguuacauuauuau

SEQ ID NO: 448276 - RNA, 20 nt, Homo sapiens
aauguuacugaucaugcauu

SEQ ID NO: 448277 - RNA, 14 nt, Homo sapiens
aauguuaguggcau

SEQ ID NO: 448278 - RNA, 16 nt, Homo sapiens
aauguuauagguuugu

SEQ ID NO: 448279 - RNA, 18 nt, Homo sapiens
aauguuauccucuugcua

SEQ ID NO: 448280 - RNA, 21 nt, Homo sapiens
aauguuauuuuuuaauuauua

SEQ ID NO: 448281 - RNA, 23 nt, Homo sapiens
aauguucucuggguagguguuga

SEQ ID NO: 448282 - RNA, 18 nt, Homo sapiens
aauguuguccugugucau

SEQ ID NO: 448283 - RNA, 21 nt, Homo sapiens
aucaccuccccuccuugccuc

SEQ ID NO: 448284 - RNA, 22 nt, Homo sapiens
aucaccucuuaugcacaccucc

SEQ ID NO: 448285 - RNA, 19 nt, Homo sapiens
aucaccugcgugucccauc

SEQ ID NO: 448286 - RNA, 22 nt, Homo sapiens
aucaccuuuuugacuuuuccaa

SEQ ID NO: 448287 - RNA, 15 nt, Homo sapiens
aucacuccucuguca

SEQ ID NO: 448288 - RNA, 21 nt, Homo sapiens
aucacugaggcauuuuuacua

SEQ ID NO: 448289 - RNA, 17 nt, Homo sapiens
aucacuugacuuugcca

SEQ ID NO: 448290 - RNA, 19 nt, Homo sapiens
aucacuugacuuugccaca

SEQ ID NO: 448291 - RNA, 11 nt, Homo sapiens
aucagacacaa

SEQ ID NO: 448292 - RNA, 16 nt, Homo sapiens
aucagacuagugacaa

SEQ ID NO: 448293 - RNA, 15 nt, Homo sapiens
aucagagagcucacu

SEQ ID NO: 448294 - RNA, 16 nt, Homo sapiens
aucagaguaaggcucu

SEQ ID NO: 448295 - RNA, 14 nt, Homo sapiens
aucagaguauguca

SEQ ID NO: 448296 - RNA, 15 nt, Homo sapiens
aucagaguaugucag

SEQ ID NO: 448297 - RNA, 23 nt, Homo sapiens
aucagaguggccaaucccugugu

SEQ ID NO: 448298 - RNA, 17 nt, Homo sapiens
aucagcauucaaaauag

SEQ ID NO: 448299 - RNA, 19 nt, Homo sapiens
aucagccuccgccauucca

SEQ ID NO: 448300 - RNA, 22 nt, Homo sapiens
aucagggggcaugaagcacauu

SEQ ID NO: 448301 - RNA, 15 nt, Homo sapiens
aucaggucauuauuu

SEQ ID NO: 448302 - RNA, 22 nt, Homo sapiens
aucaguaauguauucuaucucu

SEQ ID NO: 448303 - RNA, 13 nt, Homo sapiens
aucaguuacuggu

SEQ ID NO: 448304 - RNA, 12 nt, Homo sapiens
aucaguugcuau

SEQ ID NO: 448305 - RNA, 20 nt, Homo sapiens
aucaguuugcuaacauauuu

SEQ ID NO: 448306 - RNA, 14 nt, Homo sapiens
aucauaugccugac

SEQ ID NO: 448307 - RNA, 21 nt, Homo sapiens
aucauauugguauucacuaau

SEQ ID NO: 448308 - RNA, 18 nt, Homo sapiens
aucauccgaggcaaagag

SEQ ID NO: 448309 - RNA, 23 nt, Homo sapiens
aucaucuuugcugaaugucauua

SEQ ID NO: 448310 - RNA, 20 nt, Homo sapiens
aucaugccccuguacuccag

SEQ ID NO: 448311 - RNA, 14 nt, Homo sapiens
aucauggcucacug

SEQ ID NO: 448312 - RNA, 17 nt, Homo sapiens
aucauguaaaugcucaa

SEQ ID NO: 448313 - RNA, 18 nt, Homo sapiens
aucauguaaaugcucaaa

SEQ ID NO: 448314 - RNA, 12 nt, Homo sapiens
aucauguuccua

SEQ ID NO: 448315 - RNA, 12 nt, Homo sapiens
aucauuaacagu

SEQ ID NO: 448316 - RNA, 23 nt, Homo sapiens
aucauucuccuuguaaaagccua

SEQ ID NO: 448317 - RNA, 16 nt, Homo sapiens
aucauuggaauacagg

SEQ ID NO: 448318 - RNA, 15 nt, Homo sapiens
aucauuucaguauca

SEQ ID NO: 448319 - RNA, 20 nt, Homo sapiens
aucauuucuugguaugauca

SEQ ID NO: 448320 - RNA, 22 nt, Homo sapiens
auccaagaccuuacaaccacau

SEQ ID NO: 448321 - RNA, 16 nt, Homo sapiens
auccaauuaugugaca

SEQ ID NO: 448322 - RNA, 14 nt, Homo sapiens
auccacaagccauu

SEQ ID NO: 448323 - RNA, 19 nt, Homo sapiens
auccaccaccuugccaaug

SEQ ID NO: 448324 - RNA, 21 nt, Homo sapiens
auccaccugcagcccuuuuag

SEQ ID NO: 448325 - RNA, 14 nt, Homo sapiens
auccacgcucaucu

SEQ ID NO: 448326 - RNA, 16 nt, Homo sapiens
auccagaggugaggga

SEQ ID NO: 448327 - RNA, 22 nt, Homo sapiens
auccagcaugugugugucucua

SEQ ID NO: 448328 - RNA, 22 nt, Homo sapiens
auccaggcacucagaaggcaaa

SEQ ID NO: 448329 - RNA, 13 nt, Homo sapiens
auccaggugccaa

SEQ ID NO: 448330 - RNA, 16 nt, Homo sapiens
auccagugcuuccaca

SEQ ID NO: 448331 - RNA, 20 nt, Homo sapiens
auccauagacacaguauuga

SEQ ID NO: 448332 - RNA, 21 nt, Homo sapiens
auccaugcagauaacagcugg

SEQ ID NO: 448333 - RNA, 23 nt, Homo sapiens
auccaugugcugcuguggcauca

SEQ ID NO: 448334 - RNA, 15 nt, Homo sapiens
aucccaacacuuugg

SEQ ID NO: 448335 - RNA, 23 nt, Homo sapiens
aucccacggaaaaugccaaucuc

SEQ ID NO: 448336 - RNA, 20 nt, Homo sapiens
aucccacuugccccuguuac

SEQ ID NO: 448337 - RNA, 15 nt, Homo sapiens
aucccagcaccugcc

SEQ ID NO: 448338 - RNA, 16 nt, Homo sapiens
aucccagcaccugcca

SEQ ID NO: 448339 - RNA, 20 nt, Homo sapiens
aucccagcagcccaagcuua

SEQ ID NO: 448340 - RNA, 17 nt, Homo sapiens
aucccauccaucagcuc

SEQ ID NO: 448341 - RNA, 14 nt, Homo sapiens
auccccaacuccau

SEQ ID NO: 448342 - RNA, 15 nt, Homo sapiens
auccccaccuuccaa

SEQ ID NO: 448343 - RNA, 12 nt, Homo sapiens
auccccagugaa

SEQ ID NO: 448344 - RNA, 22 nt, Homo sapiens
auccccugugaacuuaucaaaa

SEQ ID NO: 448345 - RNA, 22 nt, Homo sapiens
auccccuuuggcuaccugaugg

SEQ ID NO: 448346 - RNA, 18 nt, Homo sapiens
aucccgugaaagaauuau

SEQ ID NO: 448347 - RNA, 16 nt, Homo sapiens
aucccguguugccaug

SEQ ID NO: 448348 - RNA, 16 nt, Homo sapiens
aucccugaaacauugc

SEQ ID NO: 448349 - RNA, 18 nt, Homo sapiens
aucccugaaacauugcau

SEQ ID NO: 448350 - RNA, 16 nt, Homo sapiens
aucccuugaguuauau

SEQ ID NO: 448351 - RNA, 18 nt, Homo sapiens
auccgcaugugucuguau

SEQ ID NO: 448352 - RNA, 15 nt, Homo sapiens
auccuagacuugaaa

SEQ ID NO: 448353 - RNA, 21 nt, Homo sapiens
auccuauagagucaaccacca

SEQ ID NO: 448354 - RNA, 17 nt, Homo sapiens
auccucacccagcaccc

SEQ ID NO: 448355 - RNA, 20 nt, Homo sapiens
auccucacccagcacccaca

SEQ ID NO: 448356 - RNA, 21 nt, Homo sapiens
auccucagguaguacugggaa

SEQ ID NO: 448357 - RNA, 22 nt, Homo sapiens
auccuccucccaacucuagccu

SEQ ID NO: 448358 - RNA, 16 nt, Homo sapiens
auccuccuugucuuaa

SEQ ID NO: 448359 - RNA, 21 nt, Homo sapiens
auccucucccauggagacaag

SEQ ID NO: 448360 - RNA, 19 nt, Homo sapiens
auccugaguaguaaucuca

SEQ ID NO: 448361 - RNA, 23 nt, Homo sapiens
auccugauuauugaauguuauau

SEQ ID NO: 448362 - RNA, 16 nt, Homo sapiens
auccugcgagcuccuu

SEQ ID NO: 448363 - RNA, 16 nt, Homo sapiens
auccugcuagcuguag

SEQ ID NO: 448364 - RNA, 19 nt, Homo sapiens
auccuggcccucuguguug

SEQ ID NO: 448365 - RNA, 19 nt, Homo sapiens
auccuguaaucacaacuca

SEQ ID NO: 448366 - RNA, 21 nt, Homo sapiens
auccuguuacugaauuugcua

SEQ ID NO: 448367 - RNA, 12 nt, Homo sapiens
auccuguuacuu

SEQ ID NO: 448368 - RNA, 18 nt, Homo sapiens
auccuuaaguaucagaaa

SEQ ID NO: 448369 - RNA, 20 nt, Homo sapiens
auccuucacaggcagugcau

SEQ ID NO: 448370 - RNA, 15 nt, Homo sapiens
auccuuuacuguuag

SEQ ID NO: 448371 - RNA, 15 nt, Homo sapiens
aucgaaaguaaaaaa

SEQ ID NO: 448372 - RNA, 19 nt, Homo sapiens
aucgaggcucuugcucaag

SEQ ID NO: 448373 - RNA, 22 nt, Homo sapiens
aucgaucuggaaagagcuguuu

SEQ ID NO: 448374 - RNA, 22 nt, Homo sapiens
aucgcaccuuuuauaccagaga

SEQ ID NO: 448375 - RNA, 18 nt, Homo sapiens
aucgcucauagaucagca

SEQ ID NO: 448376 - RNA, 21 nt, Homo sapiens
aucgcuggaaaugaauagcca

SEQ ID NO: 448377 - RNA, 19 nt, Homo sapiens
aucgcuuucuacacuguau

SEQ ID NO: 448378 - RNA, 17 nt, Homo sapiens
aucggagacagugaucu

SEQ ID NO: 448379 - RNA, 16 nt, Homo sapiens
aucgggagcagugucu

SEQ ID NO: 448380 - RNA, 17 nt, Homo sapiens
aucggugcugucagccc

SEQ ID NO: 448381 - RNA, 17 nt, Homo sapiens
aucguucucugccucac

SEQ ID NO: 448382 - RNA, 23 nt, Homo sapiens
aucguuuucuuugcugugccaaa

SEQ ID NO: 448383 - RNA, 20 nt, Homo sapiens
aucuaaauagauacuuuuga

SEQ ID NO: 448384 - RNA, 19 nt, Homo sapiens
aucuaaucccuucaaggaa

SEQ ID NO: 448385 - RNA, 21 nt, Homo sapiens
aucuaauccuuaaaagcauaa

SEQ ID NO: 448386 - RNA, 13 nt, Homo sapiens
aucuacacccacc

SEQ ID NO: 448387 - RNA, 17 nt, Homo sapiens
aucuacagcucaccucu

SEQ ID NO: 448388 - RNA, 13 nt, Homo sapiens
aucuacccugcug

SEQ ID NO: 448389 - RNA, 18 nt, Homo sapiens
aucuacccugcugaccuc

SEQ ID NO: 448390 - RNA, 20 nt, Homo sapiens
aucuacccuugagucauauu

SEQ ID NO: 448391 - RNA, 11 nt, Homo sapiens
aucuaccuccc

SEQ ID NO: 448392 - RNA, 18 nt, Homo sapiens
aucuagaucaauuaauuc

SEQ ID NO: 448393 - RNA, 20 nt, Homo sapiens
aucuagcaagaagauucuaa

SEQ ID NO: 448394 - RNA, 14 nt, Homo sapiens
aucuagccaaagag

SEQ ID NO: 448395 - RNA, 16 nt, Homo sapiens
aucuaguuccugauag

SEQ ID NO: 448396 - RNA, 12 nt, Homo sapiens
aucuaguuuaca

SEQ ID NO: 448397 - RNA, 13 nt, Homo sapiens
aucuauaguauag

SEQ ID NO: 448398 - RNA, 18 nt, Homo sapiens
aucuaucuauauauacau

SEQ ID NO: 448399 - RNA, 20 nt, Homo sapiens
aucuauggauuggguaucaa

SEQ ID NO: 448400 - RNA, 12 nt, Homo sapiens
aucuaugggaga

SEQ ID NO: 448401 - RNA, 21 nt, Homo sapiens
aucuauuuaucugucugagcc

SEQ ID NO: 448402 - RNA, 12 nt, Homo sapiens
aucucagaagau

SEQ ID NO: 448403 - RNA, 21 nt, Homo sapiens
aucucagagguagggcugcca

SEQ ID NO: 448404 - RNA, 19 nt, Homo sapiens
aucucaggccaccugcccc

SEQ ID NO: 448405 - RNA, 15 nt, Homo sapiens
aucucaggugccacu

SEQ ID NO: 448406 - RNA, 18 nt, Homo sapiens
aucucauucagguguucu

SEQ ID NO: 448407 - RNA, 18 nt, Homo sapiens
aucuccaaaaacagugau

SEQ ID NO: 448408 - RNA, 21 nt, Homo sapiens
aucuccaauccacacauauug

SEQ ID NO: 448409 - RNA, 18 nt, Homo sapiens
aucuccccucagauucca

SEQ ID NO: 448410 - RNA, 21 nt, Homo sapiens
aucuccccucagauuccaccu

SEQ ID NO: 448411 - RNA, 19 nt, Homo sapiens
aucucccugcuucauaucu

SEQ ID NO: 448412 - RNA, 19 nt, Homo sapiens
auguauaauuucacagaua

SEQ ID NO: 448413 - RNA, 17 nt, Homo sapiens
auguauaucuuugcacu

SEQ ID NO: 448414 - RNA, 22 nt, Homo sapiens
auguauaugaacuuaacaugcu

SEQ ID NO: 448415 - RNA, 15 nt, Homo sapiens
auguaucuaaaugaa

SEQ ID NO: 448416 - RNA, 15 nt, Homo sapiens
auguaucuaccucac

SEQ ID NO: 448417 - RNA, 21 nt, Homo sapiens
auguaugcugauuuacuacuu

SEQ ID NO: 448418 - RNA, 14 nt, Homo sapiens
auguaugugcacug

SEQ ID NO: 448419 - RNA, 17 nt, Homo sapiens
auguauuggaacauguc

SEQ ID NO: 448420 - RNA, 19 nt, Homo sapiens
auguauuuaaccagucuuc

SEQ ID NO: 448421 - RNA, 20 nt, Homo sapiens
augucauugaugaacugcca

SEQ ID NO: 448422 - RNA, 15 nt, Homo sapiens
auguccaaguccaac

SEQ ID NO: 448423 - RNA, 22 nt, Homo sapiens
auguccaauggaguucagagau

SEQ ID NO: 448424 - RNA, 22 nt, Homo sapiens
auguccaugauggaauauuccc

SEQ ID NO: 448425 - RNA, 16 nt, Homo sapiens
auguccccugucccac

SEQ ID NO: 448426 - RNA, 18 nt, Homo sapiens
auguccuccaccacaaga

SEQ ID NO: 448427 - RNA, 22 nt, Homo sapiens
augucuauaaucccagcacuuu

SEQ ID NO: 448428 - RNA, 23 nt, Homo sapiens
augucucuacccacuaugcacag

SEQ ID NO: 448429 - RNA, 17 nt, Homo sapiens
augucucuuguagaaga

SEQ ID NO: 448430 - RNA, 11 nt, Homo sapiens
augucugugau

SEQ ID NO: 448431 - RNA, 21 nt, Homo sapiens
augucuuccuuggagggggga

SEQ ID NO: 448432 - RNA, 19 nt, Homo sapiens
augucuuuaaaaugauuca

SEQ ID NO: 448433 - RNA, 20 nt, Homo sapiens
augugaaaaaugugucugua

SEQ ID NO: 448434 - RNA, 23 nt, Homo sapiens
augugaagagggagaagcaugaa

SEQ ID NO: 448435 - RNA, 13 nt, Homo sapiens
augugaagcugaa

SEQ ID NO: 448436 - RNA, 17 nt, Homo sapiens
augugaauugaagucau

SEQ ID NO: 448437 - RNA, 19 nt, Homo sapiens
augugaccagacugcacag

SEQ ID NO: 448438 - RNA, 20 nt, Homo sapiens
augugagaccauuuagcaca

SEQ ID NO: 448439 - RNA, 16 nt, Homo sapiens
augugagcgagcaagc

SEQ ID NO: 448440 - RNA, 13 nt, Homo sapiens
augugauacaaau

SEQ ID NO: 448441 - RNA, 14 nt, Homo sapiens
augugauacaaauu

SEQ ID NO: 448442 - RNA, 16 nt, Homo sapiens
augugauggaacacac

SEQ ID NO: 448443 - RNA, 17 nt, Homo sapiens
augugcaaguguaugca

SEQ ID NO: 448444 - RNA, 13 nt, Homo sapiens
augugcagauauc

SEQ ID NO: 448445 - RNA, 13 nt, Homo sapiens
augugcauuucac

SEQ ID NO: 448446 - RNA, 18 nt, Homo sapiens
augugcauuucugugaug

SEQ ID NO: 448447 - RNA, 20 nt, Homo sapiens
augugcauuucugugauguu

SEQ ID NO: 448448 - RNA, 17 nt, Homo sapiens
augugccgaaugugcag

SEQ ID NO: 448449 - RNA, 18 nt, Homo sapiens
auguggaaucuccaggcu

SEQ ID NO: 448450 - RNA, 14 nt, Homo sapiens
auguggaugcucuu

SEQ ID NO: 448451 - RNA, 18 nt, Homo sapiens
auguggcagcugucucaa

SEQ ID NO: 448452 - RNA, 18 nt, Homo sapiens
auguggccaagggcucca

SEQ ID NO: 448453 - RNA, 15 nt, Homo sapiens
augugggugagccag

SEQ ID NO: 448454 - RNA, 18 nt, Homo sapiens
auguggguugugauauug

SEQ ID NO: 448455 - RNA, 20 nt, Homo sapiens
augugguguauauccuucca

SEQ ID NO: 448456 - RNA, 21 nt, Homo sapiens
augugucacuacucacagucu

SEQ ID NO: 448457 - RNA, 12 nt, Homo sapiens
augugucuucaa

SEQ ID NO: 448458 - RNA, 22 nt, Homo sapiens
augugugaagcaaauuucuaga

SEQ ID NO: 448459 - RNA, 15 nt, Homo sapiens
augugugaggagcug

SEQ ID NO: 448460 - RNA, 18 nt, Homo sapiens
augugugagugugugcaa

SEQ ID NO: 448461 - RNA, 16 nt, Homo sapiens
augugugcgagugugu

SEQ ID NO: 448462 - RNA, 12 nt, Homo sapiens
augugugugcaa

SEQ ID NO: 448463 - RNA, 14 nt, Homo sapiens
augugugugcuuug

SEQ ID NO: 448464 - RNA, 16 nt, Homo sapiens
auguguuaagugcagg

SEQ ID NO: 448465 - RNA, 20 nt, Homo sapiens
auguguuauuugucacaaau

SEQ ID NO: 448466 - RNA, 17 nt, Homo sapiens
auguguuuuaauuccaa

SEQ ID NO: 448467 - RNA, 16 nt, Homo sapiens
auguuaaagcaucaga

SEQ ID NO: 448468 - RNA, 17 nt, Homo sapiens
auguuaacaccuaccuc

SEQ ID NO: 448469 - RNA, 16 nt, Homo sapiens
auguuaaccucagugu

SEQ ID NO: 448470 - RNA, 18 nt, Homo sapiens
auguuagaaguccaggca

SEQ ID NO: 448471 - RNA, 13 nt, Homo sapiens
auguuaguggcau

SEQ ID NO: 448472 - RNA, 18 nt, Homo sapiens
auguucauuaaguucuga

SEQ ID NO: 448473 - RNA, 16 nt, Homo sapiens
auguuccguucaucug

SEQ ID NO: 448474 - RNA, 15 nt, Homo sapiens
auguucuaacagauc

SEQ ID NO: 448475 - RNA, 15 nt, Homo sapiens
auguucugacagcau

SEQ ID NO: 448476 - RNA, 15 nt, Homo sapiens
auguucugacauuaa

SEQ ID NO: 448477 - RNA, 23 nt, Homo sapiens
auguugcaugccuauguacucua

SEQ ID NO: 448478 - RNA, 21 nt, Homo sapiens
auguugugauguauucuagcu

SEQ ID NO: 448479 - RNA, 23 nt, Homo sapiens
auguuguuaugcuauuaaaguga

SEQ ID NO: 448480 - RNA, 19 nt, Homo sapiens
auguuuaaaggacccuaua

SEQ ID NO: 448481 - RNA, 19 nt, Homo sapiens
auguuuaccucacuggugc

SEQ ID NO: 448482 - RNA, 15 nt, Homo sapiens
auguuuaugagccag

SEQ ID NO: 448483 - RNA, 23 nt, Homo sapiens
auguuucccuacuaacaucccaa

SEQ ID NO: 448484 - RNA, 20 nt, Homo sapiens
auguuucuaucuuguauguc

SEQ ID NO: 448485 - RNA, 13 nt, Homo sapiens
auguuugcauuaa

SEQ ID NO: 448486 - RNA, 22 nt, Homo sapiens
auguuuguacacaacaccuaaa

SEQ ID NO: 448487 - RNA, 17 nt, Homo sapiens
auguuuguggccucaga

SEQ ID NO: 448488 - RNA, 22 nt, Homo sapiens
auguuuugaaauguaccaucaa

SEQ ID NO: 448489 - RNA, 23 nt, Homo sapiens
auguuuuuguguagaguggcgau

SEQ ID NO: 448490 - RNA, 22 nt, Homo sapiens
auuaaaaaagcucaaugcauug

SEQ ID NO: 448491 - RNA, 23 nt, Homo sapiens
auuaaacgaggcaaugacuguga

SEQ ID NO: 448492 - RNA, 19 nt, Homo sapiens
auuaaagcaagagaauuau

SEQ ID NO: 448493 - RNA, 21 nt, Homo sapiens
auuaaaggggcugucucccaa

SEQ ID NO: 448494 - RNA, 17 nt, Homo sapiens
auuaaauggcaccugua

SEQ ID NO: 448495 - RNA, 21 nt, Homo sapiens
auuaaauggugauuucuugcu

SEQ ID NO: 448496 - RNA, 13 nt, Homo sapiens
auuaaauuaggaa

SEQ ID NO: 448497 - RNA, 15 nt, Homo sapiens
auuaacaucaaagac

SEQ ID NO: 448498 - RNA, 14 nt, Homo sapiens
auuaaccuggugcu

SEQ ID NO: 448499 - RNA, 20 nt, Homo sapiens
auuaacuauuaguguuaacu

SEQ ID NO: 448500 - RNA, 20 nt, Homo sapiens
auuaacugaauucugaacuu

SEQ ID NO: 448501 - RNA, 17 nt, Homo sapiens
auuaacuuaaaagauuc

SEQ ID NO: 448502 - RNA, 20 nt, Homo sapiens
auuaagagagugaacauauc

SEQ ID NO: 448503 - RNA, 16 nt, Homo sapiens
auuaagauacacuccu

SEQ ID NO: 448504 - RNA, 18 nt, Homo sapiens
auuaagauggucauauua

SEQ ID NO: 448505 - RNA, 19 nt, Homo sapiens
auuaagcuccuucaguuug

SEQ ID NO: 448506 - RNA, 16 nt, Homo sapiens
auuaaggcaguaugcc

SEQ ID NO: 448507 - RNA, 16 nt, Homo sapiens
auuaauauauccuaaa

SEQ ID NO: 448508 - RNA, 16 nt, Homo sapiens
auuaauccacacauca

SEQ ID NO: 448509 - RNA, 17 nt, Homo sapiens
auuaauccauuuuaaca

SEQ ID NO: 448510 - RNA, 15 nt, Homo sapiens
auuaaugaacuguga

SEQ ID NO: 448511 - RNA, 20 nt, Homo sapiens
auuaauguguuaagugcagg

SEQ ID NO: 448512 - RNA, 13 nt, Homo sapiens
auuaauguuaauu

SEQ ID NO: 448513 - RNA, 23 nt, Homo sapiens
auuaauguuaauucagcacugau

SEQ ID NO: 448514 - RNA, 12 nt, Homo sapiens
auuaauucaccu

SEQ ID NO: 448515 - RNA, 23 nt, Homo sapiens
auuaauugguuugugccuuacau

SEQ ID NO: 448516 - RNA, 14 nt, Homo sapiens
auuacaauugucau

SEQ ID NO: 448517 - RNA, 14 nt, Homo sapiens
auuacaauugugag

SEQ ID NO: 448518 - RNA, 18 nt, Homo sapiens
auuacacgccacaacucc

SEQ ID NO: 448519 - RNA, 14 nt, Homo sapiens
auuacagacaugaa

SEQ ID NO: 448520 - RNA, 19 nt, Homo sapiens
auuacagacaugaaccacc

SEQ ID NO: 448521 - RNA, 19 nt, Homo sapiens
auuacaggaaguacuggag

SEQ ID NO: 448522 - RNA, 20 nt, Homo sapiens
auuacaguuuggaaguguua

SEQ ID NO: 448523 - RNA, 17 nt, Homo sapiens
auuacauggcugugguu

SEQ ID NO: 448524 - RNA, 20 nt, Homo sapiens
auuacccccuuuccucuugg

SEQ ID NO: 448525 - RNA, 21 nt, Homo sapiens
auuaccgucugugauugccau

SEQ ID NO: 448526 - RNA, 17 nt, Homo sapiens
auuaccucugauaccuc

SEQ ID NO: 448527 - RNA, 18 nt, Homo sapiens
auuaccugucaucugggc

SEQ ID NO: 448528 - RNA, 22 nt, Homo sapiens
auuacuaguacuaguacuauga

SEQ ID NO: 448529 - RNA, 18 nt, Homo sapiens
auuacuguugcauuuacu

SEQ ID NO: 448530 - RNA, 19 nt, Homo sapiens
auuacuguugcauuuacuu

SEQ ID NO: 448531 - RNA, 22 nt, Homo sapiens
auuagaaacacacuuuugcaca

SEQ ID NO: 448532 - RNA, 21 nt, Homo sapiens
auuagaaacugaaaacuguaa

SEQ ID NO: 448533 - RNA, 14 nt, Homo sapiens
auuagaagccaaga

SEQ ID NO: 448534 - RNA, 17 nt, Homo sapiens
auuagaaugcauguaag

SEQ ID NO: 448535 - RNA, 15 nt, Homo sapiens
auuagaggauugcac

SEQ ID NO: 448536 - RNA, 16 nt, Homo sapiens
auuagaugaacucaac

SEQ ID NO: 448537 - RNA, 22 nt, Homo sapiens
auuagcaaguuacagugaugcu

SEQ ID NO: 448538 - RNA, 13 nt, Homo sapiens
auuagcauuccau

SEQ ID NO: 448539 - RNA, 10 nt, Homo sapiens
auuagcugug

SEQ ID NO: 448540 - RNA, 15 nt, Homo sapiens
auuaggaaguguaac

SEQ ID NO: 448541 - RNA, 20 nt, Homo sapiens
cuaaacagacuauuuaacuu

SEQ ID NO: 448542 - RNA, 14 nt, Homo sapiens
cuaaacagauauaa

SEQ ID NO: 448543 - RNA, 14 nt, Homo sapiens
cuaaacugagacaa

SEQ ID NO: 448544 - RNA, 20 nt, Homo sapiens
cuaaagaaaaacuaauguca

SEQ ID NO: 448545 - RNA, 13 nt, Homo sapiens
cuaaagagcuuua

SEQ ID NO: 448546 - RNA, 22 nt, Homo sapiens
cuaaagcagccagccgugagug

SEQ ID NO: 448547 - RNA, 20 nt, Homo sapiens
cuaaagcagggaagugacag

SEQ ID NO: 448548 - RNA, 19 nt, Homo sapiens
cuaaauacuguaacacugu

SEQ ID NO: 448549 - RNA, 22 nt, Homo sapiens
cuaaauacuguaacacuguaua

SEQ ID NO: 448550 - RNA, 20 nt, Homo sapiens
cuaaauauccaaagacugua

SEQ ID NO: 448551 - RNA, 18 nt, Homo sapiens
cuaaauccuuuacuguua

SEQ ID NO: 448552 - RNA, 22 nt, Homo sapiens
cuaaaucuguaagcucuuugaa

SEQ ID NO: 448553 - RNA, 16 nt, Homo sapiens
cuaaaugcagugaauu

SEQ ID NO: 448554 - RNA, 19 nt, Homo sapiens
cuaaauggcaacaaacaca

SEQ ID NO: 448555 - RNA, 16 nt, Homo sapiens
cuaaaugucagcuguu

SEQ ID NO: 448556 - RNA, 20 nt, Homo sapiens
cuaaauuuacguauauuuca

SEQ ID NO: 448557 - RNA, 15 nt, Homo sapiens
cuaaauuugguucua

SEQ ID NO: 448558 - RNA, 11 nt, Homo sapiens
cuaacaaaaga

SEQ ID NO: 448559 - RNA, 20 nt, Homo sapiens
cuaacaaacugaaaaaucua

SEQ ID NO: 448560 - RNA, 22 nt, Homo sapiens
cuaacaaguagcacccuggauu

SEQ ID NO: 448561 - RNA, 20 nt, Homo sapiens
cuaacaccacacugaccaca

SEQ ID NO: 448562 - RNA, 22 nt, Homo sapiens
cuaacagacauagacugcaaaa

SEQ ID NO: 448563 - RNA, 21 nt, Homo sapiens
cuaacaggauuagacagucaa

SEQ ID NO: 448564 - RNA, 14 nt, Homo sapiens
cuaacauagugucu

SEQ ID NO: 448565 - RNA, 18 nt, Homo sapiens
cuaacauuggugcaaaga

SEQ ID NO: 448566 - RNA, 17 nt, Homo sapiens
cuaacgacuucagggca

SEQ ID NO: 448567 - RNA, 19 nt, Homo sapiens
cuaacuguaugugucuuua

SEQ ID NO: 448568 - RNA, 23 nt, Homo sapiens
cuaagacugugacaacugucuaa

SEQ ID NO: 448569 - RNA, 12 nt, Homo sapiens
cuaagagaucug

SEQ ID NO: 448570 - RNA, 15 nt, Homo sapiens
cuaagagugaaguag

SEQ ID NO: 448571 - RNA, 15 nt, Homo sapiens
cuaagaugggugggg

SEQ ID NO: 448572 - RNA, 15 nt, Homo sapiens
cuaagccaacuuuaa

SEQ ID NO: 448573 - RNA, 15 nt, Homo sapiens
cuaagccaguuuuca

SEQ ID NO: 448574 - RNA, 14 nt, Homo sapiens
cuaagccugaugau

SEQ ID NO: 448575 - RNA, 11 nt, Homo sapiens
cuaagccuuuc

SEQ ID NO: 448576 - RNA, 17 nt, Homo sapiens
cuaagcucaaauguaua

SEQ ID NO: 448577 - RNA, 13 nt, Homo sapiens
cuaagcuguaacc

SEQ ID NO: 448578 - RNA, 21 nt, Homo sapiens
cuaaggccaaggccucaggag

SEQ ID NO: 448579 - RNA, 21 nt, Homo sapiens
cuaagggaaauaacaguauuu

SEQ ID NO: 448580 - RNA, 15 nt, Homo sapiens
cuaagguacggugag

SEQ ID NO: 448581 - RNA, 20 nt, Homo sapiens
cuaagugggagaaggacuau

SEQ ID NO: 448582 - RNA, 15 nt, Homo sapiens
cuaaguuauuuacuu

SEQ ID NO: 448583 - RNA, 19 nt, Homo sapiens
cuaaguuauuuacuuuuac

SEQ ID NO: 448584 - RNA, 16 nt, Homo sapiens
cuaauaaaacuuugac

SEQ ID NO: 448585 - RNA, 14 nt, Homo sapiens
cuaauaaaauauca

SEQ ID NO: 448586 - RNA, 16 nt, Homo sapiens
cuaauaaaauaucauu

SEQ ID NO: 448587 - RNA, 20 nt, Homo sapiens
cuaauaaauauacuaugaaa

SEQ ID NO: 448588 - RNA, 20 nt, Homo sapiens
cuaauaauaaauuaauaaca

SEQ ID NO: 448589 - RNA, 22 nt, Homo sapiens
cuaauagacuuagccccaugag

SEQ ID NO: 448590 - RNA, 22 nt, Homo sapiens
cuaauagagugguacagcacug

SEQ ID NO: 448591 - RNA, 17 nt, Homo sapiens
cuaauagcccaagaaug

SEQ ID NO: 448592 - RNA, 18 nt, Homo sapiens
cuaauaugccuagcacaa

SEQ ID NO: 448593 - RNA, 23 nt, Homo sapiens
cuaaucagaguggccaaucccug

SEQ ID NO: 448594 - RNA, 15 nt, Homo sapiens
cuaaucagcucccuu

SEQ ID NO: 448595 - RNA, 21 nt, Homo sapiens
cuaaugaguggucggaccgug

SEQ ID NO: 448596 - RNA, 20 nt, Homo sapiens
cuaaugcuucaaguguugcu

SEQ ID NO: 448597 - RNA, 14 nt, Homo sapiens
cuaaugucagcaca

SEQ ID NO: 448598 - RNA, 20 nt, Homo sapiens
cuaauguggcagcugucuca

SEQ ID NO: 448599 - RNA, 23 nt, Homo sapiens
cuaauguuuaaaagcaaaacugc

SEQ ID NO: 448600 - RNA, 12 nt, Homo sapiens
cuaauuaauucu

SEQ ID NO: 448601 - RNA, 14 nt, Homo sapiens
cuaauuauaaugca

SEQ ID NO: 448602 - RNA, 18 nt, Homo sapiens
cuaauuauaaugcaaauu

SEQ ID NO: 448603 - RNA, 18 nt, Homo sapiens
cuaauucugggaagggag

SEQ ID NO: 448604 - RNA, 18 nt, Homo sapiens
cuaauucuuauuuuauaa

SEQ ID NO: 448605 - RNA, 15 nt, Homo sapiens
cuaauuuacaagcac

SEQ ID NO: 448606 - RNA, 20 nt, Homo sapiens
cuaauuuucuagauuuucua

SEQ ID NO: 448607 - RNA, 15 nt, Homo sapiens
cuacaaaaugacuag

SEQ ID NO: 448608 - RNA, 15 nt, Homo sapiens
cuacaaccagagccc

SEQ ID NO: 448609 - RNA, 13 nt, Homo sapiens
cuacacaacaugu

SEQ ID NO: 448610 - RNA, 17 nt, Homo sapiens
cuacacacauccacgca

SEQ ID NO: 448611 - RNA, 22 nt, Homo sapiens
cuacagacaccaaguuccguca

SEQ ID NO: 448612 - RNA, 13 nt, Homo sapiens
cuacagacauuaa

SEQ ID NO: 448613 - RNA, 21 nt, Homo sapiens
cuacagagcagcuccccagga

SEQ ID NO: 448614 - RNA, 14 nt, Homo sapiens
cuacagauuuuaga

SEQ ID NO: 448615 - RNA, 15 nt, Homo sapiens
cuacaggcauuuaac

SEQ ID NO: 448616 - RNA, 19 nt, Homo sapiens
cuacaguauacuugguuga

SEQ ID NO: 448617 - RNA, 16 nt, Homo sapiens
cuacauucugaaggcc

SEQ ID NO: 448618 - RNA, 21 nt, Homo sapiens
cuacauugacgagcaugagcu

SEQ ID NO: 448619 - RNA, 13 nt, Homo sapiens
cuaccacaaggaa

SEQ ID NO: 448620 - RNA, 16 nt, Homo sapiens
cuaccaccccacuggc

SEQ ID NO: 448621 - RNA, 17 nt, Homo sapiens
cuaccagcuaugccaaa

SEQ ID NO: 448622 - RNA, 21 nt, Homo sapiens
cuaccagguguucuacacuca

SEQ ID NO: 448623 - RNA, 11 nt, Homo sapiens
cuaccaucucc

SEQ ID NO: 448624 - RNA, 14 nt, Homo sapiens
cuacccacuaugca

SEQ ID NO: 448625 - RNA, 23 nt, Homo sapiens
cuacccagacucagagaccguga

SEQ ID NO: 448626 - RNA, 14 nt, Homo sapiens
cuacccgagcccag

SEQ ID NO: 448627 - RNA, 18 nt, Homo sapiens
cuacccugcugaccuccc

SEQ ID NO: 448628 - RNA, 18 nt, Homo sapiens
cuacccuugagucauauu

SEQ ID NO: 448629 - RNA, 23 nt, Homo sapiens
cuaccgagucucuucuccacugg

SEQ ID NO: 448630 - RNA, 15 nt, Homo sapiens
cuaccguaaaugucc

SEQ ID NO: 448631 - RNA, 18 nt, Homo sapiens
cuaccuauaaauggacuu

SEQ ID NO: 448632 - RNA, 14 nt, Homo sapiens
cuacgaaagcacag

SEQ ID NO: 448633 - RNA, 14 nt, Homo sapiens
cuacgccaaagugc

SEQ ID NO: 448634 - RNA, 22 nt, Homo sapiens
cuacgguuuuauaaaagccuug

SEQ ID NO: 448635 - RNA, 18 nt, Homo sapiens
cuacguauaaauaugaaa

SEQ ID NO: 448636 - RNA, 15 nt, Homo sapiens
cuacuaaaaacacaa

SEQ ID NO: 448637 - RNA, 17 nt, Homo sapiens
cuacuacccgagcccag

SEQ ID NO: 448638 - RNA, 14 nt, Homo sapiens
cuacuagagucuga

SEQ ID NO: 448639 - RNA, 22 nt, Homo sapiens
cuacuaugugcugggugccucc

SEQ ID NO: 448640 - RNA, 15 nt, Homo sapiens
cuacugaacuguuac

SEQ ID NO: 448641 - RNA, 17 nt, Homo sapiens
cuacuggagauaccaga

SEQ ID NO: 448642 - RNA, 13 nt, Homo sapiens
cuacuggcagcuc

SEQ ID NO: 448643 - RNA, 15 nt, Homo sapiens
cuacuuaaugagaua

SEQ ID NO: 448644 - RNA, 20 nt, Homo sapiens
cuacuugggaggcugaggca

SEQ ID NO: 448645 - RNA, 21 nt, Homo sapiens
cuacuuuauuuugaaacauuu

SEQ ID NO: 448646 - RNA, 18 nt, Homo sapiens
cuagaaagccauauucca

SEQ ID NO: 448647 - RNA, 14 nt, Homo sapiens
cuagaaucacuuga

SEQ ID NO: 448648 - RNA, 20 nt, Homo sapiens
cuagaauuauaagucacaaa

SEQ ID NO: 448649 - RNA, 23 nt, Homo sapiens
cuagacguucauuugugugcuca

SEQ ID NO: 448650 - RNA, 12 nt, Homo sapiens
cuagagccucac

SEQ ID NO: 448651 - RNA, 23 nt, Homo sapiens
cuagagcuagaugugucuuacca

SEQ ID NO: 448652 - RNA, 16 nt, Homo sapiens
cuagagcuaugcacac

SEQ ID NO: 448653 - RNA, 15 nt, Homo sapiens
cuagagcucaguaua

SEQ ID NO: 448654 - RNA, 22 nt, Homo sapiens
cuagaggacauauucacaguga

SEQ ID NO: 448655 - RNA, 14 nt, Homo sapiens
cuagaggcgagcca

SEQ ID NO: 448656 - RNA, 17 nt, Homo sapiens
cuagaguccucacuccc

SEQ ID NO: 448657 - RNA, 12 nt, Homo sapiens
cuagaguuuuau

SEQ ID NO: 448658 - RNA, 13 nt, Homo sapiens
cuagaugagccca

SEQ ID NO: 448659 - RNA, 15 nt, Homo sapiens
cuagaugagcccagc

SEQ ID NO: 448660 - RNA, 21 nt, Homo sapiens
cuagaugagcccagcccuguu

SEQ ID NO: 448661 - RNA, 17 nt, Homo sapiens
cuagaugggcauggggu

SEQ ID NO: 448662 - RNA, 14 nt, Homo sapiens
cuagaugugucuua

SEQ ID NO: 448663 - RNA, 23 nt, Homo sapiens
cuagauuaguaguaaaugcuuga

SEQ ID NO: 448664 - RNA, 18 nt, Homo sapiens
cuagauuuucuacuuuau

SEQ ID NO: 448665 - RNA, 19 nt, Homo sapiens
cuagauuuucuacuuuauu

SEQ ID NO: 448666 - RNA, 17 nt, Homo sapiens
cuagcaagaccuguugg

SEQ ID NO: 448667 - RNA, 18 nt, Homo sapiens
cuagcaauugcuucucua

SEQ ID NO: 448668 - RNA, 19 nt, Homo sapiens
cuagcagaaaaaugaaaga

SEQ ID NO: 448669 - RNA, 16 nt, Homo sapiens
cuagcauuuucuugaa

SEQ ID NO: 448670 - RNA, 13 nt, Homo sapiens
cuagccaaauggu

SEQ ID NO: 448671 - RNA, 16 nt, Homo sapiens
cucugcacuacugaca

SEQ ID NO: 448672 - RNA, 17 nt, Homo sapiens
cucugcacuacugacau

SEQ ID NO: 448673 - RNA, 22 nt, Homo sapiens
cucugcacuauagccauuugcc

SEQ ID NO: 448674 - RNA, 16 nt, Homo sapiens
cucugcagcccacaga

SEQ ID NO: 448675 - RNA, 21 nt, Homo sapiens
cucugcagcccacagaggaca

SEQ ID NO: 448676 - RNA, 21 nt, Homo sapiens
cucugcauccgacacccaccc

SEQ ID NO: 448677 - RNA, 18 nt, Homo sapiens
cucugcaugacaaacaca

SEQ ID NO: 448678 - RNA, 20 nt, Homo sapiens
cucugcauuaucugagguca

SEQ ID NO: 448679 - RNA, 15 nt, Homo sapiens
cucugcauucuagua

SEQ ID NO: 448680 - RNA, 16 nt, Homo sapiens
cucugccgguccccca

SEQ ID NO: 448681 - RNA, 17 nt, Homo sapiens
cucugccuccucuucaa

SEQ ID NO: 448682 - RNA, 14 nt, Homo sapiens
cucugcucaaugaa

SEQ ID NO: 448683 - RNA, 15 nt, Homo sapiens
cucugcuccacagaa

SEQ ID NO: 448684 - RNA, 21 nt, Homo sapiens
cucugcuguauugauaucacu

SEQ ID NO: 448685 - RNA, 17 nt, Homo sapiens
cucuggacaagucaucu

SEQ ID NO: 448686 - RNA, 21 nt, Homo sapiens
cucuggcuacgacuugggacg

SEQ ID NO: 448687 - RNA, 15 nt, Homo sapiens
cucugggcacagccu

SEQ ID NO: 448688 - RNA, 17 nt, Homo sapiens
cucuggggucuuuuuau

SEQ ID NO: 448689 - RNA, 16 nt, Homo sapiens
cucuggggugcacaug

SEQ ID NO: 448690 - RNA, 22 nt, Homo sapiens
cucugguaaaugaucacuccag

SEQ ID NO: 448691 - RNA, 19 nt, Homo sapiens
cucugguccuucugacccc

SEQ ID NO: 448692 - RNA, 16 nt, Homo sapiens
cucuggucugggugcc

SEQ ID NO: 448693 - RNA, 22 nt, Homo sapiens
cucuguagggaacucugggguc

SEQ ID NO: 448694 - RNA, 17 nt, Homo sapiens
cucugucuuccugguca

SEQ ID NO: 448695 - RNA, 23 nt, Homo sapiens
cucuguuuugcauggaguauuau

SEQ ID NO: 448696 - RNA, 19 nt, Homo sapiens
cucuuaaauauacaacuuu

SEQ ID NO: 448697 - RNA, 15 nt, Homo sapiens
cucuuacaaaacucu

SEQ ID NO: 448698 - RNA, 15 nt, Homo sapiens
cucuuacaaccaaga

SEQ ID NO: 448699 - RNA, 15 nt, Homo sapiens
cucuuaccuguaaua

SEQ ID NO: 448700 - RNA, 19 nt, Homo sapiens
cucuuaugggauuacaugu

SEQ ID NO: 448701 - RNA, 12 nt, Homo sapiens
cucuuauuacag

SEQ ID NO: 448702 - RNA, 15 nt, Homo sapiens
cucuucaagcuugaa

SEQ ID NO: 448703 - RNA, 14 nt, Homo sapiens
cucuucaagcuuuu

SEQ ID NO: 448704 - RNA, 16 nt, Homo sapiens
cucuucaaucucuugc

SEQ ID NO: 448705 - RNA, 19 nt, Homo sapiens
cucuucagaaaacccuuuu

SEQ ID NO: 448706 - RNA, 20 nt, Homo sapiens
cucuuccacuuugauaccau

SEQ ID NO: 448707 - RNA, 22 nt, Homo sapiens
cucuuccacuuugauaccauug

SEQ ID NO: 448708 - RNA, 21 nt, Homo sapiens
cucuuccaggaagcacaggcc

SEQ ID NO: 448709 - RNA, 15 nt, Homo sapiens
cucuucccaugacug

SEQ ID NO: 448710 - RNA, 18 nt, Homo sapiens
cucuucccccucucccag

SEQ ID NO: 448711 - RNA, 22 nt, Homo sapiens
cucuuccuacccaaccacucaa

SEQ ID NO: 448712 - RNA, 14 nt, Homo sapiens
cucuuccucugcag

SEQ ID NO: 448713 - RNA, 21 nt, Homo sapiens
cucuuccuggaaugcauucac

SEQ ID NO: 448714 - RNA, 13 nt, Homo sapiens
cucuucuacuucu

SEQ ID NO: 448715 - RNA, 18 nt, Homo sapiens
cucuugccuaaguauucc

SEQ ID NO: 448716 - RNA, 13 nt, Homo sapiens
cucuugcugccac

SEQ ID NO: 448717 - RNA, 22 nt, Homo sapiens
cucuuggagcugagaugagccc

SEQ ID NO: 448718 - RNA, 20 nt, Homo sapiens
cucuugggcugagacuggau

SEQ ID NO: 448719 - RNA, 20 nt, Homo sapiens
cucuuggguucaagugauuc

SEQ ID NO: 448720 - RNA, 17 nt, Homo sapiens
cucuuguauaugaugau

SEQ ID NO: 448721 - RNA, 15 nt, Homo sapiens
cucuuuaaucuucag

SEQ ID NO: 448722 - RNA, 23 nt, Homo sapiens
cucuuuaguugauuuaaacucuu

SEQ ID NO: 448723 - RNA, 13 nt, Homo sapiens
cucuuuaugacug

SEQ ID NO: 448724 - RNA, 22 nt, Homo sapiens
cucuuucaauugcagaugccaa

SEQ ID NO: 448725 - RNA, 17 nt, Homo sapiens
cucuuucucugccagug

SEQ ID NO: 448726 - RNA, 20 nt, Homo sapiens
cucuuuucccucucuaggcc

SEQ ID NO: 448727 - RNA, 20 nt, Homo sapiens
cucuuuugagacuuugccca

SEQ ID NO: 448728 - RNA, 23 nt, Homo sapiens
cucuuuuuaaagaaaaaugcuaa

SEQ ID NO: 448729 - RNA, 18 nt, Homo sapiens
cugaaaaagaacuguauu

SEQ ID NO: 448730 - RNA, 21 nt, Homo sapiens
cugaaaaaugacugucccauu

SEQ ID NO: 448731 - RNA, 21 nt, Homo sapiens
cugaaaagaaaugcuaaugua

SEQ ID NO: 448732 - RNA, 21 nt, Homo sapiens
cugaaaagauguugugucuug

SEQ ID NO: 448733 - RNA, 13 nt, Homo sapiens
cugaaaauucugu

SEQ ID NO: 448734 - RNA, 12 nt, Homo sapiens
cugaaacuucaa

SEQ ID NO: 448735 - RNA, 15 nt, Homo sapiens
cugaaagaagacauc

SEQ ID NO: 448736 - RNA, 12 nt, Homo sapiens
cugaaagccugu

SEQ ID NO: 448737 - RNA, 17 nt, Homo sapiens
cugaaagucaugcacau

SEQ ID NO: 448738 - RNA, 18 nt, Homo sapiens
cugaaauaacauggccuu

SEQ ID NO: 448739 - RNA, 15 nt, Homo sapiens
cugaaauacauauga

SEQ ID NO: 448740 - RNA, 16 nt, Homo sapiens
cugaaaucagugccua

SEQ ID NO: 448741 - RNA, 14 nt, Homo sapiens
cugaacaauuaccu

SEQ ID NO: 448742 - RNA, 18 nt, Homo sapiens
cugaacauucuugcucaa

SEQ ID NO: 448743 - RNA, 17 nt, Homo sapiens
cugaaccauuacuguaa

SEQ ID NO: 448744 - RNA, 13 nt, Homo sapiens
cugaaccccaugg

SEQ ID NO: 448745 - RNA, 22 nt, Homo sapiens
cugaacuaauaaaucuguugcc

SEQ ID NO: 448746 - RNA, 13 nt, Homo sapiens
cugaagaagacca

SEQ ID NO: 448747 - RNA, 20 nt, Homo sapiens
cugaagagcaggugagcaaa

SEQ ID NO: 448748 - RNA, 15 nt, Homo sapiens
cugaagauaaucuua

SEQ ID NO: 448749 - RNA, 13 nt, Homo sapiens
cugaagcuuuuua

SEQ ID NO: 448750 - RNA, 19 nt, Homo sapiens
cugaagguaauacuauaaa

SEQ ID NO: 448751 - RNA, 20 nt, Homo sapiens
cugaagucuuuguacagaca

SEQ ID NO: 448752 - RNA, 14 nt, Homo sapiens
cugaaguuucacau

SEQ ID NO: 448753 - RNA, 20 nt, Homo sapiens
cugaaguuucacaugagcua

SEQ ID NO: 448754 - RNA, 23 nt, Homo sapiens
cugaauauuaagaaacaauuuaa

SEQ ID NO: 448755 - RNA, 18 nt, Homo sapiens
cugaauccucaugaggcu

SEQ ID NO: 448756 - RNA, 17 nt, Homo sapiens
cugaaugcauucagggg

SEQ ID NO: 448757 - RNA, 13 nt, Homo sapiens
cugacaagugaag

SEQ ID NO: 448758 - RNA, 14 nt, Homo sapiens
cugacaccaagaag

SEQ ID NO: 448759 - RNA, 13 nt, Homo sapiens
cugacagcaauaa

SEQ ID NO: 448760 - RNA, 15 nt, Homo sapiens
cugacaguaaaucuc

SEQ ID NO: 448761 - RNA, 23 nt, Homo sapiens
cugacaugugacaucuaccuccc

SEQ ID NO: 448762 - RNA, 16 nt, Homo sapiens
cugacauuucacuucc

SEQ ID NO: 448763 - RNA, 14 nt, Homo sapiens
cugaccacagaauu

SEQ ID NO: 448764 - RNA, 13 nt, Homo sapiens
cugacccuagcuc

SEQ ID NO: 448765 - RNA, 20 nt, Homo sapiens
cugacccuccuccacuccac

SEQ ID NO: 448766 - RNA, 22 nt, Homo sapiens
cugaccucaagcaaccaugaac

SEQ ID NO: 448767 - RNA, 17 nt, Homo sapiens
cugaccucaugauccac

SEQ ID NO: 448768 - RNA, 16 nt, Homo sapiens
cugaccucccagugac

SEQ ID NO: 448769 - RNA, 19 nt, Homo sapiens
cugaccuccuggacuguag

SEQ ID NO: 448770 - RNA, 19 nt, Homo sapiens
cugaccuggcuggugacag

SEQ ID NO: 448771 - RNA, 16 nt, Homo sapiens
cugacuguugccuuug

SEQ ID NO: 448772 - RNA, 15 nt, Homo sapiens
cugacuuaacaacug

SEQ ID NO: 448773 - RNA, 18 nt, Homo sapiens
cugacuuaaguggcauua

SEQ ID NO: 448774 - RNA, 20 nt, Homo sapiens
cugacuuaaguggcauuaaa

SEQ ID NO: 448775 - RNA, 18 nt, Homo sapiens
cugacuuuugcagaugga

SEQ ID NO: 448776 - RNA, 13 nt, Homo sapiens
cugagaaaccucg

SEQ ID NO: 448777 - RNA, 21 nt, Homo sapiens
cugagaaagagaaugagaaga

SEQ ID NO: 448778 - RNA, 15 nt, Homo sapiens
cugagaaauggggug

SEQ ID NO: 448779 - RNA, 17 nt, Homo sapiens
cugagaacaaauacaau

SEQ ID NO: 448780 - RNA, 22 nt, Homo sapiens
cugagaacagaucuccaaagcu

SEQ ID NO: 448781 - RNA, 23 nt, Homo sapiens
cugagaaggcuaaagaagacaca

SEQ ID NO: 448782 - RNA, 19 nt, Homo sapiens
cugagaagucaaacauuuc

SEQ ID NO: 448783 - RNA, 12 nt, Homo sapiens
cugagacacaaa

SEQ ID NO: 448784 - RNA, 20 nt, Homo sapiens
cugagacauucuucaccucc

SEQ ID NO: 448785 - RNA, 23 nt, Homo sapiens
cugagaccaguugggagcacugg

SEQ ID NO: 448786 - RNA, 16 nt, Homo sapiens
cugagagcucacagua

SEQ ID NO: 448787 - RNA, 16 nt, Homo sapiens
cugagaucacucgcuu

SEQ ID NO: 448788 - RNA, 22 nt, Homo sapiens
cugagauuacagacaugagccu

SEQ ID NO: 448789 - RNA, 16 nt, Homo sapiens
cugagcagugccagcu

SEQ ID NO: 448790 - RNA, 17 nt, Homo sapiens
cugagcagugccagcuu

SEQ ID NO: 448791 - RNA, 23 nt, Homo sapiens
cugagcccuccuucuugcccuga

SEQ ID NO: 448792 - RNA, 16 nt, Homo sapiens
cugagcuuuccgggga

SEQ ID NO: 448793 - RNA, 20 nt, Homo sapiens
cugaggaaugcgguucaggg

SEQ ID NO: 448794 - RNA, 13 nt, Homo sapiens
cugaggaccagcc

SEQ ID NO: 448795 - RNA, 14 nt, Homo sapiens
cugaggaguccaaa

SEQ ID NO: 448796 - RNA, 20 nt, Homo sapiens
cugaggcauuuuuacuacua

SEQ ID NO: 448797 - RNA, 15 nt, Homo sapiens
cugaggccauucccu

SEQ ID NO: 448798 - RNA, 20 nt, Homo sapiens
cugaggcgggagaaucaugu

SEQ ID NO: 448799 - RNA, 19 nt, Homo sapiens
cugaggcuugggcccagua

SEQ ID NO: 448800 - RNA, 18 nt, Homo sapiens
cugagggacuuggcagua

SEQ ID NO: 448801 - RNA, 14 nt, Homo sapiens
ggcaagggguuucc

SEQ ID NO: 448802 - RNA, 20 nt, Homo sapiens
ggcaaggugagggaugccau

SEQ ID NO: 448803 - RNA, 15 nt, Homo sapiens
ggcaagugaggcaag

SEQ ID NO: 448804 - RNA, 18 nt, Homo sapiens
ggcaauggugaacuguca

SEQ ID NO: 448805 - RNA, 15 nt, Homo sapiens
ggcacaaaaccagaa

SEQ ID NO: 448806 - RNA, 17 nt, Homo sapiens
ggcacacgccuguaauc

SEQ ID NO: 448807 - RNA, 13 nt, Homo sapiens
ggcacacuacaga

SEQ ID NO: 448808 - RNA, 13 nt, Homo sapiens
ggcacagccagaa

SEQ ID NO: 448809 - RNA, 19 nt, Homo sapiens
ggcacagggucugcucuuu

SEQ ID NO: 448810 - RNA, 13 nt, Homo sapiens
ggcaccuccucac

SEQ ID NO: 448811 - RNA, 16 nt, Homo sapiens
ggcacgccaacagccc

SEQ ID NO: 448812 - RNA, 12 nt, Homo sapiens
ggcacuguguuu

SEQ ID NO: 448813 - RNA, 15 nt, Homo sapiens
ggcagaaccaaagcu

SEQ ID NO: 448814 - RNA, 13 nt, Homo sapiens
ggcagaagggaac

SEQ ID NO: 448815 - RNA, 17 nt, Homo sapiens
ggcagagaagagaccaa

SEQ ID NO: 448816 - RNA, 17 nt, Homo sapiens
ggcagagguugugguga

SEQ ID NO: 448817 - RNA, 18 nt, Homo sapiens
ggcagauuaaaagcacaa

SEQ ID NO: 448818 - RNA, 14 nt, Homo sapiens
ggcagauugaaaag

SEQ ID NO: 448819 - RNA, 14 nt, Homo sapiens
ggcagcacugggaa

SEQ ID NO: 448820 - RNA, 22 nt, Homo sapiens
ggcagccccuccccauggugca

SEQ ID NO: 448821 - RNA, 22 nt, Homo sapiens
ggcagcuguagcucccgagcua

SEQ ID NO: 448822 - RNA, 14 nt, Homo sapiens
ggcagcuucgugug

SEQ ID NO: 448823 - RNA, 16 nt, Homo sapiens
ggcaggagccggcugc

SEQ ID NO: 448824 - RNA, 17 nt, Homo sapiens
ggcaggaggguggcacu

SEQ ID NO: 448825 - RNA, 22 nt, Homo sapiens
ggcaggaucaaagacacacagg

SEQ ID NO: 448826 - RNA, 16 nt, Homo sapiens
ggcaggcuccaggccu

SEQ ID NO: 448827 - RNA, 23 nt, Homo sapiens
ggcagguguugggaccugcugcu

SEQ ID NO: 448828 - RNA, 16 nt, Homo sapiens
ggcagguugaucagug

SEQ ID NO: 448829 - RNA, 20 nt, Homo sapiens
ggcaguauggcggaggccau

SEQ ID NO: 448830 - RNA, 15 nt, Homo sapiens
ggcaguauuaagugu

SEQ ID NO: 448831 - RNA, 13 nt, Homo sapiens
ggcagucacacug

SEQ ID NO: 448832 - RNA, 20 nt, Homo sapiens
ggcagucugaacccuugugc

SEQ ID NO: 448833 - RNA, 14 nt, Homo sapiens
ggcagugcaugugg

SEQ ID NO: 448834 - RNA, 17 nt, Homo sapiens
ggcauaaaugucuaaag

SEQ ID NO: 448835 - RNA, 13 nt, Homo sapiens
ggcauaccaaaau

SEQ ID NO: 448836 - RNA, 24 nt, Homo sapiens
ggcauaggcugacuuuugcagaug

SEQ ID NO: 448837 - RNA, 18 nt, Homo sapiens
ggcaugacuuugucccau

SEQ ID NO: 448838 - RNA, 19 nt, Homo sapiens
ggcaugccaaauguuccau

SEQ ID NO: 448839 - RNA, 23 nt, Homo sapiens
ggcaugcuggcucccagggccau

SEQ ID NO: 448840 - RNA, 18 nt, Homo sapiens
ggcauggccagguggcca

SEQ ID NO: 448841 - RNA, 16 nt, Homo sapiens
ggcauguauacuuaau

SEQ ID NO: 448842 - RNA, 13 nt, Homo sapiens
ggcauucgcagug

SEQ ID NO: 448843 - RNA, 20 nt, Homo sapiens
ggcauucgcagugcccagug

SEQ ID NO: 448844 - RNA, 15 nt, Homo sapiens
ggcauuguaguuaau

SEQ ID NO: 448845 - RNA, 17 nt, Homo sapiens
ggccaagacuuggcaac

SEQ ID NO: 448846 - RNA, 19 nt, Homo sapiens
ggccaagagcaucgugacc

SEQ ID NO: 448847 - RNA, 22 nt, Homo sapiens
ggccaagcauuucuagcaguga

SEQ ID NO: 448848 - RNA, 17 nt, Homo sapiens
ggccacagcaggacuga

SEQ ID NO: 448849 - RNA, 19 nt, Homo sapiens
ggccacaugagucccagug

SEQ ID NO: 448850 - RNA, 15 nt, Homo sapiens
ggccacucccugcca

SEQ ID NO: 448851 - RNA, 21 nt, Homo sapiens
ggccacucccugccaacucca

SEQ ID NO: 448852 - RNA, 15 nt, Homo sapiens
ggccacucuaccuga

SEQ ID NO: 448853 - RNA, 14 nt, Homo sapiens
ggccacuugcucag

SEQ ID NO: 448854 - RNA, 15 nt, Homo sapiens
ggccacuugcucaga

SEQ ID NO: 448855 - RNA, 19 nt, Homo sapiens
ggccagaagggggccauga

SEQ ID NO: 448856 - RNA, 19 nt, Homo sapiens
ggccaggaagaauggugug

SEQ ID NO: 448857 - RNA, 14 nt, Homo sapiens
ggccaggccugcca

SEQ ID NO: 448858 - RNA, 22 nt, Homo sapiens
ggccagggcucuggcagguggc

SEQ ID NO: 448859 - RNA, 18 nt, Homo sapiens
ggccagucaggcugcaga

SEQ ID NO: 448860 - RNA, 14 nt, Homo sapiens
ggccauacugccuu

SEQ ID NO: 448861 - RNA, 14 nt, Homo sapiens
ggccauccauguga

SEQ ID NO: 448862 - RNA, 14 nt, Homo sapiens
ggccaugcaagugg

SEQ ID NO: 448863 - RNA, 14 nt, Homo sapiens
ggccauggugcaca

SEQ ID NO: 448864 - RNA, 12 nt, Homo sapiens
ggccauguauua

SEQ ID NO: 448865 - RNA, 14 nt, Homo sapiens
ggcccaagagcaga

SEQ ID NO: 448866 - RNA, 20 nt, Homo sapiens
ggcccagaggggcggggcca

SEQ ID NO: 448867 - RNA, 13 nt, Homo sapiens
ggcccaguccucu

SEQ ID NO: 448868 - RNA, 12 nt, Homo sapiens
ggcccaucugcc

SEQ ID NO: 448869 - RNA, 18 nt, Homo sapiens
ggccccggccuugggaga

SEQ ID NO: 448870 - RNA, 14 nt, Homo sapiens
ggccccuccaggaa

SEQ ID NO: 448871 - RNA, 20 nt, Homo sapiens
ggccccuggcaccugggugc

SEQ ID NO: 448872 - RNA, 14 nt, Homo sapiens
ggccccuugcaaag

SEQ ID NO: 448873 - RNA, 19 nt, Homo sapiens
ggcccgacagccuggcaca

SEQ ID NO: 448874 - RNA, 21 nt, Homo sapiens
ggcccucccugucuccagggc

SEQ ID NO: 448875 - RNA, 22 nt, Homo sapiens
ggcccuguuaaggcauccacuu

SEQ ID NO: 448876 - RNA, 20 nt, Homo sapiens
ggccgaaccccccacucccu

SEQ ID NO: 448877 - RNA, 15 nt, Homo sapiens
ggccgaguccaggag

SEQ ID NO: 448878 - RNA, 19 nt, Homo sapiens
ggccuccagcccucucacu

SEQ ID NO: 448879 - RNA, 13 nt, Homo sapiens
ggccugaccucaa

SEQ ID NO: 448880 - RNA, 17 nt, Homo sapiens
ggccugaccuggcacag

SEQ ID NO: 448881 - RNA, 13 nt, Homo sapiens
ggccugauggugc

SEQ ID NO: 448882 - RNA, 15 nt, Homo sapiens
ggccugcacuggugu

SEQ ID NO: 448883 - RNA, 18 nt, Homo sapiens
ggccugccaaacuguaca

SEQ ID NO: 448884 - RNA, 17 nt, Homo sapiens
ggccugccaaugccaca

SEQ ID NO: 448885 - RNA, 16 nt, Homo sapiens
ggccuggccaccucuc

SEQ ID NO: 448886 - RNA, 14 nt, Homo sapiens
ggccuggggcugcc

SEQ ID NO: 448887 - RNA, 21 nt, Homo sapiens
ggccugucccuggccaucucu

SEQ ID NO: 448888 - RNA, 12 nt, Homo sapiens
ggccuucucacc

SEQ ID NO: 448889 - RNA, 18 nt, Homo sapiens
ggccuugucucuuccucu

SEQ ID NO: 448890 - RNA, 12 nt, Homo sapiens
ggccuuucccau

SEQ ID NO: 448891 - RNA, 15 nt, Homo sapiens
ggcgacuccaucuca

SEQ ID NO: 448892 - RNA, 16 nt, Homo sapiens
ggcgacugucaugugg

SEQ ID NO: 448893 - RNA, 18 nt, Homo sapiens
ggcgccaucuauggugug

SEQ ID NO: 448894 - RNA, 19 nt, Homo sapiens
ggcggaaccuggcugcgaa

SEQ ID NO: 448895 - RNA, 14 nt, Homo sapiens
ggcgugacuucaga

SEQ ID NO: 448896 - RNA, 12 nt, Homo sapiens
ggcgugaucuug

SEQ ID NO: 448897 - RNA, 14 nt, Homo sapiens
ggcguguccaggag

SEQ ID NO: 448898 - RNA, 18 nt, Homo sapiens
ggcuaagaggcugcugaa

SEQ ID NO: 448899 - RNA, 13 nt, Homo sapiens
ggcuagauguuua

SEQ ID NO: 448900 - RNA, 15 nt, Homo sapiens
ggcuaucugcauuua

SEQ ID NO: 448901 - RNA, 20 nt, Homo sapiens
ggcuaugccugccucaaagg

SEQ ID NO: 448902 - RNA, 16 nt, Homo sapiens
ggcuauucuacuuuaa

SEQ ID NO: 448903 - RNA, 14 nt, Homo sapiens
ggcucagaacaccc

SEQ ID NO: 448904 - RNA, 14 nt, Homo sapiens
ggcucagccucaaa

SEQ ID NO: 448905 - RNA, 14 nt, Homo sapiens
ggcucagugccacc

SEQ ID NO: 448906 - RNA, 18 nt, Homo sapiens
ggcucauucuucuuggcu

SEQ ID NO: 448907 - RNA, 15 nt, Homo sapiens
ggcucccagggccau

SEQ ID NO: 448908 - RNA, 20 nt, Homo sapiens
ggcucccagggccaugaacu

SEQ ID NO: 448909 - RNA, 13 nt, Homo sapiens
ggcuccucaccac

SEQ ID NO: 448910 - RNA, 17 nt, Homo sapiens
ggcuccuccucucugga

SEQ ID NO: 448911 - RNA, 21 nt, Homo sapiens
ggcucucccucucugcaccug

SEQ ID NO: 448912 - RNA, 24 nt, Homo sapiens
ggcucucccucucugcaccugucu

SEQ ID NO: 448913 - RNA, 22 nt, Homo sapiens
ggcucugggagacuuugaagac

SEQ ID NO: 448914 - RNA, 15 nt, Homo sapiens
ggcucuuucagagag

SEQ ID NO: 448915 - RNA, 15 nt, Homo sapiens
ggcucuuuccuugcu

SEQ ID NO: 448916 - RNA, 17 nt, Homo sapiens
ggcugaaaagugcuuug

SEQ ID NO: 448917 - RNA, 23 nt, Homo sapiens
ggcugacaccuaccaugcugcuu

SEQ ID NO: 448918 - RNA, 23 nt, Homo sapiens
ggcugacacguccaccccagugc

SEQ ID NO: 448919 - RNA, 14 nt, Homo sapiens
ggcugagaugcgca

SEQ ID NO: 448920 - RNA, 15 nt, Homo sapiens
ggcugagcugagcuu

SEQ ID NO: 448921 - RNA, 19 nt, Homo sapiens
ggcugcccacacaccccaa

SEQ ID NO: 448922 - RNA, 20 nt, Homo sapiens
ggcugccgugcacggggcca

SEQ ID NO: 448923 - RNA, 17 nt, Homo sapiens
ggcugccugacacugag

SEQ ID NO: 448924 - RNA, 12 nt, Homo sapiens
ggcugcugagaa

SEQ ID NO: 448925 - RNA, 19 nt, Homo sapiens
ggcuggacuuuugcagcuu

SEQ ID NO: 448926 - RNA, 20 nt, Homo sapiens
ggcuggagugcaaugacaca

SEQ ID NO: 448927 - RNA, 13 nt, Homo sapiens
ggcuggcacugac

SEQ ID NO: 448928 - RNA, 18 nt, Homo sapiens
ggcuguacgucugguguu

SEQ ID NO: 448929 - RNA, 17 nt, Homo sapiens
ggcugugcacauucucc

SEQ ID NO: 448930 - RNA, 17 nt, Homo sapiens
ggcuguuccagacucag

SEQ ID NO: 448931 - RNA, 19 nt, Homo sapiens
ggcuuaaguuuuacuugag

SEQ ID NO: 448932 - RNA, 17 nt, Homo sapiens
guccugccucagccucc

SEQ ID NO: 448933 - RNA, 15 nt, Homo sapiens
guccugcuguggaaa

SEQ ID NO: 448934 - RNA, 17 nt, Homo sapiens
guccuggggaccauuca

SEQ ID NO: 448935 - RNA, 23 nt, Homo sapiens
guccugggguauaaaacuuuccu

SEQ ID NO: 448936 - RNA, 14 nt, Homo sapiens
guccuggggugguu

SEQ ID NO: 448937 - RNA, 15 nt, Homo sapiens
guccuguacauugug

SEQ ID NO: 448938 - RNA, 16 nt, Homo sapiens
guccugucaccaagga

SEQ ID NO: 448939 - RNA, 15 nt, Homo sapiens
guccuguuccugcca

SEQ ID NO: 448940 - RNA, 22 nt, Homo sapiens
guccuuagcaaggggcucagaa

SEQ ID NO: 448941 - RNA, 21 nt, Homo sapiens
guccuucucucaccuccuaaa

SEQ ID NO: 448942 - RNA, 15 nt, Homo sapiens
guccuugucgcugug

SEQ ID NO: 448943 - RNA, 16 nt, Homo sapiens
gucgacuucaugacaa

SEQ ID NO: 448944 - RNA, 18 nt, Homo sapiens
gucgcaucucagugcagg

SEQ ID NO: 448945 - RNA, 14 nt, Homo sapiens
gucgcugugcccug

SEQ ID NO: 448946 - RNA, 11 nt, Homo sapiens
gucgucucuuc

SEQ ID NO: 448947 - RNA, 19 nt, Homo sapiens
gucguucccuugugucugu

SEQ ID NO: 448948 - RNA, 23 nt, Homo sapiens
gucuaaaaauaaaaugcauuuaa

SEQ ID NO: 448949 - RNA, 13 nt, Homo sapiens
gucuaccaucucc

SEQ ID NO: 448950 - RNA, 16 nt, Homo sapiens
gucuauacauuccuga

SEQ ID NO: 448951 - RNA, 17 nt, Homo sapiens
gucucacccacuaggau

SEQ ID NO: 448952 - RNA, 15 nt, Homo sapiens
gucucagauugggau

SEQ ID NO: 448953 - RNA, 17 nt, Homo sapiens
gucucauugccaguggu

SEQ ID NO: 448954 - RNA, 18 nt, Homo sapiens
gucuccuacccucuuauu

SEQ ID NO: 448955 - RNA, 17 nt, Homo sapiens
gucucgcuuuguugccc

SEQ ID NO: 448956 - RNA, 15 nt, Homo sapiens
gucucuauacuacau

SEQ ID NO: 448957 - RNA, 21 nt, Homo sapiens
gucucucacccccacacuggg

SEQ ID NO: 448958 - RNA, 22 nt, Homo sapiens
gucucucccaccccggccucca

SEQ ID NO: 448959 - RNA, 15 nt, Homo sapiens
gucucucccuacccu

SEQ ID NO: 448960 - RNA, 17 nt, Homo sapiens
gucucugauuugcaaau

SEQ ID NO: 448961 - RNA, 14 nt, Homo sapiens
gucucuggcgugug

SEQ ID NO: 448962 - RNA, 16 nt, Homo sapiens
gucucuuuuuuuggcc

SEQ ID NO: 448963 - RNA, 22 nt, Homo sapiens
gucugaaggagaggagugcgcu

SEQ ID NO: 448964 - RNA, 16 nt, Homo sapiens
gucugagaagauucaa

SEQ ID NO: 448965 - RNA, 22 nt, Homo sapiens
gucugagcuucaguauaaaaga

SEQ ID NO: 448966 - RNA, 19 nt, Homo sapiens
gucugcaggccaccagcug

SEQ ID NO: 448967 - RNA, 15 nt, Homo sapiens
gucuggaugcacaga

SEQ ID NO: 448968 - RNA, 19 nt, Homo sapiens
gucuggcaaacaugugcaa

SEQ ID NO: 448969 - RNA, 17 nt, Homo sapiens
gucuguaagagaauucu

SEQ ID NO: 448970 - RNA, 15 nt, Homo sapiens
gucuguccuuuccca

SEQ ID NO: 448971 - RNA, 14 nt, Homo sapiens
gucugucugcacug

SEQ ID NO: 448972 - RNA, 15 nt, Homo sapiens
gucugugauugccau

SEQ ID NO: 448973 - RNA, 20 nt, Homo sapiens
gucugugugcaagugugugc

SEQ ID NO: 448974 - RNA, 12 nt, Homo sapiens
gucuguucucac

SEQ ID NO: 448975 - RNA, 18 nt, Homo sapiens
gucuuacucuuuguauga

SEQ ID NO: 448976 - RNA, 21 nt, Homo sapiens
gucuuacuguugcauaacuau

SEQ ID NO: 448977 - RNA, 16 nt, Homo sapiens
gucuuacuuugugcaa

SEQ ID NO: 448978 - RNA, 15 nt, Homo sapiens
gucuuagcuuuacau

SEQ ID NO: 448979 - RNA, 21 nt, Homo sapiens
gucuuccuccuaaauuuccag

SEQ ID NO: 448980 - RNA, 17 nt, Homo sapiens
gucuucugccuguuaua

SEQ ID NO: 448981 - RNA, 17 nt, Homo sapiens
gucuucuucaauacuga

SEQ ID NO: 448982 - RNA, 14 nt, Homo sapiens
gucuugccuuccac

SEQ ID NO: 448983 - RNA, 12 nt, Homo sapiens
gucuuggcucac

SEQ ID NO: 448984 - RNA, 22 nt, Homo sapiens
gucuugucugagaacaaauaca

SEQ ID NO: 448985 - RNA, 13 nt, Homo sapiens
gucuuuaacucau

SEQ ID NO: 448986 - RNA, 15 nt, Homo sapiens
gucuuuaucaaagga

SEQ ID NO: 448987 - RNA, 22 nt, Homo sapiens
gucuuucgcacauucuccugau

SEQ ID NO: 448988 - RNA, 20 nt, Homo sapiens
gucuuugaaauaugcaugua

SEQ ID NO: 448989 - RNA, 20 nt, Homo sapiens
gucuuuggcuucagaauugu

SEQ ID NO: 448990 - RNA, 19 nt, Homo sapiens
gucuuuguuaagacugcug

SEQ ID NO: 448991 - RNA, 20 nt, Homo sapiens
gucuuuuccccucauugcau

SEQ ID NO: 448992 - RNA, 18 nt, Homo sapiens
gucuuuuucuacagccag

SEQ ID NO: 448993 - RNA, 17 nt, Homo sapiens
gugaaaauccaucucau

SEQ ID NO: 448994 - RNA, 21 nt, Homo sapiens
gugaaaccccaucucuacuaa

SEQ ID NO: 448995 - RNA, 17 nt, Homo sapiens
gugaaacuugugcuaua

SEQ ID NO: 448996 - RNA, 19 nt, Homo sapiens
gugaaagaugcaagcaccu

SEQ ID NO: 448997 - RNA, 15 nt, Homo sapiens
gugaaagcuuucaug

SEQ ID NO: 448998 - RNA, 15 nt, Homo sapiens
gugaaaguacauuug

SEQ ID NO: 448999 - RNA, 15 nt, Homo sapiens
gugaaccaucauuau

SEQ ID NO: 449000 - RNA, 14 nt, Homo sapiens
gugaacuuacacuu

SEQ ID NO: 449001 - RNA, 20 nt, Homo sapiens
gugaagagggagaagcauga

SEQ ID NO: 449002 - RNA, 18 nt, Homo sapiens
gugaagggagagccagcu

SEQ ID NO: 449003 - RNA, 15 nt, Homo sapiens
gugaagugguuuaaa

SEQ ID NO: 449004 - RNA, 21 nt, Homo sapiens
gugaauccuuuguacugauga

SEQ ID NO: 449005 - RNA, 17 nt, Homo sapiens
gugaaugaaacacucag

SEQ ID NO: 449006 - RNA, 16 nt, Homo sapiens
gugaauguacauuucu

SEQ ID NO: 449007 - RNA, 20 nt, Homo sapiens
gugaauguggauucuuccca

SEQ ID NO: 449008 - RNA, 15 nt, Homo sapiens
gugaauuucuucacu

SEQ ID NO: 449009 - RNA, 17 nt, Homo sapiens
gugacagagcccagcau

SEQ ID NO: 449010 - RNA, 23 nt, Homo sapiens
gugacaugaacccauccaaugga

SEQ ID NO: 449011 - RNA, 11 nt, Homo sapiens
gugaccagcac

SEQ ID NO: 449012 - RNA, 19 nt, Homo sapiens
gugaccuggcaucuuggaa

SEQ ID NO: 449013 - RNA, 14 nt, Homo sapiens
gugaccuugagcaa

SEQ ID NO: 449014 - RNA, 13 nt, Homo sapiens
gugacuccaggag

SEQ ID NO: 449015 - RNA, 22 nt, Homo sapiens
gugacugucccuucgacacgga

SEQ ID NO: 449016 - RNA, 16 nt, Homo sapiens
gugacugugcauuuga

SEQ ID NO: 449017 - RNA, 20 nt, Homo sapiens
gugacuuuuuagccagugac

SEQ ID NO: 449018 - RNA, 22 nt, Homo sapiens
gugagacagugggggugccugg

SEQ ID NO: 449019 - RNA, 12 nt, Homo sapiens
gugagacucuga

SEQ ID NO: 449020 - RNA, 23 nt, Homo sapiens
gugagcaauccugcaagaacaag

SEQ ID NO: 449021 - RNA, 15 nt, Homo sapiens
gugagcacaaaggua

SEQ ID NO: 449022 - RNA, 21 nt, Homo sapiens
gugagcagggcccucagagga

SEQ ID NO: 449023 - RNA, 16 nt, Homo sapiens
gugagcggagaucgca

SEQ ID NO: 449024 - RNA, 17 nt, Homo sapiens
gugagcucaaacuggcc

SEQ ID NO: 449025 - RNA, 14 nt, Homo sapiens
gugaggaagcaaaa

SEQ ID NO: 449026 - RNA, 13 nt, Homo sapiens
gugaggcagggga

SEQ ID NO: 449027 - RNA, 19 nt, Homo sapiens
gugagguuaguucugugug

SEQ ID NO: 449028 - RNA, 18 nt, Homo sapiens
gugaguaagagcuggugu

SEQ ID NO: 449029 - RNA, 18 nt, Homo sapiens
gugaguacccaggaugau

SEQ ID NO: 449030 - RNA, 19 nt, Homo sapiens
gugagugcuugucauggaa

SEQ ID NO: 449031 - RNA, 15 nt, Homo sapiens
gugaguggcagccau

SEQ ID NO: 449032 - RNA, 22 nt, Homo sapiens
gugaguggggaggagacucagg

SEQ ID NO: 449033 - RNA, 17 nt, Homo sapiens
gugaguuuuucuuuuga

SEQ ID NO: 449034 - RNA, 14 nt, Homo sapiens
gugauagaagaaaa

SEQ ID NO: 449035 - RNA, 15 nt, Homo sapiens
gugauauauauuugu

SEQ ID NO: 449036 - RNA, 15 nt, Homo sapiens
gugaucgcacaagga

SEQ ID NO: 449037 - RNA, 17 nt, Homo sapiens
gugaugaugcugugaca

SEQ ID NO: 449038 - RNA, 22 nt, Homo sapiens
gugauggcauuacucugcacua

SEQ ID NO: 449039 - RNA, 22 nt, Homo sapiens
gugauuaaagcaagagaauuau

SEQ ID NO: 449040 - RNA, 23 nt, Homo sapiens
gugauugaaccagcucaucucca

SEQ ID NO: 449041 - RNA, 14 nt, Homo sapiens
gugauugcugccau

SEQ ID NO: 449042 - RNA, 20 nt, Homo sapiens
gugcaagugucugugugcaa

SEQ ID NO: 449043 - RNA, 15 nt, Homo sapiens
gugcaaguguguaug

SEQ ID NO: 449044 - RNA, 16 nt, Homo sapiens
gugcaagugugugcac

SEQ ID NO: 449045 - RNA, 14 nt, Homo sapiens
gugcaaugaaugau

SEQ ID NO: 449046 - RNA, 22 nt, Homo sapiens
gugcaauguuccguucaucuga

SEQ ID NO: 449047 - RNA, 23 nt, Homo sapiens
gugcaauuucuucuguagcuauu

SEQ ID NO: 449048 - RNA, 13 nt, Homo sapiens
gugcacggggcca

SEQ ID NO: 449049 - RNA, 22 nt, Homo sapiens
gugcacugaaucguuucaugua

SEQ ID NO: 449050 - RNA, 16 nt, Homo sapiens
gugcagcugauuuuaa

SEQ ID NO: 449051 - RNA, 16 nt, Homo sapiens
gugcagcuuuccaguu

SEQ ID NO: 449052 - RNA, 19 nt, Homo sapiens
gugcaguggcgugaucucg

SEQ ID NO: 449053 - RNA, 17 nt, Homo sapiens
gugcauaauuuugccaa

SEQ ID NO: 449054 - RNA, 18 nt, Homo sapiens
gugcaugagaaugucauu

SEQ ID NO: 449055 - RNA, 15 nt, Homo sapiens
gugcaugugcacuug

SEQ ID NO: 449056 - RNA, 16 nt, Homo sapiens
gugcaugugcacuugc

SEQ ID NO: 449057 - RNA, 22 nt, Homo sapiens
gugcauuggaagaccccaccca

SEQ ID NO: 449058 - RNA, 20 nt, Homo sapiens
gugccaauauguauuguaaa

SEQ ID NO: 449059 - RNA, 16 nt, Homo sapiens
gugccacaaauugaaa

SEQ ID NO: 449060 - RNA, 20 nt, Homo sapiens
gugccaccaacauaaaacaa

SEQ ID NO: 449061 - RNA, 23 nt, Homo sapiens
gugccaccaccccucccucugcu

SEQ ID NO: 449062 - RNA, 22 nt, Homo sapiens
ugagccccugggacugcugcuu

SEQ ID NO: 449063 - RNA, 23 nt, Homo sapiens
ugagccgagauagcaccauugca

SEQ ID NO: 449064 - RNA, 14 nt, Homo sapiens
ugagccuacugucu

SEQ ID NO: 449065 - RNA, 19 nt, Homo sapiens
ugagccucuuuaacagcuu

SEQ ID NO: 449066 - RNA, 24 nt, Homo sapiens
ugagcgaugacucaagugucucag

SEQ ID NO: 449067 - RNA, 16 nt, Homo sapiens
ugagcuaacgugcugu

SEQ ID NO: 449068 - RNA, 22 nt, Homo sapiens
ugagcuauuuccauuccagaau

SEQ ID NO: 449069 - RNA, 16 nt, Homo sapiens
ugagcucucuaauaga

SEQ ID NO: 449070 - RNA, 20 nt, Homo sapiens
ugagcugagaucacaccacu

SEQ ID NO: 449071 - RNA, 19 nt, Homo sapiens
ugagcugccuguaacuuga

SEQ ID NO: 449072 - RNA, 17 nt, Homo sapiens
ugaggaaacugcacugu

SEQ ID NO: 449073 - RNA, 16 nt, Homo sapiens
ugaggaagugaacauu

SEQ ID NO: 449074 - RNA, 23 nt, Homo sapiens
ugaggacuuaaaauauuccugca

SEQ ID NO: 449075 - RNA, 14 nt, Homo sapiens
ugaggacuucacaa

SEQ ID NO: 449076 - RNA, 15 nt, Homo sapiens
ugaggaguaaaaaga

SEQ ID NO: 449077 - RNA, 15 nt, Homo sapiens
ugaggagugaacauu

SEQ ID NO: 449078 - RNA, 13 nt, Homo sapiens
ugaggaucauaug

SEQ ID NO: 449079 - RNA, 21 nt, Homo sapiens
ugaggcacgagcaaagugaag

SEQ ID NO: 449080 - RNA, 19 nt, Homo sapiens
ugaggcagagucucauucu

SEQ ID NO: 449081 - RNA, 16 nt, Homo sapiens
ugaggcauuuuuacua

SEQ ID NO: 449082 - RNA, 14 nt, Homo sapiens
ugaggcuucucagc

SEQ ID NO: 449083 - RNA, 19 nt, Homo sapiens
ugagggcacucucugccag

SEQ ID NO: 449084 - RNA, 15 nt, Homo sapiens
ugagggcagcacugg

SEQ ID NO: 449085 - RNA, 17 nt, Homo sapiens
ugagggcagcacuggga

SEQ ID NO: 449086 - RNA, 15 nt, Homo sapiens
ugaggguuaaugaaa

SEQ ID NO: 449087 - RNA, 20 nt, Homo sapiens
ugaggucaucccggggccau

SEQ ID NO: 449088 - RNA, 13 nt, Homo sapiens
ugaggugguacua

SEQ ID NO: 449089 - RNA, 19 nt, Homo sapiens
ugagguggugccuucucac

SEQ ID NO: 449090 - RNA, 15 nt, Homo sapiens
ugagguuaaggggau

SEQ ID NO: 449091 - RNA, 14 nt, Homo sapiens
ugagguuucaccuc

SEQ ID NO: 449092 - RNA, 13 nt, Homo sapiens
ugaguagggacuc

SEQ ID NO: 449093 - RNA, 15 nt, Homo sapiens
ugaguaguaaucuca

SEQ ID NO: 449094 - RNA, 17 nt, Homo sapiens
ugagucagguuugagua

SEQ ID NO: 449095 - RNA, 19 nt, Homo sapiens
ugagucuguggacacugug

SEQ ID NO: 449096 - RNA, 17 nt, Homo sapiens
ugagucuucacauuuag

SEQ ID NO: 449097 - RNA, 22 nt, Homo sapiens
ugagucuuccagagccuaagaa

SEQ ID NO: 449098 - RNA, 20 nt, Homo sapiens
ugagugaaucugcauuuucu

SEQ ID NO: 449099 - RNA, 14 nt, Homo sapiens
ugagugacuagacg

SEQ ID NO: 449100 - RNA, 18 nt, Homo sapiens
ugagugcuugucauggaa

SEQ ID NO: 449101 - RNA, 15 nt, Homo sapiens
ugaguggccugcuaa

SEQ ID NO: 449102 - RNA, 13 nt, Homo sapiens
ugaguggugccaa

SEQ ID NO: 449103 - RNA, 15 nt, Homo sapiens
ugaguggugccaaac

SEQ ID NO: 449104 - RNA, 23 nt, Homo sapiens
ugagugguguguguuaucagaua

SEQ ID NO: 449105 - RNA, 10 nt, Homo sapiens
ugagugucaa

SEQ ID NO: 449106 - RNA, 14 nt, Homo sapiens
ugaguucaaauacu

SEQ ID NO: 449107 - RNA, 18 nt, Homo sapiens
ugaguucuggucaaagaa

SEQ ID NO: 449108 - RNA, 17 nt, Homo sapiens
ugaguugcaccauucuu

SEQ ID NO: 449109 - RNA, 16 nt, Homo sapiens
ugaguuugaacacaga

SEQ ID NO: 449110 - RNA, 12 nt, Homo sapiens
ugaguuugacau

SEQ ID NO: 449111 - RNA, 22 nt, Homo sapiens
ugaguuugcuguauacaaacag

SEQ ID NO: 449112 - RNA, 15 nt, Homo sapiens
ugaguuuuacauuac

SEQ ID NO: 449113 - RNA, 18 nt, Homo sapiens
ugaguuuuacauuacaaa

SEQ ID NO: 449114 - RNA, 20 nt, Homo sapiens
ugauaaauuugacuguuauu

SEQ ID NO: 449115 - RNA, 14 nt, Homo sapiens
ugauacaguauuau

SEQ ID NO: 449116 - RNA, 12 nt, Homo sapiens
ugauacuuuuaa

SEQ ID NO: 449117 - RNA, 14 nt, Homo sapiens
ugauagagccuuug

SEQ ID NO: 449118 - RNA, 16 nt, Homo sapiens
ugauagagccuuugau

SEQ ID NO: 449119 - RNA, 16 nt, Homo sapiens
ugauagaguguuauca

SEQ ID NO: 449120 - RNA, 12 nt, Homo sapiens
ugauagugcuuc

SEQ ID NO: 449121 - RNA, 23 nt, Homo sapiens
ugauagugucccacggugccuug

SEQ ID NO: 449122 - RNA, 16 nt, Homo sapiens
ugauauuauaguauuc

SEQ ID NO: 449123 - RNA, 20 nt, Homo sapiens
ugauauuauguggcuuuuau

SEQ ID NO: 449124 - RNA, 14 nt, Homo sapiens
ugauauucucauua

SEQ ID NO: 449125 - RNA, 20 nt, Homo sapiens
ugauauugcaguaaugauau

SEQ ID NO: 449126 - RNA, 15 nt, Homo sapiens
ugauauuucuugcuu

SEQ ID NO: 449127 - RNA, 15 nt, Homo sapiens
ugauauuuuccaaau

SEQ ID NO: 449128 - RNA, 12 nt, Homo sapiens
ugaucaacuguu

SEQ ID NO: 449129 - RNA, 15 nt, Homo sapiens
ugaucagaucuuaca

SEQ ID NO: 449130 - RNA, 13 nt, Homo sapiens
ugaucauuugccc

SEQ ID NO: 449131 - RNA, 17 nt, Homo sapiens
ugauccaguggacacuu

SEQ ID NO: 449132 - RNA, 21 nt, Homo sapiens
ugauccaugaguuugcccugg

SEQ ID NO: 449133 - RNA, 15 nt, Homo sapiens
ugaucgcacaaggac

SEQ ID NO: 449134 - RNA, 23 nt, Homo sapiens
ugaucggagccuccucucucaaa

SEQ ID NO: 449135 - RNA, 20 nt, Homo sapiens
ugaucgugggguugaccaac

SEQ ID NO: 449136 - RNA, 12 nt, Homo sapiens
ugaucugggaac

SEQ ID NO: 449137 - RNA, 14 nt, Homo sapiens
ugaugaacugccaa

SEQ ID NO: 449138 - RNA, 13 nt, Homo sapiens
ugaugacacugag

SEQ ID NO: 449139 - RNA, 14 nt, Homo sapiens
ugaugacuuacuau

SEQ ID NO: 449140 - RNA, 17 nt, Homo sapiens
ugaugaugaugaugacu

SEQ ID NO: 449141 - RNA, 22 nt, Homo sapiens
ugaugaugggaauugugugaug

SEQ ID NO: 449142 - RNA, 14 nt, Homo sapiens
ugaugcaggcagug

SEQ ID NO: 449143 - RNA, 17 nt, Homo sapiens
ugaugccguuucuuuca

SEQ ID NO: 449144 - RNA, 21 nt, Homo sapiens
ugaugcgucuacccagacuca

SEQ ID NO: 449145 - RNA, 13 nt, Homo sapiens
ugauguacuuuaa

SEQ ID NO: 449146 - RNA, 13 nt, Homo sapiens
ugauguccagaag

SEQ ID NO: 449147 - RNA, 13 nt, Homo sapiens
ugaugucugcaaa

SEQ ID NO: 449148 - RNA, 15 nt, Homo sapiens
ugauuaaagcaagag

SEQ ID NO: 449149 - RNA, 14 nt, Homo sapiens
ugauuaacugugaa

SEQ ID NO: 449150 - RNA, 14 nt, Homo sapiens
ugauuaauguuucu

SEQ ID NO: 449151 - RNA, 21 nt, Homo sapiens
ugauuagaaggcaaguuucua

SEQ ID NO: 449152 - RNA, 20 nt, Homo sapiens
ugauucgcccaaagccagac

SEQ ID NO: 449153 - RNA, 13 nt, Homo sapiens
ugauucuaaaggg

SEQ ID NO: 449154 - RNA, 15 nt, Homo sapiens
ugauucuaaagggga

SEQ ID NO: 449155 - RNA, 20 nt, Homo sapiens
ugauucuuuucccaucacca

SEQ ID NO: 449156 - RNA, 19 nt, Homo sapiens
ugauugaaaauaguaaaug

SEQ ID NO: 449157 - RNA, 15 nt, Homo sapiens
ugauugaaccagcuc

SEQ ID NO: 449158 - RNA, 16 nt, Homo sapiens
ugauugaaccagcuca

SEQ ID NO: 449159 - RNA, 21 nt, Homo sapiens
ugauuggacauuuucuucaga

SEQ ID NO: 449160 - RNA, 12 nt, Homo sapiens
ugauugugaacu

SEQ ID NO: 449161 - RNA, 13 nt, Homo sapiens
ugauuuacaugcu

SEQ ID NO: 449162 - RNA, 20 nt, Homo sapiens
ugauuuaccacuuaugcaua

SEQ ID NO: 449163 - RNA, 16 nt, Homo sapiens
ugauuuaucacacaaa

SEQ ID NO: 449164 - RNA, 16 nt, Homo sapiens
ugauuuccauuugcaa

SEQ ID NO: 449165 - RNA, 19 nt, Homo sapiens
ugauuuggaagagaggcac

SEQ ID NO: 449166 - RNA, 19 nt, Homo sapiens
ugauuuuguuuacugaaau

SEQ ID NO: 449167 - RNA, 22 nt, Homo sapiens
ugauuuuuaucuagaacauuca

SEQ ID NO: 449168 - RNA, 14 nt, Homo sapiens
ugcaaaacauaucu

SEQ ID NO: 449169 - RNA, 19 nt, Homo sapiens
ugcaaaagguuaagccaua

SEQ ID NO: 449170 - RNA, 19 nt, Homo sapiens
ugcaaacucacugcucaag

SEQ ID NO: 449171 - RNA, 12 nt, Homo sapiens
ugcaaagacuga

SEQ ID NO: 449172 - RNA, 15 nt, Homo sapiens
ugcaaagaguuauau

SEQ ID NO: 449173 - RNA, 19 nt, Homo sapiens
ugcaaagaguuauaugacu

SEQ ID NO: 449174 - RNA, 17 nt, Homo sapiens
ugcaaagcgcuauuuca

SEQ ID NO: 449175 - RNA, 18 nt, Homo sapiens
ugcaaaugcuauauugca

SEQ ID NO: 449176 - RNA, 23 nt, Homo sapiens
ugcaaauucaguaguaacagagu

SEQ ID NO: 449177 - RNA, 22 nt, Homo sapiens
ugcaaauuccaccccuccuucc

SEQ ID NO: 449178 - RNA, 23 nt, Homo sapiens
ugcaaauuuuagcguuaaaguca

SEQ ID NO: 449179 - RNA, 19 nt, Homo sapiens
ugcaacaggaagacacugg

SEQ ID NO: 449180 - RNA, 23 nt, Homo sapiens
ugcaacagggaggcauagucucu

SEQ ID NO: 449181 - RNA, 17 nt, Homo sapiens
ugcaacuaauucaauaa

SEQ ID NO: 449182 - RNA, 15 nt, Homo sapiens
ugcaacuucuguccc

SEQ ID NO: 449183 - RNA, 19 nt, Homo sapiens
ugcaagagaacaauguuuc

SEQ ID NO: 449184 - RNA, 20 nt, Homo sapiens
ugcaaggauucagcauuauu

SEQ ID NO: 449185 - RNA, 22 nt, Homo sapiens
ugcaaggauucagcauuauucc

SEQ ID NO: 449186 - RNA, 20 nt, Homo sapiens
ugcaagugucugugugcaag

SEQ ID NO: 449187 - RNA, 18 nt, Homo sapiens
ugcaauaugaggggacug

SEQ ID NO: 449188 - RNA, 13 nt, Homo sapiens
ugcaauccuucca

SEQ ID NO: 449189 - RNA, 23 nt, Homo sapiens
ugcaaucuuauguugaucgaugu

SEQ ID NO: 449190 - RNA, 12 nt, Homo sapiens
ugcaaucuucua

SEQ ID NO: 449191 - RNA, 16 nt, Homo sapiens
ugcaaugacacagucu

SEQ ID NO: 449192 - RNA, 20 nt, Homo sapiens
ugcaauguaucccuucucac

SEQ ID NO: 449193 - RNA, 19 nt, Homo sapiens
ugcuggcucccagggccau

SEQ ID NO: 449194 - RNA, 17 nt, Homo sapiens
ugcugggcccaccaccu

SEQ ID NO: 449195 - RNA, 21 nt, Homo sapiens
ugcugggccucauucuagcac

SEQ ID NO: 449196 - RNA, 16 nt, Homo sapiens
ugcuggggccgaaaga

SEQ ID NO: 449197 - RNA, 16 nt, Homo sapiens
ugcuggucacugccau

SEQ ID NO: 449198 - RNA, 13 nt, Homo sapiens
ugcuggucuucaa

SEQ ID NO: 449199 - RNA, 23 nt, Homo sapiens
ugcuggucuucaauuaccaagaa

SEQ ID NO: 449200 - RNA, 16 nt, Homo sapiens
ugcuguaaaagugaau

SEQ ID NO: 449201 - RNA, 15 nt, Homo sapiens
ugcuguauacuguac

SEQ ID NO: 449202 - RNA, 23 nt, Homo sapiens
ugcuguaugauauuaauguggaa

SEQ ID NO: 449203 - RNA, 23 nt, Homo sapiens
ugcugucauuguccaugccuaca

SEQ ID NO: 449204 - RNA, 21 nt, Homo sapiens
ugcuguccaggaacuuuccag

SEQ ID NO: 449205 - RNA, 13 nt, Homo sapiens
ugcugucuguccu

SEQ ID NO: 449206 - RNA, 10 nt, Homo sapiens
ugcugugcaa

SEQ ID NO: 449207 - RNA, 21 nt, Homo sapiens
ugcuguggguauucaccaccc

SEQ ID NO: 449208 - RNA, 16 nt, Homo sapiens
ugcuuaccacaucaca

SEQ ID NO: 449209 - RNA, 21 nt, Homo sapiens
ugcuuagagcauguucuugga

SEQ ID NO: 449210 - RNA, 16 nt, Homo sapiens
ugcuuaggaaauugcu

SEQ ID NO: 449211 - RNA, 18 nt, Homo sapiens
ugcuuaggaaauugcuca

SEQ ID NO: 449212 - RNA, 21 nt, Homo sapiens
ugcuucaugaaaauccuacca

SEQ ID NO: 449213 - RNA, 14 nt, Homo sapiens
ugcuucccaccucc

SEQ ID NO: 449214 - RNA, 19 nt, Homo sapiens
ugcuucccguucagcguca

SEQ ID NO: 449215 - RNA, 22 nt, Homo sapiens
ugcuucuaagaugccagcauau

SEQ ID NO: 449216 - RNA, 22 nt, Homo sapiens
ugcuucucuaaaacagcacuau

SEQ ID NO: 449217 - RNA, 13 nt, Homo sapiens
ugcuucugggaag

SEQ ID NO: 449218 - RNA, 16 nt, Homo sapiens
ugcuucuucaauggca

SEQ ID NO: 449219 - RNA, 14 nt, Homo sapiens
ugcuugaacccaag

SEQ ID NO: 449220 - RNA, 16 nt, Homo sapiens
ugcuugcccgcuccca

SEQ ID NO: 449221 - RNA, 15 nt, Homo sapiens
ugcuuguaacaagaa

SEQ ID NO: 449222 - RNA, 13 nt, Homo sapiens
ugcuugucaucca

SEQ ID NO: 449223 - RNA, 12 nt, Homo sapiens
ugcuuguucccu

SEQ ID NO: 449224 - RNA, 18 nt, Homo sapiens
ugcuuguuuacagcacua

SEQ ID NO: 449225 - RNA, 20 nt, Homo sapiens
ugcuuuauaccccauuugau

SEQ ID NO: 449226 - RNA, 15 nt, Homo sapiens
ugcuuucaauuacaa

SEQ ID NO: 449227 - RNA, 16 nt, Homo sapiens
ugcuuucagauccauc

SEQ ID NO: 449228 - RNA, 12 nt, Homo sapiens
ugcuuuccaaca

SEQ ID NO: 449229 - RNA, 19 nt, Homo sapiens
ugcuuucuuaucccaguga

SEQ ID NO: 449230 - RNA, 17 nt, Homo sapiens
ugcuuugagaaaucuca

SEQ ID NO: 449231 - RNA, 16 nt, Homo sapiens
ugcuuugcugaccaaa

SEQ ID NO: 449232 - RNA, 23 nt, Homo sapiens
ugcuuugcuggaguccuguucuc

SEQ ID NO: 449233 - RNA, 17 nt, Homo sapiens
ugcuuuguaugcacuuu

SEQ ID NO: 449234 - RNA, 22 nt, Homo sapiens
ugcuuuucccuagugcugguau

SEQ ID NO: 449235 - RNA, 21 nt, Homo sapiens
ugcuuuuguuuuccugcuggu

SEQ ID NO: 449236 - RNA, 13 nt, Homo sapiens
uggaaaacugccu

SEQ ID NO: 449237 - RNA, 22 nt, Homo sapiens
uggaaaacuuaguuugugaauu

SEQ ID NO: 449238 - RNA, 19 nt, Homo sapiens
uggaaaaggaagacuagag

SEQ ID NO: 449239 - RNA, 14 nt, Homo sapiens
uggaaaaugcaaug

SEQ ID NO: 449240 - RNA, 20 nt, Homo sapiens
uggaaaccugcccugccuga

SEQ ID NO: 449241 - RNA, 14 nt, Homo sapiens
uggaaagcuuugaa

SEQ ID NO: 449242 - RNA, 15 nt, Homo sapiens
uggaaaggggggagc

SEQ ID NO: 449243 - RNA, 17 nt, Homo sapiens
uggaaauaaacugugca

SEQ ID NO: 449244 - RNA, 23 nt, Homo sapiens
uggaaauaaaguuauuacucuga

SEQ ID NO: 449245 - RNA, 12 nt, Homo sapiens
uggaacaaacaa

SEQ ID NO: 449246 - RNA, 15 nt, Homo sapiens
uggaacaaacaauga

SEQ ID NO: 449247 - RNA, 16 nt, Homo sapiens
uggaacacucucugag

SEQ ID NO: 449248 - RNA, 16 nt, Homo sapiens
uggaacauaugcacag

SEQ ID NO: 449249 - RNA, 22 nt, Homo sapiens
uggaaccaacgaucauaucugu

SEQ ID NO: 449250 - RNA, 23 nt, Homo sapiens
uggaacucugugcaggugcugcc

SEQ ID NO: 449251 - RNA, 14 nt, Homo sapiens
uggaagaccuggac

SEQ ID NO: 449252 - RNA, 19 nt, Homo sapiens
uggaagaggcugagacauu

SEQ ID NO: 449253 - RNA, 18 nt, Homo sapiens
uggaagggccuucuccac

SEQ ID NO: 449254 - RNA, 14 nt, Homo sapiens
uggaagucaucuca

SEQ ID NO: 449255 - RNA, 15 nt, Homo sapiens
uggaauaacucugug

SEQ ID NO: 449256 - RNA, 20 nt, Homo sapiens
uggaauagggaacuguaaug

SEQ ID NO: 449257 - RNA, 22 nt, Homo sapiens
uggaauauaaggaaagcaauaa

SEQ ID NO: 449258 - RNA, 20 nt, Homo sapiens
uggaauauaauaugucuuca

SEQ ID NO: 449259 - RNA, 15 nt, Homo sapiens
uggaauaucacccaa

SEQ ID NO: 449260 - RNA, 22 nt, Homo sapiens
uggaaucuauaguauagaauga

SEQ ID NO: 449261 - RNA, 23 nt, Homo sapiens
uggaaugcagggaagagggcagu

SEQ ID NO: 449262 - RNA, 20 nt, Homo sapiens
uggaauuccuuggagccacu

SEQ ID NO: 449263 - RNA, 14 nt, Homo sapiens
uggaauugcucaag

SEQ ID NO: 449264 - RNA, 16 nt, Homo sapiens
uggacacacacagcuu

SEQ ID NO: 449265 - RNA, 16 nt, Homo sapiens
uggacacgcugcgcaa

SEQ ID NO: 449266 - RNA, 13 nt, Homo sapiens
uggacacugagag

SEQ ID NO: 449267 - RNA, 15 nt, Homo sapiens
uggacauccccagaa

SEQ ID NO: 449268 - RNA, 23 nt, Homo sapiens
uggaccacaggaggugugauaga

SEQ ID NO: 449269 - RNA, 19 nt, Homo sapiens
uggaccuauguccuaagga

SEQ ID NO: 449270 - RNA, 17 nt, Homo sapiens
uggaccugcaccaaagc

SEQ ID NO: 449271 - RNA, 14 nt, Homo sapiens
uggacucucaggga

SEQ ID NO: 449272 - RNA, 14 nt, Homo sapiens
uggacucuugcucu

SEQ ID NO: 449273 - RNA, 20 nt, Homo sapiens
uggacuuuugaaaagcuuuu

SEQ ID NO: 449274 - RNA, 23 nt, Homo sapiens
uggacuuuugaaguccacuuguu

SEQ ID NO: 449275 - RNA, 15 nt, Homo sapiens
uggagaauugaaaag

SEQ ID NO: 449276 - RNA, 15 nt, Homo sapiens
uggagagagccuuau

SEQ ID NO: 449277 - RNA, 16 nt, Homo sapiens
uggagaggaacccaga

SEQ ID NO: 449278 - RNA, 17 nt, Homo sapiens
uggagaucuuaagauuc

SEQ ID NO: 449279 - RNA, 16 nt, Homo sapiens
uggagcaaaacaaagc

SEQ ID NO: 449280 - RNA, 11 nt, Homo sapiens
uggagcacgug

SEQ ID NO: 449281 - RNA, 22 nt, Homo sapiens
uggagccaccugucccaccuca

SEQ ID NO: 449282 - RNA, 23 nt, Homo sapiens
uggagccacugggauucauggcu

SEQ ID NO: 449283 - RNA, 18 nt, Homo sapiens
uggagccagccacccuaa

SEQ ID NO: 449284 - RNA, 19 nt, Homo sapiens
uggagcccauccagucucc

SEQ ID NO: 449285 - RNA, 15 nt, Homo sapiens
uggaggaaaacugag

SEQ ID NO: 449286 - RNA, 16 nt, Homo sapiens
uggaggaaaacugaga

SEQ ID NO: 449287 - RNA, 19 nt, Homo sapiens
uggaggaacaacucuccag

SEQ ID NO: 449288 - RNA, 14 nt, Homo sapiens
uggaggcagacagg

SEQ ID NO: 449289 - RNA, 18 nt, Homo sapiens
uggagggcaugaagacag

SEQ ID NO: 449290 - RNA, 16 nt, Homo sapiens
uggaguccuguucuca

SEQ ID NO: 449291 - RNA, 23 nt, Homo sapiens
uggaguccuguucucagagcucc

SEQ ID NO: 449292 - RNA, 15 nt, Homo sapiens
uggagugccuguaca

SEQ ID NO: 449293 - RNA, 13 nt, Homo sapiens
uggagugucacau

SEQ ID NO: 449294 - RNA, 17 nt, Homo sapiens
uggagugucacaucucu

SEQ ID NO: 449295 - RNA, 13 nt, Homo sapiens
uggaguucagaga

SEQ ID NO: 449296 - RNA, 22 nt, Homo sapiens
uggauacuagaucuuacaucug

SEQ ID NO: 449297 - RNA, 16 nt, Homo sapiens
uggauccugcacucua

SEQ ID NO: 449298 - RNA, 17 nt, Homo sapiens
uggaucugggcacaauc

SEQ ID NO: 449299 - RNA, 21 nt, Homo sapiens
uggauggaguuaaacuugaug

SEQ ID NO: 449300 - RNA, 23 nt, Homo sapiens
uggauggccgggcugcugcugau

SEQ ID NO: 449301 - RNA, 13 nt, Homo sapiens
uggaugucuuccu

SEQ ID NO: 449302 - RNA, 21 nt, Homo sapiens
uggauuaaauggcaccuguau

SEQ ID NO: 449303 - RNA, 12 nt, Homo sapiens
uggauugagggu

SEQ ID NO: 449304 - RNA, 13 nt, Homo sapiens
uggcaaacauuua

SEQ ID NO: 449305 - RNA, 14 nt, Homo sapiens
uggcaaagugcugu

SEQ ID NO: 449306 - RNA, 12 nt, Homo sapiens
uggcaagaagac

SEQ ID NO: 449307 - RNA, 19 nt, Homo sapiens
uggcaauuucacugaugua

SEQ ID NO: 449308 - RNA, 22 nt, Homo sapiens
uggcaauuuuuuuauacuacca

SEQ ID NO: 449309 - RNA, 12 nt, Homo sapiens
uggcaccuguau

SEQ ID NO: 449310 - RNA, 16 nt, Homo sapiens
uggcacugacugggca

SEQ ID NO: 449311 - RNA, 17 nt, Homo sapiens
uggcacuggaugcagaa

SEQ ID NO: 449312 - RNA, 15 nt, Homo sapiens
uggcagaaccaaagc

SEQ ID NO: 449313 - RNA, 16 nt, Homo sapiens
uggcagcauacacaga

SEQ ID NO: 449314 - RNA, 16 nt, Homo sapiens
uggcagccgugccuuc

SEQ ID NO: 449315 - RNA, 15 nt, Homo sapiens
uggcagcugucucaa

SEQ ID NO: 449316 - RNA, 15 nt, Homo sapiens
uggcaggugaugucc

SEQ ID NO: 449317 - RNA, 17 nt, Homo sapiens
uggcaggugauguccug

SEQ ID NO: 449318 - RNA, 13 nt, Homo sapiens
uggcaggugcaga

SEQ ID NO: 449319 - RNA, 18 nt, Homo sapiens
uggcaguacagagugcag

SEQ ID NO: 449320 - RNA, 13 nt, Homo sapiens
uggcagucacuga

SEQ ID NO: 449321 - RNA, 17 nt, Homo sapiens
uggcaguggccaggcag

SEQ ID NO: 449322 - RNA, 13 nt, Homo sapiens
uggcaguguuugu

SEQ ID NO: 449323 - RNA, 16 nt, Homo sapiens
uggcaucugacacuga

SEQ ID NO: 449324 - RNA, 21 nt, Homo sapiens
uguauauugauguaacugugu

SEQ ID NO: 449325 - RNA, 17 nt, Homo sapiens
uguaucaaacuagugca

SEQ ID NO: 449326 - RNA, 23 nt, Homo sapiens
uguauccccccccuguauaguua

SEQ ID NO: 449327 - RNA, 17 nt, Homo sapiens
uguaucggagacaguga

SEQ ID NO: 449328 - RNA, 18 nt, Homo sapiens
uguaucggagacagugau

SEQ ID NO: 449329 - RNA, 23 nt, Homo sapiens
uguaucuaaaaaauaacugugca

SEQ ID NO: 449330 - RNA, 20 nt, Homo sapiens
uguaucuaccucacuauuca

SEQ ID NO: 449331 - RNA, 14 nt, Homo sapiens
uguaugacuaaaga

SEQ ID NO: 449332 - RNA, 16 nt, Homo sapiens
uguaugccaagugaga

SEQ ID NO: 449333 - RNA, 21 nt, Homo sapiens
uguaugcugauuuacuacuua

SEQ ID NO: 449334 - RNA, 20 nt, Homo sapiens
uguauggagagaaaacagac

SEQ ID NO: 449335 - RNA, 20 nt, Homo sapiens
uguauggauuuaaagauuuc

SEQ ID NO: 449336 - RNA, 14 nt, Homo sapiens
uguaugguguguga

SEQ ID NO: 449337 - RNA, 22 nt, Homo sapiens
uguaugugcgugugugcaagug

SEQ ID NO: 449338 - RNA, 18 nt, Homo sapiens
uguauuaaagacagaggc

SEQ ID NO: 449339 - RNA, 20 nt, Homo sapiens
uguauuaacugaauucugaa

SEQ ID NO: 449340 - RNA, 23 nt, Homo sapiens
uguauuaauguguuaagugcagg

SEQ ID NO: 449341 - RNA, 22 nt, Homo sapiens
uguauuacaucuaaugcuucaa

SEQ ID NO: 449342 - RNA, 14 nt, Homo sapiens
uguauuagauauca

SEQ ID NO: 449343 - RNA, 17 nt, Homo sapiens
uguauuuccagugcaau

SEQ ID NO: 449344 - RNA, 20 nt, Homo sapiens
uguauuuuacuuugugcaau

SEQ ID NO: 449345 - RNA, 22 nt, Homo sapiens
ugucaaagugaaagacauuuca

SEQ ID NO: 449346 - RNA, 21 nt, Homo sapiens
ugucaaccucuccuccaggcc

SEQ ID NO: 449347 - RNA, 14 nt, Homo sapiens
ugucaaguacaagc

SEQ ID NO: 449348 - RNA, 19 nt, Homo sapiens
ugucaaugagguuaugaga

SEQ ID NO: 449349 - RNA, 12 nt, Homo sapiens
ugucaaugauac

SEQ ID NO: 449350 - RNA, 18 nt, Homo sapiens
ugucacaaccucucugau

SEQ ID NO: 449351 - RNA, 23 nt, Homo sapiens
ugucaccaaauuuguaccucuaa

SEQ ID NO: 449352 - RNA, 20 nt, Homo sapiens
ugucaccaagaaggggcucg

SEQ ID NO: 449353 - RNA, 14 nt, Homo sapiens
ugucaccagcaaca

SEQ ID NO: 449354 - RNA, 23 nt, Homo sapiens
ugucaccggccuugugacauuca

SEQ ID NO: 449355 - RNA, 21 nt, Homo sapiens
ugucacuacaaaaauacaauu

SEQ ID NO: 449356 - RNA, 22 nt, Homo sapiens
ugucacuacucacagucucuuu

SEQ ID NO: 449357 - RNA, 23 nt, Homo sapiens
ugucacuucgcgugcccucgcug

SEQ ID NO: 449358 - RNA, 18 nt, Homo sapiens
ugucacuugacucuugaa

SEQ ID NO: 449359 - RNA, 18 nt, Homo sapiens
ugucagcagcucugagac

SEQ ID NO: 449360 - RNA, 15 nt, Homo sapiens
ugucagucuacaggc

SEQ ID NO: 449361 - RNA, 16 nt, Homo sapiens
ugucagugacaguauu

SEQ ID NO: 449362 - RNA, 12 nt, Homo sapiens
ugucagugcagc

SEQ ID NO: 449363 - RNA, 15 nt, Homo sapiens
ugucauagcuaugac

SEQ ID NO: 449364 - RNA, 16 nt, Homo sapiens
ugucauagcuaugaca

SEQ ID NO: 449365 - RNA, 13 nt, Homo sapiens
ugucaucugucag

SEQ ID NO: 449366 - RNA, 19 nt, Homo sapiens
ugucaugauuucaaugauu

SEQ ID NO: 449367 - RNA, 19 nt, Homo sapiens
ugucauucaagccugugaa

SEQ ID NO: 449368 - RNA, 22 nt, Homo sapiens
ugucauugaugaacugccaaag

SEQ ID NO: 449369 - RNA, 20 nt, Homo sapiens
uguccacacuaccaguuuca

SEQ ID NO: 449370 - RNA, 22 nt, Homo sapiens
uguccacguaucuuugggucuu

SEQ ID NO: 449371 - RNA, 13 nt, Homo sapiens
uguccauaagaga

SEQ ID NO: 449372 - RNA, 18 nt, Homo sapiens
uguccaugugugugcaag

SEQ ID NO: 449373 - RNA, 20 nt, Homo sapiens
ugucccagcaccuggcacac

SEQ ID NO: 449374 - RNA, 13 nt, Homo sapiens
ugucccaugaccu

SEQ ID NO: 449375 - RNA, 21 nt, Homo sapiens
uguccccagcccuguccuggu

SEQ ID NO: 449376 - RNA, 13 nt, Homo sapiens
ugucccccccuaa

SEQ ID NO: 449377 - RNA, 15 nt, Homo sapiens
uguccccgccuuccc

SEQ ID NO: 449378 - RNA, 20 nt, Homo sapiens
ugucccggggcuccacugaa

SEQ ID NO: 449379 - RNA, 12 nt, Homo sapiens
ugucccuguggu

SEQ ID NO: 449380 - RNA, 22 nt, Homo sapiens
ugucccuugccucaaugccagu

SEQ ID NO: 449381 - RNA, 11 nt, Homo sapiens
uguccuaagca

SEQ ID NO: 449382 - RNA, 14 nt, Homo sapiens
uguccuacaauauc

SEQ ID NO: 449383 - RNA, 16 nt, Homo sapiens
uguccuacaauaucau

SEQ ID NO: 449384 - RNA, 13 nt, Homo sapiens
uguccuaugcgcu

SEQ ID NO: 449385 - RNA, 16 nt, Homo sapiens
uguccucuugcucaaa

SEQ ID NO: 449386 - RNA, 20 nt, Homo sapiens
uguccugaugcuuuugucua

SEQ ID NO: 449387 - RNA, 21 nt, Homo sapiens
uguccugaugcuuuugucuaa

SEQ ID NO: 449388 - RNA, 14 nt, Homo sapiens
uguccugccagcug

SEQ ID NO: 449389 - RNA, 13 nt, Homo sapiens
uguccugggguau

SEQ ID NO: 449390 - RNA, 21 nt, Homo sapiens
uguccuguacauugugggaug

SEQ ID NO: 449391 - RNA, 20 nt, Homo sapiens
uguccuucccacggccacug

SEQ ID NO: 449392 - RNA, 21 nt, Homo sapiens
uguccuuuuggcacugagaua

SEQ ID NO: 449393 - RNA, 17 nt, Homo sapiens
ugucgauuuucaauaau

SEQ ID NO: 449394 - RNA, 16 nt, Homo sapiens
ugucgccucugcauuc

SEQ ID NO: 449395 - RNA, 17 nt, Homo sapiens
ugucgucuuagcaagaa

SEQ ID NO: 449396 - RNA, 13 nt, Homo sapiens
ugucucaccagcu

SEQ ID NO: 449397 - RNA, 14 nt, Homo sapiens
ugucucagccuccc

SEQ ID NO: 449398 - RNA, 14 nt, Homo sapiens
ugucuccuaccucu

SEQ ID NO: 449399 - RNA, 17 nt, Homo sapiens
ugucucuaucuugcauc

SEQ ID NO: 449400 - RNA, 24 nt, Homo sapiens
ugucucugacaaugcguggcacau

SEQ ID NO: 449401 - RNA, 13 nt, Homo sapiens
ugucugauucuau

SEQ ID NO: 449402 - RNA, 20 nt, Homo sapiens
ugucugcugcucccagccac

SEQ ID NO: 449403 - RNA, 19 nt, Homo sapiens
ugucugggaaaaagugcac

SEQ ID NO: 449404 - RNA, 14 nt, Homo sapiens
ugucuggugggugg

SEQ ID NO: 449405 - RNA, 14 nt, Homo sapiens
ugucugugccaagg

SEQ ID NO: 449406 - RNA, 13 nt, Homo sapiens
ugucugugugcaa

SEQ ID NO: 449407 - RNA, 15 nt, Homo sapiens
ugucugugugcaagu

SEQ ID NO: 449408 - RNA, 17 nt, Homo sapiens
ugucugugugcaagugu

SEQ ID NO: 449409 - RNA, 18 nt, Homo sapiens
ugucuguuaaaugaacuu

SEQ ID NO: 449410 - RNA, 21 nt, Homo sapiens
ugucuguuucaaugaccugua

SEQ ID NO: 449411 - RNA, 19 nt, Homo sapiens
ugucuuccaggcccagucc

SEQ ID NO: 449412 - RNA, 15 nt, Homo sapiens
ugucuucucccugca

SEQ ID NO: 449413 - RNA, 16 nt, Homo sapiens
ugucuugucaucuuuu

SEQ ID NO: 449414 - RNA, 22 nt, Homo sapiens
ugugaaaauuacacccaugcac

SEQ ID NO: 449415 - RNA, 18 nt, Homo sapiens
ugugaaagcaccaucauc

SEQ ID NO: 449416 - RNA, 18 nt, Homo sapiens
ugugaaaguaugugauau

SEQ ID NO: 449417 - RNA, 22 nt, Homo sapiens
ugugaaaguaugugauaucuga

SEQ ID NO: 449418 - RNA, 19 nt, Homo sapiens
ugugaacauggacucuucc

SEQ ID NO: 449419 - RNA, 14 nt, Homo sapiens
ugugaaguacauau

SEQ ID NO: 449420 - RNA, 16 nt, Homo sapiens
ugugaauaaaaacccu

SEQ ID NO: 449421 - RNA, 22 nt, Homo sapiens
ugugaauaaaaacccuguaugg

SEQ ID NO: 449422 - RNA, 19 nt, Homo sapiens
ugugaauguaaaacagagc

SEQ ID NO: 449423 - RNA, 21 nt, Homo sapiens
ugugacaauaaguuugaaccu

SEQ ID NO: 449424 - RNA, 12 nt, Homo sapiens
ugugacauucac

SEQ ID NO: 449425 - RNA, 18 nt, Homo sapiens
ugugacccagggugcauu

SEQ ID NO: 449426 - RNA, 19 nt, Homo sapiens
ugugacccucucacuuugg

SEQ ID NO: 449427 - RNA, 15 nt, Homo sapiens
ugugaccgggguccu

SEQ ID NO: 449428 - RNA, 15 nt, Homo sapiens
ugugaccucccaugg

SEQ ID NO: 449429 - RNA, 15 nt, Homo sapiens
ugugacuggcaguau

SEQ ID NO: 449430 - RNA, 20 nt, Homo sapiens
ugugacuugaacuagauugc

SEQ ID NO: 449431 - RNA, 19 nt, Homo sapiens
ugugacuuuuucagaguug

SEQ ID NO: 449432 - RNA, 20 nt, Homo sapiens
ugugacuuuuucagaguugc

SEQ ID NO: 449433 - RNA, 21 nt, Homo sapiens
ugugagaacuguucucaugga

SEQ ID NO: 449434 - RNA, 18 nt, Homo sapiens
ugugagaauaaacuagac

SEQ ID NO: 449435 - RNA, 17 nt, Homo sapiens
ugugagaauaaagcauu

SEQ ID NO: 449436 - RNA, 15 nt, Homo sapiens
ugugagauccuucac

SEQ ID NO: 449437 - RNA, 16 nt, Homo sapiens
ugugagauccuucaca

SEQ ID NO: 449438 - RNA, 16 nt, Homo sapiens
ugugagccaccacguc

SEQ ID NO: 449439 - RNA, 18 nt, Homo sapiens
ugugaugaugcugugaca

SEQ ID NO: 449440 - RNA, 16 nt, Homo sapiens
ugugaugcaugagcuc

SEQ ID NO: 449441 - RNA, 18 nt, Homo sapiens
ugugauggauggacacaa

SEQ ID NO: 449442 - RNA, 19 nt, Homo sapiens
ugugauugcugccauaauu

SEQ ID NO: 449443 - RNA, 14 nt, Homo sapiens
ugugauugugauuc

SEQ ID NO: 449444 - RNA, 18 nt, Homo sapiens
ugugauuuuugaacaaua

SEQ ID NO: 449445 - RNA, 16 nt, Homo sapiens
ugugcacgagugggaa

SEQ ID NO: 449446 - RNA, 15 nt, Homo sapiens
ugugcacucauauga

SEQ ID NO: 449447 - RNA, 17 nt, Homo sapiens
ugugcacugucacuuug

SEQ ID NO: 449448 - RNA, 23 nt, Homo sapiens
ugugcacuugcacgcccaugugu

SEQ ID NO: 449449 - RNA, 21 nt, Homo sapiens
ugugcaguguugacaguucau

SEQ ID NO: 449450 - RNA, 23 nt, Homo sapiens
ugugcaugagaaugucauuugcu

SEQ ID NO: 449451 - RNA, 19 nt, Homo sapiens
ugugcauguauauuacuga

SEQ ID NO: 449452 - RNA, 18 nt, Homo sapiens
ugugcaugugugugcuca

SEQ ID NO: 449453 - RNA, 21 nt, Homo sapiens
uauucuuuacaaaaugaaugc

SEQ ID NO: 449454 - RNA, 20 nt, Homo sapiens
uauucuuuacaaacugaaga

SEQ ID NO: 449455 - RNA, 20 nt, Homo sapiens
uauugaaugaugugauacaa

SEQ ID NO: 449456 - RNA, 14 nt, Homo sapiens
uauugaucuuugcc

SEQ ID NO: 449457 - RNA, 12 nt, Homo sapiens
uauugcuaguac

SEQ ID NO: 449458 - RNA, 14 nt, Homo sapiens
uauugcuaguacua

SEQ ID NO: 449459 - RNA, 15 nt, Homo sapiens
uauugcuuggacuac

SEQ ID NO: 449460 - RNA, 21 nt, Homo sapiens
uauuggaaaggucauuguggc

SEQ ID NO: 449461 - RNA, 22 nt, Homo sapiens
uauuggacauccccagaaaaga

SEQ ID NO: 449462 - RNA, 19 nt, Homo sapiens
uauugugccaauauguauu

SEQ ID NO: 449463 - RNA, 15 nt, Homo sapiens
ucacacacacagcug

SEQ ID NO: 449464 - RNA, 20 nt, Homo sapiens
ucacacaguggcacuagcau

SEQ ID NO: 449465 - RNA, 23 nt, Homo sapiens
ucacaccuaugacauacauggaa

SEQ ID NO: 449466 - RNA, 17 nt, Homo sapiens
ucacacucauaacucau

SEQ ID NO: 449467 - RNA, 12 nt, Homo sapiens
ucacacuguaaa

SEQ ID NO: 449468 - RNA, 17 nt, Homo sapiens
ucacacuguaaacauuc

SEQ ID NO: 449469 - RNA, 19 nt, Homo sapiens
ucacacuguaaacauucau

SEQ ID NO: 449470 - RNA, 19 nt, Homo sapiens
ucacagacuggcaacaaga

SEQ ID NO: 449471 - RNA, 15 nt, Homo sapiens
ucacagagugcauug

SEQ ID NO: 449472 - RNA, 13 nt, Homo sapiens
ucacagaugggca

SEQ ID NO: 449473 - RNA, 21 nt, Homo sapiens
ucacagcaguacuugcucaau

SEQ ID NO: 449474 - RNA, 14 nt, Homo sapiens
ucacagccauuuca

SEQ ID NO: 449475 - RNA, 19 nt, Homo sapiens
ucacaggacucugccuccu

SEQ ID NO: 449476 - RNA, 16 nt, Homo sapiens
ucacaggagucuuugu

SEQ ID NO: 449477 - RNA, 20 nt, Homo sapiens
ucacaggcuacaguugaaca

SEQ ID NO: 449478 - RNA, 22 nt, Homo sapiens
ucacaguacuucccaacaacuc

SEQ ID NO: 449479 - RNA, 21 nt, Homo sapiens
ucacagugaacauaacuguaa

SEQ ID NO: 449480 - RNA, 15 nt, Homo sapiens
ucacaugaugcauac

SEQ ID NO: 449481 - RNA, 18 nt, Homo sapiens
ucacaugcuggacagguc

SEQ ID NO: 449482 - RNA, 12 nt, Homo sapiens
ucacauguccua

SEQ ID NO: 449483 - RNA, 17 nt, Homo sapiens
ucacauucccucucauc

SEQ ID NO: 449484 - RNA, 15 nt, Homo sapiens
ucacauuuugccuuu

SEQ ID NO: 449485 - RNA, 15 nt, Homo sapiens
ucaccacaagccacc

SEQ ID NO: 449486 - RNA, 16 nt, Homo sapiens
ucaccacaucuugucu

SEQ ID NO: 449487 - RNA, 17 nt, Homo sapiens
ucaccagaauugugcaa

SEQ ID NO: 449488 - RNA, 20 nt, Homo sapiens
ucaccagucugucuacugug

SEQ ID NO: 449489 - RNA, 21 nt, Homo sapiens
ucaccauuuaaucauuuccag

SEQ ID NO: 449490 - RNA, 12 nt, Homo sapiens
ucaccauuucau

SEQ ID NO: 449491 - RNA, 19 nt, Homo sapiens
ucacccaaaagaauuauca

SEQ ID NO: 449492 - RNA, 17 nt, Homo sapiens
ucaccccacagacacuu

SEQ ID NO: 449493 - RNA, 20 nt, Homo sapiens
ucacccugccuuaucuugca

SEQ ID NO: 449494 - RNA, 17 nt, Homo sapiens
ucacccugucaaguuaa

SEQ ID NO: 449495 - RNA, 12 nt, Homo sapiens
ucacccugugac

SEQ ID NO: 449496 - RNA, 16 nt, Homo sapiens
ucaccgcauggacaag

SEQ ID NO: 449497 - RNA, 16 nt, Homo sapiens
ucaccuaaaaaaagag

SEQ ID NO: 449498 - RNA, 17 nt, Homo sapiens
ucaccuagaccuugccu

SEQ ID NO: 449499 - RNA, 21 nt, Homo sapiens
ucaccuagcuugucccaagcu

SEQ ID NO: 449500 - RNA, 18 nt, Homo sapiens
ucaccucacacuccucca

SEQ ID NO: 449501 - RNA, 18 nt, Homo sapiens
ucaccucccaaacccagc

SEQ ID NO: 449502 - RNA, 21 nt, Homo sapiens
ucaccucuuaugcacaccucc

SEQ ID NO: 449503 - RNA, 20 nt, Homo sapiens
ucaccuuaaaauuagcaucu

SEQ ID NO: 449504 - RNA, 14 nt, Homo sapiens
ucaccuuccagugu

SEQ ID NO: 449505 - RNA, 18 nt, Homo sapiens
ucaccuuuucuaaaaagu

SEQ ID NO: 449506 - RNA, 13 nt, Homo sapiens
ucacgacucuucc

SEQ ID NO: 449507 - RNA, 18 nt, Homo sapiens
ucacgggaggaaucuuuu

SEQ ID NO: 449508 - RNA, 23 nt, Homo sapiens
ucacuaaagcaguagaaauaaua

SEQ ID NO: 449509 - RNA, 23 nt, Homo sapiens
ucacuacaaccuccaccuuccag

SEQ ID NO: 449510 - RNA, 12 nt, Homo sapiens
ucacuacaggug

SEQ ID NO: 449511 - RNA, 16 nt, Homo sapiens
ucacuauaaccaucag

SEQ ID NO: 449512 - RNA, 15 nt, Homo sapiens
ucacuaugcauuuua

SEQ ID NO: 449513 - RNA, 14 nt, Homo sapiens
ucacuccacucccc

SEQ ID NO: 449514 - RNA, 14 nt, Homo sapiens
ucacucccagucca

SEQ ID NO: 449515 - RNA, 12 nt, Homo sapiens
ucacucugaauc

SEQ ID NO: 449516 - RNA, 16 nt, Homo sapiens
ucacucugaauccuca

SEQ ID NO: 449517 - RNA, 23 nt, Homo sapiens
ucacucuuucuucucucuuuguc

SEQ ID NO: 449518 - RNA, 17 nt, Homo sapiens
ucacugcccccagcucu

SEQ ID NO: 449519 - RNA, 12 nt, Homo sapiens
ucacugcugcuc

SEQ ID NO: 449520 - RNA, 18 nt, Homo sapiens
ucacugcuggcugccuua

SEQ ID NO: 449521 - RNA, 21 nt, Homo sapiens
ucacuggggaggacgugauga

SEQ ID NO: 449522 - RNA, 20 nt, Homo sapiens
ucacuguccaccaccaccug

SEQ ID NO: 449523 - RNA, 13 nt, Homo sapiens
ucacuguugcuua

SEQ ID NO: 449524 - RNA, 15 nt, Homo sapiens
ucacuuaaacuuugu

SEQ ID NO: 449525 - RNA, 20 nt, Homo sapiens
ucacuuauuucauaaacaac

SEQ ID NO: 449526 - RNA, 14 nt, Homo sapiens
ucacuucucccacc

SEQ ID NO: 449527 - RNA, 16 nt, Homo sapiens
ucacuugacuuugcca

SEQ ID NO: 449528 - RNA, 15 nt, Homo sapiens
ucacuugagcccagg

SEQ ID NO: 449529 - RNA, 18 nt, Homo sapiens
ucacuuuucuccaugagu

SEQ ID NO: 449530 - RNA, 14 nt, Homo sapiens
ucagaaaacucugg

SEQ ID NO: 449531 - RNA, 16 nt, Homo sapiens
ucagaaaagacacuuc

SEQ ID NO: 449532 - RNA, 18 nt, Homo sapiens
ucagaaaagacacuucaa

SEQ ID NO: 449533 - RNA, 12 nt, Homo sapiens
ucagaaaccaaa

SEQ ID NO: 449534 - RNA, 17 nt, Homo sapiens
ucagaaagucaccagga

SEQ ID NO: 449535 - RNA, 14 nt, Homo sapiens
ucagaacacauucu

SEQ ID NO: 449536 - RNA, 16 nt, Homo sapiens
ucagaauauacccauc

SEQ ID NO: 449537 - RNA, 21 nt, Homo sapiens
ucagaccaacucucuccugua

SEQ ID NO: 449538 - RNA, 18 nt, Homo sapiens
ucagaccaguacugggaa

SEQ ID NO: 449539 - RNA, 14 nt, Homo sapiens
ucagacugagcucc

SEQ ID NO: 449540 - RNA, 17 nt, Homo sapiens
ucagacugcaagugagc

SEQ ID NO: 449541 - RNA, 14 nt, Homo sapiens
ucagagaagucagu

SEQ ID NO: 449542 - RNA, 20 nt, Homo sapiens
ucagagagcuaaauuacaau

SEQ ID NO: 449543 - RNA, 22 nt, Homo sapiens
ucagagcagugauucucucuuc

SEQ ID NO: 449544 - RNA, 15 nt, Homo sapiens
ucagagccaccccua

SEQ ID NO: 449545 - RNA, 15 nt, Homo sapiens
ucagagccagugaag

SEQ ID NO: 449546 - RNA, 15 nt, Homo sapiens
ucagaggacuuggca

SEQ ID NO: 449547 - RNA, 22 nt, Homo sapiens
ucagauaaagcacccuguauca

SEQ ID NO: 449548 - RNA, 14 nt, Homo sapiens
ucagauccuacccc

SEQ ID NO: 449549 - RNA, 23 nt, Homo sapiens
ucagaugaauuguuaauuaucua

SEQ ID NO: 449550 - RNA, 14 nt, Homo sapiens
ucagauuccaccua

SEQ ID NO: 449551 - RNA, 18 nt, Homo sapiens
ucagauuguuaucuauca

SEQ ID NO: 449552 - RNA, 17 nt, Homo sapiens
ucagcaacagagcaaaa

SEQ ID NO: 449553 - RNA, 16 nt, Homo sapiens
ucagcaccaugggccu

SEQ ID NO: 449554 - RNA, 15 nt, Homo sapiens
ucagcaccugggacc

SEQ ID NO: 449555 - RNA, 16 nt, Homo sapiens
ucagcaccugggaccc

SEQ ID NO: 449556 - RNA, 20 nt, Homo sapiens
ucagcagaaacccccaggag

SEQ ID NO: 449557 - RNA, 21 nt, Homo sapiens
ucagcaguucagcuccuucca

SEQ ID NO: 449558 - RNA, 21 nt, Homo sapiens
ucagcaugauguguuguguau

SEQ ID NO: 449559 - RNA, 17 nt, Homo sapiens
ucagccaacauugccuu

SEQ ID NO: 449560 - RNA, 14 nt, Homo sapiens
ucagccacauucua

SEQ ID NO: 449561 - RNA, 16 nt, Homo sapiens
ucagccagccuccagc

SEQ ID NO: 449562 - RNA, 23 nt, Homo sapiens
ucagccuacuuucacacuaagaa

SEQ ID NO: 449563 - RNA, 19 nt, Homo sapiens
ucagccuccgccauuccaa

SEQ ID NO: 449564 - RNA, 19 nt, Homo sapiens
ucagccuccugagccugug

SEQ ID NO: 449565 - RNA, 14 nt, Homo sapiens
ucagccugagucuc

SEQ ID NO: 449566 - RNA, 11 nt, Homo sapiens
ucagccuucca

SEQ ID NO: 449567 - RNA, 16 nt, Homo sapiens
ucagcuacacaaggaa

SEQ ID NO: 449568 - RNA, 21 nt, Homo sapiens
ucagcuagauuuguguccaca

SEQ ID NO: 449569 - RNA, 14 nt, Homo sapiens
ucagcuaugcaaau

SEQ ID NO: 449570 - RNA, 22 nt, Homo sapiens
ucagcucccaucucauuuccag

SEQ ID NO: 449571 - RNA, 14 nt, Homo sapiens
ucagcuccuuccac

SEQ ID NO: 449572 - RNA, 14 nt, Homo sapiens
ucagcucucugcag

SEQ ID NO: 449573 - RNA, 18 nt, Homo sapiens
ucagcucuggcucacaga

SEQ ID NO: 449574 - RNA, 16 nt, Homo sapiens
ucagcucuuugacaac

SEQ ID NO: 449575 - RNA, 22 nt, Homo sapiens
ucagcuuucccuggcucaggga

SEQ ID NO: 449576 - RNA, 13 nt, Homo sapiens
ucagcuuugccuu

SEQ ID NO: 449577 - RNA, 18 nt, Homo sapiens
ucagcuuuuguucuagac

SEQ ID NO: 449578 - RNA, 19 nt, Homo sapiens
ucagcuuuuguucuagacu

SEQ ID NO: 449579 - RNA, 20 nt, Homo sapiens
ucaggaagccuccugcugag

SEQ ID NO: 449580 - RNA, 21 nt, Homo sapiens
ucaggacacccuacacaaaau

SEQ ID NO: 449581 - RNA, 13 nt, Homo sapiens
ucaggagaaggcc

SEQ ID NO: 449582 - RNA, 15 nt, Homo sapiens
ucaggagacugaguu

SEQ ID NO: 449583 - RNA, 20 nt, Homo sapiens
ucaggagggcagccacggag

SEQ ID NO: 449584 - RNA, 14 nt, Homo sapiens
ucaggcccuggaac

SEQ ID NO: 449585 - RNA, 14 nt, Homo sapiens
ucagggaucucaga

SEQ ID NO: 449586 - RNA, 16 nt, Homo sapiens
ucagggcagggcucau

SEQ ID NO: 449587 - RNA, 15 nt, Homo sapiens
ucagggccaugccug

SEQ ID NO: 449588 - RNA, 19 nt, Homo sapiens
ucagggcuauggauggggc

SEQ ID NO: 449589 - RNA, 16 nt, Homo sapiens
uccaccaaguucucau

SEQ ID NO: 449590 - RNA, 12 nt, Homo sapiens
uccaccacaaga

SEQ ID NO: 449591 - RNA, 16 nt, Homo sapiens
uccaccaccuugccaa

SEQ ID NO: 449592 - RNA, 17 nt, Homo sapiens
uccaccaucaccucucu

SEQ ID NO: 449593 - RNA, 17 nt, Homo sapiens
uccaccccacucacaga

SEQ ID NO: 449594 - RNA, 16 nt, Homo sapiens
uccacccuauucccua

SEQ ID NO: 449595 - RNA, 19 nt, Homo sapiens
uccacccuuggacuuucuu

SEQ ID NO: 449596 - RNA, 17 nt, Homo sapiens
uccaccuaccuauucau

SEQ ID NO: 449597 - RNA, 24 nt, Homo sapiens
uccaccuuaaauuaaacaauuuau

SEQ ID NO: 449598 - RNA, 14 nt, Homo sapiens
uccacgaagccuua

SEQ ID NO: 449599 - RNA, 16 nt, Homo sapiens
uccacgcucaucuugc

SEQ ID NO: 449600 - RNA, 18 nt, Homo sapiens
uccacggaaacagaacuc

SEQ ID NO: 449601 - RNA, 20 nt, Homo sapiens
uccacgggucucacuuauac

SEQ ID NO: 449602 - RNA, 21 nt, Homo sapiens
uccacuacgcuccugucucca

SEQ ID NO: 449603 - RNA, 13 nt, Homo sapiens
uccacuccuccca

SEQ ID NO: 449604 - RNA, 21 nt, Homo sapiens
uccacucggagugcccugugu

SEQ ID NO: 449605 - RNA, 17 nt, Homo sapiens
uccacucuacccuccca

SEQ ID NO: 449606 - RNA, 19 nt, Homo sapiens
uccacuggaaaaguguaau

SEQ ID NO: 449607 - RNA, 20 nt, Homo sapiens
uccacuggagaauugaaaag

SEQ ID NO: 449608 - RNA, 11 nt, Homo sapiens
uccacuuagaa

SEQ ID NO: 449609 - RNA, 20 nt, Homo sapiens
uccacuuagaaauugcauuu

SEQ ID NO: 449610 - RNA, 23 nt, Homo sapiens
uccacuucuuguuccccacugac

SEQ ID NO: 449611 - RNA, 22 nt, Homo sapiens
uccacuuguucuguacuuguaa

SEQ ID NO: 449612 - RNA, 15 nt, Homo sapiens
uccagaagaucugaa

SEQ ID NO: 449613 - RNA, 19 nt, Homo sapiens
uccagaguaggugggucuu

SEQ ID NO: 449614 - RNA, 17 nt, Homo sapiens
uccagauccagacugua

SEQ ID NO: 449615 - RNA, 19 nt, Homo sapiens
uccagauccagacuguaag

SEQ ID NO: 449616 - RNA, 16 nt, Homo sapiens
uccagaugaacugaga

SEQ ID NO: 449617 - RNA, 20 nt, Homo sapiens
uccagcaccuucccucucac

SEQ ID NO: 449618 - RNA, 22 nt, Homo sapiens
uccagccaacauuuaaugagca

SEQ ID NO: 449619 - RNA, 17 nt, Homo sapiens
uccagccacuuauuucc

SEQ ID NO: 449620 - RNA, 22 nt, Homo sapiens
uccagccacuuauuuccaugga

SEQ ID NO: 449621 - RNA, 21 nt, Homo sapiens
uccagcccgaguggucuccuc

SEQ ID NO: 449622 - RNA, 17 nt, Homo sapiens
uccagccugggcaacag

SEQ ID NO: 449623 - RNA, 23 nt, Homo sapiens
uccagcuggaagggucaacaucu

SEQ ID NO: 449624 - RNA, 21 nt, Homo sapiens
uccagcuguacuagugccauu

SEQ ID NO: 449625 - RNA, 14 nt, Homo sapiens
uccagcuucaggca

SEQ ID NO: 449626 - RNA, 17 nt, Homo sapiens
uccaggaagcacaggcc

SEQ ID NO: 449627 - RNA, 23 nt, Homo sapiens
uccagggggcagcccaguggaau

SEQ ID NO: 449628 - RNA, 14 nt, Homo sapiens
uccagguacugauc

SEQ ID NO: 449629 - RNA, 16 nt, Homo sapiens
uccagucccaugaccu

SEQ ID NO: 449630 - RNA, 11 nt, Homo sapiens
uccagugcagg

SEQ ID NO: 449631 - RNA, 22 nt, Homo sapiens
uccagugggaggugagaccacc

SEQ ID NO: 449632 - RNA, 13 nt, Homo sapiens
uccaguguuuaca

SEQ ID NO: 449633 - RNA, 14 nt, Homo sapiens
uccaguucugauga

SEQ ID NO: 449634 - RNA, 15 nt, Homo sapiens
uccauaaagcacauu

SEQ ID NO: 449635 - RNA, 13 nt, Homo sapiens
uccauaauugcaa

SEQ ID NO: 449636 - RNA, 16 nt, Homo sapiens
uccauagcuucaucca

SEQ ID NO: 449637 - RNA, 18 nt, Homo sapiens
uccauagugcacuagcau

SEQ ID NO: 449638 - RNA, 21 nt, Homo sapiens
uccauagugcacuagcauuuu

SEQ ID NO: 449639 - RNA, 13 nt, Homo sapiens
uccauauguuaua

SEQ ID NO: 449640 - RNA, 23 nt, Homo sapiens
uccauauguuauaucaacagaua

SEQ ID NO: 449641 - RNA, 23 nt, Homo sapiens
uccauauuggacauccccagaaa

SEQ ID NO: 449642 - RNA, 17 nt, Homo sapiens
uccaucagcuguaagaa

SEQ ID NO: 449643 - RNA, 12 nt, Homo sapiens
uccaucccgaaa

SEQ ID NO: 449644 - RNA, 17 nt, Homo sapiens
uccaucuuucuacagag

SEQ ID NO: 449645 - RNA, 23 nt, Homo sapiens
uccaugacaguagcauacugaug

SEQ ID NO: 449646 - RNA, 17 nt, Homo sapiens
uccaugacugcauuuua

SEQ ID NO: 449647 - RNA, 22 nt, Homo sapiens
uccaugacugcauuuuacugua

SEQ ID NO: 449648 - RNA, 16 nt, Homo sapiens
uccaugagacacaucu

SEQ ID NO: 449649 - RNA, 22 nt, Homo sapiens
uccauggccaccccgugccacc

SEQ ID NO: 449650 - RNA, 18 nt, Homo sapiens
uccauggcccugccaugc

SEQ ID NO: 449651 - RNA, 17 nt, Homo sapiens
uccaugugugugcaagu

SEQ ID NO: 449652 - RNA, 19 nt, Homo sapiens
uccauguguuuugcuuuua

SEQ ID NO: 449653 - RNA, 15 nt, Homo sapiens
uccauguuuguaaaa

SEQ ID NO: 449654 - RNA, 21 nt, Homo sapiens
uccauuuaccuggaaaccaga

SEQ ID NO: 449655 - RNA, 17 nt, Homo sapiens
uccauuuuauacaagaa

SEQ ID NO: 449656 - RNA, 23 nt, Homo sapiens
uccauuuuugucagucugaguca

SEQ ID NO: 449657 - RNA, 21 nt, Homo sapiens
ucccaaacccagccucuagaa

SEQ ID NO: 449658 - RNA, 15 nt, Homo sapiens
ucccaaacuacagaa

SEQ ID NO: 449659 - RNA, 13 nt, Homo sapiens
ucccaaacuccca

SEQ ID NO: 449660 - RNA, 10 nt, Homo sapiens
ucccaaagaa

SEQ ID NO: 449661 - RNA, 16 nt, Homo sapiens
ucccaaaggcuuucuu

SEQ ID NO: 449662 - RNA, 20 nt, Homo sapiens
ucccaaagugcugagauuac

SEQ ID NO: 449663 - RNA, 14 nt, Homo sapiens
ucccaacagccuua

SEQ ID NO: 449664 - RNA, 13 nt, Homo sapiens
ucccaacauuucu

SEQ ID NO: 449665 - RNA, 13 nt, Homo sapiens
ucccaacccauuc

SEQ ID NO: 449666 - RNA, 22 nt, Homo sapiens
ucccaacccauucacuacaggu

SEQ ID NO: 449667 - RNA, 23 nt, Homo sapiens
ucccaaccucaaugcccugccau

SEQ ID NO: 449668 - RNA, 20 nt, Homo sapiens
ucccaacucacugugcuccu

SEQ ID NO: 449669 - RNA, 15 nt, Homo sapiens
ucccaagaugcagaa

SEQ ID NO: 449670 - RNA, 16 nt, Homo sapiens
ucccaagguccucuca

SEQ ID NO: 449671 - RNA, 20 nt, Homo sapiens
ucccaaguaggugggauuac

SEQ ID NO: 449672 - RNA, 15 nt, Homo sapiens
ucccaaguccagugu

SEQ ID NO: 449673 - RNA, 17 nt, Homo sapiens
ucccaaguccaguguga

SEQ ID NO: 449674 - RNA, 21 nt, Homo sapiens
ucccaauccuuaucccaagcu

SEQ ID NO: 449675 - RNA, 12 nt, Homo sapiens
ucccaauuuccc

SEQ ID NO: 449676 - RNA, 16 nt, Homo sapiens
ucccaccccaagcaaa

SEQ ID NO: 449677 - RNA, 17 nt, Homo sapiens
ucccacccccaucucuc

SEQ ID NO: 449678 - RNA, 18 nt, Homo sapiens
ucccacccccaucucucc

SEQ ID NO: 449679 - RNA, 17 nt, Homo sapiens
ucccaccccggccucca

SEQ ID NO: 449680 - RNA, 23 nt, Homo sapiens
ucccaccgguugcuucugggaag

SEQ ID NO: 449681 - RNA, 23 nt, Homo sapiens
ucccacugcacuuggugcugcuu

SEQ ID NO: 449682 - RNA, 22 nt, Homo sapiens
ucccacuuaucaaaucauucaa

SEQ ID NO: 449683 - RNA, 18 nt, Homo sapiens
ucccagaggaugucacaa

SEQ ID NO: 449684 - RNA, 18 nt, Homo sapiens
ucccagaggcuccuggag

SEQ ID NO: 449685 - RNA, 14 nt, Homo sapiens
ucccagaguuuuca

SEQ ID NO: 449686 - RNA, 18 nt, Homo sapiens
ucccagccucuugcucag

SEQ ID NO: 449687 - RNA, 17 nt, Homo sapiens
ucccaggaagcagggag

SEQ ID NO: 449688 - RNA, 17 nt, Homo sapiens
ucccaguccuccagacc

SEQ ID NO: 449689 - RNA, 15 nt, Homo sapiens
ucccagucucuggca

SEQ ID NO: 449690 - RNA, 16 nt, Homo sapiens
ucccaucucagaagau

SEQ ID NO: 449691 - RNA, 18 nt, Homo sapiens
ucccaucugucaccaauu

SEQ ID NO: 449692 - RNA, 15 nt, Homo sapiens
ucccaugacugcacc

SEQ ID NO: 449693 - RNA, 21 nt, Homo sapiens
ucccauggaaugcagcaguaa

SEQ ID NO: 449694 - RNA, 17 nt, Homo sapiens
ucccauggcaccuucag

SEQ ID NO: 449695 - RNA, 14 nt, Homo sapiens
ucccauuugcuccu

SEQ ID NO: 449696 - RNA, 22 nt, Homo sapiens
ucccauuuguaauguaucuuau

SEQ ID NO: 449697 - RNA, 17 nt, Homo sapiens
uccccaaaggcauccau

SEQ ID NO: 449698 - RNA, 12 nt, Homo sapiens
uccccaaagggu

SEQ ID NO: 449699 - RNA, 21 nt, Homo sapiens
uccccaauccaacccaugcau

SEQ ID NO: 449700 - RNA, 16 nt, Homo sapiens
uccccaaugcucuccu

SEQ ID NO: 449701 - RNA, 17 nt, Homo sapiens
uccccacauaccaucug

SEQ ID NO: 449702 - RNA, 15 nt, Homo sapiens
uccccaccagucuca

SEQ ID NO: 449703 - RNA, 19 nt, Homo sapiens
uccccaccccaaccacucu

SEQ ID NO: 449704 - RNA, 15 nt, Homo sapiens
uccccagagcacugg

SEQ ID NO: 449705 - RNA, 18 nt, Homo sapiens
uccccaggggaaaaugaa

SEQ ID NO: 449706 - RNA, 16 nt, Homo sapiens
uccccagguguguugg

SEQ ID NO: 449707 - RNA, 22 nt, Homo sapiens
uccccagguguguuggggccuu

SEQ ID NO: 449708 - RNA, 22 nt, Homo sapiens
uccccauauccaaguaccaaug

SEQ ID NO: 449709 - RNA, 21 nt, Homo sapiens
ucccccagcccucaguuuuca

SEQ ID NO: 449710 - RNA, 13 nt, Homo sapiens
ucccccgcuguaa

SEQ ID NO: 449711 - RNA, 18 nt, Homo sapiens
ucccccuauccuuggcac

SEQ ID NO: 449712 - RNA, 14 nt, Homo sapiens
uccccggaguaccu

SEQ ID NO: 449713 - RNA, 14 nt, Homo sapiens
uccccucagauucc

SEQ ID NO: 449714 - RNA, 16 nt, Homo sapiens
uccccuccacauccca

SEQ ID NO: 449715 - RNA, 13 nt, Homo sapiens
uccccucccagau

SEQ ID NO: 449716 - RNA, 22 nt, Homo sapiens
uccccucccuggcucccaugac

SEQ ID NO: 449717 - RNA, 15 nt, Homo sapiens
uccccuccucacagu

SEQ ID NO: 449718 - RNA, 12 nt, Homo sapiens
uccccucuuccu

SEQ ID NO: 449719 - RNA, 16 nt, Homo sapiens
ugaaugguuccaugcc

SEQ ID NO: 449720 - RNA, 17 nt, Homo sapiens
ugaaugucaauaugaga

SEQ ID NO: 449721 - RNA, 23 nt, Homo sapiens
ugaaugucauuauuugauaacau

SEQ ID NO: 449722 - RNA, 23 nt, Homo sapiens
ugaaugugguuacuuccuacugu

SEQ ID NO: 449723 - RNA, 18 nt, Homo sapiens
ugaaugugucacuacuca

SEQ ID NO: 449724 - RNA, 21 nt, Homo sapiens
ugaauguuaaacuacucuuga
